United States Patent 8,969,254 (OLIGONUCLEOTIDE ARRAY FOR TISSUE TYPING) - sequence listing, part 13

SEQ ID NO: 289111 - DNA, 28 bp, Artificial Sequence
  Description of Artificial Sequence: Synthetic oligonucleotide
tgttcctggagaagctggatctggtgcg

SEQ ID NO: 289112 - DNA, 27 bp, Artificial Sequence
  Description of Artificial Sequence: Synthetic oligonucleotide
gttcctggagaagctggatctggtgcg

SEQ ID NO: 289113 - DNA, 27 bp, Artificial Sequence
  Description of Artificial Sequence: Synthetic oligonucleotide
ttcctggagaagctggatctggtgcgc

SEQ ID NO: 289114 - DNA, 27 bp, Artificial Sequence
  Description of Artificial Sequence: Synthetic oligonucleotide
tcctggagaagctggatctggtgcgca

SEQ ID NO: 289115 - DNA, 26 bp, Artificial Sequence
  Description of Artificial Sequence: Synthetic oligonucleotide
cctggagaagctggatctggtgcgca

SEQ ID NO: 289116 - DNA, 26 bp, Artificial Sequence
  Description of Artificial Sequence: Synthetic oligonucleotide
ctggagaagctggatctggtgcgcac

SEQ ID NO: 289117 - DNA, 27 bp, Artificial Sequence
  Description of Artificial Sequence: Synthetic oligonucleotide
tggagaagctggatctggtgcgcacct

SEQ ID NO: 289118 - DNA, 27 bp, Artificial Sequence
  Description of Artificial Sequence: Synthetic oligonucleotide
ggagaagctggatctggtgcgcacctt

SEQ ID NO: 289119 - DNA, 27 bp, Artificial Sequence
  Description of Artificial Sequence: Synthetic oligonucleotide
gagaagctggatctggtgcgcaccttc

SEQ ID NO: 289120 - DNA, 29 bp, Artificial Sequence
  Description of Artificial Sequence: Synthetic oligonucleotide
agaagctggatctggtgcgcaccttcttg

SEQ ID NO: 289121 - DNA, 28 bp, Artificial Sequence
  Description of Artificial Sequence: Synthetic oligonucleotide
gaagctggatctggtgcgcaccttcttg

SEQ ID NO: 289122 - DNA, 28 bp, Artificial Sequence
  Description of Artificial Sequence: Synthetic oligonucleotide
aagctggatctggtgcgcaccttcttgc

SEQ ID NO: 289123 - DNA, 27 bp, Artificial Sequence
  Description of Artificial Sequence: Synthetic oligonucleotide
agctggatctggtgcgcaccttcttgc

SEQ ID NO: 289124 - DNA, 27 bp, Artificial Sequence
  Description of Artificial Sequence: Synthetic oligonucleotide
gctggatctggtgcgcaccttcttgca

SEQ ID NO: 289125 - DNA, 28 bp, Artificial Sequence
  Description of Artificial Sequence: Synthetic oligonucleotide
ctggatctggtgcgcaccttcttgcaag

SEQ ID NO: 289126 - DNA, 28 bp, Artificial Sequence
  Description of Artificial Sequence: Synthetic oligonucleotide
tggatctggtgcgcaccttcttgcaagc

SEQ ID NO: 289127 - DNA, 27 bp, Artificial Sequence
  Description of Artificial Sequence: Synthetic oligonucleotide
ggatctggtgcgcaccttcttgcaagc

SEQ ID NO: 289128 - DNA, 28 bp, Artificial Sequence
  Description of Artificial Sequence: Synthetic oligonucleotide
gatctggtgcgcaccttcttgcaagctc

SEQ ID NO: 289129 - DNA, 28 bp, Artificial Sequence
  Description of Artificial Sequence: Synthetic oligonucleotide
atctggtgcgcaccttcttgcaagctcg

SEQ ID NO: 289130 - DNA, 27 bp, Artificial Sequence
  Description of Artificial Sequence: Synthetic oligonucleotide
tctggtgcgcaccttcttgcaagctcg

SEQ ID NO: 289131 - DNA, 26 bp, Artificial Sequence
  Description of Artificial Sequence: Synthetic oligonucleotide
ctggtgcgcaccttcttgcaagctcg

SEQ ID NO: 289132 - DNA, 26 bp, Artificial Sequence
  Description of Artificial Sequence: Synthetic oligonucleotide
tggtgcgcaccttcttgcaagctcgg

SEQ ID NO: 289133 - DNA, 25 bp, Artificial Sequence
  Description of Artificial Sequence: Synthetic oligonucleotide
ggtgcgcaccttcttgcaagctcgg

SEQ ID NO: 289134 - DNA, 26 bp, Artificial Sequence
  Description of Artificial Sequence: Synthetic oligonucleotide
gtgcgcaccttcttgcaagctcggct

SEQ ID NO: 289135 - DNA, 26 bp, Artificial Sequence
  Description of Artificial Sequence: Synthetic oligonucleotide
tgcgcaccttcttgcaagctcggctc

SEQ ID NO: 289136 - DNA, 25 bp, Artificial Sequence
  Description of Artificial Sequence: Synthetic oligonucleotide
gcgcaccttcttgcaagctcggctc

SEQ ID NO: 289137 - DNA, 25 bp, Artificial Sequence
  Description of Artificial Sequence: Synthetic oligonucleotide
cgcaccttcttgcaagctcggctcg

SEQ ID NO: 289138 - DNA, 25 bp, Artificial Sequence
  Description of Artificial Sequence: Synthetic oligonucleotide
gcaccttcttgcaagctcggctcgg

SEQ ID NO: 289139 - DNA, 26 bp, Artificial Sequence
  Description of Artificial Sequence: Synthetic oligonucleotide
caccttcttgcaagctcggctcggga

SEQ ID NO: 289140 - DNA, 27 bp, Artificial Sequence
  Description of Artificial Sequence: Synthetic oligonucleotide
accttcttgcaagctcggctcgggaca

SEQ ID NO: 289141 - DNA, 26 bp, Artificial Sequence
  Description of Artificial Sequence: Synthetic oligonucleotide
ccttcttgcaagctcggctcgggaca

SEQ ID NO: 289142 - DNA, 26 bp, Artificial Sequence
  Description of Artificial Sequence: Synthetic oligonucleotide
cttcttgcaagctcggctcgggacag

SEQ ID NO: 289143 - DNA, 27 bp, Artificial Sequence
  Description of Artificial Sequence: Synthetic oligonucleotide
ttcttgcaagctcggctcgggacagct

SEQ ID NO: 289144 - DNA, 27 bp, Artificial Sequence
  Description of Artificial Sequence: Synthetic oligonucleotide
tcttgcaagctcggctcgggacagcta

SEQ ID NO: 289145 - DNA, 26 bp, Artificial Sequence
  Description of Artificial Sequence: Synthetic oligonucleotide
cttgcaagctcggctcgggacagcta

SEQ ID NO: 289146 - DNA, 26 bp, Artificial Sequence
  Description of Artificial Sequence: Synthetic oligonucleotide
ttgcaagctcggctcgggacagctag

SEQ ID NO: 289147 - DNA, 25 bp, Artificial Sequence
  Description of Artificial Sequence: Synthetic oligonucleotide
tgcaagctcggctcgggacagctag

SEQ ID NO: 289148 - DNA, 24 bp, Artificial Sequence
  Description of Artificial Sequence: Synthetic oligonucleotide
gcaagctcggctcgggacagctag

SEQ ID NO: 289149 - DNA, 24 bp, Artificial Sequence
  Description of Artificial Sequence: Synthetic oligonucleotide
caagctcggctcgggacagctagg

SEQ ID NO: 289150 - DNA, 26 bp, Artificial Sequence
  Description of Artificial Sequence: Synthetic oligonucleotide
aagctcggctcgggacagctaggctt

SEQ ID NO: 289151 - DNA, 25 bp, Artificial Sequence
  Description of Artificial Sequence: Synthetic oligonucleotide
agctcggctcgggacagctaggctt

SEQ ID NO: 289152 - DNA, 24 bp, Artificial Sequence
  Description of Artificial Sequence: Synthetic oligonucleotide
gctcggctcgggacagctaggctt

SEQ ID NO: 289153 - DNA, 24 bp, Artificial Sequence
  Description of Artificial Sequence: Synthetic oligonucleotide
ctcggctcgggacagctaggcttc

SEQ ID NO: 289154 - DNA, 24 bp, Artificial Sequence
  Description of Artificial Sequence: Synthetic oligonucleotide
tcggctcgggacagctaggcttcg

SEQ ID NO: 289155 - DNA, 23 bp, Artificial Sequence
  Description of Artificial Sequence: Synthetic oligonucleotide
cggctcgggacagctaggcttcg

SEQ ID NO: 289156 - DNA, 23 bp, Artificial Sequence
  Description of Artificial Sequence: Synthetic oligonucleotide
ggctcgggacagctaggcttcgg

SEQ ID NO: 289157 - DNA, 25 bp, Artificial Sequence
  Description of Artificial Sequence: Synthetic oligonucleotide
gctcgggacagctaggcttcggcaa

SEQ ID NO: 289158 - DNA, 26 bp, Artificial Sequence
  Description of Artificial Sequence: Synthetic oligonucleotide
ctcgggacagctaggcttcggcaaga

SEQ ID NO: 289159 - DNA, 26 bp, Artificial Sequence
  Description of Artificial Sequence: Synthetic oligonucleotide
tcgggacagctaggcttcggcaagac

SEQ ID NO: 289160 - DNA, 25 bp, Artificial Sequence
  Description of Artificial Sequence: Synthetic oligonucleotide
cgggacagctaggcttcggcaagac

SEQ ID NO: 289161 - DNA, 25 bp, Artificial Sequence
  Description of Artificial Sequence: Synthetic oligonucleotide
gggacagctaggcttcggcaagacg

SEQ ID NO: 289162 - DNA, 26 bp, Artificial Sequence
  Description of Artificial Sequence: Synthetic oligonucleotide
ggacagctaggcttcggcaagacgca

SEQ ID NO: 289163 - DNA, 27 bp, Artificial Sequence
  Description of Artificial Sequence: Synthetic oligonucleotide
gacagctaggcttcggcaagacgcaga

SEQ ID NO: 289164 - DNA, 27 bp, Artificial Sequence
  Description of Artificial Sequence: Synthetic oligonucleotide
acagctaggcttcggcaagacgcagac

SEQ ID NO: 289165 - DNA, 26 bp, Artificial Sequence
  Description of Artificial Sequence: Synthetic oligonucleotide
cagctaggcttcggcaagacgcagac

SEQ ID NO: 289166 - DNA, 26 bp, Artificial Sequence
  Description of Artificial Sequence: Synthetic oligonucleotide
agctaggcttcggcaagacgcagacc

SEQ ID NO: 289167 - DNA, 25 bp, Artificial Sequence
  Description of Artificial Sequence: Synthetic oligonucleotide
gctaggcttcggcaagacgcagacc

SEQ ID NO: 289168 - DNA, 25 bp, Artificial Sequence
  Description of Artificial Sequence: Synthetic oligonucleotide
ctaggcttcggcaagacgcagaccg

SEQ ID NO: 289169 - DNA, 25 bp, Artificial Sequence
  Description of Artificial Sequence: Synthetic oligonucleotide
taggcttcggcaagacgcagaccgg

SEQ ID NO: 289170 - DNA, 24 bp, Artificial Sequence
  Description of Artificial Sequence: Synthetic oligonucleotide
aggcttcggcaagacgcagaccgg

SEQ ID NO: 289171 - DNA, 23 bp, Artificial Sequence
  Description of Artificial Sequence: Synthetic oligonucleotide
ggcttcggcaagacgcagaccgg

SEQ ID NO: 289172 - DNA, 24 bp, Artificial Sequence
  Description of Artificial Sequence: Synthetic oligonucleotide
gcttcggcaagacgcagaccggca

SEQ ID NO: 289173 - DNA, 24 bp, Artificial Sequence
  Description of Artificial Sequence: Synthetic oligonucleotide
cttcggcaagacgcagaccggcag

SEQ ID NO: 289174 - DNA, 24 bp, Artificial Sequence
  Description of Artificial Sequence: Synthetic oligonucleotide
ttcggcaagacgcagaccggcagg

SEQ ID NO: 289175 - DNA, 23 bp, Artificial Sequence
  Description of Artificial Sequence: Synthetic oligonucleotide
tcggcaagacgcagaccggcagg

SEQ ID NO: 289176 - DNA, 22 bp, Artificial Sequence
  Description of Artificial Sequence: Synthetic oligonucleotide
cggcaagacgcagaccggcagg

SEQ ID NO: 289177 - DNA, 22 bp, Artificial Sequence
  Description of Artificial Sequence: Synthetic oligonucleotide
ggcaagacgcagaccggcaggc

SEQ ID NO: 289178 - DNA, 23 bp, Artificial Sequence
  Description of Artificial Sequence: Synthetic oligonucleotide
gcaagacgcagaccggcaggcca

SEQ ID NO: 289179 - DNA, 23 bp, Artificial Sequence
  Description of Artificial Sequence: Synthetic oligonucleotide
caagacgcagaccggcaggccag

SEQ ID NO: 289180 - DNA, 23 bp, Artificial Sequence
  Description of Artificial Sequence: Synthetic oligonucleotide
aagacgcagaccggcaggccagc

SEQ ID NO: 289181 - DNA, 22 bp, Artificial Sequence
  Description of Artificial Sequence: Synthetic oligonucleotide
agacgcagaccggcaggccagc

SEQ ID NO: 289182 - DNA, 21 bp, Artificial Sequence
  Description of Artificial Sequence: Synthetic oligonucleotide
gacgcagaccggcaggccagc

SEQ ID NO: 289183 - DNA, 22 bp, Artificial Sequence
  Description of Artificial Sequence: Synthetic oligonucleotide
acgcagaccggcaggccagcct

SEQ ID NO: 289184 - DNA, 21 bp, Artificial Sequence
  Description of Artificial Sequence: Synthetic oligonucleotide
cgcagaccggcaggccagcct

SEQ ID NO: 289185 - DNA, 23 bp, Artificial Sequence
  Description of Artificial Sequence: Synthetic oligonucleotide
gcagaccggcaggccagcctgtt

SEQ ID NO: 289186 - DNA, 25 bp, Artificial Sequence
  Description of Artificial Sequence: Synthetic oligonucleotide
cagaccggcaggccagcctgttgaa

SEQ ID NO: 289187 - DNA, 25 bp, Artificial Sequence
  Description of Artificial Sequence: Synthetic oligonucleotide
agaccggcaggccagcctgttgaag

SEQ ID NO: 289188 - DNA, 24 bp, Artificial Sequence
  Description of Artificial Sequence: Synthetic oligonucleotide
gaccggcaggccagcctgttgaag

SEQ ID NO: 289189 - DNA, 25 bp, Artificial Sequence
  Description of Artificial Sequence: Synthetic oligonucleotide
accggcaggccagcctgttgaagct

SEQ ID NO: 289190 - DNA, 24 bp, Artificial Sequence
  Description of Artificial Sequence: Synthetic oligonucleotide
ccggcaggccagcctgttgaagct

SEQ ID NO: 289191 - DNA, 24 bp, Artificial Sequence
  Description of Artificial Sequence: Synthetic oligonucleotide
cggcaggccagcctgttgaagctc

SEQ ID NO: 289192 - DNA, 25 bp, Artificial Sequence
  Description of Artificial Sequence: Synthetic oligonucleotide
ggcaggccagcctgttgaagctcct

SEQ ID NO: 289193 - DNA, 25 bp, Artificial Sequence
  Description of Artificial Sequence: Synthetic oligonucleotide
gcaggccagcctgttgaagctcctg

SEQ ID NO: 289194 - DNA, 26 bp, Artificial Sequence
  Description of Artificial Sequence: Synthetic oligonucleotide
caggccagcctgttgaagctcctgct

SEQ ID NO: 289195 - DNA, 26 bp, Artificial Sequence
  Description of Artificial Sequence: Synthetic oligonucleotide
aggccagcctgttgaagctcctgctg

SEQ ID NO: 289196 - DNA, 25 bp, Artificial Sequence
  Description of Artificial Sequence: Synthetic oligonucleotide
ggccagcctgttgaagctcctgctg

SEQ ID NO: 289197 - DNA, 25 bp, Artificial Sequence
  Description of Artificial Sequence: Synthetic oligonucleotide
gccagcctgttgaagctcctgctgg

SEQ ID NO: 289198 - DNA, 25 bp, Artificial Sequence
  Description of Artificial Sequence: Synthetic oligonucleotide
ccagcctgttgaagctcctgctggg

SEQ ID NO: 289199 - DNA, 27 bp, Artificial Sequence
  Description of Artificial Sequence: Synthetic oligonucleotide
cagcctgttgaagctcctgctggggaa

SEQ ID NO: 289200 - DNA, 30 bp, Artificial Sequence
  Description of Artificial Sequence: Synthetic oligonucleotide
agcctgttgaagctcctgctggggaattac

SEQ ID NO: 289201 - DNA, 29 bp, Artificial Sequence
  Description of Artificial Sequence: Synthetic oligonucleotide
gcctgttgaagctcctgctggggaattac

SEQ ID NO: 289202 - DNA, 29 bp, Artificial Sequence
  Description of Artificial Sequence: Synthetic oligonucleotide
cctgttgaagctcctgctggggaattacc

SEQ ID NO: 289203 - DNA, 31 bp, Artificial Sequence
  Description of Artificial Sequence: Synthetic oligonucleotide
ctgttgaagctcctgctggggaattaccaac

SEQ ID NO: 289204 - DNA, 32 bp, Artificial Sequence
  Description of Artificial Sequence: Synthetic oligonucleotide
tgttgaagctcctgctggggaattaccaacac

SEQ ID NO: 289205 - DNA, 31 bp, Artificial Sequence
  Description of Artificial Sequence: Synthetic oligonucleotide
gttgaagctcctgctggggaattaccaacac

SEQ ID NO: 289206 - DNA, 33 bp, Artificial Sequence
  Description of Artificial Sequence: Synthetic oligonucleotide
ttgaagctcctgctggggaattaccaacactac

SEQ ID NO: 289207 - DNA, 32 bp, Artificial Sequence
  Description of Artificial Sequence: Synthetic oligonucleotide
tgaagctcctgctggggaattaccaacactac

SEQ ID NO: 289208 - DNA, 31 bp, Artificial Sequence
  Description of Artificial Sequence: Synthetic oligonucleotide
gaagctcctgctggggaattaccaacactac

SEQ ID NO: 289209 - DNA, 32 bp, Artificial Sequence
  Description of Artificial Sequence: Synthetic oligonucleotide
aagctcctgctggggaattaccaacactacag

SEQ ID NO: 289210 - DNA, 31 bp, Artificial Sequence
  Description of Artificial Sequence: Synthetic oligonucleotide
agctcctgctggggaattaccaacactacag

SEQ ID NO: 289211 - DNA, 30 bp, Artificial Sequence
  Description of Artificial Sequence: Synthetic oligonucleotide
gctcctgctggggaattaccaacactacag

SEQ ID NO: 289212 - DNA, 30 bp, Artificial Sequence
  Description of Artificial Sequence: Synthetic oligonucleotide
ctcctgctggggaattaccaacactacagg

SEQ ID NO: 289213 - DNA, 32 bp, Artificial Sequence
  Description of Artificial Sequence: Synthetic oligonucleotide
tcctgctggggaattaccaacactacaggttg

SEQ ID NO: 289214 - DNA, 31 bp, Artificial Sequence
  Description of Artificial Sequence: Synthetic oligonucleotide
cctgctggggaattaccaacactacaggttg

SEQ ID NO: 289215 - DNA, 33 bp, Artificial Sequence
  Description of Artificial Sequence: Synthetic oligonucleotide
ctgctggggaattaccaacactacaggttgtac

SEQ ID NO: 289216 - DNA, 33 bp, Artificial Sequence
  Description of Artificial Sequence: Synthetic oligonucleotide
tgctggggaattaccaacactacaggttgtacg

SEQ ID NO: 289217 - DNA, 32 bp, Artificial Sequence
  Description of Artificial Sequence: Synthetic oligonucleotide
gctggggaattaccaacactacaggttgtacg

SEQ ID NO: 289218 - DNA, 33 bp, Artificial Sequence
  Description of Artificial Sequence: Synthetic oligonucleotide
ctggggaattaccaacactacaggttgtacgac

SEQ ID NO: 289219 - DNA, 33 bp, Artificial Sequence
  Description of Artificial Sequence: Synthetic oligonucleotide
tggggaattaccaacactacaggttgtacgacg

SEQ ID NO: 289220 - DNA, 32 bp, Artificial Sequence
  Description of Artificial Sequence: Synthetic oligonucleotide
ggggaattaccaacactacaggttgtacgacg

SEQ ID NO: 289221 - DNA, 33 bp, Artificial Sequence
  Description of Artificial Sequence: Synthetic oligonucleotide
gggaattaccaacactacaggttgtacgacgag

SEQ ID NO: 289222 - DNA, 33 bp, Artificial Sequence
  Description of Artificial Sequence: Synthetic oligonucleotide
ggaattaccaacactacaggttgtacgacgagg

SEQ ID NO: 289223 - DNA, 33 bp, Artificial Sequence
  Description of Artificial Sequence: Synthetic oligonucleotide
gaattaccaacactacaggttgtacgacgaggc

SEQ ID NO: 289224 - DNA, 34 bp, Artificial Sequence
  Description of Artificial Sequence: Synthetic oligonucleotide
aattaccaacactacaggttgtacgacgaggctg

SEQ ID NO: 289225 - DNA, 33 bp, Artificial Sequence
  Description of Artificial Sequence: Synthetic oligonucleotide
attaccaacactacaggttgtacgacgaggctg

SEQ ID NO: 289226 - DNA, 32 bp, Artificial Sequence
  Description of Artificial Sequence: Synthetic oligonucleotide
ttaccaacactacaggttgtacgacgaggctg

SEQ ID NO: 289227 - DNA, 31 bp, Artificial Sequence
  Description of Artificial Sequence: Synthetic oligonucleotide
taccaacactacaggttgtacgacgaggctg

SEQ ID NO: 289228 - DNA, 30 bp, Artificial Sequence
  Description of Artificial Sequence: Synthetic oligonucleotide
accaacactacaggttgtacgacgaggctg

SEQ ID NO: 289229 - DNA, 29 bp, Artificial Sequence
  Description of Artificial Sequence: Synthetic oligonucleotide
ccaacactacaggttgtacgacgaggctg

SEQ ID NO: 289230 - DNA, 30 bp, Artificial Sequence
  Description of Artificial Sequence: Synthetic oligonucleotide
caacactacaggttgtacgacgaggctgag

SEQ ID NO: 289231 - DNA, 32 bp, Artificial Sequence
  Description of Artificial Sequence: Synthetic oligonucleotide
aacactacaggttgtacgacgaggctgagatg

SEQ ID NO: 289232 - DNA, 31 bp, Artificial Sequence
  Description of Artificial Sequence: Synthetic oligonucleotide
acactacaggttgtacgacgaggctgagatg

SEQ ID NO: 289233 - DNA, 30 bp, Artificial Sequence
  Description of Artificial Sequence: Synthetic oligonucleotide
cactacaggttgtacgacgaggctgagatg

SEQ ID NO: 289234 - DNA, 30 bp, Artificial Sequence
  Description of Artificial Sequence: Synthetic oligonucleotide
actacaggttgtacgacgaggctgagatgc

SEQ ID NO: 289235 - DNA, 29 bp, Artificial Sequence
  Description of Artificial Sequence: Synthetic oligonucleotide
ctacaggttgtacgacgaggctgagatgc

SEQ ID NO: 289236 - DNA, 30 bp, Artificial Sequence
  Description of Artificial Sequence: Synthetic oligonucleotide
tacaggttgtacgacgaggctgagatgctg

SEQ ID NO: 289237 - DNA, 29 bp, Artificial Sequence
  Description of Artificial Sequence: Synthetic oligonucleotide
acaggttgtacgacgaggctgagatgctg

SEQ ID NO: 289238 - DNA, 28 bp, Artificial Sequence
  Description of Artificial Sequence: Synthetic oligonucleotide
caggttgtacgacgaggctgagatgctg

SEQ ID NO: 289239 - DNA, 28 bp, Artificial Sequence
  Description of Artificial Sequence: Synthetic oligonucleotide
aggttgtacgacgaggctgagatgctgg

SEQ ID NO: 289240 - DNA, 27 bp, Artificial Sequence
  Description of Artificial Sequence: Synthetic oligonucleotide
ggttgtacgacgaggctgagatgctgg

SEQ ID NO: 289241 - DNA, 28 bp, Artificial Sequence
  Description of Artificial Sequence: Synthetic oligonucleotide
gttgtacgacgaggctgagatgctggtg

SEQ ID NO: 289242 - DNA, 29 bp, Artificial Sequence
  Description of Artificial Sequence: Synthetic oligonucleotide
ttgtacgacgaggctgagatgctggtgtc

SEQ ID NO: 289243 - DNA, 28 bp, Artificial Sequence
  Description of Artificial Sequence: Synthetic oligonucleotide
tgtacgacgaggctgagatgctggtgtc

SEQ ID NO: 289244 - DNA, 27 bp, Artificial Sequence
  Description of Artificial Sequence: Synthetic oligonucleotide
gtacgacgaggctgagatgctggtgtc

SEQ ID NO: 289245 - DNA, 27 bp, Artificial Sequence
  Description of Artificial Sequence: Synthetic oligonucleotide
tacgacgaggctgagatgctggtgtcg

SEQ ID NO: 289246 - DNA, 27 bp, Artificial Sequence
  Description of Artificial Sequence: Synthetic oligonucleotide
acgacgaggctgagatgctggtgtcga

SEQ ID NO: 289247 - DNA, 27 bp, Artificial Sequence
  Description of Artificial Sequence: Synthetic oligonucleotide
cgacgaggctgagatgctggtgtcgaa

SEQ ID NO: 289248 - DNA, 27 bp, Artificial Sequence
  Description of Artificial Sequence: Synthetic oligonucleotide
gacgaggctgagatgctggtgtcgaag

SEQ ID NO: 289249 - DNA, 28 bp, Artificial Sequence
  Description of Artificial Sequence: Synthetic oligonucleotide
acgaggctgagatgctggtgtcgaagtc

SEQ ID NO: 289250 - DNA, 27 bp, Artificial Sequence
  Description of Artificial Sequence: Synthetic oligonucleotide
cgaggctgagatgctggtgtcgaagtc

SEQ ID NO: 289251 - DNA, 28 bp, Artificial Sequence
  Description of Artificial Sequence: Synthetic oligonucleotide
gaggctgagatgctggtgtcgaagtctg

SEQ ID NO: 289252 - DNA, 29 bp, Artificial Sequence
  Description of Artificial Sequence: Synthetic oligonucleotide
aggctgagatgctggtgtcgaagtctgtg

SEQ ID NO: 289253 - DNA, 28 bp, Artificial Sequence
  Description of Artificial Sequence: Synthetic oligonucleotide
ggctgagatgctggtgtcgaagtctgtg

SEQ ID NO: 289254 - DNA, 30 bp, Artificial Sequence
  Description of Artificial Sequence: Synthetic oligonucleotide
gctgagatgctggtgtcgaagtctgtgatc

SEQ ID NO: 289255 - DNA, 30 bp, Artificial Sequence
  Description of Artificial Sequence: Synthetic oligonucleotide
ctgagatgctggtgtcgaagtctgtgatcc

SEQ ID NO: 289256 - DNA, 30 bp, Artificial Sequence
  Description of Artificial Sequence: Synthetic oligonucleotide
tgagatgctggtgtcgaagtctgtgatccc

SEQ ID NO: 289257 - DNA, 29 bp, Artificial Sequence
  Description of Artificial Sequence: Synthetic oligonucleotide
gagatgctggtgtcgaagtctgtgatccc

SEQ ID NO: 289258 - DNA, 30 bp, Artificial Sequence
  Description of Artificial Sequence: Synthetic oligonucleotide
agatgctggtgtcgaagtctgtgatcccag

SEQ ID NO: 289259 - DNA, 29 bp, Artificial Sequence
  Description of Artificial Sequence: Synthetic oligonucleotide
gatgctggtgtcgaagtctgtgatcccag

SEQ ID NO: 289260 - DNA, 30 bp, Artificial Sequence
  Description of Artificial Sequence: Synthetic oligonucleotide
atgctggtgtcgaagtctgtgatcccagag

SEQ ID NO: 289261 - DNA, 29 bp, Artificial Sequence
  Description of Artificial Sequence: Synthetic oligonucleotide
tgctggtgtcgaagtctgtgatcccagag

SEQ ID NO: 289262 - DNA, 28 bp, Artificial Sequence
  Description of Artificial Sequence: Synthetic oligonucleotide
gctggtgtcgaagtctgtgatcccagag

SEQ ID NO: 289263 - DNA, 28 bp, Artificial Sequence
  Description of Artificial Sequence: Synthetic oligonucleotide
ctggtgtcgaagtctgtgatcccagagc

SEQ ID NO: 289264 - DNA, 29 bp, Artificial Sequence
  Description of Artificial Sequence: Synthetic oligonucleotide
tggtgtcgaagtctgtgatcccagagctg

SEQ ID NO: 289265 - DNA, 28 bp, Artificial Sequence
  Description of Artificial Sequence: Synthetic oligonucleotide
ggtgtcgaagtctgtgatcccagagctg

SEQ ID NO: 289266 - DNA, 28 bp, Artificial Sequence
  Description of Artificial Sequence: Synthetic oligonucleotide
gtgtcgaagtctgtgatcccagagctgg

SEQ ID NO: 289267 - DNA, 28 bp, Artificial Sequence
  Description of Artificial Sequence: Synthetic oligonucleotide
tgtcgaagtctgtgatcccagagctggc

SEQ ID NO: 289268 - DNA, 27 bp, Artificial Sequence
  Description of Artificial Sequence: Synthetic oligonucleotide
gtcgaagtctgtgatcccagagctggc

SEQ ID NO: 289269 - DNA, 27 bp, Artificial Sequence
  Description of Artificial Sequence: Synthetic oligonucleotide
tcgaagtctgtgatcccagagctggcc

SEQ ID NO: 289270 - DNA, 27 bp, Artificial Sequence
  Description of Artificial Sequence: Synthetic oligonucleotide
cgaagtctgtgatcccagagctggcca

SEQ ID NO: 289271 - DNA, 28 bp, Artificial Sequence
  Description of Artificial Sequence: Synthetic oligonucleotide
gaagtctgtgatcccagagctggccaac

SEQ ID NO: 289272 - DNA, 30 bp, Artificial Sequence
  Description of Artificial Sequence: Synthetic oligonucleotide
aagtctgtgatcccagagctggccaacaag

SEQ ID NO: 289273 - DNA, 29 bp, Artificial Sequence
  Description of Artificial Sequence: Synthetic oligonucleotide
agtctgtgatcccagagctggccaacaag

SEQ ID NO: 289274 - DNA, 28 bp, Artificial Sequence
  Description of Artificial Sequence: Synthetic oligonucleotide
gtctgtgatcccagagctggccaacaag

SEQ ID NO: 289275 - DNA, 31 bp, Artificial Sequence
  Description of Artificial Sequence: Synthetic oligonucleotide
tctgtgatcccagagctggccaacaagaatg

SEQ ID NO: 289276 - DNA, 30 bp, Artificial Sequence
  Description of Artificial Sequence: Synthetic oligonucleotide
ctgtgatcccagagctggccaacaagaatg

SEQ ID NO: 289277 - DNA, 31 bp, Artificial Sequence
  Description of Artificial Sequence: Synthetic oligonucleotide
tgtgatcccagagctggccaacaagaatgag

SEQ ID NO: 289278 - DNA, 30 bp, Artificial Sequence
  Description of Artificial Sequence: Synthetic oligonucleotide
gtgatcccagagctggccaacaagaatgag

SEQ ID NO: 289279 - DNA, 31 bp, Artificial Sequence
  Description of Artificial Sequence: Synthetic oligonucleotide
tgatcccagagctggccaacaagaatgagtg

SEQ ID NO: 289280 - DNA, 30 bp, Artificial Sequence
  Description of Artificial Sequence: Synthetic oligonucleotide
gatcccagagctggccaacaagaatgagtg

SEQ ID NO: 289281 - DNA, 30 bp, Artificial Sequence
  Description of Artificial Sequence: Synthetic oligonucleotide
atcccagagctggccaacaagaatgagtgg

SEQ ID NO: 289282 - DNA, 29 bp, Artificial Sequence
  Description of Artificial Sequence: Synthetic oligonucleotide
tcccagagctggccaacaagaatgagtgg

SEQ ID NO: 289283 - DNA, 28 bp, Artificial Sequence
  Description of Artificial Sequence: Synthetic oligonucleotide
cccagagctggccaacaagaatgagtgg

SEQ ID NO: 289284 - DNA, 28 bp, Artificial Sequence
  Description of Artificial Sequence: Synthetic oligonucleotide
ccagagctggccaacaagaatgagtggc

SEQ ID NO: 289285 - DNA, 28 bp, Artificial Sequence
  Description of Artificial Sequence: Synthetic oligonucleotide
cagagctggccaacaagaatgagtggcc

SEQ ID NO: 289286 - DNA, 28 bp, Artificial Sequence
  Description of Artificial Sequence: Synthetic oligonucleotide
agagctggccaacaagaatgagtggccc

SEQ ID NO: 289287 - DNA, 27 bp, Artificial Sequence
  Description of Artificial Sequence: Synthetic oligonucleotide
gagctggccaacaagaatgagtggccc

SEQ ID NO: 289288 - DNA, 28 bp, Artificial Sequence
  Description of Artificial Sequence: Synthetic oligonucleotide
agctggccaacaagaatgagtggcccag

SEQ ID NO: 289289 - DNA, 27 bp, Artificial Sequence
  Description of Artificial Sequence: Synthetic oligonucleotide
gctggccaacaagaatgagtggcccag

SEQ ID NO: 289290 - DNA, 27 bp, Artificial Sequence
  Description of Artificial Sequence: Synthetic oligonucleotide
ctggccaacaagaatgagtggcccagg

SEQ ID NO: 289291 - DNA, 29 bp, Artificial Sequence
  Description of Artificial Sequence: Synthetic oligonucleotide
tggccaacaagaatgagtggcccaggtac

SEQ ID NO: 289292 - DNA, 28 bp, Artificial Sequence
  Description of Artificial Sequence: Synthetic oligonucleotide
ggccaacaagaatgagtggcccaggtac

SEQ ID NO: 289293 - DNA, 28 bp, Artificial Sequence
  Description of Artificial Sequence: Synthetic oligonucleotide
gccaacaagaatgagtggcccaggtacc

SEQ ID NO: 289294 - DNA, 29 bp, Artificial Sequence
  Description of Artificial Sequence: Synthetic oligonucleotide
ccaacaagaatgagtggcccaggtaccac

SEQ ID NO: 289295 - DNA, 31 bp, Artificial Sequence
  Description of Artificial Sequence: Synthetic oligonucleotide
caacaagaatgagtggcccaggtaccactac

SEQ ID NO: 289296 - DNA, 33 bp, Artificial Sequence
  Description of Artificial Sequence: Synthetic oligonucleotide
aacaagaatgagtggcccaggtaccactactac

SEQ ID NO: 289297 - DNA, 32 bp, Artificial Sequence
  Description of Artificial Sequence: Synthetic oligonucleotide
acaagaatgagtggcccaggtaccactactac

SEQ ID NO: 289298 - DNA, 31 bp, Artificial Sequence
  Description of Artificial Sequence: Synthetic oligonucleotide
caagaatgagtggcccaggtaccactactac

SEQ ID NO: 289299 - DNA, 32 bp, Artificial Sequence
  Description of Artificial Sequence: Synthetic oligonucleotide
aagaatgagtggcccaggtaccactactacac

SEQ ID NO: 289300 - DNA, 31 bp, Artificial Sequence
  Description of Artificial Sequence: Synthetic oligonucleotide
agaatgagtggcccaggtaccactactacac

SEQ ID NO: 289301 - DNA, 30 bp, Artificial Sequence
  Description of Artificial Sequence: Synthetic oligonucleotide
gaatgagtggcccaggtaccactactacac

SEQ ID NO: 289302 - DNA, 31 bp, Artificial Sequence
  Description of Artificial Sequence: Synthetic oligonucleotide
aatgagtggcccaggtaccactactacactg

SEQ ID NO: 289303 - DNA, 30 bp, Artificial Sequence
  Description of Artificial Sequence: Synthetic oligonucleotide
atgagtggcccaggtaccactactacactg

SEQ ID NO: 289304 - DNA, 29 bp, Artificial Sequence
  Description of Artificial Sequence: Synthetic oligonucleotide
tgagtggcccaggtaccactactacactg

SEQ ID NO: 289305 - DNA, 28 bp, Artificial Sequence
  Description of Artificial Sequence: Synthetic oligonucleotide
gagtggcccaggtaccactactacactg

SEQ ID NO: 289306 - DNA, 28 bp, Artificial Sequence
  Description of Artificial Sequence: Synthetic oligonucleotide
agtggcccaggtaccactactacactgg

SEQ ID NO: 289307 - DNA, 27 bp, Artificial Sequence
  Description of Artificial Sequence: Synthetic oligonucleotide
gtggcccaggtaccactactacactgg

SEQ ID NO: 289308 - DNA, 27 bp, Artificial Sequence
  Description of Artificial Sequence: Synthetic oligonucleotide
tggcccaggtaccactactacactggg

SEQ ID NO: 289309 - DNA, 26 bp, Artificial Sequence
  Description of Artificial Sequence: Synthetic oligonucleotide
ggcccaggtaccactactacactggg

SEQ ID NO: 289310 - DNA, 26 bp, Artificial Sequence
  Description of Artificial Sequence: Synthetic oligonucleotide
gcccaggtaccactactacactgggc

SEQ ID NO: 289311 - DNA, 27 bp, Artificial Sequence
  Description of Artificial Sequence: Synthetic oligonucleotide
cccaggtaccactactacactgggcga

SEQ ID NO: 289312 - DNA, 29 bp, Artificial Sequence
  Description of Artificial Sequence: Synthetic oligonucleotide
ccaggtaccactactacactgggcgaatc

SEQ ID NO: 289313 - DNA, 32 bp, Artificial Sequence
  Description of Artificial Sequence: Synthetic oligonucleotide
caggtaccactactacactgggcgaatctaag

SEQ ID NO: 289314 - DNA, 32 bp, Artificial Sequence
  Description of Artificial Sequence: Synthetic oligonucleotide
aggtaccactactacactgggcgaatctaagc

SEQ ID NO: 289315 - DNA, 31 bp, Artificial Sequence
  Description of Artificial Sequence: Synthetic oligonucleotide
ggtaccactactacactgggcgaatctaagc

SEQ ID NO: 289316 - DNA, 31 bp, Artificial Sequence
  Description of Artificial Sequence: Synthetic oligonucleotide
gtaccactactacactgggcgaatctaagcc

SEQ ID NO: 289317 - DNA, 33 bp, Artificial Sequence
  Description of Artificial Sequence: Synthetic oligonucleotide
taccactactacactgggcgaatctaagccatc

SEQ ID NO: 289318 - DNA, 32 bp, Artificial Sequence
  Description of Artificial Sequence: Synthetic oligonucleotide
accactactacactgggcgaatctaagccatc

SEQ ID NO: 289319 - DNA, 31 bp, Artificial Sequence
  Description of Artificial Sequence: Synthetic oligonucleotide
ccactactacactgggcgaatctaagccatc

SEQ ID NO: 289320 - DNA, 31 bp, Artificial Sequence
  Description of Artificial Sequence: Synthetic oligonucleotide
cactactacactgggcgaatctaagccatcc

SEQ ID NO: 289321 - DNA, 32 bp, Artificial Sequence
  Description of Artificial Sequence: Synthetic oligonucleotide
actactacactgggcgaatctaagccatcctg

SEQ ID NO: 289322 - DNA, 31 bp, Artificial Sequence
  Description of Artificial Sequence: Synthetic oligonucleotide
ctactacactgggcgaatctaagccatcctg

SEQ ID NO: 289323 - DNA, 31 bp, Artificial Sequence
  Description of Artificial Sequence: Synthetic oligonucleotide
tactacactgggcgaatctaagccatcctgc

SEQ ID NO: 289324 - DNA, 30 bp, Artificial Sequence
  Description of Artificial Sequence: Synthetic oligonucleotide
actacactgggcgaatctaagccatcctgc

SEQ ID NO: 289325 - DNA, 29 bp, Artificial Sequence
  Description of Artificial Sequence: Synthetic oligonucleotide
ctacactgggcgaatctaagccatcctgc

SEQ ID NO: 289326 - DNA, 30 bp, Artificial Sequence
  Description of Artificial Sequence: Synthetic oligonucleotide
tacactgggcgaatctaagccatcctgctg

SEQ ID NO: 289327 - DNA, 29 bp, Artificial Sequence
  Description of Artificial Sequence: Synthetic oligonucleotide
acactgggcgaatctaagccatcctgctg

SEQ ID NO: 289328 - DNA, 28 bp, Artificial Sequence
  Description of Artificial Sequence: Synthetic oligonucleotide
cactgggcgaatctaagccatcctgctg

SEQ ID NO: 289329 - DNA, 28 bp, Artificial Sequence
  Description of Artificial Sequence: Synthetic oligonucleotide
actgggcgaatctaagccatcctgctgg

SEQ ID NO: 289330 - DNA, 27 bp, Artificial Sequence
  Description of Artificial Sequence: Synthetic oligonucleotide
ctgggcgaatctaagccatcctgctgg

SEQ ID NO: 289331 - DNA, 28 bp, Artificial Sequence
  Description of Artificial Sequence: Synthetic oligonucleotide
tgggcgaatctaagccatcctgctggag

SEQ ID NO: 289332 - DNA, 27 bp, Artificial Sequence
  Description of Artificial Sequence: Synthetic oligonucleotide
gggcgaatctaagccatcctgctggag

SEQ ID NO: 289333 - DNA, 29 bp, Artificial Sequence
  Description of Artificial Sequence: Synthetic oligonucleotide
ggcgaatctaagccatcctgctggagtag

SEQ ID NO: 289334 - DNA, 30 bp, Artificial Sequence
  Description of Artificial Sequence: Synthetic oligonucleotide
gcgaatctaagccatcctgctggagtagtc

SEQ ID NO: 289335 - DNA, 31 bp, Artificial Sequence
  Description of Artificial Sequence: Synthetic oligonucleotide
cgaatctaagccatcctgctggagtagtcag

SEQ ID NO: 289336 - DNA, 32 bp, Artificial Sequence
  Description of Artificial Sequence: Synthetic oligonucleotide
gaatctaagccatcctgctggagtagtcagag

SEQ ID NO: 289337 - DNA, 32 bp, Artificial Sequence
  Description of Artificial Sequence: Synthetic oligonucleotide
aatctaagccatcctgctggagtagtcagagg

SEQ ID NO: 289338 - DNA, 31 bp, Artificial Sequence
  Description of Artificial Sequence: Synthetic oligonucleotide
atctaagccatcctgctggagtagtcagagg

SEQ ID NO: 289339 - DNA, 30 bp, Artificial Sequence
  Description of Artificial Sequence: Synthetic oligonucleotide
tctaagccatcctgctggagtagtcagagg

SEQ ID NO: 289340 - DNA, 29 bp, Artificial Sequence
  Description of Artificial Sequence: Synthetic oligonucleotide
ctaagccatcctgctggagtagtcagagg

SEQ ID NO: 289341 - DNA, 29 bp, Artificial Sequence
  Description of Artificial Sequence: Synthetic oligonucleotide
taagccatcctgctggagtagtcagaggc

SEQ ID NO: 289342 - DNA, 28 bp, Artificial Sequence
  Description of Artificial Sequence: Synthetic oligonucleotide
aagccatcctgctggagtagtcagaggc

SEQ ID NO: 289343 - DNA, 27 bp, Artificial Sequence
  Description of Artificial Sequence: Synthetic oligonucleotide
agccatcctgctggagtagtcagaggc

SEQ ID NO: 289344 - DNA, 26 bp, Artificial Sequence
  Description of Artificial Sequence: Synthetic oligonucleotide
gccatcctgctggagtagtcagaggc

SEQ ID NO: 289345 - DNA, 26 bp, Artificial Sequence
  Description of Artificial Sequence: Synthetic oligonucleotide
ccatcctgctggagtagtcagaggcc

SEQ ID NO: 289346 - DNA, 26 bp, Artificial Sequence
  Description of Artificial Sequence: Synthetic oligonucleotide
catcctgctggagtagtcagaggccg

SEQ ID NO: 289347 - DNA, 26 bp, Artificial Sequence
  Description of Artificial Sequence: Synthetic oligonucleotide
atcctgctggagtagtcagaggccgg

SEQ ID NO: 289348 - DNA, 25 bp, Artificial Sequence
  Description of Artificial Sequence: Synthetic oligonucleotide
tcctgctggagtagtcagaggccgg

SEQ ID NO: 289349 - DNA, 24 bp, Artificial Sequence
  Description of Artificial Sequence: Synthetic oligonucleotide
cctgctggagtagtcagaggccgg

SEQ ID NO: 289350 - DNA, 25 bp, Artificial Sequence
  Description of Artificial Sequence: Synthetic oligonucleotide
ctgctggagtagtcagaggccggga

SEQ ID NO: 289351 - DNA, 27 bp, Artificial Sequence
  Description of Artificial Sequence: Synthetic oligonucleotide
tgctggagtagtcagaggccgggagaa

SEQ ID NO: 289352 - DNA, 26 bp, Artificial Sequence
  Description of Artificial Sequence: Synthetic oligonucleotide
gctggagtagtcagaggccgggagaa

SEQ ID NO: 289353 - DNA, 26 bp, Artificial Sequence
  Description of Artificial Sequence: Synthetic oligonucleotide
ctggagtagtcagaggccgggagaac

SEQ ID NO: 289354 - DNA, 27 bp, Artificial Sequence
  Description of Artificial Sequence: Synthetic oligonucleotide
tggagtagtcagaggccgggagaacga

SEQ ID NO: 289355 - DNA, 27 bp, Artificial Sequence
  Description of Artificial Sequence: Synthetic oligonucleotide
ggagtagtcagaggccgggagaacgaa

SEQ ID NO: 289356 - DNA, 27 bp, Artificial Sequence
  Description of Artificial Sequence: Synthetic oligonucleotide
gagtagtcagaggccgggagaacgaag

SEQ ID NO: 289357 - DNA, 28 bp, Artificial Sequence
  Description of Artificial Sequence: Synthetic oligonucleotide
agtagtcagaggccgggagaacgaagac

SEQ ID NO: 289358 - DNA, 27 bp, Artificial Sequence
  Description of Artificial Sequence: Synthetic oligonucleotide
gtagtcagaggccgggagaacgaagac

SEQ ID NO: 289359 - DNA, 27 bp, Artificial Sequence
  Description of Artificial Sequence: Synthetic oligonucleotide
tagtcagaggccgggagaacgaagacc

SEQ ID NO: 289360 - DNA, 27 bp, Artificial Sequence
  Description of Artificial Sequence: Synthetic oligonucleotide
agtcagaggccgggagaacgaagacca

SEQ ID NO: 289361 - DNA, 27 bp, Artificial Sequence
  Description of Artificial Sequence: Synthetic oligonucleotide
gtcagaggccgggagaacgaagaccaa

SEQ ID NO: 289362 - DNA, 27 bp, Artificial Sequence
  Description of Artificial Sequence: Synthetic oligonucleotide
tcagaggccgggagaacgaagaccaac

SEQ ID NO: 289363 - DNA, 26 bp, Artificial Sequence
  Description of Artificial Sequence: Synthetic oligonucleotide
cagaggccgggagaacgaagaccaac

SEQ ID NO: 289364 - DNA, 26 bp, Artificial Sequence
  Description of Artificial Sequence: Synthetic oligonucleotide
agaggccgggagaacgaagaccaacg

SEQ ID NO: 289365 - DNA, 25 bp, Artificial Sequence
  Description of Artificial Sequence: Synthetic oligonucleotide
gaggccgggagaacgaagaccaacg

SEQ ID NO: 289366 - DNA, 25 bp, Artificial Sequence
  Description of Artificial Sequence: Synthetic oligonucleotide
aggccgggagaacgaagaccaacgc

SEQ ID NO: 289367 - DNA, 24 bp, Artificial Sequence
  Description of Artificial Sequence: Synthetic oligonucleotide
ggccgggagaacgaagaccaacgc

SEQ ID NO: 289368 - DNA, 24 bp, Artificial Sequence
  Description of Artificial Sequence: Synthetic oligonucleotide
gccgggagaacgaagaccaacgcg

SEQ ID NO: 289369 - DNA, 26 bp, Artificial Sequence
  Description of Artificial Sequence: Synthetic oligonucleotide
ccgggagaacgaagaccaacgcgctt

SEQ ID NO: 289370 - DNA, 26 bp, Artificial Sequence
  Description of Artificial Sequence: Synthetic oligonucleotide
cgggagaacgaagaccaacgcgcttc

SEQ ID NO: 289371 - DNA, 26 bp, Artificial Sequence
  Description of Artificial Sequence: Synthetic oligonucleotide
gggagaacgaagaccaacgcgcttcg

SEQ ID NO: 289372 - DNA, 27 bp, Artificial Sequence
  Description of Artificial Sequence: Synthetic oligonucleotide
ggagaacgaagaccaacgcgcttcgca

SEQ ID NO: 289373 - DNA, 28 bp, Artificial Sequence
  Description of Artificial Sequence: Synthetic oligonucleotide
gagaacgaagaccaacgcgcttcgcaag

SEQ ID NO: 289374 - DNA, 28 bp, Artificial Sequence
  Description of Artificial Sequence: Synthetic oligonucleotide
agaacgaagaccaacgcgcttcgcaagc

SEQ ID NO: 289375 - DNA, 27 bp, Artificial Sequence
  Description of Artificial Sequence: Synthetic oligonucleotide
gaacgaagaccaacgcgcttcgcaagc

SEQ ID NO: 289376 - DNA, 27 bp, Artificial Sequence
  Description of Artificial Sequence: Synthetic oligonucleotide
aacgaagaccaacgcgcttcgcaagcc

SEQ ID NO: 289377 - DNA, 26 bp, Artificial Sequence
  Description of Artificial Sequence: Synthetic oligonucleotide
acgaagaccaacgcgcttcgcaagcc

SEQ ID NO: 289378 - DNA, 25 bp, Artificial Sequence
  Description of Artificial Sequence: Synthetic oligonucleotide
cgaagaccaacgcgcttcgcaagcc

SEQ ID NO: 289379 - DNA, 25 bp, Artificial Sequence
  Description of Artificial Sequence: Synthetic oligonucleotide
gaagaccaacgcgcttcgcaagccc

SEQ ID NO: 289380 - DNA, 25 bp, Artificial Sequence
  Description of Artificial Sequence: Synthetic oligonucleotide
aagaccaacgcgcttcgcaagcccc

SEQ ID NO: 289381 - DNA, 24 bp, Artificial Sequence
  Description of Artificial Sequence: Synthetic oligonucleotide
agaccaacgcgcttcgcaagcccc

SEQ ID NO: 289382 - DNA, 23 bp, Artificial Sequence
  Description of Artificial Sequence: Synthetic oligonucleotide
gaccaacgcgcttcgcaagcccc

SEQ ID NO: 289383 - DNA, 24 bp, Artificial Sequence
  Description of Artificial Sequence: Synthetic oligonucleotide
accaacgcgcttcgcaagccccct

SEQ ID NO: 289384 - DNA, 23 bp, Artificial Sequence
  Description of Artificial Sequence: Synthetic oligonucleotide
ccaacgcgcttcgcaagccccct

SEQ ID NO: 289385 - DNA, 24 bp, Artificial Sequence
  Description of Artificial Sequence: Synthetic oligonucleotide
caacgcgcttcgcaagccccctca

SEQ ID NO: 289386 - DNA, 24 bp, Artificial Sequence
  Description of Artificial Sequence: Synthetic oligonucleotide
aacgcgcttcgcaagccccctcag

SEQ ID NO: 289387 - DNA, 23 bp, Artificial Sequence
  Description of Artificial Sequence: Synthetic oligonucleotide
acgcgcttcgcaagccccctcag

SEQ ID NO: 289388 - DNA, 22 bp, Artificial Sequence
  Description of Artificial Sequence: Synthetic oligonucleotide
cgcgcttcgcaagccccctcag

SEQ ID NO: 289389 - DNA, 23 bp, Artificial Sequence
  Description of Artificial Sequence: Synthetic oligonucleotide
gcgcttcgcaagccccctcagct

SEQ ID NO: 289390 - DNA, 24 bp, Artificial Sequence
  Description of Artificial Sequence: Synthetic oligonucleotide
cgcttcgcaagccccctcagctca

SEQ ID NO: 289391 - DNA, 25 bp, Artificial Sequence
  Description of Artificial Sequence: Synthetic oligonucleotide
gcttcgcaagccccctcagctcaca

SEQ ID NO: 289392 - DNA, 25 bp, Artificial Sequence
  Description of Artificial Sequence: Synthetic oligonucleotide
cttcgcaagccccctcagctcacag

SEQ ID NO: 289393 - DNA, 26 bp, Artificial Sequence
  Description of Artificial Sequence: Synthetic oligonucleotide
ttcgcaagccccctcagctcacagct

SEQ ID NO: 289394 - DNA, 25 bp, Artificial Sequence
  Description of Artificial Sequence: Synthetic oligonucleotide
tcgcaagccccctcagctcacagct

SEQ ID NO: 289395 - DNA, 24 bp, Artificial Sequence
  Description of Artificial Sequence: Synthetic oligonucleotide
cgcaagccccctcagctcacagct

SEQ ID NO: 289396 - DNA, 25 bp, Artificial Sequence
  Description of Artificial Sequence: Synthetic oligonucleotide
gcaagccccctcagctcacagctgt

SEQ ID NO: 289397 - DNA, 25 bp, Artificial Sequence
  Description of Artificial Sequence: Synthetic oligonucleotide
caagccccctcagctcacagctgtg

SEQ ID NO: 289398 - DNA, 25 bp, Artificial Sequence
  Description of Artificial Sequence: Synthetic oligonucleotide
aagccccctcagctcacagctgtgg

SEQ ID NO: 289399 - DNA, 24 bp, Artificial Sequence
  Description of Artificial Sequence: Synthetic oligonucleotide
agccccctcagctcacagctgtgg

SEQ ID NO: 289400 - DNA, 23 bp, Artificial Sequence
  Description of Artificial Sequence: Synthetic oligonucleotide
gccccctcagctcacagctgtgg

SEQ ID NO: 289401 - DNA, 23 bp, Artificial Sequence
  Description of Artificial Sequence: Synthetic oligonucleotide
ccccctcagctcacagctgtggg

SEQ ID NO: 289402 - DNA, 25 bp, Artificial Sequence
  Description of Artificial Sequence: Synthetic oligonucleotide
cccctcagctcacagctgtgggctt

SEQ ID NO: 289403 - DNA, 27 bp, Artificial Sequence
  Description of Artificial Sequence: Synthetic oligonucleotide
ccctcagctcacagctgtgggcttcaa

SEQ ID NO: 289404 - DNA, 28 bp, Artificial Sequence
  Description of Artificial Sequence: Synthetic oligonucleotide
cctcagctcacagctgtgggcttcaaag

SEQ ID NO: 289405 - DNA, 29 bp, Artificial Sequence
  Description of Artificial Sequence: Synthetic oligonucleotide
ctcagctcacagctgtgggcttcaaagag

SEQ ID NO: 289406 - DNA, 30 bp, Artificial Sequence
  Description of Artificial Sequence: Synthetic oligonucleotide
tcagctcacagctgtgggcttcaaagagac

SEQ ID NO: 289407 - DNA, 29 bp, Artificial Sequence
  Description of Artificial Sequence: Synthetic oligonucleotide
cagctcacagctgtgggcttcaaagagac

SEQ ID NO: 289408 - DNA, 29 bp, Artificial Sequence
  Description of Artificial Sequence: Synthetic oligonucleotide
agctcacagctgtgggcttcaaagagacg

SEQ ID NO: 289409 - DNA, 28 bp, Artificial Sequence
  Description of Artificial Sequence: Synthetic oligonucleotide
gctcacagctgtgggcttcaaagagacg

SEQ ID NO: 289410 - DNA, 28 bp, Artificial Sequence
  Description of Artificial Sequence: Synthetic oligonucleotide
ctcacagctgtgggcttcaaagagacgg

SEQ ID NO: 289411 - DNA, 29 bp, Artificial Sequence
  Description of Artificial Sequence: Synthetic oligonucleotide
tcacagctgtgggcttcaaagagacggtg

SEQ ID NO: 289412 - DNA, 28 bp, Artificial Sequence
  Description of Artificial Sequence: Synthetic oligonucleotide
cacagctgtgggcttcaaagagacggtg

SEQ ID NO: 289413 - DNA, 28 bp, Artificial Sequence
  Description of Artificial Sequence: Synthetic oligonucleotide
acagctgtgggcttcaaagagacggtgc

SEQ ID NO: 289414 - DNA, 27 bp, Artificial Sequence
  Description of Artificial Sequence: Synthetic oligonucleotide
cagctgtgggcttcaaagagacggtgc

SEQ ID NO: 289415 - DNA, 28 bp, Artificial Sequence
  Description of Artificial Sequence: Synthetic oligonucleotide
agctgtgggcttcaaagagacggtgctc

SEQ ID NO: 289416 - DNA, 27 bp, Artificial Sequence
  Description of Artificial Sequence: Synthetic oligonucleotide
gctgtgggcttcaaagagacggtgctc

SEQ ID NO: 289417 - DNA, 29 bp, Artificial Sequence
  Description of Artificial Sequence: Synthetic oligonucleotide
ctgtgggcttcaaagagacggtgctcaag

SEQ ID NO: 289418 - DNA, 29 bp, Artificial Sequence
  Description of Artificial Sequence: Synthetic oligonucleotide
tgtgggcttcaaagagacggtgctcaagc

SEQ ID NO: 289419 - DNA, 28 bp, Artificial Sequence
  Description of Artificial Sequence: Synthetic oligonucleotide
gtgggcttcaaagagacggtgctcaagc

SEQ ID NO: 289420 - DNA, 30 bp, Artificial Sequence
  Description of Artificial Sequence: Synthetic oligonucleotide
tgggcttcaaagagacggtgctcaagcttc

SEQ ID NO: 289421 - DNA, 29 bp, Artificial Sequence
  Description of Artificial Sequence: Synthetic oligonucleotide
gggcttcaaagagacggtgctcaagcttc

SEQ ID NO: 289422 - DNA, 30 bp, Artificial Sequence
  Description of Artificial Sequence: Synthetic oligonucleotide
ggcttcaaagagacggtgctcaagcttctg

SEQ ID NO: 289423 - DNA, 32 bp, Artificial Sequence
  Description of Artificial Sequence: Synthetic oligonucleotide
gcttcaaagagacggtgctcaagcttctgatc

SEQ ID NO: 289424 - DNA, 32 bp, Artificial Sequence
  Description of Artificial Sequence: Synthetic oligonucleotide
cttcaaagagacggtgctcaagcttctgatcg

SEQ ID NO: 289425 - DNA, 33 bp, Artificial Sequence
  Description of Artificial Sequence: Synthetic oligonucleotide
ttcaaagagacggtgctcaagcttctgatcgtg

SEQ ID NO: 289426 - DNA, 32 bp, Artificial Sequence
  Description of Artificial Sequence: Synthetic oligonucleotide
tcaaagagacggtgctcaagcttctgatcgtg

SEQ ID NO: 289427 - DNA, 31 bp, Artificial Sequence
  Description of Artificial Sequence: Synthetic oligonucleotide
caaagagacggtgctcaagcttctgatcgtg

SEQ ID NO: 289428 - DNA, 31 bp, Artificial Sequence
  Description of Artificial Sequence: Synthetic oligonucleotide
aaagagacggtgctcaagcttctgatcgtgg

SEQ ID NO: 289429 - DNA, 30 bp, Artificial Sequence
  Description of Artificial Sequence: Synthetic oligonucleotide
aagagacggtgctcaagcttctgatcgtgg

SEQ ID NO: 289430 - DNA, 29 bp, Artificial Sequence
  Description of Artificial Sequence: Synthetic oligonucleotide
agagacggtgctcaagcttctgatcgtgg

SEQ ID NO: 289431 - DNA, 28 bp, Artificial Sequence
  Description of Artificial Sequence: Synthetic oligonucleotide
gagacggtgctcaagcttctgatcgtgg

SEQ ID NO: 289432 - DNA, 29 bp, Artificial Sequence
  Description of Artificial Sequence: Synthetic oligonucleotide
agacggtgctcaagcttctgatcgtggtg

SEQ ID NO: 289433 - DNA, 28 bp, Artificial Sequence
  Description of Artificial Sequence: Synthetic oligonucleotide
gacggtgctcaagcttctgatcgtggtg

SEQ ID NO: 289434 - DNA, 28 bp, Artificial Sequence
  Description of Artificial Sequence: Synthetic oligonucleotide
acggtgctcaagcttctgatcgtggtgc

SEQ ID NO: 289435 - DNA, 27 bp, Artificial Sequence
  Description of Artificial Sequence: Synthetic oligonucleotide
cggtgctcaagcttctgatcgtggtgc

SEQ ID NO: 289436 - DNA, 28 bp, Artificial Sequence
  Description of Artificial Sequence: Synthetic oligonucleotide
ggtgctcaagcttctgatcgtggtgcag

SEQ ID NO: 289437 - DNA, 28 bp, Artificial Sequence
  Description of Artificial Sequence: Synthetic oligonucleotide
gtgctcaagcttctgatcgtggtgcagc

SEQ ID NO: 289438 - DNA, 29 bp, Artificial Sequence
  Description of Artificial Sequence: Synthetic oligonucleotide
tgctcaagcttctgatcgtggtgcagctg

SEQ ID NO: 289439 - DNA, 28 bp, Artificial Sequence
  Description of Artificial Sequence: Synthetic oligonucleotide
gctcaagcttctgatcgtggtgcagctg

SEQ ID NO: 289440 - DNA, 30 bp, Artificial Sequence
  Description of Artificial Sequence: Synthetic oligonucleotide
ctcaagcttctgatcgtggtgcagctgttg

SEQ ID NO: 289441 - DNA, 30 bp, Artificial Sequence
  Description of Artificial Sequence: Synthetic oligonucleotide
tcaagcttctgatcgtggtgcagctgttgc

SEQ ID NO: 289442 - DNA, 29 bp, Artificial Sequence
  Description of Artificial Sequence: Synthetic oligonucleotide
caagcttctgatcgtggtgcagctgttgc

SEQ ID NO: 289443 - DNA, 30 bp, Artificial Sequence
  Description of Artificial Sequence: Synthetic oligonucleotide
aagcttctgatcgtggtgcagctgttgcag

SEQ ID NO: 289444 - DNA, 29 bp, Artificial Sequence
  Description of Artificial Sequence: Synthetic oligonucleotide
agcttctgatcgtggtgcagctgttgcag

SEQ ID NO: 289445 - DNA, 28 bp, Artificial Sequence
  Description of Artificial Sequence: Synthetic oligonucleotide
gcttctgatcgtggtgcagctgttgcag

SEQ ID NO: 289446 - DNA, 28 bp, Artificial Sequence
  Description of Artificial Sequence: Synthetic oligonucleotide
cttctgatcgtggtgcagctgttgcagg

SEQ ID NO: 289447 - DNA, 28 bp, Artificial Sequence
  Description of Artificial Sequence: Synthetic oligonucleotide
ttctgatcgtggtgcagctgttgcaggg

SEQ ID NO: 289448 - DNA, 27 bp, Artificial Sequence
  Description of Artificial Sequence: Synthetic oligonucleotide
tctgatcgtggtgcagctgttgcaggg

SEQ ID NO: 289449 - DNA, 26 bp, Artificial Sequence
  Description of Artificial Sequence: Synthetic oligonucleotide
ctgatcgtggtgcagctgttgcaggg

SEQ ID NO: 289450 - DNA, 26 bp, Artificial Sequence
  Description of Artificial Sequence: Synthetic oligonucleotide
tgatcgtggtgcagctgttgcagggg

SEQ ID NO: 289451 - DNA, 25 bp, Artificial Sequence
  Description of Artificial Sequence: Synthetic oligonucleotide
gatcgtggtgcagctgttgcagggg

SEQ ID NO: 289452 - DNA, 26 bp, Artificial Sequence
  Description of Artificial Sequence: Synthetic oligonucleotide
atcgtggtgcagctgttgcaggggga

SEQ ID NO: 289453 - DNA, 25 bp, Artificial Sequence
  Description of Artificial Sequence: Synthetic oligonucleotide
tcgtggtgcagctgttgcaggggga

SEQ ID NO: 289454 - DNA, 24 bp, Artificial Sequence
  Description of Artificial Sequence: Synthetic oligonucleotide
cgtggtgcagctgttgcaggggga

SEQ ID NO: 289455 - DNA, 26 bp, Artificial Sequence
  Description of Artificial Sequence: Synthetic oligonucleotide
gtggtgcagctgttgcagggggagat

SEQ ID NO: 289456 - DNA, 26 bp, Artificial Sequence
  Description of Artificial Sequence: Synthetic oligonucleotide
tggtgcagctgttgcagggggagatg

SEQ ID NO: 289457 - DNA, 25 bp, Artificial Sequence
  Description of Artificial Sequence: Synthetic oligonucleotide
ggtgcagctgttgcagggggagatg

SEQ ID NO: 289458 - DNA, 25 bp, Artificial Sequence
  Description of Artificial Sequence: Synthetic oligonucleotide
gtgcagctgttgcagggggagatgc

SEQ ID NO: 289459 - DNA, 26 bp, Artificial Sequence
  Description of Artificial Sequence: Synthetic oligonucleotide
tgcagctgttgcagggggagatgcct

SEQ ID NO: 289460 - DNA, 25 bp, Artificial Sequence
  Description of Artificial Sequence: Synthetic oligonucleotide
gcagctgttgcagggggagatgcct

SEQ ID NO: 289461 - DNA, 26 bp, Artificial Sequence
  Description of Artificial Sequence: Synthetic oligonucleotide
cagctgttgcagggggagatgcctga

SEQ ID NO: 289462 - DNA, 26 bp, Artificial Sequence
  Description of Artificial Sequence: Synthetic oligonucleotide
agctgttgcagggggagatgcctgac

SEQ ID NO: 289463 - DNA, 25 bp, Artificial Sequence
  Description of Artificial Sequence: Synthetic oligonucleotide
gctgttgcagggggagatgcctgac

SEQ ID NO: 289464 - DNA, 25 bp, Artificial Sequence
  Description of Artificial Sequence: Synthetic oligonucleotide
ctgttgcagggggagatgcctgacc

SEQ ID NO: 289465 - DNA, 25 bp, Artificial Sequence
  Description of Artificial Sequence: Synthetic oligonucleotide
tgttgcagggggagatgcctgaccg

SEQ ID NO: 289466 - DNA, 24 bp, Artificial Sequence
  Description of Artificial Sequence: Synthetic oligonucleotide
gttgcagggggagatgcctgaccg

SEQ ID NO: 289467 - DNA, 24 bp, Artificial Sequence
  Description of Artificial Sequence: Synthetic oligonucleotide
ttgcagggggagatgcctgaccgg

SEQ ID NO: 289468 - DNA, 23 bp, Artificial Sequence
  Description of Artificial Sequence: Synthetic oligonucleotide
tgcagggggagatgcctgaccgg

SEQ ID NO: 289469 - DNA, 22 bp, Artificial Sequence
  Description of Artificial Sequence: Synthetic oligonucleotide
gcagggggagatgcctgaccgg

SEQ ID NO: 289470 - DNA, 23 bp, Artificial Sequence
  Description of Artificial Sequence: Synthetic oligonucleotide
cagggggagatgcctgaccgggt

SEQ ID NO: 289471 - DNA, 23 bp, Artificial Sequence
  Description of Artificial Sequence: Synthetic oligonucleotide
agggggagatgcctgaccgggtg

SEQ ID NO: 289472 - DNA, 22 bp, Artificial Sequence
  Description of Artificial Sequence: Synthetic oligonucleotide
gggggagatgcctgaccgggtg

SEQ ID NO: 289473 - DNA, 23 bp, Artificial Sequence
  Description of Artificial Sequence: Synthetic oligonucleotide
ggggagatgcctgaccgggtgca

SEQ ID NO: 289474 - DNA, 25 bp, Artificial Sequence
  Description of Artificial Sequence: Synthetic oligonucleotide
gggagatgcctgaccgggtgcagtt

SEQ ID NO: 289475 - DNA, 25 bp, Artificial Sequence
  Description of Artificial Sequence: Synthetic oligonucleotide
ggagatgcctgaccgggtgcagttc

SEQ ID NO: 289476 - DNA, 25 bp, Artificial Sequence
  Description of Artificial Sequence: Synthetic oligonucleotide
gagatgcctgaccgggtgcagttcc

SEQ ID NO: 289477 - DNA, 25 bp, Artificial Sequence
  Description of Artificial Sequence: Synthetic oligonucleotide
agatgcctgaccgggtgcagttccc

SEQ ID NO: 289478 - DNA, 24 bp, Artificial Sequence
  Description of Artificial Sequence: Synthetic oligonucleotide
gatgcctgaccgggtgcagttccc

SEQ ID NO: 289479 - DNA, 24 bp, Artificial Sequence
  Description of Artificial Sequence: Synthetic oligonucleotide
atgcctgaccgggtgcagttcccc

SEQ ID NO: 289480 - DNA, 23 bp, Artificial Sequence
  Description of Artificial Sequence: Synthetic oligonucleotide
tgcctgaccgggtgcagttcccc

SEQ ID NO: 289481 - DNA, 22 bp, Artificial Sequence
  Description of Artificial Sequence: Synthetic oligonucleotide
gcctgaccgggtgcagttcccc

SEQ ID NO: 289482 - DNA, 23 bp, Artificial Sequence
  Description of Artificial Sequence: Synthetic oligonucleotide
cctgaccgggtgcagttccccca

SEQ ID NO: 289483 - DNA, 23 bp, Artificial Sequence
  Description of Artificial Sequence: Synthetic oligonucleotide
ctgaccgggtgcagttcccccag

SEQ ID NO: 289484 - DNA, 23 bp, Artificial Sequence
  Description of Artificial Sequence: Synthetic oligonucleotide
tgaccgggtgcagttcccccagc

SEQ ID NO: 289485 - DNA, 22 bp, Artificial Sequence
  Description of Artificial Sequence: Synthetic oligonucleotide
gaccgggtgcagttcccccagc

SEQ ID NO: 289486 - DNA, 22 bp, Artificial Sequence
  Description of Artificial Sequence: Synthetic oligonucleotide
accgggtgcagttcccccagcc

SEQ ID NO: 289487 - DNA, 21 bp, Artificial Sequence
  Description of Artificial Sequence: Synthetic oligonucleotide
ccgggtgcagttcccccagcc

SEQ ID NO: 289488 - DNA, 22 bp, Artificial Sequence
  Description of Artificial Sequence: Synthetic oligonucleotide
cgggtgcagttcccccagccct

SEQ ID NO: 289489 - DNA, 22 bp, Artificial Sequence
  Description of Artificial Sequence: Synthetic oligonucleotide
gggtgcagttcccccagccctc

SEQ ID NO: 289490 - DNA, 22 bp, Artificial Sequence
  Description of Artificial Sequence: Synthetic oligonucleotide
ggtgcagttcccccagccctcg

SEQ ID NO: 289491 - DNA, 23 bp, Artificial Sequence
  Description of Artificial Sequence: Synthetic oligonucleotide
gtgcagttcccccagccctcgct

SEQ ID NO: 289492 - DNA, 25 bp, Artificial Sequence
  Description of Artificial Sequence: Synthetic oligonucleotide
tgcagttcccccagccctcgctcaa

SEQ ID NO: 289493 - DNA, 24 bp, Artificial Sequence
  Description of Artificial Sequence: Synthetic oligonucleotide
gcagttcccccagccctcgctcaa

SEQ ID NO: 289494 - DNA, 24 bp, Artificial Sequence
  Description of Artificial Sequence: Synthetic oligonucleotide
cagttcccccagccctcgctcaag

SEQ ID NO: 289495 - DNA, 24 bp, Artificial Sequence
  Description of Artificial Sequence: Synthetic oligonucleotide
agttcccccagccctcgctcaagc

SEQ ID NO: 289496 - DNA, 23 bp, Artificial Sequence
  Description of Artificial Sequence: Synthetic oligonucleotide
gttcccccagccctcgctcaagc

SEQ ID NO: 289497 - DNA, 23 bp, Artificial Sequence
  Description of Artificial Sequence: Synthetic oligonucleotide
ttcccccagccctcgctcaagcg

SEQ ID NO: 289498 - DNA, 22 bp, Artificial Sequence
  Description of Artificial Sequence: Synthetic oligonucleotide
tcccccagccctcgctcaagcg

SEQ ID NO: 289499 - DNA, 21 bp, Artificial Sequence
  Description of Artificial Sequence: Synthetic oligonucleotide
cccccagccctcgctcaagcg

SEQ ID NO: 289500 - DNA, 22 bp, Artificial Sequence
  Description of Artificial Sequence: Synthetic oligonucleotide
ccccagccctcgctcaagcgca

SEQ ID NO: 289501 - DNA, 23 bp, Artificial Sequence
  Description of Artificial Sequence: Synthetic oligonucleotide
cccagccctcgctcaagcgcaca

SEQ ID NO: 289502 - DNA, 24 bp, Artificial Sequence
  Description of Artificial Sequence: Synthetic oligonucleotide
ccagccctcgctcaagcgcacact

SEQ ID NO: 289503 - DNA, 26 bp, Artificial Sequence
  Description of Artificial Sequence: Synthetic oligonucleotide
cagccctcgctcaagcgcacactcat

SEQ ID NO: 289504 - DNA, 26 bp, Artificial Sequence
  Description of Artificial Sequence: Synthetic oligonucleotide
agccctcgctcaagcgcacactcatg

SEQ ID NO: 289505 - DNA, 25 bp, Artificial Sequence
  Description of Artificial Sequence: Synthetic oligonucleotide
gccctcgctcaagcgcacactcatg

SEQ ID NO: 289506 - DNA, 25 bp, Artificial Sequence
  Description of Artificial Sequence: Synthetic oligonucleotide
ccctcgctcaagcgcacactcatgc

SEQ ID NO: 289507 - DNA, 25 bp, Artificial Sequence
  Description of Artificial Sequence: Synthetic oligonucleotide
cctcgctcaagcgcacactcatgcg

SEQ ID NO: 289508 - DNA, 27 bp, Artificial Sequence
  Description of Artificial Sequence: Synthetic oligonucleotide
ctcgctcaagcgcacactcatgcgcta

SEQ ID NO: 289509 - DNA, 30 bp, Artificial Sequence
  Description of Artificial Sequence: Synthetic oligonucleotide
tcgctcaagcgcacactcatgcgctatttc

SEQ ID NO: 289510 - DNA, 29 bp, Artificial Sequence
  Description of Artificial Sequence: Synthetic oligonucleotide
cgctcaagcgcacactcatgcgctatttc

SEQ ID NO: 289511 - DNA, 29 bp, Artificial Sequence
  Description of Artificial Sequence: Synthetic oligonucleotide
gctcaagcgcacactcatgcgctatttcc

SEQ ID NO: 289512 - DNA, 31 bp, Artificial Sequence
  Description of Artificial Sequence: Synthetic oligonucleotide
ctcaagcgcacactcatgcgctatttcctac

SEQ ID NO: 289513 - DNA, 32 bp, Artificial Sequence
  Description of Artificial Sequence: Synthetic oligonucleotide
tcaagcgcacactcatgcgctatttcctactg

SEQ ID NO: 289514 - DNA, 31 bp, Artificial Sequence
  Description of Artificial Sequence: Synthetic oligonucleotide
caagcgcacactcatgcgctatttcctactg

SEQ ID NO: 289515 - DNA, 32 bp, Artificial Sequence
  Description of Artificial Sequence: Synthetic oligonucleotide
aagcgcacactcatgcgctatttcctactgac

SEQ ID NO: 289516 - DNA, 31 bp, Artificial Sequence
  Description of Artificial Sequence: Synthetic oligonucleotide
agcgcacactcatgcgctatttcctactgac

SEQ ID NO: 289517 - DNA, 30 bp, Artificial Sequence
  Description of Artificial Sequence: Synthetic oligonucleotide
gcgcacactcatgcgctatttcctactgac

SEQ ID NO: 289518 - DNA, 31 bp, Artificial Sequence
  Description of Artificial Sequence: Synthetic oligonucleotide
cgcacactcatgcgctatttcctactgactc

SEQ ID NO: 289519 - DNA, 33 bp, Artificial Sequence
  Description of Artificial Sequence: Synthetic oligonucleotide
gcacactcatgcgctatttcctactgactcaac

SEQ ID NO: 289520 - DNA, 33 bp, Artificial Sequence
  Description of Artificial Sequence: Synthetic oligonucleotide
cacactcatgcgctatttcctactgactcaacc

SEQ ID NO: 289521 - DNA, 34 bp, Artificial Sequence
  Description of Artificial Sequence: Synthetic oligonucleotide
acactcatgcgctatttcctactgactcaacctg

SEQ ID NO: 289522 - DNA, 33 bp, Artificial Sequence
  Description of Artificial Sequence: Synthetic oligonucleotide
cactcatgcgctatttcctactgactcaacctg

SEQ ID NO: 289523 - DNA, 34 bp, Artificial Sequence
  Description of Artificial Sequence: Synthetic oligonucleotide
actcatgcgctatttcctactgactcaacctgtc

SEQ ID NO: 289524 - DNA, 33 bp, Artificial Sequence
  Description of Artificial Sequence: Synthetic oligonucleotide
ctcatgcgctatttcctactgactcaacctgtc

SEQ ID NO: 289525 - DNA, 34 bp, Artificial Sequence
  Description of Artificial Sequence: Synthetic oligonucleotide
tcatgcgctatttcctactgactcaacctgtcag

SEQ ID NO: 289526 - DNA, 33 bp, Artificial Sequence
  Description of Artificial Sequence: Synthetic oligonucleotide
catgcgctatttcctactgactcaacctgtcag

SEQ ID NO: 289527 - DNA, 33 bp, Artificial Sequence
  Description of Artificial Sequence: Synthetic oligonucleotide
atgcgctatttcctactgactcaacctgtcagg

SEQ ID NO: 289528 - DNA, 32 bp, Artificial Sequence
  Description of Artificial Sequence: Synthetic oligonucleotide
tgcgctatttcctactgactcaacctgtcagg

SEQ ID NO: 289529 - DNA, 31 bp, Artificial Sequence
  Description of Artificial Sequence: Synthetic oligonucleotide
gcgctatttcctactgactcaacctgtcagg

SEQ ID NO: 289530 - DNA, 32 bp, Artificial Sequence
  Description of Artificial Sequence: Synthetic oligonucleotide
cgctatttcctactgactcaacctgtcaggag

SEQ ID NO: 289531 - DNA, 33 bp, Artificial Sequence
  Description of Artificial Sequence: Synthetic oligonucleotide
gctatttcctactgactcaacctgtcaggagag

SEQ ID NO: 289532 - DNA, 33 bp, Artificial Sequence
  Description of Artificial Sequence: Synthetic oligonucleotide
ctatttcctactgactcaacctgtcaggagagg

SEQ ID NO: 289533 - DNA, 36 bp, Artificial Sequence
  Description of Artificial Sequence: Synthetic oligonucleotide
tatttcctactgactcaacctgtcaggagaggaaac

SEQ ID NO: 289534 - DNA, 35 bp, Artificial Sequence
  Description of Artificial Sequence: Synthetic oligonucleotide
atttcctactgactcaacctgtcaggagaggaaac

SEQ ID NO: 289535 - DNA, 34 bp, Artificial Sequence
  Description of Artificial Sequence: Synthetic oligonucleotide
tttcctactgactcaacctgtcaggagaggaaac

SEQ ID NO: 289536 - DNA, 33 bp, Artificial Sequence
  Description of Artificial Sequence: Synthetic oligonucleotide
ttcctactgactcaacctgtcaggagaggaaac

SEQ ID NO: 289537 - DNA, 32 bp, Artificial Sequence
  Description of Artificial Sequence: Synthetic oligonucleotide
tcctactgactcaacctgtcaggagaggaaac

SEQ ID NO: 289538 - DNA, 31 bp, Artificial Sequence
  Description of Artificial Sequence: Synthetic oligonucleotide
cctactgactcaacctgtcaggagaggaaac

SEQ ID NO: 289539 - DNA, 31 bp, Artificial Sequence
  Description of Artificial Sequence: Synthetic oligonucleotide
ctactgactcaacctgtcaggagaggaaacc

SEQ ID NO: 289540 - DNA, 33 bp, Artificial Sequence
  Description of Artificial Sequence: Synthetic oligonucleotide
tactgactcaacctgtcaggagaggaaaccttg

SEQ ID NO: 289541 - DNA, 32 bp, Artificial Sequence
  Description of Artificial Sequence: Synthetic oligonucleotide
actgactcaacctgtcaggagaggaaaccttg

SEQ ID NO: 289542 - DNA, 31 bp, Artificial Sequence
  Description of Artificial Sequence: Synthetic oligonucleotide
ctgactcaacctgtcaggagaggaaaccttg

SEQ ID NO: 289543 - DNA, 31 bp, Artificial Sequence
  Description of Artificial Sequence: Synthetic oligonucleotide
tgactcaacctgtcaggagaggaaaccttgc

SEQ ID NO: 289544 - DNA, 30 bp, Artificial Sequence
  Description of Artificial Sequence: Synthetic oligonucleotide
gactcaacctgtcaggagaggaaaccttgc

SEQ ID NO: 289545 - DNA, 30 bp, Artificial Sequence
  Description of Artificial Sequence: Synthetic oligonucleotide
actcaacctgtcaggagaggaaaccttgcc

SEQ ID NO: 289546 - DNA, 29 bp, Artificial Sequence
  Description of Artificial Sequence: Synthetic oligonucleotide
ctcaacctgtcaggagaggaaaccttgcc

SEQ ID NO: 289547 - DNA, 31 bp, Artificial Sequence
  Description of Artificial Sequence: Synthetic oligonucleotide
tcaacctgtcaggagaggaaaccttgccaag

SEQ ID NO: 289548 - DNA, 30 bp, Artificial Sequence
  Description of Artificial Sequence: Synthetic oligonucleotide
caacctgtcaggagaggaaaccttgccaag

SEQ ID NO: 289549 - DNA, 32 bp, Artificial Sequence
  Description of Artificial Sequence: Synthetic oligonucleotide
aacctgtcaggagaggaaaccttgccaagttc

SEQ ID NO: 289550 - DNA, 31 bp, Artificial Sequence
  Description of Artificial Sequence: Synthetic oligonucleotide
acctgtcaggagaggaaaccttgccaagttc

SEQ ID NO: 289551 - DNA, 30 bp, Artificial Sequence
  Description of Artificial Sequence: Synthetic oligonucleotide
cctgtcaggagaggaaaccttgccaagttc

SEQ ID NO: 289552 - DNA, 32 bp, Artificial Sequence
  Description of Artificial Sequence: Synthetic oligonucleotide
ctgtcaggagaggaaaccttgccaagttctac

SEQ ID NO: 289553 - DNA, 32 bp, Artificial Sequence
  Description of Artificial Sequence: Synthetic oligonucleotide
tgtcaggagaggaaaccttgccaagttctacc

SEQ ID NO: 289554 - DNA, 31 bp, Artificial Sequence
  Description of Artificial Sequence: Synthetic oligonucleotide
gtcaggagaggaaaccttgccaagttctacc

SEQ ID NO: 289555 - DNA, 32 bp, Artificial Sequence
  Description of Artificial Sequence: Synthetic oligonucleotide
tcaggagaggaaaccttgccaagttctaccag

SEQ ID NO: 289556 - DNA, 31 bp, Artificial Sequence
  Description of Artificial Sequence: Synthetic oligonucleotide
caggagaggaaaccttgccaagttctaccag

SEQ ID NO: 289557 - DNA, 31 bp, Artificial Sequence
  Description of Artificial Sequence: Synthetic oligonucleotide
aggagaggaaaccttgccaagttctaccagg

SEQ ID NO: 289558 - DNA, 30 bp, Artificial Sequence
  Description of Artificial Sequence: Synthetic oligonucleotide
ggagaggaaaccttgccaagttctaccagg

SEQ ID NO: 289559 - DNA, 31 bp, Artificial Sequence
  Description of Artificial Sequence: Synthetic oligonucleotide
gagaggaaaccttgccaagttctaccaggtc

SEQ ID NO: 289560 - DNA, 31 bp, Artificial Sequence
  Description of Artificial Sequence: Synthetic oligonucleotide
agaggaaaccttgccaagttctaccaggtcc

SEQ ID NO: 289561 - DNA, 30 bp, Artificial Sequence
  Description of Artificial Sequence: Synthetic oligonucleotide
gaggaaaccttgccaagttctaccaggtcc

SEQ ID NO: 289562 - DNA, 31 bp, Artificial Sequence
  Description of Artificial Sequence: Synthetic oligonucleotide
aggaaaccttgccaagttctaccaggtccag

SEQ ID NO: 289563 - DNA, 30 bp, Artificial Sequence
  Description of Artificial Sequence: Synthetic oligonucleotide
ggaaaccttgccaagttctaccaggtccag

SEQ ID NO: 289564 - DNA, 30 bp, Artificial Sequence
  Description of Artificial Sequence: Synthetic oligonucleotide
gaaaccttgccaagttctaccaggtccagg

SEQ ID NO: 289565 - DNA, 32 bp, Artificial Sequence
  Description of Artificial Sequence: Synthetic oligonucleotide
aaaccttgccaagttctaccaggtccaggatc

SEQ ID NO: 289566 - DNA, 31 bp, Artificial Sequence
  Description of Artificial Sequence: Synthetic oligonucleotide
aaccttgccaagttctaccaggtccaggatc

SEQ ID NO: 289567 - DNA, 30 bp, Artificial Sequence
  Description of Artificial Sequence: Synthetic oligonucleotide
accttgccaagttctaccaggtccaggatc

SEQ ID NO: 289568 - DNA, 29 bp, Artificial Sequence
  Description of Artificial Sequence: Synthetic oligonucleotide
ccttgccaagttctaccaggtccaggatc

SEQ ID NO: 289569 - DNA, 30 bp, Artificial Sequence
  Description of Artificial Sequence: Synthetic oligonucleotide
cttgccaagttctaccaggtccaggatcag

SEQ ID NO: 289570 - DNA, 33 bp, Artificial Sequence
  Description of Artificial Sequence: Synthetic oligonucleotide
ttgccaagttctaccaggtccaggatcagttag

SEQ ID NO: 289571 - DNA, 32 bp, Artificial Sequence
  Description of Artificial Sequence: Synthetic oligonucleotide
tgccaagttctaccaggtccaggatcagttag

SEQ ID NO: 289572 - DNA, 31 bp, Artificial Sequence
  Description of Artificial Sequence: Synthetic oligonucleotide
gccaagttctaccaggtccaggatcagttag

SEQ ID NO: 289573 - DNA, 31 bp, Artificial Sequence
  Description of Artificial Sequence: Synthetic oligonucleotide
ccaagttctaccaggtccaggatcagttagg

SEQ ID NO: 289574 - DNA, 31 bp, Artificial Sequence
  Description of Artificial Sequence: Synthetic oligonucleotide
caagttctaccaggtccaggatcagttaggg

SEQ ID NO: 289575 - DNA, 31 bp, Artificial Sequence
  Description of Artificial Sequence: Synthetic oligonucleotide
aagttctaccaggtccaggatcagttagggg

SEQ ID NO: 289576 - DNA, 30 bp, Artificial Sequence
  Description of Artificial Sequence: Synthetic oligonucleotide
agttctaccaggtccaggatcagttagggg

SEQ ID NO: 289577 - DNA, 29 bp, Artificial Sequence
  Description of Artificial Sequence: Synthetic oligonucleotide
gttctaccaggtccaggatcagttagggg

SEQ ID NO: 289578 - DNA, 30 bp, Artificial Sequence
  Description of Artificial Sequence: Synthetic oligonucleotide
ttctaccaggtccaggatcagttaggggag

SEQ ID NO: 289579 - DNA, 29 bp, Artificial Sequence
  Description of Artificial Sequence: Synthetic oligonucleotide
tctaccaggtccaggatcagttaggggag

SEQ ID NO: 289580 - DNA, 28 bp, Artificial Sequence
  Description of Artificial Sequence: Synthetic oligonucleotide
ctaccaggtccaggatcagttaggggag

SEQ ID NO: 289581 - DNA, 30 bp, Artificial Sequence
  Description of Artificial Sequence: Synthetic oligonucleotide
taccaggtccaggatcagttaggggagaag

SEQ ID NO: 289582 - DNA, 29 bp, Artificial Sequence
  Description of Artificial Sequence: Synthetic oligonucleotide
accaggtccaggatcagttaggggagaag

SEQ ID NO: 289583 - DNA, 28 bp, Artificial Sequence
  Description of Artificial Sequence: Synthetic oligonucleotide
ccaggtccaggatcagttaggggagaag

SEQ ID NO: 289584 - DNA, 31 bp, Artificial Sequence
  Description of Artificial Sequence: Synthetic oligonucleotide
caggtccaggatcagttaggggagaagattc

SEQ ID NO: 289585 - DNA, 33 bp, Artificial Sequence
  Description of Artificial Sequence: Synthetic oligonucleotide
aggtccaggatcagttaggggagaagattcaag

SEQ ID NO: 289586 - DNA, 32 bp, Artificial Sequence
  Description of Artificial Sequence: Synthetic oligonucleotide
ggtccaggatcagttaggggagaagattcaag

SEQ ID NO: 289587 - DNA, 32 bp, Artificial Sequence
  Description of Artificial Sequence: Synthetic oligonucleotide
gtccaggatcagttaggggagaagattcaagc

SEQ ID NO: 289588 - DNA, 33 bp, Artificial Sequence
  Description of Artificial Sequence: Synthetic oligonucleotide
tccaggatcagttaggggagaagattcaagcag

SEQ ID NO: 289589 - DNA, 32 bp, Artificial Sequence
  Description of Artificial Sequence: Synthetic oligonucleotide
ccaggatcagttaggggagaagattcaagcag

SEQ ID NO: 289590 - DNA, 34 bp, Artificial Sequence
  Description of Artificial Sequence: Synthetic oligonucleotide
caggatcagttaggggagaagattcaagcagttg

SEQ ID NO: 289591 - DNA, 34 bp, Artificial Sequence
  Description of Artificial Sequence: Synthetic oligonucleotide
aggatcagttaggggagaagattcaagcagttgg

SEQ ID NO: 289592 - DNA, 33 bp, Artificial Sequence
  Description of Artificial Sequence: Synthetic oligonucleotide
ggatcagttaggggagaagattcaagcagttgg

SEQ ID NO: 289593 - DNA, 33 bp, Artificial Sequence
  Description of Artificial Sequence: Synthetic oligonucleotide
gatcagttaggggagaagattcaagcagttggg

SEQ ID NO: 289594 - DNA, 34 bp, Artificial Sequence
  Description of Artificial Sequence: Synthetic oligonucleotide
atcagttaggggagaagattcaagcagttgggac

SEQ ID NO: 289595 - DNA, 33 bp, Artificial Sequence
  Description of Artificial Sequence: Synthetic oligonucleotide
tcagttaggggagaagattcaagcagttgggac

SEQ ID NO: 289596 - DNA, 32 bp, Artificial Sequence
  Description of Artificial Sequence: Synthetic oligonucleotide
cagttaggggagaagattcaagcagttgggac

SEQ ID NO: 289597 - DNA, 32 bp, Artificial Sequence
  Description of Artificial Sequence: Synthetic oligonucleotide
agttaggggagaagattcaagcagttgggacc

SEQ ID NO: 289598 - DNA, 31 bp, Artificial Sequence
  Description of Artificial Sequence: Synthetic oligonucleotide
gttaggggagaagattcaagcagttgggacc

SEQ ID NO: 289599 - DNA, 33 bp, Artificial Sequence
  Description of Artificial Sequence: Synthetic oligonucleotide
ttaggggagaagattcaagcagttgggacctag

SEQ ID NO: 289600 - DNA, 32 bp, Artificial Sequence
  Description of Artificial Sequence: Synthetic oligonucleotide
taggggagaagattcaagcagttgggacctag

SEQ ID NO: 289601 - DNA, 31 bp, Artificial Sequence
  Description of Artificial Sequence: Synthetic oligonucleotide
aggggagaagattcaagcagttgggacctag

SEQ ID NO: 289602 - DNA, 30 bp, Artificial Sequence
  Description of Artificial Sequence: Synthetic oligonucleotide
ggggagaagattcaagcagttgggacctag

SEQ ID NO: 289603 - DNA, 31 bp, Artificial Sequence
  Description of Artificial Sequence: Synthetic oligonucleotide
gggagaagattcaagcagttgggacctagac

SEQ ID NO: 289604 - DNA, 31 bp, Artificial Sequence
  Description of Artificial Sequence: Synthetic oligonucleotide
ggagaagattcaagcagttgggacctagacc

SEQ ID NO: 289605 - DNA, 31 bp, Artificial Sequence
  Description of Artificial Sequence: Synthetic oligonucleotide
gagaagattcaagcagttgggacctagaccc

SEQ ID NO: 289606 - DNA, 38 bp, Artificial Sequence
  Description of Artificial Sequence: Synthetic oligonucleotide
agaagattcaagcagttgggacctagaccctaattttc

SEQ ID NO: 289607 - DNA, 37 bp, Artificial Sequence
  Description of Artificial Sequence: Synthetic oligonucleotide
gaagattcaagcagttgggacctagaccctaattttc

SEQ ID NO: 289608 - DNA, 37 bp, Artificial Sequence
  Description of Artificial Sequence: Synthetic oligonucleotide
aagattcaagcagttgggacctagaccctaattttcc

SEQ ID NO: 289609 - DNA, 36 bp, Artificial Sequence
  Description of Artificial Sequence: Synthetic oligonucleotide
agattcaagcagttgggacctagaccctaattttcc

SEQ ID NO: 289610 - DNA, 35 bp, Artificial Sequence
  Description of Artificial Sequence: Synthetic oligonucleotide
gattcaagcagttgggacctagaccctaattttcc

SEQ ID NO: 289611 - DNA, 35 bp, Artificial Sequence
  Description of Artificial Sequence: Synthetic oligonucleotide
attcaagcagttgggacctagaccctaattttccg

SEQ ID NO: 289612 - DNA, 34 bp, Artificial Sequence
  Description of Artificial Sequence: Synthetic oligonucleotide
ttcaagcagttgggacctagaccctaattttccg

SEQ ID NO: 289613 - DNA, 33 bp, Artificial Sequence
  Description of Artificial Sequence: Synthetic oligonucleotide
tcaagcagttgggacctagaccctaattttccg

SEQ ID NO: 289614 - DNA, 32 bp, Artificial Sequence
  Description of Artificial Sequence: Synthetic oligonucleotide
caagcagttgggacctagaccctaattttccg

SEQ ID NO: 289615 - DNA, 32 bp, Artificial Sequence
  Description of Artificial Sequence: Synthetic oligonucleotide
aagcagttgggacctagaccctaattttccgg

SEQ ID NO: 289616 - DNA, 31 bp, Artificial Sequence
  Description of Artificial Sequence: Synthetic oligonucleotide
agcagttgggacctagaccctaattttccgg

SEQ ID NO: 289617 - DNA, 30 bp, Artificial Sequence
  Description of Artificial Sequence: Synthetic oligonucleotide
gcagttgggacctagaccctaattttccgg

SEQ ID NO: 289618 - DNA, 30 bp, Artificial Sequence
  Description of Artificial Sequence: Synthetic oligonucleotide
cagttgggacctagaccctaattttccggc

SEQ ID NO: 289619 - DNA, 31 bp, Artificial Sequence
  Description of Artificial Sequence: Synthetic oligonucleotide
agttgggacctagaccctaattttccggctg

SEQ ID NO: 289620 - DNA, 30 bp, Artificial Sequence
  Description of Artificial Sequence: Synthetic oligonucleotide
gttgggacctagaccctaattttccggctg

SEQ ID NO: 289621 - DNA, 30 bp, Artificial Sequence
  Description of Artificial Sequence: Synthetic oligonucleotide
ttgggacctagaccctaattttccggctgc

SEQ ID NO: 289622 - DNA, 29 bp, Artificial Sequence
  Description of Artificial Sequence: Synthetic oligonucleotide
tgggacctagaccctaattttccggctgc

SEQ ID NO: 289623 - DNA, 28 bp, Artificial Sequence
  Description of Artificial Sequence: Synthetic oligonucleotide
gggacctagaccctaattttccggctgc

SEQ ID NO: 289624 - DNA, 28 bp, Artificial Sequence
  Description of Artificial Sequence: Synthetic oligonucleotide
ggacctagaccctaattttccggctgcc

SEQ ID NO: 289625 - DNA, 28 bp, Artificial Sequence
  Description of Artificial Sequence: Synthetic oligonucleotide
gacctagaccctaattttccggctgccg

SEQ ID NO: 289626 - DNA, 28 bp, Artificial Sequence
  Description of Artificial Sequence: Synthetic oligonucleotide
acctagaccctaattttccggctgccgc

SEQ ID NO: 289627 - DNA, 27 bp, Artificial Sequence
  Description of Artificial Sequence: Synthetic oligonucleotide
cctagaccctaattttccggctgccgc

SEQ ID NO: 289628 - DNA, 28 bp, Artificial Sequence
  Description of Artificial Sequence: Synthetic oligonucleotide
ctagaccctaattttccggctgccgcac

SEQ ID NO: 289629 - DNA, 30 bp, Artificial Sequence
  Description of Artificial Sequence: Synthetic oligonucleotide
tagaccctaattttccggctgccgcacaac

SEQ ID NO: 289630 - DNA, 29 bp, Artificial Sequence
  Description of Artificial Sequence: Synthetic oligonucleotide
agaccctaattttccggctgccgcacaac

SEQ ID NO: 289631 - DNA, 28 bp, Artificial Sequence
  Description of Artificial Sequence: Synthetic oligonucleotide
gaccctaattttccggctgccgcacaac

SEQ ID NO: 289632 - DNA, 28 bp, Artificial Sequence
  Description of Artificial Sequence: Synthetic oligonucleotide
accctaattttccggctgccgcacaacg

SEQ ID NO: 289633 - DNA, 27 bp, Artificial Sequence
  Description of Artificial Sequence: Synthetic oligonucleotide
ccctaattttccggctgccgcacaacg

SEQ ID NO: 289634 - DNA, 28 bp, Artificial Sequence
  Description of Artificial Sequence: Synthetic oligonucleotide
cctaattttccggctgccgcacaacgtc

SEQ ID NO: 289635 - DNA, 33 bp, Artificial Sequence
  Description of Artificial Sequence: Synthetic oligonucleotide
ctaattttccggctgccgcacaacgtcattaag

SEQ ID NO: 289636 - DNA, 34 bp, Artificial Sequence
  Description of Artificial Sequence: Synthetic oligonucleotide
taattttccggctgccgcacaacgtcattaagac

SEQ ID NO: 289637 - DNA, 33 bp, Artificial Sequence
  Description of Artificial Sequence: Synthetic oligonucleotide
aattttccggctgccgcacaacgtcattaagac

SEQ ID NO: 289638 - DNA, 32 bp, Artificial Sequence
  Description of Artificial Sequence: Synthetic oligonucleotide
attttccggctgccgcacaacgtcattaagac

SEQ ID NO: 289639 - DNA, 31 bp, Artificial Sequence
  Description of Artificial Sequence: Synthetic oligonucleotide
ttttccggctgccgcacaacgtcattaagac

SEQ ID NO: 289640 - DNA, 30 bp, Artificial Sequence
  Description of Artificial Sequence: Synthetic oligonucleotide
tttccggctgccgcacaacgtcattaagac

SEQ ID NO: 289641 - DNA, 29 bp, Artificial Sequence
  Description of Artificial Sequence: Synthetic oligonucleotide
ttccggctgccgcacaacgtcattaagac

SEQ ID NO: 289642 - DNA, 28 bp, Artificial Sequence
  Description of Artificial Sequence: Synthetic oligonucleotide
tccggctgccgcacaacgtcattaagac

SEQ ID NO: 289643 - DNA, 27 bp, Artificial Sequence
  Description of Artificial Sequence: Synthetic oligonucleotide
ccggctgccgcacaacgtcattaagac

SEQ ID NO: 289644 - DNA, 28 bp, Artificial Sequence
  Description of Artificial Sequence: Synthetic oligonucleotide
cggctgccgcacaacgtcattaagacac

SEQ ID NO: 289645 - DNA, 28 bp, Artificial Sequence
  Description of Artificial Sequence: Synthetic oligonucleotide
ggctgccgcacaacgtcattaagacacg

SEQ ID NO: 289646 - DNA, 29 bp, Artificial Sequence
  Description of Artificial Sequence: Synthetic oligonucleotide
gctgccgcacaacgtcattaagacacgtg

SEQ ID NO: 289647 - DNA, 31 bp, Artificial Sequence
  Description of Artificial Sequence: Synthetic oligonucleotide
ctgccgcacaacgtcattaagacacgtgtac

SEQ ID NO: 289648 - DNA, 31 bp, Artificial Sequence
  Description of Artificial Sequence: Synthetic oligonucleotide
tgccgcacaacgtcattaagacacgtgtacg

SEQ ID NO: 289649 - DNA, 30 bp, Artificial Sequence
  Description of Artificial Sequence: Synthetic oligonucleotide
gccgcacaacgtcattaagacacgtgtacg

SEQ ID NO: 289650 - DNA, 30 bp, Artificial Sequence
  Description of Artificial Sequence: Synthetic oligonucleotide
ccgcacaacgtcattaagacacgtgtacgc

SEQ ID NO: 289651 - DNA, 32 bp, Artificial Sequence
  Description of Artificial Sequence: Synthetic oligonucleotide
cgcacaacgtcattaagacacgtgtacgcaag

SEQ ID NO: 289652 - DNA, 34 bp, Artificial Sequence
  Description of Artificial Sequence: Synthetic oligonucleotide
gcacaacgtcattaagacacgtgtacgcaagatc

SEQ ID NO: 289653 - DNA, 35 bp, Artificial Sequence
  Description of Artificial Sequence: Synthetic oligonucleotide
cacaacgtcattaagacacgtgtacgcaagatcag

SEQ ID NO: 289654 - DNA, 35 bp, Artificial Sequence
  Description of Artificial Sequence: Synthetic oligonucleotide
acaacgtcattaagacacgtgtacgcaagatcagc

SEQ ID NO: 289655 - DNA, 34 bp, Artificial Sequence
  Description of Artificial Sequence: Synthetic oligonucleotide
caacgtcattaagacacgtgtacgcaagatcagc

SEQ ID NO: 289656 - DNA, 34 bp, Artificial Sequence
  Description of Artificial Sequence: Synthetic oligonucleotide
aacgtcattaagacacgtgtacgcaagatcagcc

SEQ ID NO: 289657 - DNA, 33 bp, Artificial Sequence
  Description of Artificial Sequence: Synthetic oligonucleotide
acgtcattaagacacgtgtacgcaagatcagcc

SEQ ID NO: 289658 - DNA, 32 bp, Artificial Sequence
  Description of Artificial Sequence: Synthetic oligonucleotide
cgtcattaagacacgtgtacgcaagatcagcc

SEQ ID NO: 289659 - DNA, 33 bp, Artificial Sequence
  Description of Artificial Sequence: Synthetic oligonucleotide
gtcattaagacacgtgtacgcaagatcagcctg

SEQ ID NO: 289660 - DNA, 34 bp, Artificial Sequence
  Description of Artificial Sequence: Synthetic oligonucleotide
tcattaagacacgtgtacgcaagatcagcctgtc

SEQ ID NO: 289661 - DNA, 33 bp, Artificial Sequence
  Description of Artificial Sequence: Synthetic oligonucleotide
cattaagacacgtgtacgcaagatcagcctgtc

SEQ ID NO: 289662 - DNA, 33 bp, Artificial Sequence
  Description of Artificial Sequence: Synthetic oligonucleotide
attaagacacgtgtacgcaagatcagcctgtcc

SEQ ID NO: 289663 - DNA, 32 bp, Artificial Sequence
  Description of Artificial Sequence: Synthetic oligonucleotide
ttaagacacgtgtacgcaagatcagcctgtcc

SEQ ID NO: 289664 - DNA, 31 bp, Artificial Sequence
  Description of Artificial Sequence: Synthetic oligonucleotide
taagacacgtgtacgcaagatcagcctgtcc

SEQ ID NO: 289665 - DNA, 30 bp, Artificial Sequence
  Description of Artificial Sequence: Synthetic oligonucleotide
aagacacgtgtacgcaagatcagcctgtcc

SEQ ID NO: 289666 - DNA, 29 bp, Artificial Sequence
  Description of Artificial Sequence: Synthetic oligonucleotide
agacacgtgtacgcaagatcagcctgtcc

SEQ ID NO: 289667 - DNA, 28 bp, Artificial Sequence
  Description of Artificial Sequence: Synthetic oligonucleotide
gacacgtgtacgcaagatcagcctgtcc

SEQ ID NO: 289668 - DNA, 32 bp, Artificial Sequence
  Description of Artificial Sequence: Synthetic oligonucleotide
acacgtgtacgcaagatcagcctgtcctattc

SEQ ID NO: 289669 - DNA, 31 bp, Artificial Sequence
  Description of Artificial Sequence: Synthetic oligonucleotide
cacgtgtacgcaagatcagcctgtcctattc

SEQ ID NO: 289670 - DNA, 31 bp, Artificial Sequence
  Description of Artificial Sequence: Synthetic oligonucleotide
acgtgtacgcaagatcagcctgtcctattcc

SEQ ID NO: 289671 - DNA, 30 bp, Artificial Sequence
  Description of Artificial Sequence: Synthetic oligonucleotide
cgtgtacgcaagatcagcctgtcctattcc

SEQ ID NO: 289672 - DNA, 30 bp, Artificial Sequence
  Description of Artificial Sequence: Synthetic oligonucleotide
gtgtacgcaagatcagcctgtcctattccg

SEQ ID NO: 289673 - DNA, 30 bp, Artificial Sequence
  Description of Artificial Sequence: Synthetic oligonucleotide
tgtacgcaagatcagcctgtcctattccgg

SEQ ID NO: 289674 - DNA, 29 bp, Artificial Sequence
  Description of Artificial Sequence: Synthetic oligonucleotide
gtacgcaagatcagcctgtcctattccgg

SEQ ID NO: 289675 - DNA, 32 bp, Artificial Sequence
  Description of Artificial Sequence: Synthetic oligonucleotide
tacgcaagatcagcctgtcctattccggaatc

SEQ ID NO: 289676 - DNA, 31 bp, Artificial Sequence
  Description of Artificial Sequence: Synthetic oligonucleotide
acgcaagatcagcctgtcctattccggaatc

SEQ ID NO: 289677 - DNA, 30 bp, Artificial Sequence
  Description of Artificial Sequence: Synthetic oligonucleotide
cgcaagatcagcctgtcctattccggaatc

SEQ ID NO: 289678 - DNA, 31 bp, Artificial Sequence
  Description of Artificial Sequence: Synthetic oligonucleotide
gcaagatcagcctgtcctattccggaatctc

SEQ ID NO: 289679 - DNA, 31 bp, Artificial Sequence
  Description of Artificial Sequence: Synthetic oligonucleotide
caagatcagcctgtcctattccggaatctcc

SEQ ID NO: 289680 - DNA, 33 bp, Artificial Sequence
  Description of Artificial Sequence: Synthetic oligonucleotide
aagatcagcctgtcctattccggaatctcctag

SEQ ID NO: 289681 - DNA, 32 bp, Artificial Sequence
  Description of Artificial Sequence: Synthetic oligonucleotide
agatcagcctgtcctattccggaatctcctag

SEQ ID NO: 289682 - DNA, 31 bp, Artificial Sequence
  Description of Artificial Sequence: Synthetic oligonucleotide
gatcagcctgtcctattccggaatctcctag

SEQ ID NO: 289683 - DNA, 31 bp, Artificial Sequence
  Description of Artificial Sequence: Synthetic oligonucleotide
atcagcctgtcctattccggaatctcctagg

SEQ ID NO: 289684 - DNA, 30 bp, Artificial Sequence
  Description of Artificial Sequence: Synthetic oligonucleotide
tcagcctgtcctattccggaatctcctagg

SEQ ID NO: 289685 - DNA, 29 bp, Artificial Sequence
  Description of Artificial Sequence: Synthetic oligonucleotide
cagcctgtcctattccggaatctcctagg

SEQ ID NO: 289686 - DNA, 29 bp, Artificial Sequence
  Description of Artificial Sequence: Synthetic oligonucleotide
agcctgtcctattccggaatctcctaggc

SEQ ID NO: 289687 - DNA, 28 bp, Artificial Sequence
  Description of Artificial Sequence: Synthetic oligonucleotide
gcctgtcctattccggaatctcctaggc

SEQ ID NO: 289688 - DNA, 29 bp, Artificial Sequence
  Description of Artificial Sequence: Synthetic oligonucleotide
cctgtcctattccggaatctcctaggctg

SEQ ID NO: 289689 - DNA, 30 bp, Artificial Sequence
  Description of Artificial Sequence: Synthetic oligonucleotide
ctgtcctattccggaatctcctaggctgac

SEQ ID NO: 289690 - DNA, 32 bp, Artificial Sequence
  Description of Artificial Sequence: Synthetic oligonucleotide
tgtcctattccggaatctcctaggctgacatg

SEQ ID NO: 289691 - DNA, 31 bp, Artificial Sequence
  Description of Artificial Sequence: Synthetic oligonucleotide
gtcctattccggaatctcctaggctgacatg

SEQ ID NO: 289692 - DNA, 31 bp, Artificial Sequence
  Description of Artificial Sequence: Synthetic oligonucleotide
tcctattccggaatctcctaggctgacatgg

SEQ ID NO: 289693 - DNA, 30 bp, Artificial Sequence
  Description of Artificial Sequence: Synthetic oligonucleotide
cctattccggaatctcctaggctgacatgg

SEQ ID NO: 289694 - DNA, 30 bp, Artificial Sequence
  Description of Artificial Sequence: Synthetic oligonucleotide
ctattccggaatctcctaggctgacatggc

SEQ ID NO: 289695 - DNA, 30 bp, Artificial Sequence
  Description of Artificial Sequence: Synthetic oligonucleotide
tattccggaatctcctaggctgacatggcc

SEQ ID NO: 289696 - DNA, 29 bp, Artificial Sequence
  Description of Artificial Sequence: Synthetic oligonucleotide
attccggaatctcctaggctgacatggcc

SEQ ID NO: 289697 - DNA, 28 bp, Artificial Sequence
  Description of Artificial Sequence: Synthetic oligonucleotide
ttccggaatctcctaggctgacatggcc

SEQ ID NO: 289698 - DNA, 27 bp, Artificial Sequence
  Description of Artificial Sequence: Synthetic oligonucleotide
tccggaatctcctaggctgacatggcc

SEQ ID NO: 289699 - DNA, 26 bp, Artificial Sequence
  Description of Artificial Sequence: Synthetic oligonucleotide
ccggaatctcctaggctgacatggcc

SEQ ID NO: 289700 - DNA, 27 bp, Artificial Sequence
  Description of Artificial Sequence: Synthetic oligonucleotide
cggaatctcctaggctgacatggccca

SEQ ID NO: 289701 - DNA, 27 bp, Artificial Sequence
  Description of Artificial Sequence: Synthetic oligonucleotide
ggaatctcctaggctgacatggcccag

SEQ ID NO: 289702 - DNA, 29 bp, Artificial Sequence
  Description of Artificial Sequence: Synthetic oligonucleotide
gaatctcctaggctgacatggcccagaag

SEQ ID NO: 289703 - DNA, 29 bp, Artificial Sequence
  Description of Artificial Sequence: Synthetic oligonucleotide
aatctcctaggctgacatggcccagaagg

SEQ ID NO: 289704 - DNA, 28 bp, Artificial Sequence
  Description of Artificial Sequence: Synthetic oligonucleotide
atctcctaggctgacatggcccagaagg

SEQ ID NO: 289705 - DNA, 27 bp, Artificial Sequence
  Description of Artificial Sequence: Synthetic oligonucleotide
tctcctaggctgacatggcccagaagg

SEQ ID NO: 289706 - DNA, 27 bp, Artificial Sequence
  Description of Artificial Sequence: Synthetic oligonucleotide
ctcctaggctgacatggcccagaaggt

SEQ ID NO: 289707 - DNA, 27 bp, Artificial Sequence
  Description of Artificial Sequence: Synthetic oligonucleotide
tcctaggctgacatggcccagaaggtg

SEQ ID NO: 289708 - DNA, 26 bp, Artificial Sequence
  Description of Artificial Sequence: Synthetic oligonucleotide
cctaggctgacatggcccagaaggtg

SEQ ID NO: 289709 - DNA, 27 bp, Artificial Sequence
  Description of Artificial Sequence: Synthetic oligonucleotide
ctaggctgacatggcccagaaggtgca

SEQ ID NO: 289710 - DNA, 27 bp, Artificial Sequence
  Description of Artificial Sequence: Synthetic oligonucleotide
taggctgacatggcccagaaggtgcag

SEQ ID NO: 289711 - DNA, 27 bp, Artificial Sequence
  Description of Artificial Sequence: Synthetic oligonucleotide
aggctgacatggcccagaaggtgcagt

SEQ ID NO: 289712 - DNA, 27 bp, Artificial Sequence
  Description of Artificial Sequence: Synthetic oligonucleotide
ggctgacatggcccagaaggtgcagtt

SEQ ID NO: 289713 - DNA, 27 bp, Artificial Sequence
  Description of Artificial Sequence: Synthetic oligonucleotide
gctgacatggcccagaaggtgcagttg

SEQ ID NO: 289714 - DNA, 27 bp, Artificial Sequence
  Description of Artificial Sequence: Synthetic oligonucleotide
ctgacatggcccagaaggtgcagttgg

SEQ ID NO: 289715 - DNA, 30 bp, Artificial Sequence
  Description of Artificial Sequence: Synthetic oligonucleotide
tgacatggcccagaaggtgcagttggttag

SEQ ID NO: 289716 - DNA, 29 bp, Artificial Sequence
  Description of Artificial Sequence: Synthetic oligonucleotide
gacatggcccagaaggtgcagttggttag

SEQ ID NO: 289717 - DNA, 29 bp, Artificial Sequence
  Description of Artificial Sequence: Synthetic oligonucleotide
acatggcccagaaggtgcagttggttagc

SEQ ID NO: 289718 - DNA, 28 bp, Artificial Sequence
  Description of Artificial Sequence: Synthetic oligonucleotide
catggcccagaaggtgcagttggttagc

SEQ ID NO: 289719 - DNA, 28 bp, Artificial Sequence
  Description of Artificial Sequence: Synthetic oligonucleotide
atggcccagaaggtgcagttggttagcc

SEQ ID NO: 289720 - DNA, 27 bp, Artificial Sequence
  Description of Artificial Sequence: Synthetic oligonucleotide
tggcccagaaggtgcagttggttagcc

SEQ ID NO: 289721 - DNA, 26 bp, Artificial Sequence
  Description of Artificial Sequence: Synthetic oligonucleotide
ggcccagaaggtgcagttggttagcc

SEQ ID NO: 289722 - DNA, 26 bp, Artificial Sequence
  Description of Artificial Sequence: Synthetic oligonucleotide
gcccagaaggtgcagttggttagccc

SEQ ID NO: 289723 - DNA, 26 bp, Artificial Sequence
  Description of Artificial Sequence: Synthetic oligonucleotide
cccagaaggtgcagttggttagcccc

SEQ ID NO: 289724 - DNA, 27 bp, Artificial Sequence
  Description of Artificial Sequence: Synthetic oligonucleotide
ccagaaggtgcagttggttagccccga

SEQ ID NO: 289725 - DNA, 28 bp, Artificial Sequence
  Description of Artificial Sequence: Synthetic oligonucleotide
cagaaggtgcagttggttagccccgatg

SEQ ID NO: 289726 - DNA, 30 bp, Artificial Sequence
  Description of Artificial Sequence: Synthetic oligonucleotide
agaaggtgcagttggttagccccgatgatg

SEQ ID NO: 289727 - DNA, 29 bp, Artificial Sequence
  Description of Artificial Sequence: Synthetic oligonucleotide
gaaggtgcagttggttagccccgatgatg

SEQ ID NO: 289728 - DNA, 29 bp, Artificial Sequence
  Description of Artificial Sequence: Synthetic oligonucleotide
aaggtgcagttggttagccccgatgatgc

SEQ ID NO: 289729 - DNA, 28 bp, Artificial Sequence
  Description of Artificial Sequence: Synthetic oligonucleotide
aggtgcagttggttagccccgatgatgc

SEQ ID NO: 289730 - DNA, 27 bp, Artificial Sequence
  Description of Artificial Sequence: Synthetic oligonucleotide
ggtgcagttggttagccccgatgatgc

SEQ ID NO: 289731 - DNA, 28 bp, Artificial Sequence
  Description of Artificial Sequence: Synthetic oligonucleotide
gtgcagttggttagccccgatgatgcag

SEQ ID NO: 289732 - DNA, 29 bp, Artificial Sequence
  Description of Artificial Sequence: Synthetic oligonucleotide
tgcagttggttagccccgatgatgcagag

SEQ ID NO: 289733 - DNA, 28 bp, Artificial Sequence
  Description of Artificial Sequence: Synthetic oligonucleotide
gcagttggttagccccgatgatgcagag

SEQ ID NO: 289734 - DNA, 30 bp, Artificial Sequence
  Description of Artificial Sequence: Synthetic oligonucleotide
cagttggttagccccgatgatgcagagatc

SEQ ID NO: 289735 - DNA, 33 bp, Artificial Sequence
  Description of Artificial Sequence: Synthetic oligonucleotide
agttggttagccccgatgatgcagagatcattg

SEQ ID NO: 289736 - DNA, 32 bp, Artificial Sequence
  Description of Artificial Sequence: Synthetic oligonucleotide
gttggttagccccgatgatgcagagatcattg

SEQ ID NO: 289737 - DNA, 34 bp, Artificial Sequence
  Description of Artificial Sequence: Synthetic oligonucleotide
ttggttagccccgatgatgcagagatcattgttg

SEQ ID NO: 289738 - DNA, 33 bp, Artificial Sequence
  Description of Artificial Sequence: Synthetic oligonucleotide
tggttagccccgatgatgcagagatcattgttg

SEQ ID NO: 289739 - DNA, 32 bp, Artificial Sequence
  Description of Artificial Sequence: Synthetic oligonucleotide
ggttagccccgatgatgcagagatcattgttg

SEQ ID NO: 289740 - DNA, 32 bp, Artificial Sequence
  Description of Artificial Sequence: Synthetic oligonucleotide
gttagccccgatgatgcagagatcattgttgg

SEQ ID NO: 289741 - DNA, 32 bp, Artificial Sequence
  Description of Artificial Sequence: Synthetic oligonucleotide
ttagccccgatgatgcagagatcattgttggc

SEQ ID NO: 289742 - DNA, 31 bp, Artificial Sequence
  Description of Artificial Sequence: Synthetic oligonucleotide
tagccccgatgatgcagagatcattgttggc

SEQ ID NO: 289743 - DNA, 30 bp, Artificial Sequence
  Description of Artificial Sequence: Synthetic oligonucleotide
agccccgatgatgcagagatcattgttggc

SEQ ID NO: 289744 - DNA, 29 bp, Artificial Sequence
  Description of Artificial Sequence: Synthetic oligonucleotide
gccccgatgatgcagagatcattgttggc

SEQ ID NO: 289745 - DNA, 31 bp, Artificial Sequence
  Description of Artificial Sequence: Synthetic oligonucleotide
ccccgatgatgcagagatcattgttggcaag

SEQ ID NO: 289746 - DNA, 31 bp, Artificial Sequence
  Description of Artificial Sequence: Synthetic oligonucleotide
cccgatgatgcagagatcattgttggcaagg

SEQ ID NO: 289747 - DNA, 31 bp, Artificial Sequence
  Description of Artificial Sequence: Synthetic oligonucleotide
ccgatgatgcagagatcattgttggcaaggc

SEQ ID NO: 289748 - DNA, 31 bp, Artificial Sequence
  Description of Artificial Sequence: Synthetic oligonucleotide
cgatgatgcagagatcattgttggcaaggcc

SEQ ID NO: 289749 - DNA, 33 bp, Artificial Sequence
  Description of Artificial Sequence: Synthetic oligonucleotide
gatgatgcagagatcattgttggcaaggccatg

SEQ ID NO: 289750 - DNA, 33 bp, Artificial Sequence
  Description of Artificial Sequence: Synthetic oligonucleotide
atgatgcagagatcattgttggcaaggccatgc

SEQ ID NO: 289751 - DNA, 32 bp, Artificial Sequence
  Description of Artificial Sequence: Synthetic oligonucleotide
tgatgcagagatcattgttggcaaggccatgc

SEQ ID NO: 289752 - DNA, 31 bp, Artificial Sequence
  Description of Artificial Sequence: Synthetic oligonucleotide
gatgcagagatcattgttggcaaggccatgc

SEQ ID NO: 289753 - DNA, 31 bp, Artificial Sequence
  Description of Artificial Sequence: Synthetic oligonucleotide
atgcagagatcattgttggcaaggccatgcg

SEQ ID NO: 289754 - DNA, 30 bp, Artificial Sequence
  Description of Artificial Sequence: Synthetic oligonucleotide
tgcagagatcattgttggcaaggccatgcg

SEQ ID NO: 289755 - DNA, 29 bp, Artificial Sequence
  Description of Artificial Sequence: Synthetic oligonucleotide
gcagagatcattgttggcaaggccatgcg

SEQ ID NO: 289756 - DNA, 29 bp, Artificial Sequence
  Description of Artificial Sequence: Synthetic oligonucleotide
cagagatcattgttggcaaggccatgcgg

SEQ ID NO: 289757 - DNA, 29 bp, Artificial Sequence
  Description of Artificial Sequence: Synthetic oligonucleotide
agagatcattgttggcaaggccatgcggg

SEQ ID NO: 289758 - DNA, 28 bp, Artificial Sequence
  Description of Artificial Sequence: Synthetic oligonucleotide
gagatcattgttggcaaggccatgcggg

SEQ ID NO: 289759 - DNA, 30 bp, Artificial Sequence
  Description of Artificial Sequence: Synthetic oligonucleotide
agatcattgttggcaaggccatgcgggatg

SEQ ID NO: 289760 - DNA, 29 bp, Artificial Sequence
  Description of Artificial Sequence: Synthetic oligonucleotide
gatcattgttggcaaggccatgcgggatg

SEQ ID NO: 289761 - DNA, 29 bp, Artificial Sequence
  Description of Artificial Sequence: Synthetic oligonucleotide
atcattgttggcaaggccatgcgggatgg

SEQ ID NO: 289762 - DNA, 28 bp, Artificial Sequence
  Description of Artificial Sequence: Synthetic oligonucleotide
tcattgttggcaaggccatgcgggatgg

SEQ ID NO: 289763 - DNA, 27 bp, Artificial Sequence
  Description of Artificial Sequence: Synthetic oligonucleotide
cattgttggcaaggccatgcgggatgg

SEQ ID NO: 289764 - DNA, 28 bp, Artificial Sequence
  Description of Artificial Sequence: Synthetic oligonucleotide
attgttggcaaggccatgcgggatggtc

SEQ ID NO: 289765 - DNA, 27 bp, Artificial Sequence
  Description of Artificial Sequence: Synthetic oligonucleotide
ttgttggcaaggccatgcgggatggtc

SEQ ID NO: 289766 - DNA, 27 bp, Artificial Sequence
  Description of Artificial Sequence: Synthetic oligonucleotide
tgttggcaaggccatgcgggatggtct

SEQ ID NO: 289767 - DNA, 26 bp, Artificial Sequence
  Description of Artificial Sequence: Synthetic oligonucleotide
gttggcaaggccatgcgggatggtct

SEQ ID NO: 289768 - DNA, 27 bp, Artificial Sequence
  Description of Artificial Sequence: Synthetic oligonucleotide
ttggcaaggccatgcgggatggtctca

SEQ ID NO: 289769 - DNA, 27 bp, Artificial Sequence
  Description of Artificial Sequence: Synthetic oligonucleotide
tggcaaggccatgcgggatggtctcat

SEQ ID NO: 289770 - DNA, 27 bp, Artificial Sequence
  Description of Artificial Sequence: Synthetic oligonucleotide
ggcaaggccatgcgggatggtctcatt

SEQ ID NO: 289771 - DNA, 27 bp, Artificial Sequence
  Description of Artificial Sequence: Synthetic oligonucleotide
gcaaggccatgcgggatggtctcattg

SEQ ID NO: 289772 - DNA, 28 bp, Artificial Sequence
  Description of Artificial Sequence: Synthetic oligonucleotide
caaggccatgcgggatggtctcattgag

SEQ ID NO: 289773 - DNA, 28 bp, Artificial Sequence
  Description of Artificial Sequence: Synthetic oligonucleotide
aaggccatgcgggatggtctcattgagg

SEQ ID NO: 289774 - DNA, 27 bp, Artificial Sequence
  Description of Artificial Sequence: Synthetic oligonucleotide
aggccatgcgggatggtctcattgagg

SEQ ID NO: 289775 - DNA, 26 bp, Artificial Sequence
  Description of Artificial Sequence: Synthetic oligonucleotide
ggccatgcgggatggtctcattgagg

SEQ ID NO: 289776 - DNA, 26 bp, Artificial Sequence
  Description of Artificial Sequence: Synthetic oligonucleotide
gccatgcgggatggtctcattgaggg

SEQ ID NO: 289777 - DNA, 27 bp, Artificial Sequence
  Description of Artificial Sequence: Synthetic oligonucleotide
ccatgcgggatggtctcattgagggca

SEQ ID NO: 289778 - DNA, 27 bp, Artificial Sequence
  Description of Artificial Sequence: Synthetic oligonucleotide
catgcgggatggtctcattgagggcag

SEQ ID NO: 289779 - DNA, 27 bp, Artificial Sequence
  Description of Artificial Sequence: Synthetic oligonucleotide
atgcgggatggtctcattgagggcagc

SEQ ID NO: 289780 - DNA, 27 bp, Artificial Sequence
  Description of Artificial Sequence: Synthetic oligonucleotide
tgcgggatggtctcattgagggcagca

SEQ ID NO: 289781 - DNA, 27 bp, Artificial Sequence
  Description of Artificial Sequence: Synthetic oligonucleotide
gcgggatggtctcattgagggcagcat

SEQ ID NO: 289782 - DNA, 27 bp, Artificial Sequence
  Description of Artificial Sequence: Synthetic oligonucleotide
cgggatggtctcattgagggcagcatc

SEQ ID NO: 289783 - DNA, 29 bp, Artificial Sequence
  Description of Artificial Sequence: Synthetic oligonucleotide
gggatggtctcattgagggcagcatcaag

SEQ ID NO: 289784 - DNA, 29 bp, Artificial Sequence
  Description of Artificial Sequence: Synthetic oligonucleotide
ggatggtctcattgagggcagcatcaagc

SEQ ID NO: 289785 - DNA, 30 bp, Artificial Sequence
  Description of Artificial Sequence: Synthetic oligonucleotide
gatggtctcattgagggcagcatcaagcac

SEQ ID NO: 289786 - DNA, 30 bp, Artificial Sequence
  Description of Artificial Sequence: Synthetic oligonucleotide
atggtctcattgagggcagcatcaagcacg

SEQ ID NO: 289787 - DNA, 29 bp, Artificial Sequence
  Description of Artificial Sequence: Synthetic oligonucleotide
tggtctcattgagggcagcatcaagcacg

SEQ ID NO: 289788 - DNA, 28 bp, Artificial Sequence
  Description of Artificial Sequence: Synthetic oligonucleotide
ggtctcattgagggcagcatcaagcacg

SEQ ID NO: 289789 - DNA, 29 bp, Artificial Sequence
  Description of Artificial Sequence: Synthetic oligonucleotide
gtctcattgagggcagcatcaagcacgag

SEQ ID NO: 289790 - DNA, 31 bp, Artificial Sequence
  Description of Artificial Sequence: Synthetic oligonucleotide
tctcattgagggcagcatcaagcacgagaag

SEQ ID NO: 289791 - DNA, 30 bp, Artificial Sequence
  Description of Artificial Sequence: Synthetic oligonucleotide
ctcattgagggcagcatcaagcacgagaag

SEQ ID NO: 289792 - DNA, 30 bp, Artificial Sequence
  Description of Artificial Sequence: Synthetic oligonucleotide
tcattgagggcagcatcaagcacgagaagc

SEQ ID NO: 289793 - DNA, 29 bp, Artificial Sequence
  Description of Artificial Sequence: Synthetic oligonucleotide
cattgagggcagcatcaagcacgagaagc

SEQ ID NO: 289794 - DNA, 29 bp, Artificial Sequence
  Description of Artificial Sequence: Synthetic oligonucleotide
attgagggcagcatcaagcacgagaagcg

SEQ ID NO: 289795 - DNA, 28 bp, Artificial Sequence
  Description of Artificial Sequence: Synthetic oligonucleotide
ttgagggcagcatcaagcacgagaagcg

SEQ ID NO: 289796 - DNA, 27 bp, Artificial Sequence
  Description of Artificial Sequence: Synthetic oligonucleotide
tgagggcagcatcaagcacgagaagcg

SEQ ID NO: 289797 - DNA, 26 bp, Artificial Sequence
  Description of Artificial Sequence: Synthetic oligonucleotide
gagggcagcatcaagcacgagaagcg

SEQ ID NO: 289798 - DNA, 27 bp, Artificial Sequence
  Description of Artificial Sequence: Synthetic oligonucleotide
agggcagcatcaagcacgagaagcgct

SEQ ID NO: 289799 - DNA, 27 bp, Artificial Sequence
  Description of Artificial Sequence: Synthetic oligonucleotide
gggcagcatcaagcacgagaagcgcta

SEQ ID NO: 289800 - DNA, 28 bp, Artificial Sequence
  Description of Artificial Sequence: Synthetic oligonucleotide
ggcagcatcaagcacgagaagcgctatg

SEQ ID NO: 289801 - DNA, 29 bp, Artificial Sequence
  Description of Artificial Sequence: Synthetic oligonucleotide
gcagcatcaagcacgagaagcgctatgtc

SEQ ID NO: 289802 - DNA, 29 bp, Artificial Sequence
  Description of Artificial Sequence: Synthetic oligonucleotide
cagcatcaagcacgagaagcgctatgtcc

SEQ ID NO: 289803 - DNA, 32 bp, Artificial Sequence
  Description of Artificial Sequence: Synthetic oligonucleotide
agcatcaagcacgagaagcgctatgtcctatc

SEQ ID NO: 289804 - DNA, 31 bp, Artificial Sequence
  Description of Artificial Sequence: Synthetic oligonucleotide
gcatcaagcacgagaagcgctatgtcctatc

SEQ ID NO: 289805 - DNA, 31 bp, Artificial Sequence
  Description of Artificial Sequence: Synthetic oligonucleotide
catcaagcacgagaagcgctatgtcctatcc

SEQ ID NO: 289806 - DNA, 33 bp, Artificial Sequence
  Description of Artificial Sequence: Synthetic oligonucleotide
atcaagcacgagaagcgctatgtcctatccaag

SEQ ID NO: 289807 - DNA, 32 bp, Artificial Sequence
  Description of Artificial Sequence: Synthetic oligonucleotide
tcaagcacgagaagcgctatgtcctatccaag

SEQ ID NO: 289808 - DNA, 31 bp, Artificial Sequence
  Description of Artificial Sequence: Synthetic oligonucleotide
caagcacgagaagcgctatgtcctatccaag

SEQ ID NO: 289809 - DNA, 31 bp, Artificial Sequence
  Description of Artificial Sequence: Synthetic oligonucleotide
aagcacgagaagcgctatgtcctatccaagg

SEQ ID NO: 289810 - DNA, 30 bp, Artificial Sequence
  Description of Artificial Sequence: Synthetic oligonucleotide
agcacgagaagcgctatgtcctatccaagg

SEQ ID NO: 289811 - DNA, 29 bp, Artificial Sequence
  Description of Artificial Sequence: Synthetic oligonucleotide
gcacgagaagcgctatgtcctatccaagg

SEQ ID NO: 289812 - DNA, 30 bp, Artificial Sequence
  Description of Artificial Sequence: Synthetic oligonucleotide
cacgagaagcgctatgtcctatccaaggac

SEQ ID NO: 289813 - DNA, 32 bp, Artificial Sequence
  Description of Artificial Sequence: Synthetic oligonucleotide
acgagaagcgctatgtcctatccaaggacatg

SEQ ID NO: 289814 - DNA, 31 bp, Artificial Sequence
  Description of Artificial Sequence: Synthetic oligonucleotide
cgagaagcgctatgtcctatccaaggacatg

SEQ ID NO: 289815 - DNA, 34 bp, Artificial Sequence
  Description of Artificial Sequence: Synthetic oligonucleotide
gagaagcgctatgtcctatccaaggacatgattg

SEQ ID NO: 289816 - DNA, 35 bp, Artificial Sequence
  Description of Artificial Sequence: Synthetic oligonucleotide
agaagcgctatgtcctatccaaggacatgattgac

SEQ ID NO: 289817 - DNA, 34 bp, Artificial Sequence
  Description of Artificial Sequence: Synthetic oligonucleotide
gaagcgctatgtcctatccaaggacatgattgac

SEQ ID NO: 289818 - DNA, 36 bp, Artificial Sequence
  Description of Artificial Sequence: Synthetic oligonucleotide
aagcgctatgtcctatccaaggacatgattgacttc

SEQ ID NO: 289819 - DNA, 35 bp, Artificial Sequence
  Description of Artificial Sequence: Synthetic oligonucleotide
agcgctatgtcctatccaaggacatgattgacttc

SEQ ID NO: 289820 - DNA, 34 bp, Artificial Sequence
  Description of Artificial Sequence: Synthetic oligonucleotide
gcgctatgtcctatccaaggacatgattgacttc

SEQ ID NO: 289821 - DNA, 38 bp, Artificial Sequence
  Description of Artificial Sequence: Synthetic oligonucleotide
cgctatgtcctatccaaggacatgattgacttctattc

SEQ ID NO: 289822 - DNA, 38 bp, Artificial Sequence
  Description of Artificial Sequence: Synthetic oligonucleotide
gctatgtcctatccaaggacatgattgacttctattcc

SEQ ID NO: 289823 - DNA, 39 bp, Artificial Sequence
  Description of Artificial Sequence: Synthetic oligonucleotide
ctatgtcctatccaaggacatgattgacttctattccag

SEQ ID NO: 289824 - DNA, 39 bp, Artificial Sequence
  Description of Artificial Sequence: Synthetic oligonucleotide
tatgtcctatccaaggacatgattgacttctattccagc

SEQ ID NO: 289825 - DNA, 38 bp, Artificial Sequence
  Description of Artificial Sequence: Synthetic oligonucleotide
atgtcctatccaaggacatgattgacttctattccagc

SEQ ID NO: 289826 - DNA, 37 bp, Artificial Sequence
  Description of Artificial Sequence: Synthetic oligonucleotide
tgtcctatccaaggacatgattgacttctattccagc

SEQ ID NO: 289827 - DNA, 36 bp, Artificial Sequence
  Description of Artificial Sequence: Synthetic oligonucleotide
gtcctatccaaggacatgattgacttctattccagc

SEQ ID NO: 289828 - DNA, 36 bp, Artificial Sequence
  Description of Artificial Sequence: Synthetic oligonucleotide
tcctatccaaggacatgattgacttctattccagcc

SEQ ID NO: 289829 - DNA, 35 bp, Artificial Sequence
  Description of Artificial Sequence: Synthetic oligonucleotide
cctatccaaggacatgattgacttctattccagcc

SEQ ID NO: 289830 - DNA, 35 bp, Artificial Sequence
  Description of Artificial Sequence: Synthetic oligonucleotide
ctatccaaggacatgattgacttctattccagccg

SEQ ID NO: 289831 - DNA, 36 bp, Artificial Sequence
  Description of Artificial Sequence: Synthetic oligonucleotide
tatccaaggacatgattgacttctattccagccgag

SEQ ID NO: 289832 - DNA, 35 bp, Artificial Sequence
  Description of Artificial Sequence: Synthetic oligonucleotide
atccaaggacatgattgacttctattccagccgag

SEQ ID NO: 289833 - DNA, 34 bp, Artificial Sequence
  Description of Artificial Sequence: Synthetic oligonucleotide
tccaaggacatgattgacttctattccagccgag

SEQ ID NO: 289834 - DNA, 33 bp, Artificial Sequence
  Description of Artificial Sequence: Synthetic oligonucleotide
ccaaggacatgattgacttctattccagccgag

SEQ ID NO: 289835 - DNA, 34 bp, Artificial Sequence
  Description of Artificial Sequence: Synthetic oligonucleotide
caaggacatgattgacttctattccagccgagag

SEQ ID NO: 289836 - DNA, 34 bp, Artificial Sequence
  Description of Artificial Sequence: Synthetic oligonucleotide
aaggacatgattgacttctattccagccgagagc

SEQ ID NO: 289837 - DNA, 33 bp, Artificial Sequence
  Description of Artificial Sequence: Synthetic oligonucleotide
aggacatgattgacttctattccagccgagagc

SEQ ID NO: 289838 - DNA, 32 bp, Artificial Sequence
  Description of Artificial Sequence: Synthetic oligonucleotide
ggacatgattgacttctattccagccgagagc

SEQ ID NO: 289839 - DNA, 32 bp, Artificial Sequence
  Description of Artificial Sequence: Synthetic oligonucleotide
gacatgattgacttctattccagccgagagcc

SEQ ID NO: 289840 - DNA, 32 bp, Artificial Sequence
  Description of Artificial Sequence: Synthetic oligonucleotide
acatgattgacttctattccagccgagagccg

SEQ ID NO: 289841 - DNA, 31 bp, Artificial Sequence
  Description of Artificial Sequence: Synthetic oligonucleotide
catgattgacttctattccagccgagagccg

SEQ ID NO: 289842 - DNA, 31 bp, Artificial Sequence
  Description of Artificial Sequence: Synthetic oligonucleotide
atgattgacttctattccagccgagagccgc

SEQ ID NO: 289843 - DNA, 30 bp, Artificial Sequence
  Description of Artificial Sequence: Synthetic oligonucleotide
tgattgacttctattccagccgagagccgc

SEQ ID NO: 289844 - DNA, 29 bp, Artificial Sequence
  Description of Artificial Sequence: Synthetic oligonucleotide
gattgacttctattccagccgagagccgc

SEQ ID NO: 289845 - DNA, 30 bp, Artificial Sequence
  Description of Artificial Sequence: Synthetic oligonucleotide
attgacttctattccagccgagagccgcag

SEQ ID NO: 289846 - DNA, 29 bp, Artificial Sequence
  Description of Artificial Sequence: Synthetic oligonucleotide
ttgacttctattccagccgagagccgcag

SEQ ID NO: 289847 - DNA, 28 bp, Artificial Sequence
  Description of Artificial Sequence: Synthetic oligonucleotide
tgacttctattccagccgagagccgcag

SEQ ID NO: 289848 - DNA, 27 bp, Artificial Sequence
  Description of Artificial Sequence: Synthetic oligonucleotide
gacttctattccagccgagagccgcag

SEQ ID NO: 289849 - DNA, 27 bp, Artificial Sequence
  Description of Artificial Sequence: Synthetic oligonucleotide
acttctattccagccgagagccgcagc

SEQ ID NO: 289850 - DNA, 27 bp, Artificial Sequence
  Description of Artificial Sequence: Synthetic oligonucleotide
cttctattccagccgagagccgcagct

SEQ ID NO: 289851 - DNA, 28 bp, Artificial Sequence
  Description of Artificial Sequence: Synthetic oligonucleotide
ttctattccagccgagagccgcagctag

SEQ ID NO: 289852 - DNA, 27 bp, Artificial Sequence
  Description of Artificial Sequence: Synthetic oligonucleotide
tctattccagccgagagccgcagctag

SEQ ID NO: 289853 - DNA, 26 bp, Artificial Sequence
  Description of Artificial Sequence: Synthetic oligonucleotide
ctattccagccgagagccgcagctag

SEQ ID NO: 289854 - DNA, 26 bp, Artificial Sequence
  Description of Artificial Sequence: Synthetic oligonucleotide
tattccagccgagagccgcagctagc

SEQ ID NO: 289855 - DNA, 25 bp, Artificial Sequence
  Description of Artificial Sequence: Synthetic oligonucleotide
attccagccgagagccgcagctagc

SEQ ID NO: 289856 - DNA, 24 bp, Artificial Sequence
  Description of Artificial Sequence: Synthetic oligonucleotide
ttccagccgagagccgcagctagc

SEQ ID NO: 289857 - DNA, 23 bp, Artificial Sequence
  Description of Artificial Sequence: Synthetic oligonucleotide
tccagccgagagccgcagctagc

SEQ ID NO: 289858 - DNA, 22 bp, Artificial Sequence
  Description of Artificial Sequence: Synthetic oligonucleotide
ccagccgagagccgcagctagc

SEQ ID NO: 289859 - DNA, 24 bp, Artificial Sequence
  Description of Artificial Sequence: Synthetic oligonucleotide
cagccgagagccgcagctagccat

SEQ ID NO: 289860 - DNA, 24 bp, Artificial Sequence
  Description of Artificial Sequence: Synthetic oligonucleotide
agccgagagccgcagctagccatc

SEQ ID NO: 289861 - DNA, 23 bp, Artificial Sequence
  Description of Artificial Sequence: Synthetic oligonucleotide
gccgagagccgcagctagccatc

SEQ ID NO: 289862 - DNA, 24 bp, Artificial Sequence
  Description of Artificial Sequence: Synthetic oligonucleotide
ccgagagccgcagctagccatcca

SEQ ID NO: 289863 - DNA, 24 bp, Artificial Sequence
  Description of Artificial Sequence: Synthetic oligonucleotide
cgagagccgcagctagccatccac

SEQ ID NO: 289864 - DNA, 25 bp, Artificial Sequence
  Description of Artificial Sequence: Synthetic oligonucleotide
gagagccgcagctagccatccacca

SEQ ID NO: 289865 - DNA, 25 bp, Artificial Sequence
  Description of Artificial Sequence: Synthetic oligonucleotide
agagccgcagctagccatccaccag

SEQ ID NO: 289866 - DNA, 24 bp, Artificial Sequence
  Description of Artificial Sequence: Synthetic oligonucleotide
gagccgcagctagccatccaccag

SEQ ID NO: 289867 - DNA, 24 bp, Artificial Sequence
  Description of Artificial Sequence: Synthetic oligonucleotide
agccgcagctagccatccaccagc

SEQ ID NO: 289868 - DNA, 23 bp, Artificial Sequence
  Description of Artificial Sequence: Synthetic oligonucleotide
gccgcagctagccatccaccagc

SEQ ID NO: 289869 - DNA, 23 bp, Artificial Sequence
  Description of Artificial Sequence: Synthetic oligonucleotide
ccgcagctagccatccaccagcc

SEQ ID NO: 289870 - DNA, 25 bp, Artificial Sequence
  Description of Artificial Sequence: Synthetic oligonucleotide
cgcagctagccatccaccagcccat

SEQ ID NO: 289871 - DNA, 26 bp, Artificial Sequence
  Description of Artificial Sequence: Synthetic oligonucleotide
gcagctagccatccaccagcccatct

SEQ ID NO: 289872 - DNA, 26 bp, Artificial Sequence
  Description of Artificial Sequence: Synthetic oligonucleotide
cagctagccatccaccagcccatctc

SEQ ID NO: 289873 - DNA, 27 bp, Artificial Sequence
  Description of Artificial Sequence: Synthetic oligonucleotide
agctagccatccaccagcccatctcct

SEQ ID NO: 289874 - DNA, 27 bp, Artificial Sequence
  Description of Artificial Sequence: Synthetic oligonucleotide
gctagccatccaccagcccatctcctt

SEQ ID NO: 289875 - DNA, 27 bp, Artificial Sequence
  Description of Artificial Sequence: Synthetic oligonucleotide
ctagccatccaccagcccatctccttg

SEQ ID NO: 289876 - DNA, 28 bp, Artificial Sequence
  Description of Artificial Sequence: Synthetic oligonucleotide
tagccatccaccagcccatctccttgtg

SEQ ID NO: 289877 - DNA, 27 bp, Artificial Sequence
  Description of Artificial Sequence: Synthetic oligonucleotide
agccatccaccagcccatctccttgtg

SEQ ID NO: 289878 - DNA, 26 bp, Artificial Sequence
  Description of Artificial Sequence: Synthetic oligonucleotide
gccatccaccagcccatctccttgtg

SEQ ID NO: 289879 - DNA, 26 bp, Artificial Sequence
  Description of Artificial Sequence: Synthetic oligonucleotide
ccatccaccagcccatctccttgtgc

SEQ ID NO: 289880 - DNA, 27 bp, Artificial Sequence
  Description of Artificial Sequence: Synthetic oligonucleotide
catccaccagcccatctccttgtgcct

SEQ ID NO: 289881 - DNA, 28 bp, Artificial Sequence
  Description of Artificial Sequence: Synthetic oligonucleotide
atccaccagcccatctccttgtgcctag

SEQ ID NO: 289882 - DNA, 27 bp, Artificial Sequence
  Description of Artificial Sequence: Synthetic oligonucleotide
tccaccagcccatctccttgtgcctag

SEQ ID NO: 289883 - DNA, 27 bp, Artificial Sequence
  Description of Artificial Sequence: Synthetic oligonucleotide
ccaccagcccatctccttgtgcctaga

SEQ ID NO: 289884 - DNA, 30 bp, Artificial Sequence
  Description of Artificial Sequence: Synthetic oligonucleotide
caccagcccatctccttgtgcctagatttc

SEQ ID NO: 289885 - DNA, 30 bp, Artificial Sequence
  Description of Artificial Sequence: Synthetic oligonucleotide
accagcccatctccttgtgcctagatttcc

SEQ ID NO: 289886 - DNA, 29 bp, Artificial Sequence
  Description of Artificial Sequence: Synthetic oligonucleotide
ccagcccatctccttgtgcctagatttcc

SEQ ID NO: 289887 - DNA, 30 bp, Artificial Sequence
  Description of Artificial Sequence: Synthetic oligonucleotide
cagcccatctccttgtgcctagatttccac

SEQ ID NO: 289888 - DNA, 32 bp, Artificial Sequence
  Description of Artificial Sequence: Synthetic oligonucleotide
agcccatctccttgtgcctagatttccacaac

SEQ ID NO: 289889 - DNA, 31 bp, Artificial Sequence
  Description of Artificial Sequence: Synthetic oligonucleotide
gcccatctccttgtgcctagatttccacaac

SEQ ID NO: 289890 - DNA, 33 bp, Artificial Sequence
  Description of Artificial Sequence: Synthetic oligonucleotide
cccatctccttgtgcctagatttccacaacaag

SEQ ID NO: 289891 - DNA, 34 bp, Artificial Sequence
  Description of Artificial Sequence: Synthetic oligonucleotide
ccatctccttgtgcctagatttccacaacaagtc

SEQ ID NO: 289892 - DNA, 35 bp, Artificial Sequence
  Description of Artificial Sequence: Synthetic oligonucleotide
catctccttgtgcctagatttccacaacaagtctg

SEQ ID NO: 289893 - DNA, 36 bp, Artificial Sequence
  Description of Artificial Sequence: Synthetic oligonucleotide
atctccttgtgcctagatttccacaacaagtctgtc

SEQ ID NO: 289894 - DNA, 35 bp, Artificial Sequence
  Description of Artificial Sequence: Synthetic oligonucleotide
tctccttgtgcctagatttccacaacaagtctgtc

SEQ ID NO: 289895 - DNA, 34 bp, Artificial Sequence
  Description of Artificial Sequence: Synthetic oligonucleotide
ctccttgtgcctagatttccacaacaagtctgtc

SEQ ID NO: 289896 - DNA, 36 bp, Artificial Sequence
  Description of Artificial Sequence: Synthetic oligonucleotide
tccttgtgcctagatttccacaacaagtctgtcaac

SEQ ID NO: 289897 - DNA, 35 bp, Artificial Sequence
  Description of Artificial Sequence: Synthetic oligonucleotide
ccttgtgcctagatttccacaacaagtctgtcaac

SEQ ID NO: 289898 - DNA, 35 bp, Artificial Sequence
  Description of Artificial Sequence: Synthetic oligonucleotide
cttgtgcctagatttccacaacaagtctgtcaacg

SEQ ID NO: 289899 - DNA, 35 bp, Artificial Sequence
  Description of Artificial Sequence: Synthetic oligonucleotide
ttgtgcctagatttccacaacaagtctgtcaacgc

SEQ ID NO: 289900 - DNA, 34 bp, Artificial Sequence
  Description of Artificial Sequence: Synthetic oligonucleotide
tgtgcctagatttccacaacaagtctgtcaacgc

SEQ ID NO: 289901 - DNA, 33 bp, Artificial Sequence
  Description of Artificial Sequence: Synthetic oligonucleotide
gtgcctagatttccacaacaagtctgtcaacgc

SEQ ID NO: 289902 - DNA, 33 bp, Artificial Sequence
  Description of Artificial Sequence: Synthetic oligonucleotide
tgcctagatttccacaacaagtctgtcaacgcc

SEQ ID NO: 289903 - DNA, 32 bp, Artificial Sequence
  Description of Artificial Sequence: Synthetic oligonucleotide
gcctagatttccacaacaagtctgtcaacgcc

SEQ ID NO: 289904 - DNA, 34 bp, Artificial Sequence
  Description of Artificial Sequence: Synthetic oligonucleotide
cctagatttccacaacaagtctgtcaacgccatg

SEQ ID NO: 289905 - DNA, 35 bp, Artificial Sequence
  Description of Artificial Sequence: Synthetic oligonucleotide
ctagatttccacaacaagtctgtcaacgccatgag

SEQ ID NO: 289906 - DNA, 35 bp, Artificial Sequence
  Description of Artificial Sequence: Synthetic oligonucleotide
tagatttccacaacaagtctgtcaacgccatgagg

SEQ ID NO: 289907 - DNA, 34 bp, Artificial Sequence
  Description of Artificial Sequence: Synthetic oligonucleotide
agatttccacaacaagtctgtcaacgccatgagg

SEQ ID NO: 289908 - DNA, 33 bp, Artificial Sequence
  Description of Artificial Sequence: Synthetic oligonucleotide
gatttccacaacaagtctgtcaacgccatgagg

SEQ ID NO: 289909 - DNA, 36 bp, Artificial Sequence
  Description of Artificial Sequence: Synthetic oligonucleotide
atttccacaacaagtctgtcaacgccatgaggattc

SEQ ID NO: 289910 - DNA, 35 bp, Artificial Sequence
  Description of Artificial Sequence: Synthetic oligonucleotide
tttccacaacaagtctgtcaacgccatgaggattc

SEQ ID NO: 289911 - DNA, 34 bp, Artificial Sequence
  Description of Artificial Sequence: Synthetic oligonucleotide
ttccacaacaagtctgtcaacgccatgaggattc

SEQ ID NO: 289912 - DNA, 33 bp, Artificial Sequence
  Description of Artificial Sequence: Synthetic oligonucleotide
tccacaacaagtctgtcaacgccatgaggattc

SEQ ID NO: 289913 - DNA, 32 bp, Artificial Sequence
  Description of Artificial Sequence: Synthetic oligonucleotide
ccacaacaagtctgtcaacgccatgaggattc

SEQ ID NO: 289914 - DNA, 32 bp, Artificial Sequence
  Description of Artificial Sequence: Synthetic oligonucleotide
cacaacaagtctgtcaacgccatgaggattcc

SEQ ID NO: 289915 - DNA, 33 bp, Artificial Sequence
  Description of Artificial Sequence: Synthetic oligonucleotide
acaacaagtctgtcaacgccatgaggattcctc

SEQ ID NO: 289916 - DNA, 32 bp, Artificial Sequence
  Description of Artificial Sequence: Synthetic oligonucleotide
caacaagtctgtcaacgccatgaggattcctc

SEQ ID NO: 289917 - DNA, 32 bp, Artificial Sequence
  Description of Artificial Sequence: Synthetic oligonucleotide
aacaagtctgtcaacgccatgaggattcctcc

SEQ ID NO: 289918 - DNA, 31 bp, Artificial Sequence
  Description of Artificial Sequence: Synthetic oligonucleotide
acaagtctgtcaacgccatgaggattcctcc

SEQ ID NO: 289919 - DNA, 30 bp, Artificial Sequence
  Description of Artificial Sequence: Synthetic oligonucleotide
caagtctgtcaacgccatgaggattcctcc

SEQ ID NO: 289920 - DNA, 30 bp, Artificial Sequence
  Description of Artificial Sequence: Synthetic oligonucleotide
aagtctgtcaacgccatgaggattcctccc

SEQ ID NO: 289921 - DNA, 29 bp, Artificial Sequence
  Description of Artificial Sequence: Synthetic oligonucleotide
agtctgtcaacgccatgaggattcctccc

SEQ ID NO: 289922 - DNA, 28 bp, Artificial Sequence
  Description of Artificial Sequence: Synthetic oligonucleotide
gtctgtcaacgccatgaggattcctccc

SEQ ID NO: 289923 - DNA, 32 bp, Artificial Sequence
  Description of Artificial Sequence: Synthetic oligonucleotide
tctgtcaacgccatgaggattcctcccatatc

SEQ ID NO: 289924 - DNA, 31 bp, Artificial Sequence
  Description of Artificial Sequence: Synthetic oligonucleotide
ctgtcaacgccatgaggattcctcccatatc

SEQ ID NO: 289925 - DNA, 31 bp, Artificial Sequence
  Description of Artificial Sequence: Synthetic oligonucleotide
tgtcaacgccatgaggattcctcccatatcg

SEQ ID NO: 289926 - DNA, 30 bp, Artificial Sequence
  Description of Artificial Sequence: Synthetic oligonucleotide
gtcaacgccatgaggattcctcccatatcg

SEQ ID NO: 289927 - DNA, 32 bp, Artificial Sequence
  Description of Artificial Sequence: Synthetic oligonucleotide
tcaacgccatgaggattcctcccatatcgtac

SEQ ID NO: 289928 - DNA, 31 bp, Artificial Sequence
  Description of Artificial Sequence: Synthetic oligonucleotide
caacgccatgaggattcctcccatatcgtac

SEQ ID NO: 289929 - DNA, 33 bp, Artificial Sequence
  Description of Artificial Sequence: Synthetic oligonucleotide
aacgccatgaggattcctcccatatcgtacaag

SEQ ID NO: 289930 - DNA, 32 bp, Artificial Sequence
  Description of Artificial Sequence: Synthetic oligonucleotide
acgccatgaggattcctcccatatcgtacaag

SEQ ID NO: 289931 - DNA, 31 bp, Artificial Sequence
  Description of Artificial Sequence: Synthetic oligonucleotide
cgccatgaggattcctcccatatcgtacaag

SEQ ID NO: 289932 - DNA, 33 bp, Artificial Sequence
  Description of Artificial Sequence: Synthetic oligonucleotide
gccatgaggattcctcccatatcgtacaagaag

SEQ ID NO: 289933 - DNA, 33 bp, Artificial Sequence
  Description of Artificial Sequence: Synthetic oligonucleotide
ccatgaggattcctcccatatcgtacaagaagg

SEQ ID NO: 289934 - DNA, 34 bp, Artificial Sequence
  Description of Artificial Sequence: Synthetic oligonucleotide
catgaggattcctcccatatcgtacaagaaggac

SEQ ID NO: 289935 - DNA, 36 bp, Artificial Sequence
  Description of Artificial Sequence: Synthetic oligonucleotide
atgaggattcctcccatatcgtacaagaaggacttg

SEQ ID NO: 289936 - DNA, 35 bp, Artificial Sequence
  Description of Artificial Sequence: Synthetic oligonucleotide
tgaggattcctcccatatcgtacaagaaggacttg

SEQ ID NO: 289937 - DNA, 34 bp, Artificial Sequence
  Description of Artificial Sequence: Synthetic oligonucleotide
gaggattcctcccatatcgtacaagaaggacttg

SEQ ID NO: 289938 - DNA, 34 bp, Artificial Sequence
  Description of Artificial Sequence: Synthetic oligonucleotide
aggattcctcccatatcgtacaagaaggacttgc

SEQ ID NO: 289939 - DNA, 33 bp, Artificial Sequence
  Description of Artificial Sequence: Synthetic oligonucleotide
ggattcctcccatatcgtacaagaaggacttgc

SEQ ID NO: 289940 - DNA, 34 bp, Artificial Sequence
  Description of Artificial Sequence: Synthetic oligonucleotide
gattcctcccatatcgtacaagaaggacttgcag

SEQ ID NO: 289941 - DNA, 35 bp, Artificial Sequence
  Description of Artificial Sequence: Synthetic oligonucleotide
attcctcccatatcgtacaagaaggacttgcagtc

SEQ ID NO: 289942 - DNA, 34 bp, Artificial Sequence
  Description of Artificial Sequence: Synthetic oligonucleotide
ttcctcccatatcgtacaagaaggacttgcagtc

SEQ ID NO: 289943 - DNA, 33 bp, Artificial Sequence
  Description of Artificial Sequence: Synthetic oligonucleotide
tcctcccatatcgtacaagaaggacttgcagtc

SEQ ID NO: 289944 - DNA, 32 bp, Artificial Sequence
  Description of Artificial Sequence: Synthetic oligonucleotide
cctcccatatcgtacaagaaggacttgcagtc

SEQ ID NO: 289945 - DNA, 33 bp, Artificial Sequence
  Description of Artificial Sequence: Synthetic oligonucleotide
ctcccatatcgtacaagaaggacttgcagtctg

SEQ ID NO: 289946 - DNA, 33 bp, Artificial Sequence
  Description of Artificial Sequence: Synthetic oligonucleotide
tcccatatcgtacaagaaggacttgcagtctgc

SEQ ID NO: 289947 - DNA, 32 bp, Artificial Sequence
  Description of Artificial Sequence: Synthetic oligonucleotide
cccatatcgtacaagaaggacttgcagtctgc

SEQ ID NO: 289948 - DNA, 33 bp, Artificial Sequence
  Description of Artificial Sequence: Synthetic oligonucleotide
ccatatcgtacaagaaggacttgcagtctgcag

SEQ ID NO: 289949 - DNA, 34 bp, Artificial Sequence
  Description of Artificial Sequence: Synthetic oligonucleotide
catatcgtacaagaaggacttgcagtctgcagtg

SEQ ID NO: 289950 - DNA, 34 bp, Artificial Sequence
  Description of Artificial Sequence: Synthetic oligonucleotide
atatcgtacaagaaggacttgcagtctgcagtgg

SEQ ID NO: 289951 - DNA, 33 bp, Artificial Sequence
  Description of Artificial Sequence: Synthetic oligonucleotide
tatcgtacaagaaggacttgcagtctgcagtgg

SEQ ID NO: 289952 - DNA, 32 bp, Artificial Sequence
  Description of Artificial Sequence: Synthetic oligonucleotide
atcgtacaagaaggacttgcagtctgcagtgg

SEQ ID NO: 289953 - DNA, 31 bp, Artificial Sequence
  Description of Artificial Sequence: Synthetic oligonucleotide
tcgtacaagaaggacttgcagtctgcagtgg

SEQ ID NO: 289954 - DNA, 30 bp, Artificial Sequence
  Description of Artificial Sequence: Synthetic oligonucleotide
cgtacaagaaggacttgcagtctgcagtgg

SEQ ID NO: 289955 - DNA, 32 bp, Artificial Sequence
  Description of Artificial Sequence: Synthetic oligonucleotide
gtacaagaaggacttgcagtctgcagtggaac

SEQ ID NO: 289956 - DNA, 32 bp, Artificial Sequence
  Description of Artificial Sequence: Synthetic oligonucleotide
tacaagaaggacttgcagtctgcagtggaacg

SEQ ID NO: 289957 - DNA, 31 bp, Artificial Sequence
  Description of Artificial Sequence: Synthetic oligonucleotide
acaagaaggacttgcagtctgcagtggaacg

SEQ ID NO: 289958 - DNA, 30 bp, Artificial Sequence
  Description of Artificial Sequence: Synthetic oligonucleotide
caagaaggacttgcagtctgcagtggaacg

SEQ ID NO: 289959 - DNA, 30 bp, Artificial Sequence
  Description of Artificial Sequence: Synthetic oligonucleotide
aagaaggacttgcagtctgcagtggaacgg

SEQ ID NO: 289960 - DNA, 29 bp, Artificial Sequence
  Description of Artificial Sequence: Synthetic oligonucleotide
agaaggacttgcagtctgcagtggaacgg

SEQ ID NO: 289961 - DNA, 28 bp, Artificial Sequence
  Description of Artificial Sequence: Synthetic oligonucleotide
gaaggacttgcagtctgcagtggaacgg

SEQ ID NO: 289962 - DNA, 28 bp, Artificial Sequence
  Description of Artificial Sequence: Synthetic oligonucleotide
aaggacttgcagtctgcagtggaacggc

SEQ ID NO: 289963 - DNA, 27 bp, Artificial Sequence
  Description of Artificial Sequence: Synthetic oligonucleotide
aggacttgcagtctgcagtggaacggc

SEQ ID NO: 289964 - DNA, 26 bp, Artificial Sequence
  Description of Artificial Sequence: Synthetic oligonucleotide
ggacttgcagtctgcagtggaacggc

SEQ ID NO: 289965 - DNA, 27 bp, Artificial Sequence
  Description of Artificial Sequence: Synthetic oligonucleotide
gacttgcagtctgcagtggaacggcga

SEQ ID NO: 289966 - DNA, 27 bp, Artificial Sequence
  Description of Artificial Sequence: Synthetic oligonucleotide
acttgcagtctgcagtggaacggcgag

SEQ ID NO: 289967 - DNA, 27 bp, Artificial Sequence
  Description of Artificial Sequence: Synthetic oligonucleotide
cttgcagtctgcagtggaacggcgaga

SEQ ID NO: 289968 - DNA, 27 bp, Artificial Sequence
  Description of Artificial Sequence: Synthetic oligonucleotide
ttgcagtctgcagtggaacggcgagag

SEQ ID NO: 289969 - DNA, 26 bp, Artificial Sequence
  Description of Artificial Sequence: Synthetic oligonucleotide
tgcagtctgcagtggaacggcgagag

SEQ ID NO: 289970 - DNA, 25 bp, Artificial Sequence
  Description of Artificial Sequence: Synthetic oligonucleotide
gcagtctgcagtggaacggcgagag

SEQ ID NO: 289971 - DNA, 25 bp, Artificial Sequence
  Description of Artificial Sequence: Synthetic oligonucleotide
cagtctgcagtggaacggcgagagc

SEQ ID NO: 289972 - DNA, 26 bp, Artificial Sequence
  Description of Artificial Sequence: Synthetic oligonucleotide
agtctgcagtggaacggcgagagcga

SEQ ID NO: 289973 - DNA, 25 bp, Artificial Sequence
  Description of Artificial Sequence: Synthetic oligonucleotide
gtctgcagtggaacggcgagagcga

SEQ ID NO: 289974 - DNA, 27 bp, Artificial Sequence
  Description of Artificial Sequence: Synthetic oligonucleotide
tctgcagtggaacggcgagagcgagaa

SEQ ID NO: 289975 - DNA, 26 bp, Artificial Sequence
  Description of Artificial Sequence: Synthetic oligonucleotide
ctgcagtggaacggcgagagcgagaa

SEQ ID NO: 289976 - DNA, 27 bp, Artificial Sequence
  Description of Artificial Sequence: Synthetic oligonucleotide
tgcagtggaacggcgagagcgagaaga

SEQ ID NO: 289977 - DNA, 26 bp, Artificial Sequence
  Description of Artificial Sequence: Synthetic oligonucleotide
gcagtggaacggcgagagcgagaaga

SEQ ID NO: 289978 - DNA, 26 bp, Artificial Sequence
  Description of Artificial Sequence: Synthetic oligonucleotide
cagtggaacggcgagagcgagaagag

SEQ ID NO: 289979 - DNA, 27 bp, Artificial Sequence
  Description of Artificial Sequence: Synthetic oligonucleotide
agtggaacggcgagagcgagaagagca

SEQ ID NO: 289980 - DNA, 26 bp, Artificial Sequence
  Description of Artificial Sequence: Synthetic oligonucleotide
gtggaacggcgagagcgagaagagca

SEQ ID NO: 289981 - DNA, 26 bp, Artificial Sequence
  Description of Artificial Sequence: Synthetic oligonucleotide
tggaacggcgagagcgagaagagcag

SEQ ID NO: 289982 - DNA, 25 bp, Artificial Sequence
  Description of Artificial Sequence: Synthetic oligonucleotide
ggaacggcgagagcgagaagagcag

SEQ ID NO: 289983 - DNA, 26 bp, Artificial Sequence
  Description of Artificial Sequence: Synthetic oligonucleotide
gaacggcgagagcgagaagagcagga

SEQ ID NO: 289984 - DNA, 27 bp, Artificial Sequence
  Description of Artificial Sequence: Synthetic oligonucleotide
aacggcgagagcgagaagagcaggact

SEQ ID NO: 289985 - DNA, 27 bp, Artificial Sequence
  Description of Artificial Sequence: Synthetic oligonucleotide
acggcgagagcgagaagagcaggacta

SEQ ID NO: 289986 - DNA, 26 bp, Artificial Sequence
  Description of Artificial Sequence: Synthetic oligonucleotide
cggcgagagcgagaagagcaggacta

SEQ ID NO: 289987 - DNA, 26 bp, Artificial Sequence
  Description of Artificial Sequence: Synthetic oligonucleotide
ggcgagagcgagaagagcaggactag

SEQ ID NO: 289988 - DNA, 27 bp, Artificial Sequence
  Description of Artificial Sequence: Synthetic oligonucleotide
gcgagagcgagaagagcaggactagga

SEQ ID NO: 289989 - DNA, 27 bp, Artificial Sequence
  Description of Artificial Sequence: Synthetic oligonucleotide
cgagagcgagaagagcaggactaggag

SEQ ID NO: 289990 - DNA, 30 bp, Artificial Sequence
  Description of Artificial Sequence: Synthetic oligonucleotide
gagagcgagaagagcaggactaggagtttg

SEQ ID NO: 289991 - DNA, 30 bp, Artificial Sequence
  Description of Artificial Sequence: Synthetic oligonucleotide
agagcgagaagagcaggactaggagtttgc

SEQ ID NO: 289992 - DNA, 29 bp, Artificial Sequence
  Description of Artificial Sequence: Synthetic oligonucleotide
gagcgagaagagcaggactaggagtttgc

SEQ ID NO: 289993 - DNA, 29 bp, Artificial Sequence
  Description of Artificial Sequence: Synthetic oligonucleotide
agcgagaagagcaggactaggagtttgcg

SEQ ID NO: 289994 - DNA, 28 bp, Artificial Sequence
  Description of Artificial Sequence: Synthetic oligonucleotide
gcgagaagagcaggactaggagtttgcg

SEQ ID NO: 289995 - DNA, 30 bp, Artificial Sequence
  Description of Artificial Sequence: Synthetic oligonucleotide
cgagaagagcaggactaggagtttgcgaag

SEQ ID NO: 289996 - DNA, 30 bp, Artificial Sequence
  Description of Artificial Sequence: Synthetic oligonucleotide
gagaagagcaggactaggagtttgcgaagg

SEQ ID NO: 289997 - DNA, 31 bp, Artificial Sequence
  Description of Artificial Sequence: Synthetic oligonucleotide
agaagagcaggactaggagtttgcgaaggag

SEQ ID NO: 289998 - DNA, 30 bp, Artificial Sequence
  Description of Artificial Sequence: Synthetic oligonucleotide
gaagagcaggactaggagtttgcgaaggag

SEQ ID NO: 289999 - DNA, 32 bp, Artificial Sequence
  Description of Artificial Sequence: Synthetic oligonucleotide
aagagcaggactaggagtttgcgaaggagatg

SEQ ID NO: 290000 - DNA, 31 bp, Artificial Sequence
  Description of Artificial Sequence: Synthetic oligonucleotide
agagcaggactaggagtttgcgaaggagatg

SEQ ID NO: 290001 - DNA, 30 bp, Artificial Sequence
  Description of Artificial Sequence: Synthetic oligonucleotide
gagcaggactaggagtttgcgaaggagatg

SEQ ID NO: 290002 - DNA, 30 bp, Artificial Sequence
  Description of Artificial Sequence: Synthetic oligonucleotide
agcaggactaggagtttgcgaaggagatgc

SEQ ID NO: 290003 - DNA, 29 bp, Artificial Sequence
  Description of Artificial Sequence: Synthetic oligonucleotide
gcaggactaggagtttgcgaaggagatgc

SEQ ID NO: 290004 - DNA, 29 bp, Artificial Sequence
  Description of Artificial Sequence: Synthetic oligonucleotide
caggactaggagtttgcgaaggagatgcc

SEQ ID NO: 290005 - DNA, 30 bp, Artificial Sequence
  Description of Artificial Sequence: Synthetic oligonucleotide
aggactaggagtttgcgaaggagatgccag

SEQ ID NO: 290006 - DNA, 29 bp, Artificial Sequence
  Description of Artificial Sequence: Synthetic oligonucleotide
ggactaggagtttgcgaaggagatgccag

SEQ ID NO: 290007 - DNA, 31 bp, Artificial Sequence
  Description of Artificial Sequence: Synthetic oligonucleotide
gactaggagtttgcgaaggagatgccagaag

SEQ ID NO: 290008 - DNA, 33 bp, Artificial Sequence
  Description of Artificial Sequence: Synthetic oligonucleotide
actaggagtttgcgaaggagatgccagaagatg

SEQ ID NO: 290009 - DNA, 32 bp, Artificial Sequence
  Description of Artificial Sequence: Synthetic oligonucleotide
ctaggagtttgcgaaggagatgccagaagatg

SEQ ID NO: 290010 - DNA, 34 bp, Artificial Sequence
  Description of Artificial Sequence: Synthetic oligonucleotide
taggagtttgcgaaggagatgccagaagatgttg

SEQ ID NO: 290011 - DNA, 33 bp, Artificial Sequence
  Description of Artificial Sequence: Synthetic oligonucleotide
aggagtttgcgaaggagatgccagaagatgttg

SEQ ID NO: 290012 - DNA, 32 bp, Artificial Sequence
  Description of Artificial Sequence: Synthetic oligonucleotide
ggagtttgcgaaggagatgccagaagatgttg

SEQ ID NO: 290013 - DNA, 34 bp, Artificial Sequence
  Description of Artificial Sequence: Synthetic oligonucleotide
gagtttgcgaaggagatgccagaagatgttgatg

SEQ ID NO: 290014 - DNA, 35 bp, Artificial Sequence
  Description of Artificial Sequence: Synthetic oligonucleotide
agtttgcgaaggagatgccagaagatgttgatgac

SEQ ID NO: 290015 - DNA, 34 bp, Artificial Sequence
  Description of Artificial Sequence: Synthetic oligonucleotide
gtttgcgaaggagatgccagaagatgttgatgac

SEQ ID NO: 290016 - DNA, 35 bp, Artificial Sequence
  Description of Artificial Sequence: Synthetic oligonucleotide
tttgcgaaggagatgccagaagatgttgatgacag

SEQ ID NO: 290017 - DNA, 34 bp, Artificial Sequence
  Description of Artificial Sequence: Synthetic oligonucleotide
ttgcgaaggagatgccagaagatgttgatgacag

SEQ ID NO: 290018 - DNA, 33 bp, Artificial Sequence
  Description of Artificial Sequence: Synthetic oligonucleotide
tgcgaaggagatgccagaagatgttgatgacag

SEQ ID NO: 290019 - DNA, 32 bp, Artificial Sequence
  Description of Artificial Sequence: Synthetic oligonucleotide
gcgaaggagatgccagaagatgttgatgacag

SEQ ID NO: 290020 - DNA, 32 bp, Artificial Sequence
  Description of Artificial Sequence: Synthetic oligonucleotide
cgaaggagatgccagaagatgttgatgacagg

SEQ ID NO: 290021 - DNA, 34 bp, Artificial Sequence
  Description of Artificial Sequence: Synthetic oligonucleotide
gaaggagatgccagaagatgttgatgacaggttc

SEQ ID NO: 290022 - DNA, 34 bp, Artificial Sequence
  Description of Artificial Sequence: Synthetic oligonucleotide
aaggagatgccagaagatgttgatgacaggttcc

SEQ ID NO: 290023 - DNA, 33 bp, Artificial Sequence
  Description of Artificial Sequence: Synthetic oligonucleotide
aggagatgccagaagatgttgatgacaggttcc

SEQ ID NO: 290024 - DNA, 32 bp, Artificial Sequence
  Description of Artificial Sequence: Synthetic oligonucleotide
ggagatgccagaagatgttgatgacaggttcc

SEQ ID NO: 290025 - DNA, 32 bp, Artificial Sequence
  Description of Artificial Sequence: Synthetic oligonucleotide
gagatgccagaagatgttgatgacaggttccc

SEQ ID NO: 290026 - DNA, 34 bp, Artificial Sequence
  Description of Artificial Sequence: Synthetic oligonucleotide
agatgccagaagatgttgatgacaggttcccttg

SEQ ID NO: 290027 - DNA, 33 bp, Artificial Sequence
  Description of Artificial Sequence: Synthetic oligonucleotide
gatgccagaagatgttgatgacaggttcccttg

SEQ ID NO: 290028 - DNA, 33 bp, Artificial Sequence
  Description of Artificial Sequence: Synthetic oligonucleotide
atggtgtaggaaagcacaatggtgtgtctggac

SEQ ID NO: 290029 - DNA, 32 bp, Artificial Sequence
  Description of Artificial Sequence: Synthetic oligonucleotide
tggtgtaggaaagcacaatggtgtgtctggac

SEQ ID NO: 290030 - DNA, 31 bp, Artificial Sequence
  Description of Artificial Sequence: Synthetic oligonucleotide
ggtgtaggaaagcacaatggtgtgtctggac

SEQ ID NO: 290031 - DNA, 33 bp, Artificial Sequence
  Description of Artificial Sequence: Synthetic oligonucleotide
gtgtaggaaagcacaatggtgtgtctggacaac

SEQ ID NO: 290032 - DNA, 34 bp, Artificial Sequence
  Description of Artificial Sequence: Synthetic oligonucleotide
tgtaggaaagcacaatggtgtgtctggacaacac

SEQ ID NO: 290033 - DNA, 33 bp, Artificial Sequence
  Description of Artificial Sequence: Synthetic oligonucleotide
gtaggaaagcacaatggtgtgtctggacaacac

SEQ ID NO: 290034 - DNA, 34 bp, Artificial Sequence
  Description of Artificial Sequence: Synthetic oligonucleotide
taggaaagcacaatggtgtgtctggacaacactg

SEQ ID NO: 290035 - DNA, 33 bp, Artificial Sequence
  Description of Artificial Sequence: Synthetic oligonucleotide
aggaaagcacaatggtgtgtctggacaacactg

SEQ ID NO: 290036 - DNA, 32 bp, Artificial Sequence
  Description of Artificial Sequence: Synthetic oligonucleotide
ggaaagcacaatggtgtgtctggacaacactg

SEQ ID NO: 290037 - DNA, 33 bp, Artificial Sequence
  Description of Artificial Sequence: Synthetic oligonucleotide
gaaagcacaatggtgtgtctggacaacactgag

SEQ ID NO: 290038 - DNA, 38 bp, Artificial Sequence
  Description of Artificial Sequence: Synthetic oligonucleotide
aaagcacaatggtgtgtctggacaacactgagtatatc

SEQ ID NO: 290039 - DNA, 37 bp, Artificial Sequence
  Description of Artificial Sequence: Synthetic oligonucleotide
aagcacaatggtgtgtctggacaacactgagtatatc

SEQ ID NO: 290040 - DNA, 36 bp, Artificial Sequence
  Description of Artificial Sequence: Synthetic oligonucleotide
agcacaatggtgtgtctggacaacactgagtatatc

SEQ ID NO: 290041 - DNA, 35 bp, Artificial Sequence
  Description of Artificial Sequence: Synthetic oligonucleotide
gcacaatggtgtgtctggacaacactgagtatatc

SEQ ID NO: 290042 - DNA, 35 bp, Artificial Sequence
  Description of Artificial Sequence: Synthetic oligonucleotide
cacaatggtgtgtctggacaacactgagtatatcc

SEQ ID NO: 290043 - DNA, 35 bp, Artificial Sequence
  Description of Artificial Sequence: Synthetic oligonucleotide
acaatggtgtgtctggacaacactgagtatatccg

SEQ ID NO: 290044 - DNA, 34 bp, Artificial Sequence
  Description of Artificial Sequence: Synthetic oligonucleotide
caatggtgtgtctggacaacactgagtatatccg

SEQ ID NO: 290045 - DNA, 34 bp, Artificial Sequence
  Description of Artificial Sequence: Synthetic oligonucleotide
aatggtgtgtctggacaacactgagtatatccgg

SEQ ID NO: 290046 - DNA, 33 bp, Artificial Sequence
  Description of Artificial Sequence: Synthetic oligonucleotide
atggtgtgtctggacaacactgagtatatccgg

SEQ ID NO: 290047 - DNA, 32 bp, Artificial Sequence
  Description of Artificial Sequence: Synthetic oligonucleotide
tggtgtgtctggacaacactgagtatatccgg

SEQ ID NO: 290048 - DNA, 31 bp, Artificial Sequence
  Description of Artificial Sequence: Synthetic oligonucleotide
ggtgtgtctggacaacactgagtatatccgg

SEQ ID NO: 290049 - DNA, 34 bp, Artificial Sequence
  Description of Artificial Sequence: Synthetic oligonucleotide
gtgtgtctggacaacactgagtatatccggaatg

SEQ ID NO: 290050 - DNA, 34 bp, Artificial Sequence
  Description of Artificial Sequence: Synthetic oligonucleotide
tgtgtctggacaacactgagtatatccggaatgg

SEQ ID NO: 290051 - DNA, 33 bp, Artificial Sequence
  Description of Artificial Sequence: Synthetic oligonucleotide
gtgtctggacaacactgagtatatccggaatgg

SEQ ID NO: 290052 - DNA, 34 bp, Artificial Sequence
  Description of Artificial Sequence: Synthetic oligonucleotide
tgtctggacaacactgagtatatccggaatggac

SEQ ID NO: 290053 - DNA, 33 bp, Artificial Sequence
  Description of Artificial Sequence: Synthetic oligonucleotide
gtctggacaacactgagtatatccggaatggac

SEQ ID NO: 290054 - DNA, 34 bp, Artificial Sequence
  Description of Artificial Sequence: Synthetic oligonucleotide
tctggacaacactgagtatatccggaatggacac

SEQ ID NO: 290055 - DNA, 33 bp, Artificial Sequence
  Description of Artificial Sequence: Synthetic oligonucleotide
ctggacaacactgagtatatccggaatggacac

SEQ ID NO: 290056 - DNA, 35 bp, Artificial Sequence
  Description of Artificial Sequence: Synthetic oligonucleotide
tggacaacactgagtatatccggaatggacacttc

SEQ ID NO: 290057 - DNA, 34 bp, Artificial Sequence
  Description of Artificial Sequence: Synthetic oligonucleotide
ggacaacactgagtatatccggaatggacacttc

SEQ ID NO: 290058 - DNA, 37 bp, Artificial Sequence
  Description of Artificial Sequence: Synthetic oligonucleotide
gacaacactgagtatatccggaatggacacttcttac

SEQ ID NO: 290059 - DNA, 37 bp, Artificial Sequence
  Description of Artificial Sequence: Synthetic oligonucleotide
acaacactgagtatatccggaatggacacttcttacg

SEQ ID NO: 290060 - DNA, 36 bp, Artificial Sequence
  Description of Artificial Sequence: Synthetic oligonucleotide
caacactgagtatatccggaatggacacttcttacg

SEQ ID NO: 290061 - DNA, 36 bp, Artificial Sequence
  Description of Artificial Sequence: Synthetic oligonucleotide
aacactgagtatatccggaatggacacttcttacgc

SEQ ID NO: 290062 - DNA, 35 bp, Artificial Sequence
  Description of Artificial Sequence: Synthetic oligonucleotide
acactgagtatatccggaatggacacttcttacgc

SEQ ID NO: 290063 - DNA, 34 bp, Artificial Sequence
  Description of Artificial Sequence: Synthetic oligonucleotide
cactgagtatatccggaatggacacttcttacgc

SEQ ID NO: 290064 - DNA, 35 bp, Artificial Sequence
  Description of Artificial Sequence: Synthetic oligonucleotide
actgagtatatccggaatggacacttcttacgcac

SEQ ID NO: 290065 - DNA, 34 bp, Artificial Sequence
  Description of Artificial Sequence: Synthetic oligonucleotide
ctgagtatatccggaatggacacttcttacgcac

SEQ ID NO: 290066 - DNA, 34 bp, Artificial Sequence
  Description of Artificial Sequence: Synthetic oligonucleotide
tgagtatatccggaatggacacttcttacgcacc

SEQ ID NO: 290067 - DNA, 33 bp, Artificial Sequence
  Description of Artificial Sequence: Synthetic oligonucleotide
gagtatatccggaatggacacttcttacgcacc

SEQ ID NO: 290068 - DNA, 34 bp, Artificial Sequence
  Description of Artificial Sequence: Synthetic oligonucleotide
agtatatccggaatggacacttcttacgcaccag

SEQ ID NO: 290069 - DNA, 33 bp, Artificial Sequence
  Description of Artificial Sequence: Synthetic oligonucleotide
gtatatccggaatggacacttcttacgcaccag

SEQ ID NO: 290070 - DNA, 33 bp, Artificial Sequence
  Description of Artificial Sequence: Synthetic oligonucleotide
tatatccggaatggacacttcttacgcaccagg

SEQ ID NO: 290071 - DNA, 32 bp, Artificial Sequence
  Description of Artificial Sequence: Synthetic oligonucleotide
atatccggaatggacacttcttacgcaccagg

SEQ ID NO: 290072 - DNA, 31 bp, Artificial Sequence
  Description of Artificial Sequence: Synthetic oligonucleotide
tatccggaatggacacttcttacgcaccagg

SEQ ID NO: 290073 - DNA, 30 bp, Artificial Sequence
  Description of Artificial Sequence: Synthetic oligonucleotide
atccggaatggacacttcttacgcaccagg

SEQ ID NO: 290074 - DNA, 29 bp, Artificial Sequence
  Description of Artificial Sequence: Synthetic oligonucleotide
tccggaatggacacttcttacgcaccagg

SEQ ID NO: 290075 - DNA, 28 bp, Artificial Sequence
  Description of Artificial Sequence: Synthetic oligonucleotide
ccggaatggacacttcttacgcaccagg

SEQ ID NO: 290076 - DNA, 28 bp, Artificial Sequence
  Description of Artificial Sequence: Synthetic oligonucleotide
cggaatggacacttcttacgcaccaggc

SEQ ID NO: 290077 - DNA, 29 bp, Artificial Sequence
  Description of Artificial Sequence: Synthetic oligonucleotide
ggaatggacacttcttacgcaccaggctc

SEQ ID NO: 290078 - DNA, 29 bp, Artificial Sequence
  Description of Artificial Sequence: Synthetic oligonucleotide
gaatggacacttcttacgcaccaggctcc

SEQ ID NO: 290079 - DNA, 30 bp, Artificial Sequence
  Description of Artificial Sequence: Synthetic oligonucleotide
aatggacacttcttacgcaccaggctccag

SEQ ID NO: 290080 - DNA, 29 bp, Artificial Sequence
  Description of Artificial Sequence: Synthetic oligonucleotide
atggacacttcttacgcaccaggctccag

SEQ ID NO: 290081 - DNA, 28 bp, Artificial Sequence
  Description of Artificial Sequence: Synthetic oligonucleotide
tggacacttcttacgcaccaggctccag

SEQ ID NO: 290082 - DNA, 27 bp, Artificial Sequence
  Description of Artificial Sequence: Synthetic oligonucleotide
ggacacttcttacgcaccaggctccag

SEQ ID NO: 290083 - DNA, 27 bp, Artificial Sequence
  Description of Artificial Sequence: Synthetic oligonucleotide
gacacttcttacgcaccaggctccagg

SEQ ID NO: 290084 - DNA, 27 bp, Artificial Sequence
  Description of Artificial Sequence: Synthetic oligonucleotide
acacttcttacgcaccaggctccaggc

SEQ ID NO: 290085 - DNA, 26 bp, Artificial Sequence
  Description of Artificial Sequence: Synthetic oligonucleotide
cacttcttacgcaccaggctccaggc

SEQ ID NO: 290086 - DNA, 26 bp, Artificial Sequence
  Description of Artificial Sequence: Synthetic oligonucleotide
acttcttacgcaccaggctccaggcc

SEQ ID NO: 290087 - DNA, 25 bp, Artificial Sequence
  Description of Artificial Sequence: Synthetic oligonucleotide
cttcttacgcaccaggctccaggcc

SEQ ID NO: 290088 - DNA, 26 bp, Artificial Sequence
  Description of Artificial Sequence: Synthetic oligonucleotide
ttcttacgcaccaggctccaggccca

SEQ ID NO: 290089 - DNA, 25 bp, Artificial Sequence
  Description of Artificial Sequence: Synthetic oligonucleotide
tcttacgcaccaggctccaggccca

SEQ ID NO: 290090 - DNA, 24 bp, Artificial Sequence
  Description of Artificial Sequence: Synthetic oligonucleotide
cttacgcaccaggctccaggccca

SEQ ID NO: 290091 - DNA, 24 bp, Artificial Sequence
  Description of Artificial Sequence: Synthetic oligonucleotide
ttacgcaccaggctccaggcccag

SEQ ID NO: 290092 - DNA, 23 bp, Artificial Sequence
  Description of Artificial Sequence: Synthetic oligonucleotide
tacgcaccaggctccaggcccag

SEQ ID NO: 290093 - DNA, 22 bp, Artificial Sequence
  Description of Artificial Sequence: Synthetic oligonucleotide
acgcaccaggctccaggcccag

SEQ ID NO: 290094 - DNA, 21 bp, Artificial Sequence
  Description of Artificial Sequence: Synthetic oligonucleotide
cgcaccaggctccaggcccag

SEQ ID NO: 290095 - DNA, 22 bp, Artificial Sequence
  Description of Artificial Sequence: Synthetic oligonucleotide
gcaccaggctccaggcccagga

SEQ ID NO: 290096 - DNA, 22 bp, Artificial Sequence
  Description of Artificial Sequence: Synthetic oligonucleotide
caccaggctccaggcccaggag

SEQ ID NO: 290097 - DNA, 24 bp, Artificial Sequence
  Description of Artificial Sequence: Synthetic oligonucleotide
accaggctccaggcccaggaggat

SEQ ID NO: 290098 - DNA, 23 bp, Artificial Sequence
  Description of Artificial Sequence: Synthetic oligonucleotide
ccaggctccaggcccaggaggat

SEQ ID NO: 290099 - DNA, 23 bp, Artificial Sequence
  Description of Artificial Sequence: Synthetic oligonucleotide
caggctccaggcccaggaggatg

SEQ ID NO: 290100 - DNA, 24 bp, Artificial Sequence
  Description of Artificial Sequence: Synthetic oligonucleotide
aggctccaggcccaggaggatgct

SEQ ID NO: 290101 - DNA, 23 bp, Artificial Sequence
  Description of Artificial Sequence: Synthetic oligonucleotide
ggctccaggcccaggaggatgct

SEQ ID NO: 290102 - DNA, 24 bp, Artificial Sequence
  Description of Artificial Sequence: Synthetic oligonucleotide
gctccaggcccaggaggatgctga

SEQ ID NO: 290103 - DNA, 26 bp, Artificial Sequence
  Description of Artificial Sequence: Synthetic oligonucleotide
ctccaggcccaggaggatgctgacaa

SEQ ID NO: 290104 - DNA, 27 bp, Artificial Sequence
  Description of Artificial Sequence: Synthetic oligonucleotide
tccaggcccaggaggatgctgacaaca

SEQ ID NO: 290105 - DNA, 27 bp, Artificial Sequence
  Description of Artificial Sequence: Synthetic oligonucleotide
ccaggcccaggaggatgctgacaacat

SEQ ID NO: 290106 - DNA, 28 bp, Artificial Sequence
  Description of Artificial Sequence: Synthetic oligonucleotide
caggcccaggaggatgctgacaacatag

SEQ ID NO: 290107 - DNA, 31 bp, Artificial Sequence
  Description of Artificial Sequence: Synthetic oligonucleotide
aggcccaggaggatgctgacaacatagtatg

SEQ ID NO: 290108 - DNA, 30 bp, Artificial Sequence
  Description of Artificial Sequence: Synthetic oligonucleotide
ggcccaggaggatgctgacaacatagtatg

SEQ ID NO: 290109 - DNA, 31 bp, Artificial Sequence
  Description of Artificial Sequence: Synthetic oligonucleotide
gcccaggaggatgctgacaacatagtatgtc

SEQ ID NO: 290110 - DNA, 34 bp, Artificial Sequence
  Description of Artificial Sequence: Synthetic oligonucleotide
cccaggaggatgctgacaacatagtatgtcattc

SEQ ID NO: 290111 - DNA, 37 bp, Artificial Sequence
  Description of Artificial Sequence: Synthetic oligonucleotide
ccaggaggatgctgacaacatagtatgtcattcatag

SEQ ID NO: 290112 - DNA, 38 bp, Artificial Sequence
  Description of Artificial Sequence: Synthetic oligonucleotide
caggaggatgctgacaacatagtatgtcattcatagac

SEQ ID NO: 290113 - DNA, 38 bp, Artificial Sequence
  Description of Artificial Sequence: Synthetic oligonucleotide
aggaggatgctgacaacatagtatgtcattcatagacc

SEQ ID NO: 290114 - DNA, 37 bp, Artificial Sequence
  Description of Artificial Sequence: Synthetic oligonucleotide
ggaggatgctgacaacatagtatgtcattcatagacc

SEQ ID NO: 290115 - DNA, 37 bp, Artificial Sequence
  Description of Artificial Sequence: Synthetic oligonucleotide
gaggatgctgacaacatagtatgtcattcatagaccc

SEQ ID NO: 290116 - DNA, 37 bp, Artificial Sequence
  Description of Artificial Sequence: Synthetic oligonucleotide
aggatgctgacaacatagtatgtcattcatagacccg

SEQ ID NO: 290117 - DNA, 36 bp, Artificial Sequence
  Description of Artificial Sequence: Synthetic oligonucleotide
ggatgctgacaacatagtatgtcattcatagacccg

SEQ ID NO: 290118 - DNA, 36 bp, Artificial Sequence
  Description of Artificial Sequence: Synthetic oligonucleotide
gatgctgacaacatagtatgtcattcatagacccgc

SEQ ID NO: 290119 - DNA, 37 bp, Artificial Sequence
  Description of Artificial Sequence: Synthetic oligonucleotide
atgctgacaacatagtatgtcattcatagacccgcac

SEQ ID NO: 290120 - DNA, 36 bp, Artificial Sequence
  Description of Artificial Sequence: Synthetic oligonucleotide
tgctgacaacatagtatgtcattcatagacccgcac

SEQ ID NO: 290121 - DNA, 35 bp, Artificial Sequence
  Description of Artificial Sequence: Synthetic oligonucleotide
gctgacaacatagtatgtcattcatagacccgcac

SEQ ID NO: 290122 - DNA, 35 bp, Artificial Sequence
  Description of Artificial Sequence: Synthetic oligonucleotide
ctgacaacatagtatgtcattcatagacccgcacc

SEQ ID NO: 290123 - DNA, 37 bp, Artificial Sequence
  Description of Artificial Sequence: Synthetic oligonucleotide
tgacaacatagtatgtcattcatagacccgcaccaac

SEQ ID NO: 290124 - DNA, 36 bp, Artificial Sequence
  Description of Artificial Sequence: Synthetic oligonucleotide
gacaacatagtatgtcattcatagacccgcaccaac

SEQ ID NO: 290125 - DNA, 36 bp, Artificial Sequence
  Description of Artificial Sequence: Synthetic oligonucleotide
acaacatagtatgtcattcatagacccgcaccaacc

SEQ ID NO: 290126 - DNA, 35 bp, Artificial Sequence
  Description of Artificial Sequence: Synthetic oligonucleotide
caacatagtatgtcattcatagacccgcaccaacc

SEQ ID NO: 290127 - DNA, 35 bp, Artificial Sequence
  Description of Artificial Sequence: Synthetic oligonucleotide
aacatagtatgtcattcatagacccgcaccaaccc

SEQ ID NO: 290128 - DNA, 34 bp, Artificial Sequence
  Description of Artificial Sequence: Synthetic oligonucleotide
acatagtatgtcattcatagacccgcaccaaccc

SEQ ID NO: 290129 - DNA, 33 bp, Artificial Sequence
  Description of Artificial Sequence: Synthetic oligonucleotide
catagtatgtcattcatagacccgcaccaaccc

SEQ ID NO: 290130 - DNA, 34 bp, Artificial Sequence
  Description of Artificial Sequence: Synthetic oligonucleotide
atagtatgtcattcatagacccgcaccaaccctg

SEQ ID NO: 290131 - DNA, 33 bp, Artificial Sequence
  Description of Artificial Sequence: Synthetic oligonucleotide
tagtatgtcattcatagacccgcaccaaccctg

SEQ ID NO: 290132 - DNA, 32 bp, Artificial Sequence
  Description of Artificial Sequence: Synthetic oligonucleotide
agtatgtcattcatagacccgcaccaaccctg

SEQ ID NO: 290133 - DNA, 31 bp, Artificial Sequence
  Description of Artificial Sequence: Synthetic oligonucleotide
gtatgtcattcatagacccgcaccaaccctg

SEQ ID NO: 290134 - DNA, 32 bp, Artificial Sequence
  Description of Artificial Sequence: Synthetic oligonucleotide
tatgtcattcatagacccgcaccaaccctgac

SEQ ID NO: 290135 - DNA, 31 bp, Artificial Sequence
  Description of Artificial Sequence: Synthetic oligonucleotide
atgtcattcatagacccgcaccaaccctgac

SEQ ID NO: 290136 - DNA, 30 bp, Artificial Sequence
  Description of Artificial Sequence: Synthetic oligonucleotide
tgtcattcatagacccgcaccaaccctgac

SEQ ID NO: 290137 - DNA, 29 bp, Artificial Sequence
  Description of Artificial Sequence: Synthetic oligonucleotide
gtcattcatagacccgcaccaaccctgac

SEQ ID NO: 290138 - DNA, 31 bp, Artificial Sequence
  Description of Artificial Sequence: Synthetic oligonucleotide
tcattcatagacccgcaccaaccctgacaac

SEQ ID NO: 290139 - DNA, 30 bp, Artificial Sequence
  Description of Artificial Sequence: Synthetic oligonucleotide
cattcatagacccgcaccaaccctgacaac

SEQ ID NO: 290140 - DNA, 32 bp, Artificial Sequence
  Description of Artificial Sequence: Synthetic oligonucleotide
attcatagacccgcaccaaccctgacaacaac

SEQ ID NO: 290141 - DNA, 31 bp, Artificial Sequence
  Description of Artificial Sequence: Synthetic oligonucleotide
ttcatagacccgcaccaaccctgacaacaac

SEQ ID NO: 290142 - DNA, 30 bp, Artificial Sequence
  Description of Artificial Sequence: Synthetic oligonucleotide
tcatagacccgcaccaaccctgacaacaac

SEQ ID NO: 290143 - DNA, 29 bp, Artificial Sequence
  Description of Artificial Sequence: Synthetic oligonucleotide
catagacccgcaccaaccctgacaacaac

SEQ ID NO: 290144 - DNA, 29 bp, Artificial Sequence
  Description of Artificial Sequence: Synthetic oligonucleotide
atagacccgcaccaaccctgacaacaacg

SEQ ID NO: 290145 - DNA, 28 bp, Artificial Sequence
  Description of Artificial Sequence: Synthetic oligonucleotide
tagacccgcaccaaccctgacaacaacg

SEQ ID NO: 290146 - DNA, 27 bp, Artificial Sequence
  Description of Artificial Sequence: Synthetic oligonucleotide
agacccgcaccaaccctgacaacaacg

SEQ ID NO: 290147 - DNA, 27 bp, Artificial Sequence
  Description of Artificial Sequence: Synthetic oligonucleotide
gacccgcaccaaccctgacaacaacgt

SEQ ID NO: 290148 - DNA, 27 bp, Artificial Sequence
  Description of Artificial Sequence: Synthetic oligonucleotide
acccgcaccaaccctgacaacaacgtg

SEQ ID NO: 290149 - DNA, 26 bp, Artificial Sequence
  Description of Artificial Sequence: Synthetic oligonucleotide
cccgcaccaaccctgacaacaacgtg

SEQ ID NO: 290150 - DNA, 26 bp, Artificial Sequence
  Description of Artificial Sequence: Synthetic oligonucleotide
ccgcaccaaccctgacaacaacgtgc

SEQ ID NO: 290151 - DNA, 26 bp, Artificial Sequence
  Description of Artificial Sequence: Synthetic oligonucleotide
cgcaccaaccctgacaacaacgtgcg

SEQ ID NO: 290152 - DNA, 26 bp, Artificial Sequence
  Description of Artificial Sequence: Synthetic oligonucleotide
gcaccaaccctgacaacaacgtgcgc

SEQ ID NO: 290153 - DNA, 27 bp, Artificial Sequence
  Description of Artificial Sequence: Synthetic oligonucleotide
caccaaccctgacaacaacgtgcgcct

SEQ ID NO: 290154 - DNA, 30 bp, Artificial Sequence
  Description of Artificial Sequence: Synthetic oligonucleotide
accaaccctgacaacaacgtgcgccttatc

SEQ ID NO: 290155 - DNA, 29 bp, Artificial Sequence
  Description of Artificial Sequence: Synthetic oligonucleotide
ccaaccctgacaacaacgtgcgccttatc

SEQ ID NO: 290156 - DNA, 30 bp, Artificial Sequence
  Description of Artificial Sequence: Synthetic oligonucleotide
caaccctgacaacaacgtgcgccttatcag

SEQ ID NO: 290157 - DNA, 31 bp, Artificial Sequence
  Description of Artificial Sequence: Synthetic oligonucleotide
aaccctgacaacaacgtgcgccttatcagac

SEQ ID NO: 290158 - DNA, 30 bp, Artificial Sequence
  Description of Artificial Sequence: Synthetic oligonucleotide
accctgacaacaacgtgcgccttatcagac

SEQ ID NO: 290159 - DNA, 29 bp, Artificial Sequence
  Description of Artificial Sequence: Synthetic oligonucleotide
ccctgacaacaacgtgcgccttatcagac

SEQ ID NO: 290160 - DNA, 30 bp, Artificial Sequence
  Description of Artificial Sequence: Synthetic oligonucleotide
cctgacaacaacgtgcgccttatcagactg

SEQ ID NO: 290161 - DNA, 30 bp, Artificial Sequence
  Description of Artificial Sequence: Synthetic oligonucleotide
ctgacaacaacgtgcgccttatcagactgg

SEQ ID NO: 290162 - DNA, 30 bp, Artificial Sequence
  Description of Artificial Sequence: Synthetic oligonucleotide
tgacaacaacgtgcgccttatcagactggc

SEQ ID NO: 290163 - DNA, 29 bp, Artificial Sequence
  Description of Artificial Sequence: Synthetic oligonucleotide
gacaacaacgtgcgccttatcagactggc

SEQ ID NO: 290164 - DNA, 33 bp, Artificial Sequence
  Description of Artificial Sequence: Synthetic oligonucleotide
acaacaacgtgcgccttatcagactggctaaag

SEQ ID NO: 290165 - DNA, 32 bp, Artificial Sequence
  Description of Artificial Sequence: Synthetic oligonucleotide
caacaacgtgcgccttatcagactggctaaag

SEQ ID NO: 290166 - DNA, 33 bp, Artificial Sequence
  Description of Artificial Sequence: Synthetic oligonucleotide
aacaacgtgcgccttatcagactggctaaagac

SEQ ID NO: 290167 - DNA, 32 bp, Artificial Sequence
  Description of Artificial Sequence: Synthetic oligonucleotide
acaacgtgcgccttatcagactggctaaagac

SEQ ID NO: 290168 - DNA, 31 bp, Artificial Sequence
  Description of Artificial Sequence: Synthetic oligonucleotide
caacgtgcgccttatcagactggctaaagac

SEQ ID NO: 290169 - DNA, 32 bp, Artificial Sequence
  Description of Artificial Sequence: Synthetic oligonucleotide
aacgtgcgccttatcagactggctaaagactg

SEQ ID NO: 290170 - DNA, 31 bp, Artificial Sequence
  Description of Artificial Sequence: Synthetic oligonucleotide
acgtgcgccttatcagactggctaaagactg

SEQ ID NO: 290171 - DNA, 30 bp, Artificial Sequence
  Description of Artificial Sequence: Synthetic oligonucleotide
cgtgcgccttatcagactggctaaagactg

SEQ ID NO: 290172 - DNA, 31 bp, Artificial Sequence
  Description of Artificial Sequence: Synthetic oligonucleotide
gtgcgccttatcagactggctaaagactgtg

SEQ ID NO: 290173 - DNA, 33 bp, Artificial Sequence
  Description of Artificial Sequence: Synthetic oligonucleotide
tgcgccttatcagactggctaaagactgtgaac

SEQ ID NO: 290174 - DNA, 32 bp, Artificial Sequence
  Description of Artificial Sequence: Synthetic oligonucleotide
gcgccttatcagactggctaaagactgtgaac

SEQ ID NO: 290175 - DNA, 33 bp, Artificial Sequence
  Description of Artificial Sequence: Synthetic oligonucleotide
cgccttatcagactggctaaagactgtgaactg

SEQ ID NO: 290176 - DNA, 33 bp, Artificial Sequence
  Description of Artificial Sequence: Synthetic oligonucleotide
gccttatcagactggctaaagactgtgaactgc

SEQ ID NO: 290177 - DNA, 34 bp, Artificial Sequence
  Description of Artificial Sequence: Synthetic oligonucleotide
ccttatcagactggctaaagactgtgaactgctg

SEQ ID NO: 290178 - DNA, 35 bp, Artificial Sequence
  Description of Artificial Sequence: Synthetic oligonucleotide
cttatcagactggctaaagactgtgaactgctgac

SEQ ID NO: 290179 - DNA, 35 bp, Artificial Sequence
  Description of Artificial Sequence: Synthetic oligonucleotide
ttatcagactggctaaagactgtgaactgctgacc

SEQ ID NO: 290180 - DNA, 34 bp, Artificial Sequence
  Description of Artificial Sequence: Synthetic oligonucleotide
tatcagactggctaaagactgtgaactgctgacc

SEQ ID NO: 290181 - DNA, 33 bp, Artificial Sequence
  Description of Artificial Sequence: Synthetic oligonucleotide
atcagactggctaaagactgtgaactgctgacc

SEQ ID NO: 290182 - DNA, 32 bp, Artificial Sequence
  Description of Artificial Sequence: Synthetic oligonucleotide
tcagactggctaaagactgtgaactgctgacc

SEQ ID NO: 290183 - DNA, 31 bp, Artificial Sequence
  Description of Artificial Sequence: Synthetic oligonucleotide
cagactggctaaagactgtgaactgctgacc

SEQ ID NO: 290184 - DNA, 32 bp, Artificial Sequence
  Description of Artificial Sequence: Synthetic oligonucleotide
agactggctaaagactgtgaactgctgaccag

SEQ ID NO: 290185 - DNA, 31 bp, Artificial Sequence
  Description of Artificial Sequence: Synthetic oligonucleotide
gactggctaaagactgtgaactgctgaccag

SEQ ID NO: 290186 - DNA, 32 bp, Artificial Sequence
  Description of Artificial Sequence: Synthetic oligonucleotide
actggctaaagactgtgaactgctgaccagac

SEQ ID NO: 290187 - DNA, 31 bp, Artificial Sequence
  Description of Artificial Sequence: Synthetic oligonucleotide
ctggctaaagactgtgaactgctgaccagac

SEQ ID NO: 290188 - DNA, 32 bp, Artificial Sequence
  Description of Artificial Sequence: Synthetic oligonucleotide
tggctaaagactgtgaactgctgaccagactc

SEQ ID NO: 290189 - DNA, 31 bp, Artificial Sequence
  Description of Artificial Sequence: Synthetic oligonucleotide
ggctaaagactgtgaactgctgaccagactc

SEQ ID NO: 290190 - DNA, 32 bp, Artificial Sequence
  Description of Artificial Sequence: Synthetic oligonucleotide
gctaaagactgtgaactgctgaccagactcac

SEQ ID NO: 290191 - DNA, 32 bp, Artificial Sequence
  Description of Artificial Sequence: Synthetic oligonucleotide
ctaaagactgtgaactgctgaccagactcacc

SEQ ID NO: 290192 - DNA, 32 bp, Artificial Sequence
  Description of Artificial Sequence: Synthetic oligonucleotide
taaagactgtgaactgctgaccagactcaccc

SEQ ID NO: 290193 - DNA, 31 bp, Artificial Sequence
  Description of Artificial Sequence: Synthetic oligonucleotide
aaagactgtgaactgctgaccagactcaccc

SEQ ID NO: 290194 - DNA, 30 bp, Artificial Sequence
  Description of Artificial Sequence: Synthetic oligonucleotide
aagactgtgaactgctgaccagactcaccc

SEQ ID NO: 290195 - DNA, 29 bp, Artificial Sequence
  Description of Artificial Sequence: Synthetic oligonucleotide
agactgtgaactgctgaccagactcaccc

SEQ ID NO: 290196 - DNA, 28 bp, Artificial Sequence
  Description of Artificial Sequence: Synthetic oligonucleotide
gactgtgaactgctgaccagactcaccc

SEQ ID NO: 290197 - DNA, 28 bp, Artificial Sequence
  Description of Artificial Sequence: Synthetic oligonucleotide
actgtgaactgctgaccagactcacccc

SEQ ID NO: 290198 - DNA, 27 bp, Artificial Sequence
  Description of Artificial Sequence: Synthetic oligonucleotide
ctgtgaactgctgaccagactcacccc

SEQ ID NO: 290199 - DNA, 28 bp, Artificial Sequence
  Description of Artificial Sequence: Synthetic oligonucleotide
tgtgaactgctgaccagactcacccctg

SEQ ID NO: 290200 - DNA, 27 bp, Artificial Sequence
  Description of Artificial Sequence: Synthetic oligonucleotide
gtgaactgctgaccagactcacccctg

SEQ ID NO: 290201 - DNA, 28 bp, Artificial Sequence
  Description of Artificial Sequence: Synthetic oligonucleotide
tgaactgctgaccagactcacccctgac

SEQ ID NO: 290202 - DNA, 27 bp, Artificial Sequence
  Description of Artificial Sequence: Synthetic oligonucleotide
gaactgctgaccagactcacccctgac

SEQ ID NO: 290203 - DNA, 28 bp, Artificial Sequence
  Description of Artificial Sequence: Synthetic oligonucleotide
aactgctgaccagactcacccctgacac

SEQ ID NO: 290204 - DNA, 27 bp, Artificial Sequence
  Description of Artificial Sequence: Synthetic oligonucleotide
actgctgaccagactcacccctgacac

SEQ ID NO: 290205 - DNA, 27 bp, Artificial Sequence
  Description of Artificial Sequence: Synthetic oligonucleotide
ctgctgaccagactcacccctgacact

SEQ ID NO: 290206 - DNA, 27 bp, Artificial Sequence
  Description of Artificial Sequence: Synthetic oligonucleotide
tgctgaccagactcacccctgacactg

SEQ ID NO: 290207 - DNA, 26 bp, Artificial Sequence
  Description of Artificial Sequence: Synthetic oligonucleotide
gctgaccagactcacccctgacactg

SEQ ID NO: 290208 - DNA, 26 bp, Artificial Sequence
  Description of Artificial Sequence: Synthetic oligonucleotide
ctgaccagactcacccctgacactgg

SEQ ID NO: 290209 - DNA, 26 bp, Artificial Sequence
  Description of Artificial Sequence: Synthetic oligonucleotide
tgaccagactcacccctgacactggc

SEQ ID NO: 290210 - DNA, 25 bp, Artificial Sequence
  Description of Artificial Sequence: Synthetic oligonucleotide
gaccagactcacccctgacactggc

SEQ ID NO: 290211 - DNA, 25 bp, Artificial Sequence
  Description of Artificial Sequence: Synthetic oligonucleotide
accagactcacccctgacactggcg

SEQ ID NO: 290212 - DNA, 24 bp, Artificial Sequence
  Description of Artificial Sequence: Synthetic oligonucleotide
ccagactcacccctgacactggcg

SEQ ID NO: 290213 - DNA, 27 bp, Artificial Sequence
  Description of Artificial Sequence: Synthetic oligonucleotide
cagactcacccctgacactggcggtat

SEQ ID NO: 290214 - DNA, 27 bp, Artificial Sequence
  Description of Artificial Sequence: Synthetic oligonucleotide
agactcacccctgacactggcggtatc

SEQ ID NO: 290215 - DNA, 26 bp, Artificial Sequence
  Description of Artificial Sequence: Synthetic oligonucleotide
gactcacccctgacactggcggtatc

SEQ ID NO: 290216 - DNA, 27 bp, Artificial Sequence
  Description of Artificial Sequence: Synthetic oligonucleotide
actcacccctgacactggcggtatcct

SEQ ID NO: 290217 - DNA, 26 bp, Artificial Sequence
  Description of Artificial Sequence: Synthetic oligonucleotide
ctcacccctgacactggcggtatcct

SEQ ID NO: 290218 - DNA, 27 bp, Artificial Sequence
  Description of Artificial Sequence: Synthetic oligonucleotide
tcacccctgacactggcggtatcctgt

SEQ ID NO: 290219 - DNA, 26 bp, Artificial Sequence
  Description of Artificial Sequence: Synthetic oligonucleotide
cacccctgacactggcggtatcctgt

SEQ ID NO: 290220 - DNA, 26 bp, Artificial Sequence
  Description of Artificial Sequence: Synthetic oligonucleotide
acccctgacactggcggtatcctgtg

SEQ ID NO: 290221 - DNA, 25 bp, Artificial Sequence
  Description of Artificial Sequence: Synthetic oligonucleotide
cccctgacactggcggtatcctgtg

SEQ ID NO: 290222 - DNA, 27 bp, Artificial Sequence
  Description of Artificial Sequence: Synthetic oligonucleotide
ccctgacactggcggtatcctgtgcaa

SEQ ID NO: 290223 - DNA, 27 bp, Artificial Sequence
  Description of Artificial Sequence: Synthetic oligonucleotide
cctgacactggcggtatcctgtgcaag

SEQ ID NO: 290224 - DNA, 27 bp, Artificial Sequence
  Description of Artificial Sequence: Synthetic oligonucleotide
ctgacactggcggtatcctgtgcaagc

SEQ ID NO: 290225 - DNA, 29 bp, Artificial Sequence
  Description of Artificial Sequence: Synthetic oligonucleotide
tgacactggcggtatcctgtgcaagctac

SEQ ID NO: 290226 - DNA, 28 bp, Artificial Sequence
  Description of Artificial Sequence: Synthetic oligonucleotide
gacactggcggtatcctgtgcaagctac

SEQ ID NO: 290227 - DNA, 31 bp, Artificial Sequence
  Description of Artificial Sequence: Synthetic oligonucleotide
acactggcggtatcctgtgcaagctacaaac

SEQ ID NO: 290228 - DNA, 30 bp, Artificial Sequence
  Description of Artificial Sequence: Synthetic oligonucleotide
cactggcggtatcctgtgcaagctacaaac

SEQ ID NO: 290229 - DNA, 31 bp, Artificial Sequence
  Description of Artificial Sequence: Synthetic oligonucleotide
actggcggtatcctgtgcaagctacaaactg

SEQ ID NO: 290230 - DNA, 30 bp, Artificial Sequence
  Description of Artificial Sequence: Synthetic oligonucleotide
ctggcggtatcctgtgcaagctacaaactg

SEQ ID NO: 290231 - DNA, 31 bp, Artificial Sequence
  Description of Artificial Sequence: Synthetic oligonucleotide
tggcggtatcctgtgcaagctacaaactgtc

SEQ ID NO: 290232 - DNA, 30 bp, Artificial Sequence
  Description of Artificial Sequence: Synthetic oligonucleotide
ggcggtatcctgtgcaagctacaaactgtc

SEQ ID NO: 290233 - DNA, 30 bp, Artificial Sequence
  Description of Artificial Sequence: Synthetic oligonucleotide
gcggtatcctgtgcaagctacaaactgtcc

SEQ ID NO: 290234 - DNA, 32 bp, Artificial Sequence
  Description of Artificial Sequence: Synthetic oligonucleotide
cggtatcctgtgcaagctacaaactgtccaag

SEQ ID NO: 290235 - DNA, 32 bp, Artificial Sequence
  Description of Artificial Sequence: Synthetic oligonucleotide
ggtatcctgtgcaagctacaaactgtccaagc

SEQ ID NO: 290236 - DNA, 32 bp, Artificial Sequence
  Description of Artificial Sequence: Synthetic oligonucleotide
gtatcctgtgcaagctacaaactgtccaagcc

SEQ ID NO: 290237 - DNA, 34 bp, Artificial Sequence
  Description of Artificial Sequence: Synthetic oligonucleotide
tatcctgtgcaagctacaaactgtccaagccaag

SEQ ID NO: 290238 - DNA, 33 bp, Artificial Sequence
  Description of Artificial Sequence: Synthetic oligonucleotide
atcctgtgcaagctacaaactgtccaagccaag

SEQ ID NO: 290239 - DNA, 32 bp, Artificial Sequence
  Description of Artificial Sequence: Synthetic oligonucleotide
tcctgtgcaagctacaaactgtccaagccaag

SEQ ID NO: 290240 - DNA, 31 bp, Artificial Sequence
  Description of Artificial Sequence: Synthetic oligonucleotide
cctgtgcaagctacaaactgtccaagccaag

SEQ ID NO: 290241 - DNA, 31 bp, Artificial Sequence
  Description of Artificial Sequence: Synthetic oligonucleotide
ctgtgcaagctacaaactgtccaagccaagg

SEQ ID NO: 290242 - DNA, 31 bp, Artificial Sequence
  Description of Artificial Sequence: Synthetic oligonucleotide
tgtgcaagctacaaactgtccaagccaaggg

SEQ ID NO: 290243 - DNA, 30 bp, Artificial Sequence
  Description of Artificial Sequence: Synthetic oligonucleotide
gtgcaagctacaaactgtccaagccaaggg

SEQ ID NO: 290244 - DNA, 30 bp, Artificial Sequence
  Description of Artificial Sequence: Synthetic oligonucleotide
tgcaagctacaaactgtccaagccaagggc

SEQ ID NO: 290245 - DNA, 29 bp, Artificial Sequence
  Description of Artificial Sequence: Synthetic oligonucleotide
gcaagctacaaactgtccaagccaagggc

SEQ ID NO: 290246 - DNA, 31 bp, Artificial Sequence
  Description of Artificial Sequence: Synthetic oligonucleotide
caagctacaaactgtccaagccaagggcatg

SEQ ID NO: 290247 - DNA, 33 bp, Artificial Sequence
  Description of Artificial Sequence: Synthetic oligonucleotide
aagctacaaactgtccaagccaagggcatgatc

SEQ ID NO: 290248 - DNA, 32 bp, Artificial Sequence
  Description of Artificial Sequence: Synthetic oligonucleotide
agctacaaactgtccaagccaagggcatgatc

SEQ ID NO: 290249 - DNA, 31 bp, Artificial Sequence
  Description of Artificial Sequence: Synthetic oligonucleotide
gctacaaactgtccaagccaagggcatgatc

SEQ ID NO: 290250 - DNA, 32 bp, Artificial Sequence
  Description of Artificial Sequence: Synthetic oligonucleotide
ctacaaactgtccaagccaagggcatgatcac

SEQ ID NO: 290251 - DNA, 32 bp, Artificial Sequence
  Description of Artificial Sequence: Synthetic oligonucleotide
tacaaactgtccaagccaagggcatgatcacc

SEQ ID NO: 290252 - DNA, 31 bp, Artificial Sequence
  Description of Artificial Sequence: Synthetic oligonucleotide
acaaactgtccaagccaagggcatgatcacc

SEQ ID NO: 290253 - DNA, 30 bp, Artificial Sequence
  Description of Artificial Sequence: Synthetic oligonucleotide
caaactgtccaagccaagggcatgatcacc

SEQ ID NO: 290254 - DNA, 32 bp, Artificial Sequence
  Description of Artificial Sequence: Synthetic oligonucleotide
aaactgtccaagccaagggcatgatcaccttg

SEQ ID NO: 290255 - DNA, 31 bp, Artificial Sequence
  Description of Artificial Sequence: Synthetic oligonucleotide
aactgtccaagccaagggcatgatcaccttg

SEQ ID NO: 290256 - DNA, 30 bp, Artificial Sequence
  Description of Artificial Sequence: Synthetic oligonucleotide
actgtccaagccaagggcatgatcaccttg

SEQ ID NO: 290257 - DNA, 29 bp, Artificial Sequence
  Description of Artificial Sequence: Synthetic oligonucleotide
ctgtccaagccaagggcatgatcaccttg

SEQ ID NO: 290258 - DNA, 30 bp, Artificial Sequence
  Description of Artificial Sequence: Synthetic oligonucleotide
tgtccaagccaagggcatgatcaccttgtg

SEQ ID NO: 290259 - DNA, 29 bp, Artificial Sequence
  Description of Artificial Sequence: Synthetic oligonucleotide
gtccaagccaagggcatgatcaccttgtg

SEQ ID NO: 290260 - DNA, 29 bp, Artificial Sequence
  Description of Artificial Sequence: Synthetic oligonucleotide
tccaagccaagggcatgatcaccttgtgc

SEQ ID NO: 290261 - DNA, 28 bp, Artificial Sequence
  Description of Artificial Sequence: Synthetic oligonucleotide
ccaagccaagggcatgatcaccttgtgc

SEQ ID NO: 290262 - DNA, 29 bp, Artificial Sequence
  Description of Artificial Sequence: Synthetic oligonucleotide
caagccaagggcatgatcaccttgtgcac

SEQ ID NO: 290263 - DNA, 29 bp, Artificial Sequence
  Description of Artificial Sequence: Synthetic oligonucleotide
aagccaagggcatgatcaccttgtgcacg

SEQ ID NO: 290264 - DNA, 28 bp, Artificial Sequence
  Description of Artificial Sequence: Synthetic oligonucleotide
agccaagggcatgatcaccttgtgcacg

SEQ ID NO: 290265 - DNA, 27 bp, Artificial Sequence
  Description of Artificial Sequence: Synthetic oligonucleotide
gccaagggcatgatcaccttgtgcacg

SEQ ID NO: 290266 - DNA, 27 bp, Artificial Sequence
  Description of Artificial Sequence: Synthetic oligonucleotide
ccaagggcatgatcaccttgtgcacgg

SEQ ID NO: 290267 - DNA, 27 bp, Artificial Sequence
  Description of Artificial Sequence: Synthetic oligonucleotide
caagggcatgatcaccttgtgcacggg

SEQ ID NO: 290268 - DNA, 27 bp, Artificial Sequence
  Description of Artificial Sequence: Synthetic oligonucleotide
aagggcatgatcaccttgtgcacgggc

SEQ ID NO: 290269 - DNA, 27 bp, Artificial Sequence
  Description of Artificial Sequence: Synthetic oligonucleotide
agggcatgatcaccttgtgcacgggct

SEQ ID NO: 290270 - DNA, 27 bp, Artificial Sequence
  Description of Artificial Sequence: Synthetic oligonucleotide
gggcatgatcaccttgtgcacgggctt

SEQ ID NO: 290271 - DNA, 27 bp, Artificial Sequence
  Description of Artificial Sequence: Synthetic oligonucleotide
ggcatgatcaccttgtgcacgggcttc

SEQ ID NO: 290272 - DNA, 27 bp, Artificial Sequence
  Description of Artificial Sequence: Synthetic oligonucleotide
gcatgatcaccttgtgcacgggcttcc

SEQ ID NO: 290273 - DNA, 27 bp, Artificial Sequence
  Description of Artificial Sequence: Synthetic oligonucleotide
catgatcaccttgtgcacgggcttccg

SEQ ID NO: 290274 - DNA, 27 bp, Artificial Sequence
  Description of Artificial Sequence: Synthetic oligonucleotide
atgatcaccttgtgcacgggcttccgc

SEQ ID NO: 290275 - DNA, 26 bp, Artificial Sequence
  Description of Artificial Sequence: Synthetic oligonucleotide
tgatcaccttgtgcacgggcttccgc

SEQ ID NO: 290276 - DNA, 25 bp, Artificial Sequence
  Description of Artificial Sequence: Synthetic oligonucleotide
gatcaccttgtgcacgggcttccgc

SEQ ID NO: 290277 - DNA, 26 bp, Artificial Sequence
  Description of Artificial Sequence: Synthetic oligonucleotide
atcaccttgtgcacgggcttccgcgt

SEQ ID NO: 290278 - DNA, 25 bp, Artificial Sequence
  Description of Artificial Sequence: Synthetic oligonucleotide
tcaccttgtgcacgggcttccgcgt

SEQ ID NO: 290279 - DNA, 24 bp, Artificial Sequence
  Description of Artificial Sequence: Synthetic oligonucleotide
caccttgtgcacgggcttccgcgt

SEQ ID NO: 290280 - DNA, 24 bp, Artificial Sequence
  Description of Artificial Sequence: Synthetic oligonucleotide
accttgtgcacgggcttccgcgtg

SEQ ID NO: 290281 - DNA, 23 bp, Artificial Sequence
  Description of Artificial Sequence: Synthetic oligonucleotide
ccttgtgcacgggcttccgcgtg

SEQ ID NO: 290282 - DNA, 23 bp, Artificial Sequence
  Description of Artificial Sequence: Synthetic oligonucleotide
cttgtgcacgggcttccgcgtgg

SEQ ID NO: 290283 - DNA, 23 bp, Artificial Sequence
  Description of Artificial Sequence: Synthetic oligonucleotide
ttgtgcacgggcttccgcgtggg

SEQ ID NO: 290284 - DNA, 22 bp, Artificial Sequence
  Description of Artificial Sequence: Synthetic oligonucleotide
tgtgcacgggcttccgcgtggg

SEQ ID NO: 290285 - DNA, 21 bp, Artificial Sequence
  Description of Artificial Sequence: Synthetic oligonucleotide
gtgcacgggcttccgcgtggg

SEQ ID NO: 290286 - DNA, 21 bp, Artificial Sequence
  Description of Artificial Sequence: Synthetic oligonucleotide
tgcacgggcttccgcgtgggc

SEQ ID NO: 290287 - DNA, 20 bp, Artificial Sequence
  Description of Artificial Sequence: Synthetic oligonucleotide
gcacgggcttccgcgtgggc

SEQ ID NO: 290288 - DNA, 22 bp, Artificial Sequence
  Description of Artificial Sequence: Synthetic oligonucleotide
cacgggcttccgcgtgggccat

SEQ ID NO: 290289 - DNA, 23 bp, Artificial Sequence
  Description of Artificial Sequence: Synthetic oligonucleotide
acgggcttccgcgtgggccatct

SEQ ID NO: 290290 - DNA, 22 bp, Artificial Sequence
  Description of Artificial Sequence: Synthetic oligonucleotide
cgggcttccgcgtgggccatct

SEQ ID NO: 290291 - DNA, 22 bp, Artificial Sequence
  Description of Artificial Sequence: Synthetic oligonucleotide
gggcttccgcgtgggccatctg

SEQ ID NO: 290292 - DNA, 22 bp, Artificial Sequence
  Description of Artificial Sequence: Synthetic oligonucleotide
ggcttccgcgtgggccatctgg

SEQ ID NO: 290293 - DNA, 23 bp, Artificial Sequence
  Description of Artificial Sequence: Synthetic oligonucleotide
gcttccgcgtgggccatctggca

SEQ ID NO: 290294 - DNA, 24 bp, Artificial Sequence
  Description of Artificial Sequence: Synthetic oligonucleotide
cttccgcgtgggccatctggcact

SEQ ID NO: 290295 - DNA, 26 bp, Artificial Sequence
  Description of Artificial Sequence: Synthetic oligonucleotide
ttccgcgtgggccatctggcactgaa

SEQ ID NO: 290296 - DNA, 25 bp, Artificial Sequence
  Description of Artificial Sequence: Synthetic oligonucleotide
tccgcgtgggccatctggcactgaa

SEQ ID NO: 290297 - DNA, 24 bp, Artificial Sequence
  Description of Artificial Sequence: Synthetic oligonucleotide
ccgcgtgggccatctggcactgaa

SEQ ID NO: 290298 - DNA, 24 bp, Artificial Sequence
  Description of Artificial Sequence: Synthetic oligonucleotide
cgcgtgggccatctggcactgaag

SEQ ID NO: 290299 - DNA, 25 bp, Artificial Sequence
  Description of Artificial Sequence: Synthetic oligonucleotide
gcgtgggccatctggcactgaagca

SEQ ID NO: 290300 - DNA, 25 bp, Artificial Sequence
  Description of Artificial Sequence: Synthetic oligonucleotide
cgtgggccatctggcactgaagcac

SEQ ID NO: 290301 - DNA, 25 bp, Artificial Sequence
  Description of Artificial Sequence: Synthetic oligonucleotide
gtgggccatctggcactgaagcacg

SEQ ID NO: 290302 - DNA, 26 bp, Artificial Sequence
  Description of Artificial Sequence: Synthetic oligonucleotide
tgggccatctggcactgaagcacgga

SEQ ID NO: 290303 - DNA, 25 bp, Artificial Sequence
  Description of Artificial Sequence: Synthetic oligonucleotide
gggccatctggcactgaagcacgga

SEQ ID NO: 290304 - DNA, 27 bp, Artificial Sequence
  Description of Artificial Sequence: Synthetic oligonucleotide
ggccatctggcactgaagcacggacaa

SEQ ID NO: 290305 - DNA, 27 bp, Artificial Sequence
  Description of Artificial Sequence: Synthetic oligonucleotide
gccatctggcactgaagcacggacaag

SEQ ID NO: 290306 - DNA, 27 bp, Artificial Sequence
  Description of Artificial Sequence: Synthetic oligonucleotide
ccatctggcactgaagcacggacaagg

SEQ ID NO: 290307 - DNA, 27 bp, Artificial Sequence
  Description of Artificial Sequence: Synthetic oligonucleotide
catctggcactgaagcacggacaaggc

SEQ ID NO: 290308 - DNA, 29 bp, Artificial Sequence
  Description of Artificial Sequence: Synthetic oligonucleotide
atctggcactgaagcacggacaaggcatg

SEQ ID NO: 290309 - DNA, 28 bp, Artificial Sequence
  Description of Artificial Sequence: Synthetic oligonucleotide
tctggcactgaagcacggacaaggcatg

SEQ ID NO: 290310 - DNA, 27 bp, Artificial Sequence
  Description of Artificial Sequence: Synthetic oligonucleotide
ctggcactgaagcacggacaaggcatg

SEQ ID NO: 290311 - DNA, 30 bp, Artificial Sequence
  Description of Artificial Sequence: Synthetic oligonucleotide
tggcactgaagcacggacaaggcatgaatc

SEQ ID NO: 290312 - DNA, 29 bp, Artificial Sequence
  Description of Artificial Sequence: Synthetic oligonucleotide
ggcactgaagcacggacaaggcatgaatc

SEQ ID NO: 290313 - DNA, 30 bp, Artificial Sequence
  Description of Artificial Sequence: Synthetic oligonucleotide
gcactgaagcacggacaaggcatgaatcac

SEQ ID NO: 290314 - DNA, 32 bp, Artificial Sequence
  Description of Artificial Sequence: Synthetic oligonucleotide
cactgaagcacggacaaggcatgaatcacaac

SEQ ID NO: 290315 - DNA, 34 bp, Artificial Sequence
  Description of Artificial Sequence: Synthetic oligonucleotide
actgaagcacggacaaggcatgaatcacaacatg

SEQ ID NO: 290316 - DNA, 33 bp, Artificial Sequence
  Description of Artificial Sequence: Synthetic oligonucleotide
ctgaagcacggacaaggcatgaatcacaacatg

SEQ ID NO: 290317 - DNA, 33 bp, Artificial Sequence
  Description of Artificial Sequence: Synthetic oligonucleotide
tgaagcacggacaaggcatgaatcacaacatgc

SEQ ID NO: 290318 - DNA, 32 bp, Artificial Sequence
  Description of Artificial Sequence: Synthetic oligonucleotide
gaagcacggacaaggcatgaatcacaacatgc

SEQ ID NO: 290319 - DNA, 32 bp, Artificial Sequence
  Description of Artificial Sequence: Synthetic oligonucleotide
aagcacggacaaggcatgaatcacaacatgcg

SEQ ID NO: 290320 - DNA, 31 bp, Artificial Sequence
  Description of Artificial Sequence: Synthetic oligonucleotide
agcacggacaaggcatgaatcacaacatgcg

SEQ ID NO: 290321 - DNA, 30 bp, Artificial Sequence
  Description of Artificial Sequence: Synthetic oligonucleotide
gcacggacaaggcatgaatcacaacatgcg

SEQ ID NO: 290322 - DNA, 30 bp, Artificial Sequence
  Description of Artificial Sequence: Synthetic oligonucleotide
cacggacaaggcatgaatcacaacatgcgc

SEQ ID NO: 290323 - DNA, 32 bp, Artificial Sequence
  Description of Artificial Sequence: Synthetic oligonucleotide
acggacaaggcatgaatcacaacatgcgcatc

SEQ ID NO: 290324 - DNA, 31 bp, Artificial Sequence
  Description of Artificial Sequence: Synthetic oligonucleotide
cggacaaggcatgaatcacaacatgcgcatc

SEQ ID NO: 290325 - DNA, 34 bp, Artificial Sequence
  Description of Artificial Sequence: Synthetic oligonucleotide
ggacaaggcatgaatcacaacatgcgcatctttg

SEQ ID NO: 290326 - DNA, 34 bp, Artificial Sequence
  Description of Artificial Sequence: Synthetic oligonucleotide
gacaaggcatgaatcacaacatgcgcatctttgc

SEQ ID NO: 290327 - DNA, 34 bp, Artificial Sequence
  Description of Artificial Sequence: Synthetic oligonucleotide
acaaggcatgaatcacaacatgcgcatctttgcc

SEQ ID NO: 290328 - DNA, 33 bp, Artificial Sequence
  Description of Artificial Sequence: Synthetic oligonucleotide
caaggcatgaatcacaacatgcgcatctttgcc

SEQ ID NO: 290329 - DNA, 36 bp, Artificial Sequence
  Description of Artificial Sequence: Synthetic oligonucleotide
aaggcatgaatcacaacatgcgcatctttgcctttg

SEQ ID NO: 290330 - DNA, 35 bp, Artificial Sequence
  Description of Artificial Sequence: Synthetic oligonucleotide
aggcatgaatcacaacatgcgcatctttgcctttg

SEQ ID NO: 290331 - DNA, 34 bp, Artificial Sequence
  Description of Artificial Sequence: Synthetic oligonucleotide
ggcatgaatcacaacatgcgcatctttgcctttg

SEQ ID NO: 290332 - DNA, 35 bp, Artificial Sequence
  Description of Artificial Sequence: Synthetic oligonucleotide
gcatgaatcacaacatgcgcatctttgcctttgag

SEQ ID NO: 290333 - DNA, 35 bp, Artificial Sequence
  Description of Artificial Sequence: Synthetic oligonucleotide
catgaatcacaacatgcgcatctttgcctttgagg

SEQ ID NO: 290334 - DNA, 35 bp, Artificial Sequence
  Description of Artificial Sequence: Synthetic oligonucleotide
atgaatcacaacatgcgcatctttgcctttgaggg

SEQ ID NO: 290335 - DNA, 34 bp, Artificial Sequence
  Description of Artificial Sequence: Synthetic oligonucleotide
tgaatcacaacatgcgcatctttgcctttgaggg

SEQ ID NO: 290336 - DNA, 33 bp, Artificial Sequence
  Description of Artificial Sequence: Synthetic oligonucleotide
gaatcacaacatgcgcatctttgcctttgaggg

SEQ ID NO: 290337 - DNA, 35 bp, Artificial Sequence
  Description of Artificial Sequence: Synthetic oligonucleotide
aatcacaacatgcgcatctttgcctttgagggaag

SEQ ID NO: 290338 - DNA, 34 bp, Artificial Sequence
  Description of Artificial Sequence: Synthetic oligonucleotide
atcacaacatgcgcatctttgcctttgagggaag

SEQ ID NO: 290339 - DNA, 33 bp, Artificial Sequence
  Description of Artificial Sequence: Synthetic oligonucleotide
tcacaacatgcgcatctttgcctttgagggaag

SEQ ID NO: 290340 - DNA, 32 bp, Artificial Sequence
  Description of Artificial Sequence: Synthetic oligonucleotide
cacaacatgcgcatctttgcctttgagggaag

SEQ ID NO: 290341 - DNA, 32 bp, Artificial Sequence
  Description of Artificial Sequence: Synthetic oligonucleotide
acaacatgcgcatctttgcctttgagggaagc

SEQ ID NO: 290342 - DNA, 31 bp, Artificial Sequence
  Description of Artificial Sequence: Synthetic oligonucleotide
caacatgcgcatctttgcctttgagggaagc

SEQ ID NO: 290343 - DNA, 31 bp, Artificial Sequence
  Description of Artificial Sequence: Synthetic oligonucleotide
aacatgcgcatctttgcctttgagggaagcc

SEQ ID NO: 290344 - DNA, 30 bp, Artificial Sequence
  Description of Artificial Sequence: Synthetic oligonucleotide
acatgcgcatctttgcctttgagggaagcc

SEQ ID NO: 290345 - DNA, 29 bp, Artificial Sequence
  Description of Artificial Sequence: Synthetic oligonucleotide
catgcgcatctttgcctttgagggaagcc

SEQ ID NO: 290346 - DNA, 29 bp, Artificial Sequence
  Description of Artificial Sequence: Synthetic oligonucleotide
atgcgcatctttgcctttgagggaagccc

SEQ ID NO: 290347 - DNA, 28 bp, Artificial Sequence
  Description of Artificial Sequence: Synthetic oligonucleotide
tgcgcatctttgcctttgagggaagccc

SEQ ID NO: 290348 - DNA, 27 bp, Artificial Sequence
  Description of Artificial Sequence: Synthetic oligonucleotide
gcgcatctttgcctttgagggaagccc

SEQ ID NO: 290349 - DNA, 28 bp, Artificial Sequence
  Description of Artificial Sequence: Synthetic oligonucleotide
cgcatctttgcctttgagggaagccctg

SEQ ID NO: 290350 - DNA, 29 bp, Artificial Sequence
  Description of Artificial Sequence: Synthetic oligonucleotide
gcatctttgcctttgagggaagccctgtg

SEQ ID NO: 290351 - DNA, 29 bp, Artificial Sequence
  Description of Artificial Sequence: Synthetic oligonucleotide
catctttgcctttgagggaagccctgtgg

SEQ ID NO: 290352 - DNA, 30 bp, Artificial Sequence
  Description of Artificial Sequence: Synthetic oligonucleotide
atctttgcctttgagggaagccctgtggag

SEQ ID NO: 290353 - DNA, 29 bp, Artificial Sequence
  Description of Artificial Sequence: Synthetic oligonucleotide
tctttgcctttgagggaagccctgtggag

SEQ ID NO: 290354 - DNA, 28 bp, Artificial Sequence
  Description of Artificial Sequence: Synthetic oligonucleotide
ctttgcctttgagggaagccctgtggag

SEQ ID NO: 290355 - DNA, 28 bp, Artificial Sequence
  Description of Artificial Sequence: Synthetic oligonucleotide
tttgcctttgagggaagccctgtggagg

SEQ ID NO: 290356 - DNA, 27 bp, Artificial Sequence
  Description of Artificial Sequence: Synthetic oligonucleotide
ttgcctttgagggaagccctgtggagg

SEQ ID NO: 290357 - DNA, 27 bp, Artificial Sequence
  Description of Artificial Sequence: Synthetic oligonucleotide
tgcctttgagggaagccctgtggagga

SEQ ID NO: 290358 - DNA, 26 bp, Artificial Sequence
  Description of Artificial Sequence: Synthetic oligonucleotide
gcctttgagggaagccctgtggagga

SEQ ID NO: 290359 - DNA, 27 bp, Artificial Sequence
  Description of Artificial Sequence: Synthetic oligonucleotide
cctttgagggaagccctgtggaggact

SEQ ID NO: 290360 - DNA, 29 bp, Artificial Sequence
  Description of Artificial Sequence: Synthetic oligonucleotide
ctttgagggaagccctgtggaggactatg

SEQ ID NO: 290361 - DNA, 30 bp, Artificial Sequence
  Description of Artificial Sequence: Synthetic oligonucleotide
tttgagggaagccctgtggaggactatgag

SEQ ID NO: 290362 - DNA, 29 bp, Artificial Sequence
  Description of Artificial Sequence: Synthetic oligonucleotide
ttgagggaagccctgtggaggactatgag

SEQ ID NO: 290363 - DNA, 28 bp, Artificial Sequence
  Description of Artificial Sequence: Synthetic oligonucleotide
tgagggaagccctgtggaggactatgag

SEQ ID NO: 290364 - DNA, 27 bp, Artificial Sequence
  Description of Artificial Sequence: Synthetic oligonucleotide
gagggaagccctgtggaggactatgag

SEQ ID NO: 290365 - DNA, 29 bp, Artificial Sequence
  Description of Artificial Sequence: Synthetic oligonucleotide
agggaagccctgtggaggactatgagaag

SEQ ID NO: 290366 - DNA, 28 bp, Artificial Sequence
  Description of Artificial Sequence: Synthetic oligonucleotide
gggaagccctgtggaggactatgagaag

SEQ ID NO: 290367 - DNA, 28 bp, Artificial Sequence
  Description of Artificial Sequence: Synthetic oligonucleotide
ggaagccctgtggaggactatgagaagg

SEQ ID NO: 290368 - DNA, 30 bp, Artificial Sequence
  Description of Artificial Sequence: Synthetic oligonucleotide
gaagccctgtggaggactatgagaaggttc

SEQ ID NO: 290369 - DNA, 31 bp, Artificial Sequence
  Description of Artificial Sequence: Synthetic oligonucleotide
aagccctgtggaggactatgagaaggttctg

SEQ ID NO: 290370 - DNA, 30 bp, Artificial Sequence
  Description of Artificial Sequence: Synthetic oligonucleotide
agccctgtggaggactatgagaaggttctg

SEQ ID NO: 290371 - DNA, 29 bp, Artificial Sequence
  Description of Artificial Sequence: Synthetic oligonucleotide
gccctgtggaggactatgagaaggttctg

SEQ ID NO: 290372 - DNA, 29 bp, Artificial Sequence
  Description of Artificial Sequence: Synthetic oligonucleotide
ccctgtggaggactatgagaaggttctgg

SEQ ID NO: 290373 - DNA, 30 bp, Artificial Sequence
  Description of Artificial Sequence: Synthetic oligonucleotide
cctgtggaggactatgagaaggttctggtg

SEQ ID NO: 290374 - DNA, 33 bp, Artificial Sequence
  Description of Artificial Sequence: Synthetic oligonucleotide
ctgtggaggactatgagaaggttctggtgaatc

SEQ ID NO: 290375 - DNA, 34 bp, Artificial Sequence
  Description of Artificial Sequence: Synthetic oligonucleotide
tgtggaggactatgagaaggttctggtgaatctg

SEQ ID NO: 290376 - DNA, 33 bp, Artificial Sequence
  Description of Artificial Sequence: Synthetic oligonucleotide
gtggaggactatgagaaggttctggtgaatctg

SEQ ID NO: 290377 - DNA, 33 bp, Artificial Sequence
  Description of Artificial Sequence: Synthetic oligonucleotide
tggaggactatgagaaggttctggtgaatctgg

SEQ ID NO: 290378 - DNA, 32 bp, Artificial Sequence
  Description of Artificial Sequence: Synthetic oligonucleotide
ggaggactatgagaaggttctggtgaatctgg

SEQ ID NO: 290379 - DNA, 32 bp, Artificial Sequence
  Description of Artificial Sequence: Synthetic oligonucleotide
gaggactatgagaaggttctggtgaatctggc

SEQ ID NO: 290380 - DNA, 36 bp, Artificial Sequence
  Description of Artificial Sequence: Synthetic oligonucleotide
aggactatgagaaggttctggtgaatctggctaaag

SEQ ID NO: 290381 - DNA, 35 bp, Artificial Sequence
  Description of Artificial Sequence: Synthetic oligonucleotide
ggactatgagaaggttctggtgaatctggctaaag

SEQ ID NO: 290382 - DNA, 35 bp, Artificial Sequence
  Description of Artificial Sequence: Synthetic oligonucleotide
gactatgagaaggttctggtgaatctggctaaagg

SEQ ID NO: 290383 - DNA, 35 bp, Artificial Sequence
  Description of Artificial Sequence: Synthetic oligonucleotide
actatgagaaggttctggtgaatctggctaaaggc

SEQ ID NO: 290384 - DNA, 34 bp, Artificial Sequence
  Description of Artificial Sequence: Synthetic oligonucleotide
ctatgagaaggttctggtgaatctggctaaaggc

SEQ ID NO: 290385 - DNA, 34 bp, Artificial Sequence
  Description of Artificial Sequence: Synthetic oligonucleotide
tatgagaaggttctggtgaatctggctaaaggcc

SEQ ID NO: 290386 - DNA, 33 bp, Artificial Sequence
  Description of Artificial Sequence: Synthetic oligonucleotide
atgagaaggttctggtgaatctggctaaaggcc

SEQ ID NO: 290387 - DNA, 32 bp, Artificial Sequence
  Description of Artificial Sequence: Synthetic oligonucleotide
tgagaaggttctggtgaatctggctaaaggcc

SEQ ID NO: 290388 - DNA, 31 bp, Artificial Sequence
  Description of Artificial Sequence: Synthetic oligonucleotide
gagaaggttctggtgaatctggctaaaggcc

SEQ ID NO: 290389 - DNA, 32 bp, Artificial Sequence
  Description of Artificial Sequence: Synthetic oligonucleotide
agaaggttctggtgaatctggctaaaggcctc

SEQ ID NO: 290390 - DNA, 31 bp, Artificial Sequence
  Description of Artificial Sequence: Synthetic oligonucleotide
gaaggttctggtgaatctggctaaaggcctc

SEQ ID NO: 290391 - DNA, 33 bp, Artificial Sequence
  Description of Artificial Sequence: Synthetic oligonucleotide
aaggttctggtgaatctggctaaaggcctcaag

SEQ ID NO: 290392 - DNA, 32 bp, Artificial Sequence
  Description of Artificial Sequence: Synthetic oligonucleotide
aggttctggtgaatctggctaaaggcctcaag

SEQ ID NO: 290393 - DNA, 31 bp, Artificial Sequence
  Description of Artificial Sequence: Synthetic oligonucleotide
ggttctggtgaatctggctaaaggcctcaag

SEQ ID NO: 290394 - DNA, 33 bp, Artificial Sequence
  Description of Artificial Sequence: Synthetic oligonucleotide
gttctggtgaatctggctaaaggcctcaagatg

SEQ ID NO: 290395 - DNA, 33 bp, Artificial Sequence
  Description of Artificial Sequence: Synthetic oligonucleotide
ttctggtgaatctggctaaaggcctcaagatgg

SEQ ID NO: 290396 - DNA, 32 bp, Artificial Sequence
  Description of Artificial Sequence: Synthetic oligonucleotide
tctggtgaatctggctaaaggcctcaagatgg

SEQ ID NO: 290397 - DNA, 31 bp, Artificial Sequence
  Description of Artificial Sequence: Synthetic oligonucleotide
ctggtgaatctggctaaaggcctcaagatgg

SEQ ID NO: 290398 - DNA, 32 bp, Artificial Sequence
  Description of Artificial Sequence: Synthetic oligonucleotide
tggtgaatctggctaaaggcctcaagatggag

SEQ ID NO: 290399 - DNA, 31 bp, Artificial Sequence
  Description of Artificial Sequence: Synthetic oligonucleotide
ggtgaatctggctaaaggcctcaagatggag

SEQ ID NO: 290400 - DNA, 34 bp, Artificial Sequence
  Description of Artificial Sequence: Synthetic oligonucleotide
gtgaatctggctaaaggcctcaagatggagaaag

SEQ ID NO: 290401 - DNA, 39 bp, Artificial Sequence
  Description of Artificial Sequence: Synthetic oligonucleotide
tgaatctggctaaaggcctcaagatggagaaagttaatg

SEQ ID NO: 290402 - DNA, 38 bp, Artificial Sequence
  Description of Artificial Sequence: Synthetic oligonucleotide
gaatctggctaaaggcctcaagatggagaaagttaatg

SEQ ID NO: 290403 - DNA, 40 bp, Artificial Sequence
  Description of Artificial Sequence: Synthetic oligonucleotide
aatctggctaaaggcctcaagatggagaaagttaatgttg

SEQ ID NO: 290404 - DNA, 39 bp, Artificial Sequence
  Description of Artificial Sequence: Synthetic oligonucleotide
atctggctaaaggcctcaagatggagaaagttaatgttg

SEQ ID NO: 290405 - DNA, 38 bp, Artificial Sequence
  Description of Artificial Sequence: Synthetic oligonucleotide
tctggctaaaggcctcaagatggagaaagttaatgttg

SEQ ID NO: 290406 - DNA, 37 bp, Artificial Sequence
  Description of Artificial Sequence: Synthetic oligonucleotide
ctggctaaaggcctcaagatggagaaagttaatgttg

SEQ ID NO: 290407 - DNA, 38 bp, Artificial Sequence
  Description of Artificial Sequence: Synthetic oligonucleotide
tggctaaaggcctcaagatggagaaagttaatgttgac

SEQ ID NO: 290408 - DNA, 37 bp, Artificial Sequence
  Description of Artificial Sequence: Synthetic oligonucleotide
ggctaaaggcctcaagatggagaaagttaatgttgac

SEQ ID NO: 290409 - DNA, 42 bp, Artificial Sequence
  Description of Artificial Sequence: Synthetic oligonucleotide
gctaaaggcctcaagatggagaaagttaatgttgactttatc

SEQ ID NO: 290410 - DNA, 48 bp, Artificial Sequence
  Description of Artificial Sequence: Synthetic oligonucleotide
ctaaaggcctcaagatggagaaagttaatgttgactttatcaattatg

SEQ ID NO: 290411 - DNA, 48 bp, Artificial Sequence
  Description of Artificial Sequence: Synthetic oligonucleotide
taaaggcctcaagatggagaaagttaatgttgactttatcaattatgg

SEQ ID NO: 290412 - DNA, 47 bp, Artificial Sequence
  Description of Artificial Sequence: Synthetic oligonucleotide
aaaggcctcaagatggagaaagttaatgttgactttatcaattatgg

SEQ ID NO: 290413 - DNA, 46 bp, Artificial Sequence
  Description of Artificial Sequence: Synthetic oligonucleotide
aaggcctcaagatggagaaagttaatgttgactttatcaattatgg

SEQ ID NO: 290414 - DNA, 45 bp, Artificial Sequence
  Description of Artificial Sequence: Synthetic oligonucleotide
aggcctcaagatggagaaagttaatgttgactttatcaattatgg

SEQ ID NO: 290415 - DNA, 44 bp, Artificial Sequence
  Description of Artificial Sequence: Synthetic oligonucleotide
ggcctcaagatggagaaagttaatgttgactttatcaattatgg

SEQ ID NO: 290416 - DNA, 44 bp, Artificial Sequence
  Description of Artificial Sequence: Synthetic oligonucleotide
gcctcaagatggagaaagttaatgttgactttatcaattatggg

SEQ ID NO: 290417 - DNA, 44 bp, Artificial Sequence
  Description of Artificial Sequence: Synthetic oligonucleotide
cctcaagatggagaaagttaatgttgactttatcaattatgggg

SEQ ID NO: 290418 - DNA, 46 bp, Artificial Sequence
  Description of Artificial Sequence: Synthetic oligonucleotide
ctcaagatggagaaagttaatgttgactttatcaattatggggaag

SEQ ID NO: 290419 - DNA, 47 bp, Artificial Sequence
  Description of Artificial Sequence: Synthetic oligonucleotide
tcaagatggagaaagttaatgttgactttatcaattatggggaagac

SEQ ID NO: 290420 - DNA, 46 bp, Artificial Sequence
  Description of Artificial Sequence: Synthetic oligonucleotide
caagatggagaaagttaatgttgactttatcaattatggggaagac

SEQ ID NO: 290421 - DNA, 46 bp, Artificial Sequence
  Description of Artificial Sequence: Synthetic oligonucleotide
aagatggagaaagttaatgttgactttatcaattatggggaagacg

SEQ ID NO: 290422 - DNA, 45 bp, Artificial Sequence
  Description of Artificial Sequence: Synthetic oligonucleotide
agatggagaaagttaatgttgactttatcaattatggggaagacg

SEQ ID NO: 290423 - DNA, 44 bp, Artificial Sequence
  Description of Artificial Sequence: Synthetic oligonucleotide
gatggagaaagttaatgttgactttatcaattatggggaagacg

SEQ ID NO: 290424 - DNA, 45 bp, Artificial Sequence
  Description of Artificial Sequence: Synthetic oligonucleotide
atggagaaagttaatgttgactttatcaattatggggaagacgag

SEQ ID NO: 290425 - DNA, 44 bp, Artificial Sequence
  Description of Artificial Sequence: Synthetic oligonucleotide
tggagaaagttaatgttgactttatcaattatggggaagacgag

SEQ ID NO: 290426 - DNA, 43 bp, Artificial Sequence
  Description of Artificial Sequence: Synthetic oligonucleotide
ggagaaagttaatgttgactttatcaattatggggaagacgag

SEQ ID NO: 290427 - DNA, 43 bp, Artificial Sequence
  Description of Artificial Sequence: Synthetic oligonucleotide
gagaaagttaatgttgactttatcaattatggggaagacgagg

SEQ ID NO: 290428 - DNA, 44 bp, Artificial Sequence
  Description of Artificial Sequence: Synthetic oligonucleotide
agaaagttaatgttgactttatcaattatggggaagacgaggtg

SEQ ID NO: 290429 - DNA, 43 bp, Artificial Sequence
  Description of Artificial Sequence: Synthetic oligonucleotide
gaaagttaatgttgactttatcaattatggggaagacgaggtg

SEQ ID NO: 290430 - DNA, 45 bp, Artificial Sequence
  Description of Artificial Sequence: Synthetic oligonucleotide
aaagttaatgttgactttatcaattatggggaagacgaggtgaac

SEQ ID NO: 290431 - DNA, 44 bp, Artificial Sequence
  Description of Artificial Sequence: Synthetic oligonucleotide
aagttaatgttgactttatcaattatggggaagacgaggtgaac

SEQ ID NO: 290432 - DNA, 43 bp, Artificial Sequence
  Description of Artificial Sequence: Synthetic oligonucleotide
agttaatgttgactttatcaattatggggaagacgaggtgaac

SEQ ID NO: 290433 - DNA, 42 bp, Artificial Sequence
  Description of Artificial Sequence: Synthetic oligonucleotide
gttaatgttgactttatcaattatggggaagacgaggtgaac

SEQ ID NO: 290434 - DNA, 43 bp, Artificial Sequence
  Description of Artificial Sequence: Synthetic oligonucleotide
ttaatgttgactttatcaattatggggaagacgaggtgaactc

SEQ ID NO: 290435 - DNA, 42 bp, Artificial Sequence
  Description of Artificial Sequence: Synthetic oligonucleotide
taatgttgactttatcaattatggggaagacgaggtgaactc

SEQ ID NO: 290436 - DNA, 41 bp, Artificial Sequence
  Description of Artificial Sequence: Synthetic oligonucleotide
aatgttgactttatcaattatggggaagacgaggtgaactc

SEQ ID NO: 290437 - DNA, 40 bp, Artificial Sequence
  Description of Artificial Sequence: Synthetic oligonucleotide
atgttgactttatcaattatggggaagacgaggtgaactc

SEQ ID NO: 290438 - DNA, 39 bp, Artificial Sequence
  Description of Artificial Sequence: Synthetic oligonucleotide
tgttgactttatcaattatggggaagacgaggtgaactc

SEQ ID NO: 290439 - DNA, 38 bp, Artificial Sequence
  Description of Artificial Sequence: Synthetic oligonucleotide
gttgactttatcaattatggggaagacgaggtgaactc

SEQ ID NO: 290440 - DNA, 39 bp, Artificial Sequence
  Description of Artificial Sequence: Synthetic oligonucleotide
ttgactttatcaattatggggaagacgaggtgaactcag

SEQ ID NO: 290441 - DNA, 38 bp, Artificial Sequence
  Description of Artificial Sequence: Synthetic oligonucleotide
tgactttatcaattatggggaagacgaggtgaactcag

SEQ ID NO: 290442 - DNA, 37 bp, Artificial Sequence
  Description of Artificial Sequence: Synthetic oligonucleotide
gactttatcaattatggggaagacgaggtgaactcag

SEQ ID NO: 290443 - DNA, 41 bp, Artificial Sequence
  Description of Artificial Sequence: Synthetic oligonucleotide
actttatcaattatggggaagacgaggtgaactcagaaaag

SEQ ID NO: 290444 - DNA, 40 bp, Artificial Sequence
  Description of Artificial Sequence: Synthetic oligonucleotide
ctttatcaattatggggaagacgaggtgaactcagaaaag

SEQ ID NO: 290445 - DNA, 40 bp, Artificial Sequence
  Description of Artificial Sequence: Synthetic oligonucleotide
tttatcaattatggggaagacgaggtgaactcagaaaagc

SEQ ID NO: 290446 - DNA, 39 bp, Artificial Sequence
  Description of Artificial Sequence: Synthetic oligonucleotide
ttatcaattatggggaagacgaggtgaactcagaaaagc

SEQ ID NO: 290447 - DNA, 38 bp, Artificial Sequence
  Description of Artificial Sequence: Synthetic oligonucleotide
tatcaattatggggaagacgaggtgaactcagaaaagc

SEQ ID NO: 290448 - DNA, 37 bp, Artificial Sequence
  Description of Artificial Sequence: Synthetic oligonucleotide
atcaattatggggaagacgaggtgaactcagaaaagc

SEQ ID NO: 290449 - DNA, 36 bp, Artificial Sequence
  Description of Artificial Sequence: Synthetic oligonucleotide
tcaattatggggaagacgaggtgaactcagaaaagc

SEQ ID NO: 290450 - DNA, 35 bp, Artificial Sequence
  Description of Artificial Sequence: Synthetic oligonucleotide
caattatggggaagacgaggtgaactcagaaaagc

SEQ ID NO: 290451 - DNA, 36 bp, Artificial Sequence
  Description of Artificial Sequence: Synthetic oligonucleotide
aattatggggaagacgaggtgaactcagaaaagcag

SEQ ID NO: 290452 - DNA, 35 bp, Artificial Sequence
  Description of Artificial Sequence: Synthetic oligonucleotide
attatggggaagacgaggtgaactcagaaaagcag

SEQ ID NO: 290453 - DNA, 34 bp, Artificial Sequence
  Description of Artificial Sequence: Synthetic oligonucleotide
ttatggggaagacgaggtgaactcagaaaagcag

SEQ ID NO: 290454 - DNA, 33 bp, Artificial Sequence
  Description of Artificial Sequence: Synthetic oligonucleotide
tatggggaagacgaggtgaactcagaaaagcag

SEQ ID NO: 290455 - DNA, 32 bp, Artificial Sequence
  Description of Artificial Sequence: Synthetic oligonucleotide
atggggaagacgaggtgaactcagaaaagcag

SEQ ID NO: 290456 - DNA, 31 bp, Artificial Sequence
  Description of Artificial Sequence: Synthetic oligonucleotide
tggggaagacgaggtgaactcagaaaagcag

SEQ ID NO: 290457 - DNA, 30 bp, Artificial Sequence
  Description of Artificial Sequence: Synthetic oligonucleotide
ggggaagacgaggtgaactcagaaaagcag

SEQ ID NO: 290458 - DNA, 31 bp, Artificial Sequence
  Description of Artificial Sequence: Synthetic oligonucleotide
gggaagacgaggtgaactcagaaaagcagac

SEQ ID NO: 290459 - DNA, 32 bp, Artificial Sequence
  Description of Artificial Sequence: Synthetic oligonucleotide
ggaagacgaggtgaactcagaaaagcagacag

SEQ ID NO: 290460 - DNA, 32 bp, Artificial Sequence
  Description of Artificial Sequence: Synthetic oligonucleotide
gaagacgaggtgaactcagaaaagcagacagc

SEQ ID NO: 290461 - DNA, 32 bp, Artificial Sequence
  Description of Artificial Sequence: Synthetic oligonucleotide
aagacgaggtgaactcagaaaagcagacagcc

SEQ ID NO: 290462 - DNA, 31 bp, Artificial Sequence
  Description of Artificial Sequence: Synthetic oligonucleotide
agacgaggtgaactcagaaaagcagacagcc

SEQ ID NO: 290463 - DNA, 30 bp, Artificial Sequence
  Description of Artificial Sequence: Synthetic oligonucleotide
gacgaggtgaactcagaaaagcagacagcc

SEQ ID NO: 290464 - DNA, 33 bp, Artificial Sequence
  Description of Artificial Sequence: Synthetic oligonucleotide
acgaggtgaactcagaaaagcagacagccttag

SEQ ID NO: 290465 - DNA, 32 bp, Artificial Sequence
  Description of Artificial Sequence: Synthetic oligonucleotide
cgaggtgaactcagaaaagcagacagccttag

SEQ ID NO: 290466 - DNA, 36 bp, Artificial Sequence
  Description of Artificial Sequence: Synthetic oligonucleotide
gaggtgaactcagaaaagcagacagccttagtaaac

SEQ ID NO: 290467 - DNA, 37 bp, Artificial Sequence
  Description of Artificial Sequence: Synthetic oligonucleotide
aggtgaactcagaaaagcagacagccttagtaaacac

SEQ ID NO: 290468 - DNA, 36 bp, Artificial Sequence
  Description of Artificial Sequence: Synthetic oligonucleotide
ggtgaactcagaaaagcagacagccttagtaaacac

SEQ ID NO: 290469 - DNA, 36 bp, Artificial Sequence
  Description of Artificial Sequence: Synthetic oligonucleotide
gtgaactcagaaaagcagacagccttagtaaacacg

SEQ ID NO: 290470 - DNA, 38 bp, Artificial Sequence
  Description of Artificial Sequence: Synthetic oligonucleotide
tgaactcagaaaagcagacagccttagtaaacacgatg

SEQ ID NO: 290471 - DNA, 37 bp, Artificial Sequence
  Description of Artificial Sequence: Synthetic oligonucleotide
gaactcagaaaagcagacagccttagtaaacacgatg

SEQ ID NO: 290472 - DNA, 40 bp, Artificial Sequence
  Description of Artificial Sequence: Synthetic oligonucleotide
aactcagaaaagcagacagccttagtaaacacgatgaatg

SEQ ID NO: 290473 - DNA, 39 bp, Artificial Sequence
  Description of Artificial Sequence: Synthetic oligonucleotide
actcagaaaagcagacagccttagtaaacacgatgaatg

SEQ ID NO: 290474 - DNA, 38 bp, Artificial Sequence
  Description of Artificial Sequence: Synthetic oligonucleotide
ctcagaaaagcagacagccttagtaaacacgatgaatg

SEQ ID NO: 290475 - DNA, 38 bp, Artificial Sequence
  Description of Artificial Sequence: Synthetic oligonucleotide
tcagaaaagcagacagccttagtaaacacgatgaatgg

SEQ ID NO: 290476 - DNA, 37 bp, Artificial Sequence
  Description of Artificial Sequence: Synthetic oligonucleotide
cagaaaagcagacagccttagtaaacacgatgaatgg

SEQ ID NO: 290477 - DNA, 37 bp, Artificial Sequence
  Description of Artificial Sequence: Synthetic oligonucleotide
agaaaagcagacagccttagtaaacacgatgaatggc

SEQ ID NO: 290478 - DNA, 36 bp, Artificial Sequence
  Description of Artificial Sequence: Synthetic oligonucleotide
gaaaagcagacagccttagtaaacacgatgaatggc

SEQ ID NO: 290479 - DNA, 39 bp, Artificial Sequence
  Description of Artificial Sequence: Synthetic oligonucleotide
aaaagcagacagccttagtaaacacgatgaatggcatag

SEQ ID NO: 290480 - DNA, 38 bp, Artificial Sequence
  Description of Artificial Sequence: Synthetic oligonucleotide
aaagcagacagccttagtaaacacgatgaatggcatag

SEQ ID NO: 290481 - DNA, 37 bp, Artificial Sequence
  Description of Artificial Sequence: Synthetic oligonucleotide
aagcagacagccttagtaaacacgatgaatggcatag

SEQ ID NO: 290482 - DNA, 36 bp, Artificial Sequence
  Description of Artificial Sequence: Synthetic oligonucleotide
agcagacagccttagtaaacacgatgaatggcatag

SEQ ID NO: 290483 - DNA, 35 bp, Artificial Sequence
  Description of Artificial Sequence: Synthetic oligonucleotide
gcagacagccttagtaaacacgatgaatggcatag

SEQ ID NO: 290484 - DNA, 37 bp, Artificial Sequence
  Description of Artificial Sequence: Synthetic oligonucleotide
cagacagccttagtaaacacgatgaatggcatagatg

SEQ ID NO: 290485 - DNA, 37 bp, Artificial Sequence
  Description of Artificial Sequence: Synthetic oligonucleotide
agacagccttagtaaacacgatgaatggcatagatgg

SEQ ID NO: 290486 - DNA, 36 bp, Artificial Sequence
  Description of Artificial Sequence: Synthetic oligonucleotide
gacagccttagtaaacacgatgaatggcatagatgg

SEQ ID NO: 290487 - DNA, 38 bp, Artificial Sequence
  Description of Artificial Sequence: Synthetic oligonucleotide
acagccttagtaaacacgatgaatggcatagatggaac

SEQ ID NO: 290488 - DNA, 37 bp, Artificial Sequence
  Description of Artificial Sequence: Synthetic oligonucleotide
cagccttagtaaacacgatgaatggcatagatggaac

SEQ ID NO: 290489 - DNA, 37 bp, Artificial Sequence
  Description of Artificial Sequence: Synthetic oligonucleotide
agccttagtaaacacgatgaatggcatagatggaacg

SEQ ID NO: 290490 - DNA, 36 bp, Artificial Sequence
  Description of Artificial Sequence: Synthetic oligonucleotide
gccttagtaaacacgatgaatggcatagatggaacg

SEQ ID NO: 290491 - DNA, 36 bp, Artificial Sequence
  Description of Artificial Sequence: Synthetic oligonucleotide
ccttagtaaacacgatgaatggcatagatggaacgg

SEQ ID NO: 290492 - DNA, 36 bp, Artificial Sequence
  Description of Artificial Sequence: Synthetic oligonucleotide
cttagtaaacacgatgaatggcatagatggaacggg

SEQ ID NO: 290493 - DNA, 38 bp, Artificial Sequence
  Description of Artificial Sequence: Synthetic oligonucleotide
ttagtaaacacgatgaatggcatagatggaacgggttc

SEQ ID NO: 290494 - DNA, 37 bp, Artificial Sequence
  Description of Artificial Sequence: Synthetic oligonucleotide
tagtaaacacgatgaatggcatagatggaacgggttc

SEQ ID NO: 290495 - DNA, 36 bp, Artificial Sequence
  Description of Artificial Sequence: Synthetic oligonucleotide
agtaaacacgatgaatggcatagatggaacgggttc

SEQ ID NO: 290496 - DNA, 35 bp, Artificial Sequence
  Description of Artificial Sequence: Synthetic oligonucleotide
gtaaacacgatgaatggcatagatggaacgggttc

SEQ ID NO: 290497 - DNA, 36 bp, Artificial Sequence
  Description of Artificial Sequence: Synthetic oligonucleotide
taaacacgatgaatggcatagatggaacgggttctc

SEQ ID NO: 290498 - DNA, 35 bp, Artificial Sequence
  Description of Artificial Sequence: Synthetic oligonucleotide
aaacacgatgaatggcatagatggaacgggttctc

SEQ ID NO: 290499 - DNA, 34 bp, Artificial Sequence
  Description of Artificial Sequence: Synthetic oligonucleotide
aacacgatgaatggcatagatggaacgggttctc

SEQ ID NO: 290500 - DNA, 33 bp, Artificial Sequence
  Description of Artificial Sequence: Synthetic oligonucleotide
acacgatgaatggcatagatggaacgggttctc

SEQ ID NO: 290501 - DNA, 32 bp, Artificial Sequence
  Description of Artificial Sequence: Synthetic oligonucleotide
cacgatgaatggcatagatggaacgggttctc

SEQ ID NO: 290502 - DNA, 34 bp, Artificial Sequence
  Description of Artificial Sequence: Synthetic oligonucleotide
acgatgaatggcatagatggaacgggttctcatg

SEQ ID NO: 290503 - DNA, 33 bp, Artificial Sequence
  Description of Artificial Sequence: Synthetic oligonucleotide
cgatgaatggcatagatggaacgggttctcatg

SEQ ID NO: 290504 - DNA, 34 bp, Artificial Sequence
  Description of Artificial Sequence: Synthetic oligonucleotide
gatgaatggcatagatggaacgggttctcatgtg

SEQ ID NO: 290505 - DNA, 34 bp, Artificial Sequence
  Description of Artificial Sequence: Synthetic oligonucleotide
atgaatggcatagatggaacgggttctcatgtgg

SEQ ID NO: 290506 - DNA, 33 bp, Artificial Sequence
  Description of Artificial Sequence: Synthetic oligonucleotide
tgaatggcatagatggaacgggttctcatgtgg

SEQ ID NO: 290507 - DNA, 32 bp, Artificial Sequence
  Description of Artificial Sequence: Synthetic oligonucleotide
gaatggcatagatggaacgggttctcatgtgg

SEQ ID NO: 290508 - DNA, 33 bp, Artificial Sequence
  Description of Artificial Sequence: Synthetic oligonucleotide
aatggcatagatggaacgggttctcatgtggtg

SEQ ID NO: 290509 - DNA, 32 bp, Artificial Sequence
  Description of Artificial Sequence: Synthetic oligonucleotide
atggcatagatggaacgggttctcatgtggtg

SEQ ID NO: 290510 - DNA, 31 bp, Artificial Sequence
  Description of Artificial Sequence: Synthetic oligonucleotide
tggcatagatggaacgggttctcatgtggtg

SEQ ID NO: 290511 - DNA, 30 bp, Artificial Sequence
  Description of Artificial Sequence: Synthetic oligonucleotide
ggcatagatggaacgggttctcatgtggtg

SEQ ID NO: 290512 - DNA, 31 bp, Artificial Sequence
  Description of Artificial Sequence: Synthetic oligonucleotide
gcatagatggaacgggttctcatgtggtgac

SEQ ID NO: 290513 - DNA, 32 bp, Artificial Sequence
  Description of Artificial Sequence: Synthetic oligonucleotide
catagatggaacgggttctcatgtggtgacag

SEQ ID NO: 290514 - DNA, 33 bp, Artificial Sequence
  Description of Artificial Sequence: Synthetic oligonucleotide
atagatggaacgggttctcatgtggtgacagag

SEQ ID NO: 290515 - DNA, 32 bp, Artificial Sequence
  Description of Artificial Sequence: Synthetic oligonucleotide
tagatggaacgggttctcatgtggtgacagag

SEQ ID NO: 290516 - DNA, 31 bp, Artificial Sequence
  Description of Artificial Sequence: Synthetic oligonucleotide
agatggaacgggttctcatgtggtgacagag

SEQ ID NO: 290517 - DNA, 30 bp, Artificial Sequence
  Description of Artificial Sequence: Synthetic oligonucleotide
gatggaacgggttctcatgtggtgacagag

SEQ ID NO: 290518 - DNA, 30 bp, Artificial Sequence
  Description of Artificial Sequence: Synthetic oligonucleotide
atggaacgggttctcatgtggtgacagagc

SEQ ID NO: 290519 - DNA, 29 bp, Artificial Sequence
  Description of Artificial Sequence: Synthetic oligonucleotide
tggaacgggttctcatgtggtgacagagc

SEQ ID NO: 290520 - DNA, 28 bp, Artificial Sequence
  Description of Artificial Sequence: Synthetic oligonucleotide
ggaacgggttctcatgtggtgacagagc

SEQ ID NO: 290521 - DNA, 28 bp, Artificial Sequence
  Description of Artificial Sequence: Synthetic oligonucleotide
gaacgggttctcatgtggtgacagagcc

SEQ ID NO: 290522 - DNA, 29 bp, Artificial Sequence
  Description of Artificial Sequence: Synthetic oligonucleotide
aacgggttctcatgtggtgacagagcctc

SEQ ID NO: 290523 - DNA, 28 bp, Artificial Sequence
  Description of Artificial Sequence: Synthetic oligonucleotide
acgggttctcatgtggtgacagagcctc

SEQ ID NO: 290524 - DNA, 27 bp, Artificial Sequence
  Description of Artificial Sequence: Synthetic oligonucleotide
cgggttctcatgtggtgacagagcctc

SEQ ID NO: 290525 - DNA, 27 bp, Artificial Sequence
  Description of Artificial Sequence: Synthetic oligonucleotide
gggttctcatgtggtgacagagcctcc

SEQ ID NO: 290526 - DNA, 28 bp, Artificial Sequence
  Description of Artificial Sequence: Synthetic oligonucleotide
ggttctcatgtggtgacagagcctcctg

SEQ ID NO: 290527 - DNA, 28 bp, Artificial Sequence
  Description of Artificial Sequence: Synthetic oligonucleotide
gttctcatgtggtgacagagcctcctgg

SEQ ID NO: 290528 - DNA, 28 bp, Artificial Sequence
  Description of Artificial Sequence: Synthetic oligonucleotide
ttctcatgtggtgacagagcctcctggc

SEQ ID NO: 290529 - DNA, 27 bp, Artificial Sequence
  Description of Artificial Sequence: Synthetic oligonucleotide
tctcatgtggtgacagagcctcctggc

SEQ ID NO: 290530 - DNA, 26 bp, Artificial Sequence
  Description of Artificial Sequence: Synthetic oligonucleotide
ctcatgtggtgacagagcctcctggc

SEQ ID NO: 290531 - DNA, 26 bp, Artificial Sequence
  Description of Artificial Sequence: Synthetic oligonucleotide
tcatgtggtgacagagcctcctggcc

SEQ ID NO: 290532 - DNA, 25 bp, Artificial Sequence
  Description of Artificial Sequence: Synthetic oligonucleotide
catgtggtgacagagcctcctggcc

SEQ ID NO: 290533 - DNA, 25 bp, Artificial Sequence
  Description of Artificial Sequence: Synthetic oligonucleotide
atgtggtgacagagcctcctggccc

SEQ ID NO: 290534 - DNA, 24 bp, Artificial Sequence
  Description of Artificial Sequence: Synthetic oligonucleotide
tgtggtgacagagcctcctggccc

SEQ ID NO: 290535 - DNA, 23 bp, Artificial Sequence
  Description of Artificial Sequence: Synthetic oligonucleotide
gtggtgacagagcctcctggccc

SEQ ID NO: 290536 - DNA, 24 bp, Artificial Sequence
  Description of Artificial Sequence: Synthetic oligonucleotide
tggtgacagagcctcctggcccca

SEQ ID NO: 290537 - DNA, 23 bp, Artificial Sequence
  Description of Artificial Sequence: Synthetic oligonucleotide
ggtgacagagcctcctggcccca

SEQ ID NO: 290538 - DNA, 26 bp, Artificial Sequence
  Description of Artificial Sequence: Synthetic oligonucleotide
gtgacagagcctcctggccccagttt

SEQ ID NO: 290539 - DNA, 26 bp, Artificial Sequence
  Description of Artificial Sequence: Synthetic oligonucleotide
tgacagagcctcctggccccagtttg

SEQ ID NO: 290540 - DNA, 25 bp, Artificial Sequence
  Description of Artificial Sequence: Synthetic oligonucleotide
gacagagcctcctggccccagtttg

SEQ ID NO: 290541 - DNA, 25 bp, Artificial Sequence
  Description of Artificial Sequence: Synthetic oligonucleotide
acagagcctcctggccccagtttgc

SEQ ID NO: 290542 - DNA, 24 bp, Artificial Sequence
  Description of Artificial Sequence: Synthetic oligonucleotide
cagagcctcctggccccagtttgc

SEQ ID NO: 290543 - DNA, 25 bp, Artificial Sequence
  Description of Artificial Sequence: Synthetic oligonucleotide
agagcctcctggccccagtttgcct

SEQ ID NO: 290544 - DNA, 24 bp, Artificial Sequence
  Description of Artificial Sequence: Synthetic oligonucleotide
gagcctcctggccccagtttgcct

SEQ ID NO: 290545 - DNA, 26 bp, Artificial Sequence
  Description of Artificial Sequence: Synthetic oligonucleotide
agcctcctggccccagtttgcctgat

SEQ ID NO: 290546 - DNA, 25 bp, Artificial Sequence
  Description of Artificial Sequence: Synthetic oligonucleotide
gcctcctggccccagtttgcctgat

SEQ ID NO: 290547 - DNA, 25 bp, Artificial Sequence
  Description of Artificial Sequence: Synthetic oligonucleotide
cctcctggccccagtttgcctgatg

SEQ ID NO: 290548 - DNA, 26 bp, Artificial Sequence
  Description of Artificial Sequence: Synthetic oligonucleotide
ctcctggccccagtttgcctgatgct

SEQ ID NO: 290549 - DNA, 27 bp, Artificial Sequence
  Description of Artificial Sequence: Synthetic oligonucleotide
tcctggccccagtttgcctgatgctca

SEQ ID NO: 290550 - DNA, 26 bp, Artificial Sequence
  Description of Artificial Sequence: Synthetic oligonucleotide
cctggccccagtttgcctgatgctca

SEQ ID NO: 290551 - DNA, 27 bp, Artificial Sequence
  Description of Artificial Sequence: Synthetic oligonucleotide
ctggccccagtttgcctgatgctcaca

SEQ ID NO: 290552 - DNA, 28 bp, Artificial Sequence
  Description of Artificial Sequence: Synthetic oligonucleotide
tggccccagtttgcctgatgctcacatc

SEQ ID NO: 290553 - DNA, 27 bp, Artificial Sequence
  Description of Artificial Sequence: Synthetic oligonucleotide
ggccccagtttgcctgatgctcacatc

SEQ ID NO: 290554 - DNA, 28 bp, Artificial Sequence
  Description of Artificial Sequence: Synthetic oligonucleotide
gccccagtttgcctgatgctcacatcag

SEQ ID NO: 290555 - DNA, 30 bp, Artificial Sequence
  Description of Artificial Sequence: Synthetic oligonucleotide
ccccagtttgcctgatgctcacatcagttc

SEQ ID NO: 290556 - DNA, 31 bp, Artificial Sequence
  Description of Artificial Sequence: Synthetic oligonucleotide
cccagtttgcctgatgctcacatcagttcac

SEQ ID NO: 290557 - DNA, 31 bp, Artificial Sequence
  Description of Artificial Sequence: Synthetic oligonucleotide
ccagtttgcctgatgctcacatcagttcacc

SEQ ID NO: 290558 - DNA, 31 bp, Artificial Sequence
  Description of Artificial Sequence: Synthetic oligonucleotide
cagtttgcctgatgctcacatcagttcaccg

SEQ ID NO: 290559 - DNA, 36 bp, Artificial Sequence
  Description of Artificial Sequence: Synthetic oligonucleotide
agtttgcctgatgctcacatcagttcaccgattttg

SEQ ID NO: 290560 - DNA, 35 bp, Artificial Sequence
  Description of Artificial Sequence: Synthetic oligonucleotide
gtttgcctgatgctcacatcagttcaccgattttg

SEQ ID NO: 290561 - DNA, 35 bp, Artificial Sequence
  Description of Artificial Sequence: Synthetic oligonucleotide
tttgcctgatgctcacatcagttcaccgattttgc

SEQ ID NO: 290562 - DNA, 34 bp, Artificial Sequence
  Description of Artificial Sequence: Synthetic oligonucleotide
ttgcctgatgctcacatcagttcaccgattttgc

SEQ ID NO: 290563 - DNA, 33 bp, Artificial Sequence
  Description of Artificial Sequence: Synthetic oligonucleotide
tgcctgatgctcacatcagttcaccgattttgc

SEQ ID NO: 290564 - DNA, 32 bp, Artificial Sequence
  Description of Artificial Sequence: Synthetic oligonucleotide
gcctgatgctcacatcagttcaccgattttgc

SEQ ID NO: 290565 - DNA, 32 bp, Artificial Sequence
  Description of Artificial Sequence: Synthetic oligonucleotide
cctgatgctcacatcagttcaccgattttgcc

SEQ ID NO: 290566 - DNA, 33 bp, Artificial Sequence
  Description of Artificial Sequence: Synthetic oligonucleotide
ctgatgctcacatcagttcaccgattttgcctg

SEQ ID NO: 290567 - DNA, 33 bp, Artificial Sequence
  Description of Artificial Sequence: Synthetic oligonucleotide
tgatgctcacatcagttcaccgattttgcctgg

SEQ ID NO: 290568 - DNA, 32 bp, Artificial Sequence
  Description of Artificial Sequence: Synthetic oligonucleotide
gatgctcacatcagttcaccgattttgcctgg

SEQ ID NO: 290569 - DNA, 33 bp, Artificial Sequence
  Description of Artificial Sequence: Synthetic oligonucleotide
atgctcacatcagttcaccgattttgcctggtg

SEQ ID NO: 290570 - DNA, 32 bp, Artificial Sequence
  Description of Artificial Sequence: Synthetic oligonucleotide
tgctcacatcagttcaccgattttgcctggtg

SEQ ID NO: 290571 - DNA, 31 bp, Artificial Sequence
  Description of Artificial Sequence: Synthetic oligonucleotide
gctcacatcagttcaccgattttgcctggtg

SEQ ID NO: 290572 - DNA, 33 bp, Artificial Sequence
  Description of Artificial Sequence: Synthetic oligonucleotide
ctcacatcagttcaccgattttgcctggtgaag

SEQ ID NO: 290573 - DNA, 33 bp, Artificial Sequence
  Description of Artificial Sequence: Synthetic oligonucleotide
tcacatcagttcaccgattttgcctggtgaagc

SEQ ID NO: 290574 - DNA, 32 bp, Artificial Sequence
  Description of Artificial Sequence: Synthetic oligonucleotide
cacatcagttcaccgattttgcctggtgaagc

SEQ ID NO: 290575 - DNA, 33 bp, Artificial Sequence
  Description of Artificial Sequence: Synthetic oligonucleotide
acatcagttcaccgattttgcctggtgaagctg

SEQ ID NO: 290576 - DNA, 32 bp, Artificial Sequence
  Description of Artificial Sequence: Synthetic oligonucleotide
catcagttcaccgattttgcctggtgaagctg

SEQ ID NO: 290577 - DNA, 32 bp, Artificial Sequence
  Description of Artificial Sequence: Synthetic oligonucleotide
atcagttcaccgattttgcctggtgaagctgg

SEQ ID NO: 290578 - DNA, 31 bp, Artificial Sequence
  Description of Artificial Sequence: Synthetic oligonucleotide
tcagttcaccgattttgcctggtgaagctgg

SEQ ID NO: 290579 - DNA, 30 bp, Artificial Sequence
  Description of Artificial Sequence: Synthetic oligonucleotide
cagttcaccgattttgcctggtgaagctgg

SEQ ID NO: 290580 - DNA, 31 bp, Artificial Sequence
  Description of Artificial Sequence: Synthetic oligonucleotide
agttcaccgattttgcctggtgaagctggtg

SEQ ID NO: 290581 - DNA, 30 bp, Artificial Sequence
  Description of Artificial Sequence: Synthetic oligonucleotide
gttcaccgattttgcctggtgaagctggtg

SEQ ID NO: 290582 - DNA, 30 bp, Artificial Sequence
  Description of Artificial Sequence: Synthetic oligonucleotide
ttcaccgattttgcctggtgaagctggtgc

SEQ ID NO: 290583 - DNA, 29 bp, Artificial Sequence
  Description of Artificial Sequence: Synthetic oligonucleotide
tcaccgattttgcctggtgaagctggtgc

SEQ ID NO: 290584 - DNA, 28 bp, Artificial Sequence
  Description of Artificial Sequence: Synthetic oligonucleotide
caccgattttgcctggtgaagctggtgc

SEQ ID NO: 290585 - DNA, 28 bp, Artificial Sequence
  Description of Artificial Sequence: Synthetic oligonucleotide
accgattttgcctggtgaagctggtgcc

SEQ ID NO: 290586 - DNA, 27 bp, Artificial Sequence
  Description of Artificial Sequence: Synthetic oligonucleotide
ccgattttgcctggtgaagctggtgcc

SEQ ID NO: 290587 - DNA, 29 bp, Artificial Sequence
  Description of Artificial Sequence: Synthetic oligonucleotide
cgattttgcctggtgaagctggtgccatc

SEQ ID NO: 290588 - DNA, 29 bp, Artificial Sequence
  Description of Artificial Sequence: Synthetic oligonucleotide
gattttgcctggtgaagctggtgccatcc

SEQ ID NO: 290589 - DNA, 30 bp, Artificial Sequence
  Description of Artificial Sequence: Synthetic oligonucleotide
attttgcctggtgaagctggtgccatcctg

SEQ ID NO: 290590 - DNA, 29 bp, Artificial Sequence
  Description of Artificial Sequence: Synthetic oligonucleotide
ttttgcctggtgaagctggtgccatcctg

SEQ ID NO: 290591 - DNA, 28 bp, Artificial Sequence
  Description of Artificial Sequence: Synthetic oligonucleotide
tttgcctggtgaagctggtgccatcctg

SEQ ID NO: 290592 - DNA, 27 bp, Artificial Sequence
  Description of Artificial Sequence: Synthetic oligonucleotide
ttgcctggtgaagctggtgccatcctg

SEQ ID NO: 290593 - DNA, 26 bp, Artificial Sequence
  Description of Artificial Sequence: Synthetic oligonucleotide
tgcctggtgaagctggtgccatcctg

SEQ ID NO: 290594 - DNA, 25 bp, Artificial Sequence
  Description of Artificial Sequence: Synthetic oligonucleotide
gcctggtgaagctggtgccatcctg

SEQ ID NO: 290595 - DNA, 25 bp, Artificial Sequence
  Description of Artificial Sequence: Synthetic oligonucleotide
cctggtgaagctggtgccatcctgg

SEQ ID NO: 290596 - DNA, 26 bp, Artificial Sequence
  Description of Artificial Sequence: Synthetic oligonucleotide
ctggtgaagctggtgccatcctgggt

SEQ ID NO: 290597 - DNA, 27 bp, Artificial Sequence
  Description of Artificial Sequence: Synthetic oligonucleotide
tggtgaagctggtgccatcctgggtct

SEQ ID NO: 290598 - DNA, 27 bp, Artificial Sequence
  Description of Artificial Sequence: Synthetic oligonucleotide
ggtgaagctggtgccatcctgggtctt

SEQ ID NO: 290599 - DNA, 27 bp, Artificial Sequence
  Description of Artificial Sequence: Synthetic oligonucleotide
gtgaagctggtgccatcctgggtcttc

SEQ ID NO: 290600 - DNA, 27 bp, Artificial Sequence
  Description of Artificial Sequence: Synthetic oligonucleotide
tgaagctggtgccatcctgggtcttcg

SEQ ID NO: 290601 - DNA, 27 bp, Artificial Sequence
  Description of Artificial Sequence: Synthetic oligonucleotide
gaagctggtgccatcctgggtcttcgt

SEQ ID NO: 290602 - DNA, 27 bp, Artificial Sequence
  Description of Artificial Sequence: Synthetic oligonucleotide
aagctggtgccatcctgggtcttcgtg

SEQ ID NO: 290603 - DNA, 26 bp, Artificial Sequence
  Description of Artificial Sequence: Synthetic oligonucleotide
agctggtgccatcctgggtcttcgtg

SEQ ID NO: 290604 - DNA, 25 bp, Artificial Sequence
  Description of Artificial Sequence: Synthetic oligonucleotide
gctggtgccatcctgggtcttcgtg

SEQ ID NO: 290605 - DNA, 25 bp, Artificial Sequence
  Description of Artificial Sequence: Synthetic oligonucleotide
ctggtgccatcctgggtcttcgtgc

SEQ ID NO: 290606 - DNA, 26 bp, Artificial Sequence
  Description of Artificial Sequence: Synthetic oligonucleotide
tggtgccatcctgggtcttcgtgcca

SEQ ID NO: 290607 - DNA, 25 bp, Artificial Sequence
  Description of Artificial Sequence: Synthetic oligonucleotide
ggtgccatcctgggtcttcgtgcca

SEQ ID NO: 290608 - DNA, 26 bp, Artificial Sequence
  Description of Artificial Sequence: Synthetic oligonucleotide
gtgccatcctgggtcttcgtgccagt

SEQ ID NO: 290609 - DNA, 27 bp, Artificial Sequence
  Description of Artificial Sequence: Synthetic oligonucleotide
tgccatcctgggtcttcgtgccagtgt

SEQ ID NO: 290610 - DNA, 26 bp, Artificial Sequence
  Description of Artificial Sequence: Synthetic oligonucleotide
gccatcctgggtcttcgtgccagtgt

SEQ ID NO: 290611 - DNA, 27 bp, Artificial Sequence
  Description of Artificial Sequence: Synthetic oligonucleotide
ccatcctgggtcttcgtgccagtgtct

SEQ ID NO: 290612 - DNA, 29 bp, Artificial Sequence
  Description of Artificial Sequence: Synthetic oligonucleotide
catcctgggtcttcgtgccagtgtctttg

SEQ ID NO: 290613 - DNA, 34 bp, Artificial Sequence
  Description of Artificial Sequence: Synthetic oligonucleotide
atcctgggtcttcgtgccagtgtctttgaattag

SEQ ID NO: 290614 - DNA, 33 bp, Artificial Sequence
  Description of Artificial Sequence: Synthetic oligonucleotide
tcctgggtcttcgtgccagtgtctttgaattag

SEQ ID NO: 290615 - DNA, 32 bp, Artificial Sequence
  Description of Artificial Sequence: Synthetic oligonucleotide
cctgggtcttcgtgccagtgtctttgaattag

SEQ ID NO: 290616 - DNA, 32 bp, Artificial Sequence
  Description of Artificial Sequence: Synthetic oligonucleotide
ctgggtcttcgtgccagtgtctttgaattagg

SEQ ID NO: 290617 - DNA, 33 bp, Artificial Sequence
  Description of Artificial Sequence: Synthetic oligonucleotide
tgggtcttcgtgccagtgtctttgaattaggag

SEQ ID NO: 290618 - DNA, 32 bp, Artificial Sequence
  Description of Artificial Sequence: Synthetic oligonucleotide
gggtcttcgtgccagtgtctttgaattaggag

SEQ ID NO: 290619 - DNA, 34 bp, Artificial Sequence
  Description of Artificial Sequence: Synthetic oligonucleotide
ggtcttcgtgccagtgtctttgaattaggagtag

SEQ ID NO: 290620 - DNA, 36 bp, Artificial Sequence
  Description of Artificial Sequence: Synthetic oligonucleotide
gtcttcgtgccagtgtctttgaattaggagtagatg

SEQ ID NO: 290621 - DNA, 36 bp, Artificial Sequence
  Description of Artificial Sequence: Synthetic oligonucleotide
tcttcgtgccagtgtctttgaattaggagtagatgc

SEQ ID NO: 290622 - DNA, 35 bp, Artificial Sequence
  Description of Artificial Sequence: Synthetic oligonucleotide
cttcgtgccagtgtctttgaattaggagtagatgc

SEQ ID NO: 290623 - DNA, 35 bp, Artificial Sequence
  Description of Artificial Sequence: Synthetic oligonucleotide
ttcgtgccagtgtctttgaattaggagtagatgcc

SEQ ID NO: 290624 - DNA, 34 bp, Artificial Sequence
  Description of Artificial Sequence: Synthetic oligonucleotide
tcgtgccagtgtctttgaattaggagtagatgcc

SEQ ID NO: 290625 - DNA, 33 bp, Artificial Sequence
  Description of Artificial Sequence: Synthetic oligonucleotide
cgtgccagtgtctttgaattaggagtagatgcc

SEQ ID NO: 290626 - DNA, 34 bp, Artificial Sequence
  Description of Artificial Sequence: Synthetic oligonucleotide
gtgccagtgtctttgaattaggagtagatgccag

SEQ ID NO: 290627 - DNA, 35 bp, Artificial Sequence
  Description of Artificial Sequence: Synthetic oligonucleotide
tgccagtgtctttgaattaggagtagatgccagtg

SEQ ID NO: 290628 - DNA, 34 bp, Artificial Sequence
  Description of Artificial Sequence: Synthetic oligonucleotide
gccagtgtctttgaattaggagtagatgccagtg

SEQ ID NO: 290629 - DNA, 34 bp, Artificial Sequence
  Description of Artificial Sequence: Synthetic oligonucleotide
ccagtgtctttgaattaggagtagatgccagtgc

SEQ ID NO: 290630 - DNA, 35 bp, Artificial Sequence
  Description of Artificial Sequence: Synthetic oligonucleotide
cagtgtctttgaattaggagtagatgccagtgctg

SEQ ID NO: 290631 - DNA, 37 bp, Artificial Sequence
  Description of Artificial Sequence: Synthetic oligonucleotide
agtgtctttgaattaggagtagatgccagtgctgttc

SEQ ID NO: 290632 - DNA, 36 bp, Artificial Sequence
  Description of Artificial Sequence: Synthetic oligonucleotide
gtgtctttgaattaggagtagatgccagtgctgttc

SEQ ID NO: 290633 - DNA, 36 bp, Artificial Sequence
  Description of Artificial Sequence: Synthetic oligonucleotide
tgtctttgaattaggagtagatgccagtgctgttcc

SEQ ID NO: 290634 - DNA, 35 bp, Artificial Sequence
  Description of Artificial Sequence: Synthetic oligonucleotide
gtctttgaattaggagtagatgccagtgctgttcc

SEQ ID NO: 290635 - DNA, 36 bp, Artificial Sequence
  Description of Artificial Sequence: Synthetic oligonucleotide
tctttgaattaggagtagatgccagtgctgttcctg

SEQ ID NO: 290636 - DNA, 35 bp, Artificial Sequence
  Description of Artificial Sequence: Synthetic oligonucleotide
ctttgaattaggagtagatgccagtgctgttcctg

SEQ ID NO: 290637 - DNA, 36 bp, Artificial Sequence
  Description of Artificial Sequence: Synthetic oligonucleotide
tttgaattaggagtagatgccagtgctgttcctgag

SEQ ID NO: 290638 - DNA, 35 bp, Artificial Sequence
  Description of Artificial Sequence: Synthetic oligonucleotide
ttgaattaggagtagatgccagtgctgttcctgag

SEQ ID NO: 290639 - DNA, 34 bp, Artificial Sequence
  Description of Artificial Sequence: Synthetic oligonucleotide
tgaattaggagtagatgccagtgctgttcctgag

SEQ ID NO: 290640 - DNA, 33 bp, Artificial Sequence
  Description of Artificial Sequence: Synthetic oligonucleotide
gaattaggagtagatgccagtgctgttcctgag

SEQ ID NO: 290641 - DNA, 33 bp, Artificial Sequence
  Description of Artificial Sequence: Synthetic oligonucleotide
aattaggagtagatgccagtgctgttcctgagc

SEQ ID NO: 290642 - DNA, 32 bp, Artificial Sequence
  Description of Artificial Sequence: Synthetic oligonucleotide
attaggagtagatgccagtgctgttcctgagc

SEQ ID NO: 290643 - DNA, 31 bp, Artificial Sequence
  Description of Artificial Sequence: Synthetic oligonucleotide
ttaggagtagatgccagtgctgttcctgagc

SEQ ID NO: 290644 - DNA, 30 bp, Artificial Sequence
  Description of Artificial Sequence: Synthetic oligonucleotide
taggagtagatgccagtgctgttcctgagc

SEQ ID NO: 290645 - DNA, 29 bp, Artificial Sequence
  Description of Artificial Sequence: Synthetic oligonucleotide
aggagtagatgccagtgctgttcctgagc

SEQ ID NO: 290646 - DNA, 28 bp, Artificial Sequence
  Description of Artificial Sequence: Synthetic oligonucleotide
ggagtagatgccagtgctgttcctgagc

SEQ ID NO: 290647 - DNA, 29 bp, Artificial Sequence
  Description of Artificial Sequence: Synthetic oligonucleotide
gagtagatgccagtgctgttcctgagctc

SEQ ID NO: 290648 - DNA, 29 bp, Artificial Sequence
  Description of Artificial Sequence: Synthetic oligonucleotide
agtagatgccagtgctgttcctgagctcg

SEQ ID NO: 290649 - DNA, 28 bp, Artificial Sequence
  Description of Artificial Sequence: Synthetic oligonucleotide
gtagatgccagtgctgttcctgagctcg

SEQ ID NO: 290650 - DNA, 28 bp, Artificial Sequence
  Description of Artificial Sequence: Synthetic oligonucleotide
tagatgccagtgctgttcctgagctcgc

SEQ ID NO: 290651 - DNA, 27 bp, Artificial Sequence
  Description of Artificial Sequence: Synthetic oligonucleotide
agatgccagtgctgttcctgagctcgc

SEQ ID NO: 290652 - DNA, 26 bp, Artificial Sequence
  Description of Artificial Sequence: Synthetic oligonucleotide
gatgccagtgctgttcctgagctcgc

SEQ ID NO: 290653 - DNA, 27 bp, Artificial Sequence
  Description of Artificial Sequence: Synthetic oligonucleotide
atgccagtgctgttcctgagctcgcct

SEQ ID NO: 290654 - DNA, 27 bp, Artificial Sequence
  Description of Artificial Sequence: Synthetic oligonucleotide
tgccagtgctgttcctgagctcgcctt

SEQ ID NO: 290655 - DNA, 26 bp, Artificial Sequence
  Description of Artificial Sequence: Synthetic oligonucleotide
gccagtgctgttcctgagctcgcctt

SEQ ID NO: 290656 - DNA, 26 bp, Artificial Sequence
  Description of Artificial Sequence: Synthetic oligonucleotide
ccagtgctgttcctgagctcgccttg

SEQ ID NO: 290657 - DNA, 26 bp, Artificial Sequence
  Description of Artificial Sequence: Synthetic oligonucleotide
cagtgctgttcctgagctcgccttgg

SEQ ID NO: 290658 - DNA, 26 bp, Artificial Sequence
  Description of Artificial Sequence: Synthetic oligonucleotide
agtgctgttcctgagctcgccttggc

SEQ ID NO: 290659 - DNA, 25 bp, Artificial Sequence
  Description of Artificial Sequence: Synthetic oligonucleotide
gtgctgttcctgagctcgccttggc

SEQ ID NO: 290660 - DNA, 25 bp, Artificial Sequence
  Description of Artificial Sequence: Synthetic oligonucleotide
tgctgttcctgagctcgccttggcc

SEQ ID NO: 290661 - DNA, 24 bp, Artificial Sequence
  Description of Artificial Sequence: Synthetic oligonucleotide
gctgttcctgagctcgccttggcc

SEQ ID NO: 290662 - DNA, 26 bp, Artificial Sequence
  Description of Artificial Sequence: Synthetic oligonucleotide
ctgttcctgagctcgccttggccgtt

SEQ ID NO: 290663 - DNA, 26 bp, Artificial Sequence
  Description of Artificial Sequence: Synthetic oligonucleotide
tgttcctgagctcgccttggccgttc

SEQ ID NO: 290664 - DNA, 25 bp, Artificial Sequence
  Description of Artificial Sequence: Synthetic oligonucleotide
gttcctgagctcgccttggccgttc

SEQ ID NO: 290665 - DNA, 26 bp, Artificial Sequence
  Description of Artificial Sequence: Synthetic oligonucleotide
ttcctgagctcgccttggccgttcgt

SEQ ID NO: 290666 - DNA, 25 bp, Artificial Sequence
  Description of Artificial Sequence: Synthetic oligonucleotide
tcctgagctcgccttggccgttcgt

SEQ ID NO: 290667 - DNA, 24 bp, Artificial Sequence
  Description of Artificial Sequence: Synthetic oligonucleotide
cctgagctcgccttggccgttcgt

SEQ ID NO: 290668 - DNA, 27 bp, Artificial Sequence
  Description of Artificial Sequence: Synthetic oligonucleotide
ctgagctcgccttggccgttcgtgtat

SEQ ID NO: 290669 - DNA, 27 bp, Artificial Sequence
  Description of Artificial Sequence: Synthetic oligonucleotide
tgagctcgccttggccgttcgtgtatg

SEQ ID NO: 290670 - DNA, 27 bp, Artificial Sequence
  Description of Artificial Sequence: Synthetic oligonucleotide
gagctcgccttggccgttcgtgtatgt

SEQ ID NO: 290671 - DNA, 29 bp, Artificial Sequence
  Description of Artificial Sequence: Synthetic oligonucleotide
agctcgccttggccgttcgtgtatgtatg

SEQ ID NO: 290672 - DNA, 28 bp, Artificial Sequence
  Description of Artificial Sequence: Synthetic oligonucleotide
gctcgccttggccgttcgtgtatgtatg

SEQ ID NO: 290673 - DNA, 28 bp, Artificial Sequence
  Description of Artificial Sequence: Synthetic oligonucleotide
ctcgccttggccgttcgtgtatgtatgg

SEQ ID NO: 290674 - DNA, 30 bp, Artificial Sequence
  Description of Artificial Sequence: Synthetic oligonucleotide
tcgccttggccgttcgtgtatgtatggaag

SEQ ID NO: 290675 - DNA, 29 bp, Artificial Sequence
  Description of Artificial Sequence: Synthetic oligonucleotide
cgccttggccgttcgtgtatgtatggaag

SEQ ID NO: 290676 - DNA, 30 bp, Artificial Sequence
  Description of Artificial Sequence: Synthetic oligonucleotide
gccttggccgttcgtgtatgtatggaagac

SEQ ID NO: 290677 - DNA, 30 bp, Artificial Sequence
  Description of Artificial Sequence: Synthetic oligonucleotide
ccttggccgttcgtgtatgtatggaagacc

SEQ ID NO: 290678 - DNA, 31 bp, Artificial Sequence
  Description of Artificial Sequence: Synthetic oligonucleotide
cttggccgttcgtgtatgtatggaagaccag

SEQ ID NO: 290679 - DNA, 31 bp, Artificial Sequence
  Description of Artificial Sequence: Synthetic oligonucleotide
ttggccgttcgtgtatgtatggaagaccagc

SEQ ID NO: 290680 - DNA, 30 bp, Artificial Sequence
  Description of Artificial Sequence: Synthetic oligonucleotide
tggccgttcgtgtatgtatggaagaccagc

SEQ ID NO: 290681 - DNA, 29 bp, Artificial Sequence
  Description of Artificial Sequence: Synthetic oligonucleotide
ggccgttcgtgtatgtatggaagaccagc

SEQ ID NO: 290682 - DNA, 29 bp, Artificial Sequence
  Description of Artificial Sequence: Synthetic oligonucleotide
gccgttcgtgtatgtatggaagaccagcg

SEQ ID NO: 290683 - DNA, 29 bp, Artificial Sequence
  Description of Artificial Sequence: Synthetic oligonucleotide
ccgttcgtgtatgtatggaagaccagcgg

SEQ ID NO: 290684 - DNA, 29 bp, Artificial Sequence
  Description of Artificial Sequence: Synthetic oligonucleotide
cgttcgtgtatgtatggaagaccagcggc

SEQ ID NO: 290685 - DNA, 30 bp, Artificial Sequence
  Description of Artificial Sequence: Synthetic oligonucleotide
gttcgtgtatgtatggaagaccagcggcag

SEQ ID NO: 290686 - DNA, 30 bp, Artificial Sequence
  Description of Artificial Sequence: Synthetic oligonucleotide
ttcgtgtatgtatggaagaccagcggcagg

SEQ ID NO: 290687 - DNA, 29 bp, Artificial Sequence
  Description of Artificial Sequence: Synthetic oligonucleotide
tcgtgtatgtatggaagaccagcggcagg

SEQ ID NO: 290688 - DNA, 28 bp, Artificial Sequence
  Description of Artificial Sequence: Synthetic oligonucleotide
cgtgtatgtatggaagaccagcggcagg

SEQ ID NO: 290689 - DNA, 28 bp, Artificial Sequence
  Description of Artificial Sequence: Synthetic oligonucleotide
gtgtatgtatggaagaccagcggcaggg

SEQ ID NO: 290690 - DNA, 28 bp, Artificial Sequence
  Description of Artificial Sequence: Synthetic oligonucleotide
tgtatgtatggaagaccagcggcagggg

SEQ ID NO: 290691 - DNA, 27 bp, Artificial Sequence
  Description of Artificial Sequence: Synthetic oligonucleotide
gtatgtatggaagaccagcggcagggg

SEQ ID NO: 290692 - DNA, 27 bp, Artificial Sequence
  Description of Artificial Sequence: Synthetic oligonucleotide
tatgtatggaagaccagcggcaggggc

SEQ ID NO: 290693 - DNA, 27 bp, Artificial Sequence
  Description of Artificial Sequence: Synthetic oligonucleotide
atgtatggaagaccagcggcaggggca

SEQ ID NO: 290694 - DNA, 26 bp, Artificial Sequence
  Description of Artificial Sequence: Synthetic oligonucleotide
tgtatggaagaccagcggcaggggca

SEQ ID NO: 290695 - DNA, 25 bp, Artificial Sequence
  Description of Artificial Sequence: Synthetic oligonucleotide
gtatggaagaccagcggcaggggca

SEQ ID NO: 290696 - DNA, 25 bp, Artificial Sequence
  Description of Artificial Sequence: Synthetic oligonucleotide
tatggaagaccagcggcaggggcag

SEQ ID NO: 290697 - DNA, 24 bp, Artificial Sequence
  Description of Artificial Sequence: Synthetic oligonucleotide
atggaagaccagcggcaggggcag

SEQ ID NO: 290698 - DNA, 23 bp, Artificial Sequence
  Description of Artificial Sequence: Synthetic oligonucleotide
tggaagaccagcggcaggggcag

SEQ ID NO: 290699 - DNA, 22 bp, Artificial Sequence
  Description of Artificial Sequence: Synthetic oligonucleotide
ggaagaccagcggcaggggcag

SEQ ID NO: 290700 - DNA, 23 bp, Artificial Sequence
  Description of Artificial Sequence: Synthetic oligonucleotide
gaagaccagcggcaggggcagga

SEQ ID NO: 290701 - DNA, 23 bp, Artificial Sequence
  Description of Artificial Sequence: Synthetic oligonucleotide
aagaccagcggcaggggcaggag

SEQ ID NO: 290702 - DNA, 22 bp, Artificial Sequence
  Description of Artificial Sequence: Synthetic oligonucleotide
agaccagcggcaggggcaggag

SEQ ID NO: 290703 - DNA, 21 bp, Artificial Sequence
  Description of Artificial Sequence: Synthetic oligonucleotide
gaccagcggcaggggcaggag

SEQ ID NO: 290704 - DNA, 22 bp, Artificial Sequence
  Description of Artificial Sequence: Synthetic oligonucleotide
accagcggcaggggcaggaggt

SEQ ID NO: 290705 - DNA, 21 bp, Artificial Sequence
  Description of Artificial Sequence: Synthetic oligonucleotide
ccagcggcaggggcaggaggt

SEQ ID NO: 290706 - DNA, 21 bp, Artificial Sequence
  Description of Artificial Sequence: Synthetic oligonucleotide
cagcggcaggggcaggaggtg

SEQ ID NO: 290707 - DNA, 22 bp, Artificial Sequence
  Description of Artificial Sequence: Synthetic oligonucleotide
agcggcaggggcaggaggtgga

SEQ ID NO: 290708 - DNA, 21 bp, Artificial Sequence
  Description of Artificial Sequence: Synthetic oligonucleotide
gcggcaggggcaggaggtgga

SEQ ID NO: 290709 - DNA, 21 bp, Artificial Sequence
  Description of Artificial Sequence: Synthetic oligonucleotide
cggcaggggcaggaggtggag

SEQ ID NO: 290710 - DNA, 21 bp, Artificial Sequence
  Description of Artificial Sequence: Synthetic oligonucleotide
ggcaggggcaggaggtggagg

SEQ ID NO: 290711 - DNA, 21 bp, Artificial Sequence
  Description of Artificial Sequence: Synthetic oligonucleotide
gcaggggcaggaggtggaggc

SEQ ID NO: 290712 - DNA, 21 bp, Artificial Sequence
  Description of Artificial Sequence: Synthetic oligonucleotide
caggggcaggaggtggaggcc

SEQ ID NO: 290713 - DNA, 21 bp, Artificial Sequence
  Description of Artificial Sequence: Synthetic oligonucleotide
aggggcaggaggtggaggccc

SEQ ID NO: 290714 - DNA, 20 bp, Artificial Sequence
  Description of Artificial Sequence: Synthetic oligonucleotide
ggggcaggaggtggaggccc

SEQ ID NO: 290715 - DNA, 20 bp, Artificial Sequence
  Description of Artificial Sequence: Synthetic oligonucleotide
gggcaggaggtggaggcccg

SEQ ID NO: 290716 - DNA, 20 bp, Artificial Sequence
  Description of Artificial Sequence: Synthetic oligonucleotide
ggcaggaggtggaggcccgc

SEQ ID NO: 290717 - DNA, 20 bp, Artificial Sequence
  Description of Artificial Sequence: Synthetic oligonucleotide
gcaggaggtggaggcccgcc

SEQ ID NO: 290718 - DNA, 20 bp, Artificial Sequence
  Description of Artificial Sequence: Synthetic oligonucleotide
caggaggtggaggcccgccg

SEQ ID NO: 290719 - DNA, 20 bp, Artificial Sequence
  Description of Artificial Sequence: Synthetic oligonucleotide
aggaggtggaggcccgccgg

SEQ ID NO: 290720 - DNA, 20 bp, Artificial Sequence
  Description of Artificial Sequence: Synthetic oligonucleotide
ggaggtggaggcccgccggt

SEQ ID NO: 290721 - DNA, 20 bp, Artificial Sequence
  Description of Artificial Sequence: Synthetic oligonucleotide
gaggtggaggcccgccgggt

SEQ ID NO: 290722 - DNA, 20 bp, Artificial Sequence
  Description of Artificial Sequence: Synthetic oligonucleotide
aggtggaggcccgccgggca

SEQ ID NO: 290723 - DNA, 20 bp, Artificial Sequence
  Description of Artificial Sequence: Synthetic oligonucleotide
ggtggaggcccgccgggcat

SEQ ID NO: 290724 - DNA, 20 bp, Artificial Sequence
  Description of Artificial Sequence: Synthetic oligonucleotide
gtggaggcccgccgggcagt

SEQ ID NO: 290725 - DNA, 20 bp, Artificial Sequence
  Description of Artificial Sequence: Synthetic oligonucleotide
tggaggcccgccgggcagct

SEQ ID NO: 290726 - DNA, 20 bp, Artificial Sequence
  Description of Artificial Sequence: Synthetic oligonucleotide
ggaggcccgccgggcagctt

SEQ ID NO: 290727 - DNA, 20 bp, Artificial Sequence
  Description of Artificial Sequence: Synthetic oligonucleotide
gaggcccgccgggcagctct

SEQ ID NO: 290728 - DNA, 20 bp, Artificial Sequence
  Description of Artificial Sequence: Synthetic oligonucleotide
aggcccgccgggcagctcca

SEQ ID NO: 290729 - DNA, 20 bp, Artificial Sequence
  Description of Artificial Sequence: Synthetic oligonucleotide
ggcccgccgggcagctccat

SEQ ID NO: 290730 - DNA, 20 bp, Artificial Sequence
  Description of Artificial Sequence: Synthetic oligonucleotide
gcccgccgggcagctccagt

SEQ ID NO: 290731 - DNA, 21 bp, Artificial Sequence
  Description of Artificial Sequence: Synthetic oligonucleotide
cccgccgggcagctccagctt

SEQ ID NO: 290732 - DNA, 22 bp, Artificial Sequence
  Description of Artificial Sequence: Synthetic oligonucleotide
ccgccgggcagctccagcttct

SEQ ID NO: 290733 - DNA, 22 bp, Artificial Sequence
  Description of Artificial Sequence: Synthetic oligonucleotide
cgccgggcagctccagcttctg

SEQ ID NO: 290734 - DNA, 23 bp, Artificial Sequence
  Description of Artificial Sequence: Synthetic oligonucleotide
gccgggcagctccagcttctggt

SEQ ID NO: 290735 - DNA, 23 bp, Artificial Sequence
  Description of Artificial Sequence: Synthetic oligonucleotide
ccgggcagctccagcttctggtg

SEQ ID NO: 290736 - DNA, 24 bp, Artificial Sequence
  Description of Artificial Sequence: Synthetic oligonucleotide
cgggcagctccagcttctggtgct

SEQ ID NO: 290737 - DNA, 25 bp, Artificial Sequence
  Description of Artificial Sequence: Synthetic oligonucleotide
gggcagctccagcttctggtgctga

SEQ ID NO: 290738 - DNA, 25 bp, Artificial Sequence
  Description of Artificial Sequence: Synthetic oligonucleotide
ggcagctccagcttctggtgctgag

SEQ ID NO: 290739 - DNA, 25 bp, Artificial Sequence
  Description of Artificial Sequence: Synthetic oligonucleotide
gcagctccagcttctggtgctgagg

SEQ ID NO: 290740 - DNA, 25 bp, Artificial Sequence
  Description of Artificial Sequence: Synthetic oligonucleotide
cagctccagcttctggtgctgaggc

SEQ ID NO: 290741 - DNA, 25 bp, Artificial Sequence
  Description of Artificial Sequence: Synthetic oligonucleotide
agctccagcttctggtgctgaggcg

SEQ ID NO: 290742 - DNA, 24 bp, Artificial Sequence
  Description of Artificial Sequence: Synthetic oligonucleotide
gctccagcttctggtgctgaggcg

SEQ ID NO: 290743 - DNA, 24 bp, Artificial Sequence
  Description of Artificial Sequence: Synthetic oligonucleotide
ctccagcttctggtgctgaggcgg

SEQ ID NO: 290744 - DNA, 24 bp, Artificial Sequence
  Description of Artificial Sequence: Synthetic oligonucleotide
tccagcttctggtgctgaggcggg

SEQ ID NO: 290745 - DNA, 23 bp, Artificial Sequence
  Description of Artificial Sequence: Synthetic oligonucleotide
ccagcttctggtgctgaggcggg

SEQ ID NO: 290746 - DNA, 26 bp, Artificial Sequence
  Description of Artificial Sequence: Synthetic oligonucleotide
cagcttctggtgctgaggcggggatt

SEQ ID NO: 290747 - DNA, 26 bp, Artificial Sequence
  Description of Artificial Sequence: Synthetic oligonucleotide
agcttctggtgctgaggcggggattg

SEQ ID NO: 290748 - DNA, 25 bp, Artificial Sequence
  Description of Artificial Sequence: Synthetic oligonucleotide
gcttctggtgctgaggcggggattg

SEQ ID NO: 290749 - DNA, 27 bp, Artificial Sequence
  Description of Artificial Sequence: Synthetic oligonucleotide
cttctggtgctgaggcggggattgctt

SEQ ID NO: 290750 - DNA, 27 bp, Artificial Sequence
  Description of Artificial Sequence: Synthetic oligonucleotide
ttctggtgctgaggcggggattgcttc

SEQ ID NO: 290751 - DNA, 26 bp, Artificial Sequence
  Description of Artificial Sequence: Synthetic oligonucleotide
tctggtgctgaggcggggattgcttc

SEQ ID NO: 290752 - DNA, 25 bp, Artificial Sequence
  Description of Artificial Sequence: Synthetic oligonucleotide
ctggtgctgaggcggggattgcttc

SEQ ID NO: 290753 - DNA, 26 bp, Artificial Sequence
  Description of Artificial Sequence: Synthetic oligonucleotide
tggtgctgaggcggggattgcttcga

SEQ ID NO: 290754 - DNA, 25 bp, Artificial Sequence
  Description of Artificial Sequence: Synthetic oligonucleotide
ggtgctgaggcggggattgcttcga

SEQ ID NO: 290755 - DNA, 26 bp, Artificial Sequence
  Description of Artificial Sequence: Synthetic oligonucleotide
gtgctgaggcggggattgcttcgact

SEQ ID NO: 290756 - DNA, 26 bp, Artificial Sequence
  Description of Artificial Sequence: Synthetic oligonucleotide
tgctgaggcggggattgcttcgactg

SEQ ID NO: 290757 - DNA, 25 bp, Artificial Sequence
  Description of Artificial Sequence: Synthetic oligonucleotide
gctgaggcggggattgcttcgactg

SEQ ID NO: 290758 - DNA, 25 bp, Artificial Sequence
  Description of Artificial Sequence: Synthetic oligonucleotide
ctgaggcggggattgcttcgactgg

SEQ ID NO: 290759 - DNA, 26 bp, Artificial Sequence
  Description of Artificial Sequence: Synthetic oligonucleotide
tgaggcggggattgcttcgactggga

SEQ ID NO: 290760 - DNA, 25 bp, Artificial Sequence
  Description of Artificial Sequence: Synthetic oligonucleotide
gaggcggggattgcttcgactggga

SEQ ID NO: 290761 - DNA, 26 bp, Artificial Sequence
  Description of Artificial Sequence: Synthetic oligonucleotide
aggcggggattgcttcgactgggagt

SEQ ID NO: 290762 - DNA, 25 bp, Artificial Sequence
  Description of Artificial Sequence: Synthetic oligonucleotide
ggcggggattgcttcgactgggagt

SEQ ID NO: 290763 - DNA, 27 bp, Artificial Sequence
  Description of Artificial Sequence: Synthetic oligonucleotide
gcggggattgcttcgactgggagtgaa

SEQ ID NO: 290764 - DNA, 27 bp, Artificial Sequence
  Description of Artificial Sequence: Synthetic oligonucleotide
cggggattgcttcgactgggagtgaag

SEQ ID NO: 290765 - DNA, 28 bp, Artificial Sequence
  Description of Artificial Sequence: Synthetic oligonucleotide
ggggattgcttcgactgggagtgaagac

SEQ ID NO: 290766 - DNA, 29 bp, Artificial Sequence
  Description of Artificial Sequence: Synthetic oligonucleotide
gggattgcttcgactgggagtgaagactc

SEQ ID NO: 290767 - DNA, 30 bp, Artificial Sequence
  Description of Artificial Sequence: Synthetic oligonucleotide
ggattgcttcgactgggagtgaagactctg

SEQ ID NO: 290768 - DNA, 31 bp, Artificial Sequence
  Description of Artificial Sequence: Synthetic oligonucleotide
gattgcttcgactgggagtgaagactctgac

SEQ ID NO: 290769 - DNA, 31 bp, Artificial Sequence
  Description of Artificial Sequence: Synthetic oligonucleotide
attgcttcgactgggagtgaagactctgacg

SEQ ID NO: 290770 - DNA, 30 bp, Artificial Sequence
  Description of Artificial Sequence: Synthetic oligonucleotide
ttgcttcgactgggagtgaagactctgacg

SEQ ID NO: 290771 - DNA, 29 bp, Artificial Sequence
  Description of Artificial Sequence: Synthetic oligonucleotide
tgcttcgactgggagtgaagactctgacg

SEQ ID NO: 290772 - DNA, 28 bp, Artificial Sequence
  Description of Artificial Sequence: Synthetic oligonucleotide
gcttcgactgggagtgaagactctgacg

SEQ ID NO: 290773 - DNA, 30 bp, Artificial Sequence
  Description of Artificial Sequence: Synthetic oligonucleotide
cttcgactgggagtgaagactctgacgatg

SEQ ID NO: 290774 - DNA, 30 bp, Artificial Sequence
  Description of Artificial Sequence: Synthetic oligonucleotide
ttcgactgggagtgaagactctgacgatgc

SEQ ID NO: 290775 - DNA, 29 bp, Artificial Sequence
  Description of Artificial Sequence: Synthetic oligonucleotide
tcgactgggagtgaagactctgacgatgc

SEQ ID NO: 290776 - DNA, 28 bp, Artificial Sequence
  Description of Artificial Sequence: Synthetic oligonucleotide
cgactgggagtgaagactctgacgatgc

SEQ ID NO: 290777 - DNA, 28 bp, Artificial Sequence
  Description of Artificial Sequence: Synthetic oligonucleotide
gactgggagtgaagactctgacgatgcc

SEQ ID NO: 290778 - DNA, 28 bp, Artificial Sequence
  Description of Artificial Sequence: Synthetic oligonucleotide
actgggagtgaagactctgacgatgccg

SEQ ID NO: 290779 - DNA, 27 bp, Artificial Sequence
  Description of Artificial Sequence: Synthetic oligonucleotide
ctgggagtgaagactctgacgatgccg

SEQ ID NO: 290780 - DNA, 28 bp, Artificial Sequence
  Description of Artificial Sequence: Synthetic oligonucleotide
tgggagtgaagactctgacgatgccgtg

SEQ ID NO: 290781 - DNA, 27 bp, Artificial Sequence
  Description of Artificial Sequence: Synthetic oligonucleotide
gggagtgaagactctgacgatgccgtg

SEQ ID NO: 290782 - DNA, 27 bp, Artificial Sequence
  Description of Artificial Sequence: Synthetic oligonucleotide
ggagtgaagactctgacgatgccgtgc

SEQ ID NO: 290783 - DNA, 28 bp, Artificial Sequence
  Description of Artificial Sequence: Synthetic oligonucleotide
gagtgaagactctgacgatgccgtgctg

SEQ ID NO: 290784 - DNA, 30 bp, Artificial Sequence
  Description of Artificial Sequence: Synthetic oligonucleotide
agtgaagactctgacgatgccgtgctgaag

SEQ ID NO: 290785 - DNA, 29 bp, Artificial Sequence
  Description of Artificial Sequence: Synthetic oligonucleotide
gtgaagactctgacgatgccgtgctgaag

SEQ ID NO: 290786 - DNA, 31 bp, Artificial Sequence
  Description of Artificial Sequence: Synthetic oligonucleotide
tgaagactctgacgatgccgtgctgaagaag

SEQ ID NO: 290787 - DNA, 30 bp, Artificial Sequence
  Description of Artificial Sequence: Synthetic oligonucleotide
gaagactctgacgatgccgtgctgaagaag

SEQ ID NO: 290788 - DNA, 31 bp, Artificial Sequence
  Description of Artificial Sequence: Synthetic oligonucleotide
aagactctgacgatgccgtgctgaagaagac

SEQ ID NO: 290789 - DNA, 30 bp, Artificial Sequence
  Description of Artificial Sequence: Synthetic oligonucleotide
agactctgacgatgccgtgctgaagaagac

SEQ ID NO: 290790 - DNA, 29 bp, Artificial Sequence
  Description of Artificial Sequence: Synthetic oligonucleotide
gactctgacgatgccgtgctgaagaagac

SEQ ID NO: 290791 - DNA, 29 bp, Artificial Sequence
  Description of Artificial Sequence: Synthetic oligonucleotide
actctgacgatgccgtgctgaagaagacc

SEQ ID NO: 290792 - DNA, 28 bp, Artificial Sequence
  Description of Artificial Sequence: Synthetic oligonucleotide
ctctgacgatgccgtgctgaagaagacc

SEQ ID NO: 290793 - DNA, 30 bp, Artificial Sequence
  Description of Artificial Sequence: Synthetic oligonucleotide
tctgacgatgccgtgctgaagaagaccatc

SEQ ID NO: 290794 - DNA, 29 bp, Artificial Sequence
  Description of Artificial Sequence: Synthetic oligonucleotide
ctgacgatgccgtgctgaagaagaccatc

SEQ ID NO: 290795 - DNA, 30 bp, Artificial Sequence
  Description of Artificial Sequence: Synthetic oligonucleotide
tgacgatgccgtgctgaagaagaccatcag

SEQ ID NO: 290796 - DNA, 29 bp, Artificial Sequence
  Description of Artificial Sequence: Synthetic oligonucleotide
gacgatgccgtgctgaagaagaccatcag

SEQ ID NO: 290797 - DNA, 29 bp, Artificial Sequence
  Description of Artificial Sequence: Synthetic oligonucleotide
acgatgccgtgctgaagaagaccatcagg

SEQ ID NO: 290798 - DNA, 28 bp, Artificial Sequence
  Description of Artificial Sequence: Synthetic oligonucleotide
cgatgccgtgctgaagaagaccatcagg

SEQ ID NO: 290799 - DNA, 28 bp, Artificial Sequence
  Description of Artificial Sequence: Synthetic oligonucleotide
gatgccgtgctgaagaagaccatcaggc

SEQ ID NO: 290800 - DNA, 29 bp, Artificial Sequence
  Description of Artificial Sequence: Synthetic oligonucleotide
atgccgtgctgaagaagaccatcaggcag

SEQ ID NO: 290801 - DNA, 28 bp, Artificial Sequence
  Description of Artificial Sequence: Synthetic oligonucleotide
tgccgtgctgaagaagaccatcaggcag

SEQ ID NO: 290802 - DNA, 27 bp, Artificial Sequence
  Description of Artificial Sequence: Synthetic oligonucleotide
gccgtgctgaagaagaccatcaggcag

SEQ ID NO: 290803 - DNA, 27 bp, Artificial Sequence
  Description of Artificial Sequence: Synthetic oligonucleotide
ccgtgctgaagaagaccatcaggcagc

SEQ ID NO: 290804 - DNA, 29 bp, Artificial Sequence
  Description of Artificial Sequence: Synthetic oligonucleotide
cgtgctgaagaagaccatcaggcagcaag

SEQ ID NO: 290805 - DNA, 30 bp, Artificial Sequence
  Description of Artificial Sequence: Synthetic oligonucleotide
gtgctgaagaagaccatcaggcagcaagag

SEQ ID NO: 290806 - DNA, 33 bp, Artificial Sequence
  Description of Artificial Sequence: Synthetic oligonucleotide
tgctgaagaagaccatcaggcagcaagagattg

SEQ ID NO: 290807 - DNA, 32 bp, Artificial Sequence
  Description of Artificial Sequence: Synthetic oligonucleotide
gctgaagaagaccatcaggcagcaagagattg

SEQ ID NO: 290808 - DNA, 32 bp, Artificial Sequence
  Description of Artificial Sequence: Synthetic oligonucleotide
ctgaagaagaccatcaggcagcaagagattgg

SEQ ID NO: 290809 - DNA, 32 bp, Artificial Sequence
  Description of Artificial Sequence: Synthetic oligonucleotide
tgaagaagaccatcaggcagcaagagattggc

SEQ ID NO: 290810 - DNA, 31 bp, Artificial Sequence
  Description of Artificial Sequence: Synthetic oligonucleotide
gaagaagaccatcaggcagcaagagattggc

SEQ ID NO: 290811 - DNA, 31 bp, Artificial Sequence
  Description of Artificial Sequence: Synthetic oligonucleotide
aagaagaccatcaggcagcaagagattggcc

SEQ ID NO: 290812 - DNA, 30 bp, Artificial Sequence
  Description of Artificial Sequence: Synthetic oligonucleotide
agaagaccatcaggcagcaagagattggcc

SEQ ID NO: 290813 - DNA, 29 bp, Artificial Sequence
  Description of Artificial Sequence: Synthetic oligonucleotide
gaagaccatcaggcagcaagagattggcc

SEQ ID NO: 290814 - DNA, 29 bp, Artificial Sequence
  Description of Artificial Sequence: Synthetic oligonucleotide
aagaccatcaggcagcaagagattggccg

SEQ ID NO: 290815 - DNA, 28 bp, Artificial Sequence
  Description of Artificial Sequence: Synthetic oligonucleotide
agaccatcaggcagcaagagattggccg

SEQ ID NO: 290816 - DNA, 27 bp, Artificial Sequence
  Description of Artificial Sequence: Synthetic oligonucleotide
gaccatcaggcagcaagagattggccg

SEQ ID NO: 290817 - DNA, 27 bp, Artificial Sequence
  Description of Artificial Sequence: Synthetic oligonucleotide
accatcaggcagcaagagattggccgc

SEQ ID NO: 290818 - DNA, 27 bp, Artificial Sequence
  Description of Artificial Sequence: Synthetic oligonucleotide
ccatcaggcagcaagagattggccgca

SEQ ID NO: 290819 - DNA, 27 bp, Artificial Sequence
  Description of Artificial Sequence: Synthetic oligonucleotide
catcaggcagcaagagattggccgcag

SEQ ID NO: 290820 - DNA, 28 bp, Artificial Sequence
  Description of Artificial Sequence: Synthetic oligonucleotide
atcaggcagcaagagattggccgcagtg

SEQ ID NO: 290821 - DNA, 27 bp, Artificial Sequence
  Description of Artificial Sequence: Synthetic oligonucleotide
tcaggcagcaagagattggccgcagtg

SEQ ID NO: 290822 - DNA, 26 bp, Artificial Sequence
  Description of Artificial Sequence: Synthetic oligonucleotide
caggcagcaagagattggccgcagtg

SEQ ID NO: 290823 - DNA, 26 bp, Artificial Sequence
  Description of Artificial Sequence: Synthetic oligonucleotide
aggcagcaagagattggccgcagtgg

SEQ ID NO: 290824 - DNA, 25 bp, Artificial Sequence
  Description of Artificial Sequence: Synthetic oligonucleotide
ggcagcaagagattggccgcagtgg

SEQ ID NO: 290825 - DNA, 25 bp, Artificial Sequence
  Description of Artificial Sequence: Synthetic oligonucleotide
gcagcaagagattggccgcagtggg

SEQ ID NO: 290826 - DNA, 27 bp, Artificial Sequence
  Description of Artificial Sequence: Synthetic oligonucleotide
cagcaagagattggccgcagtgggctt

SEQ ID NO: 290827 - DNA, 27 bp, Artificial Sequence
  Description of Artificial Sequence: Synthetic oligonucleotide
agcaagagattggccgcagtgggcttc

SEQ ID NO: 290828 - DNA, 26 bp, Artificial Sequence
  Description of Artificial Sequence: Synthetic oligonucleotide
gcaagagattggccgcagtgggcttc

SEQ ID NO: 290829 - DNA, 27 bp, Artificial Sequence
  Description of Artificial Sequence: Synthetic oligonucleotide
caagagattggccgcagtgggcttcca

SEQ ID NO: 290830 - DNA, 27 bp, Artificial Sequence
  Description of Artificial Sequence: Synthetic oligonucleotide
aagagattggccgcagtgggcttccag

SEQ ID NO: 290831 - DNA, 27 bp, Artificial Sequence
  Description of Artificial Sequence: Synthetic oligonucleotide
agagattggccgcagtgggcttccaga

SEQ ID NO: 290832 - DNA, 26 bp, Artificial Sequence
  Description of Artificial Sequence: Synthetic oligonucleotide
gagattggccgcagtgggcttccaga

SEQ ID NO: 290833 - DNA, 26 bp, Artificial Sequence
  Description of Artificial Sequence: Synthetic oligonucleotide
agattggccgcagtgggcttccagac

SEQ ID NO: 290834 - DNA, 25 bp, Artificial Sequence
  Description of Artificial Sequence: Synthetic oligonucleotide
gattggccgcagtgggcttccagac

SEQ ID NO: 290835 - DNA, 27 bp, Artificial Sequence
  Description of Artificial Sequence: Synthetic oligonucleotide
attggccgcagtgggcttccagaccta

SEQ ID NO: 290836 - DNA, 27 bp, Artificial Sequence
  Description of Artificial Sequence: Synthetic oligonucleotide
ttggccgcagtgggcttccagacctaa

SEQ ID NO: 290837 - DNA, 26 bp, Artificial Sequence
  Description of Artificial Sequence: Synthetic oligonucleotide
tggccgcagtgggcttccagacctaa

SEQ ID NO: 290838 - DNA, 25 bp, Artificial Sequence
  Description of Artificial Sequence: Synthetic oligonucleotide
ggccgcagtgggcttccagacctaa

SEQ ID NO: 290839 - DNA, 25 bp, Artificial Sequence
  Description of Artificial Sequence: Synthetic oligonucleotide
gccgcagtgggcttccagacctaag

SEQ ID NO: 290840 - DNA, 26 bp, Artificial Sequence
  Description of Artificial Sequence: Synthetic oligonucleotide
ccgcagtgggcttccagacctaagct

SEQ ID NO: 290841 - DNA, 27 bp, Artificial Sequence
  Description of Artificial Sequence: Synthetic oligonucleotide
cgcagtgggcttccagacctaagctgt

SEQ ID NO: 290842 - DNA, 29 bp, Artificial Sequence
  Description of Artificial Sequence: Synthetic oligonucleotide
gcagtgggcttccagacctaagctgtatg

SEQ ID NO: 290843 - DNA, 30 bp, Artificial Sequence
  Description of Artificial Sequence: Synthetic oligonucleotide
cagtgggcttccagacctaagctgtatgac

SEQ ID NO: 290844 - DNA, 31 bp, Artificial Sequence
  Description of Artificial Sequence: Synthetic oligonucleotide
agtgggcttccagacctaagctgtatgactg

SEQ ID NO: 290845 - DNA, 30 bp, Artificial Sequence
  Description of Artificial Sequence: Synthetic oligonucleotide
gtgggcttccagacctaagctgtatgactg

SEQ ID NO: 290846 - DNA, 31 bp, Artificial Sequence
  Description of Artificial Sequence: Synthetic oligonucleotide
tgggcttccagacctaagctgtatgactgtg

SEQ ID NO: 290847 - DNA, 30 bp, Artificial Sequence
  Description of Artificial Sequence: Synthetic oligonucleotide
gggcttccagacctaagctgtatgactgtg

SEQ ID NO: 290848 - DNA, 30 bp, Artificial Sequence
  Description of Artificial Sequence: Synthetic oligonucleotide
ggcttccagacctaagctgtatgactgtgg

SEQ ID NO: 290849 - DNA, 32 bp, Artificial Sequence
  Description of Artificial Sequence: Synthetic oligonucleotide
gcttccagacctaagctgtatgactgtggaag

SEQ ID NO: 290850 - DNA, 33 bp, Artificial Sequence
  Description of Artificial Sequence: Synthetic oligonucleotide
cttccagacctaagctgtatgactgtggaagag

SEQ ID NO: 290851 - DNA, 33 bp, Artificial Sequence
  Description of Artificial Sequence: Synthetic oligonucleotide
ttccagacctaagctgtatgactgtggaagagc

SEQ ID NO: 290852 - DNA, 32 bp, Artificial Sequence
  Description of Artificial Sequence: Synthetic oligonucleotide
tccagacctaagctgtatgactgtggaagagc

SEQ ID NO: 290853 - DNA, 31 bp, Artificial Sequence
  Description of Artificial Sequence: Synthetic oligonucleotide
ccagacctaagctgtatgactgtggaagagc

SEQ ID NO: 290854 - DNA, 32 bp, Artificial Sequence
  Description of Artificial Sequence: Synthetic oligonucleotide
cagacctaagctgtatgactgtggaagagcac

SEQ ID NO: 290855 - DNA, 35 bp, Artificial Sequence
  Description of Artificial Sequence: Synthetic oligonucleotide
agacctaagctgtatgactgtggaagagcacattg

SEQ ID NO: 290856 - DNA, 34 bp, Artificial Sequence
  Description of Artificial Sequence: Synthetic oligonucleotide
gacctaagctgtatgactgtggaagagcacattg

SEQ ID NO: 290857 - DNA, 34 bp, Artificial Sequence
  Description of Artificial Sequence: Synthetic oligonucleotide
acctaagctgtatgactgtggaagagcacattgc

SEQ ID NO: 290858 - DNA, 33 bp, Artificial Sequence
  Description of Artificial Sequence: Synthetic oligonucleotide
cctaagctgtatgactgtggaagagcacattgc

SEQ ID NO: 290859 - DNA, 37 bp, Artificial Sequence
  Description of Artificial Sequence: Synthetic oligonucleotide
ctaagctgtatgactgtggaagagcacattgcttatc

SEQ ID NO: 290860 - DNA, 37 bp, Artificial Sequence
  Description of Artificial Sequence: Synthetic oligonucleotide
taagctgtatgactgtggaagagcacattgcttatcc

SEQ ID NO: 290861 - DNA, 36 bp, Artificial Sequence
  Description of Artificial Sequence: Synthetic oligonucleotide
aagctgtatgactgtggaagagcacattgcttatcc

SEQ ID NO: 290862 - DNA, 35 bp, Artificial Sequence
  Description of Artificial Sequence: Synthetic oligonucleotide
agctgtatgactgtggaagagcacattgcttatcc

SEQ ID NO: 290863 - DNA, 34 bp, Artificial Sequence
  Description of Artificial Sequence: Synthetic oligonucleotide
gctgtatgactgtggaagagcacattgcttatcc

SEQ ID NO: 290864 - DNA, 34 bp, Artificial Sequence
  Description of Artificial Sequence: Synthetic oligonucleotide
ctgtatgactgtggaagagcacattgcttatccc

SEQ ID NO: 290865 - DNA, 36 bp, Artificial Sequence
  Description of Artificial Sequence: Synthetic oligonucleotide
tgtatgactgtggaagagcacattgcttatcccatg

SEQ ID NO: 290866 - DNA, 35 bp, Artificial Sequence
  Description of Artificial Sequence: Synthetic oligonucleotide
gtatgactgtggaagagcacattgcttatcccatg

SEQ ID NO: 290867 - DNA, 35 bp, Artificial Sequence
  Description of Artificial Sequence: Synthetic oligonucleotide
tatgactgtggaagagcacattgcttatcccatgc

SEQ ID NO: 290868 - DNA, 34 bp, Artificial Sequence
  Description of Artificial Sequence: Synthetic oligonucleotide
atgactgtggaagagcacattgcttatcccatgc

SEQ ID NO: 290869 - DNA, 33 bp, Artificial Sequence
  Description of Artificial Sequence: Synthetic oligonucleotide
tgactgtggaagagcacattgcttatcccatgc

SEQ ID NO: 290870 - DNA, 32 bp, Artificial Sequence
  Description of Artificial Sequence: Synthetic oligonucleotide
gactgtggaagagcacattgcttatcccatgc

SEQ ID NO: 290871 - DNA, 33 bp, Artificial Sequence
  Description of Artificial Sequence: Synthetic oligonucleotide
actgtggaagagcacattgcttatcccatgcag

SEQ ID NO: 290872 - DNA, 32 bp, Artificial Sequence
  Description of Artificial Sequence: Synthetic oligonucleotide
ctgtggaagagcacattgcttatcccatgcag

SEQ ID NO: 290873 - DNA, 34 bp, Artificial Sequence
  Description of Artificial Sequence: Synthetic oligonucleotide
tgtggaagagcacattgcttatcccatgcagaag

SEQ ID NO: 290874 - DNA, 33 bp, Artificial Sequence
  Description of Artificial Sequence: Synthetic oligonucleotide
gtggaagagcacattgcttatcccatgcagaag

SEQ ID NO: 290875 - DNA, 34 bp, Artificial Sequence
  Description of Artificial Sequence: Synthetic oligonucleotide
tggaagagcacattgcttatcccatgcagaagtc

SEQ ID NO: 290876 - DNA, 33 bp, Artificial Sequence
  Description of Artificial Sequence: Synthetic oligonucleotide
ggaagagcacattgcttatcccatgcagaagtc

SEQ ID NO: 290877 - DNA, 33 bp, Artificial Sequence
  Description of Artificial Sequence: Synthetic oligonucleotide
gaagagcacattgcttatcccatgcagaagtcc

SEQ ID NO: 290878 - DNA, 33 bp, Artificial Sequence
  Description of Artificial Sequence: Synthetic oligonucleotide
aagagcacattgcttatcccatgcagaagtccc

SEQ ID NO: 290879 - DNA, 32 bp, Artificial Sequence
  Description of Artificial Sequence: Synthetic oligonucleotide
agagcacattgcttatcccatgcagaagtccc

SEQ ID NO: 290880 - DNA, 31 bp, Artificial Sequence
  Description of Artificial Sequence: Synthetic oligonucleotide
gagcacattgcttatcccatgcagaagtccc

SEQ ID NO: 290881 - DNA, 32 bp, Artificial Sequence
  Description of Artificial Sequence: Synthetic oligonucleotide
agcacattgcttatcccatgcagaagtccctg

SEQ ID NO: 290882 - DNA, 31 bp, Artificial Sequence
  Description of Artificial Sequence: Synthetic oligonucleotide
gcacattgcttatcccatgcagaagtccctg

SEQ ID NO: 290883 - DNA, 31 bp, Artificial Sequence
  Description of Artificial Sequence: Synthetic oligonucleotide
cacattgcttatcccatgcagaagtccctgc

SEQ ID NO: 290884 - DNA, 32 bp, Artificial Sequence
  Description of Artificial Sequence: Synthetic oligonucleotide
acattgcttatcccatgcagaagtccctgcac

SEQ ID NO: 290885 - DNA, 31 bp, Artificial Sequence
  Description of Artificial Sequence: Synthetic oligonucleotide
cattgcttatcccatgcagaagtccctgcac

SEQ ID NO: 290886 - DNA, 31 bp, Artificial Sequence
  Description of Artificial Sequence: Synthetic oligonucleotide
attgcttatcccatgcagaagtccctgcacg

SEQ ID NO: 290887 - DNA, 30 bp, Artificial Sequence
  Description of Artificial Sequence: Synthetic oligonucleotide
ttgcttatcccatgcagaagtccctgcacg

SEQ ID NO: 290888 - DNA, 29 bp, Artificial Sequence
  Description of Artificial Sequence: Synthetic oligonucleotide
tgcttatcccatgcagaagtccctgcacg

SEQ ID NO: 290889 - DNA, 28 bp, Artificial Sequence
  Description of Artificial Sequence: Synthetic oligonucleotide
gcttatcccatgcagaagtccctgcacg

SEQ ID NO: 290890 - DNA, 28 bp, Artificial Sequence
  Description of Artificial Sequence: Synthetic oligonucleotide
cttatcccatgcagaagtccctgcacgg

SEQ ID NO: 290891 - DNA, 29 bp, Artificial Sequence
  Description of Artificial Sequence: Synthetic oligonucleotide
ttatcccatgcagaagtccctgcacggag

SEQ ID NO: 290892 - DNA, 28 bp, Artificial Sequence
  Description of Artificial Sequence: Synthetic oligonucleotide
tatcccatgcagaagtccctgcacggag

SEQ ID NO: 290893 - DNA, 27 bp, Artificial Sequence
  Description of Artificial Sequence: Synthetic oligonucleotide
atcccatgcagaagtccctgcacggag

SEQ ID NO: 290894 - DNA, 26 bp, Artificial Sequence
  Description of Artificial Sequence: Synthetic oligonucleotide
tcccatgcagaagtccctgcacggag

SEQ ID NO: 290895 - DNA, 25 bp, Artificial Sequence
  Description of Artificial Sequence: Synthetic oligonucleotide
cccatgcagaagtccctgcacggag

SEQ ID NO: 290896 - DNA, 26 bp, Artificial Sequence
  Description of Artificial Sequence: Synthetic oligonucleotide
ccatgcagaagtccctgcacggagca

SEQ ID NO: 290897 - DNA, 27 bp, Artificial Sequence
  Description of Artificial Sequence: Synthetic oligonucleotide
catgcagaagtccctgcacggagcaga

SEQ ID NO: 290898 - DNA, 27 bp, Artificial Sequence
  Description of Artificial Sequence: Synthetic oligonucleotide
atgcagaagtccctgcacggagcagag

SEQ ID NO: 290899 - DNA, 27 bp, Artificial Sequence
  Description of Artificial Sequence: Synthetic oligonucleotide
tgcagaagtccctgcacggagcagaga

SEQ ID NO: 290900 - DNA, 27 bp, Artificial Sequence
  Description of Artificial Sequence: Synthetic oligonucleotide
gcagaagtccctgcacggagcagagat

SEQ ID NO: 290901 - DNA, 28 bp, Artificial Sequence
  Description of Artificial Sequence: Synthetic oligonucleotide
cagaagtccctgcacggagcagagattg

SEQ ID NO: 290902 - DNA, 28 bp, Artificial Sequence
  Description of Artificial Sequence: Synthetic oligonucleotide
agaagtccctgcacggagcagagattgg

SEQ ID NO: 290903 - DNA, 27 bp, Artificial Sequence
  Description of Artificial Sequence: Synthetic oligonucleotide
gaagtccctgcacggagcagagattgg

SEQ ID NO: 290904 - DNA, 27 bp, Artificial Sequence
  Description of Artificial Sequence: Synthetic oligonucleotide
aagtccctgcacggagcagagattggc

SEQ ID NO: 290905 - DNA, 26 bp, Artificial Sequence
  Description of Artificial Sequence: Synthetic oligonucleotide
agtccctgcacggagcagagattggc

SEQ ID NO: 290906 - DNA, 25 bp, Artificial Sequence
  Description of Artificial Sequence: Synthetic oligonucleotide
gtccctgcacggagcagagattggc

SEQ ID NO: 290907 - DNA, 26 bp, Artificial Sequence
  Description of Artificial Sequence: Synthetic oligonucleotide
tccctgcacggagcagagattggcca

SEQ ID NO: 290908 - DNA, 25 bp, Artificial Sequence
  Description of Artificial Sequence: Synthetic oligonucleotide
ccctgcacggagcagagattggcca

SEQ ID NO: 290909 - DNA, 25 bp, Artificial Sequence
  Description of Artificial Sequence: Synthetic oligonucleotide
cctgcacggagcagagattggccag

SEQ ID NO: 290910 - DNA, 25 bp, Artificial Sequence
  Description of Artificial Sequence: Synthetic oligonucleotide
ctgcacggagcagagattggccagg

SEQ ID NO: 290911 - DNA, 25 bp, Artificial Sequence
  Description of Artificial Sequence: Synthetic oligonucleotide
tgcacggagcagagattggccaggg

SEQ ID NO: 290912 - DNA, 24 bp, Artificial Sequence
  Description of Artificial Sequence: Synthetic oligonucleotide
gcacggagcagagattggccaggg

SEQ ID NO: 290913 - DNA, 24 bp, Artificial Sequence
  Description of Artificial Sequence: Synthetic oligonucleotide
cacggagcagagattggccagggg

SEQ ID NO: 290914 - DNA, 27 bp, Artificial Sequence
  Description of Artificial Sequence: Synthetic oligonucleotide
acggagcagagattggccagggggaat

SEQ ID NO: 290915 - DNA, 26 bp, Artificial Sequence
  Description of Artificial Sequence: Synthetic oligonucleotide
cggagcagagattggccagggggaat

SEQ ID NO: 290916 - DNA, 27 bp, Artificial Sequence
  Description of Artificial Sequence: Synthetic oligonucleotide
ggagcagagattggccagggggaatca

SEQ ID NO: 290917 - DNA, 27 bp, Artificial Sequence
  Description of Artificial Sequence: Synthetic oligonucleotide
gagcagagattggccagggggaatcag

SEQ ID NO: 290918 - DNA, 27 bp, Artificial Sequence
  Description of Artificial Sequence: Synthetic oligonucleotide
agcagagattggccagggggaatcagc

SEQ ID NO: 290919 - DNA, 27 bp, Artificial Sequence
  Description of Artificial Sequence: Synthetic oligonucleotide
gcagagattggccagggggaatcagct

SEQ ID NO: 290920 - DNA, 27 bp, Artificial Sequence
  Description of Artificial Sequence: Synthetic oligonucleotide
cagagattggccagggggaatcagctg

SEQ ID NO: 290921 - DNA, 28 bp, Artificial Sequence
  Description of Artificial Sequence: Synthetic oligonucleotide
agagattggccagggggaatcagctgac

SEQ ID NO: 290922 - DNA, 27 bp, Artificial Sequence
  Description of Artificial Sequence: Synthetic oligonucleotide
gagattggccagggggaatcagctgac

SEQ ID NO: 290923 - DNA, 30 bp, Artificial Sequence
  Description of Artificial Sequence: Synthetic oligonucleotide
agattggccagggggaatcagctgacattg

SEQ ID NO: 290924 - DNA, 29 bp, Artificial Sequence
  Description of Artificial Sequence: Synthetic oligonucleotide
gattggccagggggaatcagctgacattg

SEQ ID NO: 290925 - DNA, 31 bp, Artificial Sequence
  Description of Artificial Sequence: Synthetic oligonucleotide
attggccagggggaatcagctgacattgatc

SEQ ID NO: 290926 - DNA, 30 bp, Artificial Sequence
  Description of Artificial Sequence: Synthetic oligonucleotide
ttggccagggggaatcagctgacattgatc

SEQ ID NO: 290927 - DNA, 29 bp, Artificial Sequence
  Description of Artificial Sequence: Synthetic oligonucleotide
tggccagggggaatcagctgacattgatc

SEQ ID NO: 290928 - DNA, 28 bp, Artificial Sequence
  Description of Artificial Sequence: Synthetic oligonucleotide
ggccagggggaatcagctgacattgatc

SEQ ID NO: 290929 - DNA, 28 bp, Artificial Sequence
  Description of Artificial Sequence: Synthetic oligonucleotide
gccagggggaatcagctgacattgatcc

SEQ ID NO: 290930 - DNA, 28 bp, Artificial Sequence
  Description of Artificial Sequence: Synthetic oligonucleotide
ccagggggaatcagctgacattgatccc

SEQ ID NO: 290931 - DNA, 29 bp, Artificial Sequence
  Description of Artificial Sequence: Synthetic oligonucleotide
cagggggaatcagctgacattgatcccag

SEQ ID NO: 290932 - DNA, 29 bp, Artificial Sequence
  Description of Artificial Sequence: Synthetic oligonucleotide
agggggaatcagctgacattgatcccagc

SEQ ID NO: 290933 - DNA, 28 bp, Artificial Sequence
  Description of Artificial Sequence: Synthetic oligonucleotide
gggggaatcagctgacattgatcccagc

SEQ ID NO: 290934 - DNA, 29 bp, Artificial Sequence
  Description of Artificial Sequence: Synthetic oligonucleotide
ggggaatcagctgacattgatcccagctc

SEQ ID NO: 290935 - DNA, 30 bp, Artificial Sequence
  Description of Artificial Sequence: Synthetic oligonucleotide
gggaatcagctgacattgatcccagctcag

SEQ ID NO: 290936 - DNA, 30 bp, Artificial Sequence
  Description of Artificial Sequence: Synthetic oligonucleotide
ggaatcagctgacattgatcccagctcagg

SEQ ID NO: 290937 - DNA, 33 bp, Artificial Sequence
  Description of Artificial Sequence: Synthetic oligonucleotide
gaatcagctgacattgatcccagctcaggtatg

SEQ ID NO: 290938 - DNA, 33 bp, Artificial Sequence
  Description of Artificial Sequence: Synthetic oligonucleotide
aatcagctgacattgatcccagctcaggtatgg

SEQ ID NO: 290939 - DNA, 32 bp, Artificial Sequence
  Description of Artificial Sequence: Synthetic oligonucleotide
atcagctgacattgatcccagctcaggtatgg

SEQ ID NO: 290940 - DNA, 31 bp, Artificial Sequence
  Description of Artificial Sequence: Synthetic oligonucleotide
tcagctgacattgatcccagctcaggtatgg

SEQ ID NO: 290941 - DNA, 30 bp, Artificial Sequence
  Description of Artificial Sequence: Synthetic oligonucleotide
cagctgacattgatcccagctcaggtatgg

SEQ ID NO: 290942 - DNA, 31 bp, Artificial Sequence
  Description of Artificial Sequence: Synthetic oligonucleotide
agctgacattgatcccagctcaggtatggac

SEQ ID NO: 290943 - DNA, 30 bp, Artificial Sequence
  Description of Artificial Sequence: Synthetic oligonucleotide
gctgacattgatcccagctcaggtatggac

SEQ ID NO: 290944 - DNA, 31 bp, Artificial Sequence
  Description of Artificial Sequence: Synthetic oligonucleotide
ctgacattgatcccagctcaggtatggacac

SEQ ID NO: 290945 - DNA, 33 bp, Artificial Sequence
  Description of Artificial Sequence: Synthetic oligonucleotide
tgacattgatcccagctcaggtatggacacttc

SEQ ID NO: 290946 - DNA, 32 bp, Artificial Sequence
  Description of Artificial Sequence: Synthetic oligonucleotide
gacattgatcccagctcaggtatggacacttc

SEQ ID NO: 290947 - DNA, 33 bp, Artificial Sequence
  Description of Artificial Sequence: Synthetic oligonucleotide
acattgatcccagctcaggtatggacacttctg

SEQ ID NO: 290948 - DNA, 32 bp, Artificial Sequence
  Description of Artificial Sequence: Synthetic oligonucleotide
cattgatcccagctcaggtatggacacttctg

SEQ ID NO: 290949 - DNA, 33 bp, Artificial Sequence
  Description of Artificial Sequence: Synthetic oligonucleotide
attgatcccagctcaggtatggacacttctgag

SEQ ID NO: 290950 - DNA, 32 bp, Artificial Sequence
  Description of Artificial Sequence: Synthetic oligonucleotide
ttgatcccagctcaggtatggacacttctgag

SEQ ID NO: 290951 - DNA, 31 bp, Artificial Sequence
  Description of Artificial Sequence: Synthetic oligonucleotide
tgatcccagctcaggtatggacacttctgag

SEQ ID NO: 290952 - DNA, 30 bp, Artificial Sequence
  Description of Artificial Sequence: Synthetic oligonucleotide
gatcccagctcaggtatggacacttctgag

SEQ ID NO: 290953 - DNA, 30 bp, Artificial Sequence
  Description of Artificial Sequence: Synthetic oligonucleotide
atcccagctcaggtatggacacttctgagc

SEQ ID NO: 290954 - DNA, 29 bp, Artificial Sequence
  Description of Artificial Sequence: Synthetic oligonucleotide
tcccagctcaggtatggacacttctgagc

SEQ ID NO: 290955 - DNA, 28 bp, Artificial Sequence
  Description of Artificial Sequence: Synthetic oligonucleotide
cccagctcaggtatggacacttctgagc

SEQ ID NO: 290956 - DNA, 28 bp, Artificial Sequence
  Description of Artificial Sequence: Synthetic oligonucleotide
ccagctcaggtatggacacttctgagcc

SEQ ID NO: 290957 - DNA, 29 bp, Artificial Sequence
  Description of Artificial Sequence: Synthetic oligonucleotide
cagctcaggtatggacacttctgagccac

SEQ ID NO: 290958 - DNA, 29 bp, Artificial Sequence
  Description of Artificial Sequence: Synthetic oligonucleotide
agctcaggtatggacacttctgagccacc

SEQ ID NO: 290959 - DNA, 28 bp, Artificial Sequence
  Description of Artificial Sequence: Synthetic oligonucleotide
gctcaggtatggacacttctgagccacc

SEQ ID NO: 290960 - DNA, 28 bp, Artificial Sequence
  Description of Artificial Sequence: Synthetic oligonucleotide
ctcaggtatggacacttctgagccaccc

SEQ ID NO: 290961 - DNA, 30 bp, Artificial Sequence
  Description of Artificial Sequence: Synthetic oligonucleotide
tcaggtatggacacttctgagccacccaag

SEQ ID NO: 290962 - DNA, 29 bp, Artificial Sequence
  Description of Artificial Sequence: Synthetic oligonucleotide
caggtatggacacttctgagccacccaag

SEQ ID NO: 290963 - DNA, 29 bp, Artificial Sequence
  Description of Artificial Sequence: Synthetic oligonucleotide
aggtatggacacttctgagccacccaagg

SEQ ID NO: 290964 - DNA, 28 bp, Artificial Sequence
  Description of Artificial Sequence: Synthetic oligonucleotide
ggtatggacacttctgagccacccaagg

SEQ ID NO: 290965 - DNA, 29 bp, Artificial Sequence
  Description of Artificial Sequence: Synthetic oligonucleotide
gtatggacacttctgagccacccaaggag

SEQ ID NO: 290966 - DNA, 29 bp, Artificial Sequence
  Description of Artificial Sequence: Synthetic oligonucleotide
tatggacacttctgagccacccaaggagg

SEQ ID NO: 290967 - DNA, 28 bp, Artificial Sequence
  Description of Artificial Sequence: Synthetic oligonucleotide
atggacacttctgagccacccaaggagg

SEQ ID NO: 290968 - DNA, 27 bp, Artificial Sequence
  Description of Artificial Sequence: Synthetic oligonucleotide
tggacacttctgagccacccaaggagg

SEQ ID NO: 290969 - DNA, 27 bp, Artificial Sequence
  Description of Artificial Sequence: Synthetic oligonucleotide
ggacacttctgagccacccaaggaggt

SEQ ID NO: 290970 - DNA, 27 bp, Artificial Sequence
  Description of Artificial Sequence: Synthetic oligonucleotide
gacacttctgagccacccaaggaggtg

SEQ ID NO: 290971 - DNA, 27 bp, Artificial Sequence
  Description of Artificial Sequence: Synthetic oligonucleotide
acacttctgagccacccaaggaggtgg

SEQ ID NO: 290972 - DNA, 27 bp, Artificial Sequence
  Description of Artificial Sequence: Synthetic oligonucleotide
cacttctgagccacccaaggaggtgga

SEQ ID NO: 290973 - DNA, 28 bp, Artificial Sequence
  Description of Artificial Sequence: Synthetic oligonucleotide
acttctgagccacccaaggaggtggatg

SEQ ID NO: 290974 - DNA, 27 bp, Artificial Sequence
  Description of Artificial Sequence: Synthetic oligonucleotide
cttctgagccacccaaggaggtggatg

SEQ ID NO: 290975 - DNA, 31 bp, Artificial Sequence
  Description of Artificial Sequence: Synthetic oligonucleotide
ttctgagccacccaaggaggtggatgattag

SEQ ID NO: 290976 - DNA, 30 bp, Artificial Sequence
  Description of Artificial Sequence: Synthetic oligonucleotide
tctgagccacccaaggaggtggatgattag

SEQ ID NO: 290977 - DNA, 29 bp, Artificial Sequence
  Description of Artificial Sequence: Synthetic oligonucleotide
ctgagccacccaaggaggtggatgattag

SEQ ID NO: 290978 - DNA, 29 bp, Artificial Sequence
  Description of Artificial Sequence: Synthetic oligonucleotide
tgagccacccaaggaggtggatgattagg

SEQ ID NO: 290979 - DNA, 28 bp, Artificial Sequence
  Description of Artificial Sequence: Synthetic oligonucleotide
gagccacccaaggaggtggatgattagg

SEQ ID NO: 290980 - DNA, 29 bp, Artificial Sequence
  Description of Artificial Sequence: Synthetic oligonucleotide
agccacccaaggaggtggatgattaggac

SEQ ID NO: 290981 - DNA, 28 bp, Artificial Sequence
  Description of Artificial Sequence: Synthetic oligonucleotide
gccacccaaggaggtggatgattaggac

SEQ ID NO: 290982 - DNA, 28 bp, Artificial Sequence
  Description of Artificial Sequence: Synthetic oligonucleotide
ccacccaaggaggtggatgattaggacg

SEQ ID NO: 290983 - DNA, 29 bp, Artificial Sequence
  Description of Artificial Sequence: Synthetic oligonucleotide
cacccaaggaggtggatgattaggacgtg

SEQ ID NO: 290984 - DNA, 31 bp, Artificial Sequence
  Description of Artificial Sequence: Synthetic oligonucleotide
acccaaggaggtggatgattaggacgtgatg

SEQ ID NO: 290985 - DNA, 30 bp, Artificial Sequence
  Description of Artificial Sequence: Synthetic oligonucleotide
cccaaggaggtggatgattaggacgtgatg

SEQ ID NO: 290986 - DNA, 30 bp, Artificial Sequence
  Description of Artificial Sequence: Synthetic oligonucleotide
ccaaggaggtggatgattaggacgtgatgg

SEQ ID NO: 290987 - DNA, 31 bp, Artificial Sequence
  Description of Artificial Sequence: Synthetic oligonucleotide
caaggaggtggatgattaggacgtgatggag

SEQ ID NO: 290988 - DNA, 31 bp, Artificial Sequence
  Description of Artificial Sequence: Synthetic oligonucleotide
aaggaggtggatgattaggacgtgatggagg

SEQ ID NO: 290989 - DNA, 30 bp, Artificial Sequence
  Description of Artificial Sequence: Synthetic oligonucleotide
aggaggtggatgattaggacgtgatggagg

SEQ ID NO: 290990 - DNA, 29 bp, Artificial Sequence
  Description of Artificial Sequence: Synthetic oligonucleotide
ggaggtggatgattaggacgtgatggagg

SEQ ID NO: 290991 - DNA, 30 bp, Artificial Sequence
  Description of Artificial Sequence: Synthetic oligonucleotide
gaggtggatgattaggacgtgatggaggac

SEQ ID NO: 290992 - DNA, 30 bp, Artificial Sequence
  Description of Artificial Sequence: Synthetic oligonucleotide
aggtggatgattaggacgtgatggaggacc

SEQ ID NO: 290993 - DNA, 29 bp, Artificial Sequence
  Description of Artificial Sequence: Synthetic oligonucleotide
ggtggatgattaggacgtgatggaggacc

SEQ ID NO: 290994 - DNA, 29 bp, Artificial Sequence
  Description of Artificial Sequence: Synthetic oligonucleotide
gtggatgattaggacgtgatggaggaccc

SEQ ID NO: 290995 - DNA, 29 bp, Artificial Sequence
  Description of Artificial Sequence: Synthetic oligonucleotide
tggatgattaggacgtgatggaggacccc

SEQ ID NO: 290996 - DNA, 28 bp, Artificial Sequence
  Description of Artificial Sequence: Synthetic oligonucleotide
ggatgattaggacgtgatggaggacccc

SEQ ID NO: 290997 - DNA, 28 bp, Artificial Sequence
  Description of Artificial Sequence: Synthetic oligonucleotide
gatgattaggacgtgatggaggaccccg

SEQ ID NO: 290998 - DNA, 29 bp, Artificial Sequence
  Description of Artificial Sequence: Synthetic oligonucleotide
atgattaggacgtgatggaggaccccgtg

SEQ ID NO: 290999 - DNA, 28 bp, Artificial Sequence
  Description of Artificial Sequence: Synthetic oligonucleotide
tgattaggacgtgatggaggaccccgtg

SEQ ID NO: 291000 - DNA, 27 bp, Artificial Sequence
  Description of Artificial Sequence: Synthetic oligonucleotide
gattaggacgtgatggaggaccccgtg

SEQ ID NO: 291001 - DNA, 29 bp, Artificial Sequence
  Description of Artificial Sequence: Synthetic oligonucleotide
attaggacgtgatggaggaccccgtgttc

SEQ ID NO: 291002 - DNA, 28 bp, Artificial Sequence
  Description of Artificial Sequence: Synthetic oligonucleotide
ttaggacgtgatggaggaccccgtgttc

SEQ ID NO: 291003 - DNA, 27 bp, Artificial Sequence
  Description of Artificial Sequence: Synthetic oligonucleotide
taggacgtgatggaggaccccgtgttc

SEQ ID NO: 291004 - DNA, 26 bp, Artificial Sequence
  Description of Artificial Sequence: Synthetic oligonucleotide
aggacgtgatggaggaccccgtgttc

SEQ ID NO: 291005 - DNA, 25 bp, Artificial Sequence
  Description of Artificial Sequence: Synthetic oligonucleotide
ggacgtgatggaggaccccgtgttc

SEQ ID NO: 291006 - DNA, 27 bp, Artificial Sequence
  Description of Artificial Sequence: Synthetic oligonucleotide
gacgtgatggaggaccccgtgttcctt

SEQ ID NO: 291007 - DNA, 27 bp, Artificial Sequence
  Description of Artificial Sequence: Synthetic oligonucleotide
acgtgatggaggaccccgtgttccttc

SEQ ID NO: 291008 - DNA, 27 bp, Artificial Sequence
  Description of Artificial Sequence: Synthetic oligonucleotide
cgtgatggaggaccccgtgttccttca

SEQ ID NO: 291009 - DNA, 27 bp, Artificial Sequence
  Description of Artificial Sequence: Synthetic oligonucleotide
gtgatggaggaccccgtgttccttcac

SEQ ID NO: 291010 - DNA, 28 bp, Artificial Sequence
  Description of Artificial Sequence: Synthetic oligonucleotide
tgatggaggaccccgtgttccttcacag

SEQ ID NO: 291011 - DNA, 27 bp, Artificial Sequence
  Description of Artificial Sequence: Synthetic oligonucleotide
gatggaggaccccgtgttccttcacag

SEQ ID NO: 291012 - DNA, 28 bp, Artificial Sequence
  Description of Artificial Sequence: Synthetic oligonucleotide
atggaggaccccgtgttccttcacagtg

SEQ ID NO: 291013 - DNA, 27 bp, Artificial Sequence
  Description of Artificial Sequence: Synthetic oligonucleotide
tggaggaccccgtgttccttcacagtg

SEQ ID NO: 291014 - DNA, 27 bp, Artificial Sequence
  Description of Artificial Sequence: Synthetic oligonucleotide
ggaggaccccgtgttccttcacagtgt

SEQ ID NO: 291015 - DNA, 27 bp, Artificial Sequence
  Description of Artificial Sequence: Synthetic oligonucleotide
gaggaccccgtgttccttcacagtgtc

SEQ ID NO: 291016 - DNA, 27 bp, Artificial Sequence
  Description of Artificial Sequence: Synthetic oligonucleotide
aggaccccgtgttccttcacagtgtcc

SEQ ID NO: 291017 - DNA, 27 bp, Artificial Sequence
  Description of Artificial Sequence: Synthetic oligonucleotide
ggaccccgtgttccttcacagtgtcct

SEQ ID NO: 291018 - DNA, 28 bp, Artificial Sequence
  Description of Artificial Sequence: Synthetic oligonucleotide
gaccccgtgttccttcacagtgtcctac

SEQ ID NO: 291019 - DNA, 29 bp, Artificial Sequence
  Description of Artificial Sequence: Synthetic oligonucleotide
accccgtgttccttcacagtgtcctacag

SEQ ID NO: 291020 - DNA, 28 bp, Artificial Sequence
  Description of Artificial Sequence: Synthetic oligonucleotide
ccccgtgttccttcacagtgtcctacag

SEQ ID NO: 291021 - DNA, 30 bp, Artificial Sequence
  Description of Artificial Sequence: Synthetic oligonucleotide
cccgtgttccttcacagtgtcctacagaac

SEQ ID NO: 291022 - DNA, 30 bp, Artificial Sequence
  Description of Artificial Sequence: Synthetic oligonucleotide
ccgtgttccttcacagtgtcctacagaacc

SEQ ID NO: 291023 - DNA, 31 bp, Artificial Sequence
  Description of Artificial Sequence: Synthetic oligonucleotide
cgtgttccttcacagtgtcctacagaacctc

SEQ ID NO: 291024 - DNA, 31 bp, Artificial Sequence
  Description of Artificial Sequence: Synthetic oligonucleotide
gtgttccttcacagtgtcctacagaacctcc

SEQ ID NO: 291025 - DNA, 31 bp, Artificial Sequence
  Description of Artificial Sequence: Synthetic oligonucleotide
tgttccttcacagtgtcctacagaacctccg

SEQ ID NO: 291026 - DNA, 30 bp, Artificial Sequence
  Description of Artificial Sequence: Synthetic oligonucleotide
gttccttcacagtgtcctacagaacctccg

SEQ ID NO: 291027 - DNA, 31 bp, Artificial Sequence
  Description of Artificial Sequence: Synthetic oligonucleotide
ttccttcacagtgtcctacagaacctccgag

SEQ ID NO: 291028 - DNA, 30 bp, Artificial Sequence
  Description of Artificial Sequence: Synthetic oligonucleotide
tccttcacagtgtcctacagaacctccgag

SEQ ID NO: 291029 - DNA, 29 bp, Artificial Sequence
  Description of Artificial Sequence: Synthetic oligonucleotide
ccttcacagtgtcctacagaacctccgag

SEQ ID NO: 291030 - DNA, 29 bp, Artificial Sequence
  Description of Artificial Sequence: Synthetic oligonucleotide
cttcacagtgtcctacagaacctccgagg

SEQ ID NO: 291031 - DNA, 30 bp, Artificial Sequence
  Description of Artificial Sequence: Synthetic oligonucleotide
ttcacagtgtcctacagaacctccgaggtg

SEQ ID NO: 291032 - DNA, 29 bp, Artificial Sequence
  Description of Artificial Sequence: Synthetic oligonucleotide
tcacagtgtcctacagaacctccgaggtg

SEQ ID NO: 291033 - DNA, 28 bp, Artificial Sequence
  Description of Artificial Sequence: Synthetic oligonucleotide
cacagtgtcctacagaacctccgaggtg

SEQ ID NO: 291034 - DNA, 29 bp, Artificial Sequence
  Description of Artificial Sequence: Synthetic oligonucleotide
acagtgtcctacagaacctccgaggtgtg

SEQ ID NO: 291035 - DNA, 28 bp, Artificial Sequence
  Description of Artificial Sequence: Synthetic oligonucleotide
cagtgtcctacagaacctccgaggtgtg

SEQ ID NO: 291036 - DNA, 28 bp, Artificial Sequence
  Description of Artificial Sequence: Synthetic oligonucleotide
agtgtcctacagaacctccgaggtgtgg

SEQ ID NO: 291037 - DNA, 27 bp, Artificial Sequence
  Description of Artificial Sequence: Synthetic oligonucleotide
gtgtcctacagaacctccgaggtgtgg

SEQ ID NO: 291038 - DNA, 29 bp, Artificial Sequence
  Description of Artificial Sequence: Synthetic oligonucleotide
tgtcctacagaacctccgaggtgtggaac

SEQ ID NO: 291039 - DNA, 28 bp, Artificial Sequence
  Description of Artificial Sequence: Synthetic oligonucleotide
gtcctacagaacctccgaggtgtggaac

SEQ ID NO: 291040 - DNA, 28 bp, Artificial Sequence
  Description of Artificial Sequence: Synthetic oligonucleotide
tcctacagaacctccgaggtgtggaacc

SEQ ID NO: 291041 - DNA, 27 bp, Artificial Sequence
  Description of Artificial Sequence: Synthetic oligonucleotide
cctacagaacctccgaggtgtggaacc

SEQ ID NO: 291042 - DNA, 27 bp, Artificial Sequence
  Description of Artificial Sequence: Synthetic oligonucleotide
ctacagaacctccgaggtgtggaaccc

SEQ ID NO: 291043 - DNA, 29 bp, Artificial Sequence
  Description of Artificial Sequence: Synthetic oligonucleotide
tacagaacctccgaggtgtggaacccaac

SEQ ID NO: 291044 - DNA, 28 bp, Artificial Sequence
  Description of Artificial Sequence: Synthetic oligonucleotide
acagaacctccgaggtgtggaacccaac

SEQ ID NO: 291045 - DNA, 27 bp, Artificial Sequence
  Description of Artificial Sequence: Synthetic oligonucleotide
cagaacctccgaggtgtggaacccaac

SEQ ID NO: 291046 - DNA, 30 bp, Artificial Sequence
  Description of Artificial Sequence: Synthetic oligonucleotide
agaacctccgaggtgtggaacccaacaatc

SEQ ID NO: 291047 - DNA, 29 bp, Artificial Sequence
  Description of Artificial Sequence: Synthetic oligonucleotide
gaacctccgaggtgtggaacccaacaatc

SEQ ID NO: 291048 - DNA, 31 bp, Artificial Sequence
  Description of Artificial Sequence: Synthetic oligonucleotide
aacctccgaggtgtggaacccaacaatcaag

SEQ ID NO: 291049 - DNA, 30 bp, Artificial Sequence
  Description of Artificial Sequence: Synthetic oligonucleotide
acctccgaggtgtggaacccaacaatcaag

SEQ ID NO: 291050 - DNA, 29 bp, Artificial Sequence
  Description of Artificial Sequence: Synthetic oligonucleotide
cctccgaggtgtggaacccaacaatcaag

SEQ ID NO: 291051 - DNA, 29 bp, Artificial Sequence
  Description of Artificial Sequence: Synthetic oligonucleotide
ctccgaggtgtggaacccaacaatcaagc

SEQ ID NO: 291052 - DNA, 29 bp, Artificial Sequence
  Description of Artificial Sequence: Synthetic oligonucleotide
tccgaggtgtggaacccaacaatcaagcc

SEQ ID NO: 291053 - DNA, 28 bp, Artificial Sequence
  Description of Artificial Sequence: Synthetic oligonucleotide
ccgaggtgtggaacccaacaatcaagcc

SEQ ID NO: 291054 - DNA, 31 bp, Artificial Sequence
  Description of Artificial Sequence: Synthetic oligonucleotide
cgaggtgtggaacccaacaatcaagccattc

SEQ ID NO: 291055 - DNA, 31 bp, Artificial Sequence
  Description of Artificial Sequence: Synthetic oligonucleotide
gaggtgtggaacccaacaatcaagccattcc

SEQ ID NO: 291056 - DNA, 35 bp, Artificial Sequence
  Description of Artificial Sequence: Synthetic oligonucleotide
aggtgtggaacccaacaatcaagccattccaaatg

SEQ ID NO: 291057 - DNA, 34 bp, Artificial Sequence
  Description of Artificial Sequence: Synthetic oligonucleotide
ggtgtggaacccaacaatcaagccattccaaatg

SEQ ID NO: 291058 - DNA, 34 bp, Artificial Sequence
  Description of Artificial Sequence: Synthetic oligonucleotide
gtgtggaacccaacaatcaagccattccaaatgc

SEQ ID NO: 291059 - DNA, 37 bp, Artificial Sequence
  Description of Artificial Sequence: Synthetic oligonucleotide
tgtggaacccaacaatcaagccattccaaatgctatc

SEQ ID NO: 291060 - DNA, 36 bp, Artificial Sequence
  Description of Artificial Sequence: Synthetic oligonucleotide
gtggaacccaacaatcaagccattccaaatgctatc

SEQ ID NO: 291061 - DNA, 36 bp, Artificial Sequence
  Description of Artificial Sequence: Synthetic oligonucleotide
tggaacccaacaatcaagccattccaaatgctatcg

SEQ ID NO: 291062 - DNA, 35 bp, Artificial Sequence
  Description of Artificial Sequence: Synthetic oligonucleotide
ggaacccaacaatcaagccattccaaatgctatcg

SEQ ID NO: 291063 - DNA, 35 bp, Artificial Sequence
  Description of Artificial Sequence: Synthetic oligonucleotide
gaacccaacaatcaagccattccaaatgctatcgg

SEQ ID NO: 291064 - DNA, 35 bp, Artificial Sequence
  Description of Artificial Sequence: Synthetic oligonucleotide
aacccaacaatcaagccattccaaatgctatcggc

SEQ ID NO: 291065 - DNA, 34 bp, Artificial Sequence
  Description of Artificial Sequence: Synthetic oligonucleotide
acccaacaatcaagccattccaaatgctatcggc

SEQ ID NO: 291066 - DNA, 33 bp, Artificial Sequence
  Description of Artificial Sequence: Synthetic oligonucleotide
cccaacaatcaagccattccaaatgctatcggc

SEQ ID NO: 291067 - DNA, 34 bp, Artificial Sequence
  Description of Artificial Sequence: Synthetic oligonucleotide
ccaacaatcaagccattccaaatgctatcggctc

SEQ ID NO: 291068 - DNA, 34 bp, Artificial Sequence
  Description of Artificial Sequence: Synthetic oligonucleotide
caacaatcaagccattccaaatgctatcggctcc

SEQ ID NO: 291069 - DNA, 34 bp, Artificial Sequence
  Description of Artificial Sequence: Synthetic oligonucleotide
aacaatcaagccattccaaatgctatcggctccc

SEQ ID NO: 291070 - DNA, 33 bp, Artificial Sequence
  Description of Artificial Sequence: Synthetic oligonucleotide
acaatcaagccattccaaatgctatcggctccc

SEQ ID NO: 291071 - DNA, 32 bp, Artificial Sequence
  Description of Artificial Sequence: Synthetic oligonucleotide
caatcaagccattccaaatgctatcggctccc

SEQ ID NO: 291072 - DNA, 33 bp, Artificial Sequence
  Description of Artificial Sequence: Synthetic oligonucleotide
aatcaagccattccaaatgctatcggctccctg

SEQ ID NO: 291073 - DNA, 32 bp, Artificial Sequence
  Description of Artificial Sequence: Synthetic oligonucleotide
atcaagccattccaaatgctatcggctccctg

SEQ ID NO: 291074 - DNA, 31 bp, Artificial Sequence
  Description of Artificial Sequence: Synthetic oligonucleotide
tcaagccattccaaatgctatcggctccctg

SEQ ID NO: 291075 - DNA, 30 bp, Artificial Sequence
  Description of Artificial Sequence: Synthetic oligonucleotide
caagccattccaaatgctatcggctccctg

SEQ ID NO: 291076 - DNA, 30 bp, Artificial Sequence
  Description of Artificial Sequence: Synthetic oligonucleotide
aagccattccaaatgctatcggctccctgc

SEQ ID NO: 291077 - DNA, 29 bp, Artificial Sequence
  Description of Artificial Sequence: Synthetic oligonucleotide
agccattccaaatgctatcggctccctgc

SEQ ID NO: 291078 - DNA, 28 bp, Artificial Sequence
  Description of Artificial Sequence: Synthetic oligonucleotide
gccattccaaatgctatcggctccctgc

SEQ ID NO: 291079 - DNA, 28 bp, Artificial Sequence
  Description of Artificial Sequence: Synthetic oligonucleotide
ccattccaaatgctatcggctccctgcc

SEQ ID NO: 291080 - DNA, 28 bp, Artificial Sequence
  Description of Artificial Sequence: Synthetic oligonucleotide
cattccaaatgctatcggctccctgccc

SEQ ID NO: 291081 - DNA, 29 bp, Artificial Sequence
  Description of Artificial Sequence: Synthetic oligonucleotide
attccaaatgctatcggctccctgccctc

SEQ ID NO: 291082 - DNA, 28 bp, Artificial Sequence
  Description of Artificial Sequence: Synthetic oligonucleotide
ttccaaatgctatcggctccctgccctc

SEQ ID NO: 291083 - DNA, 27 bp, Artificial Sequence
  Description of Artificial Sequence: Synthetic oligonucleotide
tccaaatgctatcggctccctgccctc

SEQ ID NO: 291084 - DNA, 26 bp, Artificial Sequence
  Description of Artificial Sequence: Synthetic oligonucleotide
ccaaatgctatcggctccctgccctc

SEQ ID NO: 291085 - DNA, 26 bp, Artificial Sequence
  Description of Artificial Sequence: Synthetic oligonucleotide
caaatgctatcggctccctgccctcc

SEQ ID NO: 291086 - DNA, 27 bp, Artificial Sequence
  Description of Artificial Sequence: Synthetic oligonucleotide
aaatgctatcggctccctgccctccca

SEQ ID NO: 291087 - DNA, 26 bp, Artificial Sequence
  Description of Artificial Sequence: Synthetic oligonucleotide
aatgctatcggctccctgccctccca

SEQ ID NO: 291088 - DNA, 25 bp, Artificial Sequence
  Description of Artificial Sequence: Synthetic oligonucleotide
atgctatcggctccctgccctccca

SEQ ID NO: 291089 - DNA, 24 bp, Artificial Sequence
  Description of Artificial Sequence: Synthetic oligonucleotide
tgctatcggctccctgccctccca

SEQ ID NO: 291090 - DNA, 23 bp, Artificial Sequence
  Description of Artificial Sequence: Synthetic oligonucleotide
gctatcggctccctgccctccca

SEQ ID NO: 291091 - DNA, 23 bp, Artificial Sequence
  Description of Artificial Sequence: Synthetic oligonucleotide
ctatcggctccctgccctcccag

SEQ ID NO: 291092 - DNA, 23 bp, Artificial Sequence
  Description of Artificial Sequence: Synthetic oligonucleotide
tatcggctccctgccctcccagg

SEQ ID NO: 291093 - DNA, 22 bp, Artificial Sequence
  Description of Artificial Sequence: Synthetic oligonucleotide
atcggctccctgccctcccagg

SEQ ID NO: 291094 - DNA, 21 bp, Artificial Sequence
  Description of Artificial Sequence: Synthetic oligonucleotide
tcggctccctgccctcccagg

SEQ ID NO: 291095 - DNA, 20 bp, Artificial Sequence
  Description of Artificial Sequence: Synthetic oligonucleotide
cggctccctgccctcccagg

SEQ ID NO: 291096 - DNA, 20 bp, Artificial Sequence
  Description of Artificial Sequence: Synthetic oligonucleotide
ggctccctgccctcccaggg

SEQ ID NO: 291097 - DNA, 21 bp, Artificial Sequence
  Description of Artificial Sequence: Synthetic oligonucleotide
gctccctgccctcccagggca

SEQ ID NO: 291098 - DNA, 21 bp, Artificial Sequence
  Description of Artificial Sequence: Synthetic oligonucleotide
ctccctgccctcccagggcac

SEQ ID NO: 291099 - DNA, 23 bp, Artificial Sequence
  Description of Artificial Sequence: Synthetic oligonucleotide
tccctgccctcccagggcaccaa

SEQ ID NO: 291100 - DNA, 22 bp, Artificial Sequence
  Description of Artificial Sequence: Synthetic oligonucleotide
ccctgccctcccagggcaccaa

SEQ ID NO: 291101 - DNA, 22 bp, Artificial Sequence
  Description of Artificial Sequence: Synthetic oligonucleotide
cctgccctcccagggcaccaag

SEQ ID NO: 291102 - DNA, 23 bp, Artificial Sequence
  Description of Artificial Sequence: Synthetic oligonucleotide
ctgccctcccagggcaccaagga

SEQ ID NO: 291103 - DNA, 23 bp, Artificial Sequence
  Description of Artificial Sequence: Synthetic oligonucleotide
tgccctcccagggcaccaaggag

SEQ ID NO: 291104 - DNA, 22 bp, Artificial Sequence
  Description of Artificial Sequence: Synthetic oligonucleotide
gccctcccagggcaccaaggag

SEQ ID NO: 291105 - DNA, 22 bp, Artificial Sequence
  Description of Artificial Sequence: Synthetic oligonucleotide
ccctcccagggcaccaaggagg

SEQ ID NO: 291106 - DNA, 22 bp, Artificial Sequence
  Description of Artificial Sequence: Synthetic oligonucleotide
cctcccagggcaccaaggaggg

SEQ ID NO: 291107 - DNA, 24 bp, Artificial Sequence
  Description of Artificial Sequence: Synthetic oligonucleotide
ctcccagggcaccaaggagggcaa

SEQ ID NO: 291108 - DNA, 26 bp, Artificial Sequence
  Description of Artificial Sequence: Synthetic oligonucleotide
tcccagggcaccaaggagggcaagaa

SEQ ID NO: 291109 - DNA, 25 bp, Artificial Sequence
  Description of Artificial Sequence: Synthetic oligonucleotide
cccagggcaccaaggagggcaagaa

SEQ ID NO: 291110 - DNA, 25 bp, Artificial Sequence
  Description of Artificial Sequence: Synthetic oligonucleotide
ccagggcaccaaggagggcaagaag

SEQ ID NO: 291111 - DNA, 26 bp, Artificial Sequence
  Description of Artificial Sequence: Synthetic oligonucleotide
cagggcaccaaggagggcaagaagca

SEQ ID NO: 291112 - DNA, 27 bp, Artificial Sequence
  Description of Artificial Sequence: Synthetic oligonucleotide
agggcaccaaggagggcaagaagcaca

SEQ ID NO: 291113 - DNA, 27 bp, Artificial Sequence
  Description of Artificial Sequence: Synthetic oligonucleotide
gggcaccaaggagggcaagaagcacaa

SEQ ID NO: 291114 - DNA, 27 bp, Artificial Sequence
  Description of Artificial Sequence: Synthetic oligonucleotide
ggcaccaaggagggcaagaagcacaag

SEQ ID NO: 291115 - DNA, 29 bp, Artificial Sequence
  Description of Artificial Sequence: Synthetic oligonucleotide
gcaccaaggagggcaagaagcacaagaag

SEQ ID NO: 291116 - DNA, 29 bp, Artificial Sequence
  Description of Artificial Sequence: Synthetic oligonucleotide
caccaaggagggcaagaagcacaagaagg

SEQ ID NO: 291117 - DNA, 30 bp, Artificial Sequence
  Description of Artificial Sequence: Synthetic oligonucleotide
accaaggagggcaagaagcacaagaaggtg

SEQ ID NO: 291118 - DNA, 29 bp, Artificial Sequence
  Description of Artificial Sequence: Synthetic oligonucleotide
ccaaggagggcaagaagcacaagaaggtg

SEQ ID NO: 291119 - DNA, 29 bp, Artificial Sequence
  Description of Artificial Sequence: Synthetic oligonucleotide
caaggagggcaagaagcacaagaaggtgg

SEQ ID NO: 291120 - DNA, 31 bp, Artificial Sequence
  Description of Artificial Sequence: Synthetic oligonucleotide
aaggagggcaagaagcacaagaaggtggaag

SEQ ID NO: 291121 - DNA, 30 bp, Artificial Sequence
  Description of Artificial Sequence: Synthetic oligonucleotide
aggagggcaagaagcacaagaaggtggaag

SEQ ID NO: 291122 - DNA, 29 bp, Artificial Sequence
  Description of Artificial Sequence: Synthetic oligonucleotide
ggagggcaagaagcacaagaaggtggaag

SEQ ID NO: 291123 - DNA, 30 bp, Artificial Sequence
  Description of Artificial Sequence: Synthetic oligonucleotide
gagggcaagaagcacaagaaggtggaagac

SEQ ID NO: 291124 - DNA, 32 bp, Artificial Sequence
  Description of Artificial Sequence: Synthetic oligonucleotide
agggcaagaagcacaagaaggtggaagacaac

SEQ ID NO: 291125 - DNA, 31 bp, Artificial Sequence
  Description of Artificial Sequence: Synthetic oligonucleotide
gggcaagaagcacaagaaggtggaagacaac

SEQ ID NO: 291126 - DNA, 33 bp, Artificial Sequence
  Description of Artificial Sequence: Synthetic oligonucleotide
ggcaagaagcacaagaaggtggaagacaacaag

SEQ ID NO: 291127 - DNA, 34 bp, Artificial Sequence
  Description of Artificial Sequence: Synthetic oligonucleotide
gcaagaagcacaagaaggtggaagacaacaagtg

SEQ ID NO: 291128 - DNA, 24 bp, Artificial Sequence
  Description of Artificial Sequence: Synthetic oligonucleotide
ttggcagccctggctttggccctg

SEQ ID NO: 291129 - DNA, 23 bp, Artificial Sequence
  Description of Artificial Sequence: Synthetic oligonucleotide
tggcagccctggctttggccctg

SEQ ID NO: 291130 - DNA, 22 bp, Artificial Sequence
  Description of Artificial Sequence: Synthetic oligonucleotide
ggcagccctggctttggccctg

SEQ ID NO: 291131 - DNA, 23 bp, Artificial Sequence
  Description of Artificial Sequence: Synthetic oligonucleotide
gcagccctggctttggccctgct

SEQ ID NO: 291132 - DNA, 24 bp, Artificial Sequence
  Description of Artificial Sequence: Synthetic oligonucleotide
cagccctggctttggccctgctga

SEQ ID NO: 291133 - DNA, 25 bp, Artificial Sequence
  Description of Artificial Sequence: Synthetic oligonucleotide
agccctggctttggccctgctgaga

SEQ ID NO: 291134 - DNA, 24 bp, Artificial Sequence
  Description of Artificial Sequence: Synthetic oligonucleotide
gccctggctttggccctgctgaga

SEQ ID NO: 291135 - DNA, 25 bp, Artificial Sequence
  Description of Artificial Sequence: Synthetic oligonucleotide
ccctggctttggccctgctgagaca

SEQ ID NO: 291136 - DNA, 25 bp, Artificial Sequence
  Description of Artificial Sequence: Synthetic oligonucleotide
cctggctttggccctgctgagacag

SEQ ID NO: 291137 - DNA, 27 bp, Artificial Sequence
  Description of Artificial Sequence: Synthetic oligonucleotide
ctggctttggccctgctgagacaggta

SEQ ID NO: 291138 - DNA, 27 bp, Artificial Sequence
  Description of Artificial Sequence: Synthetic oligonucleotide
tggctttggccctgctgagacaggtag

SEQ ID NO: 291139 - DNA, 26 bp, Artificial Sequence
  Description of Artificial Sequence: Synthetic oligonucleotide
ggctttggccctgctgagacaggtag

SEQ ID NO: 291140 - DNA, 26 bp, Artificial Sequence
  Description of Artificial Sequence: Synthetic oligonucleotide
gctttggccctgctgagacaggtagc

SEQ ID NO: 291141 - DNA, 27 bp, Artificial Sequence
  Description of Artificial Sequence: Synthetic oligonucleotide
ctttggccctgctgagacaggtagcga

SEQ ID NO: 291142 - DNA, 27 bp, Artificial Sequence
  Description of Artificial Sequence: Synthetic oligonucleotide
tttggccctgctgagacaggtagcgac

SEQ ID NO: 291143 - DNA, 26 bp, Artificial Sequence
  Description of Artificial Sequence: Synthetic oligonucleotide
ttggccctgctgagacaggtagcgac

SEQ ID NO: 291144 - DNA, 25 bp, Artificial Sequence
  Description of Artificial Sequence: Synthetic oligonucleotide
tggccctgctgagacaggtagcgac

SEQ ID NO: 291145 - DNA, 24 bp, Artificial Sequence
  Description of Artificial Sequence: Synthetic oligonucleotide
ggccctgctgagacaggtagcgac

SEQ ID NO: 291146 - DNA, 24 bp, Artificial Sequence
  Description of Artificial Sequence: Synthetic oligonucleotide
gccctgctgagacaggtagcgacg

SEQ ID NO: 291147 - DNA, 25 bp, Artificial Sequence
  Description of Artificial Sequence: Synthetic oligonucleotide
ccctgctgagacaggtagcgacgct

SEQ ID NO: 291148 - DNA, 25 bp, Artificial Sequence
  Description of Artificial Sequence: Synthetic oligonucleotide
cctgctgagacaggtagcgacgctg

SEQ ID NO: 291149 - DNA, 27 bp, Artificial Sequence
  Description of Artificial Sequence: Synthetic oligonucleotide
ctgctgagacaggtagcgacgctggaa

SEQ ID NO: 291150 - DNA, 27 bp, Artificial Sequence
  Description of Artificial Sequence: Synthetic oligonucleotide
tgctgagacaggtagcgacgctggaag

SEQ ID NO: 291151 - DNA, 26 bp, Artificial Sequence
  Description of Artificial Sequence: Synthetic oligonucleotide
gctgagacaggtagcgacgctggaag

SEQ ID NO: 291152 - DNA, 26 bp, Artificial Sequence
  Description of Artificial Sequence: Synthetic oligonucleotide
ctgagacaggtagcgacgctggaagc

SEQ ID NO: 291153 - DNA, 26 bp, Artificial Sequence
  Description of Artificial Sequence: Synthetic oligonucleotide
tgagacaggtagcgacgctggaagcc

SEQ ID NO: 291154 - DNA, 25 bp, Artificial Sequence
  Description of Artificial Sequence: Synthetic oligonucleotide
gagacaggtagcgacgctggaagcc

SEQ ID NO: 291155 - DNA, 25 bp, Artificial Sequence
  Description of Artificial Sequence: Synthetic oligonucleotide
agacaggtagcgacgctggaagccc

SEQ ID NO: 291156 - DNA, 24 bp, Artificial Sequence
  Description of Artificial Sequence: Synthetic oligonucleotide
gacaggtagcgacgctggaagccc

SEQ ID NO: 291157 - DNA, 24 bp, Artificial Sequence
  Description of Artificial Sequence: Synthetic oligonucleotide
acaggtagcgacgctggaagcccc

SEQ ID NO: 291158 - DNA, 23 bp, Artificial Sequence
  Description of Artificial Sequence: Synthetic oligonucleotide
caggtagcgacgctggaagcccc

SEQ ID NO: 291159 - DNA, 23 bp, Artificial Sequence
  Description of Artificial Sequence: Synthetic oligonucleotide
aggtagcgacgctggaagccccg

SEQ ID NO: 291160 - DNA, 22 bp, Artificial Sequence
  Description of Artificial Sequence: Synthetic oligonucleotide
ggtagcgacgctggaagccccg

SEQ ID NO: 291161 - DNA, 23 bp, Artificial Sequence
  Description of Artificial Sequence: Synthetic oligonucleotide
gtagcgacgctggaagccccgct

SEQ ID NO: 291162 - DNA, 23 bp, Artificial Sequence
  Description of Artificial Sequence: Synthetic oligonucleotide
tagcgacgctggaagccccgctg

SEQ ID NO: 291163 - DNA, 22 bp, Artificial Sequence
  Description of Artificial Sequence: Synthetic oligonucleotide
agcgacgctggaagccccgctg

SEQ ID NO: 291164 - DNA, 21 bp, Artificial Sequence
  Description of Artificial Sequence: Synthetic oligonucleotide
gcgacgctggaagccccgctg

SEQ ID NO: 291165 - DNA, 22 bp, Artificial Sequence
  Description of Artificial Sequence: Synthetic oligonucleotide
cgacgctggaagccccgctgga

SEQ ID NO: 291166 - DNA, 22 bp, Artificial Sequence
  Description of Artificial Sequence: Synthetic oligonucleotide
gacgctggaagccccgctggag

SEQ ID NO: 291167 - DNA, 23 bp, Artificial Sequence
  Description of Artificial Sequence: Synthetic oligonucleotide
acgctggaagccccgctggagca

SEQ ID NO: 291168 - DNA, 22 bp, Artificial Sequence
  Description of Artificial Sequence: Synthetic oligonucleotide
cgctggaagccccgctggagca

SEQ ID NO: 291169 - DNA, 22 bp, Artificial Sequence
  Description of Artificial Sequence: Synthetic oligonucleotide
gctggaagccccgctggagcag

SEQ ID NO: 291170 - DNA, 24 bp, Artificial Sequence
  Description of Artificial Sequence: Synthetic oligonucleotide
ctggaagccccgctggagcagcta

SEQ ID NO: 291171 - DNA, 24 bp, Artificial Sequence
  Description of Artificial Sequence: Synthetic oligonucleotide
tggaagccccgctggagcagctac

SEQ ID NO: 291172 - DNA, 23 bp, Artificial Sequence
  Description of Artificial Sequence: Synthetic oligonucleotide
ggaagccccgctggagcagctac

SEQ ID NO: 291173 - DNA, 23 bp, Artificial Sequence
  Description of Artificial Sequence: Synthetic oligonucleotide
gaagccccgctggagcagctacg

SEQ ID NO: 291174 - DNA, 23 bp, Artificial Sequence
  Description of Artificial Sequence: Synthetic oligonucleotide
aagccccgctggagcagctacgc

SEQ ID NO: 291175 - DNA, 22 bp, Artificial Sequence
  Description of Artificial Sequence: Synthetic oligonucleotide
agccccgctggagcagctacgc

SEQ ID NO: 291176 - DNA, 21 bp, Artificial Sequence
  Description of Artificial Sequence: Synthetic oligonucleotide
gccccgctggagcagctacgc

SEQ ID NO: 291177 - DNA, 21 bp, Artificial Sequence
  Description of Artificial Sequence: Synthetic oligonucleotide
ccccgctggagcagctacgcg

SEQ ID NO: 291178 - DNA, 21 bp, Artificial Sequence
  Description of Artificial Sequence: Synthetic oligonucleotide
cccgctggagcagctacgcgg

SEQ ID NO: 291179 - DNA, 21 bp, Artificial Sequence
  Description of Artificial Sequence: Synthetic oligonucleotide
ccgctggagcagctacgcggg

SEQ ID NO: 291180 - DNA, 23 bp, Artificial Sequence
  Description of Artificial Sequence: Synthetic oligonucleotide
cgctggagcagctacgcgggctt

SEQ ID NO: 291181 - DNA, 24 bp, Artificial Sequence
  Description of Artificial Sequence: Synthetic oligonucleotide
gctggagcagctacgcgggcttca

SEQ ID NO: 291182 - DNA, 25 bp, Artificial Sequence
  Description of Artificial Sequence: Synthetic oligonucleotide
ctggagcagctacgcgggcttcact

SEQ ID NO: 291183 - DNA, 25 bp, Artificial Sequence
  Description of Artificial Sequence: Synthetic oligonucleotide
tggagcagctacgcgggcttcactc

SEQ ID NO: 291184 - DNA, 24 bp, Artificial Sequence
  Description of Artificial Sequence: Synthetic oligonucleotide
ggagcagctacgcgggcttcactc

SEQ ID NO: 291185 - DNA, 24 bp, Artificial Sequence
  Description of Artificial Sequence: Synthetic oligonucleotide
gagcagctacgcgggcttcactcg

SEQ ID NO: 291186 - DNA, 25 bp, Artificial Sequence
  Description of Artificial Sequence: Synthetic oligonucleotide
agcagctacgcgggcttcactcggt

SEQ ID NO: 291187 - DNA, 24 bp, Artificial Sequence
  Description of Artificial Sequence: Synthetic oligonucleotide
gcagctacgcgggcttcactcggt

SEQ ID NO: 291188 - DNA, 24 bp, Artificial Sequence
  Description of Artificial Sequence: Synthetic oligonucleotide
cagctacgcgggcttcactcggtg

SEQ ID NO: 291189 - DNA, 25 bp, Artificial Sequence
  Description of Artificial Sequence: Synthetic oligonucleotide
agctacgcgggcttcactcggtgct

SEQ ID NO: 291190 - DNA, 24 bp, Artificial Sequence
  Description of Artificial Sequence: Synthetic oligonucleotide
gctacgcgggcttcactcggtgct

SEQ ID NO: 291191 - DNA, 24 bp, Artificial Sequence
  Description of Artificial Sequence: Synthetic oligonucleotide
ctacgcgggcttcactcggtgctg

SEQ ID NO: 291192 - DNA, 25 bp, Artificial Sequence
  Description of Artificial Sequence: Synthetic oligonucleotide
tacgcgggcttcactcggtgctgca

SEQ ID NO: 291193 - DNA, 24 bp, Artificial Sequence
  Description of Artificial Sequence: Synthetic oligonucleotide
acgcgggcttcactcggtgctgca

SEQ ID NO: 291194 - DNA, 23 bp, Artificial Sequence
  Description of Artificial Sequence: Synthetic oligonucleotide
cgcgggcttcactcggtgctgca

SEQ ID NO: 291195 - DNA, 23 bp, Artificial Sequence
  Description of Artificial Sequence: Synthetic oligonucleotide
gcgggcttcactcggtgctgcag

SEQ ID NO: 291196 - DNA, 23 bp, Artificial Sequence
  Description of Artificial Sequence: Synthetic oligonucleotide
cgggcttcactcggtgctgcagc

SEQ ID NO: 291197 - DNA, 24 bp, Artificial Sequence
  Description of Artificial Sequence: Synthetic oligonucleotide
gggcttcactcggtgctgcagcca

SEQ ID NO: 291198 - DNA, 25 bp, Artificial Sequence
  Description of Artificial Sequence: Synthetic oligonucleotide
ggcttcactcggtgctgcagccagt

SEQ ID NO: 291199 - DNA, 25 bp, Artificial Sequence
  Description of Artificial Sequence: Synthetic oligonucleotide
gcttcactcggtgctgcagccagtg

SEQ ID NO: 291200 - DNA, 25 bp, Artificial Sequence
  Description of Artificial Sequence: Synthetic oligonucleotide
cttcactcggtgctgcagccagtgc

SEQ ID NO: 291201 - DNA, 25 bp, Artificial Sequence
  Description of Artificial Sequence: Synthetic oligonucleotide
ttcactcggtgctgcagccagtgcc

SEQ ID NO: 291202 - DNA, 24 bp, Artificial Sequence
  Description of Artificial Sequence: Synthetic oligonucleotide
tcactcggtgctgcagccagtgcc

SEQ ID NO: 291203 - DNA, 23 bp, Artificial Sequence
  Description of Artificial Sequence: Synthetic oligonucleotide
cactcggtgctgcagccagtgcc

SEQ ID NO: 291204 - DNA, 23 bp, Artificial Sequence
  Description of Artificial Sequence: Synthetic oligonucleotide
actcggtgctgcagccagtgccg

SEQ ID NO: 291205 - DNA, 22 bp, Artificial Sequence
  Description of Artificial Sequence: Synthetic oligonucleotide
ctcggtgctgcagccagtgccg

SEQ ID NO: 291206 - DNA, 23 bp, Artificial Sequence
  Description of Artificial Sequence: Synthetic oligonucleotide
tcggtgctgcagccagtgccgca

SEQ ID NO: 291207 - DNA, 22 bp, Artificial Sequence
  Description of Artificial Sequence: Synthetic oligonucleotide
cggtgctgcagccagtgccgca

SEQ ID NO: 291208 - DNA, 24 bp, Artificial Sequence
  Description of Artificial Sequence: Synthetic oligonucleotide
ggtgctgcagccagtgccgcacaa

SEQ ID NO: 291209 - DNA, 24 bp, Artificial Sequence
  Description of Artificial Sequence: Synthetic oligonucleotide
gtgctgcagccagtgccgcacaac

SEQ ID NO: 291210 - DNA, 25 bp, Artificial Sequence
  Description of Artificial Sequence: Synthetic oligonucleotide
tgctgcagccagtgccgcacaacga

SEQ ID NO: 291211 - DNA, 24 bp, Artificial Sequence
  Description of Artificial Sequence: Synthetic oligonucleotide
gctgcagccagtgccgcacaacga

SEQ ID NO: 291212 - DNA, 24 bp, Artificial Sequence
  Description of Artificial Sequence: Synthetic oligonucleotide
ctgcagccagtgccgcacaacgag

SEQ ID NO: 291213 - DNA, 26 bp, Artificial Sequence
  Description of Artificial Sequence: Synthetic oligonucleotide
tgcagccagtgccgcacaacgagcta

SEQ ID NO: 291214 - DNA, 25 bp, Artificial Sequence
  Description of Artificial Sequence: Synthetic oligonucleotide
gcagccagtgccgcacaacgagcta

SEQ ID NO: 291215 - DNA, 25 bp, Artificial Sequence
  Description of Artificial Sequence: Synthetic oligonucleotide
cagccagtgccgcacaacgagctac

SEQ ID NO: 291216 - DNA, 25 bp, Artificial Sequence
  Description of Artificial Sequence: Synthetic oligonucleotide
agccagtgccgcacaacgagctacg

SEQ ID NO: 291217 - DNA, 24 bp, Artificial Sequence
  Description of Artificial Sequence: Synthetic oligonucleotide
gccagtgccgcacaacgagctacg

SEQ ID NO: 291218 - DNA, 24 bp, Artificial Sequence
  Description of Artificial Sequence: Synthetic oligonucleotide
ccagtgccgcacaacgagctacgc

SEQ ID NO: 291219 - DNA, 25 bp, Artificial Sequence
  Description of Artificial Sequence: Synthetic oligonucleotide
cagtgccgcacaacgagctacgcca

SEQ ID NO: 291220 - DNA, 25 bp, Artificial Sequence
  Description of Artificial Sequence: Synthetic oligonucleotide
agtgccgcacaacgagctacgccag

SEQ ID NO: 291221 - DNA, 24 bp, Artificial Sequence
  Description of Artificial Sequence: Synthetic oligonucleotide
gtgccgcacaacgagctacgccag

SEQ ID NO: 291222 - DNA, 26 bp, Artificial Sequence
  Description of Artificial Sequence: Synthetic oligonucleotide
tgccgcacaacgagctacgccagcaa

SEQ ID NO: 291223 - DNA, 25 bp, Artificial Sequence
  Description of Artificial Sequence: Synthetic oligonucleotide
gccgcacaacgagctacgccagcaa

SEQ ID NO: 291224 - DNA, 25 bp, Artificial Sequence
  Description of Artificial Sequence: Synthetic oligonucleotide
ccgcacaacgagctacgccagcaac

SEQ ID NO: 291225 - DNA, 25 bp, Artificial Sequence
  Description of Artificial Sequence: Synthetic oligonucleotide
cgcacaacgagctacgccagcaacc

SEQ ID NO: 291226 - DNA, 25 bp, Artificial Sequence
  Description of Artificial Sequence: Synthetic oligonucleotide
gcacaacgagctacgccagcaaccg

SEQ ID NO: 291227 - DNA, 25 bp, Artificial Sequence
  Description of Artificial Sequence: Synthetic oligonucleotide
cacaacgagctacgccagcaaccgg

SEQ ID NO: 291228 - DNA, 25 bp, Artificial Sequence
  Description of Artificial Sequence: Synthetic oligonucleotide
acaacgagctacgccagcaaccggc

SEQ ID NO: 291229 - DNA, 24 bp, Artificial Sequence
  Description of Artificial Sequence: Synthetic oligonucleotide
caacgagctacgccagcaaccggc

SEQ ID NO: 291230 - DNA, 24 bp, Artificial Sequence
  Description of Artificial Sequence: Synthetic oligonucleotide
aacgagctacgccagcaaccggcg

SEQ ID NO: 291231 - DNA, 23 bp, Artificial Sequence
  Description of Artificial Sequence: Synthetic oligonucleotide
acgagctacgccagcaaccggcg

SEQ ID NO: 291232 - DNA, 22 bp, Artificial Sequence
  Description of Artificial Sequence: Synthetic oligonucleotide
cgagctacgccagcaaccggcg

SEQ ID NO: 291233 - DNA, 23 bp, Artificial Sequence
  Description of Artificial Sequence: Synthetic oligonucleotide
gagctacgccagcaaccggcgga

SEQ ID NO: 291234 - DNA, 23 bp, Artificial Sequence
  Description of Artificial Sequence: Synthetic oligonucleotide
agctacgccagcaaccggcggag

SEQ ID NO: 291235 - DNA, 22 bp, Artificial Sequence
  Description of Artificial Sequence: Synthetic oligonucleotide
gctacgccagcaaccggcggag

SEQ ID NO: 291236 - DNA, 23 bp, Artificial Sequence
  Description of Artificial Sequence: Synthetic oligonucleotide
ctacgccagcaaccggcggagca

SEQ ID NO: 291237 - DNA, 23 bp, Artificial Sequence
  Description of Artificial Sequence: Synthetic oligonucleotide
tacgccagcaaccggcggagcag

SEQ ID NO: 291238 - DNA, 22 bp, Artificial Sequence
  Description of Artificial Sequence: Synthetic oligonucleotide
acgccagcaaccggcggagcag

SEQ ID NO: 291239 - DNA, 21 bp, Artificial Sequence
  Description of Artificial Sequence: Synthetic oligonucleotide
cgccagcaaccggcggagcag

SEQ ID NO: 291240 - DNA, 21 bp, Artificial Sequence
  Description of Artificial Sequence: Synthetic oligonucleotide
gccagcaaccggcggagcagc

SEQ ID NO: 291241 - DNA, 21 bp, Artificial Sequence
  Description of Artificial Sequence: Synthetic oligonucleotide
ccagcaaccggcggagcagcg

SEQ ID NO: 291242 - DNA, 21 bp, Artificial Sequence
  Description of Artificial Sequence: Synthetic oligonucleotide
cagcaaccggcggagcagcgc

SEQ ID NO: 291243 - DNA, 22 bp, Artificial Sequence
  Description of Artificial Sequence: Synthetic oligonucleotide
agcaaccggcggagcagcgcct

SEQ ID NO: 291244 - DNA, 21 bp, Artificial Sequence
  Description of Artificial Sequence: Synthetic oligonucleotide
gcaaccggcggagcagcgcct

SEQ ID NO: 291245 - DNA, 21 bp, Artificial Sequence
  Description of Artificial Sequence: Synthetic oligonucleotide
caaccggcggagcagcgcctc

SEQ ID NO: 291246 - DNA, 21 bp, Artificial Sequence
  Description of Artificial Sequence: Synthetic oligonucleotide
aaccggcggagcagcgcctcg

SEQ ID NO: 291247 - DNA, 20 bp, Artificial Sequence
  Description of Artificial Sequence: Synthetic oligonucleotide
accggcggagcagcgcctcg

SEQ ID NO: 291248 - DNA, 20 bp, Artificial Sequence
  Description of Artificial Sequence: Synthetic oligonucleotide
ccggcggagcagcgcctcgt

SEQ ID NO: 291249 - DNA, 20 bp, Artificial Sequence
  Description of Artificial Sequence: Synthetic oligonucleotide
cggcggagcagcgcctcggt

SEQ ID NO: 291250 - DNA, 20 bp, Artificial Sequence
  Description of Artificial Sequence: Synthetic oligonucleotide
ggcggagcagcgcctcgggt

SEQ ID NO: 291251 - DNA, 20 bp, Artificial Sequence
  Description of Artificial Sequence: Synthetic oligonucleotide
gcggagcagcgcctcgggct

SEQ ID NO: 291252 - DNA, 20 bp, Artificial Sequence
  Description of Artificial Sequence: Synthetic oligonucleotide
cggagcagcgcctcgggcct

SEQ ID NO: 291253 - DNA, 20 bp, Artificial Sequence
  Description of Artificial Sequence: Synthetic oligonucleotide
ggagcagcgcctcgggccgt

SEQ ID NO: 291254 - DNA, 20 bp, Artificial Sequence
  Description of Artificial Sequence: Synthetic oligonucleotide
gagcagcgcctcgggccgct

SEQ ID NO: 291255 - DNA, 22 bp, Artificial Sequence
  Description of Artificial Sequence: Synthetic oligonucleotide
agcagcgcctcgggccgctctt

SEQ ID NO: 291256 - DNA, 21 bp, Artificial Sequence
  Description of Artificial Sequence: Synthetic oligonucleotide
gcagcgcctcgggccgctctt

SEQ ID NO: 291257 - DNA, 22 bp, Artificial Sequence
  Description of Artificial Sequence: Synthetic oligonucleotide
cagcgcctcgggccgctcttca

SEQ ID NO: 291258 - DNA, 22 bp, Artificial Sequence
  Description of Artificial Sequence: Synthetic oligonucleotide
agcgcctcgggccgctcttcac

SEQ ID NO: 291259 - DNA, 21 bp, Artificial Sequence
  Description of Artificial Sequence: Synthetic oligonucleotide
gcgcctcgggccgctcttcac

SEQ ID NO: 291260 - DNA, 21 bp, Artificial Sequence
  Description of Artificial Sequence: Synthetic oligonucleotide
cgcctcgggccgctcttcacc

SEQ ID NO: 291261 - DNA, 22 bp, Artificial Sequence
  Description of Artificial Sequence: Synthetic oligonucleotide
gcctcgggccgctcttcaccct

SEQ ID NO: 291262 - DNA, 22 bp, Artificial Sequence
  Description of Artificial Sequence: Synthetic oligonucleotide
cctcgggccgctcttcaccctg

SEQ ID NO: 291263 - DNA, 26 bp, Artificial Sequence
  Description of Artificial Sequence: Synthetic oligonucleotide
ctcgggccgctcttcaccctgcttat

SEQ ID NO: 291264 - DNA, 26 bp, Artificial Sequence
  Description of Artificial Sequence: Synthetic oligonucleotide
tcgggccgctcttcaccctgcttatc

SEQ ID NO: 291265 - DNA, 25 bp, Artificial Sequence
  Description of Artificial Sequence: Synthetic oligonucleotide
cgggccgctcttcaccctgcttatc

SEQ ID NO: 291266 - DNA, 26 bp, Artificial Sequence
  Description of Artificial Sequence: Synthetic oligonucleotide
gggccgctcttcaccctgcttatcga

SEQ ID NO: 291267 - DNA, 27 bp, Artificial Sequence
  Description of Artificial Sequence: Synthetic oligonucleotide
ggccgctcttcaccctgcttatcgaga

SEQ ID NO: 291268 - DNA, 28 bp, Artificial Sequence
  Description of Artificial Sequence: Synthetic oligonucleotide
gccgctcttcaccctgcttatcgagaac

SEQ ID NO: 291269 - DNA, 28 bp, Artificial Sequence
  Description of Artificial Sequence: Synthetic oligonucleotide
ccgctcttcaccctgcttatcgagaacc

SEQ ID NO: 291270 - DNA, 31 bp, Artificial Sequence
  Description of Artificial Sequence: Synthetic oligonucleotide
cgctcttcaccctgcttatcgagaaccaaag

SEQ ID NO: 291271 - DNA, 31 bp, Artificial Sequence
  Description of Artificial Sequence: Synthetic oligonucleotide
gctcttcaccctgcttatcgagaaccaaagg

SEQ ID NO: 291272 - DNA, 31 bp, Artificial Sequence
  Description of Artificial Sequence: Synthetic oligonucleotide
ctcttcaccctgcttatcgagaaccaaaggg

SEQ ID NO: 291273 - DNA, 35 bp, Artificial Sequence
  Description of Artificial Sequence: Synthetic oligonucleotide
tcttcaccctgcttatcgagaaccaaagggaaaag

SEQ ID NO: 291274 - DNA, 34 bp, Artificial Sequence
  Description of Artificial Sequence: Synthetic oligonucleotide
cttcaccctgcttatcgagaaccaaagggaaaag

SEQ ID NO: 291275 - DNA, 35 bp, Artificial Sequence
  Description of Artificial Sequence: Synthetic oligonucleotide
ttcaccctgcttatcgagaaccaaagggaaaagtc

SEQ ID NO: 291276 - DNA, 34 bp, Artificial Sequence
  Description of Artificial Sequence: Synthetic oligonucleotide
tcaccctgcttatcgagaaccaaagggaaaagtc

SEQ ID NO: 291277 - DNA, 33 bp, Artificial Sequence
  Description of Artificial Sequence: Synthetic oligonucleotide
caccctgcttatcgagaaccaaagggaaaagtc

SEQ ID NO: 291278 - DNA, 35 bp, Artificial Sequence
  Description of Artificial Sequence: Synthetic oligonucleotide
accctgcttatcgagaaccaaagggaaaagtctac

SEQ ID NO: 291279 - DNA, 34 bp, Artificial Sequence
  Description of Artificial Sequence: Synthetic oligonucleotide
ccctgcttatcgagaaccaaagggaaaagtctac

SEQ ID NO: 291280 - DNA, 37 bp, Artificial Sequence
  Description of Artificial Sequence: Synthetic oligonucleotide
cctgcttatcgagaaccaaagggaaaagtctactttg

SEQ ID NO: 291281 - DNA, 38 bp, Artificial Sequence
  Description of Artificial Sequence: Synthetic oligonucleotide
ctgcttatcgagaaccaaagggaaaagtctactttgtc

SEQ ID NO: 291282 - DNA, 39 bp, Artificial Sequence
  Description of Artificial Sequence: Synthetic oligonucleotide
tgcttatcgagaaccaaagggaaaagtctactttgtctg

SEQ ID NO: 291283 - DNA, 38 bp, Artificial Sequence
  Description of Artificial Sequence: Synthetic oligonucleotide
gcttatcgagaaccaaagggaaaagtctactttgtctg

SEQ ID NO: 291284 - DNA, 41 bp, Artificial Sequence
  Description of Artificial Sequence: Synthetic oligonucleotide
cttatcgagaaccaaagggaaaagtctactttgtctgtatc

SEQ ID NO: 291285 - DNA, 41 bp, Artificial Sequence
  Description of Artificial Sequence: Synthetic oligonucleotide
ttatcgagaaccaaagggaaaagtctactttgtctgtatcc

SEQ ID NO: 291286 - DNA, 40 bp, Artificial Sequence
  Description of Artificial Sequence: Synthetic oligonucleotide
tatcgagaaccaaagggaaaagtctactttgtctgtatcc

SEQ ID NO: 291287 - DNA, 39 bp, Artificial Sequence
  Description of Artificial Sequence: Synthetic oligonucleotide
atcgagaaccaaagggaaaagtctactttgtctgtatcc

SEQ ID NO: 291288 - DNA, 38 bp, Artificial Sequence
  Description of Artificial Sequence: Synthetic oligonucleotide
tcgagaaccaaagggaaaagtctactttgtctgtatcc

SEQ ID NO: 291289 - DNA, 37 bp, Artificial Sequence
  Description of Artificial Sequence: Synthetic oligonucleotide
cgagaaccaaagggaaaagtctactttgtctgtatcc

SEQ ID NO: 291290 - DNA, 40 bp, Artificial Sequence
  Description of Artificial Sequence: Synthetic oligonucleotide
gagaaccaaagggaaaagtctactttgtctgtatccatac

SEQ ID NO: 291291 - DNA, 41 bp, Artificial Sequence
  Description of Artificial Sequence: Synthetic oligonucleotide
agaaccaaagggaaaagtctactttgtctgtatccatactg

SEQ ID NO: 291292 - DNA, 40 bp, Artificial Sequence
  Description of Artificial Sequence: Synthetic oligonucleotide
gaaccaaagggaaaagtctactttgtctgtatccatactg

SEQ ID NO: 291293 - DNA, 40 bp, Artificial Sequence
  Description of Artificial Sequence: Synthetic oligonucleotide
aaccaaagggaaaagtctactttgtctgtatccatactgg

SEQ ID NO: 291294 - DNA, 39 bp, Artificial Sequence
  Description of Artificial Sequence: Synthetic oligonucleotide
accaaagggaaaagtctactttgtctgtatccatactgg

SEQ ID NO: 291295 - DNA, 38 bp, Artificial Sequence
  Description of Artificial Sequence: Synthetic oligonucleotide
ccaaagggaaaagtctactttgtctgtatccatactgg

SEQ ID NO: 291296 - DNA, 39 bp, Artificial Sequence
  Description of Artificial Sequence: Synthetic oligonucleotide
caaagggaaaagtctactttgtctgtatccatactggag

SEQ ID NO: 291297 - DNA, 40 bp, Artificial Sequence
  Description of Artificial Sequence: Synthetic oligonucleotide
aaagggaaaagtctactttgtctgtatccatactggagag

SEQ ID NO: 291298 - DNA, 39 bp, Artificial Sequence
  Description of Artificial Sequence: Synthetic oligonucleotide
aagggaaaagtctactttgtctgtatccatactggagag

SEQ ID NO: 291299 - DNA, 38 bp, Artificial Sequence
  Description of Artificial Sequence: Synthetic oligonucleotide
agggaaaagtctactttgtctgtatccatactggagag

SEQ ID NO: 291300 - DNA, 37 bp, Artificial Sequence
  Description of Artificial Sequence: Synthetic oligonucleotide
gggaaaagtctactttgtctgtatccatactggagag

SEQ ID NO: 291301 - DNA, 40 bp, Artificial Sequence
  Description of Artificial Sequence: Synthetic oligonucleotide
ggaaaagtctactttgtctgtatccatactggagagaatg

SEQ ID NO: 291302 - DNA, 40 bp, Artificial Sequence
  Description of Artificial Sequence: Synthetic oligonucleotide
gaaaagtctactttgtctgtatccatactggagagaatgc

SEQ ID NO: 291303 - DNA, 41 bp, Artificial Sequence
  Description of Artificial Sequence: Synthetic oligonucleotide
aaaagtctactttgtctgtatccatactggagagaatgctc

SEQ ID NO: 291304 - DNA, 40 bp, Artificial Sequence
  Description of Artificial Sequence: Synthetic oligonucleotide
aaagtctactttgtctgtatccatactggagagaatgctc

SEQ ID NO: 291305 - DNA, 39 bp, Artificial Sequence
  Description of Artificial Sequence: Synthetic oligonucleotide
aagtctactttgtctgtatccatactggagagaatgctc

SEQ ID NO: 291306 - DNA, 38 bp, Artificial Sequence
  Description of Artificial Sequence: Synthetic oligonucleotide
agtctactttgtctgtatccatactggagagaatgctc

SEQ ID NO: 291307 - DNA, 37 bp, Artificial Sequence
  Description of Artificial Sequence: Synthetic oligonucleotide
gtctactttgtctgtatccatactggagagaatgctc

SEQ ID NO: 291308 - DNA, 37 bp, Artificial Sequence
  Description of Artificial Sequence: Synthetic oligonucleotide
tctactttgtctgtatccatactggagagaatgctcc

SEQ ID NO: 291309 - DNA, 36 bp, Artificial Sequence
  Description of Artificial Sequence: Synthetic oligonucleotide
ctactttgtctgtatccatactggagagaatgctcc

SEQ ID NO: 291310 - DNA, 38 bp, Artificial Sequence
  Description of Artificial Sequence: Synthetic oligonucleotide
tactttgtctgtatccatactggagagaatgctccaag

SEQ ID NO: 291311 - DNA, 37 bp, Artificial Sequence
  Description of Artificial Sequence: Synthetic oligonucleotide
actttgtctgtatccatactggagagaatgctccaag

SEQ ID NO: 291312 - DNA, 36 bp, Artificial Sequence
  Description of Artificial Sequence: Synthetic oligonucleotide
ctttgtctgtatccatactggagagaatgctccaag

SEQ ID NO: 291313 - DNA, 36 bp, Artificial Sequence
  Description of Artificial Sequence: Synthetic oligonucleotide
tttgtctgtatccatactggagagaatgctccaagg

SEQ ID NO: 291314 - DNA, 35 bp, Artificial Sequence
  Description of Artificial Sequence: Synthetic oligonucleotide
ttgtctgtatccatactggagagaatgctccaagg

SEQ ID NO: 291315 - DNA, 34 bp, Artificial Sequence
  Description of Artificial Sequence: Synthetic oligonucleotide
tgtctgtatccatactggagagaatgctccaagg

SEQ ID NO: 291316 - DNA, 33 bp, Artificial Sequence
  Description of Artificial Sequence: Synthetic oligonucleotide
gtctgtatccatactggagagaatgctccaagg

SEQ ID NO: 291317 - DNA, 36 bp, Artificial Sequence
  Description of Artificial Sequence: Synthetic oligonucleotide
tctgtatccatactggagagaatgctccaaggtatg

SEQ ID NO: 291318 - DNA, 35 bp, Artificial Sequence
  Description of Artificial Sequence: Synthetic oligonucleotide
ctgtatccatactggagagaatgctccaaggtatg

SEQ ID NO: 291319 - DNA, 35 bp, Artificial Sequence
  Description of Artificial Sequence: Synthetic oligonucleotide
tgtatccatactggagagaatgctccaaggtatgg

SEQ ID NO: 291320 - DNA, 34 bp, Artificial Sequence
  Description of Artificial Sequence: Synthetic oligonucleotide
gtatccatactggagagaatgctccaaggtatgg

SEQ ID NO: 291321 - DNA, 36 bp, Artificial Sequence
  Description of Artificial Sequence: Synthetic oligonucleotide
tatccatactggagagaatgctccaaggtatggaac

SEQ ID NO: 291322 - DNA, 35 bp, Artificial Sequence
  Description of Artificial Sequence: Synthetic oligonucleotide
atccatactggagagaatgctccaaggtatggaac

SEQ ID NO: 291323 - DNA, 34 bp, Artificial Sequence
  Description of Artificial Sequence: Synthetic oligonucleotide
tccatactggagagaatgctccaaggtatggaac

SEQ ID NO: 291324 - DNA, 33 bp, Artificial Sequence
  Description of Artificial Sequence: Synthetic oligonucleotide
ccatactggagagaatgctccaaggtatggaac

SEQ ID NO: 291325 - DNA, 33 bp, Artificial Sequence
  Description of Artificial Sequence: Synthetic oligonucleotide
catactggagagaatgctccaaggtatggaacc

SEQ ID NO: 291326 - DNA, 33 bp, Artificial Sequence
  Description of Artificial Sequence: Synthetic oligonucleotide
atactggagagaatgctccaaggtatggaaccc

SEQ ID NO: 291327 - DNA, 32 bp, Artificial Sequence
  Description of Artificial Sequence: Synthetic oligonucleotide
tactggagagaatgctccaaggtatggaaccc

SEQ ID NO: 291328 - DNA, 31 bp, Artificial Sequence
  Description of Artificial Sequence: Synthetic oligonucleotide
actggagagaatgctccaaggtatggaaccc

SEQ ID NO: 291329 - DNA, 30 bp, Artificial Sequence
  Description of Artificial Sequence: Synthetic oligonucleotide
ctggagagaatgctccaaggtatggaaccc

SEQ ID NO: 291330 - DNA, 30 bp, Artificial Sequence
  Description of Artificial Sequence: Synthetic oligonucleotide
tggagagaatgctccaaggtatggaacccg

SEQ ID NO: 291331 - DNA, 29 bp, Artificial Sequence
  Description of Artificial Sequence: Synthetic oligonucleotide
ggagagaatgctccaaggtatggaacccg

SEQ ID NO: 291332 - DNA, 31 bp, Artificial Sequence
  Description of Artificial Sequence: Synthetic oligonucleotide
gagagaatgctccaaggtatggaacccgttc

SEQ ID NO: 291333 - DNA, 32 bp, Artificial Sequence
  Description of Artificial Sequence: Synthetic oligonucleotide
agagaatgctccaaggtatggaacccgttcac

SEQ ID NO: 291334 - DNA, 31 bp, Artificial Sequence
  Description of Artificial Sequence: Synthetic oligonucleotide
gagaatgctccaaggtatggaacccgttcac

SEQ ID NO: 291335 - DNA, 31 bp, Artificial Sequence
  Description of Artificial Sequence: Synthetic oligonucleotide
agaatgctccaaggtatggaacccgttcacg

SEQ ID NO: 291336 - DNA, 30 bp, Artificial Sequence
  Description of Artificial Sequence: Synthetic oligonucleotide
gaatgctccaaggtatggaacccgttcacg

SEQ ID NO: 291337 - DNA, 31 bp, Artificial Sequence
  Description of Artificial Sequence: Synthetic oligonucleotide
aatgctccaaggtatggaacccgttcacgtg

SEQ ID NO: 291338 - DNA, 30 bp, Artificial Sequence
  Description of Artificial Sequence: Synthetic oligonucleotide
atgctccaaggtatggaacccgttcacgtg

SEQ ID NO: 291339 - DNA, 29 bp, Artificial Sequence
  Description of Artificial Sequence: Synthetic oligonucleotide
tgctccaaggtatggaacccgttcacgtg

SEQ ID NO: 291340 - DNA, 28 bp, Artificial Sequence
  Description of Artificial Sequence: Synthetic oligonucleotide
gctccaaggtatggaacccgttcacgtg

SEQ ID NO: 291341 - DNA, 28 bp, Artificial Sequence
  Description of Artificial Sequence: Synthetic oligonucleotide
ctccaaggtatggaacccgttcacgtgc

SEQ ID NO: 291342 - DNA, 28 bp, Artificial Sequence
  Description of Artificial Sequence: Synthetic oligonucleotide
tccaaggtatggaacccgttcacgtgcc

SEQ ID NO: 291343 - DNA, 27 bp, Artificial Sequence
  Description of Artificial Sequence: Synthetic oligonucleotide
ccaaggtatggaacccgttcacgtgcc

SEQ ID NO: 291344 - DNA, 27 bp, Artificial Sequence
  Description of Artificial Sequence: Synthetic oligonucleotide
caaggtatggaacccgttcacgtgccc

SEQ ID NO: 291345 - DNA, 27 bp, Artificial Sequence
  Description of Artificial Sequence: Synthetic oligonucleotide
aaggtatggaacccgttcacgtgcccc

SEQ ID NO: 291346 - DNA, 26 bp, Artificial Sequence
  Description of Artificial Sequence: Synthetic oligonucleotide
aggtatggaacccgttcacgtgcccc

SEQ ID NO: 291347 - DNA, 25 bp, Artificial Sequence
  Description of Artificial Sequence: Synthetic oligonucleotide
ggtatggaacccgttcacgtgcccc

SEQ ID NO: 291348 - DNA, 25 bp, Artificial Sequence
  Description of Artificial Sequence: Synthetic oligonucleotide
gtatggaacccgttcacgtgccccg

SEQ ID NO: 291349 - DNA, 27 bp, Artificial Sequence
  Description of Artificial Sequence: Synthetic oligonucleotide
tatggaacccgttcacgtgccccggaa

SEQ ID NO: 291350 - DNA, 26 bp, Artificial Sequence
  Description of Artificial Sequence: Synthetic oligonucleotide
atggaacccgttcacgtgccccggaa

SEQ ID NO: 291351 - DNA, 25 bp, Artificial Sequence
  Description of Artificial Sequence: Synthetic oligonucleotide
tggaacccgttcacgtgccccggaa

SEQ ID NO: 291352 - DNA, 24 bp, Artificial Sequence
  Description of Artificial Sequence: Synthetic oligonucleotide
ggaacccgttcacgtgccccggaa

SEQ ID NO: 291353 - DNA, 24 bp, Artificial Sequence
  Description of Artificial Sequence: Synthetic oligonucleotide
gaacccgttcacgtgccccggaac

SEQ ID NO: 291354 - DNA, 25 bp, Artificial Sequence
  Description of Artificial Sequence: Synthetic oligonucleotide
aacccgttcacgtgccccggaacca

SEQ ID NO: 291355 - DNA, 24 bp, Artificial Sequence
  Description of Artificial Sequence: Synthetic oligonucleotide
acccgttcacgtgccccggaacca

SEQ ID NO: 291356 - DNA, 23 bp, Artificial Sequence
  Description of Artificial Sequence: Synthetic oligonucleotide
cccgttcacgtgccccggaacca

SEQ ID NO: 291357 - DNA, 24 bp, Artificial Sequence
  Description of Artificial Sequence: Synthetic oligonucleotide
ccgttcacgtgccccggaaccaca

SEQ ID NO: 291358 - DNA, 24 bp, Artificial Sequence
  Description of Artificial Sequence: Synthetic oligonucleotide
cgttcacgtgccccggaaccacag

SEQ ID NO: 291359 - DNA, 24 bp, Artificial Sequence
  Description of Artificial Sequence: Synthetic oligonucleotide
gttcacgtgccccggaaccacagg

SEQ ID NO: 291360 - DNA, 26 bp, Artificial Sequence
  Description of Artificial Sequence: Synthetic oligonucleotide
ttcacgtgccccggaaccacagggtt

SEQ ID NO: 291361 - DNA, 25 bp, Artificial Sequence
  Description of Artificial Sequence: Synthetic oligonucleotide
tcacgtgccccggaaccacagggtt

SEQ ID NO: 291362 - DNA, 24 bp, Artificial Sequence
  Description of Artificial Sequence: Synthetic oligonucleotide
cacgtgccccggaaccacagggtt

SEQ ID NO: 291363 - DNA, 25 bp, Artificial Sequence
  Description of Artificial Sequence: Synthetic oligonucleotide
acgtgccccggaaccacagggttga

SEQ ID NO: 291364 - DNA, 24 bp, Artificial Sequence
  Description of Artificial Sequence: Synthetic oligonucleotide
cgtgccccggaaccacagggttga

SEQ ID NO: 291365 - DNA, 24 bp, Artificial Sequence
  Description of Artificial Sequence: Synthetic oligonucleotide
gtgccccggaaccacagggttgag

SEQ ID NO: 291366 - DNA, 25 bp, Artificial Sequence
  Description of Artificial Sequence: Synthetic oligonucleotide
tgccccggaaccacagggttgagct

SEQ ID NO: 291367 - DNA, 24 bp, Artificial Sequence
  Description of Artificial Sequence: Synthetic oligonucleotide
gccccggaaccacagggttgagct

SEQ ID NO: 291368 - DNA, 24 bp, Artificial Sequence
  Description of Artificial Sequence: Synthetic oligonucleotide
ccccggaaccacagggttgagctg

SEQ ID NO: 291369 - DNA, 25 bp, Artificial Sequence
  Description of Artificial Sequence: Synthetic oligonucleotide
cccggaaccacagggttgagctgca

SEQ ID NO: 291370 - DNA, 26 bp, Artificial Sequence
  Description of Artificial Sequence: Synthetic oligonucleotide
ccggaaccacagggttgagctgcaga

SEQ ID NO: 291371 - DNA, 26 bp, Artificial Sequence
  Description of Artificial Sequence: Synthetic oligonucleotide
cggaaccacagggttgagctgcagag

SEQ ID NO: 291372 - DNA, 26 bp, Artificial Sequence
  Description of Artificial Sequence: Synthetic oligonucleotide
ggaaccacagggttgagctgcagagg

SEQ ID NO: 291373 - DNA, 26 bp, Artificial Sequence
  Description of Artificial Sequence: Synthetic oligonucleotide
gaaccacagggttgagctgcagaggc

SEQ ID NO: 291374 - DNA, 27 bp, Artificial Sequence
  Description of Artificial Sequence: Synthetic oligonucleotide
aaccacagggttgagctgcagaggcga

SEQ ID NO: 291375 - DNA, 26 bp, Artificial Sequence
  Description of Artificial Sequence: Synthetic oligonucleotide
accacagggttgagctgcagaggcga

SEQ ID NO: 291376 - DNA, 25 bp, Artificial Sequence
  Description of Artificial Sequence: Synthetic oligonucleotide
ccacagggttgagctgcagaggcga

SEQ ID NO: 291377 - DNA, 27 bp, Artificial Sequence
  Description of Artificial Sequence: Synthetic oligonucleotide
cacagggttgagctgcagaggcgacta

SEQ ID NO: 291378 - DNA, 30 bp, Artificial Sequence
  Description of Artificial Sequence: Synthetic oligonucleotide
acagggttgagctgcagaggcgactaattc

SEQ ID NO: 291379 - DNA, 29 bp, Artificial Sequence
  Description of Artificial Sequence: Synthetic oligonucleotide
cagggttgagctgcagaggcgactaattc

SEQ ID NO: 291380 - DNA, 30 bp, Artificial Sequence
  Description of Artificial Sequence: Synthetic oligonucleotide
agggttgagctgcagaggcgactaattctc

SEQ ID NO: 291381 - DNA, 29 bp, Artificial Sequence
  Description of Artificial Sequence: Synthetic oligonucleotide
gggttgagctgcagaggcgactaattctc

SEQ ID NO: 291382 - DNA, 29 bp, Artificial Sequence
  Description of Artificial Sequence: Synthetic oligonucleotide
ggttgagctgcagaggcgactaattctcc

SEQ ID NO: 291383 - DNA, 29 bp, Artificial Sequence
  Description of Artificial Sequence: Synthetic oligonucleotide
gttgagctgcagaggcgactaattctccc

SEQ ID NO: 291384 - DNA, 30 bp, Artificial Sequence
  Description of Artificial Sequence: Synthetic oligonucleotide
ttgagctgcagaggcgactaattctccctg

SEQ ID NO: 291385 - DNA, 29 bp, Artificial Sequence
  Description of Artificial Sequence: Synthetic oligonucleotide
tgagctgcagaggcgactaattctccctg

SEQ ID NO: 291386 - DNA, 28 bp, Artificial Sequence
  Description of Artificial Sequence: Synthetic oligonucleotide
gagctgcagaggcgactaattctccctg

SEQ ID NO: 291387 - DNA, 30 bp, Artificial Sequence
  Description of Artificial Sequence: Synthetic oligonucleotide
agctgcagaggcgactaattctccctgatg

SEQ ID NO: 291388 - DNA, 29 bp, Artificial Sequence
  Description of Artificial Sequence: Synthetic oligonucleotide
gctgcagaggcgactaattctccctgatg

SEQ ID NO: 291389 - DNA, 32 bp, Artificial Sequence
  Description of Artificial Sequence: Synthetic oligonucleotide
ctgcagaggcgactaattctccctgatgaatc

SEQ ID NO: 291390 - DNA, 33 bp, Artificial Sequence
  Description of Artificial Sequence: Synthetic oligonucleotide
tgcagaggcgactaattctccctgatgaatctg

SEQ ID NO: 291391 - DNA, 32 bp, Artificial Sequence
  Description of Artificial Sequence: Synthetic oligonucleotide
gcagaggcgactaattctccctgatgaatctg

SEQ ID NO: 291392 - DNA, 39 bp, Artificial Sequence
  Description of Artificial Sequence: Synthetic oligonucleotide
cagaggcgactaattctccctgatgaatctgtaaaattc

SEQ ID NO: 291393 - DNA, 39 bp, Artificial Sequence
  Description of Artificial Sequence: Synthetic oligonucleotide
agaggcgactaattctccctgatgaatctgtaaaattcc

SEQ ID NO: 291394 - DNA, 38 bp, Artificial Sequence
  Description of Artificial Sequence: Synthetic oligonucleotide
gaggcgactaattctccctgatgaatctgtaaaattcc

SEQ ID NO: 291395 - DNA, 39 bp, Artificial Sequence
  Description of Artificial Sequence: Synthetic oligonucleotide
aggcgactaattctccctgatgaatctgtaaaattcctc

SEQ ID NO: 291396 - DNA, 38 bp, Artificial Sequence
  Description of Artificial Sequence: Synthetic oligonucleotide
ggcgactaattctccctgatgaatctgtaaaattcctc

SEQ ID NO: 291397 - DNA, 39 bp, Artificial Sequence
  Description of Artificial Sequence: Synthetic oligonucleotide
gcgactaattctccctgatgaatctgtaaaattcctcac

SEQ ID NO: 291398 - DNA, 40 bp, Artificial Sequence
  Description of Artificial Sequence: Synthetic oligonucleotide
cgactaattctccctgatgaatctgtaaaattcctcactc

SEQ ID NO: 291399 - DNA, 43 bp, Artificial Sequence
  Description of Artificial Sequence: Synthetic oligonucleotide
gactaattctccctgatgaatctgtaaaattcctcactcattc

SEQ ID NO: 291400 - DNA, 43 bp, Artificial Sequence
  Description of Artificial Sequence: Synthetic oligonucleotide
actaattctccctgatgaatctgtaaaattcctcactcattcc

SEQ ID NO: 291401 - DNA, 42 bp, Artificial Sequence
  Description of Artificial Sequence: Synthetic oligonucleotide
ctaattctccctgatgaatctgtaaaattcctcactcattcc

SEQ ID NO: 291402 - DNA, 42 bp, Artificial Sequence
  Description of Artificial Sequence: Synthetic oligonucleotide
taattctccctgatgaatctgtaaaattcctcactcattccc

SEQ ID NO: 291403 - DNA, 41 bp, Artificial Sequence
  Description of Artificial Sequence: Synthetic oligonucleotide
aattctccctgatgaatctgtaaaattcctcactcattccc

SEQ ID NO: 291404 - DNA, 40 bp, Artificial Sequence
  Description of Artificial Sequence: Synthetic oligonucleotide
attctccctgatgaatctgtaaaattcctcactcattccc

SEQ ID NO: 291405 - DNA, 39 bp, Artificial Sequence
  Description of Artificial Sequence: Synthetic oligonucleotide
ttctccctgatgaatctgtaaaattcctcactcattccc

SEQ ID NO: 291406 - DNA, 38 bp, Artificial Sequence
  Description of Artificial Sequence: Synthetic oligonucleotide
tctccctgatgaatctgtaaaattcctcactcattccc

SEQ ID NO: 291407 - DNA, 37 bp, Artificial Sequence
  Description of Artificial Sequence: Synthetic oligonucleotide
ctccctgatgaatctgtaaaattcctcactcattccc

SEQ ID NO: 291408 - DNA, 38 bp, Artificial Sequence
  Description of Artificial Sequence: Synthetic oligonucleotide
tccctgatgaatctgtaaaattcctcactcattcccag

SEQ ID NO: 291409 - DNA, 37 bp, Artificial Sequence
  Description of Artificial Sequence: Synthetic oligonucleotide
ccctgatgaatctgtaaaattcctcactcattcccag

SEQ ID NO: 291410 - DNA, 40 bp, Artificial Sequence
  Description of Artificial Sequence: Synthetic oligonucleotide
cctgatgaatctgtaaaattcctcactcattcccagatag

SEQ ID NO: 291411 - DNA, 40 bp, Artificial Sequence
  Description of Artificial Sequence: Synthetic oligonucleotide
ctgatgaatctgtaaaattcctcactcattcccagatagg

SEQ ID NO: 291412 - DNA, 42 bp, Artificial Sequence
  Description of Artificial Sequence: Synthetic oligonucleotide
tgatgaatctgtaaaattcctcactcattcccagataggaag

SEQ ID NO: 291413 - DNA, 41 bp, Artificial Sequence
  Description of Artificial Sequence: Synthetic oligonucleotide
gatgaatctgtaaaattcctcactcattcccagataggaag

SEQ ID NO: 291414 - DNA, 45 bp, Artificial Sequence
  Description of Artificial Sequence: Synthetic oligonucleotide
atgaatctgtaaaattcctcactcattcccagataggaagaattc

SEQ ID NO: 291415 - DNA, 44 bp, Artificial Sequence
  Description of Artificial Sequence: Synthetic oligonucleotide
tgaatctgtaaaattcctcactcattcccagataggaagaattc

SEQ ID NO: 291416 - DNA, 43 bp, Artificial Sequence
  Description of Artificial Sequence: Synthetic oligonucleotide
gaatctgtaaaattcctcactcattcccagataggaagaattc

SEQ ID NO: 291417 - DNA, 45 bp, Artificial Sequence
  Description of Artificial Sequence: Synthetic oligonucleotide
aatctgtaaaattcctcactcattcccagataggaagaattcttg

SEQ ID NO: 291418 - DNA, 44 bp, Artificial Sequence
  Description of Artificial Sequence: Synthetic oligonucleotide
atctgtaaaattcctcactcattcccagataggaagaattcttg

SEQ ID NO: 291419 - DNA, 43 bp, Artificial Sequence
  Description of Artificial Sequence: Synthetic oligonucleotide
tctgtaaaattcctcactcattcccagataggaagaattcttg

SEQ ID NO: 291420 - DNA, 42 bp, Artificial Sequence
  Description of Artificial Sequence: Synthetic oligonucleotide
ctgtaaaattcctcactcattcccagataggaagaattcttg

SEQ ID NO: 291421 - DNA, 48 bp, Artificial Sequence
  Description of Artificial Sequence: Synthetic oligonucleotide
tgtaaaattcctcactcattcccagataggaagaattcttgaaaattg

SEQ ID NO: 291422 - DNA, 47 bp, Artificial Sequence
  Description of Artificial Sequence: Synthetic oligonucleotide
gtaaaattcctcactcattcccagataggaagaattcttgaaaattg

SEQ ID NO: 291423 - DNA, 48 bp, Artificial Sequence
  Description of Artificial Sequence: Synthetic oligonucleotide
taaaattcctcactcattcccagataggaagaattcttgaaaattgtg

SEQ ID NO: 291424 - DNA, 47 bp, Artificial Sequence
  Description of Artificial Sequence: Synthetic oligonucleotide
aaaattcctcactcattcccagataggaagaattcttgaaaattgtg

SEQ ID NO: 291425 - DNA, 46 bp, Artificial Sequence
  Description of Artificial Sequence: Synthetic oligonucleotide
aaattcctcactcattcccagataggaagaattcttgaaaattgtg

SEQ ID NO: 291426 - DNA, 45 bp, Artificial Sequence
  Description of Artificial Sequence: Synthetic oligonucleotide
aattcctcactcattcccagataggaagaattcttgaaaattgtg

SEQ ID NO: 291427 - DNA, 44 bp, Artificial Sequence
  Description of Artificial Sequence: Synthetic oligonucleotide
attcctcactcattcccagataggaagaattcttgaaaattgtg

SEQ ID NO: 291428 - DNA, 43 bp, Artificial Sequence
  Description of Artificial Sequence: Synthetic oligonucleotide
ttcctcactcattcccagataggaagaattcttgaaaattgtg

SEQ ID NO: 291429 - DNA, 42 bp, Artificial Sequence
  Description of Artificial Sequence: Synthetic oligonucleotide
tcctcactcattcccagataggaagaattcttgaaaattgtg

SEQ ID NO: 291430 - DNA, 41 bp, Artificial Sequence
  Description of Artificial Sequence: Synthetic oligonucleotide
cctcactcattcccagataggaagaattcttgaaaattgtg

SEQ ID NO: 291431 - DNA, 43 bp, Artificial Sequence
  Description of Artificial Sequence: Synthetic oligonucleotide
ctcactcattcccagataggaagaattcttgaaaattgtgatg

SEQ ID NO: 291432 - DNA, 43 bp, Artificial Sequence
  Description of Artificial Sequence: Synthetic oligonucleotide
tcactcattcccagataggaagaattcttgaaaattgtgatgc

SEQ ID NO: 291433 - DNA, 42 bp, Artificial Sequence
  Description of Artificial Sequence: Synthetic oligonucleotide
cactcattcccagataggaagaattcttgaaaattgtgatgc

SEQ ID NO: 291434 - DNA, 43 bp, Artificial Sequence
  Description of Artificial Sequence: Synthetic oligonucleotide
actcattcccagataggaagaattcttgaaaattgtgatgctg

SEQ ID NO: 291435 - DNA, 42 bp, Artificial Sequence
  Description of Artificial Sequence: Synthetic oligonucleotide
ctcattcccagataggaagaattcttgaaaattgtgatgctg

SEQ ID NO: 291436 - DNA, 45 bp, Artificial Sequence
  Description of Artificial Sequence: Synthetic oligonucleotide
tcattcccagataggaagaattcttgaaaattgtgatgctgtaac

SEQ ID NO: 291437 - DNA, 44 bp, Artificial Sequence
  Description of Artificial Sequence: Synthetic oligonucleotide
cattcccagataggaagaattcttgaaaattgtgatgctgtaac

SEQ ID NO: 291438 - DNA, 45 bp, Artificial Sequence
  Description of Artificial Sequence: Synthetic oligonucleotide
attcccagataggaagaattcttgaaaattgtgatgctgtaactg

SEQ ID NO: 291439 - DNA, 44 bp, Artificial Sequence
  Description of Artificial Sequence: Synthetic oligonucleotide
ttcccagataggaagaattcttgaaaattgtgatgctgtaactg

SEQ ID NO: 291440 - DNA, 43 bp, Artificial Sequence
  Description of Artificial Sequence: Synthetic oligonucleotide
tcccagataggaagaattcttgaaaattgtgatgctgtaactg

SEQ ID NO: 291441 - DNA, 42 bp, Artificial Sequence
  Description of Artificial Sequence: Synthetic oligonucleotide
cccagataggaagaattcttgaaaattgtgatgctgtaactg

SEQ ID NO: 291442 - DNA, 43 bp, Artificial Sequence
  Description of Artificial Sequence: Synthetic oligonucleotide
ccagataggaagaattcttgaaaattgtgatgctgtaactgag

SEQ ID NO: 291443 - DNA, 46 bp, Artificial Sequence
  Description of Artificial Sequence: Synthetic oligonucleotide
cagataggaagaattcttgaaaattgtgatgctgtaactgagattg

SEQ ID NO: 291444 - DNA, 54 bp, Artificial Sequence
  Description of Artificial Sequence: Synthetic oligonucleotide
agataggaagaattcttgaaaattgtgatgctgtaactgagattgtaaataatg

SEQ ID NO: 291445 - DNA, 53 bp, Artificial Sequence
  Description of Artificial Sequence: Synthetic oligonucleotide
gataggaagaattcttgaaaattgtgatgctgtaactgagattgtaaataatg

SEQ ID NO: 291446 - DNA, 53 bp, Artificial Sequence
  Description of Artificial Sequence: Synthetic oligonucleotide
ataggaagaattcttgaaaattgtgatgctgtaactgagattgtaaataatgg

SEQ ID NO: 291447 - DNA, 52 bp, Artificial Sequence
  Description of Artificial Sequence: Synthetic oligonucleotide
taggaagaattcttgaaaattgtgatgctgtaactgagattgtaaataatgg

SEQ ID NO: 291448 - DNA, 51 bp, Artificial Sequence
  Description of Artificial Sequence: Synthetic oligonucleotide
aggaagaattcttgaaaattgtgatgctgtaactgagattgtaaataatgg

SEQ ID NO: 291449 - DNA, 50 bp, Artificial Sequence
  Description of Artificial Sequence: Synthetic oligonucleotide
ggaagaattcttgaaaattgtgatgctgtaactgagattgtaaataatgg

SEQ ID NO: 291450 - DNA, 51 bp, Artificial Sequence
  Description of Artificial Sequence: Synthetic oligonucleotide
gaagaattcttgaaaattgtgatgctgtaactgagattgtaaataatggtg

SEQ ID NO: 291451 - DNA, 56 bp, Artificial Sequence
  Description of Artificial Sequence: Synthetic oligonucleotide
aagaattcttgaaaattgtgatgctgtaactgagattgtaaataatggtgaattac

SEQ ID NO: 291452 - DNA, 55 bp, Artificial Sequence
  Description of Artificial Sequence: Synthetic oligonucleotide
agaattcttgaaaattgtgatgctgtaactgagattgtaaataatggtgaattac

SEQ ID NO: 291453 - DNA, 54 bp, Artificial Sequence
  Description of Artificial Sequence: Synthetic oligonucleotide
gaattcttgaaaattgtgatgctgtaactgagattgtaaataatggtgaattac

SEQ ID NO: 291454 - DNA, 59 bp, Artificial Sequence
  Description of Artificial Sequence: Synthetic oligonucleotide
aattcttgaaaattgtgatgctgtaactgagattgtaaataatggtgaattacttaaac

SEQ ID NO: 291455 - DNA, 58 bp, Artificial Sequence
  Description of Artificial Sequence: Synthetic oligonucleotide
attcttgaaaattgtgatgctgtaactgagattgtaaataatggtgaattacttaaac

SEQ ID NO: 291456 - DNA, 57 bp, Artificial Sequence
  Description of Artificial Sequence: Synthetic oligonucleotide
ttcttgaaaattgtgatgctgtaactgagattgtaaataatggtgaattacttaaac

SEQ ID NO: 291457 - DNA, 56 bp, Artificial Sequence
  Description of Artificial Sequence: Synthetic oligonucleotide
tcttgaaaattgtgatgctgtaactgagattgtaaataatggtgaattacttaaac

SEQ ID NO: 291458 - DNA, 55 bp, Artificial Sequence
  Description of Artificial Sequence: Synthetic oligonucleotide
cttgaaaattgtgatgctgtaactgagattgtaaataatggtgaattacttaaac

SEQ ID NO: 291459 - DNA, 60 bp, Artificial Sequence
  Description of Artificial Sequence: Synthetic oligonucleotide
ttgaaaattgtgatgctgtaactgagattgtaaataatggtgaattacttaaacaaattc

SEQ ID NO: 291460 - DNA, 59 bp, Artificial Sequence
  Description of Artificial Sequence: Synthetic oligonucleotide
tgaaaattgtgatgctgtaactgagattgtaaataatggtgaattacttaaacaaattc

SEQ ID NO: 291461 - DNA, 58 bp, Artificial Sequence
  Description of Artificial Sequence: Synthetic oligonucleotide
gaaaattgtgatgctgtaactgagattgtaaataatggtgaattacttaaacaaattc

SEQ ID NO: 291462 - DNA, 60 bp, Artificial Sequence
  Description of Artificial Sequence: Synthetic oligonucleotide
aaaattgtgatgctgtaactgagattgtaaataatggtgaattacttaaacaaattcttt

SEQ ID NO: 291463 - DNA, 60 bp, Artificial Sequence
  Description of Artificial Sequence: Synthetic oligonucleotide
aaattgtgatgctgtaactgagattgtaaataatggtgaattacttaaacaaattcttta

SEQ ID NO: 291464 - DNA, 60 bp, Artificial Sequence
  Description of Artificial Sequence: Synthetic oligonucleotide
aattgtgatgctgtaactgagattgtaaataatggtgaattacttaaacaaattctttat

SEQ ID NO: 291465 - DNA, 60 bp, Artificial Sequence
  Description of Artificial Sequence: Synthetic oligonucleotide
attgtgatgctgtaactgagattgtaaataatggtgaattacttaaacaaattctttatt

SEQ ID NO: 291466 - DNA, 60 bp, Artificial Sequence
  Description of Artificial Sequence: Synthetic oligonucleotide
ttgtgatgctgtaactgagattgtaaataatggtgaattacttaaacaaattctttattg

SEQ ID NO: 291467 - DNA, 59 bp, Artificial Sequence
  Description of Artificial Sequence: Synthetic oligonucleotide
tgtgatgctgtaactgagattgtaaataatggtgaattacttaaacaaattctttattg

SEQ ID NO: 291468 - DNA, 58 bp, Artificial Sequence
  Description of Artificial Sequence: Synthetic oligonucleotide
gtgatgctgtaactgagattgtaaataatggtgaattacttaaacaaattctttattg

SEQ ID NO: 291469 - DNA, 58 bp, Artificial Sequence
  Description of Artificial Sequence: Synthetic oligonucleotide
tgatgctgtaactgagattgtaaataatggtgaattacttaaacaaattctttattgc

SEQ ID NO: 291470 - DNA, 57 bp, Artificial Sequence
  Description of Artificial Sequence: Synthetic oligonucleotide
gatgctgtaactgagattgtaaataatggtgaattacttaaacaaattctttattgc

SEQ ID NO: 291471 - DNA, 60 bp, Artificial Sequence
  Description of Artificial Sequence: Synthetic oligonucleotide
atgctgtaactgagattgtaaataatggtgaattacttaaacaaattctttattgcaatg

SEQ ID NO: 291472 - DNA, 59 bp, Artificial Sequence
  Description of Artificial Sequence: Synthetic oligonucleotide
tgctgtaactgagattgtaaataatggtgaattacttaaacaaattctttattgcaatg

SEQ ID NO: 291473 - DNA, 58 bp, Artificial Sequence
  Description of Artificial Sequence: Synthetic oligonucleotide
gctgtaactgagattgtaaataatggtgaattacttaaacaaattctttattgcaatg

SEQ ID NO: 291474 - DNA, 58 bp, Artificial Sequence
  Description of Artificial Sequence: Synthetic oligonucleotide
ctgtaactgagattgtaaataatggtgaattacttaaacaaattctttattgcaatgg

SEQ ID NO: 291475 - DNA, 59 bp, Artificial Sequence
  Description of Artificial Sequence: Synthetic oligonucleotide
tgtaactgagattgtaaataatggtgaattacttaaacaaattctttattgcaatggtg

SEQ ID NO: 291476 - DNA, 58 bp, Artificial Sequence
  Description of Artificial Sequence: Synthetic oligonucleotide
gtaactgagattgtaaataatggtgaattacttaaacaaattctttattgcaatggtg

SEQ ID NO: 291477 - DNA, 58 bp, Artificial Sequence
  Description of Artificial Sequence: Synthetic oligonucleotide
taactgagattgtaaataatggtgaattacttaaacaaattctttattgcaatggtgg

SEQ ID NO: 291478 - DNA, 57 bp, Artificial Sequence
  Description of Artificial Sequence: Synthetic oligonucleotide
aactgagattgtaaataatggtgaattacttaaacaaattctttattgcaatggtgg

SEQ ID NO: 291479 - DNA, 56 bp, Artificial Sequence
  Description of Artificial Sequence: Synthetic oligonucleotide
actgagattgtaaataatggtgaattacttaaacaaattctttattgcaatggtgg

SEQ ID NO: 291480 - DNA, 55 bp, Artificial Sequence
  Description of Artificial Sequence: Synthetic oligonucleotide
ctgagattgtaaataatggtgaattacttaaacaaattctttattgcaatggtgg

SEQ ID NO: 291481 - DNA, 56 bp, Artificial Sequence
  Description of Artificial Sequence: Synthetic oligonucleotide
tgagattgtaaataatggtgaattacttaaacaaattctttattgcaatggtggag

SEQ ID NO: 291482 - DNA, 55 bp, Artificial Sequence
  Description of Artificial Sequence: Synthetic oligonucleotide
gagattgtaaataatggtgaattacttaaacaaattctttattgcaatggtggag

SEQ ID NO: 291483 - DNA, 56 bp, Artificial Sequence
  Description of Artificial Sequence: Synthetic oligonucleotide
agattgtaaataatggtgaattacttaaacaaattctttattgcaatggtggagac

SEQ ID NO: 291484 - DNA, 55 bp, Artificial Sequence
  Description of Artificial Sequence: Synthetic oligonucleotide
gattgtaaataatggtgaattacttaaacaaattctttattgcaatggtggagac

SEQ ID NO: 291485 - DNA, 58 bp, Artificial Sequence
  Description of Artificial Sequence: Synthetic oligonucleotide
attgtaaataatggtgaattacttaaacaaattctttattgcaatggtggagacaatc

SEQ ID NO: 291486 - DNA, 57 bp, Artificial Sequence
  Description of Artificial Sequence: Synthetic oligonucleotide
ttgtaaataatggtgaattacttaaacaaattctttattgcaatggtggagacaatc

SEQ ID NO: 291487 - DNA, 56 bp, Artificial Sequence
  Description of Artificial Sequence: Synthetic oligonucleotide
tgtaaataatggtgaattacttaaacaaattctttattgcaatggtggagacaatc

SEQ ID NO: 291488 - DNA, 55 bp, Artificial Sequence
  Description of Artificial Sequence: Synthetic oligonucleotide
gtaaataatggtgaattacttaaacaaattctttattgcaatggtggagacaatc

SEQ ID NO: 291489 - DNA, 58 bp, Artificial Sequence
  Description of Artificial Sequence: Synthetic oligonucleotide
taaataatggtgaattacttaaacaaattctttattgcaatggtggagacaatctatc

SEQ ID NO: 291490 - DNA, 57 bp, Artificial Sequence
  Description of Artificial Sequence: Synthetic oligonucleotide
aaataatggtgaattacttaaacaaattctttattgcaatggtggagacaatctatc

SEQ ID NO: 291491 - DNA, 56 bp, Artificial Sequence
  Description of Artificial Sequence: Synthetic oligonucleotide
aataatggtgaattacttaaacaaattctttattgcaatggtggagacaatctatc

SEQ ID NO: 291492 - DNA, 55 bp, Artificial Sequence
  Description of Artificial Sequence: Synthetic oligonucleotide
ataatggtgaattacttaaacaaattctttattgcaatggtggagacaatctatc

SEQ ID NO: 291493 - DNA, 54 bp, Artificial Sequence
  Description of Artificial Sequence: Synthetic oligonucleotide
taatggtgaattacttaaacaaattctttattgcaatggtggagacaatctatc

SEQ ID NO: 291494 - DNA, 53 bp, Artificial Sequence
  Description of Artificial Sequence: Synthetic oligonucleotide
aatggtgaattacttaaacaaattctttattgcaatggtggagacaatctatc

SEQ ID NO: 291495 - DNA, 52 bp, Artificial Sequence
  Description of Artificial Sequence: Synthetic oligonucleotide
atggtgaattacttaaacaaattctttattgcaatggtggagacaatctatc

SEQ ID NO: 291496 - DNA, 51 bp, Artificial Sequence
  Description of Artificial Sequence: Synthetic oligonucleotide
tggtgaattacttaaacaaattctttattgcaatggtggagacaatctatc

SEQ ID NO: 291497 - DNA, 50 bp, Artificial Sequence
  Description of Artificial Sequence: Synthetic oligonucleotide
ggtgaattacttaaacaaattctttattgcaatggtggagacaatctatc

SEQ ID NO: 291498 - DNA, 51 bp, Artificial Sequence
  Description of Artificial Sequence: Synthetic oligonucleotide
gtgaattacttaaacaaattctttattgcaatggtggagacaatctatctc

SEQ ID NO: 291499 - DNA, 53 bp, Artificial Sequence
  Description of Artificial Sequence: Synthetic oligonucleotide
tgaattacttaaacaaattctttattgcaatggtggagacaatctatctctag

SEQ ID NO: 291500 - DNA, 52 bp, Artificial Sequence
  Description of Artificial Sequence: Synthetic oligonucleotide
gaattacttaaacaaattctttattgcaatggtggagacaatctatctctag

SEQ ID NO: 291501 - DNA, 52 bp, Artificial Sequence
  Description of Artificial Sequence: Synthetic oligonucleotide
aattacttaaacaaattctttattgcaatggtggagacaatctatctctagc

SEQ ID NO: 291502 - DNA, 51 bp, Artificial Sequence
  Description of Artificial Sequence: Synthetic oligonucleotide
attacttaaacaaattctttattgcaatggtggagacaatctatctctagc

SEQ ID NO: 291503 - DNA, 50 bp, Artificial Sequence
  Description of Artificial Sequence: Synthetic oligonucleotide
ttacttaaacaaattctttattgcaatggtggagacaatctatctctagc

SEQ ID NO: 291504 - DNA, 49 bp, Artificial Sequence
  Description of Artificial Sequence: Synthetic oligonucleotide
tacttaaacaaattctttattgcaatggtggagacaatctatctctagc

SEQ ID NO: 291505 - DNA, 48 bp, Artificial Sequence
  Description of Artificial Sequence: Synthetic oligonucleotide
acttaaacaaattctttattgcaatggtggagacaatctatctctagc

SEQ ID NO: 291506 - DNA, 47 bp, Artificial Sequence
  Description of Artificial Sequence: Synthetic oligonucleotide
cttaaacaaattctttattgcaatggtggagacaatctatctctagc

SEQ ID NO: 291507 - DNA, 51 bp, Artificial Sequence
  Description of Artificial Sequence: Synthetic oligonucleotide
ttaaacaaattctttattgcaatggtggagacaatctatctctagcaaaag

SEQ ID NO: 291508 - DNA, 50 bp, Artificial Sequence
  Description of Artificial Sequence: Synthetic oligonucleotide
taaacaaattctttattgcaatggtggagacaatctatctctagcaaaag

SEQ ID NO: 291509 - DNA, 49 bp, Artificial Sequence
  Description of Artificial Sequence: Synthetic oligonucleotide
aaacaaattctttattgcaatggtggagacaatctatctctagcaaaag

SEQ ID NO: 291510 - DNA, 48 bp, Artificial Sequence
  Description of Artificial Sequence: Synthetic oligonucleotide
aacaaattctttattgcaatggtggagacaatctatctctagcaaaag

SEQ ID NO: 291511 - DNA, 47 bp, Artificial Sequence
  Description of Artificial Sequence: Synthetic oligonucleotide
acaaattctttattgcaatggtggagacaatctatctctagcaaaag

SEQ ID NO: 291512 - DNA, 46 bp, Artificial Sequence
  Description of Artificial Sequence: Synthetic oligonucleotide
caaattctttattgcaatggtggagacaatctatctctagcaaaag

SEQ ID NO: 291513 - DNA, 46 bp, Artificial Sequence
  Description of Artificial Sequence: Synthetic oligonucleotide
aaattctttattgcaatggtggagacaatctatctctagcaaaagg

SEQ ID NO: 291514 - DNA, 45 bp, Artificial Sequence
  Description of Artificial Sequence: Synthetic oligonucleotide
aattctttattgcaatggtggagacaatctatctctagcaaaagg

SEQ ID NO: 291515 - DNA, 44 bp, Artificial Sequence
  Description of Artificial Sequence: Synthetic oligonucleotide
attctttattgcaatggtggagacaatctatctctagcaaaagg

SEQ ID NO: 291516 - DNA, 43 bp, Artificial Sequence
  Description of Artificial Sequence: Synthetic oligonucleotide
ttctttattgcaatggtggagacaatctatctctagcaaaagg

SEQ ID NO: 291517 - DNA, 42 bp, Artificial Sequence
  Description of Artificial Sequence: Synthetic oligonucleotide
tctttattgcaatggtggagacaatctatctctagcaaaagg

SEQ ID NO: 291518 - DNA, 41 bp, Artificial Sequence
  Description of Artificial Sequence: Synthetic oligonucleotide
ctttattgcaatggtggagacaatctatctctagcaaaagg

SEQ ID NO: 291519 - DNA, 41 bp, Artificial Sequence
  Description of Artificial Sequence: Synthetic oligonucleotide
tttattgcaatggtggagacaatctatctctagcaaaaggg

SEQ ID NO: 291520 - DNA, 40 bp, Artificial Sequence
  Description of Artificial Sequence: Synthetic oligonucleotide
ttattgcaatggtggagacaatctatctctagcaaaaggg

SEQ ID NO: 291521 - DNA, 39 bp, Artificial Sequence
  Description of Artificial Sequence: Synthetic oligonucleotide
tattgcaatggtggagacaatctatctctagcaaaaggg

SEQ ID NO: 291522 - DNA, 38 bp, Artificial Sequence
  Description of Artificial Sequence: Synthetic oligonucleotide
attgcaatggtggagacaatctatctctagcaaaaggg

SEQ ID NO: 291523 - DNA, 37 bp, Artificial Sequence
  Description of Artificial Sequence: Synthetic oligonucleotide
ttgcaatggtggagacaatctatctctagcaaaaggg

SEQ ID NO: 291524 - DNA, 36 bp, Artificial Sequence
  Description of Artificial Sequence: Synthetic oligonucleotide
tgcaatggtggagacaatctatctctagcaaaaggg

SEQ ID NO: 291525 - DNA, 35 bp, Artificial Sequence
  Description of Artificial Sequence: Synthetic oligonucleotide
gcaatggtggagacaatctatctctagcaaaaggg

SEQ ID NO: 291526 - DNA, 35 bp, Artificial Sequence
  Description of Artificial Sequence: Synthetic oligonucleotide
caatggtggagacaatctatctctagcaaaagggg

SEQ ID NO: 291527 - DNA, 35 bp, Artificial Sequence
  Description of Artificial Sequence: Synthetic oligonucleotide
aatggtggagacaatctatctctagcaaaaggggc

SEQ ID NO: 291528 - DNA, 34 bp, Artificial Sequence
  Description of Artificial Sequence: Synthetic oligonucleotide
atggtggagacaatctatctctagcaaaaggggc

SEQ ID NO: 291529 - DNA, 33 bp, Artificial Sequence
  Description of Artificial Sequence: Synthetic oligonucleotide
tggtggagacaatctatctctagcaaaaggggc

SEQ ID NO: 291530 - DNA, 32 bp, Artificial Sequence
  Description of Artificial Sequence: Synthetic oligonucleotide
ggtggagacaatctatctctagcaaaaggggc

SEQ ID NO: 291531 - DNA, 35 bp, Artificial Sequence
  Description of Artificial Sequence: Synthetic oligonucleotide
gtggagacaatctatctctagcaaaaggggctatc

SEQ ID NO: 291532 - DNA, 39 bp, Artificial Sequence
  Description of Artificial Sequence: Synthetic oligonucleotide
tggagacaatctatctctagcaaaaggggctatcaattc

SEQ ID NO: 291533 - DNA, 38 bp, Artificial Sequence
  Description of Artificial Sequence: Synthetic oligonucleotide
ggagacaatctatctctagcaaaaggggctatcaattc

SEQ ID NO: 291534 - DNA, 38 bp, Artificial Sequence
  Description of Artificial Sequence: Synthetic oligonucleotide
gagacaatctatctctagcaaaaggggctatcaattcc

SEQ ID NO: 291535 - DNA, 38 bp, Artificial Sequence
  Description of Artificial Sequence: Synthetic oligonucleotide
agacaatctatctctagcaaaaggggctatcaattccc

SEQ ID NO: 291536 - DNA, 37 bp, Artificial Sequence
  Description of Artificial Sequence: Synthetic oligonucleotide
gacaatctatctctagcaaaaggggctatcaattccc

SEQ ID NO: 291537 - DNA, 38 bp, Artificial Sequence
  Description of Artificial Sequence: Synthetic oligonucleotide
acaatctatctctagcaaaaggggctatcaattccctg

SEQ ID NO: 291538 - DNA, 37 bp, Artificial Sequence
  Description of Artificial Sequence: Synthetic oligonucleotide
caatctatctctagcaaaaggggctatcaattccctg

SEQ ID NO: 291539 - DNA, 38 bp, Artificial Sequence
  Description of Artificial Sequence: Synthetic oligonucleotide
aatctatctctagcaaaaggggctatcaattccctgtc

SEQ ID NO: 291540 - DNA, 37 bp, Artificial Sequence
  Description of Artificial Sequence: Synthetic oligonucleotide
atctatctctagcaaaaggggctatcaattccctgtc

SEQ ID NO: 291541 - DNA, 36 bp, Artificial Sequence
  Description of Artificial Sequence: Synthetic oligonucleotide
tctatctctagcaaaaggggctatcaattccctgtc

SEQ ID NO: 291542 - DNA, 35 bp, Artificial Sequence
  Description of Artificial Sequence: Synthetic oligonucleotide
ctatctctagcaaaaggggctatcaattccctgtc

SEQ ID NO: 291543 - DNA, 37 bp, Artificial Sequence
  Description of Artificial Sequence: Synthetic oligonucleotide
tatctctagcaaaaggggctatcaattccctgtcatg

SEQ ID NO: 291544 - DNA, 36 bp, Artificial Sequence
  Description of Artificial Sequence: Synthetic oligonucleotide
atctctagcaaaaggggctatcaattccctgtcatg

SEQ ID NO: 291545 - DNA, 35 bp, Artificial Sequence
  Description of Artificial Sequence: Synthetic oligonucleotide
tctctagcaaaaggggctatcaattccctgtcatg

SEQ ID NO: 291546 - DNA, 34 bp, Artificial Sequence
  Description of Artificial Sequence: Synthetic oligonucleotide
ctctagcaaaaggggctatcaattccctgtcatg

SEQ ID NO: 291547 - DNA, 39 bp, Artificial Sequence
  Description of Artificial Sequence: Synthetic oligonucleotide
tctagcaaaaggggctatcaattccctgtcatgaatatc

SEQ ID NO: 291548 - DNA, 38 bp, Artificial Sequence
  Description of Artificial Sequence: Synthetic oligonucleotide
ctagcaaaaggggctatcaattccctgtcatgaatatc

SEQ ID NO: 291549 - DNA, 39 bp, Artificial Sequence
  Description of Artificial Sequence: Synthetic oligonucleotide
tagcaaaaggggctatcaattccctgtcatgaatatcac

SEQ ID NO: 291550 - DNA, 38 bp, Artificial Sequence
  Description of Artificial Sequence: Synthetic oligonucleotide
agcaaaaggggctatcaattccctgtcatgaatatcac

SEQ ID NO: 291551 - DNA, 37 bp, Artificial Sequence
  Description of Artificial Sequence: Synthetic oligonucleotide
gcaaaaggggctatcaattccctgtcatgaatatcac

SEQ ID NO: 291552 - DNA, 40 bp, Artificial Sequence
  Description of Artificial Sequence: Synthetic oligonucleotide
caaaaggggctatcaattccctgtcatgaatatcacaaac

SEQ ID NO: 291553 - DNA, 40 bp, Artificial Sequence
  Description of Artificial Sequence: Synthetic oligonucleotide
aaaaggggctatcaattccctgtcatgaatatcacaaacc

SEQ ID NO: 291554 - DNA, 39 bp, Artificial Sequence
  Description of Artificial Sequence: Synthetic oligonucleotide
aaaggggctatcaattccctgtcatgaatatcacaaacc

SEQ ID NO: 291555 - DNA, 38 bp, Artificial Sequence
  Description of Artificial Sequence: Synthetic oligonucleotide
aaggggctatcaattccctgtcatgaatatcacaaacc

SEQ ID NO: 291556 - DNA, 37 bp, Artificial Sequence
  Description of Artificial Sequence: Synthetic oligonucleotide
aggggctatcaattccctgtcatgaatatcacaaacc

SEQ ID NO: 291557 - DNA, 36 bp, Artificial Sequence
  Description of Artificial Sequence: Synthetic oligonucleotide
ggggctatcaattccctgtcatgaatatcacaaacc

SEQ ID NO: 291558 - DNA, 36 bp, Artificial Sequence
  Description of Artificial Sequence: Synthetic oligonucleotide
gggctatcaattccctgtcatgaatatcacaaaccc

SEQ ID NO: 291559 - DNA, 38 bp, Artificial Sequence
  Description of Artificial Sequence: Synthetic oligonucleotide
ggctatcaattccctgtcatgaatatcacaaacccaag

SEQ ID NO: 291560 - DNA, 38 bp, Artificial Sequence
  Description of Artificial Sequence: Synthetic oligonucleotide
gctatcaattccctgtcatgaatatcacaaacccaagc

SEQ ID NO: 291561 - DNA, 39 bp, Artificial Sequence
  Description of Artificial Sequence: Synthetic oligonucleotide
ctatcaattccctgtcatgaatatcacaaacccaagcag

SEQ ID NO: 291562 - DNA, 39 bp, Artificial Sequence
  Description of Artificial Sequence: Synthetic oligonucleotide
tatcaattccctgtcatgaatatcacaaacccaagcagg

SEQ ID NO: 291563 - DNA, 38 bp, Artificial Sequence
  Description of Artificial Sequence: Synthetic oligonucleotide
atcaattccctgtcatgaatatcacaaacccaagcagg

SEQ ID NO: 291564 - DNA, 37 bp, Artificial Sequence
  Description of Artificial Sequence: Synthetic oligonucleotide
tcaattccctgtcatgaatatcacaaacccaagcagg

SEQ ID NO: 291565 - DNA, 36 bp, Artificial Sequence
  Description of Artificial Sequence: Synthetic oligonucleotide
caattccctgtcatgaatatcacaaacccaagcagg

SEQ ID NO: 291566 - DNA, 37 bp, Artificial Sequence
  Description of Artificial Sequence: Synthetic oligonucleotide
aattccctgtcatgaatatcacaaacccaagcaggac

SEQ ID NO: 291567 - DNA, 36 bp, Artificial Sequence
  Description of Artificial Sequence: Synthetic oligonucleotide
attccctgtcatgaatatcacaaacccaagcaggac

SEQ ID NO: 291568 - DNA, 35 bp, Artificial Sequence
  Description of Artificial Sequence: Synthetic oligonucleotide
ttccctgtcatgaatatcacaaacccaagcaggac

SEQ ID NO: 291569 - DNA, 34 bp, Artificial Sequence
  Description of Artificial Sequence: Synthetic oligonucleotide
tccctgtcatgaatatcacaaacccaagcaggac

SEQ ID NO: 291570 - DNA, 33 bp, Artificial Sequence
  Description of Artificial Sequence: Synthetic oligonucleotide
ccctgtcatgaatatcacaaacccaagcaggac

SEQ ID NO: 291571 - DNA, 34 bp, Artificial Sequence
  Description of Artificial Sequence: Synthetic oligonucleotide
cctgtcatgaatatcacaaacccaagcaggactg

SEQ ID NO: 291572 - DNA, 34 bp, Artificial Sequence
  Description of Artificial Sequence: Synthetic oligonucleotide
ctgtcatgaatatcacaaacccaagcaggactgg

SEQ ID NO: 291573 - DNA, 35 bp, Artificial Sequence
  Description of Artificial Sequence: Synthetic oligonucleotide
tgtcatgaatatcacaaacccaagcaggactggag

SEQ ID NO: 291574 - DNA, 34 bp, Artificial Sequence
  Description of Artificial Sequence: Synthetic oligonucleotide
gtcatgaatatcacaaacccaagcaggactggag

SEQ ID NO: 291575 - DNA, 34 bp, Artificial Sequence
  Description of Artificial Sequence: Synthetic oligonucleotide
tcatgaatatcacaaacccaagcaggactggagc

SEQ ID NO: 291576 - DNA, 33 bp, Artificial Sequence
  Description of Artificial Sequence: Synthetic oligonucleotide
catgaatatcacaaacccaagcaggactggagc

SEQ ID NO: 291577 - DNA, 33 bp, Artificial Sequence
  Description of Artificial Sequence: Synthetic oligonucleotide
atgaatatcacaaacccaagcaggactggagcc

SEQ ID NO: 291578 - DNA, 32 bp, Artificial Sequence
  Description of Artificial Sequence: Synthetic oligonucleotide
tgaatatcacaaacccaagcaggactggagcc

SEQ ID NO: 291579 - DNA, 31 bp, Artificial Sequence
  Description of Artificial Sequence: Synthetic oligonucleotide
gaatatcacaaacccaagcaggactggagcc

SEQ ID NO: 291580 - DNA, 38 bp, Artificial Sequence
  Description of Artificial Sequence: Synthetic oligonucleotide
aatatcacaaacccaagcaggactggagcctttatttg

SEQ ID NO: 291581 - DNA, 37 bp, Artificial Sequence
  Description of Artificial Sequence: Synthetic oligonucleotide
atatcacaaacccaagcaggactggagcctttatttg

SEQ ID NO: 291582 - DNA, 36 bp, Artificial Sequence
  Description of Artificial Sequence: Synthetic oligonucleotide
tatcacaaacccaagcaggactggagcctttatttg

SEQ ID NO: 291583 - DNA, 35 bp, Artificial Sequence
  Description of Artificial Sequence: Synthetic oligonucleotide
atcacaaacccaagcaggactggagcctttatttg

SEQ ID NO: 291584 - DNA, 34 bp, Artificial Sequence
  Description of Artificial Sequence: Synthetic oligonucleotide
tcacaaacccaagcaggactggagcctttatttg

SEQ ID NO: 291585 - DNA, 33 bp, Artificial Sequence
  Description of Artificial Sequence: Synthetic oligonucleotide
cacaaacccaagcaggactggagcctttatttg

SEQ ID NO: 291586 - DNA, 36 bp, Artificial Sequence
  Description of Artificial Sequence: Synthetic oligonucleotide
acaaacccaagcaggactggagcctttatttgtaag

SEQ ID NO: 291587 - DNA, 35 bp, Artificial Sequence
  Description of Artificial Sequence: Synthetic oligonucleotide
caaacccaagcaggactggagcctttatttgtaag

SEQ ID NO: 291588 - DNA, 35 bp, Artificial Sequence
  Description of Artificial Sequence: Synthetic oligonucleotide
aaacccaagcaggactggagcctttatttgtaagc

SEQ ID NO: 291589 - DNA, 34 bp, Artificial Sequence
  Description of Artificial Sequence: Synthetic oligonucleotide
aacccaagcaggactggagcctttatttgtaagc

SEQ ID NO: 291590 - DNA, 33 bp, Artificial Sequence
  Description of Artificial Sequence: Synthetic oligonucleotide
acccaagcaggactggagcctttatttgtaagc

SEQ ID NO: 291591 - DNA, 32 bp, Artificial Sequence
  Description of Artificial Sequence: Synthetic oligonucleotide
cccaagcaggactggagcctttatttgtaagc

SEQ ID NO: 291592 - DNA, 35 bp, Artificial Sequence
  Description of Artificial Sequence: Synthetic oligonucleotide
ccaagcaggactggagcctttatttgtaagcaatc

SEQ ID NO: 291593 - DNA, 36 bp, Artificial Sequence
  Description of Artificial Sequence: Synthetic oligonucleotide
caagcaggactggagcctttatttgtaagcaatctc

SEQ ID NO: 291594 - DNA, 36 bp, Artificial Sequence
  Description of Artificial Sequence: Synthetic oligonucleotide
aagcaggactggagcctttatttgtaagcaatctcc

SEQ ID NO: 291595 - DNA, 35 bp, Artificial Sequence
  Description of Artificial Sequence: Synthetic oligonucleotide
agcaggactggagcctttatttgtaagcaatctcc

SEQ ID NO: 291596 - DNA, 34 bp, Artificial Sequence
  Description of Artificial Sequence: Synthetic oligonucleotide
gcaggactggagcctttatttgtaagcaatctcc

SEQ ID NO: 291597 - DNA, 35 bp, Artificial Sequence
  Description of Artificial Sequence: Synthetic oligonucleotide
caggactggagcctttatttgtaagcaatctcctg

SEQ ID NO: 291598 - DNA, 35 bp, Artificial Sequence
  Description of Artificial Sequence: Synthetic oligonucleotide
aggactggagcctttatttgtaagcaatctcctgg

SEQ ID NO: 291599 - DNA, 34 bp, Artificial Sequence
  Description of Artificial Sequence: Synthetic oligonucleotide
ggactggagcctttatttgtaagcaatctcctgg

SEQ ID NO: 291600 - DNA, 36 bp, Artificial Sequence
  Description of Artificial Sequence: Synthetic oligonucleotide
gactggagcctttatttgtaagcaatctcctggatg

SEQ ID NO: 291601 - DNA, 40 bp, Artificial Sequence
  Description of Artificial Sequence: Synthetic oligonucleotide
actggagcctttatttgtaagcaatctcctggatgatatg

SEQ ID NO: 291602 - DNA, 39 bp, Artificial Sequence
  Description of Artificial Sequence: Synthetic oligonucleotide
ctggagcctttatttgtaagcaatctcctggatgatatg

SEQ ID NO: 291603 - DNA, 43 bp, Artificial Sequence
  Description of Artificial Sequence: Synthetic oligonucleotide
tggagcctttatttgtaagcaatctcctggatgatatgaaaag

SEQ ID NO: 291604 - DNA, 42 bp, Artificial Sequence
  Description of Artificial Sequence: Synthetic oligonucleotide
ggagcctttatttgtaagcaatctcctggatgatatgaaaag

SEQ ID NO: 291605 - DNA, 43 bp, Artificial Sequence
  Description of Artificial Sequence: Synthetic oligonucleotide
gagcctttatttgtaagcaatctcctggatgatatgaaaagtg

SEQ ID NO: 291606 - DNA, 47 bp, Artificial Sequence
  Description of Artificial Sequence: Synthetic oligonucleotide
agcctttatttgtaagcaatctcctggatgatatgaaaagtgaaatg

SEQ ID NO: 291607 - DNA, 46 bp, Artificial Sequence
  Description of Artificial Sequence: Synthetic oligonucleotide
gcctttatttgtaagcaatctcctggatgatatgaaaagtgaaatg

SEQ ID NO: 291608 - DNA, 50 bp, Artificial Sequence
  Description of Artificial Sequence: Synthetic oligonucleotide
cctttatttgtaagcaatctcctggatgatatgaaaagtgaaatgaaaac

SEQ ID NO: 291609 - DNA, 54 bp, Artificial Sequence
  Description of Artificial Sequence: Synthetic oligonucleotide
ctttatttgtaagcaatctcctggatgatatgaaaagtgaaatgaaaactaatg

SEQ ID NO: 291610 - DNA, 55 bp, Artificial Sequence
  Description of Artificial Sequence: Synthetic oligonucleotide
tttatttgtaagcaatctcctggatgatatgaaaagtgaaatgaaaactaatgac

SEQ ID NO: 291611 - DNA, 54 bp, Artificial Sequence
  Description of Artificial Sequence: Synthetic oligonucleotide
ttatttgtaagcaatctcctggatgatatgaaaagtgaaatgaaaactaatgac

SEQ ID NO: 291612 - DNA, 53 bp, Artificial Sequence
  Description of Artificial Sequence: Synthetic oligonucleotide
tatttgtaagcaatctcctggatgatatgaaaagtgaaatgaaaactaatgac

SEQ ID NO: 291613 - DNA, 52 bp, Artificial Sequence
  Description of Artificial Sequence: Synthetic oligonucleotide
atttgtaagcaatctcctggatgatatgaaaagtgaaatgaaaactaatgac

SEQ ID NO: 291614 - DNA, 51 bp, Artificial Sequence
  Description of Artificial Sequence: Synthetic oligonucleotide
tttgtaagcaatctcctggatgatatgaaaagtgaaatgaaaactaatgac

SEQ ID NO: 291615 - DNA, 50 bp, Artificial Sequence
  Description of Artificial Sequence: Synthetic oligonucleotide
ttgtaagcaatctcctggatgatatgaaaagtgaaatgaaaactaatgac

SEQ ID NO: 291616 - DNA, 49 bp, Artificial Sequence
  Description of Artificial Sequence: Synthetic oligonucleotide
tgtaagcaatctcctggatgatatgaaaagtgaaatgaaaactaatgac

SEQ ID NO: 291617 - DNA, 48 bp, Artificial Sequence
  Description of Artificial Sequence: Synthetic oligonucleotide
gtaagcaatctcctggatgatatgaaaagtgaaatgaaaactaatgac

SEQ ID NO: 291618 - DNA, 51 bp, Artificial Sequence
  Description of Artificial Sequence: Synthetic oligonucleotide
taagcaatctcctggatgatatgaaaagtgaaatgaaaactaatgacattc

SEQ ID NO: 291619 - DNA, 50 bp, Artificial Sequence
  Description of Artificial Sequence: Synthetic oligonucleotide
aagcaatctcctggatgatatgaaaagtgaaatgaaaactaatgacattc

SEQ ID NO: 291620 - DNA, 49 bp, Artificial Sequence
  Description of Artificial Sequence: Synthetic oligonucleotide
agcaatctcctggatgatatgaaaagtgaaatgaaaactaatgacattc

SEQ ID NO: 291621 - DNA, 48 bp, Artificial Sequence
  Description of Artificial Sequence: Synthetic oligonucleotide
gcaatctcctggatgatatgaaaagtgaaatgaaaactaatgacattc

SEQ ID NO: 291622 - DNA, 50 bp, Artificial Sequence
  Description of Artificial Sequence: Synthetic oligonucleotide
caatctcctggatgatatgaaaagtgaaatgaaaactaatgacattcttc

SEQ ID NO: 291623 - DNA, 50 bp, Artificial Sequence
  Description of Artificial Sequence: Synthetic oligonucleotide
aatctcctggatgatatgaaaagtgaaatgaaaactaatgacattcttcg

SEQ ID NO: 291624 - DNA, 49 bp, Artificial Sequence
  Description of Artificial Sequence: Synthetic oligonucleotide
atctcctggatgatatgaaaagtgaaatgaaaactaatgacattcttcg

SEQ ID NO: 291625 - DNA, 48 bp, Artificial Sequence
  Description of Artificial Sequence: Synthetic oligonucleotide
tctcctggatgatatgaaaagtgaaatgaaaactaatgacattcttcg

SEQ ID NO: 291626 - DNA, 47 bp, Artificial Sequence
  Description of Artificial Sequence: Synthetic oligonucleotide
ctcctggatgatatgaaaagtgaaatgaaaactaatgacattcttcg

SEQ ID NO: 291627 - DNA, 50 bp, Artificial Sequence
  Description of Artificial Sequence: Synthetic oligonucleotide
tcctggatgatatgaaaagtgaaatgaaaactaatgacattcttcgatac

SEQ ID NO: 291628 - DNA, 49 bp, Artificial Sequence
  Description of Artificial Sequence: Synthetic oligonucleotide
cctggatgatatgaaaagtgaaatgaaaactaatgacattcttcgatac

SEQ ID NO: 291629 - DNA, 50 bp, Artificial Sequence
  Description of Artificial Sequence: Synthetic oligonucleotide
ctggatgatatgaaaagtgaaatgaaaactaatgacattcttcgatacac

SEQ ID NO: 291630 - DNA, 50 bp, Artificial Sequence
  Description of Artificial Sequence: Synthetic oligonucleotide
tggatgatatgaaaagtgaaatgaaaactaatgacattcttcgatacacg

SEQ ID NO: 291631 - DNA, 49 bp, Artificial Sequence
  Description of Artificial Sequence: Synthetic oligonucleotide
ggatgatatgaaaagtgaaatgaaaactaatgacattcttcgatacacg

SEQ ID NO: 291632 - DNA, 49 bp, Artificial Sequence
  Description of Artificial Sequence: Synthetic oligonucleotide
gatgatatgaaaagtgaaatgaaaactaatgacattcttcgatacacgg

SEQ ID NO: 291633 - DNA, 50 bp, Artificial Sequence
  Description of Artificial Sequence: Synthetic oligonucleotide
atgatatgaaaagtgaaatgaaaactaatgacattcttcgatacacggtg

SEQ ID NO: 291634 - DNA, 49 bp, Artificial Sequence
  Description of Artificial Sequence: Synthetic oligonucleotide
tgatatgaaaagtgaaatgaaaactaatgacattcttcgatacacggtg

SEQ ID NO: 291635 - DNA, 48 bp, Artificial Sequence
  Description of Artificial Sequence: Synthetic oligonucleotide
gatatgaaaagtgaaatgaaaactaatgacattcttcgatacacggtg

SEQ ID NO: 291636 - DNA, 51 bp, Artificial Sequence
  Description of Artificial Sequence: Synthetic oligonucleotide
atatgaaaagtgaaatgaaaactaatgacattcttcgatacacggtgtatg

SEQ ID NO: 291637 - DNA, 50 bp, Artificial Sequence
  Description of Artificial Sequence: Synthetic oligonucleotide
tatgaaaagtgaaatgaaaactaatgacattcttcgatacacggtgtatg

SEQ ID NO: 291638 - DNA, 49 bp, Artificial Sequence
  Description of Artificial Sequence: Synthetic oligonucleotide
atgaaaagtgaaatgaaaactaatgacattcttcgatacacggtgtatg

SEQ ID NO: 291639 - DNA, 48 bp, Artificial Sequence
  Description of Artificial Sequence: Synthetic oligonucleotide
tgaaaagtgaaatgaaaactaatgacattcttcgatacacggtgtatg

SEQ ID NO: 291640 - DNA, 47 bp, Artificial Sequence
  Description of Artificial Sequence: Synthetic oligonucleotide
gaaaagtgaaatgaaaactaatgacattcttcgatacacggtgtatg

SEQ ID NO: 291641 - DNA, 48 bp, Artificial Sequence
  Description of Artificial Sequence: Synthetic oligonucleotide
aaaagtgaaatgaaaactaatgacattcttcgatacacggtgtatgac

SEQ ID NO: 291642 - DNA, 47 bp, Artificial Sequence
  Description of Artificial Sequence: Synthetic oligonucleotide
aaagtgaaatgaaaactaatgacattcttcgatacacggtgtatgac

SEQ ID NO: 291643 - DNA, 46 bp, Artificial Sequence
  Description of Artificial Sequence: Synthetic oligonucleotide
aagtgaaatgaaaactaatgacattcttcgatacacggtgtatgac

SEQ ID NO: 291644 - DNA, 45 bp, Artificial Sequence
  Description of Artificial Sequence: Synthetic oligonucleotide
agtgaaatgaaaactaatgacattcttcgatacacggtgtatgac

SEQ ID NO: 291645 - DNA, 44 bp, Artificial Sequence
  Description of Artificial Sequence: Synthetic oligonucleotide
gtgaaatgaaaactaatgacattcttcgatacacggtgtatgac

SEQ ID NO: 291646 - DNA, 44 bp, Artificial Sequence
  Description of Artificial Sequence: Synthetic oligonucleotide
tgaaatgaaaactaatgacattcttcgatacacggtgtatgacc

SEQ ID NO: 291647 - DNA, 43 bp, Artificial Sequence
  Description of Artificial Sequence: Synthetic oligonucleotide
gaaatgaaaactaatgacattcttcgatacacggtgtatgacc

SEQ ID NO: 291648 - DNA, 51 bp, Artificial Sequence
  Description of Artificial Sequence: Synthetic oligonucleotide
aaatgaaaactaatgacattcttcgatacacggtgtatgacctaattatac

SEQ ID NO: 291649 - DNA, 50 bp, Artificial Sequence
  Description of Artificial Sequence: Synthetic oligonucleotide
aatgaaaactaatgacattcttcgatacacggtgtatgacctaattatac

SEQ ID NO: 291650 - DNA, 49 bp, Artificial Sequence
  Description of Artificial Sequence: Synthetic oligonucleotide
atgaaaactaatgacattcttcgatacacggtgtatgacctaattatac

SEQ ID NO: 291651 - DNA, 48 bp, Artificial Sequence
  Description of Artificial Sequence: Synthetic oligonucleotide
tgaaaactaatgacattcttcgatacacggtgtatgacctaattatac

SEQ ID NO: 291652 - DNA, 47 bp, Artificial Sequence
  Description of Artificial Sequence: Synthetic oligonucleotide
gaaaactaatgacattcttcgatacacggtgtatgacctaattatac

SEQ ID NO: 291653 - DNA, 48 bp, Artificial Sequence
  Description of Artificial Sequence: Synthetic oligonucleotide
aaaactaatgacattcttcgatacacggtgtatgacctaattatacag

SEQ ID NO: 291654 - DNA, 47 bp, Artificial Sequence
  Description of Artificial Sequence: Synthetic oligonucleotide
aaactaatgacattcttcgatacacggtgtatgacctaattatacag

SEQ ID NO: 291655 - DNA, 46 bp, Artificial Sequence
  Description of Artificial Sequence: Synthetic oligonucleotide
aactaatgacattcttcgatacacggtgtatgacctaattatacag

SEQ ID NO: 291656 - DNA, 45 bp, Artificial Sequence
  Description of Artificial Sequence: Synthetic oligonucleotide
actaatgacattcttcgatacacggtgtatgacctaattatacag

SEQ ID NO: 291657 - DNA, 44 bp, Artificial Sequence
  Description of Artificial Sequence: Synthetic oligonucleotide
ctaatgacattcttcgatacacggtgtatgacctaattatacag

SEQ ID NO: 291658 - DNA, 48 bp, Artificial Sequence
  Description of Artificial Sequence: Synthetic oligonucleotide
taatgacattcttcgatacacggtgtatgacctaattatacagatttc

SEQ ID NO: 291659 - DNA, 47 bp, Artificial Sequence
  Description of Artificial Sequence: Synthetic oligonucleotide
aatgacattcttcgatacacggtgtatgacctaattatacagatttc

SEQ ID NO: 291660 - DNA, 46 bp, Artificial Sequence
  Description of Artificial Sequence: Synthetic oligonucleotide
atgacattcttcgatacacggtgtatgacctaattatacagatttc

SEQ ID NO: 291661 - DNA, 45 bp, Artificial Sequence
  Description of Artificial Sequence: Synthetic oligonucleotide
tgacattcttcgatacacggtgtatgacctaattatacagatttc

SEQ ID NO: 291662 - DNA, 44 bp, Artificial Sequence
  Description of Artificial Sequence: Synthetic oligonucleotide
gacattcttcgatacacggtgtatgacctaattatacagatttc

SEQ ID NO: 291663 - DNA, 46 bp, Artificial Sequence
  Description of Artificial Sequence: Synthetic oligonucleotide
acattcttcgatacacggtgtatgacctaattatacagatttcttg

SEQ ID NO: 291664 - DNA, 45 bp, Artificial Sequence
  Description of Artificial Sequence: Synthetic oligonucleotide
cattcttcgatacacggtgtatgacctaattatacagatttcttg

SEQ ID NO: 291665 - DNA, 45 bp, Artificial Sequence
  Description of Artificial Sequence: Synthetic oligonucleotide
attcttcgatacacggtgtatgacctaattatacagatttcttgc

SEQ ID NO: 291666 - DNA, 44 bp, Artificial Sequence
  Description of Artificial Sequence: Synthetic oligonucleotide
ttcttcgatacacggtgtatgacctaattatacagatttcttgc

SEQ ID NO: 291667 - DNA, 43 bp, Artificial Sequence
  Description of Artificial Sequence: Synthetic oligonucleotide
tcttcgatacacggtgtatgacctaattatacagatttcttgc

SEQ ID NO: 291668 - DNA, 42 bp, Artificial Sequence
  Description of Artificial Sequence: Synthetic oligonucleotide
cttcgatacacggtgtatgacctaattatacagatttcttgc

SEQ ID NO: 291669 - DNA, 42 bp, Artificial Sequence
  Description of Artificial Sequence: Synthetic oligonucleotide
ttcgatacacggtgtatgacctaattatacagatttcttgcg

SEQ ID NO: 291670 - DNA, 41 bp, Artificial Sequence
  Description of Artificial Sequence: Synthetic oligonucleotide
tcgatacacggtgtatgacctaattatacagatttcttgcg

SEQ ID NO: 291671 - DNA, 40 bp, Artificial Sequence
  Description of Artificial Sequence: Synthetic oligonucleotide
cgatacacggtgtatgacctaattatacagatttcttgcg

SEQ ID NO: 291672 - DNA, 41 bp, Artificial Sequence
  Description of Artificial Sequence: Synthetic oligonucleotide
gatacacggtgtatgacctaattatacagatttcttgcgtg

SEQ ID NO: 291673 - DNA, 42 bp, Artificial Sequence
  Description of Artificial Sequence: Synthetic oligonucleotide
atacacggtgtatgacctaattatacagatttcttgcgtgtc

SEQ ID NO: 291674 - DNA, 41 bp, Artificial Sequence
  Description of Artificial Sequence: Synthetic oligonucleotide
tacacggtgtatgacctaattatacagatttcttgcgtgtc

SEQ ID NO: 291675 - DNA, 40 bp, Artificial Sequence
  Description of Artificial Sequence: Synthetic oligonucleotide
acacggtgtatgacctaattatacagatttcttgcgtgtc

SEQ ID NO: 291676 - DNA, 39 bp, Artificial Sequence
  Description of Artificial Sequence: Synthetic oligonucleotide
cacggtgtatgacctaattatacagatttcttgcgtgtc

SEQ ID NO: 291677 - DNA, 40 bp, Artificial Sequence
  Description of Artificial Sequence: Synthetic oligonucleotide
acggtgtatgacctaattatacagatttcttgcgtgtcac

SEQ ID NO: 291678 - DNA, 39 bp, Artificial Sequence
  Description of Artificial Sequence: Synthetic oligonucleotide
cggtgtatgacctaattatacagatttcttgcgtgtcac

SEQ ID NO: 291679 - DNA, 39 bp, Artificial Sequence
  Description of Artificial Sequence: Synthetic oligonucleotide
ggtgtatgacctaattatacagatttcttgcgtgtcacc

SEQ ID NO: 291680 - DNA, 40 bp, Artificial Sequence
  Description of Artificial Sequence: Synthetic oligonucleotide
gtgtatgacctaattatacagatttcttgcgtgtcacctg

SEQ ID NO: 291681 - DNA, 43 bp, Artificial Sequence
  Description of Artificial Sequence: Synthetic oligonucleotide
tgtatgacctaattatacagatttcttgcgtgtcacctgaatc

SEQ ID NO: 291682 - DNA, 42 bp, Artificial Sequence
  Description of Artificial Sequence: Synthetic oligonucleotide
gtatgacctaattatacagatttcttgcgtgtcacctgaatc

SEQ ID NO: 291683 - DNA, 48 bp, Artificial Sequence
  Description of Artificial Sequence: Synthetic oligonucleotide
tatgacctaattatacagatttcttgcgtgtcacctgaatctttatac

SEQ ID NO: 291684 - DNA, 47 bp, Artificial Sequence
  Description of Artificial Sequence: Synthetic oligonucleotide
atgacctaattatacagatttcttgcgtgtcacctgaatctttatac

SEQ ID NO: 291685 - DNA, 46 bp, Artificial Sequence
  Description of Artificial Sequence: Synthetic oligonucleotide
tgacctaattatacagatttcttgcgtgtcacctgaatctttatac

SEQ ID NO: 291686 - DNA, 45 bp, Artificial Sequence
  Description of Artificial Sequence: Synthetic oligonucleotide
gacctaattatacagatttcttgcgtgtcacctgaatctttatac

SEQ ID NO: 291687 - DNA, 47 bp, Artificial Sequence
  Description of Artificial Sequence: Synthetic oligonucleotide
acctaattatacagatttcttgcgtgtcacctgaatctttatactac

SEQ ID NO: 291688 - DNA, 46 bp, Artificial Sequence
  Description of Artificial Sequence: Synthetic oligonucleotide
cctaattatacagatttcttgcgtgtcacctgaatctttatactac

SEQ ID NO: 291689 - DNA, 47 bp, Artificial Sequence
  Description of Artificial Sequence: Synthetic oligonucleotide
ctaattatacagatttcttgcgtgtcacctgaatctttatactactg

SEQ ID NO: 291690 - DNA, 49 bp, Artificial Sequence
  Description of Artificial Sequence: Synthetic oligonucleotide
taattatacagatttcttgcgtgtcacctgaatctttatactactgtag

SEQ ID NO: 291691 - DNA, 48 bp, Artificial Sequence
  Description of Artificial Sequence: Synthetic oligonucleotide
aattatacagatttcttgcgtgtcacctgaatctttatactactgtag

SEQ ID NO: 291692 - DNA, 47 bp, Artificial Sequence
  Description of Artificial Sequence: Synthetic oligonucleotide
attatacagatttcttgcgtgtcacctgaatctttatactactgtag

SEQ ID NO: 291693 - DNA, 46 bp, Artificial Sequence
  Description of Artificial Sequence: Synthetic oligonucleotide
ttatacagatttcttgcgtgtcacctgaatctttatactactgtag

SEQ ID NO: 291694 - DNA, 45 bp, Artificial Sequence
  Description of Artificial Sequence: Synthetic oligonucleotide
tatacagatttcttgcgtgtcacctgaatctttatactactgtag

SEQ ID NO: 291695 - DNA, 44 bp, Artificial Sequence
  Description of Artificial Sequence: Synthetic oligonucleotide
atacagatttcttgcgtgtcacctgaatctttatactactgtag

SEQ ID NO: 291696 - DNA, 43 bp, Artificial Sequence
  Description of Artificial Sequence: Synthetic oligonucleotide
tacagatttcttgcgtgtcacctgaatctttatactactgtag

SEQ ID NO: 291697 - DNA, 42 bp, Artificial Sequence
  Description of Artificial Sequence: Synthetic oligonucleotide
acagatttcttgcgtgtcacctgaatctttatactactgtag

SEQ ID NO: 291698 - DNA, 41 bp, Artificial Sequence
  Description of Artificial Sequence: Synthetic oligonucleotide
cagatttcttgcgtgtcacctgaatctttatactactgtag

SEQ ID NO: 291699 - DNA, 41 bp, Artificial Sequence
  Description of Artificial Sequence: Synthetic oligonucleotide
agatttcttgcgtgtcacctgaatctttatactactgtagc

SEQ ID NO: 291700 - DNA, 40 bp, Artificial Sequence
  Description of Artificial Sequence: Synthetic oligonucleotide
gatttcttgcgtgtcacctgaatctttatactactgtagc

SEQ ID NO: 291701 - DNA, 41 bp, Artificial Sequence
  Description of Artificial Sequence: Synthetic oligonucleotide
atttcttgcgtgtcacctgaatctttatactactgtagcac

SEQ ID NO: 291702 - DNA, 40 bp, Artificial Sequence
  Description of Artificial Sequence: Synthetic oligonucleotide
tttcttgcgtgtcacctgaatctttatactactgtagcac

SEQ ID NO: 291703 - DNA, 39 bp, Artificial Sequence
  Description of Artificial Sequence: Synthetic oligonucleotide
ttcttgcgtgtcacctgaatctttatactactgtagcac

SEQ ID NO: 291704 - DNA, 38 bp, Artificial Sequence
  Description of Artificial Sequence: Synthetic oligonucleotide
tcttgcgtgtcacctgaatctttatactactgtagcac

SEQ ID NO: 291705 - DNA, 37 bp, Artificial Sequence
  Description of Artificial Sequence: Synthetic oligonucleotide
cttgcgtgtcacctgaatctttatactactgtagcac

SEQ ID NO: 291706 - DNA, 39 bp, Artificial Sequence
  Description of Artificial Sequence: Synthetic oligonucleotide
ttgcgtgtcacctgaatctttatactactgtagcacaag

SEQ ID NO: 291707 - DNA, 38 bp, Artificial Sequence
  Description of Artificial Sequence: Synthetic oligonucleotide
tgcgtgtcacctgaatctttatactactgtagcacaag

SEQ ID NO: 291708 - DNA, 37 bp, Artificial Sequence
  Description of Artificial Sequence: Synthetic oligonucleotide
gcgtgtcacctgaatctttatactactgtagcacaag

SEQ ID NO: 291709 - DNA, 38 bp, Artificial Sequence
  Description of Artificial Sequence: Synthetic oligonucleotide
cgtgtcacctgaatctttatactactgtagcacaagtg

SEQ ID NO: 291710 - DNA, 38 bp, Artificial Sequence
  Description of Artificial Sequence: Synthetic oligonucleotide
gtgtcacctgaatctttatactactgtagcacaagtgg

SEQ ID NO: 291711 - DNA, 41 bp, Artificial Sequence
  Description of Artificial Sequence: Synthetic oligonucleotide
tgtcacctgaatctttatactactgtagcacaagtggtttg

SEQ ID NO: 291712 - DNA, 40 bp, Artificial Sequence
  Description of Artificial Sequence: Synthetic oligonucleotide
gtcacctgaatctttatactactgtagcacaagtggtttg

SEQ ID NO: 291713 - DNA, 40 bp, Artificial Sequence
  Description of Artificial Sequence: Synthetic oligonucleotide
tcacctgaatctttatactactgtagcacaagtggtttgg

SEQ ID NO: 291714 - DNA, 39 bp, Artificial Sequence
  Description of Artificial Sequence: Synthetic oligonucleotide
cacctgaatctttatactactgtagcacaagtggtttgg

SEQ ID NO: 291715 - DNA, 42 bp, Artificial Sequence
  Description of Artificial Sequence: Synthetic oligonucleotide
acctgaatctttatactactgtagcacaagtggtttggtaac

SEQ ID NO: 291716 - DNA, 41 bp, Artificial Sequence
  Description of Artificial Sequence: Synthetic oligonucleotide
cctgaatctttatactactgtagcacaagtggtttggtaac

SEQ ID NO: 291717 - DNA, 41 bp, Artificial Sequence
  Description of Artificial Sequence: Synthetic oligonucleotide
ctgaatctttatactactgtagcacaagtggtttggtaacc

SEQ ID NO: 291718 - DNA, 41 bp, Artificial Sequence
  Description of Artificial Sequence: Synthetic oligonucleotide
tgaatctttatactactgtagcacaagtggtttggtaaccg

SEQ ID NO: 291719 - DNA, 40 bp, Artificial Sequence
  Description of Artificial Sequence: Synthetic oligonucleotide
gaatctttatactactgtagcacaagtggtttggtaaccg

SEQ ID NO: 291720 - DNA, 41 bp, Artificial Sequence
  Description of Artificial Sequence: Synthetic oligonucleotide
aatctttatactactgtagcacaagtggtttggtaaccgag

SEQ ID NO: 291721 - DNA, 40 bp, Artificial Sequence
  Description of Artificial Sequence: Synthetic oligonucleotide
atctttatactactgtagcacaagtggtttggtaaccgag

SEQ ID NO: 291722 - DNA, 39 bp, Artificial Sequence
  Description of Artificial Sequence: Synthetic oligonucleotide
tctttatactactgtagcacaagtggtttggtaaccgag

SEQ ID NO: 291723 - DNA, 38 bp, Artificial Sequence
  Description of Artificial Sequence: Synthetic oligonucleotide
ctttatactactgtagcacaagtggtttggtaaccgag

SEQ ID NO: 291724 - DNA, 38 bp, Artificial Sequence
  Description of Artificial Sequence: Synthetic oligonucleotide
tttatactactgtagcacaagtggtttggtaaccgagc

SEQ ID NO: 291725 - DNA, 37 bp, Artificial Sequence
  Description of Artificial Sequence: Synthetic oligonucleotide
ttatactactgtagcacaagtggtttggtaaccgagc

SEQ ID NO: 291726 - DNA, 36 bp, Artificial Sequence
  Description of Artificial Sequence: Synthetic oligonucleotide
tatactactgtagcacaagtggtttggtaaccgagc

SEQ ID NO: 291727 - DNA, 35 bp, Artificial Sequence
  Description of Artificial Sequence: Synthetic oligonucleotide
atactactgtagcacaagtggtttggtaaccgagc

SEQ ID NO: 291728 - DNA, 34 bp, Artificial Sequence
  Description of Artificial Sequence: Synthetic oligonucleotide
tactactgtagcacaagtggtttggtaaccgagc

SEQ ID NO: 291729 - DNA, 33 bp, Artificial Sequence
  Description of Artificial Sequence: Synthetic oligonucleotide
actactgtagcacaagtggtttggtaaccgagc

SEQ ID NO: 291730 - DNA, 32 bp, Artificial Sequence
  Description of Artificial Sequence: Synthetic oligonucleotide
ctactgtagcacaagtggtttggtaaccgagc

SEQ ID NO: 291731 - DNA, 33 bp, Artificial Sequence
  Description of Artificial Sequence: Synthetic oligonucleotide
tactgtagcacaagtggtttggtaaccgagctc

SEQ ID NO: 291732 - DNA, 32 bp, Artificial Sequence
  Description of Artificial Sequence: Synthetic oligonucleotide
actgtagcacaagtggtttggtaaccgagctc

SEQ ID NO: 291733 - DNA, 31 bp, Artificial Sequence
  Description of Artificial Sequence: Synthetic oligonucleotide
ctgtagcacaagtggtttggtaaccgagctc

SEQ ID NO: 291734 - DNA, 31 bp, Artificial Sequence
  Description of Artificial Sequence: Synthetic oligonucleotide
tgtagcacaagtggtttggtaaccgagctcc

SEQ ID NO: 291735 - DNA, 30 bp, Artificial Sequence
  Description of Artificial Sequence: Synthetic oligonucleotide
gtagcacaagtggtttggtaaccgagctcc

SEQ ID NO: 291736 - DNA, 31 bp, Artificial Sequence
  Description of Artificial Sequence: Synthetic oligonucleotide
tagcacaagtggtttggtaaccgagctcctg

SEQ ID NO: 291737 - DNA, 30 bp, Artificial Sequence
  Description of Artificial Sequence: Synthetic oligonucleotide
agcacaagtggtttggtaaccgagctcctg

SEQ ID NO: 291738 - DNA, 29 bp, Artificial Sequence
  Description of Artificial Sequence: Synthetic oligonucleotide
gcacaagtggtttggtaaccgagctcctg

SEQ ID NO: 291739 - DNA, 30 bp, Artificial Sequence
  Description of Artificial Sequence: Synthetic oligonucleotide
cacaagtggtttggtaaccgagctcctgac

SEQ ID NO: 291740 - DNA, 31 bp, Artificial Sequence
  Description of Artificial Sequence: Synthetic oligonucleotide
acaagtggtttggtaaccgagctcctgacag

SEQ ID NO: 291741 - DNA, 30 bp, Artificial Sequence
  Description of Artificial Sequence: Synthetic oligonucleotide
caagtggtttggtaaccgagctcctgacag

SEQ ID NO: 291742 - DNA, 31 bp, Artificial Sequence
  Description of Artificial Sequence: Synthetic oligonucleotide
aagtggtttggtaaccgagctcctgacagag

SEQ ID NO: 291743 - DNA, 30 bp, Artificial Sequence
  Description of Artificial Sequence: Synthetic oligonucleotide
agtggtttggtaaccgagctcctgacagag

SEQ ID NO: 291744 - DNA, 29 bp, Artificial Sequence
  Description of Artificial Sequence: Synthetic oligonucleotide
gtggtttggtaaccgagctcctgacagag

SEQ ID NO: 291745 - DNA, 29 bp, Artificial Sequence
  Description of Artificial Sequence: Synthetic oligonucleotide
tggtttggtaaccgagctcctgacagagc

SEQ ID NO: 291746 - DNA, 28 bp, Artificial Sequence
  Description of Artificial Sequence: Synthetic oligonucleotide
ggtttggtaaccgagctcctgacagagc

SEQ ID NO: 291747 - DNA, 29 bp, Artificial Sequence
  Description of Artificial Sequence: Synthetic oligonucleotide
gtttggtaaccgagctcctgacagagctg

SEQ ID NO: 291748 - DNA, 30 bp, Artificial Sequence
  Description of Artificial Sequence: Synthetic oligonucleotide
tttggtaaccgagctcctgacagagctgac

SEQ ID NO: 291749 - DNA, 29 bp, Artificial Sequence
  Description of Artificial Sequence: Synthetic oligonucleotide
ttggtaaccgagctcctgacagagctgac

SEQ ID NO: 291750 - DNA, 28 bp, Artificial Sequence
  Description of Artificial Sequence: Synthetic oligonucleotide
tggtaaccgagctcctgacagagctgac

SEQ ID NO: 291751 - DNA, 27 bp, Artificial Sequence
  Description of Artificial Sequence: Synthetic oligonucleotide
ggtaaccgagctcctgacagagctgac

SEQ ID NO: 291752 - DNA, 28 bp, Artificial Sequence
  Description of Artificial Sequence: Synthetic oligonucleotide
gtaaccgagctcctgacagagctgacag

SEQ ID NO: 291753 - DNA, 28 bp, Artificial Sequence
  Description of Artificial Sequence: Synthetic oligonucleotide
taaccgagctcctgacagagctgacagg

SEQ ID NO: 291754 - DNA, 27 bp, Artificial Sequence
  Description of Artificial Sequence: Synthetic oligonucleotide
aaccgagctcctgacagagctgacagg

SEQ ID NO: 291755 - DNA, 27 bp, Artificial Sequence
  Description of Artificial Sequence: Synthetic oligonucleotide
accgagctcctgacagagctgacaggt

SEQ ID NO: 291756 - DNA, 26 bp, Artificial Sequence
  Description of Artificial Sequence: Synthetic oligonucleotide
ccgagctcctgacagagctgacaggt

SEQ ID NO: 291757 - DNA, 27 bp, Artificial Sequence
  Description of Artificial Sequence: Synthetic oligonucleotide
cgagctcctgacagagctgacaggtga

SEQ ID NO: 291758 - DNA, 27 bp, Artificial Sequence
  Description of Artificial Sequence: Synthetic oligonucleotide
gagctcctgacagagctgacaggtgag

SEQ ID NO: 291759 - DNA, 27 bp, Artificial Sequence
  Description of Artificial Sequence: Synthetic oligonucleotide
agctcctgacagagctgacaggtgagg

SEQ ID NO: 291760 - DNA, 27 bp, Artificial Sequence
  Description of Artificial Sequence: Synthetic oligonucleotide
gctcctgacagagctgacaggtgagga

SEQ ID NO: 291761 - DNA, 28 bp, Artificial Sequence
  Description of Artificial Sequence: Synthetic oligonucleotide
ctcctgacagagctgacaggtgaggatc

SEQ ID NO: 291762 - DNA, 29 bp, Artificial Sequence
  Description of Artificial Sequence: Synthetic oligonucleotide
tcctgacagagctgacaggtgaggatctg

SEQ ID NO: 291763 - DNA, 28 bp, Artificial Sequence
  Description of Artificial Sequence: Synthetic oligonucleotide
cctgacagagctgacaggtgaggatctg

SEQ ID NO: 291764 - DNA, 30 bp, Artificial Sequence
  Description of Artificial Sequence: Synthetic oligonucleotide
ctgacagagctgacaggtgaggatctgttg

SEQ ID NO: 291765 - DNA, 30 bp, Artificial Sequence
  Description of Artificial Sequence: Synthetic oligonucleotide
tgacagagctgacaggtgaggatctgttgg

SEQ ID NO: 291766 - DNA, 29 bp, Artificial Sequence
  Description of Artificial Sequence: Synthetic oligonucleotide
gacagagctgacaggtgaggatctgttgg

SEQ ID NO: 291767 - DNA, 30 bp, Artificial Sequence
  Description of Artificial Sequence: Synthetic oligonucleotide
acagagctgacaggtgaggatctgttggtc

SEQ ID NO: 291768 - DNA, 29 bp, Artificial Sequence
  Description of Artificial Sequence: Synthetic oligonucleotide
cagagctgacaggtgaggatctgttggtc

SEQ ID NO: 291769 - DNA, 30 bp, Artificial Sequence
  Description of Artificial Sequence: Synthetic oligonucleotide
agagctgacaggtgaggatctgttggtcac

SEQ ID NO: 291770 - DNA, 29 bp, Artificial Sequence
  Description of Artificial Sequence: Synthetic oligonucleotide
gagctgacaggtgaggatctgttggtcac

SEQ ID NO: 291771 - DNA, 30 bp, Artificial Sequence
  Description of Artificial Sequence: Synthetic oligonucleotide
agctgacaggtgaggatctgttggtcacag

SEQ ID NO: 291772 - DNA, 29 bp, Artificial Sequence
  Description of Artificial Sequence: Synthetic oligonucleotide
gctgacaggtgaggatctgttggtcacag

SEQ ID NO: 291773 - DNA, 29 bp, Artificial Sequence
  Description of Artificial Sequence: Synthetic oligonucleotide
ctgacaggtgaggatctgttggtcacagc

SEQ ID NO: 291774 - DNA, 29 bp, Artificial Sequence
  Description of Artificial Sequence: Synthetic oligonucleotide
tgacaggtgaggatctgttggtcacagcc

SEQ ID NO: 291775 - DNA, 28 bp, Artificial Sequence
  Description of Artificial Sequence: Synthetic oligonucleotide
gacaggtgaggatctgttggtcacagcc

SEQ ID NO: 291776 - DNA, 29 bp, Artificial Sequence
  Description of Artificial Sequence: Synthetic oligonucleotide
acaggtgaggatctgttggtcacagccac

SEQ ID NO: 291777 - DNA, 28 bp, Artificial Sequence
  Description of Artificial Sequence: Synthetic oligonucleotide
caggtgaggatctgttggtcacagccac

SEQ ID NO: 291778 - DNA, 28 bp, Artificial Sequence
  Description of Artificial Sequence: Synthetic oligonucleotide
aggtgaggatctgttggtcacagccacc

SEQ ID NO: 291779 - DNA, 27 bp, Artificial Sequence
  Description of Artificial Sequence: Synthetic oligonucleotide
ggtgaggatctgttggtcacagccacc

SEQ ID NO: 291780 - DNA, 28 bp, Artificial Sequence
  Description of Artificial Sequence: Synthetic oligonucleotide
gtgaggatctgttggtcacagccacctg

SEQ ID NO: 291781 - DNA, 32 bp, Artificial Sequence
  Description of Artificial Sequence: Synthetic oligonucleotide
tgaggatctgttggtcacagccacctgaatag

SEQ ID NO: 291782 - DNA, 31 bp, Artificial Sequence
  Description of Artificial Sequence: Synthetic oligonucleotide
gaggatctgttggtcacagccacctgaatag

SEQ ID NO: 291783 - DNA, 35 bp, Artificial Sequence
  Description of Artificial Sequence: Synthetic oligonucleotide
aggatctgttggtcacagccacctgaatagaaatg

SEQ ID NO: 291784 - DNA, 34 bp, Artificial Sequence
  Description of Artificial Sequence: Synthetic oligonucleotide
ggatctgttggtcacagccacctgaatagaaatg

SEQ ID NO: 291785 - DNA, 34 bp, Artificial Sequence
  Description of Artificial Sequence: Synthetic oligonucleotide
gatctgttggtcacagccacctgaatagaaatgc

SEQ ID NO: 291786 - DNA, 35 bp, Artificial Sequence
  Description of Artificial Sequence: Synthetic oligonucleotide
atctgttggtcacagccacctgaatagaaatgctg

SEQ ID NO: 291787 - DNA, 34 bp, Artificial Sequence
  Description of Artificial Sequence: Synthetic oligonucleotide
tctgttggtcacagccacctgaatagaaatgctg

SEQ ID NO: 291788 - DNA, 33 bp, Artificial Sequence
  Description of Artificial Sequence: Synthetic oligonucleotide
ctgttggtcacagccacctgaatagaaatgctg

SEQ ID NO: 291789 - DNA, 34 bp, Artificial Sequence
  Description of Artificial Sequence: Synthetic oligonucleotide
tgttggtcacagccacctgaatagaaatgctgac

SEQ ID NO: 291790 - DNA, 33 bp, Artificial Sequence
  Description of Artificial Sequence: Synthetic oligonucleotide
gttggtcacagccacctgaatagaaatgctgac

SEQ ID NO: 291791 - DNA, 35 bp, Artificial Sequence
  Description of Artificial Sequence: Synthetic oligonucleotide
ttggtcacagccacctgaatagaaatgctgacatc

SEQ ID NO: 291792 - DNA, 34 bp, Artificial Sequence
  Description of Artificial Sequence: Synthetic oligonucleotide
tggtcacagccacctgaatagaaatgctgacatc

SEQ ID NO: 291793 - DNA, 33 bp, Artificial Sequence
  Description of Artificial Sequence: Synthetic oligonucleotide
ggtcacagccacctgaatagaaatgctgacatc

SEQ ID NO: 291794 - DNA, 34 bp, Artificial Sequence
  Description of Artificial Sequence: Synthetic oligonucleotide
gtcacagccacctgaatagaaatgctgacatcac

SEQ ID NO: 291795 - DNA, 35 bp, Artificial Sequence
  Description of Artificial Sequence: Synthetic oligonucleotide
tcacagccacctgaatagaaatgctgacatcacag

SEQ ID NO: 291796 - DNA, 34 bp, Artificial Sequence
  Description of Artificial Sequence: Synthetic oligonucleotide
cacagccacctgaatagaaatgctgacatcacag

SEQ ID NO: 291797 - DNA, 34 bp, Artificial Sequence
  Description of Artificial Sequence: Synthetic oligonucleotide
acagccacctgaatagaaatgctgacatcacagg

SEQ ID NO: 291798 - DNA, 33 bp, Artificial Sequence
  Description of Artificial Sequence: Synthetic oligonucleotide
cagccacctgaatagaaatgctgacatcacagg

SEQ ID NO: 291799 - DNA, 33 bp, Artificial Sequence
  Description of Artificial Sequence: Synthetic oligonucleotide
agccacctgaatagaaatgctgacatcacaggc

SEQ ID NO: 291800 - DNA, 32 bp, Artificial Sequence
  Description of Artificial Sequence: Synthetic oligonucleotide
gccacctgaatagaaatgctgacatcacaggc

SEQ ID NO: 291801 - DNA, 37 bp, Artificial Sequence
  Description of Artificial Sequence: Synthetic oligonucleotide
ccacctgaatagaaatgctgacatcacaggcatatac

SEQ ID NO: 291802 - DNA, 38 bp, Artificial Sequence
  Description of Artificial Sequence: Synthetic oligonucleotide
cacctgaatagaaatgctgacatcacaggcatatacac

SEQ ID NO: 291803 - DNA, 40 bp, Artificial Sequence
  Description of Artificial Sequence: Synthetic oligonucleotide
acctgaatagaaatgctgacatcacaggcatatacacatc

SEQ ID NO: 291804 - DNA, 39 bp, Artificial Sequence
  Description of Artificial Sequence: Synthetic oligonucleotide
cctgaatagaaatgctgacatcacaggcatatacacatc

SEQ ID NO: 291805 - DNA, 41 bp, Artificial Sequence
  Description of Artificial Sequence: Synthetic oligonucleotide
ctgaatagaaatgctgacatcacaggcatatacacatcatg

SEQ ID NO: 291806 - DNA, 41 bp, Artificial Sequence
  Description of Artificial Sequence: Synthetic oligonucleotide
tgaatagaaatgctgacatcacaggcatatacacatcatgg

SEQ ID NO: 291807 - DNA, 40 bp, Artificial Sequence
  Description of Artificial Sequence: Synthetic oligonucleotide
gaatagaaatgctgacatcacaggcatatacacatcatgg

SEQ ID NO: 291808 - DNA, 40 bp, Artificial Sequence
  Description of Artificial Sequence: Synthetic oligonucleotide
aatagaaatgctgacatcacaggcatatacacatcatggg

SEQ ID NO: 291809 - DNA, 39 bp, Artificial Sequence
  Description of Artificial Sequence: Synthetic oligonucleotide
atagaaatgctgacatcacaggcatatacacatcatggg

SEQ ID NO: 291810 - DNA, 38 bp, Artificial Sequence
  Description of Artificial Sequence: Synthetic oligonucleotide
tagaaatgctgacatcacaggcatatacacatcatggg

SEQ ID NO: 291811 - DNA, 37 bp, Artificial Sequence
  Description of Artificial Sequence: Synthetic oligonucleotide
agaaatgctgacatcacaggcatatacacatcatggg

SEQ ID NO: 291812 - DNA, 36 bp, Artificial Sequence
  Description of Artificial Sequence: Synthetic oligonucleotide
gaaatgctgacatcacaggcatatacacatcatggg

SEQ ID NO: 291813 - DNA, 36 bp, Artificial Sequence
  Description of Artificial Sequence: Synthetic oligonucleotide
aaatgctgacatcacaggcatatacacatcatgggg

SEQ ID NO: 291814 - DNA, 35 bp, Artificial Sequence
  Description of Artificial Sequence: Synthetic oligonucleotide
aatgctgacatcacaggcatatacacatcatgggg

SEQ ID NO: 291815 - DNA, 34 bp, Artificial Sequence
  Description of Artificial Sequence: Synthetic oligonucleotide
atgctgacatcacaggcatatacacatcatgggg

SEQ ID NO: 291816 - DNA, 33 bp, Artificial Sequence
  Description of Artificial Sequence: Synthetic oligonucleotide
tgctgacatcacaggcatatacacatcatgggg

SEQ ID NO: 291817 - DNA, 32 bp, Artificial Sequence
  Description of Artificial Sequence: Synthetic oligonucleotide
gctgacatcacaggcatatacacatcatgggg

SEQ ID NO: 291818 - DNA, 32 bp, Artificial Sequence
  Description of Artificial Sequence: Synthetic oligonucleotide
ctgacatcacaggcatatacacatcatggggg

SEQ ID NO: 291819 - DNA, 33 bp, Artificial Sequence
  Description of Artificial Sequence: Synthetic oligonucleotide
tgacatcacaggcatatacacatcatgggggac

SEQ ID NO: 291820 - DNA, 32 bp, Artificial Sequence
  Description of Artificial Sequence: Synthetic oligonucleotide
gacatcacaggcatatacacatcatgggggac

SEQ ID NO: 291821 - DNA, 37 bp, Artificial Sequence
  Description of Artificial Sequence: Synthetic oligonucleotide
acatcacaggcatatacacatcatgggggacaatatc

SEQ ID NO: 291822 - DNA, 36 bp, Artificial Sequence
  Description of Artificial Sequence: Synthetic oligonucleotide
catcacaggcatatacacatcatgggggacaatatc

SEQ ID NO: 291823 - DNA, 38 bp, Artificial Sequence
  Description of Artificial Sequence: Synthetic oligonucleotide
atcacaggcatatacacatcatgggggacaatatcatg

SEQ ID NO: 291824 - DNA, 37 bp, Artificial Sequence
  Description of Artificial Sequence: Synthetic oligonucleotide
tcacaggcatatacacatcatgggggacaatatcatg

SEQ ID NO: 291825 - DNA, 36 bp, Artificial Sequence
  Description of Artificial Sequence: Synthetic oligonucleotide
cacaggcatatacacatcatgggggacaatatcatg

SEQ ID NO: 291826 - DNA, 36 bp, Artificial Sequence
  Description of Artificial Sequence: Synthetic oligonucleotide
acaggcatatacacatcatgggggacaatatcatgc

SEQ ID NO: 291827 - DNA, 35 bp, Artificial Sequence
  Description of Artificial Sequence: Synthetic oligonucleotide
caggcatatacacatcatgggggacaatatcatgc

SEQ ID NO: 291828 - DNA, 36 bp, Artificial Sequence
  Description of Artificial Sequence: Synthetic oligonucleotide
aggcatatacacatcatgggggacaatatcatgctc

SEQ ID NO: 291829 - DNA, 35 bp, Artificial Sequence
  Description of Artificial Sequence: Synthetic oligonucleotide
ggcatatacacatcatgggggacaatatcatgctc

SEQ ID NO: 291830 - DNA, 37 bp, Artificial Sequence
  Description of Artificial Sequence: Synthetic oligonucleotide
gcatatacacatcatgggggacaatatcatgctcaag

SEQ ID NO: 291831 - DNA, 39 bp, Artificial Sequence
  Description of Artificial Sequence: Synthetic oligonucleotide
catatacacatcatgggggacaatatcatgctcaagatg

SEQ ID NO: 291832 - DNA, 39 bp, Artificial Sequence
  Description of Artificial Sequence: Synthetic oligonucleotide
atatacacatcatgggggacaatatcatgctcaagatgg

SEQ ID NO: 291833 - DNA, 38 bp, Artificial Sequence
  Description of Artificial Sequence: Synthetic oligonucleotide
tatacacatcatgggggacaatatcatgctcaagatgg

SEQ ID NO: 291834 - DNA, 37 bp, Artificial Sequence
  Description of Artificial Sequence: Synthetic oligonucleotide
atacacatcatgggggacaatatcatgctcaagatgg

SEQ ID NO: 291835 - DNA, 36 bp, Artificial Sequence
  Description of Artificial Sequence: Synthetic oligonucleotide
tacacatcatgggggacaatatcatgctcaagatgg

SEQ ID NO: 291836 - DNA, 35 bp, Artificial Sequence
  Description of Artificial Sequence: Synthetic oligonucleotide
acacatcatgggggacaatatcatgctcaagatgg

SEQ ID NO: 291837 - DNA, 34 bp, Artificial Sequence
  Description of Artificial Sequence: Synthetic oligonucleotide
cacatcatgggggacaatatcatgctcaagatgg

SEQ ID NO: 291838 - DNA, 35 bp, Artificial Sequence
  Description of Artificial Sequence: Synthetic oligonucleotide
acatcatgggggacaatatcatgctcaagatggag

SEQ ID NO: 291839 - DNA, 34 bp, Artificial Sequence
  Description of Artificial Sequence: Synthetic oligonucleotide
catcatgggggacaatatcatgctcaagatggag

SEQ ID NO: 291840 - DNA, 39 bp, Artificial Sequence
  Description of Artificial Sequence: Synthetic oligonucleotide
atcatgggggacaatatcatgctcaagatggagtaattc

SEQ ID NO: 291841 - DNA, 38 bp, Artificial Sequence
  Description of Artificial Sequence: Synthetic oligonucleotide
tcatgggggacaatatcatgctcaagatggagtaattc

SEQ ID NO: 291842 - DNA, 37 bp, Artificial Sequence
  Description of Artificial Sequence: Synthetic oligonucleotide
catgggggacaatatcatgctcaagatggagtaattc

SEQ ID NO: 291843 - DNA, 38 bp, Artificial Sequence
  Description of Artificial Sequence: Synthetic oligonucleotide
atgggggacaatatcatgctcaagatggagtaattcac

SEQ ID NO: 291844 - DNA, 37 bp, Artificial Sequence
  Description of Artificial Sequence: Synthetic oligonucleotide
tgggggacaatatcatgctcaagatggagtaattcac

SEQ ID NO: 291845 - DNA, 36 bp, Artificial Sequence
  Description of Artificial Sequence: Synthetic oligonucleotide
gggggacaatatcatgctcaagatggagtaattcac

SEQ ID NO: 291846 - DNA, 36 bp, Artificial Sequence
  Description of Artificial Sequence: Synthetic oligonucleotide
ggggacaatatcatgctcaagatggagtaattcacc

SEQ ID NO: 291847 - DNA, 42 bp, Artificial Sequence
  Description of Artificial Sequence: Synthetic oligonucleotide
gggacaatatcatgctcaagatggagtaattcaccaaatttg

SEQ ID NO: 291848 - DNA, 52 bp, Artificial Sequence
  Description of Artificial Sequence: Synthetic oligonucleotide
ggacaatatcatgctcaagatggagtaattcaccaaatttgtaatataatag

SEQ ID NO: 291849 - DNA, 54 bp, Artificial Sequence
  Description of Artificial Sequence: Synthetic oligonucleotide
gacaatatcatgctcaagatggagtaattcaccaaatttgtaatataatagttg

SEQ ID NO: 291850 - DNA, 54 bp, Artificial Sequence
  Description of Artificial Sequence: Synthetic oligonucleotide
acaatatcatgctcaagatggagtaattcaccaaatttgtaatataatagttgg

SEQ ID NO: 291851 - DNA, 53 bp, Artificial Sequence
  Description of Artificial Sequence: Synthetic oligonucleotide
caatatcatgctcaagatggagtaattcaccaaatttgtaatataatagttgg

SEQ ID NO: 291852 - DNA, 53 bp, Artificial Sequence
  Description of Artificial Sequence: Synthetic oligonucleotide
aatatcatgctcaagatggagtaattcaccaaatttgtaatataatagttggg

SEQ ID NO: 291853 - DNA, 52 bp, Artificial Sequence
  Description of Artificial Sequence: Synthetic oligonucleotide
atatcatgctcaagatggagtaattcaccaaatttgtaatataatagttggg

SEQ ID NO: 291854 - DNA, 51 bp, Artificial Sequence
  Description of Artificial Sequence: Synthetic oligonucleotide
tatcatgctcaagatggagtaattcaccaaatttgtaatataatagttggg

SEQ ID NO: 291855 - DNA, 50 bp, Artificial Sequence
  Description of Artificial Sequence: Synthetic oligonucleotide
atcatgctcaagatggagtaattcaccaaatttgtaatataatagttggg

SEQ ID NO: 291856 - DNA, 49 bp, Artificial Sequence
  Description of Artificial Sequence: Synthetic oligonucleotide
tcatgctcaagatggagtaattcaccaaatttgtaatataatagttggg

SEQ ID NO: 291857 - DNA, 48 bp, Artificial Sequence
  Description of Artificial Sequence: Synthetic oligonucleotide
catgctcaagatggagtaattcaccaaatttgtaatataatagttggg

SEQ ID NO: 291858 - DNA, 48 bp, Artificial Sequence
  Description of Artificial Sequence: Synthetic oligonucleotide
atgctcaagatggagtaattcaccaaatttgtaatataatagttgggg

SEQ ID NO: 291859 - DNA, 47 bp, Artificial Sequence
  Description of Artificial Sequence: Synthetic oligonucleotide
tgctcaagatggagtaattcaccaaatttgtaatataatagttgggg

SEQ ID NO: 291860 - DNA, 46 bp, Artificial Sequence
  Description of Artificial Sequence: Synthetic oligonucleotide
gctcaagatggagtaattcaccaaatttgtaatataatagttgggg

SEQ ID NO: 291861 - DNA, 46 bp, Artificial Sequence
  Description of Artificial Sequence: Synthetic oligonucleotide
ctcaagatggagtaattcaccaaatttgtaatataatagttggggc

SEQ ID NO: 291862 - DNA, 47 bp, Artificial Sequence
  Description of Artificial Sequence: Synthetic oligonucleotide
tcaagatggagtaattcaccaaatttgtaatataatagttggggcac

SEQ ID NO: 291863 - DNA, 46 bp, Artificial Sequence
  Description of Artificial Sequence: Synthetic oligonucleotide
caagatggagtaattcaccaaatttgtaatataatagttggggcac

SEQ ID NO: 291864 - DNA, 49 bp, Artificial Sequence
  Description of Artificial Sequence: Synthetic oligonucleotide
aagatggagtaattcaccaaatttgtaatataatagttggggcacattc

SEQ ID NO: 291865 - DNA, 48 bp, Artificial Sequence
  Description of Artificial Sequence: Synthetic oligonucleotide
agatggagtaattcaccaaatttgtaatataatagttggggcacattc

SEQ ID NO: 291866 - DNA, 47 bp, Artificial Sequence
  Description of Artificial Sequence: Synthetic oligonucleotide
gatggagtaattcaccaaatttgtaatataatagttggggcacattc

SEQ ID NO: 291867 - DNA, 48 bp, Artificial Sequence
  Description of Artificial Sequence: Synthetic oligonucleotide
atggagtaattcaccaaatttgtaatataatagttggggcacattcag

SEQ ID NO: 291868 - DNA, 47 bp, Artificial Sequence
  Description of Artificial Sequence: Synthetic oligonucleotide
tggagtaattcaccaaatttgtaatataatagttggggcacattcag

SEQ ID NO: 291869 - DNA, 46 bp, Artificial Sequence
  Description of Artificial Sequence: Synthetic oligonucleotide
ggagtaattcaccaaatttgtaatataatagttggggcacattcag

SEQ ID NO: 291870 - DNA, 47 bp, Artificial Sequence
  Description of Artificial Sequence: Synthetic oligonucleotide
gagtaattcaccaaatttgtaatataatagttggggcacattcagac

SEQ ID NO: 291871 - DNA, 47 bp, Artificial Sequence
  Description of Artificial Sequence: Synthetic oligonucleotide
agtaattcaccaaatttgtaatataatagttggggcacattcagacc

SEQ ID NO: 291872 - DNA, 46 bp, Artificial Sequence
  Description of Artificial Sequence: Synthetic oligonucleotide
gtaattcaccaaatttgtaatataatagttggggcacattcagacc

SEQ ID NO: 291873 - DNA, 46 bp, Artificial Sequence
  Description of Artificial Sequence: Synthetic oligonucleotide
taattcaccaaatttgtaatataatagttggggcacattcagaccg

SEQ ID NO: 291874 - DNA, 45 bp, Artificial Sequence
  Description of Artificial Sequence: Synthetic oligonucleotide
aattcaccaaatttgtaatataatagttggggcacattcagaccg

SEQ ID NO: 291875 - DNA, 44 bp, Artificial Sequence
  Description of Artificial Sequence: Synthetic oligonucleotide
attcaccaaatttgtaatataatagttggggcacattcagaccg

SEQ ID NO: 291876 - DNA, 43 bp, Artificial Sequence
  Description of Artificial Sequence: Synthetic oligonucleotide
ttcaccaaatttgtaatataatagttggggcacattcagaccg

SEQ ID NO: 291877 - DNA, 42 bp, Artificial Sequence
  Description of Artificial Sequence: Synthetic oligonucleotide
tcaccaaatttgtaatataatagttggggcacattcagaccg

SEQ ID NO: 291878 - DNA, 41 bp, Artificial Sequence
  Description of Artificial Sequence: Synthetic oligonucleotide
caccaaatttgtaatataatagttggggcacattcagaccg

SEQ ID NO: 291879 - DNA, 44 bp, Artificial Sequence
  Description of Artificial Sequence: Synthetic oligonucleotide
accaaatttgtaatataatagttggggcacattcagaccgtttc

SEQ ID NO: 291880 - DNA, 43 bp, Artificial Sequence
  Description of Artificial Sequence: Synthetic oligonucleotide
ccaaatttgtaatataatagttggggcacattcagaccgtttc

SEQ ID NO: 291881 - DNA, 44 bp, Artificial Sequence
  Description of Artificial Sequence: Synthetic oligonucleotide
caaatttgtaatataatagttggggcacattcagaccgtttctc

SEQ ID NO: 291882 - DNA, 46 bp, Artificial Sequence
  Description of Artificial Sequence: Synthetic oligonucleotide
aaatttgtaatataatagttggggcacattcagaccgtttctctag

SEQ ID NO: 291883 - DNA, 45 bp, Artificial Sequence
  Description of Artificial Sequence: Synthetic oligonucleotide
aatttgtaatataatagttggggcacattcagaccgtttctctag

SEQ ID NO: 291884 - DNA, 44 bp, Artificial Sequence
  Description of Artificial Sequence: Synthetic oligonucleotide
atttgtaatataatagttggggcacattcagaccgtttctctag

SEQ ID NO: 291885 - DNA, 43 bp, Artificial Sequence
  Description of Artificial Sequence: Synthetic oligonucleotide
tttgtaatataatagttggggcacattcagaccgtttctctag

SEQ ID NO: 291886 - DNA, 42 bp, Artificial Sequence
  Description of Artificial Sequence: Synthetic oligonucleotide
ttgtaatataatagttggggcacattcagaccgtttctctag

SEQ ID NO: 291887 - DNA, 41 bp, Artificial Sequence
  Description of Artificial Sequence: Synthetic oligonucleotide
tgtaatataatagttggggcacattcagaccgtttctctag

SEQ ID NO: 291888 - DNA, 40 bp, Artificial Sequence
  Description of Artificial Sequence: Synthetic oligonucleotide
gtaatataatagttggggcacattcagaccgtttctctag

SEQ ID NO: 291889 - DNA, 40 bp, Artificial Sequence
  Description of Artificial Sequence: Synthetic oligonucleotide
taatataatagttggggcacattcagaccgtttctctagg

SEQ ID NO: 291890 - DNA, 39 bp, Artificial Sequence
  Description of Artificial Sequence: Synthetic oligonucleotide
aatataatagttggggcacattcagaccgtttctctagg

SEQ ID NO: 291891 - DNA, 38 bp, Artificial Sequence
  Description of Artificial Sequence: Synthetic oligonucleotide
atataatagttggggcacattcagaccgtttctctagg

SEQ ID NO: 291892 - DNA, 37 bp, Artificial Sequence
  Description of Artificial Sequence: Synthetic oligonucleotide
tataatagttggggcacattcagaccgtttctctagg

SEQ ID NO: 291893 - DNA, 36 bp, Artificial Sequence
  Description of Artificial Sequence: Synthetic oligonucleotide
ataatagttggggcacattcagaccgtttctctagg

SEQ ID NO: 291894 - DNA, 35 bp, Artificial Sequence
  Description of Artificial Sequence: Synthetic oligonucleotide
taatagttggggcacattcagaccgtttctctagg

SEQ ID NO: 291895 - DNA, 34 bp, Artificial Sequence
  Description of Artificial Sequence: Synthetic oligonucleotide
aatagttggggcacattcagaccgtttctctagg

SEQ ID NO: 291896 - DNA, 33 bp, Artificial Sequence
  Description of Artificial Sequence: Synthetic oligonucleotide
atagttggggcacattcagaccgtttctctagg

SEQ ID NO: 291897 - DNA, 32 bp, Artificial Sequence
  Description of Artificial Sequence: Synthetic oligonucleotide
tagttggggcacattcagaccgtttctctagg

SEQ ID NO: 291898 - DNA, 31 bp, Artificial Sequence
  Description of Artificial Sequence: Synthetic oligonucleotide
agttggggcacattcagaccgtttctctagg

SEQ ID NO: 291899 - DNA, 30 bp, Artificial Sequence
  Description of Artificial Sequence: Synthetic oligonucleotide
gttggggcacattcagaccgtttctctagg

SEQ ID NO: 291900 - DNA, 32 bp, Artificial Sequence
  Description of Artificial Sequence: Synthetic oligonucleotide
ttggggcacattcagaccgtttctctaggttc

SEQ ID NO: 291901 - DNA, 31 bp, Artificial Sequence
  Description of Artificial Sequence: Synthetic oligonucleotide
tggggcacattcagaccgtttctctaggttc

SEQ ID NO: 291902 - DNA, 30 bp, Artificial Sequence
  Description of Artificial Sequence: Synthetic oligonucleotide
ggggcacattcagaccgtttctctaggttc

SEQ ID NO: 291903 - DNA, 33 bp, Artificial Sequence
  Description of Artificial Sequence: Synthetic oligonucleotide
gggcacattcagaccgtttctctaggttctatc

SEQ ID NO: 291904 - DNA, 34 bp, Artificial Sequence
  Description of Artificial Sequence: Synthetic oligonucleotide
ggcacattcagaccgtttctctaggttctatctg

SEQ ID NO: 291905 - DNA, 34 bp, Artificial Sequence
  Description of Artificial Sequence: Synthetic oligonucleotide
gcacattcagaccgtttctctaggttctatctgg

SEQ ID NO: 291906 - DNA, 34 bp, Artificial Sequence
  Description of Artificial Sequence: Synthetic oligonucleotide
cacattcagaccgtttctctaggttctatctggc

SEQ ID NO: 291907 - DNA, 35 bp, Artificial Sequence
  Description of Artificial Sequence: Synthetic oligonucleotide
acattcagaccgtttctctaggttctatctggcag

SEQ ID NO: 291908 - DNA, 34 bp, Artificial Sequence
  Description of Artificial Sequence: Synthetic oligonucleotide
cattcagaccgtttctctaggttctatctggcag

SEQ ID NO: 291909 - DNA, 34 bp, Artificial Sequence
  Description of Artificial Sequence: Synthetic oligonucleotide
attcagaccgtttctctaggttctatctggcagg

SEQ ID NO: 291910 - DNA, 33 bp, Artificial Sequence
  Description of Artificial Sequence: Synthetic oligonucleotide
ttcagaccgtttctctaggttctatctggcagg

SEQ ID NO: 291911 - DNA, 32 bp, Artificial Sequence
  Description of Artificial Sequence: Synthetic oligonucleotide
tcagaccgtttctctaggttctatctggcagg

SEQ ID NO: 291912 - DNA, 31 bp, Artificial Sequence
  Description of Artificial Sequence: Synthetic oligonucleotide
cagaccgtttctctaggttctatctggcagg

SEQ ID NO: 291913 - DNA, 34 bp, Artificial Sequence
  Description of Artificial Sequence: Synthetic oligonucleotide
agaccgtttctctaggttctatctggcaggattc

SEQ ID NO: 291914 - DNA, 33 bp, Artificial Sequence
  Description of Artificial Sequence: Synthetic oligonucleotide
gaccgtttctctaggttctatctggcaggattc

SEQ ID NO: 291915 - DNA, 33 bp, Artificial Sequence
  Description of Artificial Sequence: Synthetic oligonucleotide
accgtttctctaggttctatctggcaggattcg

SEQ ID NO: 291916 - DNA, 32 bp, Artificial Sequence
  Description of Artificial Sequence: Synthetic oligonucleotide
ccgtttctctaggttctatctggcaggattcg

SEQ ID NO: 291917 - DNA, 33 bp, Artificial Sequence
  Description of Artificial Sequence: Synthetic oligonucleotide
cgtttctctaggttctatctggcaggattcgag

SEQ ID NO: 291918 - DNA, 35 bp, Artificial Sequence
  Description of Artificial Sequence: Synthetic oligonucleotide
gtttctctaggttctatctggcaggattcgagaag

SEQ ID NO: 291919 - DNA, 41 bp, Artificial Sequence
  Description of Artificial Sequence: Synthetic oligonucleotide
tttctctaggttctatctggcaggattcgagaagtttttag

SEQ ID NO: 291920 - DNA, 40 bp, Artificial Sequence
  Description of Artificial Sequence: Synthetic oligonucleotide
ttctctaggttctatctggcaggattcgagaagtttttag

SEQ ID NO: 291921 - DNA, 39 bp, Artificial Sequence
  Description of Artificial Sequence: Synthetic oligonucleotide
tctctaggttctatctggcaggattcgagaagtttttag

SEQ ID NO: 291922 - DNA, 38 bp, Artificial Sequence
  Description of Artificial Sequence: Synthetic oligonucleotide
ctctaggttctatctggcaggattcgagaagtttttag

SEQ ID NO: 291923 - DNA, 38 bp, Artificial Sequence
  Description of Artificial Sequence: Synthetic oligonucleotide
tctaggttctatctggcaggattcgagaagtttttagg

SEQ ID NO: 291924 - DNA, 37 bp, Artificial Sequence
  Description of Artificial Sequence: Synthetic oligonucleotide
ctaggttctatctggcaggattcgagaagtttttagg

SEQ ID NO: 291925 - DNA, 40 bp, Artificial Sequence
  Description of Artificial Sequence: Synthetic oligonucleotide
taggttctatctggcaggattcgagaagtttttaggaaac

SEQ ID NO: 291926 - DNA, 39 bp, Artificial Sequence
  Description of Artificial Sequence: Synthetic oligonucleotide
aggttctatctggcaggattcgagaagtttttaggaaac

SEQ ID NO: 291927 - DNA, 38 bp, Artificial Sequence
  Description of Artificial Sequence: Synthetic oligonucleotide
ggttctatctggcaggattcgagaagtttttaggaaac

SEQ ID NO: 291928 - DNA, 38 bp, Artificial Sequence
  Description of Artificial Sequence: Synthetic oligonucleotide
gttctatctggcaggattcgagaagtttttaggaaacc

SEQ ID NO: 291929 - DNA, 39 bp, Artificial Sequence
  Description of Artificial Sequence: Synthetic oligonucleotide
ttctatctggcaggattcgagaagtttttaggaaacctg

SEQ ID NO: 291930 - DNA, 38 bp, Artificial Sequence
  Description of Artificial Sequence: Synthetic oligonucleotide
tctatctggcaggattcgagaagtttttaggaaacctg

SEQ ID NO: 291931 - DNA, 37 bp, Artificial Sequence
  Description of Artificial Sequence: Synthetic oligonucleotide
ctatctggcaggattcgagaagtttttaggaaacctg

SEQ ID NO: 291932 - DNA, 37 bp, Artificial Sequence
  Description of Artificial Sequence: Synthetic oligonucleotide
tatctggcaggattcgagaagtttttaggaaacctgc

SEQ ID NO: 291933 - DNA, 36 bp, Artificial Sequence
  Description of Artificial Sequence: Synthetic oligonucleotide
atctggcaggattcgagaagtttttaggaaacctgc

SEQ ID NO: 291934 - DNA, 35 bp, Artificial Sequence
  Description of Artificial Sequence: Synthetic oligonucleotide
tctggcaggattcgagaagtttttaggaaacctgc

SEQ ID NO: 291935 - DNA, 34 bp, Artificial Sequence
  Description of Artificial Sequence: Synthetic oligonucleotide
ctggcaggattcgagaagtttttaggaaacctgc

SEQ ID NO: 291936 - DNA, 34 bp, Artificial Sequence
  Description of Artificial Sequence: Synthetic oligonucleotide
tggcaggattcgagaagtttttaggaaacctgcc

SEQ ID NO: 291937 - DNA, 33 bp, Artificial Sequence
  Description of Artificial Sequence: Synthetic oligonucleotide
ggcaggattcgagaagtttttaggaaacctgcc

SEQ ID NO: 291938 - DNA, 34 bp, Artificial Sequence
  Description of Artificial Sequence: Synthetic oligonucleotide
gcaggattcgagaagtttttaggaaacctgcctg

SEQ ID NO: 291939 - DNA, 35 bp, Artificial Sequence
  Description of Artificial Sequence: Synthetic oligonucleotide
caggattcgagaagtttttaggaaacctgcctgtc

SEQ ID NO: 291940 - DNA, 37 bp, Artificial Sequence
  Description of Artificial Sequence: Synthetic oligonucleotide
aggattcgagaagtttttaggaaacctgcctgtcatg

SEQ ID NO: 291941 - DNA, 36 bp, Artificial Sequence
  Description of Artificial Sequence: Synthetic oligonucleotide
ggattcgagaagtttttaggaaacctgcctgtcatg

SEQ ID NO: 291942 - DNA, 36 bp, Artificial Sequence
  Description of Artificial Sequence: Synthetic oligonucleotide
gattcgagaagtttttaggaaacctgcctgtcatgg

SEQ ID NO: 291943 - DNA, 39 bp, Artificial Sequence
  Description of Artificial Sequence: Synthetic oligonucleotide
attcgagaagtttttaggaaacctgcctgtcatggttag

SEQ ID NO: 291944 - DNA, 38 bp, Artificial Sequence
  Description of Artificial Sequence: Synthetic oligonucleotide
ttcgagaagtttttaggaaacctgcctgtcatggttag

SEQ ID NO: 291945 - DNA, 37 bp, Artificial Sequence
  Description of Artificial Sequence: Synthetic oligonucleotide
tcgagaagtttttaggaaacctgcctgtcatggttag

SEQ ID NO: 291946 - DNA, 36 bp, Artificial Sequence
  Description of Artificial Sequence: Synthetic oligonucleotide
cgagaagtttttaggaaacctgcctgtcatggttag

SEQ ID NO: 291947 - DNA, 37 bp, Artificial Sequence
  Description of Artificial Sequence: Synthetic oligonucleotide
gagaagtttttaggaaacctgcctgtcatggttagtc

SEQ ID NO: 291948 - DNA, 37 bp, Artificial Sequence
  Description of Artificial Sequence: Synthetic oligonucleotide
agaagtttttaggaaacctgcctgtcatggttagtcc

SEQ ID NO: 291949 - DNA, 36 bp, Artificial Sequence
  Description of Artificial Sequence: Synthetic oligonucleotide
gaagtttttaggaaacctgcctgtcatggttagtcc

SEQ ID NO: 291950 - DNA, 37 bp, Artificial Sequence
  Description of Artificial Sequence: Synthetic oligonucleotide
aagtttttaggaaacctgcctgtcatggttagtcctc

SEQ ID NO: 291951 - DNA, 36 bp, Artificial Sequence
  Description of Artificial Sequence: Synthetic oligonucleotide
agtttttaggaaacctgcctgtcatggttagtcctc

SEQ ID NO: 291952 - DNA, 35 bp, Artificial Sequence
  Description of Artificial Sequence: Synthetic oligonucleotide
gtttttaggaaacctgcctgtcatggttagtcctc

SEQ ID NO: 291953 - DNA, 37 bp, Artificial Sequence
  Description of Artificial Sequence: Synthetic oligonucleotide
tttttaggaaacctgcctgtcatggttagtcctcatc

SEQ ID NO: 291954 - DNA, 36 bp, Artificial Sequence
  Description of Artificial Sequence: Synthetic oligonucleotide
ttttaggaaacctgcctgtcatggttagtcctcatc

SEQ ID NO: 291955 - DNA, 35 bp, Artificial Sequence
  Description of Artificial Sequence: Synthetic oligonucleotide
tttaggaaacctgcctgtcatggttagtcctcatc

SEQ ID NO: 291956 - DNA, 34 bp, Artificial Sequence
  Description of Artificial Sequence: Synthetic oligonucleotide
ttaggaaacctgcctgtcatggttagtcctcatc

SEQ ID NO: 291957 - DNA, 33 bp, Artificial Sequence
  Description of Artificial Sequence: Synthetic oligonucleotide
taggaaacctgcctgtcatggttagtcctcatc

SEQ ID NO: 291958 - DNA, 32 bp, Artificial Sequence
  Description of Artificial Sequence: Synthetic oligonucleotide
aggaaacctgcctgtcatggttagtcctcatc

SEQ ID NO: 291959 - DNA, 31 bp, Artificial Sequence
  Description of Artificial Sequence: Synthetic oligonucleotide
ggaaacctgcctgtcatggttagtcctcatc

SEQ ID NO: 291960 - DNA, 32 bp, Artificial Sequence
  Description of Artificial Sequence: Synthetic oligonucleotide
gaaacctgcctgtcatggttagtcctcatcag

SEQ ID NO: 291961 - DNA, 34 bp, Artificial Sequence
  Description of Artificial Sequence: Synthetic oligonucleotide
aaacctgcctgtcatggttagtcctcatcagatc

SEQ ID NO: 291962 - DNA, 33 bp, Artificial Sequence
  Description of Artificial Sequence: Synthetic oligonucleotide
aacctgcctgtcatggttagtcctcatcagatc

SEQ ID NO: 291963 - DNA, 32 bp, Artificial Sequence
  Description of Artificial Sequence: Synthetic oligonucleotide
acctgcctgtcatggttagtcctcatcagatc

SEQ ID NO: 291964 - DNA, 31 bp, Artificial Sequence
  Description of Artificial Sequence: Synthetic oligonucleotide
cctgcctgtcatggttagtcctcatcagatc

SEQ ID NO: 291965 - DNA, 32 bp, Artificial Sequence
  Description of Artificial Sequence: Synthetic oligonucleotide
ctgcctgtcatggttagtcctcatcagatctg

SEQ ID NO: 291966 - DNA, 33 bp, Artificial Sequence
  Description of Artificial Sequence: Synthetic oligonucleotide
tgcctgtcatggttagtcctcatcagatctgtc

SEQ ID NO: 291967 - DNA, 32 bp, Artificial Sequence
  Description of Artificial Sequence: Synthetic oligonucleotide
gcctgtcatggttagtcctcatcagatctgtc

SEQ ID NO: 291968 - DNA, 33 bp, Artificial Sequence
  Description of Artificial Sequence: Synthetic oligonucleotide
cctgtcatggttagtcctcatcagatctgtcag

SEQ ID NO: 291969 - DNA, 33 bp, Artificial Sequence
  Description of Artificial Sequence: Synthetic oligonucleotide
ctgtcatggttagtcctcatcagatctgtcagc

SEQ ID NO: 291970 - DNA, 33 bp, Artificial Sequence
  Description of Artificial Sequence: Synthetic oligonucleotide
tgtcatggttagtcctcatcagatctgtcagcg

SEQ ID NO: 291971 - DNA, 32 bp, Artificial Sequence
  Description of Artificial Sequence: Synthetic oligonucleotide
gtcatggttagtcctcatcagatctgtcagcg

SEQ ID NO: 291972 - DNA, 36 bp, Artificial Sequence
  Description of Artificial Sequence: Synthetic oligonucleotide
tcatggttagtcctcatcagatctgtcagcgttatc

SEQ ID NO: 291973 - DNA, 35 bp, Artificial Sequence
  Description of Artificial Sequence: Synthetic oligonucleotide
catggttagtcctcatcagatctgtcagcgttatc

SEQ ID NO: 291974 - DNA, 35 bp, Artificial Sequence
  Description of Artificial Sequence: Synthetic oligonucleotide
atggttagtcctcatcagatctgtcagcgttatcg

SEQ ID NO: 291975 - DNA, 34 bp, Artificial Sequence
  Description of Artificial Sequence: Synthetic oligonucleotide
tggttagtcctcatcagatctgtcagcgttatcg

SEQ ID NO: 291976 - DNA, 33 bp, Artificial Sequence
  Description of Artificial Sequence: Synthetic oligonucleotide
ggttagtcctcatcagatctgtcagcgttatcg

SEQ ID NO: 291977 - DNA, 36 bp, Artificial Sequence
  Description of Artificial Sequence: Synthetic oligonucleotide
gttagtcctcatcagatctgtcagcgttatcgtatc

SEQ ID NO: 291978 - DNA, 39 bp, Artificial Sequence
  Description of Artificial Sequence: Synthetic oligonucleotide
ttagtcctcatcagatctgtcagcgttatcgtatctttg

SEQ ID NO: 291979 - DNA, 38 bp, Artificial Sequence
  Description of Artificial Sequence: Synthetic oligonucleotide
tagtcctcatcagatctgtcagcgttatcgtatctttg

SEQ ID NO: 291980 - DNA, 37 bp, Artificial Sequence
  Description of Artificial Sequence: Synthetic oligonucleotide
agtcctcatcagatctgtcagcgttatcgtatctttg

SEQ ID NO: 291981 - DNA, 36 bp, Artificial Sequence
  Description of Artificial Sequence: Synthetic oligonucleotide
gtcctcatcagatctgtcagcgttatcgtatctttg

SEQ ID NO: 291982 - DNA, 37 bp, Artificial Sequence
  Description of Artificial Sequence: Synthetic oligonucleotide
tcctcatcagatctgtcagcgttatcgtatctttgtc

SEQ ID NO: 291983 - DNA, 36 bp, Artificial Sequence
  Description of Artificial Sequence: Synthetic oligonucleotide
cctcatcagatctgtcagcgttatcgtatctttgtc

SEQ ID NO: 291984 - DNA, 36 bp, Artificial Sequence
  Description of Artificial Sequence: Synthetic oligonucleotide
ctcatcagatctgtcagcgttatcgtatctttgtcg

SEQ ID NO: 291985 - DNA, 41 bp, Artificial Sequence
  Description of Artificial Sequence: Synthetic oligonucleotide
tcatcagatctgtcagcgttatcgtatctttgtcgaaaaag

SEQ ID NO: 291986 - DNA, 40 bp, Artificial Sequence
  Description of Artificial Sequence: Synthetic oligonucleotide
catcagatctgtcagcgttatcgtatctttgtcgaaaaag

SEQ ID NO: 291987 - DNA, 41 bp, Artificial Sequence
  Description of Artificial Sequence: Synthetic oligonucleotide
atcagatctgtcagcgttatcgtatctttgtcgaaaaagtc

SEQ ID NO: 291988 - DNA, 40 bp, Artificial Sequence
  Description of Artificial Sequence: Synthetic oligonucleotide
tcagatctgtcagcgttatcgtatctttgtcgaaaaagtc

SEQ ID NO: 291989 - DNA, 39 bp, Artificial Sequence
  Description of Artificial Sequence: Synthetic oligonucleotide
cagatctgtcagcgttatcgtatctttgtcgaaaaagtc

SEQ ID NO: 291990 - DNA, 42 bp, Artificial Sequence
  Description of Artificial Sequence: Synthetic oligonucleotide
agatctgtcagcgttatcgtatctttgtcgaaaaagtcattg

SEQ ID NO: 291991 - DNA, 41 bp, Artificial Sequence
  Description of Artificial Sequence: Synthetic oligonucleotide
gatctgtcagcgttatcgtatctttgtcgaaaaagtcattg

SEQ ID NO: 291992 - DNA, 45 bp, Artificial Sequence
  Description of Artificial Sequence: Synthetic oligonucleotide
atctgtcagcgttatcgtatctttgtcgaaaaagtcattgaaatg

SEQ ID NO: 291993 - DNA, 44 bp, Artificial Sequence
  Description of Artificial Sequence: Synthetic oligonucleotide
tctgtcagcgttatcgtatctttgtcgaaaaagtcattgaaatg

SEQ ID NO: 291994 - DNA, 43 bp, Artificial Sequence
  Description of Artificial Sequence: Synthetic oligonucleotide
ctgtcagcgttatcgtatctttgtcgaaaaagtcattgaaatg

SEQ ID NO: 291995 - DNA, 46 bp, Artificial Sequence
  Description of Artificial Sequence: Synthetic oligonucleotide
tgtcagcgttatcgtatctttgtcgaaaaagtcattgaaatgaaag

SEQ ID NO: 291996 - DNA, 45 bp, Artificial Sequence
  Description of Artificial Sequence: Synthetic oligonucleotide
gtcagcgttatcgtatctttgtcgaaaaagtcattgaaatgaaag

SEQ ID NO: 291997 - DNA, 48 bp, Artificial Sequence
  Description of Artificial Sequence: Synthetic oligonucleotide
tcagcgttatcgtatctttgtcgaaaaagtcattgaaatgaaagaaag

SEQ ID NO: 291998 - DNA, 47 bp, Artificial Sequence
  Description of Artificial Sequence: Synthetic oligonucleotide
cagcgttatcgtatctttgtcgaaaaagtcattgaaatgaaagaaag

SEQ ID NO: 291999 - DNA, 48 bp, Artificial Sequence
  Description of Artificial Sequence: Synthetic oligonucleotide
agcgttatcgtatctttgtcgaaaaagtcattgaaatgaaagaaagtc

SEQ ID NO: 292000 - DNA, 47 bp, Artificial Sequence
  Description of Artificial Sequence: Synthetic oligonucleotide
gcgttatcgtatctttgtcgaaaaagtcattgaaatgaaagaaagtc

SEQ ID NO: 292001 - DNA, 48 bp, Artificial Sequence
  Description of Artificial Sequence: Synthetic oligonucleotide
cgttatcgtatctttgtcgaaaaagtcattgaaatgaaagaaagtcac

SEQ ID NO: 292002 - DNA, 48 bp, Artificial Sequence
  Description of Artificial Sequence: Synthetic oligonucleotide
gttatcgtatctttgtcgaaaaagtcattgaaatgaaagaaagtcacg

SEQ ID NO: 292003 - DNA, 49 bp, Artificial Sequence
  Description of Artificial Sequence: Synthetic oligonucleotide
ttatcgtatctttgtcgaaaaagtcattgaaatgaaagaaagtcacgac

SEQ ID NO: 292004 - DNA, 48 bp, Artificial Sequence
  Description of Artificial Sequence: Synthetic oligonucleotide
tatcgtatctttgtcgaaaaagtcattgaaatgaaagaaagtcacgac

SEQ ID NO: 292005 - DNA, 47 bp, Artificial Sequence
  Description of Artificial Sequence: Synthetic oligonucleotide
atcgtatctttgtcgaaaaagtcattgaaatgaaagaaagtcacgac

SEQ ID NO: 292006 - DNA, 46 bp, Artificial Sequence
  Description of Artificial Sequence: Synthetic oligonucleotide
tcgtatctttgtcgaaaaagtcattgaaatgaaagaaagtcacgac

SEQ ID NO: 292007 - DNA, 45 bp, Artificial Sequence
  Description of Artificial Sequence: Synthetic oligonucleotide
cgtatctttgtcgaaaaagtcattgaaatgaaagaaagtcacgac

SEQ ID NO: 292008 - DNA, 45 bp, Artificial Sequence
  Description of Artificial Sequence: Synthetic oligonucleotide
gtatctttgtcgaaaaagtcattgaaatgaaagaaagtcacgacc

SEQ ID NO: 292009 - DNA, 45 bp, Artificial Sequence
  Description of Artificial Sequence: Synthetic oligonucleotide
tatctttgtcgaaaaagtcattgaaatgaaagaaagtcacgaccc

SEQ ID NO: 292010 - DNA, 44 bp, Artificial Sequence
  Description of Artificial Sequence: Synthetic oligonucleotide
atctttgtcgaaaaagtcattgaaatgaaagaaagtcacgaccc

SEQ ID NO: 292011 - DNA, 43 bp, Artificial Sequence
  Description of Artificial Sequence: Synthetic oligonucleotide
tctttgtcgaaaaagtcattgaaatgaaagaaagtcacgaccc

SEQ ID NO: 292012 - DNA, 42 bp, Artificial Sequence
  Description of Artificial Sequence: Synthetic oligonucleotide
ctttgtcgaaaaagtcattgaaatgaaagaaagtcacgaccc

SEQ ID NO: 292013 - DNA, 42 bp, Artificial Sequence
  Description of Artificial Sequence: Synthetic oligonucleotide
tttgtcgaaaaagtcattgaaatgaaagaaagtcacgacccc

SEQ ID NO: 292014 - DNA, 41 bp, Artificial Sequence
  Description of Artificial Sequence: Synthetic oligonucleotide
ttgtcgaaaaagtcattgaaatgaaagaaagtcacgacccc

SEQ ID NO: 292015 - DNA, 40 bp, Artificial Sequence
  Description of Artificial Sequence: Synthetic oligonucleotide
tgtcgaaaaagtcattgaaatgaaagaaagtcacgacccc

SEQ ID NO: 292016 - DNA, 39 bp, Artificial Sequence
  Description of Artificial Sequence: Synthetic oligonucleotide
gtcgaaaaagtcattgaaatgaaagaaagtcacgacccc

SEQ ID NO: 292017 - DNA, 40 bp, Artificial Sequence
  Description of Artificial Sequence: Synthetic oligonucleotide
tcgaaaaagtcattgaaatgaaagaaagtcacgaccccac

SEQ ID NO: 292018 - DNA, 39 bp, Artificial Sequence
  Description of Artificial Sequence: Synthetic oligonucleotide
cgaaaaagtcattgaaatgaaagaaagtcacgaccccac

SEQ ID NO: 292019 - DNA, 42 bp, Artificial Sequence
  Description of Artificial Sequence: Synthetic oligonucleotide
gaaaaagtcattgaaatgaaagaaagtcacgaccccactttg

SEQ ID NO: 292020 - DNA, 45 bp, Artificial Sequence
  Description of Artificial Sequence: Synthetic oligonucleotide
aaaaagtcattgaaatgaaagaaagtcacgaccccactttgattg

SEQ ID NO: 292021 - DNA, 44 bp, Artificial Sequence
  Description of Artificial Sequence: Synthetic oligonucleotide
aaaagtcattgaaatgaaagaaagtcacgaccccactttgattg

SEQ ID NO: 292022 - DNA, 43 bp, Artificial Sequence
  Description of Artificial Sequence: Synthetic oligonucleotide
aaagtcattgaaatgaaagaaagtcacgaccccactttgattg

SEQ ID NO: 292023 - DNA, 42 bp, Artificial Sequence
  Description of Artificial Sequence: Synthetic oligonucleotide
aagtcattgaaatgaaagaaagtcacgaccccactttgattg

SEQ ID NO: 292024 - DNA, 41 bp, Artificial Sequence
  Description of Artificial Sequence: Synthetic oligonucleotide
agtcattgaaatgaaagaaagtcacgaccccactttgattg

SEQ ID NO: 292025 - DNA, 40 bp, Artificial Sequence
  Description of Artificial Sequence: Synthetic oligonucleotide
gtcattgaaatgaaagaaagtcacgaccccactttgattg

SEQ ID NO: 292026 - DNA, 40 bp, Artificial Sequence
  Description of Artificial Sequence: Synthetic oligonucleotide
tcattgaaatgaaagaaagtcacgaccccactttgattgg

SEQ ID NO: 292027 - DNA, 39 bp, Artificial Sequence
  Description of Artificial Sequence: Synthetic oligonucleotide
cattgaaatgaaagaaagtcacgaccccactttgattgg

SEQ ID NO: 292028 - DNA, 40 bp, Artificial Sequence
  Description of Artificial Sequence: Synthetic oligonucleotide
attgaaatgaaagaaagtcacgaccccactttgattggtg

SEQ ID NO: 292029 - DNA, 39 bp, Artificial Sequence
  Description of Artificial Sequence: Synthetic oligonucleotide
ttgaaatgaaagaaagtcacgaccccactttgattggtg

SEQ ID NO: 292030 - DNA, 38 bp, Artificial Sequence
  Description of Artificial Sequence: Synthetic oligonucleotide
tgaaatgaaagaaagtcacgaccccactttgattggtg

SEQ ID NO: 292031 - DNA, 37 bp, Artificial Sequence
  Description of Artificial Sequence: Synthetic oligonucleotide
gaaatgaaagaaagtcacgaccccactttgattggtg

SEQ ID NO: 292032 - DNA, 39 bp, Artificial Sequence
  Description of Artificial Sequence: Synthetic oligonucleotide
aaatgaaagaaagtcacgaccccactttgattggtgaag

SEQ ID NO: 292033 - DNA, 38 bp, Artificial Sequence
  Description of Artificial Sequence: Synthetic oligonucleotide
aatgaaagaaagtcacgaccccactttgattggtgaag

SEQ ID NO: 292034 - DNA, 37 bp, Artificial Sequence
  Description of Artificial Sequence: Synthetic oligonucleotide
atgaaagaaagtcacgaccccactttgattggtgaag

SEQ ID NO: 292035 - DNA, 36 bp, Artificial Sequence
  Description of Artificial Sequence: Synthetic oligonucleotide
tgaaagaaagtcacgaccccactttgattggtgaag

SEQ ID NO: 292036 - DNA, 35 bp, Artificial Sequence
  Description of Artificial Sequence: Synthetic oligonucleotide
gaaagaaagtcacgaccccactttgattggtgaag

SEQ ID NO: 292037 - DNA, 35 bp, Artificial Sequence
  Description of Artificial Sequence: Synthetic oligonucleotide
aaagaaagtcacgaccccactttgattggtgaagc

SEQ ID NO: 292038 - DNA, 34 bp, Artificial Sequence
  Description of Artificial Sequence: Synthetic oligonucleotide
aagaaagtcacgaccccactttgattggtgaagc

SEQ ID NO: 292039 - DNA, 33 bp, Artificial Sequence
  Description of Artificial Sequence: Synthetic oligonucleotide
agaaagtcacgaccccactttgattggtgaagc

SEQ ID NO: 292040 - DNA, 32 bp, Artificial Sequence
  Description of Artificial Sequence: Synthetic oligonucleotide
gaaagtcacgaccccactttgattggtgaagc

SEQ ID NO: 292041 - DNA, 33 bp, Artificial Sequence
  Description of Artificial Sequence: Synthetic oligonucleotide
aaagtcacgaccccactttgattggtgaagctg

SEQ ID NO: 292042 - DNA, 32 bp, Artificial Sequence
  Description of Artificial Sequence: Synthetic oligonucleotide
aagtcacgaccccactttgattggtgaagctg

SEQ ID NO: 292043 - DNA, 31 bp, Artificial Sequence
  Description of Artificial Sequence: Synthetic oligonucleotide
agtcacgaccccactttgattggtgaagctg

SEQ ID NO: 292044 - DNA, 30 bp, Artificial Sequence
  Description of Artificial Sequence: Synthetic oligonucleotide
gtcacgaccccactttgattggtgaagctg

SEQ ID NO: 292045 - DNA, 32 bp, Artificial Sequence
  Description of Artificial Sequence: Synthetic oligonucleotide
tcacgaccccactttgattggtgaagctgtag

SEQ ID NO: 292046 - DNA, 31 bp, Artificial Sequence
  Description of Artificial Sequence: Synthetic oligonucleotide
cacgaccccactttgattggtgaagctgtag

SEQ ID NO: 292047 - DNA, 32 bp, Artificial Sequence
  Description of Artificial Sequence: Synthetic oligonucleotide
acgaccccactttgattggtgaagctgtagag

SEQ ID NO: 292048 - DNA, 31 bp, Artificial Sequence
  Description of Artificial Sequence: Synthetic oligonucleotide
cgaccccactttgattggtgaagctgtagag

SEQ ID NO: 292049 - DNA, 32 bp, Artificial Sequence
  Description of Artificial Sequence: Synthetic oligonucleotide
gaccccactttgattggtgaagctgtagagac

SEQ ID NO: 292050 - DNA, 33 bp, Artificial Sequence
  Description of Artificial Sequence: Synthetic oligonucleotide
accccactttgattggtgaagctgtagagacag

SEQ ID NO: 292051 - DNA, 32 bp, Artificial Sequence
  Description of Artificial Sequence: Synthetic oligonucleotide
ccccactttgattggtgaagctgtagagacag

SEQ ID NO: 292052 - DNA, 34 bp, Artificial Sequence
  Description of Artificial Sequence: Synthetic oligonucleotide
cccactttgattggtgaagctgtagagacagttg

SEQ ID NO: 292053 - DNA, 34 bp, Artificial Sequence
  Description of Artificial Sequence: Synthetic oligonucleotide
ccactttgattggtgaagctgtagagacagttgg

SEQ ID NO: 292054 - DNA, 37 bp, Artificial Sequence
  Description of Artificial Sequence: Synthetic oligonucleotide
cactttgattggtgaagctgtagagacagttggattc

SEQ ID NO: 292055 - DNA, 39 bp, Artificial Sequence
  Description of Artificial Sequence: Synthetic oligonucleotide
actttgattggtgaagctgtagagacagttggattcttg

SEQ ID NO: 292056 - DNA, 38 bp, Artificial Sequence
  Description of Artificial Sequence: Synthetic oligonucleotide
ctttgattggtgaagctgtagagacagttggattcttg

SEQ ID NO: 292057 - DNA, 38 bp, Artificial Sequence
  Description of Artificial Sequence: Synthetic oligonucleotide
tttgattggtgaagctgtagagacagttggattcttgg

SEQ ID NO: 292058 - DNA, 37 bp, Artificial Sequence
  Description of Artificial Sequence: Synthetic oligonucleotide
ttgattggtgaagctgtagagacagttggattcttgg

SEQ ID NO: 292059 - DNA, 36 bp, Artificial Sequence
  Description of Artificial Sequence: Synthetic oligonucleotide
tgattggtgaagctgtagagacagttggattcttgg

SEQ ID NO: 292060 - DNA, 35 bp, Artificial Sequence
  Description of Artificial Sequence: Synthetic oligonucleotide
gattggtgaagctgtagagacagttggattcttgg

SEQ ID NO: 292061 - DNA, 35 bp, Artificial Sequence
  Description of Artificial Sequence: Synthetic oligonucleotide
attggtgaagctgtagagacagttggattcttggg

SEQ ID NO: 292062 - DNA, 34 bp, Artificial Sequence
  Description of Artificial Sequence: Synthetic oligonucleotide
ttggtgaagctgtagagacagttggattcttggg

SEQ ID NO: 292063 - DNA, 33 bp, Artificial Sequence
  Description of Artificial Sequence: Synthetic oligonucleotide
tggtgaagctgtagagacagttggattcttggg

SEQ ID NO: 292064 - DNA, 32 bp, Artificial Sequence
  Description of Artificial Sequence: Synthetic oligonucleotide
ggtgaagctgtagagacagttggattcttggg

SEQ ID NO: 292065 - DNA, 34 bp, Artificial Sequence
  Description of Artificial Sequence: Synthetic oligonucleotide
gtgaagctgtagagacagttggattcttgggatg

SEQ ID NO: 292066 - DNA, 34 bp, Artificial Sequence
  Description of Artificial Sequence: Synthetic oligonucleotide
tgaagctgtagagacagttggattcttgggatgc

SEQ ID NO: 292067 - DNA, 33 bp, Artificial Sequence
  Description of Artificial Sequence: Synthetic oligonucleotide
gaagctgtagagacagttggattcttgggatgc

SEQ ID NO: 292068 - DNA, 36 bp, Artificial Sequence
  Description of Artificial Sequence: Synthetic oligonucleotide
aagctgtagagacagttggattcttgggatgcaatg

SEQ ID NO: 292069 - DNA, 35 bp, Artificial Sequence
  Description of Artificial Sequence: Synthetic oligonucleotide
agctgtagagacagttggattcttgggatgcaatg

SEQ ID NO: 292070 - DNA, 34 bp, Artificial Sequence
  Description of Artificial Sequence: Synthetic oligonucleotide
gctgtagagacagttggattcttgggatgcaatg

SEQ ID NO: 292071 - DNA, 36 bp, Artificial Sequence
  Description of Artificial Sequence: Synthetic oligonucleotide
ctgtagagacagttggattcttgggatgcaatgttg

SEQ ID NO: 292072 - DNA, 38 bp, Artificial Sequence
  Description of Artificial Sequence: Synthetic oligonucleotide
tgtagagacagttggattcttgggatgcaatgttgatg

SEQ ID NO: 292073 - DNA, 37 bp, Artificial Sequence
  Description of Artificial Sequence: Synthetic oligonucleotide
gtagagacagttggattcttgggatgcaatgttgatg

SEQ ID NO: 292074 - DNA, 37 bp, Artificial Sequence
  Description of Artificial Sequence: Synthetic oligonucleotide
tagagacagttggattcttgggatgcaatgttgatgg

SEQ ID NO: 292075 - DNA, 36 bp, Artificial Sequence
  Description of Artificial Sequence: Synthetic oligonucleotide
agagacagttggattcttgggatgcaatgttgatgg

SEQ ID NO: 292076 - DNA, 35 bp, Artificial Sequence
  Description of Artificial Sequence: Synthetic oligonucleotide
gagacagttggattcttgggatgcaatgttgatgg

SEQ ID NO: 292077 - DNA, 39 bp, Artificial Sequence
  Description of Artificial Sequence: Synthetic oligonucleotide
agacagttggattcttgggatgcaatgttgatggaaaac

SEQ ID NO: 292078 - DNA, 38 bp, Artificial Sequence
  Description of Artificial Sequence: Synthetic oligonucleotide
gacagttggattcttgggatgcaatgttgatggaaaac

SEQ ID NO: 292079 - DNA, 39 bp, Artificial Sequence
  Description of Artificial Sequence: Synthetic oligonucleotide
acagttggattcttgggatgcaatgttgatggaaaacag

SEQ ID NO: 292080 - DNA, 38 bp, Artificial Sequence
  Description of Artificial Sequence: Synthetic oligonucleotide
cagttggattcttgggatgcaatgttgatggaaaacag

SEQ ID NO: 292081 - DNA, 38 bp, Artificial Sequence
  Description of Artificial Sequence: Synthetic oligonucleotide
agttggattcttgggatgcaatgttgatggaaaacagc

SEQ ID NO: 292082 - DNA, 37 bp, Artificial Sequence
  Description of Artificial Sequence: Synthetic oligonucleotide
gttggattcttgggatgcaatgttgatggaaaacagc

SEQ ID NO: 292083 - DNA, 42 bp, Artificial Sequence
  Description of Artificial Sequence: Synthetic oligonucleotide
ttggattcttgggatgcaatgttgatggaaaacagcttttac

SEQ ID NO: 292084 - DNA, 41 bp, Artificial Sequence
  Description of Artificial Sequence: Synthetic oligonucleotide
tggattcttgggatgcaatgttgatggaaaacagcttttac

SEQ ID NO: 292085 - DNA, 40 bp, Artificial Sequence
  Description of Artificial Sequence: Synthetic oligonucleotide
ggattcttgggatgcaatgttgatggaaaacagcttttac

SEQ ID NO: 292086 - DNA, 41 bp, Artificial Sequence
  Description of Artificial Sequence: Synthetic oligonucleotide
gattcttgggatgcaatgttgatggaaaacagcttttacag

SEQ ID NO: 292087 - DNA, 45 bp, Artificial Sequence
  Description of Artificial Sequence: Synthetic oligonucleotide
attcttgggatgcaatgttgatggaaaacagcttttacagataac

SEQ ID NO: 292088 - DNA, 44 bp, Artificial Sequence
  Description of Artificial Sequence: Synthetic oligonucleotide
ttcttgggatgcaatgttgatggaaaacagcttttacagataac

SEQ ID NO: 292089 - DNA, 43 bp, Artificial Sequence
  Description of Artificial Sequence: Synthetic oligonucleotide
tcttgggatgcaatgttgatggaaaacagcttttacagataac

SEQ ID NO: 292090 - DNA, 42 bp, Artificial Sequence
  Description of Artificial Sequence: Synthetic oligonucleotide
cttgggatgcaatgttgatggaaaacagcttttacagataac

SEQ ID NO: 292091 - DNA, 43 bp, Artificial Sequence
  Description of Artificial Sequence: Synthetic oligonucleotide
ttgggatgcaatgttgatggaaaacagcttttacagataacag

SEQ ID NO: 292092 - DNA, 42 bp, Artificial Sequence
  Description of Artificial Sequence: Synthetic oligonucleotide
tgggatgcaatgttgatggaaaacagcttttacagataacag

SEQ ID NO: 292093 - DNA, 41 bp, Artificial Sequence
  Description of Artificial Sequence: Synthetic oligonucleotide
gggatgcaatgttgatggaaaacagcttttacagataacag

SEQ ID NO: 292094 - DNA, 41 bp, Artificial Sequence
  Description of Artificial Sequence: Synthetic oligonucleotide
ggatgcaatgttgatggaaaacagcttttacagataacagg

SEQ ID NO: 292095 - DNA, 43 bp, Artificial Sequence
  Description of Artificial Sequence: Synthetic oligonucleotide
gatgcaatgttgatggaaaacagcttttacagataacaggaac

SEQ ID NO: 292096 - DNA, 44 bp, Artificial Sequence
  Description of Artificial Sequence: Synthetic oligonucleotide
atgcaatgttgatggaaaacagcttttacagataacaggaacac

SEQ ID NO: 292097 - DNA, 43 bp, Artificial Sequence
  Description of Artificial Sequence: Synthetic oligonucleotide
tgcaatgttgatggaaaacagcttttacagataacaggaacac

SEQ ID NO: 292098 - DNA, 42 bp, Artificial Sequence
  Description of Artificial Sequence: Synthetic oligonucleotide
gcaatgttgatggaaaacagcttttacagataacaggaacac

SEQ ID NO: 292099 - DNA, 42 bp, Artificial Sequence
  Description of Artificial Sequence: Synthetic oligonucleotide
caatgttgatggaaaacagcttttacagataacaggaacacg

SEQ ID NO: 292100 - DNA, 42 bp, Artificial Sequence
  Description of Artificial Sequence: Synthetic oligonucleotide
aatgttgatggaaaacagcttttacagataacaggaacacgc

SEQ ID NO: 292101 - DNA, 41 bp, Artificial Sequence
  Description of Artificial Sequence: Synthetic oligonucleotide
atgttgatggaaaacagcttttacagataacaggaacacgc

SEQ ID NO: 292102 - DNA, 40 bp, Artificial Sequence
  Description of Artificial Sequence: Synthetic oligonucleotide
tgttgatggaaaacagcttttacagataacaggaacacgc

SEQ ID NO: 292103 - DNA, 39 bp, Artificial Sequence
  Description of Artificial Sequence: Synthetic oligonucleotide
gttgatggaaaacagcttttacagataacaggaacacgc

SEQ ID NO: 292104 - DNA, 42 bp, Artificial Sequence
  Description of Artificial Sequence: Synthetic oligonucleotide
ttgatggaaaacagcttttacagataacaggaacacgctttg

SEQ ID NO: 292105 - DNA, 41 bp, Artificial Sequence
  Description of Artificial Sequence: Synthetic oligonucleotide
tgatggaaaacagcttttacagataacaggaacacgctttg

SEQ ID NO: 292106 - DNA, 40 bp, Artificial Sequence
  Description of Artificial Sequence: Synthetic oligonucleotide
gatggaaaacagcttttacagataacaggaacacgctttg

SEQ ID NO: 292107 - DNA, 42 bp, Artificial Sequence
  Description of Artificial Sequence: Synthetic oligonucleotide
atggaaaacagcttttacagataacaggaacacgctttgaag

SEQ ID NO: 292108 - DNA, 41 bp, Artificial Sequence
  Description of Artificial Sequence: Synthetic oligonucleotide
tggaaaacagcttttacagataacaggaacacgctttgaag

SEQ ID NO: 292109 - DNA, 40 bp, Artificial Sequence
  Description of Artificial Sequence: Synthetic oligonucleotide
ggaaaacagcttttacagataacaggaacacgctttgaag

SEQ ID NO: 292110 - DNA, 40 bp, Artificial Sequence
  Description of Artificial Sequence: Synthetic oligonucleotide
gaaaacagcttttacagataacaggaacacgctttgaagg

SEQ ID NO: 292111 - DNA, 40 bp, Artificial Sequence
  Description of Artificial Sequence: Synthetic oligonucleotide
aaaacagcttttacagataacaggaacacgctttgaaggc

SEQ ID NO: 292112 - DNA, 39 bp, Artificial Sequence
  Description of Artificial Sequence: Synthetic oligonucleotide
aaacagcttttacagataacaggaacacgctttgaaggc

SEQ ID NO: 292113 - DNA, 38 bp, Artificial Sequence
  Description of Artificial Sequence: Synthetic oligonucleotide
aacagcttttacagataacaggaacacgctttgaaggc

SEQ ID NO: 292114 - DNA, 37 bp, Artificial Sequence
  Description of Artificial Sequence: Synthetic oligonucleotide
acagcttttacagataacaggaacacgctttgaaggc

SEQ ID NO: 292115 - DNA, 36 bp, Artificial Sequence
  Description of Artificial Sequence: Synthetic oligonucleotide
cagcttttacagataacaggaacacgctttgaaggc

SEQ ID NO: 292116 - DNA, 38 bp, Artificial Sequence
  Description of Artificial Sequence: Synthetic oligonucleotide
agcttttacagataacaggaacacgctttgaaggcttg

SEQ ID NO: 292117 - DNA, 37 bp, Artificial Sequence
  Description of Artificial Sequence: Synthetic oligonucleotide
gcttttacagataacaggaacacgctttgaaggcttg

SEQ ID NO: 292118 - DNA, 37 bp, Artificial Sequence
  Description of Artificial Sequence: Synthetic oligonucleotide
cttttacagataacaggaacacgctttgaaggcttgc

SEQ ID NO: 292119 - DNA, 41 bp, Artificial Sequence
  Description of Artificial Sequence: Synthetic oligonucleotide
ttttacagataacaggaacacgctttgaaggcttgcttaag

SEQ ID NO: 292120 - DNA, 40 bp, Artificial Sequence
  Description of Artificial Sequence: Synthetic oligonucleotide
tttacagataacaggaacacgctttgaaggcttgcttaag

SEQ ID NO: 292121 - DNA, 39 bp, Artificial Sequence
  Description of Artificial Sequence: Synthetic oligonucleotide
ttacagataacaggaacacgctttgaaggcttgcttaag

SEQ ID NO: 292122 - DNA, 38 bp, Artificial Sequence
  Description of Artificial Sequence: Synthetic oligonucleotide
tacagataacaggaacacgctttgaaggcttgcttaag

SEQ ID NO: 292123 - DNA, 37 bp, Artificial Sequence
  Description of Artificial Sequence: Synthetic oligonucleotide
acagataacaggaacacgctttgaaggcttgcttaag

SEQ ID NO: 292124 - DNA, 36 bp, Artificial Sequence
  Description of Artificial Sequence: Synthetic oligonucleotide
cagataacaggaacacgctttgaaggcttgcttaag

SEQ ID NO: 292125 - DNA, 37 bp, Artificial Sequence
  Description of Artificial Sequence: Synthetic oligonucleotide
agataacaggaacacgctttgaaggcttgcttaagag

SEQ ID NO: 292126 - DNA, 36 bp, Artificial Sequence
  Description of Artificial Sequence: Synthetic oligonucleotide
gataacaggaacacgctttgaaggcttgcttaagag

SEQ ID NO: 292127 - DNA, 40 bp, Artificial Sequence
  Description of Artificial Sequence: Synthetic oligonucleotide
ataacaggaacacgctttgaaggcttgcttaagagaatag

SEQ ID NO: 292128 - DNA, 39 bp, Artificial Sequence
  Description of Artificial Sequence: Synthetic oligonucleotide
taacaggaacacgctttgaaggcttgcttaagagaatag

SEQ ID NO: 292129 - DNA, 38 bp, Artificial Sequence
  Description of Artificial Sequence: Synthetic oligonucleotide
aacaggaacacgctttgaaggcttgcttaagagaatag

SEQ ID NO: 292130 - DNA, 37 bp, Artificial Sequence
  Description of Artificial Sequence: Synthetic oligonucleotide
acaggaacacgctttgaaggcttgcttaagagaatag

SEQ ID NO: 292131 - DNA, 36 bp, Artificial Sequence
  Description of Artificial Sequence: Synthetic oligonucleotide
caggaacacgctttgaaggcttgcttaagagaatag

SEQ ID NO: 292132 - DNA, 36 bp, Artificial Sequence
  Description of Artificial Sequence: Synthetic oligonucleotide
aggaacacgctttgaaggcttgcttaagagaatagg

SEQ ID NO: 292133 - DNA, 35 bp, Artificial Sequence
  Description of Artificial Sequence: Synthetic oligonucleotide
ggaacacgctttgaaggcttgcttaagagaatagg

SEQ ID NO: 292134 - DNA, 36 bp, Artificial Sequence
  Description of Artificial Sequence: Synthetic oligonucleotide
gaacacgctttgaaggcttgcttaagagaataggtc

SEQ ID NO: 292135 - DNA, 38 bp, Artificial Sequence
  Description of Artificial Sequence: Synthetic oligonucleotide
aacacgctttgaaggcttgcttaagagaataggtcatc

SEQ ID NO: 292136 - DNA, 37 bp, Artificial Sequence
  Description of Artificial Sequence: Synthetic oligonucleotide
acacgctttgaaggcttgcttaagagaataggtcatc

SEQ ID NO: 292137 - DNA, 36 bp, Artificial Sequence
  Description of Artificial Sequence: Synthetic oligonucleotide
cacgctttgaaggcttgcttaagagaataggtcatc

SEQ ID NO: 292138 - DNA, 39 bp, Artificial Sequence
  Description of Artificial Sequence: Synthetic oligonucleotide
acgctttgaaggcttgcttaagagaataggtcatcaatc

SEQ ID NO: 292139 - DNA, 38 bp, Artificial Sequence
  Description of Artificial Sequence: Synthetic oligonucleotide
cgctttgaaggcttgcttaagagaataggtcatcaatc

SEQ ID NO: 292140 - DNA, 41 bp, Artificial Sequence
  Description of Artificial Sequence: Synthetic oligonucleotide
gctttgaaggcttgcttaagagaataggtcatcaatcatag

SEQ ID NO: 292141 - DNA, 44 bp, Artificial Sequence
  Description of Artificial Sequence: Synthetic oligonucleotide
ctttgaaggcttgcttaagagaataggtcatcaatcatagaatg

SEQ ID NO: 292142 - DNA, 44 bp, Artificial Sequence
  Description of Artificial Sequence: Synthetic oligonucleotide
tttgaaggcttgcttaagagaataggtcatcaatcatagaatgc

SEQ ID NO: 292143 - DNA, 43 bp, Artificial Sequence
  Description of Artificial Sequence: Synthetic oligonucleotide
ttgaaggcttgcttaagagaataggtcatcaatcatagaatgc

SEQ ID NO: 292144 - DNA, 42 bp, Artificial Sequence
  Description of Artificial Sequence: Synthetic oligonucleotide
tgaaggcttgcttaagagaataggtcatcaatcatagaatgc

SEQ ID NO: 292145 - DNA, 41 bp, Artificial Sequence
  Description of Artificial Sequence: Synthetic oligonucleotide
gaaggcttgcttaagagaataggtcatcaatcatagaatgc

SEQ ID NO: 292146 - DNA, 41 bp, Artificial Sequence
  Description of Artificial Sequence: Synthetic oligonucleotide
aaggcttgcttaagagaataggtcatcaatcatagaatgcc

SEQ ID NO: 292147 - DNA, 40 bp, Artificial Sequence
  Description of Artificial Sequence: Synthetic oligonucleotide
aggcttgcttaagagaataggtcatcaatcatagaatgcc

SEQ ID NO: 292148 - DNA, 39 bp, Artificial Sequence
  Description of Artificial Sequence: Synthetic oligonucleotide
ggcttgcttaagagaataggtcatcaatcatagaatgcc

SEQ ID NO: 292149 - DNA, 39 bp, Artificial Sequence
  Description of Artificial Sequence: Synthetic oligonucleotide
gcttgcttaagagaataggtcatcaatcatagaatgccc

SEQ ID NO: 292150 - DNA, 39 bp, Artificial Sequence
  Description of Artificial Sequence: Synthetic oligonucleotide
cttgcttaagagaataggtcatcaatcatagaatgcccg

SEQ ID NO: 292151 - DNA, 40 bp, Artificial Sequence
  Description of Artificial Sequence: Synthetic oligonucleotide
ttgcttaagagaataggtcatcaatcatagaatgcccgag

SEQ ID NO: 292152 - DNA, 39 bp, Artificial Sequence
  Description of Artificial Sequence: Synthetic oligonucleotide
tgcttaagagaataggtcatcaatcatagaatgcccgag

SEQ ID NO: 292153 - DNA, 38 bp, Artificial Sequence
  Description of Artificial Sequence: Synthetic oligonucleotide
gcttaagagaataggtcatcaatcatagaatgcccgag

SEQ ID NO: 292154 - DNA, 39 bp, Artificial Sequence
  Description of Artificial Sequence: Synthetic oligonucleotide
cttaagagaataggtcatcaatcatagaatgcccgagtg

SEQ ID NO: 292155 - DNA, 39 bp, Artificial Sequence
  Description of Artificial Sequence: Synthetic oligonucleotide
ttaagagaataggtcatcaatcatagaatgcccgagtgg

SEQ ID NO: 292156 - DNA, 38 bp, Artificial Sequence
  Description of Artificial Sequence: Synthetic oligonucleotide
taagagaataggtcatcaatcatagaatgcccgagtgg

SEQ ID NO: 292157 - DNA, 37 bp, Artificial Sequence
  Description of Artificial Sequence: Synthetic oligonucleotide
aagagaataggtcatcaatcatagaatgcccgagtgg

SEQ ID NO: 292158 - DNA, 36 bp, Artificial Sequence
  Description of Artificial Sequence: Synthetic oligonucleotide
agagaataggtcatcaatcatagaatgcccgagtgg

SEQ ID NO: 292159 - DNA, 35 bp, Artificial Sequence
  Description of Artificial Sequence: Synthetic oligonucleotide
gagaataggtcatcaatcatagaatgcccgagtgg

SEQ ID NO: 292160 - DNA, 36 bp, Artificial Sequence
  Description of Artificial Sequence: Synthetic oligonucleotide
agaataggtcatcaatcatagaatgcccgagtggag

SEQ ID NO: 292161 - DNA, 35 bp, Artificial Sequence
  Description of Artificial Sequence: Synthetic oligonucleotide
gaataggtcatcaatcatagaatgcccgagtggag

SEQ ID NO: 292162 - DNA, 35 bp, Artificial Sequence
  Description of Artificial Sequence: Synthetic oligonucleotide
aataggtcatcaatcatagaatgcccgagtggagc

SEQ ID NO: 292163 - DNA, 34 bp, Artificial Sequence
  Description of Artificial Sequence: Synthetic oligonucleotide
ataggtcatcaatcatagaatgcccgagtggagc

SEQ ID NO: 292164 - DNA, 33 bp, Artificial Sequence
  Description of Artificial Sequence: Synthetic oligonucleotide
taggtcatcaatcatagaatgcccgagtggagc

SEQ ID NO: 292165 - DNA, 32 bp, Artificial Sequence
  Description of Artificial Sequence: Synthetic oligonucleotide
aggtcatcaatcatagaatgcccgagtggagc

SEQ ID NO: 292166 - DNA, 31 bp, Artificial Sequence
  Description of Artificial Sequence: Synthetic oligonucleotide
ggtcatcaatcatagaatgcccgagtggagc

SEQ ID NO: 292167 - DNA, 40 bp, Artificial Sequence
  Description of Artificial Sequence: Synthetic oligonucleotide
gtcatcaatcatagaatgcccgagtggagcttaaaattag

SEQ ID NO: 292168 - DNA, 42 bp, Artificial Sequence
  Description of Artificial Sequence: Synthetic oligonucleotide
tcatcaatcatagaatgcccgagtggagcttaaaattagaag

SEQ ID NO: 292169 - DNA, 41 bp, Artificial Sequence
  Description of Artificial Sequence: Synthetic oligonucleotide
catcaatcatagaatgcccgagtggagcttaaaattagaag

SEQ ID NO: 292170 - DNA, 44 bp, Artificial Sequence
  Description of Artificial Sequence: Synthetic oligonucleotide
atcaatcatagaatgcccgagtggagcttaaaattagaagtttg

SEQ ID NO: 292171 - DNA, 43 bp, Artificial Sequence
  Description of Artificial Sequence: Synthetic oligonucleotide
tcaatcatagaatgcccgagtggagcttaaaattagaagtttg

SEQ ID NO: 292172 - DNA, 42 bp, Artificial Sequence
  Description of Artificial Sequence: Synthetic oligonucleotide
caatcatagaatgcccgagtggagcttaaaattagaagtttg

SEQ ID NO: 292173 - DNA, 42 bp, Artificial Sequence
  Description of Artificial Sequence: Synthetic oligonucleotide
aatcatagaatgcccgagtggagcttaaaattagaagtttgg

SEQ ID NO: 292174 - DNA, 41 bp, Artificial Sequence
  Description of Artificial Sequence: Synthetic oligonucleotide
atcatagaatgcccgagtggagcttaaaattagaagtttgg

SEQ ID NO: 292175 - DNA, 40 bp, Artificial Sequence
  Description of Artificial Sequence: Synthetic oligonucleotide
tcatagaatgcccgagtggagcttaaaattagaagtttgg

SEQ ID NO: 292176 - DNA, 39 bp, Artificial Sequence
  Description of Artificial Sequence: Synthetic oligonucleotide
catagaatgcccgagtggagcttaaaattagaagtttgg

SEQ ID NO: 292177 - DNA, 41 bp, Artificial Sequence
  Description of Artificial Sequence: Synthetic oligonucleotide
atagaatgcccgagtggagcttaaaattagaagtttggatg

SEQ ID NO: 292178 - DNA, 40 bp, Artificial Sequence
  Description of Artificial Sequence: Synthetic oligonucleotide
tagaatgcccgagtggagcttaaaattagaagtttggatg

SEQ ID NO: 292179 - DNA, 39 bp, Artificial Sequence
  Description of Artificial Sequence: Synthetic oligonucleotide
agaatgcccgagtggagcttaaaattagaagtttggatg

SEQ ID NO: 292180 - DNA, 38 bp, Artificial Sequence
  Description of Artificial Sequence: Synthetic oligonucleotide
gaatgcccgagtggagcttaaaattagaagtttggatg

SEQ ID NO: 292181 - DNA, 38 bp, Artificial Sequence
  Description of Artificial Sequence: Synthetic oligonucleotide
aatgcccgagtggagcttaaaattagaagtttggatgg

SEQ ID NO: 292182 - DNA, 37 bp, Artificial Sequence
  Description of Artificial Sequence: Synthetic oligonucleotide
atgcccgagtggagcttaaaattagaagtttggatgg

SEQ ID NO: 292183 - DNA, 36 bp, Artificial Sequence
  Description of Artificial Sequence: Synthetic oligonucleotide
tgcccgagtggagcttaaaattagaagtttggatgg

SEQ ID NO: 292184 - DNA, 35 bp, Artificial Sequence
  Description of Artificial Sequence: Synthetic oligonucleotide
gcccgagtggagcttaaaattagaagtttggatgg

SEQ ID NO: 292185 - DNA, 40 bp, Artificial Sequence
  Description of Artificial Sequence: Synthetic oligonucleotide
cccgagtggagcttaaaattagaagtttggatggaatttc

SEQ ID NO: 292186 - DNA, 42 bp, Artificial Sequence
  Description of Artificial Sequence: Synthetic oligonucleotide
ccgagtggagcttaaaattagaagtttggatggaatttcatc

SEQ ID NO: 292187 - DNA, 43 bp, Artificial Sequence
  Description of Artificial Sequence: Synthetic oligonucleotide
cgagtggagcttaaaattagaagtttggatggaatttcatcac

SEQ ID NO: 292188 - DNA, 45 bp, Artificial Sequence
  Description of Artificial Sequence: Synthetic oligonucleotide
gagtggagcttaaaattagaagtttggatggaatttcatcacttc

SEQ ID NO: 292189 - DNA, 46 bp, Artificial Sequence
  Description of Artificial Sequence: Synthetic oligonucleotide
agtggagcttaaaattagaagtttggatggaatttcatcacttctg

SEQ ID NO: 292190 - DNA, 45 bp, Artificial Sequence
  Description of Artificial Sequence: Synthetic oligonucleotide
gtggagcttaaaattagaagtttggatggaatttcatcacttctg

SEQ ID NO: 292191 - DNA, 47 bp, Artificial Sequence
  Description of Artificial Sequence: Synthetic oligonucleotide
tggagcttaaaattagaagtttggatggaatttcatcacttctgtac

SEQ ID NO: 292192 - DNA, 46 bp, Artificial Sequence
  Description of Artificial Sequence: Synthetic oligonucleotide
ggagcttaaaattagaagtttggatggaatttcatcacttctgtac

SEQ ID NO: 292193 - DNA, 49 bp, Artificial Sequence
  Description of Artificial Sequence: Synthetic oligonucleotide
gagcttaaaattagaagtttggatggaatttcatcacttctgtacatac

SEQ ID NO: 292194 - DNA, 49 bp, Artificial Sequence
  Description of Artificial Sequence: Synthetic oligonucleotide
agcttaaaattagaagtttggatggaatttcatcacttctgtacatacc

SEQ ID NO: 292195 - DNA, 48 bp, Artificial Sequence
  Description of Artificial Sequence: Synthetic oligonucleotide
gcttaaaattagaagtttggatggaatttcatcacttctgtacatacc

SEQ ID NO: 292196 - DNA, 49 bp, Artificial Sequence
  Description of Artificial Sequence: Synthetic oligonucleotide
cttaaaattagaagtttggatggaatttcatcacttctgtacataccac

SEQ ID NO: 292197 - DNA, 49 bp, Artificial Sequence
  Description of Artificial Sequence: Synthetic oligonucleotide
ttaaaattagaagtttggatggaatttcatcacttctgtacataccacc

SEQ ID NO: 292198 - DNA, 48 bp, Artificial Sequence
  Description of Artificial Sequence: Synthetic oligonucleotide
taaaattagaagtttggatggaatttcatcacttctgtacataccacc

SEQ ID NO: 292199 - DNA, 47 bp, Artificial Sequence
  Description of Artificial Sequence: Synthetic oligonucleotide
aaaattagaagtttggatggaatttcatcacttctgtacataccacc

SEQ ID NO: 292200 - DNA, 46 bp, Artificial Sequence
  Description of Artificial Sequence: Synthetic oligonucleotide
aaattagaagtttggatggaatttcatcacttctgtacataccacc

SEQ ID NO: 292201 - DNA, 45 bp, Artificial Sequence
  Description of Artificial Sequence: Synthetic oligonucleotide
aattagaagtttggatggaatttcatcacttctgtacataccacc

SEQ ID NO: 292202 - DNA, 44 bp, Artificial Sequence
  Description of Artificial Sequence: Synthetic oligonucleotide
attagaagtttggatggaatttcatcacttctgtacataccacc

SEQ ID NO: 292203 - DNA, 43 bp, Artificial Sequence
  Description of Artificial Sequence: Synthetic oligonucleotide
ttagaagtttggatggaatttcatcacttctgtacataccacc

SEQ ID NO: 292204 - DNA, 42 bp, Artificial Sequence
  Description of Artificial Sequence: Synthetic oligonucleotide
tagaagtttggatggaatttcatcacttctgtacataccacc

SEQ ID NO: 292205 - DNA, 41 bp, Artificial Sequence
  Description of Artificial Sequence: Synthetic oligonucleotide
agaagtttggatggaatttcatcacttctgtacataccacc

SEQ ID NO: 292206 - DNA, 40 bp, Artificial Sequence
  Description of Artificial Sequence: Synthetic oligonucleotide
gaagtttggatggaatttcatcacttctgtacataccacc

SEQ ID NO: 292207 - DNA, 41 bp, Artificial Sequence
  Description of Artificial Sequence: Synthetic oligonucleotide
aagtttggatggaatttcatcacttctgtacataccacctg

SEQ ID NO: 292208 - DNA, 40 bp, Artificial Sequence
  Description of Artificial Sequence: Synthetic oligonucleotide
agtttggatggaatttcatcacttctgtacataccacctg

SEQ ID NO: 292209 - DNA, 39 bp, Artificial Sequence
  Description of Artificial Sequence: Synthetic oligonucleotide
gtttggatggaatttcatcacttctgtacataccacctg

SEQ ID NO: 292210 - DNA, 40 bp, Artificial Sequence
  Description of Artificial Sequence: Synthetic oligonucleotide
tttggatggaatttcatcacttctgtacataccacctgtg

SEQ ID NO: 292211 - DNA, 39 bp, Artificial Sequence
  Description of Artificial Sequence: Synthetic oligonucleotide
ttggatggaatttcatcacttctgtacataccacctgtg

SEQ ID NO: 292212 - DNA, 38 bp, Artificial Sequence
  Description of Artificial Sequence: Synthetic oligonucleotide
tggatggaatttcatcacttctgtacataccacctgtg

SEQ ID NO: 292213 - DNA, 37 bp, Artificial Sequence
  Description of Artificial Sequence: Synthetic oligonucleotide
ggatggaatttcatcacttctgtacataccacctgtg

SEQ ID NO: 292214 - DNA, 37 bp, Artificial Sequence
  Description of Artificial Sequence: Synthetic oligonucleotide
gatggaatttcatcacttctgtacataccacctgtgc

SEQ ID NO: 292215 - DNA, 38 bp, Artificial Sequence
  Description of Artificial Sequence: Synthetic oligonucleotide
atggaatttcatcacttctgtacataccacctgtgcag

SEQ ID NO: 292216 - DNA, 37 bp, Artificial Sequence
  Description of Artificial Sequence: Synthetic oligonucleotide
tggaatttcatcacttctgtacataccacctgtgcag

SEQ ID NO: 292217 - DNA, 36 bp, Artificial Sequence
  Description of Artificial Sequence: Synthetic oligonucleotide
ggaatttcatcacttctgtacataccacctgtgcag

SEQ ID NO: 292218 - DNA, 36 bp, Artificial Sequence
  Description of Artificial Sequence: Synthetic oligonucleotide
gaatttcatcacttctgtacataccacctgtgcagc

SEQ ID NO: 292219 - DNA, 37 bp, Artificial Sequence
  Description of Artificial Sequence: Synthetic oligonucleotide
aatttcatcacttctgtacataccacctgtgcagcag

SEQ ID NO: 292220 - DNA, 36 bp, Artificial Sequence
  Description of Artificial Sequence: Synthetic oligonucleotide
atttcatcacttctgtacataccacctgtgcagcag

SEQ ID NO: 292221 - DNA, 35 bp, Artificial Sequence
  Description of Artificial Sequence: Synthetic oligonucleotide
tttcatcacttctgtacataccacctgtgcagcag

SEQ ID NO: 292222 - DNA, 34 bp, Artificial Sequence
  Description of Artificial Sequence: Synthetic oligonucleotide
ttcatcacttctgtacataccacctgtgcagcag

SEQ ID NO: 292223 - DNA, 33 bp, Artificial Sequence
  Description of Artificial Sequence: Synthetic oligonucleotide
tcatcacttctgtacataccacctgtgcagcag

SEQ ID NO: 292224 - DNA, 32 bp, Artificial Sequence
  Description of Artificial Sequence: Synthetic oligonucleotide
catcacttctgtacataccacctgtgcagcag

SEQ ID NO: 292225 - DNA, 33 bp, Artificial Sequence
  Description of Artificial Sequence: Synthetic oligonucleotide
atcacttctgtacataccacctgtgcagcagac

SEQ ID NO: 292226 - DNA, 32 bp, Artificial Sequence
  Description of Artificial Sequence: Synthetic oligonucleotide
tcacttctgtacataccacctgtgcagcagac

SEQ ID NO: 292227 - DNA, 31 bp, Artificial Sequence
  Description of Artificial Sequence: Synthetic oligonucleotide
cacttctgtacataccacctgtgcagcagac

SEQ ID NO: 292228 - DNA, 32 bp, Artificial Sequence
  Description of Artificial Sequence: Synthetic oligonucleotide
acttctgtacataccacctgtgcagcagacag

SEQ ID NO: 292229 - DNA, 31 bp, Artificial Sequence
  Description of Artificial Sequence: Synthetic oligonucleotide
cttctgtacataccacctgtgcagcagacag

SEQ ID NO: 292230 - DNA, 33 bp, Artificial Sequence
  Description of Artificial Sequence: Synthetic oligonucleotide
ttctgtacataccacctgtgcagcagacagatg

SEQ ID NO: 292231 - DNA, 32 bp, Artificial Sequence
  Description of Artificial Sequence: Synthetic oligonucleotide
tctgtacataccacctgtgcagcagacagatg

SEQ ID NO: 292232 - DNA, 31 bp, Artificial Sequence
  Description of Artificial Sequence: Synthetic oligonucleotide
ctgtacataccacctgtgcagcagacagatg

SEQ ID NO: 292233 - DNA, 32 bp, Artificial Sequence
  Description of Artificial Sequence: Synthetic oligonucleotide
tgtacataccacctgtgcagcagacagatgac

SEQ ID NO: 292234 - DNA, 31 bp, Artificial Sequence
  Description of Artificial Sequence: Synthetic oligonucleotide
gtacataccacctgtgcagcagacagatgac

SEQ ID NO: 292235 - DNA, 31 bp, Artificial Sequence
  Description of Artificial Sequence: Synthetic oligonucleotide
tacataccacctgtgcagcagacagatgacc

SEQ ID NO: 292236 - DNA, 30 bp, Artificial Sequence
  Description of Artificial Sequence: Synthetic oligonucleotide
acataccacctgtgcagcagacagatgacc

SEQ ID NO: 292237 - DNA, 29 bp, Artificial Sequence
  Description of Artificial Sequence: Synthetic oligonucleotide
cataccacctgtgcagcagacagatgacc

SEQ ID NO: 292238 - DNA, 31 bp, Artificial Sequence
  Description of Artificial Sequence: Synthetic oligonucleotide
ataccacctgtgcagcagacagatgaccttg

SEQ ID NO: 292239 - DNA, 30 bp, Artificial Sequence
  Description of Artificial Sequence: Synthetic oligonucleotide
taccacctgtgcagcagacagatgaccttg

SEQ ID NO: 292240 - DNA, 29 bp, Artificial Sequence
  Description of Artificial Sequence: Synthetic oligonucleotide
accacctgtgcagcagacagatgaccttg

SEQ ID NO: 292241 - DNA, 28 bp, Artificial Sequence
  Description of Artificial Sequence: Synthetic oligonucleotide
ccacctgtgcagcagacagatgaccttg

SEQ ID NO: 292242 - DNA, 29 bp, Artificial Sequence
  Description of Artificial Sequence: Synthetic oligonucleotide
cacctgtgcagcagacagatgaccttgtg

SEQ ID NO: 292243 - DNA, 30 bp, Artificial Sequence
  Description of Artificial Sequence: Synthetic oligonucleotide
acctgtgcagcagacagatgaccttgtgag

SEQ ID NO: 292244 - DNA, 29 bp, Artificial Sequence
  Description of Artificial Sequence: Synthetic oligonucleotide
cctgtgcagcagacagatgaccttgtgag

SEQ ID NO: 292245 - DNA, 29 bp, Artificial Sequence
  Description of Artificial Sequence: Synthetic oligonucleotide
ctgtgcagcagacagatgaccttgtgagg

SEQ ID NO: 292246 - DNA, 31 bp, Artificial Sequence
  Description of Artificial Sequence: Synthetic oligonucleotide
tgtgcagcagacagatgaccttgtgaggatg

SEQ ID NO: 292247 - DNA, 30 bp, Artificial Sequence
  Description of Artificial Sequence: Synthetic oligonucleotide
gtgcagcagacagatgaccttgtgaggatg

SEQ ID NO: 292248 - DNA, 31 bp, Artificial Sequence
  Description of Artificial Sequence: Synthetic oligonucleotide
tgcagcagacagatgaccttgtgaggatgag

SEQ ID NO: 292249 - DNA, 30 bp, Artificial Sequence
  Description of Artificial Sequence: Synthetic oligonucleotide
gcagcagacagatgaccttgtgaggatgag

SEQ ID NO: 292250 - DNA, 31 bp, Artificial Sequence
  Description of Artificial Sequence: Synthetic oligonucleotide
cagcagacagatgaccttgtgaggatgagag

SEQ ID NO: 292251 - DNA, 34 bp, Artificial Sequence
  Description of Artificial Sequence: Synthetic oligonucleotide
agcagacagatgaccttgtgaggatgagagaatc

SEQ ID NO: 292252 - DNA, 33 bp, Artificial Sequence
  Description of Artificial Sequence: Synthetic oligonucleotide
gcagacagatgaccttgtgaggatgagagaatc

SEQ ID NO: 292253 - DNA, 33 bp, Artificial Sequence
  Description of Artificial Sequence: Synthetic oligonucleotide
cagacagatgaccttgtgaggatgagagaatcc

SEQ ID NO: 292254 - DNA, 34 bp, Artificial Sequence
  Description of Artificial Sequence: Synthetic oligonucleotide
agacagatgaccttgtgaggatgagagaatcctg

SEQ ID NO: 292255 - DNA, 33 bp, Artificial Sequence
  Description of Artificial Sequence: Synthetic oligonucleotide
gacagatgaccttgtgaggatgagagaatcctg

SEQ ID NO: 292256 - DNA, 33 bp, Artificial Sequence
  Description of Artificial Sequence: Synthetic oligonucleotide
acagatgaccttgtgaggatgagagaatcctgc

SEQ ID NO: 292257 - DNA, 32 bp, Artificial Sequence
  Description of Artificial Sequence: Synthetic oligonucleotide
cagatgaccttgtgaggatgagagaatcctgc

SEQ ID NO: 292258 - DNA, 36 bp, Artificial Sequence
  Description of Artificial Sequence: Synthetic oligonucleotide
agatgaccttgtgaggatgagagaatcctgcttttc

SEQ ID NO: 292259 - DNA, 35 bp, Artificial Sequence
  Description of Artificial Sequence: Synthetic oligonucleotide
gatgaccttgtgaggatgagagaatcctgcttttc

SEQ ID NO: 292260 - DNA, 37 bp, Artificial Sequence
  Description of Artificial Sequence: Synthetic oligonucleotide
atgaccttgtgaggatgagagaatcctgcttttcttc

SEQ ID NO: 292261 - DNA, 36 bp, Artificial Sequence
  Description of Artificial Sequence: Synthetic oligonucleotide
tgaccttgtgaggatgagagaatcctgcttttcttc

SEQ ID NO: 292262 - DNA, 35 bp, Artificial Sequence
  Description of Artificial Sequence: Synthetic oligonucleotide
gaccttgtgaggatgagagaatcctgcttttcttc

SEQ ID NO: 292263 - DNA, 40 bp, Artificial Sequence
  Description of Artificial Sequence: Synthetic oligonucleotide
accttgtgaggatgagagaatcctgcttttcttctatatc

SEQ ID NO: 292264 - DNA, 39 bp, Artificial Sequence
  Description of Artificial Sequence: Synthetic oligonucleotide
ccttgtgaggatgagagaatcctgcttttcttctatatc

SEQ ID NO: 292265 - DNA, 40 bp, Artificial Sequence
  Description of Artificial Sequence: Synthetic oligonucleotide
cttgtgaggatgagagaatcctgcttttcttctatatctc

SEQ ID NO: 292266 - DNA, 40 bp, Artificial Sequence
  Description of Artificial Sequence: Synthetic oligonucleotide
ttgtgaggatgagagaatcctgcttttcttctatatctcg

SEQ ID NO: 292267 - DNA, 39 bp, Artificial Sequence
  Description of Artificial Sequence: Synthetic oligonucleotide
tgtgaggatgagagaatcctgcttttcttctatatctcg

SEQ ID NO: 292268 - DNA, 38 bp, Artificial Sequence
  Description of Artificial Sequence: Synthetic oligonucleotide
gtgaggatgagagaatcctgcttttcttctatatctcg

SEQ ID NO: 292269 - DNA, 38 bp, Artificial Sequence
  Description of Artificial Sequence: Synthetic oligonucleotide
tgaggatgagagaatcctgcttttcttctatatctcgg

SEQ ID NO: 292270 - DNA, 37 bp, Artificial Sequence
  Description of Artificial Sequence: Synthetic oligonucleotide
gaggatgagagaatcctgcttttcttctatatctcgg

SEQ ID NO: 292271 - DNA, 37 bp, Artificial Sequence
  Description of Artificial Sequence: Synthetic oligonucleotide
aggatgagagaatcctgcttttcttctatatctcggg

SEQ ID NO: 292272 - DNA, 36 bp, Artificial Sequence
  Description of Artificial Sequence: Synthetic oligonucleotide
ggatgagagaatcctgcttttcttctatatctcggg

SEQ ID NO: 292273 - DNA, 38 bp, Artificial Sequence
  Description of Artificial Sequence: Synthetic oligonucleotide
gatgagagaatcctgcttttcttctatatctcgggttc

SEQ ID NO: 292274 - DNA, 38 bp, Artificial Sequence
  Description of Artificial Sequence: Synthetic oligonucleotide
atgagagaatcctgcttttcttctatatctcgggttcc

SEQ ID NO: 292275 - DNA, 37 bp, Artificial Sequence
  Description of Artificial Sequence: Synthetic oligonucleotide
tgagagaatcctgcttttcttctatatctcgggttcc

SEQ ID NO: 292276 - DNA, 36 bp, Artificial Sequence
  Description of Artificial Sequence: Synthetic oligonucleotide
gagagaatcctgcttttcttctatatctcgggttcc

SEQ ID NO: 292277 - DNA, 37 bp, Artificial Sequence
  Description of Artificial Sequence: Synthetic oligonucleotide
agagaatcctgcttttcttctatatctcgggttccac

SEQ ID NO: 292278 - DNA, 36 bp, Artificial Sequence
  Description of Artificial Sequence: Synthetic oligonucleotide
gagaatcctgcttttcttctatatctcgggttccac

SEQ ID NO: 292279 - DNA, 37 bp, Artificial Sequence
  Description of Artificial Sequence: Synthetic oligonucleotide
agaatcctgcttttcttctatatctcgggttccactg

SEQ ID NO: 292280 - DNA, 36 bp, Artificial Sequence
  Description of Artificial Sequence: Synthetic oligonucleotide
gaatcctgcttttcttctatatctcgggttccactg

SEQ ID NO: 292281 - DNA, 36 bp, Artificial Sequence
  Description of Artificial Sequence: Synthetic oligonucleotide
aatcctgcttttcttctatatctcgggttccactgg

SEQ ID NO: 292282 - DNA, 35 bp, Artificial Sequence
  Description of Artificial Sequence: Synthetic oligonucleotide
atcctgcttttcttctatatctcgggttccactgg

SEQ ID NO: 292283 - DNA, 34 bp, Artificial Sequence
  Description of Artificial Sequence: Synthetic oligonucleotide
tcctgcttttcttctatatctcgggttccactgg

SEQ ID NO: 292284 - DNA, 33 bp, Artificial Sequence
  Description of Artificial Sequence: Synthetic oligonucleotide
cctgcttttcttctatatctcgggttccactgg

SEQ ID NO: 292285 - DNA, 34 bp, Artificial Sequence
  Description of Artificial Sequence: Synthetic oligonucleotide
ctgcttttcttctatatctcgggttccactggac

SEQ ID NO: 292286 - DNA, 34 bp, Artificial Sequence
  Description of Artificial Sequence: Synthetic oligonucleotide
tgcttttcttctatatctcgggttccactggacc

SEQ ID NO: 292287 - DNA, 33 bp, Artificial Sequence
  Description of Artificial Sequence: Synthetic oligonucleotide
gcttttcttctatatctcgggttccactggacc

SEQ ID NO: 292288 - DNA, 34 bp, Artificial Sequence
  Description of Artificial Sequence: Synthetic oligonucleotide
cttttcttctatatctcgggttccactggacctc

SEQ ID NO: 292289 - DNA, 36 bp, Artificial Sequence
  Description of Artificial Sequence: Synthetic oligonucleotide
ttttcttctatatctcgggttccactggacctcttc

SEQ ID NO: 292290 - DNA, 35 bp, Artificial Sequence
  Description of Artificial Sequence: Synthetic oligonucleotide
tttcttctatatctcgggttccactggacctcttc

SEQ ID NO: 292291 - DNA, 34 bp, Artificial Sequence
  Description of Artificial Sequence: Synthetic oligonucleotide
ttcttctatatctcgggttccactggacctcttc

SEQ ID NO: 292292 - DNA, 33 bp, Artificial Sequence
  Description of Artificial Sequence: Synthetic oligonucleotide
tcttctatatctcgggttccactggacctcttc

SEQ ID NO: 292293 - DNA, 32 bp, Artificial Sequence
  Description of Artificial Sequence: Synthetic oligonucleotide
cttctatatctcgggttccactggacctcttc

SEQ ID NO: 292294 - DNA, 32 bp, Artificial Sequence
  Description of Artificial Sequence: Synthetic oligonucleotide
ttctatatctcgggttccactggacctcttcc

SEQ ID NO: 292295 - DNA, 31 bp, Artificial Sequence
  Description of Artificial Sequence: Synthetic oligonucleotide
tctatatctcgggttccactggacctcttcc

SEQ ID NO: 292296 - DNA, 30 bp, Artificial Sequence
  Description of Artificial Sequence: Synthetic oligonucleotide
ctatatctcgggttccactggacctcttcc

SEQ ID NO: 292297 - DNA, 30 bp, Artificial Sequence
  Description of Artificial Sequence: Synthetic oligonucleotide
tatatctcgggttccactggacctcttccg

SEQ ID NO: 292298 - DNA, 29 bp, Artificial Sequence
  Description of Artificial Sequence: Synthetic oligonucleotide
atatctcgggttccactggacctcttccg

SEQ ID NO: 292299 - DNA, 28 bp, Artificial Sequence
  Description of Artificial Sequence: Synthetic oligonucleotide
tatctcgggttccactggacctcttccg

SEQ ID NO: 292300 - DNA, 27 bp, Artificial Sequence
  Description of Artificial Sequence: Synthetic oligonucleotide
atctcgggttccactggacctcttccg

SEQ ID NO: 292301 - DNA, 27 bp, Artificial Sequence
  Description of Artificial Sequence: Synthetic oligonucleotide
tctcgggttccactggacctcttccgt

SEQ ID NO: 292302 - DNA, 26 bp, Artificial Sequence
  Description of Artificial Sequence: Synthetic oligonucleotide
ctcgggttccactggacctcttccgt

SEQ ID NO: 292303 - DNA, 26 bp, Artificial Sequence
  Description of Artificial Sequence: Synthetic oligonucleotide
tcgggttccactggacctcttccgtc

SEQ ID NO: 292304 - DNA, 25 bp, Artificial Sequence
  Description of Artificial Sequence: Synthetic oligonucleotide
cgggttccactggacctcttccgtc

SEQ ID NO: 292305 - DNA, 25 bp, Artificial Sequence
  Description of Artificial Sequence: Synthetic oligonucleotide
gggttccactggacctcttccgtcg

SEQ ID NO: 292306 - DNA, 27 bp, Artificial Sequence
  Description of Artificial Sequence: Synthetic oligonucleotide
ggttccactggacctcttccgtcgcat

SEQ ID NO: 292307 - DNA, 29 bp, Artificial Sequence
  Description of Artificial Sequence: Synthetic oligonucleotide
gttccactggacctcttccgtcgcattag

SEQ ID NO: 292308 - DNA, 31 bp, Artificial Sequence
  Description of Artificial Sequence: Synthetic oligonucleotide
ttccactggacctcttccgtcgcattagtac

SEQ ID NO: 292309 - DNA, 30 bp, Artificial Sequence
  Description of Artificial Sequence: Synthetic oligonucleotide
tccactggacctcttccgtcgcattagtac

SEQ ID NO: 292310 - DNA, 29 bp, Artificial Sequence
  Description of Artificial Sequence: Synthetic oligonucleotide
ccactggacctcttccgtcgcattagtac

SEQ ID NO: 292311 - DNA, 30 bp, Artificial Sequence
  Description of Artificial Sequence: Synthetic oligonucleotide
cactggacctcttccgtcgcattagtactc

SEQ ID NO: 292312 - DNA, 31 bp, Artificial Sequence
  Description of Artificial Sequence: Synthetic oligonucleotide
actggacctcttccgtcgcattagtactcag

SEQ ID NO: 292313 - DNA, 30 bp, Artificial Sequence
  Description of Artificial Sequence: Synthetic oligonucleotide
ctggacctcttccgtcgcattagtactcag

SEQ ID NO: 292314 - DNA, 30 bp, Artificial Sequence
  Description of Artificial Sequence: Synthetic oligonucleotide
tggacctcttccgtcgcattagtactcagc

SEQ ID NO: 292315 - DNA, 29 bp, Artificial Sequence
  Description of Artificial Sequence: Synthetic oligonucleotide
ggacctcttccgtcgcattagtactcagc

SEQ ID NO: 292316 - DNA, 29 bp, Artificial Sequence
  Description of Artificial Sequence: Synthetic oligonucleotide
gacctcttccgtcgcattagtactcagcc

SEQ ID NO: 292317 - DNA, 29 bp, Artificial Sequence
  Description of Artificial Sequence: Synthetic oligonucleotide
acctcttccgtcgcattagtactcagccc

SEQ ID NO: 292318 - DNA, 28 bp, Artificial Sequence
  Description of Artificial Sequence: Synthetic oligonucleotide
cctcttccgtcgcattagtactcagccc

SEQ ID NO: 292319 - DNA, 30 bp, Artificial Sequence
  Description of Artificial Sequence: Synthetic oligonucleotide
ctcttccgtcgcattagtactcagcccttg

SEQ ID NO: 292320 - DNA, 30 bp, Artificial Sequence
  Description of Artificial Sequence: Synthetic oligonucleotide
tcttccgtcgcattagtactcagcccttgc

SEQ ID NO: 292321 - DNA, 29 bp, Artificial Sequence
  Description of Artificial Sequence: Synthetic oligonucleotide
cttccgtcgcattagtactcagcccttgc

SEQ ID NO: 292322 - DNA, 29 bp, Artificial Sequence
  Description of Artificial Sequence: Synthetic oligonucleotide
ttccgtcgcattagtactcagcccttgcc

SEQ ID NO: 292323 - DNA, 28 bp, Artificial Sequence
  Description of Artificial Sequence: Synthetic oligonucleotide
tccgtcgcattagtactcagcccttgcc

SEQ ID NO: 292324 - DNA, 27 bp, Artificial Sequence
  Description of Artificial Sequence: Synthetic oligonucleotide
ccgtcgcattagtactcagcccttgcc

SEQ ID NO: 292325 - DNA, 28 bp, Artificial Sequence
  Description of Artificial Sequence: Synthetic oligonucleotide
cgtcgcattagtactcagcccttgcctg

SEQ ID NO: 292326 - DNA, 30 bp, Artificial Sequence
  Description of Artificial Sequence: Synthetic oligonucleotide
gtcgcattagtactcagcccttgcctgaac

SEQ ID NO: 292327 - DNA, 32 bp, Artificial Sequence
  Description of Artificial Sequence: Synthetic oligonucleotide
tcgcattagtactcagcccttgcctgaactag

SEQ ID NO: 292328 - DNA, 31 bp, Artificial Sequence
  Description of Artificial Sequence: Synthetic oligonucleotide
cgcattagtactcagcccttgcctgaactag

SEQ ID NO: 292329 - DNA, 32 bp, Artificial Sequence
  Description of Artificial Sequence: Synthetic oligonucleotide
gcattagtactcagcccttgcctgaactagac

SEQ ID NO: 292330 - DNA, 33 bp, Artificial Sequence
  Description of Artificial Sequence: Synthetic oligonucleotide
cattagtactcagcccttgcctgaactagactg

SEQ ID NO: 292331 - DNA, 34 bp, Artificial Sequence
  Description of Artificial Sequence: Synthetic oligonucleotide
attagtactcagcccttgcctgaactagactgtg

SEQ ID NO: 292332 - DNA, 33 bp, Artificial Sequence
  Description of Artificial Sequence: Synthetic oligonucleotide
ttagtactcagcccttgcctgaactagactgtg

SEQ ID NO: 292333 - DNA, 32 bp, Artificial Sequence
  Description of Artificial Sequence: Synthetic oligonucleotide
tagtactcagcccttgcctgaactagactgtg

SEQ ID NO: 292334 - DNA, 31 bp, Artificial Sequence
  Description of Artificial Sequence: Synthetic oligonucleotide
agtactcagcccttgcctgaactagactgtg

SEQ ID NO: 292335 - DNA, 30 bp, Artificial Sequence
  Description of Artificial Sequence: Synthetic oligonucleotide
gtactcagcccttgcctgaactagactgtg

SEQ ID NO: 292336 - DNA, 30 bp, Artificial Sequence
  Description of Artificial Sequence: Synthetic oligonucleotide
tactcagcccttgcctgaactagactgtgc

SEQ ID NO: 292337 - DNA, 29 bp, Artificial Sequence
  Description of Artificial Sequence: Synthetic oligonucleotide
actcagcccttgcctgaactagactgtgc

SEQ ID NO: 292338 - DNA, 28 bp, Artificial Sequence
  Description of Artificial Sequence: Synthetic oligonucleotide
ctcagcccttgcctgaactagactgtgc

SEQ ID NO: 292339 - DNA, 29 bp, Artificial Sequence
  Description of Artificial Sequence: Synthetic oligonucleotide
tcagcccttgcctgaactagactgtgctg

SEQ ID NO: 292340 - DNA, 28 bp, Artificial Sequence
  Description of Artificial Sequence: Synthetic oligonucleotide
cagcccttgcctgaactagactgtgctg

SEQ ID NO: 292341 - DNA, 28 bp, Artificial Sequence
  Description of Artificial Sequence: Synthetic oligonucleotide
agcccttgcctgaactagactgtgctgg

SEQ ID NO: 292342 - DNA, 27 bp, Artificial Sequence
  Description of Artificial Sequence: Synthetic oligonucleotide
gcccttgcctgaactagactgtgctgg

SEQ ID NO: 292343 - DNA, 27 bp, Artificial Sequence
  Description of Artificial Sequence: Synthetic oligonucleotide
cccttgcctgaactagactgtgctggc

SEQ ID NO: 292344 - DNA, 33 bp, Artificial Sequence
  Description of Artificial Sequence: Synthetic oligonucleotide
ccttgcctgaactagactgtgctggcttaaaag

SEQ ID NO: 292345 - DNA, 34 bp, Artificial Sequence
  Description of Artificial Sequence: Synthetic oligonucleotide
cttgcctgaactagactgtgctggcttaaaagtc

SEQ ID NO: 292346 - DNA, 38 bp, Artificial Sequence
  Description of Artificial Sequence: Synthetic oligonucleotide
ttgcctgaactagactgtgctggcttaaaagtctttac

SEQ ID NO: 292347 - DNA, 37 bp, Artificial Sequence
  Description of Artificial Sequence: Synthetic oligonucleotide
tgcctgaactagactgtgctggcttaaaagtctttac

SEQ ID NO: 292348 - DNA, 36 bp, Artificial Sequence
  Description of Artificial Sequence: Synthetic oligonucleotide
gcctgaactagactgtgctggcttaaaagtctttac

SEQ ID NO: 292349 - DNA, 36 bp, Artificial Sequence
  Description of Artificial Sequence: Synthetic oligonucleotide
cctgaactagactgtgctggcttaaaagtctttacg

SEQ ID NO: 292350 - DNA, 36 bp, Artificial Sequence
  Description of Artificial Sequence: Synthetic oligonucleotide
ctgaactagactgtgctggcttaaaagtctttacgg

SEQ ID NO: 292351 - DNA, 36 bp, Artificial Sequence
  Description of Artificial Sequence: Synthetic oligonucleotide
tgaactagactgtgctggcttaaaagtctttacggc

SEQ ID NO: 292352 - DNA, 35 bp, Artificial Sequence
  Description of Artificial Sequence: Synthetic oligonucleotide
gaactagactgtgctggcttaaaagtctttacggc

SEQ ID NO: 292353 - DNA, 35 bp, Artificial Sequence
  Description of Artificial Sequence: Synthetic oligonucleotide
aactagactgtgctggcttaaaagtctttacggcc

SEQ ID NO: 292354 - DNA, 34 bp, Artificial Sequence
  Description of Artificial Sequence: Synthetic oligonucleotide
actagactgtgctggcttaaaagtctttacggcc

SEQ ID NO: 292355 - DNA, 33 bp, Artificial Sequence
  Description of Artificial Sequence: Synthetic oligonucleotide
ctagactgtgctggcttaaaagtctttacggcc

SEQ ID NO: 292356 - DNA, 36 bp, Artificial Sequence
  Description of Artificial Sequence: Synthetic oligonucleotide
tagactgtgctggcttaaaagtctttacggcctttg

SEQ ID NO: 292357 - DNA, 35 bp, Artificial Sequence
  Description of Artificial Sequence: Synthetic oligonucleotide
agactgtgctggcttaaaagtctttacggcctttg

SEQ ID NO: 292358 - DNA, 34 bp, Artificial Sequence
  Description of Artificial Sequence: Synthetic oligonucleotide
gactgtgctggcttaaaagtctttacggcctttg

SEQ ID NO: 292359 - DNA, 34 bp, Artificial Sequence
  Description of Artificial Sequence: Synthetic oligonucleotide
actgtgctggcttaaaagtctttacggcctttgc

SEQ ID NO: 292360 - DNA, 33 bp, Artificial Sequence
  Description of Artificial Sequence: Synthetic oligonucleotide
ctgtgctggcttaaaagtctttacggcctttgc

SEQ ID NO: 292361 - DNA, 36 bp, Artificial Sequence
  Description of Artificial Sequence: Synthetic oligonucleotide
tgtgctggcttaaaagtctttacggcctttgcaaac

SEQ ID NO: 292362 - DNA, 35 bp, Artificial Sequence
  Description of Artificial Sequence: Synthetic oligonucleotide
gtgctggcttaaaagtctttacggcctttgcaaac

SEQ ID NO: 292363 - DNA, 35 bp, Artificial Sequence
  Description of Artificial Sequence: Synthetic oligonucleotide
tgctggcttaaaagtctttacggcctttgcaaacc

SEQ ID NO: 292364 - DNA, 34 bp, Artificial Sequence
  Description of Artificial Sequence: Synthetic oligonucleotide
gctggcttaaaagtctttacggcctttgcaaacc

SEQ ID NO: 292365 - DNA, 36 bp, Artificial Sequence
  Description of Artificial Sequence: Synthetic oligonucleotide
ctggcttaaaagtctttacggcctttgcaaacctac

SEQ ID NO: 292366 - DNA, 36 bp, Artificial Sequence
  Description of Artificial Sequence: Synthetic oligonucleotide
tggcttaaaagtctttacggcctttgcaaacctacc

SEQ ID NO: 292367 - DNA, 35 bp, Artificial Sequence
  Description of Artificial Sequence: Synthetic oligonucleotide
ggcttaaaagtctttacggcctttgcaaacctacc

SEQ ID NO: 292368 - DNA, 35 bp, Artificial Sequence
  Description of Artificial Sequence: Synthetic oligonucleotide
gcttaaaagtctttacggcctttgcaaacctaccc

SEQ ID NO: 292369 - DNA, 36 bp, Artificial Sequence
  Description of Artificial Sequence: Synthetic oligonucleotide
cttaaaagtctttacggcctttgcaaacctaccctg

SEQ ID NO: 292370 - DNA, 36 bp, Artificial Sequence
  Description of Artificial Sequence: Synthetic oligonucleotide
ttaaaagtctttacggcctttgcaaacctaccctgg

SEQ ID NO: 292371 - DNA, 35 bp, Artificial Sequence
  Description of Artificial Sequence: Synthetic oligonucleotide
taaaagtctttacggcctttgcaaacctaccctgg

SEQ ID NO: 292372 - DNA, 34 bp, Artificial Sequence
  Description of Artificial Sequence: Synthetic oligonucleotide
aaaagtctttacggcctttgcaaacctaccctgg

SEQ ID NO: 292373 - DNA, 33 bp, Artificial Sequence
  Description of Artificial Sequence: Synthetic oligonucleotide
aaagtctttacggcctttgcaaacctaccctgg

SEQ ID NO: 292374 - DNA, 32 bp, Artificial Sequence
  Description of Artificial Sequence: Synthetic oligonucleotide
aagtctttacggcctttgcaaacctaccctgg

SEQ ID NO: 292375 - DNA, 31 bp, Artificial Sequence
  Description of Artificial Sequence: Synthetic oligonucleotide
agtctttacggcctttgcaaacctaccctgg

SEQ ID NO: 292376 - DNA, 30 bp, Artificial Sequence
  Description of Artificial Sequence: Synthetic oligonucleotide
gtctttacggcctttgcaaacctaccctgg

SEQ ID NO: 292377 - DNA, 30 bp, Artificial Sequence
  Description of Artificial Sequence: Synthetic oligonucleotide
tctttacggcctttgcaaacctaccctggg

SEQ ID NO: 292378 - DNA, 29 bp, Artificial Sequence
  Description of Artificial Sequence: Synthetic oligonucleotide
ctttacggcctttgcaaacctaccctggg

SEQ ID NO: 292379 - DNA, 29 bp, Artificial Sequence
  Description of Artificial Sequence: Synthetic oligonucleotide
tttacggcctttgcaaacctaccctgggc

SEQ ID NO: 292380 - DNA, 28 bp, Artificial Sequence
  Description of Artificial Sequence: Synthetic oligonucleotide
ttacggcctttgcaaacctaccctgggc

SEQ ID NO: 292381 - DNA, 27 bp, Artificial Sequence
  Description of Artificial Sequence: Synthetic oligonucleotide
tacggcctttgcaaacctaccctgggc

SEQ ID NO: 292382 - DNA, 27 bp, Artificial Sequence
  Description of Artificial Sequence: Synthetic oligonucleotide
acggcctttgcaaacctaccctgggca

SEQ ID NO: 292383 - DNA, 26 bp, Artificial Sequence
  Description of Artificial Sequence: Synthetic oligonucleotide
cggcctttgcaaacctaccctgggca

SEQ ID NO: 292384 - DNA, 27 bp, Artificial Sequence
  Description of Artificial Sequence: Synthetic oligonucleotide
ggcctttgcaaacctaccctgggcaca

SEQ ID NO: 292385 - DNA, 27 bp, Artificial Sequence
  Description of Artificial Sequence: Synthetic oligonucleotide
gcctttgcaaacctaccctgggcacag

SEQ ID NO: 292386 - DNA, 30 bp, Artificial Sequence
  Description of Artificial Sequence: Synthetic oligonucleotide
cctttgcaaacctaccctgggcacagaaac

SEQ ID NO: 292387 - DNA, 34 bp, Artificial Sequence
  Description of Artificial Sequence: Synthetic oligonucleotide
ctttgcaaacctaccctgggcacagaaacttttg

SEQ ID NO: 292388 - DNA, 39 bp, Artificial Sequence
  Description of Artificial Sequence: Synthetic oligonucleotide
tttgcaaacctaccctgggcacagaaacttttgtttaac

SEQ ID NO: 292389 - DNA, 38 bp, Artificial Sequence
  Description of Artificial Sequence: Synthetic oligonucleotide
ttgcaaacctaccctgggcacagaaacttttgtttaac

SEQ ID NO: 292390 - DNA, 37 bp, Artificial Sequence
  Description of Artificial Sequence: Synthetic oligonucleotide
tgcaaacctaccctgggcacagaaacttttgtttaac

SEQ ID NO: 292391 - DNA, 36 bp, Artificial Sequence
  Description of Artificial Sequence: Synthetic oligonucleotide
gcaaacctaccctgggcacagaaacttttgtttaac

SEQ ID NO: 292392 - DNA, 37 bp, Artificial Sequence
  Description of Artificial Sequence: Synthetic oligonucleotide
caaacctaccctgggcacagaaacttttgtttaacac

SEQ ID NO: 292393 - DNA, 38 bp, Artificial Sequence
  Description of Artificial Sequence: Synthetic oligonucleotide
aaacctaccctgggcacagaaacttttgtttaacactc

SEQ ID NO: 292394 - DNA, 37 bp, Artificial Sequence
  Description of Artificial Sequence: Synthetic oligonucleotide
aacctaccctgggcacagaaacttttgtttaacactc

SEQ ID NO: 292395 - DNA, 36 bp, Artificial Sequence
  Description of Artificial Sequence: Synthetic oligonucleotide
acctaccctgggcacagaaacttttgtttaacactc

SEQ ID NO: 292396 - DNA, 35 bp, Artificial Sequence
  Description of Artificial Sequence: Synthetic oligonucleotide
cctaccctgggcacagaaacttttgtttaacactc

SEQ ID NO: 292397 - DNA, 35 bp, Artificial Sequence
  Description of Artificial Sequence: Synthetic oligonucleotide
ctaccctgggcacagaaacttttgtttaacactcc

SEQ ID NO: 292398 - DNA, 36 bp, Artificial Sequence
  Description of Artificial Sequence: Synthetic oligonucleotide
taccctgggcacagaaacttttgtttaacactccag

SEQ ID NO: 292399 - DNA, 35 bp, Artificial Sequence
  Description of Artificial Sequence: Synthetic oligonucleotide
accctgggcacagaaacttttgtttaacactccag

SEQ ID NO: 292400 - DNA, 34 bp, Artificial Sequence
  Description of Artificial Sequence: Synthetic oligonucleotide
ccctgggcacagaaacttttgtttaacactccag

SEQ ID NO: 292401 - DNA, 34 bp, Artificial Sequence
  Description of Artificial Sequence: Synthetic oligonucleotide
cctgggcacagaaacttttgtttaacactccagg

SEQ ID NO: 292402 - DNA, 38 bp, Artificial Sequence
  Description of Artificial Sequence: Synthetic oligonucleotide
ctgggcacagaaacttttgtttaacactccaggtttag

SEQ ID NO: 292403 - DNA, 40 bp, Artificial Sequence
  Description of Artificial Sequence: Synthetic oligonucleotide
tgggcacagaaacttttgtttaacactccaggtttagtag

SEQ ID NO: 292404 - DNA, 39 bp, Artificial Sequence
  Description of Artificial Sequence: Synthetic oligonucleotide
gggcacagaaacttttgtttaacactccaggtttagtag

SEQ ID NO: 292405 - DNA, 44 bp, Artificial Sequence
  Description of Artificial Sequence: Synthetic oligonucleotide
ggcacagaaacttttgtttaacactccaggtttagtagaatatc

SEQ ID NO: 292406 - DNA, 45 bp, Artificial Sequence
  Description of Artificial Sequence: Synthetic oligonucleotide
gcacagaaacttttgtttaacactccaggtttagtagaatatctg

SEQ ID NO: 292407 - DNA, 45 bp, Artificial Sequence
  Description of Artificial Sequence: Synthetic oligonucleotide
cacagaaacttttgtttaacactccaggtttagtagaatatctgg

SEQ ID NO: 292408 - DNA, 46 bp, Artificial Sequence
  Description of Artificial Sequence: Synthetic oligonucleotide
acagaaacttttgtttaacactccaggtttagtagaatatctggtg

SEQ ID NO: 292409 - DNA, 45 bp, Artificial Sequence
  Description of Artificial Sequence: Synthetic oligonucleotide
cagaaacttttgtttaacactccaggtttagtagaatatctggtg

SEQ ID NO: 292410 - DNA, 45 bp, Artificial Sequence
  Description of Artificial Sequence: Synthetic oligonucleotide
agaaacttttgtttaacactccaggtttagtagaatatctggtgg

SEQ ID NO: 292411 - DNA, 44 bp, Artificial Sequence
  Description of Artificial Sequence: Synthetic oligonucleotide
gaaacttttgtttaacactccaggtttagtagaatatctggtgg

SEQ ID NO: 292412 - DNA, 45 bp, Artificial Sequence
  Description of Artificial Sequence: Synthetic oligonucleotide
aaacttttgtttaacactccaggtttagtagaatatctggtggac

SEQ ID NO: 292413 - DNA, 44 bp, Artificial Sequence
  Description of Artificial Sequence: Synthetic oligonucleotide
aacttttgtttaacactccaggtttagtagaatatctggtggac

SEQ ID NO: 292414 - DNA, 43 bp, Artificial Sequence
  Description of Artificial Sequence: Synthetic oligonucleotide
acttttgtttaacactccaggtttagtagaatatctggtggac

SEQ ID NO: 292415 - DNA, 42 bp, Artificial Sequence
  Description of Artificial Sequence: Synthetic oligonucleotide
cttttgtttaacactccaggtttagtagaatatctggtggac

SEQ ID NO: 292416 - DNA, 42 bp, Artificial Sequence
  Description of Artificial Sequence: Synthetic oligonucleotide
ttttgtttaacactccaggtttagtagaatatctggtggacc

SEQ ID NO: 292417 - DNA, 41 bp, Artificial Sequence
  Description of Artificial Sequence: Synthetic oligonucleotide
tttgtttaacactccaggtttagtagaatatctggtggacc

SEQ ID NO: 292418 - DNA, 40 bp, Artificial Sequence
  Description of Artificial Sequence: Synthetic oligonucleotide
ttgtttaacactccaggtttagtagaatatctggtggacc

SEQ ID NO: 292419 - DNA, 39 bp, Artificial Sequence
  Description of Artificial Sequence: Synthetic oligonucleotide
tgtttaacactccaggtttagtagaatatctggtggacc

SEQ ID NO: 292420 - DNA, 38 bp, Artificial Sequence
  Description of Artificial Sequence: Synthetic oligonucleotide
gtttaacactccaggtttagtagaatatctggtggacc

SEQ ID NO: 292421 - DNA, 38 bp, Artificial Sequence
  Description of Artificial Sequence: Synthetic oligonucleotide
tttaacactccaggtttagtagaatatctggtggaccc

SEQ ID NO: 292422 - DNA, 37 bp, Artificial Sequence
  Description of Artificial Sequence: Synthetic oligonucleotide
ttaacactccaggtttagtagaatatctggtggaccc

SEQ ID NO: 292423 - DNA, 36 bp, Artificial Sequence
  Description of Artificial Sequence: Synthetic oligonucleotide
taacactccaggtttagtagaatatctggtggaccc

SEQ ID NO: 292424 - DNA, 35 bp, Artificial Sequence
  Description of Artificial Sequence: Synthetic oligonucleotide
aacactccaggtttagtagaatatctggtggaccc

SEQ ID NO: 292425 - DNA, 34 bp, Artificial Sequence
  Description of Artificial Sequence: Synthetic oligonucleotide
acactccaggtttagtagaatatctggtggaccc

SEQ ID NO: 292426 - DNA, 33 bp, Artificial Sequence
  Description of Artificial Sequence: Synthetic oligonucleotide
cactccaggtttagtagaatatctggtggaccc

SEQ ID NO: 292427 - DNA, 33 bp, Artificial Sequence
  Description of Artificial Sequence: Synthetic oligonucleotide
actccaggtttagtagaatatctggtggacccg

SEQ ID NO: 292428 - DNA, 32 bp, Artificial Sequence
  Description of Artificial Sequence: Synthetic oligonucleotide
ctccaggtttagtagaatatctggtggacccg

SEQ ID NO: 292429 - DNA, 33 bp, Artificial Sequence
  Description of Artificial Sequence: Synthetic oligonucleotide
tccaggtttagtagaatatctggtggacccgtc

SEQ ID NO: 292430 - DNA, 32 bp, Artificial Sequence
  Description of Artificial Sequence: Synthetic oligonucleotide
ccaggtttagtagaatatctggtggacccgtc

SEQ ID NO: 292431 - DNA, 33 bp, Artificial Sequence
  Description of Artificial Sequence: Synthetic oligonucleotide
caggtttagtagaatatctggtggacccgtctg

SEQ ID NO: 292432 - DNA, 34 bp, Artificial Sequence
  Description of Artificial Sequence: Synthetic oligonucleotide
aggtttagtagaatatctggtggacccgtctgtg

SEQ ID NO: 292433 - DNA, 33 bp, Artificial Sequence
  Description of Artificial Sequence: Synthetic oligonucleotide
ggtttagtagaatatctggtggacccgtctgtg

SEQ ID NO: 292434 - DNA, 33 bp, Artificial Sequence
  Description of Artificial Sequence: Synthetic oligonucleotide
gtttagtagaatatctggtggacccgtctgtgg

SEQ ID NO: 292435 - DNA, 34 bp, Artificial Sequence
  Description of Artificial Sequence: Synthetic oligonucleotide
tttagtagaatatctggtggacccgtctgtggac

SEQ ID NO: 292436 - DNA, 33 bp, Artificial Sequence
  Description of Artificial Sequence: Synthetic oligonucleotide
ttagtagaatatctggtggacccgtctgtggac

SEQ ID NO: 292437 - DNA, 32 bp, Artificial Sequence
  Description of Artificial Sequence: Synthetic oligonucleotide
tagtagaatatctggtggacccgtctgtggac

SEQ ID NO: 292438 - DNA, 31 bp, Artificial Sequence
  Description of Artificial Sequence: Synthetic oligonucleotide
agtagaatatctggtggacccgtctgtggac

SEQ ID NO: 292439 - DNA, 30 bp, Artificial Sequence
  Description of Artificial Sequence: Synthetic oligonucleotide
gtagaatatctggtggacccgtctgtggac

SEQ ID NO: 292440 - DNA, 30 bp, Artificial Sequence
  Description of Artificial Sequence: Synthetic oligonucleotide
tagaatatctggtggacccgtctgtggacc

SEQ ID NO: 292441 - DNA, 29 bp, Artificial Sequence
  Description of Artificial Sequence: Synthetic oligonucleotide
agaatatctggtggacccgtctgtggacc

SEQ ID NO: 292442 - DNA, 28 bp, Artificial Sequence
  Description of Artificial Sequence: Synthetic oligonucleotide
gaatatctggtggacccgtctgtggacc

SEQ ID NO: 292443 - DNA, 30 bp, Artificial Sequence
  Description of Artificial Sequence: Synthetic oligonucleotide
aatatctggtggacccgtctgtggaccatg

SEQ ID NO: 292444 - DNA, 29 bp, Artificial Sequence
  Description of Artificial Sequence: Synthetic oligonucleotide
atatctggtggacccgtctgtggaccatg

SEQ ID NO: 292445 - DNA, 28 bp, Artificial Sequence
  Description of Artificial Sequence: Synthetic oligonucleotide
tatctggtggacccgtctgtggaccatg

SEQ ID NO: 292446 - DNA, 27 bp, Artificial Sequence
  Description of Artificial Sequence: Synthetic oligonucleotide
atctggtggacccgtctgtggaccatg

SEQ ID NO: 292447 - DNA, 27 bp, Artificial Sequence
  Description of Artificial Sequence: Synthetic oligonucleotide
tctggtggacccgtctgtggaccatga

SEQ ID NO: 292448 - DNA, 26 bp, Artificial Sequence
  Description of Artificial Sequence: Synthetic oligonucleotide
ctggtggacccgtctgtggaccatga

SEQ ID NO: 292449 - DNA, 27 bp, Artificial Sequence
  Description of Artificial Sequence: Synthetic oligonucleotide
tggtggacccgtctgtggaccatgaca

SEQ ID NO: 292450 - DNA, 27 bp, Artificial Sequence
  Description of Artificial Sequence: Synthetic oligonucleotide
ggtggacccgtctgtggaccatgacaa

SEQ ID NO: 292451 - DNA, 28 bp, Artificial Sequence
  Description of Artificial Sequence: Synthetic oligonucleotide
gtggacccgtctgtggaccatgacaaac

SEQ ID NO: 292452 - DNA, 28 bp, Artificial Sequence
  Description of Artificial Sequence: Synthetic oligonucleotide
tggacccgtctgtggaccatgacaaacc

SEQ ID NO: 292453 - DNA, 27 bp, Artificial Sequence
  Description of Artificial Sequence: Synthetic oligonucleotide
ggacccgtctgtggaccatgacaaacc

SEQ ID NO: 292454 - DNA, 29 bp, Artificial Sequence
  Description of Artificial Sequence: Synthetic oligonucleotide
gacccgtctgtggaccatgacaaaccttc

SEQ ID NO: 292455 - DNA, 32 bp, Artificial Sequence
  Description of Artificial Sequence: Synthetic oligonucleotide
acccgtctgtggaccatgacaaaccttcaaag

SEQ ID NO: 292456 - DNA, 31 bp, Artificial Sequence
  Description of Artificial Sequence: Synthetic oligonucleotide
cccgtctgtggaccatgacaaaccttcaaag

SEQ ID NO: 292457 - DNA, 31 bp, Artificial Sequence
  Description of Artificial Sequence: Synthetic oligonucleotide
ccgtctgtggaccatgacaaaccttcaaagg

SEQ ID NO: 292458 - DNA, 33 bp, Artificial Sequence
  Description of Artificial Sequence: Synthetic oligonucleotide
cgtctgtggaccatgacaaaccttcaaaggttg

SEQ ID NO: 292459 - DNA, 33 bp, Artificial Sequence
  Description of Artificial Sequence: Synthetic oligonucleotide
gtctgtggaccatgacaaaccttcaaaggttgc

SEQ ID NO: 292460 - DNA, 33 bp, Artificial Sequence
  Description of Artificial Sequence: Synthetic oligonucleotide
tctgtggaccatgacaaaccttcaaaggttgcc

SEQ ID NO: 292461 - DNA, 32 bp, Artificial Sequence
  Description of Artificial Sequence: Synthetic oligonucleotide
ctgtggaccatgacaaaccttcaaaggttgcc

SEQ ID NO: 292462 - DNA, 38 bp, Artificial Sequence
  Description of Artificial Sequence: Synthetic oligonucleotide
tgtggaccatgacaaaccttcaaaggttgccaaataag

SEQ ID NO: 292463 - DNA, 37 bp, Artificial Sequence
  Description of Artificial Sequence: Synthetic oligonucleotide
gtggaccatgacaaaccttcaaaggttgccaaataag

SEQ ID NO: 292464 - DNA, 39 bp, Artificial Sequence
  Description of Artificial Sequence: Synthetic oligonucleotide
tggaccatgacaaaccttcaaaggttgccaaataagaac

SEQ ID NO: 292465 - DNA, 38 bp, Artificial Sequence
  Description of Artificial Sequence: Synthetic oligonucleotide
ggaccatgacaaaccttcaaaggttgccaaataagaac

SEQ ID NO: 292466 - DNA, 40 bp, Artificial Sequence
  Description of Artificial Sequence: Synthetic oligonucleotide
gaccatgacaaaccttcaaaggttgccaaataagaactag

SEQ ID NO: 292467 - DNA, 41 bp, Artificial Sequence
  Description of Artificial Sequence: Synthetic oligonucleotide
accatgacaaaccttcaaaggttgccaaataagaactagtg

SEQ ID NO: 292468 - DNA, 40 bp, Artificial Sequence
  Description of Artificial Sequence: Synthetic oligonucleotide
ccatgacaaaccttcaaaggttgccaaataagaactagtg

SEQ ID NO: 292469 - DNA, 43 bp, Artificial Sequence
  Description of Artificial Sequence: Synthetic oligonucleotide
catgacaaaccttcaaaggttgccaaataagaactagtgtaag

SEQ ID NO: 292470 - DNA, 43 bp, Artificial Sequence
  Description of Artificial Sequence: Synthetic oligonucleotide
atgacaaaccttcaaaggttgccaaataagaactagtgtaagc

SEQ ID NO: 292471 - DNA, 42 bp, Artificial Sequence
  Description of Artificial Sequence: Synthetic oligonucleotide
tgacaaaccttcaaaggttgccaaataagaactagtgtaagc

SEQ ID NO: 292472 - DNA, 41 bp, Artificial Sequence
  Description of Artificial Sequence: Synthetic oligonucleotide
gacaaaccttcaaaggttgccaaataagaactagtgtaagc

SEQ ID NO: 292473 - DNA, 42 bp, Artificial Sequence
  Description of Artificial Sequence: Synthetic oligonucleotide
acaaaccttcaaaggttgccaaataagaactagtgtaagcac

SEQ ID NO: 292474 - DNA, 41 bp, Artificial Sequence
  Description of Artificial Sequence: Synthetic oligonucleotide
caaaccttcaaaggttgccaaataagaactagtgtaagcac

SEQ ID NO: 292475 - DNA, 43 bp, Artificial Sequence
  Description of Artificial Sequence: Synthetic oligonucleotide
aaaccttcaaaggttgccaaataagaactagtgtaagcacttg

SEQ ID NO: 292476 - DNA, 42 bp, Artificial Sequence
  Description of Artificial Sequence: Synthetic oligonucleotide
aaccttcaaaggttgccaaataagaactagtgtaagcacttg

SEQ ID NO: 292477 - DNA, 41 bp, Artificial Sequence
  Description of Artificial Sequence: Synthetic oligonucleotide
accttcaaaggttgccaaataagaactagtgtaagcacttg

SEQ ID NO: 292478 - DNA, 40 bp, Artificial Sequence
  Description of Artificial Sequence: Synthetic oligonucleotide
ccttcaaaggttgccaaataagaactagtgtaagcacttg

SEQ ID NO: 292479 - DNA, 40 bp, Artificial Sequence
  Description of Artificial Sequence: Synthetic oligonucleotide
cttcaaaggttgccaaataagaactagtgtaagcacttgg

SEQ ID NO: 292480 - DNA, 40 bp, Artificial Sequence
  Description of Artificial Sequence: Synthetic oligonucleotide
ttcaaaggttgccaaataagaactagtgtaagcacttggc

SEQ ID NO: 292481 - DNA, 39 bp, Artificial Sequence
  Description of Artificial Sequence: Synthetic oligonucleotide
tcaaaggttgccaaataagaactagtgtaagcacttggc

SEQ ID NO: 292482 - DNA, 38 bp, Artificial Sequence
  Description of Artificial Sequence: Synthetic oligonucleotide
caaaggttgccaaataagaactagtgtaagcacttggc

SEQ ID NO: 292483 - DNA, 42 bp, Artificial Sequence
  Description of Artificial Sequence: Synthetic oligonucleotide
aaaggttgccaaataagaactagtgtaagcacttggcaattc

SEQ ID NO: 292484 - DNA, 41 bp, Artificial Sequence
  Description of Artificial Sequence: Synthetic oligonucleotide
aaggttgccaaataagaactagtgtaagcacttggcaattc

SEQ ID NO: 292485 - DNA, 40 bp, Artificial Sequence
  Description of Artificial Sequence: Synthetic oligonucleotide
aggttgccaaataagaactagtgtaagcacttggcaattc

SEQ ID NO: 292486 - DNA, 39 bp, Artificial Sequence
  Description of Artificial Sequence: Synthetic oligonucleotide
ggttgccaaataagaactagtgtaagcacttggcaattc

SEQ ID NO: 292487 - DNA, 39 bp, Artificial Sequence
  Description of Artificial Sequence: Synthetic oligonucleotide
gttgccaaataagaactagtgtaagcacttggcaattcc

SEQ ID NO: 292488 - DNA, 41 bp, Artificial Sequence
  Description of Artificial Sequence: Synthetic oligonucleotide
ttgccaaataagaactagtgtaagcacttggcaattccaac

SEQ ID NO: 292489 - DNA, 40 bp, Artificial Sequence
  Description of Artificial Sequence: Synthetic oligonucleotide
tgccaaataagaactagtgtaagcacttggcaattccaac

SEQ ID NO: 292490 - DNA, 39 bp, Artificial Sequence
  Description of Artificial Sequence: Synthetic oligonucleotide
gccaaataagaactagtgtaagcacttggcaattccaac

SEQ ID NO: 292491 - DNA, 40 bp, Artificial Sequence
  Description of Artificial Sequence: Synthetic oligonucleotide
ccaaataagaactagtgtaagcacttggcaattccaacac

SEQ ID NO: 292492 - DNA, 44 bp, Artificial Sequence
  Description of Artificial Sequence: Synthetic oligonucleotide
caaataagaactagtgtaagcacttggcaattccaacacaattg

SEQ ID NO: 292493 - DNA, 44 bp, Artificial Sequence
  Description of Artificial Sequence: Synthetic oligonucleotide
aaataagaactagtgtaagcacttggcaattccaacacaattgc

SEQ ID NO: 292494 - DNA, 43 bp, Artificial Sequence
  Description of Artificial Sequence: Synthetic oligonucleotide
aataagaactagtgtaagcacttggcaattccaacacaattgc

SEQ ID NO: 292495 - DNA, 42 bp, Artificial Sequence
  Description of Artificial Sequence: Synthetic oligonucleotide
ataagaactagtgtaagcacttggcaattccaacacaattgc

SEQ ID NO: 292496 - DNA, 41 bp, Artificial Sequence
  Description of Artificial Sequence: Synthetic oligonucleotide
taagaactagtgtaagcacttggcaattccaacacaattgc

SEQ ID NO: 292497 - DNA, 40 bp, Artificial Sequence
  Description of Artificial Sequence: Synthetic oligonucleotide
aagaactagtgtaagcacttggcaattccaacacaattgc

SEQ ID NO: 292498 - DNA, 39 bp, Artificial Sequence
  Description of Artificial Sequence: Synthetic oligonucleotide
agaactagtgtaagcacttggcaattccaacacaattgc

SEQ ID NO: 292499 - DNA, 38 bp, Artificial Sequence
  Description of Artificial Sequence: Synthetic oligonucleotide
gaactagtgtaagcacttggcaattccaacacaattgc

SEQ ID NO: 292500 - DNA, 39 bp, Artificial Sequence
  Description of Artificial Sequence: Synthetic oligonucleotide
aactagtgtaagcacttggcaattccaacacaattgcac

SEQ ID NO: 292501 - DNA, 38 bp, Artificial Sequence
  Description of Artificial Sequence: Synthetic oligonucleotide
actagtgtaagcacttggcaattccaacacaattgcac

SEQ ID NO: 292502 - DNA, 37 bp, Artificial Sequence
  Description of Artificial Sequence: Synthetic oligonucleotide
ctagtgtaagcacttggcaattccaacacaattgcac

SEQ ID NO: 292503 - DNA, 41 bp, Artificial Sequence
  Description of Artificial Sequence: Synthetic oligonucleotide
tagtgtaagcacttggcaattccaacacaattgcacaaatc

SEQ ID NO: 292504 - DNA, 40 bp, Artificial Sequence
  Description of Artificial Sequence: Synthetic oligonucleotide
agtgtaagcacttggcaattccaacacaattgcacaaatc

SEQ ID NO: 292505 - DNA, 39 bp, Artificial Sequence
  Description of Artificial Sequence: Synthetic oligonucleotide
gtgtaagcacttggcaattccaacacaattgcacaaatc

SEQ ID NO: 292506 - DNA, 42 bp, Artificial Sequence
  Description of Artificial Sequence: Synthetic oligonucleotide
tgtaagcacttggcaattccaacacaattgcacaaatctttg

SEQ ID NO: 292507 - DNA, 41 bp, Artificial Sequence
  Description of Artificial Sequence: Synthetic oligonucleotide
gtaagcacttggcaattccaacacaattgcacaaatctttg

SEQ ID NO: 292508 - DNA, 41 bp, Artificial Sequence
  Description of Artificial Sequence: Synthetic oligonucleotide
taagcacttggcaattccaacacaattgcacaaatctttgc

SEQ ID NO: 292509 - DNA, 40 bp, Artificial Sequence
  Description of Artificial Sequence: Synthetic oligonucleotide
aagcacttggcaattccaacacaattgcacaaatctttgc

SEQ ID NO: 292510 - DNA, 39 bp, Artificial Sequence
  Description of Artificial Sequence: Synthetic oligonucleotide
agcacttggcaattccaacacaattgcacaaatctttgc

SEQ ID NO: 292511 - DNA, 38 bp, Artificial Sequence
  Description of Artificial Sequence: Synthetic oligonucleotide
gcacttggcaattccaacacaattgcacaaatctttgc

SEQ ID NO: 292512 - DNA, 38 bp, Artificial Sequence
  Description of Artificial Sequence: Synthetic oligonucleotide
cacttggcaattccaacacaattgcacaaatctttgcg

SEQ ID NO: 292513 - DNA, 40 bp, Artificial Sequence
  Description of Artificial Sequence: Synthetic oligonucleotide
acttggcaattccaacacaattgcacaaatctttgcgaac

SEQ ID NO: 292514 - DNA, 39 bp, Artificial Sequence
  Description of Artificial Sequence: Synthetic oligonucleotide
cttggcaattccaacacaattgcacaaatctttgcgaac

SEQ ID NO: 292515 - DNA, 39 bp, Artificial Sequence
  Description of Artificial Sequence: Synthetic oligonucleotide
ttggcaattccaacacaattgcacaaatctttgcgaacc

SEQ ID NO: 292516 - DNA, 38 bp, Artificial Sequence
  Description of Artificial Sequence: Synthetic oligonucleotide
tggcaattccaacacaattgcacaaatctttgcgaacc

SEQ ID NO: 292517 - DNA, 37 bp, Artificial Sequence
  Description of Artificial Sequence: Synthetic oligonucleotide
ggcaattccaacacaattgcacaaatctttgcgaacc

SEQ ID NO: 292518 - DNA, 37 bp, Artificial Sequence
  Description of Artificial Sequence: Synthetic oligonucleotide
gcaattccaacacaattgcacaaatctttgcgaaccc

SEQ ID NO: 292519 - DNA, 46 bp, Artificial Sequence
  Description of Artificial Sequence: Synthetic oligonucleotide
caattccaacacaattgcacaaatctttgcgaacccaaaatatttg

SEQ ID NO: 292520 - DNA, 47 bp, Artificial Sequence
  Description of Artificial Sequence: Synthetic oligonucleotide
aattccaacacaattgcacaaatctttgcgaacccaaaatatttgag

SEQ ID NO: 292521 - DNA, 46 bp, Artificial Sequence
  Description of Artificial Sequence: Synthetic oligonucleotide
attccaacacaattgcacaaatctttgcgaacccaaaatatttgag

SEQ ID NO: 292522 - DNA, 45 bp, Artificial Sequence
  Description of Artificial Sequence: Synthetic oligonucleotide
ttccaacacaattgcacaaatctttgcgaacccaaaatatttgag

SEQ ID NO: 292523 - DNA, 44 bp, Artificial Sequence
  Description of Artificial Sequence: Synthetic oligonucleotide
tccaacacaattgcacaaatctttgcgaacccaaaatatttgag

SEQ ID NO: 292524 - DNA, 43 bp, Artificial Sequence
  Description of Artificial Sequence: Synthetic oligonucleotide
ccaacacaattgcacaaatctttgcgaacccaaaatatttgag

SEQ ID NO: 292525 - DNA, 43 bp, Artificial Sequence
  Description of Artificial Sequence: Synthetic oligonucleotide
caacacaattgcacaaatctttgcgaacccaaaatatttgagg

SEQ ID NO: 292526 - DNA, 43 bp, Artificial Sequence
  Description of Artificial Sequence: Synthetic oligonucleotide
aacacaattgcacaaatctttgcgaacccaaaatatttgaggg

SEQ ID NO: 292527 - DNA, 42 bp, Artificial Sequence
  Description of Artificial Sequence: Synthetic oligonucleotide
acacaattgcacaaatctttgcgaacccaaaatatttgaggg

SEQ ID NO: 292528 - DNA, 41 bp, Artificial Sequence
  Description of Artificial Sequence: Synthetic oligonucleotide
cacaattgcacaaatctttgcgaacccaaaatatttgaggg

SEQ ID NO: 292529 - DNA, 42 bp, Artificial Sequence
  Description of Artificial Sequence: Synthetic oligonucleotide
acaattgcacaaatctttgcgaacccaaaatatttgagggtc

SEQ ID NO: 292530 - DNA, 41 bp, Artificial Sequence
  Description of Artificial Sequence: Synthetic oligonucleotide
caattgcacaaatctttgcgaacccaaaatatttgagggtc

SEQ ID NO: 292531 - DNA, 42 bp, Artificial Sequence
  Description of Artificial Sequence: Synthetic oligonucleotide
aattgcacaaatctttgcgaacccaaaatatttgagggtcag

SEQ ID NO: 292532 - DNA, 41 bp, Artificial Sequence
  Description of Artificial Sequence: Synthetic oligonucleotide
attgcacaaatctttgcgaacccaaaatatttgagggtcag

SEQ ID NO: 292533 - DNA, 40 bp, Artificial Sequence
  Description of Artificial Sequence: Synthetic oligonucleotide
ttgcacaaatctttgcgaacccaaaatatttgagggtcag

SEQ ID NO: 292534 - DNA, 39 bp, Artificial Sequence
  Description of Artificial Sequence: Synthetic oligonucleotide
tgcacaaatctttgcgaacccaaaatatttgagggtcag

SEQ ID NO: 292535 - DNA, 38 bp, Artificial Sequence
  Description of Artificial Sequence: Synthetic oligonucleotide
gcacaaatctttgcgaacccaaaatatttgagggtcag

SEQ ID NO: 292536 - DNA, 40 bp, Artificial Sequence
  Description of Artificial Sequence: Synthetic oligonucleotide
cacaaatctttgcgaacccaaaatatttgagggtcagaac

SEQ ID NO: 292537 - DNA, 43 bp, Artificial Sequence
  Description of Artificial Sequence: Synthetic oligonucleotide
acaaatctttgcgaacccaaaatatttgagggtcagaactttc

SEQ ID NO: 292538 - DNA, 42 bp, Artificial Sequence
  Description of Artificial Sequence: Synthetic oligonucleotide
caaatctttgcgaacccaaaatatttgagggtcagaactttc

SEQ ID NO: 292539 - DNA, 42 bp, Artificial Sequence
  Description of Artificial Sequence: Synthetic oligonucleotide
aaatctttgcgaacccaaaatatttgagggtcagaactttcc

SEQ ID NO: 292540 - DNA, 41 bp, Artificial Sequence
  Description of Artificial Sequence: Synthetic oligonucleotide
aatctttgcgaacccaaaatatttgagggtcagaactttcc

SEQ ID NO: 292541 - DNA, 40 bp, Artificial Sequence
  Description of Artificial Sequence: Synthetic oligonucleotide
atctttgcgaacccaaaatatttgagggtcagaactttcc

SEQ ID NO: 292542 - DNA, 39 bp, Artificial Sequence
  Description of Artificial Sequence: Synthetic oligonucleotide
tctttgcgaacccaaaatatttgagggtcagaactttcc

SEQ ID NO: 292543 - DNA, 38 bp, Artificial Sequence
  Description of Artificial Sequence: Synthetic oligonucleotide
ctttgcgaacccaaaatatttgagggtcagaactttcc

SEQ ID NO: 292544 - DNA, 39 bp, Artificial Sequence
  Description of Artificial Sequence: Synthetic oligonucleotide
tttgcgaacccaaaatatttgagggtcagaactttcctg

SEQ ID NO: 292545 - DNA, 38 bp, Artificial Sequence
  Description of Artificial Sequence: Synthetic oligonucleotide
ttgcgaacccaaaatatttgagggtcagaactttcctg

SEQ ID NO: 292546 - DNA, 37 bp, Artificial Sequence
  Description of Artificial Sequence: Synthetic oligonucleotide
tgcgaacccaaaatatttgagggtcagaactttcctg

SEQ ID NO: 292547 - DNA, 36 bp, Artificial Sequence
  Description of Artificial Sequence: Synthetic oligonucleotide
gcgaacccaaaatatttgagggtcagaactttcctg

SEQ ID NO: 292548 - DNA, 37 bp, Artificial Sequence
  Description of Artificial Sequence: Synthetic oligonucleotide
cgaacccaaaatatttgagggtcagaactttcctgag

SEQ ID NO: 292549 - DNA, 38 bp, Artificial Sequence
  Description of Artificial Sequence: Synthetic oligonucleotide
gaacccaaaatatttgagggtcagaactttcctgagtg

SEQ ID NO: 292550 - DNA, 40 bp, Artificial Sequence
  Description of Artificial Sequence: Synthetic oligonucleotide
aacccaaaatatttgagggtcagaactttcctgagtgatg

SEQ ID NO: 292551 - DNA, 39 bp, Artificial Sequence
  Description of Artificial Sequence: Synthetic oligonucleotide
acccaaaatatttgagggtcagaactttcctgagtgatg

SEQ ID NO: 292552 - DNA, 38 bp, Artificial Sequence
  Description of Artificial Sequence: Synthetic oligonucleotide
cccaaaatatttgagggtcagaactttcctgagtgatg

SEQ ID NO: 292553 - DNA, 38 bp, Artificial Sequence
  Description of Artificial Sequence: Synthetic oligonucleotide
ccaaaatatttgagggtcagaactttcctgagtgatgg

SEQ ID NO: 292554 - DNA, 38 bp, Artificial Sequence
  Description of Artificial Sequence: Synthetic oligonucleotide
caaaatatttgagggtcagaactttcctgagtgatggg

SEQ ID NO: 292555 - DNA, 38 bp, Artificial Sequence
  Description of Artificial Sequence: Synthetic oligonucleotide
aaaatatttgagggtcagaactttcctgagtgatgggc

SEQ ID NO: 292556 - DNA, 37 bp, Artificial Sequence
  Description of Artificial Sequence: Synthetic oligonucleotide
aaatatttgagggtcagaactttcctgagtgatgggc

SEQ ID NO: 292557 - DNA, 36 bp, Artificial Sequence
  Description of Artificial Sequence: Synthetic oligonucleotide
aatatttgagggtcagaactttcctgagtgatgggc

SEQ ID NO: 292558 - DNA, 35 bp, Artificial Sequence
  Description of Artificial Sequence: Synthetic oligonucleotide
atatttgagggtcagaactttcctgagtgatgggc

SEQ ID NO: 292559 - DNA, 34 bp, Artificial Sequence
  Description of Artificial Sequence: Synthetic oligonucleotide
tatttgagggtcagaactttcctgagtgatgggc

SEQ ID NO: 292560 - DNA, 33 bp, Artificial Sequence
  Description of Artificial Sequence: Synthetic oligonucleotide
atttgagggtcagaactttcctgagtgatgggc

SEQ ID NO: 292561 - DNA, 32 bp, Artificial Sequence
  Description of Artificial Sequence: Synthetic oligonucleotide
tttgagggtcagaactttcctgagtgatgggc

SEQ ID NO: 292562 - DNA, 31 bp, Artificial Sequence
  Description of Artificial Sequence: Synthetic oligonucleotide
ttgagggtcagaactttcctgagtgatgggc

SEQ ID NO: 292563 - DNA, 30 bp, Artificial Sequence
  Description of Artificial Sequence: Synthetic oligonucleotide
tgagggtcagaactttcctgagtgatgggc

SEQ ID NO: 292564 - DNA, 29 bp, Artificial Sequence
  Description of Artificial Sequence: Synthetic oligonucleotide
gagggtcagaactttcctgagtgatgggc

SEQ ID NO: 292565 - DNA, 29 bp, Artificial Sequence
  Description of Artificial Sequence: Synthetic oligonucleotide
agggtcagaactttcctgagtgatgggcc

SEQ ID NO: 292566 - DNA, 28 bp, Artificial Sequence
  Description of Artificial Sequence: Synthetic oligonucleotide
gggtcagaactttcctgagtgatgggcc

SEQ ID NO: 292567 - DNA, 31 bp, Artificial Sequence
  Description of Artificial Sequence: Synthetic oligonucleotide
ggtcagaactttcctgagtgatgggccatac

SEQ ID NO: 292568 - DNA, 34 bp, Artificial Sequence
  Description of Artificial Sequence: Synthetic oligonucleotide
gtcagaactttcctgagtgatgggccatacaatg

SEQ ID NO: 292569 - DNA, 35 bp, Artificial Sequence
  Description of Artificial Sequence: Synthetic oligonucleotide
tcagaactttcctgagtgatgggccatacaatgtg

SEQ ID NO: 292570 - DNA, 34 bp, Artificial Sequence
  Description of Artificial Sequence: Synthetic oligonucleotide
cagaactttcctgagtgatgggccatacaatgtg

SEQ ID NO: 292571 - DNA, 37 bp, Artificial Sequence
  Description of Artificial Sequence: Synthetic oligonucleotide
agaactttcctgagtgatgggccatacaatgtgaaac

SEQ ID NO: 292572 - DNA, 36 bp, Artificial Sequence
  Description of Artificial Sequence: Synthetic oligonucleotide
gaactttcctgagtgatgggccatacaatgtgaaac

SEQ ID NO: 292573 - DNA, 36 bp, Artificial Sequence
  Description of Artificial Sequence: Synthetic oligonucleotide
aactttcctgagtgatgggccatacaatgtgaaacg

SEQ ID NO: 292574 - DNA, 35 bp, Artificial Sequence
  Description of Artificial Sequence: Synthetic oligonucleotide
actttcctgagtgatgggccatacaatgtgaaacg

SEQ ID NO: 292575 - DNA, 34 bp, Artificial Sequence
  Description of Artificial Sequence: Synthetic oligonucleotide
ctttcctgagtgatgggccatacaatgtgaaacg

SEQ ID NO: 292576 - DNA, 35 bp, Artificial Sequence
  Description of Artificial Sequence: Synthetic oligonucleotide
tttcctgagtgatgggccatacaatgtgaaacgtg

SEQ ID NO: 292577 - DNA, 34 bp, Artificial Sequence
  Description of Artificial Sequence: Synthetic oligonucleotide
ttcctgagtgatgggccatacaatgtgaaacgtg

SEQ ID NO: 292578 - DNA, 33 bp, Artificial Sequence
  Description of Artificial Sequence: Synthetic oligonucleotide
tcctgagtgatgggccatacaatgtgaaacgtg

SEQ ID NO: 292579 - DNA, 32 bp, Artificial Sequence
  Description of Artificial Sequence: Synthetic oligonucleotide
cctgagtgatgggccatacaatgtgaaacgtg

SEQ ID NO: 292580 - DNA, 35 bp, Artificial Sequence
  Description of Artificial Sequence: Synthetic oligonucleotide
ctgagtgatgggccatacaatgtgaaacgtgtttc

SEQ ID NO: 292581 - DNA, 35 bp, Artificial Sequence
  Description of Artificial Sequence: Synthetic oligonucleotide
tgagtgatgggccatacaatgtgaaacgtgtttcc

SEQ ID NO: 292582 - DNA, 34 bp, Artificial Sequence
  Description of Artificial Sequence: Synthetic oligonucleotide
gagtgatgggccatacaatgtgaaacgtgtttcc

SEQ ID NO: 292583 - DNA, 35 bp, Artificial Sequence
  Description of Artificial Sequence: Synthetic oligonucleotide
agtgatgggccatacaatgtgaaacgtgtttccac

SEQ ID NO: 292584 - DNA, 34 bp, Artificial Sequence
  Description of Artificial Sequence: Synthetic oligonucleotide
gtgatgggccatacaatgtgaaacgtgtttccac

SEQ ID NO: 292585 - DNA, 34 bp, Artificial Sequence
  Description of Artificial Sequence: Synthetic oligonucleotide
tgatgggccatacaatgtgaaacgtgtttccacc

SEQ ID NO: 292586 - DNA, 33 bp, Artificial Sequence
  Description of Artificial Sequence: Synthetic oligonucleotide
gatgggccatacaatgtgaaacgtgtttccacc

SEQ ID NO: 292587 - DNA, 34 bp, Artificial Sequence
  Description of Artificial Sequence: Synthetic oligonucleotide
atgggccatacaatgtgaaacgtgtttccaccac

SEQ ID NO: 292588 - DNA, 33 bp, Artificial Sequence
  Description of Artificial Sequence: Synthetic oligonucleotide
tgggccatacaatgtgaaacgtgtttccaccac

SEQ ID NO: 292589 - DNA, 32 bp, Artificial Sequence
  Description of Artificial Sequence: Synthetic oligonucleotide
gggccatacaatgtgaaacgtgtttccaccac

SEQ ID NO: 292590 - DNA, 33 bp, Artificial Sequence
  Description of Artificial Sequence: Synthetic oligonucleotide
ggccatacaatgtgaaacgtgtttccaccacag

SEQ ID NO: 292591 - DNA, 33 bp, Artificial Sequence
  Description of Artificial Sequence: Synthetic oligonucleotide
gccatacaatgtgaaacgtgtttccaccacagc

SEQ ID NO: 292592 - DNA, 34 bp, Artificial Sequence
  Description of Artificial Sequence: Synthetic oligonucleotide
ccatacaatgtgaaacgtgtttccaccacagcag

SEQ ID NO: 292593 - DNA, 36 bp, Artificial Sequence
  Description of Artificial Sequence: Synthetic oligonucleotide
catacaatgtgaaacgtgtttccaccacagcagtac

SEQ ID NO: 292594 - DNA, 38 bp, Artificial Sequence
  Description of Artificial Sequence: Synthetic oligonucleotide
atacaatgtgaaacgtgtttccaccacagcagtacaag

SEQ ID NO: 292595 - DNA, 37 bp, Artificial Sequence
  Description of Artificial Sequence: Synthetic oligonucleotide
tacaatgtgaaacgtgtttccaccacagcagtacaag

SEQ ID NO: 292596 - DNA, 36 bp, Artificial Sequence
  Description of Artificial Sequence: Synthetic oligonucleotide
acaatgtgaaacgtgtttccaccacagcagtacaag

SEQ ID NO: 292597 - DNA, 35 bp, Artificial Sequence
  Description of Artificial Sequence: Synthetic oligonucleotide
caatgtgaaacgtgtttccaccacagcagtacaag

SEQ ID NO: 292598 - DNA, 35 bp, Artificial Sequence
  Description of Artificial Sequence: Synthetic oligonucleotide
aatgtgaaacgtgtttccaccacagcagtacaagg

SEQ ID NO: 292599 - DNA, 34 bp, Artificial Sequence
  Description of Artificial Sequence: Synthetic oligonucleotide
atgtgaaacgtgtttccaccacagcagtacaagg

SEQ ID NO: 292600 - DNA, 33 bp, Artificial Sequence
  Description of Artificial Sequence: Synthetic oligonucleotide
tgtgaaacgtgtttccaccacagcagtacaagg

SEQ ID NO: 292601 - DNA, 32 bp, Artificial Sequence
  Description of Artificial Sequence: Synthetic oligonucleotide
gtgaaacgtgtttccaccacagcagtacaagg

SEQ ID NO: 292602 - DNA, 33 bp, Artificial Sequence
  Description of Artificial Sequence: Synthetic oligonucleotide
tgaaacgtgtttccaccacagcagtacaaggag

SEQ ID NO: 292603 - DNA, 32 bp, Artificial Sequence
  Description of Artificial Sequence: Synthetic oligonucleotide
gaaacgtgtttccaccacagcagtacaaggag

SEQ ID NO: 292604 - DNA, 32 bp, Artificial Sequence
  Description of Artificial Sequence: Synthetic oligonucleotide
aaacgtgtttccaccacagcagtacaaggagc

SEQ ID NO: 292605 - DNA, 31 bp, Artificial Sequence
  Description of Artificial Sequence: Synthetic oligonucleotide
aacgtgtttccaccacagcagtacaaggagc

SEQ ID NO: 292606 - DNA, 30 bp, Artificial Sequence
  Description of Artificial Sequence: Synthetic oligonucleotide
acgtgtttccaccacagcagtacaaggagc

SEQ ID NO: 292607 - DNA, 29 bp, Artificial Sequence
  Description of Artificial Sequence: Synthetic oligonucleotide
cgtgtttccaccacagcagtacaaggagc

SEQ ID NO: 292608 - DNA, 29 bp, Artificial Sequence
  Description of Artificial Sequence: Synthetic oligonucleotide
gtgtttccaccacagcagtacaaggagcc

SEQ ID NO: 292609 - DNA, 29 bp, Artificial Sequence
  Description of Artificial Sequence: Synthetic oligonucleotide
tgtttccaccacagcagtacaaggagccg

SEQ ID NO: 292610 - DNA, 28 bp, Artificial Sequence
  Description of Artificial Sequence: Synthetic oligonucleotide
gtttccaccacagcagtacaaggagccg

SEQ ID NO: 292611 - DNA, 31 bp, Artificial Sequence
  Description of Artificial Sequence: Synthetic oligonucleotide
tttccaccacagcagtacaaggagccgtatg

SEQ ID NO: 292612 - DNA, 30 bp, Artificial Sequence
  Description of Artificial Sequence: Synthetic oligonucleotide
ttccaccacagcagtacaaggagccgtatg

SEQ ID NO: 292613 - DNA, 29 bp, Artificial Sequence
  Description of Artificial Sequence: Synthetic oligonucleotide
tccaccacagcagtacaaggagccgtatg

SEQ ID NO: 292614 - DNA, 28 bp, Artificial Sequence
  Description of Artificial Sequence: Synthetic oligonucleotide
ccaccacagcagtacaaggagccgtatg

SEQ ID NO: 292615 - DNA, 26 bp, Artificial Sequence
  Description of Artificial Sequence: Synthetic oligonucleotide
atgcggctggagaagctggaggagca

SEQ ID NO: 292616 - DNA, 25 bp, Artificial Sequence
  Description of Artificial Sequence: Synthetic oligonucleotide
tgcggctggagaagctggaggagca

SEQ ID NO: 292617 - DNA, 24 bp, Artificial Sequence
  Description of Artificial Sequence: Synthetic oligonucleotide
gcggctggagaagctggaggagca

SEQ ID NO: 292618 - DNA, 24 bp, Artificial Sequence
  Description of Artificial Sequence: Synthetic oligonucleotide
cggctggagaagctggaggagcag

SEQ ID NO: 292619 - DNA, 24 bp, Artificial Sequence
  Description of Artificial Sequence: Synthetic oligonucleotide
ggctggagaagctggaggagcagg

SEQ ID NO: 292620 - DNA, 25 bp, Artificial Sequence
  Description of Artificial Sequence: Synthetic oligonucleotide
gctggagaagctggaggagcagggt

SEQ ID NO: 292621 - DNA, 26 bp, Artificial Sequence
  Description of Artificial Sequence: Synthetic oligonucleotide
ctggagaagctggaggagcagggtct

SEQ ID NO: 292622 - DNA, 26 bp, Artificial Sequence
  Description of Artificial Sequence: Synthetic oligonucleotide
tggagaagctggaggagcagggtctg

SEQ ID NO: 292623 - DNA, 25 bp, Artificial Sequence
  Description of Artificial Sequence: Synthetic oligonucleotide
ggagaagctggaggagcagggtctg

SEQ ID NO: 292624 - DNA, 25 bp, Artificial Sequence
  Description of Artificial Sequence: Synthetic oligonucleotide
gagaagctggaggagcagggtctgc

SEQ ID NO: 292625 - DNA, 25 bp, Artificial Sequence
  Description of Artificial Sequence: Synthetic oligonucleotide
agaagctggaggagcagggtctgcg

SEQ ID NO: 292626 - DNA, 24 bp, Artificial Sequence
  Description of Artificial Sequence: Synthetic oligonucleotide
gaagctggaggagcagggtctgcg

SEQ ID NO: 292627 - DNA, 26 bp, Artificial Sequence
  Description of Artificial Sequence: Synthetic oligonucleotide
aagctggaggagcagggtctgcgcaa

SEQ ID NO: 292628 - DNA, 25 bp, Artificial Sequence
  Description of Artificial Sequence: Synthetic oligonucleotide
agctggaggagcagggtctgcgcaa

SEQ ID NO: 292629 - DNA, 24 bp, Artificial Sequence
  Description of Artificial Sequence: Synthetic oligonucleotide
gctggaggagcagggtctgcgcaa

SEQ ID NO: 292630 - DNA, 26 bp, Artificial Sequence
  Description of Artificial Sequence: Synthetic oligonucleotide
ctggaggagcagggtctgcgcaagaa

SEQ ID NO: 292631 - DNA, 26 bp, Artificial Sequence
  Description of Artificial Sequence: Synthetic oligonucleotide
tggaggagcagggtctgcgcaagaac

SEQ ID NO: 292632 - DNA, 25 bp, Artificial Sequence
  Description of Artificial Sequence: Synthetic oligonucleotide
ggaggagcagggtctgcgcaagaac

SEQ ID NO: 292633 - DNA, 25 bp, Artificial Sequence
  Description of Artificial Sequence: Synthetic oligonucleotide
gaggagcagggtctgcgcaagaacc

SEQ ID NO: 292634 - DNA, 25 bp, Artificial Sequence
  Description of Artificial Sequence: Synthetic oligonucleotide
aggagcagggtctgcgcaagaaccc

SEQ ID NO: 292635 - DNA, 24 bp, Artificial Sequence
  Description of Artificial Sequence: Synthetic oligonucleotide
ggagcagggtctgcgcaagaaccc

SEQ ID NO: 292636 - DNA, 24 bp, Artificial Sequence
  Description of Artificial Sequence: Synthetic oligonucleotide
gagcagggtctgcgcaagaacccg

SEQ ID NO: 292637 - DNA, 25 bp, Artificial Sequence
  Description of Artificial Sequence: Synthetic oligonucleotide
agcagggtctgcgcaagaacccgga

SEQ ID NO: 292638 - DNA, 24 bp, Artificial Sequence
  Description of Artificial Sequence: Synthetic oligonucleotide
gcagggtctgcgcaagaacccgga

SEQ ID NO: 292639 - DNA, 26 bp, Artificial Sequence
  Description of Artificial Sequence: Synthetic oligonucleotide
cagggtctgcgcaagaacccggactt

SEQ ID NO: 292640 - DNA, 26 bp, Artificial Sequence
  Description of Artificial Sequence: Synthetic oligonucleotide
agggtctgcgcaagaacccggacttg

SEQ ID NO: 292641 - DNA, 25 bp, Artificial Sequence
  Description of Artificial Sequence: Synthetic oligonucleotide
gggtctgcgcaagaacccggacttg

SEQ ID NO: 292642 - DNA, 25 bp, Artificial Sequence
  Description of Artificial Sequence: Synthetic oligonucleotide
ggtctgcgcaagaacccggacttgc

SEQ ID NO: 292643 - DNA, 27 bp, Artificial Sequence
  Description of Artificial Sequence: Synthetic oligonucleotide
gtctgcgcaagaacccggacttgcgtt

SEQ ID NO: 292644 - DNA, 28 bp, Artificial Sequence
  Description of Artificial Sequence: Synthetic oligonucleotide
tctgcgcaagaacccggacttgcgtttc

SEQ ID NO: 292645 - DNA, 27 bp, Artificial Sequence
  Description of Artificial Sequence: Synthetic oligonucleotide
ctgcgcaagaacccggacttgcgtttc

SEQ ID NO: 292646 - DNA, 27 bp, Artificial Sequence
  Description of Artificial Sequence: Synthetic oligonucleotide
tgcgcaagaacccggacttgcgtttcg

SEQ ID NO: 292647 - DNA, 26 bp, Artificial Sequence
  Description of Artificial Sequence: Synthetic oligonucleotide
gcgcaagaacccggacttgcgtttcg

SEQ ID NO: 292648 - DNA, 26 bp, Artificial Sequence
  Description of Artificial Sequence: Synthetic oligonucleotide
cgcaagaacccggacttgcgtttcgc

SEQ ID NO: 292649 - DNA, 26 bp, Artificial Sequence
  Description of Artificial Sequence: Synthetic oligonucleotide
gcaagaacccggacttgcgtttcgcg

SEQ ID NO: 292650 - DNA, 27 bp, Artificial Sequence
  Description of Artificial Sequence: Synthetic oligonucleotide
caagaacccggacttgcgtttcgcgca

SEQ ID NO: 292651 - DNA, 27 bp, Artificial Sequence
  Description of Artificial Sequence: Synthetic oligonucleotide
aagaacccggacttgcgtttcgcgcag

SEQ ID NO: 292652 - DNA, 26 bp, Artificial Sequence
  Description of Artificial Sequence: Synthetic oligonucleotide
agaacccggacttgcgtttcgcgcag

SEQ ID NO: 292653 - DNA, 25 bp, Artificial Sequence
  Description of Artificial Sequence: Synthetic oligonucleotide
gaacccggacttgcgtttcgcgcag

SEQ ID NO: 292654 - DNA, 26 bp, Artificial Sequence
  Description of Artificial Sequence: Synthetic oligonucleotide
aacccggacttgcgtttcgcgcagca

SEQ ID NO: 292655 - DNA, 25 bp, Artificial Sequence
  Description of Artificial Sequence: Synthetic oligonucleotide
acccggacttgcgtttcgcgcagca

SEQ ID NO: 292656 - DNA, 24 bp, Artificial Sequence
  Description of Artificial Sequence: Synthetic oligonucleotide
cccggacttgcgtttcgcgcagca

SEQ ID NO: 292657 - DNA, 24 bp, Artificial Sequence
  Description of Artificial Sequence: Synthetic oligonucleotide
ccggacttgcgtttcgcgcagcag

SEQ ID NO: 292658 - DNA, 24 bp, Artificial Sequence
  Description of Artificial Sequence: Synthetic oligonucleotide
cggacttgcgtttcgcgcagcagc

SEQ ID NO: 292659 - DNA, 24 bp, Artificial Sequence
  Description of Artificial Sequence: Synthetic oligonucleotide
ggacttgcgtttcgcgcagcagcg

SEQ ID NO: 292660 - DNA, 26 bp, Artificial Sequence
  Description of Artificial Sequence: Synthetic oligonucleotide
gacttgcgtttcgcgcagcagcgctt

SEQ ID NO: 292661 - DNA, 26 bp, Artificial Sequence
  Description of Artificial Sequence: Synthetic oligonucleotide
acttgcgtttcgcgcagcagcgcttc

SEQ ID NO: 292662 - DNA, 25 bp, Artificial Sequence
  Description of Artificial Sequence: Synthetic oligonucleotide
cttgcgtttcgcgcagcagcgcttc

SEQ ID NO: 292663 - DNA, 26 bp, Artificial Sequence
  Description of Artificial Sequence: Synthetic oligonucleotide
ttgcgtttcgcgcagcagcgcttcct

SEQ ID NO: 292664 - DNA, 25 bp, Artificial Sequence
  Description of Artificial Sequence: Synthetic oligonucleotide
tgcgtttcgcgcagcagcgcttcct

SEQ ID NO: 292665 - DNA, 24 bp, Artificial Sequence
  Description of Artificial Sequence: Synthetic oligonucleotide
gcgtttcgcgcagcagcgcttcct

SEQ ID NO: 292666 - DNA, 24 bp, Artificial Sequence
  Description of Artificial Sequence: Synthetic oligonucleotide
cgtttcgcgcagcagcgcttcctc

SEQ ID NO: 292667 - DNA, 25 bp, Artificial Sequence
  Description of Artificial Sequence: Synthetic oligonucleotide
gtttcgcgcagcagcgcttcctcct

SEQ ID NO: 292668 - DNA, 26 bp, Artificial Sequence
  Description of Artificial Sequence: Synthetic oligonucleotide
tttcgcgcagcagcgcttcctcctca

SEQ ID NO: 292669 - DNA, 25 bp, Artificial Sequence
  Description of Artificial Sequence: Synthetic oligonucleotide
ttcgcgcagcagcgcttcctcctca

SEQ ID NO: 292670 - DNA, 24 bp, Artificial Sequence
  Description of Artificial Sequence: Synthetic oligonucleotide
tcgcgcagcagcgcttcctcctca

SEQ ID NO: 292671 - DNA, 23 bp, Artificial Sequence
  Description of Artificial Sequence: Synthetic oligonucleotide
cgcgcagcagcgcttcctcctca

SEQ ID NO: 292672 - DNA, 23 bp, Artificial Sequence
  Description of Artificial Sequence: Synthetic oligonucleotide
gcgcagcagcgcttcctcctcag

SEQ ID NO: 292673 - DNA, 23 bp, Artificial Sequence
  Description of Artificial Sequence: Synthetic oligonucleotide
cgcagcagcgcttcctcctcagc

SEQ ID NO: 292674 - DNA, 24 bp, Artificial Sequence
  Description of Artificial Sequence: Synthetic oligonucleotide
gcagcagcgcttcctcctcagcct

SEQ ID NO: 292675 - DNA, 24 bp, Artificial Sequence
  Description of Artificial Sequence: Synthetic oligonucleotide
cagcagcgcttcctcctcagcctg

SEQ ID NO: 292676 - DNA, 24 bp, Artificial Sequence
  Description of Artificial Sequence: Synthetic oligonucleotide
agcagcgcttcctcctcagcctgg

SEQ ID NO: 292677 - DNA, 23 bp, Artificial Sequence
  Description of Artificial Sequence: Synthetic oligonucleotide
gcagcgcttcctcctcagcctgg

SEQ ID NO: 292678 - DNA, 23 bp, Artificial Sequence
  Description of Artificial Sequence: Synthetic oligonucleotide
cagcgcttcctcctcagcctggc

SEQ ID NO: 292679 - DNA, 23 bp, Artificial Sequence
  Description of Artificial Sequence: Synthetic oligonucleotide
agcgcttcctcctcagcctggcc

SEQ ID NO: 292680 - DNA, 22 bp, Artificial Sequence
  Description of Artificial Sequence: Synthetic oligonucleotide
gcgcttcctcctcagcctggcc

SEQ ID NO: 292681 - DNA, 23 bp, Artificial Sequence
  Description of Artificial Sequence: Synthetic oligonucleotide
cgcttcctcctcagcctggccga

SEQ ID NO: 292682 - DNA, 23 bp, Artificial Sequence
  Description of Artificial Sequence: Synthetic oligonucleotide
gcttcctcctcagcctggccgag

SEQ ID NO: 292683 - DNA, 24 bp, Artificial Sequence
  Description of Artificial Sequence: Synthetic oligonucleotide
cttcctcctcagcctggccgagca

SEQ ID NO: 292684 - DNA, 24 bp, Artificial Sequence
  Description of Artificial Sequence: Synthetic oligonucleotide
ttcctcctcagcctggccgagcac

SEQ ID NO: 292685 - DNA, 23 bp, Artificial Sequence
  Description of Artificial Sequence: Synthetic oligonucleotide
tcctcctcagcctggccgagcac

SEQ ID NO: 292686 - DNA, 22 bp, Artificial Sequence
  Description of Artificial Sequence: Synthetic oligonucleotide
cctcctcagcctggccgagcac

SEQ ID NO: 292687 - DNA, 22 bp, Artificial Sequence
  Description of Artificial Sequence: Synthetic oligonucleotide
ctcctcagcctggccgagcacc

SEQ ID NO: 292688 - DNA, 22 bp, Artificial Sequence
  Description of Artificial Sequence: Synthetic oligonucleotide
tcctcagcctggccgagcaccc

SEQ ID NO: 292689 - DNA, 21 bp, Artificial Sequence
  Description of Artificial Sequence: Synthetic oligonucleotide
cctcagcctggccgagcaccc

SEQ ID NO: 292690 - DNA, 21 bp, Artificial Sequence
  Description of Artificial Sequence: Synthetic oligonucleotide
ctcagcctggccgagcacccc

SEQ ID NO: 292691 - DNA, 21 bp, Artificial Sequence
  Description of Artificial Sequence: Synthetic oligonucleotide
tcagcctggccgagcaccccg

SEQ ID NO: 292692 - DNA, 20 bp, Artificial Sequence
  Description of Artificial Sequence: Synthetic oligonucleotide
cagcctggccgagcaccccg

SEQ ID NO: 292693 - DNA, 21 bp, Artificial Sequence
  Description of Artificial Sequence: Synthetic oligonucleotide
agcctggccgagcaccccgga

SEQ ID NO: 292694 - DNA, 20 bp, Artificial Sequence
  Description of Artificial Sequence: Synthetic oligonucleotide
gcctggccgagcaccccgga

SEQ ID NO: 292695 - DNA, 21 bp, Artificial Sequence
  Description of Artificial Sequence: Synthetic oligonucleotide
cctggccgagcaccccggaga

SEQ ID NO: 292696 - DNA, 21 bp, Artificial Sequence
  Description of Artificial Sequence: Synthetic oligonucleotide
ctggccgagcaccccggagac

SEQ ID NO: 292697 - DNA, 21 bp, Artificial Sequence
  Description of Artificial Sequence: Synthetic oligonucleotide
tggccgagcaccccggagacg

SEQ ID NO: 292698 - DNA, 20 bp, Artificial Sequence
  Description of Artificial Sequence: Synthetic oligonucleotide
ggccgagcaccccggagacg

SEQ ID NO: 292699 - DNA, 21 bp, Artificial Sequence
  Description of Artificial Sequence: Synthetic oligonucleotide
gccgagcaccccggagacgca

SEQ ID NO: 292700 - DNA, 21 bp, Artificial Sequence
  Description of Artificial Sequence: Synthetic oligonucleotide
ccgagcaccccggagacgcag

SEQ ID NO: 292701 - DNA, 21 bp, Artificial Sequence
  Description of Artificial Sequence: Synthetic oligonucleotide
cgagcaccccggagacgcagc

SEQ ID NO: 292702 - DNA, 21 bp, Artificial Sequence
  Description of Artificial Sequence: Synthetic oligonucleotide
gagcaccccggagacgcagcc

SEQ ID NO: 292703 - DNA, 22 bp, Artificial Sequence
  Description of Artificial Sequence: Synthetic oligonucleotide
agcaccccggagacgcagccgt

SEQ ID NO: 292704 - DNA, 21 bp, Artificial Sequence
  Description of Artificial Sequence: Synthetic oligonucleotide
gcaccccggagacgcagccgt

SEQ ID NO: 292705 - DNA, 21 bp, Artificial Sequence
  Description of Artificial Sequence: Synthetic oligonucleotide
caccccggagacgcagccgtg

SEQ ID NO: 292706 - DNA, 21 bp, Artificial Sequence
  Description of Artificial Sequence: Synthetic oligonucleotide
accccggagacgcagccgtgc

SEQ ID NO: 292707 - DNA, 20 bp, Artificial Sequence
  Description of Artificial Sequence: Synthetic oligonucleotide
ccccggagacgcagccgtgc

SEQ ID NO: 292708 - DNA, 20 bp, Artificial Sequence
  Description of Artificial Sequence: Synthetic oligonucleotide
cccggagacgcagccgtgcg

SEQ ID NO: 292709 - DNA, 20 bp, Artificial Sequence
  Description of Artificial Sequence: Synthetic oligonucleotide
ccggagacgcagccgtgcgc

SEQ ID NO: 292710 - DNA, 21 bp, Artificial Sequence
  Description of Artificial Sequence: Synthetic oligonucleotide
cggagacgcagccgtgcgcca

SEQ ID NO: 292711 - DNA, 21 bp, Artificial Sequence
  Description of Artificial Sequence: Synthetic oligonucleotide
ggagacgcagccgtgcgccac

SEQ ID NO: 292712 - DNA, 22 bp, Artificial Sequence
  Description of Artificial Sequence: Synthetic oligonucleotide
gagacgcagccgtgcgccacga

SEQ ID NO: 292713 - DNA, 22 bp, Artificial Sequence
  Description of Artificial Sequence: Synthetic oligonucleotide
agacgcagccgtgcgccacgag

SEQ ID NO: 292714 - DNA, 21 bp, Artificial Sequence
  Description of Artificial Sequence: Synthetic oligonucleotide
gacgcagccgtgcgccacgag

SEQ ID NO: 292715 - DNA, 22 bp, Artificial Sequence
  Description of Artificial Sequence: Synthetic oligonucleotide
acgcagccgtgcgccacgagct

SEQ ID NO: 292716 - DNA, 21 bp, Artificial Sequence
  Description of Artificial Sequence: Synthetic oligonucleotide
cgcagccgtgcgccacgagct

SEQ ID NO: 292717 - DNA, 23 bp, Artificial Sequence
  Description of Artificial Sequence: Synthetic oligonucleotide
gcagccgtgcgccacgagctgaa

SEQ ID NO: 292718 - DNA, 23 bp, Artificial Sequence
  Description of Artificial Sequence: Synthetic oligonucleotide
cagccgtgcgccacgagctgaag

SEQ ID NO: 292719 - DNA, 23 bp, Artificial Sequence
  Description of Artificial Sequence: Synthetic oligonucleotide
agccgtgcgccacgagctgaagg

SEQ ID NO: 292720 - DNA, 22 bp, Artificial Sequence
  Description of Artificial Sequence: Synthetic oligonucleotide
gccgtgcgccacgagctgaagg

SEQ ID NO: 292721 - DNA, 22 bp, Artificial Sequence
  Description of Artificial Sequence: Synthetic oligonucleotide
ccgtgcgccacgagctgaaggc

SEQ ID NO: 292722 - DNA, 22 bp, Artificial Sequence
  Description of Artificial Sequence: Synthetic oligonucleotide
cgtgcgccacgagctgaaggcg

SEQ ID NO: 292723 - DNA, 22 bp, Artificial Sequence
  Description of Artificial Sequence: Synthetic oligonucleotide
gtgcgccacgagctgaaggcgg

SEQ ID NO: 292724 - DNA, 22 bp, Artificial Sequence
  Description of Artificial Sequence: Synthetic oligonucleotide
tgcgccacgagctgaaggcggc

SEQ ID NO: 292725 - DNA, 21 bp, Artificial Sequence
  Description of Artificial Sequence: Synthetic oligonucleotide
gcgccacgagctgaaggcggc

SEQ ID NO: 292726 - DNA, 21 bp, Artificial Sequence
  Description of Artificial Sequence: Synthetic oligonucleotide
cgccacgagctgaaggcggcc

SEQ ID NO: 292727 - DNA, 22 bp, Artificial Sequence
  Description of Artificial Sequence: Synthetic oligonucleotide
gccacgagctgaaggcggccgt

SEQ ID NO: 292728 - DNA, 22 bp, Artificial Sequence
  Description of Artificial Sequence: Synthetic oligonucleotide
ccacgagctgaaggcggccgtg

SEQ ID NO: 292729 - DNA, 22 bp, Artificial Sequence
  Description of Artificial Sequence: Synthetic oligonucleotide
cacgagctgaaggcggccgtgc

SEQ ID NO: 292730 - DNA, 22 bp, Artificial Sequence
  Description of Artificial Sequence: Synthetic oligonucleotide
acgagctgaaggcggccgtgcg

SEQ ID NO: 292731 - DNA, 21 bp, Artificial Sequence
  Description of Artificial Sequence: Synthetic oligonucleotide
cgagctgaaggcggccgtgcg

SEQ ID NO: 292732 - DNA, 21 bp, Artificial Sequence
  Description of Artificial Sequence: Synthetic oligonucleotide
gagctgaaggcggccgtgcgc

SEQ ID NO: 292733 - DNA, 25 bp, Artificial Sequence
  Description of Artificial Sequence: Synthetic oligonucleotide
agctgaaggcggccgtgcgcgataa

SEQ ID NO: 292734 - DNA, 24 bp, Artificial Sequence
  Description of Artificial Sequence: Synthetic oligonucleotide
gctgaaggcggccgtgcgcgataa

SEQ ID NO: 292735 - DNA, 26 bp, Artificial Sequence
  Description of Artificial Sequence: Synthetic oligonucleotide
ctgaaggcggccgtgcgcgataacta

SEQ ID NO: 292736 - DNA, 27 bp, Artificial Sequence
  Description of Artificial Sequence: Synthetic oligonucleotide
tgaaggcggccgtgcgcgataactaca

SEQ ID NO: 292737 - DNA, 27 bp, Artificial Sequence
  Description of Artificial Sequence: Synthetic oligonucleotide
gaaggcggccgtgcgcgataactacat

SEQ ID NO: 292738 - DNA, 27 bp, Artificial Sequence
  Description of Artificial Sequence: Synthetic oligonucleotide
aaggcggccgtgcgcgataactacatg

SEQ ID NO: 292739 - DNA, 26 bp, Artificial Sequence
  Description of Artificial Sequence: Synthetic oligonucleotide
aggcggccgtgcgcgataactacatg

SEQ ID NO: 292740 - DNA, 25 bp, Artificial Sequence
  Description of Artificial Sequence: Synthetic oligonucleotide
ggcggccgtgcgcgataactacatg

SEQ ID NO: 292741 - DNA, 25 bp, Artificial Sequence
  Description of Artificial Sequence: Synthetic oligonucleotide
gcggccgtgcgcgataactacatgg

SEQ ID NO: 292742 - DNA, 26 bp, Artificial Sequence
  Description of Artificial Sequence: Synthetic oligonucleotide
cggccgtgcgcgataactacatggct

SEQ ID NO: 292743 - DNA, 26 bp, Artificial Sequence
  Description of Artificial Sequence: Synthetic oligonucleotide
ggccgtgcgcgataactacatggctc

SEQ ID NO: 292744 - DNA, 27 bp, Artificial Sequence
  Description of Artificial Sequence: Synthetic oligonucleotide
gccgtgcgcgataactacatggctcgt

SEQ ID NO: 292745 - DNA, 29 bp, Artificial Sequence
  Description of Artificial Sequence: Synthetic oligonucleotide
ccgtgcgcgataactacatggctcgttac

SEQ ID NO: 292746 - DNA, 32 bp, Artificial Sequence
  Description of Artificial Sequence: Synthetic oligonucleotide
cgtgcgcgataactacatggctcgttactatg

SEQ ID NO: 292747 - DNA, 34 bp, Artificial Sequence
  Description of Artificial Sequence: Synthetic oligonucleotide
gtgcgcgataactacatggctcgttactatgatg

SEQ ID NO: 292748 - DNA, 34 bp, Artificial Sequence
  Description of Artificial Sequence: Synthetic oligonucleotide
tgcgcgataactacatggctcgttactatgatgc

SEQ ID NO: 292749 - DNA, 33 bp, Artificial Sequence
  Description of Artificial Sequence: Synthetic oligonucleotide
gcgcgataactacatggctcgttactatgatgc

SEQ ID NO: 292750 - DNA, 33 bp, Artificial Sequence
  Description of Artificial Sequence: Synthetic oligonucleotide
cgcgataactacatggctcgttactatgatgcc

SEQ ID NO: 292751 - DNA, 35 bp, Artificial Sequence
  Description of Artificial Sequence: Synthetic oligonucleotide
gcgataactacatggctcgttactatgatgccttg

SEQ ID NO: 292752 - DNA, 36 bp, Artificial Sequence
  Description of Artificial Sequence: Synthetic oligonucleotide
cgataactacatggctcgttactatgatgccttgtg

SEQ ID NO: 292753 - DNA, 36 bp, Artificial Sequence
  Description of Artificial Sequence: Synthetic oligonucleotide
gataactacatggctcgttactatgatgccttgtgc

SEQ ID NO: 292754 - DNA, 40 bp, Artificial Sequence
  Description of Artificial Sequence: Synthetic oligonucleotide
ataactacatggctcgttactatgatgccttgtgctaatc

SEQ ID NO: 292755 - DNA, 39 bp, Artificial Sequence
  Description of Artificial Sequence: Synthetic oligonucleotide
taactacatggctcgttactatgatgccttgtgctaatc

SEQ ID NO: 292756 - DNA, 38 bp, Artificial Sequence
  Description of Artificial Sequence: Synthetic oligonucleotide
aactacatggctcgttactatgatgccttgtgctaatc

SEQ ID NO: 292757 - DNA, 37 bp, Artificial Sequence
  Description of Artificial Sequence: Synthetic oligonucleotide
actacatggctcgttactatgatgccttgtgctaatc

SEQ ID NO: 292758 - DNA, 36 bp, Artificial Sequence
  Description of Artificial Sequence: Synthetic oligonucleotide
ctacatggctcgttactatgatgccttgtgctaatc

SEQ ID NO: 292759 - DNA, 36 bp, Artificial Sequence
  Description of Artificial Sequence: Synthetic oligonucleotide
tacatggctcgttactatgatgccttgtgctaatcc

SEQ ID NO: 292760 - DNA, 35 bp, Artificial Sequence
  Description of Artificial Sequence: Synthetic oligonucleotide
acatggctcgttactatgatgccttgtgctaatcc

SEQ ID NO: 292761 - DNA, 34 bp, Artificial Sequence
  Description of Artificial Sequence: Synthetic oligonucleotide
catggctcgttactatgatgccttgtgctaatcc

SEQ ID NO: 292762 - DNA, 34 bp, Artificial Sequence
  Description of Artificial Sequence: Synthetic oligonucleotide
atggctcgttactatgatgccttgtgctaatccc

SEQ ID NO: 292763 - DNA, 33 bp, Artificial Sequence
  Description of Artificial Sequence: Synthetic oligonucleotide
tggctcgttactatgatgccttgtgctaatccc

SEQ ID NO: 292764 - DNA, 32 bp, Artificial Sequence
  Description of Artificial Sequence: Synthetic oligonucleotide
ggctcgttactatgatgccttgtgctaatccc

SEQ ID NO: 292765 - DNA, 33 bp, Artificial Sequence
  Description of Artificial Sequence: Synthetic oligonucleotide
gctcgttactatgatgccttgtgctaatccctc

SEQ ID NO: 292766 - DNA, 33 bp, Artificial Sequence
  Description of Artificial Sequence: Synthetic oligonucleotide
ctcgttactatgatgccttgtgctaatccctcg

SEQ ID NO: 292767 - DNA, 34 bp, Artificial Sequence
  Description of Artificial Sequence: Synthetic oligonucleotide
tcgttactatgatgccttgtgctaatccctcgtc

SEQ ID NO: 292768 - DNA, 33 bp, Artificial Sequence
  Description of Artificial Sequence: Synthetic oligonucleotide
cgttactatgatgccttgtgctaatccctcgtc

SEQ ID NO: 292769 - DNA, 34 bp, Artificial Sequence
  Description of Artificial Sequence: Synthetic oligonucleotide
gttactatgatgccttgtgctaatccctcgtctg

SEQ ID NO: 292770 - DNA, 34 bp, Artificial Sequence
  Description of Artificial Sequence: Synthetic oligonucleotide
ttactatgatgccttgtgctaatccctcgtctgg

SEQ ID NO: 292771 - DNA, 33 bp, Artificial Sequence
  Description of Artificial Sequence: Synthetic oligonucleotide
tactatgatgccttgtgctaatccctcgtctgg

SEQ ID NO: 292772 - DNA, 32 bp, Artificial Sequence
  Description of Artificial Sequence: Synthetic oligonucleotide
actatgatgccttgtgctaatccctcgtctgg

SEQ ID NO: 292773 - DNA, 31 bp, Artificial Sequence
  Description of Artificial Sequence: Synthetic oligonucleotide
ctatgatgccttgtgctaatccctcgtctgg

SEQ ID NO: 292774 - DNA, 31 bp, Artificial Sequence
  Description of Artificial Sequence: Synthetic oligonucleotide
tatgatgccttgtgctaatccctcgtctggc

SEQ ID NO: 292775 - DNA, 30 bp, Artificial Sequence
  Description of Artificial Sequence: Synthetic oligonucleotide
atgatgccttgtgctaatccctcgtctggc

SEQ ID NO: 292776 - DNA, 29 bp, Artificial Sequence
  Description of Artificial Sequence: Synthetic oligonucleotide
tgatgccttgtgctaatccctcgtctggc

SEQ ID NO: 292777 - DNA, 28 bp, Artificial Sequence
  Description of Artificial Sequence: Synthetic oligonucleotide
gatgccttgtgctaatccctcgtctggc

SEQ ID NO: 292778 - DNA, 29 bp, Artificial Sequence
  Description of Artificial Sequence: Synthetic oligonucleotide
atgccttgtgctaatccctcgtctggcag

SEQ ID NO: 292779 - DNA, 28 bp, Artificial Sequence
  Description of Artificial Sequence: Synthetic oligonucleotide
tgccttgtgctaatccctcgtctggcag

SEQ ID NO: 292780 - DNA, 27 bp, Artificial Sequence
  Description of Artificial Sequence: Synthetic oligonucleotide
gccttgtgctaatccctcgtctggcag

SEQ ID NO: 292781 - DNA, 30 bp, Artificial Sequence
  Description of Artificial Sequence: Synthetic oligonucleotide
ccttgtgctaatccctcgtctggcagattg

SEQ ID NO: 292782 - DNA, 31 bp, Artificial Sequence
  Description of Artificial Sequence: Synthetic oligonucleotide
cttgtgctaatccctcgtctggcagattgac

SEQ ID NO: 292783 - DNA, 31 bp, Artificial Sequence
  Description of Artificial Sequence: Synthetic oligonucleotide
ttgtgctaatccctcgtctggcagattgacg

SEQ ID NO: 292784 - DNA, 30 bp, Artificial Sequence
  Description of Artificial Sequence: Synthetic oligonucleotide
tgtgctaatccctcgtctggcagattgacg

SEQ ID NO: 292785 - DNA, 29 bp, Artificial Sequence
  Description of Artificial Sequence: Synthetic oligonucleotide
gtgctaatccctcgtctggcagattgacg

SEQ ID NO: 292786 - DNA, 30 bp, Artificial Sequence
  Description of Artificial Sequence: Synthetic oligonucleotide
tgctaatccctcgtctggcagattgacgtg

SEQ ID NO: 292787 - DNA, 29 bp, Artificial Sequence
  Description of Artificial Sequence: Synthetic oligonucleotide
gctaatccctcgtctggcagattgacgtg

SEQ ID NO: 292788 - DNA, 29 bp, Artificial Sequence
  Description of Artificial Sequence: Synthetic oligonucleotide
ctaatccctcgtctggcagattgacgtgg

SEQ ID NO: 292789 - DNA, 30 bp, Artificial Sequence
  Description of Artificial Sequence: Synthetic oligonucleotide
taatccctcgtctggcagattgacgtggac

SEQ ID NO: 292790 - DNA, 29 bp, Artificial Sequence
  Description of Artificial Sequence: Synthetic oligonucleotide
aatccctcgtctggcagattgacgtggac

SEQ ID NO: 292791 - DNA, 28 bp, Artificial Sequence
  Description of Artificial Sequence: Synthetic oligonucleotide
atccctcgtctggcagattgacgtggac

SEQ ID NO: 292792 - DNA, 27 bp, Artificial Sequence
  Description of Artificial Sequence: Synthetic oligonucleotide
tccctcgtctggcagattgacgtggac

SEQ ID NO: 292793 - DNA, 26 bp, Artificial Sequence
  Description of Artificial Sequence: Synthetic oligonucleotide
ccctcgtctggcagattgacgtggac

SEQ ID NO: 292794 - DNA, 27 bp, Artificial Sequence
  Description of Artificial Sequence: Synthetic oligonucleotide
cctcgtctggcagattgacgtggacgt

SEQ ID NO: 292795 - DNA, 28 bp, Artificial Sequence
  Description of Artificial Sequence: Synthetic oligonucleotide
ctcgtctggcagattgacgtggacgtac

SEQ ID NO: 292796 - DNA, 29 bp, Artificial Sequence
  Description of Artificial Sequence: Synthetic oligonucleotide
tcgtctggcagattgacgtggacgtactc

SEQ ID NO: 292797 - DNA, 28 bp, Artificial Sequence
  Description of Artificial Sequence: Synthetic oligonucleotide
cgtctggcagattgacgtggacgtactc

SEQ ID NO: 292798 - DNA, 36 bp, Artificial Sequence
  Description of Artificial Sequence: Synthetic oligonucleotide
gtctggcagattgacgtggacgtactcaatataatg

SEQ ID NO: 292799 - DNA, 38 bp, Artificial Sequence
  Description of Artificial Sequence: Synthetic oligonucleotide
tctggcagattgacgtggacgtactcaatataatgaag

SEQ ID NO: 292800 - DNA, 37 bp, Artificial Sequence
  Description of Artificial Sequence: Synthetic oligonucleotide
ctggcagattgacgtggacgtactcaatataatgaag

SEQ ID NO: 292801 - DNA, 39 bp, Artificial Sequence
  Description of Artificial Sequence: Synthetic oligonucleotide
tggcagattgacgtggacgtactcaatataatgaagaac

SEQ ID NO: 292802 - DNA, 38 bp, Artificial Sequence
  Description of Artificial Sequence: Synthetic oligonucleotide
ggcagattgacgtggacgtactcaatataatgaagaac

SEQ ID NO: 292803 - DNA, 38 bp, Artificial Sequence
  Description of Artificial Sequence: Synthetic oligonucleotide
gcagattgacgtggacgtactcaatataatgaagaacg

SEQ ID NO: 292804 - DNA, 38 bp, Artificial Sequence
  Description of Artificial Sequence: Synthetic oligonucleotide
cagattgacgtggacgtactcaatataatgaagaacgc

SEQ ID NO: 292805 - DNA, 42 bp, Artificial Sequence
  Description of Artificial Sequence: Synthetic oligonucleotide
agattgacgtggacgtactcaatataatgaagaacgcaaatg

SEQ ID NO: 292806 - DNA, 41 bp, Artificial Sequence
  Description of Artificial Sequence: Synthetic oligonucleotide
gattgacgtggacgtactcaatataatgaagaacgcaaatg

SEQ ID NO: 292807 - DNA, 43 bp, Artificial Sequence
  Description of Artificial Sequence: Synthetic oligonucleotide
attgacgtggacgtactcaatataatgaagaacgcaaatgaac

SEQ ID NO: 292808 - DNA, 42 bp, Artificial Sequence
  Description of Artificial Sequence: Synthetic oligonucleotide
ttgacgtggacgtactcaatataatgaagaacgcaaatgaac

SEQ ID NO: 292809 - DNA, 41 bp, Artificial Sequence
  Description of Artificial Sequence: Synthetic oligonucleotide
tgacgtggacgtactcaatataatgaagaacgcaaatgaac

SEQ ID NO: 292810 - DNA, 40 bp, Artificial Sequence
  Description of Artificial Sequence: Synthetic oligonucleotide
gacgtggacgtactcaatataatgaagaacgcaaatgaac

SEQ ID NO: 292811 - DNA, 42 bp, Artificial Sequence
  Description of Artificial Sequence: Synthetic oligonucleotide
acgtggacgtactcaatataatgaagaacgcaaatgaacatg

SEQ ID NO: 292812 - DNA, 41 bp, Artificial Sequence
  Description of Artificial Sequence: Synthetic oligonucleotide
cgtggacgtactcaatataatgaagaacgcaaatgaacatg

SEQ ID NO: 292813 - DNA, 42 bp, Artificial Sequence
  Description of Artificial Sequence: Synthetic oligonucleotide
gtggacgtactcaatataatgaagaacgcaaatgaacatgag

SEQ ID NO: 292814 - DNA, 44 bp, Artificial Sequence
  Description of Artificial Sequence: Synthetic oligonucleotide
tggacgtactcaatataatgaagaacgcaaatgaacatgagttg

SEQ ID NO: 292815 - DNA, 43 bp, Artificial Sequence
  Description of Artificial Sequence: Synthetic oligonucleotide
ggacgtactcaatataatgaagaacgcaaatgaacatgagttg

SEQ ID NO: 292816 - DNA, 45 bp, Artificial Sequence
  Description of Artificial Sequence: Synthetic oligonucleotide
gacgtactcaatataatgaagaacgcaaatgaacatgagttgatg

SEQ ID NO: 292817 - DNA, 45 bp, Artificial Sequence
  Description of Artificial Sequence: Synthetic oligonucleotide
acgtactcaatataatgaagaacgcaaatgaacatgagttgatgc

SEQ ID NO: 292818 - DNA, 44 bp, Artificial Sequence
  Description of Artificial Sequence: Synthetic oligonucleotide
cgtactcaatataatgaagaacgcaaatgaacatgagttgatgc

SEQ ID NO: 292819 - DNA, 44 bp, Artificial Sequence
  Description of Artificial Sequence: Synthetic oligonucleotide
gtactcaatataatgaagaacgcaaatgaacatgagttgatgcg

SEQ ID NO: 292820 - DNA, 47 bp, Artificial Sequence
  Description of Artificial Sequence: Synthetic oligonucleotide
tactcaatataatgaagaacgcaaatgaacatgagttgatgcgtttg

SEQ ID NO: 292821 - DNA, 46 bp, Artificial Sequence
  Description of Artificial Sequence: Synthetic oligonucleotide
actcaatataatgaagaacgcaaatgaacatgagttgatgcgtttg

SEQ ID NO: 292822 - DNA, 45 bp, Artificial Sequence
  Description of Artificial Sequence: Synthetic oligonucleotide
ctcaatataatgaagaacgcaaatgaacatgagttgatgcgtttg

SEQ ID NO: 292823 - DNA, 45 bp, Artificial Sequence
  Description of Artificial Sequence: Synthetic oligonucleotide
tcaatataatgaagaacgcaaatgaacatgagttgatgcgtttgg

SEQ ID NO: 292824 - DNA, 44 bp, Artificial Sequence
  Description of Artificial Sequence: Synthetic oligonucleotide
caatataatgaagaacgcaaatgaacatgagttgatgcgtttgg

SEQ ID NO: 292825 - DNA, 46 bp, Artificial Sequence
  Description of Artificial Sequence: Synthetic oligonucleotide
aatataatgaagaacgcaaatgaacatgagttgatgcgtttggaag

SEQ ID NO: 292826 - DNA, 45 bp, Artificial Sequence
  Description of Artificial Sequence: Synthetic oligonucleotide
atataatgaagaacgcaaatgaacatgagttgatgcgtttggaag

SEQ ID NO: 292827 - DNA, 44 bp, Artificial Sequence
  Description of Artificial Sequence: Synthetic oligonucleotide
tataatgaagaacgcaaatgaacatgagttgatgcgtttggaag

SEQ ID NO: 292828 - DNA, 43 bp, Artificial Sequence
  Description of Artificial Sequence: Synthetic oligonucleotide
ataatgaagaacgcaaatgaacatgagttgatgcgtttggaag

SEQ ID NO: 292829 - DNA, 42 bp, Artificial Sequence
  Description of Artificial Sequence: Synthetic oligonucleotide
taatgaagaacgcaaatgaacatgagttgatgcgtttggaag

SEQ ID NO: 292830 - DNA, 41 bp, Artificial Sequence
  Description of Artificial Sequence: Synthetic oligonucleotide
aatgaagaacgcaaatgaacatgagttgatgcgtttggaag

SEQ ID NO: 292831 - DNA, 40 bp, Artificial Sequence
  Description of Artificial Sequence: Synthetic oligonucleotide
atgaagaacgcaaatgaacatgagttgatgcgtttggaag

SEQ ID NO: 292832 - DNA, 39 bp, Artificial Sequence
  Description of Artificial Sequence: Synthetic oligonucleotide
tgaagaacgcaaatgaacatgagttgatgcgtttggaag

SEQ ID NO: 292833 - DNA, 38 bp, Artificial Sequence
  Description of Artificial Sequence: Synthetic oligonucleotide
gaagaacgcaaatgaacatgagttgatgcgtttggaag

SEQ ID NO: 292834 - DNA, 39 bp, Artificial Sequence
  Description of Artificial Sequence: Synthetic oligonucleotide
aagaacgcaaatgaacatgagttgatgcgtttggaagag

SEQ ID NO: 292835 - DNA, 38 bp, Artificial Sequence
  Description of Artificial Sequence: Synthetic oligonucleotide
agaacgcaaatgaacatgagttgatgcgtttggaagag

SEQ ID NO: 292836 - DNA, 37 bp, Artificial Sequence
  Description of Artificial Sequence: Synthetic oligonucleotide
gaacgcaaatgaacatgagttgatgcgtttggaagag

SEQ ID NO: 292837 - DNA, 37 bp, Artificial Sequence
  Description of Artificial Sequence: Synthetic oligonucleotide
aacgcaaatgaacatgagttgatgcgtttggaagagg

SEQ ID NO: 292838 - DNA, 36 bp, Artificial Sequence
  Description of Artificial Sequence: Synthetic oligonucleotide
acgcaaatgaacatgagttgatgcgtttggaagagg

SEQ ID NO: 292839 - DNA, 35 bp, Artificial Sequence
  Description of Artificial Sequence: Synthetic oligonucleotide
cgcaaatgaacatgagttgatgcgtttggaagagg

SEQ ID NO: 292840 - DNA, 36 bp, Artificial Sequence
  Description of Artificial Sequence: Synthetic oligonucleotide
gcaaatgaacatgagttgatgcgtttggaagaggag

SEQ ID NO: 292841 - DNA, 36 bp, Artificial Sequence
  Description of Artificial Sequence: Synthetic oligonucleotide
caaatgaacatgagttgatgcgtttggaagaggagc

SEQ ID NO: 292842 - DNA, 37 bp, Artificial Sequence
  Description of Artificial Sequence: Synthetic oligonucleotide
aaatgaacatgagttgatgcgtttggaagaggagctg

SEQ ID NO: 292843 - DNA, 36 bp, Artificial Sequence
  Description of Artificial Sequence: Synthetic oligonucleotide
aatgaacatgagttgatgcgtttggaagaggagctg

SEQ ID NO: 292844 - DNA, 35 bp, Artificial Sequence
  Description of Artificial Sequence: Synthetic oligonucleotide
atgaacatgagttgatgcgtttggaagaggagctg

SEQ ID NO: 292845 - DNA, 34 bp, Artificial Sequence
  Description of Artificial Sequence: Synthetic oligonucleotide
tgaacatgagttgatgcgtttggaagaggagctg

SEQ ID NO: 292846 - DNA, 33 bp, Artificial Sequence
  Description of Artificial Sequence: Synthetic oligonucleotide
gaacatgagttgatgcgtttggaagaggagctg

SEQ ID NO: 292847 - DNA, 33 bp, Artificial Sequence
  Description of Artificial Sequence: Synthetic oligonucleotide
aacatgagttgatgcgtttggaagaggagctgc

SEQ ID NO: 292848 - DNA, 32 bp, Artificial Sequence
  Description of Artificial Sequence: Synthetic oligonucleotide
acatgagttgatgcgtttggaagaggagctgc

SEQ ID NO: 292849 - DNA, 31 bp, Artificial Sequence
  Description of Artificial Sequence: Synthetic oligonucleotide
catgagttgatgcgtttggaagaggagctgc

SEQ ID NO: 292850 - DNA, 33 bp, Artificial Sequence
  Description of Artificial Sequence: Synthetic oligonucleotide
atgagttgatgcgtttggaagaggagctgcaag

SEQ ID NO: 292851 - DNA, 32 bp, Artificial Sequence
  Description of Artificial Sequence: Synthetic oligonucleotide
tgagttgatgcgtttggaagaggagctgcaag

SEQ ID NO: 292852 - DNA, 31 bp, Artificial Sequence
  Description of Artificial Sequence: Synthetic oligonucleotide
gagttgatgcgtttggaagaggagctgcaag

SEQ ID NO: 292853 - DNA, 33 bp, Artificial Sequence
  Description of Artificial Sequence: Synthetic oligonucleotide
agttgatgcgtttggaagaggagctgcaagatg

SEQ ID NO: 292854 - DNA, 32 bp, Artificial Sequence
  Description of Artificial Sequence: Synthetic oligonucleotide
gttgatgcgtttggaagaggagctgcaagatg

SEQ ID NO: 292855 - DNA, 32 bp, Artificial Sequence
  Description of Artificial Sequence: Synthetic oligonucleotide
ttgatgcgtttggaagaggagctgcaagatgc

SEQ ID NO: 292856 - DNA, 31 bp, Artificial Sequence
  Description of Artificial Sequence: Synthetic oligonucleotide
tgatgcgtttggaagaggagctgcaagatgc

SEQ ID NO: 292857 - DNA, 30 bp, Artificial Sequence
  Description of Artificial Sequence: Synthetic oligonucleotide
gatgcgtttggaagaggagctgcaagatgc

SEQ ID NO: 292858 - DNA, 31 bp, Artificial Sequence
  Description of Artificial Sequence: Synthetic oligonucleotide
atgcgtttggaagaggagctgcaagatgcag

SEQ ID NO: 292859 - DNA, 30 bp, Artificial Sequence
  Description of Artificial Sequence: Synthetic oligonucleotide
tgcgtttggaagaggagctgcaagatgcag

SEQ ID NO: 292860 - DNA, 29 bp, Artificial Sequence
  Description of Artificial Sequence: Synthetic oligonucleotide
gcgtttggaagaggagctgcaagatgcag

SEQ ID NO: 292861 - DNA, 30 bp, Artificial Sequence
  Description of Artificial Sequence: Synthetic oligonucleotide
cgtttggaagaggagctgcaagatgcagtg

SEQ ID NO: 292862 - DNA, 32 bp, Artificial Sequence
  Description of Artificial Sequence: Synthetic oligonucleotide
gtttggaagaggagctgcaagatgcagtgaag

SEQ ID NO: 292863 - DNA, 35 bp, Artificial Sequence
  Description of Artificial Sequence: Synthetic oligonucleotide
tttggaagaggagctgcaagatgcagtgaagaatc

SEQ ID NO: 292864 - DNA, 34 bp, Artificial Sequence
  Description of Artificial Sequence: Synthetic oligonucleotide
ttggaagaggagctgcaagatgcagtgaagaatc

SEQ ID NO: 292865 - DNA, 33 bp, Artificial Sequence
  Description of Artificial Sequence: Synthetic oligonucleotide
tggaagaggagctgcaagatgcagtgaagaatc

SEQ ID NO: 292866 - DNA, 32 bp, Artificial Sequence
  Description of Artificial Sequence: Synthetic oligonucleotide
ggaagaggagctgcaagatgcagtgaagaatc

SEQ ID NO: 292867 - DNA, 34 bp, Artificial Sequence
  Description of Artificial Sequence: Synthetic oligonucleotide
gaagaggagctgcaagatgcagtgaagaatcttg

SEQ ID NO: 292868 - DNA, 34 bp, Artificial Sequence
  Description of Artificial Sequence: Synthetic oligonucleotide
aagaggagctgcaagatgcagtgaagaatcttgg

SEQ ID NO: 292869 - DNA, 33 bp, Artificial Sequence
  Description of Artificial Sequence: Synthetic oligonucleotide
agaggagctgcaagatgcagtgaagaatcttgg

SEQ ID NO: 292870 - DNA, 32 bp, Artificial Sequence
  Description of Artificial Sequence: Synthetic oligonucleotide
gaggagctgcaagatgcagtgaagaatcttgg

SEQ ID NO: 292871 - DNA, 33 bp, Artificial Sequence
  Description of Artificial Sequence: Synthetic oligonucleotide
aggagctgcaagatgcagtgaagaatcttggag

SEQ ID NO: 292872 - DNA, 32 bp, Artificial Sequence
  Description of Artificial Sequence: Synthetic oligonucleotide
ggagctgcaagatgcagtgaagaatcttggag

SEQ ID NO: 292873 - DNA, 33 bp, Artificial Sequence
  Description of Artificial Sequence: Synthetic oligonucleotide
gagctgcaagatgcagtgaagaatcttggagag

SEQ ID NO: 292874 - DNA, 34 bp, Artificial Sequence
  Description of Artificial Sequence: Synthetic oligonucleotide
agctgcaagatgcagtgaagaatcttggagagag

SEQ ID NO: 292875 - DNA, 33 bp, Artificial Sequence
  Description of Artificial Sequence: Synthetic oligonucleotide
gctgcaagatgcagtgaagaatcttggagagag

SEQ ID NO: 292876 - DNA, 33 bp, Artificial Sequence
  Description of Artificial Sequence: Synthetic oligonucleotide
ctgcaagatgcagtgaagaatcttggagagagc

SEQ ID NO: 292877 - DNA, 33 bp, Artificial Sequence
  Description of Artificial Sequence: Synthetic oligonucleotide
tgcaagatgcagtgaagaatcttggagagagcc

SEQ ID NO: 292878 - DNA, 32 bp, Artificial Sequence
  Description of Artificial Sequence: Synthetic oligonucleotide
gcaagatgcagtgaagaatcttggagagagcc

SEQ ID NO: 292879 - DNA, 37 bp, Artificial Sequence
  Description of Artificial Sequence: Synthetic oligonucleotide
caagatgcagtgaagaatcttggagagagccaaattc

SEQ ID NO: 292880 - DNA, 37 bp, Artificial Sequence
  Description of Artificial Sequence: Synthetic oligonucleotide
aagatgcagtgaagaatcttggagagagccaaattcg

SEQ ID NO: 292881 - DNA, 36 bp, Artificial Sequence
  Description of Artificial Sequence: Synthetic oligonucleotide
agatgcagtgaagaatcttggagagagccaaattcg

SEQ ID NO: 292882 - DNA, 35 bp, Artificial Sequence
  Description of Artificial Sequence: Synthetic oligonucleotide
gatgcagtgaagaatcttggagagagccaaattcg

SEQ ID NO: 292883 - DNA, 35 bp, Artificial Sequence
  Description of Artificial Sequence: Synthetic oligonucleotide
atgcagtgaagaatcttggagagagccaaattcgc

SEQ ID NO: 292884 - DNA, 34 bp, Artificial Sequence
  Description of Artificial Sequence: Synthetic oligonucleotide
tgcagtgaagaatcttggagagagccaaattcgc

SEQ ID NO: 292885 - DNA, 33 bp, Artificial Sequence
  Description of Artificial Sequence: Synthetic oligonucleotide
gcagtgaagaatcttggagagagccaaattcgc

SEQ ID NO: 292886 - DNA, 33 bp, Artificial Sequence
  Description of Artificial Sequence: Synthetic oligonucleotide
cagtgaagaatcttggagagagccaaattcgcg

SEQ ID NO: 292887 - DNA, 35 bp, Artificial Sequence
  Description of Artificial Sequence: Synthetic oligonucleotide
agtgaagaatcttggagagagccaaattcgcgttg

SEQ ID NO: 292888 - DNA, 34 bp, Artificial Sequence
  Description of Artificial Sequence: Synthetic oligonucleotide
gtgaagaatcttggagagagccaaattcgcgttg

SEQ ID NO: 292889 - DNA, 34 bp, Artificial Sequence
  Description of Artificial Sequence: Synthetic oligonucleotide
tgaagaatcttggagagagccaaattcgcgttgc

SEQ ID NO: 292890 - DNA, 33 bp, Artificial Sequence
  Description of Artificial Sequence: Synthetic oligonucleotide
gaagaatcttggagagagccaaattcgcgttgc

SEQ ID NO: 292891 - DNA, 36 bp, Artificial Sequence
  Description of Artificial Sequence: Synthetic oligonucleotide
aagaatcttggagagagccaaattcgcgttgcaatg

SEQ ID NO: 292892 - DNA, 35 bp, Artificial Sequence
  Description of Artificial Sequence: Synthetic oligonucleotide
agaatcttggagagagccaaattcgcgttgcaatg

SEQ ID NO: 292893 - DNA, 34 bp, Artificial Sequence
  Description of Artificial Sequence: Synthetic oligonucleotide
gaatcttggagagagccaaattcgcgttgcaatg

SEQ ID NO: 292894 - DNA, 36 bp, Artificial Sequence
  Description of Artificial Sequence: Synthetic oligonucleotide
aatcttggagagagccaaattcgcgttgcaatgatc

SEQ ID NO: 292895 - DNA, 35 bp, Artificial Sequence
  Description of Artificial Sequence: Synthetic oligonucleotide
atcttggagagagccaaattcgcgttgcaatgatc

SEQ ID NO: 292896 - DNA, 34 bp, Artificial Sequence
  Description of Artificial Sequence: Synthetic oligonucleotide
tcttggagagagccaaattcgcgttgcaatgatc

SEQ ID NO: 292897 - DNA, 33 bp, Artificial Sequence
  Description of Artificial Sequence: Synthetic oligonucleotide
cttggagagagccaaattcgcgttgcaatgatc

SEQ ID NO: 292898 - DNA, 33 bp, Artificial Sequence
  Description of Artificial Sequence: Synthetic oligonucleotide
ttggagagagccaaattcgcgttgcaatgatcg

SEQ ID NO: 292899 - DNA, 32 bp, Artificial Sequence
  Description of Artificial Sequence: Synthetic oligonucleotide
tggagagagccaaattcgcgttgcaatgatcg

SEQ ID NO: 292900 - DNA, 31 bp, Artificial Sequence
  Description of Artificial Sequence: Synthetic oligonucleotide
ggagagagccaaattcgcgttgcaatgatcg

SEQ ID NO: 292901 - DNA, 31 bp, Artificial Sequence
  Description of Artificial Sequence: Synthetic oligonucleotide
gagagagccaaattcgcgttgcaatgatcgc

SEQ ID NO: 292902 - DNA, 34 bp, Artificial Sequence
  Description of Artificial Sequence: Synthetic oligonucleotide
agagagccaaattcgcgttgcaatgatcgcaaag

SEQ ID NO: 292903 - DNA, 33 bp, Artificial Sequence
  Description of Artificial Sequence: Synthetic oligonucleotide
gagagccaaattcgcgttgcaatgatcgcaaag

SEQ ID NO: 292904 - DNA, 33 bp, Artificial Sequence
  Description of Artificial Sequence: Synthetic oligonucleotide
agagccaaattcgcgttgcaatgatcgcaaagg

SEQ ID NO: 292905 - DNA, 32 bp, Artificial Sequence
  Description of Artificial Sequence: Synthetic oligonucleotide
gagccaaattcgcgttgcaatgatcgcaaagg

SEQ ID NO: 292906 - DNA, 32 bp, Artificial Sequence
  Description of Artificial Sequence: Synthetic oligonucleotide
agccaaattcgcgttgcaatgatcgcaaaggc

SEQ ID NO: 292907 - DNA, 31 bp, Artificial Sequence
  Description of Artificial Sequence: Synthetic oligonucleotide
gccaaattcgcgttgcaatgatcgcaaaggc

SEQ ID NO: 292908 - DNA, 31 bp, Artificial Sequence
  Description of Artificial Sequence: Synthetic oligonucleotide
ccaaattcgcgttgcaatgatcgcaaaggcc

SEQ ID NO: 292909 - DNA, 31 bp, Artificial Sequence
  Description of Artificial Sequence: Synthetic oligonucleotide
caaattcgcgttgcaatgatcgcaaaggccc

SEQ ID NO: 292910 - DNA, 32 bp, Artificial Sequence
  Description of Artificial Sequence: Synthetic oligonucleotide
aaattcgcgttgcaatgatcgcaaaggcccag

SEQ ID NO: 292911 - DNA, 31 bp, Artificial Sequence
  Description of Artificial Sequence: Synthetic oligonucleotide
aattcgcgttgcaatgatcgcaaaggcccag

SEQ ID NO: 292912 - DNA, 30 bp, Artificial Sequence
  Description of Artificial Sequence: Synthetic oligonucleotide
attcgcgttgcaatgatcgcaaaggcccag

SEQ ID NO: 292913 - DNA, 29 bp, Artificial Sequence
  Description of Artificial Sequence: Synthetic oligonucleotide
ttcgcgttgcaatgatcgcaaaggcccag

SEQ ID NO: 292914 - DNA, 28 bp, Artificial Sequence
  Description of Artificial Sequence: Synthetic oligonucleotide
tcgcgttgcaatgatcgcaaaggcccag

SEQ ID NO: 292915 - DNA, 27 bp, Artificial Sequence
  Description of Artificial Sequence: Synthetic oligonucleotide
cgcgttgcaatgatcgcaaaggcccag

SEQ ID NO: 292916 - DNA, 29 bp, Artificial Sequence
  Description of Artificial Sequence: Synthetic oligonucleotide
gcgttgcaatgatcgcaaaggcccagtac

SEQ ID NO: 292917 - DNA, 29 bp, Artificial Sequence
  Description of Artificial Sequence: Synthetic oligonucleotide
cgttgcaatgatcgcaaaggcccagtacc

SEQ ID NO: 292918 - DNA, 30 bp, Artificial Sequence
  Description of Artificial Sequence: Synthetic oligonucleotide
gttgcaatgatcgcaaaggcccagtacctc

SEQ ID NO: 292919 - DNA, 31 bp, Artificial Sequence
  Description of Artificial Sequence: Synthetic oligonucleotide
ttgcaatgatcgcaaaggcccagtacctctc

SEQ ID NO: 292920 - DNA, 30 bp, Artificial Sequence
  Description of Artificial Sequence: Synthetic oligonucleotide
tgcaatgatcgcaaaggcccagtacctctc

SEQ ID NO: 292921 - DNA, 29 bp, Artificial Sequence
  Description of Artificial Sequence: Synthetic oligonucleotide
gcaatgatcgcaaaggcccagtacctctc

SEQ ID NO: 292922 - DNA, 29 bp, Artificial Sequence
  Description of Artificial Sequence: Synthetic oligonucleotide
caatgatcgcaaaggcccagtacctctcc

SEQ ID NO: 292923 - DNA, 29 bp, Artificial Sequence
  Description of Artificial Sequence: Synthetic oligonucleotide
aatgatcgcaaaggcccagtacctctccc

SEQ ID NO: 292924 - DNA, 28 bp, Artificial Sequence
  Description of Artificial Sequence: Synthetic oligonucleotide
atgatcgcaaaggcccagtacctctccc

SEQ ID NO: 292925 - DNA, 27 bp, Artificial Sequence
  Description of Artificial Sequence: Synthetic oligonucleotide
tgatcgcaaaggcccagtacctctccc

SEQ ID NO: 292926 - DNA, 26 bp, Artificial Sequence
  Description of Artificial Sequence: Synthetic oligonucleotide
gatcgcaaaggcccagtacctctccc

SEQ ID NO: 292927 - DNA, 26 bp, Artificial Sequence
  Description of Artificial Sequence: Synthetic oligonucleotide
atcgcaaaggcccagtacctctcccg

SEQ ID NO: 292928 - DNA, 25 bp, Artificial Sequence
  Description of Artificial Sequence: Synthetic oligonucleotide
tcgcaaaggcccagtacctctcccg

SEQ ID NO: 292929 - DNA, 24 bp, Artificial Sequence
  Description of Artificial Sequence: Synthetic oligonucleotide
cgcaaaggcccagtacctctcccg

SEQ ID NO: 292930 - DNA, 27 bp, Artificial Sequence
  Description of Artificial Sequence: Synthetic oligonucleotide
gcaaaggcccagtacctctcccggata

SEQ ID NO: 292931 - DNA, 27 bp, Artificial Sequence
  Description of Artificial Sequence: Synthetic oligonucleotide
caaaggcccagtacctctcccggatag

SEQ ID NO: 292932 - DNA, 27 bp, Artificial Sequence
  Description of Artificial Sequence: Synthetic oligonucleotide
aaaggcccagtacctctcccggatagg

SEQ ID NO: 292933 - DNA, 27 bp, Artificial Sequence
  Description of Artificial Sequence: Synthetic oligonucleotide
aaggcccagtacctctcccggatagga

SEQ ID NO: 292934 - DNA, 26 bp, Artificial Sequence
  Description of Artificial Sequence: Synthetic oligonucleotide
aggcccagtacctctcccggatagga

SEQ ID NO: 292935 - DNA, 25 bp, Artificial Sequence
  Description of Artificial Sequence: Synthetic oligonucleotide
ggcccagtacctctcccggatagga

SEQ ID NO: 292936 - DNA, 26 bp, Artificial Sequence
  Description of Artificial Sequence: Synthetic oligonucleotide
gcccagtacctctcccggataggaga

SEQ ID NO: 292937 - DNA, 27 bp, Artificial Sequence
  Description of Artificial Sequence: Synthetic oligonucleotide
cccagtacctctcccggataggagaca

SEQ ID NO: 292938 - DNA, 29 bp, Artificial Sequence
  Description of Artificial Sequence: Synthetic oligonucleotide
ccagtacctctcccggataggagacaaag

SEQ ID NO: 292939 - DNA, 30 bp, Artificial Sequence
  Description of Artificial Sequence: Synthetic oligonucleotide
cagtacctctcccggataggagacaaagag

SEQ ID NO: 292940 - DNA, 30 bp, Artificial Sequence
  Description of Artificial Sequence: Synthetic oligonucleotide
agtacctctcccggataggagacaaagagc

SEQ ID NO: 292941 - DNA, 29 bp, Artificial Sequence
  Description of Artificial Sequence: Synthetic oligonucleotide
gtacctctcccggataggagacaaagagc

SEQ ID NO: 292942 - DNA, 29 bp, Artificial Sequence
  Description of Artificial Sequence: Synthetic oligonucleotide
tacctctcccggataggagacaaagagcg

SEQ ID NO: 292943 - DNA, 28 bp, Artificial Sequence
  Description of Artificial Sequence: Synthetic oligonucleotide
acctctcccggataggagacaaagagcg

SEQ ID NO: 292944 - DNA, 27 bp, Artificial Sequence
  Description of Artificial Sequence: Synthetic oligonucleotide
cctctcccggataggagacaaagagcg

SEQ ID NO: 292945 - DNA, 28 bp, Artificial Sequence
  Description of Artificial Sequence: Synthetic oligonucleotide
ctctcccggataggagacaaagagcgag

SEQ ID NO: 292946 - DNA, 28 bp, Artificial Sequence
  Description of Artificial Sequence: Synthetic oligonucleotide
tctcccggataggagacaaagagcgagc

SEQ ID NO: 292947 - DNA, 27 bp, Artificial Sequence
  Description of Artificial Sequence: Synthetic oligonucleotide
ctcccggataggagacaaagagcgagc

SEQ ID NO: 292948 - DNA, 28 bp, Artificial Sequence
  Description of Artificial Sequence: Synthetic oligonucleotide
tcccggataggagacaaagagcgagctc

SEQ ID NO: 292949 - DNA, 27 bp, Artificial Sequence
  Description of Artificial Sequence: Synthetic oligonucleotide
cccggataggagacaaagagcgagctc

SEQ ID NO: 292950 - DNA, 28 bp, Artificial Sequence
  Description of Artificial Sequence: Synthetic oligonucleotide
ccggataggagacaaagagcgagctctg

SEQ ID NO: 292951 - DNA, 29 bp, Artificial Sequence
  Description of Artificial Sequence: Synthetic oligonucleotide
cggataggagacaaagagcgagctctgag

SEQ ID NO: 292952 - DNA, 30 bp, Artificial Sequence
  Description of Artificial Sequence: Synthetic oligonucleotide
ggataggagacaaagagcgagctctgagag

SEQ ID NO: 292953 - DNA, 30 bp, Artificial Sequence
  Description of Artificial Sequence: Synthetic oligonucleotide
gataggagacaaagagcgagctctgagagc

SEQ ID NO: 292954 - DNA, 30 bp, Artificial Sequence
  Description of Artificial Sequence: Synthetic oligonucleotide
ataggagacaaagagcgagctctgagagcc

SEQ ID NO: 292955 - DNA, 29 bp, Artificial Sequence
  Description of Artificial Sequence: Synthetic oligonucleotide
taggagacaaagagcgagctctgagagcc

SEQ ID NO: 292956 - DNA, 28 bp, Artificial Sequence
  Description of Artificial Sequence: Synthetic oligonucleotide
aggagacaaagagcgagctctgagagcc

SEQ ID NO: 292957 - DNA, 27 bp, Artificial Sequence
  Description of Artificial Sequence: Synthetic oligonucleotide
ggagacaaagagcgagctctgagagcc

SEQ ID NO: 292958 - DNA, 30 bp, Artificial Sequence
  Description of Artificial Sequence: Synthetic oligonucleotide
gagacaaagagcgagctctgagagcctttc

SEQ ID NO: 292959 - DNA, 30 bp, Artificial Sequence
  Description of Artificial Sequence: Synthetic oligonucleotide
agacaaagagcgagctctgagagcctttcg

SEQ ID NO: 292960 - DNA, 29 bp, Artificial Sequence
  Description of Artificial Sequence: Synthetic oligonucleotide
gacaaagagcgagctctgagagcctttcg

SEQ ID NO: 292961 - DNA, 29 bp, Artificial Sequence
  Description of Artificial Sequence: Synthetic oligonucleotide
acaaagagcgagctctgagagcctttcgg

SEQ ID NO: 292962 - DNA, 28 bp, Artificial Sequence
  Description of Artificial Sequence: Synthetic oligonucleotide
caaagagcgagctctgagagcctttcgg

SEQ ID NO: 292963 - DNA, 30 bp, Artificial Sequence
  Description of Artificial Sequence: Synthetic oligonucleotide
aaagagcgagctctgagagcctttcggaag

SEQ ID NO: 292964 - DNA, 29 bp, Artificial Sequence
  Description of Artificial Sequence: Synthetic oligonucleotide
aagagcgagctctgagagcctttcggaag

SEQ ID NO: 292965 - DNA, 28 bp, Artificial Sequence
  Description of Artificial Sequence: Synthetic oligonucleotide
agagcgagctctgagagcctttcggaag

SEQ ID NO: 292966 - DNA, 27 bp, Artificial Sequence
  Description of Artificial Sequence: Synthetic oligonucleotide
gagcgagctctgagagcctttcggaag

SEQ ID NO: 292967 - DNA, 28 bp, Artificial Sequence
  Description of Artificial Sequence: Synthetic oligonucleotide
agcgagctctgagagcctttcggaagac

SEQ ID NO: 292968 - DNA, 27 bp, Artificial Sequence
  Description of Artificial Sequence: Synthetic oligonucleotide
gcgagctctgagagcctttcggaagac

SEQ ID NO: 292969 - DNA, 31 bp, Artificial Sequence
  Description of Artificial Sequence: Synthetic oligonucleotide
cgagctctgagagcctttcggaagacatatc

SEQ ID NO: 292970 - DNA, 32 bp, Artificial Sequence
  Description of Artificial Sequence: Synthetic oligonucleotide
gagctctgagagcctttcggaagacatatcac

SEQ ID NO: 292971 - DNA, 36 bp, Artificial Sequence
  Description of Artificial Sequence: Synthetic oligonucleotide
agctctgagagcctttcggaagacatatcacaaaac

SEQ ID NO: 292972 - DNA, 35 bp, Artificial Sequence
  Description of Artificial Sequence: Synthetic oligonucleotide
gctctgagagcctttcggaagacatatcacaaaac

SEQ ID NO: 292973 - DNA, 36 bp, Artificial Sequence
  Description of Artificial Sequence: Synthetic oligonucleotide
ctctgagagcctttcggaagacatatcacaaaactg

SEQ ID NO: 292974 - DNA, 37 bp, Artificial Sequence
  Description of Artificial Sequence: Synthetic oligonucleotide
tctgagagcctttcggaagacatatcacaaaactgag

SEQ ID NO: 292975 - DNA, 36 bp, Artificial Sequence
  Description of Artificial Sequence: Synthetic oligonucleotide
ctgagagcctttcggaagacatatcacaaaactgag

SEQ ID NO: 292976 - DNA, 36 bp, Artificial Sequence
  Description of Artificial Sequence: Synthetic oligonucleotide
tgagagcctttcggaagacatatcacaaaactgagg

SEQ ID NO: 292977 - DNA, 35 bp, Artificial Sequence
  Description of Artificial Sequence: Synthetic oligonucleotide
gagagcctttcggaagacatatcacaaaactgagg

SEQ ID NO: 292978 - DNA, 35 bp, Artificial Sequence
  Description of Artificial Sequence: Synthetic oligonucleotide
agagcctttcggaagacatatcacaaaactgaggc

SEQ ID NO: 292979 - DNA, 34 bp, Artificial Sequence
  Description of Artificial Sequence: Synthetic oligonucleotide
gagcctttcggaagacatatcacaaaactgaggc

SEQ ID NO: 292980 - DNA, 34 bp, Artificial Sequence
  Description of Artificial Sequence: Synthetic oligonucleotide
agcctttcggaagacatatcacaaaactgaggcc

SEQ ID NO: 292981 - DNA, 33 bp, Artificial Sequence
  Description of Artificial Sequence: Synthetic oligonucleotide
gcctttcggaagacatatcacaaaactgaggcc

SEQ ID NO: 292982 - DNA, 33 bp, Artificial Sequence
  Description of Artificial Sequence: Synthetic oligonucleotide
cctttcggaagacatatcacaaaactgaggccc

SEQ ID NO: 292983 - DNA, 34 bp, Artificial Sequence
  Description of Artificial Sequence: Synthetic oligonucleotide
ctttcggaagacatatcacaaaactgaggccctg

SEQ ID NO: 292984 - DNA, 34 bp, Artificial Sequence
  Description of Artificial Sequence: Synthetic oligonucleotide
tttcggaagacatatcacaaaactgaggccctgg

SEQ ID NO: 292985 - DNA, 33 bp, Artificial Sequence
  Description of Artificial Sequence: Synthetic oligonucleotide
ttcggaagacatatcacaaaactgaggccctgg

SEQ ID NO: 292986 - DNA, 32 bp, Artificial Sequence
  Description of Artificial Sequence: Synthetic oligonucleotide
tcggaagacatatcacaaaactgaggccctgg

SEQ ID NO: 292987 - DNA, 31 bp, Artificial Sequence
  Description of Artificial Sequence: Synthetic oligonucleotide
cggaagacatatcacaaaactgaggccctgg

SEQ ID NO: 292988 - DNA, 31 bp, Artificial Sequence
  Description of Artificial Sequence: Synthetic oligonucleotide
ggaagacatatcacaaaactgaggccctggg

SEQ ID NO: 292989 - DNA, 32 bp, Artificial Sequence
  Description of Artificial Sequence: Synthetic oligonucleotide
gaagacatatcacaaaactgaggccctgggac

SEQ ID NO: 292990 - DNA, 33 bp, Artificial Sequence
  Description of Artificial Sequence: Synthetic oligonucleotide
aagacatatcacaaaactgaggccctgggacac

SEQ ID NO: 292991 - DNA, 32 bp, Artificial Sequence
  Description of Artificial Sequence: Synthetic oligonucleotide
agacatatcacaaaactgaggccctgggacac

SEQ ID NO: 292992 - DNA, 31 bp, Artificial Sequence
  Description of Artificial Sequence: Synthetic oligonucleotide
gacatatcacaaaactgaggccctgggacac

SEQ ID NO: 292993 - DNA, 31 bp, Artificial Sequence
  Description of Artificial Sequence: Synthetic oligonucleotide
acatatcacaaaactgaggccctgggacacc

SEQ ID NO: 292994 - DNA, 30 bp, Artificial Sequence
  Description of Artificial Sequence: Synthetic oligonucleotide
catatcacaaaactgaggccctgggacacc

SEQ ID NO: 292995 - DNA, 30 bp, Artificial Sequence
  Description of Artificial Sequence: Synthetic oligonucleotide
atatcacaaaactgaggccctgggacaccg

SEQ ID NO: 292996 - DNA, 29 bp, Artificial Sequence
  Description of Artificial Sequence: Synthetic oligonucleotide
tatcacaaaactgaggccctgggacaccg

SEQ ID NO: 292997 - DNA, 28 bp, Artificial Sequence
  Description of Artificial Sequence: Synthetic oligonucleotide
atcacaaaactgaggccctgggacaccg

SEQ ID NO: 292998 - DNA, 27 bp, Artificial Sequence
  Description of Artificial Sequence: Synthetic oligonucleotide
tcacaaaactgaggccctgggacaccg

SEQ ID NO: 292999 - DNA, 27 bp, Artificial Sequence
  Description of Artificial Sequence: Synthetic oligonucleotide
cacaaaactgaggccctgggacaccga

SEQ ID NO: 293000 - DNA, 29 bp, Artificial Sequence
  Description of Artificial Sequence: Synthetic oligonucleotide
acaaaactgaggccctgggacaccgattg

SEQ ID NO: 293001 - DNA, 28 bp, Artificial Sequence
  Description of Artificial Sequence: Synthetic oligonucleotide
caaaactgaggccctgggacaccgattg

SEQ ID NO: 293002 - DNA, 28 bp, Artificial Sequence
  Description of Artificial Sequence: Synthetic oligonucleotide
aaaactgaggccctgggacaccgattgc

SEQ ID NO: 293003 - DNA, 27 bp, Artificial Sequence
  Description of Artificial Sequence: Synthetic oligonucleotide
aaactgaggccctgggacaccgattgc

SEQ ID NO: 293004 - DNA, 27 bp, Artificial Sequence
  Description of Artificial Sequence: Synthetic oligonucleotide
aactgaggccctgggacaccgattgca

SEQ ID NO: 293005 - DNA, 27 bp, Artificial Sequence
  Description of Artificial Sequence: Synthetic oligonucleotide
actgaggccctgggacaccgattgcat

SEQ ID NO: 293006 - DNA, 27 bp, Artificial Sequence
  Description of Artificial Sequence: Synthetic oligonucleotide
ctgaggccctgggacaccgattgcata

SEQ ID NO: 293007 - DNA, 29 bp, Artificial Sequence
  Description of Artificial Sequence: Synthetic oligonucleotide
tgaggccctgggacaccgattgcatattg

SEQ ID NO: 293008 - DNA, 28 bp, Artificial Sequence
  Description of Artificial Sequence: Synthetic oligonucleotide
gaggccctgggacaccgattgcatattg

SEQ ID NO: 293009 - DNA, 32 bp, Artificial Sequence
  Description of Artificial Sequence: Synthetic oligonucleotide
aggccctgggacaccgattgcatattgtatac

SEQ ID NO: 293010 - DNA, 31 bp, Artificial Sequence
  Description of Artificial Sequence: Synthetic oligonucleotide
ggccctgggacaccgattgcatattgtatac

SEQ ID NO: 293011 - DNA, 34 bp, Artificial Sequence
  Description of Artificial Sequence: Synthetic oligonucleotide
gccctgggacaccgattgcatattgtatactatc

SEQ ID NO: 293012 - DNA, 35 bp, Artificial Sequence
  Description of Artificial Sequence: Synthetic oligonucleotide
ccctgggacaccgattgcatattgtatactatctc

SEQ ID NO: 293013 - DNA, 35 bp, Artificial Sequence
  Description of Artificial Sequence: Synthetic oligonucleotide
cctgggacaccgattgcatattgtatactatctcc

SEQ ID NO: 293014 - DNA, 38 bp, Artificial Sequence
  Description of Artificial Sequence: Synthetic oligonucleotide
ctgggacaccgattgcatattgtatactatctcctaag

SEQ ID NO: 293015 - DNA, 38 bp, Artificial Sequence
  Description of Artificial Sequence: Synthetic oligonucleotide
tgggacaccgattgcatattgtatactatctcctaagg

SEQ ID NO: 293016 - DNA, 37 bp, Artificial Sequence
  Description of Artificial Sequence: Synthetic oligonucleotide
gggacaccgattgcatattgtatactatctcctaagg

SEQ ID NO: 293017 - DNA, 40 bp, Artificial Sequence
  Description of Artificial Sequence: Synthetic oligonucleotide
ggacaccgattgcatattgtatactatctcctaaggattg

SEQ ID NO: 293018 - DNA, 40 bp, Artificial Sequence
  Description of Artificial Sequence: Synthetic oligonucleotide
gacaccgattgcatattgtatactatctcctaaggattgg

SEQ ID NO: 293019 - DNA, 40 bp, Artificial Sequence
  Description of Artificial Sequence: Synthetic oligonucleotide
acaccgattgcatattgtatactatctcctaaggattggc

SEQ ID NO: 293020 - DNA, 39 bp, Artificial Sequence
  Description of Artificial Sequence: Synthetic oligonucleotide
caccgattgcatattgtatactatctcctaaggattggc

SEQ ID NO: 293021 - DNA, 50 bp, Artificial Sequence
  Description of Artificial Sequence: Synthetic oligonucleotide
accgattgcatattgtatactatctcctaaggattggcatattttataag

SEQ ID NO: 293022 - DNA, 49 bp, Artificial Sequence
  Description of Artificial Sequence: Synthetic oligonucleotide
ccgattgcatattgtatactatctcctaaggattggcatattttataag

SEQ ID NO: 293023 - DNA, 49 bp, Artificial Sequence
  Description of Artificial Sequence: Synthetic oligonucleotide
cgattgcatattgtatactatctcctaaggattggcatattttataagg

SEQ ID NO: 293024 - DNA, 54 bp, Artificial Sequence
  Description of Artificial Sequence: Synthetic oligonucleotide
gattgcatattgtatactatctcctaaggattggcatattttataaggataatg

SEQ ID NO: 293025 - DNA, 56 bp, Artificial Sequence
  Description of Artificial Sequence: Synthetic oligonucleotide
attgcatattgtatactatctcctaaggattggcatattttataaggataatgaac

SEQ ID NO: 293026 - DNA, 55 bp, Artificial Sequence
  Description of Artificial Sequence: Synthetic oligonucleotide
ttgcatattgtatactatctcctaaggattggcatattttataaggataatgaac

SEQ ID NO: 293027 - DNA, 54 bp, Artificial Sequence
  Description of Artificial Sequence: Synthetic oligonucleotide
tgcatattgtatactatctcctaaggattggcatattttataaggataatgaac

SEQ ID NO: 293028 - DNA, 53 bp, Artificial Sequence
  Description of Artificial Sequence: Synthetic oligonucleotide
gcatattgtatactatctcctaaggattggcatattttataaggataatgaac

SEQ ID NO: 293029 - DNA, 54 bp, Artificial Sequence
  Description of Artificial Sequence: Synthetic oligonucleotide
catattgtatactatctcctaaggattggcatattttataaggataatgaactc

SEQ ID NO: 293030 - DNA, 56 bp, Artificial Sequence
  Description of Artificial Sequence: Synthetic oligonucleotide
atattgtatactatctcctaaggattggcatattttataaggataatgaactcatc

SEQ ID NO: 293031 - DNA, 55 bp, Artificial Sequence
  Description of Artificial Sequence: Synthetic oligonucleotide
tattgtatactatctcctaaggattggcatattttataaggataatgaactcatc

SEQ ID NO: 293032 - DNA, 54 bp, Artificial Sequence
  Description of Artificial Sequence: Synthetic oligonucleotide
attgtatactatctcctaaggattggcatattttataaggataatgaactcatc

SEQ ID NO: 293033 - DNA, 53 bp, Artificial Sequence
  Description of Artificial Sequence: Synthetic oligonucleotide
ttgtatactatctcctaaggattggcatattttataaggataatgaactcatc

SEQ ID NO: 293034 - DNA, 52 bp, Artificial Sequence
  Description of Artificial Sequence: Synthetic oligonucleotide
tgtatactatctcctaaggattggcatattttataaggataatgaactcatc

SEQ ID NO: 293035 - DNA, 51 bp, Artificial Sequence
  Description of Artificial Sequence: Synthetic oligonucleotide
gtatactatctcctaaggattggcatattttataaggataatgaactcatc

SEQ ID NO: 293036 - DNA, 52 bp, Artificial Sequence
  Description of Artificial Sequence: Synthetic oligonucleotide
tatactatctcctaaggattggcatattttataaggataatgaactcatcac

SEQ ID NO: 293037 - DNA, 51 bp, Artificial Sequence
  Description of Artificial Sequence: Synthetic oligonucleotide
atactatctcctaaggattggcatattttataaggataatgaactcatcac

SEQ ID NO: 293038 - DNA, 50 bp, Artificial Sequence
  Description of Artificial Sequence: Synthetic oligonucleotide
tactatctcctaaggattggcatattttataaggataatgaactcatcac

SEQ ID NO: 293039 - DNA, 49 bp, Artificial Sequence
  Description of Artificial Sequence: Synthetic oligonucleotide
actatctcctaaggattggcatattttataaggataatgaactcatcac

SEQ ID NO: 293040 - DNA, 48 bp, Artificial Sequence
  Description of Artificial Sequence: Synthetic oligonucleotide
ctatctcctaaggattggcatattttataaggataatgaactcatcac

SEQ ID NO: 293041 - DNA, 49 bp, Artificial Sequence
  Description of Artificial Sequence: Synthetic oligonucleotide
tatctcctaaggattggcatattttataaggataatgaactcatcacag

SEQ ID NO: 293042 - DNA, 48 bp, Artificial Sequence
  Description of Artificial Sequence: Synthetic oligonucleotide
atctcctaaggattggcatattttataaggataatgaactcatcacag

SEQ ID NO: 293043 - DNA, 47 bp, Artificial Sequence
  Description of Artificial Sequence: Synthetic oligonucleotide
tctcctaaggattggcatattttataaggataatgaactcatcacag

SEQ ID NO: 293044 - DNA, 46 bp, Artificial Sequence
  Description of Artificial Sequence: Synthetic oligonucleotide
ctcctaaggattggcatattttataaggataatgaactcatcacag

SEQ ID NO: 293045 - DNA, 46 bp, Artificial Sequence
  Description of Artificial Sequence: Synthetic oligonucleotide
tcctaaggattggcatattttataaggataatgaactcatcacagg

SEQ ID NO: 293046 - DNA, 45 bp, Artificial Sequence
  Description of Artificial Sequence: Synthetic oligonucleotide
cctaaggattggcatattttataaggataatgaactcatcacagg

SEQ ID NO: 293047 - DNA, 48 bp, Artificial Sequence
  Description of Artificial Sequence: Synthetic oligonucleotide
ctaaggattggcatattttataaggataatgaactcatcacaggaaac

SEQ ID NO: 293048 - DNA, 49 bp, Artificial Sequence
  Description of Artificial Sequence: Synthetic oligonucleotide
taaggattggcatattttataaggataatgaactcatcacaggaaacac

SEQ ID NO: 293049 - DNA, 48 bp, Artificial Sequence
  Description of Artificial Sequence: Synthetic oligonucleotide
aaggattggcatattttataaggataatgaactcatcacaggaaacac

SEQ ID NO: 293050 - DNA, 47 bp, Artificial Sequence
  Description of Artificial Sequence: Synthetic oligonucleotide
aggattggcatattttataaggataatgaactcatcacaggaaacac

SEQ ID NO: 293051 - DNA, 46 bp, Artificial Sequence
  Description of Artificial Sequence: Synthetic oligonucleotide
ggattggcatattttataaggataatgaactcatcacaggaaacac

SEQ ID NO: 293052 - DNA, 47 bp, Artificial Sequence
  Description of Artificial Sequence: Synthetic oligonucleotide
gattggcatattttataaggataatgaactcatcacaggaaacacag

SEQ ID NO: 293053 - DNA, 51 bp, Artificial Sequence
  Description of Artificial Sequence: Synthetic oligonucleotide
attggcatattttataaggataatgaactcatcacaggaaacacagtaaag

SEQ ID NO: 293054 - DNA, 50 bp, Artificial Sequence
  Description of Artificial Sequence: Synthetic oligonucleotide
ttggcatattttataaggataatgaactcatcacaggaaacacagtaaag

SEQ ID NO: 293055 - DNA, 49 bp, Artificial Sequence
  Description of Artificial Sequence: Synthetic oligonucleotide
tggcatattttataaggataatgaactcatcacaggaaacacagtaaag

SEQ ID NO: 293056 - DNA, 48 bp, Artificial Sequence
  Description of Artificial Sequence: Synthetic oligonucleotide
ggcatattttataaggataatgaactcatcacaggaaacacagtaaag

SEQ ID NO: 293057 - DNA, 48 bp, Artificial Sequence
  Description of Artificial Sequence: Synthetic oligonucleotide
gcatattttataaggataatgaactcatcacaggaaacacagtaaagg

SEQ ID NO: 293058 - DNA, 48 bp, Artificial Sequence
  Description of Artificial Sequence: Synthetic oligonucleotide
catattttataaggataatgaactcatcacaggaaacacagtaaaggc

SEQ ID NO: 293059 - DNA, 48 bp, Artificial Sequence
  Description of Artificial Sequence: Synthetic oligonucleotide
atattttataaggataatgaactcatcacaggaaacacagtaaaggcc

SEQ ID NO: 293060 - DNA, 47 bp, Artificial Sequence
  Description of Artificial Sequence: Synthetic oligonucleotide
tattttataaggataatgaactcatcacaggaaacacagtaaaggcc

SEQ ID NO: 293061 - DNA, 46 bp, Artificial Sequence
  Description of Artificial Sequence: Synthetic oligonucleotide
attttataaggataatgaactcatcacaggaaacacagtaaaggcc

SEQ ID NO: 293062 - DNA, 45 bp, Artificial Sequence
  Description of Artificial Sequence: Synthetic oligonucleotide
ttttataaggataatgaactcatcacaggaaacacagtaaaggcc

SEQ ID NO: 293063 - DNA, 44 bp, Artificial Sequence
  Description of Artificial Sequence: Synthetic oligonucleotide
tttataaggataatgaactcatcacaggaaacacagtaaaggcc

SEQ ID NO: 293064 - DNA, 43 bp, Artificial Sequence
  Description of Artificial Sequence: Synthetic oligonucleotide
ttataaggataatgaactcatcacaggaaacacagtaaaggcc

SEQ ID NO: 293065 - DNA, 42 bp, Artificial Sequence
  Description of Artificial Sequence: Synthetic oligonucleotide
tataaggataatgaactcatcacaggaaacacagtaaaggcc

SEQ ID NO: 293066 - DNA, 41 bp, Artificial Sequence
  Description of Artificial Sequence: Synthetic oligonucleotide
ataaggataatgaactcatcacaggaaacacagtaaaggcc

SEQ ID NO: 293067 - DNA, 40 bp, Artificial Sequence
  Description of Artificial Sequence: Synthetic oligonucleotide
taaggataatgaactcatcacaggaaacacagtaaaggcc

SEQ ID NO: 293068 - DNA, 39 bp, Artificial Sequence
  Description of Artificial Sequence: Synthetic oligonucleotide
aaggataatgaactcatcacaggaaacacagtaaaggcc

SEQ ID NO: 293069 - DNA, 38 bp, Artificial Sequence
  Description of Artificial Sequence: Synthetic oligonucleotide
aggataatgaactcatcacaggaaacacagtaaaggcc

SEQ ID NO: 293070 - DNA, 37 bp, Artificial Sequence
  Description of Artificial Sequence: Synthetic oligonucleotide
ggataatgaactcatcacaggaaacacagtaaaggcc

SEQ ID NO: 293071 - DNA, 41 bp, Artificial Sequence
  Description of Artificial Sequence: Synthetic oligonucleotide
gataatgaactcatcacaggaaacacagtaaaggccaatag

SEQ ID NO: 293072 - DNA, 41 bp, Artificial Sequence
  Description of Artificial Sequence: Synthetic oligonucleotide
ataatgaactcatcacaggaaacacagtaaaggccaatagc

SEQ ID NO: 293073 - DNA, 40 bp, Artificial Sequence
  Description of Artificial Sequence: Synthetic oligonucleotide
taatgaactcatcacaggaaacacagtaaaggccaatagc

SEQ ID NO: 293074 - DNA, 39 bp, Artificial Sequence
  Description of Artificial Sequence: Synthetic oligonucleotide
aatgaactcatcacaggaaacacagtaaaggccaatagc

SEQ ID NO: 293075 - DNA, 38 bp, Artificial Sequence
  Description of Artificial Sequence: Synthetic oligonucleotide
atgaactcatcacaggaaacacagtaaaggccaatagc

SEQ ID NO: 293076 - DNA, 37 bp, Artificial Sequence
  Description of Artificial Sequence: Synthetic oligonucleotide
tgaactcatcacaggaaacacagtaaaggccaatagc

SEQ ID NO: 293077 - DNA, 36 bp, Artificial Sequence
  Description of Artificial Sequence: Synthetic oligonucleotide
gaactcatcacaggaaacacagtaaaggccaatagc

SEQ ID NO: 293078 - DNA, 42 bp, Artificial Sequence
  Description of Artificial Sequence: Synthetic oligonucleotide
aactcatcacaggaaacacagtaaaggccaatagcttaatac

SEQ ID NO: 293079 - DNA, 41 bp, Artificial Sequence
  Description of Artificial Sequence: Synthetic oligonucleotide
actcatcacaggaaacacagtaaaggccaatagcttaatac

SEQ ID NO: 293080 - DNA, 40 bp, Artificial Sequence
  Description of Artificial Sequence: Synthetic oligonucleotide
ctcatcacaggaaacacagtaaaggccaatagcttaatac

SEQ ID NO: 293081 - DNA, 42 bp, Artificial Sequence
  Description of Artificial Sequence: Synthetic oligonucleotide
tcatcacaggaaacacagtaaaggccaatagcttaatacaag

SEQ ID NO: 293082 - DNA, 41 bp, Artificial Sequence
  Description of Artificial Sequence: Synthetic oligonucleotide
catcacaggaaacacagtaaaggccaatagcttaatacaag

SEQ ID NO: 293083 - DNA, 43 bp, Artificial Sequence
  Description of Artificial Sequence: Synthetic oligonucleotide
atcacaggaaacacagtaaaggccaatagcttaatacaagaag

SEQ ID NO: 293084 - DNA, 42 bp, Artificial Sequence
  Description of Artificial Sequence: Synthetic oligonucleotide
tcacaggaaacacagtaaaggccaatagcttaatacaagaag

SEQ ID NO: 293085 - DNA, 41 bp, Artificial Sequence
  Description of Artificial Sequence: Synthetic oligonucleotide
cacaggaaacacagtaaaggccaatagcttaatacaagaag

SEQ ID NO: 293086 - DNA, 41 bp, Artificial Sequence
  Description of Artificial Sequence: Synthetic oligonucleotide
acaggaaacacagtaaaggccaatagcttaatacaagaagg

SEQ ID NO: 293087 - DNA, 40 bp, Artificial Sequence
  Description of Artificial Sequence: Synthetic oligonucleotide
caggaaacacagtaaaggccaatagcttaatacaagaagg

SEQ ID NO: 293088 - DNA, 41 bp, Artificial Sequence
  Description of Artificial Sequence: Synthetic oligonucleotide
aggaaacacagtaaaggccaatagcttaatacaagaaggag

SEQ ID NO: 293089 - DNA, 40 bp, Artificial Sequence
  Description of Artificial Sequence: Synthetic oligonucleotide
ggaaacacagtaaaggccaatagcttaatacaagaaggag

SEQ ID NO: 293090 - DNA, 40 bp, Artificial Sequence
  Description of Artificial Sequence: Synthetic oligonucleotide
gaaacacagtaaaggccaatagcttaatacaagaaggagc

SEQ ID NO: 293091 - DNA, 41 bp, Artificial Sequence
  Description of Artificial Sequence: Synthetic oligonucleotide
aaacacagtaaaggccaatagcttaatacaagaaggagcag

SEQ ID NO: 293092 - DNA, 40 bp, Artificial Sequence
  Description of Artificial Sequence: Synthetic oligonucleotide
aacacagtaaaggccaatagcttaatacaagaaggagcag

SEQ ID NO: 293093 - DNA, 39 bp, Artificial Sequence
  Description of Artificial Sequence: Synthetic oligonucleotide
acacagtaaaggccaatagcttaatacaagaaggagcag

SEQ ID NO: 293094 - DNA, 38 bp, Artificial Sequence
  Description of Artificial Sequence: Synthetic oligonucleotide
cacagtaaaggccaatagcttaatacaagaaggagcag

SEQ ID NO: 293095 - DNA, 39 bp, Artificial Sequence
  Description of Artificial Sequence: Synthetic oligonucleotide
acagtaaaggccaatagcttaatacaagaaggagcagac

SEQ ID NO: 293096 - DNA, 38 bp, Artificial Sequence
  Description of Artificial Sequence: Synthetic oligonucleotide
cagtaaaggccaatagcttaatacaagaaggagcagac

SEQ ID NO: 293097 - DNA, 39 bp, Artificial Sequence
  Description of Artificial Sequence: Synthetic oligonucleotide
agtaaaggccaatagcttaatacaagaaggagcagactg

SEQ ID NO: 293098 - DNA, 38 bp, Artificial Sequence
  Description of Artificial Sequence: Synthetic oligonucleotide
gtaaaggccaatagcttaatacaagaaggagcagactg

SEQ ID NO: 293099 - DNA, 38 bp, Artificial Sequence
  Description of Artificial Sequence: Synthetic oligonucleotide
taaaggccaatagcttaatacaagaaggagcagactgg

SEQ ID NO: 293100 - DNA, 37 bp, Artificial Sequence
  Description of Artificial Sequence: Synthetic oligonucleotide
aaaggccaatagcttaatacaagaaggagcagactgg

SEQ ID NO: 293101 - DNA, 36 bp, Artificial Sequence
  Description of Artificial Sequence: Synthetic oligonucleotide
aaggccaatagcttaatacaagaaggagcagactgg

SEQ ID NO: 293102 - DNA, 35 bp, Artificial Sequence
  Description of Artificial Sequence: Synthetic oligonucleotide
aggccaatagcttaatacaagaaggagcagactgg

SEQ ID NO: 293103 - DNA, 34 bp, Artificial Sequence
  Description of Artificial Sequence: Synthetic oligonucleotide
ggccaatagcttaatacaagaaggagcagactgg

SEQ ID NO: 293104 - DNA, 34 bp, Artificial Sequence
  Description of Artificial Sequence: Synthetic oligonucleotide
gccaatagcttaatacaagaaggagcagactggg

SEQ ID NO: 293105 - DNA, 35 bp, Artificial Sequence
  Description of Artificial Sequence: Synthetic oligonucleotide
ccaatagcttaatacaagaaggagcagactgggag

SEQ ID NO: 293106 - DNA, 36 bp, Artificial Sequence
  Description of Artificial Sequence: Synthetic oligonucleotide
caatagcttaatacaagaaggagcagactgggagag

SEQ ID NO: 293107 - DNA, 36 bp, Artificial Sequence
  Description of Artificial Sequence: Synthetic oligonucleotide
aatagcttaatacaagaaggagcagactgggagagg

SEQ ID NO: 293108 - DNA, 35 bp, Artificial Sequence
  Description of Artificial Sequence: Synthetic oligonucleotide
atagcttaatacaagaaggagcagactgggagagg

SEQ ID NO: 293109 - DNA, 34 bp, Artificial Sequence
  Description of Artificial Sequence: Synthetic oligonucleotide
tagcttaatacaagaaggagcagactgggagagg

SEQ ID NO: 293110 - DNA, 33 bp, Artificial Sequence
  Description of Artificial Sequence: Synthetic oligonucleotide
agcttaatacaagaaggagcagactgggagagg

SEQ ID NO: 293111 - DNA, 32 bp, Artificial Sequence
  Description of Artificial Sequence: Synthetic oligonucleotide
gcttaatacaagaaggagcagactgggagagg

SEQ ID NO: 293112 - DNA, 33 bp, Artificial Sequence
  Description of Artificial Sequence: Synthetic oligonucleotide
cttaatacaagaaggagcagactgggagaggag

SEQ ID NO: 293113 - DNA, 36 bp, Artificial Sequence
  Description of Artificial Sequence: Synthetic oligonucleotide
ttaatacaagaaggagcagactgggagaggagaaac

SEQ ID NO: 293114 - DNA, 35 bp, Artificial Sequence
  Description of Artificial Sequence: Synthetic oligonucleotide
taatacaagaaggagcagactgggagaggagaaac

SEQ ID NO: 293115 - DNA, 34 bp, Artificial Sequence
  Description of Artificial Sequence: Synthetic oligonucleotide
aatacaagaaggagcagactgggagaggagaaac

SEQ ID NO: 293116 - DNA, 33 bp, Artificial Sequence
  Description of Artificial Sequence: Synthetic oligonucleotide
atacaagaaggagcagactgggagaggagaaac

SEQ ID NO: 293117 - DNA, 32 bp, Artificial Sequence
  Description of Artificial Sequence: Synthetic oligonucleotide
tacaagaaggagcagactgggagaggagaaac

SEQ ID NO: 293118 - DNA, 31 bp, Artificial Sequence
  Description of Artificial Sequence: Synthetic oligonucleotide
acaagaaggagcagactgggagaggagaaac

SEQ ID NO: 293119 - DNA, 30 bp, Artificial Sequence
  Description of Artificial Sequence: Synthetic oligonucleotide
caagaaggagcagactgggagaggagaaac

SEQ ID NO: 293120 - DNA, 30 bp, Artificial Sequence
  Description of Artificial Sequence: Synthetic oligonucleotide
aagaaggagcagactgggagaggagaaacg

SEQ ID NO: 293121 - DNA, 29 bp, Artificial Sequence
  Description of Artificial Sequence: Synthetic oligonucleotide
agaaggagcagactgggagaggagaaacg

SEQ ID NO: 293122 - DNA, 28 bp, Artificial Sequence
  Description of Artificial Sequence: Synthetic oligonucleotide
gaaggagcagactgggagaggagaaacg

SEQ ID NO: 293123 - DNA, 28 bp, Artificial Sequence
  Description of Artificial Sequence: Synthetic oligonucleotide
aaggagcagactgggagaggagaaacgg

SEQ ID NO: 293124 - DNA, 27 bp, Artificial Sequence
  Description of Artificial Sequence: Synthetic oligonucleotide
aggagcagactgggagaggagaaacgg

SEQ ID NO: 293125 - DNA, 26 bp, Artificial Sequence
  Description of Artificial Sequence: Synthetic oligonucleotide
ggagcagactgggagaggagaaacgg

SEQ ID NO: 293126 - DNA, 26 bp, Artificial Sequence
  Description of Artificial Sequence: Synthetic oligonucleotide
gagcagactgggagaggagaaacggc

SEQ ID NO: 293127 - DNA, 27 bp, Artificial Sequence
  Description of Artificial Sequence: Synthetic oligonucleotide
agcagactgggagaggagaaacggcct

SEQ ID NO: 293128 - DNA, 27 bp, Artificial Sequence
  Description of Artificial Sequence: Synthetic oligonucleotide
gcagactgggagaggagaaacggccta

SEQ ID NO: 293129 - DNA, 30 bp, Artificial Sequence
  Description of Artificial Sequence: Synthetic oligonucleotide
cagactgggagaggagaaacggcctaaaag

SEQ ID NO: 293130 - DNA, 31 bp, Artificial Sequence
  Description of Artificial Sequence: Synthetic oligonucleotide
agactgggagaggagaaacggcctaaaagag

SEQ ID NO: 293131 - DNA, 30 bp, Artificial Sequence
  Description of Artificial Sequence: Synthetic oligonucleotide
gactgggagaggagaaacggcctaaaagag

SEQ ID NO: 293132 - DNA, 33 bp, Artificial Sequence
  Description of Artificial Sequence: Synthetic oligonucleotide
actgggagaggagaaacggcctaaaagagtatc

SEQ ID NO: 293133 - DNA, 32 bp, Artificial Sequence
  Description of Artificial Sequence: Synthetic oligonucleotide
ctgggagaggagaaacggcctaaaagagtatc

SEQ ID NO: 293134 - DNA, 33 bp, Artificial Sequence
  Description of Artificial Sequence: Synthetic oligonucleotide
tgggagaggagaaacggcctaaaagagtatcag

SEQ ID NO: 293135 - DNA, 32 bp, Artificial Sequence
  Description of Artificial Sequence: Synthetic oligonucleotide
gggagaggagaaacggcctaaaagagtatcag

SEQ ID NO: 293136 - DNA, 32 bp, Artificial Sequence
  Description of Artificial Sequence: Synthetic oligonucleotide
ggagaggagaaacggcctaaaagagtatcagg

SEQ ID NO: 293137 - DNA, 32 bp, Artificial Sequence
  Description of Artificial Sequence: Synthetic oligonucleotide
gagaggagaaacggcctaaaagagtatcaggg

SEQ ID NO: 293138 - DNA, 33 bp, Artificial Sequence
  Description of Artificial Sequence: Synthetic oligonucleotide
agaggagaaacggcctaaaagagtatcagggac

SEQ ID NO: 293139 - DNA, 32 bp, Artificial Sequence
  Description of Artificial Sequence: Synthetic oligonucleotide
gaggagaaacggcctaaaagagtatcagggac

SEQ ID NO: 293140 - DNA, 38 bp, Artificial Sequence
  Description of Artificial Sequence: Synthetic oligonucleotide
aggagaaacggcctaaaagagtatcagggactttattg

SEQ ID NO: 293141 - DNA, 37 bp, Artificial Sequence
  Description of Artificial Sequence: Synthetic oligonucleotide
ggagaaacggcctaaaagagtatcagggactttattg

SEQ ID NO: 293142 - DNA, 38 bp, Artificial Sequence
  Description of Artificial Sequence: Synthetic oligonucleotide
gagaaacggcctaaaagagtatcagggactttattgtc

SEQ ID NO: 293143 - DNA, 39 bp, Artificial Sequence
  Description of Artificial Sequence: Synthetic oligonucleotide
agaaacggcctaaaagagtatcagggactttattgtctg

SEQ ID NO: 293144 - DNA, 38 bp, Artificial Sequence
  Description of Artificial Sequence: Synthetic oligonucleotide
gaaacggcctaaaagagtatcagggactttattgtctg

SEQ ID NO: 293145 - DNA, 38 bp, Artificial Sequence
  Description of Artificial Sequence: Synthetic oligonucleotide
aaacggcctaaaagagtatcagggactttattgtctgg

SEQ ID NO: 293146 - DNA, 37 bp, Artificial Sequence
  Description of Artificial Sequence: Synthetic oligonucleotide
aacggcctaaaagagtatcagggactttattgtctgg

SEQ ID NO: 293147 - DNA, 36 bp, Artificial Sequence
  Description of Artificial Sequence: Synthetic oligonucleotide
acggcctaaaagagtatcagggactttattgtctgg

SEQ ID NO: 293148 - DNA, 35 bp, Artificial Sequence
  Description of Artificial Sequence: Synthetic oligonucleotide
cggcctaaaagagtatcagggactttattgtctgg

SEQ ID NO: 293149 - DNA, 35 bp, Artificial Sequence
  Description of Artificial Sequence: Synthetic oligonucleotide
ggcctaaaagagtatcagggactttattgtctggc

SEQ ID NO: 293150 - DNA, 39 bp, Artificial Sequence
  Description of Artificial Sequence: Synthetic oligonucleotide
gcctaaaagagtatcagggactttattgtctggctattc

SEQ ID NO: 293151 - DNA, 39 bp, Artificial Sequence
  Description of Artificial Sequence: Synthetic oligonucleotide
cctaaaagagtatcagggactttattgtctggctattcc

SEQ ID NO: 293152 - DNA, 40 bp, Artificial Sequence
  Description of Artificial Sequence: Synthetic oligonucleotide
ctaaaagagtatcagggactttattgtctggctattcctg

SEQ ID NO: 293153 - DNA, 44 bp, Artificial Sequence
  Description of Artificial Sequence: Synthetic oligonucleotide
taaaagagtatcagggactttattgtctggctattcctgatttc

SEQ ID NO: 293154 - DNA, 43 bp, Artificial Sequence
  Description of Artificial Sequence: Synthetic oligonucleotide
aaaagagtatcagggactttattgtctggctattcctgatttc

SEQ ID NO: 293155 - DNA, 42 bp, Artificial Sequence
  Description of Artificial Sequence: Synthetic oligonucleotide
aaagagtatcagggactttattgtctggctattcctgatttc

SEQ ID NO: 293156 - DNA, 41 bp, Artificial Sequence
  Description of Artificial Sequence: Synthetic oligonucleotide
aagagtatcagggactttattgtctggctattcctgatttc

SEQ ID NO: 293157 - DNA, 40 bp, Artificial Sequence
  Description of Artificial Sequence: Synthetic oligonucleotide
agagtatcagggactttattgtctggctattcctgatttc

SEQ ID NO: 293158 - DNA, 39 bp, Artificial Sequence
  Description of Artificial Sequence: Synthetic oligonucleotide
gagtatcagggactttattgtctggctattcctgatttc

SEQ ID NO: 293159 - DNA, 42 bp, Artificial Sequence
  Description of Artificial Sequence: Synthetic oligonucleotide
agtatcagggactttattgtctggctattcctgatttcaatc

SEQ ID NO: 293160 - DNA, 41 bp, Artificial Sequence
  Description of Artificial Sequence: Synthetic oligonucleotide
gtatcagggactttattgtctggctattcctgatttcaatc

SEQ ID NO: 293161 - DNA, 42 bp, Artificial Sequence
  Description of Artificial Sequence: Synthetic oligonucleotide
tatcagggactttattgtctggctattcctgatttcaatcag

SEQ ID NO: 293162 - DNA, 41 bp, Artificial Sequence
  Description of Artificial Sequence: Synthetic oligonucleotide
atcagggactttattgtctggctattcctgatttcaatcag

SEQ ID NO: 293163 - DNA, 40 bp, Artificial Sequence
  Description of Artificial Sequence: Synthetic oligonucleotide
tcagggactttattgtctggctattcctgatttcaatcag

SEQ ID NO: 293164 - DNA, 39 bp, Artificial Sequence
  Description of Artificial Sequence: Synthetic oligonucleotide
cagggactttattgtctggctattcctgatttcaatcag

SEQ ID NO: 293165 - DNA, 39 bp, Artificial Sequence
  Description of Artificial Sequence: Synthetic oligonucleotide
agggactttattgtctggctattcctgatttcaatcagg

SEQ ID NO: 293166 - DNA, 38 bp, Artificial Sequence
  Description of Artificial Sequence: Synthetic oligonucleotide
gggactttattgtctggctattcctgatttcaatcagg

SEQ ID NO: 293167 - DNA, 38 bp, Artificial Sequence
  Description of Artificial Sequence: Synthetic oligonucleotide
ggactttattgtctggctattcctgatttcaatcaggc

SEQ ID NO: 293168 - DNA, 39 bp, Artificial Sequence
  Description of Artificial Sequence: Synthetic oligonucleotide
gactttattgtctggctattcctgatttcaatcaggcag

SEQ ID NO: 293169 - DNA, 39 bp, Artificial Sequence
  Description of Artificial Sequence: Synthetic oligonucleotide
actttattgtctggctattcctgatttcaatcaggcagc

SEQ ID NO: 293170 - DNA, 38 bp, Artificial Sequence
  Description of Artificial Sequence: Synthetic oligonucleotide
ctttattgtctggctattcctgatttcaatcaggcagc

SEQ ID NO: 293171 - DNA, 39 bp, Artificial Sequence
  Description of Artificial Sequence: Synthetic oligonucleotide
tttattgtctggctattcctgatttcaatcaggcagctc

SEQ ID NO: 293172 - DNA, 38 bp, Artificial Sequence
  Description of Artificial Sequence: Synthetic oligonucleotide
ttattgtctggctattcctgatttcaatcaggcagctc

SEQ ID NO: 293173 - DNA, 37 bp, Artificial Sequence
  Description of Artificial Sequence: Synthetic oligonucleotide
tattgtctggctattcctgatttcaatcaggcagctc

SEQ ID NO: 293174 - DNA, 36 bp, Artificial Sequence
  Description of Artificial Sequence: Synthetic oligonucleotide
attgtctggctattcctgatttcaatcaggcagctc

SEQ ID NO: 293175 - DNA, 35 bp, Artificial Sequence
  Description of Artificial Sequence: Synthetic oligonucleotide
ttgtctggctattcctgatttcaatcaggcagctc

SEQ ID NO: 293176 - DNA, 34 bp, Artificial Sequence
  Description of Artificial Sequence: Synthetic oligonucleotide
tgtctggctattcctgatttcaatcaggcagctc

SEQ ID NO: 293177 - DNA, 33 bp, Artificial Sequence
  Description of Artificial Sequence: Synthetic oligonucleotide
gtctggctattcctgatttcaatcaggcagctc

SEQ ID NO: 293178 - DNA, 35 bp, Artificial Sequence
  Description of Artificial Sequence: Synthetic oligonucleotide
tctggctattcctgatttcaatcaggcagctcaac

SEQ ID NO: 293179 - DNA, 34 bp, Artificial Sequence
  Description of Artificial Sequence: Synthetic oligonucleotide
ctggctattcctgatttcaatcaggcagctcaac

SEQ ID NO: 293180 - DNA, 35 bp, Artificial Sequence
  Description of Artificial Sequence: Synthetic oligonucleotide
tggctattcctgatttcaatcaggcagctcaactc

SEQ ID NO: 293181 - DNA, 34 bp, Artificial Sequence
  Description of Artificial Sequence: Synthetic oligonucleotide
ggctattcctgatttcaatcaggcagctcaactc

SEQ ID NO: 293182 - DNA, 36 bp, Artificial Sequence
  Description of Artificial Sequence: Synthetic oligonucleotide
gctattcctgatttcaatcaggcagctcaactcttc

SEQ ID NO: 293183 - DNA, 36 bp, Artificial Sequence
  Description of Artificial Sequence: Synthetic oligonucleotide
ctattcctgatttcaatcaggcagctcaactcttcc

SEQ ID NO: 293184 - DNA, 38 bp, Artificial Sequence
  Description of Artificial Sequence: Synthetic oligonucleotide
tattcctgatttcaatcaggcagctcaactcttccatg

SEQ ID NO: 293185 - DNA, 37 bp, Artificial Sequence
  Description of Artificial Sequence: Synthetic oligonucleotide
attcctgatttcaatcaggcagctcaactcttccatg

SEQ ID NO: 293186 - DNA, 36 bp, Artificial Sequence
  Description of Artificial Sequence: Synthetic oligonucleotide
ttcctgatttcaatcaggcagctcaactcttccatg

SEQ ID NO: 293187 - DNA, 35 bp, Artificial Sequence
  Description of Artificial Sequence: Synthetic oligonucleotide
tcctgatttcaatcaggcagctcaactcttccatg

SEQ ID NO: 293188 - DNA, 34 bp, Artificial Sequence
  Description of Artificial Sequence: Synthetic oligonucleotide
cctgatttcaatcaggcagctcaactcttccatg

SEQ ID NO: 293189 - DNA, 35 bp, Artificial Sequence
  Description of Artificial Sequence: Synthetic oligonucleotide
ctgatttcaatcaggcagctcaactcttccatgac

SEQ ID NO: 293190 - DNA, 36 bp, Artificial Sequence
  Description of Artificial Sequence: Synthetic oligonucleotide
tgatttcaatcaggcagctcaactcttccatgacac

SEQ ID NO: 293191 - DNA, 35 bp, Artificial Sequence
  Description of Artificial Sequence: Synthetic oligonucleotide
gatttcaatcaggcagctcaactcttccatgacac

SEQ ID NO: 293192 - DNA, 36 bp, Artificial Sequence
  Description of Artificial Sequence: Synthetic oligonucleotide
atttcaatcaggcagctcaactcttccatgacactg

SEQ ID NO: 293193 - DNA, 35 bp, Artificial Sequence
  Description of Artificial Sequence: Synthetic oligonucleotide
tttcaatcaggcagctcaactcttccatgacactg

SEQ ID NO: 293194 - DNA, 34 bp, Artificial Sequence
  Description of Artificial Sequence: Synthetic oligonucleotide
ttcaatcaggcagctcaactcttccatgacactg

SEQ ID NO: 293195 - DNA, 33 bp, Artificial Sequence
  Description of Artificial Sequence: Synthetic oligonucleotide
tcaatcaggcagctcaactcttccatgacactg

SEQ ID NO: 293196 - DNA, 32 bp, Artificial Sequence
  Description of Artificial Sequence: Synthetic oligonucleotide
caatcaggcagctcaactcttccatgacactg

SEQ ID NO: 293197 - DNA, 35 bp, Artificial Sequence
  Description of Artificial Sequence: Synthetic oligonucleotide
aatcaggcagctcaactcttccatgacactgtatc

SEQ ID NO: 293198 - DNA, 34 bp, Artificial Sequence
  Description of Artificial Sequence: Synthetic oligonucleotide
atcaggcagctcaactcttccatgacactgtatc

SEQ ID NO: 293199 - DNA, 33 bp, Artificial Sequence
  Description of Artificial Sequence: Synthetic oligonucleotide
tcaggcagctcaactcttccatgacactgtatc

SEQ ID NO: 293200 - DNA, 32 bp, Artificial Sequence
  Description of Artificial Sequence: Synthetic oligonucleotide
caggcagctcaactcttccatgacactgtatc

SEQ ID NO: 293201 - DNA, 34 bp, Artificial Sequence
  Description of Artificial Sequence: Synthetic oligonucleotide
aggcagctcaactcttccatgacactgtatcaac

SEQ ID NO: 293202 - DNA, 33 bp, Artificial Sequence
  Description of Artificial Sequence: Synthetic oligonucleotide
ggcagctcaactcttccatgacactgtatcaac

SEQ ID NO: 293203 - DNA, 38 bp, Artificial Sequence
  Description of Artificial Sequence: Synthetic oligonucleotide
gcagctcaactcttccatgacactgtatcaacattttc

SEQ ID NO: 293204 - DNA, 40 bp, Artificial Sequence
  Description of Artificial Sequence: Synthetic oligonucleotide
cagctcaactcttccatgacactgtatcaacattttcatc

SEQ ID NO: 293205 - DNA, 40 bp, Artificial Sequence
  Description of Artificial Sequence: Synthetic oligonucleotide
agctcaactcttccatgacactgtatcaacattttcatcc

SEQ ID NO: 293206 - DNA, 39 bp, Artificial Sequence
  Description of Artificial Sequence: Synthetic oligonucleotide
gctcaactcttccatgacactgtatcaacattttcatcc

SEQ ID NO: 293207 - DNA, 42 bp, Artificial Sequence
  Description of Artificial Sequence: Synthetic oligonucleotide
ctcaactcttccatgacactgtatcaacattttcatcctatg

SEQ ID NO: 293208 - DNA, 44 bp, Artificial Sequence
  Description of Artificial Sequence: Synthetic oligonucleotide
tcaactcttccatgacactgtatcaacattttcatcctatgtac

SEQ ID NO: 293209 - DNA, 43 bp, Artificial Sequence
  Description of Artificial Sequence: Synthetic oligonucleotide
caactcttccatgacactgtatcaacattttcatcctatgtac

SEQ ID NO: 293210 - DNA, 44 bp, Artificial Sequence
  Description of Artificial Sequence: Synthetic oligonucleotide
aactcttccatgacactgtatcaacattttcatcctatgtactc

SEQ ID NO: 293211 - DNA, 43 bp, Artificial Sequence
  Description of Artificial Sequence: Synthetic oligonucleotide
actcttccatgacactgtatcaacattttcatcctatgtactc

SEQ ID NO: 293212 - DNA, 42 bp, Artificial Sequence
  Description of Artificial Sequence: Synthetic oligonucleotide
ctcttccatgacactgtatcaacattttcatcctatgtactc

SEQ ID NO: 293213 - DNA, 44 bp, Artificial Sequence
  Description of Artificial Sequence: Synthetic oligonucleotide
tcttccatgacactgtatcaacattttcatcctatgtactcatg

SEQ ID NO: 293214 - DNA, 43 bp, Artificial Sequence
  Description of Artificial Sequence: Synthetic oligonucleotide
cttccatgacactgtatcaacattttcatcctatgtactcatg

SEQ ID NO: 293215 - DNA, 43 bp, Artificial Sequence
  Description of Artificial Sequence: Synthetic oligonucleotide
ttccatgacactgtatcaacattttcatcctatgtactcatgg

SEQ ID NO: 293216 - DNA, 42 bp, Artificial Sequence
  Description of Artificial Sequence: Synthetic oligonucleotide
tccatgacactgtatcaacattttcatcctatgtactcatgg

SEQ ID NO: 293217 - DNA, 41 bp, Artificial Sequence
  Description of Artificial Sequence: Synthetic oligonucleotide
ccatgacactgtatcaacattttcatcctatgtactcatgg

SEQ ID NO: 293218 - DNA, 50 bp, Artificial Sequence
  Description of Artificial Sequence: Synthetic oligonucleotide
catgacactgtatcaacattttcatcctatgtactcatggaatataaaac

SEQ ID NO: 293219 - DNA, 54 bp, Artificial Sequence
  Description of Artificial Sequence: Synthetic oligonucleotide
atgacactgtatcaacattttcatcctatgtactcatggaatataaaacaattg

SEQ ID NO: 293220 - DNA, 53 bp, Artificial Sequence
  Description of Artificial Sequence: Synthetic oligonucleotide
tgacactgtatcaacattttcatcctatgtactcatggaatataaaacaattg

SEQ ID NO: 293221 - DNA, 52 bp, Artificial Sequence
  Description of Artificial Sequence: Synthetic oligonucleotide
gacactgtatcaacattttcatcctatgtactcatggaatataaaacaattg

SEQ ID NO: 293222 - DNA, 53 bp, Artificial Sequence
  Description of Artificial Sequence: Synthetic oligonucleotide
acactgtatcaacattttcatcctatgtactcatggaatataaaacaattgtg

SEQ ID NO: 293223 - DNA, 52 bp, Artificial Sequence
  Description of Artificial Sequence: Synthetic oligonucleotide
cactgtatcaacattttcatcctatgtactcatggaatataaaacaattgtg

SEQ ID NO: 293224 - DNA, 53 bp, Artificial Sequence
  Description of Artificial Sequence: Synthetic oligonucleotide
actgtatcaacattttcatcctatgtactcatggaatataaaacaattgtgac

SEQ ID NO: 293225 - DNA, 52 bp, Artificial Sequence
  Description of Artificial Sequence: Synthetic oligonucleotide
ctgtatcaacattttcatcctatgtactcatggaatataaaacaattgtgac

SEQ ID NO: 293226 - DNA, 57 bp, Artificial Sequence
  Description of Artificial Sequence: Synthetic oligonucleotide
tgtatcaacattttcatcctatgtactcatggaatataaaacaattgtgacttttac

SEQ ID NO: 293227 - DNA, 56 bp, Artificial Sequence
  Description of Artificial Sequence: Synthetic oligonucleotide
gtatcaacattttcatcctatgtactcatggaatataaaacaattgtgacttttac

SEQ ID NO: 293228 - DNA, 57 bp, Artificial Sequence
  Description of Artificial Sequence: Synthetic oligonucleotide
tatcaacattttcatcctatgtactcatggaatataaaacaattgtgacttttactg

SEQ ID NO: 293229 - DNA, 56 bp, Artificial Sequence
  Description of Artificial Sequence: Synthetic oligonucleotide
atcaacattttcatcctatgtactcatggaatataaaacaattgtgacttttactg

SEQ ID NO: 293230 - DNA, 55 bp, Artificial Sequence
  Description of Artificial Sequence: Synthetic oligonucleotide
tcaacattttcatcctatgtactcatggaatataaaacaattgtgacttttactg

SEQ ID NO: 293231 - DNA, 54 bp, Artificial Sequence
  Description of Artificial Sequence: Synthetic oligonucleotide
caacattttcatcctatgtactcatggaatataaaacaattgtgacttttactg

SEQ ID NO: 293232 - DNA, 55 bp, Artificial Sequence
  Description of Artificial Sequence: Synthetic oligonucleotide
aacattttcatcctatgtactcatggaatataaaacaattgtgacttttactgtc

SEQ ID NO: 293233 - DNA, 54 bp, Artificial Sequence
  Description of Artificial Sequence: Synthetic oligonucleotide
acattttcatcctatgtactcatggaatataaaacaattgtgacttttactgtc

SEQ ID NO: 293234 - DNA, 53 bp, Artificial Sequence
  Description of Artificial Sequence: Synthetic oligonucleotide
cattttcatcctatgtactcatggaatataaaacaattgtgacttttactgtc

SEQ ID NO: 293235 - DNA, 56 bp, Artificial Sequence
  Description of Artificial Sequence: Synthetic oligonucleotide
attttcatcctatgtactcatggaatataaaacaattgtgacttttactgtctaag

SEQ ID NO: 293236 - DNA, 55 bp, Artificial Sequence
  Description of Artificial Sequence: Synthetic oligonucleotide
ttttcatcctatgtactcatggaatataaaacaattgtgacttttactgtctaag

SEQ ID NO: 293237 - DNA, 54 bp, Artificial Sequence
  Description of Artificial Sequence: Synthetic oligonucleotide
tttcatcctatgtactcatggaatataaaacaattgtgacttttactgtctaag

SEQ ID NO: 293238 - DNA, 53 bp, Artificial Sequence
  Description of Artificial Sequence: Synthetic oligonucleotide
ttcatcctatgtactcatggaatataaaacaattgtgacttttactgtctaag

SEQ ID NO: 293239 - DNA, 52 bp, Artificial Sequence
  Description of Artificial Sequence: Synthetic oligonucleotide
tcatcctatgtactcatggaatataaaacaattgtgacttttactgtctaag

SEQ ID NO: 293240 - DNA, 51 bp, Artificial Sequence
  Description of Artificial Sequence: Synthetic oligonucleotide
catcctatgtactcatggaatataaaacaattgtgacttttactgtctaag

SEQ ID NO: 293241 - DNA, 52 bp, Artificial Sequence
  Description of Artificial Sequence: Synthetic oligonucleotide
atcctatgtactcatggaatataaaacaattgtgacttttactgtctaagtc

SEQ ID NO: 293242 - DNA, 51 bp, Artificial Sequence
  Description of Artificial Sequence: Synthetic oligonucleotide
tcctatgtactcatggaatataaaacaattgtgacttttactgtctaagtc

SEQ ID NO: 293243 - DNA, 50 bp, Artificial Sequence
  Description of Artificial Sequence: Synthetic oligonucleotide
cctatgtactcatggaatataaaacaattgtgacttttactgtctaagtc

SEQ ID NO: 293244 - DNA, 51 bp, Artificial Sequence
  Description of Artificial Sequence: Synthetic oligonucleotide
ctatgtactcatggaatataaaacaattgtgacttttactgtctaagtcag

SEQ ID NO: 293245 - DNA, 54 bp, Artificial Sequence
  Description of Artificial Sequence: Synthetic oligonucleotide
tatgtactcatggaatataaaacaattgtgacttttactgtctaagtcagtatg

SEQ ID NO: 293246 - DNA, 53 bp, Artificial Sequence
  Description of Artificial Sequence: Synthetic oligonucleotide
atgtactcatggaatataaaacaattgtgacttttactgtctaagtcagtatg

SEQ ID NO: 293247 - DNA, 52 bp, Artificial Sequence
  Description of Artificial Sequence: Synthetic oligonucleotide
tgtactcatggaatataaaacaattgtgacttttactgtctaagtcagtatg

SEQ ID NO: 293248 - DNA, 51 bp, Artificial Sequence
  Description of Artificial Sequence: Synthetic oligonucleotide
gtactcatggaatataaaacaattgtgacttttactgtctaagtcagtatg

SEQ ID NO: 293249 - DNA, 54 bp, Artificial Sequence
  Description of Artificial Sequence: Synthetic oligonucleotide
tactcatggaatataaaacaattgtgacttttactgtctaagtcagtatgtttg

SEQ ID NO: 293250 - DNA, 53 bp, Artificial Sequence
  Description of Artificial Sequence: Synthetic oligonucleotide
actcatggaatataaaacaattgtgacttttactgtctaagtcagtatgtttg

SEQ ID NO: 293251 - DNA, 52 bp, Artificial Sequence
  Description of Artificial Sequence: Synthetic oligonucleotide
ctcatggaatataaaacaattgtgacttttactgtctaagtcagtatgtttg

SEQ ID NO: 293252 - DNA, 52 bp, Artificial Sequence
  Description of Artificial Sequence: Synthetic oligonucleotide
tcatggaatataaaacaattgtgacttttactgtctaagtcagtatgtttgc

SEQ ID NO: 293253 - DNA, 51 bp, Artificial Sequence
  Description of Artificial Sequence: Synthetic oligonucleotide
catggaatataaaacaattgtgacttttactgtctaagtcagtatgtttgc

SEQ ID NO: 293254 - DNA, 51 bp, Artificial Sequence
  Description of Artificial Sequence: Synthetic oligonucleotide
atggaatataaaacaattgtgacttttactgtctaagtcagtatgtttgcc

SEQ ID NO: 293255 - DNA, 50 bp, Artificial Sequence
  Description of Artificial Sequence: Synthetic oligonucleotide
tggaatataaaacaattgtgacttttactgtctaagtcagtatgtttgcc

SEQ ID NO: 293256 - DNA, 49 bp, Artificial Sequence
  Description of Artificial Sequence: Synthetic oligonucleotide
ggaatataaaacaattgtgacttttactgtctaagtcagtatgtttgcc

SEQ ID NO: 293257 - DNA, 52 bp, Artificial Sequence
  Description of Artificial Sequence: Synthetic oligonucleotide
gaatataaaacaattgtgacttttactgtctaagtcagtatgtttgccttag

SEQ ID NO: 293258 - DNA, 55 bp, Artificial Sequence
  Description of Artificial Sequence: Synthetic oligonucleotide
aatataaaacaattgtgacttttactgtctaagtcagtatgtttgccttagtaag

SEQ ID NO: 293259 - DNA, 54 bp, Artificial Sequence
  Description of Artificial Sequence: Synthetic oligonucleotide
atataaaacaattgtgacttttactgtctaagtcagtatgtttgccttagtaag

SEQ ID NO: 293260 - DNA, 53 bp, Artificial Sequence
  Description of Artificial Sequence: Synthetic oligonucleotide
tataaaacaattgtgacttttactgtctaagtcagtatgtttgccttagtaag

SEQ ID NO: 293261 - DNA, 52 bp, Artificial Sequence
  Description of Artificial Sequence: Synthetic oligonucleotide
ataaaacaattgtgacttttactgtctaagtcagtatgtttgccttagtaag

SEQ ID NO: 293262 - DNA, 51 bp, Artificial Sequence
  Description of Artificial Sequence: Synthetic oligonucleotide
taaaacaattgtgacttttactgtctaagtcagtatgtttgccttagtaag

SEQ ID NO: 293263 - DNA, 50 bp, Artificial Sequence
  Description of Artificial Sequence: Synthetic oligonucleotide
aaaacaattgtgacttttactgtctaagtcagtatgtttgccttagtaag

SEQ ID NO: 293264 - DNA, 49 bp, Artificial Sequence
  Description of Artificial Sequence: Synthetic oligonucleotide
aaacaattgtgacttttactgtctaagtcagtatgtttgccttagtaag

SEQ ID NO: 293265 - DNA, 48 bp, Artificial Sequence
  Description of Artificial Sequence: Synthetic oligonucleotide
aacaattgtgacttttactgtctaagtcagtatgtttgccttagtaag

SEQ ID NO: 293266 - DNA, 47 bp, Artificial Sequence
  Description of Artificial Sequence: Synthetic oligonucleotide
acaattgtgacttttactgtctaagtcagtatgtttgccttagtaag

SEQ ID NO: 293267 - DNA, 46 bp, Artificial Sequence
  Description of Artificial Sequence: Synthetic oligonucleotide
caattgtgacttttactgtctaagtcagtatgtttgccttagtaag

SEQ ID NO: 293268 - DNA, 47 bp, Artificial Sequence
  Description of Artificial Sequence: Synthetic oligonucleotide
aattgtgacttttactgtctaagtcagtatgtttgccttagtaagac

SEQ ID NO: 293269 - DNA, 46 bp, Artificial Sequence
  Description of Artificial Sequence: Synthetic oligonucleotide
attgtgacttttactgtctaagtcagtatgtttgccttagtaagac

SEQ ID NO: 293270 - DNA, 45 bp, Artificial Sequence
  Description of Artificial Sequence: Synthetic oligonucleotide
ttgtgacttttactgtctaagtcagtatgtttgccttagtaagac

SEQ ID NO: 293271 - DNA, 44 bp, Artificial Sequence
  Description of Artificial Sequence: Synthetic oligonucleotide
tgtgacttttactgtctaagtcagtatgtttgccttagtaagac

SEQ ID NO: 293272 - DNA, 43 bp, Artificial Sequence
  Description of Artificial Sequence: Synthetic oligonucleotide
gtgacttttactgtctaagtcagtatgtttgccttagtaagac

SEQ ID NO: 293273 - DNA, 43 bp, Artificial Sequence
  Description of Artificial Sequence: Synthetic oligonucleotide
tgacttttactgtctaagtcagtatgtttgccttagtaagacc

SEQ ID NO: 293274 - DNA, 42 bp, Artificial Sequence
  Description of Artificial Sequence: Synthetic oligonucleotide
gacttttactgtctaagtcagtatgtttgccttagtaagacc

SEQ ID NO: 293275 - DNA, 43 bp, Artificial Sequence
  Description of Artificial Sequence: Synthetic oligonucleotide
acttttactgtctaagtcagtatgtttgccttagtaagaccag

SEQ ID NO: 293276 - DNA, 42 bp, Artificial Sequence
  Description of Artificial Sequence: Synthetic oligonucleotide
cttttactgtctaagtcagtatgtttgccttagtaagaccag

SEQ ID NO: 293277 - DNA, 44 bp, Artificial Sequence
  Description of Artificial Sequence: Synthetic oligonucleotide
ttttactgtctaagtcagtatgtttgccttagtaagaccagaac

SEQ ID NO: 293278 - DNA, 43 bp, Artificial Sequence
  Description of Artificial Sequence: Synthetic oligonucleotide
tttactgtctaagtcagtatgtttgccttagtaagaccagaac

SEQ ID NO: 293279 - DNA, 42 bp, Artificial Sequence
  Description of Artificial Sequence: Synthetic oligonucleotide
ttactgtctaagtcagtatgtttgccttagtaagaccagaac

SEQ ID NO: 293280 - DNA, 41 bp, Artificial Sequence
  Description of Artificial Sequence: Synthetic oligonucleotide
tactgtctaagtcagtatgtttgccttagtaagaccagaac

SEQ ID NO: 293281 - DNA, 40 bp, Artificial Sequence
  Description of Artificial Sequence: Synthetic oligonucleotide
actgtctaagtcagtatgtttgccttagtaagaccagaac

SEQ ID NO: 293282 - DNA, 39 bp, Artificial Sequence
  Description of Artificial Sequence: Synthetic oligonucleotide
ctgtctaagtcagtatgtttgccttagtaagaccagaac

SEQ ID NO: 293283 - DNA, 40 bp, Artificial Sequence
  Description of Artificial Sequence: Synthetic oligonucleotide
tgtctaagtcagtatgtttgccttagtaagaccagaactc

SEQ ID NO: 293284 - DNA, 39 bp, Artificial Sequence
  Description of Artificial Sequence: Synthetic oligonucleotide
gtctaagtcagtatgtttgccttagtaagaccagaactc

SEQ ID NO: 293285 - DNA, 40 bp, Artificial Sequence
  Description of Artificial Sequence: Synthetic oligonucleotide
tctaagtcagtatgtttgccttagtaagaccagaactcag

SEQ ID NO: 293286 - DNA, 39 bp, Artificial Sequence
  Description of Artificial Sequence: Synthetic oligonucleotide
ctaagtcagtatgtttgccttagtaagaccagaactcag

SEQ ID NO: 293287 - DNA, 39 bp, Artificial Sequence
  Description of Artificial Sequence: Synthetic oligonucleotide
taagtcagtatgtttgccttagtaagaccagaactcagg

SEQ ID NO: 293288 - DNA, 38 bp, Artificial Sequence
  Description of Artificial Sequence: Synthetic oligonucleotide
aagtcagtatgtttgccttagtaagaccagaactcagg

SEQ ID NO: 293289 - DNA, 37 bp, Artificial Sequence
  Description of Artificial Sequence: Synthetic oligonucleotide
agtcagtatgtttgccttagtaagaccagaactcagg

SEQ ID NO: 293290 - DNA, 36 bp, Artificial Sequence
  Description of Artificial Sequence: Synthetic oligonucleotide
gtcagtatgtttgccttagtaagaccagaactcagg

SEQ ID NO: 293291 - DNA, 36 bp, Artificial Sequence
  Description of Artificial Sequence: Synthetic oligonucleotide
tcagtatgtttgccttagtaagaccagaactcaggg

SEQ ID NO: 293292 - DNA, 35 bp, Artificial Sequence
  Description of Artificial Sequence: Synthetic oligonucleotide
cagtatgtttgccttagtaagaccagaactcaggg

SEQ ID NO: 293293 - DNA, 39 bp, Artificial Sequence
  Description of Artificial Sequence: Synthetic oligonucleotide
agtatgtttgccttagtaagaccagaactcagggaatag

SEQ ID NO: 293294 - DNA, 38 bp, Artificial Sequence
  Description of Artificial Sequence: Synthetic oligonucleotide
gtatgtttgccttagtaagaccagaactcagggaatag

SEQ ID NO: 293295 - DNA, 38 bp, Artificial Sequence
  Description of Artificial Sequence: Synthetic oligonucleotide
tatgtttgccttagtaagaccagaactcagggaatagg

SEQ ID NO: 293296 - DNA, 37 bp, Artificial Sequence
  Description of Artificial Sequence: Synthetic oligonucleotide
atgtttgccttagtaagaccagaactcagggaatagg

SEQ ID NO: 293297 - DNA, 36 bp, Artificial Sequence
  Description of Artificial Sequence: Synthetic oligonucleotide
tgtttgccttagtaagaccagaactcagggaatagg

SEQ ID NO: 293298 - DNA, 35 bp, Artificial Sequence
  Description of Artificial Sequence: Synthetic oligonucleotide
gtttgccttagtaagaccagaactcagggaatagg

SEQ ID NO: 293299 - DNA, 36 bp, Artificial Sequence
  Description of Artificial Sequence: Synthetic oligonucleotide
tttgccttagtaagaccagaactcagggaataggtc

SEQ ID NO: 293300 - DNA, 35 bp, Artificial Sequence
  Description of Artificial Sequence: Synthetic oligonucleotide
ttgccttagtaagaccagaactcagggaataggtc

SEQ ID NO: 293301 - DNA, 34 bp, Artificial Sequence
  Description of Artificial Sequence: Synthetic oligonucleotide
tgccttagtaagaccagaactcagggaataggtc

SEQ ID NO: 293302 - DNA, 33 bp, Artificial Sequence
  Description of Artificial Sequence: Synthetic oligonucleotide
gccttagtaagaccagaactcagggaataggtc

SEQ ID NO: 293303 - DNA, 39 bp, Artificial Sequence
  Description of Artificial Sequence: Synthetic oligonucleotide
ccttagtaagaccagaactcagggaataggtcattatag

SEQ ID NO: 293304 - DNA, 39 bp, Artificial Sequence
  Description of Artificial Sequence: Synthetic oligonucleotide
cttagtaagaccagaactcagggaataggtcattatagg

SEQ ID NO: 293305 - DNA, 40 bp, Artificial Sequence
  Description of Artificial Sequence: Synthetic oligonucleotide
ttagtaagaccagaactcagggaataggtcattataggag

SEQ ID NO: 293306 - DNA, 39 bp, Artificial Sequence
  Description of Artificial Sequence: Synthetic oligonucleotide
tagtaagaccagaactcagggaataggtcattataggag

SEQ ID NO: 293307 - DNA, 38 bp, Artificial Sequence
  Description of Artificial Sequence: Synthetic oligonucleotide
agtaagaccagaactcagggaataggtcattataggag

SEQ ID NO: 293308 - DNA, 37 bp, Artificial Sequence
  Description of Artificial Sequence: Synthetic oligonucleotide
gtaagaccagaactcagggaataggtcattataggag

SEQ ID NO: 293309 - DNA, 37 bp, Artificial Sequence
  Description of Artificial Sequence: Synthetic oligonucleotide
taagaccagaactcagggaataggtcattataggagc

SEQ ID NO: 293310 - DNA, 36 bp, Artificial Sequence
  Description of Artificial Sequence: Synthetic oligonucleotide
aagaccagaactcagggaataggtcattataggagc

SEQ ID NO: 293311 - DNA, 35 bp, Artificial Sequence
  Description of Artificial Sequence: Synthetic oligonucleotide
agaccagaactcagggaataggtcattataggagc

SEQ ID NO: 293312 - DNA, 34 bp, Artificial Sequence
  Description of Artificial Sequence: Synthetic oligonucleotide
gaccagaactcagggaataggtcattataggagc

SEQ ID NO: 293313 - DNA, 35 bp, Artificial Sequence
  Description of Artificial Sequence: Synthetic oligonucleotide
accagaactcagggaataggtcattataggagcag

SEQ ID NO: 293314 - DNA, 34 bp, Artificial Sequence
  Description of Artificial Sequence: Synthetic oligonucleotide
ccagaactcagggaataggtcattataggagcag

SEQ ID NO: 293315 - DNA, 35 bp, Artificial Sequence
  Description of Artificial Sequence: Synthetic oligonucleotide
cagaactcagggaataggtcattataggagcagac

SEQ ID NO: 293316 - DNA, 38 bp, Artificial Sequence
  Description of Artificial Sequence: Synthetic oligonucleotide
agaactcagggaataggtcattataggagcagacattc

SEQ ID NO: 293317 - DNA, 37 bp, Artificial Sequence
  Description of Artificial Sequence: Synthetic oligonucleotide
gaactcagggaataggtcattataggagcagacattc

SEQ ID NO: 293318 - DNA, 39 bp, Artificial Sequence
  Description of Artificial Sequence: Synthetic oligonucleotide
aactcagggaataggtcattataggagcagacattcttg

SEQ ID NO: 293319 - DNA, 38 bp, Artificial Sequence
  Description of Artificial Sequence: Synthetic oligonucleotide
actcagggaataggtcattataggagcagacattcttg

SEQ ID NO: 293320 - DNA, 37 bp, Artificial Sequence
  Description of Artificial Sequence: Synthetic oligonucleotide
ctcagggaataggtcattataggagcagacattcttg

SEQ ID NO: 293321 - DNA, 39 bp, Artificial Sequence
  Description of Artificial Sequence: Synthetic oligonucleotide
tcagggaataggtcattataggagcagacattcttgaac

SEQ ID NO: 293322 - DNA, 38 bp, Artificial Sequence
  Description of Artificial Sequence: Synthetic oligonucleotide
cagggaataggtcattataggagcagacattcttgaac

SEQ ID NO: 293323 - DNA, 39 bp, Artificial Sequence
  Description of Artificial Sequence: Synthetic oligonucleotide
agggaataggtcattataggagcagacattcttgaactg

SEQ ID NO: 293324 - DNA, 38 bp, Artificial Sequence
  Description of Artificial Sequence: Synthetic oligonucleotide
gggaataggtcattataggagcagacattcttgaactg

SEQ ID NO: 293325 - DNA, 40 bp, Artificial Sequence
  Description of Artificial Sequence: Synthetic oligonucleotide
ggaataggtcattataggagcagacattcttgaactgttg

SEQ ID NO: 293326 - DNA, 40 bp, Artificial Sequence
  Description of Artificial Sequence: Synthetic oligonucleotide
gaataggtcattataggagcagacattcttgaactgttgc

SEQ ID NO: 293327 - DNA, 41 bp, Artificial Sequence
  Description of Artificial Sequence: Synthetic oligonucleotide
aataggtcattataggagcagacattcttgaactgttgcac

SEQ ID NO: 293328 - DNA, 40 bp, Artificial Sequence
  Description of Artificial Sequence: Synthetic oligonucleotide
ataggtcattataggagcagacattcttgaactgttgcac

SEQ ID NO: 293329 - DNA, 39 bp, Artificial Sequence
  Description of Artificial Sequence: Synthetic oligonucleotide
taggtcattataggagcagacattcttgaactgttgcac

SEQ ID NO: 293330 - DNA, 38 bp, Artificial Sequence
  Description of Artificial Sequence: Synthetic oligonucleotide
aggtcattataggagcagacattcttgaactgttgcac

SEQ ID NO: 293331 - DNA, 37 bp, Artificial Sequence
  Description of Artificial Sequence: Synthetic oligonucleotide
ggtcattataggagcagacattcttgaactgttgcac

SEQ ID NO: 293332 - DNA, 38 bp, Artificial Sequence
  Description of Artificial Sequence: Synthetic oligonucleotide
gtcattataggagcagacattcttgaactgttgcacac

SEQ ID NO: 293333 - DNA, 39 bp, Artificial Sequence
  Description of Artificial Sequence: Synthetic oligonucleotide
tcattataggagcagacattcttgaactgttgcacactc

SEQ ID NO: 293334 - DNA, 38 bp, Artificial Sequence
  Description of Artificial Sequence: Synthetic oligonucleotide
cattataggagcagacattcttgaactgttgcacactc

SEQ ID NO: 293335 - DNA, 40 bp, Artificial Sequence
  Description of Artificial Sequence: Synthetic oligonucleotide
attataggagcagacattcttgaactgttgcacactcttc

SEQ ID NO: 293336 - DNA, 39 bp, Artificial Sequence
  Description of Artificial Sequence: Synthetic oligonucleotide
ttataggagcagacattcttgaactgttgcacactcttc

SEQ ID NO: 293337 - DNA, 38 bp, Artificial Sequence
  Description of Artificial Sequence: Synthetic oligonucleotide
tataggagcagacattcttgaactgttgcacactcttc

SEQ ID NO: 293338 - DNA, 37 bp, Artificial Sequence
  Description of Artificial Sequence: Synthetic oligonucleotide
ataggagcagacattcttgaactgttgcacactcttc

SEQ ID NO: 293339 - DNA, 36 bp, Artificial Sequence
  Description of Artificial Sequence: Synthetic oligonucleotide
taggagcagacattcttgaactgttgcacactcttc

SEQ ID NO: 293340 - DNA, 35 bp, Artificial Sequence
  Description of Artificial Sequence: Synthetic oligonucleotide
aggagcagacattcttgaactgttgcacactcttc

SEQ ID NO: 293341 - DNA, 34 bp, Artificial Sequence
  Description of Artificial Sequence: Synthetic oligonucleotide
ggagcagacattcttgaactgttgcacactcttc

SEQ ID NO: 293342 - DNA, 34 bp, Artificial Sequence
  Description of Artificial Sequence: Synthetic oligonucleotide
gagcagacattcttgaactgttgcacactcttcc

SEQ ID NO: 293343 - DNA, 35 bp, Artificial Sequence
  Description of Artificial Sequence: Synthetic oligonucleotide
agcagacattcttgaactgttgcacactcttccag

SEQ ID NO: 293344 - DNA, 34 bp, Artificial Sequence
  Description of Artificial Sequence: Synthetic oligonucleotide
gcagacattcttgaactgttgcacactcttccag

SEQ ID NO: 293345 - DNA, 34 bp, Artificial Sequence
  Description of Artificial Sequence: Synthetic oligonucleotide
cagacattcttgaactgttgcacactcttccagc

SEQ ID NO: 293346 - DNA, 35 bp, Artificial Sequence
  Description of Artificial Sequence: Synthetic oligonucleotide
agacattcttgaactgttgcacactcttccagctg

SEQ ID NO: 293347 - DNA, 34 bp, Artificial Sequence
  Description of Artificial Sequence: Synthetic oligonucleotide
gacattcttgaactgttgcacactcttccagctg

SEQ ID NO: 293348 - DNA, 36 bp, Artificial Sequence
  Description of Artificial Sequence: Synthetic oligonucleotide
acattcttgaactgttgcacactcttccagctgttc

SEQ ID NO: 293349 - DNA, 35 bp, Artificial Sequence
  Description of Artificial Sequence: Synthetic oligonucleotide
cattcttgaactgttgcacactcttccagctgttc

SEQ ID NO: 293350 - DNA, 35 bp, Artificial Sequence
  Description of Artificial Sequence: Synthetic oligonucleotide
attcttgaactgttgcacactcttccagctgttcg

SEQ ID NO: 293351 - DNA, 34 bp, Artificial Sequence
  Description of Artificial Sequence: Synthetic oligonucleotide
ttcttgaactgttgcacactcttccagctgttcg

SEQ ID NO: 293352 - DNA, 33 bp, Artificial Sequence
  Description of Artificial Sequence: Synthetic oligonucleotide
tcttgaactgttgcacactcttccagctgttcg

SEQ ID NO: 293353 - DNA, 32 bp, Artificial Sequence
  Description of Artificial Sequence: Synthetic oligonucleotide
cttgaactgttgcacactcttccagctgttcg

SEQ ID NO: 293354 - DNA, 32 bp, Artificial Sequence
  Description of Artificial Sequence: Synthetic oligonucleotide
ttgaactgttgcacactcttccagctgttcgg

SEQ ID NO: 293355 - DNA, 31 bp, Artificial Sequence
  Description of Artificial Sequence: Synthetic oligonucleotide
tgaactgttgcacactcttccagctgttcgg

SEQ ID NO: 293356 - DNA, 30 bp, Artificial Sequence
  Description of Artificial Sequence: Synthetic oligonucleotide
gaactgttgcacactcttccagctgttcgg

SEQ ID NO: 293357 - DNA, 30 bp, Artificial Sequence
  Description of Artificial Sequence: Synthetic oligonucleotide
aactgttgcacactcttccagctgttcggc

SEQ ID NO: 293358 - DNA, 29 bp, Artificial Sequence
  Description of Artificial Sequence: Synthetic oligonucleotide
actgttgcacactcttccagctgttcggc

SEQ ID NO: 293359 - DNA, 28 bp, Artificial Sequence
  Description of Artificial Sequence: Synthetic oligonucleotide
ctgttgcacactcttccagctgttcggc

SEQ ID NO: 293360 - DNA, 29 bp, Artificial Sequence
  Description of Artificial Sequence: Synthetic oligonucleotide
tgttgcacactcttccagctgttcggcag

SEQ ID NO: 293361 - DNA, 28 bp, Artificial Sequence
  Description of Artificial Sequence: Synthetic oligonucleotide
gttgcacactcttccagctgttcggcag

SEQ ID NO: 293362 - DNA, 31 bp, Artificial Sequence
  Description of Artificial Sequence: Synthetic oligonucleotide
ttgcacactcttccagctgttcggcagaatc

SEQ ID NO: 293363 - DNA, 30 bp, Artificial Sequence
  Description of Artificial Sequence: Synthetic oligonucleotide
tgcacactcttccagctgttcggcagaatc

SEQ ID NO: 293364 - DNA, 29 bp, Artificial Sequence
  Description of Artificial Sequence: Synthetic oligonucleotide
gcacactcttccagctgttcggcagaatc

SEQ ID NO: 293365 - DNA, 30 bp, Artificial Sequence
  Description of Artificial Sequence: Synthetic oligonucleotide
cacactcttccagctgttcggcagaatctg

SEQ ID NO: 293366 - DNA, 34 bp, Artificial Sequence
  Description of Artificial Sequence: Synthetic oligonucleotide
acactcttccagctgttcggcagaatctgttttg

SEQ ID NO: 293367 - DNA, 33 bp, Artificial Sequence
  Description of Artificial Sequence: Synthetic oligonucleotide
cactcttccagctgttcggcagaatctgttttg

SEQ ID NO: 293368 - DNA, 34 bp, Artificial Sequence
  Description of Artificial Sequence: Synthetic oligonucleotide
actcttccagctgttcggcagaatctgttttgac

SEQ ID NO: 293369 - DNA, 33 bp, Artificial Sequence
  Description of Artificial Sequence: Synthetic oligonucleotide
ctcttccagctgttcggcagaatctgttttgac

SEQ ID NO: 293370 - DNA, 34 bp, Artificial Sequence
  Description of Artificial Sequence: Synthetic oligonucleotide
tcttccagctgttcggcagaatctgttttgactc

SEQ ID NO: 293371 - DNA, 33 bp, Artificial Sequence
  Description of Artificial Sequence: Synthetic oligonucleotide
cttccagctgttcggcagaatctgttttgactc

SEQ ID NO: 293372 - DNA, 36 bp, Artificial Sequence
  Description of Artificial Sequence: Synthetic oligonucleotide
ttccagctgttcggcagaatctgttttgactctatg

SEQ ID NO: 293373 - DNA, 35 bp, Artificial Sequence
  Description of Artificial Sequence: Synthetic oligonucleotide
tccagctgttcggcagaatctgttttgactctatg

SEQ ID NO: 293374 - DNA, 34 bp, Artificial Sequence
  Description of Artificial Sequence: Synthetic oligonucleotide
ccagctgttcggcagaatctgttttgactctatg

SEQ ID NO: 293375 - DNA, 37 bp, Artificial Sequence
  Description of Artificial Sequence: Synthetic oligonucleotide
cagctgttcggcagaatctgttttgactctatgattg

SEQ ID NO: 293376 - DNA, 37 bp, Artificial Sequence
  Description of Artificial Sequence: Synthetic oligonucleotide
agctgttcggcagaatctgttttgactctatgattgc

SEQ ID NO: 293377 - DNA, 36 bp, Artificial Sequence
  Description of Artificial Sequence: Synthetic oligonucleotide
gctgttcggcagaatctgttttgactctatgattgc

SEQ ID NO: 293378 - DNA, 36 bp, Artificial Sequence
  Description of Artificial Sequence: Synthetic oligonucleotide
ctgttcggcagaatctgttttgactctatgattgcc

SEQ ID NO: 293379 - DNA, 36 bp, Artificial Sequence
  Description of Artificial Sequence: Synthetic oligonucleotide
tgttcggcagaatctgttttgactctatgattgccg

SEQ ID NO: 293380 - DNA, 35 bp, Artificial Sequence
  Description of Artificial Sequence: Synthetic oligonucleotide
gttcggcagaatctgttttgactctatgattgccg

SEQ ID NO: 293381 - DNA, 38 bp, Artificial Sequence
  Description of Artificial Sequence: Synthetic oligonucleotide
ttcggcagaatctgttttgactctatgattgccgttac

SEQ ID NO: 293382 - DNA, 37 bp, Artificial Sequence
  Description of Artificial Sequence: Synthetic oligonucleotide
tcggcagaatctgttttgactctatgattgccgttac

SEQ ID NO: 293383 - DNA, 36 bp, Artificial Sequence
  Description of Artificial Sequence: Synthetic oligonucleotide
cggcagaatctgttttgactctatgattgccgttac

SEQ ID NO: 293384 - DNA, 37 bp, Artificial Sequence
  Description of Artificial Sequence: Synthetic oligonucleotide
ggcagaatctgttttgactctatgattgccgttacac

SEQ ID NO: 293385 - DNA, 38 bp, Artificial Sequence
  Description of Artificial Sequence: Synthetic oligonucleotide
gcagaatctgttttgactctatgattgccgttacactg

SEQ ID NO: 293386 - DNA, 42 bp, Artificial Sequence
  Description of Artificial Sequence: Synthetic oligonucleotide
cagaatctgttttgactctatgattgccgttacactgttttc

SEQ ID NO: 293387 - DNA, 44 bp, Artificial Sequence
  Description of Artificial Sequence: Synthetic oligonucleotide
agaatctgttttgactctatgattgccgttacactgttttctac

SEQ ID NO: 293388 - DNA, 43 bp, Artificial Sequence
  Description of Artificial Sequence: Synthetic oligonucleotide
gaatctgttttgactctatgattgccgttacactgttttctac

SEQ ID NO: 293389 - DNA, 43 bp, Artificial Sequence
  Description of Artificial Sequence: Synthetic oligonucleotide
aatctgttttgactctatgattgccgttacactgttttctacc

SEQ ID NO: 293390 - DNA, 42 bp, Artificial Sequence
  Description of Artificial Sequence: Synthetic oligonucleotide
atctgttttgactctatgattgccgttacactgttttctacc

SEQ ID NO: 293391 - DNA, 41 bp, Artificial Sequence
  Description of Artificial Sequence: Synthetic oligonucleotide
tctgttttgactctatgattgccgttacactgttttctacc

SEQ ID NO: 293392 - DNA, 40 bp, Artificial Sequence
  Description of Artificial Sequence: Synthetic oligonucleotide
ctgttttgactctatgattgccgttacactgttttctacc

SEQ ID NO: 293393 - DNA, 43 bp, Artificial Sequence
  Description of Artificial Sequence: Synthetic oligonucleotide
tgttttgactctatgattgccgttacactgttttctaccaatc

SEQ ID NO: 293394 - DNA, 42 bp, Artificial Sequence
  Description of Artificial Sequence: Synthetic oligonucleotide
gttttgactctatgattgccgttacactgttttctaccaatc

SEQ ID NO: 293395 - DNA, 46 bp, Artificial Sequence
  Description of Artificial Sequence: Synthetic oligonucleotide
ttttgactctatgattgccgttacactgttttctaccaatcatttg

SEQ ID NO: 293396 - DNA, 45 bp, Artificial Sequence
  Description of Artificial Sequence: Synthetic oligonucleotide
tttgactctatgattgccgttacactgttttctaccaatcatttg

SEQ ID NO: 293397 - DNA, 44 bp, Artificial Sequence
  Description of Artificial Sequence: Synthetic oligonucleotide
ttgactctatgattgccgttacactgttttctaccaatcatttg

SEQ ID NO: 293398 - DNA, 43 bp, Artificial Sequence
  Description of Artificial Sequence: Synthetic oligonucleotide
tgactctatgattgccgttacactgttttctaccaatcatttg

SEQ ID NO: 293399 - DNA, 42 bp, Artificial Sequence
  Description of Artificial Sequence: Synthetic oligonucleotide
gactctatgattgccgttacactgttttctaccaatcatttg

SEQ ID NO: 293400 - DNA, 42 bp, Artificial Sequence
  Description of Artificial Sequence: Synthetic oligonucleotide
actctatgattgccgttacactgttttctaccaatcatttgc

SEQ ID NO: 293401 - DNA, 41 bp, Artificial Sequence
  Description of Artificial Sequence: Synthetic oligonucleotide
ctctatgattgccgttacactgttttctaccaatcatttgc

SEQ ID NO: 293402 - DNA, 41 bp, Artificial Sequence
  Description of Artificial Sequence: Synthetic oligonucleotide
tctatgattgccgttacactgttttctaccaatcatttgcg

SEQ ID NO: 293403 - DNA, 40 bp, Artificial Sequence
  Description of Artificial Sequence: Synthetic oligonucleotide
ctatgattgccgttacactgttttctaccaatcatttgcg

SEQ ID NO: 293404 - DNA, 40 bp, Artificial Sequence
  Description of Artificial Sequence: Synthetic oligonucleotide
tatgattgccgttacactgttttctaccaatcatttgcgg

SEQ ID NO: 293405 - DNA, 39 bp, Artificial Sequence
  Description of Artificial Sequence: Synthetic oligonucleotide
atgattgccgttacactgttttctaccaatcatttgcgg

SEQ ID NO: 293406 - DNA, 38 bp, Artificial Sequence
  Description of Artificial Sequence: Synthetic oligonucleotide
tgattgccgttacactgttttctaccaatcatttgcgg

SEQ ID NO: 293407 - DNA, 37 bp, Artificial Sequence
  Description of Artificial Sequence: Synthetic oligonucleotide
gattgccgttacactgttttctaccaatcatttgcgg

SEQ ID NO: 293408 - DNA, 39 bp, Artificial Sequence
  Description of Artificial Sequence: Synthetic oligonucleotide
attgccgttacactgttttctaccaatcatttgcggttg

SEQ ID NO: 293409 - DNA, 38 bp, Artificial Sequence
  Description of Artificial Sequence: Synthetic oligonucleotide
ttgccgttacactgttttctaccaatcatttgcggttg

SEQ ID NO: 293410 - DNA, 37 bp, Artificial Sequence
  Description of Artificial Sequence: Synthetic oligonucleotide
tgccgttacactgttttctaccaatcatttgcggttg

SEQ ID NO: 293411 - DNA, 36 bp, Artificial Sequence
  Description of Artificial Sequence: Synthetic oligonucleotide
gccgttacactgttttctaccaatcatttgcggttg

SEQ ID NO: 293412 - DNA, 37 bp, Artificial Sequence
  Description of Artificial Sequence: Synthetic oligonucleotide
ccgttacactgttttctaccaatcatttgcggttgtg

SEQ ID NO: 293413 - DNA, 37 bp, Artificial Sequence
  Description of Artificial Sequence: Synthetic oligonucleotide
cgttacactgttttctaccaatcatttgcggttgtgc

SEQ ID NO: 293414 - DNA, 39 bp, Artificial Sequence
  Description of Artificial Sequence: Synthetic oligonucleotide
gttacactgttttctaccaatcatttgcggttgtgcaac

SEQ ID NO: 293415 - DNA, 40 bp, Artificial Sequence
  Description of Artificial Sequence: Synthetic oligonucleotide
ttacactgttttctaccaatcatttgcggttgtgcaacag

SEQ ID NO: 293416 - DNA, 39 bp, Artificial Sequence
  Description of Artificial Sequence: Synthetic oligonucleotide
tacactgttttctaccaatcatttgcggttgtgcaacag

SEQ ID NO: 293417 - DNA, 38 bp, Artificial Sequence
  Description of Artificial Sequence: Synthetic oligonucleotide
acactgttttctaccaatcatttgcggttgtgcaacag

SEQ ID NO: 293418 - DNA, 37 bp, Artificial Sequence
  Description of Artificial Sequence: Synthetic oligonucleotide
cactgttttctaccaatcatttgcggttgtgcaacag

SEQ ID NO: 293419 - DNA, 37 bp, Artificial Sequence
  Description of Artificial Sequence: Synthetic oligonucleotide
actgttttctaccaatcatttgcggttgtgcaacagg

SEQ ID NO: 293420 - DNA, 36 bp, Artificial Sequence
  Description of Artificial Sequence: Synthetic oligonucleotide
ctgttttctaccaatcatttgcggttgtgcaacagg

SEQ ID NO: 293421 - DNA, 40 bp, Artificial Sequence
  Description of Artificial Sequence: Synthetic oligonucleotide
tgttttctaccaatcatttgcggttgtgcaacaggaaaag

SEQ ID NO: 293422 - DNA, 39 bp, Artificial Sequence
  Description of Artificial Sequence: Synthetic oligonucleotide
gttttctaccaatcatttgcggttgtgcaacaggaaaag

SEQ ID NO: 293423 - DNA, 44 bp, Artificial Sequence
  Description of Artificial Sequence: Synthetic oligonucleotide
ttttctaccaatcatttgcggttgtgcaacaggaaaagaaaaag

SEQ ID NO: 293424 - DNA, 43 bp, Artificial Sequence
  Description of Artificial Sequence: Synthetic oligonucleotide
tttctaccaatcatttgcggttgtgcaacaggaaaagaaaaag

SEQ ID NO: 293425 - DNA, 42 bp, Artificial Sequence
  Description of Artificial Sequence: Synthetic oligonucleotide
ttctaccaatcatttgcggttgtgcaacaggaaaagaaaaag

SEQ ID NO: 293426 - DNA, 41 bp, Artificial Sequence
  Description of Artificial Sequence: Synthetic oligonucleotide
tctaccaatcatttgcggttgtgcaacaggaaaagaaaaag

SEQ ID NO: 293427 - DNA, 40 bp, Artificial Sequence
  Description of Artificial Sequence: Synthetic oligonucleotide
ctaccaatcatttgcggttgtgcaacaggaaaagaaaaag

SEQ ID NO: 293428 - DNA, 40 bp, Artificial Sequence
  Description of Artificial Sequence: Synthetic oligonucleotide
taccaatcatttgcggttgtgcaacaggaaaagaaaaagg

SEQ ID NO: 293429 - DNA, 39 bp, Artificial Sequence
  Description of Artificial Sequence: Synthetic oligonucleotide
accaatcatttgcggttgtgcaacaggaaaagaaaaagg

SEQ ID NO: 293430 - DNA, 38 bp, Artificial Sequence
  Description of Artificial Sequence: Synthetic oligonucleotide
ccaatcatttgcggttgtgcaacaggaaaagaaaaagg

SEQ ID NO: 293431 - DNA, 39 bp, Artificial Sequence
  Description of Artificial Sequence: Synthetic oligonucleotide
caatcatttgcggttgtgcaacaggaaaagaaaaaggag

SEQ ID NO: 293432 - DNA, 40 bp, Artificial Sequence
  Description of Artificial Sequence: Synthetic oligonucleotide
aatcatttgcggttgtgcaacaggaaaagaaaaaggagtg

SEQ ID NO: 293433 - DNA, 39 bp, Artificial Sequence
  Description of Artificial Sequence: Synthetic oligonucleotide
atcatttgcggttgtgcaacaggaaaagaaaaaggagtg

SEQ ID NO: 293434 - DNA, 38 bp, Artificial Sequence
  Description of Artificial Sequence: Synthetic oligonucleotide
tcatttgcggttgtgcaacaggaaaagaaaaaggagtg

SEQ ID NO: 293435 - DNA, 37 bp, Artificial Sequence
  Description of Artificial Sequence: Synthetic oligonucleotide
catttgcggttgtgcaacaggaaaagaaaaaggagtg

SEQ ID NO: 293436 - DNA, 37 bp, Artificial Sequence
  Description of Artificial Sequence: Synthetic oligonucleotide
atttgcggttgtgcaacaggaaaagaaaaaggagtgg

SEQ ID NO: 293437 - DNA, 36 bp, Artificial Sequence
  Description of Artificial Sequence: Synthetic oligonucleotide
tttgcggttgtgcaacaggaaaagaaaaaggagtgg

SEQ ID NO: 293438 - DNA, 35 bp, Artificial Sequence
  Description of Artificial Sequence: Synthetic oligonucleotide
ttgcggttgtgcaacaggaaaagaaaaaggagtgg

SEQ ID NO: 293439 - DNA, 34 bp, Artificial Sequence
  Description of Artificial Sequence: Synthetic oligonucleotide
tgcggttgtgcaacaggaaaagaaaaaggagtgg

SEQ ID NO: 293440 - DNA, 33 bp, Artificial Sequence
  Description of Artificial Sequence: Synthetic oligonucleotide
gcggttgtgcaacaggaaaagaaaaaggagtgg

SEQ ID NO: 293441 - DNA, 33 bp, Artificial Sequence
  Description of Artificial Sequence: Synthetic oligonucleotide
cggttgtgcaacaggaaaagaaaaaggagtggc

SEQ ID NO: 293442 - DNA, 38 bp, Artificial Sequence
  Description of Artificial Sequence: Synthetic oligonucleotide
ggttgtgcaacaggaaaagaaaaaggagtggctttttc

SEQ ID NO: 293443 - DNA, 38 bp, Artificial Sequence
  Description of Artificial Sequence: Synthetic oligonucleotide
gttgtgcaacaggaaaagaaaaaggagtggctttttcc

SEQ ID NO: 293444 - DNA, 38 bp, Artificial Sequence
  Description of Artificial Sequence: Synthetic oligonucleotide
ttgtgcaacaggaaaagaaaaaggagtggctttttccc

SEQ ID NO: 293445 - DNA, 37 bp, Artificial Sequence
  Description of Artificial Sequence: Synthetic oligonucleotide
tgtgcaacaggaaaagaaaaaggagtggctttttccc

SEQ ID NO: 293446 - DNA, 36 bp, Artificial Sequence
  Description of Artificial Sequence: Synthetic oligonucleotide
gtgcaacaggaaaagaaaaaggagtggctttttccc

SEQ ID NO: 293447 - DNA, 36 bp, Artificial Sequence
  Description of Artificial Sequence: Synthetic oligonucleotide
tgcaacaggaaaagaaaaaggagtggctttttcccc

SEQ ID NO: 293448 - DNA, 35 bp, Artificial Sequence
  Description of Artificial Sequence: Synthetic oligonucleotide
gcaacaggaaaagaaaaaggagtggctttttcccc

SEQ ID NO: 293449 - DNA, 35 bp, Artificial Sequence
  Description of Artificial Sequence: Synthetic oligonucleotide
caacaggaaaagaaaaaggagtggctttttccccc

SEQ ID NO: 293450 - DNA, 36 bp, Artificial Sequence
  Description of Artificial Sequence: Synthetic oligonucleotide
aacaggaaaagaaaaaggagtggctttttccccctc

SEQ ID NO: 293451 - DNA, 35 bp, Artificial Sequence
  Description of Artificial Sequence: Synthetic oligonucleotide
acaggaaaagaaaaaggagtggctttttccccctc

SEQ ID NO: 293452 - DNA, 34 bp, Artificial Sequence
  Description of Artificial Sequence: Synthetic oligonucleotide
caggaaaagaaaaaggagtggctttttccccctc

SEQ ID NO: 293453 - DNA, 39 bp, Artificial Sequence
  Description of Artificial Sequence: Synthetic oligonucleotide
aggaaaagaaaaaggagtggctttttccccctcattttc

SEQ ID NO: 293454 - DNA, 38 bp, Artificial Sequence
  Description of Artificial Sequence: Synthetic oligonucleotide
ggaaaagaaaaaggagtggctttttccccctcattttc

SEQ ID NO: 293455 - DNA, 38 bp, Artificial Sequence
  Description of Artificial Sequence: Synthetic oligonucleotide
gaaaagaaaaaggagtggctttttccccctcattttcg

SEQ ID NO: 293456 - DNA, 41 bp, Artificial Sequence
  Description of Artificial Sequence: Synthetic oligonucleotide
aaaagaaaaaggagtggctttttccccctcattttcgatac

SEQ ID NO: 293457 - DNA, 40 bp, Artificial Sequence
  Description of Artificial Sequence: Synthetic oligonucleotide
aaagaaaaaggagtggctttttccccctcattttcgatac

SEQ ID NO: 293458 - DNA, 39 bp, Artificial Sequence
  Description of Artificial Sequence: Synthetic oligonucleotide
aagaaaaaggagtggctttttccccctcattttcgatac

SEQ ID NO: 293459 - DNA, 38 bp, Artificial Sequence
  Description of Artificial Sequence: Synthetic oligonucleotide
agaaaaaggagtggctttttccccctcattttcgatac

SEQ ID NO: 293460 - DNA, 37 bp, Artificial Sequence
  Description of Artificial Sequence: Synthetic oligonucleotide
gaaaaaggagtggctttttccccctcattttcgatac

SEQ ID NO: 293461 - DNA, 40 bp, Artificial Sequence
  Description of Artificial Sequence: Synthetic oligonucleotide
aaaaaggagtggctttttccccctcattttcgatactaag

SEQ ID NO: 293462 - DNA, 39 bp, Artificial Sequence
  Description of Artificial Sequence: Synthetic oligonucleotide
aaaaggagtggctttttccccctcattttcgatactaag

SEQ ID NO: 293463 - DNA, 38 bp, Artificial Sequence
  Description of Artificial Sequence: Synthetic oligonucleotide
aaaggagtggctttttccccctcattttcgatactaag

SEQ ID NO: 293464 - DNA, 37 bp, Artificial Sequence
  Description of Artificial Sequence: Synthetic oligonucleotide
aaggagtggctttttccccctcattttcgatactaag

SEQ ID NO: 293465 - DNA, 36 bp, Artificial Sequence
  Description of Artificial Sequence: Synthetic oligonucleotide
aggagtggctttttccccctcattttcgatactaag

SEQ ID NO: 293466 - DNA, 35 bp, Artificial Sequence
  Description of Artificial Sequence: Synthetic oligonucleotide
ggagtggctttttccccctcattttcgatactaag

SEQ ID NO: 293467 - DNA, 38 bp, Artificial Sequence
  Description of Artificial Sequence: Synthetic oligonucleotide
gagtggctttttccccctcattttcgatactaagtaag

SEQ ID NO: 293468 - DNA, 39 bp, Artificial Sequence
  Description of Artificial Sequence: Synthetic oligonucleotide
agtggctttttccccctcattttcgatactaagtaagag

SEQ ID NO: 293469 - DNA, 38 bp, Artificial Sequence
  Description of Artificial Sequence: Synthetic oligonucleotide
gtggctttttccccctcattttcgatactaagtaagag

SEQ ID NO: 293470 - DNA, 42 bp, Artificial Sequence
  Description of Artificial Sequence: Synthetic oligonucleotide
tggctttttccccctcattttcgatactaagtaagagaattg

SEQ ID NO: 293471 - DNA, 41 bp, Artificial Sequence
  Description of Artificial Sequence: Synthetic oligonucleotide
ggctttttccccctcattttcgatactaagtaagagaattg

SEQ ID NO: 293472 - DNA, 42 bp, Artificial Sequence
  Description of Artificial Sequence: Synthetic oligonucleotide
gctttttccccctcattttcgatactaagtaagagaattgag

SEQ ID NO: 293473 - DNA, 46 bp, Artificial Sequence
  Description of Artificial Sequence: Synthetic oligonucleotide
ctttttccccctcattttcgatactaagtaagagaattgagaattc

SEQ ID NO: 293474 - DNA, 48 bp, Artificial Sequence
  Description of Artificial Sequence: Synthetic oligonucleotide
tttttccccctcattttcgatactaagtaagagaattgagaattcttg

SEQ ID NO: 293475 - DNA, 47 bp, Artificial Sequence
  Description of Artificial Sequence: Synthetic oligonucleotide
ttttccccctcattttcgatactaagtaagagaattgagaattcttg

SEQ ID NO: 293476 - DNA, 46 bp, Artificial Sequence
  Description of Artificial Sequence: Synthetic oligonucleotide
tttccccctcattttcgatactaagtaagagaattgagaattcttg

SEQ ID NO: 293477 - DNA, 45 bp, Artificial Sequence
  Description of Artificial Sequence: Synthetic oligonucleotide
ttccccctcattttcgatactaagtaagagaattgagaattcttg

SEQ ID NO: 293478 - DNA, 44 bp, Artificial Sequence
  Description of Artificial Sequence: Synthetic oligonucleotide
tccccctcattttcgatactaagtaagagaattgagaattcttg

SEQ ID NO: 293479 - DNA, 43 bp, Artificial Sequence
  Description of Artificial Sequence: Synthetic oligonucleotide
ccccctcattttcgatactaagtaagagaattgagaattcttg

SEQ ID NO: 293480 - DNA, 43 bp, Artificial Sequence
  Description of Artificial Sequence: Synthetic oligonucleotide
cccctcattttcgatactaagtaagagaattgagaattcttgc

SEQ ID NO: 293481 - DNA, 46 bp, Artificial Sequence
  Description of Artificial Sequence: Synthetic oligonucleotide
ccctcattttcgatactaagtaagagaattgagaattcttgcatac

SEQ ID NO: 293482 - DNA, 47 bp, Artificial Sequence
  Description of Artificial Sequence: Synthetic oligonucleotide
cctcattttcgatactaagtaagagaattgagaattcttgcatacag

SEQ ID NO: 293483 - DNA, 48 bp, Artificial Sequence
  Description of Artificial Sequence: Synthetic oligonucleotide
ctcattttcgatactaagtaagagaattgagaattcttgcatacagac

SEQ ID NO: 293484 - DNA, 49 bp, Artificial Sequence
  Description of Artificial Sequence: Synthetic oligonucleotide
tcattttcgatactaagtaagagaattgagaattcttgcatacagacag

SEQ ID NO: 293485 - DNA, 48 bp, Artificial Sequence
  Description of Artificial Sequence: Synthetic oligonucleotide
cattttcgatactaagtaagagaattgagaattcttgcatacagacag

SEQ ID NO: 293486 - DNA, 48 bp, Artificial Sequence
  Description of Artificial Sequence: Synthetic oligonucleotide
attttcgatactaagtaagagaattgagaattcttgcatacagacagc

SEQ ID NO: 293487 - DNA, 47 bp, Artificial Sequence
  Description of Artificial Sequence: Synthetic oligonucleotide
ttttcgatactaagtaagagaattgagaattcttgcatacagacagc

SEQ ID NO: 293488 - DNA, 46 bp, Artificial Sequence
  Description of Artificial Sequence: Synthetic oligonucleotide
tttcgatactaagtaagagaattgagaattcttgcatacagacagc

SEQ ID NO: 293489 - DNA, 45 bp, Artificial Sequence
  Description of Artificial Sequence: Synthetic oligonucleotide
ttcgatactaagtaagagaattgagaattcttgcatacagacagc

SEQ ID NO: 293490 - DNA, 44 bp, Artificial Sequence
  Description of Artificial Sequence: Synthetic oligonucleotide
tcgatactaagtaagagaattgagaattcttgcatacagacagc

SEQ ID NO: 293491 - DNA, 43 bp, Artificial Sequence
  Description of Artificial Sequence: Synthetic oligonucleotide
cgatactaagtaagagaattgagaattcttgcatacagacagc

SEQ ID NO: 293492 - DNA, 44 bp, Artificial Sequence
  Description of Artificial Sequence: Synthetic oligonucleotide
gatactaagtaagagaattgagaattcttgcatacagacagctg

SEQ ID NO: 293493 - DNA, 44 bp, Artificial Sequence
  Description of Artificial Sequence: Synthetic oligonucleotide
atactaagtaagagaattgagaattcttgcatacagacagctgc

SEQ ID NO: 293494 - DNA, 43 bp, Artificial Sequence
  Description of Artificial Sequence: Synthetic oligonucleotide
tactaagtaagagaattgagaattcttgcatacagacagctgc

SEQ ID NO: 293495 - DNA, 42 bp, Artificial Sequence
  Description of Artificial Sequence: Synthetic oligonucleotide
actaagtaagagaattgagaattcttgcatacagacagctgc

SEQ ID NO: 293496 - DNA, 41 bp, Artificial Sequence
  Description of Artificial Sequence: Synthetic oligonucleotide
ctaagtaagagaattgagaattcttgcatacagacagctgc

SEQ ID NO: 293497 - DNA, 42 bp, Artificial Sequence
  Description of Artificial Sequence: Synthetic oligonucleotide
taagtaagagaattgagaattcttgcatacagacagctgctg

SEQ ID NO: 293498 - DNA, 41 bp, Artificial Sequence
  Description of Artificial Sequence: Synthetic oligonucleotide
aagtaagagaattgagaattcttgcatacagacagctgctg

SEQ ID NO: 293499 - DNA, 40 bp, Artificial Sequence
  Description of Artificial Sequence: Synthetic oligonucleotide
agtaagagaattgagaattcttgcatacagacagctgctg

SEQ ID NO: 293500 - DNA, 39 bp, Artificial Sequence
  Description of Artificial Sequence: Synthetic oligonucleotide
gtaagagaattgagaattcttgcatacagacagctgctg

SEQ ID NO: 293501 - DNA, 39 bp, Artificial Sequence
  Description of Artificial Sequence: Synthetic oligonucleotide
taagagaattgagaattcttgcatacagacagctgctgc

SEQ ID NO: 293502 - DNA, 38 bp, Artificial Sequence
  Description of Artificial Sequence: Synthetic oligonucleotide
aagagaattgagaattcttgcatacagacagctgctgc

SEQ ID NO: 293503 - DNA, 37 bp, Artificial Sequence
  Description of Artificial Sequence: Synthetic oligonucleotide
agagaattgagaattcttgcatacagacagctgctgc

SEQ ID NO: 293504 - DNA, 36 bp, Artificial Sequence
  Description of Artificial Sequence: Synthetic oligonucleotide
gagaattgagaattcttgcatacagacagctgctgc

SEQ ID NO: 293505 - DNA, 39 bp, Artificial Sequence
  Description of Artificial Sequence: Synthetic oligonucleotide
agaattgagaattcttgcatacagacagctgctgcaatc

SEQ ID NO: 293506 - DNA, 38 bp, Artificial Sequence
  Description of Artificial Sequence: Synthetic oligonucleotide
gaattgagaattcttgcatacagacagctgctgcaatc

SEQ ID NO: 293507 - DNA, 43 bp, Artificial Sequence
  Description of Artificial Sequence: Synthetic oligonucleotide
aattgagaattcttgcatacagacagctgctgcaatcatatac

SEQ ID NO: 293508 - DNA, 42 bp, Artificial Sequence
  Description of Artificial Sequence: Synthetic oligonucleotide
attgagaattcttgcatacagacagctgctgcaatcatatac

SEQ ID NO: 293509 - DNA, 41 bp, Artificial Sequence
  Description of Artificial Sequence: Synthetic oligonucleotide
ttgagaattcttgcatacagacagctgctgcaatcatatac

SEQ ID NO: 293510 - DNA, 40 bp, Artificial Sequence
  Description of Artificial Sequence: Synthetic oligonucleotide
tgagaattcttgcatacagacagctgctgcaatcatatac

SEQ ID NO: 293511 - DNA, 39 bp, Artificial Sequence
  Description of Artificial Sequence: Synthetic oligonucleotide
gagaattcttgcatacagacagctgctgcaatcatatac

SEQ ID NO: 293512 - DNA, 39 bp, Artificial Sequence
  Description of Artificial Sequence: Synthetic oligonucleotide
agaattcttgcatacagacagctgctgcaatcatatacg

SEQ ID NO: 293513 - DNA, 38 bp, Artificial Sequence
  Description of Artificial Sequence: Synthetic oligonucleotide
gaattcttgcatacagacagctgctgcaatcatatacg

SEQ ID NO: 293514 - DNA, 39 bp, Artificial Sequence
  Description of Artificial Sequence: Synthetic oligonucleotide
aattcttgcatacagacagctgctgcaatcatatacgtc

SEQ ID NO: 293515 - DNA, 38 bp, Artificial Sequence
  Description of Artificial Sequence: Synthetic oligonucleotide
attcttgcatacagacagctgctgcaatcatatacgtc

SEQ ID NO: 293516 - DNA, 37 bp, Artificial Sequence
  Description of Artificial Sequence: Synthetic oligonucleotide
ttcttgcatacagacagctgctgcaatcatatacgtc

SEQ ID NO: 293517 - DNA, 36 bp, Artificial Sequence
  Description of Artificial Sequence: Synthetic oligonucleotide
tcttgcatacagacagctgctgcaatcatatacgtc

SEQ ID NO: 293518 - DNA, 35 bp, Artificial Sequence
  Description of Artificial Sequence: Synthetic oligonucleotide
cttgcatacagacagctgctgcaatcatatacgtc

SEQ ID NO: 293519 - DNA, 40 bp, Artificial Sequence
  Description of Artificial Sequence: Synthetic oligonucleotide
ttgcatacagacagctgctgcaatcatatacgtcattaac

SEQ ID NO: 293520 - DNA, 39 bp, Artificial Sequence
  Description of Artificial Sequence: Synthetic oligonucleotide
tgcatacagacagctgctgcaatcatatacgtcattaac

SEQ ID NO: 293521 - DNA, 38 bp, Artificial Sequence
  Description of Artificial Sequence: Synthetic oligonucleotide
gcatacagacagctgctgcaatcatatacgtcattaac

SEQ ID NO: 293522 - DNA, 38 bp, Artificial Sequence
  Description of Artificial Sequence: Synthetic oligonucleotide
catacagacagctgctgcaatcatatacgtcattaacg

SEQ ID NO: 293523 - DNA, 38 bp, Artificial Sequence
  Description of Artificial Sequence: Synthetic oligonucleotide
atacagacagctgctgcaatcatatacgtcattaacgc

SEQ ID NO: 293524 - DNA, 37 bp, Artificial Sequence
  Description of Artificial Sequence: Synthetic oligonucleotide
tacagacagctgctgcaatcatatacgtcattaacgc

SEQ ID NO: 293525 - DNA, 36 bp, Artificial Sequence
  Description of Artificial Sequence: Synthetic oligonucleotide
acagacagctgctgcaatcatatacgtcattaacgc

SEQ ID NO: 293526 - DNA, 35 bp, Artificial Sequence
  Description of Artificial Sequence: Synthetic oligonucleotide
cagacagctgctgcaatcatatacgtcattaacgc

SEQ ID NO: 293527 - DNA, 37 bp, Artificial Sequence
  Description of Artificial Sequence: Synthetic oligonucleotide
agacagctgctgcaatcatatacgtcattaacgcttg

SEQ ID NO: 293528 - DNA, 36 bp, Artificial Sequence
  Description of Artificial Sequence: Synthetic oligonucleotide
gacagctgctgcaatcatatacgtcattaacgcttg

SEQ ID NO: 293529 - DNA, 36 bp, Artificial Sequence
  Description of Artificial Sequence: Synthetic oligonucleotide
acagctgctgcaatcatatacgtcattaacgcttgg

SEQ ID NO: 293530 - DNA, 35 bp, Artificial Sequence
  Description of Artificial Sequence: Synthetic oligonucleotide
cagctgctgcaatcatatacgtcattaacgcttgg

SEQ ID NO: 293531 - DNA, 35 bp, Artificial Sequence
  Description of Artificial Sequence: Synthetic oligonucleotide
agctgctgcaatcatatacgtcattaacgcttggc

SEQ ID NO: 293532 - DNA, 34 bp, Artificial Sequence
  Description of Artificial Sequence: Synthetic oligonucleotide
gctgctgcaatcatatacgtcattaacgcttggc

SEQ ID NO: 293533 - DNA, 39 bp, Artificial Sequence
  Description of Artificial Sequence: Synthetic oligonucleotide
ctgctgcaatcatatacgtcattaacgcttggctatttg

SEQ ID NO: 293534 - DNA, 39 bp, Artificial Sequence
  Description of Artificial Sequence: Synthetic oligonucleotide
tgctgcaatcatatacgtcattaacgcttggctatttgg

SEQ ID NO: 293535 - DNA, 38 bp, Artificial Sequence
  Description of Artificial Sequence: Synthetic oligonucleotide
gctgcaatcatatacgtcattaacgcttggctatttgg

SEQ ID NO: 293536 - DNA, 38 bp, Artificial Sequence
  Description of Artificial Sequence: Synthetic oligonucleotide
ctgcaatcatatacgtcattaacgcttggctatttggc

SEQ ID NO: 293537 - DNA, 39 bp, Artificial Sequence
  Description of Artificial Sequence: Synthetic oligonucleotide
tgcaatcatatacgtcattaacgcttggctatttggcag

SEQ ID NO: 293538 - DNA, 38 bp, Artificial Sequence
  Description of Artificial Sequence: Synthetic oligonucleotide
gcaatcatatacgtcattaacgcttggctatttggcag

SEQ ID NO: 293539 - DNA, 40 bp, Artificial Sequence
  Description of Artificial Sequence: Synthetic oligonucleotide
caatcatatacgtcattaacgcttggctatttggcagaag

SEQ ID NO: 293540 - DNA, 40 bp, Artificial Sequence
  Description of Artificial Sequence: Synthetic oligonucleotide
aatcatatacgtcattaacgcttggctatttggcagaagg

SEQ ID NO: 293541 - DNA, 39 bp, Artificial Sequence
  Description of Artificial Sequence: Synthetic oligonucleotide
atcatatacgtcattaacgcttggctatttggcagaagg

SEQ ID NO: 293542 - DNA, 38 bp, Artificial Sequence
  Description of Artificial Sequence: Synthetic oligonucleotide
tcatatacgtcattaacgcttggctatttggcagaagg

SEQ ID NO: 293543 - DNA, 37 bp, Artificial Sequence
  Description of Artificial Sequence: Synthetic oligonucleotide
catatacgtcattaacgcttggctatttggcagaagg

SEQ ID NO: 293544 - DNA, 37 bp, Artificial Sequence
  Description of Artificial Sequence: Synthetic oligonucleotide
atatacgtcattaacgcttggctatttggcagaaggg

SEQ ID NO: 293545 - DNA, 36 bp, Artificial Sequence
  Description of Artificial Sequence: Synthetic oligonucleotide
tatacgtcattaacgcttggctatttggcagaaggg

SEQ ID NO: 293546 - DNA, 35 bp, Artificial Sequence
  Description of Artificial Sequence: Synthetic oligonucleotide
atacgtcattaacgcttggctatttggcagaaggg

SEQ ID NO: 293547 - DNA, 34 bp, Artificial Sequence
  Description of Artificial Sequence: Synthetic oligonucleotide
tacgtcattaacgcttggctatttggcagaaggg

SEQ ID NO: 293548 - DNA, 33 bp, Artificial Sequence
  Description of Artificial Sequence: Synthetic oligonucleotide
acgtcattaacgcttggctatttggcagaaggg

SEQ ID NO: 293549 - DNA, 32 bp, Artificial Sequence
  Description of Artificial Sequence: Synthetic oligonucleotide
cgtcattaacgcttggctatttggcagaaggg

SEQ ID NO: 293550 - DNA, 35 bp, Artificial Sequence
  Description of Artificial Sequence: Synthetic oligonucleotide
gtcattaacgcttggctatttggcagaagggtttg

SEQ ID NO: 293551 - DNA, 35 bp, Artificial Sequence
  Description of Artificial Sequence: Synthetic oligonucleotide
tcattaacgcttggctatttggcagaagggtttgg

SEQ ID NO: 293552 - DNA, 34 bp, Artificial Sequence
  Description of Artificial Sequence: Synthetic oligonucleotide
cattaacgcttggctatttggcagaagggtttgg

SEQ ID NO: 293553 - DNA, 35 bp, Artificial Sequence
  Description of Artificial Sequence: Synthetic oligonucleotide
attaacgcttggctatttggcagaagggtttggtg

SEQ ID NO: 293554 - DNA, 34 bp, Artificial Sequence
  Description of Artificial Sequence: Synthetic oligonucleotide
ttaacgcttggctatttggcagaagggtttggtg

SEQ ID NO: 293555 - DNA, 33 bp, Artificial Sequence
  Description of Artificial Sequence: Synthetic oligonucleotide
taacgcttggctatttggcagaagggtttggtg

SEQ ID NO: 293556 - DNA, 32 bp, Artificial Sequence
  Description of Artificial Sequence: Synthetic oligonucleotide
aacgcttggctatttggcagaagggtttggtg

SEQ ID NO: 293557 - DNA, 31 bp, Artificial Sequence
  Description of Artificial Sequence: Synthetic oligonucleotide
acgcttggctatttggcagaagggtttggtg

SEQ ID NO: 293558 - DNA, 30 bp, Artificial Sequence
  Description of Artificial Sequence: Synthetic oligonucleotide
cgcttggctatttggcagaagggtttggtg

SEQ ID NO: 293559 - DNA, 32 bp, Artificial Sequence
  Description of Artificial Sequence: Synthetic oligonucleotide
gcttggctatttggcagaagggtttggtgtag

SEQ ID NO: 293560 - DNA, 32 bp, Artificial Sequence
  Description of Artificial Sequence: Synthetic oligonucleotide
cttggctatttggcagaagggtttggtgtagg

SEQ ID NO: 293561 - DNA, 33 bp, Artificial Sequence
  Description of Artificial Sequence: Synthetic oligonucleotide
ttggctatttggcagaagggtttggtgtaggtg

SEQ ID NO: 293562 - DNA, 32 bp, Artificial Sequence
  Description of Artificial Sequence: Synthetic oligonucleotide
tggctatttggcagaagggtttggtgtaggtg

SEQ ID NO: 293563 - DNA, 31 bp, Artificial Sequence
  Description of Artificial Sequence: Synthetic oligonucleotide
ggctatttggcagaagggtttggtgtaggtg

SEQ ID NO: 293564 - DNA, 32 bp, Artificial Sequence
  Description of Artificial Sequence: Synthetic oligonucleotide
gctatttggcagaagggtttggtgtaggtgtg

SEQ ID NO: 293565 - DNA, 32 bp, Artificial Sequence
  Description of Artificial Sequence: Synthetic oligonucleotide
ctatttggcagaagggtttggtgtaggtgtgg

SEQ ID NO: 293566 - DNA, 36 bp, Artificial Sequence
  Description of Artificial Sequence: Synthetic oligonucleotide
tatttggcagaagggtttggtgtaggtgtggaaatc

SEQ ID NO: 293567 - DNA, 35 bp, Artificial Sequence
  Description of Artificial Sequence: Synthetic oligonucleotide
atttggcagaagggtttggtgtaggtgtggaaatc

SEQ ID NO: 293568 - DNA, 34 bp, Artificial Sequence
  Description of Artificial Sequence: Synthetic oligonucleotide
tttggcagaagggtttggtgtaggtgtggaaatc

SEQ ID NO: 293569 - DNA, 33 bp, Artificial Sequence
  Description of Artificial Sequence: Synthetic oligonucleotide
ttggcagaagggtttggtgtaggtgtggaaatc

SEQ ID NO: 293570 - DNA, 32 bp, Artificial Sequence
  Description of Artificial Sequence: Synthetic oligonucleotide
tggcagaagggtttggtgtaggtgtggaaatc

SEQ ID NO: 293571 - DNA, 31 bp, Artificial Sequence
  Description of Artificial Sequence: Synthetic oligonucleotide
ggcagaagggtttggtgtaggtgtggaaatc

SEQ ID NO: 293572 - DNA, 34 bp, Artificial Sequence
  Description of Artificial Sequence: Synthetic oligonucleotide
gcagaagggtttggtgtaggtgtggaaatcattg

SEQ ID NO: 293573 - DNA, 36 bp, Artificial Sequence
  Description of Artificial Sequence: Synthetic oligonucleotide
cagaagggtttggtgtaggtgtggaaatcattgatc

SEQ ID NO: 293574 - DNA, 37 bp, Artificial Sequence
  Description of Artificial Sequence: Synthetic oligonucleotide
agaagggtttggtgtaggtgtggaaatcattgatctg

SEQ ID NO: 293575 - DNA, 36 bp, Artificial Sequence
  Description of Artificial Sequence: Synthetic oligonucleotide
gaagggtttggtgtaggtgtggaaatcattgatctg

SEQ ID NO: 293576 - DNA, 36 bp, Artificial Sequence
  Description of Artificial Sequence: Synthetic oligonucleotide
aagggtttggtgtaggtgtggaaatcattgatctgg

SEQ ID NO: 293577 - DNA, 35 bp, Artificial Sequence
  Description of Artificial Sequence: Synthetic oligonucleotide
agggtttggtgtaggtgtggaaatcattgatctgg

SEQ ID NO: 293578 - DNA, 34 bp, Artificial Sequence
  Description of Artificial Sequence: Synthetic oligonucleotide
gggtttggtgtaggtgtggaaatcattgatctgg

SEQ ID NO: 293579 - DNA, 36 bp, Artificial Sequence
  Description of Artificial Sequence: Synthetic oligonucleotide
ggtttggtgtaggtgtggaaatcattgatctggaac

SEQ ID NO: 293580 - DNA, 37 bp, Artificial Sequence
  Description of Artificial Sequence: Synthetic oligonucleotide
gtttggtgtaggtgtggaaatcattgatctggaactg

SEQ ID NO: 293581 - DNA, 38 bp, Artificial Sequence
  Description of Artificial Sequence: Synthetic oligonucleotide
tttggtgtaggtgtggaaatcattgatctggaactgtc

SEQ ID NO: 293582 - DNA, 37 bp, Artificial Sequence
  Description of Artificial Sequence: Synthetic oligonucleotide
ttggtgtaggtgtggaaatcattgatctggaactgtc

SEQ ID NO: 293583 - DNA, 36 bp, Artificial Sequence
  Description of Artificial Sequence: Synthetic oligonucleotide
tggtgtaggtgtggaaatcattgatctggaactgtc

SEQ ID NO: 293584 - DNA, 35 bp, Artificial Sequence
  Description of Artificial Sequence: Synthetic oligonucleotide
ggtgtaggtgtggaaatcattgatctggaactgtc

SEQ ID NO: 293585 - DNA, 35 bp, Artificial Sequence
  Description of Artificial Sequence: Synthetic oligonucleotide
gtgtaggtgtggaaatcattgatctggaactgtcg

SEQ ID NO: 293586 - DNA, 36 bp, Artificial Sequence
  Description of Artificial Sequence: Synthetic oligonucleotide
tgtaggtgtggaaatcattgatctggaactgtcgag

SEQ ID NO: 293587 - DNA, 35 bp, Artificial Sequence
  Description of Artificial Sequence: Synthetic oligonucleotide
gtaggtgtggaaatcattgatctggaactgtcgag

SEQ ID NO: 293588 - DNA, 35 bp, Artificial Sequence
  Description of Artificial Sequence: Synthetic oligonucleotide
taggtgtggaaatcattgatctggaactgtcgagg

SEQ ID NO: 293589 - DNA, 34 bp, Artificial Sequence
  Description of Artificial Sequence: Synthetic oligonucleotide
aggtgtggaaatcattgatctggaactgtcgagg

SEQ ID NO: 293590 - DNA, 33 bp, Artificial Sequence
  Description of Artificial Sequence: Synthetic oligonucleotide
ggtgtggaaatcattgatctggaactgtcgagg

SEQ ID NO: 293591 - DNA, 39 bp, Artificial Sequence
  Description of Artificial Sequence: Synthetic oligonucleotide
gtgtggaaatcattgatctggaactgtcgaggtttattc

SEQ ID NO: 293592 - DNA, 39 bp, Artificial Sequence
  Description of Artificial Sequence: Synthetic oligonucleotide
tgtggaaatcattgatctggaactgtcgaggtttattcc

SEQ ID NO: 293593 - DNA, 38 bp, Artificial Sequence
  Description of Artificial Sequence: Synthetic oligonucleotide
gtggaaatcattgatctggaactgtcgaggtttattcc

SEQ ID NO: 293594 - DNA, 39 bp, Artificial Sequence
  Description of Artificial Sequence: Synthetic oligonucleotide
tggaaatcattgatctggaactgtcgaggtttattcctg

SEQ ID NO: 293595 - DNA, 38 bp, Artificial Sequence
  Description of Artificial Sequence: Synthetic oligonucleotide
ggaaatcattgatctggaactgtcgaggtttattcctg

SEQ ID NO: 293596 - DNA, 38 bp, Artificial Sequence
  Description of Artificial Sequence: Synthetic oligonucleotide
gaaatcattgatctggaactgtcgaggtttattcctgc

SEQ ID NO: 293597 - DNA, 38 bp, Artificial Sequence
  Description of Artificial Sequence: Synthetic oligonucleotide
aaatcattgatctggaactgtcgaggtttattcctgcc

SEQ ID NO: 293598 - DNA, 37 bp, Artificial Sequence
  Description of Artificial Sequence: Synthetic oligonucleotide
aatcattgatctggaactgtcgaggtttattcctgcc

SEQ ID NO: 293599 - DNA, 36 bp, Artificial Sequence
  Description of Artificial Sequence: Synthetic oligonucleotide
atcattgatctggaactgtcgaggtttattcctgcc

SEQ ID NO: 293600 - DNA, 35 bp, Artificial Sequence
  Description of Artificial Sequence: Synthetic oligonucleotide
tcattgatctggaactgtcgaggtttattcctgcc

SEQ ID NO: 293601 - DNA, 34 bp, Artificial Sequence
  Description of Artificial Sequence: Synthetic oligonucleotide
cattgatctggaactgtcgaggtttattcctgcc

SEQ ID NO: 293602 - DNA, 34 bp, Artificial Sequence
  Description of Artificial Sequence: Synthetic oligonucleotide
attgatctggaactgtcgaggtttattcctgccg

SEQ ID NO: 293603 - DNA, 33 bp, Artificial Sequence
  Description of Artificial Sequence: Synthetic oligonucleotide
ttgatctggaactgtcgaggtttattcctgccg

SEQ ID NO: 293604 - DNA, 32 bp, Artificial Sequence
  Description of Artificial Sequence: Synthetic oligonucleotide
tgatctggaactgtcgaggtttattcctgccg

SEQ ID NO: 293605 - DNA, 31 bp, Artificial Sequence
  Description of Artificial Sequence: Synthetic oligonucleotide
gatctggaactgtcgaggtttattcctgccg

SEQ ID NO: 293606 - DNA, 31 bp, Artificial Sequence
  Description of Artificial Sequence: Synthetic oligonucleotide
atctggaactgtcgaggtttattcctgccgg

SEQ ID NO: 293607 - DNA, 30 bp, Artificial Sequence
  Description of Artificial Sequence: Synthetic oligonucleotide
tctggaactgtcgaggtttattcctgccgg

SEQ ID NO: 293608 - DNA, 29 bp, Artificial Sequence
  Description of Artificial Sequence: Synthetic oligonucleotide
ctggaactgtcgaggtttattcctgccgg

SEQ ID NO: 293609 - DNA, 29 bp, Artificial Sequence
  Description of Artificial Sequence: Synthetic oligonucleotide
tggaactgtcgaggtttattcctgccggg

SEQ ID NO: 293610 - DNA, 28 bp, Artificial Sequence
  Description of Artificial Sequence: Synthetic oligonucleotide
ggaactgtcgaggtttattcctgccggg

SEQ ID NO: 293611 - DNA, 29 bp, Artificial Sequence
  Description of Artificial Sequence: Synthetic oligonucleotide
gaactgtcgaggtttattcctgccgggac

SEQ ID NO: 293612 - DNA, 30 bp, Artificial Sequence
  Description of Artificial Sequence: Synthetic oligonucleotide
aactgtcgaggtttattcctgccgggacac

SEQ ID NO: 293613 - DNA, 29 bp, Artificial Sequence
  Description of Artificial Sequence: Synthetic oligonucleotide
actgtcgaggtttattcctgccgggacac

SEQ ID NO: 293614 - DNA, 28 bp, Artificial Sequence
  Description of Artificial Sequence: Synthetic oligonucleotide
ctgtcgaggtttattcctgccgggacac

SEQ ID NO: 293615 - DNA, 30 bp, Artificial Sequence
  Description of Artificial Sequence: Synthetic oligonucleotide
tgtcgaggtttattcctgccgggacactac

SEQ ID NO: 293616 - DNA, 29 bp, Artificial Sequence
  Description of Artificial Sequence: Synthetic oligonucleotide
gtcgaggtttattcctgccgggacactac

SEQ ID NO: 293617 - DNA, 30 bp, Artificial Sequence
  Description of Artificial Sequence: Synthetic oligonucleotide
tcgaggtttattcctgccgggacactacac

SEQ ID NO: 293618 - DNA, 29 bp, Artificial Sequence
  Description of Artificial Sequence: Synthetic oligonucleotide
cgaggtttattcctgccgggacactacac

SEQ ID NO: 293619 - DNA, 30 bp, Artificial Sequence
  Description of Artificial Sequence: Synthetic oligonucleotide
gaggtttattcctgccgggacactacactg

SEQ ID NO: 293620 - DNA, 30 bp, Artificial Sequence
  Description of Artificial Sequence: Synthetic oligonucleotide
aggtttattcctgccgggacactacactgg

SEQ ID NO: 293621 - DNA, 29 bp, Artificial Sequence
  Description of Artificial Sequence: Synthetic oligonucleotide
ggtttattcctgccgggacactacactgg

SEQ ID NO: 293622 - DNA, 35 bp, Artificial Sequence
  Description of Artificial Sequence: Synthetic oligonucleotide
gtttattcctgccgggacactacactggaaaatag

SEQ ID NO: 293623 - DNA, 40 bp, Artificial Sequence
  Description of Artificial Sequence: Synthetic oligonucleotide
tttattcctgccgggacactacactggaaaatagattaag

SEQ ID NO: 293624 - DNA, 39 bp, Artificial Sequence
  Description of Artificial Sequence: Synthetic oligonucleotide
ttattcctgccgggacactacactggaaaatagattaag

SEQ ID NO: 293625 - DNA, 38 bp, Artificial Sequence
  Description of Artificial Sequence: Synthetic oligonucleotide
tattcctgccgggacactacactggaaaatagattaag

SEQ ID NO: 293626 - DNA, 37 bp, Artificial Sequence
  Description of Artificial Sequence: Synthetic oligonucleotide
attcctgccgggacactacactggaaaatagattaag

SEQ ID NO: 293627 - DNA, 36 bp, Artificial Sequence
  Description of Artificial Sequence: Synthetic oligonucleotide
ttcctgccgggacactacactggaaaatagattaag

SEQ ID NO: 293628 - DNA, 35 bp, Artificial Sequence
  Description of Artificial Sequence: Synthetic oligonucleotide
tcctgccgggacactacactggaaaatagattaag

SEQ ID NO: 293629 - DNA, 34 bp, Artificial Sequence
  Description of Artificial Sequence: Synthetic oligonucleotide
cctgccgggacactacactggaaaatagattaag

SEQ ID NO: 293630 - DNA, 35 bp, Artificial Sequence
  Description of Artificial Sequence: Synthetic oligonucleotide
ctgccgggacactacactggaaaatagattaagtg

SEQ ID NO: 293631 - DNA, 38 bp, Artificial Sequence
  Description of Artificial Sequence: Synthetic oligonucleotide
tgccgggacactacactggaaaatagattaagtgaatg

SEQ ID NO: 293632 - DNA, 37 bp, Artificial Sequence
  Description of Artificial Sequence: Synthetic oligonucleotide
gccgggacactacactggaaaatagattaagtgaatg

SEQ ID NO: 293633 - DNA, 42 bp, Artificial Sequence
  Description of Artificial Sequence: Synthetic oligonucleotide
ccgggacactacactggaaaatagattaagtgaatgtaatag

SEQ ID NO: 293634 - DNA, 44 bp, Artificial Sequence
  Description of Artificial Sequence: Synthetic oligonucleotide
cgggacactacactggaaaatagattaagtgaatgtaatagtag

SEQ ID NO: 293635 - DNA, 47 bp, Artificial Sequence
  Description of Artificial Sequence: Synthetic oligonucleotide
gggacactacactggaaaatagattaagtgaatgtaatagtagatac

SEQ ID NO: 293636 - DNA, 47 bp, Artificial Sequence
  Description of Artificial Sequence: Synthetic oligonucleotide
ggacactacactggaaaatagattaagtgaatgtaatagtagatacc

SEQ ID NO: 293637 - DNA, 49 bp, Artificial Sequence
  Description of Artificial Sequence: Synthetic oligonucleotide
gacactacactggaaaatagattaagtgaatgtaatagtagataccaac

SEQ ID NO: 293638 - DNA, 50 bp, Artificial Sequence
  Description of Artificial Sequence: Synthetic oligonucleotide
acactacactggaaaatagattaagtgaatgtaatagtagataccaacag

SEQ ID NO: 293639 - DNA, 49 bp, Artificial Sequence
  Description of Artificial Sequence: Synthetic oligonucleotide
cactacactggaaaatagattaagtgaatgtaatagtagataccaacag

SEQ ID NO: 293640 - DNA, 50 bp, Artificial Sequence
  Description of Artificial Sequence: Synthetic oligonucleotide
actacactggaaaatagattaagtgaatgtaatagtagataccaacagag

SEQ ID NO: 293641 - DNA, 49 bp, Artificial Sequence
  Description of Artificial Sequence: Synthetic oligonucleotide
ctacactggaaaatagattaagtgaatgtaatagtagataccaacagag

SEQ ID NO: 293642 - DNA, 49 bp, Artificial Sequence
  Description of Artificial Sequence: Synthetic oligonucleotide
tacactggaaaatagattaagtgaatgtaatagtagataccaacagagc

SEQ ID NO: 293643 - DNA, 48 bp, Artificial Sequence
  Description of Artificial Sequence: Synthetic oligonucleotide
acactggaaaatagattaagtgaatgtaatagtagataccaacagagc

SEQ ID NO: 293644 - DNA, 47 bp, Artificial Sequence
  Description of Artificial Sequence: Synthetic oligonucleotide
cactggaaaatagattaagtgaatgtaatagtagataccaacagagc

SEQ ID NO: 293645 - DNA, 48 bp, Artificial Sequence
  Description of Artificial Sequence: Synthetic oligonucleotide
actggaaaatagattaagtgaatgtaatagtagataccaacagagctg

SEQ ID NO: 293646 - DNA, 47 bp, Artificial Sequence
  Description of Artificial Sequence: Synthetic oligonucleotide
ctggaaaatagattaagtgaatgtaatagtagataccaacagagctg

SEQ ID NO: 293647 - DNA, 50 bp, Artificial Sequence
  Description of Artificial Sequence: Synthetic oligonucleotide
tggaaaatagattaagtgaatgtaatagtagataccaacagagctgatag

SEQ ID NO: 293648 - DNA, 49 bp, Artificial Sequence
  Description of Artificial Sequence: Synthetic oligonucleotide
ggaaaatagattaagtgaatgtaatagtagataccaacagagctgatag

SEQ ID NO: 293649 - DNA, 49 bp, Artificial Sequence
  Description of Artificial Sequence: Synthetic oligonucleotide
gaaaatagattaagtgaatgtaatagtagataccaacagagctgatagc

SEQ ID NO: 293650 - DNA, 51 bp, Artificial Sequence
  Description of Artificial Sequence: Synthetic oligonucleotide
aaaatagattaagtgaatgtaatagtagataccaacagagctgatagcatg

SEQ ID NO: 293651 - DNA, 50 bp, Artificial Sequence
  Description of Artificial Sequence: Synthetic oligonucleotide
aaatagattaagtgaatgtaatagtagataccaacagagctgatagcatg

SEQ ID NO: 293652 - DNA, 49 bp, Artificial Sequence
  Description of Artificial Sequence: Synthetic oligonucleotide
aatagattaagtgaatgtaatagtagataccaacagagctgatagcatg

SEQ ID NO: 293653 - DNA, 48 bp, Artificial Sequence
  Description of Artificial Sequence: Synthetic oligonucleotide
atagattaagtgaatgtaatagtagataccaacagagctgatagcatg

SEQ ID NO: 293654 - DNA, 47 bp, Artificial Sequence
  Description of Artificial Sequence: Synthetic oligonucleotide
tagattaagtgaatgtaatagtagataccaacagagctgatagcatg

SEQ ID NO: 293655 - DNA, 46 bp, Artificial Sequence
  Description of Artificial Sequence: Synthetic oligonucleotide
agattaagtgaatgtaatagtagataccaacagagctgatagcatg

SEQ ID NO: 293656 - DNA, 45 bp, Artificial Sequence
  Description of Artificial Sequence: Synthetic oligonucleotide
gattaagtgaatgtaatagtagataccaacagagctgatagcatg

SEQ ID NO: 293657 - DNA, 47 bp, Artificial Sequence
  Description of Artificial Sequence: Synthetic oligonucleotide
attaagtgaatgtaatagtagataccaacagagctgatagcatgaac

SEQ ID NO: 293658 - DNA, 46 bp, Artificial Sequence
  Description of Artificial Sequence: Synthetic oligonucleotide
ttaagtgaatgtaatagtagataccaacagagctgatagcatgaac

SEQ ID NO: 293659 - DNA, 45 bp, Artificial Sequence
  Description of Artificial Sequence: Synthetic oligonucleotide
taagtgaatgtaatagtagataccaacagagctgatagcatgaac

SEQ ID NO: 293660 - DNA, 44 bp, Artificial Sequence
  Description of Artificial Sequence: Synthetic oligonucleotide
aagtgaatgtaatagtagataccaacagagctgatagcatgaac

SEQ ID NO: 293661 - DNA, 43 bp, Artificial Sequence
  Description of Artificial Sequence: Synthetic oligonucleotide
agtgaatgtaatagtagataccaacagagctgatagcatgaac

SEQ ID NO: 293662 - DNA, 42 bp, Artificial Sequence
  Description of Artificial Sequence: Synthetic oligonucleotide
gtgaatgtaatagtagataccaacagagctgatagcatgaac

SEQ ID NO: 293663 - DNA, 43 bp, Artificial Sequence
  Description of Artificial Sequence: Synthetic oligonucleotide
tgaatgtaatagtagataccaacagagctgatagcatgaactg

SEQ ID NO: 293664 - DNA, 42 bp, Artificial Sequence
  Description of Artificial Sequence: Synthetic oligonucleotide
gaatgtaatagtagataccaacagagctgatagcatgaactg

SEQ ID NO: 293665 - DNA, 42 bp, Artificial Sequence
  Description of Artificial Sequence: Synthetic oligonucleotide
aatgtaatagtagataccaacagagctgatagcatgaactgg

SEQ ID NO: 293666 - DNA, 41 bp, Artificial Sequence
  Description of Artificial Sequence: Synthetic oligonucleotide
atgtaatagtagataccaacagagctgatagcatgaactgg

SEQ ID NO: 293667 - DNA, 40 bp, Artificial Sequence
  Description of Artificial Sequence: Synthetic oligonucleotide
tgtaatagtagataccaacagagctgatagcatgaactgg

SEQ ID NO: 293668 - DNA, 39 bp, Artificial Sequence
  Description of Artificial Sequence: Synthetic oligonucleotide
gtaatagtagataccaacagagctgatagcatgaactgg

SEQ ID NO: 293669 - DNA, 39 bp, Artificial Sequence
  Description of Artificial Sequence: Synthetic oligonucleotide
taatagtagataccaacagagctgatagcatgaactggc

SEQ ID NO: 293670 - DNA, 38 bp, Artificial Sequence
  Description of Artificial Sequence: Synthetic oligonucleotide
aatagtagataccaacagagctgatagcatgaactggc

SEQ ID NO: 293671 - DNA, 37 bp, Artificial Sequence
  Description of Artificial Sequence: Synthetic oligonucleotide
atagtagataccaacagagctgatagcatgaactggc

SEQ ID NO: 293672 - DNA, 36 bp, Artificial Sequence
  Description of Artificial Sequence: Synthetic oligonucleotide
tagtagataccaacagagctgatagcatgaactggc

SEQ ID NO: 293673 - DNA, 35 bp, Artificial Sequence
  Description of Artificial Sequence: Synthetic oligonucleotide
agtagataccaacagagctgatagcatgaactggc

SEQ ID NO: 293674 - DNA, 34 bp, Artificial Sequence
  Description of Artificial Sequence: Synthetic oligonucleotide
gtagataccaacagagctgatagcatgaactggc

SEQ ID NO: 293675 - DNA, 35 bp, Artificial Sequence
  Description of Artificial Sequence: Synthetic oligonucleotide
tagataccaacagagctgatagcatgaactggcac

SEQ ID NO: 293676 - DNA, 34 bp, Artificial Sequence
  Description of Artificial Sequence: Synthetic oligonucleotide
agataccaacagagctgatagcatgaactggcac

SEQ ID NO: 293677 - DNA, 33 bp, Artificial Sequence
  Description of Artificial Sequence: Synthetic oligonucleotide
gataccaacagagctgatagcatgaactggcac

SEQ ID NO: 293678 - DNA, 35 bp, Artificial Sequence
  Description of Artificial Sequence: Synthetic oligonucleotide
ataccaacagagctgatagcatgaactggcactac

SEQ ID NO: 293679 - DNA, 34 bp, Artificial Sequence
  Description of Artificial Sequence: Synthetic oligonucleotide
taccaacagagctgatagcatgaactggcactac

SEQ ID NO: 293680 - DNA, 33 bp, Artificial Sequence
  Description of Artificial Sequence: Synthetic oligonucleotide
accaacagagctgatagcatgaactggcactac

SEQ ID NO: 293681 - DNA, 32 bp, Artificial Sequence
  Description of Artificial Sequence: Synthetic oligonucleotide
ccaacagagctgatagcatgaactggcactac

SEQ ID NO: 293682 - DNA, 32 bp, Artificial Sequence
  Description of Artificial Sequence: Synthetic oligonucleotide
caacagagctgatagcatgaactggcactacc

SEQ ID NO: 293683 - DNA, 34 bp, Artificial Sequence
  Description of Artificial Sequence: Synthetic oligonucleotide
aacagagctgatagcatgaactggcactaccaag

SEQ ID NO: 293684 - DNA, 33 bp, Artificial Sequence
  Description of Artificial Sequence: Synthetic oligonucleotide
acagagctgatagcatgaactggcactaccaag

SEQ ID NO: 293685 - DNA, 32 bp, Artificial Sequence
  Description of Artificial Sequence: Synthetic oligonucleotide
cagagctgatagcatgaactggcactaccaag

SEQ ID NO: 293686 - DNA, 35 bp, Artificial Sequence
  Description of Artificial Sequence: Synthetic oligonucleotide
agagctgatagcatgaactggcactaccaagaatc

SEQ ID NO: 293687 - DNA, 34 bp, Artificial Sequence
  Description of Artificial Sequence: Synthetic oligonucleotide
gagctgatagcatgaactggcactaccaagaatc

SEQ ID NO: 293688 - DNA, 37 bp, Artificial Sequence
  Description of Artificial Sequence: Synthetic oligonucleotide
agctgatagcatgaactggcactaccaagaatctatc

SEQ ID NO: 293689 - DNA, 36 bp, Artificial Sequence
  Description of Artificial Sequence: Synthetic oligonucleotide
gctgatagcatgaactggcactaccaagaatctatc

SEQ ID NO: 293690 - DNA, 38 bp, Artificial Sequence
  Description of Artificial Sequence: Synthetic oligonucleotide
ctgatagcatgaactggcactaccaagaatctatcaag

SEQ ID NO: 293691 - DNA, 41 bp, Artificial Sequence
  Description of Artificial Sequence: Synthetic oligonucleotide
tgatagcatgaactggcactaccaagaatctatcaagatag

SEQ ID NO: 293692 - DNA, 40 bp, Artificial Sequence
  Description of Artificial Sequence: Synthetic oligonucleotide
gatagcatgaactggcactaccaagaatctatcaagatag

SEQ ID NO: 293693 - DNA, 40 bp, Artificial Sequence
  Description of Artificial Sequence: Synthetic oligonucleotide
atagcatgaactggcactaccaagaatctatcaagatagg

SEQ ID NO: 293694 - DNA, 39 bp, Artificial Sequence
  Description of Artificial Sequence: Synthetic oligonucleotide
tagcatgaactggcactaccaagaatctatcaagatagg

SEQ ID NO: 293695 - DNA, 38 bp, Artificial Sequence
  Description of Artificial Sequence: Synthetic oligonucleotide
agcatgaactggcactaccaagaatctatcaagatagg

SEQ ID NO: 293696 - DNA, 37 bp, Artificial Sequence
  Description of Artificial Sequence: Synthetic oligonucleotide
gcatgaactggcactaccaagaatctatcaagatagg

SEQ ID NO: 293697 - DNA, 38 bp, Artificial Sequence
  Description of Artificial Sequence: Synthetic oligonucleotide
catgaactggcactaccaagaatctatcaagataggag

SEQ ID NO: 293698 - DNA, 40 bp, Artificial Sequence
  Description of Artificial Sequence: Synthetic oligonucleotide
atgaactggcactaccaagaatctatcaagataggagatc

SEQ ID NO: 293699 - DNA, 39 bp, Artificial Sequence
  Description of Artificial Sequence: Synthetic oligonucleotide
tgaactggcactaccaagaatctatcaagataggagatc

SEQ ID NO: 293700 - DNA, 38 bp, Artificial Sequence
  Description of Artificial Sequence: Synthetic oligonucleotide
gaactggcactaccaagaatctatcaagataggagatc

SEQ ID NO: 293701 - DNA, 39 bp, Artificial Sequence
  Description of Artificial Sequence: Synthetic oligonucleotide
aactggcactaccaagaatctatcaagataggagatctc

SEQ ID NO: 293702 - DNA, 38 bp, Artificial Sequence
  Description of Artificial Sequence: Synthetic oligonucleotide
actggcactaccaagaatctatcaagataggagatctc

SEQ ID NO: 293703 - DNA, 37 bp, Artificial Sequence
  Description of Artificial Sequence: Synthetic oligonucleotide
ctggcactaccaagaatctatcaagataggagatctc

SEQ ID NO: 293704 - DNA, 37 bp, Artificial Sequence
  Description of Artificial Sequence: Synthetic oligonucleotide
tggcactaccaagaatctatcaagataggagatctcc

SEQ ID NO: 293705 - DNA, 36 bp, Artificial Sequence
  Description of Artificial Sequence: Synthetic oligonucleotide
ggcactaccaagaatctatcaagataggagatctcc

SEQ ID NO: 293706 - DNA, 38 bp, Artificial Sequence
  Description of Artificial Sequence: Synthetic oligonucleotide
gcactaccaagaatctatcaagataggagatctcctac

SEQ ID NO: 293707 - DNA, 42 bp, Artificial Sequence
  Description of Artificial Sequence: Synthetic oligonucleotide
cactaccaagaatctatcaagataggagatctcctactaaac

SEQ ID NO: 293708 - DNA, 43 bp, Artificial Sequence
  Description of Artificial Sequence: Synthetic oligonucleotide
actaccaagaatctatcaagataggagatctcctactaaactg

SEQ ID NO: 293709 - DNA, 42 bp, Artificial Sequence
  Description of Artificial Sequence: Synthetic oligonucleotide
ctaccaagaatctatcaagataggagatctcctactaaactg

SEQ ID NO: 293710 - DNA, 43 bp, Artificial Sequence
  Description of Artificial Sequence: Synthetic oligonucleotide
taccaagaatctatcaagataggagatctcctactaaactgag

SEQ ID NO: 293711 - DNA, 42 bp, Artificial Sequence
  Description of Artificial Sequence: Synthetic oligonucleotide
accaagaatctatcaagataggagatctcctactaaactgag

SEQ ID NO: 293712 - DNA, 41 bp, Artificial Sequence
  Description of Artificial Sequence: Synthetic oligonucleotide
ccaagaatctatcaagataggagatctcctactaaactgag

SEQ ID NO: 293713 - DNA, 43 bp, Artificial Sequence
  Description of Artificial Sequence: Synthetic oligonucleotide
caagaatctatcaagataggagatctcctactaaactgagttc

SEQ ID NO: 293714 - DNA, 48 bp, Artificial Sequence
  Description of Artificial Sequence: Synthetic oligonucleotide
aagaatctatcaagataggagatctcctactaaactgagttcaaatac

SEQ ID NO: 293715 - DNA, 47 bp, Artificial Sequence
  Description of Artificial Sequence: Synthetic oligonucleotide
agaatctatcaagataggagatctcctactaaactgagttcaaatac

SEQ ID NO: 293716 - DNA, 46 bp, Artificial Sequence
  Description of Artificial Sequence: Synthetic oligonucleotide
gaatctatcaagataggagatctcctactaaactgagttcaaatac

SEQ ID NO: 293717 - DNA, 49 bp, Artificial Sequence
  Description of Artificial Sequence: Synthetic oligonucleotide
aatctatcaagataggagatctcctactaaactgagttcaaatactttc

SEQ ID NO: 293718 - DNA, 48 bp, Artificial Sequence
  Description of Artificial Sequence: Synthetic oligonucleotide
atctatcaagataggagatctcctactaaactgagttcaaatactttc

SEQ ID NO: 293719 - DNA, 47 bp, Artificial Sequence
  Description of Artificial Sequence: Synthetic oligonucleotide
tctatcaagataggagatctcctactaaactgagttcaaatactttc

SEQ ID NO: 293720 - DNA, 46 bp, Artificial Sequence
  Description of Artificial Sequence: Synthetic oligonucleotide
ctatcaagataggagatctcctactaaactgagttcaaatactttc

SEQ ID NO: 293721 - DNA, 46 bp, Artificial Sequence
  Description of Artificial Sequence: Synthetic oligonucleotide
tatcaagataggagatctcctactaaactgagttcaaatactttcc

SEQ ID NO: 293722 - DNA, 45 bp, Artificial Sequence
  Description of Artificial Sequence: Synthetic oligonucleotide
atcaagataggagatctcctactaaactgagttcaaatactttcc

SEQ ID NO: 293723 - DNA, 44 bp, Artificial Sequence
  Description of Artificial Sequence: Synthetic oligonucleotide
tcaagataggagatctcctactaaactgagttcaaatactttcc

SEQ ID NO: 293724 - DNA, 43 bp, Artificial Sequence
  Description of Artificial Sequence: Synthetic oligonucleotide
caagataggagatctcctactaaactgagttcaaatactttcc

SEQ ID NO: 293725 - DNA, 44 bp, Artificial Sequence
  Description of Artificial Sequence: Synthetic oligonucleotide
aagataggagatctcctactaaactgagttcaaatactttccag

SEQ ID NO: 293726 - DNA, 43 bp, Artificial Sequence
  Description of Artificial Sequence: Synthetic oligonucleotide
agataggagatctcctactaaactgagttcaaatactttccag

SEQ ID NO: 293727 - DNA, 42 bp, Artificial Sequence
  Description of Artificial Sequence: Synthetic oligonucleotide
gataggagatctcctactaaactgagttcaaatactttccag

SEQ ID NO: 293728 - DNA, 43 bp, Artificial Sequence
  Description of Artificial Sequence: Synthetic oligonucleotide
ataggagatctcctactaaactgagttcaaatactttccagtg

SEQ ID NO: 293729 - DNA, 42 bp, Artificial Sequence
  Description of Artificial Sequence: Synthetic oligonucleotide
taggagatctcctactaaactgagttcaaatactttccagtg

SEQ ID NO: 293730 - DNA, 41 bp, Artificial Sequence
  Description of Artificial Sequence: Synthetic oligonucleotide
aggagatctcctactaaactgagttcaaatactttccagtg

SEQ ID NO: 293731 - DNA, 40 bp, Artificial Sequence
  Description of Artificial Sequence: Synthetic oligonucleotide
ggagatctcctactaaactgagttcaaatactttccagtg

SEQ ID NO: 293732 - DNA, 50 bp, Artificial Sequence
  Description of Artificial Sequence: Synthetic oligonucleotide
gagatctcctactaaactgagttcaaatactttccagtgtaattaatttg

SEQ ID NO: 293733 - DNA, 26 bp, Artificial Sequence
  Description of Artificial Sequence: Synthetic oligonucleotide
atgccggtgctggcagtccagaaggt

SEQ ID NO: 293734 - DNA, 25 bp, Artificial Sequence
  Description of Artificial Sequence: Synthetic oligonucleotide
tgccggtgctggcagtccagaaggt

SEQ ID NO: 293735 - DNA, 24 bp, Artificial Sequence
  Description of Artificial Sequence: Synthetic oligonucleotide
gccggtgctggcagtccagaaggt

SEQ ID NO: 293736 - DNA, 24 bp, Artificial Sequence
  Description of Artificial Sequence: Synthetic oligonucleotide
ccggtgctggcagtccagaaggtg

SEQ ID NO: 293737 - DNA, 25 bp, Artificial Sequence
  Description of Artificial Sequence: Synthetic oligonucleotide
cggtgctggcagtccagaaggtgct

SEQ ID NO: 293738 - DNA, 25 bp, Artificial Sequence
  Description of Artificial Sequence: Synthetic oligonucleotide
ggtgctggcagtccagaaggtgctg

SEQ ID NO: 293739 - DNA, 26 bp, Artificial Sequence
  Description of Artificial Sequence: Synthetic oligonucleotide
gtgctggcagtccagaaggtgctggt

SEQ ID NO: 293740 - DNA, 26 bp, Artificial Sequence
  Description of Artificial Sequence: Synthetic oligonucleotide
tgctggcagtccagaaggtgctggtc

SEQ ID NO: 293741 - DNA, 25 bp, Artificial Sequence
  Description of Artificial Sequence: Synthetic oligonucleotide
gctggcagtccagaaggtgctggtc

SEQ ID NO: 293742 - DNA, 26 bp, Artificial Sequence
  Description of Artificial Sequence: Synthetic oligonucleotide
ctggcagtccagaaggtgctggtcca

SEQ ID NO: 293743 - DNA, 26 bp, Artificial Sequence
  Description of Artificial Sequence: Synthetic oligonucleotide
tggcagtccagaaggtgctggtccac

SEQ ID NO: 293744 - DNA, 25 bp, Artificial Sequence
  Description of Artificial Sequence: Synthetic oligonucleotide
ggcagtccagaaggtgctggtccac

SEQ ID NO: 293745 - DNA, 25 bp, Artificial Sequence
  Description of Artificial Sequence: Synthetic oligonucleotide
gcagtccagaaggtgctggtccacc

SEQ ID NO: 293746 - DNA, 25 bp, Artificial Sequence
  Description of Artificial Sequence: Synthetic oligonucleotide
cagtccagaaggtgctggtccaccg

SEQ ID NO: 293747 - DNA, 25 bp, Artificial Sequence
  Description of Artificial Sequence: Synthetic oligonucleotide
agtccagaaggtgctggtccaccgc

SEQ ID NO: 293748 - DNA, 24 bp, Artificial Sequence
  Description of Artificial Sequence: Synthetic oligonucleotide
gtccagaaggtgctggtccaccgc

SEQ ID NO: 293749 - DNA, 25 bp, Artificial Sequence
  Description of Artificial Sequence: Synthetic oligonucleotide
tccagaaggtgctggtccaccgcct

SEQ ID NO: 293750 - DNA, 24 bp, Artificial Sequence
  Description of Artificial Sequence: Synthetic oligonucleotide
ccagaaggtgctggtccaccgcct

SEQ ID NO: 293751 - DNA, 24 bp, Artificial Sequence
  Description of Artificial Sequence: Synthetic oligonucleotide
cagaaggtgctggtccaccgcctg

SEQ ID NO: 293752 - DNA, 25 bp, Artificial Sequence
  Description of Artificial Sequence: Synthetic oligonucleotide
agaaggtgctggtccaccgcctggt

SEQ ID NO: 293753 - DNA, 24 bp, Artificial Sequence
  Description of Artificial Sequence: Synthetic oligonucleotide
gaaggtgctggtccaccgcctggt

SEQ ID NO: 293754 - DNA, 24 bp, Artificial Sequence
  Description of Artificial Sequence: Synthetic oligonucleotide
aaggtgctggtccaccgcctggtg

SEQ ID NO: 293755 - DNA, 23 bp, Artificial Sequence
  Description of Artificial Sequence: Synthetic oligonucleotide
aggtgctggtccaccgcctggtg

SEQ ID NO: 293756 - DNA, 22 bp, Artificial Sequence
  Description of Artificial Sequence: Synthetic oligonucleotide
ggtgctggtccaccgcctggtg

SEQ ID NO: 293757 - DNA, 23 bp, Artificial Sequence
  Description of Artificial Sequence: Synthetic oligonucleotide
gtgctggtccaccgcctggtgct

SEQ ID NO: 293758 - DNA, 23 bp, Artificial Sequence
  Description of Artificial Sequence: Synthetic oligonucleotide
tgctggtccaccgcctggtgctc

SEQ ID NO: 293759 - DNA, 22 bp, Artificial Sequence
  Description of Artificial Sequence: Synthetic oligonucleotide
gctggtccaccgcctggtgctc

SEQ ID NO: 293760 - DNA, 23 bp, Artificial Sequence
  Description of Artificial Sequence: Synthetic oligonucleotide
ctggtccaccgcctggtgctcct

SEQ ID NO: 293761 - DNA, 24 bp, Artificial Sequence
  Description of Artificial Sequence: Synthetic oligonucleotide
tggtccaccgcctggtgctcctca

SEQ ID NO: 293762 - DNA, 23 bp, Artificial Sequence
  Description of Artificial Sequence: Synthetic oligonucleotide
ggtccaccgcctggtgctcctca

SEQ ID NO: 293763 - DNA, 24 bp, Artificial Sequence
  Description of Artificial Sequence: Synthetic oligonucleotide
gtccaccgcctggtgctcctcagt

SEQ ID NO: 293764 - DNA, 25 bp, Artificial Sequence
  Description of Artificial Sequence: Synthetic oligonucleotide
tccaccgcctggtgctcctcagtgt

SEQ ID NO: 293765 - DNA, 24 bp, Artificial Sequence
  Description of Artificial Sequence: Synthetic oligonucleotide
ccaccgcctggtgctcctcagtgt

SEQ ID NO: 293766 - DNA, 24 bp, Artificial Sequence
  Description of Artificial Sequence: Synthetic oligonucleotide
caccgcctggtgctcctcagtgtg

SEQ ID NO: 293767 - DNA, 25 bp, Artificial Sequence
  Description of Artificial Sequence: Synthetic oligonucleotide
accgcctggtgctcctcagtgtgct

SEQ ID NO: 293768 - DNA, 24 bp, Artificial Sequence
  Description of Artificial Sequence: Synthetic oligonucleotide
ccgcctggtgctcctcagtgtgct

SEQ ID NO: 293769 - DNA, 24 bp, Artificial Sequence
  Description of Artificial Sequence: Synthetic oligonucleotide
cgcctggtgctcctcagtgtgctg

SEQ ID NO: 293770 - DNA, 26 bp, Artificial Sequence
  Description of Artificial Sequence: Synthetic oligonucleotide
gcctggtgctcctcagtgtgctggat

SEQ ID NO: 293771 - DNA, 27 bp, Artificial Sequence
  Description of Artificial Sequence: Synthetic oligonucleotide
cctggtgctcctcagtgtgctggatca

SEQ ID NO: 293772 - DNA, 30 bp, Artificial Sequence
  Description of Artificial Sequence: Synthetic oligonucleotide
ctggtgctcctcagtgtgctggatcattac

SEQ ID NO: 293773 - DNA, 32 bp, Artificial Sequence
  Description of Artificial Sequence: Synthetic oligonucleotide
tggtgctcctcagtgtgctggatcattacaac

SEQ ID NO: 293774 - DNA, 31 bp, Artificial Sequence
  Description of Artificial Sequence: Synthetic oligonucleotide
ggtgctcctcagtgtgctggatcattacaac

SEQ ID NO: 293775 - DNA, 31 bp, Artificial Sequence
  Description of Artificial Sequence: Synthetic oligonucleotide
gtgctcctcagtgtgctggatcattacaacc

SEQ ID NO: 293776 - DNA, 31 bp, Artificial Sequence
  Description of Artificial Sequence: Synthetic oligonucleotide
tgctcctcagtgtgctggatcattacaaccg

SEQ ID NO: 293777 - DNA, 30 bp, Artificial Sequence
  Description of Artificial Sequence: Synthetic oligonucleotide
gctcctcagtgtgctggatcattacaaccg

SEQ ID NO: 293778 - DNA, 33 bp, Artificial Sequence
  Description of Artificial Sequence: Synthetic oligonucleotide
ctcctcagtgtgctggatcattacaaccgaatg

SEQ ID NO: 293779 - DNA, 33 bp, Artificial Sequence
  Description of Artificial Sequence: Synthetic oligonucleotide
tcctcagtgtgctggatcattacaaccgaatgg

SEQ ID NO: 293780 - DNA, 32 bp, Artificial Sequence
  Description of Artificial Sequence: Synthetic oligonucleotide
cctcagtgtgctggatcattacaaccgaatgg

SEQ ID NO: 293781 - DNA, 32 bp, Artificial Sequence
  Description of Artificial Sequence: Synthetic oligonucleotide
ctcagtgtgctggatcattacaaccgaatggg

SEQ ID NO: 293782 - DNA, 32 bp, Artificial Sequence
  Description of Artificial Sequence: Synthetic oligonucleotide
tcagtgtgctggatcattacaaccgaatgggc

SEQ ID NO: 293783 - DNA, 31 bp, Artificial Sequence
  Description of Artificial Sequence: Synthetic oligonucleotide
cagtgtgctggatcattacaaccgaatgggc

SEQ ID NO: 293784 - DNA, 33 bp, Artificial Sequence
  Description of Artificial Sequence: Synthetic oligonucleotide
agtgtgctggatcattacaaccgaatgggcaag

SEQ ID NO: 293785 - DNA, 32 bp, Artificial Sequence
  Description of Artificial Sequence: Synthetic oligonucleotide
gtgtgctggatcattacaaccgaatgggcaag

SEQ ID NO: 293786 - DNA, 32 bp, Artificial Sequence
  Description of Artificial Sequence: Synthetic oligonucleotide
tgtgctggatcattacaaccgaatgggcaagg

SEQ ID NO: 293787 - DNA, 31 bp, Artificial Sequence
  Description of Artificial Sequence: Synthetic oligonucleotide
gtgctggatcattacaaccgaatgggcaagg

SEQ ID NO: 293788 - DNA, 33 bp, Artificial Sequence
  Description of Artificial Sequence: Synthetic oligonucleotide
tgctggatcattacaaccgaatgggcaaggttc

SEQ ID NO: 293789 - DNA, 32 bp, Artificial Sequence
  Description of Artificial Sequence: Synthetic oligonucleotide
gctggatcattacaaccgaatgggcaaggttc

SEQ ID NO: 293790 - DNA, 32 bp, Artificial Sequence
  Description of Artificial Sequence: Synthetic oligonucleotide
ctggatcattacaaccgaatgggcaaggttcg

SEQ ID NO: 293791 - DNA, 35 bp, Artificial Sequence
  Description of Artificial Sequence: Synthetic oligonucleotide
tggatcattacaaccgaatgggcaaggttcgaaac

SEQ ID NO: 293792 - DNA, 34 bp, Artificial Sequence
  Description of Artificial Sequence: Synthetic oligonucleotide
ggatcattacaaccgaatgggcaaggttcgaaac

SEQ ID NO: 293793 - DNA, 34 bp, Artificial Sequence
  Description of Artificial Sequence: Synthetic oligonucleotide
gatcattacaaccgaatgggcaaggttcgaaacc

SEQ ID NO: 293794 - DNA, 35 bp, Artificial Sequence
  Description of Artificial Sequence: Synthetic oligonucleotide
atcattacaaccgaatgggcaaggttcgaaaccag

SEQ ID NO: 293795 - DNA, 34 bp, Artificial Sequence
  Description of Artificial Sequence: Synthetic oligonucleotide
tcattacaaccgaatgggcaaggttcgaaaccag

SEQ ID NO: 293796 - DNA, 33 bp, Artificial Sequence
  Description of Artificial Sequence: Synthetic oligonucleotide
cattacaaccgaatgggcaaggttcgaaaccag

SEQ ID NO: 293797 - DNA, 35 bp, Artificial Sequence
  Description of Artificial Sequence: Synthetic oligonucleotide
attacaaccgaatgggcaaggttcgaaaccagatg

SEQ ID NO: 293798 - DNA, 34 bp, Artificial Sequence
  Description of Artificial Sequence: Synthetic oligonucleotide
ttacaaccgaatgggcaaggttcgaaaccagatg

SEQ ID NO: 293799 - DNA, 33 bp, Artificial Sequence
  Description of Artificial Sequence: Synthetic oligonucleotide
tacaaccgaatgggcaaggttcgaaaccagatg

SEQ ID NO: 293800 - DNA, 32 bp, Artificial Sequence
  Description of Artificial Sequence: Synthetic oligonucleotide
acaaccgaatgggcaaggttcgaaaccagatg

SEQ ID NO: 293801 - DNA, 31 bp, Artificial Sequence
  Description of Artificial Sequence: Synthetic oligonucleotide
caaccgaatgggcaaggttcgaaaccagatg

SEQ ID NO: 293802 - DNA, 31 bp, Artificial Sequence
  Description of Artificial Sequence: Synthetic oligonucleotide
aaccgaatgggcaaggttcgaaaccagatgc

SEQ ID NO: 293803 - DNA, 30 bp, Artificial Sequence
  Description of Artificial Sequence: Synthetic oligonucleotide
accgaatgggcaaggttcgaaaccagatgc

SEQ ID NO: 293804 - DNA, 29 bp, Artificial Sequence
  Description of Artificial Sequence: Synthetic oligonucleotide
ccgaatgggcaaggttcgaaaccagatgc

SEQ ID NO: 293805 - DNA, 29 bp, Artificial Sequence
  Description of Artificial Sequence: Synthetic oligonucleotide
cgaatgggcaaggttcgaaaccagatgcg

SEQ ID NO: 293806 - DNA, 30 bp, Artificial Sequence
  Description of Artificial Sequence: Synthetic oligonucleotide
gaatgggcaaggttcgaaaccagatgcgtg

SEQ ID NO: 293807 - DNA, 32 bp, Artificial Sequence
  Description of Artificial Sequence: Synthetic oligonucleotide
aatgggcaaggttcgaaaccagatgcgtgttg

SEQ ID NO: 293808 - DNA, 31 bp, Artificial Sequence
  Description of Artificial Sequence: Synthetic oligonucleotide
atgggcaaggttcgaaaccagatgcgtgttg

SEQ ID NO: 293809 - DNA, 30 bp, Artificial Sequence
  Description of Artificial Sequence: Synthetic oligonucleotide
tgggcaaggttcgaaaccagatgcgtgttg

SEQ ID NO: 293810 - DNA, 29 bp, Artificial Sequence
  Description of Artificial Sequence: Synthetic oligonucleotide
gggcaaggttcgaaaccagatgcgtgttg

SEQ ID NO: 293811 - DNA, 31 bp, Artificial Sequence
  Description of Artificial Sequence: Synthetic oligonucleotide
ggcaaggttcgaaaccagatgcgtgttgtag

SEQ ID NO: 293812 - DNA, 31 bp, Artificial Sequence
  Description of Artificial Sequence: Synthetic oligonucleotide
gcaaggttcgaaaccagatgcgtgttgtagg

SEQ ID NO: 293813 - DNA, 32 bp, Artificial Sequence
  Description of Artificial Sequence: Synthetic oligonucleotide
caaggttcgaaaccagatgcgtgttgtaggtg

SEQ ID NO: 293814 - DNA, 33 bp, Artificial Sequence
  Description of Artificial Sequence: Synthetic oligonucleotide
aaggttcgaaaccagatgcgtgttgtaggtgtg

SEQ ID NO: 293815 - DNA, 32 bp, Artificial Sequence
  Description of Artificial Sequence: Synthetic oligonucleotide
aggttcgaaaccagatgcgtgttgtaggtgtg

SEQ ID NO: 293816 - DNA, 31 bp, Artificial Sequence
  Description of Artificial Sequence: Synthetic oligonucleotide
ggttcgaaaccagatgcgtgttgtaggtgtg

SEQ ID NO: 293817 - DNA, 31 bp, Artificial Sequence
  Description of Artificial Sequence: Synthetic oligonucleotide
gttcgaaaccagatgcgtgttgtaggtgtgc

SEQ ID NO: 293818 - DNA, 35 bp, Artificial Sequence
  Description of Artificial Sequence: Synthetic oligonucleotide
ttcgaaaccagatgcgtgttgtaggtgtgcttatg

SEQ ID NO: 293819 - DNA, 34 bp, Artificial Sequence
  Description of Artificial Sequence: Synthetic oligonucleotide
tcgaaaccagatgcgtgttgtaggtgtgcttatg

SEQ ID NO: 293820 - DNA, 33 bp, Artificial Sequence
  Description of Artificial Sequence: Synthetic oligonucleotide
cgaaaccagatgcgtgttgtaggtgtgcttatg

SEQ ID NO: 293821 - DNA, 33 bp, Artificial Sequence
  Description of Artificial Sequence: Synthetic oligonucleotide
gaaaccagatgcgtgttgtaggtgtgcttatgg

SEQ ID NO: 293822 - DNA, 33 bp, Artificial Sequence
  Description of Artificial Sequence: Synthetic oligonucleotide
aaaccagatgcgtgttgtaggtgtgcttatggg

SEQ ID NO: 293823 - DNA, 32 bp, Artificial Sequence
  Description of Artificial Sequence: Synthetic oligonucleotide
aaccagatgcgtgttgtaggtgtgcttatggg

SEQ ID NO: 293824 - DNA, 31 bp, Artificial Sequence
  Description of Artificial Sequence: Synthetic oligonucleotide
accagatgcgtgttgtaggtgtgcttatggg

SEQ ID NO: 293825 - DNA, 30 bp, Artificial Sequence
  Description of Artificial Sequence: Synthetic oligonucleotide
ccagatgcgtgttgtaggtgtgcttatggg

SEQ ID NO: 293826 - DNA, 30 bp, Artificial Sequence
  Description of Artificial Sequence: Synthetic oligonucleotide
cagatgcgtgttgtaggtgtgcttatgggg

SEQ ID NO: 293827 - DNA, 31 bp, Artificial Sequence
  Description of Artificial Sequence: Synthetic oligonucleotide
agatgcgtgttgtaggtgtgcttatggggtc

SEQ ID NO: 293828 - DNA, 30 bp, Artificial Sequence
  Description of Artificial Sequence: Synthetic oligonucleotide
gatgcgtgttgtaggtgtgcttatggggtc

SEQ ID NO: 293829 - DNA, 32 bp, Artificial Sequence
  Description of Artificial Sequence: Synthetic oligonucleotide
atgcgtgttgtaggtgtgcttatggggtcatc

SEQ ID NO: 293830 - DNA, 31 bp, Artificial Sequence
  Description of Artificial Sequence: Synthetic oligonucleotide
tgcgtgttgtaggtgtgcttatggggtcatc

SEQ ID NO: 293831 - DNA, 30 bp, Artificial Sequence
  Description of Artificial Sequence: Synthetic oligonucleotide
gcgtgttgtaggtgtgcttatggggtcatc

SEQ ID NO: 293832 - DNA, 30 bp, Artificial Sequence
  Description of Artificial Sequence: Synthetic oligonucleotide
cgtgttgtaggtgtgcttatggggtcatcg

SEQ ID NO: 293833 - DNA, 30 bp, Artificial Sequence
  Description of Artificial Sequence: Synthetic oligonucleotide
gtgttgtaggtgtgcttatggggtcatcgc

SEQ ID NO: 293834 - DNA, 34 bp, Artificial Sequence
  Description of Artificial Sequence: Synthetic oligonucleotide
tgttgtaggtgtgcttatggggtcatcgcaaaag

SEQ ID NO: 293835 - DNA, 33 bp, Artificial Sequence
  Description of Artificial Sequence: Synthetic oligonucleotide
gttgtaggtgtgcttatggggtcatcgcaaaag

SEQ ID NO: 293836 - DNA, 36 bp, Artificial Sequence
  Description of Artificial Sequence: Synthetic oligonucleotide
ttgtaggtgtgcttatggggtcatcgcaaaagaatg

SEQ ID NO: 293837 - DNA, 35 bp, Artificial Sequence
  Description of Artificial Sequence: Synthetic oligonucleotide
tgtaggtgtgcttatggggtcatcgcaaaagaatg

SEQ ID NO: 293838 - DNA, 34 bp, Artificial Sequence
  Description of Artificial Sequence: Synthetic oligonucleotide
gtaggtgtgcttatggggtcatcgcaaaagaatg

SEQ ID NO: 293839 - DNA, 36 bp, Artificial Sequence
  Description of Artificial Sequence: Synthetic oligonucleotide
taggtgtgcttatggggtcatcgcaaaagaatgtac

SEQ ID NO: 293840 - DNA, 35 bp, Artificial Sequence
  Description of Artificial Sequence: Synthetic oligonucleotide
aggtgtgcttatggggtcatcgcaaaagaatgtac

SEQ ID NO: 293841 - DNA, 34 bp, Artificial Sequence
  Description of Artificial Sequence: Synthetic oligonucleotide
ggtgtgcttatggggtcatcgcaaaagaatgtac

SEQ ID NO: 293842 - DNA, 36 bp, Artificial Sequence
  Description of Artificial Sequence: Synthetic oligonucleotide
gtgtgcttatggggtcatcgcaaaagaatgtacttg

SEQ ID NO: 293843 - DNA, 38 bp, Artificial Sequence
  Description of Artificial Sequence: Synthetic oligonucleotide
tgtgcttatggggtcatcgcaaaagaatgtacttgatc

SEQ ID NO: 293844 - DNA, 37 bp, Artificial Sequence
  Description of Artificial Sequence: Synthetic oligonucleotide
gtgcttatggggtcatcgcaaaagaatgtacttgatc

SEQ ID NO: 293845 - DNA, 40 bp, Artificial Sequence
  Description of Artificial Sequence: Synthetic oligonucleotide
tgcttatggggtcatcgcaaaagaatgtacttgatctatc

SEQ ID NO: 293846 - DNA, 39 bp, Artificial Sequence
  Description of Artificial Sequence: Synthetic oligonucleotide
gcttatggggtcatcgcaaaagaatgtacttgatctatc

SEQ ID NO: 293847 - DNA, 39 bp, Artificial Sequence
  Description of Artificial Sequence: Synthetic oligonucleotide
cttatggggtcatcgcaaaagaatgtacttgatctatcg

SEQ ID NO: 293848 - DNA, 41 bp, Artificial Sequence
  Description of Artificial Sequence: Synthetic oligonucleotide
ttatggggtcatcgcaaaagaatgtacttgatctatcgaac

SEQ ID NO: 293849 - DNA, 40 bp, Artificial Sequence
  Description of Artificial Sequence: Synthetic oligonucleotide
tatggggtcatcgcaaaagaatgtacttgatctatcgaac

SEQ ID NO: 293850 - DNA, 39 bp, Artificial Sequence
  Description of Artificial Sequence: Synthetic oligonucleotide
atggggtcatcgcaaaagaatgtacttgatctatcgaac

SEQ ID NO: 293851 - DNA, 38 bp, Artificial Sequence
  Description of Artificial Sequence: Synthetic oligonucleotide
tggggtcatcgcaaaagaatgtacttgatctatcgaac

SEQ ID NO: 293852 - DNA, 37 bp, Artificial Sequence
  Description of Artificial Sequence: Synthetic oligonucleotide
ggggtcatcgcaaaagaatgtacttgatctatcgaac

SEQ ID NO: 293853 - DNA, 38 bp, Artificial Sequence
  Description of Artificial Sequence: Synthetic oligonucleotide
gggtcatcgcaaaagaatgtacttgatctatcgaacac

SEQ ID NO: 293854 - DNA, 42 bp, Artificial Sequence
  Description of Artificial Sequence: Synthetic oligonucleotide
ggtcatcgcaaaagaatgtacttgatctatcgaacacttttg

SEQ ID NO: 293855 - DNA, 42 bp, Artificial Sequence
  Description of Artificial Sequence: Synthetic oligonucleotide
gtcatcgcaaaagaatgtacttgatctatcgaacacttttgc

SEQ ID NO: 293856 - DNA, 43 bp, Artificial Sequence
  Description of Artificial Sequence: Synthetic oligonucleotide
tcatcgcaaaagaatgtacttgatctatcgaacacttttgcag

SEQ ID NO: 293857 - DNA, 42 bp, Artificial Sequence
  Description of Artificial Sequence: Synthetic oligonucleotide
catcgcaaaagaatgtacttgatctatcgaacacttttgcag

SEQ ID NO: 293858 - DNA, 44 bp, Artificial Sequence
  Description of Artificial Sequence: Synthetic oligonucleotide
atcgcaaaagaatgtacttgatctatcgaacacttttgcagtac

SEQ ID NO: 293859 - DNA, 43 bp, Artificial Sequence
  Description of Artificial Sequence: Synthetic oligonucleotide
tcgcaaaagaatgtacttgatctatcgaacacttttgcagtac

SEQ ID NO: 293860 - DNA, 42 bp, Artificial Sequence
  Description of Artificial Sequence: Synthetic oligonucleotide
cgcaaaagaatgtacttgatctatcgaacacttttgcagtac

SEQ ID NO: 293861 - DNA, 42 bp, Artificial Sequence
  Description of Artificial Sequence: Synthetic oligonucleotide
gcaaaagaatgtacttgatctatcgaacacttttgcagtacc

SEQ ID NO: 293862 - DNA, 46 bp, Artificial Sequence
  Description of Artificial Sequence: Synthetic oligonucleotide
caaaagaatgtacttgatctatcgaacacttttgcagtaccttttg

SEQ ID NO: 293863 - DNA, 48 bp, Artificial Sequence
  Description of Artificial Sequence: Synthetic oligonucleotide
aaaagaatgtacttgatctatcgaacacttttgcagtaccttttgatc

SEQ ID NO: 293864 - DNA, 47 bp, Artificial Sequence
  Description of Artificial Sequence: Synthetic oligonucleotide
aaagaatgtacttgatctatcgaacacttttgcagtaccttttgatc

SEQ ID NO: 293865 - DNA, 46 bp, Artificial Sequence
  Description of Artificial Sequence: Synthetic oligonucleotide
aagaatgtacttgatctatcgaacacttttgcagtaccttttgatc

SEQ ID NO: 293866 - DNA, 45 bp, Artificial Sequence
  Description of Artificial Sequence: Synthetic oligonucleotide
agaatgtacttgatctatcgaacacttttgcagtaccttttgatc

SEQ ID NO: 293867 - DNA, 44 bp, Artificial Sequence
  Description of Artificial Sequence: Synthetic oligonucleotide
gaatgtacttgatctatcgaacacttttgcagtaccttttgatc

SEQ ID NO: 293868 - DNA, 46 bp, Artificial Sequence
  Description of Artificial Sequence: Synthetic oligonucleotide
aatgtacttgatctatcgaacacttttgcagtaccttttgatcaag

SEQ ID NO: 293869 - DNA, 45 bp, Artificial Sequence
  Description of Artificial Sequence: Synthetic oligonucleotide
atgtacttgatctatcgaacacttttgcagtaccttttgatcaag

SEQ ID NO: 293870 - DNA, 44 bp, Artificial Sequence
  Description of Artificial Sequence: Synthetic oligonucleotide
tgtacttgatctatcgaacacttttgcagtaccttttgatcaag

SEQ ID NO: 293871 - DNA, 43 bp, Artificial Sequence
  Description of Artificial Sequence: Synthetic oligonucleotide
gtacttgatctatcgaacacttttgcagtaccttttgatcaag

SEQ ID NO: 293872 - DNA, 45 bp, Artificial Sequence
  Description of Artificial Sequence: Synthetic oligonucleotide
tacttgatctatcgaacacttttgcagtaccttttgatcaagatg

SEQ ID NO: 293873 - DNA, 44 bp, Artificial Sequence
  Description of Artificial Sequence: Synthetic oligonucleotide
acttgatctatcgaacacttttgcagtaccttttgatcaagatg

SEQ ID NO: 293874 - DNA, 43 bp, Artificial Sequence
  Description of Artificial Sequence: Synthetic oligonucleotide
cttgatctatcgaacacttttgcagtaccttttgatcaagatg

SEQ ID NO: 293875 - DNA, 44 bp, Artificial Sequence
  Description of Artificial Sequence: Synthetic oligonucleotide
ttgatctatcgaacacttttgcagtaccttttgatcaagatgac

SEQ ID NO: 293876 - DNA, 43 bp, Artificial Sequence
  Description of Artificial Sequence: Synthetic oligonucleotide
tgatctatcgaacacttttgcagtaccttttgatcaagatgac

SEQ ID NO: 293877 - DNA, 42 bp, Artificial Sequence
  Description of Artificial Sequence: Synthetic oligonucleotide
gatctatcgaacacttttgcagtaccttttgatcaagatgac

SEQ ID NO: 293878 - DNA, 45 bp, Artificial Sequence
  Description of Artificial Sequence: Synthetic oligonucleotide
atctatcgaacacttttgcagtaccttttgatcaagatgacatag

SEQ ID NO: 293879 - DNA, 44 bp, Artificial Sequence
  Description of Artificial Sequence: Synthetic oligonucleotide
tctatcgaacacttttgcagtaccttttgatcaagatgacatag

SEQ ID NO: 293880 - DNA, 43 bp, Artificial Sequence
  Description of Artificial Sequence: Synthetic oligonucleotide
ctatcgaacacttttgcagtaccttttgatcaagatgacatag

SEQ ID NO: 293881 - DNA, 44 bp, Artificial Sequence
  Description of Artificial Sequence: Synthetic oligonucleotide
tatcgaacacttttgcagtaccttttgatcaagatgacatagac

SEQ ID NO: 293882 - DNA, 43 bp, Artificial Sequence
  Description of Artificial Sequence: Synthetic oligonucleotide
atcgaacacttttgcagtaccttttgatcaagatgacatagac

SEQ ID NO: 293883 - DNA, 42 bp, Artificial Sequence
  Description of Artificial Sequence: Synthetic oligonucleotide
tcgaacacttttgcagtaccttttgatcaagatgacatagac

SEQ ID NO: 293884 - DNA, 41 bp, Artificial Sequence
  Description of Artificial Sequence: Synthetic oligonucleotide
cgaacacttttgcagtaccttttgatcaagatgacatagac

SEQ ID NO: 293885 - DNA, 41 bp, Artificial Sequence
  Description of Artificial Sequence: Synthetic oligonucleotide
gaacacttttgcagtaccttttgatcaagatgacatagacg

SEQ ID NO: 293886 - DNA, 44 bp, Artificial Sequence
  Description of Artificial Sequence: Synthetic oligonucleotide
aacacttttgcagtaccttttgatcaagatgacatagacgattc

SEQ ID NO: 293887 - DNA, 43 bp, Artificial Sequence
  Description of Artificial Sequence: Synthetic oligonucleotide
acacttttgcagtaccttttgatcaagatgacatagacgattc

SEQ ID NO: 293888 - DNA, 42 bp, Artificial Sequence
  Description of Artificial Sequence: Synthetic oligonucleotide
cacttttgcagtaccttttgatcaagatgacatagacgattc

SEQ ID NO: 293889 - DNA, 43 bp, Artificial Sequence
  Description of Artificial Sequence: Synthetic oligonucleotide
acttttgcagtaccttttgatcaagatgacatagacgattcag

SEQ ID NO: 293890 - DNA, 42 bp, Artificial Sequence
  Description of Artificial Sequence: Synthetic oligonucleotide
cttttgcagtaccttttgatcaagatgacatagacgattcag

SEQ ID NO: 293891 - DNA, 45 bp, Artificial Sequence
  Description of Artificial Sequence: Synthetic oligonucleotide
ttttgcagtaccttttgatcaagatgacatagacgattcagtatg

SEQ ID NO: 293892 - DNA, 44 bp, Artificial Sequence
  Description of Artificial Sequence: Synthetic oligonucleotide
tttgcagtaccttttgatcaagatgacatagacgattcagtatg

SEQ ID NO: 293893 - DNA, 43 bp, Artificial Sequence
  Description of Artificial Sequence: Synthetic oligonucleotide
ttgcagtaccttttgatcaagatgacatagacgattcagtatg

SEQ ID NO: 293894 - DNA, 42 bp, Artificial Sequence
  Description of Artificial Sequence: Synthetic oligonucleotide
tgcagtaccttttgatcaagatgacatagacgattcagtatg

SEQ ID NO: 293895 - DNA, 41 bp, Artificial Sequence
  Description of Artificial Sequence: Synthetic oligonucleotide
gcagtaccttttgatcaagatgacatagacgattcagtatg

SEQ ID NO: 293896 - DNA, 41 bp, Artificial Sequence
  Description of Artificial Sequence: Synthetic oligonucleotide
cagtaccttttgatcaagatgacatagacgattcagtatgg

SEQ ID NO: 293897 - DNA, 47 bp, Artificial Sequence
  Description of Artificial Sequence: Synthetic oligonucleotide
agtaccttttgatcaagatgacatagacgattcagtatggtttatag

SEQ ID NO: 293898 - DNA, 46 bp, Artificial Sequence
  Description of Artificial Sequence: Synthetic oligonucleotide
gtaccttttgatcaagatgacatagacgattcagtatggtttatag

SEQ ID NO: 293899 - DNA, 47 bp, Artificial Sequence
  Description of Artificial Sequence: Synthetic oligonucleotide
taccttttgatcaagatgacatagacgattcagtatggtttatagac

SEQ ID NO: 293900 - DNA, 46 bp, Artificial Sequence
  Description of Artificial Sequence: Synthetic oligonucleotide
accttttgatcaagatgacatagacgattcagtatggtttatagac

SEQ ID NO: 293901 - DNA, 45 bp, Artificial Sequence
  Description of Artificial Sequence: Synthetic oligonucleotide
ccttttgatcaagatgacatagacgattcagtatggtttatagac

SEQ ID NO: 293902 - DNA, 45 bp, Artificial Sequence
  Description of Artificial Sequence: Synthetic oligonucleotide
cttttgatcaagatgacatagacgattcagtatggtttatagacc

SEQ ID NO: 293903 - DNA, 47 bp, Artificial Sequence
  Description of Artificial Sequence: Synthetic oligonucleotide
ttttgatcaagatgacatagacgattcagtatggtttatagaccatg

SEQ ID NO: 293904 - DNA, 46 bp, Artificial Sequence
  Description of Artificial Sequence: Synthetic oligonucleotide
tttgatcaagatgacatagacgattcagtatggtttatagaccatg

SEQ ID NO: 293905 - DNA, 45 bp, Artificial Sequence
  Description of Artificial Sequence: Synthetic oligonucleotide
ttgatcaagatgacatagacgattcagtatggtttatagaccatg

SEQ ID NO: 293906 - DNA, 44 bp, Artificial Sequence
  Description of Artificial Sequence: Synthetic oligonucleotide
tgatcaagatgacatagacgattcagtatggtttatagaccatg

SEQ ID NO: 293907 - DNA, 43 bp, Artificial Sequence
  Description of Artificial Sequence: Synthetic oligonucleotide
gatcaagatgacatagacgattcagtatggtttatagaccatg

SEQ ID NO: 293908 - DNA, 50 bp, Artificial Sequence
  Description of Artificial Sequence: Synthetic oligonucleotide
atcaagatgacatagacgattcagtatggtttatagaccatgtttatttg

SEQ ID NO: 293909 - DNA, 49 bp, Artificial Sequence
  Description of Artificial Sequence: Synthetic oligonucleotide
tcaagatgacatagacgattcagtatggtttatagaccatgtttatttg

SEQ ID NO: 293910 - DNA, 48 bp, Artificial Sequence
  Description of Artificial Sequence: Synthetic oligonucleotide
caagatgacatagacgattcagtatggtttatagaccatgtttatttg

SEQ ID NO: 293911 - DNA, 48 bp, Artificial Sequence
  Description of Artificial Sequence: Synthetic oligonucleotide
aagatgacatagacgattcagtatggtttatagaccatgtttatttgg

SEQ ID NO: 293912 - DNA, 47 bp, Artificial Sequence
  Description of Artificial Sequence: Synthetic oligonucleotide
agatgacatagacgattcagtatggtttatagaccatgtttatttgg

SEQ ID NO: 293913 - DNA, 46 bp, Artificial Sequence
  Description of Artificial Sequence: Synthetic oligonucleotide
gatgacatagacgattcagtatggtttatagaccatgtttatttgg

SEQ ID NO: 293914 - DNA, 50 bp, Artificial Sequence
  Description of Artificial Sequence: Synthetic oligonucleotide
atgacatagacgattcagtatggtttatagaccatgtttatttggataac

SEQ ID NO: 293915 - DNA, 49 bp, Artificial Sequence
  Description of Artificial Sequence: Synthetic oligonucleotide
tgacatagacgattcagtatggtttatagaccatgtttatttggataac

SEQ ID NO: 293916 - DNA, 48 bp, Artificial Sequence
  Description of Artificial Sequence: Synthetic oligonucleotide
gacatagacgattcagtatggtttatagaccatgtttatttggataac

SEQ ID NO: 293917 - DNA, 50 bp, Artificial Sequence
  Description of Artificial Sequence: Synthetic oligonucleotide
acatagacgattcagtatggtttatagaccatgtttatttggataacatg

SEQ ID NO: 293918 - DNA, 49 bp, Artificial Sequence
  Description of Artificial Sequence: Synthetic oligonucleotide
catagacgattcagtatggtttatagaccatgtttatttggataacatg

SEQ ID NO: 293919 - DNA, 52 bp, Artificial Sequence
  Description of Artificial Sequence: Synthetic oligonucleotide
atagacgattcagtatggtttatagaccatgtttatttggataacatgtatc

SEQ ID NO: 293920 - DNA, 51 bp, Artificial Sequence
  Description of Artificial Sequence: Synthetic oligonucleotide
tagacgattcagtatggtttatagaccatgtttatttggataacatgtatc

SEQ ID NO: 293921 - DNA, 50 bp, Artificial Sequence
  Description of Artificial Sequence: Synthetic oligonucleotide
agacgattcagtatggtttatagaccatgtttatttggataacatgtatc

SEQ ID NO: 293922 - DNA, 49 bp, Artificial Sequence
  Description of Artificial Sequence: Synthetic oligonucleotide
gacgattcagtatggtttatagaccatgtttatttggataacatgtatc

SEQ ID NO: 293923 - DNA, 49 bp, Artificial Sequence
  Description of Artificial Sequence: Synthetic oligonucleotide
acgattcagtatggtttatagaccatgtttatttggataacatgtatcg

SEQ ID NO: 293924 - DNA, 48 bp, Artificial Sequence
  Description of Artificial Sequence: Synthetic oligonucleotide
cgattcagtatggtttatagaccatgtttatttggataacatgtatcg

SEQ ID NO: 293925 - DNA, 51 bp, Artificial Sequence
  Description of Artificial Sequence: Synthetic oligonucleotide
gattcagtatggtttatagaccatgtttatttggataacatgtatcgaatg

SEQ ID NO: 293926 - DNA, 56 bp, Artificial Sequence
  Description of Artificial Sequence: Synthetic oligonucleotide
attcagtatggtttatagaccatgtttatttggataacatgtatcgaatgtttatg

SEQ ID NO: 293927 - DNA, 55 bp, Artificial Sequence
  Description of Artificial Sequence: Synthetic oligonucleotide
ttcagtatggtttatagaccatgtttatttggataacatgtatcgaatgtttatg

SEQ ID NO: 293928 - DNA, 54 bp, Artificial Sequence
  Description of Artificial Sequence: Synthetic oligonucleotide
tcagtatggtttatagaccatgtttatttggataacatgtatcgaatgtttatg

SEQ ID NO: 293929 - DNA, 53 bp, Artificial Sequence
  Description of Artificial Sequence: Synthetic oligonucleotide
cagtatggtttatagaccatgtttatttggataacatgtatcgaatgtttatg

SEQ ID NO: 293930 - DNA, 56 bp, Artificial Sequence
  Description of Artificial Sequence: Synthetic oligonucleotide
agtatggtttatagaccatgtttatttggataacatgtatcgaatgtttatgaaag

SEQ ID NO: 293931 - DNA, 55 bp, Artificial Sequence
  Description of Artificial Sequence: Synthetic oligonucleotide
gtatggtttatagaccatgtttatttggataacatgtatcgaatgtttatgaaag

SEQ ID NO: 293932 - DNA, 56 bp, Artificial Sequence
  Description of Artificial Sequence: Synthetic oligonucleotide
tatggtttatagaccatgtttatttggataacatgtatcgaatgtttatgaaagtc

SEQ ID NO: 293933 - DNA, 55 bp, Artificial Sequence
  Description of Artificial Sequence: Synthetic oligonucleotide
atggtttatagaccatgtttatttggataacatgtatcgaatgtttatgaaagtc

SEQ ID NO: 293934 - DNA, 54 bp, Artificial Sequence
  Description of Artificial Sequence: Synthetic oligonucleotide
tggtttatagaccatgtttatttggataacatgtatcgaatgtttatgaaagtc

SEQ ID NO: 293935 - DNA, 53 bp, Artificial Sequence
  Description of Artificial Sequence: Synthetic oligonucleotide
ggtttatagaccatgtttatttggataacatgtatcgaatgtttatgaaagtc

SEQ ID NO: 293936 - DNA, 56 bp, Artificial Sequence
  Description of Artificial Sequence: Synthetic oligonucleotide
gtttatagaccatgtttatttggataacatgtatcgaatgtttatgaaagtcaaag

SEQ ID NO: 293937 - DNA, 56 bp, Artificial Sequence
  Description of Artificial Sequence: Synthetic oligonucleotide
tttatagaccatgtttatttggataacatgtatcgaatgtttatgaaagtcaaagc

SEQ ID NO: 293938 - DNA, 55 bp, Artificial Sequence
  Description of Artificial Sequence: Synthetic oligonucleotide
ttatagaccatgtttatttggataacatgtatcgaatgtttatgaaagtcaaagc

SEQ ID NO: 293939 - DNA, 54 bp, Artificial Sequence
  Description of Artificial Sequence: Synthetic oligonucleotide
tatagaccatgtttatttggataacatgtatcgaatgtttatgaaagtcaaagc

SEQ ID NO: 293940 - DNA, 53 bp, Artificial Sequence
  Description of Artificial Sequence: Synthetic oligonucleotide
atagaccatgtttatttggataacatgtatcgaatgtttatgaaagtcaaagc

SEQ ID NO: 293941 - DNA, 52 bp, Artificial Sequence
  Description of Artificial Sequence: Synthetic oligonucleotide
tagaccatgtttatttggataacatgtatcgaatgtttatgaaagtcaaagc

SEQ ID NO: 293942 - DNA, 51 bp, Artificial Sequence
  Description of Artificial Sequence: Synthetic oligonucleotide
agaccatgtttatttggataacatgtatcgaatgtttatgaaagtcaaagc

SEQ ID NO: 293943 - DNA, 50 bp, Artificial Sequence
  Description of Artificial Sequence: Synthetic oligonucleotide
gaccatgtttatttggataacatgtatcgaatgtttatgaaagtcaaagc

SEQ ID NO: 293944 - DNA, 50 bp, Artificial Sequence
  Description of Artificial Sequence: Synthetic oligonucleotide
accatgtttatttggataacatgtatcgaatgtttatgaaagtcaaagcc

SEQ ID NO: 293945 - DNA, 49 bp, Artificial Sequence
  Description of Artificial Sequence: Synthetic oligonucleotide
ccatgtttatttggataacatgtatcgaatgtttatgaaagtcaaagcc

SEQ ID NO: 293946 - DNA, 50 bp, Artificial Sequence
  Description of Artificial Sequence: Synthetic oligonucleotide
catgtttatttggataacatgtatcgaatgtttatgaaagtcaaagccag

SEQ ID NO: 293947 - DNA, 50 bp, Artificial Sequence
  Description of Artificial Sequence: Synthetic oligonucleotide
atgtttatttggataacatgtatcgaatgtttatgaaagtcaaagccagg

SEQ ID NO: 293948 - DNA, 49 bp, Artificial Sequence
  Description of Artificial Sequence: Synthetic oligonucleotide
tgtttatttggataacatgtatcgaatgtttatgaaagtcaaagccagg

SEQ ID NO: 293949 - DNA, 48 bp, Artificial Sequence
  Description of Artificial Sequence: Synthetic oligonucleotide
gtttatttggataacatgtatcgaatgtttatgaaagtcaaagccagg

SEQ ID NO: 293950 - DNA, 48 bp, Artificial Sequence
  Description of Artificial Sequence: Synthetic oligonucleotide
tttatttggataacatgtatcgaatgtttatgaaagtcaaagccaggg

SEQ ID NO: 293951 - DNA, 47 bp, Artificial Sequence
  Description of Artificial Sequence: Synthetic oligonucleotide
ttatttggataacatgtatcgaatgtttatgaaagtcaaagccaggg

SEQ ID NO: 293952 - DNA, 46 bp, Artificial Sequence
  Description of Artificial Sequence: Synthetic oligonucleotide
tatttggataacatgtatcgaatgtttatgaaagtcaaagccaggg

SEQ ID NO: 293953 - DNA, 45 bp, Artificial Sequence
  Description of Artificial Sequence: Synthetic oligonucleotide
atttggataacatgtatcgaatgtttatgaaagtcaaagccaggg

SEQ ID NO: 293954 - DNA, 44 bp, Artificial Sequence
  Description of Artificial Sequence: Synthetic oligonucleotide
tttggataacatgtatcgaatgtttatgaaagtcaaagccaggg

SEQ ID NO: 293955 - DNA, 43 bp, Artificial Sequence
  Description of Artificial Sequence: Synthetic oligonucleotide
ttggataacatgtatcgaatgtttatgaaagtcaaagccaggg

SEQ ID NO: 293956 - DNA, 42 bp, Artificial Sequence
  Description of Artificial Sequence: Synthetic oligonucleotide
tggataacatgtatcgaatgtttatgaaagtcaaagccaggg

SEQ ID NO: 293957 - DNA, 41 bp, Artificial Sequence
  Description of Artificial Sequence: Synthetic oligonucleotide
ggataacatgtatcgaatgtttatgaaagtcaaagccaggg

SEQ ID NO: 293958 - DNA, 44 bp, Artificial Sequence
  Description of Artificial Sequence: Synthetic oligonucleotide
gataacatgtatcgaatgtttatgaaagtcaaagccagggaatg

SEQ ID NO: 293959 - DNA, 48 bp, Artificial Sequence
  Description of Artificial Sequence: Synthetic oligonucleotide
ataacatgtatcgaatgtttatgaaagtcaaagccagggaatgaatag

SEQ ID NO: 293960 - DNA, 47 bp, Artificial Sequence
  Description of Artificial Sequence: Synthetic oligonucleotide
taacatgtatcgaatgtttatgaaagtcaaagccagggaatgaatag

SEQ ID NO: 293961 - DNA, 46 bp, Artificial Sequence
  Description of Artificial Sequence: Synthetic oligonucleotide
aacatgtatcgaatgtttatgaaagtcaaagccagggaatgaatag

SEQ ID NO: 293962 - DNA, 45 bp, Artificial Sequence
  Description of Artificial Sequence: Synthetic oligonucleotide
acatgtatcgaatgtttatgaaagtcaaagccagggaatgaatag

SEQ ID NO: 293963 - DNA, 44 bp, Artificial Sequence
  Description of Artificial Sequence: Synthetic oligonucleotide
catgtatcgaatgtttatgaaagtcaaagccagggaatgaatag

SEQ ID NO: 293964 - DNA, 46 bp, Artificial Sequence
  Description of Artificial Sequence: Synthetic oligonucleotide
atgtatcgaatgtttatgaaagtcaaagccagggaatgaatagttg

SEQ ID NO: 293965 - DNA, 45 bp, Artificial Sequence
  Description of Artificial Sequence: Synthetic oligonucleotide
tgtatcgaatgtttatgaaagtcaaagccagggaatgaatagttg

SEQ ID NO: 293966 - DNA, 44 bp, Artificial Sequence
  Description of Artificial Sequence: Synthetic oligonucleotide
gtatcgaatgtttatgaaagtcaaagccagggaatgaatagttg

SEQ ID NO: 293967 - DNA, 44 bp, Artificial Sequence
  Description of Artificial Sequence: Synthetic oligonucleotide
tatcgaatgtttatgaaagtcaaagccagggaatgaatagttgc

SEQ ID NO: 293968 - DNA, 43 bp, Artificial Sequence
  Description of Artificial Sequence: Synthetic oligonucleotide
atcgaatgtttatgaaagtcaaagccagggaatgaatagttgc

SEQ ID NO: 293969 - DNA, 42 bp, Artificial Sequence
  Description of Artificial Sequence: Synthetic oligonucleotide
tcgaatgtttatgaaagtcaaagccagggaatgaatagttgc

SEQ ID NO: 293970 - DNA, 41 bp, Artificial Sequence
  Description of Artificial Sequence: Synthetic oligonucleotide
cgaatgtttatgaaagtcaaagccagggaatgaatagttgc

SEQ ID NO: 293971 - DNA, 41 bp, Artificial Sequence
  Description of Artificial Sequence: Synthetic oligonucleotide
gaatgtttatgaaagtcaaagccagggaatgaatagttgcc

SEQ ID NO: 293972 - DNA, 42 bp, Artificial Sequence
  Description of Artificial Sequence: Synthetic oligonucleotide
aatgtttatgaaagtcaaagccagggaatgaatagttgcctg

SEQ ID NO: 293973 - DNA, 41 bp, Artificial Sequence
  Description of Artificial Sequence: Synthetic oligonucleotide
atgtttatgaaagtcaaagccagggaatgaatagttgcctg

SEQ ID NO: 293974 - DNA, 40 bp, Artificial Sequence
  Description of Artificial Sequence: Synthetic oligonucleotide
tgtttatgaaagtcaaagccagggaatgaatagttgcctg

SEQ ID NO: 293975 - DNA, 39 bp, Artificial Sequence
  Description of Artificial Sequence: Synthetic oligonucleotide
gtttatgaaagtcaaagccagggaatgaatagttgcctg

SEQ ID NO: 293976 - DNA, 39 bp, Artificial Sequence
  Description of Artificial Sequence: Synthetic oligonucleotide
tttatgaaagtcaaagccagggaatgaatagttgcctgg

SEQ ID NO: 293977 - DNA, 38 bp, Artificial Sequence
  Description of Artificial Sequence: Synthetic oligonucleotide
ttatgaaagtcaaagccagggaatgaatagttgcctgg

SEQ ID NO: 293978 - DNA, 37 bp, Artificial Sequence
  Description of Artificial Sequence: Synthetic oligonucleotide
tatgaaagtcaaagccagggaatgaatagttgcctgg

SEQ ID NO: 293979 - DNA, 36 bp, Artificial Sequence
  Description of Artificial Sequence: Synthetic oligonucleotide
atgaaagtcaaagccagggaatgaatagttgcctgg

SEQ ID NO: 293980 - DNA, 35 bp, Artificial Sequence
  Description of Artificial Sequence: Synthetic oligonucleotide
tgaaagtcaaagccagggaatgaatagttgcctgg

SEQ ID NO: 293981 - DNA, 34 bp, Artificial Sequence
  Description of Artificial Sequence: Synthetic oligonucleotide
gaaagtcaaagccagggaatgaatagttgcctgg

SEQ ID NO: 293982 - DNA, 36 bp, Artificial Sequence
  Description of Artificial Sequence: Synthetic oligonucleotide
aaagtcaaagccagggaatgaatagttgcctggtac

SEQ ID NO: 293983 - DNA, 35 bp, Artificial Sequence
  Description of Artificial Sequence: Synthetic oligonucleotide
aagtcaaagccagggaatgaatagttgcctggtac

SEQ ID NO: 293984 - DNA, 34 bp, Artificial Sequence
  Description of Artificial Sequence: Synthetic oligonucleotide
agtcaaagccagggaatgaatagttgcctggtac

SEQ ID NO: 293985 - DNA, 33 bp, Artificial Sequence
  Description of Artificial Sequence: Synthetic oligonucleotide
gtcaaagccagggaatgaatagttgcctggtac

SEQ ID NO: 293986 - DNA, 33 bp, Artificial Sequence
  Description of Artificial Sequence: Synthetic oligonucleotide
tcaaagccagggaatgaatagttgcctggtacc

SEQ ID NO: 293987 - DNA, 32 bp, Artificial Sequence
  Description of Artificial Sequence: Synthetic oligonucleotide
caaagccagggaatgaatagttgcctggtacc

SEQ ID NO: 293988 - DNA, 33 bp, Artificial Sequence
  Description of Artificial Sequence: Synthetic oligonucleotide
aaagccagggaatgaatagttgcctggtaccag

SEQ ID NO: 293989 - DNA, 32 bp, Artificial Sequence
  Description of Artificial Sequence: Synthetic oligonucleotide
aagccagggaatgaatagttgcctggtaccag

SEQ ID NO: 293990 - DNA, 31 bp, Artificial Sequence
  Description of Artificial Sequence: Synthetic oligonucleotide
agccagggaatgaatagttgcctggtaccag

SEQ ID NO: 293991 - DNA, 30 bp, Artificial Sequence
  Description of Artificial Sequence: Synthetic oligonucleotide
gccagggaatgaatagttgcctggtaccag

SEQ ID NO: 293992 - DNA, 31 bp, Artificial Sequence
  Description of Artificial Sequence: Synthetic oligonucleotide
ccagggaatgaatagttgcctggtaccagac

SEQ ID NO: 293993 - DNA, 32 bp, Artificial Sequence
  Description of Artificial Sequence: Synthetic oligonucleotide
cagggaatgaatagttgcctggtaccagacag

SEQ ID NO: 293994 - DNA, 32 bp, Artificial Sequence
  Description of Artificial Sequence: Synthetic oligonucleotide
agggaatgaatagttgcctggtaccagacagg

SEQ ID NO: 293995 - DNA, 31 bp, Artificial Sequence
  Description of Artificial Sequence: Synthetic oligonucleotide
gggaatgaatagttgcctggtaccagacagg

SEQ ID NO: 293996 - DNA, 31 bp, Artificial Sequence
  Description of Artificial Sequence: Synthetic oligonucleotide
ggaatgaatagttgcctggtaccagacaggc

SEQ ID NO: 293997 - DNA, 31 bp, Artificial Sequence
  Description of Artificial Sequence: Synthetic oligonucleotide
gaatgaatagttgcctggtaccagacaggcc

SEQ ID NO: 293998 - DNA, 31 bp, Artificial Sequence
  Description of Artificial Sequence: Synthetic oligonucleotide
aatgaatagttgcctggtaccagacaggccc

SEQ ID NO: 293999 - DNA, 30 bp, Artificial Sequence
  Description of Artificial Sequence: Synthetic oligonucleotide
atgaatagttgcctggtaccagacaggccc

SEQ ID NO: 294000 - DNA, 29 bp, Artificial Sequence
  Description of Artificial Sequence: Synthetic oligonucleotide
tgaatagttgcctggtaccagacaggccc

SEQ ID NO: 294001 - DNA, 28 bp, Artificial Sequence
  Description of Artificial Sequence: Synthetic oligonucleotide
gaatagttgcctggtaccagacaggccc

SEQ ID NO: 294002 - DNA, 32 bp, Artificial Sequence
  Description of Artificial Sequence: Synthetic oligonucleotide
aatagttgcctggtaccagacaggcccttaac

SEQ ID NO: 294003 - DNA, 31 bp, Artificial Sequence
  Description of Artificial Sequence: Synthetic oligonucleotide
atagttgcctggtaccagacaggcccttaac

SEQ ID NO: 294004 - DNA, 30 bp, Artificial Sequence
  Description of Artificial Sequence: Synthetic oligonucleotide
tagttgcctggtaccagacaggcccttaac

SEQ ID NO: 294005 - DNA, 29 bp, Artificial Sequence
  Description of Artificial Sequence: Synthetic oligonucleotide
agttgcctggtaccagacaggcccttaac

SEQ ID NO: 294006 - DNA, 28 bp, Artificial Sequence
  Description of Artificial Sequence: Synthetic oligonucleotide
gttgcctggtaccagacaggcccttaac

SEQ ID NO: 294007 - DNA, 30 bp, Artificial Sequence
  Description of Artificial Sequence: Synthetic oligonucleotide
ttgcctggtaccagacaggcccttaactac

SEQ ID NO: 294008 - DNA, 29 bp, Artificial Sequence
  Description of Artificial Sequence: Synthetic oligonucleotide
tgcctggtaccagacaggcccttaactac

SEQ ID NO: 294009 - DNA, 28 bp, Artificial Sequence
  Description of Artificial Sequence: Synthetic oligonucleotide
gcctggtaccagacaggcccttaactac

SEQ ID NO: 294010 - DNA, 29 bp, Artificial Sequence
  Description of Artificial Sequence: Synthetic oligonucleotide
cctggtaccagacaggcccttaactacac

SEQ ID NO: 294011 - DNA, 31 bp, Artificial Sequence
  Description of Artificial Sequence: Synthetic oligonucleotide
ctggtaccagacaggcccttaactacacatg

SEQ ID NO: 294012 - DNA, 34 bp, Artificial Sequence
  Description of Artificial Sequence: Synthetic oligonucleotide
tggtaccagacaggcccttaactacacatgaatg

SEQ ID NO: 294013 - DNA, 33 bp, Artificial Sequence
  Description of Artificial Sequence: Synthetic oligonucleotide
ggtaccagacaggcccttaactacacatgaatg

SEQ ID NO: 294014 - DNA, 34 bp, Artificial Sequence
  Description of Artificial Sequence: Synthetic oligonucleotide
gtaccagacaggcccttaactacacatgaatgac

SEQ ID NO: 294015 - DNA, 37 bp, Artificial Sequence
  Description of Artificial Sequence: Synthetic oligonucleotide
taccagacaggcccttaactacacatgaatgacatag

SEQ ID NO: 294016 - DNA, 36 bp, Artificial Sequence
  Description of Artificial Sequence: Synthetic oligonucleotide
accagacaggcccttaactacacatgaatgacatag

SEQ ID NO: 294017 - DNA, 35 bp, Artificial Sequence
  Description of Artificial Sequence: Synthetic oligonucleotide
ccagacaggcccttaactacacatgaatgacatag

SEQ ID NO: 294018 - DNA, 35 bp, Artificial Sequence
  Description of Artificial Sequence: Synthetic oligonucleotide
cagacaggcccttaactacacatgaatgacatagc

SEQ ID NO: 294019 - DNA, 35 bp, Artificial Sequence
  Description of Artificial Sequence: Synthetic oligonucleotide
agacaggcccttaactacacatgaatgacatagcc

SEQ ID NO: 294020 - DNA, 34 bp, Artificial Sequence
  Description of Artificial Sequence: Synthetic oligonucleotide
gacaggcccttaactacacatgaatgacatagcc

SEQ ID NO: 294021 - DNA, 36 bp, Artificial Sequence
  Description of Artificial Sequence: Synthetic oligonucleotide
acaggcccttaactacacatgaatgacatagccatc

SEQ ID NO: 294022 - DNA, 35 bp, Artificial Sequence
  Description of Artificial Sequence: Synthetic oligonucleotide
caggcccttaactacacatgaatgacatagccatc

SEQ ID NO: 294023 - DNA, 37 bp, Artificial Sequence
  Description of Artificial Sequence: Synthetic oligonucleotide
aggcccttaactacacatgaatgacatagccatcaac

SEQ ID NO: 294024 - DNA, 36 bp, Artificial Sequence
  Description of Artificial Sequence: Synthetic oligonucleotide
ggcccttaactacacatgaatgacatagccatcaac

SEQ ID NO: 294025 - DNA, 36 bp, Artificial Sequence
  Description of Artificial Sequence: Synthetic oligonucleotide
gcccttaactacacatgaatgacatagccatcaacc

SEQ ID NO: 294026 - DNA, 38 bp, Artificial Sequence
  Description of Artificial Sequence: Synthetic oligonucleotide
cccttaactacacatgaatgacatagccatcaaccaac

SEQ ID NO: 294027 - DNA, 39 bp, Artificial Sequence
  Description of Artificial Sequence: Synthetic oligonucleotide
ccttaactacacatgaatgacatagccatcaaccaactc

SEQ ID NO: 294028 - DNA, 41 bp, Artificial Sequence
  Description of Artificial Sequence: Synthetic oligonucleotide
cttaactacacatgaatgacatagccatcaaccaactcatg

SEQ ID NO: 294029 - DNA, 45 bp, Artificial Sequence
  Description of Artificial Sequence: Synthetic oligonucleotide
ttaactacacatgaatgacatagccatcaaccaactcatgataag

SEQ ID NO: 294030 - DNA, 44 bp, Artificial Sequence
  Description of Artificial Sequence: Synthetic oligonucleotide
taactacacatgaatgacatagccatcaaccaactcatgataag

SEQ ID NO: 294031 - DNA, 43 bp, Artificial Sequence
  Description of Artificial Sequence: Synthetic oligonucleotide
aactacacatgaatgacatagccatcaaccaactcatgataag

SEQ ID NO: 294032 - DNA, 42 bp, Artificial Sequence
  Description of Artificial Sequence: Synthetic oligonucleotide
actacacatgaatgacatagccatcaaccaactcatgataag

SEQ ID NO: 294033 - DNA, 41 bp, Artificial Sequence
  Description of Artificial Sequence: Synthetic oligonucleotide
ctacacatgaatgacatagccatcaaccaactcatgataag

SEQ ID NO: 294034 - DNA, 44 bp, Artificial Sequence
  Description of Artificial Sequence: Synthetic oligonucleotide
tacacatgaatgacatagccatcaaccaactcatgataagatac

SEQ ID NO: 294035 - DNA, 43 bp, Artificial Sequence
  Description of Artificial Sequence: Synthetic oligonucleotide
acacatgaatgacatagccatcaaccaactcatgataagatac

SEQ ID NO: 294036 - DNA, 42 bp, Artificial Sequence
  Description of Artificial Sequence: Synthetic oligonucleotide
cacatgaatgacatagccatcaaccaactcatgataagatac

SEQ ID NO: 294037 - DNA, 43 bp, Artificial Sequence
  Description of Artificial Sequence: Synthetic oligonucleotide
acatgaatgacatagccatcaaccaactcatgataagatactg

SEQ ID NO: 294038 - DNA, 42 bp, Artificial Sequence
  Description of Artificial Sequence: Synthetic oligonucleotide
catgaatgacatagccatcaaccaactcatgataagatactg

SEQ ID NO: 294039 - DNA, 43 bp, Artificial Sequence
  Description of Artificial Sequence: Synthetic oligonucleotide
atgaatgacatagccatcaaccaactcatgataagatactgac

SEQ ID NO: 294040 - DNA, 42 bp, Artificial Sequence
  Description of Artificial Sequence: Synthetic oligonucleotide
tgaatgacatagccatcaaccaactcatgataagatactgac

SEQ ID NO: 294041 - DNA, 41 bp, Artificial Sequence
  Description of Artificial Sequence: Synthetic oligonucleotide
gaatgacatagccatcaaccaactcatgataagatactgac

SEQ ID NO: 294042 - DNA, 41 bp, Artificial Sequence
  Description of Artificial Sequence: Synthetic oligonucleotide
aatgacatagccatcaaccaactcatgataagatactgacc

SEQ ID NO: 294043 - DNA, 40 bp, Artificial Sequence
  Description of Artificial Sequence: Synthetic oligonucleotide
atgacatagccatcaaccaactcatgataagatactgacc

SEQ ID NO: 294044 - DNA, 39 bp, Artificial Sequence
  Description of Artificial Sequence: Synthetic oligonucleotide
tgacatagccatcaaccaactcatgataagatactgacc

SEQ ID NO: 294045 - DNA, 38 bp, Artificial Sequence
  Description of Artificial Sequence: Synthetic oligonucleotide
gacatagccatcaaccaactcatgataagatactgacc

SEQ ID NO: 294046 - DNA, 43 bp, Artificial Sequence
  Description of Artificial Sequence: Synthetic oligonucleotide
acatagccatcaaccaactcatgataagatactgacctaattc

SEQ ID NO: 294047 - DNA, 42 bp, Artificial Sequence
  Description of Artificial Sequence: Synthetic oligonucleotide
catagccatcaaccaactcatgataagatactgacctaattc

SEQ ID NO: 294048 - DNA, 42 bp, Artificial Sequence
  Description of Artificial Sequence: Synthetic oligonucleotide
atagccatcaaccaactcatgataagatactgacctaattcc

SEQ ID NO: 294049 - DNA, 41 bp, Artificial Sequence
  Description of Artificial Sequence: Synthetic oligonucleotide
tagccatcaaccaactcatgataagatactgacctaattcc

SEQ ID NO: 294050 - DNA, 40 bp, Artificial Sequence
  Description of Artificial Sequence: Synthetic oligonucleotide
agccatcaaccaactcatgataagatactgacctaattcc

SEQ ID NO: 294051 - DNA, 39 bp, Artificial Sequence
  Description of Artificial Sequence: Synthetic oligonucleotide
gccatcaaccaactcatgataagatactgacctaattcc

SEQ ID NO: 294052 - DNA, 39 bp, Artificial Sequence
  Description of Artificial Sequence: Synthetic oligonucleotide
ccatcaaccaactcatgataagatactgacctaattccc

SEQ ID NO: 294053 - DNA, 43 bp, Artificial Sequence
  Description of Artificial Sequence: Synthetic oligonucleotide
catcaaccaactcatgataagatactgacctaattccctattg

SEQ ID NO: 294054 - DNA, 43 bp, Artificial Sequence
  Description of Artificial Sequence: Synthetic oligonucleotide
atcaaccaactcatgataagatactgacctaattccctattgg

SEQ ID NO: 294055 - DNA, 42 bp, Artificial Sequence
  Description of Artificial Sequence: Synthetic oligonucleotide
tcaaccaactcatgataagatactgacctaattccctattgg

SEQ ID NO: 294056 - DNA, 41 bp, Artificial Sequence
  Description of Artificial Sequence: Synthetic oligonucleotide
caaccaactcatgataagatactgacctaattccctattgg

SEQ ID NO: 294057 - DNA, 42 bp, Artificial Sequence
  Description of Artificial Sequence: Synthetic oligonucleotide
aaccaactcatgataagatactgacctaattccctattggtc

SEQ ID NO: 294058 - DNA, 41 bp, Artificial Sequence
  Description of Artificial Sequence: Synthetic oligonucleotide
accaactcatgataagatactgacctaattccctattggtc

SEQ ID NO: 294059 - DNA, 40 bp, Artificial Sequence
  Description of Artificial Sequence: Synthetic oligonucleotide
ccaactcatgataagatactgacctaattccctattggtc

SEQ ID NO: 294060 - DNA, 42 bp, Artificial Sequence
  Description of Artificial Sequence: Synthetic oligonucleotide
caactcatgataagatactgacctaattccctattggtcaac

SEQ ID NO: 294061 - DNA, 45 bp, Artificial Sequence
  Description of Artificial Sequence: Synthetic oligonucleotide
aactcatgataagatactgacctaattccctattggtcaacattg

SEQ ID NO: 294062 - DNA, 44 bp, Artificial Sequence
  Description of Artificial Sequence: Synthetic oligonucleotide
actcatgataagatactgacctaattccctattggtcaacattg

SEQ ID NO: 294063 - DNA, 43 bp, Artificial Sequence
  Description of Artificial Sequence: Synthetic oligonucleotide
ctcatgataagatactgacctaattccctattggtcaacattg

SEQ ID NO: 294064 - DNA, 45 bp, Artificial Sequence
  Description of Artificial Sequence: Synthetic oligonucleotide
tcatgataagatactgacctaattccctattggtcaacattgatg

SEQ ID NO: 294065 - DNA, 44 bp, Artificial Sequence
  Description of Artificial Sequence: Synthetic oligonucleotide
catgataagatactgacctaattccctattggtcaacattgatg

SEQ ID NO: 294066 - DNA, 45 bp, Artificial Sequence
  Description of Artificial Sequence: Synthetic oligonucleotide
atgataagatactgacctaattccctattggtcaacattgatgtc

SEQ ID NO: 294067 - DNA, 44 bp, Artificial Sequence
  Description of Artificial Sequence: Synthetic oligonucleotide
tgataagatactgacctaattccctattggtcaacattgatgtc

SEQ ID NO: 294068 - DNA, 43 bp, Artificial Sequence
  Description of Artificial Sequence: Synthetic oligonucleotide
gataagatactgacctaattccctattggtcaacattgatgtc

SEQ ID NO: 294069 - DNA, 45 bp, Artificial Sequence
  Description of Artificial Sequence: Synthetic oligonucleotide
ataagatactgacctaattccctattggtcaacattgatgtcaag

SEQ ID NO: 294070 - DNA, 44 bp, Artificial Sequence
  Description of Artificial Sequence: Synthetic oligonucleotide
taagatactgacctaattccctattggtcaacattgatgtcaag

SEQ ID NO: 294071 - DNA, 43 bp, Artificial Sequence
  Description of Artificial Sequence: Synthetic oligonucleotide
aagatactgacctaattccctattggtcaacattgatgtcaag

SEQ ID NO: 294072 - DNA, 42 bp, Artificial Sequence
  Description of Artificial Sequence: Synthetic oligonucleotide
agatactgacctaattccctattggtcaacattgatgtcaag

SEQ ID NO: 294073 - DNA, 41 bp, Artificial Sequence
  Description of Artificial Sequence: Synthetic oligonucleotide
gatactgacctaattccctattggtcaacattgatgtcaag

SEQ ID NO: 294074 - DNA, 41 bp, Artificial Sequence
  Description of Artificial Sequence: Synthetic oligonucleotide
atactgacctaattccctattggtcaacattgatgtcaagc

SEQ ID NO: 294075 - DNA, 40 bp, Artificial Sequence
  Description of Artificial Sequence: Synthetic oligonucleotide
tactgacctaattccctattggtcaacattgatgtcaagc

SEQ ID NO: 294076 - DNA, 39 bp, Artificial Sequence
  Description of Artificial Sequence: Synthetic oligonucleotide
actgacctaattccctattggtcaacattgatgtcaagc

SEQ ID NO: 294077 - DNA, 38 bp, Artificial Sequence
  Description of Artificial Sequence: Synthetic oligonucleotide
ctgacctaattccctattggtcaacattgatgtcaagc

SEQ ID NO: 294078 - DNA, 38 bp, Artificial Sequence
  Description of Artificial Sequence: Synthetic oligonucleotide
tgacctaattccctattggtcaacattgatgtcaagcc

SEQ ID NO: 294079 - DNA, 37 bp, Artificial Sequence
  Description of Artificial Sequence: Synthetic oligonucleotide
gacctaattccctattggtcaacattgatgtcaagcc

SEQ ID NO: 294080 - DNA, 37 bp, Artificial Sequence
  Description of Artificial Sequence: Synthetic oligonucleotide
acctaattccctattggtcaacattgatgtcaagccg

SEQ ID NO: 294081 - DNA, 36 bp, Artificial Sequence
  Description of Artificial Sequence: Synthetic oligonucleotide
cctaattccctattggtcaacattgatgtcaagccg

SEQ ID NO: 294082 - DNA, 38 bp, Artificial Sequence
  Description of Artificial Sequence: Synthetic oligonucleotide
ctaattccctattggtcaacattgatgtcaagccgaag

SEQ ID NO: 294083 - DNA, 38 bp, Artificial Sequence
  Description of Artificial Sequence: Synthetic oligonucleotide
taattccctattggtcaacattgatgtcaagccgaagc

SEQ ID NO: 294084 - DNA, 37 bp, Artificial Sequence
  Description of Artificial Sequence: Synthetic oligonucleotide
aattccctattggtcaacattgatgtcaagccgaagc

SEQ ID NO: 294085 - DNA, 36 bp, Artificial Sequence
  Description of Artificial Sequence: Synthetic oligonucleotide
attccctattggtcaacattgatgtcaagccgaagc

SEQ ID NO: 294086 - DNA, 35 bp, Artificial Sequence
  Description of Artificial Sequence: Synthetic oligonucleotide
ttccctattggtcaacattgatgtcaagccgaagc

SEQ ID NO: 294087 - DNA, 34 bp, Artificial Sequence
  Description of Artificial Sequence: Synthetic oligonucleotide
tccctattggtcaacattgatgtcaagccgaagc

SEQ ID NO: 294088 - DNA, 33 bp, Artificial Sequence
  Description of Artificial Sequence: Synthetic oligonucleotide
ccctattggtcaacattgatgtcaagccgaagc

SEQ ID NO: 294089 - DNA, 34 bp, Artificial Sequence
  Description of Artificial Sequence: Synthetic oligonucleotide
cctattggtcaacattgatgtcaagccgaagcac

SEQ ID NO: 294090 - DNA, 34 bp, Artificial Sequence
  Description of Artificial Sequence: Synthetic oligonucleotide
ctattggtcaacattgatgtcaagccgaagcacc

SEQ ID NO: 294091 - DNA, 36 bp, Artificial Sequence
  Description of Artificial Sequence: Synthetic oligonucleotide
tattggtcaacattgatgtcaagccgaagcacctag

SEQ ID NO: 294092 - DNA, 35 bp, Artificial Sequence
  Description of Artificial Sequence: Synthetic oligonucleotide
attggtcaacattgatgtcaagccgaagcacctag

SEQ ID NO: 294093 - DNA, 34 bp, Artificial Sequence
  Description of Artificial Sequence: Synthetic oligonucleotide
ttggtcaacattgatgtcaagccgaagcacctag

SEQ ID NO: 294094 - DNA, 33 bp, Artificial Sequence
  Description of Artificial Sequence: Synthetic oligonucleotide
tggtcaacattgatgtcaagccgaagcacctag

SEQ ID NO: 294095 - DNA, 32 bp, Artificial Sequence
  Description of Artificial Sequence: Synthetic oligonucleotide
ggtcaacattgatgtcaagccgaagcacctag

SEQ ID NO: 294096 - DNA, 32 bp, Artificial Sequence
  Description of Artificial Sequence: Synthetic oligonucleotide
gtcaacattgatgtcaagccgaagcacctagg

SEQ ID NO: 294097 - DNA, 32 bp, Artificial Sequence
  Description of Artificial Sequence: Synthetic oligonucleotide
tcaacattgatgtcaagccgaagcacctaggg

SEQ ID NO: 294098 - DNA, 31 bp, Artificial Sequence
  Description of Artificial Sequence: Synthetic oligonucleotide
caacattgatgtcaagccgaagcacctaggg

SEQ ID NO: 294099 - DNA, 31 bp, Artificial Sequence
  Description of Artificial Sequence: Synthetic oligonucleotide
aacattgatgtcaagccgaagcacctagggc

SEQ ID NO: 294100 - DNA, 30 bp, Artificial Sequence
  Description of Artificial Sequence: Synthetic oligonucleotide
acattgatgtcaagccgaagcacctagggc

SEQ ID NO: 294101 - DNA, 29 bp, Artificial Sequence
  Description of Artificial Sequence: Synthetic oligonucleotide
cattgatgtcaagccgaagcacctagggc

SEQ ID NO: 294102 - DNA, 30 bp, Artificial Sequence
  Description of Artificial Sequence: Synthetic oligonucleotide
attgatgtcaagccgaagcacctagggcag

SEQ ID NO: 294103 - DNA, 29 bp, Artificial Sequence
  Description of Artificial Sequence: Synthetic oligonucleotide
ttgatgtcaagccgaagcacctagggcag

SEQ ID NO: 294104 - DNA, 28 bp, Artificial Sequence
  Description of Artificial Sequence: Synthetic oligonucleotide
tgatgtcaagccgaagcacctagggcag

SEQ ID NO: 294105 - DNA, 27 bp, Artificial Sequence
  Description of Artificial Sequence: Synthetic oligonucleotide
gatgtcaagccgaagcacctagggcag

SEQ ID NO: 294106 - DNA, 27 bp, Artificial Sequence
  Description of Artificial Sequence: Synthetic oligonucleotide
atgtcaagccgaagcacctagggcagc

SEQ ID NO: 294107 - DNA, 26 bp, Artificial Sequence
  Description of Artificial Sequence: Synthetic oligonucleotide
tgtcaagccgaagcacctagggcagc

SEQ ID NO: 294108 - DNA, 25 bp, Artificial Sequence
  Description of Artificial Sequence: Synthetic oligonucleotide
gtcaagccgaagcacctagggcagc

SEQ ID NO: 294109 - DNA, 27 bp, Artificial Sequence
  Description of Artificial Sequence: Synthetic oligonucleotide
tcaagccgaagcacctagggcagccta

SEQ ID NO: 294110 - DNA, 26 bp, Artificial Sequence
  Description of Artificial Sequence: Synthetic oligonucleotide
caagccgaagcacctagggcagccta

SEQ ID NO: 294111 - DNA, 27 bp, Artificial Sequence
  Description of Artificial Sequence: Synthetic oligonucleotide
aagccgaagcacctagggcagcctaca

SEQ ID NO: 294112 - DNA, 26 bp, Artificial Sequence
  Description of Artificial Sequence: Synthetic oligonucleotide
agccgaagcacctagggcagcctaca

SEQ ID NO: 294113 - DNA, 25 bp, Artificial Sequence
  Description of Artificial Sequence: Synthetic oligonucleotide
gccgaagcacctagggcagcctaca

SEQ ID NO: 294114 - DNA, 27 bp, Artificial Sequence
  Description of Artificial Sequence: Synthetic oligonucleotide
ccgaagcacctagggcagcctacagat

SEQ ID NO: 294115 - DNA, 27 bp, Artificial Sequence
  Description of Artificial Sequence: Synthetic oligonucleotide
cgaagcacctagggcagcctacagatg

SEQ ID NO: 294116 - DNA, 27 bp, Artificial Sequence
  Description of Artificial Sequence: Synthetic oligonucleotide
gaagcacctagggcagcctacagatgc

SEQ ID NO: 294117 - DNA, 27 bp, Artificial Sequence
  Description of Artificial Sequence: Synthetic oligonucleotide
aagcacctagggcagcctacagatgcg

SEQ ID NO: 294118 - DNA, 27 bp, Artificial Sequence
  Description of Artificial Sequence: Synthetic oligonucleotide
agcacctagggcagcctacagatgcgt

SEQ ID NO: 294119 - DNA, 27 bp, Artificial Sequence
  Description of Artificial Sequence: Synthetic oligonucleotide
gcacctagggcagcctacagatgcgta

SEQ ID NO: 294120 - DNA, 27 bp, Artificial Sequence
  Description of Artificial Sequence: Synthetic oligonucleotide
cacctagggcagcctacagatgcgtac

SEQ ID NO: 294121 - DNA, 31 bp, Artificial Sequence
  Description of Artificial Sequence: Synthetic oligonucleotide
acctagggcagcctacagatgcgtacattac

SEQ ID NO: 294122 - DNA, 30 bp, Artificial Sequence
  Description of Artificial Sequence: Synthetic oligonucleotide
cctagggcagcctacagatgcgtacattac

SEQ ID NO: 294123 - DNA, 31 bp, Artificial Sequence
  Description of Artificial Sequence: Synthetic oligonucleotide
ctagggcagcctacagatgcgtacattacag

SEQ ID NO: 294124 - DNA, 32 bp, Artificial Sequence
  Description of Artificial Sequence: Synthetic oligonucleotide
tagggcagcctacagatgcgtacattacagtg

SEQ ID NO: 294125 - DNA, 31 bp, Artificial Sequence
  Description of Artificial Sequence: Synthetic oligonucleotide
agggcagcctacagatgcgtacattacagtg

SEQ ID NO: 294126 - DNA, 30 bp, Artificial Sequence
  Description of Artificial Sequence: Synthetic oligonucleotide
gggcagcctacagatgcgtacattacagtg

SEQ ID NO: 294127 - DNA, 30 bp, Artificial Sequence
  Description of Artificial Sequence: Synthetic oligonucleotide
ggcagcctacagatgcgtacattacagtgg

SEQ ID NO: 294128 - DNA, 32 bp, Artificial Sequence
  Description of Artificial Sequence: Synthetic oligonucleotide
gcagcctacagatgcgtacattacagtggaag

SEQ ID NO: 294129 - DNA, 34 bp, Artificial Sequence
  Description of Artificial Sequence: Synthetic oligonucleotide
cagcctacagatgcgtacattacagtggaagtag

SEQ ID NO: 294130 - DNA, 35 bp, Artificial Sequence
  Description of Artificial Sequence: Synthetic oligonucleotide
agcctacagatgcgtacattacagtggaagtagtc

SEQ ID NO: 294131 - DNA, 34 bp, Artificial Sequence
  Description of Artificial Sequence: Synthetic oligonucleotide
gcctacagatgcgtacattacagtggaagtagtc

SEQ ID NO: 294132 - DNA, 34 bp, Artificial Sequence
  Description of Artificial Sequence: Synthetic oligonucleotide
cctacagatgcgtacattacagtggaagtagtcc

SEQ ID NO: 294133 - DNA, 36 bp, Artificial Sequence
  Description of Artificial Sequence: Synthetic oligonucleotide
ctacagatgcgtacattacagtggaagtagtccatg

SEQ ID NO: 294134 - DNA, 38 bp, Artificial Sequence
  Description of Artificial Sequence: Synthetic oligonucleotide
tacagatgcgtacattacagtggaagtagtccatgaag

SEQ ID NO: 294135 - DNA, 37 bp, Artificial Sequence
  Description of Artificial Sequence: Synthetic oligonucleotide
acagatgcgtacattacagtggaagtagtccatgaag

SEQ ID NO: 294136 - DNA, 36 bp, Artificial Sequence
  Description of Artificial Sequence: Synthetic oligonucleotide
cagatgcgtacattacagtggaagtagtccatgaag

SEQ ID NO: 294137 - DNA, 38 bp, Artificial Sequence
  Description of Artificial Sequence: Synthetic oligonucleotide
agatgcgtacattacagtggaagtagtccatgaagatg

SEQ ID NO: 294138 - DNA, 37 bp, Artificial Sequence
  Description of Artificial Sequence: Synthetic oligonucleotide
gatgcgtacattacagtggaagtagtccatgaagatg

SEQ ID NO: 294139 - DNA, 37 bp, Artificial Sequence
  Description of Artificial Sequence: Synthetic oligonucleotide
atgcgtacattacagtggaagtagtccatgaagatgg

SEQ ID NO: 294140 - DNA, 36 bp, Artificial Sequence
  Description of Artificial Sequence: Synthetic oligonucleotide
tgcgtacattacagtggaagtagtccatgaagatgg

SEQ ID NO: 294141 - DNA, 35 bp, Artificial Sequence
  Description of Artificial Sequence: Synthetic oligonucleotide
gcgtacattacagtggaagtagtccatgaagatgg

SEQ ID NO: 294142 - DNA, 37 bp, Artificial Sequence
  Description of Artificial Sequence: Synthetic oligonucleotide
cgtacattacagtggaagtagtccatgaagatggaac

SEQ ID NO: 294143 - DNA, 38 bp, Artificial Sequence
  Description of Artificial Sequence: Synthetic oligonucleotide
gtacattacagtggaagtagtccatgaagatggaactg

SEQ ID NO: 294144 - DNA, 38 bp, Artificial Sequence
  Description of Artificial Sequence: Synthetic oligonucleotide
tacattacagtggaagtagtccatgaagatggaactgc

SEQ ID NO: 294145 - DNA, 37 bp, Artificial Sequence
  Description of Artificial Sequence: Synthetic oligonucleotide
acattacagtggaagtagtccatgaagatggaactgc

SEQ ID NO: 294146 - DNA, 36 bp, Artificial Sequence
  Description of Artificial Sequence: Synthetic oligonucleotide
cattacagtggaagtagtccatgaagatggaactgc

SEQ ID NO: 294147 - DNA, 38 bp, Artificial Sequence
  Description of Artificial Sequence: Synthetic oligonucleotide
attacagtggaagtagtccatgaagatggaactgcaac

SEQ ID NO: 294148 - DNA, 37 bp, Artificial Sequence
  Description of Artificial Sequence: Synthetic oligonucleotide
ttacagtggaagtagtccatgaagatggaactgcaac

SEQ ID NO: 294149 - DNA, 36 bp, Artificial Sequence
  Description of Artificial Sequence: Synthetic oligonucleotide
tacagtggaagtagtccatgaagatggaactgcaac

SEQ ID NO: 294150 - DNA, 35 bp, Artificial Sequence
  Description of Artificial Sequence: Synthetic oligonucleotide
acagtggaagtagtccatgaagatggaactgcaac

SEQ ID NO: 294151 - DNA, 34 bp, Artificial Sequence
  Description of Artificial Sequence: Synthetic oligonucleotide
cagtggaagtagtccatgaagatggaactgcaac

SEQ ID NO: 294152 - DNA, 34 bp, Artificial Sequence
  Description of Artificial Sequence: Synthetic oligonucleotide
agtggaagtagtccatgaagatggaactgcaacc

SEQ ID NO: 294153 - DNA, 33 bp, Artificial Sequence
  Description of Artificial Sequence: Synthetic oligonucleotide
gtggaagtagtccatgaagatggaactgcaacc

SEQ ID NO: 294154 - DNA, 34 bp, Artificial Sequence
  Description of Artificial Sequence: Synthetic oligonucleotide
tggaagtagtccatgaagatggaactgcaacctc

SEQ ID NO: 294155 - DNA, 33 bp, Artificial Sequence
  Description of Artificial Sequence: Synthetic oligonucleotide
ggaagtagtccatgaagatggaactgcaacctc

SEQ ID NO: 294156 - DNA, 33 bp, Artificial Sequence
  Description of Artificial Sequence: Synthetic oligonucleotide
gaagtagtccatgaagatggaactgcaacctcg

SEQ ID NO: 294157 - DNA, 37 bp, Artificial Sequence
  Description of Artificial Sequence: Synthetic oligonucleotide
aagtagtccatgaagatggaactgcaacctcgataac

SEQ ID NO: 294158 - DNA, 36 bp, Artificial Sequence
  Description of Artificial Sequence: Synthetic oligonucleotide
agtagtccatgaagatggaactgcaacctcgataac

SEQ ID NO: 294159 - DNA, 35 bp, Artificial Sequence
  Description of Artificial Sequence: Synthetic oligonucleotide
gtagtccatgaagatggaactgcaacctcgataac

SEQ ID NO: 294160 - DNA, 39 bp, Artificial Sequence
  Description of Artificial Sequence: Synthetic oligonucleotide
tagtccatgaagatggaactgcaacctcgataacatttg

SEQ ID NO: 294161 - DNA, 38 bp, Artificial Sequence
  Description of Artificial Sequence: Synthetic oligonucleotide
agtccatgaagatggaactgcaacctcgataacatttg

SEQ ID NO: 294162 - DNA, 37 bp, Artificial Sequence
  Description of Artificial Sequence: Synthetic oligonucleotide
gtccatgaagatggaactgcaacctcgataacatttg

SEQ ID NO: 294163 - DNA, 39 bp, Artificial Sequence
  Description of Artificial Sequence: Synthetic oligonucleotide
tccatgaagatggaactgcaacctcgataacatttgatc

SEQ ID NO: 294164 - DNA, 38 bp, Artificial Sequence
  Description of Artificial Sequence: Synthetic oligonucleotide
ccatgaagatggaactgcaacctcgataacatttgatc

SEQ ID NO: 294165 - DNA, 39 bp, Artificial Sequence
  Description of Artificial Sequence: Synthetic oligonucleotide
catgaagatggaactgcaacctcgataacatttgatcac

SEQ ID NO: 294166 - DNA, 39 bp, Artificial Sequence
  Description of Artificial Sequence: Synthetic oligonucleotide
atgaagatggaactgcaacctcgataacatttgatcacg

SEQ ID NO: 294167 - DNA, 38 bp, Artificial Sequence
  Description of Artificial Sequence: Synthetic oligonucleotide
tgaagatggaactgcaacctcgataacatttgatcacg

SEQ ID NO: 294168 - DNA, 37 bp, Artificial Sequence
  Description of Artificial Sequence: Synthetic oligonucleotide
gaagatggaactgcaacctcgataacatttgatcacg

SEQ ID NO: 294169 - DNA, 38 bp, Artificial Sequence
  Description of Artificial Sequence: Synthetic oligonucleotide
aagatggaactgcaacctcgataacatttgatcacgtg

SEQ ID NO: 294170 - DNA, 37 bp, Artificial Sequence
  Description of Artificial Sequence: Synthetic oligonucleotide
agatggaactgcaacctcgataacatttgatcacgtg

SEQ ID NO: 294171 - DNA, 36 bp, Artificial Sequence
  Description of Artificial Sequence: Synthetic oligonucleotide
gatggaactgcaacctcgataacatttgatcacgtg

SEQ ID NO: 294172 - DNA, 37 bp, Artificial Sequence
  Description of Artificial Sequence: Synthetic oligonucleotide
atggaactgcaacctcgataacatttgatcacgtgac

SEQ ID NO: 294173 - DNA, 36 bp, Artificial Sequence
  Description of Artificial Sequence: Synthetic oligonucleotide
tggaactgcaacctcgataacatttgatcacgtgac

SEQ ID NO: 294174 - DNA, 35 bp, Artificial Sequence
  Description of Artificial Sequence: Synthetic oligonucleotide
ggaactgcaacctcgataacatttgatcacgtgac

SEQ ID NO: 294175 - DNA, 35 bp, Artificial Sequence
  Description of Artificial Sequence: Synthetic oligonucleotide
gaactgcaacctcgataacatttgatcacgtgacc

SEQ ID NO: 294176 - DNA, 36 bp, Artificial Sequence
  Description of Artificial Sequence: Synthetic oligonucleotide
aactgcaacctcgataacatttgatcacgtgacctg

SEQ ID NO: 294177 - DNA, 35 bp, Artificial Sequence
  Description of Artificial Sequence: Synthetic oligonucleotide
actgcaacctcgataacatttgatcacgtgacctg

SEQ ID NO: 294178 - DNA, 34 bp, Artificial Sequence
  Description of Artificial Sequence: Synthetic oligonucleotide
ctgcaacctcgataacatttgatcacgtgacctg

SEQ ID NO: 294179 - DNA, 35 bp, Artificial Sequence
  Description of Artificial Sequence: Synthetic oligonucleotide
tgcaacctcgataacatttgatcacgtgacctgtg

SEQ ID NO: 294180 - DNA, 34 bp, Artificial Sequence
  Description of Artificial Sequence: Synthetic oligonucleotide
gcaacctcgataacatttgatcacgtgacctgtg

SEQ ID NO: 294181 - DNA, 39 bp, Artificial Sequence
  Description of Artificial Sequence: Synthetic oligonucleotide
caacctcgataacatttgatcacgtgacctgtgaaattg

SEQ ID NO: 294182 - DNA, 39 bp, Artificial Sequence
  Description of Artificial Sequence: Synthetic oligonucleotide
aacctcgataacatttgatcacgtgacctgtgaaattgc

SEQ ID NO: 294183 - DNA, 38 bp, Artificial Sequence
  Description of Artificial Sequence: Synthetic oligonucleotide
acctcgataacatttgatcacgtgacctgtgaaattgc

SEQ ID NO: 294184 - DNA, 37 bp, Artificial Sequence
  Description of Artificial Sequence: Synthetic oligonucleotide
cctcgataacatttgatcacgtgacctgtgaaattgc

SEQ ID NO: 294185 - DNA, 38 bp, Artificial Sequence
  Description of Artificial Sequence: Synthetic oligonucleotide
ctcgataacatttgatcacgtgacctgtgaaattgcag

SEQ ID NO: 294186 - DNA, 38 bp, Artificial Sequence
  Description of Artificial Sequence: Synthetic oligonucleotide
tcgataacatttgatcacgtgacctgtgaaattgcagc

SEQ ID NO: 294187 - DNA, 37 bp, Artificial Sequence
  Description of Artificial Sequence: Synthetic oligonucleotide
cgataacatttgatcacgtgacctgtgaaattgcagc

SEQ ID NO: 294188 - DNA, 38 bp, Artificial Sequence
  Description of Artificial Sequence: Synthetic oligonucleotide
gataacatttgatcacgtgacctgtgaaattgcagcag

SEQ ID NO: 294189 - DNA, 39 bp, Artificial Sequence
  Description of Artificial Sequence: Synthetic oligonucleotide
ataacatttgatcacgtgacctgtgaaattgcagcagag

SEQ ID NO: 294190 - DNA, 38 bp, Artificial Sequence
  Description of Artificial Sequence: Synthetic oligonucleotide
taacatttgatcacgtgacctgtgaaattgcagcagag

SEQ ID NO: 294191 - DNA, 37 bp, Artificial Sequence
  Description of Artificial Sequence: Synthetic oligonucleotide
aacatttgatcacgtgacctgtgaaattgcagcagag

SEQ ID NO: 294192 - DNA, 36 bp, Artificial Sequence
  Description of Artificial Sequence: Synthetic oligonucleotide
acatttgatcacgtgacctgtgaaattgcagcagag

SEQ ID NO: 294193 - DNA, 35 bp, Artificial Sequence
  Description of Artificial Sequence: Synthetic oligonucleotide
catttgatcacgtgacctgtgaaattgcagcagag

SEQ ID NO: 294194 - DNA, 35 bp, Artificial Sequence
  Description of Artificial Sequence: Synthetic oligonucleotide
atttgatcacgtgacctgtgaaattgcagcagagg

SEQ ID NO: 294195 - DNA, 34 bp, Artificial Sequence
  Description of Artificial Sequence: Synthetic oligonucleotide
tttgatcacgtgacctgtgaaattgcagcagagg

SEQ ID NO: 294196 - DNA, 33 bp, Artificial Sequence
  Description of Artificial Sequence: Synthetic oligonucleotide
ttgatcacgtgacctgtgaaattgcagcagagg

SEQ ID NO: 294197 - DNA, 32 bp, Artificial Sequence
  Description of Artificial Sequence: Synthetic oligonucleotide
tgatcacgtgacctgtgaaattgcagcagagg

SEQ ID NO: 294198 - DNA, 31 bp, Artificial Sequence
  Description of Artificial Sequence: Synthetic oligonucleotide
gatcacgtgacctgtgaaattgcagcagagg

SEQ ID NO: 294199 - DNA, 33 bp, Artificial Sequence
  Description of Artificial Sequence: Synthetic oligonucleotide
atcacgtgacctgtgaaattgcagcagaggatg

SEQ ID NO: 294200 - DNA, 32 bp, Artificial Sequence
  Description of Artificial Sequence: Synthetic oligonucleotide
tcacgtgacctgtgaaattgcagcagaggatg

SEQ ID NO: 294201 - DNA, 31 bp, Artificial Sequence
  Description of Artificial Sequence: Synthetic oligonucleotide
cacgtgacctgtgaaattgcagcagaggatg

SEQ ID NO: 294202 - DNA, 31 bp, Artificial Sequence
  Description of Artificial Sequence: Synthetic oligonucleotide
acgtgacctgtgaaattgcagcagaggatgc

SEQ ID NO: 294203 - DNA, 30 bp, Artificial Sequence
  Description of Artificial Sequence: Synthetic oligonucleotide
cgtgacctgtgaaattgcagcagaggatgc

SEQ ID NO: 294204 - DNA, 31 bp, Artificial Sequence
  Description of Artificial Sequence: Synthetic oligonucleotide
gtgacctgtgaaattgcagcagaggatgctg

SEQ ID NO: 294205 - DNA, 32 bp, Artificial Sequence
  Description of Artificial Sequence: Synthetic oligonucleotide
tgacctgtgaaattgcagcagaggatgctgag

SEQ ID NO: 294206 - DNA, 31 bp, Artificial Sequence
  Description of Artificial Sequence: Synthetic oligonucleotide
gacctgtgaaattgcagcagaggatgctgag

SEQ ID NO: 294207 - DNA, 31 bp, Artificial Sequence
  Description of Artificial Sequence: Synthetic oligonucleotide
acctgtgaaattgcagcagaggatgctgagg

SEQ ID NO: 294208 - DNA, 30 bp, Artificial Sequence
  Description of Artificial Sequence: Synthetic oligonucleotide
cctgtgaaattgcagcagaggatgctgagg

SEQ ID NO: 294209 - DNA, 32 bp, Artificial Sequence
  Description of Artificial Sequence: Synthetic oligonucleotide
ctgtgaaattgcagcagaggatgctgaggaac

SEQ ID NO: 294210 - DNA, 34 bp, Artificial Sequence
  Description of Artificial Sequence: Synthetic oligonucleotide
tgtgaaattgcagcagaggatgctgaggaacttg

SEQ ID NO: 294211 - DNA, 33 bp, Artificial Sequence
  Description of Artificial Sequence: Synthetic oligonucleotide
gtgaaattgcagcagaggatgctgaggaacttg

SEQ ID NO: 294212 - DNA, 33 bp, Artificial Sequence
  Description of Artificial Sequence: Synthetic oligonucleotide
tgaaattgcagcagaggatgctgaggaacttgg

SEQ ID NO: 294213 - DNA, 32 bp, Artificial Sequence
  Description of Artificial Sequence: Synthetic oligonucleotide
gaaattgcagcagaggatgctgaggaacttgg

SEQ ID NO: 294214 - DNA, 33 bp, Artificial Sequence
  Description of Artificial Sequence: Synthetic oligonucleotide
aaattgcagcagaggatgctgaggaacttggag

SEQ ID NO: 294215 - DNA, 32 bp, Artificial Sequence
  Description of Artificial Sequence: Synthetic oligonucleotide
aattgcagcagaggatgctgaggaacttggag

SEQ ID NO: 294216 - DNA, 31 bp, Artificial Sequence
  Description of Artificial Sequence: Synthetic oligonucleotide
attgcagcagaggatgctgaggaacttggag

SEQ ID NO: 294217 - DNA, 30 bp, Artificial Sequence
  Description of Artificial Sequence: Synthetic oligonucleotide
ttgcagcagaggatgctgaggaacttggag

SEQ ID NO: 294218 - DNA, 29 bp, Artificial Sequence
  Description of Artificial Sequence: Synthetic oligonucleotide
tgcagcagaggatgctgaggaacttggag

SEQ ID NO: 294219 - DNA, 28 bp, Artificial Sequence
  Description of Artificial Sequence: Synthetic oligonucleotide
gcagcagaggatgctgaggaacttggag

SEQ ID NO: 294220 - DNA, 30 bp, Artificial Sequence
  Description of Artificial Sequence: Synthetic oligonucleotide
cagcagaggatgctgaggaacttggagttg

SEQ ID NO: 294221 - DNA, 32 bp, Artificial Sequence
  Description of Artificial Sequence: Synthetic oligonucleotide
agcagaggatgctgaggaacttggagttgtac

SEQ ID NO: 294222 - DNA, 31 bp, Artificial Sequence
  Description of Artificial Sequence: Synthetic oligonucleotide
gcagaggatgctgaggaacttggagttgtac

SEQ ID NO: 294223 - DNA, 32 bp, Artificial Sequence
  Description of Artificial Sequence: Synthetic oligonucleotide
cagaggatgctgaggaacttggagttgtacac

SEQ ID NO: 294224 - DNA, 34 bp, Artificial Sequence
  Description of Artificial Sequence: Synthetic oligonucleotide
agaggatgctgaggaacttggagttgtacacttg

SEQ ID NO: 294225 - DNA, 33 bp, Artificial Sequence
  Description of Artificial Sequence: Synthetic oligonucleotide
gaggatgctgaggaacttggagttgtacacttg

SEQ ID NO: 294226 - DNA, 36 bp, Artificial Sequence
  Description of Artificial Sequence: Synthetic oligonucleotide
aggatgctgaggaacttggagttgtacacttgtttc

SEQ ID NO: 294227 - DNA, 35 bp, Artificial Sequence
  Description of Artificial Sequence: Synthetic oligonucleotide
ggatgctgaggaacttggagttgtacacttgtttc

SEQ ID NO: 294228 - DNA, 35 bp, Artificial Sequence
  Description of Artificial Sequence: Synthetic oligonucleotide
gatgctgaggaacttggagttgtacacttgtttcg

SEQ ID NO: 294229 - DNA, 36 bp, Artificial Sequence
  Description of Artificial Sequence: Synthetic oligonucleotide
atgctgaggaacttggagttgtacacttgtttcgag

SEQ ID NO: 294230 - DNA, 35 bp, Artificial Sequence
  Description of Artificial Sequence: Synthetic oligonucleotide
tgctgaggaacttggagttgtacacttgtttcgag

SEQ ID NO: 294231 - DNA, 34 bp, Artificial Sequence
  Description of Artificial Sequence: Synthetic oligonucleotide
gctgaggaacttggagttgtacacttgtttcgag

SEQ ID NO: 294232 - DNA, 38 bp, Artificial Sequence
  Description of Artificial Sequence: Synthetic oligonucleotide
ctgaggaacttggagttgtacacttgtttcgagatatc

SEQ ID NO: 294233 - DNA, 41 bp, Artificial Sequence
  Description of Artificial Sequence: Synthetic oligonucleotide
tgaggaacttggagttgtacacttgtttcgagatatctaag

SEQ ID NO: 294234 - DNA, 40 bp, Artificial Sequence
  Description of Artificial Sequence: Synthetic oligonucleotide
gaggaacttggagttgtacacttgtttcgagatatctaag

SEQ ID NO: 294235 - DNA, 41 bp, Artificial Sequence
  Description of Artificial Sequence: Synthetic oligonucleotide
aggaacttggagttgtacacttgtttcgagatatctaagac

SEQ ID NO: 294236 - DNA, 40 bp, Artificial Sequence
  Description of Artificial Sequence: Synthetic oligonucleotide
ggaacttggagttgtacacttgtttcgagatatctaagac

SEQ ID NO: 294237 - DNA, 41 bp, Artificial Sequence
  Description of Artificial Sequence: Synthetic oligonucleotide
gaacttggagttgtacacttgtttcgagatatctaagacac

SEQ ID NO: 294238 - DNA, 41 bp, Artificial Sequence
  Description of Artificial Sequence: Synthetic oligonucleotide
aacttggagttgtacacttgtttcgagatatctaagacacg

SEQ ID NO: 294239 - DNA, 40 bp, Artificial Sequence
  Description of Artificial Sequence: Synthetic oligonucleotide
acttggagttgtacacttgtttcgagatatctaagacacg

SEQ ID NO: 294240 - DNA, 39 bp, Artificial Sequence
  Description of Artificial Sequence: Synthetic oligonucleotide
cttggagttgtacacttgtttcgagatatctaagacacg

SEQ ID NO: 294241 - DNA, 40 bp, Artificial Sequence
  Description of Artificial Sequence: Synthetic oligonucleotide
ttggagttgtacacttgtttcgagatatctaagacacgag

SEQ ID NO: 294242 - DNA, 39 bp, Artificial Sequence
  Description of Artificial Sequence: Synthetic oligonucleotide
tggagttgtacacttgtttcgagatatctaagacacgag

SEQ ID NO: 294243 - DNA, 38 bp, Artificial Sequence
  Description of Artificial Sequence: Synthetic oligonucleotide
ggagttgtacacttgtttcgagatatctaagacacgag

SEQ ID NO: 294244 - DNA, 38 bp, Artificial Sequence
  Description of Artificial Sequence: Synthetic oligonucleotide
gagttgtacacttgtttcgagatatctaagacacgagg

SEQ ID NO: 294245 - DNA, 38 bp, Artificial Sequence
  Description of Artificial Sequence: Synthetic oligonucleotide
agttgtacacttgtttcgagatatctaagacacgaggg

SEQ ID NO: 294246 - DNA, 37 bp, Artificial Sequence
  Description of Artificial Sequence: Synthetic oligonucleotide
gttgtacacttgtttcgagatatctaagacacgaggg

SEQ ID NO: 294247 - DNA, 38 bp, Artificial Sequence
  Description of Artificial Sequence: Synthetic oligonucleotide
ttgtacacttgtttcgagatatctaagacacgagggtg

SEQ ID NO: 294248 - DNA, 37 bp, Artificial Sequence
  Description of Artificial Sequence: Synthetic oligonucleotide
tgtacacttgtttcgagatatctaagacacgagggtg

SEQ ID NO: 294249 - DNA, 36 bp, Artificial Sequence
  Description of Artificial Sequence: Synthetic oligonucleotide
gtacacttgtttcgagatatctaagacacgagggtg

SEQ ID NO: 294250 - DNA, 36 bp, Artificial Sequence
  Description of Artificial Sequence: Synthetic oligonucleotide
tacacttgtttcgagatatctaagacacgagggtgg

SEQ ID NO: 294251 - DNA, 35 bp, Artificial Sequence
  Description of Artificial Sequence: Synthetic oligonucleotide
acacttgtttcgagatatctaagacacgagggtgg

SEQ ID NO: 294252 - DNA, 34 bp, Artificial Sequence
  Description of Artificial Sequence: Synthetic oligonucleotide
cacttgtttcgagatatctaagacacgagggtgg

SEQ ID NO: 294253 - DNA, 34 bp, Artificial Sequence
  Description of Artificial Sequence: Synthetic oligonucleotide
acttgtttcgagatatctaagacacgagggtggg

SEQ ID NO: 294254 - DNA, 33 bp, Artificial Sequence
  Description of Artificial Sequence: Synthetic oligonucleotide
cttgtttcgagatatctaagacacgagggtggg

SEQ ID NO: 294255 - DNA, 33 bp, Artificial Sequence
  Description of Artificial Sequence: Synthetic oligonucleotide
ttgtttcgagatatctaagacacgagggtgggc

SEQ ID NO: 294256 - DNA, 32 bp, Artificial Sequence
  Description of Artificial Sequence: Synthetic oligonucleotide
tgtttcgagatatctaagacacgagggtgggc

SEQ ID NO: 294257 - DNA, 31 bp, Artificial Sequence
  Description of Artificial Sequence: Synthetic oligonucleotide
gtttcgagatatctaagacacgagggtgggc

SEQ ID NO: 294258 - DNA, 32 bp, Artificial Sequence
  Description of Artificial Sequence: Synthetic oligonucleotide
tttcgagatatctaagacacgagggtgggcac

SEQ ID NO: 294259 - DNA, 31 bp, Artificial Sequence
  Description of Artificial Sequence: Synthetic oligonucleotide
ttcgagatatctaagacacgagggtgggcac

SEQ ID NO: 294260 - DNA, 30 bp, Artificial Sequence
  Description of Artificial Sequence: Synthetic oligonucleotide
tcgagatatctaagacacgagggtgggcac

SEQ ID NO: 294261 - DNA, 29 bp, Artificial Sequence
  Description of Artificial Sequence: Synthetic oligonucleotide
cgagatatctaagacacgagggtgggcac

SEQ ID NO: 294262 - DNA, 30 bp, Artificial Sequence
  Description of Artificial Sequence: Synthetic oligonucleotide
gagatatctaagacacgagggtgggcacac

SEQ ID NO: 294263 - DNA, 31 bp, Artificial Sequence
  Description of Artificial Sequence: Synthetic oligonucleotide
agatatctaagacacgagggtgggcacactg

SEQ ID NO: 294264 - DNA, 30 bp, Artificial Sequence
  Description of Artificial Sequence: Synthetic oligonucleotide
gatatctaagacacgagggtgggcacactg

SEQ ID NO: 294265 - DNA, 31 bp, Artificial Sequence
  Description of Artificial Sequence: Synthetic oligonucleotide
atatctaagacacgagggtgggcacactgtc

SEQ ID NO: 294266 - DNA, 30 bp, Artificial Sequence
  Description of Artificial Sequence: Synthetic oligonucleotide
tatctaagacacgagggtgggcacactgtc

SEQ ID NO: 294267 - DNA, 29 bp, Artificial Sequence
  Description of Artificial Sequence: Synthetic oligonucleotide
atctaagacacgagggtgggcacactgtc

SEQ ID NO: 294268 - DNA, 28 bp, Artificial Sequence
  Description of Artificial Sequence: Synthetic oligonucleotide
tctaagacacgagggtgggcacactgtc

SEQ ID NO: 294269 - DNA, 27 bp, Artificial Sequence
  Description of Artificial Sequence: Synthetic oligonucleotide
ctaagacacgagggtgggcacactgtc

SEQ ID NO: 294270 - DNA, 27 bp, Artificial Sequence
  Description of Artificial Sequence: Synthetic oligonucleotide
taagacacgagggtgggcacactgtcc

SEQ ID NO: 294271 - DNA, 26 bp, Artificial Sequence
  Description of Artificial Sequence: Synthetic oligonucleotide
aagacacgagggtgggcacactgtcc

SEQ ID NO: 294272 - DNA, 25 bp, Artificial Sequence
  Description of Artificial Sequence: Synthetic oligonucleotide
agacacgagggtgggcacactgtcc

SEQ ID NO: 294273 - DNA, 24 bp, Artificial Sequence
  Description of Artificial Sequence: Synthetic oligonucleotide
gacacgagggtgggcacactgtcc

SEQ ID NO: 294274 - DNA, 25 bp, Artificial Sequence
  Description of Artificial Sequence: Synthetic oligonucleotide
acacgagggtgggcacactgtccca

SEQ ID NO: 294275 - DNA, 24 bp, Artificial Sequence
  Description of Artificial Sequence: Synthetic oligonucleotide
cacgagggtgggcacactgtccca

SEQ ID NO: 294276 - DNA, 24 bp, Artificial Sequence
  Description of Artificial Sequence: Synthetic oligonucleotide
acgagggtgggcacactgtcccag

SEQ ID NO: 294277 - DNA, 23 bp, Artificial Sequence
  Description of Artificial Sequence: Synthetic oligonucleotide
cgagggtgggcacactgtcccag

SEQ ID NO: 294278 - DNA, 23 bp, Artificial Sequence
  Description of Artificial Sequence: Synthetic oligonucleotide
gagggtgggcacactgtcccagg

SEQ ID NO: 294279 - DNA, 23 bp, Artificial Sequence
  Description of Artificial Sequence: Synthetic oligonucleotide
agggtgggcacactgtcccaggg

SEQ ID NO: 294280 - DNA, 22 bp, Artificial Sequence
  Description of Artificial Sequence: Synthetic oligonucleotide
gggtgggcacactgtcccaggg

SEQ ID NO: 294281 - DNA, 24 bp, Artificial Sequence
  Description of Artificial Sequence: Synthetic oligonucleotide
ggtgggcacactgtcccaggggat

SEQ ID NO: 294282 - DNA, 25 bp, Artificial Sequence
  Description of Artificial Sequence: Synthetic oligonucleotide
gtgggcacactgtcccaggggatca

SEQ ID NO: 294283 - DNA, 27 bp, Artificial Sequence
  Description of Artificial Sequence: Synthetic oligonucleotide
tgggcacactgtcccaggggatcacaa

SEQ ID NO: 294284 - DNA, 27 bp, Artificial Sequence
  Description of Artificial Sequence: Synthetic oligonucleotide
gggcacactgtcccaggggatcacaat

SEQ ID NO: 294285 - DNA, 27 bp, Artificial Sequence
  Description of Artificial Sequence: Synthetic oligonucleotide
ggcacactgtcccaggggatcacaatc

SEQ ID NO: 294286 - DNA, 27 bp, Artificial Sequence
  Description of Artificial Sequence: Synthetic oligonucleotide
gcacactgtcccaggggatcacaatcc

SEQ ID NO: 294287 - DNA, 28 bp, Artificial Sequence
  Description of Artificial Sequence: Synthetic oligonucleotide
cacactgtcccaggggatcacaatccag

SEQ ID NO: 294288 - DNA, 28 bp, Artificial Sequence
  Description of Artificial Sequence: Synthetic oligonucleotide
acactgtcccaggggatcacaatccagg

SEQ ID NO: 294289 - DNA, 27 bp, Artificial Sequence
  Description of Artificial Sequence: Synthetic oligonucleotide
cactgtcccaggggatcacaatccagg

SEQ ID NO: 294290 - DNA, 28 bp, Artificial Sequence
  Description of Artificial Sequence: Synthetic oligonucleotide
actgtcccaggggatcacaatccaggtc

SEQ ID NO: 294291 - DNA, 27 bp, Artificial Sequence
  Description of Artificial Sequence: Synthetic oligonucleotide
ctgtcccaggggatcacaatccaggtc

SEQ ID NO: 294292 - DNA, 27 bp, Artificial Sequence
  Description of Artificial Sequence: Synthetic oligonucleotide
tgtcccaggggatcacaatccaggtcc

SEQ ID NO: 294293 - DNA, 27 bp, Artificial Sequence
  Description of Artificial Sequence: Synthetic oligonucleotide
gtcccaggggatcacaatccaggtcca

SEQ ID NO: 294294 - DNA, 28 bp, Artificial Sequence
  Description of Artificial Sequence: Synthetic oligonucleotide
tcccaggggatcacaatccaggtccaag

SEQ ID NO: 294295 - DNA, 27 bp, Artificial Sequence
  Description of Artificial Sequence: Synthetic oligonucleotide
cccaggggatcacaatccaggtccaag

SEQ ID NO: 294296 - DNA, 27 bp, Artificial Sequence
  Description of Artificial Sequence: Synthetic oligonucleotide
ccaggggatcacaatccaggtccaagg

SEQ ID NO: 294297 - DNA, 30 bp, Artificial Sequence
  Description of Artificial Sequence: Synthetic oligonucleotide
caggggatcacaatccaggtccaaggtttg

SEQ ID NO: 294298 - DNA, 32 bp, Artificial Sequence
  Description of Artificial Sequence: Synthetic oligonucleotide
aggggatcacaatccaggtccaaggtttgaag

SEQ ID NO: 294299 - DNA, 31 bp, Artificial Sequence
  Description of Artificial Sequence: Synthetic oligonucleotide
ggggatcacaatccaggtccaaggtttgaag

SEQ ID NO: 294300 - DNA, 31 bp, Artificial Sequence
  Description of Artificial Sequence: Synthetic oligonucleotide
gggatcacaatccaggtccaaggtttgaagc

SEQ ID NO: 294301 - DNA, 31 bp, Artificial Sequence
  Description of Artificial Sequence: Synthetic oligonucleotide
ggatcacaatccaggtccaaggtttgaagcg

SEQ ID NO: 294302 - DNA, 32 bp, Artificial Sequence
  Description of Artificial Sequence: Synthetic oligonucleotide
gatcacaatccaggtccaaggtttgaagcgac

SEQ ID NO: 294303 - DNA, 33 bp, Artificial Sequence
  Description of Artificial Sequence: Synthetic oligonucleotide
atcacaatccaggtccaaggtttgaagcgactg

SEQ ID NO: 294304 - DNA, 32 bp, Artificial Sequence
  Description of Artificial Sequence: Synthetic oligonucleotide
tcacaatccaggtccaaggtttgaagcgactg

SEQ ID NO: 294305 - DNA, 31 bp, Artificial Sequence
  Description of Artificial Sequence: Synthetic oligonucleotide
cacaatccaggtccaaggtttgaagcgactg

SEQ ID NO: 294306 - DNA, 33 bp, Artificial Sequence
  Description of Artificial Sequence: Synthetic oligonucleotide
acaatccaggtccaaggtttgaagcgactgaac

SEQ ID NO: 294307 - DNA, 32 bp, Artificial Sequence
  Description of Artificial Sequence: Synthetic oligonucleotide
caatccaggtccaaggtttgaagcgactgaac

SEQ ID NO: 294308 - DNA, 33 bp, Artificial Sequence
  Description of Artificial Sequence: Synthetic oligonucleotide
aatccaggtccaaggtttgaagcgactgaactg

SEQ ID NO: 294309 - DNA, 32 bp, Artificial Sequence
  Description of Artificial Sequence: Synthetic oligonucleotide
atccaggtccaaggtttgaagcgactgaactg

SEQ ID NO: 294310 - DNA, 31 bp, Artificial Sequence
  Description of Artificial Sequence: Synthetic oligonucleotide
tccaggtccaaggtttgaagcgactgaactg

SEQ ID NO: 294311 - DNA, 30 bp, Artificial Sequence
  Description of Artificial Sequence: Synthetic oligonucleotide
ccaggtccaaggtttgaagcgactgaactg

SEQ ID NO: 294312 - DNA, 30 bp, Artificial Sequence
  Description of Artificial Sequence: Synthetic oligonucleotide
caggtccaaggtttgaagcgactgaactgc

SEQ ID NO: 294313 - DNA, 32 bp, Artificial Sequence
  Description of Artificial Sequence: Synthetic oligonucleotide
aggtccaaggtttgaagcgactgaactgcaag

SEQ ID NO: 294314 - DNA, 31 bp, Artificial Sequence
  Description of Artificial Sequence: Synthetic oligonucleotide
ggtccaaggtttgaagcgactgaactgcaag

SEQ ID NO: 294315 - DNA, 31 bp, Artificial Sequence
  Description of Artificial Sequence: Synthetic oligonucleotide
gtccaaggtttgaagcgactgaactgcaagc

SEQ ID NO: 294316 - DNA, 33 bp, Artificial Sequence
  Description of Artificial Sequence: Synthetic oligonucleotide
tccaaggtttgaagcgactgaactgcaagcttc

SEQ ID NO: 294317 - DNA, 32 bp, Artificial Sequence
  Description of Artificial Sequence: Synthetic oligonucleotide
ccaaggtttgaagcgactgaactgcaagcttc

SEQ ID NO: 294318 - DNA, 33 bp, Artificial Sequence
  Description of Artificial Sequence: Synthetic oligonucleotide
caaggtttgaagcgactgaactgcaagcttctc

SEQ ID NO: 294319 - DNA, 33 bp, Artificial Sequence
  Description of Artificial Sequence: Synthetic oligonucleotide
aaggtttgaagcgactgaactgcaagcttctcg

SEQ ID NO: 294320 - DNA, 32 bp, Artificial Sequence
  Description of Artificial Sequence: Synthetic oligonucleotide
aggtttgaagcgactgaactgcaagcttctcg

SEQ ID NO: 294321 - DNA, 31 bp, Artificial Sequence
  Description of Artificial Sequence: Synthetic oligonucleotide
ggtttgaagcgactgaactgcaagcttctcg

SEQ ID NO: 294322 - DNA, 35 bp, Artificial Sequence
  Description of Artificial Sequence: Synthetic oligonucleotide
gtttgaagcgactgaactgcaagcttctcgatatc

SEQ ID NO: 294323 - DNA, 36 bp, Artificial Sequence
  Description of Artificial Sequence: Synthetic oligonucleotide
tttgaagcgactgaactgcaagcttctcgatatcag

SEQ ID NO: 294324 - DNA, 35 bp, Artificial Sequence
  Description of Artificial Sequence: Synthetic oligonucleotide
ttgaagcgactgaactgcaagcttctcgatatcag

SEQ ID NO: 294325 - DNA, 34 bp, Artificial Sequence
  Description of Artificial Sequence: Synthetic oligonucleotide
tgaagcgactgaactgcaagcttctcgatatcag

SEQ ID NO: 294326 - DNA, 33 bp, Artificial Sequence
  Description of Artificial Sequence: Synthetic oligonucleotide
gaagcgactgaactgcaagcttctcgatatcag

SEQ ID NO: 294327 - DNA, 33 bp, Artificial Sequence
  Description of Artificial Sequence: Synthetic oligonucleotide
aagcgactgaactgcaagcttctcgatatcagg

SEQ ID NO: 294328 - DNA, 32 bp, Artificial Sequence
  Description of Artificial Sequence: Synthetic oligonucleotide
agcgactgaactgcaagcttctcgatatcagg

SEQ ID NO: 294329 - DNA, 31 bp, Artificial Sequence
  Description of Artificial Sequence: Synthetic oligonucleotide
gcgactgaactgcaagcttctcgatatcagg

SEQ ID NO: 294330 - DNA, 32 bp, Artificial Sequence
  Description of Artificial Sequence: Synthetic oligonucleotide
cgactgaactgcaagcttctcgatatcaggtg

SEQ ID NO: 294331 - DNA, 32 bp, Artificial Sequence
  Description of Artificial Sequence: Synthetic oligonucleotide
gactgaactgcaagcttctcgatatcaggtgc

SEQ ID NO: 294332 - DNA, 34 bp, Artificial Sequence
  Description of Artificial Sequence: Synthetic oligonucleotide
actgaactgcaagcttctcgatatcaggtgctac

SEQ ID NO: 294333 - DNA, 33 bp, Artificial Sequence
  Description of Artificial Sequence: Synthetic oligonucleotide
ctgaactgcaagcttctcgatatcaggtgctac

SEQ ID NO: 294334 - DNA, 33 bp, Artificial Sequence
  Description of Artificial Sequence: Synthetic oligonucleotide
tgaactgcaagcttctcgatatcaggtgctacc

SEQ ID NO: 294335 - DNA, 32 bp, Artificial Sequence
  Description of Artificial Sequence: Synthetic oligonucleotide
gaactgcaagcttctcgatatcaggtgctacc

SEQ ID NO: 294336 - DNA, 33 bp, Artificial Sequence
  Description of Artificial Sequence: Synthetic oligonucleotide
aactgcaagcttctcgatatcaggtgctacctg

SEQ ID NO: 294337 - DNA, 32 bp, Artificial Sequence
  Description of Artificial Sequence: Synthetic oligonucleotide
actgcaagcttctcgatatcaggtgctacctg

SEQ ID NO: 294338 - DNA, 31 bp, Artificial Sequence
  Description of Artificial Sequence: Synthetic oligonucleotide
ctgcaagcttctcgatatcaggtgctacctg

SEQ ID NO: 294339 - DNA, 31 bp, Artificial Sequence
  Description of Artificial Sequence: Synthetic oligonucleotide
tgcaagcttctcgatatcaggtgctacctgg

SEQ ID NO: 294340 - DNA, 30 bp, Artificial Sequence
  Description of Artificial Sequence: Synthetic oligonucleotide
gcaagcttctcgatatcaggtgctacctgg

SEQ ID NO: 294341 - DNA, 35 bp, Artificial Sequence
  Description of Artificial Sequence: Synthetic oligonucleotide
caagcttctcgatatcaggtgctacctggtaaaag

SEQ ID NO: 294342 - DNA, 36 bp, Artificial Sequence
  Description of Artificial Sequence: Synthetic oligonucleotide
aagcttctcgatatcaggtgctacctggtaaaagtc

SEQ ID NO: 294343 - DNA, 35 bp, Artificial Sequence
  Description of Artificial Sequence: Synthetic oligonucleotide
agcttctcgatatcaggtgctacctggtaaaagtc

SEQ ID NO: 294344 - DNA, 34 bp, Artificial Sequence
  Description of Artificial Sequence: Synthetic oligonucleotide
gcttctcgatatcaggtgctacctggtaaaagtc

SEQ ID NO: 294345 - DNA, 34 bp, Artificial Sequence
  Description of Artificial Sequence: Synthetic oligonucleotide
cttctcgatatcaggtgctacctggtaaaagtcg

SEQ ID NO: 294346 - DNA, 34 bp, Artificial Sequence
  Description of Artificial Sequence: Synthetic oligonucleotide
ttctcgatatcaggtgctacctggtaaaagtcgc

SEQ ID NO: 294347 - DNA, 33 bp, Artificial Sequence
  Description of Artificial Sequence: Synthetic oligonucleotide
tctcgatatcaggtgctacctggtaaaagtcgc

SEQ ID NO: 294348 - DNA, 32 bp, Artificial Sequence
  Description of Artificial Sequence: Synthetic oligonucleotide
ctcgatatcaggtgctacctggtaaaagtcgc

SEQ ID NO: 294349 - DNA, 32 bp, Artificial Sequence
  Description of Artificial Sequence: Synthetic oligonucleotide
tcgatatcaggtgctacctggtaaaagtcgcg

SEQ ID NO: 294350 - DNA, 31 bp, Artificial Sequence
  Description of Artificial Sequence: Synthetic oligonucleotide
cgatatcaggtgctacctggtaaaagtcgcg

SEQ ID NO: 294351 - DNA, 32 bp, Artificial Sequence
  Description of Artificial Sequence: Synthetic oligonucleotide
gatatcaggtgctacctggtaaaagtcgcgac

SEQ ID NO: 294352 - DNA, 33 bp, Artificial Sequence
  Description of Artificial Sequence: Synthetic oligonucleotide
atatcaggtgctacctggtaaaagtcgcgacag

SEQ ID NO: 294353 - DNA, 32 bp, Artificial Sequence
  Description of Artificial Sequence: Synthetic oligonucleotide
tatcaggtgctacctggtaaaagtcgcgacag

SEQ ID NO: 294354 - DNA, 31 bp, Artificial Sequence
  Description of Artificial Sequence: Synthetic oligonucleotide
atcaggtgctacctggtaaaagtcgcgacag

SEQ ID NO: 294355 - DNA, 30 bp, Artificial Sequence
  Description of Artificial Sequence: Synthetic oligonucleotide
tcaggtgctacctggtaaaagtcgcgacag

SEQ ID NO: 294356 - DNA, 29 bp, Artificial Sequence
  Description of Artificial Sequence: Synthetic oligonucleotide
caggtgctacctggtaaaagtcgcgacag

SEQ ID NO: 294357 - DNA, 29 bp, Artificial Sequence
  Description of Artificial Sequence: Synthetic oligonucleotide
aggtgctacctggtaaaagtcgcgacagg

SEQ ID NO: 294358 - DNA, 28 bp, Artificial Sequence
  Description of Artificial Sequence: Synthetic oligonucleotide
ggtgctacctggtaaaagtcgcgacagg

SEQ ID NO: 294359 - DNA, 28 bp, Artificial Sequence
  Description of Artificial Sequence: Synthetic oligonucleotide
gtgctacctggtaaaagtcgcgacaggc

SEQ ID NO: 294360 - DNA, 30 bp, Artificial Sequence
  Description of Artificial Sequence: Synthetic oligonucleotide
tgctacctggtaaaagtcgcgacaggcaag

SEQ ID NO: 294361 - DNA, 29 bp, Artificial Sequence
  Description of Artificial Sequence: Synthetic oligonucleotide
gctacctggtaaaagtcgcgacaggcaag

SEQ ID NO: 294362 - DNA, 29 bp, Artificial Sequence
  Description of Artificial Sequence: Synthetic oligonucleotide
ctacctggtaaaagtcgcgacaggcaagg

SEQ ID NO: 294363 - DNA, 30 bp, Artificial Sequence
  Description of Artificial Sequence: Synthetic oligonucleotide
tacctggtaaaagtcgcgacaggcaaggtg

SEQ ID NO: 294364 - DNA, 29 bp, Artificial Sequence
  Description of Artificial Sequence: Synthetic oligonucleotide
acctggtaaaagtcgcgacaggcaaggtg

SEQ ID NO: 294365 - DNA, 28 bp, Artificial Sequence
  Description of Artificial Sequence: Synthetic oligonucleotide
cctggtaaaagtcgcgacaggcaaggtg

SEQ ID NO: 294366 - DNA, 28 bp, Artificial Sequence
  Description of Artificial Sequence: Synthetic oligonucleotide
ctggtaaaagtcgcgacaggcaaggtgc

SEQ ID NO: 294367 - DNA, 28 bp, Artificial Sequence
  Description of Artificial Sequence: Synthetic oligonucleotide
tggtaaaagtcgcgacaggcaaggtgcc

SEQ ID NO: 294368 - DNA, 27 bp, Artificial Sequence
  Description of Artificial Sequence: Synthetic oligonucleotide
ggtaaaagtcgcgacaggcaaggtgcc

SEQ ID NO: 294369 - DNA, 27 bp, Artificial Sequence
  Description of Artificial Sequence: Synthetic oligonucleotide
gtaaaagtcgcgacaggcaaggtgccc

SEQ ID NO: 294370 - DNA, 29 bp, Artificial Sequence
  Description of Artificial Sequence: Synthetic oligonucleotide
taaaagtcgcgacaggcaaggtgcccatc

SEQ ID NO: 294371 - DNA, 28 bp, Artificial Sequence
  Description of Artificial Sequence: Synthetic oligonucleotide
aaaagtcgcgacaggcaaggtgcccatc

SEQ ID NO: 294372 - DNA, 27 bp, Artificial Sequence
  Description of Artificial Sequence: Synthetic oligonucleotide
aaagtcgcgacaggcaaggtgcccatc

SEQ ID NO: 294373 - DNA, 27 bp, Artificial Sequence
  Description of Artificial Sequence: Synthetic oligonucleotide
aagtcgcgacaggcaaggtgcccatca

SEQ ID NO: 294374 - DNA, 27 bp, Artificial Sequence
  Description of Artificial Sequence: Synthetic oligonucleotide
agtcgcgacaggcaaggtgcccatcat

SEQ ID NO: 294375 - DNA, 26 bp, Artificial Sequence
  Description of Artificial Sequence: Synthetic oligonucleotide
gtcgcgacaggcaaggtgcccatcat

SEQ ID NO: 294376 - DNA, 26 bp, Artificial Sequence
  Description of Artificial Sequence: Synthetic oligonucleotide
tcgcgacaggcaaggtgcccatcatc

SEQ ID NO: 294377 - DNA, 25 bp, Artificial Sequence
  Description of Artificial Sequence: Synthetic oligonucleotide
cgcgacaggcaaggtgcccatcatc

SEQ ID NO: 294378 - DNA, 26 bp, Artificial Sequence
  Description of Artificial Sequence: Synthetic oligonucleotide
gcgacaggcaaggtgcccatcatcca

SEQ ID NO: 294379 - DNA, 26 bp, Artificial Sequence
  Description of Artificial Sequence: Synthetic oligonucleotide
cgacaggcaaggtgcccatcatccac

SEQ ID NO: 294380 - DNA, 27 bp, Artificial Sequence
  Description of Artificial Sequence: Synthetic oligonucleotide
gacaggcaaggtgcccatcatccacca

SEQ ID NO: 294381 - DNA, 27 bp, Artificial Sequence
  Description of Artificial Sequence: Synthetic oligonucleotide
acaggcaaggtgcccatcatccaccag

SEQ ID NO: 294382 - DNA, 27 bp, Artificial Sequence
  Description of Artificial Sequence: Synthetic oligonucleotide
caggcaaggtgcccatcatccaccaga

SEQ ID NO: 294383 - DNA, 28 bp, Artificial Sequence
  Description of Artificial Sequence: Synthetic oligonucleotide
aggcaaggtgcccatcatccaccagatg

SEQ ID NO: 294384 - DNA, 27 bp, Artificial Sequence
  Description of Artificial Sequence: Synthetic oligonucleotide
ggcaaggtgcccatcatccaccagatg

SEQ ID NO: 294385 - DNA, 29 bp, Artificial Sequence
  Description of Artificial Sequence: Synthetic oligonucleotide
gcaaggtgcccatcatccaccagatgatc

SEQ ID NO: 294386 - DNA, 31 bp, Artificial Sequence
  Description of Artificial Sequence: Synthetic oligonucleotide
caaggtgcccatcatccaccagatgatctac

SEQ ID NO: 294387 - DNA, 31 bp, Artificial Sequence
  Description of Artificial Sequence: Synthetic oligonucleotide
aaggtgcccatcatccaccagatgatctacc

SEQ ID NO: 294388 - DNA, 30 bp, Artificial Sequence
  Description of Artificial Sequence: Synthetic oligonucleotide
aggtgcccatcatccaccagatgatctacc

SEQ ID NO: 294389 - DNA, 29 bp, Artificial Sequence
  Description of Artificial Sequence: Synthetic oligonucleotide
ggtgcccatcatccaccagatgatctacc

SEQ ID NO: 294390 - DNA, 30 bp, Artificial Sequence
  Description of Artificial Sequence: Synthetic oligonucleotide
gtgcccatcatccaccagatgatctaccag

SEQ ID NO: 294391 - DNA, 30 bp, Artificial Sequence
  Description of Artificial Sequence: Synthetic oligonucleotide
tgcccatcatccaccagatgatctaccagg

SEQ ID NO: 294392 - DNA, 29 bp, Artificial Sequence
  Description of Artificial Sequence: Synthetic oligonucleotide
gcccatcatccaccagatgatctaccagg

SEQ ID NO: 294393 - DNA, 30 bp, Artificial Sequence
  Description of Artificial Sequence: Synthetic oligonucleotide
cccatcatccaccagatgatctaccaggtg

SEQ ID NO: 294394 - DNA, 30 bp, Artificial Sequence
  Description of Artificial Sequence: Synthetic oligonucleotide
ccatcatccaccagatgatctaccaggtgc

SEQ ID NO: 294395 - DNA, 31 bp, Artificial Sequence
  Description of Artificial Sequence: Synthetic oligonucleotide
catcatccaccagatgatctaccaggtgcag

SEQ ID NO: 294396 - DNA, 31 bp, Artificial Sequence
  Description of Artificial Sequence: Synthetic oligonucleotide
atcatccaccagatgatctaccaggtgcagg

SEQ ID NO: 294397 - DNA, 30 bp, Artificial Sequence
  Description of Artificial Sequence: Synthetic oligonucleotide
tcatccaccagatgatctaccaggtgcagg

SEQ ID NO: 294398 - DNA, 29 bp, Artificial Sequence
  Description of Artificial Sequence: Synthetic oligonucleotide
catccaccagatgatctaccaggtgcagg

SEQ ID NO: 294399 - DNA, 30 bp, Artificial Sequence
  Description of Artificial Sequence: Synthetic oligonucleotide
atccaccagatgatctaccaggtgcaggac

SEQ ID NO: 294400 - DNA, 29 bp, Artificial Sequence
  Description of Artificial Sequence: Synthetic oligonucleotide
tccaccagatgatctaccaggtgcaggac

SEQ ID NO: 294401 - DNA, 28 bp, Artificial Sequence
  Description of Artificial Sequence: Synthetic oligonucleotide
ccaccagatgatctaccaggtgcaggac

SEQ ID NO: 294402 - DNA, 28 bp, Artificial Sequence
  Description of Artificial Sequence: Synthetic oligonucleotide
caccagatgatctaccaggtgcaggacg

SEQ ID NO: 294403 - DNA, 29 bp, Artificial Sequence
  Description of Artificial Sequence: Synthetic oligonucleotide
accagatgatctaccaggtgcaggacgac

SEQ ID NO: 294404 - DNA, 28 bp, Artificial Sequence
  Description of Artificial Sequence: Synthetic oligonucleotide
ccagatgatctaccaggtgcaggacgac

SEQ ID NO: 294405 - DNA, 30 bp, Artificial Sequence
  Description of Artificial Sequence: Synthetic oligonucleotide
cagatgatctaccaggtgcaggacgacttc

SEQ ID NO: 294406 - DNA, 32 bp, Artificial Sequence
  Description of Artificial Sequence: Synthetic oligonucleotide
agatgatctaccaggtgcaggacgacttcaac

SEQ ID NO: 294407 - DNA, 31 bp, Artificial Sequence
  Description of Artificial Sequence: Synthetic oligonucleotide
gatgatctaccaggtgcaggacgacttcaac

SEQ ID NO: 294408 - DNA, 31 bp, Artificial Sequence
  Description of Artificial Sequence: Synthetic oligonucleotide
atgatctaccaggtgcaggacgacttcaacc

SEQ ID NO: 294409 - DNA, 30 bp, Artificial Sequence
  Description of Artificial Sequence: Synthetic oligonucleotide
tgatctaccaggtgcaggacgacttcaacc

SEQ ID NO: 294410 - DNA, 29 bp, Artificial Sequence
  Description of Artificial Sequence: Synthetic oligonucleotide
gatctaccaggtgcaggacgacttcaacc

SEQ ID NO: 294411 - DNA, 30 bp, Artificial Sequence
  Description of Artificial Sequence: Synthetic oligonucleotide
atctaccaggtgcaggacgacttcaacctc

SEQ ID NO: 294412 - DNA, 29 bp, Artificial Sequence
  Description of Artificial Sequence: Synthetic oligonucleotide
tctaccaggtgcaggacgacttcaacctc

SEQ ID NO: 294413 - DNA, 28 bp, Artificial Sequence
  Description of Artificial Sequence: Synthetic oligonucleotide
ctaccaggtgcaggacgacttcaacctc

SEQ ID NO: 294414 - DNA, 28 bp, Artificial Sequence
  Description of Artificial Sequence: Synthetic oligonucleotide
taccaggtgcaggacgacttcaacctcc

SEQ ID NO: 294415 - DNA, 27 bp, Artificial Sequence
  Description of Artificial Sequence: Synthetic oligonucleotide
accaggtgcaggacgacttcaacctcc

SEQ ID NO: 294416 - DNA, 27 bp, Artificial Sequence
  Description of Artificial Sequence: Synthetic oligonucleotide
ccaggtgcaggacgacttcaacctcct

SEQ ID NO: 294417 - DNA, 27 bp, Artificial Sequence
  Description of Artificial Sequence: Synthetic oligonucleotide
caggtgcaggacgacttcaacctcctg

SEQ ID NO: 294418 - DNA, 27 bp, Artificial Sequence
  Description of Artificial Sequence: Synthetic oligonucleotide
aggtgcaggacgacttcaacctcctgc

SEQ ID NO: 294419 - DNA, 26 bp, Artificial Sequence
  Description of Artificial Sequence: Synthetic oligonucleotide
ggtgcaggacgacttcaacctcctgc

SEQ ID NO: 294420 - DNA, 27 bp, Artificial Sequence
  Description of Artificial Sequence: Synthetic oligonucleotide
gtgcaggacgacttcaacctcctgcca

SEQ ID NO: 294421 - DNA, 27 bp, Artificial Sequence
  Description of Artificial Sequence: Synthetic oligonucleotide
tgcaggacgacttcaacctcctgccag

SEQ ID NO: 294422 - DNA, 27 bp, Artificial Sequence
  Description of Artificial Sequence: Synthetic oligonucleotide
gcaggacgacttcaacctcctgccaga

SEQ ID NO: 294423 - DNA, 28 bp, Artificial Sequence
  Description of Artificial Sequence: Synthetic oligonucleotide
caggacgacttcaacctcctgccagatc

SEQ ID NO: 294424 - DNA, 29 bp, Artificial Sequence
  Description of Artificial Sequence: Synthetic oligonucleotide
aggacgacttcaacctcctgccagatctc

SEQ ID NO: 294425 - DNA, 28 bp, Artificial Sequence
  Description of Artificial Sequence: Synthetic oligonucleotide
ggacgacttcaacctcctgccagatctc

SEQ ID NO: 294426 - DNA, 29 bp, Artificial Sequence
  Description of Artificial Sequence: Synthetic oligonucleotide
gacgacttcaacctcctgccagatctcag

SEQ ID NO: 294427 - DNA, 29 bp, Artificial Sequence
  Description of Artificial Sequence: Synthetic oligonucleotide
acgacttcaacctcctgccagatctcagc

SEQ ID NO: 294428 - DNA, 28 bp, Artificial Sequence
  Description of Artificial Sequence: Synthetic oligonucleotide
cgacttcaacctcctgccagatctcagc

SEQ ID NO: 294429 - DNA, 28 bp, Artificial Sequence
  Description of Artificial Sequence: Synthetic oligonucleotide
gacttcaacctcctgccagatctcagcc

SEQ ID NO: 294430 - DNA, 29 bp, Artificial Sequence
  Description of Artificial Sequence: Synthetic oligonucleotide
acttcaacctcctgccagatctcagcctg

SEQ ID NO: 294431 - DNA, 28 bp, Artificial Sequence
  Description of Artificial Sequence: Synthetic oligonucleotide
cttcaacctcctgccagatctcagcctg

SEQ ID NO: 294432 - DNA, 28 bp, Artificial Sequence
  Description of Artificial Sequence: Synthetic oligonucleotide
ttcaacctcctgccagatctcagcctgc

SEQ ID NO: 294433 - DNA, 27 bp, Artificial Sequence
  Description of Artificial Sequence: Synthetic oligonucleotide
tcaacctcctgccagatctcagcctgc

SEQ ID NO: 294434 - DNA, 27 bp, Artificial Sequence
  Description of Artificial Sequence: Synthetic oligonucleotide
caacctcctgccagatctcagcctgct

SEQ ID NO: 294435 - DNA, 27 bp, Artificial Sequence
  Description of Artificial Sequence: Synthetic oligonucleotide
aacctcctgccagatctcagcctgctg

SEQ ID NO: 294436 - DNA, 26 bp, Artificial Sequence
  Description of Artificial Sequence: Synthetic oligonucleotide
acctcctgccagatctcagcctgctg

SEQ ID NO: 294437 - DNA, 25 bp, Artificial Sequence
  Description of Artificial Sequence: Synthetic oligonucleotide
cctcctgccagatctcagcctgctg

SEQ ID NO: 294438 - DNA, 26 bp, Artificial Sequence
  Description of Artificial Sequence: Synthetic oligonucleotide
ctcctgccagatctcagcctgctgga

SEQ ID NO: 294439 - DNA, 27 bp, Artificial Sequence
  Description of Artificial Sequence: Synthetic oligonucleotide
tcctgccagatctcagcctgctggagt

SEQ ID NO: 294440 - DNA, 27 bp, Artificial Sequence
  Description of Artificial Sequence: Synthetic oligonucleotide
cctgccagatctcagcctgctggagtt

SEQ ID NO: 294441 - DNA, 27 bp, Artificial Sequence
  Description of Artificial Sequence: Synthetic oligonucleotide
ctgccagatctcagcctgctggagttc

SEQ ID NO: 294442 - DNA, 27 bp, Artificial Sequence
  Description of Artificial Sequence: Synthetic oligonucleotide
tgccagatctcagcctgctggagttcg

SEQ ID NO: 294443 - DNA, 27 bp, Artificial Sequence
  Description of Artificial Sequence: Synthetic oligonucleotide
gccagatctcagcctgctggagttcgt

SEQ ID NO: 294444 - DNA, 27 bp, Artificial Sequence
  Description of Artificial Sequence: Synthetic oligonucleotide
ccagatctcagcctgctggagttcgtg

SEQ ID NO: 294445 - DNA, 29 bp, Artificial Sequence
  Description of Artificial Sequence: Synthetic oligonucleotide
cagatctcagcctgctggagttcgtgaag

SEQ ID NO: 294446 - DNA, 29 bp, Artificial Sequence
  Description of Artificial Sequence: Synthetic oligonucleotide
agatctcagcctgctggagttcgtgaagg

SEQ ID NO: 294447 - DNA, 28 bp, Artificial Sequence
  Description of Artificial Sequence: Synthetic oligonucleotide
gatctcagcctgctggagttcgtgaagg

SEQ ID NO: 294448 - DNA, 28 bp, Artificial Sequence
  Description of Artificial Sequence: Synthetic oligonucleotide
atctcagcctgctggagttcgtgaaggc

SEQ ID NO: 294449 - DNA, 27 bp, Artificial Sequence
  Description of Artificial Sequence: Synthetic oligonucleotide
tctcagcctgctggagttcgtgaaggc

SEQ ID NO: 294450 - DNA, 26 bp, Artificial Sequence
  Description of Artificial Sequence: Synthetic oligonucleotide
ctcagcctgctggagttcgtgaaggc

SEQ ID NO: 294451 - DNA, 27 bp, Artificial Sequence
  Description of Artificial Sequence: Synthetic oligonucleotide
tcagcctgctggagttcgtgaaggcct

SEQ ID NO: 294452 - DNA, 27 bp, Artificial Sequence
  Description of Artificial Sequence: Synthetic oligonucleotide
cagcctgctggagttcgtgaaggcctt

SEQ ID NO: 294453 - DNA, 30 bp, Artificial Sequence
  Description of Artificial Sequence: Synthetic oligonucleotide
agcctgctggagttcgtgaaggcctttaac

SEQ ID NO: 294454 - DNA, 29 bp, Artificial Sequence
  Description of Artificial Sequence: Synthetic oligonucleotide
gcctgctggagttcgtgaaggcctttaac

SEQ ID NO: 294455 - DNA, 29 bp, Artificial Sequence
  Description of Artificial Sequence: Synthetic oligonucleotide
cctgctggagttcgtgaaggcctttaacc

SEQ ID NO: 294456 - DNA, 30 bp, Artificial Sequence
  Description of Artificial Sequence: Synthetic oligonucleotide
ctgctggagttcgtgaaggcctttaacctg

SEQ ID NO: 294457 - DNA, 32 bp, Artificial Sequence
  Description of Artificial Sequence: Synthetic oligonucleotide
tgctggagttcgtgaaggcctttaacctgaag

SEQ ID NO: 294458 - DNA, 31 bp, Artificial Sequence
  Description of Artificial Sequence: Synthetic oligonucleotide
gctggagttcgtgaaggcctttaacctgaag

SEQ ID NO: 294459 - DNA, 32 bp, Artificial Sequence
  Description of Artificial Sequence: Synthetic oligonucleotide
ctggagttcgtgaaggcctttaacctgaagag

SEQ ID NO: 294460 - DNA, 32 bp, Artificial Sequence
  Description of Artificial Sequence: Synthetic oligonucleotide
tggagttcgtgaaggcctttaacctgaagagc

SEQ ID NO: 294461 - DNA, 31 bp, Artificial Sequence
  Description of Artificial Sequence: Synthetic oligonucleotide
ggagttcgtgaaggcctttaacctgaagagc

SEQ ID NO: 294462 - DNA, 34 bp, Artificial Sequence
  Description of Artificial Sequence: Synthetic oligonucleotide
gagttcgtgaaggcctttaacctgaagagcaatg

SEQ ID NO: 294463 - DNA, 35 bp, Artificial Sequence
  Description of Artificial Sequence: Synthetic oligonucleotide
agttcgtgaaggcctttaacctgaagagcaatgac

SEQ ID NO: 294464 - DNA, 34 bp, Artificial Sequence
  Description of Artificial Sequence: Synthetic oligonucleotide
gttcgtgaaggcctttaacctgaagagcaatgac

SEQ ID NO: 294465 - DNA, 34 bp, Artificial Sequence
  Description of Artificial Sequence: Synthetic oligonucleotide
ttcgtgaaggcctttaacctgaagagcaatgacc

SEQ ID NO: 294466 - DNA, 33 bp, Artificial Sequence
  Description of Artificial Sequence: Synthetic oligonucleotide
tcgtgaaggcctttaacctgaagagcaatgacc

SEQ ID NO: 294467 - DNA, 32 bp, Artificial Sequence
  Description of Artificial Sequence: Synthetic oligonucleotide
cgtgaaggcctttaacctgaagagcaatgacc

SEQ ID NO: 294468 - DNA, 33 bp, Artificial Sequence
  Description of Artificial Sequence: Synthetic oligonucleotide
gtgaaggcctttaacctgaagagcaatgaccac

SEQ ID NO: 294469 - DNA, 35 bp, Artificial Sequence
  Description of Artificial Sequence: Synthetic oligonucleotide
tgaaggcctttaacctgaagagcaatgaccacatg

SEQ ID NO: 294470 - DNA, 34 bp, Artificial Sequence
  Description of Artificial Sequence: Synthetic oligonucleotide
gaaggcctttaacctgaagagcaatgaccacatg

SEQ ID NO: 294471 - DNA, 34 bp, Artificial Sequence
  Description of Artificial Sequence: Synthetic oligonucleotide
aaggcctttaacctgaagagcaatgaccacatgg

SEQ ID NO: 294472 - DNA, 33 bp, Artificial Sequence
  Description of Artificial Sequence: Synthetic oligonucleotide
aggcctttaacctgaagagcaatgaccacatgg

SEQ ID NO: 294473 - DNA, 32 bp, Artificial Sequence
  Description of Artificial Sequence: Synthetic oligonucleotide
ggcctttaacctgaagagcaatgaccacatgg

SEQ ID NO: 294474 - DNA, 33 bp, Artificial Sequence
  Description of Artificial Sequence: Synthetic oligonucleotide
gcctttaacctgaagagcaatgaccacatggtg

SEQ ID NO: 294475 - DNA, 33 bp, Artificial Sequence
  Description of Artificial Sequence: Synthetic oligonucleotide
cctttaacctgaagagcaatgaccacatggtgg

SEQ ID NO: 294476 - DNA, 35 bp, Artificial Sequence
  Description of Artificial Sequence: Synthetic oligonucleotide
ctttaacctgaagagcaatgaccacatggtggtac

SEQ ID NO: 294477 - DNA, 36 bp, Artificial Sequence
  Description of Artificial Sequence: Synthetic oligonucleotide
tttaacctgaagagcaatgaccacatggtggtactg

SEQ ID NO: 294478 - DNA, 35 bp, Artificial Sequence
  Description of Artificial Sequence: Synthetic oligonucleotide
ttaacctgaagagcaatgaccacatggtggtactg

SEQ ID NO: 294479 - DNA, 34 bp, Artificial Sequence
  Description of Artificial Sequence: Synthetic oligonucleotide
taacctgaagagcaatgaccacatggtggtactg

SEQ ID NO: 294480 - DNA, 33 bp, Artificial Sequence
  Description of Artificial Sequence: Synthetic oligonucleotide
aacctgaagagcaatgaccacatggtggtactg

SEQ ID NO: 294481 - DNA, 32 bp, Artificial Sequence
  Description of Artificial Sequence: Synthetic oligonucleotide
acctgaagagcaatgaccacatggtggtactg

SEQ ID NO: 294482 - DNA, 31 bp, Artificial Sequence
  Description of Artificial Sequence: Synthetic oligonucleotide
cctgaagagcaatgaccacatggtggtactg

SEQ ID NO: 294483 - DNA, 33 bp, Artificial Sequence
  Description of Artificial Sequence: Synthetic oligonucleotide
ctgaagagcaatgaccacatggtggtactgtac

SEQ ID NO: 294484 - DNA, 35 bp, Artificial Sequence
  Description of Artificial Sequence: Synthetic oligonucleotide
tgaagagcaatgaccacatggtggtactgtacttg

SEQ ID NO: 294485 - DNA, 34 bp, Artificial Sequence
  Description of Artificial Sequence: Synthetic oligonucleotide
gaagagcaatgaccacatggtggtactgtacttg

SEQ ID NO: 294486 - DNA, 34 bp, Artificial Sequence
  Description of Artificial Sequence: Synthetic oligonucleotide
aagagcaatgaccacatggtggtactgtacttgg

SEQ ID NO: 294487 - DNA, 33 bp, Artificial Sequence
  Description of Artificial Sequence: Synthetic oligonucleotide
agagcaatgaccacatggtggtactgtacttgg

SEQ ID NO: 294488 - DNA, 32 bp, Artificial Sequence
  Description of Artificial Sequence: Synthetic oligonucleotide
gagcaatgaccacatggtggtactgtacttgg

SEQ ID NO: 294489 - DNA, 32 bp, Artificial Sequence
  Description of Artificial Sequence: Synthetic oligonucleotide
agcaatgaccacatggtggtactgtacttggg

SEQ ID NO: 294490 - DNA, 31 bp, Artificial Sequence
  Description of Artificial Sequence: Synthetic oligonucleotide
gcaatgaccacatggtggtactgtacttggg

SEQ ID NO: 294491 - DNA, 31 bp, Artificial Sequence
  Description of Artificial Sequence: Synthetic oligonucleotide
caatgaccacatggtggtactgtacttgggc

SEQ ID NO: 294492 - DNA, 32 bp, Artificial Sequence
  Description of Artificial Sequence: Synthetic oligonucleotide
aatgaccacatggtggtactgtacttgggctc

SEQ ID NO: 294493 - DNA, 31 bp, Artificial Sequence
  Description of Artificial Sequence: Synthetic oligonucleotide
atgaccacatggtggtactgtacttgggctc

SEQ ID NO: 294494 - DNA, 30 bp, Artificial Sequence
  Description of Artificial Sequence: Synthetic oligonucleotide
tgaccacatggtggtactgtacttgggctc

SEQ ID NO: 294495 - DNA, 29 bp, Artificial Sequence
  Description of Artificial Sequence: Synthetic oligonucleotide
gaccacatggtggtactgtacttgggctc

SEQ ID NO: 294496 - DNA, 29 bp, Artificial Sequence
  Description of Artificial Sequence: Synthetic oligonucleotide
accacatggtggtactgtacttgggctcg

SEQ ID NO: 294497 - DNA, 28 bp, Artificial Sequence
  Description of Artificial Sequence: Synthetic oligonucleotide
ccacatggtggtactgtacttgggctcg

SEQ ID NO: 294498 - DNA, 28 bp, Artificial Sequence
  Description of Artificial Sequence: Synthetic oligonucleotide
cacatggtggtactgtacttgggctcgc

SEQ ID NO: 294499 - DNA, 29 bp, Artificial Sequence
  Description of Artificial Sequence: Synthetic oligonucleotide
acatggtggtactgtacttgggctcgctg

SEQ ID NO: 294500 - DNA, 28 bp, Artificial Sequence
  Description of Artificial Sequence: Synthetic oligonucleotide
catggtggtactgtacttgggctcgctg

SEQ ID NO: 294501 - DNA, 30 bp, Artificial Sequence
  Description of Artificial Sequence: Synthetic oligonucleotide
atggtggtactgtacttgggctcgctgatg

SEQ ID NO: 294502 - DNA, 29 bp, Artificial Sequence
  Description of Artificial Sequence: Synthetic oligonucleotide
tggtggtactgtacttgggctcgctgatg

SEQ ID NO: 294503 - DNA, 28 bp, Artificial Sequence
  Description of Artificial Sequence: Synthetic oligonucleotide
ggtggtactgtacttgggctcgctgatg

SEQ ID NO: 294504 - DNA, 28 bp, Artificial Sequence
  Description of Artificial Sequence: Synthetic oligonucleotide
gtggtactgtacttgggctcgctgatgc

SEQ ID NO: 294505 - DNA, 28 bp, Artificial Sequence
  Description of Artificial Sequence: Synthetic oligonucleotide
tggtactgtacttgggctcgctgatgcg

SEQ ID NO: 294506 - DNA, 27 bp, Artificial Sequence
  Description of Artificial Sequence: Synthetic oligonucleotide
ggtactgtacttgggctcgctgatgcg

SEQ ID NO: 294507 - DNA, 29 bp, Artificial Sequence
  Description of Artificial Sequence: Synthetic oligonucleotide
gtactgtacttgggctcgctgatgcgttc

SEQ ID NO: 294508 - DNA, 29 bp, Artificial Sequence
  Description of Artificial Sequence: Synthetic oligonucleotide
tactgtacttgggctcgctgatgcgttcc

SEQ ID NO: 294509 - DNA, 28 bp, Artificial Sequence
  Description of Artificial Sequence: Synthetic oligonucleotide
actgtacttgggctcgctgatgcgttcc

SEQ ID NO: 294510 - DNA, 27 bp, Artificial Sequence
  Description of Artificial Sequence: Synthetic oligonucleotide
ctgtacttgggctcgctgatgcgttcc

SEQ ID NO: 294511 - DNA, 27 bp, Artificial Sequence
  Description of Artificial Sequence: Synthetic oligonucleotide
tgtacttgggctcgctgatgcgttccg

SEQ ID NO: 294512 - DNA, 27 bp, Artificial Sequence
  Description of Artificial Sequence: Synthetic oligonucleotide
gtacttgggctcgctgatgcgttccgt

SEQ ID NO: 294513 - DNA, 27 bp, Artificial Sequence
  Description of Artificial Sequence: Synthetic oligonucleotide
tacttgggctcgctgatgcgttccgtg

SEQ ID NO: 294514 - DNA, 26 bp, Artificial Sequence
  Description of Artificial Sequence: Synthetic oligonucleotide
acttgggctcgctgatgcgttccgtg

SEQ ID NO: 294515 - DNA, 25 bp, Artificial Sequence
  Description of Artificial Sequence: Synthetic oligonucleotide
cttgggctcgctgatgcgttccgtg

SEQ ID NO: 294516 - DNA, 26 bp, Artificial Sequence
  Description of Artificial Sequence: Synthetic oligonucleotide
ttgggctcgctgatgcgttccgtgct

SEQ ID NO: 294517 - DNA, 25 bp, Artificial Sequence
  Description of Artificial Sequence: Synthetic oligonucleotide
tgggctcgctgatgcgttccgtgct

SEQ ID NO: 294518 - DNA, 24 bp, Artificial Sequence
  Description of Artificial Sequence: Synthetic oligonucleotide
gggctcgctgatgcgttccgtgct

SEQ ID NO: 294519 - DNA, 24 bp, Artificial Sequence
  Description of Artificial Sequence: Synthetic oligonucleotide
ggctcgctgatgcgttccgtgctc

SEQ ID NO: 294520 - DNA, 24 bp, Artificial Sequence
  Description of Artificial Sequence: Synthetic oligonucleotide
gctcgctgatgcgttccgtgctcg

SEQ ID NO: 294521 - DNA, 24 bp, Artificial Sequence
  Description of Artificial Sequence: Synthetic oligonucleotide
ctcgctgatgcgttccgtgctcgc

SEQ ID NO: 294522 - DNA, 24 bp, Artificial Sequence
  Description of Artificial Sequence: Synthetic oligonucleotide
tcgctgatgcgttccgtgctcgcc

SEQ ID NO: 294523 - DNA, 23 bp, Artificial Sequence
  Description of Artificial Sequence: Synthetic oligonucleotide
cgctgatgcgttccgtgctcgcc

SEQ ID NO: 294524 - DNA, 24 bp, Artificial Sequence
  Description of Artificial Sequence: Synthetic oligonucleotide
gctgatgcgttccgtgctcgccct

SEQ ID NO: 294525 - DNA, 24 bp, Artificial Sequence
  Description of Artificial Sequence: Synthetic oligonucleotide
ctgatgcgttccgtgctcgccctg

SEQ ID NO: 294526 - DNA, 25 bp, Artificial Sequence
  Description of Artificial Sequence: Synthetic oligonucleotide
tgatgcgttccgtgctcgccctgct

SEQ ID NO: 294527 - DNA, 24 bp, Artificial Sequence
  Description of Artificial Sequence: Synthetic oligonucleotide
gatgcgttccgtgctcgccctgct

SEQ ID NO: 294528 - DNA, 26 bp, Artificial Sequence
  Description of Artificial Sequence: Synthetic oligonucleotide
atgcgttccgtgctcgccctgctcaa

SEQ ID NO: 294529 - DNA, 25 bp, Artificial Sequence
  Description of Artificial Sequence: Synthetic oligonucleotide
tgcgttccgtgctcgccctgctcaa

SEQ ID NO: 294530 - DNA, 24 bp, Artificial Sequence
  Description of Artificial Sequence: Synthetic oligonucleotide
gcgttccgtgctcgccctgctcaa

SEQ ID NO: 294531 - DNA, 24 bp, Artificial Sequence
  Description of Artificial Sequence: Synthetic oligonucleotide
cgttccgtgctcgccctgctcaac

SEQ ID NO: 294532 - DNA, 25 bp, Artificial Sequence
  Description of Artificial Sequence: Synthetic oligonucleotide
gttccgtgctcgccctgctcaacct

SEQ ID NO: 294533 - DNA, 27 bp, Artificial Sequence
  Description of Artificial Sequence: Synthetic oligonucleotide
ttccgtgctcgccctgctcaacctcat

SEQ ID NO: 294534 - DNA, 26 bp, Artificial Sequence
  Description of Artificial Sequence: Synthetic oligonucleotide
tccgtgctcgccctgctcaacctcat

SEQ ID NO: 294535 - DNA, 25 bp, Artificial Sequence
  Description of Artificial Sequence: Synthetic oligonucleotide
ccgtgctcgccctgctcaacctcat

SEQ ID NO: 294536 - DNA, 27 bp, Artificial Sequence
  Description of Artificial Sequence: Synthetic oligonucleotide
cgtgctcgccctgctcaacctcatgaa

SEQ ID NO: 294537 - DNA, 27 bp, Artificial Sequence
  Description of Artificial Sequence: Synthetic oligonucleotide
gtgctcgccctgctcaacctcatgaac

SEQ ID NO: 294538 - DNA, 29 bp, Artificial Sequence
  Description of Artificial Sequence: Synthetic oligonucleotide
tgctcgccctgctcaacctcatgaacaac

SEQ ID NO: 294539 - DNA, 28 bp, Artificial Sequence
  Description of Artificial Sequence: Synthetic oligonucleotide
gctcgccctgctcaacctcatgaacaac

SEQ ID NO: 294540 - DNA, 30 bp, Artificial Sequence
  Description of Artificial Sequence: Synthetic oligonucleotide
ctcgccctgctcaacctcatgaacaacaag

SEQ ID NO: 294541 - DNA, 33 bp, Artificial Sequence
  Description of Artificial Sequence: Synthetic oligonucleotide
tcgccctgctcaacctcatgaacaacaagtttg

SEQ ID NO: 294542 - DNA, 32 bp, Artificial Sequence
  Description of Artificial Sequence: Synthetic oligonucleotide
cgccctgctcaacctcatgaacaacaagtttg

SEQ ID NO: 294543 - DNA, 32 bp, Artificial Sequence
  Description of Artificial Sequence: Synthetic oligonucleotide
gccctgctcaacctcatgaacaacaagtttgc

SEQ ID NO: 294544 - DNA, 32 bp, Artificial Sequence
  Description of Artificial Sequence: Synthetic oligonucleotide
ccctgctcaacctcatgaacaacaagtttgcc

SEQ ID NO: 294545 - DNA, 34 bp, Artificial Sequence
  Description of Artificial Sequence: Synthetic oligonucleotide
cctgctcaacctcatgaacaacaagtttgccaac

SEQ ID NO: 294546 - DNA, 34 bp, Artificial Sequence
  Description of Artificial Sequence: Synthetic oligonucleotide
ctgctcaacctcatgaacaacaagtttgccaacc

SEQ ID NO: 294547 - DNA, 34 bp, Artificial Sequence
  Description of Artificial Sequence: Synthetic oligonucleotide
tgctcaacctcatgaacaacaagtttgccaaccc

SEQ ID NO: 294548 - DNA, 33 bp, Artificial Sequence
  Description of Artificial Sequence: Synthetic oligonucleotide
gctcaacctcatgaacaacaagtttgccaaccc

SEQ ID NO: 294549 - DNA, 33 bp, Artificial Sequence
  Description of Artificial Sequence: Synthetic oligonucleotide
ctcaacctcatgaacaacaagtttgccaacccg

SEQ ID NO: 294550 - DNA, 33 bp, Artificial Sequence
  Description of Artificial Sequence: Synthetic oligonucleotide
tcaacctcatgaacaacaagtttgccaacccgg

SEQ ID NO: 294551 - DNA, 32 bp, Artificial Sequence
  Description of Artificial Sequence: Synthetic oligonucleotide
caacctcatgaacaacaagtttgccaacccgg

SEQ ID NO: 294552 - DNA, 34 bp, Artificial Sequence
  Description of Artificial Sequence: Synthetic oligonucleotide
aacctcatgaacaacaagtttgccaacccggatg

SEQ ID NO: 294553 - DNA, 33 bp, Artificial Sequence
  Description of Artificial Sequence: Synthetic oligonucleotide
acctcatgaacaacaagtttgccaacccggatg

SEQ ID NO: 294554 - DNA, 32 bp, Artificial Sequence
  Description of Artificial Sequence: Synthetic oligonucleotide
cctcatgaacaacaagtttgccaacccggatg

SEQ ID NO: 294555 - DNA, 32 bp, Artificial Sequence
  Description of Artificial Sequence: Synthetic oligonucleotide
ctcatgaacaacaagtttgccaacccggatgc

SEQ ID NO: 294556 - DNA, 33 bp, Artificial Sequence
  Description of Artificial Sequence: Synthetic oligonucleotide
tcatgaacaacaagtttgccaacccggatgcag

SEQ ID NO: 294557 - DNA, 32 bp, Artificial Sequence
  Description of Artificial Sequence: Synthetic oligonucleotide
catgaacaacaagtttgccaacccggatgcag

SEQ ID NO: 294558 - DNA, 33 bp, Artificial Sequence
  Description of Artificial Sequence: Synthetic oligonucleotide
atgaacaacaagtttgccaacccggatgcagac

SEQ ID NO: 294559 - DNA, 32 bp, Artificial Sequence
  Description of Artificial Sequence: Synthetic oligonucleotide
tgaacaacaagtttgccaacccggatgcagac

SEQ ID NO: 294560 - DNA, 31 bp, Artificial Sequence
  Description of Artificial Sequence: Synthetic oligonucleotide
gaacaacaagtttgccaacccggatgcagac

SEQ ID NO: 294561 - DNA, 33 bp, Artificial Sequence
  Description of Artificial Sequence: Synthetic oligonucleotide
aacaacaagtttgccaacccggatgcagacaag

SEQ ID NO: 294562 - DNA, 32 bp, Artificial Sequence
  Description of Artificial Sequence: Synthetic oligonucleotide
acaacaagtttgccaacccggatgcagacaag

SEQ ID NO: 294563 - DNA, 31 bp, Artificial Sequence
  Description of Artificial Sequence: Synthetic oligonucleotide
caacaagtttgccaacccggatgcagacaag

SEQ ID NO: 294564 - DNA, 34 bp, Artificial Sequence
  Description of Artificial Sequence: Synthetic oligonucleotide
aacaagtttgccaacccggatgcagacaagaaag

SEQ ID NO: 294565 - DNA, 33 bp, Artificial Sequence
  Description of Artificial Sequence: Synthetic oligonucleotide
acaagtttgccaacccggatgcagacaagaaag

SEQ ID NO: 294566 - DNA, 32 bp, Artificial Sequence
  Description of Artificial Sequence: Synthetic oligonucleotide
caagtttgccaacccggatgcagacaagaaag

SEQ ID NO: 294567 - DNA, 34 bp, Artificial Sequence
  Description of Artificial Sequence: Synthetic oligonucleotide
aagtttgccaacccggatgcagacaagaaagaac

SEQ ID NO: 294568 - DNA, 33 bp, Artificial Sequence
  Description of Artificial Sequence: Synthetic oligonucleotide
agtttgccaacccggatgcagacaagaaagaac

SEQ ID NO: 294569 - DNA, 32 bp, Artificial Sequence
  Description of Artificial Sequence: Synthetic oligonucleotide
gtttgccaacccggatgcagacaagaaagaac

SEQ ID NO: 294570 - DNA, 32 bp, Artificial Sequence
  Description of Artificial Sequence: Synthetic oligonucleotide
tttgccaacccggatgcagacaagaaagaacg

SEQ ID NO: 294571 - DNA, 31 bp, Artificial Sequence
  Description of Artificial Sequence: Synthetic oligonucleotide
ttgccaacccggatgcagacaagaaagaacg

SEQ ID NO: 294572 - DNA, 30 bp, Artificial Sequence
  Description of Artificial Sequence: Synthetic oligonucleotide
tgccaacccggatgcagacaagaaagaacg

SEQ ID NO: 294573 - DNA, 29 bp, Artificial Sequence
  Description of Artificial Sequence: Synthetic oligonucleotide
gccaacccggatgcagacaagaaagaacg

SEQ ID NO: 294574 - DNA, 29 bp, Artificial Sequence
  Description of Artificial Sequence: Synthetic oligonucleotide
ccaacccggatgcagacaagaaagaacgg

SEQ ID NO: 294575 - DNA, 29 bp, Artificial Sequence
  Description of Artificial Sequence: Synthetic oligonucleotide
caacccggatgcagacaagaaagaacggc

SEQ ID NO: 294576 - DNA, 30 bp, Artificial Sequence
  Description of Artificial Sequence: Synthetic oligonucleotide
aacccggatgcagacaagaaagaacggcag

SEQ ID NO: 294577 - DNA, 29 bp, Artificial Sequence
  Description of Artificial Sequence: Synthetic oligonucleotide
acccggatgcagacaagaaagaacggcag

SEQ ID NO: 294578 - DNA, 28 bp, Artificial Sequence
  Description of Artificial Sequence: Synthetic oligonucleotide
cccggatgcagacaagaaagaacggcag

SEQ ID NO: 294579 - DNA, 28 bp, Artificial Sequence
  Description of Artificial Sequence: Synthetic oligonucleotide
ccggatgcagacaagaaagaacggcagg

SEQ ID NO: 294580 - DNA, 29 bp, Artificial Sequence
  Description of Artificial Sequence: Synthetic oligonucleotide
cggatgcagacaagaaagaacggcaggag

SEQ ID NO: 294581 - DNA, 32 bp, Artificial Sequence
  Description of Artificial Sequence: Synthetic oligonucleotide
ggatgcagacaagaaagaacggcaggagatag

SEQ ID NO: 294582 - DNA, 34 bp, Artificial Sequence
  Description of Artificial Sequence: Synthetic oligonucleotide
gatgcagacaagaaagaacggcaggagatagaag

SEQ ID NO: 294583 - DNA, 35 bp, Artificial Sequence
  Description of Artificial Sequence: Synthetic oligonucleotide
atgcagacaagaaagaacggcaggagatagaagag

SEQ ID NO: 294584 - DNA, 34 bp, Artificial Sequence
  Description of Artificial Sequence: Synthetic oligonucleotide
tgcagacaagaaagaacggcaggagatagaagag

SEQ ID NO: 294585 - DNA, 33 bp, Artificial Sequence
  Description of Artificial Sequence: Synthetic oligonucleotide
gcagacaagaaagaacggcaggagatagaagag

SEQ ID NO: 294586 - DNA, 34 bp, Artificial Sequence
  Description of Artificial Sequence: Synthetic oligonucleotide
cagacaagaaagaacggcaggagatagaagagag

SEQ ID NO: 294587 - DNA, 34 bp, Artificial Sequence
  Description of Artificial Sequence: Synthetic oligonucleotide
agacaagaaagaacggcaggagatagaagagagg

SEQ ID NO: 294588 - DNA, 33 bp, Artificial Sequence
  Description of Artificial Sequence: Synthetic oligonucleotide
gacaagaaagaacggcaggagatagaagagagg

SEQ ID NO: 294589 - DNA, 38 bp, Artificial Sequence
  Description of Artificial Sequence: Synthetic oligonucleotide
acaagaaagaacggcaggagatagaagagaggaaaaag

SEQ ID NO: 294590 - DNA, 37 bp, Artificial Sequence
  Description of Artificial Sequence: Synthetic oligonucleotide
caagaaagaacggcaggagatagaagagaggaaaaag

SEQ ID NO: 294591 - DNA, 37 bp, Artificial Sequence
  Description of Artificial Sequence: Synthetic oligonucleotide
aagaaagaacggcaggagatagaagagaggaaaaagg

SEQ ID NO: 294592 - DNA, 36 bp, Artificial Sequence
  Description of Artificial Sequence: Synthetic oligonucleotide
agaaagaacggcaggagatagaagagaggaaaaagg

SEQ ID NO: 294593 - DNA, 35 bp, Artificial Sequence
  Description of Artificial Sequence: Synthetic oligonucleotide
gaaagaacggcaggagatagaagagaggaaaaagg

SEQ ID NO: 294594 - DNA, 38 bp, Artificial Sequence
  Description of Artificial Sequence: Synthetic oligonucleotide
aaagaacggcaggagatagaagagaggaaaaaggattg

SEQ ID NO: 294595 - DNA, 37 bp, Artificial Sequence
  Description of Artificial Sequence: Synthetic oligonucleotide
aagaacggcaggagatagaagagaggaaaaaggattg

SEQ ID NO: 294596 - DNA, 36 bp, Artificial Sequence
  Description of Artificial Sequence: Synthetic oligonucleotide
agaacggcaggagatagaagagaggaaaaaggattg

SEQ ID NO: 294597 - DNA, 35 bp, Artificial Sequence
  Description of Artificial Sequence: Synthetic oligonucleotide
gaacggcaggagatagaagagaggaaaaaggattg

SEQ ID NO: 294598 - DNA, 35 bp, Artificial Sequence
  Description of Artificial Sequence: Synthetic oligonucleotide
aacggcaggagatagaagagaggaaaaaggattgg

SEQ ID NO: 294599 - DNA, 34 bp, Artificial Sequence
  Description of Artificial Sequence: Synthetic oligonucleotide
acggcaggagatagaagagaggaaaaaggattgg

SEQ ID NO: 294600 - DNA, 33 bp, Artificial Sequence
  Description of Artificial Sequence: Synthetic oligonucleotide
cggcaggagatagaagagaggaaaaaggattgg

SEQ ID NO: 294601 - DNA, 36 bp, Artificial Sequence
  Description of Artificial Sequence: Synthetic oligonucleotide
ggcaggagatagaagagaggaaaaaggattggaaag

SEQ ID NO: 294602 - DNA, 37 bp, Artificial Sequence
  Description of Artificial Sequence: Synthetic oligonucleotide
gcaggagatagaagagaggaaaaaggattggaaagag

SEQ ID NO: 294603 - DNA, 37 bp, Artificial Sequence
  Description of Artificial Sequence: Synthetic oligonucleotide
caggagatagaagagaggaaaaaggattggaaagagg

SEQ ID NO: 294604 - DNA, 38 bp, Artificial Sequence
  Description of Artificial Sequence: Synthetic oligonucleotide
aggagatagaagagaggaaaaaggattggaaagaggtc

SEQ ID NO: 294605 - DNA, 37 bp, Artificial Sequence
  Description of Artificial Sequence: Synthetic oligonucleotide
ggagatagaagagaggaaaaaggattggaaagaggtc

SEQ ID NO: 294606 - DNA, 39 bp, Artificial Sequence
  Description of Artificial Sequence: Synthetic oligonucleotide
gagatagaagagaggaaaaaggattggaaagaggtcaag

SEQ ID NO: 294607 - DNA, 39 bp, Artificial Sequence
  Description of Artificial Sequence: Synthetic oligonucleotide
agatagaagagaggaaaaaggattggaaagaggtcaagg

SEQ ID NO: 294608 - DNA, 38 bp, Artificial Sequence
  Description of Artificial Sequence: Synthetic oligonucleotide
gatagaagagaggaaaaaggattggaaagaggtcaagg

SEQ ID NO: 294609 - DNA, 39 bp, Artificial Sequence
  Description of Artificial Sequence: Synthetic oligonucleotide
atagaagagaggaaaaaggattggaaagaggtcaaggag

SEQ ID NO: 294610 - DNA, 38 bp, Artificial Sequence
  Description of Artificial Sequence: Synthetic oligonucleotide
tagaagagaggaaaaaggattggaaagaggtcaaggag

SEQ ID NO: 294611 - DNA, 37 bp, Artificial Sequence
  Description of Artificial Sequence: Synthetic oligonucleotide
agaagagaggaaaaaggattggaaagaggtcaaggag

SEQ ID NO: 294612 - DNA, 36 bp, Artificial Sequence
  Description of Artificial Sequence: Synthetic oligonucleotide
gaagagaggaaaaaggattggaaagaggtcaaggag

SEQ ID NO: 294613 - DNA, 39 bp, Artificial Sequence
  Description of Artificial Sequence: Synthetic oligonucleotide
aagagaggaaaaaggattggaaagaggtcaaggagaatg

SEQ ID NO: 294614 - DNA, 38 bp, Artificial Sequence
  Description of Artificial Sequence: Synthetic oligonucleotide
agagaggaaaaaggattggaaagaggtcaaggagaatg

SEQ ID NO: 294615 - DNA, 37 bp, Artificial Sequence
  Description of Artificial Sequence: Synthetic oligonucleotide
gagaggaaaaaggattggaaagaggtcaaggagaatg

SEQ ID NO: 294616 - DNA, 42 bp, Artificial Sequence
  Description of Artificial Sequence: Synthetic oligonucleotide
agaggaaaaaggattggaaagaggtcaaggagaatgataaag

SEQ ID NO: 294617 - DNA, 41 bp, Artificial Sequence
  Description of Artificial Sequence: Synthetic oligonucleotide
gaggaaaaaggattggaaagaggtcaaggagaatgataaag

SEQ ID NO: 294618 - DNA, 45 bp, Artificial Sequence
  Description of Artificial Sequence: Synthetic oligonucleotide
aggaaaaaggattggaaagaggtcaaggagaatgataaagattag

SEQ ID NO: 294619 - DNA, 44 bp, Artificial Sequence
  Description of Artificial Sequence: Synthetic oligonucleotide
ggaaaaaggattggaaagaggtcaaggagaatgataaagattag

SEQ ID NO: 294620 - DNA, 44 bp, Artificial Sequence
  Description of Artificial Sequence: Synthetic oligonucleotide
gaaaaaggattggaaagaggtcaaggagaatgataaagattagg

SEQ ID NO: 294621 - DNA, 48 bp, Artificial Sequence
  Description of Artificial Sequence: Synthetic oligonucleotide
aaaaaggattggaaagaggtcaaggagaatgataaagattaggaaaag

SEQ ID NO: 294622 - DNA, 47 bp, Artificial Sequence
  Description of Artificial Sequence: Synthetic oligonucleotide
aaaaggattggaaagaggtcaaggagaatgataaagattaggaaaag

SEQ ID NO: 294623 - DNA, 46 bp, Artificial Sequence
  Description of Artificial Sequence: Synthetic oligonucleotide
aaaggattggaaagaggtcaaggagaatgataaagattaggaaaag

SEQ ID NO: 294624 - DNA, 45 bp, Artificial Sequence
  Description of Artificial Sequence: Synthetic oligonucleotide
aaggattggaaagaggtcaaggagaatgataaagattaggaaaag

SEQ ID NO: 294625 - DNA, 44 bp, Artificial Sequence
  Description of Artificial Sequence: Synthetic oligonucleotide
aggattggaaagaggtcaaggagaatgataaagattaggaaaag

SEQ ID NO: 294626 - DNA, 43 bp, Artificial Sequence
  Description of Artificial Sequence: Synthetic oligonucleotide
ggattggaaagaggtcaaggagaatgataaagattaggaaaag

SEQ ID NO: 294627 - DNA, 44 bp, Artificial Sequence
  Description of Artificial Sequence: Synthetic oligonucleotide
gattggaaagaggtcaaggagaatgataaagattaggaaaagac

SEQ ID NO: 294628 - DNA, 45 bp, Artificial Sequence
  Description of Artificial Sequence: Synthetic oligonucleotide
attggaaagaggtcaaggagaatgataaagattaggaaaagactg

SEQ ID NO: 294629 - DNA, 44 bp, Artificial Sequence
  Description of Artificial Sequence: Synthetic oligonucleotide
ttggaaagaggtcaaggagaatgataaagattaggaaaagactg

SEQ ID NO: 294630 - DNA, 43 bp, Artificial Sequence
  Description of Artificial Sequence: Synthetic oligonucleotide
tggaaagaggtcaaggagaatgataaagattaggaaaagactg

SEQ ID NO: 294631 - DNA, 42 bp, Artificial Sequence
  Description of Artificial Sequence: Synthetic oligonucleotide
ggaaagaggtcaaggagaatgataaagattaggaaaagactg

SEQ ID NO: 294632 - DNA, 44 bp, Artificial Sequence
  Description of Artificial Sequence: Synthetic oligonucleotide
gaaagaggtcaaggagaatgataaagattaggaaaagactgatg

SEQ ID NO: 294633 - DNA, 48 bp, Artificial Sequence
  Description of Artificial Sequence: Synthetic oligonucleotide
aaagaggtcaaggagaatgataaagattaggaaaagactgatgtaaac

SEQ ID NO: 294634 - DNA, 47 bp, Artificial Sequence
  Description of Artificial Sequence: Synthetic oligonucleotide
aagaggtcaaggagaatgataaagattaggaaaagactgatgtaaac

SEQ ID NO: 294635 - DNA, 46 bp, Artificial Sequence
  Description of Artificial Sequence: Synthetic oligonucleotide
agaggtcaaggagaatgataaagattaggaaaagactgatgtaaac

SEQ ID NO: 294636 - DNA, 45 bp, Artificial Sequence
  Description of Artificial Sequence: Synthetic oligonucleotide
gaggtcaaggagaatgataaagattaggaaaagactgatgtaaac

SEQ ID NO: 294637 - DNA, 48 bp, Artificial Sequence
  Description of Artificial Sequence: Synthetic oligonucleotide
aggtcaaggagaatgataaagattaggaaaagactgatgtaaacaaag

SEQ ID NO: 294638 - DNA, 47 bp, Artificial Sequence
  Description of Artificial Sequence: Synthetic oligonucleotide
ggtcaaggagaatgataaagattaggaaaagactgatgtaaacaaag

SEQ ID NO: 294639 - DNA, 48 bp, Artificial Sequence
  Description of Artificial Sequence: Synthetic oligonucleotide
gtcaaggagaatgataaagattaggaaaagactgatgtaaacaaagag

SEQ ID NO: 294640 - DNA, 48 bp, Artificial Sequence
  Description of Artificial Sequence: Synthetic oligonucleotide
tcaaggagaatgataaagattaggaaaagactgatgtaaacaaagagg

SEQ ID NO: 294641 - DNA, 47 bp, Artificial Sequence
  Description of Artificial Sequence: Synthetic oligonucleotide
caaggagaatgataaagattaggaaaagactgatgtaaacaaagagg

SEQ ID NO: 294642 - DNA, 48 bp, Artificial Sequence
  Description of Artificial Sequence: Synthetic oligonucleotide
aaggagaatgataaagattaggaaaagactgatgtaaacaaagaggag

SEQ ID NO: 294643 - DNA, 47 bp, Artificial Sequence
  Description of Artificial Sequence: Synthetic oligonucleotide
aggagaatgataaagattaggaaaagactgatgtaaacaaagaggag

SEQ ID NO: 294644 - DNA, 46 bp, Artificial Sequence
  Description of Artificial Sequence: Synthetic oligonucleotide
ggagaatgataaagattaggaaaagactgatgtaaacaaagaggag

SEQ ID NO: 294645 - DNA, 51 bp, Artificial Sequence
  Description of Artificial Sequence: Synthetic oligonucleotide
gagaatgataaagattaggaaaagactgatgtaaacaaagaggagtaaaag

SEQ ID NO: 294646 - DNA, 51 bp, Artificial Sequence
  Description of Artificial Sequence: Synthetic oligonucleotide
agaatgataaagattaggaaaagactgatgtaaacaaagaggagtaaaagg

SEQ ID NO: 294647 - DNA, 50 bp, Artificial Sequence
  Description of Artificial Sequence: Synthetic oligonucleotide
gaatgataaagattaggaaaagactgatgtaaacaaagaggagtaaaagg

SEQ ID NO: 294648 - DNA, 51 bp, Artificial Sequence
  Description of Artificial Sequence: Synthetic oligonucleotide
aatgataaagattaggaaaagactgatgtaaacaaagaggagtaaaaggag

SEQ ID NO: 294649 - DNA, 50 bp, Artificial Sequence
  Description of Artificial Sequence: Synthetic oligonucleotide
atgataaagattaggaaaagactgatgtaaacaaagaggagtaaaaggag

SEQ ID NO: 294650 - DNA, 49 bp, Artificial Sequence
  Description of Artificial Sequence: Synthetic oligonucleotide
tgataaagattaggaaaagactgatgtaaacaaagaggagtaaaaggag

SEQ ID NO: 294651 - DNA, 48 bp, Artificial Sequence
  Description of Artificial Sequence: Synthetic oligonucleotide
gataaagattaggaaaagactgatgtaaacaaagaggagtaaaaggag

SEQ ID NO: 294652 - DNA, 53 bp, Artificial Sequence
  Description of Artificial Sequence: Synthetic oligonucleotide
ataaagattaggaaaagactgatgtaaacaaagaggagtaaaaggagataaag

SEQ ID NO: 294653 - DNA, 52 bp, Artificial Sequence
  Description of Artificial Sequence: Synthetic oligonucleotide
taaagattaggaaaagactgatgtaaacaaagaggagtaaaaggagataaag

SEQ ID NO: 294654 - DNA, 51 bp, Artificial Sequence
  Description of Artificial Sequence: Synthetic oligonucleotide
aaagattaggaaaagactgatgtaaacaaagaggagtaaaaggagataaag

SEQ ID NO: 294655 - DNA, 50 bp, Artificial Sequence
  Description of Artificial Sequence: Synthetic oligonucleotide
aagattaggaaaagactgatgtaaacaaagaggagtaaaaggagataaag

SEQ ID NO: 294656 - DNA, 49 bp, Artificial Sequence
  Description of Artificial Sequence: Synthetic oligonucleotide
agattaggaaaagactgatgtaaacaaagaggagtaaaaggagataaag

SEQ ID NO: 294657 - DNA, 48 bp, Artificial Sequence
  Description of Artificial Sequence: Synthetic oligonucleotide
gattaggaaaagactgatgtaaacaaagaggagtaaaaggagataaag

SEQ ID NO: 294658 - DNA, 28 bp, Artificial Sequence
  Description of Artificial Sequence: Synthetic oligonucleotide
atgttcaataagggcagcgctccgaggc

SEQ ID NO: 294659 - DNA, 27 bp, Artificial Sequence
  Description of Artificial Sequence: Synthetic oligonucleotide
tgttcaataagggcagcgctccgaggc

SEQ ID NO: 294660 - DNA, 26 bp, Artificial Sequence
  Description of Artificial Sequence: Synthetic oligonucleotide
gttcaataagggcagcgctccgaggc

SEQ ID NO: 294661 - DNA, 26 bp, Artificial Sequence
  Description of Artificial Sequence: Synthetic oligonucleotide
ttcaataagggcagcgctccgaggcc

SEQ ID NO: 294662 - DNA, 25 bp, Artificial Sequence
  Description of Artificial Sequence: Synthetic oligonucleotide
tcaataagggcagcgctccgaggcc

SEQ ID NO: 294663 - DNA, 24 bp, Artificial Sequence
  Description of Artificial Sequence: Synthetic oligonucleotide
caataagggcagcgctccgaggcc

SEQ ID NO: 294664 - DNA, 24 bp, Artificial Sequence
  Description of Artificial Sequence: Synthetic oligonucleotide
aataagggcagcgctccgaggccg

SEQ ID NO: 294665 - DNA, 23 bp, Artificial Sequence
  Description of Artificial Sequence: Synthetic oligonucleotide
ataagggcagcgctccgaggccg

SEQ ID NO: 294666 - DNA, 22 bp, Artificial Sequence
  Description of Artificial Sequence: Synthetic oligonucleotide
taagggcagcgctccgaggccg

SEQ ID NO: 294667 - DNA, 21 bp, Artificial Sequence
  Description of Artificial Sequence: Synthetic oligonucleotide
aagggcagcgctccgaggccg

SEQ ID NO: 294668 - DNA, 20 bp, Artificial Sequence
  Description of Artificial Sequence: Synthetic oligonucleotide
agggcagcgctccgaggccg

SEQ ID NO: 294669 - DNA, 20 bp, Artificial Sequence
  Description of Artificial Sequence: Synthetic oligonucleotide
gggcagcgctccgaggccgt

SEQ ID NO: 294670 - DNA, 20 bp, Artificial Sequence
  Description of Artificial Sequence: Synthetic oligonucleotide
ggcagcgctccgaggccgct

SEQ ID NO: 294671 - DNA, 20 bp, Artificial Sequence
  Description of Artificial Sequence: Synthetic oligonucleotide
gcagcgctccgaggccgcca

SEQ ID NO: 294672 - DNA, 20 bp, Artificial Sequence
  Description of Artificial Sequence: Synthetic oligonucleotide
cagcgctccgaggccgccac

SEQ ID NO: 294673 - DNA, 21 bp, Artificial Sequence
  Description of Artificial Sequence: Synthetic oligonucleotide
agcgctccgaggccgccacct

SEQ ID NO: 294674 - DNA, 20 bp, Artificial Sequence
  Description of Artificial Sequence: Synthetic oligonucleotide
gcgctccgaggccgccacct

SEQ ID NO: 294675 - DNA, 20 bp, Artificial Sequence
  Description of Artificial Sequence: Synthetic oligonucleotide
cgctccgaggccgccacctc

SEQ ID NO: 294676 - DNA, 21 bp, Artificial Sequence
  Description of Artificial Sequence: Synthetic oligonucleotide
gctccgaggccgccacctcca

SEQ ID NO: 294677 - DNA, 22 bp, Artificial Sequence
  Description of Artificial Sequence: Synthetic oligonucleotide
ctccgaggccgccacctccaga

SEQ ID NO: 294678 - DNA, 22 bp, Artificial Sequence
  Description of Artificial Sequence: Synthetic oligonucleotide
tccgaggccgccacctccagag

SEQ ID NO: 294679 - DNA, 21 bp, Artificial Sequence
  Description of Artificial Sequence: Synthetic oligonucleotide
ccgaggccgccacctccagag

SEQ ID NO: 294680 - DNA, 21 bp, Artificial Sequence
  Description of Artificial Sequence: Synthetic oligonucleotide
cgaggccgccacctccagagc

SEQ ID NO: 294681 - DNA, 22 bp, Artificial Sequence
  Description of Artificial Sequence: Synthetic oligonucleotide
gaggccgccacctccagagcga

SEQ ID NO: 294682 - DNA, 22 bp, Artificial Sequence
  Description of Artificial Sequence: Synthetic oligonucleotide
aggccgccacctccagagcgac

SEQ ID NO: 294683 - DNA, 21 bp, Artificial Sequence
  Description of Artificial Sequence: Synthetic oligonucleotide
ggccgccacctccagagcgac

SEQ ID NO: 294684 - DNA, 21 bp, Artificial Sequence
  Description of Artificial Sequence: Synthetic oligonucleotide
gccgccacctccagagcgacg

SEQ ID NO: 294685 - DNA, 21 bp, Artificial Sequence
  Description of Artificial Sequence: Synthetic oligonucleotide
ccgccacctccagagcgacgc

SEQ ID NO: 294686 - DNA, 21 bp, Artificial Sequence
  Description of Artificial Sequence: Synthetic oligonucleotide
cgccacctccagagcgacgcc

SEQ ID NO: 294687 - DNA, 21 bp, Artificial Sequence
  Description of Artificial Sequence: Synthetic oligonucleotide
gccacctccagagcgacgccg

SEQ ID NO: 294688 - DNA, 21 bp, Artificial Sequence
  Description of Artificial Sequence: Synthetic oligonucleotide
ccacctccagagcgacgccgg

SEQ ID NO: 294689 - DNA, 21 bp, Artificial Sequence
  Description of Artificial Sequence: Synthetic oligonucleotide
cacctccagagcgacgccggg

SEQ ID NO: 294690 - DNA, 23 bp, Artificial Sequence
  Description of Artificial Sequence: Synthetic oligonucleotide
acctccagagcgacgccgggcta

SEQ ID NO: 294691 - DNA, 22 bp, Artificial Sequence
  Description of Artificial Sequence: Synthetic oligonucleotide
cctccagagcgacgccgggcta

SEQ ID NO: 294692 - DNA, 22 bp, Artificial Sequence
  Description of Artificial Sequence: Synthetic oligonucleotide
ctccagagcgacgccgggctac

SEQ ID NO: 294693 - DNA, 22 bp, Artificial Sequence
  Description of Artificial Sequence: Synthetic oligonucleotide
tccagagcgacgccgggctacc

SEQ ID NO: 294694 - DNA, 21 bp, Artificial Sequence
  Description of Artificial Sequence: Synthetic oligonucleotide
ccagagcgacgccgggctacc

SEQ ID NO: 294695 - DNA, 21 bp, Artificial Sequence
  Description of Artificial Sequence: Synthetic oligonucleotide
cagagcgacgccgggctaccg

SEQ ID NO: 294696 - DNA, 21 bp, Artificial Sequence
  Description of Artificial Sequence: Synthetic oligonucleotide
agagcgacgccgggctaccgg

SEQ ID NO: 294697 - DNA, 20 bp, Artificial Sequence
  Description of Artificial Sequence: Synthetic oligonucleotide
gagcgacgccgggctaccgg

SEQ ID NO: 294698 - DNA, 20 bp, Artificial Sequence
  Description of Artificial Sequence: Synthetic oligonucleotide
agcgacgccgggctaccggg

SEQ ID NO: 294699 - DNA, 20 bp, Artificial Sequence
  Description of Artificial Sequence: Synthetic oligonucleotide
gcgacgccgggctaccgggt

SEQ ID NO: 294700 - DNA, 20 bp, Artificial Sequence
  Description of Artificial Sequence: Synthetic oligonucleotide
cgacgccgggctaccggggt

SEQ ID NO: 294701 - DNA, 20 bp, Artificial Sequence
  Description of Artificial Sequence: Synthetic oligonucleotide
gacgccgggctaccgggggt

SEQ ID NO: 294702 - DNA, 20 bp, Artificial Sequence
  Description of Artificial Sequence: Synthetic oligonucleotide
acgccgggctaccgggggct

SEQ ID NO: 294703 - DNA, 20 bp, Artificial Sequence
  Description of Artificial Sequence: Synthetic oligonucleotide
cgccgggctaccgggggctt

SEQ ID NO: 294704 - DNA, 20 bp, Artificial Sequence
  Description of Artificial Sequence: Synthetic oligonucleotide
gccgggctaccgggggcgtt

SEQ ID NO: 294705 - DNA, 20 bp, Artificial Sequence
  Description of Artificial Sequence: Synthetic oligonucleotide
ccgggctaccgggggcggtt

SEQ ID NO: 294706 - DNA, 20 bp, Artificial Sequence
  Description of Artificial Sequence: Synthetic oligonucleotide
cgggctaccgggggcgggtt

SEQ ID NO: 294707 - DNA, 20 bp, Artificial Sequence
  Description of Artificial Sequence: Synthetic oligonucleotide
gggctaccgggggcgggcat

SEQ ID NO: 294708 - DNA, 20 bp, Artificial Sequence
  Description of Artificial Sequence: Synthetic oligonucleotide
ggctaccgggggcgggcaga

SEQ ID NO: 294709 - DNA, 20 bp, Artificial Sequence
  Description of Artificial Sequence: Synthetic oligonucleotide
gctaccgggggcgggcagag

SEQ ID NO: 294710 - DNA, 20 bp, Artificial Sequence
  Description of Artificial Sequence: Synthetic oligonucleotide
ctaccgggggcgggcagagg

SEQ ID NO: 294711 - DNA, 21 bp, Artificial Sequence
  Description of Artificial Sequence: Synthetic oligonucleotide
taccgggggcgggcagaggca

SEQ ID NO: 294712 - DNA, 20 bp, Artificial Sequence
  Description of Artificial Sequence: Synthetic oligonucleotide
accgggggcgggcagaggca

SEQ ID NO: 294713 - DNA, 20 bp, Artificial Sequence
  Description of Artificial Sequence: Synthetic oligonucleotide
ccgggggcgggcagaggcat

SEQ ID NO: 294714 - DNA, 20 bp, Artificial Sequence
  Description of Artificial Sequence: Synthetic oligonucleotide
cgggggcgggcagaggcagt

SEQ ID NO: 294715 - DNA, 21 bp, Artificial Sequence
  Description of Artificial Sequence: Synthetic oligonucleotide
gggggcgggcagaggcaggta

SEQ ID NO: 294716 - DNA, 23 bp, Artificial Sequence
  Description of Artificial Sequence: Synthetic oligonucleotide
ggggcgggcagaggcaggtagta

SEQ ID NO: 294717 - DNA, 23 bp, Artificial Sequence
  Description of Artificial Sequence: Synthetic oligonucleotide
gggcgggcagaggcaggtagtag

SEQ ID NO: 294718 - DNA, 23 bp, Artificial Sequence
  Description of Artificial Sequence: Synthetic oligonucleotide
ggcgggcagaggcaggtagtagc

SEQ ID NO: 294719 - DNA, 23 bp, Artificial Sequence
  Description of Artificial Sequence: Synthetic oligonucleotide
gcgggcagaggcaggtagtagcc

SEQ ID NO: 294720 - DNA, 23 bp, Artificial Sequence
  Description of Artificial Sequence: Synthetic oligonucleotide
cgggcagaggcaggtagtagccc

SEQ ID NO: 294721 - DNA, 23 bp, Artificial Sequence
  Description of Artificial Sequence: Synthetic oligonucleotide
gggcagaggcaggtagtagcccc

SEQ ID NO: 294722 - DNA, 23 bp, Artificial Sequence
  Description of Artificial Sequence: Synthetic oligonucleotide
ggcagaggcaggtagtagccccg

SEQ ID NO: 294723 - DNA, 23 bp, Artificial Sequence
  Description of Artificial Sequence: Synthetic oligonucleotide
gcagaggcaggtagtagccccgg

SEQ ID NO: 294724 - DNA, 23 bp, Artificial Sequence
  Description of Artificial Sequence: Synthetic oligonucleotide
cagaggcaggtagtagccccggc

SEQ ID NO: 294725 - DNA, 23 bp, Artificial Sequence
  Description of Artificial Sequence: Synthetic oligonucleotide
agaggcaggtagtagccccggcc

SEQ ID NO: 294726 - DNA, 22 bp, Artificial Sequence
  Description of Artificial Sequence: Synthetic oligonucleotide
gaggcaggtagtagccccggcc

SEQ ID NO: 294727 - DNA, 22 bp, Artificial Sequence
  Description of Artificial Sequence: Synthetic oligonucleotide
aggcaggtagtagccccggccc

SEQ ID NO: 294728 - DNA, 21 bp, Artificial Sequence
  Description of Artificial Sequence: Synthetic oligonucleotide
ggcaggtagtagccccggccc

SEQ ID NO: 294729 - DNA, 21 bp, Artificial Sequence
  Description of Artificial Sequence: Synthetic oligonucleotide
gcaggtagtagccccggcccg

SEQ ID NO: 294730 - DNA, 21 bp, Artificial Sequence
  Description of Artificial Sequence: Synthetic oligonucleotide
caggtagtagccccggcccgg

SEQ ID NO: 294731 - DNA, 21 bp, Artificial Sequence
  Description of Artificial Sequence: Synthetic oligonucleotide
aggtagtagccccggcccggg

SEQ ID NO: 294732 - DNA, 20 bp, Artificial Sequence
  Description of Artificial Sequence: Synthetic oligonucleotide
ggtagtagccccggcccggg

SEQ ID NO: 294733 - DNA, 20 bp, Artificial Sequence
  Description of Artificial Sequence: Synthetic oligonucleotide
gtagtagccccggcccgggc

SEQ ID NO: 294734 - DNA, 22 bp, Artificial Sequence
  Description of Artificial Sequence: Synthetic oligonucleotide
tagtagccccggcccgggccta

SEQ ID NO: 294735 - DNA, 21 bp, Artificial Sequence
  Description of Artificial Sequence: Synthetic oligonucleotide
agtagccccggcccgggccta

SEQ ID NO: 294736 - DNA, 20 bp, Artificial Sequence
  Description of Artificial Sequence: Synthetic oligonucleotide
gtagccccggcccgggccta

SEQ ID NO: 294737 - DNA, 20 bp, Artificial Sequence
  Description of Artificial Sequence: Synthetic oligonucleotide
tagccccggcccgggcctag

SEQ ID NO: 294738 - DNA, 20 bp, Artificial Sequence
  Description of Artificial Sequence: Synthetic oligonucleotide
agccccggcccgggcctagt

SEQ ID NO: 294739 - DNA, 20 bp, Artificial Sequence
  Description of Artificial Sequence: Synthetic oligonucleotide
gccccggcccgggcctagtt

SEQ ID NO: 294740 - DNA, 20 bp, Artificial Sequence
  Description of Artificial Sequence: Synthetic oligonucleotide
ccccggcccgggcctaggtt

SEQ ID NO: 294741 - DNA, 20 bp, Artificial Sequence
  Description of Artificial Sequence: Synthetic oligonucleotide
cccggcccgggcctagggtt

SEQ ID NO: 294742 - DNA, 20 bp, Artificial Sequence
  Description of Artificial Sequence: Synthetic oligonucleotide
ccggcccgggcctagggctt

SEQ ID NO: 294743 - DNA, 20 bp, Artificial Sequence
  Description of Artificial Sequence: Synthetic oligonucleotide
cggcccgggcctagggctct

SEQ ID NO: 294744 - DNA, 20 bp, Artificial Sequence
  Description of Artificial Sequence: Synthetic oligonucleotide
ggcccgggcctagggctcca

SEQ ID NO: 294745 - DNA, 20 bp, Artificial Sequence
  Description of Artificial Sequence: Synthetic oligonucleotide
gcccgggcctagggctccac

SEQ ID NO: 294746 - DNA, 21 bp, Artificial Sequence
  Description of Artificial Sequence: Synthetic oligonucleotide
cccgggcctagggctccacgt

SEQ ID NO: 294747 - DNA, 22 bp, Artificial Sequence
  Description of Artificial Sequence: Synthetic oligonucleotide
ccgggcctagggctccacgtct

SEQ ID NO: 294748 - DNA, 22 bp, Artificial Sequence
  Description of Artificial Sequence: Synthetic oligonucleotide
cgggcctagggctccacgtctc

SEQ ID NO: 294749 - DNA, 22 bp, Artificial Sequence
  Description of Artificial Sequence: Synthetic oligonucleotide
gggcctagggctccacgtctcg

SEQ ID NO: 294750 - DNA, 22 bp, Artificial Sequence
  Description of Artificial Sequence: Synthetic oligonucleotide
ggcctagggctccacgtctcgg

SEQ ID NO: 294751 - DNA, 22 bp, Artificial Sequence
  Description of Artificial Sequence: Synthetic oligonucleotide
gcctagggctccacgtctcggc

SEQ ID NO: 294752 - DNA, 22 bp, Artificial Sequence
  Description of Artificial Sequence: Synthetic oligonucleotide
cctagggctccacgtctcggcc

SEQ ID NO: 294753 - DNA, 22 bp, Artificial Sequence
  Description of Artificial Sequence: Synthetic oligonucleotide
ctagggctccacgtctcggccc

SEQ ID NO: 294754 - DNA, 23 bp, Artificial Sequence
  Description of Artificial Sequence: Synthetic oligonucleotide
tagggctccacgtctcggcccga

SEQ ID NO: 294755 - DNA, 22 bp, Artificial Sequence
  Description of Artificial Sequence: Synthetic oligonucleotide
agggctccacgtctcggcccga

SEQ ID NO: 294756 - DNA, 21 bp, Artificial Sequence
  Description of Artificial Sequence: Synthetic oligonucleotide
gggctccacgtctcggcccga

SEQ ID NO: 294757 - DNA, 23 bp, Artificial Sequence
  Description of Artificial Sequence: Synthetic oligonucleotide
ggctccacgtctcggcccgactt

SEQ ID NO: 294758 - DNA, 23 bp, Artificial Sequence
  Description of Artificial Sequence: Synthetic oligonucleotide
gctccacgtctcggcccgacttc

SEQ ID NO: 294759 - DNA, 23 bp, Artificial Sequence
  Description of Artificial Sequence: Synthetic oligonucleotide
ctccacgtctcggcccgacttcc

SEQ ID NO: 294760 - DNA, 23 bp, Artificial Sequence
  Description of Artificial Sequence: Synthetic oligonucleotide
tccacgtctcggcccgacttccg

SEQ ID NO: 294761 - DNA, 22 bp, Artificial Sequence
  Description of Artificial Sequence: Synthetic oligonucleotide
ccacgtctcggcccgacttccg

SEQ ID NO: 294762 - DNA, 22 bp, Artificial Sequence
  Description of Artificial Sequence: Synthetic oligonucleotide
cacgtctcggcccgacttccgc

SEQ ID NO: 294763 - DNA, 22 bp, Artificial Sequence
  Description of Artificial Sequence: Synthetic oligonucleotide
acgtctcggcccgacttccgcc

SEQ ID NO: 294764 - DNA, 21 bp, Artificial Sequence
  Description of Artificial Sequence: Synthetic oligonucleotide
cgtctcggcccgacttccgcc

SEQ ID NO: 294765 - DNA, 21 bp, Artificial Sequence
  Description of Artificial Sequence: Synthetic oligonucleotide
gtctcggcccgacttccgccc

SEQ ID NO: 294766 - DNA, 21 bp, Artificial Sequence
  Description of Artificial Sequence: Synthetic oligonucleotide
tctcggcccgacttccgcccg

SEQ ID NO: 294767 - DNA, 20 bp, Artificial Sequence
  Description of Artificial Sequence: Synthetic oligonucleotide
ctcggcccgacttccgcccg

SEQ ID NO: 294768 - DNA, 20 bp, Artificial Sequence
  Description of Artificial Sequence: Synthetic oligonucleotide
tcggcccgacttccgcccgg

SEQ ID NO: 294769 - DNA, 20 bp, Artificial Sequence
  Description of Artificial Sequence: Synthetic oligonucleotide
cggcccgacttccgcccggt

SEQ ID NO: 294770 - DNA, 21 bp, Artificial Sequence
  Description of Artificial Sequence: Synthetic oligonucleotide
ggcccgacttccgcccggcaa

SEQ ID NO: 294771 - DNA, 21 bp, Artificial Sequence
  Description of Artificial Sequence: Synthetic oligonucleotide
gcccgacttccgcccggcaag

SEQ ID NO: 294772 - DNA, 21 bp, Artificial Sequence
  Description of Artificial Sequence: Synthetic oligonucleotide
cccgacttccgcccggcaagc

SEQ ID NO: 294773 - DNA, 24 bp, Artificial Sequence
  Description of Artificial Sequence: Synthetic oligonucleotide
ccgacttccgcccggcaagcgtat

SEQ ID NO: 294774 - DNA, 26 bp, Artificial Sequence
  Description of Artificial Sequence: Synthetic oligonucleotide
cgacttccgcccggcaagcgtatgta

SEQ ID NO: 294775 - DNA, 26 bp, Artificial Sequence
  Description of Artificial Sequence: Synthetic oligonucleotide
gacttccgcccggcaagcgtatgtag

SEQ ID NO: 294776 - DNA, 26 bp, Artificial Sequence
  Description of Artificial Sequence: Synthetic oligonucleotide
acttccgcccggcaagcgtatgtagg

SEQ ID NO: 294777 - DNA, 25 bp, Artificial Sequence
  Description of Artificial Sequence: Synthetic oligonucleotide
cttccgcccggcaagcgtatgtagg

SEQ ID NO: 294778 - DNA, 25 bp, Artificial Sequence
  Description of Artificial Sequence: Synthetic oligonucleotide
ttccgcccggcaagcgtatgtaggc

SEQ ID NO: 294779 - DNA, 24 bp, Artificial Sequence
  Description of Artificial Sequence: Synthetic oligonucleotide
tccgcccggcaagcgtatgtaggc

SEQ ID NO: 294780 - DNA, 23 bp, Artificial Sequence
  Description of Artificial Sequence: Synthetic oligonucleotide
ccgcccggcaagcgtatgtaggc

SEQ ID NO: 294781 - DNA, 23 bp, Artificial Sequence
  Description of Artificial Sequence: Synthetic oligonucleotide
cgcccggcaagcgtatgtaggcg

SEQ ID NO: 294782 - DNA, 23 bp, Artificial Sequence
  Description of Artificial Sequence: Synthetic oligonucleotide
gcccggcaagcgtatgtaggcgg

SEQ ID NO: 294783 - DNA, 23 bp, Artificial Sequence
  Description of Artificial Sequence: Synthetic oligonucleotide
cccggcaagcgtatgtaggcggg

SEQ ID NO: 294784 - DNA, 23 bp, Artificial Sequence
  Description of Artificial Sequence: Synthetic oligonucleotide
ccggcaagcgtatgtaggcgggg

SEQ ID NO: 294785 - DNA, 24 bp, Artificial Sequence
  Description of Artificial Sequence: Synthetic oligonucleotide
cggcaagcgtatgtaggcggggct

SEQ ID NO: 294786 - DNA, 24 bp, Artificial Sequence
  Description of Artificial Sequence: Synthetic oligonucleotide
ggcaagcgtatgtaggcggggctg

SEQ ID NO: 294787 - DNA, 24 bp, Artificial Sequence
  Description of Artificial Sequence: Synthetic oligonucleotide
gcaagcgtatgtaggcggggctgc

SEQ ID NO: 294788 - DNA, 24 bp, Artificial Sequence
  Description of Artificial Sequence: Synthetic oligonucleotide
caagcgtatgtaggcggggctgcc

SEQ ID NO: 294789 - DNA, 27 bp, Artificial Sequence
  Description of Artificial Sequence: Synthetic oligonucleotide
aagcgtatgtaggcggggctgccgtat

SEQ ID NO: 294790 - DNA, 27 bp, Artificial Sequence
  Description of Artificial Sequence: Synthetic oligonucleotide
agcgtatgtaggcggggctgccgtata

SEQ ID NO: 294791 - DNA, 27 bp, Artificial Sequence
  Description of Artificial Sequence: Synthetic oligonucleotide
gcgtatgtaggcggggctgccgtatat

SEQ ID NO: 294792 - DNA, 27 bp, Artificial Sequence
  Description of Artificial Sequence: Synthetic oligonucleotide
cgtatgtaggcggggctgccgtatatc

SEQ ID NO: 294793 - DNA, 28 bp, Artificial Sequence
  Description of Artificial Sequence: Synthetic oligonucleotide
gtatgtaggcggggctgccgtatatcag

SEQ ID NO: 294794 - DNA, 28 bp, Artificial Sequence
  Description of Artificial Sequence: Synthetic oligonucleotide
tatgtaggcggggctgccgtatatcagg

SEQ ID NO: 294795 - DNA, 27 bp, Artificial Sequence
  Description of Artificial Sequence: Synthetic oligonucleotide
atgtaggcggggctgccgtatatcagg

SEQ ID NO: 294796 - DNA, 26 bp, Artificial Sequence
  Description of Artificial Sequence: Synthetic oligonucleotide
tgtaggcggggctgccgtatatcagg

SEQ ID NO: 294797 - DNA, 25 bp, Artificial Sequence
  Description of Artificial Sequence: Synthetic oligonucleotide
gtaggcggggctgccgtatatcagg

SEQ ID NO: 294798 - DNA, 25 bp, Artificial Sequence
  Description of Artificial Sequence: Synthetic oligonucleotide
taggcggggctgccgtatatcaggc

SEQ ID NO: 294799 - DNA, 24 bp, Artificial Sequence
  Description of Artificial Sequence: Synthetic oligonucleotide
aggcggggctgccgtatatcaggc

SEQ ID NO: 294800 - DNA, 23 bp, Artificial Sequence
  Description of Artificial Sequence: Synthetic oligonucleotide
ggcggggctgccgtatatcaggc

SEQ ID NO: 294801 - DNA, 23 bp, Artificial Sequence
  Description of Artificial Sequence: Synthetic oligonucleotide
gcggggctgccgtatatcaggcg

SEQ ID NO: 294802 - DNA, 24 bp, Artificial Sequence
  Description of Artificial Sequence: Synthetic oligonucleotide
cggggctgccgtatatcaggcgga

SEQ ID NO: 294803 - DNA, 25 bp, Artificial Sequence
  Description of Artificial Sequence: Synthetic oligonucleotide
ggggctgccgtatatcaggcggact

SEQ ID NO: 294804 - DNA, 25 bp, Artificial Sequence
  Description of Artificial Sequence: Synthetic oligonucleotide
gggctgccgtatatcaggcggactg

SEQ ID NO: 294805 - DNA, 27 bp, Artificial Sequence
  Description of Artificial Sequence: Synthetic oligonucleotide
ggctgccgtatatcaggcggactgctt

SEQ ID NO: 294806 - DNA, 27 bp, Artificial Sequence
  Description of Artificial Sequence: Synthetic oligonucleotide
gctgccgtatatcaggcggactgcttg

SEQ ID NO: 294807 - DNA, 27 bp, Artificial Sequence
  Description of Artificial Sequence: Synthetic oligonucleotide
ctgccgtatatcaggcggactgcttgc

SEQ ID NO: 294808 - DNA, 27 bp, Artificial Sequence
  Description of Artificial Sequence: Synthetic oligonucleotide
tgccgtatatcaggcggactgcttgcc

SEQ ID NO: 294809 - DNA, 26 bp, Artificial Sequence
  Description of Artificial Sequence: Synthetic oligonucleotide
gccgtatatcaggcggactgcttgcc

SEQ ID NO: 294810 - DNA, 26 bp, Artificial Sequence
  Description of Artificial Sequence: Synthetic oligonucleotide
ccgtatatcaggcggactgcttgccc

SEQ ID NO: 294811 - DNA, 27 bp, Artificial Sequence
  Description of Artificial Sequence: Synthetic oligonucleotide
cgtatatcaggcggactgcttgcccca

SEQ ID NO: 294812 - DNA, 28 bp, Artificial Sequence
  Description of Artificial Sequence: Synthetic oligonucleotide
gtatatcaggcggactgcttgccccatc

SEQ ID NO: 294813 - DNA, 29 bp, Artificial Sequence
  Description of Artificial Sequence: Synthetic oligonucleotide
tatatcaggcggactgcttgccccatcac

SEQ ID NO: 294814 - DNA, 28 bp, Artificial Sequence
  Description of Artificial Sequence: Synthetic oligonucleotide
atatcaggcggactgcttgccccatcac

SEQ ID NO: 294815 - DNA, 27 bp, Artificial Sequence
  Description of Artificial Sequence: Synthetic oligonucleotide
tatcaggcggactgcttgccccatcac

SEQ ID NO: 294816 - DNA, 26 bp, Artificial Sequence
  Description of Artificial Sequence: Synthetic oligonucleotide
atcaggcggactgcttgccccatcac

SEQ ID NO: 294817 - DNA, 25 bp, Artificial Sequence
  Description of Artificial Sequence: Synthetic oligonucleotide
tcaggcggactgcttgccccatcac

SEQ ID NO: 294818 - DNA, 24 bp, Artificial Sequence
  Description of Artificial Sequence: Synthetic oligonucleotide
caggcggactgcttgccccatcac

SEQ ID NO: 294819 - DNA, 24 bp, Artificial Sequence
  Description of Artificial Sequence: Synthetic oligonucleotide
aggcggactgcttgccccatcacg

SEQ ID NO: 294820 - DNA, 23 bp, Artificial Sequence
  Description of Artificial Sequence: Synthetic oligonucleotide
ggcggactgcttgccccatcacg

SEQ ID NO: 294821 - DNA, 25 bp, Artificial Sequence
  Description of Artificial Sequence: Synthetic oligonucleotide
gcggactgcttgccccatcacgcat

SEQ ID NO: 294822 - DNA, 27 bp, Artificial Sequence
  Description of Artificial Sequence: Synthetic oligonucleotide
cggactgcttgccccatcacgcatgat

SEQ ID NO: 294823 - DNA, 27 bp, Artificial Sequence
  Description of Artificial Sequence: Synthetic oligonucleotide
ggactgcttgccccatcacgcatgatg

SEQ ID NO: 294824 - DNA, 27 bp, Artificial Sequence
  Description of Artificial Sequence: Synthetic oligonucleotide
gactgcttgccccatcacgcatgatgg

SEQ ID NO: 294825 - DNA, 27 bp, Artificial Sequence
  Description of Artificial Sequence: Synthetic oligonucleotide
actgcttgccccatcacgcatgatggc

SEQ ID NO: 294826 - DNA, 26 bp, Artificial Sequence
  Description of Artificial Sequence: Synthetic oligonucleotide
ctgcttgccccatcacgcatgatggc

SEQ ID NO: 294827 - DNA, 26 bp, Artificial Sequence
  Description of Artificial Sequence: Synthetic oligonucleotide
tgcttgccccatcacgcatgatggcg

SEQ ID NO: 294828 - DNA, 25 bp, Artificial Sequence
  Description of Artificial Sequence: Synthetic oligonucleotide
gcttgccccatcacgcatgatggcg

SEQ ID NO: 294829 - DNA, 25 bp, Artificial Sequence
  Description of Artificial Sequence: Synthetic oligonucleotide
cttgccccatcacgcatgatggcgg

SEQ ID NO: 294830 - DNA, 25 bp, Artificial Sequence
  Description of Artificial Sequence: Synthetic oligonucleotide
ttgccccatcacgcatgatggcggc

SEQ ID NO: 294831 - DNA, 24 bp, Artificial Sequence
  Description of Artificial Sequence: Synthetic oligonucleotide
tgccccatcacgcatgatggcggc

SEQ ID NO: 294832 - DNA, 23 bp, Artificial Sequence
  Description of Artificial Sequence: Synthetic oligonucleotide
gccccatcacgcatgatggcggc

SEQ ID NO: 294833 - DNA, 23 bp, Artificial Sequence
  Description of Artificial Sequence: Synthetic oligonucleotide
ccccatcacgcatgatggcggcg

SEQ ID NO: 294834 - DNA, 23 bp, Artificial Sequence
  Description of Artificial Sequence: Synthetic oligonucleotide
cccatcacgcatgatggcggcgg

SEQ ID NO: 294835 - DNA, 23 bp, Artificial Sequence
  Description of Artificial Sequence: Synthetic oligonucleotide
ccatcacgcatgatggcggcggc

SEQ ID NO: 294836 - DNA, 23 bp, Artificial Sequence
  Description of Artificial Sequence: Synthetic oligonucleotide
catcacgcatgatggcggcggcg

SEQ ID NO: 294837 - DNA, 23 bp, Artificial Sequence
  Description of Artificial Sequence: Synthetic oligonucleotide
atcacgcatgatggcggcggcgg

SEQ ID NO: 294838 - DNA, 22 bp, Artificial Sequence
  Description of Artificial Sequence: Synthetic oligonucleotide
tcacgcatgatggcggcggcgg

SEQ ID NO: 294839 - DNA, 21 bp, Artificial Sequence
  Description of Artificial Sequence: Synthetic oligonucleotide
cacgcatgatggcggcggcgg

SEQ ID NO: 294840 - DNA, 21 bp, Artificial Sequence
  Description of Artificial Sequence: Synthetic oligonucleotide
acgcatgatggcggcggcggc

SEQ ID NO: 294841 - DNA, 20 bp, Artificial Sequence
  Description of Artificial Sequence: Synthetic oligonucleotide
cgcatgatggcggcggcggc

SEQ ID NO: 294842 - DNA, 20 bp, Artificial Sequence
  Description of Artificial Sequence: Synthetic oligonucleotide
gcatgatggcggcggcggcg

SEQ ID NO: 294843 - DNA, 21 bp, Artificial Sequence
  Description of Artificial Sequence: Synthetic oligonucleotide
catgatggcggcggcggcggt

SEQ ID NO: 294844 - DNA, 23 bp, Artificial Sequence
  Description of Artificial Sequence: Synthetic oligonucleotide
atgatggcggcggcggcggtgta

SEQ ID NO: 294845 - DNA, 22 bp, Artificial Sequence
  Description of Artificial Sequence: Synthetic oligonucleotide
tgatggcggcggcggcggtgta

SEQ ID NO: 294846 - DNA, 21 bp, Artificial Sequence
  Description of Artificial Sequence: Synthetic oligonucleotide
gatggcggcggcggcggtgta

SEQ ID NO: 294847 - DNA, 21 bp, Artificial Sequence
  Description of Artificial Sequence: Synthetic oligonucleotide
atggcggcggcggcggtgtac

SEQ ID NO: 294848 - DNA, 20 bp, Artificial Sequence
  Description of Artificial Sequence: Synthetic oligonucleotide
tggcggcggcggcggtgtac

SEQ ID NO: 294849 - DNA, 20 bp, Artificial Sequence
  Description of Artificial Sequence: Synthetic oligonucleotide
ggcggcggcggcggtgtact

SEQ ID NO: 294850 - DNA, 20 bp, Artificial Sequence
  Description of Artificial Sequence: Synthetic oligonucleotide
gcggcggcggcggtgtacgt

SEQ ID NO: 294851 - DNA, 20 bp, Artificial Sequence
  Description of Artificial Sequence: Synthetic oligonucleotide
cggcggcggcggtgtacggt

SEQ ID NO: 294852 - DNA, 20 bp, Artificial Sequence
  Description of Artificial Sequence: Synthetic oligonucleotide
ggcggcggcggtgtacgggt

SEQ ID NO: 294853 - DNA, 20 bp, Artificial Sequence
  Description of Artificial Sequence: Synthetic oligonucleotide
gcggcggcggtgtacggggt

SEQ ID NO: 294854 - DNA, 20 bp, Artificial Sequence
  Description of Artificial Sequence: Synthetic oligonucleotide
cggcggcggtgtacggggct

SEQ ID NO: 294855 - DNA, 20 bp, Artificial Sequence
  Description of Artificial Sequence: Synthetic oligonucleotide
ggcggcggtgtacggggcgt

SEQ ID NO: 294856 - DNA, 20 bp, Artificial Sequence
  Description of Artificial Sequence: Synthetic oligonucleotide
gcggcggtgtacggggcggt

SEQ ID NO: 294857 - DNA, 20 bp, Artificial Sequence
  Description of Artificial Sequence: Synthetic oligonucleotide
cggcggtgtacggggcggga

SEQ ID NO: 294858 - DNA, 20 bp, Artificial Sequence
  Description of Artificial Sequence: Synthetic oligonucleotide
ggcggtgtacggggcgggag

SEQ ID NO: 294859 - DNA, 20 bp, Artificial Sequence
  Description of Artificial Sequence: Synthetic oligonucleotide
gcggtgtacggggcgggagg

SEQ ID NO: 294860 - DNA, 22 bp, Artificial Sequence
  Description of Artificial Sequence: Synthetic oligonucleotide
cggtgtacggggcgggaggctt

SEQ ID NO: 294861 - DNA, 23 bp, Artificial Sequence
  Description of Artificial Sequence: Synthetic oligonucleotide
ggtgtacggggcgggaggcttct

SEQ ID NO: 294862 - DNA, 23 bp, Artificial Sequence
  Description of Artificial Sequence: Synthetic oligonucleotide
gtgtacggggcgggaggcttctc

SEQ ID NO: 294863 - DNA, 24 bp, Artificial Sequence
  Description of Artificial Sequence: Synthetic oligonucleotide
tgtacggggcgggaggcttctcca

SEQ ID NO: 294864 - DNA, 23 bp, Artificial Sequence
  Description of Artificial Sequence: Synthetic oligonucleotide
gtacggggcgggaggcttctcca

SEQ ID NO: 294865 - DNA, 23 bp, Artificial Sequence
  Description of Artificial Sequence: Synthetic oligonucleotide
tacggggcgggaggcttctccag

SEQ ID NO: 294866 - DNA, 22 bp, Artificial Sequence
  Description of Artificial Sequence: Synthetic oligonucleotide
acggggcgggaggcttctccag

SEQ ID NO: 294867 - DNA, 21 bp, Artificial Sequence
  Description of Artificial Sequence: Synthetic oligonucleotide
cggggcgggaggcttctccag

SEQ ID NO: 294868 - DNA, 22 bp, Artificial Sequence
  Description of Artificial Sequence: Synthetic oligonucleotide
ggggcgggaggcttctccagct

SEQ ID NO: 294869 - DNA, 22 bp, Artificial Sequence
  Description of Artificial Sequence: Synthetic oligonucleotide
gggcgggaggcttctccagctc

SEQ ID NO: 294870 - DNA, 22 bp, Artificial Sequence
  Description of Artificial Sequence: Synthetic oligonucleotide
ggcgggaggcttctccagctcc

SEQ ID NO: 294871 - DNA, 22 bp, Artificial Sequence
  Description of Artificial Sequence: Synthetic oligonucleotide
gcgggaggcttctccagctccg

SEQ ID NO: 294872 - DNA, 22 bp, Artificial Sequence
  Description of Artificial Sequence: Synthetic oligonucleotide
cgggaggcttctccagctccgg

SEQ ID NO: 294873 - DNA, 22 bp, Artificial Sequence
  Description of Artificial Sequence: Synthetic oligonucleotide
gggaggcttctccagctccggg

SEQ ID NO: 294874 - DNA, 22 bp, Artificial Sequence
  Description of Artificial Sequence: Synthetic oligonucleotide
ggaggcttctccagctccgggg

SEQ ID NO: 294875 - DNA, 22 bp, Artificial Sequence
  Description of Artificial Sequence: Synthetic oligonucleotide
gaggcttctccagctccggggc

SEQ ID NO: 294876 - DNA, 22 bp, Artificial Sequence
  Description of Artificial Sequence: Synthetic oligonucleotide
aggcttctccagctccggggcc

SEQ ID NO: 294877 - DNA, 21 bp, Artificial Sequence
  Description of Artificial Sequence: Synthetic oligonucleotide
ggcttctccagctccggggcc

SEQ ID NO: 294878 - DNA, 21 bp, Artificial Sequence
  Description of Artificial Sequence: Synthetic oligonucleotide
gcttctccagctccggggccg

SEQ ID NO: 294879 - DNA, 21 bp, Artificial Sequence
  Description of Artificial Sequence: Synthetic oligonucleotide
cttctccagctccggggccgc

SEQ ID NO: 294880 - DNA, 21 bp, Artificial Sequence
  Description of Artificial Sequence: Synthetic oligonucleotide
ttctccagctccggggccgcg

SEQ ID NO: 294881 - DNA, 20 bp, Artificial Sequence
  Description of Artificial Sequence: Synthetic oligonucleotide
tctccagctccggggccgcg

SEQ ID NO: 294882 - DNA, 20 bp, Artificial Sequence
  Description of Artificial Sequence: Synthetic oligonucleotide
ctccagctccggggccgcgt

SEQ ID NO: 294883 - DNA, 20 bp, Artificial Sequence
  Description of Artificial Sequence: Synthetic oligonucleotide
tccagctccggggccgcggt

SEQ ID NO: 294884 - DNA, 20 bp, Artificial Sequence
  Description of Artificial Sequence: Synthetic oligonucleotide
ccagctccggggccgcggtt

SEQ ID NO: 294885 - DNA, 20 bp, Artificial Sequence
  Description of Artificial Sequence: Synthetic oligonucleotide
cagctccggggccgcggcaa

SEQ ID NO: 294886 - DNA, 20 bp, Artificial Sequence
  Description of Artificial Sequence: Synthetic oligonucleotide
agctccggggccgcggcaag

SEQ ID NO: 294887 - DNA, 20 bp, Artificial Sequence
  Description of Artificial Sequence: Synthetic oligonucleotide
gctccggggccgcggcaagt

SEQ ID NO: 294888 - DNA, 20 bp, Artificial Sequence
  Description of Artificial Sequence: Synthetic oligonucleotide
ctccggggccgcggcaagct

SEQ ID NO: 294889 - DNA, 20 bp, Artificial Sequence
  Description of Artificial Sequence: Synthetic oligonucleotide
tccggggccgcggcaagctc

SEQ ID NO: 294890 - DNA, 20 bp, Artificial Sequence
  Description of Artificial Sequence: Synthetic oligonucleotide
ccggggccgcggcaagctct

SEQ ID NO: 294891 - DNA, 20 bp, Artificial Sequence
  Description of Artificial Sequence: Synthetic oligonucleotide
cggggccgcggcaagctcgt

SEQ ID NO: 294892 - DNA, 20 bp, Artificial Sequence
  Description of Artificial Sequence: Synthetic oligonucleotide
ggggccgcggcaagctcggt

SEQ ID NO: 294893 - DNA, 20 bp, Artificial Sequence
  Description of Artificial Sequence: Synthetic oligonucleotide
gggccgcggcaagctcgggt

SEQ ID NO: 294894 - DNA, 20 bp, Artificial Sequence
  Description of Artificial Sequence: Synthetic oligonucleotide
ggccgcggcaagctcgggct

SEQ ID NO: 294895 - DNA, 20 bp, Artificial Sequence
  Description of Artificial Sequence: Synthetic oligonucleotide
gccgcggcaagctcgggcgt

SEQ ID NO: 294896 - DNA, 20 bp, Artificial Sequence
  Description of Artificial Sequence: Synthetic oligonucleotide
ccgcggcaagctcgggcgca

SEQ ID NO: 294897 - DNA, 22 bp, Artificial Sequence
  Description of Artificial Sequence: Synthetic oligonucleotide
cgcggcaagctcgggcgcagtt

SEQ ID NO: 294898 - DNA, 23 bp, Artificial Sequence
  Description of Artificial Sequence: Synthetic oligonucleotide
gcggcaagctcgggcgcagttct

SEQ ID NO: 294899 - DNA, 23 bp, Artificial Sequence
  Description of Artificial Sequence: Synthetic oligonucleotide
cggcaagctcgggcgcagttctg

SEQ ID NO: 294900 - DNA, 24 bp, Artificial Sequence
  Description of Artificial Sequence: Synthetic oligonucleotide
ggcaagctcgggcgcagttctgca

SEQ ID NO: 294901 - DNA, 24 bp, Artificial Sequence
  Description of Artificial Sequence: Synthetic oligonucleotide
gcaagctcgggcgcagttctgcag

SEQ ID NO: 294902 - DNA, 24 bp, Artificial Sequence
  Description of Artificial Sequence: Synthetic oligonucleotide
caagctcgggcgcagttctgcagc

SEQ ID NO: 294903 - DNA, 24 bp, Artificial Sequence
  Description of Artificial Sequence: Synthetic oligonucleotide
aagctcgggcgcagttctgcagcc

SEQ ID NO: 294904 - DNA, 23 bp, Artificial Sequence
  Description of Artificial Sequence: Synthetic oligonucleotide
agctcgggcgcagttctgcagcc

SEQ ID NO: 294905 - DNA, 22 bp, Artificial Sequence
  Description of Artificial Sequence: Synthetic oligonucleotide
gctcgggcgcagttctgcagcc

SEQ ID NO: 294906 - DNA, 22 bp, Artificial Sequence
  Description of Artificial Sequence: Synthetic oligonucleotide
ctcgggcgcagttctgcagccc

SEQ ID NO: 294907 - DNA, 22 bp, Artificial Sequence
  Description of Artificial Sequence: Synthetic oligonucleotide
tcgggcgcagttctgcagcccg

SEQ ID NO: 294908 - DNA, 21 bp, Artificial Sequence
  Description of Artificial Sequence: Synthetic oligonucleotide
cgggcgcagttctgcagcccg

SEQ ID NO: 294909 - DNA, 21 bp, Artificial Sequence
  Description of Artificial Sequence: Synthetic oligonucleotide
gggcgcagttctgcagcccgc

SEQ ID NO: 294910 - DNA, 22 bp, Artificial Sequence
  Description of Artificial Sequence: Synthetic oligonucleotide
ggcgcagttctgcagcccgcga

SEQ ID NO: 294911 - DNA, 22 bp, Artificial Sequence
  Description of Artificial Sequence: Synthetic oligonucleotide
gcgcagttctgcagcccgcgac

SEQ ID NO: 294912 - DNA, 22 bp, Artificial Sequence
  Description of Artificial Sequence: Synthetic oligonucleotide
cgcagttctgcagcccgcgacc

SEQ ID NO: 294913 - DNA, 22 bp, Artificial Sequence
  Description of Artificial Sequence: Synthetic oligonucleotide
gcagttctgcagcccgcgaccg

SEQ ID NO: 294914 - DNA, 22 bp, Artificial Sequence
  Description of Artificial Sequence: Synthetic oligonucleotide
cagttctgcagcccgcgaccgc

SEQ ID NO: 294915 - DNA, 24 bp, Artificial Sequence
  Description of Artificial Sequence: Synthetic oligonucleotide
agttctgcagcccgcgaccgccat

SEQ ID NO: 294916 - DNA, 23 bp, Artificial Sequence
  Description of Artificial Sequence: Synthetic oligonucleotide
gttctgcagcccgcgaccgccat

SEQ ID NO: 294917 - DNA, 25 bp, Artificial Sequence
  Description of Artificial Sequence: Synthetic oligonucleotide
ttctgcagcccgcgaccgccatgta

SEQ ID NO: 294918 - DNA, 24 bp, Artificial Sequence
  Description of Artificial Sequence: Synthetic oligonucleotide
tctgcagcccgcgaccgccatgta

SEQ ID NO: 294919 - DNA, 23 bp, Artificial Sequence
  Description of Artificial Sequence: Synthetic oligonucleotide
ctgcagcccgcgaccgccatgta

SEQ ID NO: 294920 - DNA, 23 bp, Artificial Sequence
  Description of Artificial Sequence: Synthetic oligonucleotide
tgcagcccgcgaccgccatgtac

SEQ ID NO: 294921 - DNA, 22 bp, Artificial Sequence
  Description of Artificial Sequence: Synthetic oligonucleotide
gcagcccgcgaccgccatgtac

SEQ ID NO: 294922 - DNA, 23 bp, Artificial Sequence
  Description of Artificial Sequence: Synthetic oligonucleotide
cagcccgcgaccgccatgtacga

SEQ ID NO: 294923 - DNA, 23 bp, Artificial Sequence
  Description of Artificial Sequence: Synthetic oligonucleotide
agcccgcgaccgccatgtacgac

SEQ ID NO: 294924 - DNA, 22 bp, Artificial Sequence
  Description of Artificial Sequence: Synthetic oligonucleotide
gcccgcgaccgccatgtacgac

SEQ ID NO: 294925 - DNA, 24 bp, Artificial Sequence
  Description of Artificial Sequence: Synthetic oligonucleotide
cccgcgaccgccatgtacgaccaa

SEQ ID NO: 294926 - DNA, 25 bp, Artificial Sequence
  Description of Artificial Sequence: Synthetic oligonucleotide
ccgcgaccgccatgtacgaccaact

SEQ ID NO: 294927 - DNA, 27 bp, Artificial Sequence
  Description of Artificial Sequence: Synthetic oligonucleotide
cgcgaccgccatgtacgaccaactcaa

SEQ ID NO: 294928 - DNA, 27 bp, Artificial Sequence
  Description of Artificial Sequence: Synthetic oligonucleotide
gcgaccgccatgtacgaccaactcaag

SEQ ID NO: 294929 - DNA, 27 bp, Artificial Sequence
  Description of Artificial Sequence: Synthetic oligonucleotide
cgaccgccatgtacgaccaactcaagc

SEQ ID NO: 294930 - DNA, 27 bp, Artificial Sequence
  Description of Artificial Sequence: Synthetic oligonucleotide
gaccgccatgtacgaccaactcaagcg

SEQ ID NO: 294931 - DNA, 27 bp, Artificial Sequence
  Description of Artificial Sequence: Synthetic oligonucleotide
accgccatgtacgaccaactcaagcgc

SEQ ID NO: 294932 - DNA, 26 bp, Artificial Sequence
  Description of Artificial Sequence: Synthetic oligonucleotide
ccgccatgtacgaccaactcaagcgc

SEQ ID NO: 294933 - DNA, 27 bp, Artificial Sequence
  Description of Artificial Sequence: Synthetic oligonucleotide
cgccatgtacgaccaactcaagcgcga

SEQ ID NO: 294934 - DNA, 27 bp, Artificial Sequence
  Description of Artificial Sequence: Synthetic oligonucleotide
gccatgtacgaccaactcaagcgcgag

SEQ ID NO: 294935 - DNA, 28 bp, Artificial Sequence
  Description of Artificial Sequence: Synthetic oligonucleotide
ccatgtacgaccaactcaagcgcgagtg

SEQ ID NO: 294936 - DNA, 28 bp, Artificial Sequence
  Description of Artificial Sequence: Synthetic oligonucleotide
catgtacgaccaactcaagcgcgagtgg

SEQ ID NO: 294937 - DNA, 30 bp, Artificial Sequence
  Description of Artificial Sequence: Synthetic oligonucleotide
atgtacgaccaactcaagcgcgagtggatc

SEQ ID NO: 294938 - DNA, 29 bp, Artificial Sequence
  Description of Artificial Sequence: Synthetic oligonucleotide
tgtacgaccaactcaagcgcgagtggatc

SEQ ID NO: 294939 - DNA, 28 bp, Artificial Sequence
  Description of Artificial Sequence: Synthetic oligonucleotide
gtacgaccaactcaagcgcgagtggatc

SEQ ID NO: 294940 - DNA, 28 bp, Artificial Sequence
  Description of Artificial Sequence: Synthetic oligonucleotide
tacgaccaactcaagcgcgagtggatcc

SEQ ID NO: 294941 - DNA, 27 bp, Artificial Sequence
  Description of Artificial Sequence: Synthetic oligonucleotide
acgaccaactcaagcgcgagtggatcc

SEQ ID NO: 294942 - DNA, 26 bp, Artificial Sequence
  Description of Artificial Sequence: Synthetic oligonucleotide
cgaccaactcaagcgcgagtggatcc

SEQ ID NO: 294943 - DNA, 27 bp, Artificial Sequence
  Description of Artificial Sequence: Synthetic oligonucleotide
gaccaactcaagcgcgagtggatccgt

SEQ ID NO: 294944 - DNA, 31 bp, Artificial Sequence
  Description of Artificial Sequence: Synthetic oligonucleotide
accaactcaagcgcgagtggatccgtaaaag

SEQ ID NO: 294945 - DNA, 30 bp, Artificial Sequence
  Description of Artificial Sequence: Synthetic oligonucleotide
ccaactcaagcgcgagtggatccgtaaaag

SEQ ID NO: 294946 - DNA, 30 bp, Artificial Sequence
  Description of Artificial Sequence: Synthetic oligonucleotide
caactcaagcgcgagtggatccgtaaaagg

SEQ ID NO: 294947 - DNA, 30 bp, Artificial Sequence
  Description of Artificial Sequence: Synthetic oligonucleotide
aactcaagcgcgagtggatccgtaaaaggc

SEQ ID NO: 294948 - DNA, 29 bp, Artificial Sequence
  Description of Artificial Sequence: Synthetic oligonucleotide
actcaagcgcgagtggatccgtaaaaggc

SEQ ID NO: 294949 - DNA, 28 bp, Artificial Sequence
  Description of Artificial Sequence: Synthetic oligonucleotide
ctcaagcgcgagtggatccgtaaaaggc

SEQ ID NO: 294950 - DNA, 28 bp, Artificial Sequence
  Description of Artificial Sequence: Synthetic oligonucleotide
tcaagcgcgagtggatccgtaaaaggcc

SEQ ID NO: 294951 - DNA, 27 bp, Artificial Sequence
  Description of Artificial Sequence: Synthetic oligonucleotide
caagcgcgagtggatccgtaaaaggcc

SEQ ID NO: 294952 - DNA, 27 bp, Artificial Sequence
  Description of Artificial Sequence: Synthetic oligonucleotide
aagcgcgagtggatccgtaaaaggccc

SEQ ID NO: 294953 - DNA, 27 bp, Artificial Sequence
  Description of Artificial Sequence: Synthetic oligonucleotide
agcgcgagtggatccgtaaaaggccca

SEQ ID NO: 294954 - DNA, 27 bp, Artificial Sequence
  Description of Artificial Sequence: Synthetic oligonucleotide
gcgcgagtggatccgtaaaaggcccaa

SEQ ID NO: 294955 - DNA, 28 bp, Artificial Sequence
  Description of Artificial Sequence: Synthetic oligonucleotide
cgcgagtggatccgtaaaaggcccaatc

SEQ ID NO: 294956 - DNA, 31 bp, Artificial Sequence
  Description of Artificial Sequence: Synthetic oligonucleotide
gcgagtggatccgtaaaaggcccaatctttg

SEQ ID NO: 294957 - DNA, 31 bp, Artificial Sequence
  Description of Artificial Sequence: Synthetic oligonucleotide
cgagtggatccgtaaaaggcccaatctttgc

SEQ ID NO: 294958 - DNA, 33 bp, Artificial Sequence
  Description of Artificial Sequence: Synthetic oligonucleotide
gagtggatccgtaaaaggcccaatctttgcaag

SEQ ID NO: 294959 - DNA, 34 bp, Artificial Sequence
  Description of Artificial Sequence: Synthetic oligonucleotide
agtggatccgtaaaaggcccaatctttgcaagtg

SEQ ID NO: 294960 - DNA, 33 bp, Artificial Sequence
  Description of Artificial Sequence: Synthetic oligonucleotide
gtggatccgtaaaaggcccaatctttgcaagtg

SEQ ID NO: 294961 - DNA, 33 bp, Artificial Sequence
  Description of Artificial Sequence: Synthetic oligonucleotide
tggatccgtaaaaggcccaatctttgcaagtgc

SEQ ID NO: 294962 - DNA, 32 bp, Artificial Sequence
  Description of Artificial Sequence: Synthetic oligonucleotide
ggatccgtaaaaggcccaatctttgcaagtgc

SEQ ID NO: 294963 - DNA, 32 bp, Artificial Sequence
  Description of Artificial Sequence: Synthetic oligonucleotide
gatccgtaaaaggcccaatctttgcaagtgcg

SEQ ID NO: 294964 - DNA, 32 bp, Artificial Sequence
  Description of Artificial Sequence: Synthetic oligonucleotide
atccgtaaaaggcccaatctttgcaagtgcgc

SEQ ID NO: 294965 - DNA, 31 bp, Artificial Sequence
  Description of Artificial Sequence: Synthetic oligonucleotide
tccgtaaaaggcccaatctttgcaagtgcgc

SEQ ID NO: 294966 - DNA, 30 bp, Artificial Sequence
  Description of Artificial Sequence: Synthetic oligonucleotide
ccgtaaaaggcccaatctttgcaagtgcgc

SEQ ID NO: 294967 - DNA, 30 bp, Artificial Sequence
  Description of Artificial Sequence: Synthetic oligonucleotide
cgtaaaaggcccaatctttgcaagtgcgcg

SEQ ID NO: 294968 - DNA, 30 bp, Artificial Sequence
  Description of Artificial Sequence: Synthetic oligonucleotide
gtaaaaggcccaatctttgcaagtgcgcgg

SEQ ID NO: 294969 - DNA, 32 bp, Artificial Sequence
  Description of Artificial Sequence: Synthetic oligonucleotide
taaaaggcccaatctttgcaagtgcgcggaag

SEQ ID NO: 294970 - DNA, 31 bp, Artificial Sequence
  Description of Artificial Sequence: Synthetic oligonucleotide
aaaaggcccaatctttgcaagtgcgcggaag

SEQ ID NO: 294971 - DNA, 30 bp, Artificial Sequence
  Description of Artificial Sequence: Synthetic oligonucleotide
aaaggcccaatctttgcaagtgcgcggaag

SEQ ID NO: 294972 - DNA, 29 bp, Artificial Sequence
  Description of Artificial Sequence: Synthetic oligonucleotide
aaggcccaatctttgcaagtgcgcggaag

SEQ ID NO: 294973 - DNA, 28 bp, Artificial Sequence
  Description of Artificial Sequence: Synthetic oligonucleotide
aggcccaatctttgcaagtgcgcggaag

SEQ ID NO: 294974 - DNA, 27 bp, Artificial Sequence
  Description of Artificial Sequence: Synthetic oligonucleotide
ggcccaatctttgcaagtgcgcggaag

SEQ ID NO: 294975 - DNA, 28 bp, Artificial Sequence
  Description of Artificial Sequence: Synthetic oligonucleotide
gcccaatctttgcaagtgcgcggaagag

SEQ ID NO: 294976 - DNA, 28 bp, Artificial Sequence
  Description of Artificial Sequence: Synthetic oligonucleotide
cccaatctttgcaagtgcgcggaagagc

SEQ ID NO: 294977 - DNA, 29 bp, Artificial Sequence
  Description of Artificial Sequence: Synthetic oligonucleotide
ccaatctttgcaagtgcgcggaagagctc

SEQ ID NO: 294978 - DNA, 29 bp, Artificial Sequence
  Description of Artificial Sequence: Synthetic oligonucleotide
caatctttgcaagtgcgcggaagagctcg

SEQ ID NO: 294979 - DNA, 29 bp, Artificial Sequence
  Description of Artificial Sequence: Synthetic oligonucleotide
aatctttgcaagtgcgcggaagagctcgg

SEQ ID NO: 294980 - DNA, 28 bp, Artificial Sequence
  Description of Artificial Sequence: Synthetic oligonucleotide
atctttgcaagtgcgcggaagagctcgg

SEQ ID NO: 294981 - DNA, 27 bp, Artificial Sequence
  Description of Artificial Sequence: Synthetic oligonucleotide
tctttgcaagtgcgcggaagagctcgg

SEQ ID NO: 294982 - DNA, 27 bp, Artificial Sequence
  Description of Artificial Sequence: Synthetic oligonucleotide
ctttgcaagtgcgcggaagagctcggt

SEQ ID NO: 294983 - DNA, 27 bp, Artificial Sequence
  Description of Artificial Sequence: Synthetic oligonucleotide
tttgcaagtgcgcggaagagctcggtc

SEQ ID NO: 294984 - DNA, 26 bp, Artificial Sequence
  Description of Artificial Sequence: Synthetic oligonucleotide
ttgcaagtgcgcggaagagctcggtc

SEQ ID NO: 294985 - DNA, 25 bp, Artificial Sequence
  Description of Artificial Sequence: Synthetic oligonucleotide
tgcaagtgcgcggaagagctcggtc

SEQ ID NO: 294986 - DNA, 24 bp, Artificial Sequence
  Description of Artificial Sequence: Synthetic oligonucleotide
gcaagtgcgcggaagagctcggtc

SEQ ID NO: 294987 - DNA, 25 bp, Artificial Sequence
  Description of Artificial Sequence: Synthetic oligonucleotide
caagtgcgcggaagagctcggtcga

SEQ ID NO: 294988 - DNA, 26 bp, Artificial Sequence
  Description of Artificial Sequence: Synthetic oligonucleotide
aagtgcgcggaagagctcggtcgact

SEQ ID NO: 294989 - DNA, 25 bp, Artificial Sequence
  Description of Artificial Sequence: Synthetic oligonucleotide
agtgcgcggaagagctcggtcgact

SEQ ID NO: 294990 - DNA, 24 bp, Artificial Sequence
  Description of Artificial Sequence: Synthetic oligonucleotide
gtgcgcggaagagctcggtcgact

SEQ ID NO: 294991 - DNA, 26 bp, Artificial Sequence
  Description of Artificial Sequence: Synthetic oligonucleotide
tgcgcggaagagctcggtcgactcta

SEQ ID NO: 294992 - DNA, 25 bp, Artificial Sequence
  Description of Artificial Sequence: Synthetic oligonucleotide
gcgcggaagagctcggtcgactcta

SEQ ID NO: 294993 - DNA, 25 bp, Artificial Sequence
  Description of Artificial Sequence: Synthetic oligonucleotide
cgcggaagagctcggtcgactctag

SEQ ID NO: 294994 - DNA, 27 bp, Artificial Sequence
  Description of Artificial Sequence: Synthetic oligonucleotide
gcggaagagctcggtcgactctagcta

SEQ ID NO: 294995 - DNA, 27 bp, Artificial Sequence
  Description of Artificial Sequence: Synthetic oligonucleotide
cggaagagctcggtcgactctagctag

SEQ ID NO: 294996 - DNA, 29 bp, Artificial Sequence
  Description of Artificial Sequence: Synthetic oligonucleotide
ggaagagctcggtcgactctagctagttc

SEQ ID NO: 294997 - DNA, 31 bp, Artificial Sequence
  Description of Artificial Sequence: Synthetic oligonucleotide
gaagagctcggtcgactctagctagttcatc

SEQ ID NO: 294998 - DNA, 32 bp, Artificial Sequence
  Description of Artificial Sequence: Synthetic oligonucleotide
aagagctcggtcgactctagctagttcatctg

SEQ ID NO: 294999 - DNA, 31 bp, Artificial Sequence
  Description of Artificial Sequence: Synthetic oligonucleotide
agagctcggtcgactctagctagttcatctg

SEQ ID NO: 295000 - DNA, 30 bp, Artificial Sequence
  Description of Artificial Sequence: Synthetic oligonucleotide
gagctcggtcgactctagctagttcatctg

SEQ ID NO: 295001 - DNA, 30 bp, Artificial Sequence
  Description of Artificial Sequence: Synthetic oligonucleotide
agctcggtcgactctagctagttcatctgg

SEQ ID NO: 295002 - DNA, 29 bp, Artificial Sequence
  Description of Artificial Sequence: Synthetic oligonucleotide
gctcggtcgactctagctagttcatctgg

SEQ ID NO: 295003 - DNA, 30 bp, Artificial Sequence
  Description of Artificial Sequence: Synthetic oligonucleotide
ctcggtcgactctagctagttcatctggag

SEQ ID NO: 295004 - DNA, 30 bp, Artificial Sequence
  Description of Artificial Sequence: Synthetic oligonucleotide
tcggtcgactctagctagttcatctggagc

SEQ ID NO: 295005 - DNA, 29 bp, Artificial Sequence
  Description of Artificial Sequence: Synthetic oligonucleotide
cggtcgactctagctagttcatctggagc

SEQ ID NO: 295006 - DNA, 30 bp, Artificial Sequence
  Description of Artificial Sequence: Synthetic oligonucleotide
ggtcgactctagctagttcatctggagctg

SEQ ID NO: 295007 - DNA, 32 bp, Artificial Sequence
  Description of Artificial Sequence: Synthetic oligonucleotide
gtcgactctagctagttcatctggagctgaac

SEQ ID NO: 295008 - DNA, 34 bp, Artificial Sequence
  Description of Artificial Sequence: Synthetic oligonucleotide
tcgactctagctagttcatctggagctgaacttc

SEQ ID NO: 295009 - DNA, 33 bp, Artificial Sequence
  Description of Artificial Sequence: Synthetic oligonucleotide
cgactctagctagttcatctggagctgaacttc

SEQ ID NO: 295010 - DNA, 35 bp, Artificial Sequence
  Description of Artificial Sequence: Synthetic oligonucleotide
gactctagctagttcatctggagctgaacttcttg

SEQ ID NO: 295011 - DNA, 35 bp, Artificial Sequence
  Description of Artificial Sequence: Synthetic oligonucleotide
actctagctagttcatctggagctgaacttcttgg

SEQ ID NO: 295012 - DNA, 34 bp, Artificial Sequence
  Description of Artificial Sequence: Synthetic oligonucleotide
ctctagctagttcatctggagctgaacttcttgg

SEQ ID NO: 295013 - DNA, 34 bp, Artificial Sequence
  Description of Artificial Sequence: Synthetic oligonucleotide
tctagctagttcatctggagctgaacttcttggc

SEQ ID NO: 295014 - DNA, 33 bp, Artificial Sequence
  Description of Artificial Sequence: Synthetic oligonucleotide
ctagctagttcatctggagctgaacttcttggc

SEQ ID NO: 295015 - DNA, 35 bp, Artificial Sequence
  Description of Artificial Sequence: Synthetic oligonucleotide
tagctagttcatctggagctgaacttcttggcaac

SEQ ID NO: 295016 - DNA, 34 bp, Artificial Sequence
  Description of Artificial Sequence: Synthetic oligonucleotide
agctagttcatctggagctgaacttcttggcaac

SEQ ID NO: 295017 - DNA, 33 bp, Artificial Sequence
  Description of Artificial Sequence: Synthetic oligonucleotide
gctagttcatctggagctgaacttcttggcaac

SEQ ID NO: 295018 - DNA, 33 bp, Artificial Sequence
  Description of Artificial Sequence: Synthetic oligonucleotide
ctagttcatctggagctgaacttcttggcaacc

SEQ ID NO: 295019 - DNA, 34 bp, Artificial Sequence
  Description of Artificial Sequence: Synthetic oligonucleotide
tagttcatctggagctgaacttcttggcaaccac

SEQ ID NO: 295020 - DNA, 33 bp, Artificial Sequence
  Description of Artificial Sequence: Synthetic oligonucleotide
agttcatctggagctgaacttcttggcaaccac

SEQ ID NO: 295021 - DNA, 32 bp, Artificial Sequence
  Description of Artificial Sequence: Synthetic oligonucleotide
gttcatctggagctgaacttcttggcaaccac

SEQ ID NO: 295022 - DNA, 33 bp, Artificial Sequence
  Description of Artificial Sequence: Synthetic oligonucleotide
ttcatctggagctgaacttcttggcaaccacag

SEQ ID NO: 295023 - DNA, 32 bp, Artificial Sequence
  Description of Artificial Sequence: Synthetic oligonucleotide
tcatctggagctgaacttcttggcaaccacag

SEQ ID NO: 295024 - DNA, 31 bp, Artificial Sequence
  Description of Artificial Sequence: Synthetic oligonucleotide
catctggagctgaacttcttggcaaccacag

SEQ ID NO: 295025 - DNA, 31 bp, Artificial Sequence
  Description of Artificial Sequence: Synthetic oligonucleotide
atctggagctgaacttcttggcaaccacagc

SEQ ID NO: 295026 - DNA, 30 bp, Artificial Sequence
  Description of Artificial Sequence: Synthetic oligonucleotide
tctggagctgaacttcttggcaaccacagc

SEQ ID NO: 295027 - DNA, 29 bp, Artificial Sequence
  Description of Artificial Sequence: Synthetic oligonucleotide
ctggagctgaacttcttggcaaccacagc

SEQ ID NO: 295028 - DNA, 29 bp, Artificial Sequence
  Description of Artificial Sequence: Synthetic oligonucleotide
tggagctgaacttcttggcaaccacagcg

SEQ ID NO: 295029 - DNA, 28 bp, Artificial Sequence
  Description of Artificial Sequence: Synthetic oligonucleotide
ggagctgaacttcttggcaaccacagcg

SEQ ID NO: 295030 - DNA, 29 bp, Artificial Sequence
  Description of Artificial Sequence: Synthetic oligonucleotide
gagctgaacttcttggcaaccacagcgac

SEQ ID NO: 295031 - DNA, 29 bp, Artificial Sequence
  Description of Artificial Sequence: Synthetic oligonucleotide
agctgaacttcttggcaaccacagcgacc

SEQ ID NO: 295032 - DNA, 28 bp, Artificial Sequence
  Description of Artificial Sequence: Synthetic oligonucleotide
gctgaacttcttggcaaccacagcgacc

SEQ ID NO: 295033 - DNA, 30 bp, Artificial Sequence
  Description of Artificial Sequence: Synthetic oligonucleotide
ctgaacttcttggcaaccacagcgaccaag

SEQ ID NO: 295034 - DNA, 30 bp, Artificial Sequence
  Description of Artificial Sequence: Synthetic oligonucleotide
tgaacttcttggcaaccacagcgaccaagc

SEQ ID NO: 295035 - DNA, 29 bp, Artificial Sequence
  Description of Artificial Sequence: Synthetic oligonucleotide
gaacttcttggcaaccacagcgaccaagc

SEQ ID NO: 295036 - DNA, 30 bp, Artificial Sequence
  Description of Artificial Sequence: Synthetic oligonucleotide
aacttcttggcaaccacagcgaccaagctc

SEQ ID NO: 295037 - DNA, 29 bp, Artificial Sequence
  Description of Artificial Sequence: Synthetic oligonucleotide
acttcttggcaaccacagcgaccaagctc

SEQ ID NO: 295038 - DNA, 28 bp, Artificial Sequence
  Description of Artificial Sequence: Synthetic oligonucleotide
cttcttggcaaccacagcgaccaagctc

SEQ ID NO: 295039 - DNA, 29 bp, Artificial Sequence
  Description of Artificial Sequence: Synthetic oligonucleotide
ttcttggcaaccacagcgaccaagctcac

SEQ ID NO: 295040 - DNA, 28 bp, Artificial Sequence
  Description of Artificial Sequence: Synthetic oligonucleotide
tcttggcaaccacagcgaccaagctcac

SEQ ID NO: 295041 - DNA, 27 bp, Artificial Sequence
  Description of Artificial Sequence: Synthetic oligonucleotide
cttggcaaccacagcgaccaagctcac

SEQ ID NO: 295042 - DNA, 27 bp, Artificial Sequence
  Description of Artificial Sequence: Synthetic oligonucleotide
ttggcaaccacagcgaccaagctcacc

SEQ ID NO: 295043 - DNA, 27 bp, Artificial Sequence
  Description of Artificial Sequence: Synthetic oligonucleotide
tggcaaccacagcgaccaagctcacca

SEQ ID NO: 295044 - DNA, 27 bp, Artificial Sequence
  Description of Artificial Sequence: Synthetic oligonucleotide
ggcaaccacagcgaccaagctcaccaa

SEQ ID NO: 295045 - DNA, 28 bp, Artificial Sequence
  Description of Artificial Sequence: Synthetic oligonucleotide
gcaaccacagcgaccaagctcaccaaac

SEQ ID NO: 295046 - DNA, 29 bp, Artificial Sequence
  Description of Artificial Sequence: Synthetic oligonucleotide
caaccacagcgaccaagctcaccaaacag

SEQ ID NO: 295047 - DNA, 29 bp, Artificial Sequence
  Description of Artificial Sequence: Synthetic oligonucleotide
aaccacagcgaccaagctcaccaaacagg

SEQ ID NO: 295048 - DNA, 28 bp, Artificial Sequence
  Description of Artificial Sequence: Synthetic oligonucleotide
accacagcgaccaagctcaccaaacagg

SEQ ID NO: 295049 - DNA, 27 bp, Artificial Sequence
  Description of Artificial Sequence: Synthetic oligonucleotide
ccacagcgaccaagctcaccaaacagg

SEQ ID NO: 295050 - DNA, 28 bp, Artificial Sequence
  Description of Artificial Sequence: Synthetic oligonucleotide
cacagcgaccaagctcaccaaacaggag

SEQ ID NO: 295051 - DNA, 28 bp, Artificial Sequence
  Description of Artificial Sequence: Synthetic oligonucleotide
acagcgaccaagctcaccaaacaggagc

SEQ ID NO: 295052 - DNA, 27 bp, Artificial Sequence
  Description of Artificial Sequence: Synthetic oligonucleotide
cagcgaccaagctcaccaaacaggagc

SEQ ID NO: 295053 - DNA, 32 bp, Artificial Sequence
  Description of Artificial Sequence: Synthetic oligonucleotide
agcgaccaagctcaccaaacaggagctaattc

SEQ ID NO: 295054 - DNA, 31 bp, Artificial Sequence
  Description of Artificial Sequence: Synthetic oligonucleotide
gcgaccaagctcaccaaacaggagctaattc

SEQ ID NO: 295055 - DNA, 32 bp, Artificial Sequence
  Description of Artificial Sequence: Synthetic oligonucleotide
cgaccaagctcaccaaacaggagctaattcag

SEQ ID NO: 295056 - DNA, 32 bp, Artificial Sequence
  Description of Artificial Sequence: Synthetic oligonucleotide
gaccaagctcaccaaacaggagctaattcagg

SEQ ID NO: 295057 - DNA, 32 bp, Artificial Sequence
  Description of Artificial Sequence: Synthetic oligonucleotide
accaagctcaccaaacaggagctaattcaggc

SEQ ID NO: 295058 - DNA, 31 bp, Artificial Sequence
  Description of Artificial Sequence: Synthetic oligonucleotide
ccaagctcaccaaacaggagctaattcaggc

SEQ ID NO: 295059 - DNA, 31 bp, Artificial Sequence
  Description of Artificial Sequence: Synthetic oligonucleotide
caagctcaccaaacaggagctaattcaggcc

SEQ ID NO: 295060 - DNA, 31 bp, Artificial Sequence
  Description of Artificial Sequence: Synthetic oligonucleotide
aagctcaccaaacaggagctaattcaggccc

SEQ ID NO: 295061 - DNA, 30 bp, Artificial Sequence
  Description of Artificial Sequence: Synthetic oligonucleotide
agctcaccaaacaggagctaattcaggccc

SEQ ID NO: 295062 - DNA, 29 bp, Artificial Sequence
  Description of Artificial Sequence: Synthetic oligonucleotide
gctcaccaaacaggagctaattcaggccc

SEQ ID NO: 295063 - DNA, 29 bp, Artificial Sequence
  Description of Artificial Sequence: Synthetic oligonucleotide
ctcaccaaacaggagctaattcaggcccg

SEQ ID NO: 295064 - DNA, 30 bp, Artificial Sequence
  Description of Artificial Sequence: Synthetic oligonucleotide
tcaccaaacaggagctaattcaggcccgtg

SEQ ID NO: 295065 - DNA, 29 bp, Artificial Sequence
  Description of Artificial Sequence: Synthetic oligonucleotide
caccaaacaggagctaattcaggcccgtg

SEQ ID NO: 295066 - DNA, 30 bp, Artificial Sequence
  Description of Artificial Sequence: Synthetic oligonucleotide
accaaacaggagctaattcaggcccgtgag

SEQ ID NO: 295067 - DNA, 29 bp, Artificial Sequence
  Description of Artificial Sequence: Synthetic oligonucleotide
ccaaacaggagctaattcaggcccgtgag

SEQ ID NO: 295068 - DNA, 32 bp, Artificial Sequence
  Description of Artificial Sequence: Synthetic oligonucleotide
caaacaggagctaattcaggcccgtgagatac

SEQ ID NO: 295069 - DNA, 33 bp, Artificial Sequence
  Description of Artificial Sequence: Synthetic oligonucleotide
aaacaggagctaattcaggcccgtgagatactg

SEQ ID NO: 295070 - DNA, 32 bp, Artificial Sequence
  Description of Artificial Sequence: Synthetic oligonucleotide
aacaggagctaattcaggcccgtgagatactg

SEQ ID NO: 295071 - DNA, 31 bp, Artificial Sequence
  Description of Artificial Sequence: Synthetic oligonucleotide
acaggagctaattcaggcccgtgagatactg

SEQ ID NO: 295072 - DNA, 30 bp, Artificial Sequence
  Description of Artificial Sequence: Synthetic oligonucleotide
caggagctaattcaggcccgtgagatactg

SEQ ID NO: 295073 - DNA, 30 bp, Artificial Sequence
  Description of Artificial Sequence: Synthetic oligonucleotide
aggagctaattcaggcccgtgagatactgg

SEQ ID NO: 295074 - DNA, 29 bp, Artificial Sequence
  Description of Artificial Sequence: Synthetic oligonucleotide
ggagctaattcaggcccgtgagatactgg

SEQ ID NO: 295075 - DNA, 30 bp, Artificial Sequence
  Description of Artificial Sequence: Synthetic oligonucleotide
gagctaattcaggcccgtgagatactggag

SEQ ID NO: 295076 - DNA, 32 bp, Artificial Sequence
  Description of Artificial Sequence: Synthetic oligonucleotide
agctaattcaggcccgtgagatactggagttc

SEQ ID NO: 295077 - DNA, 31 bp, Artificial Sequence
  Description of Artificial Sequence: Synthetic oligonucleotide
gctaattcaggcccgtgagatactggagttc

SEQ ID NO: 295078 - DNA, 31 bp, Artificial Sequence
  Description of Artificial Sequence: Synthetic oligonucleotide
ctaattcaggcccgtgagatactggagttcg

SEQ ID NO: 295079 - DNA, 31 bp, Artificial Sequence
  Description of Artificial Sequence: Synthetic oligonucleotide
taattcaggcccgtgagatactggagttcgg

SEQ ID NO: 295080 - DNA, 30 bp, Artificial Sequence
  Description of Artificial Sequence: Synthetic oligonucleotide
aattcaggcccgtgagatactggagttcgg

SEQ ID NO: 295081 - DNA, 29 bp, Artificial Sequence
  Description of Artificial Sequence: Synthetic oligonucleotide
attcaggcccgtgagatactggagttcgg

SEQ ID NO: 295082 - DNA, 28 bp, Artificial Sequence
  Description of Artificial Sequence: Synthetic oligonucleotide
ttcaggcccgtgagatactggagttcgg

SEQ ID NO: 295083 - DNA, 27 bp, Artificial Sequence
  Description of Artificial Sequence: Synthetic oligonucleotide
tcaggcccgtgagatactggagttcgg

SEQ ID NO: 295084 - DNA, 26 bp, Artificial Sequence
  Description of Artificial Sequence: Synthetic oligonucleotide
caggcccgtgagatactggagttcgg

SEQ ID NO: 295085 - DNA, 26 bp, Artificial Sequence
  Description of Artificial Sequence: Synthetic oligonucleotide
aggcccgtgagatactggagttcggg

SEQ ID NO: 295086 - DNA, 25 bp, Artificial Sequence
  Description of Artificial Sequence: Synthetic oligonucleotide
ggcccgtgagatactggagttcggg

SEQ ID NO: 295087 - DNA, 25 bp, Artificial Sequence
  Description of Artificial Sequence: Synthetic oligonucleotide
gcccgtgagatactggagttcgggg

SEQ ID NO: 295088 - DNA, 25 bp, Artificial Sequence
  Description of Artificial Sequence: Synthetic oligonucleotide
cccgtgagatactggagttcggggc

SEQ ID NO: 295089 - DNA, 25 bp, Artificial Sequence
  Description of Artificial Sequence: Synthetic oligonucleotide
ccgtgagatactggagttcggggcc

SEQ ID NO: 295090 - DNA, 27 bp, Artificial Sequence
  Description of Artificial Sequence: Synthetic oligonucleotide
cgtgagatactggagttcggggcccta

SEQ ID NO: 295091 - DNA, 28 bp, Artificial Sequence
  Description of Artificial Sequence: Synthetic oligonucleotide
gtgagatactggagttcggggccctatg

SEQ ID NO: 295092 - DNA, 28 bp, Artificial Sequence
  Description of Artificial Sequence: Synthetic oligonucleotide
tgagatactggagttcggggccctatgg

SEQ ID NO: 295093 - DNA, 27 bp, Artificial Sequence
  Description of Artificial Sequence: Synthetic oligonucleotide
gagatactggagttcggggccctatgg

SEQ ID NO: 295094 - DNA, 28 bp, Artificial Sequence
  Description of Artificial Sequence: Synthetic oligonucleotide
agatactggagttcggggccctatggag

SEQ ID NO: 295095 - DNA, 27 bp, Artificial Sequence
  Description of Artificial Sequence: Synthetic oligonucleotide
gatactggagttcggggccctatggag

SEQ ID NO: 295096 - DNA, 27 bp, Artificial Sequence
  Description of Artificial Sequence: Synthetic oligonucleotide
atactggagttcggggccctatggagc

SEQ ID NO: 295097 - DNA, 27 bp, Artificial Sequence
  Description of Artificial Sequence: Synthetic oligonucleotide
tactggagttcggggccctatggagca

SEQ ID NO: 295098 - DNA, 27 bp, Artificial Sequence
  Description of Artificial Sequence: Synthetic oligonucleotide
actggagttcggggccctatggagcat

SEQ ID NO: 295099 - DNA, 26 bp, Artificial Sequence
  Description of Artificial Sequence: Synthetic oligonucleotide
ctggagttcggggccctatggagcat

SEQ ID NO: 295100 - DNA, 26 bp, Artificial Sequence
  Description of Artificial Sequence: Synthetic oligonucleotide
tggagttcggggccctatggagcatg

SEQ ID NO: 295101 - DNA, 25 bp, Artificial Sequence
  Description of Artificial Sequence: Synthetic oligonucleotide
ggagttcggggccctatggagcatg

SEQ ID NO: 295102 - DNA, 27 bp, Artificial Sequence
  Description of Artificial Sequence: Synthetic oligonucleotide
gagttcggggccctatggagcatgcta

SEQ ID NO: 295103 - DNA, 27 bp, Artificial Sequence
  Description of Artificial Sequence: Synthetic oligonucleotide
agttcggggccctatggagcatgctac

SEQ ID NO: 295104 - DNA, 26 bp, Artificial Sequence
  Description of Artificial Sequence: Synthetic oligonucleotide
gttcggggccctatggagcatgctac

SEQ ID NO: 295105 - DNA, 26 bp, Artificial Sequence
  Description of Artificial Sequence: Synthetic oligonucleotide
ttcggggccctatggagcatgctacg

SEQ ID NO: 295106 - DNA, 25 bp, Artificial Sequence
  Description of Artificial Sequence: Synthetic oligonucleotide
tcggggccctatggagcatgctacg

SEQ ID NO: 295107 - DNA, 24 bp, Artificial Sequence
  Description of Artificial Sequence: Synthetic oligonucleotide
cggggccctatggagcatgctacg

SEQ ID NO: 295108 - DNA, 26 bp, Artificial Sequence
  Description of Artificial Sequence: Synthetic oligonucleotide
ggggccctatggagcatgctacgcaa

SEQ ID NO: 295109 - DNA, 26 bp, Artificial Sequence
  Description of Artificial Sequence: Synthetic oligonucleotide
gggccctatggagcatgctacgcaag

SEQ ID NO: 295110 - DNA, 27 bp, Artificial Sequence
  Description of Artificial Sequence: Synthetic oligonucleotide
ggccctatggagcatgctacgcaagca

SEQ ID NO: 295111 - DNA, 27 bp, Artificial Sequence
  Description of Artificial Sequence: Synthetic oligonucleotide
gccctatggagcatgctacgcaagcac

SEQ ID NO: 295112 - DNA, 29 bp, Artificial Sequence
  Description of Artificial Sequence: Synthetic oligonucleotide
ccctatggagcatgctacgcaagcacatc

SEQ ID NO: 295113 - DNA, 29 bp, Artificial Sequence
  Description of Artificial Sequence: Synthetic oligonucleotide
cctatggagcatgctacgcaagcacatcc

SEQ ID NO: 295114 - DNA, 29 bp, Artificial Sequence
  Description of Artificial Sequence: Synthetic oligonucleotide
ctatggagcatgctacgcaagcacatccc

SEQ ID NO: 295115 - DNA, 29 bp, Artificial Sequence
  Description of Artificial Sequence: Synthetic oligonucleotide
tatggagcatgctacgcaagcacatcccc

SEQ ID NO: 295116 - DNA, 28 bp, Artificial Sequence
  Description of Artificial Sequence: Synthetic oligonucleotide
atggagcatgctacgcaagcacatcccc

SEQ ID NO: 295117 - DNA, 27 bp, Artificial Sequence
  Description of Artificial Sequence: Synthetic oligonucleotide
tggagcatgctacgcaagcacatcccc

SEQ ID NO: 295118 - DNA, 27 bp, Artificial Sequence
  Description of Artificial Sequence: Synthetic oligonucleotide
ggagcatgctacgcaagcacatcccct

SEQ ID NO: 295119 - DNA, 27 bp, Artificial Sequence
  Description of Artificial Sequence: Synthetic oligonucleotide
gagcatgctacgcaagcacatcccctg

SEQ ID NO: 295120 - DNA, 27 bp, Artificial Sequence
  Description of Artificial Sequence: Synthetic oligonucleotide
agcatgctacgcaagcacatcccctgc

SEQ ID NO: 295121 - DNA, 27 bp, Artificial Sequence
  Description of Artificial Sequence: Synthetic oligonucleotide
gcatgctacgcaagcacatcccctgct

SEQ ID NO: 295122 - DNA, 28 bp, Artificial Sequence
  Description of Artificial Sequence: Synthetic oligonucleotide
catgctacgcaagcacatcccctgcttc

SEQ ID NO: 295123 - DNA, 28 bp, Artificial Sequence
  Description of Artificial Sequence: Synthetic oligonucleotide
atgctacgcaagcacatcccctgcttcg

SEQ ID NO: 295124 - DNA, 27 bp, Artificial Sequence
  Description of Artificial Sequence: Synthetic oligonucleotide
tgctacgcaagcacatcccctgcttcg

SEQ ID NO: 295125 - DNA, 27 bp, Artificial Sequence
  Description of Artificial Sequence: Synthetic oligonucleotide
gctacgcaagcacatcccctgcttcga

SEQ ID NO: 295126 - DNA, 27 bp, Artificial Sequence
  Description of Artificial Sequence: Synthetic oligonucleotide
ctacgcaagcacatcccctgcttcgag

SEQ ID NO: 295127 - DNA, 27 bp, Artificial Sequence
  Description of Artificial Sequence: Synthetic oligonucleotide
tacgcaagcacatcccctgcttcgagc

SEQ ID NO: 295128 - DNA, 26 bp, Artificial Sequence
  Description of Artificial Sequence: Synthetic oligonucleotide
acgcaagcacatcccctgcttcgagc

SEQ ID NO: 295129 - DNA, 25 bp, Artificial Sequence
  Description of Artificial Sequence: Synthetic oligonucleotide
cgcaagcacatcccctgcttcgagc

SEQ ID NO: 295130 - DNA, 25 bp, Artificial Sequence
  Description of Artificial Sequence: Synthetic oligonucleotide
gcaagcacatcccctgcttcgagcg

SEQ ID NO: 295131 - DNA, 27 bp, Artificial Sequence
  Description of Artificial Sequence: Synthetic oligonucleotide
caagcacatcccctgcttcgagcggta

SEQ ID NO: 295132 - DNA, 27 bp, Artificial Sequence
  Description of Artificial Sequence: Synthetic oligonucleotide
aagcacatcccctgcttcgagcggtac

SEQ ID NO: 295133 - DNA, 27 bp, Artificial Sequence
  Description of Artificial Sequence: Synthetic oligonucleotide
agcacatcccctgcttcgagcggtaca

SEQ ID NO: 295134 - DNA, 27 bp, Artificial Sequence
  Description of Artificial Sequence: Synthetic oligonucleotide
gcacatcccctgcttcgagcggtacat

SEQ ID NO: 295135 - DNA, 27 bp, Artificial Sequence
  Description of Artificial Sequence: Synthetic oligonucleotide
cacatcccctgcttcgagcggtacatg

SEQ ID NO: 295136 - DNA, 27 bp, Artificial Sequence
  Description of Artificial Sequence: Synthetic oligonucleotide
acatcccctgcttcgagcggtacatgg

SEQ ID NO: 295137 - DNA, 26 bp, Artificial Sequence
  Description of Artificial Sequence: Synthetic oligonucleotide
catcccctgcttcgagcggtacatgg

SEQ ID NO: 295138 - DNA, 26 bp, Artificial Sequence
  Description of Artificial Sequence: Synthetic oligonucleotide
atcccctgcttcgagcggtacatggc

SEQ ID NO: 295139 - DNA, 25 bp, Artificial Sequence
  Description of Artificial Sequence: Synthetic oligonucleotide
tcccctgcttcgagcggtacatggc

SEQ ID NO: 295140 - DNA, 24 bp, Artificial Sequence
  Description of Artificial Sequence: Synthetic oligonucleotide
cccctgcttcgagcggtacatggc

SEQ ID NO: 295141 - DNA, 24 bp, Artificial Sequence
  Description of Artificial Sequence: Synthetic oligonucleotide
ccctgcttcgagcggtacatggcc

SEQ ID NO: 295142 - DNA, 25 bp, Artificial Sequence
  Description of Artificial Sequence: Synthetic oligonucleotide
cctgcttcgagcggtacatggccga

SEQ ID NO: 295143 - DNA, 25 bp, Artificial Sequence
  Description of Artificial Sequence: Synthetic oligonucleotide
ctgcttcgagcggtacatggccgag

SEQ ID NO: 295144 - DNA, 26 bp, Artificial Sequence
  Description of Artificial Sequence: Synthetic oligonucleotide
tgcttcgagcggtacatggccgagct

SEQ ID NO: 295145 - DNA, 25 bp, Artificial Sequence
  Description of Artificial Sequence: Synthetic oligonucleotide
gcttcgagcggtacatggccgagct

SEQ ID NO: 295146 - DNA, 27 bp, Artificial Sequence
  Description of Artificial Sequence: Synthetic oligonucleotide
cttcgagcggtacatggccgagctcaa

SEQ ID NO: 295147 - DNA, 29 bp, Artificial Sequence
  Description of Artificial Sequence: Synthetic oligonucleotide
ttcgagcggtacatggccgagctcaaatc

SEQ ID NO: 295148 - DNA, 28 bp, Artificial Sequence
  Description of Artificial Sequence: Synthetic oligonucleotide
tcgagcggtacatggccgagctcaaatc

SEQ ID NO: 295149 - DNA, 27 bp, Artificial Sequence
  Description of Artificial Sequence: Synthetic oligonucleotide
cgagcggtacatggccgagctcaaatc

SEQ ID NO: 295150 - DNA, 27 bp, Artificial Sequence
  Description of Artificial Sequence: Synthetic oligonucleotide
gagcggtacatggccgagctcaaatcc

SEQ ID NO: 295151 - DNA, 29 bp, Artificial Sequence
  Description of Artificial Sequence: Synthetic oligonucleotide
agcggtacatggccgagctcaaatcctac

SEQ ID NO: 295152 - DNA, 28 bp, Artificial Sequence
  Description of Artificial Sequence: Synthetic oligonucleotide
gcggtacatggccgagctcaaatcctac

SEQ ID NO: 295153 - DNA, 30 bp, Artificial Sequence
  Description of Artificial Sequence: Synthetic oligonucleotide
cggtacatggccgagctcaaatcctactac

SEQ ID NO: 295154 - DNA, 33 bp, Artificial Sequence
  Description of Artificial Sequence: Synthetic oligonucleotide
ggtacatggccgagctcaaatcctactacttag

SEQ ID NO: 295155 - DNA, 37 bp, Artificial Sequence
  Description of Artificial Sequence: Synthetic oligonucleotide
gtacatggccgagctcaaatcctactacttagattac

SEQ ID NO: 295156 - DNA, 39 bp, Artificial Sequence
  Description of Artificial Sequence: Synthetic oligonucleotide
tacatggccgagctcaaatcctactacttagattacaag

SEQ ID NO: 295157 - DNA, 38 bp, Artificial Sequence
  Description of Artificial Sequence: Synthetic oligonucleotide
acatggccgagctcaaatcctactacttagattacaag

SEQ ID NO: 295158 - DNA, 37 bp, Artificial Sequence
  Description of Artificial Sequence: Synthetic oligonucleotide
catggccgagctcaaatcctactacttagattacaag

SEQ ID NO: 295159 - DNA, 37 bp, Artificial Sequence
  Description of Artificial Sequence: Synthetic oligonucleotide
atggccgagctcaaatcctactacttagattacaagc

SEQ ID NO: 295160 - DNA, 36 bp, Artificial Sequence
  Description of Artificial Sequence: Synthetic oligonucleotide
tggccgagctcaaatcctactacttagattacaagc

SEQ ID NO: 295161 - DNA, 35 bp, Artificial Sequence
  Description of Artificial Sequence: Synthetic oligonucleotide
ggccgagctcaaatcctactacttagattacaagc

SEQ ID NO: 295162 - DNA, 36 bp, Artificial Sequence
  Description of Artificial Sequence: Synthetic oligonucleotide
gccgagctcaaatcctactacttagattacaagcag

SEQ ID NO: 295163 - DNA, 36 bp, Artificial Sequence
  Description of Artificial Sequence: Synthetic oligonucleotide
ccgagctcaaatcctactacttagattacaagcagc

SEQ ID NO: 295164 - DNA, 37 bp, Artificial Sequence
  Description of Artificial Sequence: Synthetic oligonucleotide
cgagctcaaatcctactacttagattacaagcagcag

SEQ ID NO: 295165 - DNA, 37 bp, Artificial Sequence
  Description of Artificial Sequence: Synthetic oligonucleotide
gagctcaaatcctactacttagattacaagcagcagc

SEQ ID NO: 295166 - DNA, 38 bp, Artificial Sequence
  Description of Artificial Sequence: Synthetic oligonucleotide
agctcaaatcctactacttagattacaagcagcagctc

SEQ ID NO: 295167 - DNA, 37 bp, Artificial Sequence
  Description of Artificial Sequence: Synthetic oligonucleotide
gctcaaatcctactacttagattacaagcagcagctc

SEQ ID NO: 295168 - DNA, 37 bp, Artificial Sequence
  Description of Artificial Sequence: Synthetic oligonucleotide
ctcaaatcctactacttagattacaagcagcagctcc

SEQ ID NO: 295169 - DNA, 37 bp, Artificial Sequence
  Description of Artificial Sequence: Synthetic oligonucleotide
tcaaatcctactacttagattacaagcagcagctccg

SEQ ID NO: 295170 - DNA, 36 bp, Artificial Sequence
  Description of Artificial Sequence: Synthetic oligonucleotide
caaatcctactacttagattacaagcagcagctccg

SEQ ID NO: 295171 - DNA, 36 bp, Artificial Sequence
  Description of Artificial Sequence: Synthetic oligonucleotide
aaatcctactacttagattacaagcagcagctccgc

SEQ ID NO: 295172 - DNA, 35 bp, Artificial Sequence
  Description of Artificial Sequence: Synthetic oligonucleotide
aatcctactacttagattacaagcagcagctccgc

SEQ ID NO: 295173 - DNA, 34 bp, Artificial Sequence
  Description of Artificial Sequence: Synthetic oligonucleotide
atcctactacttagattacaagcagcagctccgc

SEQ ID NO: 295174 - DNA, 33 bp, Artificial Sequence
  Description of Artificial Sequence: Synthetic oligonucleotide
tcctactacttagattacaagcagcagctccgc

SEQ ID NO: 295175 - DNA, 32 bp, Artificial Sequence
  Description of Artificial Sequence: Synthetic oligonucleotide
cctactacttagattacaagcagcagctccgc

SEQ ID NO: 295176 - DNA, 32 bp, Artificial Sequence
  Description of Artificial Sequence: Synthetic oligonucleotide
ctactacttagattacaagcagcagctccgcg

SEQ ID NO: 295177 - DNA, 33 bp, Artificial Sequence
  Description of Artificial Sequence: Synthetic oligonucleotide
tactacttagattacaagcagcagctccgcgag

SEQ ID NO: 295178 - DNA, 32 bp, Artificial Sequence
  Description of Artificial Sequence: Synthetic oligonucleotide
actacttagattacaagcagcagctccgcgag

SEQ ID NO: 295179 - DNA, 31 bp, Artificial Sequence
  Description of Artificial Sequence: Synthetic oligonucleotide
ctacttagattacaagcagcagctccgcgag

SEQ ID NO: 295180 - DNA, 32 bp, Artificial Sequence
  Description of Artificial Sequence: Synthetic oligonucleotide
tacttagattacaagcagcagctccgcgagtc

SEQ ID NO: 295181 - DNA, 31 bp, Artificial Sequence
  Description of Artificial Sequence: Synthetic oligonucleotide
acttagattacaagcagcagctccgcgagtc

SEQ ID NO: 295182 - DNA, 30 bp, Artificial Sequence
  Description of Artificial Sequence: Synthetic oligonucleotide
cttagattacaagcagcagctccgcgagtc

SEQ ID NO: 295183 - DNA, 31 bp, Artificial Sequence
  Description of Artificial Sequence: Synthetic oligonucleotide
ttagattacaagcagcagctccgcgagtcag

SEQ ID NO: 295184 - DNA, 30 bp, Artificial Sequence
  Description of Artificial Sequence: Synthetic oligonucleotide
tagattacaagcagcagctccgcgagtcag

SEQ ID NO: 295185 - DNA, 29 bp, Artificial Sequence
  Description of Artificial Sequence: Synthetic oligonucleotide
agattacaagcagcagctccgcgagtcag

SEQ ID NO: 295186 - DNA, 28 bp, Artificial Sequence
  Description of Artificial Sequence: Synthetic oligonucleotide
gattacaagcagcagctccgcgagtcag

SEQ ID NO: 295187 - DNA, 28 bp, Artificial Sequence
  Description of Artificial Sequence: Synthetic oligonucleotide
attacaagcagcagctccgcgagtcagc

SEQ ID NO: 295188 - DNA, 27 bp, Artificial Sequence
  Description of Artificial Sequence: Synthetic oligonucleotide
ttacaagcagcagctccgcgagtcagc

SEQ ID NO: 295189 - DNA, 26 bp, Artificial Sequence
  Description of Artificial Sequence: Synthetic oligonucleotide
tacaagcagcagctccgcgagtcagc

SEQ ID NO: 295190 - DNA, 25 bp, Artificial Sequence
  Description of Artificial Sequence: Synthetic oligonucleotide
acaagcagcagctccgcgagtcagc

SEQ ID NO: 295191 - DNA, 24 bp, Artificial Sequence
  Description of Artificial Sequence: Synthetic oligonucleotide
caagcagcagctccgcgagtcagc

SEQ ID NO: 295192 - DNA, 27 bp, Artificial Sequence
  Description of Artificial Sequence: Synthetic oligonucleotide
aagcagcagctccgcgagtcagcgtat

SEQ ID NO: 295193 - DNA, 27 bp, Artificial Sequence
  Description of Artificial Sequence: Synthetic oligonucleotide
agcagcagctccgcgagtcagcgtata

SEQ ID NO: 295194 - DNA, 27 bp, Artificial Sequence
  Description of Artificial Sequence: Synthetic oligonucleotide
gcagcagctccgcgagtcagcgtatat

SEQ ID NO: 295195 - DNA, 27 bp, Artificial Sequence
  Description of Artificial Sequence: Synthetic oligonucleotide
cagcagctccgcgagtcagcgtatatg

SEQ ID NO: 295196 - DNA, 27 bp, Artificial Sequence
  Description of Artificial Sequence: Synthetic oligonucleotide
agcagctccgcgagtcagcgtatatgc

SEQ ID NO: 295197 - DNA, 27 bp, Artificial Sequence
  Description of Artificial Sequence: Synthetic oligonucleotide
gcagctccgcgagtcagcgtatatgca

SEQ ID NO: 295198 - DNA, 27 bp, Artificial Sequence
  Description of Artificial Sequence: Synthetic oligonucleotide
cagctccgcgagtcagcgtatatgcac

SEQ ID NO: 295199 - DNA, 27 bp, Artificial Sequence
  Description of Artificial Sequence: Synthetic oligonucleotide
agctccgcgagtcagcgtatatgcacg

SEQ ID NO: 295200 - DNA, 27 bp, Artificial Sequence
  Description of Artificial Sequence: Synthetic oligonucleotide
gctccgcgagtcagcgtatatgcacga

SEQ ID NO: 295201 - DNA, 27 bp, Artificial Sequence
  Description of Artificial Sequence: Synthetic oligonucleotide
ctccgcgagtcagcgtatatgcacgag

SEQ ID NO: 295202 - DNA, 27 bp, Artificial Sequence
  Description of Artificial Sequence: Synthetic oligonucleotide
tccgcgagtcagcgtatatgcacgagc

SEQ ID NO: 295203 - DNA, 27 bp, Artificial Sequence
  Description of Artificial Sequence: Synthetic oligonucleotide
ccgcgagtcagcgtatatgcacgagct

SEQ ID NO: 295204 - DNA, 27 bp, Artificial Sequence
  Description of Artificial Sequence: Synthetic oligonucleotide
cgcgagtcagcgtatatgcacgagctc

SEQ ID NO: 295205 - DNA, 29 bp, Artificial Sequence
  Description of Artificial Sequence: Synthetic oligonucleotide
gcgagtcagcgtatatgcacgagctcttg

SEQ ID NO: 295206 - DNA, 29 bp, Artificial Sequence
  Description of Artificial Sequence: Synthetic oligonucleotide
cgagtcagcgtatatgcacgagctcttgg

SEQ ID NO: 295207 - DNA, 29 bp, Artificial Sequence
  Description of Artificial Sequence: Synthetic oligonucleotide
gagtcagcgtatatgcacgagctcttggc

SEQ ID NO: 295208 - DNA, 29 bp, Artificial Sequence
  Description of Artificial Sequence: Synthetic oligonucleotide
agtcagcgtatatgcacgagctcttggcc

SEQ ID NO: 295209 - DNA, 28 bp, Artificial Sequence
  Description of Artificial Sequence: Synthetic oligonucleotide
gtcagcgtatatgcacgagctcttggcc

SEQ ID NO: 295210 - DNA, 28 bp, Artificial Sequence
  Description of Artificial Sequence: Synthetic oligonucleotide
tcagcgtatatgcacgagctcttggccc

SEQ ID NO: 295211 - DNA, 27 bp, Artificial Sequence
  Description of Artificial Sequence: Synthetic oligonucleotide
cagcgtatatgcacgagctcttggccc

SEQ ID NO: 295212 - DNA, 28 bp, Artificial Sequence
  Description of Artificial Sequence: Synthetic oligonucleotide
agcgtatatgcacgagctcttggccctc

SEQ ID NO: 295213 - DNA, 27 bp, Artificial Sequence
  Description of Artificial Sequence: Synthetic oligonucleotide
gcgtatatgcacgagctcttggccctc

SEQ ID NO: 295214 - DNA, 29 bp, Artificial Sequence
  Description of Artificial Sequence: Synthetic oligonucleotide
cgtatatgcacgagctcttggccctcaac

SEQ ID NO: 295215 - DNA, 29 bp, Artificial Sequence
  Description of Artificial Sequence: Synthetic oligonucleotide
gtatatgcacgagctcttggccctcaacc

SEQ ID NO: 295216 - DNA, 30 bp, Artificial Sequence
  Description of Artificial Sequence: Synthetic oligonucleotide
tatatgcacgagctcttggccctcaacctg

SEQ ID NO: 295217 - DNA, 29 bp, Artificial Sequence
  Description of Artificial Sequence: Synthetic oligonucleotide
atatgcacgagctcttggccctcaacctg

SEQ ID NO: 295218 - DNA, 28 bp, Artificial Sequence
  Description of Artificial Sequence: Synthetic oligonucleotide
tatgcacgagctcttggccctcaacctg

SEQ ID NO: 295219 - DNA, 27 bp, Artificial Sequence
  Description of Artificial Sequence: Synthetic oligonucleotide
atgcacgagctcttggccctcaacctg

SEQ ID NO: 295220 - DNA, 26 bp, Artificial Sequence
  Description of Artificial Sequence: Synthetic oligonucleotide
tgcacgagctcttggccctcaacctg

SEQ ID NO: 295221 - DNA, 25 bp, Artificial Sequence
  Description of Artificial Sequence: Synthetic oligonucleotide
gcacgagctcttggccctcaacctg

SEQ ID NO: 295222 - DNA, 26 bp, Artificial Sequence
  Description of Artificial Sequence: Synthetic oligonucleotide
cacgagctcttggccctcaacctgct

SEQ ID NO: 295223 - DNA, 27 bp, Artificial Sequence
  Description of Artificial Sequence: Synthetic oligonucleotide
acgagctcttggccctcaacctgctct

SEQ ID NO: 295224 - DNA, 27 bp, Artificial Sequence
  Description of Artificial Sequence: Synthetic oligonucleotide
cgagctcttggccctcaacctgctctt

SEQ ID NO: 295225 - DNA, 27 bp, Artificial Sequence
  Description of Artificial Sequence: Synthetic oligonucleotide
gagctcttggccctcaacctgctcttc

SEQ ID NO: 295226 - DNA, 27 bp, Artificial Sequence
  Description of Artificial Sequence: Synthetic oligonucleotide
agctcttggccctcaacctgctcttcc

SEQ ID NO: 295227 - DNA, 27 bp, Artificial Sequence
  Description of Artificial Sequence: Synthetic oligonucleotide
gctcttggccctcaacctgctcttcct

SEQ ID NO: 295228 - DNA, 27 bp, Artificial Sequence
  Description of Artificial Sequence: Synthetic oligonucleotide
ctcttggccctcaacctgctcttcctg

SEQ ID NO: 295229 - DNA, 27 bp, Artificial Sequence
  Description of Artificial Sequence: Synthetic oligonucleotide
tcttggccctcaacctgctcttcctgg

SEQ ID NO: 295230 - DNA, 27 bp, Artificial Sequence
  Description of Artificial Sequence: Synthetic oligonucleotide
cttggccctcaacctgctcttcctggt

SEQ ID NO: 295231 - DNA, 27 bp, Artificial Sequence
  Description of Artificial Sequence: Synthetic oligonucleotide
ttggccctcaacctgctcttcctggtg

SEQ ID NO: 295232 - DNA, 27 bp, Artificial Sequence
  Description of Artificial Sequence: Synthetic oligonucleotide
tggccctcaacctgctcttcctggtgt

SEQ ID NO: 295233 - DNA, 26 bp, Artificial Sequence
  Description of Artificial Sequence: Synthetic oligonucleotide
ggccctcaacctgctcttcctggtgt

SEQ ID NO: 295234 - DNA, 26 bp, Artificial Sequence
  Description of Artificial Sequence: Synthetic oligonucleotide
gccctcaacctgctcttcctggtgtc

SEQ ID NO: 295235 - DNA, 26 bp, Artificial Sequence
  Description of Artificial Sequence: Synthetic oligonucleotide
ccctcaacctgctcttcctggtgtcc

SEQ ID NO: 295236 - DNA, 27 bp, Artificial Sequence
  Description of Artificial Sequence: Synthetic oligonucleotide
cctcaacctgctcttcctggtgtccca

SEQ ID NO: 295237 - DNA, 27 bp, Artificial Sequence
  Description of Artificial Sequence: Synthetic oligonucleotide
ctcaacctgctcttcctggtgtcccag

SEQ ID NO: 295238 - DNA, 29 bp, Artificial Sequence
  Description of Artificial Sequence: Synthetic oligonucleotide
tcaacctgctcttcctggtgtcccagatc

SEQ ID NO: 295239 - DNA, 28 bp, Artificial Sequence
  Description of Artificial Sequence: Synthetic oligonucleotide
caacctgctcttcctggtgtcccagatc

SEQ ID NO: 295240 - DNA, 28 bp, Artificial Sequence
  Description of Artificial Sequence: Synthetic oligonucleotide
aacctgctcttcctggtgtcccagatcc

SEQ ID NO: 295241 - DNA, 27 bp, Artificial Sequence
  Description of Artificial Sequence: Synthetic oligonucleotide
acctgctcttcctggtgtcccagatcc

SEQ ID NO: 295242 - DNA, 26 bp, Artificial Sequence
  Description of Artificial Sequence: Synthetic oligonucleotide
cctgctcttcctggtgtcccagatcc

SEQ ID NO: 295243 - DNA, 26 bp, Artificial Sequence
  Description of Artificial Sequence: Synthetic oligonucleotide
ctgctcttcctggtgtcccagatccg

SEQ ID NO: 295244 - DNA, 26 bp, Artificial Sequence
  Description of Artificial Sequence: Synthetic oligonucleotide
tgctcttcctggtgtcccagatccgg

SEQ ID NO: 295245 - DNA, 25 bp, Artificial Sequence
  Description of Artificial Sequence: Synthetic oligonucleotide
gctcttcctggtgtcccagatccgg

SEQ ID NO: 295246 - DNA, 26 bp, Artificial Sequence
  Description of Artificial Sequence: Synthetic oligonucleotide
ctcttcctggtgtcccagatccgggt

SEQ ID NO: 295247 - DNA, 26 bp, Artificial Sequence
  Description of Artificial Sequence: Synthetic oligonucleotide
tcttcctggtgtcccagatccgggtg

SEQ ID NO: 295248 - DNA, 25 bp, Artificial Sequence
  Description of Artificial Sequence: Synthetic oligonucleotide
cttcctggtgtcccagatccgggtg

SEQ ID NO: 295249 - DNA, 25 bp, Artificial Sequence
  Description of Artificial Sequence: Synthetic oligonucleotide
ttcctggtgtcccagatccgggtgg

SEQ ID NO: 295250 - DNA, 24 bp, Artificial Sequence
  Description of Artificial Sequence: Synthetic oligonucleotide
tcctggtgtcccagatccgggtgg

SEQ ID NO: 295251 - DNA, 23 bp, Artificial Sequence
  Description of Artificial Sequence: Synthetic oligonucleotide
cctggtgtcccagatccgggtgg

SEQ ID NO: 295252 - DNA, 24 bp, Artificial Sequence
  Description of Artificial Sequence: Synthetic oligonucleotide
ctggtgtcccagatccgggtggca

SEQ ID NO: 295253 - DNA, 25 bp, Artificial Sequence
  Description of Artificial Sequence: Synthetic oligonucleotide
tggtgtcccagatccgggtggcaga

SEQ ID NO: 295254 - DNA, 24 bp, Artificial Sequence
  Description of Artificial Sequence: Synthetic oligonucleotide
ggtgtcccagatccgggtggcaga

SEQ ID NO: 295255 - DNA, 26 bp, Artificial Sequence
  Description of Artificial Sequence: Synthetic oligonucleotide
gtgtcccagatccgggtggcagagtt

SEQ ID NO: 295256 - DNA, 26 bp, Artificial Sequence
  Description of Artificial Sequence: Synthetic oligonucleotide
tgtcccagatccgggtggcagagttc

SEQ ID NO: 295257 - DNA, 25 bp, Artificial Sequence
  Description of Artificial Sequence: Synthetic oligonucleotide
gtcccagatccgggtggcagagttc

SEQ ID NO: 295258 - DNA, 26 bp, Artificial Sequence
  Description of Artificial Sequence: Synthetic oligonucleotide
tcccagatccgggtggcagagttcca

SEQ ID NO: 295259 - DNA, 25 bp, Artificial Sequence
  Description of Artificial Sequence: Synthetic oligonucleotide
cccagatccgggtggcagagttcca

SEQ ID NO: 295260 - DNA, 26 bp, Artificial Sequence
  Description of Artificial Sequence: Synthetic oligonucleotide
ccagatccgggtggcagagttccact

SEQ ID NO: 295261 - DNA, 26 bp, Artificial Sequence
  Description of Artificial Sequence: Synthetic oligonucleotide
cagatccgggtggcagagttccactc

SEQ ID NO: 295262 - DNA, 26 bp, Artificial Sequence
  Description of Artificial Sequence: Synthetic oligonucleotide
agatccgggtggcagagttccactcg

SEQ ID NO: 295263 - DNA, 25 bp, Artificial Sequence
  Description of Artificial Sequence: Synthetic oligonucleotide
gatccgggtggcagagttccactcg

SEQ ID NO: 295264 - DNA, 26 bp, Artificial Sequence
  Description of Artificial Sequence: Synthetic oligonucleotide
atccgggtggcagagttccactcgga

SEQ ID NO: 295265 - DNA, 25 bp, Artificial Sequence
  Description of Artificial Sequence: Synthetic oligonucleotide
tccgggtggcagagttccactcgga

SEQ ID NO: 295266 - DNA, 24 bp, Artificial Sequence
  Description of Artificial Sequence: Synthetic oligonucleotide
ccgggtggcagagttccactcgga

SEQ ID NO: 295267 - DNA, 26 bp, Artificial Sequence
  Description of Artificial Sequence: Synthetic oligonucleotide
cgggtggcagagttccactcggagtt

SEQ ID NO: 295268 - DNA, 26 bp, Artificial Sequence
  Description of Artificial Sequence: Synthetic oligonucleotide
gggtggcagagttccactcggagttg

SEQ ID NO: 295269 - DNA, 27 bp, Artificial Sequence
  Description of Artificial Sequence: Synthetic oligonucleotide
ggtggcagagttccactcggagttggt

SEQ ID NO: 295270 - DNA, 27 bp, Artificial Sequence
  Description of Artificial Sequence: Synthetic oligonucleotide
gtggcagagttccactcggagttggtg

SEQ ID NO: 295271 - DNA, 27 bp, Artificial Sequence
  Description of Artificial Sequence: Synthetic oligonucleotide
tggcagagttccactcggagttggtgc

SEQ ID NO: 295272 - DNA, 26 bp, Artificial Sequence
  Description of Artificial Sequence: Synthetic oligonucleotide
ggcagagttccactcggagttggtgc

SEQ ID NO: 295273 - DNA, 26 bp, Artificial Sequence
  Description of Artificial Sequence: Synthetic oligonucleotide
gcagagttccactcggagttggtgcg

SEQ ID NO: 295274 - DNA, 26 bp, Artificial Sequence
  Description of Artificial Sequence: Synthetic oligonucleotide
cagagttccactcggagttggtgcgg

SEQ ID NO: 295275 - DNA, 27 bp, Artificial Sequence
  Description of Artificial Sequence: Synthetic oligonucleotide
agagttccactcggagttggtgcggct

SEQ ID NO: 295276 - DNA, 26 bp, Artificial Sequence
  Description of Artificial Sequence: Synthetic oligonucleotide
gagttccactcggagttggtgcggct

SEQ ID NO: 295277 - DNA, 26 bp, Artificial Sequence
  Description of Artificial Sequence: Synthetic oligonucleotide
agttccactcggagttggtgcggctg

SEQ ID NO: 295278 - DNA, 25 bp, Artificial Sequence
  Description of Artificial Sequence: Synthetic oligonucleotide
gttccactcggagttggtgcggctg

SEQ ID NO: 295279 - DNA, 25 bp, Artificial Sequence
  Description of Artificial Sequence: Synthetic oligonucleotide
ttccactcggagttggtgcggctgc

SEQ ID NO: 295280 - DNA, 24 bp, Artificial Sequence
  Description of Artificial Sequence: Synthetic oligonucleotide
tccactcggagttggtgcggctgc

SEQ ID NO: 295281 - DNA, 23 bp, Artificial Sequence
  Description of Artificial Sequence: Synthetic oligonucleotide
ccactcggagttggtgcggctgc

SEQ ID NO: 295282 - DNA, 24 bp, Artificial Sequence
  Description of Artificial Sequence: Synthetic oligonucleotide
cactcggagttggtgcggctgcca

SEQ ID NO: 295283 - DNA, 24 bp, Artificial Sequence
  Description of Artificial Sequence: Synthetic oligonucleotide
actcggagttggtgcggctgccag

SEQ ID NO: 295284 - DNA, 23 bp, Artificial Sequence
  Description of Artificial Sequence: Synthetic oligonucleotide
ctcggagttggtgcggctgccag

SEQ ID NO: 295285 - DNA, 23 bp, Artificial Sequence
  Description of Artificial Sequence: Synthetic oligonucleotide
tcggagttggtgcggctgccagc

SEQ ID NO: 295286 - DNA, 22 bp, Artificial Sequence
  Description of Artificial Sequence: Synthetic oligonucleotide
cggagttggtgcggctgccagc

SEQ ID NO: 295287 - DNA, 24 bp, Artificial Sequence
  Description of Artificial Sequence: Synthetic oligonucleotide
ggagttggtgcggctgccagccaa

SEQ ID NO: 295288 - DNA, 24 bp, Artificial Sequence
  Description of Artificial Sequence: Synthetic oligonucleotide
gagttggtgcggctgccagccaag

SEQ ID NO: 295289 - DNA, 25 bp, Artificial Sequence
  Description of Artificial Sequence: Synthetic oligonucleotide
agttggtgcggctgccagccaagga

SEQ ID NO: 295290 - DNA, 24 bp, Artificial Sequence
  Description of Artificial Sequence: Synthetic oligonucleotide
gttggtgcggctgccagccaagga

SEQ ID NO: 295291 - DNA, 27 bp, Artificial Sequence
  Description of Artificial Sequence: Synthetic oligonucleotide
ttggtgcggctgccagccaaggactta

SEQ ID NO: 295292 - DNA, 26 bp, Artificial Sequence
  Description of Artificial Sequence: Synthetic oligonucleotide
tggtgcggctgccagccaaggactta

SEQ ID NO: 295293 - DNA, 25 bp, Artificial Sequence
  Description of Artificial Sequence: Synthetic oligonucleotide
ggtgcggctgccagccaaggactta

SEQ ID NO: 295294 - DNA, 26 bp, Artificial Sequence
  Description of Artificial Sequence: Synthetic oligonucleotide
gtgcggctgccagccaaggacttaca

SEQ ID NO: 295295 - DNA, 27 bp, Artificial Sequence
  Description of Artificial Sequence: Synthetic oligonucleotide
tgcggctgccagccaaggacttacaga

SEQ ID NO: 295296 - DNA, 26 bp, Artificial Sequence
  Description of Artificial Sequence: Synthetic oligonucleotide
gcggctgccagccaaggacttacaga

SEQ ID NO: 295297 - DNA, 26 bp, Artificial Sequence
  Description of Artificial Sequence: Synthetic oligonucleotide
cggctgccagccaaggacttacagac

SEQ ID NO: 295298 - DNA, 27 bp, Artificial Sequence
  Description of Artificial Sequence: Synthetic oligonucleotide
ggctgccagccaaggacttacagacca

SEQ ID NO: 295299 - DNA, 29 bp, Artificial Sequence
  Description of Artificial Sequence: Synthetic oligonucleotide
gctgccagccaaggacttacagaccattg

SEQ ID NO: 295300 - DNA, 30 bp, Artificial Sequence
  Description of Artificial Sequence: Synthetic oligonucleotide
ctgccagccaaggacttacagaccattgtc

SEQ ID NO: 295301 - DNA, 32 bp, Artificial Sequence
  Description of Artificial Sequence: Synthetic oligonucleotide
tgccagccaaggacttacagaccattgtctac

SEQ ID NO: 295302 - DNA, 31 bp, Artificial Sequence
  Description of Artificial Sequence: Synthetic oligonucleotide
gccagccaaggacttacagaccattgtctac

SEQ ID NO: 295303 - DNA, 33 bp, Artificial Sequence
  Description of Artificial Sequence: Synthetic oligonucleotide
ccagccaaggacttacagaccattgtctacatg

SEQ ID NO: 295304 - DNA, 35 bp, Artificial Sequence
  Description of Artificial Sequence: Synthetic oligonucleotide
cagccaaggacttacagaccattgtctacatgaag

SEQ ID NO: 295305 - DNA, 35 bp, Artificial Sequence
  Description of Artificial Sequence: Synthetic oligonucleotide
agccaaggacttacagaccattgtctacatgaagc

SEQ ID NO: 295306 - DNA, 34 bp, Artificial Sequence
  Description of Artificial Sequence: Synthetic oligonucleotide
gccaaggacttacagaccattgtctacatgaagc

SEQ ID NO: 295307 - DNA, 35 bp, Artificial Sequence
  Description of Artificial Sequence: Synthetic oligonucleotide
ccaaggacttacagaccattgtctacatgaagcac

SEQ ID NO: 295308 - DNA, 35 bp, Artificial Sequence
  Description of Artificial Sequence: Synthetic oligonucleotide
caaggacttacagaccattgtctacatgaagcacc

SEQ ID NO: 295309 - DNA, 35 bp, Artificial Sequence
  Description of Artificial Sequence: Synthetic oligonucleotide
aaggacttacagaccattgtctacatgaagcaccc

SEQ ID NO: 295310 - DNA, 34 bp, Artificial Sequence
  Description of Artificial Sequence: Synthetic oligonucleotide
aggacttacagaccattgtctacatgaagcaccc

SEQ ID NO: 295311 - DNA, 33 bp, Artificial Sequence
  Description of Artificial Sequence: Synthetic oligonucleotide
ggacttacagaccattgtctacatgaagcaccc

SEQ ID NO: 295312 - DNA, 34 bp, Artificial Sequence
  Description of Artificial Sequence: Synthetic oligonucleotide
gacttacagaccattgtctacatgaagcacccac

SEQ ID NO: 295313 - DNA, 35 bp, Artificial Sequence
  Description of Artificial Sequence: Synthetic oligonucleotide
acttacagaccattgtctacatgaagcacccactg

SEQ ID NO: 295314 - DNA, 34 bp, Artificial Sequence
  Description of Artificial Sequence: Synthetic oligonucleotide
cttacagaccattgtctacatgaagcacccactg

SEQ ID NO: 295315 - DNA, 35 bp, Artificial Sequence
  Description of Artificial Sequence: Synthetic oligonucleotide
ttacagaccattgtctacatgaagcacccactgtc

SEQ ID NO: 295316 - DNA, 34 bp, Artificial Sequence
  Description of Artificial Sequence: Synthetic oligonucleotide
tacagaccattgtctacatgaagcacccactgtc

SEQ ID NO: 295317 - DNA, 33 bp, Artificial Sequence
  Description of Artificial Sequence: Synthetic oligonucleotide
acagaccattgtctacatgaagcacccactgtc

SEQ ID NO: 295318 - DNA, 32 bp, Artificial Sequence
  Description of Artificial Sequence: Synthetic oligonucleotide
cagaccattgtctacatgaagcacccactgtc

SEQ ID NO: 295319 - DNA, 32 bp, Artificial Sequence
  Description of Artificial Sequence: Synthetic oligonucleotide
agaccattgtctacatgaagcacccactgtcc

SEQ ID NO: 295320 - DNA, 31 bp, Artificial Sequence
  Description of Artificial Sequence: Synthetic oligonucleotide
gaccattgtctacatgaagcacccactgtcc

SEQ ID NO: 295321 - DNA, 31 bp, Artificial Sequence
  Description of Artificial Sequence: Synthetic oligonucleotide
accattgtctacatgaagcacccactgtccc

SEQ ID NO: 295322 - DNA, 30 bp, Artificial Sequence
  Description of Artificial Sequence: Synthetic oligonucleotide
ccattgtctacatgaagcacccactgtccc

SEQ ID NO: 295323 - DNA, 31 bp, Artificial Sequence
  Description of Artificial Sequence: Synthetic oligonucleotide
cattgtctacatgaagcacccactgtccctg

SEQ ID NO: 295324 - DNA, 31 bp, Artificial Sequence
  Description of Artificial Sequence: Synthetic oligonucleotide
attgtctacatgaagcacccactgtccctgg

SEQ ID NO: 295325 - DNA, 30 bp, Artificial Sequence
  Description of Artificial Sequence: Synthetic oligonucleotide
ttgtctacatgaagcacccactgtccctgg

SEQ ID NO: 295326 - DNA, 29 bp, Artificial Sequence
  Description of Artificial Sequence: Synthetic oligonucleotide
tgtctacatgaagcacccactgtccctgg

SEQ ID NO: 295327 - DNA, 28 bp, Artificial Sequence
  Description of Artificial Sequence: Synthetic oligonucleotide
gtctacatgaagcacccactgtccctgg

SEQ ID NO: 295328 - DNA, 29 bp, Artificial Sequence
  Description of Artificial Sequence: Synthetic oligonucleotide
tctacatgaagcacccactgtccctggtg

SEQ ID NO: 295329 - DNA, 28 bp, Artificial Sequence
  Description of Artificial Sequence: Synthetic oligonucleotide
ctacatgaagcacccactgtccctggtg

SEQ ID NO: 295330 - DNA, 28 bp, Artificial Sequence
  Description of Artificial Sequence: Synthetic oligonucleotide
tacatgaagcacccactgtccctggtgc

SEQ ID NO: 295331 - DNA, 27 bp, Artificial Sequence
  Description of Artificial Sequence: Synthetic oligonucleotide
acatgaagcacccactgtccctggtgc

SEQ ID NO: 295332 - DNA, 27 bp, Artificial Sequence
  Description of Artificial Sequence: Synthetic oligonucleotide
catgaagcacccactgtccctggtgca

SEQ ID NO: 295333 - DNA, 30 bp, Artificial Sequence
  Description of Artificial Sequence: Synthetic oligonucleotide
atgaagcacccactgtccctggtgcaatac

SEQ ID NO: 295334 - DNA, 29 bp, Artificial Sequence
  Description of Artificial Sequence: Synthetic oligonucleotide
tgaagcacccactgtccctggtgcaatac

SEQ ID NO: 295335 - DNA, 28 bp, Artificial Sequence
  Description of Artificial Sequence: Synthetic oligonucleotide
gaagcacccactgtccctggtgcaatac

SEQ ID NO: 295336 - DNA, 28 bp, Artificial Sequence
  Description of Artificial Sequence: Synthetic oligonucleotide
aagcacccactgtccctggtgcaatacc

SEQ ID NO: 295337 - DNA, 27 bp, Artificial Sequence
  Description of Artificial Sequence: Synthetic oligonucleotide
agcacccactgtccctggtgcaatacc

SEQ ID NO: 295338 - DNA, 27 bp, Artificial Sequence
  Description of Artificial Sequence: Synthetic oligonucleotide
gcacccactgtccctggtgcaatacct

SEQ ID NO: 295339 - DNA, 27 bp, Artificial Sequence
  Description of Artificial Sequence: Synthetic oligonucleotide
cacccactgtccctggtgcaatacctc

SEQ ID NO: 295340 - DNA, 29 bp, Artificial Sequence
  Description of Artificial Sequence: Synthetic oligonucleotide
acccactgtccctggtgcaatacctcatg

SEQ ID NO: 295341 - DNA, 28 bp, Artificial Sequence
  Description of Artificial Sequence: Synthetic oligonucleotide
cccactgtccctggtgcaatacctcatg

SEQ ID NO: 295342 - DNA, 28 bp, Artificial Sequence
  Description of Artificial Sequence: Synthetic oligonucleotide
ccactgtccctggtgcaatacctcatgg

SEQ ID NO: 295343 - DNA, 29 bp, Artificial Sequence
  Description of Artificial Sequence: Synthetic oligonucleotide
cactgtccctggtgcaatacctcatggag

SEQ ID NO: 295344 - DNA, 29 bp, Artificial Sequence
  Description of Artificial Sequence: Synthetic oligonucleotide
actgtccctggtgcaatacctcatggagg

SEQ ID NO: 295345 - DNA, 28 bp, Artificial Sequence
  Description of Artificial Sequence: Synthetic oligonucleotide
ctgtccctggtgcaatacctcatggagg

SEQ ID NO: 295346 - DNA, 28 bp, Artificial Sequence
  Description of Artificial Sequence: Synthetic oligonucleotide
tgtccctggtgcaatacctcatggaggg

SEQ ID NO: 295347 - DNA, 27 bp, Artificial Sequence
  Description of Artificial Sequence: Synthetic oligonucleotide
gtccctggtgcaatacctcatggaggg

SEQ ID NO: 295348 - DNA, 27 bp, Artificial Sequence
  Description of Artificial Sequence: Synthetic oligonucleotide
tccctggtgcaatacctcatggagggc

SEQ ID NO: 295349 - DNA, 27 bp, Artificial Sequence
  Description of Artificial Sequence: Synthetic oligonucleotide
ccctggtgcaatacctcatggagggct

SEQ ID NO: 295350 - DNA, 27 bp, Artificial Sequence
  Description of Artificial Sequence: Synthetic oligonucleotide
cctggtgcaatacctcatggagggctg

SEQ ID NO: 295351 - DNA, 27 bp, Artificial Sequence
  Description of Artificial Sequence: Synthetic oligonucleotide
ctggtgcaatacctcatggagggctgc

SEQ ID NO: 295352 - DNA, 29 bp, Artificial Sequence
  Description of Artificial Sequence: Synthetic oligonucleotide
tggtgcaatacctcatggagggctgctac

SEQ ID NO: 295353 - DNA, 28 bp, Artificial Sequence
  Description of Artificial Sequence: Synthetic oligonucleotide
ggtgcaatacctcatggagggctgctac

SEQ ID NO: 295354 - DNA, 30 bp, Artificial Sequence
  Description of Artificial Sequence: Synthetic oligonucleotide
gtgcaatacctcatggagggctgctacaac

SEQ ID NO: 295355 - DNA, 33 bp, Artificial Sequence
  Description of Artificial Sequence: Synthetic oligonucleotide
tgcaatacctcatggagggctgctacaacatag

SEQ ID NO: 295356 - DNA, 32 bp, Artificial Sequence
  Description of Artificial Sequence: Synthetic oligonucleotide
gcaatacctcatggagggctgctacaacatag

SEQ ID NO: 295357 - DNA, 33 bp, Artificial Sequence
  Description of Artificial Sequence: Synthetic oligonucleotide
caatacctcatggagggctgctacaacatagtg

SEQ ID NO: 295358 - DNA, 35 bp, Artificial Sequence
  Description of Artificial Sequence: Synthetic oligonucleotide
aatacctcatggagggctgctacaacatagtgttc

SEQ ID NO: 295359 - DNA, 34 bp, Artificial Sequence
  Description of Artificial Sequence: Synthetic oligonucleotide
atacctcatggagggctgctacaacatagtgttc

SEQ ID NO: 295360 - DNA, 33 bp, Artificial Sequence
  Description of Artificial Sequence: Synthetic oligonucleotide
tacctcatggagggctgctacaacatagtgttc

SEQ ID NO: 295361 - DNA, 32 bp, Artificial Sequence
  Description of Artificial Sequence: Synthetic oligonucleotide
acctcatggagggctgctacaacatagtgttc

SEQ ID NO: 295362 - DNA, 31 bp, Artificial Sequence
  Description of Artificial Sequence: Synthetic oligonucleotide
cctcatggagggctgctacaacatagtgttc

SEQ ID NO: 295363 - DNA, 31 bp, Artificial Sequence
  Description of Artificial Sequence: Synthetic oligonucleotide
ctcatggagggctgctacaacatagtgttcc

SEQ ID NO: 295364 - DNA, 32 bp, Artificial Sequence
  Description of Artificial Sequence: Synthetic oligonucleotide
tcatggagggctgctacaacatagtgttcctc

SEQ ID NO: 295365 - DNA, 31 bp, Artificial Sequence
  Description of Artificial Sequence: Synthetic oligonucleotide
catggagggctgctacaacatagtgttcctc

SEQ ID NO: 295366 - DNA, 31 bp, Artificial Sequence
  Description of Artificial Sequence: Synthetic oligonucleotide
atggagggctgctacaacatagtgttcctcg

SEQ ID NO: 295367 - DNA, 30 bp, Artificial Sequence
  Description of Artificial Sequence: Synthetic oligonucleotide
tggagggctgctacaacatagtgttcctcg

SEQ ID NO: 295368 - DNA, 29 bp, Artificial Sequence
  Description of Artificial Sequence: Synthetic oligonucleotide
ggagggctgctacaacatagtgttcctcg

SEQ ID NO: 295369 - DNA, 29 bp, Artificial Sequence
  Description of Artificial Sequence: Synthetic oligonucleotide
gagggctgctacaacatagtgttcctcgc

SEQ ID NO: 295370 - DNA, 29 bp, Artificial Sequence
  Description of Artificial Sequence: Synthetic oligonucleotide
agggctgctacaacatagtgttcctcgcc

SEQ ID NO: 295371 - DNA, 28 bp, Artificial Sequence
  Description of Artificial Sequence: Synthetic oligonucleotide
gggctgctacaacatagtgttcctcgcc

SEQ ID NO: 295372 - DNA, 30 bp, Artificial Sequence
  Description of Artificial Sequence: Synthetic oligonucleotide
ggctgctacaacatagtgttcctcgccaag

SEQ ID NO: 295373 - DNA, 30 bp, Artificial Sequence
  Description of Artificial Sequence: Synthetic oligonucleotide
gctgctacaacatagtgttcctcgccaagg

SEQ ID NO: 295374 - DNA, 30 bp, Artificial Sequence
  Description of Artificial Sequence: Synthetic oligonucleotide
ctgctacaacatagtgttcctcgccaaggg

SEQ ID NO: 295375 - DNA, 33 bp, Artificial Sequence
  Description of Artificial Sequence: Synthetic oligonucleotide
tgctacaacatagtgttcctcgccaagggttac

SEQ ID NO: 295376 - DNA, 32 bp, Artificial Sequence
  Description of Artificial Sequence: Synthetic oligonucleotide
gctacaacatagtgttcctcgccaagggttac

SEQ ID NO: 295377 - DNA, 34 bp, Artificial Sequence
  Description of Artificial Sequence: Synthetic oligonucleotide
ctacaacatagtgttcctcgccaagggttacatc

SEQ ID NO: 295378 - DNA, 34 bp, Artificial Sequence
  Description of Artificial Sequence: Synthetic oligonucleotide
tacaacatagtgttcctcgccaagggttacatcc

SEQ ID NO: 295379 - DNA, 33 bp, Artificial Sequence
  Description of Artificial Sequence: Synthetic oligonucleotide
acaacatagtgttcctcgccaagggttacatcc

SEQ ID NO: 295380 - DNA, 32 bp, Artificial Sequence
  Description of Artificial Sequence: Synthetic oligonucleotide
caacatagtgttcctcgccaagggttacatcc

SEQ ID NO: 295381 - DNA, 32 bp, Artificial Sequence
  Description of Artificial Sequence: Synthetic oligonucleotide
aacatagtgttcctcgccaagggttacatccc

SEQ ID NO: 295382 - DNA, 31 bp, Artificial Sequence
  Description of Artificial Sequence: Synthetic oligonucleotide
acatagtgttcctcgccaagggttacatccc

SEQ ID NO: 295383 - DNA, 30 bp, Artificial Sequence
  Description of Artificial Sequence: Synthetic oligonucleotide
catagtgttcctcgccaagggttacatccc

SEQ ID NO: 295384 - DNA, 30 bp, Artificial Sequence
  Description of Artificial Sequence: Synthetic oligonucleotide
atagtgttcctcgccaagggttacatcccc

SEQ ID NO: 295385 - DNA, 29 bp, Artificial Sequence
  Description of Artificial Sequence: Synthetic oligonucleotide
tagtgttcctcgccaagggttacatcccc

SEQ ID NO: 295386 - DNA, 28 bp, Artificial Sequence
  Description of Artificial Sequence: Synthetic oligonucleotide
agtgttcctcgccaagggttacatcccc

SEQ ID NO: 295387 - DNA, 27 bp, Artificial Sequence
  Description of Artificial Sequence: Synthetic oligonucleotide
gtgttcctcgccaagggttacatcccc

SEQ ID NO: 295388 - DNA, 27 bp, Artificial Sequence
  Description of Artificial Sequence: Synthetic oligonucleotide
tgttcctcgccaagggttacatccccg

SEQ ID NO: 295389 - DNA, 26 bp, Artificial Sequence
  Description of Artificial Sequence: Synthetic oligonucleotide
gttcctcgccaagggttacatccccg

SEQ ID NO: 295390 - DNA, 26 bp, Artificial Sequence
  Description of Artificial Sequence: Synthetic oligonucleotide
ttcctcgccaagggttacatccccgg

SEQ ID NO: 295391 - DNA, 25 bp, Artificial Sequence
  Description of Artificial Sequence: Synthetic oligonucleotide
tcctcgccaagggttacatccccgg

SEQ ID NO: 295392 - DNA, 24 bp, Artificial Sequence
  Description of Artificial Sequence: Synthetic oligonucleotide
cctcgccaagggttacatccccgg

SEQ ID NO: 295393 - DNA, 24 bp, Artificial Sequence
  Description of Artificial Sequence: Synthetic oligonucleotide
ctcgccaagggttacatccccggc

SEQ ID NO: 295394 - DNA, 25 bp, Artificial Sequence
  Description of Artificial Sequence: Synthetic oligonucleotide
tcgccaagggttacatccccggcga

SEQ ID NO: 295395 - DNA, 24 bp, Artificial Sequence
  Description of Artificial Sequence: Synthetic oligonucleotide
cgccaagggttacatccccggcga

SEQ ID NO: 295396 - DNA, 25 bp, Artificial Sequence
  Description of Artificial Sequence: Synthetic oligonucleotide
gccaagggttacatccccggcgaga

SEQ ID NO: 295397 - DNA, 25 bp, Artificial Sequence
  Description of Artificial Sequence: Synthetic oligonucleotide
ccaagggttacatccccggcgagag

SEQ ID NO: 295398 - DNA, 27 bp, Artificial Sequence
  Description of Artificial Sequence: Synthetic oligonucleotide
caagggttacatccccggcgagagcta

SEQ ID NO: 295399 - DNA, 27 bp, Artificial Sequence
  Description of Artificial Sequence: Synthetic oligonucleotide
aagggttacatccccggcgagagctag

SEQ ID NO: 295400 - DNA, 27 bp, Artificial Sequence
  Description of Artificial Sequence: Synthetic oligonucleotide
agggttacatccccggcgagagctaga

SEQ ID NO: 295401 - DNA, 26 bp, Artificial Sequence
  Description of Artificial Sequence: Synthetic oligonucleotide
gggttacatccccggcgagagctaga

SEQ ID NO: 295402 - DNA, 26 bp, Artificial Sequence
  Description of Artificial Sequence: Synthetic oligonucleotide
ggttacatccccggcgagagctagac

SEQ ID NO: 295403 - DNA, 27 bp, Artificial Sequence
  Description of Artificial Sequence: Synthetic oligonucleotide
gttacatccccggcgagagctagacct

SEQ ID NO: 295404 - DNA, 28 bp, Artificial Sequence
  Description of Artificial Sequence: Synthetic oligonucleotide
ttacatccccggcgagagctagaccttc

SEQ ID NO: 295405 - DNA, 27 bp, Artificial Sequence
  Description of Artificial Sequence: Synthetic oligonucleotide
tacatccccggcgagagctagaccttc

SEQ ID NO: 295406 - DNA, 27 bp, Artificial Sequence
  Description of Artificial Sequence: Synthetic oligonucleotide
acatccccggcgagagctagaccttct

SEQ ID NO: 295407 - DNA, 27 bp, Artificial Sequence
  Description of Artificial Sequence: Synthetic oligonucleotide
catccccggcgagagctagaccttctt

SEQ ID NO: 295408 - DNA, 27 bp, Artificial Sequence
  Description of Artificial Sequence: Synthetic oligonucleotide
atccccggcgagagctagaccttcttc

SEQ ID NO: 295409 - DNA, 27 bp, Artificial Sequence
  Description of Artificial Sequence: Synthetic oligonucleotide
tccccggcgagagctagaccttcttct

SEQ ID NO: 295410 - DNA, 27 bp, Artificial Sequence
  Description of Artificial Sequence: Synthetic oligonucleotide
ccccggcgagagctagaccttcttctt

SEQ ID NO: 295411 - DNA, 28 bp, Artificial Sequence
  Description of Artificial Sequence: Synthetic oligonucleotide
cccggcgagagctagaccttcttctttg

SEQ ID NO: 295412 - DNA, 29 bp, Artificial Sequence
  Description of Artificial Sequence: Synthetic oligonucleotide
ccggcgagagctagaccttcttctttgac

SEQ ID NO: 295413 - DNA, 31 bp, Artificial Sequence
  Description of Artificial Sequence: Synthetic oligonucleotide
cggcgagagctagaccttcttctttgacatc

SEQ ID NO: 295414 - DNA, 31 bp, Artificial Sequence
  Description of Artificial Sequence: Synthetic oligonucleotide
ggcgagagctagaccttcttctttgacatcc

SEQ ID NO: 295415 - DNA, 32 bp, Artificial Sequence
  Description of Artificial Sequence: Synthetic oligonucleotide
gcgagagctagaccttcttctttgacatccag

SEQ ID NO: 295416 - DNA, 32 bp, Artificial Sequence
  Description of Artificial Sequence: Synthetic oligonucleotide
cgagagctagaccttcttctttgacatccagc

SEQ ID NO: 295417 - DNA, 33 bp, Artificial Sequence
  Description of Artificial Sequence: Synthetic oligonucleotide
gagagctagaccttcttctttgacatccagctc

SEQ ID NO: 295418 - DNA, 33 bp, Artificial Sequence
  Description of Artificial Sequence: Synthetic oligonucleotide
agagctagaccttcttctttgacatccagctcg

SEQ ID NO: 295419 - DNA, 32 bp, Artificial Sequence
  Description of Artificial Sequence: Synthetic oligonucleotide
gagctagaccttcttctttgacatccagctcg

SEQ ID NO: 295420 - DNA, 33 bp, Artificial Sequence
  Description of Artificial Sequence: Synthetic oligonucleotide
agctagaccttcttctttgacatccagctcgac

SEQ ID NO: 295421 - DNA, 32 bp, Artificial Sequence
  Description of Artificial Sequence: Synthetic oligonucleotide
gctagaccttcttctttgacatccagctcgac

SEQ ID NO: 295422 - DNA, 33 bp, Artificial Sequence
  Description of Artificial Sequence: Synthetic oligonucleotide
ctagaccttcttctttgacatccagctcgacac

SEQ ID NO: 295423 - DNA, 36 bp, Artificial Sequence
  Description of Artificial Sequence: Synthetic oligonucleotide
tagaccttcttctttgacatccagctcgacacaatc

SEQ ID NO: 295424 - DNA, 35 bp, Artificial Sequence
  Description of Artificial Sequence: Synthetic oligonucleotide
agaccttcttctttgacatccagctcgacacaatc

SEQ ID NO: 295425 - DNA, 34 bp, Artificial Sequence
  Description of Artificial Sequence: Synthetic oligonucleotide
gaccttcttctttgacatccagctcgacacaatc

SEQ ID NO: 295426 - DNA, 35 bp, Artificial Sequence
  Description of Artificial Sequence: Synthetic oligonucleotide
accttcttctttgacatccagctcgacacaatcag

SEQ ID NO: 295427 - DNA, 34 bp, Artificial Sequence
  Description of Artificial Sequence: Synthetic oligonucleotide
ccttcttctttgacatccagctcgacacaatcag

SEQ ID NO: 295428 - DNA, 34 bp, Artificial Sequence
  Description of Artificial Sequence: Synthetic oligonucleotide
cttcttctttgacatccagctcgacacaatcagg

SEQ ID NO: 295429 - DNA, 34 bp, Artificial Sequence
  Description of Artificial Sequence: Synthetic oligonucleotide
ttcttctttgacatccagctcgacacaatcaggg

SEQ ID NO: 295430 - DNA, 33 bp, Artificial Sequence
  Description of Artificial Sequence: Synthetic oligonucleotide
tcttctttgacatccagctcgacacaatcaggg

SEQ ID NO: 295431 - DNA, 32 bp, Artificial Sequence
  Description of Artificial Sequence: Synthetic oligonucleotide
cttctttgacatccagctcgacacaatcaggg

SEQ ID NO: 295432 - DNA, 34 bp, Artificial Sequence
  Description of Artificial Sequence: Synthetic oligonucleotide
ttctttgacatccagctcgacacaatcagggatc

SEQ ID NO: 295433 - DNA, 33 bp, Artificial Sequence
  Description of Artificial Sequence: Synthetic oligonucleotide
tctttgacatccagctcgacacaatcagggatc

SEQ ID NO: 295434 - DNA, 32 bp, Artificial Sequence
  Description of Artificial Sequence: Synthetic oligonucleotide
ctttgacatccagctcgacacaatcagggatc

SEQ ID NO: 295435 - DNA, 33 bp, Artificial Sequence
  Description of Artificial Sequence: Synthetic oligonucleotide
tttgacatccagctcgacacaatcagggatcag

SEQ ID NO: 295436 - DNA, 32 bp, Artificial Sequence
  Description of Artificial Sequence: Synthetic oligonucleotide
ttgacatccagctcgacacaatcagggatcag

SEQ ID NO: 295437 - DNA, 31 bp, Artificial Sequence
  Description of Artificial Sequence: Synthetic oligonucleotide
tgacatccagctcgacacaatcagggatcag

SEQ ID NO: 295438 - DNA, 30 bp, Artificial Sequence
  Description of Artificial Sequence: Synthetic oligonucleotide
gacatccagctcgacacaatcagggatcag

SEQ ID NO: 295439 - DNA, 32 bp, Artificial Sequence
  Description of Artificial Sequence: Synthetic oligonucleotide
acatccagctcgacacaatcagggatcagatc

SEQ ID NO: 295440 - DNA, 31 bp, Artificial Sequence
  Description of Artificial Sequence: Synthetic oligonucleotide
catccagctcgacacaatcagggatcagatc

SEQ ID NO: 295441 - DNA, 31 bp, Artificial Sequence
  Description of Artificial Sequence: Synthetic oligonucleotide
atccagctcgacacaatcagggatcagatcg

SEQ ID NO: 295442 - DNA, 30 bp, Artificial Sequence
  Description of Artificial Sequence: Synthetic oligonucleotide
tccagctcgacacaatcagggatcagatcg

SEQ ID NO: 295443 - DNA, 29 bp, Artificial Sequence
  Description of Artificial Sequence: Synthetic oligonucleotide
ccagctcgacacaatcagggatcagatcg

SEQ ID NO: 295444 - DNA, 29 bp, Artificial Sequence
  Description of Artificial Sequence: Synthetic oligonucleotide
cagctcgacacaatcagggatcagatcgc

SEQ ID NO: 295445 - DNA, 30 bp, Artificial Sequence
  Description of Artificial Sequence: Synthetic oligonucleotide
agctcgacacaatcagggatcagatcgctg

SEQ ID NO: 295446 - DNA, 29 bp, Artificial Sequence
  Description of Artificial Sequence: Synthetic oligonucleotide
gctcgacacaatcagggatcagatcgctg

SEQ ID NO: 295447 - DNA, 29 bp, Artificial Sequence
  Description of Artificial Sequence: Synthetic oligonucleotide
ctcgacacaatcagggatcagatcgctgc

SEQ ID NO: 295448 - DNA, 29 bp, Artificial Sequence
  Description of Artificial Sequence: Synthetic oligonucleotide
tcgacacaatcagggatcagatcgctgcg

SEQ ID NO: 295449 - DNA, 28 bp, Artificial Sequence
  Description of Artificial Sequence: Synthetic oligonucleotide
cgacacaatcagggatcagatcgctgcg

SEQ ID NO: 295450 - DNA, 29 bp, Artificial Sequence
  Description of Artificial Sequence: Synthetic oligonucleotide
gacacaatcagggatcagatcgctgcgtg

SEQ ID NO: 295451 - DNA, 29 bp, Artificial Sequence
  Description of Artificial Sequence: Synthetic oligonucleotide
acacaatcagggatcagatcgctgcgtgc

SEQ ID NO: 295452 - DNA, 28 bp, Artificial Sequence
  Description of Artificial Sequence: Synthetic oligonucleotide
cacaatcagggatcagatcgctgcgtgc

SEQ ID NO: 295453 - DNA, 30 bp, Artificial Sequence
  Description of Artificial Sequence: Synthetic oligonucleotide
acaatcagggatcagatcgctgcgtgcatc

SEQ ID NO: 295454 - DNA, 29 bp, Artificial Sequence
  Description of Artificial Sequence: Synthetic oligonucleotide
caatcagggatcagatcgctgcgtgcatc

SEQ ID NO: 295455 - DNA, 29 bp, Artificial Sequence
  Description of Artificial Sequence: Synthetic oligonucleotide
aatcagggatcagatcgctgcgtgcatcg

SEQ ID NO: 295456 - DNA, 28 bp, Artificial Sequence
  Description of Artificial Sequence: Synthetic oligonucleotide
atcagggatcagatcgctgcgtgcatcg

SEQ ID NO: 295457 - DNA, 27 bp, Artificial Sequence
  Description of Artificial Sequence: Synthetic oligonucleotide
tcagggatcagatcgctgcgtgcatcg

SEQ ID NO: 295458 - DNA, 27 bp, Artificial Sequence
  Description of Artificial Sequence: Synthetic oligonucleotide
cagggatcagatcgctgcgtgcatcga

SEQ ID NO: 295459 - DNA, 27 bp, Artificial Sequence
  Description of Artificial Sequence: Synthetic oligonucleotide
agggatcagatcgctgcgtgcatcgac

SEQ ID NO: 295460 - DNA, 27 bp, Artificial Sequence
  Description of Artificial Sequence: Synthetic oligonucleotide
gggatcagatcgctgcgtgcatcgaca

SEQ ID NO: 295461 - DNA, 28 bp, Artificial Sequence
  Description of Artificial Sequence: Synthetic oligonucleotide
ggatcagatcgctgcgtgcatcgacaag

SEQ ID NO: 295462 - DNA, 28 bp, Artificial Sequence
  Description of Artificial Sequence: Synthetic oligonucleotide
gatcagatcgctgcgtgcatcgacaagg

SEQ ID NO: 295463 - DNA, 28 bp, Artificial Sequence
  Description of Artificial Sequence: Synthetic oligonucleotide
atcagatcgctgcgtgcatcgacaaggc

SEQ ID NO: 295464 - DNA, 27 bp, Artificial Sequence
  Description of Artificial Sequence: Synthetic oligonucleotide
tcagatcgctgcgtgcatcgacaaggc

SEQ ID NO: 295465 - DNA, 26 bp, Artificial Sequence
  Description of Artificial Sequence: Synthetic oligonucleotide
cagatcgctgcgtgcatcgacaaggc

SEQ ID NO: 295466 - DNA, 27 bp, Artificial Sequence
  Description of Artificial Sequence: Synthetic oligonucleotide
agatcgctgcgtgcatcgacaaggcct

SEQ ID NO: 295467 - DNA, 27 bp, Artificial Sequence
  Description of Artificial Sequence: Synthetic oligonucleotide
gatcgctgcgtgcatcgacaaggccta

SEQ ID NO: 295468 - DNA, 27 bp, Artificial Sequence
  Description of Artificial Sequence: Synthetic oligonucleotide
atcgctgcgtgcatcgacaaggcctac

SEQ ID NO: 295469 - DNA, 26 bp, Artificial Sequence
  Description of Artificial Sequence: Synthetic oligonucleotide
tcgctgcgtgcatcgacaaggcctac

SEQ ID NO: 295470 - DNA, 25 bp, Artificial Sequence
  Description of Artificial Sequence: Synthetic oligonucleotide
cgctgcgtgcatcgacaaggcctac

SEQ ID NO: 295471 - DNA, 26 bp, Artificial Sequence
  Description of Artificial Sequence: Synthetic oligonucleotide
gctgcgtgcatcgacaaggcctacca

SEQ ID NO: 295472 - DNA, 27 bp, Artificial Sequence
  Description of Artificial Sequence: Synthetic oligonucleotide
ctgcgtgcatcgacaaggcctaccaga

SEQ ID NO: 295473 - DNA, 31 bp, Artificial Sequence
  Description of Artificial Sequence: Synthetic oligonucleotide
tgcgtgcatcgacaaggcctaccagaaaatc

SEQ ID NO: 295474 - DNA, 30 bp, Artificial Sequence
  Description of Artificial Sequence: Synthetic oligonucleotide
gcgtgcatcgacaaggcctaccagaaaatc

SEQ ID NO: 295475 - DNA, 30 bp, Artificial Sequence
  Description of Artificial Sequence: Synthetic oligonucleotide
cgtgcatcgacaaggcctaccagaaaatcc

SEQ ID NO: 295476 - DNA, 34 bp, Artificial Sequence
  Description of Artificial Sequence: Synthetic oligonucleotide
gtgcatcgacaaggcctaccagaaaatccatttc

SEQ ID NO: 295477 - DNA, 35 bp, Artificial Sequence
  Description of Artificial Sequence: Synthetic oligonucleotide
tgcatcgacaaggcctaccagaaaatccatttcac

SEQ ID NO: 295478 - DNA, 34 bp, Artificial Sequence
  Description of Artificial Sequence: Synthetic oligonucleotide
gcatcgacaaggcctaccagaaaatccatttcac

SEQ ID NO: 295479 - DNA, 35 bp, Artificial Sequence
  Description of Artificial Sequence: Synthetic oligonucleotide
catcgacaaggcctaccagaaaatccatttcactg

SEQ ID NO: 295480 - DNA, 36 bp, Artificial Sequence
  Description of Artificial Sequence: Synthetic oligonucleotide
atcgacaaggcctaccagaaaatccatttcactgac

SEQ ID NO: 295481 - DNA, 35 bp, Artificial Sequence
  Description of Artificial Sequence: Synthetic oligonucleotide
tcgacaaggcctaccagaaaatccatttcactgac

SEQ ID NO: 295482 - DNA, 34 bp, Artificial Sequence
  Description of Artificial Sequence: Synthetic oligonucleotide
cgacaaggcctaccagaaaatccatttcactgac

SEQ ID NO: 295483 - DNA, 34 bp, Artificial Sequence
  Description of Artificial Sequence: Synthetic oligonucleotide
gacaaggcctaccagaaaatccatttcactgacg

SEQ ID NO: 295484 - DNA, 34 bp, Artificial Sequence
  Description of Artificial Sequence: Synthetic oligonucleotide
acaaggcctaccagaaaatccatttcactgacgc

SEQ ID NO: 295485 - DNA, 33 bp, Artificial Sequence
  Description of Artificial Sequence: Synthetic oligonucleotide
caaggcctaccagaaaatccatttcactgacgc

SEQ ID NO: 295486 - DNA, 33 bp, Artificial Sequence
  Description of Artificial Sequence: Synthetic oligonucleotide
aaggcctaccagaaaatccatttcactgacgcc

SEQ ID NO: 295487 - DNA, 32 bp, Artificial Sequence
  Description of Artificial Sequence: Synthetic oligonucleotide
aggcctaccagaaaatccatttcactgacgcc

SEQ ID NO: 295488 - DNA, 31 bp, Artificial Sequence
  Description of Artificial Sequence: Synthetic oligonucleotide
ggcctaccagaaaatccatttcactgacgcc

SEQ ID NO: 295489 - DNA, 32 bp, Artificial Sequence
  Description of Artificial Sequence: Synthetic oligonucleotide
gcctaccagaaaatccatttcactgacgccac

SEQ ID NO: 295490 - DNA, 32 bp, Artificial Sequence
  Description of Artificial Sequence: Synthetic oligonucleotide
cctaccagaaaatccatttcactgacgccacc

SEQ ID NO: 295491 - DNA, 32 bp, Artificial Sequence
  Description of Artificial Sequence: Synthetic oligonucleotide
ctaccagaaaatccatttcactgacgccaccc

SEQ ID NO: 295492 - DNA, 32 bp, Artificial Sequence
  Description of Artificial Sequence: Synthetic oligonucleotide
taccagaaaatccatttcactgacgccacccg

SEQ ID NO: 295493 - DNA, 31 bp, Artificial Sequence
  Description of Artificial Sequence: Synthetic oligonucleotide
accagaaaatccatttcactgacgccacccg

SEQ ID NO: 295494 - DNA, 30 bp, Artificial Sequence
  Description of Artificial Sequence: Synthetic oligonucleotide
ccagaaaatccatttcactgacgccacccg

SEQ ID NO: 295495 - DNA, 30 bp, Artificial Sequence
  Description of Artificial Sequence: Synthetic oligonucleotide
cagaaaatccatttcactgacgccacccgg

SEQ ID NO: 295496 - DNA, 32 bp, Artificial Sequence
  Description of Artificial Sequence: Synthetic oligonucleotide
agaaaatccatttcactgacgccacccggttc

SEQ ID NO: 295497 - DNA, 31 bp, Artificial Sequence
  Description of Artificial Sequence: Synthetic oligonucleotide
gaaaatccatttcactgacgccacccggttc

SEQ ID NO: 295498 - DNA, 31 bp, Artificial Sequence
  Description of Artificial Sequence: Synthetic oligonucleotide
aaaatccatttcactgacgccacccggttcc

SEQ ID NO: 295499 - DNA, 30 bp, Artificial Sequence
  Description of Artificial Sequence: Synthetic oligonucleotide
aaatccatttcactgacgccacccggttcc

SEQ ID NO: 295500 - DNA, 29 bp, Artificial Sequence
  Description of Artificial Sequence: Synthetic oligonucleotide
aatccatttcactgacgccacccggttcc

SEQ ID NO: 295501 - DNA, 28 bp, Artificial Sequence
  Description of Artificial Sequence: Synthetic oligonucleotide
atccatttcactgacgccacccggttcc

SEQ ID NO: 295502 - DNA, 27 bp, Artificial Sequence
  Description of Artificial Sequence: Synthetic oligonucleotide
tccatttcactgacgccacccggttcc

SEQ ID NO: 295503 - DNA, 27 bp, Artificial Sequence
  Description of Artificial Sequence: Synthetic oligonucleotide
ccatttcactgacgccacccggttcct

SEQ ID NO: 295504 - DNA, 27 bp, Artificial Sequence
  Description of Artificial Sequence: Synthetic oligonucleotide
catttcactgacgccacccggttcctc

SEQ ID NO: 295505 - DNA, 29 bp, Artificial Sequence
  Description of Artificial Sequence: Synthetic oligonucleotide
atttcactgacgccacccggttcctcttc

SEQ ID NO: 295506 - DNA, 28 bp, Artificial Sequence
  Description of Artificial Sequence: Synthetic oligonucleotide
tttcactgacgccacccggttcctcttc

SEQ ID NO: 295507 - DNA, 27 bp, Artificial Sequence
  Description of Artificial Sequence: Synthetic oligonucleotide
ttcactgacgccacccggttcctcttc

SEQ ID NO: 295508 - DNA, 27 bp, Artificial Sequence
  Description of Artificial Sequence: Synthetic oligonucleotide
tcactgacgccacccggttcctcttct

SEQ ID NO: 295509 - DNA, 27 bp, Artificial Sequence
  Description of Artificial Sequence: Synthetic oligonucleotide
cactgacgccacccggttcctcttcta

SEQ ID NO: 295510 - DNA, 27 bp, Artificial Sequence
  Description of Artificial Sequence: Synthetic oligonucleotide
actgacgccacccggttcctcttctac

SEQ ID NO: 295511 - DNA, 27 bp, Artificial Sequence
  Description of Artificial Sequence: Synthetic oligonucleotide
ctgacgccacccggttcctcttctaca

SEQ ID NO: 295512 - DNA, 28 bp, Artificial Sequence
  Description of Artificial Sequence: Synthetic oligonucleotide
tgacgccacccggttcctcttctacaac

SEQ ID NO: 295513 - DNA, 27 bp, Artificial Sequence
  Description of Artificial Sequence: Synthetic oligonucleotide
gacgccacccggttcctcttctacaac

SEQ ID NO: 295514 - DNA, 28 bp, Artificial Sequence
  Description of Artificial Sequence: Synthetic oligonucleotide
acgccacccggttcctcttctacaacac

SEQ ID NO: 295515 - DNA, 27 bp, Artificial Sequence
  Description of Artificial Sequence: Synthetic oligonucleotide
cgccacccggttcctcttctacaacac

SEQ ID NO: 295516 - DNA, 28 bp, Artificial Sequence
  Description of Artificial Sequence: Synthetic oligonucleotide
gccacccggttcctcttctacaacacac

SEQ ID NO: 295517 - DNA, 28 bp, Artificial Sequence
  Description of Artificial Sequence: Synthetic oligonucleotide
ccacccggttcctcttctacaacacacc

SEQ ID NO: 295518 - DNA, 28 bp, Artificial Sequence
  Description of Artificial Sequence: Synthetic oligonucleotide
cacccggttcctcttctacaacacaccg

SEQ ID NO: 295519 - DNA, 33 bp, Artificial Sequence
  Description of Artificial Sequence: Synthetic oligonucleotide
acccggttcctcttctacaacacaccgaaaaag

SEQ ID NO: 295520 - DNA, 32 bp, Artificial Sequence
  Description of Artificial Sequence: Synthetic oligonucleotide
cccggttcctcttctacaacacaccgaaaaag

SEQ ID NO: 295521 - DNA, 34 bp, Artificial Sequence
  Description of Artificial Sequence: Synthetic oligonucleotide
ccggttcctcttctacaacacaccgaaaaagatg

SEQ ID NO: 295522 - DNA, 35 bp, Artificial Sequence
  Description of Artificial Sequence: Synthetic oligonucleotide
cggttcctcttctacaacacaccgaaaaagatgtc

SEQ ID NO: 295523 - DNA, 36 bp, Artificial Sequence
  Description of Artificial Sequence: Synthetic oligonucleotide
ggttcctcttctacaacacaccgaaaaagatgtcag

SEQ ID NO: 295524 - DNA, 37 bp, Artificial Sequence
  Description of Artificial Sequence: Synthetic oligonucleotide
gttcctcttctacaacacaccgaaaaagatgtcagac

SEQ ID NO: 295525 - DNA, 39 bp, Artificial Sequence
  Description of Artificial Sequence: Synthetic oligonucleotide
ttcctcttctacaacacaccgaaaaagatgtcagactac

SEQ ID NO: 295526 - DNA, 38 bp, Artificial Sequence
  Description of Artificial Sequence: Synthetic oligonucleotide
tcctcttctacaacacaccgaaaaagatgtcagactac

SEQ ID NO: 295527 - DNA, 37 bp, Artificial Sequence
  Description of Artificial Sequence: Synthetic oligonucleotide
cctcttctacaacacaccgaaaaagatgtcagactac

SEQ ID NO: 295528 - DNA, 37 bp, Artificial Sequence
  Description of Artificial Sequence: Synthetic oligonucleotide
ctcttctacaacacaccgaaaaagatgtcagactacg

SEQ ID NO: 295529 - DNA, 37 bp, Artificial Sequence
  Description of Artificial Sequence: Synthetic oligonucleotide
tcttctacaacacaccgaaaaagatgtcagactacgg

SEQ ID NO: 295530 - DNA, 36 bp, Artificial Sequence
  Description of Artificial Sequence: Synthetic oligonucleotide
cttctacaacacaccgaaaaagatgtcagactacgg

SEQ ID NO: 295531 - DNA, 36 bp, Artificial Sequence
  Description of Artificial Sequence: Synthetic oligonucleotide
ttctacaacacaccgaaaaagatgtcagactacggc

SEQ ID NO: 295532 - DNA, 35 bp, Artificial Sequence
  Description of Artificial Sequence: Synthetic oligonucleotide
tctacaacacaccgaaaaagatgtcagactacggc

SEQ ID NO: 295533 - DNA, 34 bp, Artificial Sequence
  Description of Artificial Sequence: Synthetic oligonucleotide
ctacaacacaccgaaaaagatgtcagactacggc

SEQ ID NO: 295534 - DNA, 36 bp, Artificial Sequence
  Description of Artificial Sequence: Synthetic oligonucleotide
tacaacacaccgaaaaagatgtcagactacggcaag

SEQ ID NO: 295535 - DNA, 35 bp, Artificial Sequence
  Description of Artificial Sequence: Synthetic oligonucleotide
acaacacaccgaaaaagatgtcagactacggcaag

SEQ ID NO: 295536 - DNA, 34 bp, Artificial Sequence
  Description of Artificial Sequence: Synthetic oligonucleotide
caacacaccgaaaaagatgtcagactacggcaag

SEQ ID NO: 295537 - DNA, 36 bp, Artificial Sequence
  Description of Artificial Sequence: Synthetic oligonucleotide
aacacaccgaaaaagatgtcagactacggcaagaag

SEQ ID NO: 295538 - DNA, 35 bp, Artificial Sequence
  Description of Artificial Sequence: Synthetic oligonucleotide
acacaccgaaaaagatgtcagactacggcaagaag

SEQ ID NO: 295539 - DNA, 34 bp, Artificial Sequence
  Description of Artificial Sequence: Synthetic oligonucleotide
cacaccgaaaaagatgtcagactacggcaagaag

SEQ ID NO: 295540 - DNA, 34 bp, Artificial Sequence
  Description of Artificial Sequence: Synthetic oligonucleotide
acaccgaaaaagatgtcagactacggcaagaagc

SEQ ID NO: 295541 - DNA, 33 bp, Artificial Sequence
  Description of Artificial Sequence: Synthetic oligonucleotide
caccgaaaaagatgtcagactacggcaagaagc

SEQ ID NO: 295542 - DNA, 33 bp, Artificial Sequence
  Description of Artificial Sequence: Synthetic oligonucleotide
accgaaaaagatgtcagactacggcaagaagcg

SEQ ID NO: 295543 - DNA, 32 bp, Artificial Sequence
  Description of Artificial Sequence: Synthetic oligonucleotide
ccgaaaaagatgtcagactacggcaagaagcg

SEQ ID NO: 295544 - DNA, 33 bp, Artificial Sequence
  Description of Artificial Sequence: Synthetic oligonucleotide
cgaaaaagatgtcagactacggcaagaagcgtg

SEQ ID NO: 295545 - DNA, 33 bp, Artificial Sequence
  Description of Artificial Sequence: Synthetic oligonucleotide
gaaaaagatgtcagactacggcaagaagcgtgg

SEQ ID NO: 295546 - DNA, 33 bp, Artificial Sequence
  Description of Artificial Sequence: Synthetic oligonucleotide
aaaaagatgtcagactacggcaagaagcgtggg

SEQ ID NO: 295547 - DNA, 32 bp, Artificial Sequence
  Description of Artificial Sequence: Synthetic oligonucleotide
aaaagatgtcagactacggcaagaagcgtggg

SEQ ID NO: 295548 - DNA, 31 bp, Artificial Sequence
  Description of Artificial Sequence: Synthetic oligonucleotide
aaagatgtcagactacggcaagaagcgtggg

SEQ ID NO: 295549 - DNA, 30 bp, Artificial Sequence
  Description of Artificial Sequence: Synthetic oligonucleotide
aagatgtcagactacggcaagaagcgtggg

SEQ ID NO: 295550 - DNA, 29 bp, Artificial Sequence
  Description of Artificial Sequence: Synthetic oligonucleotide
agatgtcagactacggcaagaagcgtggg

SEQ ID NO: 295551 - DNA, 28 bp, Artificial Sequence
  Description of Artificial Sequence: Synthetic oligonucleotide
gatgtcagactacggcaagaagcgtggg

SEQ ID NO: 295552 - DNA, 29 bp, Artificial Sequence
  Description of Artificial Sequence: Synthetic oligonucleotide
atgtcagactacggcaagaagcgtgggtg

SEQ ID NO: 295553 - DNA, 28 bp, Artificial Sequence
  Description of Artificial Sequence: Synthetic oligonucleotide
tgtcagactacggcaagaagcgtgggtg

SEQ ID NO: 295554 - DNA, 27 bp, Artificial Sequence
  Description of Artificial Sequence: Synthetic oligonucleotide
gtcagactacggcaagaagcgtgggtg

SEQ ID NO: 295555 - DNA, 27 bp, Artificial Sequence
  Description of Artificial Sequence: Synthetic oligonucleotide
tcagactacggcaagaagcgtgggtgg

SEQ ID NO: 295556 - DNA, 26 bp, Artificial Sequence
  Description of Artificial Sequence: Synthetic oligonucleotide
cagactacggcaagaagcgtgggtgg

SEQ ID NO: 295557 - DNA, 27 bp, Artificial Sequence
  Description of Artificial Sequence: Synthetic oligonucleotide
agactacggcaagaagcgtgggtgggt

SEQ ID NO: 295558 - DNA, 26 bp, Artificial Sequence
  Description of Artificial Sequence: Synthetic oligonucleotide
gactacggcaagaagcgtgggtgggt

SEQ ID NO: 295559 - DNA, 26 bp, Artificial Sequence
  Description of Artificial Sequence: Synthetic oligonucleotide
actacggcaagaagcgtgggtgggtc

SEQ ID NO: 295560 - DNA, 25 bp, Artificial Sequence
  Description of Artificial Sequence: Synthetic oligonucleotide
ctacggcaagaagcgtgggtgggtc

SEQ ID NO: 295561 - DNA, 26 bp, Artificial Sequence
  Description of Artificial Sequence: Synthetic oligonucleotide
tacggcaagaagcgtgggtgggtcgt

SEQ ID NO: 295562 - DNA, 25 bp, Artificial Sequence
  Description of Artificial Sequence: Synthetic oligonucleotide
acggcaagaagcgtgggtgggtcgt

SEQ ID NO: 295563 - DNA, 24 bp, Artificial Sequence
  Description of Artificial Sequence: Synthetic oligonucleotide
cggcaagaagcgtgggtgggtcgt

SEQ ID NO: 295564 - DNA, 24 bp, Artificial Sequence
  Description of Artificial Sequence: Synthetic oligonucleotide
ggcaagaagcgtgggtgggtcgtg

SEQ ID NO: 295565 - DNA, 24 bp, Artificial Sequence
  Description of Artificial Sequence: Synthetic oligonucleotide
gcaagaagcgtgggtgggtcgtgg

SEQ ID NO: 295566 - DNA, 24 bp, Artificial Sequence
  Description of Artificial Sequence: Synthetic oligonucleotide
caagaagcgtgggtgggtcgtggg

SEQ ID NO: 295567 - DNA, 24 bp, Artificial Sequence
  Description of Artificial Sequence: Synthetic oligonucleotide
aagaagcgtgggtgggtcgtgggc

SEQ ID NO: 295568 - DNA, 23 bp, Artificial Sequence
  Description of Artificial Sequence: Synthetic oligonucleotide
agaagcgtgggtgggtcgtgggc

SEQ ID NO: 295569 - DNA, 22 bp, Artificial Sequence
  Description of Artificial Sequence: Synthetic oligonucleotide
gaagcgtgggtgggtcgtgggc

SEQ ID NO: 295570 - DNA, 22 bp, Artificial Sequence
  Description of Artificial Sequence: Synthetic oligonucleotide
aagcgtgggtgggtcgtgggcc

SEQ ID NO: 295571 - DNA, 21 bp, Artificial Sequence
  Description of Artificial Sequence: Synthetic oligonucleotide
agcgtgggtgggtcgtgggcc

SEQ ID NO: 295572 - DNA, 20 bp, Artificial Sequence
  Description of Artificial Sequence: Synthetic oligonucleotide
gcgtgggtgggtcgtgggcc

SEQ ID NO: 295573 - DNA, 20 bp, Artificial Sequence
  Description of Artificial Sequence: Synthetic oligonucleotide
cgtgggtgggtcgtgggccc

SEQ ID NO: 295574 - DNA, 22 bp, Artificial Sequence
  Description of Artificial Sequence: Synthetic oligonucleotide
gtgggtgggtcgtgggccccat

SEQ ID NO: 295575 - DNA, 24 bp, Artificial Sequence
  Description of Artificial Sequence: Synthetic oligonucleotide
tgggtgggtcgtgggccccatcaa

SEQ ID NO: 295576 - DNA, 23 bp, Artificial Sequence
  Description of Artificial Sequence: Synthetic oligonucleotide
gggtgggtcgtgggccccatcaa

SEQ ID NO: 295577 - DNA, 25 bp, Artificial Sequence
  Description of Artificial Sequence: Synthetic oligonucleotide
ggtgggtcgtgggccccatcaacta

SEQ ID NO: 295578 - DNA, 27 bp, Artificial Sequence
  Description of Artificial Sequence: Synthetic oligonucleotide
gtgggtcgtgggccccatcaactacta

SEQ ID NO: 295579 - DNA, 27 bp, Artificial Sequence
  Description of Artificial Sequence: Synthetic oligonucleotide
tgggtcgtgggccccatcaactactag

SEQ ID NO: 295580 - DNA, 27 bp, Artificial Sequence
  Description of Artificial Sequence: Synthetic oligonucleotide
gggtcgtgggccccatcaactactaga

SEQ ID NO: 295581 - DNA, 27 bp, Artificial Sequence
  Description of Artificial Sequence: Synthetic oligonucleotide
ggtcgtgggccccatcaactactagag

SEQ ID NO: 295582 - DNA, 31 bp, Artificial Sequence
  Description of Artificial Sequence: Synthetic oligonucleotide
gtcgtgggccccatcaactactagagttttg

SEQ ID NO: 295583 - DNA, 31 bp, Artificial Sequence
  Description of Artificial Sequence: Synthetic oligonucleotide
tcgtgggccccatcaactactagagttttgc

SEQ ID NO: 295584 - DNA, 30 bp, Artificial Sequence
  Description of Artificial Sequence: Synthetic oligonucleotide
cgtgggccccatcaactactagagttttgc

SEQ ID NO: 295585 - DNA, 30 bp, Artificial Sequence
  Description of Artificial Sequence: Synthetic oligonucleotide
gtgggccccatcaactactagagttttgcc

SEQ ID NO: 295586 - DNA, 31 bp, Artificial Sequence
  Description of Artificial Sequence: Synthetic oligonucleotide
tgggccccatcaactactagagttttgcctg

SEQ ID NO: 295587 - DNA, 30 bp, Artificial Sequence
  Description of Artificial Sequence: Synthetic oligonucleotide
gggccccatcaactactagagttttgcctg

SEQ ID NO: 295588 - DNA, 30 bp, Artificial Sequence
  Description of Artificial Sequence: Synthetic oligonucleotide
ggccccatcaactactagagttttgcctgc

SEQ ID NO: 295589 - DNA, 30 bp, Artificial Sequence
  Description of Artificial Sequence: Synthetic oligonucleotide
gccccatcaactactagagttttgcctgcc

SEQ ID NO: 295590 - DNA, 31 bp, Artificial Sequence
  Description of Artificial Sequence: Synthetic oligonucleotide
ccccatcaactactagagttttgcctgccag

SEQ ID NO: 295591 - DNA, 31 bp, Artificial Sequence
  Description of Artificial Sequence: Synthetic oligonucleotide
cccatcaactactagagttttgcctgccagc

SEQ ID NO: 295592 - DNA, 32 bp, Artificial Sequence
  Description of Artificial Sequence: Synthetic oligonucleotide
ccatcaactactagagttttgcctgccagcag

SEQ ID NO: 295593 - DNA, 32 bp, Artificial Sequence
  Description of Artificial Sequence: Synthetic oligonucleotide
catcaactactagagttttgcctgccagcagc

SEQ ID NO: 295594 - DNA, 33 bp, Artificial Sequence
  Description of Artificial Sequence: Synthetic oligonucleotide
atcaactactagagttttgcctgccagcagctg

SEQ ID NO: 295595 - DNA, 32 bp, Artificial Sequence
  Description of Artificial Sequence: Synthetic oligonucleotide
tcaactactagagttttgcctgccagcagctg

SEQ ID NO: 295596 - DNA, 31 bp, Artificial Sequence
  Description of Artificial Sequence: Synthetic oligonucleotide
caactactagagttttgcctgccagcagctg

SEQ ID NO: 295597 - DNA, 33 bp, Artificial Sequence
  Description of Artificial Sequence: Synthetic oligonucleotide
aactactagagttttgcctgccagcagctgaag

SEQ ID NO: 295598 - DNA, 32 bp, Artificial Sequence
  Description of Artificial Sequence: Synthetic oligonucleotide
actactagagttttgcctgccagcagctgaag

SEQ ID NO: 295599 - DNA, 31 bp, Artificial Sequence
  Description of Artificial Sequence: Synthetic oligonucleotide
ctactagagttttgcctgccagcagctgaag

SEQ ID NO: 295600 - DNA, 31 bp, Artificial Sequence
  Description of Artificial Sequence: Synthetic oligonucleotide
tactagagttttgcctgccagcagctgaagc

SEQ ID NO: 295601 - DNA, 30 bp, Artificial Sequence
  Description of Artificial Sequence: Synthetic oligonucleotide
actagagttttgcctgccagcagctgaagc

SEQ ID NO: 295602 - DNA, 29 bp, Artificial Sequence
  Description of Artificial Sequence: Synthetic oligonucleotide
ctagagttttgcctgccagcagctgaagc

SEQ ID NO: 295603 - DNA, 29 bp, Artificial Sequence
  Description of Artificial Sequence: Synthetic oligonucleotide
tagagttttgcctgccagcagctgaagcc

SEQ ID NO: 295604 - DNA, 28 bp, Artificial Sequence
  Description of Artificial Sequence: Synthetic oligonucleotide
agagttttgcctgccagcagctgaagcc

SEQ ID NO: 295605 - DNA, 27 bp, Artificial Sequence
  Description of Artificial Sequence: Synthetic oligonucleotide
gagttttgcctgccagcagctgaagcc

SEQ ID NO: 295606 - DNA, 27 bp, Artificial Sequence
  Description of Artificial Sequence: Synthetic oligonucleotide
agttttgcctgccagcagctgaagccg

SEQ ID NO: 295607 - DNA, 26 bp, Artificial Sequence
  Description of Artificial Sequence: Synthetic oligonucleotide
gttttgcctgccagcagctgaagccg

SEQ ID NO: 295608 - DNA, 27 bp, Artificial Sequence
  Description of Artificial Sequence: Synthetic oligonucleotide
ttttgcctgccagcagctgaagccgga

SEQ ID NO: 295609 - DNA, 27 bp, Artificial Sequence
  Description of Artificial Sequence: Synthetic oligonucleotide
tttgcctgccagcagctgaagccggat

SEQ ID NO: 295610 - DNA, 26 bp, Artificial Sequence
  Description of Artificial Sequence: Synthetic oligonucleotide
ttgcctgccagcagctgaagccggat

SEQ ID NO: 295611 - DNA, 25 bp, Artificial Sequence
  Description of Artificial Sequence: Synthetic oligonucleotide
tgcctgccagcagctgaagccggat

SEQ ID NO: 295612 - DNA, 24 bp, Artificial Sequence
  Description of Artificial Sequence: Synthetic oligonucleotide
gcctgccagcagctgaagccggat

SEQ ID NO: 295613 - DNA, 25 bp, Artificial Sequence
  Description of Artificial Sequence: Synthetic oligonucleotide
cctgccagcagctgaagccggatga

SEQ ID NO: 295614 - DNA, 26 bp, Artificial Sequence
  Description of Artificial Sequence: Synthetic oligonucleotide
ctgccagcagctgaagccggatgaca

SEQ ID NO: 295615 - DNA, 26 bp, Artificial Sequence
  Description of Artificial Sequence: Synthetic oligonucleotide
tgccagcagctgaagccggatgacac

SEQ ID NO: 295616 - DNA, 25 bp, Artificial Sequence
  Description of Artificial Sequence: Synthetic oligonucleotide
gccagcagctgaagccggatgacac

SEQ ID NO: 295617 - DNA, 26 bp, Artificial Sequence
  Description of Artificial Sequence: Synthetic oligonucleotide
ccagcagctgaagccggatgacacca

SEQ ID NO: 295618 - DNA, 26 bp, Artificial Sequence
  Description of Artificial Sequence: Synthetic oligonucleotide
cagcagctgaagccggatgacaccac

SEQ ID NO: 295619 - DNA, 27 bp, Artificial Sequence
  Description of Artificial Sequence: Synthetic oligonucleotide
agcagctgaagccggatgacaccacct

SEQ ID NO: 295620 - DNA, 27 bp, Artificial Sequence
  Description of Artificial Sequence: Synthetic oligonucleotide
gcagctgaagccggatgacaccacctt

SEQ ID NO: 295621 - DNA, 28 bp, Artificial Sequence
  Description of Artificial Sequence: Synthetic oligonucleotide
cagctgaagccggatgacaccacctttc

SEQ ID NO: 295622 - DNA, 28 bp, Artificial Sequence
  Description of Artificial Sequence: Synthetic oligonucleotide
agctgaagccggatgacaccacctttcc

SEQ ID NO: 295623 - DNA, 27 bp, Artificial Sequence
  Description of Artificial Sequence: Synthetic oligonucleotide
gctgaagccggatgacaccacctttcc

SEQ ID NO: 295624 - DNA, 27 bp, Artificial Sequence
  Description of Artificial Sequence: Synthetic oligonucleotide
ctgaagccggatgacaccacctttccc

SEQ ID NO: 295625 - DNA, 28 bp, Artificial Sequence
  Description of Artificial Sequence: Synthetic oligonucleotide
tgaagccggatgacaccacctttccctc

SEQ ID NO: 295626 - DNA, 27 bp, Artificial Sequence
  Description of Artificial Sequence: Synthetic oligonucleotide
gaagccggatgacaccacctttccctc

SEQ ID NO: 295627 - DNA, 27 bp, Artificial Sequence
  Description of Artificial Sequence: Synthetic oligonucleotide
aagccggatgacaccacctttccctcc

SEQ ID NO: 295628 - DNA, 27 bp, Artificial Sequence
  Description of Artificial Sequence: Synthetic oligonucleotide
agccggatgacaccacctttccctcca

SEQ ID NO: 295629 - DNA, 26 bp, Artificial Sequence
  Description of Artificial Sequence: Synthetic oligonucleotide
gccggatgacaccacctttccctcca

SEQ ID NO: 295630 - DNA, 27 bp, Artificial Sequence
  Description of Artificial Sequence: Synthetic oligonucleotide
ccggatgacaccacctttccctccaga

SEQ ID NO: 295631 - DNA, 27 bp, Artificial Sequence
  Description of Artificial Sequence: Synthetic oligonucleotide
cggatgacaccacctttccctccagag

SEQ ID NO: 295632 - DNA, 29 bp, Artificial Sequence
  Description of Artificial Sequence: Synthetic oligonucleotide
ggatgacaccacctttccctccagagaac

SEQ ID NO: 295633 - DNA, 30 bp, Artificial Sequence
  Description of Artificial Sequence: Synthetic oligonucleotide
gatgacaccacctttccctccagagaactg

SEQ ID NO: 295634 - DNA, 30 bp, Artificial Sequence
  Description of Artificial Sequence: Synthetic oligonucleotide
atgacaccacctttccctccagagaactgg

SEQ ID NO: 295635 - DNA, 29 bp, Artificial Sequence
  Description of Artificial Sequence: Synthetic oligonucleotide
tgacaccacctttccctccagagaactgg

SEQ ID NO: 295636 - DNA, 28 bp, Artificial Sequence
  Description of Artificial Sequence: Synthetic oligonucleotide
gacaccacctttccctccagagaactgg

SEQ ID NO: 295637 - DNA, 28 bp, Artificial Sequence
  Description of Artificial Sequence: Synthetic oligonucleotide
acaccacctttccctccagagaactggc

SEQ ID NO: 295638 - DNA, 27 bp, Artificial Sequence
  Description of Artificial Sequence: Synthetic oligonucleotide
caccacctttccctccagagaactggc

SEQ ID NO: 295639 - DNA, 27 bp, Artificial Sequence
  Description of Artificial Sequence: Synthetic oligonucleotide
accacctttccctccagagaactggcg

SEQ ID NO: 295640 - DNA, 27 bp, Artificial Sequence
  Description of Artificial Sequence: Synthetic oligonucleotide
ccacctttccctccagagaactggcga

SEQ ID NO: 295641 - DNA, 29 bp, Artificial Sequence
  Description of Artificial Sequence: Synthetic oligonucleotide
cacctttccctccagagaactggcgaaac

SEQ ID NO: 295642 - DNA, 30 bp, Artificial Sequence
  Description of Artificial Sequence: Synthetic oligonucleotide
acctttccctccagagaactggcgaaacag

SEQ ID NO: 295643 - DNA, 29 bp, Artificial Sequence
  Description of Artificial Sequence: Synthetic oligonucleotide
cctttccctccagagaactggcgaaacag

SEQ ID NO: 295644 - DNA, 29 bp, Artificial Sequence
  Description of Artificial Sequence: Synthetic oligonucleotide
ctttccctccagagaactggcgaaacagg

SEQ ID NO: 295645 - DNA, 30 bp, Artificial Sequence
  Description of Artificial Sequence: Synthetic oligonucleotide
tttccctccagagaactggcgaaacaggtc

SEQ ID NO: 295646 - DNA, 29 bp, Artificial Sequence
  Description of Artificial Sequence: Synthetic oligonucleotide
ttccctccagagaactggcgaaacaggtc

SEQ ID NO: 295647 - DNA, 28 bp, Artificial Sequence
  Description of Artificial Sequence: Synthetic oligonucleotide
tccctccagagaactggcgaaacaggtc

SEQ ID NO: 295648 - DNA, 27 bp, Artificial Sequence
  Description of Artificial Sequence: Synthetic oligonucleotide
ccctccagagaactggcgaaacaggtc

SEQ ID NO: 295649 - DNA, 29 bp, Artificial Sequence
  Description of Artificial Sequence: Synthetic oligonucleotide
cctccagagaactggcgaaacaggtcttc

SEQ ID NO: 295650 - DNA, 29 bp, Artificial Sequence
  Description of Artificial Sequence: Synthetic oligonucleotide
ctccagagaactggcgaaacaggtcttcg

SEQ ID NO: 295651 - DNA, 30 bp, Artificial Sequence
  Description of Artificial Sequence: Synthetic oligonucleotide
tccagagaactggcgaaacaggtcttcgag

SEQ ID NO: 295652 - DNA, 29 bp, Artificial Sequence
  Description of Artificial Sequence: Synthetic oligonucleotide
ccagagaactggcgaaacaggtcttcgag

SEQ ID NO: 295653 - DNA, 32 bp, Artificial Sequence
  Description of Artificial Sequence: Synthetic oligonucleotide
cagagaactggcgaaacaggtcttcgagtatg

SEQ ID NO: 295654 - DNA, 32 bp, Artificial Sequence
  Description of Artificial Sequence: Synthetic oligonucleotide
agagaactggcgaaacaggtcttcgagtatgg

SEQ ID NO: 295655 - DNA, 31 bp, Artificial Sequence
  Description of Artificial Sequence: Synthetic oligonucleotide
gagaactggcgaaacaggtcttcgagtatgg

SEQ ID NO: 295656 - DNA, 31 bp, Artificial Sequence
  Description of Artificial Sequence: Synthetic oligonucleotide
agaactggcgaaacaggtcttcgagtatggc

SEQ ID NO: 295657 - DNA, 30 bp, Artificial Sequence
  Description of Artificial Sequence: Synthetic oligonucleotide
gaactggcgaaacaggtcttcgagtatggc

SEQ ID NO: 295658 - DNA, 30 bp, Artificial Sequence
  Description of Artificial Sequence: Synthetic oligonucleotide
aactggcgaaacaggtcttcgagtatggcc

SEQ ID NO: 295659 - DNA, 29 bp, Artificial Sequence
  Description of Artificial Sequence: Synthetic oligonucleotide
actggcgaaacaggtcttcgagtatggcc

SEQ ID NO: 295660 - DNA, 28 bp, Artificial Sequence
  Description of Artificial Sequence: Synthetic oligonucleotide
ctggcgaaacaggtcttcgagtatggcc

SEQ ID NO: 295661 - DNA, 28 bp, Artificial Sequence
  Description of Artificial Sequence: Synthetic oligonucleotide
tggcgaaacaggtcttcgagtatggccg

SEQ ID NO: 295662 - DNA, 27 bp, Artificial Sequence
  Description of Artificial Sequence: Synthetic oligonucleotide
ggcgaaacaggtcttcgagtatggccg

SEQ ID NO: 295663 - DNA, 27 bp, Artificial Sequence
  Description of Artificial Sequence: Synthetic oligonucleotide
gcgaaacaggtcttcgagtatggccgg

SEQ ID NO: 295664 - DNA, 27 bp, Artificial Sequence
  Description of Artificial Sequence: Synthetic oligonucleotide
cgaaacaggtcttcgagtatggccggc

SEQ ID NO: 295665 - DNA, 28 bp, Artificial Sequence
  Description of Artificial Sequence: Synthetic oligonucleotide
gaaacaggtcttcgagtatggccggcag

SEQ ID NO: 295666 - DNA, 28 bp, Artificial Sequence
  Description of Artificial Sequence: Synthetic oligonucleotide
aaacaggtcttcgagtatggccggcagc

SEQ ID NO: 295667 - DNA, 27 bp, Artificial Sequence
  Description of Artificial Sequence: Synthetic oligonucleotide
aacaggtcttcgagtatggccggcagc

SEQ ID NO: 295668 - DNA, 27 bp, Artificial Sequence
  Description of Artificial Sequence: Synthetic oligonucleotide
acaggtcttcgagtatggccggcagct

SEQ ID NO: 295669 - DNA, 26 bp, Artificial Sequence
  Description of Artificial Sequence: Synthetic oligonucleotide
caggtcttcgagtatggccggcagct

SEQ ID NO: 295670 - DNA, 26 bp, Artificial Sequence
  Description of Artificial Sequence: Synthetic oligonucleotide
aggtcttcgagtatggccggcagctc

SEQ ID NO: 295671 - DNA, 25 bp, Artificial Sequence
  Description of Artificial Sequence: Synthetic oligonucleotide
ggtcttcgagtatggccggcagctc

SEQ ID NO: 295672 - DNA, 26 bp, Artificial Sequence
  Description of Artificial Sequence: Synthetic oligonucleotide
gtcttcgagtatggccggcagctcga

SEQ ID NO: 295673 - DNA, 27 bp, Artificial Sequence
  Description of Artificial Sequence: Synthetic oligonucleotide
tcttcgagtatggccggcagctcgaga

SEQ ID NO: 295674 - DNA, 27 bp, Artificial Sequence
  Description of Artificial Sequence: Synthetic oligonucleotide
cttcgagtatggccggcagctcgagat

SEQ ID NO: 295675 - DNA, 27 bp, Artificial Sequence
  Description of Artificial Sequence: Synthetic oligonucleotide
ttcgagtatggccggcagctcgagatg

SEQ ID NO: 295676 - DNA, 27 bp, Artificial Sequence
  Description of Artificial Sequence: Synthetic oligonucleotide
tcgagtatggccggcagctcgagatga

SEQ ID NO: 295677 - DNA, 27 bp, Artificial Sequence
  Description of Artificial Sequence: Synthetic oligonucleotide
cgagtatggccggcagctcgagatgat

SEQ ID NO: 295678 - DNA, 27 bp, Artificial Sequence
  Description of Artificial Sequence: Synthetic oligonucleotide
gagtatggccggcagctcgagatgatc

SEQ ID NO: 295679 - DNA, 27 bp, Artificial Sequence
  Description of Artificial Sequence: Synthetic oligonucleotide
agtatggccggcagctcgagatgatcc

SEQ ID NO: 295680 - DNA, 27 bp, Artificial Sequence
  Description of Artificial Sequence: Synthetic oligonucleotide
gtatggccggcagctcgagatgatcct

SEQ ID NO: 295681 - DNA, 27 bp, Artificial Sequence
  Description of Artificial Sequence: Synthetic oligonucleotide
tatggccggcagctcgagatgatcctc

SEQ ID NO: 295682 - DNA, 27 bp, Artificial Sequence
  Description of Artificial Sequence: Synthetic oligonucleotide
atggccggcagctcgagatgatcctct

SEQ ID NO: 295683 - DNA, 26 bp, Artificial Sequence
  Description of Artificial Sequence: Synthetic oligonucleotide
tggccggcagctcgagatgatcctct

SEQ ID NO: 295684 - DNA, 25 bp, Artificial Sequence
  Description of Artificial Sequence: Synthetic oligonucleotide
ggccggcagctcgagatgatcctct

SEQ ID NO: 295685 - DNA, 26 bp, Artificial Sequence
  Description of Artificial Sequence: Synthetic oligonucleotide
gccggcagctcgagatgatcctctga

SEQ ID NO: 295686 - DNA, 26 bp, Artificial Sequence
  Description of Artificial Sequence: Synthetic oligonucleotide
atctccgacgagcaagcgaggctgag

SEQ ID NO: 295687 - DNA, 25 bp, Artificial Sequence
  Description of Artificial Sequence: Synthetic oligonucleotide
tctccgacgagcaagcgaggctgag

SEQ ID NO: 295688 - DNA, 24 bp, Artificial Sequence
  Description of Artificial Sequence: Synthetic oligonucleotide
ctccgacgagcaagcgaggctgag

SEQ ID NO: 295689 - DNA, 24 bp, Artificial Sequence
  Description of Artificial Sequence: Synthetic oligonucleotide
tccgacgagcaagcgaggctgagc

SEQ ID NO: 295690 - DNA, 23 bp, Artificial Sequence
  Description of Artificial Sequence: Synthetic oligonucleotide
ccgacgagcaagcgaggctgagc

SEQ ID NO: 295691 - DNA, 23 bp, Artificial Sequence
  Description of Artificial Sequence: Synthetic oligonucleotide
cgacgagcaagcgaggctgagcg

SEQ ID NO: 295692 - DNA, 24 bp, Artificial Sequence
  Description of Artificial Sequence: Synthetic oligonucleotide
gacgagcaagcgaggctgagcgga

SEQ ID NO: 295693 - DNA, 24 bp, Artificial Sequence
  Description of Artificial Sequence: Synthetic oligonucleotide
acgagcaagcgaggctgagcggag

SEQ ID NO: 295694 - DNA, 23 bp, Artificial Sequence
  Description of Artificial Sequence: Synthetic oligonucleotide
cgagcaagcgaggctgagcggag

SEQ ID NO: 295695 - DNA, 23 bp, Artificial Sequence
  Description of Artificial Sequence: Synthetic oligonucleotide
gagcaagcgaggctgagcggagg

SEQ ID NO: 295696 - DNA, 24 bp, Artificial Sequence
  Description of Artificial Sequence: Synthetic oligonucleotide
agcaagcgaggctgagcggagggt

SEQ ID NO: 295697 - DNA, 23 bp, Artificial Sequence
  Description of Artificial Sequence: Synthetic oligonucleotide
gcaagcgaggctgagcggagggt

SEQ ID NO: 295698 - DNA, 23 bp, Artificial Sequence
  Description of Artificial Sequence: Synthetic oligonucleotide
caagcgaggctgagcggagggtc

SEQ ID NO: 295699 - DNA, 24 bp, Artificial Sequence
  Description of Artificial Sequence: Synthetic oligonucleotide
aagcgaggctgagcggagggtcct

SEQ ID NO: 295700 - DNA, 23 bp, Artificial Sequence
  Description of Artificial Sequence: Synthetic oligonucleotide
agcgaggctgagcggagggtcct

SEQ ID NO: 295701 - DNA, 22 bp, Artificial Sequence
  Description of Artificial Sequence: Synthetic oligonucleotide
gcgaggctgagcggagggtcct

SEQ ID NO: 295702 - DNA, 22 bp, Artificial Sequence
  Description of Artificial Sequence: Synthetic oligonucleotide
cgaggctgagcggagggtcctc

SEQ ID NO: 295703 - DNA, 22 bp, Artificial Sequence
  Description of Artificial Sequence: Synthetic oligonucleotide
gaggctgagcggagggtcctcg

SEQ ID NO: 295704 - DNA, 23 bp, Artificial Sequence
  Description of Artificial Sequence: Synthetic oligonucleotide
aggctgagcggagggtcctcgca

SEQ ID NO: 295705 - DNA, 22 bp, Artificial Sequence
  Description of Artificial Sequence: Synthetic oligonucleotide
ggctgagcggagggtcctcgca

SEQ ID NO: 295706 - DNA, 22 bp, Artificial Sequence
  Description of Artificial Sequence: Synthetic oligonucleotide
gctgagcggagggtcctcgcag

SEQ ID NO: 295707 - DNA, 22 bp, Artificial Sequence
  Description of Artificial Sequence: Synthetic oligonucleotide
ctgagcggagggtcctcgcagc

SEQ ID NO: 295708 - DNA, 22 bp, Artificial Sequence
  Description of Artificial Sequence: Synthetic oligonucleotide
tgagcggagggtcctcgcagcc

SEQ ID NO: 295709 - DNA, 21 bp, Artificial Sequence
  Description of Artificial Sequence: Synthetic oligonucleotide
gagcggagggtcctcgcagcc

SEQ ID NO: 295710 - DNA, 21 bp, Artificial Sequence
  Description of Artificial Sequence: Synthetic oligonucleotide
agcggagggtcctcgcagccc

SEQ ID NO: 295711 - DNA, 20 bp, Artificial Sequence
  Description of Artificial Sequence: Synthetic oligonucleotide
gcggagggtcctcgcagccc

SEQ ID NO: 295712 - DNA, 20 bp, Artificial Sequence
  Description of Artificial Sequence: Synthetic oligonucleotide
cggagggtcctcgcagcccg

SEQ ID NO: 295713 - DNA, 20 bp, Artificial Sequence
  Description of Artificial Sequence: Synthetic oligonucleotide
ggagggtcctcgcagcccgg

SEQ ID NO: 295714 - DNA, 20 bp, Artificial Sequence
  Description of Artificial Sequence: Synthetic oligonucleotide
gagggtcctcgcagcccggc

SEQ ID NO: 295715 - DNA, 21 bp, Artificial Sequence
  Description of Artificial Sequence: Synthetic oligonucleotide
agggtcctcgcagcccggcgt

SEQ ID NO: 295716 - DNA, 20 bp, Artificial Sequence
  Description of Artificial Sequence: Synthetic oligonucleotide
gggtcctcgcagcccggcgt

SEQ ID NO: 295717 - DNA, 20 bp, Artificial Sequence
  Description of Artificial Sequence: Synthetic oligonucleotide
ggtcctcgcagcccggcgtc

SEQ ID NO: 295718 - DNA, 21 bp, Artificial Sequence
  Description of Artificial Sequence: Synthetic oligonucleotide
gtcctcgcagcccggcgtcga

SEQ ID NO: 295719 - DNA, 22 bp, Artificial Sequence
  Description of Artificial Sequence: Synthetic oligonucleotide
tcctcgcagcccggcgtcgaga

SEQ ID NO: 295720 - DNA, 21 bp, Artificial Sequence
  Description of Artificial Sequence: Synthetic oligonucleotide
cctcgcagcccggcgtcgaga

SEQ ID NO: 295721 - DNA, 22 bp, Artificial Sequence
  Description of Artificial Sequence: Synthetic oligonucleotide
ctcgcagcccggcgtcgagact

SEQ ID NO: 295722 - DNA, 23 bp, Artificial Sequence
  Description of Artificial Sequence: Synthetic oligonucleotide
tcgcagcccggcgtcgagactgt

SEQ ID NO: 295723 - DNA, 22 bp, Artificial Sequence
  Description of Artificial Sequence: Synthetic oligonucleotide
cgcagcccggcgtcgagactgt

SEQ ID NO: 295724 - DNA, 23 bp, Artificial Sequence
  Description of Artificial Sequence: Synthetic oligonucleotide
gcagcccggcgtcgagactgtca

SEQ ID NO: 295725 - DNA, 23 bp, Artificial Sequence
  Description of Artificial Sequence: Synthetic oligonucleotide
cagcccggcgtcgagactgtcag

SEQ ID NO: 295726 - DNA, 23 bp, Artificial Sequence
  Description of Artificial Sequence: Synthetic oligonucleotide
agcccggcgtcgagactgtcagg

SEQ ID NO: 295727 - DNA, 22 bp, Artificial Sequence
  Description of Artificial Sequence: Synthetic oligonucleotide
gcccggcgtcgagactgtcagg

SEQ ID NO: 295728 - DNA, 23 bp, Artificial Sequence
  Description of Artificial Sequence: Synthetic oligonucleotide
cccggcgtcgagactgtcaggga

SEQ ID NO: 295729 - DNA, 23 bp, Artificial Sequence
  Description of Artificial Sequence: Synthetic oligonucleotide
ccggcgtcgagactgtcagggac

SEQ ID NO: 295730 - DNA, 24 bp, Artificial Sequence
  Description of Artificial Sequence: Synthetic oligonucleotide
cggcgtcgagactgtcagggacgt

SEQ ID NO: 295731 - DNA, 24 bp, Artificial Sequence
  Description of Artificial Sequence: Synthetic oligonucleotide
ggcgtcgagactgtcagggacgtc

SEQ ID NO: 295732 - DNA, 25 bp, Artificial Sequence
  Description of Artificial Sequence: Synthetic oligonucleotide
gcgtcgagactgtcagggacgtcca

SEQ ID NO: 295733 - DNA, 25 bp, Artificial Sequence
  Description of Artificial Sequence: Synthetic oligonucleotide
cgtcgagactgtcagggacgtccag

SEQ ID NO: 295734 - DNA, 26 bp, Artificial Sequence
  Description of Artificial Sequence: Synthetic oligonucleotide
gtcgagactgtcagggacgtccagca

SEQ ID NO: 295735 - DNA, 26 bp, Artificial Sequence
  Description of Artificial Sequence: Synthetic oligonucleotide
tcgagactgtcagggacgtccagcag

SEQ ID NO: 295736 - DNA, 25 bp, Artificial Sequence
  Description of Artificial Sequence: Synthetic oligonucleotide
cgagactgtcagggacgtccagcag

SEQ ID NO: 295737 - DNA, 26 bp, Artificial Sequence
  Description of Artificial Sequence: Synthetic oligonucleotide
gagactgtcagggacgtccagcagct

SEQ ID NO: 295738 - DNA, 27 bp, Artificial Sequence
  Description of Artificial Sequence: Synthetic oligonucleotide
agactgtcagggacgtccagcagctga

SEQ ID NO: 295739 - DNA, 27 bp, Artificial Sequence
  Description of Artificial Sequence: Synthetic oligonucleotide
gactgtcagggacgtccagcagctgat

SEQ ID NO: 295740 - DNA, 27 bp, Artificial Sequence
  Description of Artificial Sequence: Synthetic oligonucleotide
actgtcagggacgtccagcagctgatg

SEQ ID NO: 295741 - DNA, 26 bp, Artificial Sequence
  Description of Artificial Sequence: Synthetic oligonucleotide
ctgtcagggacgtccagcagctgatg

SEQ ID NO: 295742 - DNA, 26 bp, Artificial Sequence
  Description of Artificial Sequence: Synthetic oligonucleotide
tgtcagggacgtccagcagctgatgc

SEQ ID NO: 295743 - DNA, 25 bp, Artificial Sequence
  Description of Artificial Sequence: Synthetic oligonucleotide
gtcagggacgtccagcagctgatgc

SEQ ID NO: 295744 - DNA, 25 bp, Artificial Sequence
  Description of Artificial Sequence: Synthetic oligonucleotide
tcagggacgtccagcagctgatgcc

SEQ ID NO: 295745 - DNA, 24 bp, Artificial Sequence
  Description of Artificial Sequence: Synthetic oligonucleotide
cagggacgtccagcagctgatgcc

SEQ ID NO: 295746 - DNA, 24 bp, Artificial Sequence
  Description of Artificial Sequence: Synthetic oligonucleotide
agggacgtccagcagctgatgccg

SEQ ID NO: 295747 - DNA, 23 bp, Artificial Sequence
  Description of Artificial Sequence: Synthetic oligonucleotide
gggacgtccagcagctgatgccg

SEQ ID NO: 295748 - DNA, 23 bp, Artificial Sequence
  Description of Artificial Sequence: Synthetic oligonucleotide
ggacgtccagcagctgatgccgc

SEQ ID NO: 295749 - DNA, 23 bp, Artificial Sequence
  Description of Artificial Sequence: Synthetic oligonucleotide
gacgtccagcagctgatgccgcg

SEQ ID NO: 295750 - DNA, 25 bp, Artificial Sequence
  Description of Artificial Sequence: Synthetic oligonucleotide
acgtccagcagctgatgccgcgcaa

SEQ ID NO: 295751 - DNA, 24 bp, Artificial Sequence
  Description of Artificial Sequence: Synthetic oligonucleotide
cgtccagcagctgatgccgcgcaa

SEQ ID NO: 295752 - DNA, 24 bp, Artificial Sequence
  Description of Artificial Sequence: Synthetic oligonucleotide
gtccagcagctgatgccgcgcaag

SEQ ID NO: 295753 - DNA, 25 bp, Artificial Sequence
  Description of Artificial Sequence: Synthetic oligonucleotide
tccagcagctgatgccgcgcaagga

SEQ ID NO: 295754 - DNA, 24 bp, Artificial Sequence
  Description of Artificial Sequence: Synthetic oligonucleotide
ccagcagctgatgccgcgcaagga

SEQ ID NO: 295755 - DNA, 24 bp, Artificial Sequence
  Description of Artificial Sequence: Synthetic oligonucleotide
cagcagctgatgccgcgcaaggac

SEQ ID NO: 295756 - DNA, 25 bp, Artificial Sequence
  Description of Artificial Sequence: Synthetic oligonucleotide
agcagctgatgccgcgcaaggacga

SEQ ID NO: 295757 - DNA, 24 bp, Artificial Sequence
  Description of Artificial Sequence: Synthetic oligonucleotide
gcagctgatgccgcgcaaggacga

SEQ ID NO: 295758 - DNA, 27 bp, Artificial Sequence
  Description of Artificial Sequence: Synthetic oligonucleotide
cagctgatgccgcgcaaggacgagata

SEQ ID NO: 295759 - DNA, 27 bp, Artificial Sequence
  Description of Artificial Sequence: Synthetic oligonucleotide
agctgatgccgcgcaaggacgagatag

SEQ ID NO: 295760 - DNA, 27 bp, Artificial Sequence
  Description of Artificial Sequence: Synthetic oligonucleotide
gctgatgccgcgcaaggacgagataga

SEQ ID NO: 295761 - DNA, 28 bp, Artificial Sequence
  Description of Artificial Sequence: Synthetic oligonucleotide
ctgatgccgcgcaaggacgagatagaac

SEQ ID NO: 295762 - DNA, 28 bp, Artificial Sequence
  Description of Artificial Sequence: Synthetic oligonucleotide
tgatgccgcgcaaggacgagatagaacc

SEQ ID NO: 295763 - DNA, 27 bp, Artificial Sequence
  Description of Artificial Sequence: Synthetic oligonucleotide
gatgccgcgcaaggacgagatagaacc

SEQ ID NO: 295764 - DNA, 27 bp, Artificial Sequence
  Description of Artificial Sequence: Synthetic oligonucleotide
atgccgcgcaaggacgagatagaaccg

SEQ ID NO: 295765 - DNA, 26 bp, Artificial Sequence
  Description of Artificial Sequence: Synthetic oligonucleotide
tgccgcgcaaggacgagatagaaccg

SEQ ID NO: 295766 - DNA, 25 bp, Artificial Sequence
  Description of Artificial Sequence: Synthetic oligonucleotide
gccgcgcaaggacgagatagaaccg

SEQ ID NO: 295767 - DNA, 26 bp, Artificial Sequence
  Description of Artificial Sequence: Synthetic oligonucleotide
ccgcgcaaggacgagatagaaccgca

SEQ ID NO: 295768 - DNA, 27 bp, Artificial Sequence
  Description of Artificial Sequence: Synthetic oligonucleotide
cgcgcaaggacgagatagaaccgcaga

SEQ ID NO: 295769 - DNA, 28 bp, Artificial Sequence
  Description of Artificial Sequence: Synthetic oligonucleotide
gcgcaaggacgagatagaaccgcagatc

SEQ ID NO: 295770 - DNA, 30 bp, Artificial Sequence
  Description of Artificial Sequence: Synthetic oligonucleotide
cgcaaggacgagatagaaccgcagatcatg

SEQ ID NO: 295771 - DNA, 30 bp, Artificial Sequence
  Description of Artificial Sequence: Synthetic oligonucleotide
gcaaggacgagatagaaccgcagatcatgg

SEQ ID NO: 295772 - DNA, 30 bp, Artificial Sequence
  Description of Artificial Sequence: Synthetic oligonucleotide
caaggacgagatagaaccgcagatcatggc

SEQ ID NO: 295773 - DNA, 30 bp, Artificial Sequence
  Description of Artificial Sequence: Synthetic oligonucleotide
aaggacgagatagaaccgcagatcatggcc

SEQ ID NO: 295774 - DNA, 29 bp, Artificial Sequence
  Description of Artificial Sequence: Synthetic oligonucleotide
aggacgagatagaaccgcagatcatggcc

SEQ ID NO: 295775 - DNA, 28 bp, Artificial Sequence
  Description of Artificial Sequence: Synthetic oligonucleotide
ggacgagatagaaccgcagatcatggcc

SEQ ID NO: 295776 - DNA, 30 bp, Artificial Sequence
  Description of Artificial Sequence: Synthetic oligonucleotide
gacgagatagaaccgcagatcatggccaac

SEQ ID NO: 295777 - DNA, 33 bp, Artificial Sequence
  Description of Artificial Sequence: Synthetic oligonucleotide
acgagatagaaccgcagatcatggccaactaag

SEQ ID NO: 295778 - DNA, 32 bp, Artificial Sequence
  Description of Artificial Sequence: Synthetic oligonucleotide
cgagatagaaccgcagatcatggccaactaag

SEQ ID NO: 295779 - DNA, 33 bp, Artificial Sequence
  Description of Artificial Sequence: Synthetic oligonucleotide
gagatagaaccgcagatcatggccaactaagac

SEQ ID NO: 295780 - DNA, 33 bp, Artificial Sequence
  Description of Artificial Sequence: Synthetic oligonucleotide
agatagaaccgcagatcatggccaactaagacg

SEQ ID NO: 295781 - DNA, 32 bp, Artificial Sequence
  Description of Artificial Sequence: Synthetic oligonucleotide
gatagaaccgcagatcatggccaactaagacg

SEQ ID NO: 295782 - DNA, 33 bp, Artificial Sequence
  Description of Artificial Sequence: Synthetic oligonucleotide
atagaaccgcagatcatggccaactaagacgtg

SEQ ID NO: 295783 - DNA, 32 bp, Artificial Sequence
  Description of Artificial Sequence: Synthetic oligonucleotide
tagaaccgcagatcatggccaactaagacgtg

SEQ ID NO: 295784 - DNA, 31 bp, Artificial Sequence
  Description of Artificial Sequence: Synthetic oligonucleotide
agaaccgcagatcatggccaactaagacgtg

SEQ ID NO: 295785 - DNA, 30 bp, Artificial Sequence
  Description of Artificial Sequence: Synthetic oligonucleotide
gaaccgcagatcatggccaactaagacgtg

SEQ ID NO: 295786 - DNA, 30 bp, Artificial Sequence
  Description of Artificial Sequence: Synthetic oligonucleotide
aaccgcagatcatggccaactaagacgtgc

SEQ ID NO: 295787 - DNA, 29 bp, Artificial Sequence
  Description of Artificial Sequence: Synthetic oligonucleotide
accgcagatcatggccaactaagacgtgc

SEQ ID NO: 295788 - DNA, 28 bp, Artificial Sequence
  Description of Artificial Sequence: Synthetic oligonucleotide
ccgcagatcatggccaactaagacgtgc

SEQ ID NO: 295789 - DNA, 29 bp, Artificial Sequence
  Description of Artificial Sequence: Synthetic oligonucleotide
cgcagatcatggccaactaagacgtgctg

SEQ ID NO: 295790 - DNA, 29 bp, Artificial Sequence
  Description of Artificial Sequence: Synthetic oligonucleotide
gcagatcatggccaactaagacgtgctgc

SEQ ID NO: 295791 - DNA, 32 bp, Artificial Sequence
  Description of Artificial Sequence: Synthetic oligonucleotide
cagatcatggccaactaagacgtgctgcaaag

SEQ ID NO: 295792 - DNA, 32 bp, Artificial Sequence
  Description of Artificial Sequence: Synthetic oligonucleotide
agatcatggccaactaagacgtgctgcaaagc

SEQ ID NO: 295793 - DNA, 31 bp, Artificial Sequence
  Description of Artificial Sequence: Synthetic oligonucleotide
gatcatggccaactaagacgtgctgcaaagc

SEQ ID NO: 295794 - DNA, 31 bp, Artificial Sequence
  Description of Artificial Sequence: Synthetic oligonucleotide
atcatggccaactaagacgtgctgcaaagcc

SEQ ID NO: 295795 - DNA, 30 bp, Artificial Sequence
  Description of Artificial Sequence: Synthetic oligonucleotide
tcatggccaactaagacgtgctgcaaagcc

SEQ ID NO: 295796 - DNA, 29 bp, Artificial Sequence
  Description of Artificial Sequence: Synthetic oligonucleotide
catggccaactaagacgtgctgcaaagcc

SEQ ID NO: 295797 - DNA, 34 bp, Artificial Sequence
  Description of Artificial Sequence: Synthetic oligonucleotide
atggccaactaagacgtgctgcaaagccaaatag

SEQ ID NO: 295798 - DNA, 33 bp, Artificial Sequence
  Description of Artificial Sequence: Synthetic oligonucleotide
tggccaactaagacgtgctgcaaagccaaatag

SEQ ID NO: 295799 - DNA, 32 bp, Artificial Sequence
  Description of Artificial Sequence: Synthetic oligonucleotide
ggccaactaagacgtgctgcaaagccaaatag

SEQ ID NO: 295800 - DNA, 32 bp, Artificial Sequence
  Description of Artificial Sequence: Synthetic oligonucleotide
gccaactaagacgtgctgcaaagccaaatagg

SEQ ID NO: 295801 - DNA, 32 bp, Artificial Sequence
  Description of Artificial Sequence: Synthetic oligonucleotide
ccaactaagacgtgctgcaaagccaaataggc

SEQ ID NO: 295802 - DNA, 35 bp, Artificial Sequence
  Description of Artificial Sequence: Synthetic oligonucleotide
caactaagacgtgctgcaaagccaaataggcattg

SEQ ID NO: 295803 - DNA, 35 bp, Artificial Sequence
  Description of Artificial Sequence: Synthetic oligonucleotide
aactaagacgtgctgcaaagccaaataggcattgg

SEQ ID NO: 295804 - DNA, 34 bp, Artificial Sequence
  Description of Artificial Sequence: Synthetic oligonucleotide
actaagacgtgctgcaaagccaaataggcattgg

SEQ ID NO: 295805 - DNA, 33 bp, Artificial Sequence
  Description of Artificial Sequence: Synthetic oligonucleotide
ctaagacgtgctgcaaagccaaataggcattgg

SEQ ID NO: 295806 - DNA, 33 bp, Artificial Sequence
  Description of Artificial Sequence: Synthetic oligonucleotide
taagacgtgctgcaaagccaaataggcattggc

SEQ ID NO: 295807 - DNA, 32 bp, Artificial Sequence
  Description of Artificial Sequence: Synthetic oligonucleotide
aagacgtgctgcaaagccaaataggcattggc

SEQ ID NO: 295808 - DNA, 31 bp, Artificial Sequence
  Description of Artificial Sequence: Synthetic oligonucleotide
agacgtgctgcaaagccaaataggcattggc

SEQ ID NO: 295809 - DNA, 30 bp, Artificial Sequence
  Description of Artificial Sequence: Synthetic oligonucleotide
gacgtgctgcaaagccaaataggcattggc

SEQ ID NO: 295810 - DNA, 32 bp, Artificial Sequence
  Description of Artificial Sequence: Synthetic oligonucleotide
acgtgctgcaaagccaaataggcattggcatg

SEQ ID NO: 295811 - DNA, 31 bp, Artificial Sequence
  Description of Artificial Sequence: Synthetic oligonucleotide
cgtgctgcaaagccaaataggcattggcatg

SEQ ID NO: 295812 - DNA, 33 bp, Artificial Sequence
  Description of Artificial Sequence: Synthetic oligonucleotide
gtgctgcaaagccaaataggcattggcatgaac

SEQ ID NO: 295813 - DNA, 33 bp, Artificial Sequence
  Description of Artificial Sequence: Synthetic oligonucleotide
tgctgcaaagccaaataggcattggcatgaacg

SEQ ID NO: 295814 - DNA, 32 bp, Artificial Sequence
  Description of Artificial Sequence: Synthetic oligonucleotide
gctgcaaagccaaataggcattggcatgaacg

SEQ ID NO: 295815 - DNA, 33 bp, Artificial Sequence
  Description of Artificial Sequence: Synthetic oligonucleotide
ctgcaaagccaaataggcattggcatgaacgag

SEQ ID NO: 295816 - DNA, 33 bp, Artificial Sequence
  Description of Artificial Sequence: Synthetic oligonucleotide
tgcaaagccaaataggcattggcatgaacgagg

SEQ ID NO: 295817 - DNA, 32 bp, Artificial Sequence
  Description of Artificial Sequence: Synthetic oligonucleotide
gcaaagccaaataggcattggcatgaacgagg

SEQ ID NO: 295818 - DNA, 32 bp, Artificial Sequence
  Description of Artificial Sequence: Synthetic oligonucleotide
caaagccaaataggcattggcatgaacgaggc

SEQ ID NO: 295819 - DNA, 32 bp, Artificial Sequence
  Description of Artificial Sequence: Synthetic oligonucleotide
aaagccaaataggcattggcatgaacgaggcg

SEQ ID NO: 295820 - DNA, 31 bp, Artificial Sequence
  Description of Artificial Sequence: Synthetic oligonucleotide
aagccaaataggcattggcatgaacgaggcg

SEQ ID NO: 295821 - DNA, 30 bp, Artificial Sequence
  Description of Artificial Sequence: Synthetic oligonucleotide
agccaaataggcattggcatgaacgaggcg

SEQ ID NO: 295822 - DNA, 29 bp, Artificial Sequence
  Description of Artificial Sequence: Synthetic oligonucleotide
gccaaataggcattggcatgaacgaggcg

SEQ ID NO: 295823 - DNA, 29 bp, Artificial Sequence
  Description of Artificial Sequence: Synthetic oligonucleotide
ccaaataggcattggcatgaacgaggcgc

SEQ ID NO: 295824 - DNA, 30 bp, Artificial Sequence
  Description of Artificial Sequence: Synthetic oligonucleotide
caaataggcattggcatgaacgaggcgctg

SEQ ID NO: 295825 - DNA, 30 bp, Artificial Sequence
  Description of Artificial Sequence: Synthetic oligonucleotide
aaataggcattggcatgaacgaggcgctgg

SEQ ID NO: 295826 - DNA, 29 bp, Artificial Sequence
  Description of Artificial Sequence: Synthetic oligonucleotide
aataggcattggcatgaacgaggcgctgg

SEQ ID NO: 295827 - DNA, 28 bp, Artificial Sequence
  Description of Artificial Sequence: Synthetic oligonucleotide
ataggcattggcatgaacgaggcgctgg

SEQ ID NO: 295828 - DNA, 27 bp, Artificial Sequence
  Description of Artificial Sequence: Synthetic oligonucleotide
taggcattggcatgaacgaggcgctgg

SEQ ID NO: 295829 - DNA, 27 bp, Artificial Sequence
  Description of Artificial Sequence: Synthetic oligonucleotide
aggcattggcatgaacgaggcgctggt

SEQ ID NO: 295830 - DNA, 26 bp, Artificial Sequence
  Description of Artificial Sequence: Synthetic oligonucleotide
ggcattggcatgaacgaggcgctggt

SEQ ID NO: 295831 - DNA, 26 bp, Artificial Sequence
  Description of Artificial Sequence: Synthetic oligonucleotide
gcattggcatgaacgaggcgctggtg

SEQ ID NO: 295832 - DNA, 27 bp, Artificial Sequence
  Description of Artificial Sequence: Synthetic oligonucleotide
cattggcatgaacgaggcgctggtggt

SEQ ID NO: 295833 - DNA, 27 bp, Artificial Sequence
  Description of Artificial Sequence: Synthetic oligonucleotide
attggcatgaacgaggcgctggtggtc

SEQ ID NO: 295834 - DNA, 27 bp, Artificial Sequence
  Description of Artificial Sequence: Synthetic oligonucleotide
ttggcatgaacgaggcgctggtggtct

SEQ ID NO: 295835 - DNA, 26 bp, Artificial Sequence
  Description of Artificial Sequence: Synthetic oligonucleotide
tggcatgaacgaggcgctggtggtct

SEQ ID NO: 295836 - DNA, 25 bp, Artificial Sequence
  Description of Artificial Sequence: Synthetic oligonucleotide
ggcatgaacgaggcgctggtggtct

SEQ ID NO: 295837 - DNA, 26 bp, Artificial Sequence
  Description of Artificial Sequence: Synthetic oligonucleotide
gcatgaacgaggcgctggtggtctgt

SEQ ID NO: 295838 - DNA, 27 bp, Artificial Sequence
  Description of Artificial Sequence: Synthetic oligonucleotide
catgaacgaggcgctggtggtctgtga

SEQ ID NO: 295839 - DNA, 27 bp, Artificial Sequence
  Description of Artificial Sequence: Synthetic oligonucleotide
atgaacgaggcgctggtggtctgtgag

SEQ ID NO: 295840 - DNA, 26 bp, Artificial Sequence
  Description of Artificial Sequence: Synthetic oligonucleotide
tgaacgaggcgctggtggtctgtgag

SEQ ID NO: 295841 - DNA, 25 bp, Artificial Sequence
  Description of Artificial Sequence: Synthetic oligonucleotide
gaacgaggcgctggtggtctgtgag

SEQ ID NO: 295842 - DNA, 25 bp, Artificial Sequence
  Description of Artificial Sequence: Synthetic oligonucleotide
aacgaggcgctggtggtctgtgagg

SEQ ID NO: 295843 - DNA, 24 bp, Artificial Sequence
  Description of Artificial Sequence: Synthetic oligonucleotide
acgaggcgctggtggtctgtgagg

SEQ ID NO: 295844 - DNA, 23 bp, Artificial Sequence
  Description of Artificial Sequence: Synthetic oligonucleotide
cgaggcgctggtggtctgtgagg

SEQ ID NO: 295845 - DNA, 23 bp, Artificial Sequence
  Description of Artificial Sequence: Synthetic oligonucleotide
gaggcgctggtggtctgtgaggg

SEQ ID NO: 295846 - DNA, 25 bp, Artificial Sequence
  Description of Artificial Sequence: Synthetic oligonucleotide
aggcgctggtggtctgtgaggggta

SEQ ID NO: 295847 - DNA, 24 bp, Artificial Sequence
  Description of Artificial Sequence: Synthetic oligonucleotide
ggcgctggtggtctgtgaggggta

SEQ ID NO: 295848 - DNA, 24 bp, Artificial Sequence
  Description of Artificial Sequence: Synthetic oligonucleotide
gcgctggtggtctgtgaggggtac

SEQ ID NO: 295849 - DNA, 24 bp, Artificial Sequence
  Description of Artificial Sequence: Synthetic oligonucleotide
cgctggtggtctgtgaggggtacc

SEQ ID NO: 295850 - DNA, 24 bp, Artificial Sequence
  Description of Artificial Sequence: Synthetic oligonucleotide
gctggtggtctgtgaggggtaccc

SEQ ID NO: 295851 - DNA, 24 bp, Artificial Sequence
  Description of Artificial Sequence: Synthetic oligonucleotide
ctggtggtctgtgaggggtacccc

SEQ ID NO: 295852 - DNA, 24 bp, Artificial Sequence
  Description of Artificial Sequence: Synthetic oligonucleotide
tggtggtctgtgaggggtaccccc

SEQ ID NO: 295853 - DNA, 23 bp, Artificial Sequence
  Description of Artificial Sequence: Synthetic oligonucleotide
ggtggtctgtgaggggtaccccc

SEQ ID NO: 295854 - DNA, 23 bp, Artificial Sequence
  Description of Artificial Sequence: Synthetic oligonucleotide
gtggtctgtgaggggtacccccg

SEQ ID NO: 295855 - DNA, 24 bp, Artificial Sequence
  Description of Artificial Sequence: Synthetic oligonucleotide
tggtctgtgaggggtacccccgga

SEQ ID NO: 295856 - DNA, 23 bp, Artificial Sequence
  Description of Artificial Sequence: Synthetic oligonucleotide
ggtctgtgaggggtacccccgga

SEQ ID NO: 295857 - DNA, 24 bp, Artificial Sequence
  Description of Artificial Sequence: Synthetic oligonucleotide
gtctgtgaggggtacccccggaca

SEQ ID NO: 295858 - DNA, 25 bp, Artificial Sequence
  Description of Artificial Sequence: Synthetic oligonucleotide
tctgtgaggggtacccccggacaga

SEQ ID NO: 295859 - DNA, 24 bp, Artificial Sequence
  Description of Artificial Sequence: Synthetic oligonucleotide
ctgtgaggggtacccccggacaga

SEQ ID NO: 295860 - DNA, 24 bp, Artificial Sequence
  Description of Artificial Sequence: Synthetic oligonucleotide
tgtgaggggtacccccggacagac

SEQ ID NO: 295861 - DNA, 23 bp, Artificial Sequence
  Description of Artificial Sequence: Synthetic oligonucleotide
gtgaggggtacccccggacagac

SEQ ID NO: 295862 - DNA, 24 bp, Artificial Sequence
  Description of Artificial Sequence: Synthetic oligonucleotide
tgaggggtacccccggacagacgt

SEQ ID NO: 295863 - DNA, 23 bp, Artificial Sequence
  Description of Artificial Sequence: Synthetic oligonucleotide
gaggggtacccccggacagacgt

SEQ ID NO: 295864 - DNA, 23 bp, Artificial Sequence
  Description of Artificial Sequence: Synthetic oligonucleotide
aggggtacccccggacagacgtg

SEQ ID NO: 295865 - DNA, 22 bp, Artificial Sequence
  Description of Artificial Sequence: Synthetic oligonucleotide
ggggtacccccggacagacgtg

SEQ ID NO: 295866 - DNA, 23 bp, Artificial Sequence
  Description of Artificial Sequence: Synthetic oligonucleotide
gggtacccccggacagacgtggt

SEQ ID NO: 295867 - DNA, 23 bp, Artificial Sequence
  Description of Artificial Sequence: Synthetic oligonucleotide
ggtacccccggacagacgtggtc

SEQ ID NO: 295868 - DNA, 24 bp, Artificial Sequence
  Description of Artificial Sequence: Synthetic oligonucleotide
gtacccccggacagacgtggtcct

SEQ ID NO: 295869 - DNA, 26 bp, Artificial Sequence
  Description of Artificial Sequence: Synthetic oligonucleotide
tacccccggacagacgtggtcctgta

SEQ ID NO: 295870 - DNA, 25 bp, Artificial Sequence
  Description of Artificial Sequence: Synthetic oligonucleotide
acccccggacagacgtggtcctgta

SEQ ID NO: 295871 - DNA, 24 bp, Artificial Sequence
  Description of Artificial Sequence: Synthetic oligonucleotide
cccccggacagacgtggtcctgta

SEQ ID NO: 295872 - DNA, 24 bp, Artificial Sequence
  Description of Artificial Sequence: Synthetic oligonucleotide
ccccggacagacgtggtcctgtac

SEQ ID NO: 295873 - DNA, 26 bp, Artificial Sequence
  Description of Artificial Sequence: Synthetic oligonucleotide
cccggacagacgtggtcctgtaccat

SEQ ID NO: 295874 - DNA, 27 bp, Artificial Sequence
  Description of Artificial Sequence: Synthetic oligonucleotide
ccggacagacgtggtcctgtaccatgt

SEQ ID NO: 295875 - DNA, 27 bp, Artificial Sequence
  Description of Artificial Sequence: Synthetic oligonucleotide
cggacagacgtggtcctgtaccatgtc

SEQ ID NO: 295876 - DNA, 27 bp, Artificial Sequence
  Description of Artificial Sequence: Synthetic oligonucleotide
ggacagacgtggtcctgtaccatgtcc

SEQ ID NO: 295877 - DNA, 27 bp, Artificial Sequence
  Description of Artificial Sequence: Synthetic oligonucleotide
gacagacgtggtcctgtaccatgtccg

SEQ ID NO: 295878 - DNA, 27 bp, Artificial Sequence
  Description of Artificial Sequence: Synthetic oligonucleotide
acagacgtggtcctgtaccatgtccgc

SEQ ID NO: 295879 - DNA, 27 bp, Artificial Sequence
  Description of Artificial Sequence: Synthetic oligonucleotide
cagacgtggtcctgtaccatgtccgca

SEQ ID NO: 295880 - DNA, 27 bp, Artificial Sequence
  Description of Artificial Sequence: Synthetic oligonucleotide
agacgtggtcctgtaccatgtccgcac

SEQ ID NO: 295881 - DNA, 26 bp, Artificial Sequence
  Description of Artificial Sequence: Synthetic oligonucleotide
gacgtggtcctgtaccatgtccgcac

SEQ ID NO: 295882 - DNA, 26 bp, Artificial Sequence
  Description of Artificial Sequence: Synthetic oligonucleotide
acgtggtcctgtaccatgtccgcacc

SEQ ID NO: 295883 - DNA, 25 bp, Artificial Sequence
  Description of Artificial Sequence: Synthetic oligonucleotide
cgtggtcctgtaccatgtccgcacc

SEQ ID NO: 295884 - DNA, 25 bp, Artificial Sequence
  Description of Artificial Sequence: Synthetic oligonucleotide
gtggtcctgtaccatgtccgcaccc

SEQ ID NO: 295885 - DNA, 25 bp, Artificial Sequence
  Description of Artificial Sequence: Synthetic oligonucleotide
tggtcctgtaccatgtccgcacccc

SEQ ID NO: 295886 - DNA, 24 bp, Artificial Sequence
  Description of Artificial Sequence: Synthetic oligonucleotide
ggtcctgtaccatgtccgcacccc

SEQ ID NO: 295887 - DNA, 25 bp, Artificial Sequence
  Description of Artificial Sequence: Synthetic oligonucleotide
gtcctgtaccatgtccgcaccccca

SEQ ID NO: 295888 - DNA, 25 bp, Artificial Sequence
  Description of Artificial Sequence: Synthetic oligonucleotide
tcctgtaccatgtccgcacccccag

SEQ ID NO: 295889 - DNA, 24 bp, Artificial Sequence
  Description of Artificial Sequence: Synthetic oligonucleotide
cctgtaccatgtccgcacccccag

SEQ ID NO: 295890 - DNA, 24 bp, Artificial Sequence
  Description of Artificial Sequence: Synthetic oligonucleotide
ctgtaccatgtccgcacccccagg

SEQ ID NO: 295891 - DNA, 25 bp, Artificial Sequence
  Description of Artificial Sequence: Synthetic oligonucleotide
tgtaccatgtccgcacccccaggca

SEQ ID NO: 295892 - DNA, 24 bp, Artificial Sequence
  Description of Artificial Sequence: Synthetic oligonucleotide
gtaccatgtccgcacccccaggca

SEQ ID NO: 295893 - DNA, 26 bp, Artificial Sequence
  Description of Artificial Sequence: Synthetic oligonucleotide
taccatgtccgcacccccaggcacat

SEQ ID NO: 295894 - DNA, 25 bp, Artificial Sequence
  Description of Artificial Sequence: Synthetic oligonucleotide
accatgtccgcacccccaggcacat

SEQ ID NO: 295895 - DNA, 24 bp, Artificial Sequence
  Description of Artificial Sequence: Synthetic oligonucleotide
ccatgtccgcacccccaggcacat

SEQ ID NO: 295896 - DNA, 26 bp, Artificial Sequence
  Description of Artificial Sequence: Synthetic oligonucleotide
catgtccgcacccccaggcacatcat

SEQ ID NO: 295897 - DNA, 27 bp, Artificial Sequence
  Description of Artificial Sequence: Synthetic oligonucleotide
atgtccgcacccccaggcacatcatca

SEQ ID NO: 295898 - DNA, 27 bp, Artificial Sequence
  Description of Artificial Sequence: Synthetic oligonucleotide
tgtccgcacccccaggcacatcatcat

SEQ ID NO: 295899 - DNA, 27 bp, Artificial Sequence
  Description of Artificial Sequence: Synthetic oligonucleotide
gtccgcacccccaggcacatcatcata

SEQ ID NO: 295900 - DNA, 28 bp, Artificial Sequence
  Description of Artificial Sequence: Synthetic oligonucleotide
tccgcacccccaggcacatcatcatatg

SEQ ID NO: 295901 - DNA, 27 bp, Artificial Sequence
  Description of Artificial Sequence: Synthetic oligonucleotide
ccgcacccccaggcacatcatcatatg

SEQ ID NO: 295902 - DNA, 27 bp, Artificial Sequence
  Description of Artificial Sequence: Synthetic oligonucleotide
cgcacccccaggcacatcatcatatgg

SEQ ID NO: 295903 - DNA, 27 bp, Artificial Sequence
  Description of Artificial Sequence: Synthetic oligonucleotide
gcacccccaggcacatcatcatatggc

SEQ ID NO: 295904 - DNA, 28 bp, Artificial Sequence
  Description of Artificial Sequence: Synthetic oligonucleotide
cacccccaggcacatcatcatatggctg

SEQ ID NO: 295905 - DNA, 28 bp, Artificial Sequence
  Description of Artificial Sequence: Synthetic oligonucleotide
acccccaggcacatcatcatatggctgc

SEQ ID NO: 295906 - DNA, 27 bp, Artificial Sequence
  Description of Artificial Sequence: Synthetic oligonucleotide
cccccaggcacatcatcatatggctgc

SEQ ID NO: 295907 - DNA, 28 bp, Artificial Sequence
  Description of Artificial Sequence: Synthetic oligonucleotide
ccccaggcacatcatcatatggctgcag

SEQ ID NO: 295908 - DNA, 31 bp, Artificial Sequence
  Description of Artificial Sequence: Synthetic oligonucleotide
cccaggcacatcatcatatggctgcagaatc

SEQ ID NO: 295909 - DNA, 33 bp, Artificial Sequence
  Description of Artificial Sequence: Synthetic oligonucleotide
ccaggcacatcatcatatggctgcagaatcatc

SEQ ID NO: 295910 - DNA, 34 bp, Artificial Sequence
  Description of Artificial Sequence: Synthetic oligonucleotide
caggcacatcatcatatggctgcagaatcatcac

SEQ ID NO: 295911 - DNA, 36 bp, Artificial Sequence
  Description of Artificial Sequence: Synthetic oligonucleotide
aggcacatcatcatatggctgcagaatcatcacaag

SEQ ID NO: 295912 - DNA, 35 bp, Artificial Sequence
  Description of Artificial Sequence: Synthetic oligonucleotide
ggcacatcatcatatggctgcagaatcatcacaag

SEQ ID NO: 295913 - DNA, 35 bp, Artificial Sequence
  Description of Artificial Sequence: Synthetic oligonucleotide
gcacatcatcatatggctgcagaatcatcacaagg

SEQ ID NO: 295914 - DNA, 35 bp, Artificial Sequence
  Description of Artificial Sequence: Synthetic oligonucleotide
cacatcatcatatggctgcagaatcatcacaaggg

SEQ ID NO: 295915 - DNA, 36 bp, Artificial Sequence
  Description of Artificial Sequence: Synthetic oligonucleotide
acatcatcatatggctgcagaatcatcacaagggag

SEQ ID NO: 295916 - DNA, 35 bp, Artificial Sequence
  Description of Artificial Sequence: Synthetic oligonucleotide
catcatcatatggctgcagaatcatcacaagggag

SEQ ID NO: 295917 - DNA, 36 bp, Artificial Sequence
  Description of Artificial Sequence: Synthetic oligonucleotide
atcatcatatggctgcagaatcatcacaagggagtg

SEQ ID NO: 295918 - DNA, 35 bp, Artificial Sequence
  Description of Artificial Sequence: Synthetic oligonucleotide
tcatcatatggctgcagaatcatcacaagggagtg

SEQ ID NO: 295919 - DNA, 34 bp, Artificial Sequence
  Description of Artificial Sequence: Synthetic oligonucleotide
catcatatggctgcagaatcatcacaagggagtg

SEQ ID NO: 295920 - DNA, 36 bp, Artificial Sequence
  Description of Artificial Sequence: Synthetic oligonucleotide
atcatatggctgcagaatcatcacaagggagtgatg

SEQ ID NO: 295921 - DNA, 35 bp, Artificial Sequence
  Description of Artificial Sequence: Synthetic oligonucleotide
tcatatggctgcagaatcatcacaagggagtgatg

SEQ ID NO: 295922 - DNA, 34 bp, Artificial Sequence
  Description of Artificial Sequence: Synthetic oligonucleotide
catatggctgcagaatcatcacaagggagtgatg

SEQ ID NO: 295923 - DNA, 36 bp, Artificial Sequence
  Description of Artificial Sequence: Synthetic oligonucleotide
atatggctgcagaatcatcacaagggagtgatgaac

SEQ ID NO: 295924 - DNA, 35 bp, Artificial Sequence
  Description of Artificial Sequence: Synthetic oligonucleotide
tatggctgcagaatcatcacaagggagtgatgaac

SEQ ID NO: 295925 - DNA, 34 bp, Artificial Sequence
  Description of Artificial Sequence: Synthetic oligonucleotide
atggctgcagaatcatcacaagggagtgatgaac

SEQ ID NO: 295926 - DNA, 33 bp, Artificial Sequence
  Description of Artificial Sequence: Synthetic oligonucleotide
tggctgcagaatcatcacaagggagtgatgaac

SEQ ID NO: 295927 - DNA, 32 bp, Artificial Sequence
  Description of Artificial Sequence: Synthetic oligonucleotide
ggctgcagaatcatcacaagggagtgatgaac

SEQ ID NO: 295928 - DNA, 32 bp, Artificial Sequence
  Description of Artificial Sequence: Synthetic oligonucleotide
gctgcagaatcatcacaagggagtgatgaacc

SEQ ID NO: 295929 - DNA, 33 bp, Artificial Sequence
  Description of Artificial Sequence: Synthetic oligonucleotide
ctgcagaatcatcacaagggagtgatgaaccag

SEQ ID NO: 295930 - DNA, 33 bp, Artificial Sequence
  Description of Artificial Sequence: Synthetic oligonucleotide
tgcagaatcatcacaagggagtgatgaaccagg

SEQ ID NO: 295931 - DNA, 32 bp, Artificial Sequence
  Description of Artificial Sequence: Synthetic oligonucleotide
gcagaatcatcacaagggagtgatgaaccagg

SEQ ID NO: 295932 - DNA, 33 bp, Artificial Sequence
  Description of Artificial Sequence: Synthetic oligonucleotide
cagaatcatcacaagggagtgatgaaccaggtg

SEQ ID NO: 295933 - DNA, 33 bp, Artificial Sequence
  Description of Artificial Sequence: Synthetic oligonucleotide
agaatcatcacaagggagtgatgaaccaggtgg

SEQ ID NO: 295934 - DNA, 32 bp, Artificial Sequence
  Description of Artificial Sequence: Synthetic oligonucleotide
gaatcatcacaagggagtgatgaaccaggtgg

SEQ ID NO: 295935 - DNA, 33 bp, Artificial Sequence
  Description of Artificial Sequence: Synthetic oligonucleotide
aatcatcacaagggagtgatgaaccaggtggag

SEQ ID NO: 295936 - DNA, 32 bp, Artificial Sequence
  Description of Artificial Sequence: Synthetic oligonucleotide
atcatcacaagggagtgatgaaccaggtggag

SEQ ID NO: 295937 - DNA, 31 bp, Artificial Sequence
  Description of Artificial Sequence: Synthetic oligonucleotide
tcatcacaagggagtgatgaaccaggtggag

SEQ ID NO: 295938 - DNA, 30 bp, Artificial Sequence
  Description of Artificial Sequence: Synthetic oligonucleotide
catcacaagggagtgatgaaccaggtggag

SEQ ID NO: 295939 - DNA, 30 bp, Artificial Sequence
  Description of Artificial Sequence: Synthetic oligonucleotide
atcacaagggagtgatgaaccaggtggagc

SEQ ID NO: 295940 - DNA, 29 bp, Artificial Sequence
  Description of Artificial Sequence: Synthetic oligonucleotide
tcacaagggagtgatgaaccaggtggagc

SEQ ID NO: 295941 - DNA, 28 bp, Artificial Sequence
  Description of Artificial Sequence: Synthetic oligonucleotide
cacaagggagtgatgaaccaggtggagc

SEQ ID NO: 295942 - DNA, 29 bp, Artificial Sequence
  Description of Artificial Sequence: Synthetic oligonucleotide
acaagggagtgatgaaccaggtggagcag

SEQ ID NO: 295943 - DNA, 28 bp, Artificial Sequence
  Description of Artificial Sequence: Synthetic oligonucleotide
caagggagtgatgaaccaggtggagcag

SEQ ID NO: 295944 - DNA, 28 bp, Artificial Sequence
  Description of Artificial Sequence: Synthetic oligonucleotide
aagggagtgatgaaccaggtggagcagg

SEQ ID NO: 295945 - DNA, 27 bp, Artificial Sequence
  Description of Artificial Sequence: Synthetic oligonucleotide
agggagtgatgaaccaggtggagcagg

SEQ ID NO: 295946 - DNA, 26 bp, Artificial Sequence
  Description of Artificial Sequence: Synthetic oligonucleotide
gggagtgatgaaccaggtggagcagg

SEQ ID NO: 295947 - DNA, 26 bp, Artificial Sequence
  Description of Artificial Sequence: Synthetic oligonucleotide
ggagtgatgaaccaggtggagcaggc

SEQ ID NO: 295948 - DNA, 26 bp, Artificial Sequence
  Description of Artificial Sequence: Synthetic oligonucleotide
gagtgatgaaccaggtggagcaggcc

SEQ ID NO: 295949 - DNA, 27 bp, Artificial Sequence
  Description of Artificial Sequence: Synthetic oligonucleotide
agtgatgaaccaggtggagcaggccct

SEQ ID NO: 295950 - DNA, 26 bp, Artificial Sequence
  Description of Artificial Sequence: Synthetic oligonucleotide
gtgatgaaccaggtggagcaggccct

SEQ ID NO: 295951 - DNA, 26 bp, Artificial Sequence
  Description of Artificial Sequence: Synthetic oligonucleotide
tgatgaaccaggtggagcaggccctg

SEQ ID NO: 295952 - DNA, 25 bp, Artificial Sequence
  Description of Artificial Sequence: Synthetic oligonucleotide
gatgaaccaggtggagcaggccctg

SEQ ID NO: 295953 - DNA, 26 bp, Artificial Sequence
  Description of Artificial Sequence: Synthetic oligonucleotide
atgaaccaggtggagcaggccctgct

SEQ ID NO: 295954 - DNA, 25 bp, Artificial Sequence
  Description of Artificial Sequence: Synthetic oligonucleotide
tgaaccaggtggagcaggccctgct

SEQ ID NO: 295955 - DNA, 24 bp, Artificial Sequence
  Description of Artificial Sequence: Synthetic oligonucleotide
gaaccaggtggagcaggccctgct

SEQ ID NO: 295956 - DNA, 24 bp, Artificial Sequence
  Description of Artificial Sequence: Synthetic oligonucleotide
aaccaggtggagcaggccctgctc

SEQ ID NO: 295957 - DNA, 23 bp, Artificial Sequence
  Description of Artificial Sequence: Synthetic oligonucleotide
accaggtggagcaggccctgctc

SEQ ID NO: 295958 - DNA, 22 bp, Artificial Sequence
  Description of Artificial Sequence: Synthetic oligonucleotide
ccaggtggagcaggccctgctc

SEQ ID NO: 295959 - DNA, 23 bp, Artificial Sequence
  Description of Artificial Sequence: Synthetic oligonucleotide
caggtggagcaggccctgctcca

SEQ ID NO: 295960 - DNA, 23 bp, Artificial Sequence
  Description of Artificial Sequence: Synthetic oligonucleotide
aggtggagcaggccctgctccag

SEQ ID NO: 295961 - DNA, 22 bp, Artificial Sequence
  Description of Artificial Sequence: Synthetic oligonucleotide
ggtggagcaggccctgctccag

SEQ ID NO: 295962 - DNA, 23 bp, Artificial Sequence
  Description of Artificial Sequence: Synthetic oligonucleotide
gtggagcaggccctgctccagct

SEQ ID NO: 295963 - DNA, 23 bp, Artificial Sequence
  Description of Artificial Sequence: Synthetic oligonucleotide
tggagcaggccctgctccagctg

SEQ ID NO: 295964 - DNA, 22 bp, Artificial Sequence
  Description of Artificial Sequence: Synthetic oligonucleotide
ggagcaggccctgctccagctg

SEQ ID NO: 295965 - DNA, 23 bp, Artificial Sequence
  Description of Artificial Sequence: Synthetic oligonucleotide
gagcaggccctgctccagctgca

SEQ ID NO: 295966 - DNA, 23 bp, Artificial Sequence
  Description of Artificial Sequence: Synthetic oligonucleotide
agcaggccctgctccagctgcag

SEQ ID NO: 295967 - DNA, 22 bp, Artificial Sequence
  Description of Artificial Sequence: Synthetic oligonucleotide
gcaggccctgctccagctgcag

SEQ ID NO: 295968 - DNA, 22 bp, Artificial Sequence
  Description of Artificial Sequence: Synthetic oligonucleotide
caggccctgctccagctgcagg

SEQ ID NO: 295969 - DNA, 23 bp, Artificial Sequence
  Description of Artificial Sequence: Synthetic oligonucleotide
aggccctgctccagctgcaggct

SEQ ID NO: 295970 - DNA, 22 bp, Artificial Sequence
  Description of Artificial Sequence: Synthetic oligonucleotide
ggccctgctccagctgcaggct

SEQ ID NO: 295971 - DNA, 22 bp, Artificial Sequence
  Description of Artificial Sequence: Synthetic oligonucleotide
gccctgctccagctgcaggctc

SEQ ID NO: 295972 - DNA, 22 bp, Artificial Sequence
  Description of Artificial Sequence: Synthetic oligonucleotide
ccctgctccagctgcaggctcg

SEQ ID NO: 295973 - DNA, 22 bp, Artificial Sequence
  Description of Artificial Sequence: Synthetic oligonucleotide
cctgctccagctgcaggctcgc

SEQ ID NO: 295974 - DNA, 23 bp, Artificial Sequence
  Description of Artificial Sequence: Synthetic oligonucleotide
ctgctccagctgcaggctcgcga

SEQ ID NO: 295975 - DNA, 25 bp, Artificial Sequence
  Description of Artificial Sequence: Synthetic oligonucleotide
tgctccagctgcaggctcgcgacta

SEQ ID NO: 295976 - DNA, 24 bp, Artificial Sequence
  Description of Artificial Sequence: Synthetic oligonucleotide
gctccagctgcaggctcgcgacta

SEQ ID NO: 295977 - DNA, 24 bp, Artificial Sequence
  Description of Artificial Sequence: Synthetic oligonucleotide
ctccagctgcaggctcgcgactag

SEQ ID NO: 295978 - DNA, 25 bp, Artificial Sequence
  Description of Artificial Sequence: Synthetic oligonucleotide
tccagctgcaggctcgcgactagga

SEQ ID NO: 295979 - DNA, 24 bp, Artificial Sequence
  Description of Artificial Sequence: Synthetic oligonucleotide
ccagctgcaggctcgcgactagga

SEQ ID NO: 295980 - DNA, 26 bp, Artificial Sequence
  Description of Artificial Sequence: Synthetic oligonucleotide
cagctgcaggctcgcgactaggagaa

SEQ ID NO: 295981 - DNA, 26 bp, Artificial Sequence
  Description of Artificial Sequence: Synthetic oligonucleotide
agctgcaggctcgcgactaggagaag

SEQ ID NO: 295982 - DNA, 25 bp, Artificial Sequence
  Description of Artificial Sequence: Synthetic oligonucleotide
gctgcaggctcgcgactaggagaag

SEQ ID NO: 295983 - DNA, 26 bp, Artificial Sequence
  Description of Artificial Sequence: Synthetic oligonucleotide
ctgcaggctcgcgactaggagaagct

SEQ ID NO: 295984 - DNA, 26 bp, Artificial Sequence
  Description of Artificial Sequence: Synthetic oligonucleotide
tgcaggctcgcgactaggagaagctg

SEQ ID NO: 295985 - DNA, 25 bp, Artificial Sequence
  Description of Artificial Sequence: Synthetic oligonucleotide
gcaggctcgcgactaggagaagctg

SEQ ID NO: 295986 - DNA, 25 bp, Artificial Sequence
  Description of Artificial Sequence: Synthetic oligonucleotide
caggctcgcgactaggagaagctgg

SEQ ID NO: 295987 - DNA, 25 bp, Artificial Sequence
  Description of Artificial Sequence: Synthetic oligonucleotide
aggctcgcgactaggagaagctggc

SEQ ID NO: 295988 - DNA, 24 bp, Artificial Sequence
  Description of Artificial Sequence: Synthetic oligonucleotide
ggctcgcgactaggagaagctggc

SEQ ID NO: 295989 - DNA, 24 bp, Artificial Sequence
  Description of Artificial Sequence: Synthetic oligonucleotide
gctcgcgactaggagaagctggcc

SEQ ID NO: 295990 - DNA, 24 bp, Artificial Sequence
  Description of Artificial Sequence: Synthetic oligonucleotide
ctcgcgactaggagaagctggccc

SEQ ID NO: 295991 - DNA, 24 bp, Artificial Sequence
  Description of Artificial Sequence: Synthetic oligonucleotide
tcgcgactaggagaagctggcccg

SEQ ID NO: 295992 - DNA, 23 bp, Artificial Sequence
  Description of Artificial Sequence: Synthetic oligonucleotide
cgcgactaggagaagctggcccg

SEQ ID NO: 295993 - DNA, 23 bp, Artificial Sequence
  Description of Artificial Sequence: Synthetic oligonucleotide
gcgactaggagaagctggcccgg

SEQ ID NO: 295994 - DNA, 24 bp, Artificial Sequence
  Description of Artificial Sequence: Synthetic oligonucleotide
cgactaggagaagctggcccggga

SEQ ID NO: 295995 - DNA, 26 bp, Artificial Sequence
  Description of Artificial Sequence: Synthetic oligonucleotide
gactaggagaagctggcccgggagat

SEQ ID NO: 295996 - DNA, 26 bp, Artificial Sequence
  Description of Artificial Sequence: Synthetic oligonucleotide
actaggagaagctggcccgggagatg

SEQ ID NO: 295997 - DNA, 25 bp, Artificial Sequence
  Description of Artificial Sequence: Synthetic oligonucleotide
ctaggagaagctggcccgggagatg

SEQ ID NO: 295998 - DNA, 25 bp, Artificial Sequence
  Description of Artificial Sequence: Synthetic oligonucleotide
taggagaagctggcccgggagatgg

SEQ ID NO: 295999 - DNA, 24 bp, Artificial Sequence
  Description of Artificial Sequence: Synthetic oligonucleotide
aggagaagctggcccgggagatgg

SEQ ID NO: 296000 - DNA, 23 bp, Artificial Sequence
  Description of Artificial Sequence: Synthetic oligonucleotide
ggagaagctggcccgggagatgg

SEQ ID NO: 296001 - DNA, 24 bp, Artificial Sequence
  Description of Artificial Sequence: Synthetic oligonucleotide
gagaagctggcccgggagatggct

SEQ ID NO: 296002 - DNA, 25 bp, Artificial Sequence
  Description of Artificial Sequence: Synthetic oligonucleotide
agaagctggcccgggagatggctga

SEQ ID NO: 296003 - DNA, 24 bp, Artificial Sequence
  Description of Artificial Sequence: Synthetic oligonucleotide
gaagctggcccgggagatggctga

SEQ ID NO: 296004 - DNA, 24 bp, Artificial Sequence
  Description of Artificial Sequence: Synthetic oligonucleotide
aagctggcccgggagatggctgag

SEQ ID NO: 296005 - DNA, 23 bp, Artificial Sequence
  Description of Artificial Sequence: Synthetic oligonucleotide
agctggcccgggagatggctgag

SEQ ID NO: 296006 - DNA, 22 bp, Artificial Sequence
  Description of Artificial Sequence: Synthetic oligonucleotide
gctggcccgggagatggctgag

SEQ ID NO: 296007 - DNA, 22 bp, Artificial Sequence
  Description of Artificial Sequence: Synthetic oligonucleotide
ctggcccgggagatggctgagc

SEQ ID NO: 296008 - DNA, 22 bp, Artificial Sequence
  Description of Artificial Sequence: Synthetic oligonucleotide
tggcccgggagatggctgagcc

SEQ ID NO: 296009 - DNA, 21 bp, Artificial Sequence
  Description of Artificial Sequence: Synthetic oligonucleotide
ggcccgggagatggctgagcc

SEQ ID NO: 296010 - DNA, 21 bp, Artificial Sequence
  Description of Artificial Sequence: Synthetic oligonucleotide
gcccgggagatggctgagccc

SEQ ID NO: 296011 - DNA, 22 bp, Artificial Sequence
  Description of Artificial Sequence: Synthetic oligonucleotide
cccgggagatggctgagcccca

SEQ ID NO: 296012 - DNA, 25 bp, Artificial Sequence
  Description of Artificial Sequence: Synthetic oligonucleotide
ccgggagatggctgagccccacaaa

SEQ ID NO: 296013 - DNA, 26 bp, Artificial Sequence
  Description of Artificial Sequence: Synthetic oligonucleotide
cgggagatggctgagccccacaaagt

SEQ ID NO: 296014 - DNA, 26 bp, Artificial Sequence
  Description of Artificial Sequence: Synthetic oligonucleotide
gggagatggctgagccccacaaagtg

SEQ ID NO: 296015 - DNA, 26 bp, Artificial Sequence
  Description of Artificial Sequence: Synthetic oligonucleotide
ggagatggctgagccccacaaagtgg

SEQ ID NO: 296016 - DNA, 26 bp, Artificial Sequence
  Description of Artificial Sequence: Synthetic oligonucleotide
gagatggctgagccccacaaagtggc

SEQ ID NO: 296017 - DNA, 27 bp, Artificial Sequence
  Description of Artificial Sequence: Synthetic oligonucleotide
agatggctgagccccacaaagtggcca

SEQ ID NO: 296018 - DNA, 27 bp, Artificial Sequence
  Description of Artificial Sequence: Synthetic oligonucleotide
gatggctgagccccacaaagtggccat

SEQ ID NO: 296019 - DNA, 27 bp, Artificial Sequence
  Description of Artificial Sequence: Synthetic oligonucleotide
atggctgagccccacaaagtggccatg

SEQ ID NO: 296020 - DNA, 27 bp, Artificial Sequence
  Description of Artificial Sequence: Synthetic oligonucleotide
tggctgagccccacaaagtggccatga

SEQ ID NO: 296021 - DNA, 26 bp, Artificial Sequence
  Description of Artificial Sequence: Synthetic oligonucleotide
ggctgagccccacaaagtggccatga

SEQ ID NO: 296022 - DNA, 26 bp, Artificial Sequence
  Description of Artificial Sequence: Synthetic oligonucleotide
gctgagccccacaaagtggccatgag

SEQ ID NO: 296023 - DNA, 26 bp, Artificial Sequence
  Description of Artificial Sequence: Synthetic oligonucleotide
ctgagccccacaaagtggccatgagg

SEQ ID NO: 296024 - DNA, 26 bp, Artificial Sequence
  Description of Artificial Sequence: Synthetic oligonucleotide
tgagccccacaaagtggccatgaggc

SEQ ID NO: 296025 - DNA, 25 bp, Artificial Sequence
  Description of Artificial Sequence: Synthetic oligonucleotide
gagccccacaaagtggccatgaggc

SEQ ID NO: 296026 - DNA, 25 bp, Artificial Sequence
  Description of Artificial Sequence: Synthetic oligonucleotide
agccccacaaagtggccatgaggcg

SEQ ID NO: 296027 - DNA, 24 bp, Artificial Sequence
  Description of Artificial Sequence: Synthetic oligonucleotide
gccccacaaagtggccatgaggcg

SEQ ID NO: 296028 - DNA, 27 bp, Artificial Sequence
  Description of Artificial Sequence: Synthetic oligonucleotide
ccccacaaagtggccatgaggcgcaaa

SEQ ID NO: 296029 - DNA, 27 bp, Artificial Sequence
  Description of Artificial Sequence: Synthetic oligonucleotide
cccacaaagtggccatgaggcgcaaac

SEQ ID NO: 296030 - DNA, 28 bp, Artificial Sequence
  Description of Artificial Sequence: Synthetic oligonucleotide
ccacaaagtggccatgaggcgcaaactg

SEQ ID NO: 296031 - DNA, 28 bp, Artificial Sequence
  Description of Artificial Sequence: Synthetic oligonucleotide
cacaaagtggccatgaggcgcaaactgc

SEQ ID NO: 296032 - DNA, 28 bp, Artificial Sequence
  Description of Artificial Sequence: Synthetic oligonucleotide
acaaagtggccatgaggcgcaaactgcg

SEQ ID NO: 296033 - DNA, 27 bp, Artificial Sequence
  Description of Artificial Sequence: Synthetic oligonucleotide
caaagtggccatgaggcgcaaactgcg

SEQ ID NO: 296034 - DNA, 28 bp, Artificial Sequence
  Description of Artificial Sequence: Synthetic oligonucleotide
aaagtggccatgaggcgcaaactgcgtc

SEQ ID NO: 296035 - DNA, 27 bp, Artificial Sequence
  Description of Artificial Sequence: Synthetic oligonucleotide
aagtggccatgaggcgcaaactgcgtc

SEQ ID NO: 296036 - DNA, 27 bp, Artificial Sequence
  Description of Artificial Sequence: Synthetic oligonucleotide
agtggccatgaggcgcaaactgcgtca

SEQ ID NO: 296037 - DNA, 26 bp, Artificial Sequence
  Description of Artificial Sequence: Synthetic oligonucleotide
gtggccatgaggcgcaaactgcgtca

SEQ ID NO: 296038 - DNA, 27 bp, Artificial Sequence
  Description of Artificial Sequence: Synthetic oligonucleotide
tggccatgaggcgcaaactgcgtcaga

SEQ ID NO: 296039 - DNA, 26 bp, Artificial Sequence
  Description of Artificial Sequence: Synthetic oligonucleotide
ggccatgaggcgcaaactgcgtcaga

SEQ ID NO: 296040 - DNA, 27 bp, Artificial Sequence
  Description of Artificial Sequence: Synthetic oligonucleotide
gccatgaggcgcaaactgcgtcagagt

SEQ ID NO: 296041 - DNA, 27 bp, Artificial Sequence
  Description of Artificial Sequence: Synthetic oligonucleotide
ccatgaggcgcaaactgcgtcagagtg

SEQ ID NO: 296042 - DNA, 28 bp, Artificial Sequence
  Description of Artificial Sequence: Synthetic oligonucleotide
catgaggcgcaaactgcgtcagagtgtg

SEQ ID NO: 296043 - DNA, 29 bp, Artificial Sequence
  Description of Artificial Sequence: Synthetic oligonucleotide
atgaggcgcaaactgcgtcagagtgtgag

SEQ ID NO: 296044 - DNA, 28 bp, Artificial Sequence
  Description of Artificial Sequence: Synthetic oligonucleotide
tgaggcgcaaactgcgtcagagtgtgag

SEQ ID NO: 296045 - DNA, 27 bp, Artificial Sequence
  Description of Artificial Sequence: Synthetic oligonucleotide
gaggcgcaaactgcgtcagagtgtgag

SEQ ID NO: 296046 - DNA, 27 bp, Artificial Sequence
  Description of Artificial Sequence: Synthetic oligonucleotide
aggcgcaaactgcgtcagagtgtgagc

SEQ ID NO: 296047 - DNA, 26 bp, Artificial Sequence
  Description of Artificial Sequence: Synthetic oligonucleotide
ggcgcaaactgcgtcagagtgtgagc

SEQ ID NO: 296048 - DNA, 27 bp, Artificial Sequence
  Description of Artificial Sequence: Synthetic oligonucleotide
gcgcaaactgcgtcagagtgtgagcca

SEQ ID NO: 296049 - DNA, 27 bp, Artificial Sequence
  Description of Artificial Sequence: Synthetic oligonucleotide
cgcaaactgcgtcagagtgtgagccag

SEQ ID NO: 296050 - DNA, 27 bp, Artificial Sequence
  Description of Artificial Sequence: Synthetic oligonucleotide
gcaaactgcgtcagagtgtgagccagg

SEQ ID NO: 296051 - DNA, 27 bp, Artificial Sequence
  Description of Artificial Sequence: Synthetic oligonucleotide
caaactgcgtcagagtgtgagccaggg

SEQ ID NO: 296052 - DNA, 27 bp, Artificial Sequence
  Description of Artificial Sequence: Synthetic oligonucleotide
aaactgcgtcagagtgtgagccagggg

SEQ ID NO: 296053 - DNA, 26 bp, Artificial Sequence
  Description of Artificial Sequence: Synthetic oligonucleotide
aactgcgtcagagtgtgagccagggg

SEQ ID NO: 296054 - DNA, 25 bp, Artificial Sequence
  Description of Artificial Sequence: Synthetic oligonucleotide
actgcgtcagagtgtgagccagggg

SEQ ID NO: 296055 - DNA, 24 bp, Artificial Sequence
  Description of Artificial Sequence: Synthetic oligonucleotide
ctgcgtcagagtgtgagccagggg

SEQ ID NO: 296056 - DNA, 24 bp, Artificial Sequence
  Description of Artificial Sequence: Synthetic oligonucleotide
tgcgtcagagtgtgagccaggggc

SEQ ID NO: 296057 - DNA, 23 bp, Artificial Sequence
  Description of Artificial Sequence: Synthetic oligonucleotide
gcgtcagagtgtgagccaggggc

SEQ ID NO: 296058 - DNA, 24 bp, Artificial Sequence
  Description of Artificial Sequence: Synthetic oligonucleotide
cgtcagagtgtgagccaggggcct

SEQ ID NO: 296059 - DNA, 24 bp, Artificial Sequence
  Description of Artificial Sequence: Synthetic oligonucleotide
gtcagagtgtgagccaggggcctc

SEQ ID NO: 296060 - DNA, 25 bp, Artificial Sequence
  Description of Artificial Sequence: Synthetic oligonucleotide
tcagagtgtgagccaggggcctcca

SEQ ID NO: 296061 - DNA, 24 bp, Artificial Sequence
  Description of Artificial Sequence: Synthetic oligonucleotide
cagagtgtgagccaggggcctcca

SEQ ID NO: 296062 - DNA, 24 bp, Artificial Sequence
  Description of Artificial Sequence: Synthetic oligonucleotide
agagtgtgagccaggggcctccac

SEQ ID NO: 296063 - DNA, 23 bp, Artificial Sequence
  Description of Artificial Sequence: Synthetic oligonucleotide
gagtgtgagccaggggcctccac

SEQ ID NO: 296064 - DNA, 23 bp, Artificial Sequence
  Description of Artificial Sequence: Synthetic oligonucleotide
agtgtgagccaggggcctccacg

SEQ ID NO: 296065 - DNA, 22 bp, Artificial Sequence
  Description of Artificial Sequence: Synthetic oligonucleotide
gtgtgagccaggggcctccacg

SEQ ID NO: 296066 - DNA, 22 bp, Artificial Sequence
  Description of Artificial Sequence: Synthetic oligonucleotide
tgtgagccaggggcctccacgg

SEQ ID NO: 296067 - DNA, 21 bp, Artificial Sequence
  Description of Artificial Sequence: Synthetic oligonucleotide
gtgagccaggggcctccacgg

SEQ ID NO: 296068 - DNA, 21 bp, Artificial Sequence
  Description of Artificial Sequence: Synthetic oligonucleotide
tgagccaggggcctccacggc

SEQ ID NO: 296069 - DNA, 20 bp, Artificial Sequence
  Description of Artificial Sequence: Synthetic oligonucleotide
gagccaggggcctccacggc

SEQ ID NO: 296070 - DNA, 20 bp, Artificial Sequence
  Description of Artificial Sequence: Synthetic oligonucleotide
agccaggggcctccacggcc

SEQ ID NO: 296071 - DNA, 20 bp, Artificial Sequence
  Description of Artificial Sequence: Synthetic oligonucleotide
gccaggggcctccacggcct

SEQ ID NO: 296072 - DNA, 21 bp, Artificial Sequence
  Description of Artificial Sequence: Synthetic oligonucleotide
ccaggggcctccacggccctt

SEQ ID NO: 296073 - DNA, 21 bp, Artificial Sequence
  Description of Artificial Sequence: Synthetic oligonucleotide
caggggcctccacggcccttc

SEQ ID NO: 296074 - DNA, 21 bp, Artificial Sequence
  Description of Artificial Sequence: Synthetic oligonucleotide
aggggcctccacggcccttcg

SEQ ID NO: 296075 - DNA, 20 bp, Artificial Sequence
  Description of Artificial Sequence: Synthetic oligonucleotide
ggggcctccacggcccttcg

SEQ ID NO: 296076 - DNA, 20 bp, Artificial Sequence
  Description of Artificial Sequence: Synthetic oligonucleotide
gggcctccacggcccttcgc

SEQ ID NO: 296077 - DNA, 23 bp, Artificial Sequence
  Description of Artificial Sequence: Synthetic oligonucleotide
ggcctccacggcccttcgccata

SEQ ID NO: 296078 - DNA, 24 bp, Artificial Sequence
  Description of Artificial Sequence: Synthetic oligonucleotide
gcctccacggcccttcgccatagt

SEQ ID NO: 296079 - DNA, 26 bp, Artificial Sequence
  Description of Artificial Sequence: Synthetic oligonucleotide
cctccacggcccttcgccatagtgaa

SEQ ID NO: 296080 - DNA, 27 bp, Artificial Sequence
  Description of Artificial Sequence: Synthetic oligonucleotide
ctccacggcccttcgccatagtgaaca

SEQ ID NO: 296081 - DNA, 27 bp, Artificial Sequence
  Description of Artificial Sequence: Synthetic oligonucleotide
tccacggcccttcgccatagtgaacag

SEQ ID NO: 296082 - DNA, 26 bp, Artificial Sequence
  Description of Artificial Sequence: Synthetic oligonucleotide
ccacggcccttcgccatagtgaacag

SEQ ID NO: 296083 - DNA, 27 bp, Artificial Sequence
  Description of Artificial Sequence: Synthetic oligonucleotide
cacggcccttcgccatagtgaacagga

SEQ ID NO: 296084 - DNA, 28 bp, Artificial Sequence
  Description of Artificial Sequence: Synthetic oligonucleotide
acggcccttcgccatagtgaacaggatc

SEQ ID NO: 296085 - DNA, 27 bp, Artificial Sequence
  Description of Artificial Sequence: Synthetic oligonucleotide
cggcccttcgccatagtgaacaggatc

SEQ ID NO: 296086 - DNA, 28 bp, Artificial Sequence
  Description of Artificial Sequence: Synthetic oligonucleotide
ggcccttcgccatagtgaacaggatcag

SEQ ID NO: 296087 - DNA, 28 bp, Artificial Sequence
  Description of Artificial Sequence: Synthetic oligonucleotide
gcccttcgccatagtgaacaggatcagc

SEQ ID NO: 296088 - DNA, 28 bp, Artificial Sequence
  Description of Artificial Sequence: Synthetic oligonucleotide
cccttcgccatagtgaacaggatcagcc

SEQ ID NO: 296089 - DNA, 28 bp, Artificial Sequence
  Description of Artificial Sequence: Synthetic oligonucleotide
ccttcgccatagtgaacaggatcagccc

SEQ ID NO: 296090 - DNA, 28 bp, Artificial Sequence
  Description of Artificial Sequence: Synthetic oligonucleotide
cttcgccatagtgaacaggatcagcccc

SEQ ID NO: 296091 - DNA, 28 bp, Artificial Sequence
  Description of Artificial Sequence: Synthetic oligonucleotide
ttcgccatagtgaacaggatcagccccc

SEQ ID NO: 296092 - DNA, 27 bp, Artificial Sequence
  Description of Artificial Sequence: Synthetic oligonucleotide
tcgccatagtgaacaggatcagccccc

SEQ ID NO: 296093 - DNA, 26 bp, Artificial Sequence
  Description of Artificial Sequence: Synthetic oligonucleotide
cgccatagtgaacaggatcagccccc

SEQ ID NO: 296094 - DNA, 26 bp, Artificial Sequence
  Description of Artificial Sequence: Synthetic oligonucleotide
gccatagtgaacaggatcagcccccg

SEQ ID NO: 296095 - DNA, 27 bp, Artificial Sequence
  Description of Artificial Sequence: Synthetic oligonucleotide
ccatagtgaacaggatcagcccccgct

SEQ ID NO: 296096 - DNA, 27 bp, Artificial Sequence
  Description of Artificial Sequence: Synthetic oligonucleotide
catagtgaacaggatcagcccccgctc

SEQ ID NO: 296097 - DNA, 27 bp, Artificial Sequence
  Description of Artificial Sequence: Synthetic oligonucleotide
atagtgaacaggatcagcccccgctcc

SEQ ID NO: 296098 - DNA, 26 bp, Artificial Sequence
  Description of Artificial Sequence: Synthetic oligonucleotide
tagtgaacaggatcagcccccgctcc

SEQ ID NO: 296099 - DNA, 25 bp, Artificial Sequence
  Description of Artificial Sequence: Synthetic oligonucleotide
agtgaacaggatcagcccccgctcc

SEQ ID NO: 296100 - DNA, 24 bp, Artificial Sequence
  Description of Artificial Sequence: Synthetic oligonucleotide
gtgaacaggatcagcccccgctcc

SEQ ID NO: 296101 - DNA, 24 bp, Artificial Sequence
  Description of Artificial Sequence: Synthetic oligonucleotide
tgaacaggatcagcccccgctccc

SEQ ID NO: 296102 - DNA, 23 bp, Artificial Sequence
  Description of Artificial Sequence: Synthetic oligonucleotide
gaacaggatcagcccccgctccc

SEQ ID NO: 296103 - DNA, 24 bp, Artificial Sequence
  Description of Artificial Sequence: Synthetic oligonucleotide
aacaggatcagcccccgctcccca

SEQ ID NO: 296104 - DNA, 23 bp, Artificial Sequence
  Description of Artificial Sequence: Synthetic oligonucleotide
acaggatcagcccccgctcccca

SEQ ID NO: 296105 - DNA, 22 bp, Artificial Sequence
  Description of Artificial Sequence: Synthetic oligonucleotide
caggatcagcccccgctcccca

SEQ ID NO: 296106 - DNA, 22 bp, Artificial Sequence
  Description of Artificial Sequence: Synthetic oligonucleotide
aggatcagcccccgctccccag

SEQ ID NO: 296107 - DNA, 21 bp, Artificial Sequence
  Description of Artificial Sequence: Synthetic oligonucleotide
ggatcagcccccgctccccag

SEQ ID NO: 296108 - DNA, 21 bp, Artificial Sequence
  Description of Artificial Sequence: Synthetic oligonucleotide
gatcagcccccgctccccagg

SEQ ID NO: 296109 - DNA, 22 bp, Artificial Sequence
  Description of Artificial Sequence: Synthetic oligonucleotide
atcagcccccgctccccaggca

SEQ ID NO: 296110 - DNA, 21 bp, Artificial Sequence
  Description of Artificial Sequence: Synthetic oligonucleotide
tcagcccccgctccccaggca

SEQ ID NO: 296111 - DNA, 20 bp, Artificial Sequence
  Description of Artificial Sequence: Synthetic oligonucleotide
cagcccccgctccccaggca

SEQ ID NO: 296112 - DNA, 20 bp, Artificial Sequence
  Description of Artificial Sequence: Synthetic oligonucleotide
agcccccgctccccaggcag

SEQ ID NO: 296113 - DNA, 20 bp, Artificial Sequence
  Description of Artificial Sequence: Synthetic oligonucleotide
gcccccgctccccaggcagt

SEQ ID NO: 296114 - DNA, 21 bp, Artificial Sequence
  Description of Artificial Sequence: Synthetic oligonucleotide
cccccgctccccaggcagcat

SEQ ID NO: 296115 - DNA, 21 bp, Artificial Sequence
  Description of Artificial Sequence: Synthetic oligonucleotide
ccccgctccccaggcagcatc

SEQ ID NO: 296116 - DNA, 21 bp, Artificial Sequence
  Description of Artificial Sequence: Synthetic oligonucleotide
cccgctccccaggcagcatcg

SEQ ID NO: 296117 - DNA, 21 bp, Artificial Sequence
  Description of Artificial Sequence: Synthetic oligonucleotide
ccgctccccaggcagcatcgc

SEQ ID NO: 296118 - DNA, 21 bp, Artificial Sequence
  Description of Artificial Sequence: Synthetic oligonucleotide
cgctccccaggcagcatcgcc

SEQ ID NO: 296119 - DNA, 21 bp, Artificial Sequence
  Description of Artificial Sequence: Synthetic oligonucleotide
gctccccaggcagcatcgccg

SEQ ID NO: 296120 - DNA, 22 bp, Artificial Sequence
  Description of Artificial Sequence: Synthetic oligonucleotide
ctccccaggcagcatcgccggt

SEQ ID NO: 296121 - DNA, 23 bp, Artificial Sequence
  Description of Artificial Sequence: Synthetic oligonucleotide
tccccaggcagcatcgccggtct

SEQ ID NO: 296122 - DNA, 22 bp, Artificial Sequence
  Description of Artificial Sequence: Synthetic oligonucleotide
ccccaggcagcatcgccggtct

SEQ ID NO: 296123 - DNA, 22 bp, Artificial Sequence
  Description of Artificial Sequence: Synthetic oligonucleotide
cccaggcagcatcgccggtctg

SEQ ID NO: 296124 - DNA, 24 bp, Artificial Sequence
  Description of Artificial Sequence: Synthetic oligonucleotide
ccaggcagcatcgccggtctgcaa

SEQ ID NO: 296125 - DNA, 25 bp, Artificial Sequence
  Description of Artificial Sequence: Synthetic oligonucleotide
caggcagcatcgccggtctgcaact

SEQ ID NO: 296126 - DNA, 25 bp, Artificial Sequence
  Description of Artificial Sequence: Synthetic oligonucleotide
aggcagcatcgccggtctgcaactg

SEQ ID NO: 296127 - DNA, 24 bp, Artificial Sequence
  Description of Artificial Sequence: Synthetic oligonucleotide
ggcagcatcgccggtctgcaactg

SEQ ID NO: 296128 - DNA, 26 bp, Artificial Sequence
  Description of Artificial Sequence: Synthetic oligonucleotide
gcagcatcgccggtctgcaactggat

SEQ ID NO: 296129 - DNA, 27 bp, Artificial Sequence
  Description of Artificial Sequence: Synthetic oligonucleotide
cagcatcgccggtctgcaactggatga

SEQ ID NO: 296130 - DNA, 28 bp, Artificial Sequence
  Description of Artificial Sequence: Synthetic oligonucleotide
agcatcgccggtctgcaactggatgatg

SEQ ID NO: 296131 - DNA, 27 bp, Artificial Sequence
  Description of Artificial Sequence: Synthetic oligonucleotide
gcatcgccggtctgcaactggatgatg

SEQ ID NO: 296132 - DNA, 28 bp, Artificial Sequence
  Description of Artificial Sequence: Synthetic oligonucleotide
catcgccggtctgcaactggatgatgtg

SEQ ID NO: 296133 - DNA, 31 bp, Artificial Sequence
  Description of Artificial Sequence: Synthetic oligonucleotide
atcgccggtctgcaactggatgatgtgattg

SEQ ID NO: 296134 - DNA, 30 bp, Artificial Sequence
  Description of Artificial Sequence: Synthetic oligonucleotide
tcgccggtctgcaactggatgatgtgattg

SEQ ID NO: 296135 - DNA, 29 bp, Artificial Sequence
  Description of Artificial Sequence: Synthetic oligonucleotide
cgccggtctgcaactggatgatgtgattg

SEQ ID NO: 296136 - DNA, 30 bp, Artificial Sequence
  Description of Artificial Sequence: Synthetic oligonucleotide
gccggtctgcaactggatgatgtgattgtg

SEQ ID NO: 296137 - DNA, 30 bp, Artificial Sequence
  Description of Artificial Sequence: Synthetic oligonucleotide
ccggtctgcaactggatgatgtgattgtgg

SEQ ID NO: 296138 - DNA, 31 bp, Artificial Sequence
  Description of Artificial Sequence: Synthetic oligonucleotide
cggtctgcaactggatgatgtgattgtggac

SEQ ID NO: 296139 - DNA, 33 bp, Artificial Sequence
  Description of Artificial Sequence: Synthetic oligonucleotide
ggtctgcaactggatgatgtgattgtggacttc

SEQ ID NO: 296140 - DNA, 33 bp, Artificial Sequence
  Description of Artificial Sequence: Synthetic oligonucleotide
gtctgcaactggatgatgtgattgtggacttcg

SEQ ID NO: 296141 - DNA, 33 bp, Artificial Sequence
  Description of Artificial Sequence: Synthetic oligonucleotide
tctgcaactggatgatgtgattgtggacttcgg

SEQ ID NO: 296142 - DNA, 32 bp, Artificial Sequence
  Description of Artificial Sequence: Synthetic oligonucleotide
ctgcaactggatgatgtgattgtggacttcgg

SEQ ID NO: 296143 - DNA, 32 bp, Artificial Sequence
  Description of Artificial Sequence: Synthetic oligonucleotide
tgcaactggatgatgtgattgtggacttcggc

SEQ ID NO: 296144 - DNA, 31 bp, Artificial Sequence
  Description of Artificial Sequence: Synthetic oligonucleotide
gcaactggatgatgtgattgtggacttcggc

SEQ ID NO: 296145 - DNA, 32 bp, Artificial Sequence
  Description of Artificial Sequence: Synthetic oligonucleotide
caactggatgatgtgattgtggacttcggctc

SEQ ID NO: 296146 - DNA, 33 bp, Artificial Sequence
  Description of Artificial Sequence: Synthetic oligonucleotide
aactggatgatgtgattgtggacttcggctctc

SEQ ID NO: 296147 - DNA, 32 bp, Artificial Sequence
  Description of Artificial Sequence: Synthetic oligonucleotide
actggatgatgtgattgtggacttcggctctc

SEQ ID NO: 296148 - DNA, 31 bp, Artificial Sequence
  Description of Artificial Sequence: Synthetic oligonucleotide
ctggatgatgtgattgtggacttcggctctc

SEQ ID NO: 296149 - DNA, 32 bp, Artificial Sequence
  Description of Artificial Sequence: Synthetic oligonucleotide
tggatgatgtgattgtggacttcggctctctg

SEQ ID NO: 296150 - DNA, 31 bp, Artificial Sequence
  Description of Artificial Sequence: Synthetic oligonucleotide
ggatgatgtgattgtggacttcggctctctg

SEQ ID NO: 296151 - DNA, 33 bp, Artificial Sequence
  Description of Artificial Sequence: Synthetic oligonucleotide
gatgatgtgattgtggacttcggctctctgaac

SEQ ID NO: 296152 - DNA, 34 bp, Artificial Sequence
  Description of Artificial Sequence: Synthetic oligonucleotide
atgatgtgattgtggacttcggctctctgaacac

SEQ ID NO: 296153 - DNA, 33 bp, Artificial Sequence
  Description of Artificial Sequence: Synthetic oligonucleotide
tgatgtgattgtggacttcggctctctgaacac

SEQ ID NO: 296154 - DNA, 32 bp, Artificial Sequence
  Description of Artificial Sequence: Synthetic oligonucleotide
gatgtgattgtggacttcggctctctgaacac

SEQ ID NO: 296155 - DNA, 32 bp, Artificial Sequence
  Description of Artificial Sequence: Synthetic oligonucleotide
atgtgattgtggacttcggctctctgaacacc

SEQ ID NO: 296156 - DNA, 31 bp, Artificial Sequence
  Description of Artificial Sequence: Synthetic oligonucleotide
tgtgattgtggacttcggctctctgaacacc

SEQ ID NO: 296157 - DNA, 30 bp, Artificial Sequence
  Description of Artificial Sequence: Synthetic oligonucleotide
gtgattgtggacttcggctctctgaacacc

SEQ ID NO: 296158 - DNA, 30 bp, Artificial Sequence
  Description of Artificial Sequence: Synthetic oligonucleotide
tgattgtggacttcggctctctgaacaccc

SEQ ID NO: 296159 - DNA, 29 bp, Artificial Sequence
  Description of Artificial Sequence: Synthetic oligonucleotide
gattgtggacttcggctctctgaacaccc

SEQ ID NO: 296160 - DNA, 30 bp, Artificial Sequence
  Description of Artificial Sequence: Synthetic oligonucleotide
attgtggacttcggctctctgaacaccctg

SEQ ID NO: 296161 - DNA, 29 bp, Artificial Sequence
  Description of Artificial Sequence: Synthetic oligonucleotide
ttgtggacttcggctctctgaacaccctg

SEQ ID NO: 296162 - DNA, 28 bp, Artificial Sequence
  Description of Artificial Sequence: Synthetic oligonucleotide
tgtggacttcggctctctgaacaccctg

SEQ ID NO: 296163 - DNA, 27 bp, Artificial Sequence
  Description of Artificial Sequence: Synthetic oligonucleotide
gtggacttcggctctctgaacaccctg

SEQ ID NO: 296164 - DNA, 29 bp, Artificial Sequence
  Description of Artificial Sequence: Synthetic oligonucleotide
tggacttcggctctctgaacaccctgaac

SEQ ID NO: 296165 - DNA, 28 bp, Artificial Sequence
  Description of Artificial Sequence: Synthetic oligonucleotide
ggacttcggctctctgaacaccctgaac

SEQ ID NO: 296166 - DNA, 30 bp, Artificial Sequence
  Description of Artificial Sequence: Synthetic oligonucleotide
gacttcggctctctgaacaccctgaacttc

SEQ ID NO: 296167 - DNA, 30 bp, Artificial Sequence
  Description of Artificial Sequence: Synthetic oligonucleotide
acttcggctctctgaacaccctgaacttcc

SEQ ID NO: 296168 - DNA, 29 bp, Artificial Sequence
  Description of Artificial Sequence: Synthetic oligonucleotide
cttcggctctctgaacaccctgaacttcc

SEQ ID NO: 296169 - DNA, 30 bp, Artificial Sequence
  Description of Artificial Sequence: Synthetic oligonucleotide
ttcggctctctgaacaccctgaacttccac

SEQ ID NO: 296170 - DNA, 29 bp, Artificial Sequence
  Description of Artificial Sequence: Synthetic oligonucleotide
tcggctctctgaacaccctgaacttccac

SEQ ID NO: 296171 - DNA, 28 bp, Artificial Sequence
  Description of Artificial Sequence: Synthetic oligonucleotide
cggctctctgaacaccctgaacttccac

SEQ ID NO: 296172 - DNA, 29 bp, Artificial Sequence
  Description of Artificial Sequence: Synthetic oligonucleotide
ggctctctgaacaccctgaacttccactc

SEQ ID NO: 296173 - DNA, 30 bp, Artificial Sequence
  Description of Artificial Sequence: Synthetic oligonucleotide
gctctctgaacaccctgaacttccactcac

SEQ ID NO: 296174 - DNA, 31 bp, Artificial Sequence
  Description of Artificial Sequence: Synthetic oligonucleotide
ctctctgaacaccctgaacttccactcactg

SEQ ID NO: 296175 - DNA, 31 bp, Artificial Sequence
  Description of Artificial Sequence: Synthetic oligonucleotide
tctctgaacaccctgaacttccactcactgc

SEQ ID NO: 296176 - DNA, 30 bp, Artificial Sequence
  Description of Artificial Sequence: Synthetic oligonucleotide
ctctgaacaccctgaacttccactcactgc

SEQ ID NO: 296177 - DNA, 34 bp, Artificial Sequence
  Description of Artificial Sequence: Synthetic oligonucleotide
tctgaacaccctgaacttccactcactgcattac

SEQ ID NO: 296178 - DNA, 33 bp, Artificial Sequence
  Description of Artificial Sequence: Synthetic oligonucleotide
ctgaacaccctgaacttccactcactgcattac

SEQ ID NO: 296179 - DNA, 36 bp, Artificial Sequence
  Description of Artificial Sequence: Synthetic oligonucleotide
tgaacaccctgaacttccactcactgcattacattg

SEQ ID NO: 296180 - DNA, 35 bp, Artificial Sequence
  Description of Artificial Sequence: Synthetic oligonucleotide
gaacaccctgaacttccactcactgcattacattg

SEQ ID NO: 296181 - DNA, 35 bp, Artificial Sequence
  Description of Artificial Sequence: Synthetic oligonucleotide
aacaccctgaacttccactcactgcattacattgg

SEQ ID NO: 296182 - DNA, 34 bp, Artificial Sequence
  Description of Artificial Sequence: Synthetic oligonucleotide
acaccctgaacttccactcactgcattacattgg

SEQ ID NO: 296183 - DNA, 33 bp, Artificial Sequence
  Description of Artificial Sequence: Synthetic oligonucleotide
caccctgaacttccactcactgcattacattgg

SEQ ID NO: 296184 - DNA, 33 bp, Artificial Sequence
  Description of Artificial Sequence: Synthetic oligonucleotide
accctgaacttccactcactgcattacattggc

SEQ ID NO: 296185 - DNA, 32 bp, Artificial Sequence
  Description of Artificial Sequence: Synthetic oligonucleotide
ccctgaacttccactcactgcattacattggc

SEQ ID NO: 296186 - DNA, 33 bp, Artificial Sequence
  Description of Artificial Sequence: Synthetic oligonucleotide
cctgaacttccactcactgcattacattggcac

SEQ ID NO: 296187 - DNA, 34 bp, Artificial Sequence
  Description of Artificial Sequence: Synthetic oligonucleotide
ctgaacttccactcactgcattacattggcactg

SEQ ID NO: 296188 - DNA, 35 bp, Artificial Sequence
  Description of Artificial Sequence: Synthetic oligonucleotide
tgaacttccactcactgcattacattggcactgtg

SEQ ID NO: 296189 - DNA, 34 bp, Artificial Sequence
  Description of Artificial Sequence: Synthetic oligonucleotide
gaacttccactcactgcattacattggcactgtg

SEQ ID NO: 296190 - DNA, 34 bp, Artificial Sequence
  Description of Artificial Sequence: Synthetic oligonucleotide
aacttccactcactgcattacattggcactgtgg

SEQ ID NO: 296191 - DNA, 33 bp, Artificial Sequence
  Description of Artificial Sequence: Synthetic oligonucleotide
acttccactcactgcattacattggcactgtgg

SEQ ID NO: 296192 - DNA, 32 bp, Artificial Sequence
  Description of Artificial Sequence: Synthetic oligonucleotide
cttccactcactgcattacattggcactgtgg

SEQ ID NO: 296193 - DNA, 33 bp, Artificial Sequence
  Description of Artificial Sequence: Synthetic oligonucleotide
ttccactcactgcattacattggcactgtggtg

SEQ ID NO: 296194 - DNA, 32 bp, Artificial Sequence
  Description of Artificial Sequence: Synthetic oligonucleotide
tccactcactgcattacattggcactgtggtg

SEQ ID NO: 296195 - DNA, 31 bp, Artificial Sequence
  Description of Artificial Sequence: Synthetic oligonucleotide
ccactcactgcattacattggcactgtggtg

SEQ ID NO: 296196 - DNA, 31 bp, Artificial Sequence
  Description of Artificial Sequence: Synthetic oligonucleotide
cactcactgcattacattggcactgtggtgc

SEQ ID NO: 296197 - DNA, 32 bp, Artificial Sequence
  Description of Artificial Sequence: Synthetic oligonucleotide
actcactgcattacattggcactgtggtgcac

SEQ ID NO: 296198 - DNA, 31 bp, Artificial Sequence
  Description of Artificial Sequence: Synthetic oligonucleotide
ctcactgcattacattggcactgtggtgcac

SEQ ID NO: 296199 - DNA, 31 bp, Artificial Sequence
  Description of Artificial Sequence: Synthetic oligonucleotide
tcactgcattacattggcactgtggtgcacc

SEQ ID NO: 296200 - DNA, 30 bp, Artificial Sequence
  Description of Artificial Sequence: Synthetic oligonucleotide
cactgcattacattggcactgtggtgcacc

SEQ ID NO: 296201 - DNA, 31 bp, Artificial Sequence
  Description of Artificial Sequence: Synthetic oligonucleotide
actgcattacattggcactgtggtgcaccac

SEQ ID NO: 296202 - DNA, 30 bp, Artificial Sequence
  Description of Artificial Sequence: Synthetic oligonucleotide
ctgcattacattggcactgtggtgcaccac

SEQ ID NO: 296203 - DNA, 31 bp, Artificial Sequence
  Description of Artificial Sequence: Synthetic oligonucleotide
tgcattacattggcactgtggtgcaccacag

SEQ ID NO: 296204 - DNA, 30 bp, Artificial Sequence
  Description of Artificial Sequence: Synthetic oligonucleotide
gcattacattggcactgtggtgcaccacag

SEQ ID NO: 296205 - DNA, 31 bp, Artificial Sequence
  Description of Artificial Sequence: Synthetic oligonucleotide
cattacattggcactgtggtgcaccacagtg

SEQ ID NO: 296206 - DNA, 32 bp, Artificial Sequence
  Description of Artificial Sequence: Synthetic oligonucleotide
attacattggcactgtggtgcaccacagtgag

SEQ ID NO: 296207 - DNA, 31 bp, Artificial Sequence
  Description of Artificial Sequence: Synthetic oligonucleotide
ttacattggcactgtggtgcaccacagtgag

SEQ ID NO: 296208 - DNA, 30 bp, Artificial Sequence
  Description of Artificial Sequence: Synthetic oligonucleotide
tacattggcactgtggtgcaccacagtgag

SEQ ID NO: 296209 - DNA, 29 bp, Artificial Sequence
  Description of Artificial Sequence: Synthetic oligonucleotide
acattggcactgtggtgcaccacagtgag

SEQ ID NO: 296210 - DNA, 28 bp, Artificial Sequence
  Description of Artificial Sequence: Synthetic oligonucleotide
cattggcactgtggtgcaccacagtgag

SEQ ID NO: 296211 - DNA, 28 bp, Artificial Sequence
  Description of Artificial Sequence: Synthetic oligonucleotide
attggcactgtggtgcaccacagtgagc

SEQ ID NO: 296212 - DNA, 27 bp, Artificial Sequence
  Description of Artificial Sequence: Synthetic oligonucleotide
ttggcactgtggtgcaccacagtgagc

SEQ ID NO: 296213 - DNA, 26 bp, Artificial Sequence
  Description of Artificial Sequence: Synthetic oligonucleotide
tggcactgtggtgcaccacagtgagc

SEQ ID NO: 296214 - DNA, 25 bp, Artificial Sequence
  Description of Artificial Sequence: Synthetic oligonucleotide
ggcactgtggtgcaccacagtgagc

SEQ ID NO: 296215 - DNA, 25 bp, Artificial Sequence
  Description of Artificial Sequence: Synthetic oligonucleotide
gcactgtggtgcaccacagtgagcg

SEQ ID NO: 296216 - DNA, 27 bp, Artificial Sequence
  Description of Artificial Sequence: Synthetic oligonucleotide
cactgtggtgcaccacagtgagcggaa

SEQ ID NO: 296217 - DNA, 27 bp, Artificial Sequence
  Description of Artificial Sequence: Synthetic oligonucleotide
actgtggtgcaccacagtgagcggaag

SEQ ID NO: 296218 - DNA, 26 bp, Artificial Sequence
  Description of Artificial Sequence: Synthetic oligonucleotide
ctgtggtgcaccacagtgagcggaag

SEQ ID NO: 296219 - DNA, 26 bp, Artificial Sequence
  Description of Artificial Sequence: Synthetic oligonucleotide
tgtggtgcaccacagtgagcggaagc

SEQ ID NO: 296220 - DNA, 25 bp, Artificial Sequence
  Description of Artificial Sequence: Synthetic oligonucleotide
gtggtgcaccacagtgagcggaagc

SEQ ID NO: 296221 - DNA, 25 bp, Artificial Sequence
  Description of Artificial Sequence: Synthetic oligonucleotide
tggtgcaccacagtgagcggaagcc

SEQ ID NO: 296222 - DNA, 24 bp, Artificial Sequence
  Description of Artificial Sequence: Synthetic oligonucleotide
ggtgcaccacagtgagcggaagcc

SEQ ID NO: 296223 - DNA, 24 bp, Artificial Sequence
  Description of Artificial Sequence: Synthetic oligonucleotide
gtgcaccacagtgagcggaagccc

SEQ ID NO: 296224 - DNA, 25 bp, Artificial Sequence
  Description of Artificial Sequence: Synthetic oligonucleotide
tgcaccacagtgagcggaagcccca

SEQ ID NO: 296225 - DNA, 24 bp, Artificial Sequence
  Description of Artificial Sequence: Synthetic oligonucleotide
gcaccacagtgagcggaagcccca

SEQ ID NO: 296226 - DNA, 27 bp, Artificial Sequence
  Description of Artificial Sequence: Synthetic oligonucleotide
caccacagtgagcggaagccccagaat

SEQ ID NO: 296227 - DNA, 27 bp, Artificial Sequence
  Description of Artificial Sequence: Synthetic oligonucleotide
accacagtgagcggaagccccagaatg

SEQ ID NO: 296228 - DNA, 27 bp, Artificial Sequence
  Description of Artificial Sequence: Synthetic oligonucleotide
ccacagtgagcggaagccccagaatgt

SEQ ID NO: 296229 - DNA, 27 bp, Artificial Sequence
  Description of Artificial Sequence: Synthetic oligonucleotide
cacagtgagcggaagccccagaatgtg

SEQ ID NO: 296230 - DNA, 28 bp, Artificial Sequence
  Description of Artificial Sequence: Synthetic oligonucleotide
acagtgagcggaagccccagaatgtgac

SEQ ID NO: 296231 - DNA, 27 bp, Artificial Sequence
  Description of Artificial Sequence: Synthetic oligonucleotide
cagtgagcggaagccccagaatgtgac

SEQ ID NO: 296232 - DNA, 28 bp, Artificial Sequence
  Description of Artificial Sequence: Synthetic oligonucleotide
agtgagcggaagccccagaatgtgactg

SEQ ID NO: 296233 - DNA, 27 bp, Artificial Sequence
  Description of Artificial Sequence: Synthetic oligonucleotide
gtgagcggaagccccagaatgtgactg

SEQ ID NO: 296234 - DNA, 28 bp, Artificial Sequence
  Description of Artificial Sequence: Synthetic oligonucleotide
tgagcggaagccccagaatgtgactgtg

SEQ ID NO: 296235 - DNA, 27 bp, Artificial Sequence
  Description of Artificial Sequence: Synthetic oligonucleotide
gagcggaagccccagaatgtgactgtg

SEQ ID NO: 296236 - DNA, 29 bp, Artificial Sequence
  Description of Artificial Sequence: Synthetic oligonucleotide
agcggaagccccagaatgtgactgtgatc

SEQ ID NO: 296237 - DNA, 28 bp, Artificial Sequence
  Description of Artificial Sequence: Synthetic oligonucleotide
gcggaagccccagaatgtgactgtgatc

SEQ ID NO: 296238 - DNA, 28 bp, Artificial Sequence
  Description of Artificial Sequence: Synthetic oligonucleotide
cggaagccccagaatgtgactgtgatcc

SEQ ID NO: 296239 - DNA, 28 bp, Artificial Sequence
  Description of Artificial Sequence: Synthetic oligonucleotide
ggaagccccagaatgtgactgtgatccg

SEQ ID NO: 296240 - DNA, 28 bp, Artificial Sequence
  Description of Artificial Sequence: Synthetic oligonucleotide
gaagccccagaatgtgactgtgatccgc

SEQ ID NO: 296241 - DNA, 29 bp, Artificial Sequence
  Description of Artificial Sequence: Synthetic oligonucleotide
aagccccagaatgtgactgtgatccgctg

SEQ ID NO: 296242 - DNA, 28 bp, Artificial Sequence
  Description of Artificial Sequence: Synthetic oligonucleotide
agccccagaatgtgactgtgatccgctg

SEQ ID NO: 296243 - DNA, 27 bp, Artificial Sequence
  Description of Artificial Sequence: Synthetic oligonucleotide
gccccagaatgtgactgtgatccgctg

SEQ ID NO: 296244 - DNA, 27 bp, Artificial Sequence
  Description of Artificial Sequence: Synthetic oligonucleotide
ccccagaatgtgactgtgatccgctgg

SEQ ID NO: 296245 - DNA, 27 bp, Artificial Sequence
  Description of Artificial Sequence: Synthetic oligonucleotide
cccagaatgtgactgtgatccgctggg

SEQ ID NO: 296246 - DNA, 27 bp, Artificial Sequence
  Description of Artificial Sequence: Synthetic oligonucleotide
ccagaatgtgactgtgatccgctgggg

SEQ ID NO: 296247 - DNA, 27 bp, Artificial Sequence
  Description of Artificial Sequence: Synthetic oligonucleotide
cagaatgtgactgtgatccgctggggg

SEQ ID NO: 296248 - DNA, 27 bp, Artificial Sequence
  Description of Artificial Sequence: Synthetic oligonucleotide
agaatgtgactgtgatccgctgggggg

SEQ ID NO: 296249 - DNA, 27 bp, Artificial Sequence
  Description of Artificial Sequence: Synthetic oligonucleotide
gaatgtgactgtgatccgctgggggga

SEQ ID NO: 296250 - DNA, 31 bp, Artificial Sequence
  Description of Artificial Sequence: Synthetic oligonucleotide
aatgtgactgtgatccgctggggggaaatac

SEQ ID NO: 296251 - DNA, 30 bp, Artificial Sequence
  Description of Artificial Sequence: Synthetic oligonucleotide
atgtgactgtgatccgctggggggaaatac

SEQ ID NO: 296252 - DNA, 29 bp, Artificial Sequence
  Description of Artificial Sequence: Synthetic oligonucleotide
tgtgactgtgatccgctggggggaaatac

SEQ ID NO: 296253 - DNA, 28 bp, Artificial Sequence
  Description of Artificial Sequence: Synthetic oligonucleotide
gtgactgtgatccgctggggggaaatac

SEQ ID NO: 296254 - DNA, 29 bp, Artificial Sequence
  Description of Artificial Sequence: Synthetic oligonucleotide
tgactgtgatccgctggggggaaatacac

SEQ ID NO: 296255 - DNA, 28 bp, Artificial Sequence
  Description of Artificial Sequence: Synthetic oligonucleotide
gactgtgatccgctggggggaaatacac

SEQ ID NO: 296256 - DNA, 28 bp, Artificial Sequence
  Description of Artificial Sequence: Synthetic oligonucleotide
actgtgatccgctggggggaaatacacc

SEQ ID NO: 296257 - DNA, 27 bp, Artificial Sequence
  Description of Artificial Sequence: Synthetic oligonucleotide
ctgtgatccgctggggggaaatacacc

SEQ ID NO: 296258 - DNA, 28 bp, Artificial Sequence
  Description of Artificial Sequence: Synthetic oligonucleotide
tgtgatccgctggggggaaatacaccag

SEQ ID NO: 296259 - DNA, 27 bp, Artificial Sequence
  Description of Artificial Sequence: Synthetic oligonucleotide
gtgatccgctggggggaaatacaccag

SEQ ID NO: 296260 - DNA, 27 bp, Artificial Sequence
  Description of Artificial Sequence: Synthetic oligonucleotide
tgatccgctggggggaaatacaccagc

SEQ ID NO: 296261 - DNA, 27 bp, Artificial Sequence
  Description of Artificial Sequence: Synthetic oligonucleotide
gatccgctggggggaaatacaccagct

SEQ ID NO: 296262 - DNA, 29 bp, Artificial Sequence
  Description of Artificial Sequence: Synthetic oligonucleotide
atccgctggggggaaatacaccagctaag

SEQ ID NO: 296263 - DNA, 28 bp, Artificial Sequence
  Description of Artificial Sequence: Synthetic oligonucleotide
tccgctggggggaaatacaccagctaag

SEQ ID NO: 296264 - DNA, 27 bp, Artificial Sequence
  Description of Artificial Sequence: Synthetic oligonucleotide
ccgctggggggaaatacaccagctaag

SEQ ID NO: 296265 - DNA, 28 bp, Artificial Sequence
  Description of Artificial Sequence: Synthetic oligonucleotide
cgctggggggaaatacaccagctaagac

SEQ ID NO: 296266 - DNA, 30 bp, Artificial Sequence
  Description of Artificial Sequence: Synthetic oligonucleotide
gctggggggaaatacaccagctaagacttg

SEQ ID NO: 296267 - DNA, 32 bp, Artificial Sequence
  Description of Artificial Sequence: Synthetic oligonucleotide
ctggggggaaatacaccagctaagacttgttg

SEQ ID NO: 296268 - DNA, 32 bp, Artificial Sequence
  Description of Artificial Sequence: Synthetic oligonucleotide
tggggggaaatacaccagctaagacttgttgc

SEQ ID NO: 296269 - DNA, 31 bp, Artificial Sequence
  Description of Artificial Sequence: Synthetic oligonucleotide
ggggggaaatacaccagctaagacttgttgc

SEQ ID NO: 296270 - DNA, 33 bp, Artificial Sequence
  Description of Artificial Sequence: Synthetic oligonucleotide
gggggaaatacaccagctaagacttgttgcaac

SEQ ID NO: 296271 - DNA, 34 bp, Artificial Sequence
  Description of Artificial Sequence: Synthetic oligonucleotide
ggggaaatacaccagctaagacttgttgcaacac

SEQ ID NO: 296272 - DNA, 34 bp, Artificial Sequence
  Description of Artificial Sequence: Synthetic oligonucleotide
gggaaatacaccagctaagacttgttgcaacacg

SEQ ID NO: 296273 - DNA, 34 bp, Artificial Sequence
  Description of Artificial Sequence: Synthetic oligonucleotide
ggaaatacaccagctaagacttgttgcaacacgc

SEQ ID NO: 296274 - DNA, 35 bp, Artificial Sequence
  Description of Artificial Sequence: Synthetic oligonucleotide
gaaatacaccagctaagacttgttgcaacacgctc

SEQ ID NO: 296275 - DNA, 35 bp, Artificial Sequence
  Description of Artificial Sequence: Synthetic oligonucleotide
aaatacaccagctaagacttgttgcaacacgctcg

SEQ ID NO: 296276 - DNA, 34 bp, Artificial Sequence
  Description of Artificial Sequence: Synthetic oligonucleotide
aatacaccagctaagacttgttgcaacacgctcg

SEQ ID NO: 296277 - DNA, 33 bp, Artificial Sequence
  Description of Artificial Sequence: Synthetic oligonucleotide
atacaccagctaagacttgttgcaacacgctcg

SEQ ID NO: 296278 - DNA, 32 bp, Artificial Sequence
  Description of Artificial Sequence: Synthetic oligonucleotide
tacaccagctaagacttgttgcaacacgctcg

SEQ ID NO: 296279 - DNA, 31 bp, Artificial Sequence
  Description of Artificial Sequence: Synthetic oligonucleotide
acaccagctaagacttgttgcaacacgctcg

SEQ ID NO: 296280 - DNA, 30 bp, Artificial Sequence
  Description of Artificial Sequence: Synthetic oligonucleotide
caccagctaagacttgttgcaacacgctcg

SEQ ID NO: 296281 - DNA, 30 bp, Artificial Sequence
  Description of Artificial Sequence: Synthetic oligonucleotide
accagctaagacttgttgcaacacgctcgg

SEQ ID NO: 296282 - DNA, 29 bp, Artificial Sequence
  Description of Artificial Sequence: Synthetic oligonucleotide
ccagctaagacttgttgcaacacgctcgg

SEQ ID NO: 296283 - DNA, 29 bp, Artificial Sequence
  Description of Artificial Sequence: Synthetic oligonucleotide
cagctaagacttgttgcaacacgctcggc

SEQ ID NO: 296284 - DNA, 30 bp, Artificial Sequence
  Description of Artificial Sequence: Synthetic oligonucleotide
agctaagacttgttgcaacacgctcggcag

SEQ ID NO: 296285 - DNA, 29 bp, Artificial Sequence
  Description of Artificial Sequence: Synthetic oligonucleotide
gctaagacttgttgcaacacgctcggcag

SEQ ID NO: 296286 - DNA, 29 bp, Artificial Sequence
  Description of Artificial Sequence: Synthetic oligonucleotide
ctaagacttgttgcaacacgctcggcagg

SEQ ID NO: 296287 - DNA, 33 bp, Artificial Sequence
  Description of Artificial Sequence: Synthetic oligonucleotide
taagacttgttgcaacacgctcggcaggaaatg

SEQ ID NO: 296288 - DNA, 32 bp, Artificial Sequence
  Description of Artificial Sequence: Synthetic oligonucleotide
aagacttgttgcaacacgctcggcaggaaatg

SEQ ID NO: 296289 - DNA, 31 bp, Artificial Sequence
  Description of Artificial Sequence: Synthetic oligonucleotide
agacttgttgcaacacgctcggcaggaaatg

SEQ ID NO: 296290 - DNA, 30 bp, Artificial Sequence
  Description of Artificial Sequence: Synthetic oligonucleotide
gacttgttgcaacacgctcggcaggaaatg

SEQ ID NO: 296291 - DNA, 30 bp, Artificial Sequence
  Description of Artificial Sequence: Synthetic oligonucleotide
acttgttgcaacacgctcggcaggaaatgg

SEQ ID NO: 296292 - DNA, 29 bp, Artificial Sequence
  Description of Artificial Sequence: Synthetic oligonucleotide
cttgttgcaacacgctcggcaggaaatgg

SEQ ID NO: 296293 - DNA, 30 bp, Artificial Sequence
  Description of Artificial Sequence: Synthetic oligonucleotide
ttgttgcaacacgctcggcaggaaatggac

SEQ ID NO: 296294 - DNA, 29 bp, Artificial Sequence
  Description of Artificial Sequence: Synthetic oligonucleotide
tgttgcaacacgctcggcaggaaatggac

SEQ ID NO: 296295 - DNA, 28 bp, Artificial Sequence
  Description of Artificial Sequence: Synthetic oligonucleotide
gttgcaacacgctcggcaggaaatggac

SEQ ID NO: 296296 - DNA, 29 bp, Artificial Sequence
  Description of Artificial Sequence: Synthetic oligonucleotide
ttgcaacacgctcggcaggaaatggactg

SEQ ID NO: 296297 - DNA, 28 bp, Artificial Sequence
  Description of Artificial Sequence: Synthetic oligonucleotide
tgcaacacgctcggcaggaaatggactg

SEQ ID NO: 296298 - DNA, 27 bp, Artificial Sequence
  Description of Artificial Sequence: Synthetic oligonucleotide
gcaacacgctcggcaggaaatggactg

SEQ ID NO: 296299 - DNA, 27 bp, Artificial Sequence
  Description of Artificial Sequence: Synthetic oligonucleotide
caacacgctcggcaggaaatggactgc

SEQ ID NO: 296300 - DNA, 28 bp, Artificial Sequence
  Description of Artificial Sequence: Synthetic oligonucleotide
aacacgctcggcaggaaatggactgctg

SEQ ID NO: 296301 - DNA, 27 bp, Artificial Sequence
  Description of Artificial Sequence: Synthetic oligonucleotide
acacgctcggcaggaaatggactgctg

SEQ ID NO: 296302 - DNA, 26 bp, Artificial Sequence
  Description of Artificial Sequence: Synthetic oligonucleotide
cacgctcggcaggaaatggactgctg

SEQ ID NO: 296303 - DNA, 26 bp, Artificial Sequence
  Description of Artificial Sequence: Synthetic oligonucleotide
acgctcggcaggaaatggactgctgc

SEQ ID NO: 296304 - DNA, 25 bp, Artificial Sequence
  Description of Artificial Sequence: Synthetic oligonucleotide
cgctcggcaggaaatggactgctgc

SEQ ID NO: 296305 - DNA, 25 bp, Artificial Sequence
  Description of Artificial Sequence: Synthetic oligonucleotide
gctcggcaggaaatggactgctgcg

SEQ ID NO: 296306 - DNA, 26 bp, Artificial Sequence
  Description of Artificial Sequence: Synthetic oligonucleotide
ctcggcaggaaatggactgctgcgct

SEQ ID NO: 296307 - DNA, 26 bp, Artificial Sequence
  Description of Artificial Sequence: Synthetic oligonucleotide
tcggcaggaaatggactgctgcgctg

SEQ ID NO: 296308 - DNA, 25 bp, Artificial Sequence
  Description of Artificial Sequence: Synthetic oligonucleotide
cggcaggaaatggactgctgcgctg

SEQ ID NO: 296309 - DNA, 27 bp, Artificial Sequence
  Description of Artificial Sequence: Synthetic oligonucleotide
ggcaggaaatggactgctgcgctgcaa

SEQ ID NO: 296310 - DNA, 27 bp, Artificial Sequence
  Description of Artificial Sequence: Synthetic oligonucleotide
gcaggaaatggactgctgcgctgcaac

SEQ ID NO: 296311 - DNA, 33 bp, Artificial Sequence
  Description of Artificial Sequence: Synthetic oligonucleotide
caggaaatggactgctgcgctgcaacaatattc

SEQ ID NO: 296312 - DNA, 33 bp, Artificial Sequence
  Description of Artificial Sequence: Synthetic oligonucleotide
aggaaatggactgctgcgctgcaacaatattcc

SEQ ID NO: 296313 - DNA, 32 bp, Artificial Sequence
  Description of Artificial Sequence: Synthetic oligonucleotide
ggaaatggactgctgcgctgcaacaatattcc

SEQ ID NO: 296314 - DNA, 33 bp, Artificial Sequence
  Description of Artificial Sequence: Synthetic oligonucleotide
gaaatggactgctgcgctgcaacaatattcctc

SEQ ID NO: 296315 - DNA, 34 bp, Artificial Sequence
  Description of Artificial Sequence: Synthetic oligonucleotide
aaatggactgctgcgctgcaacaatattcctctc

SEQ ID NO: 296316 - DNA, 33 bp, Artificial Sequence
  Description of Artificial Sequence: Synthetic oligonucleotide
aatggactgctgcgctgcaacaatattcctctc

SEQ ID NO: 296317 - DNA, 32 bp, Artificial Sequence
  Description of Artificial Sequence: Synthetic oligonucleotide
atggactgctgcgctgcaacaatattcctctc

SEQ ID NO: 296318 - DNA, 31 bp, Artificial Sequence
  Description of Artificial Sequence: Synthetic oligonucleotide
tggactgctgcgctgcaacaatattcctctc

SEQ ID NO: 296319 - DNA, 30 bp, Artificial Sequence
  Description of Artificial Sequence: Synthetic oligonucleotide
ggactgctgcgctgcaacaatattcctctc

SEQ ID NO: 296320 - DNA, 30 bp, Artificial Sequence
  Description of Artificial Sequence: Synthetic oligonucleotide
gactgctgcgctgcaacaatattcctctcc

SEQ ID NO: 296321 - DNA, 33 bp, Artificial Sequence
  Description of Artificial Sequence: Synthetic oligonucleotide
actgctgcgctgcaacaatattcctctccaaag

SEQ ID NO: 296322 - DNA, 32 bp, Artificial Sequence
  Description of Artificial Sequence: Synthetic oligonucleotide
ctgctgcgctgcaacaatattcctctccaaag

SEQ ID NO: 296323 - DNA, 34 bp, Artificial Sequence
  Description of Artificial Sequence: Synthetic oligonucleotide
tgctgcgctgcaacaatattcctctccaaagatg

SEQ ID NO: 296324 - DNA, 33 bp, Artificial Sequence
  Description of Artificial Sequence: Synthetic oligonucleotide
gctgcgctgcaacaatattcctctccaaagatg

SEQ ID NO: 296325 - DNA, 32 bp, Artificial Sequence
  Description of Artificial Sequence: Synthetic oligonucleotide
aaggaggggtgagtgtctaacgtaatggtctc

SEQ ID NO: 296326 - DNA, 31 bp, Artificial Sequence
  Description of Artificial Sequence: Synthetic oligonucleotide
aggaggggtgagtgtctaacgtaatggtctc

SEQ ID NO: 296327 - DNA, 30 bp, Artificial Sequence
  Description of Artificial Sequence: Synthetic oligonucleotide
ggaggggtgagtgtctaacgtaatggtctc

SEQ ID NO: 296328 - DNA, 30 bp, Artificial Sequence
  Description of Artificial Sequence: Synthetic oligonucleotide
gaggggtgagtgtctaacgtaatggtctcc

SEQ ID NO: 296329 - DNA, 32 bp, Artificial Sequence
  Description of Artificial Sequence: Synthetic oligonucleotide
aggggtgagtgtctaacgtaatggtctccaac

SEQ ID NO: 296330 - DNA, 31 bp, Artificial Sequence
  Description of Artificial Sequence: Synthetic oligonucleotide
ggggtgagtgtctaacgtaatggtctccaac

SEQ ID NO: 296331 - DNA, 31 bp, Artificial Sequence
  Description of Artificial Sequence: Synthetic oligonucleotide
gggtgagtgtctaacgtaatggtctccaacc

SEQ ID NO: 296332 - DNA, 32 bp, Artificial Sequence
  Description of Artificial Sequence: Synthetic oligonucleotide
ggtgagtgtctaacgtaatggtctccaacctg

SEQ ID NO: 296333 - DNA, 32 bp, Artificial Sequence
  Description of Artificial Sequence: Synthetic oligonucleotide
gtgagtgtctaacgtaatggtctccaacctgg

SEQ ID NO: 296334 - DNA, 32 bp, Artificial Sequence
  Description of Artificial Sequence: Synthetic oligonucleotide
tgagtgtctaacgtaatggtctccaacctggc

SEQ ID NO: 296335 - DNA, 31 bp, Artificial Sequence
  Description of Artificial Sequence: Synthetic oligonucleotide
gagtgtctaacgtaatggtctccaacctggc

SEQ ID NO: 296336 - DNA, 31 bp, Artificial Sequence
  Description of Artificial Sequence: Synthetic oligonucleotide
agtgtctaacgtaatggtctccaacctggcg

SEQ ID NO: 296337 - DNA, 30 bp, Artificial Sequence
  Description of Artificial Sequence: Synthetic oligonucleotide
gtgtctaacgtaatggtctccaacctggcg

SEQ ID NO: 296338 - DNA, 32 bp, Artificial Sequence
  Description of Artificial Sequence: Synthetic oligonucleotide
tgtctaacgtaatggtctccaacctggcgtac

SEQ ID NO: 296339 - DNA, 31 bp, Artificial Sequence
  Description of Artificial Sequence: Synthetic oligonucleotide
gtctaacgtaatggtctccaacctggcgtac

SEQ ID NO: 296340 - DNA, 32 bp, Artificial Sequence
  Description of Artificial Sequence: Synthetic oligonucleotide
tctaacgtaatggtctccaacctggcgtacag

SEQ ID NO: 296341 - DNA, 31 bp, Artificial Sequence
  Description of Artificial Sequence: Synthetic oligonucleotide
ctaacgtaatggtctccaacctggcgtacag

SEQ ID NO: 296342 - DNA, 31 bp, Artificial Sequence
  Description of Artificial Sequence: Synthetic oligonucleotide
taacgtaatggtctccaacctggcgtacagc

SEQ ID NO: 296343 - DNA, 30 bp, Artificial Sequence
  Description of Artificial Sequence: Synthetic oligonucleotide
aacgtaatggtctccaacctggcgtacagc

SEQ ID NO: 296344 - DNA, 29 bp, Artificial Sequence
  Description of Artificial Sequence: Synthetic oligonucleotide
acgtaatggtctccaacctggcgtacagc

SEQ ID NO: 296345 - DNA, 28 bp, Artificial Sequence
  Description of Artificial Sequence: Synthetic oligonucleotide
cgtaatggtctccaacctggcgtacagc

SEQ ID NO: 296346 - DNA, 28 bp, Artificial Sequence
  Description of Artificial Sequence: Synthetic oligonucleotide
gtaatggtctccaacctggcgtacagcg

SEQ ID NO: 296347 - DNA, 28 bp, Artificial Sequence
  Description of Artificial Sequence: Synthetic oligonucleotide
taatggtctccaacctggcgtacagcgg

SEQ ID NO: 296348 - DNA, 27 bp, Artificial Sequence
  Description of Artificial Sequence: Synthetic oligonucleotide
aatggtctccaacctggcgtacagcgg

SEQ ID NO: 296349 - DNA, 26 bp, Artificial Sequence
  Description of Artificial Sequence: Synthetic oligonucleotide
atggtctccaacctggcgtacagcgg

SEQ ID NO: 296350 - DNA, 25 bp, Artificial Sequence
  Description of Artificial Sequence: Synthetic oligonucleotide
tggtctccaacctggcgtacagcgg

SEQ ID NO: 296351 - DNA, 24 bp, Artificial Sequence
  Description of Artificial Sequence: Synthetic oligonucleotide
ggtctccaacctggcgtacagcgg

SEQ ID NO: 296352 - DNA, 26 bp, Artificial Sequence
  Description of Artificial Sequence: Synthetic oligonucleotide
gtctccaacctggcgtacagcgggta

SEQ ID NO: 296353 - DNA, 26 bp, Artificial Sequence
  Description of Artificial Sequence: Synthetic oligonucleotide
tctccaacctggcgtacagcgggtag

SEQ ID NO: 296354 - DNA, 25 bp, Artificial Sequence
  Description of Artificial Sequence: Synthetic oligonucleotide
ctccaacctggcgtacagcgggtag

SEQ ID NO: 296355 - DNA, 26 bp, Artificial Sequence
  Description of Artificial Sequence: Synthetic oligonucleotide
tccaacctggcgtacagcgggtagct

SEQ ID NO: 296356 - DNA, 25 bp, Artificial Sequence
  Description of Artificial Sequence: Synthetic oligonucleotide
ccaacctggcgtacagcgggtagct

SEQ ID NO: 296357 - DNA, 25 bp, Artificial Sequence
  Description of Artificial Sequence: Synthetic oligonucleotide
caacctggcgtacagcgggtagctg

SEQ ID NO: 296358 - DNA, 27 bp, Artificial Sequence
  Description of Artificial Sequence: Synthetic oligonucleotide
aacctggcgtacagcgggtagctggaa

SEQ ID NO: 296359 - DNA, 26 bp, Artificial Sequence
  Description of Artificial Sequence: Synthetic oligonucleotide
acctggcgtacagcgggtagctggaa

SEQ ID NO: 296360 - DNA, 25 bp, Artificial Sequence
  Description of Artificial Sequence: Synthetic oligonucleotide
cctggcgtacagcgggtagctggaa

SEQ ID NO: 296361 - DNA, 26 bp, Artificial Sequence
  Description of Artificial Sequence: Synthetic oligonucleotide
ctggcgtacagcgggtagctggaagt

SEQ ID NO: 296362 - DNA, 27 bp, Artificial Sequence
  Description of Artificial Sequence: Synthetic oligonucleotide
tggcgtacagcgggtagctggaagtgt

SEQ ID NO: 296363 - DNA, 27 bp, Artificial Sequence
  Description of Artificial Sequence: Synthetic oligonucleotide
ggcgtacagcgggtagctggaagtgtt

SEQ ID NO: 296364 - DNA, 27 bp, Artificial Sequence
  Description of Artificial Sequence: Synthetic oligonucleotide
gcgtacagcgggtagctggaagtgttg

SEQ ID NO: 296365 - DNA, 29 bp, Artificial Sequence
  Description of Artificial Sequence: Synthetic oligonucleotide
cgtacagcgggtagctggaagtgttgaag

SEQ ID NO: 296366 - DNA, 29 bp, Artificial Sequence
  Description of Artificial Sequence: Synthetic oligonucleotide
gtacagcgggtagctggaagtgttgaagg

SEQ ID NO: 296367 - DNA, 30 bp, Artificial Sequence
  Description of Artificial Sequence: Synthetic oligonucleotide
tacagcgggtagctggaagtgttgaaggac

SEQ ID NO: 296368 - DNA, 29 bp, Artificial Sequence
  Description of Artificial Sequence: Synthetic oligonucleotide
acagcgggtagctggaagtgttgaaggac

SEQ ID NO: 296369 - DNA, 28 bp, Artificial Sequence
  Description of Artificial Sequence: Synthetic oligonucleotide
cagcgggtagctggaagtgttgaaggac

SEQ ID NO: 296370 - DNA, 29 bp, Artificial Sequence
  Description of Artificial Sequence: Synthetic oligonucleotide
agcgggtagctggaagtgttgaaggacag

SEQ ID NO: 296371 - DNA, 28 bp, Artificial Sequence
  Description of Artificial Sequence: Synthetic oligonucleotide
gcgggtagctggaagtgttgaaggacag

SEQ ID NO: 296372 - DNA, 32 bp, Artificial Sequence
  Description of Artificial Sequence: Synthetic oligonucleotide
cgggtagctggaagtgttgaaggacagtattc

SEQ ID NO: 296373 - DNA, 33 bp, Artificial Sequence
  Description of Artificial Sequence: Synthetic oligonucleotide
gggtagctggaagtgttgaaggacagtattctg

SEQ ID NO: 296374 - DNA, 33 bp, Artificial Sequence
  Description of Artificial Sequence: Synthetic oligonucleotide
ggtagctggaagtgttgaaggacagtattctgc

SEQ ID NO: 296375 - DNA, 33 bp, Artificial Sequence
  Description of Artificial Sequence: Synthetic oligonucleotide
gtagctggaagtgttgaaggacagtattctgcc

SEQ ID NO: 296376 - DNA, 33 bp, Artificial Sequence
  Description of Artificial Sequence: Synthetic oligonucleotide
tagctggaagtgttgaaggacagtattctgccc

SEQ ID NO: 296377 - DNA, 32 bp, Artificial Sequence
  Description of Artificial Sequence: Synthetic oligonucleotide
agctggaagtgttgaaggacagtattctgccc

SEQ ID NO: 296378 - DNA, 31 bp, Artificial Sequence
  Description of Artificial Sequence: Synthetic oligonucleotide
gctggaagtgttgaaggacagtattctgccc

SEQ ID NO: 296379 - DNA, 31 bp, Artificial Sequence
  Description of Artificial Sequence: Synthetic oligonucleotide
ctggaagtgttgaaggacagtattctgcccg

SEQ ID NO: 296380 - DNA, 37 bp, Artificial Sequence
  Description of Artificial Sequence: Synthetic oligonucleotide
tggaagtgttgaaggacagtattctgcccgataaatg

SEQ ID NO: 296381 - DNA, 36 bp, Artificial Sequence
  Description of Artificial Sequence: Synthetic oligonucleotide
ggaagtgttgaaggacagtattctgcccgataaatg

SEQ ID NO: 296382 - DNA, 36 bp, Artificial Sequence
  Description of Artificial Sequence: Synthetic oligonucleotide
gaagtgttgaaggacagtattctgcccgataaatgc

SEQ ID NO: 296383 - DNA, 36 bp, Artificial Sequence
  Description of Artificial Sequence: Synthetic oligonucleotide
aagtgttgaaggacagtattctgcccgataaatgcc

SEQ ID NO: 296384 - DNA, 35 bp, Artificial Sequence
  Description of Artificial Sequence: Synthetic oligonucleotide
agtgttgaaggacagtattctgcccgataaatgcc

SEQ ID NO: 296385 - DNA, 34 bp, Artificial Sequence
  Description of Artificial Sequence: Synthetic oligonucleotide
gtgttgaaggacagtattctgcccgataaatgcc

SEQ ID NO: 296386 - DNA, 35 bp, Artificial Sequence
  Description of Artificial Sequence: Synthetic oligonucleotide
tgttgaaggacagtattctgcccgataaatgcctg

SEQ ID NO: 296387 - DNA, 34 bp, Artificial Sequence
  Description of Artificial Sequence: Synthetic oligonucleotide
gttgaaggacagtattctgcccgataaatgcctg

SEQ ID NO: 296388 - DNA, 34 bp, Artificial Sequence
  Description of Artificial Sequence: Synthetic oligonucleotide
ttgaaggacagtattctgcccgataaatgcctgg

SEQ ID NO: 296389 - DNA, 33 bp, Artificial Sequence
  Description of Artificial Sequence: Synthetic oligonucleotide
tgaaggacagtattctgcccgataaatgcctgg

SEQ ID NO: 296390 - DNA, 32 bp, Artificial Sequence
  Description of Artificial Sequence: Synthetic oligonucleotide
gaaggacagtattctgcccgataaatgcctgg

SEQ ID NO: 296391 - DNA, 32 bp, Artificial Sequence
  Description of Artificial Sequence: Synthetic oligonucleotide
aaggacagtattctgcccgataaatgcctggc

SEQ ID NO: 296392 - DNA, 31 bp, Artificial Sequence
  Description of Artificial Sequence: Synthetic oligonucleotide
aggacagtattctgcccgataaatgcctggc

SEQ ID NO: 296393 - DNA, 30 bp, Artificial Sequence
  Description of Artificial Sequence: Synthetic oligonucleotide
ggacagtattctgcccgataaatgcctggc

SEQ ID NO: 296394 - DNA, 32 bp, Artificial Sequence
  Description of Artificial Sequence: Synthetic oligonucleotide
gacagtattctgcccgataaatgcctggctac

SEQ ID NO: 296395 - DNA, 34 bp, Artificial Sequence
  Description of Artificial Sequence: Synthetic oligonucleotide
acagtattctgcccgataaatgcctggctacaag

SEQ ID NO: 296396 - DNA, 33 bp, Artificial Sequence
  Description of Artificial Sequence: Synthetic oligonucleotide
cagtattctgcccgataaatgcctggctacaag

SEQ ID NO: 296397 - DNA, 35 bp, Artificial Sequence
  Description of Artificial Sequence: Synthetic oligonucleotide
agtattctgcccgataaatgcctggctacaagaac

SEQ ID NO: 296398 - DNA, 34 bp, Artificial Sequence
  Description of Artificial Sequence: Synthetic oligonucleotide
gtattctgcccgataaatgcctggctacaagaac

SEQ ID NO: 296399 - DNA, 35 bp, Artificial Sequence
  Description of Artificial Sequence: Synthetic oligonucleotide
tattctgcccgataaatgcctggctacaagaactg

SEQ ID NO: 296400 - DNA, 34 bp, Artificial Sequence
  Description of Artificial Sequence: Synthetic oligonucleotide
attctgcccgataaatgcctggctacaagaactg

SEQ ID NO: 296401 - DNA, 33 bp, Artificial Sequence
  Description of Artificial Sequence: Synthetic oligonucleotide
ttctgcccgataaatgcctggctacaagaactg

SEQ ID NO: 296402 - DNA, 32 bp, Artificial Sequence
  Description of Artificial Sequence: Synthetic oligonucleotide
tctgcccgataaatgcctggctacaagaactg

SEQ ID NO: 296403 - DNA, 31 bp, Artificial Sequence
  Description of Artificial Sequence: Synthetic oligonucleotide
ctgcccgataaatgcctggctacaagaactg

SEQ ID NO: 296404 - DNA, 32 bp, Artificial Sequence
  Description of Artificial Sequence: Synthetic oligonucleotide
tgcccgataaatgcctggctacaagaactgac

SEQ ID NO: 296405 - DNA, 31 bp, Artificial Sequence
  Description of Artificial Sequence: Synthetic oligonucleotide
gcccgataaatgcctggctacaagaactgac

SEQ ID NO: 296406 - DNA, 31 bp, Artificial Sequence
  Description of Artificial Sequence: Synthetic oligonucleotide
cccgataaatgcctggctacaagaactgacg

SEQ ID NO: 296407 - DNA, 32 bp, Artificial Sequence
  Description of Artificial Sequence: Synthetic oligonucleotide
ccgataaatgcctggctacaagaactgacgag

SEQ ID NO: 296408 - DNA, 32 bp, Artificial Sequence
  Description of Artificial Sequence: Synthetic oligonucleotide
cgataaatgcctggctacaagaactgacgagg

SEQ ID NO: 296409 - DNA, 33 bp, Artificial Sequence
  Description of Artificial Sequence: Synthetic oligonucleotide
gataaatgcctggctacaagaactgacgaggac

SEQ ID NO: 296410 - DNA, 34 bp, Artificial Sequence
  Description of Artificial Sequence: Synthetic oligonucleotide
ataaatgcctggctacaagaactgacgaggacag

SEQ ID NO: 296411 - DNA, 33 bp, Artificial Sequence
  Description of Artificial Sequence: Synthetic oligonucleotide
taaatgcctggctacaagaactgacgaggacag

SEQ ID NO: 296412 - DNA, 32 bp, Artificial Sequence
  Description of Artificial Sequence: Synthetic oligonucleotide
aaatgcctggctacaagaactgacgaggacag

SEQ ID NO: 296413 - DNA, 31 bp, Artificial Sequence
  Description of Artificial Sequence: Synthetic oligonucleotide
aatgcctggctacaagaactgacgaggacag

SEQ ID NO: 296414 - DNA, 30 bp, Artificial Sequence
  Description of Artificial Sequence: Synthetic oligonucleotide
atgcctggctacaagaactgacgaggacag

SEQ ID NO: 296415 - DNA, 29 bp, Artificial Sequence
  Description of Artificial Sequence: Synthetic oligonucleotide
tgcctggctacaagaactgacgaggacag

SEQ ID NO: 296416 - DNA, 28 bp, Artificial Sequence
  Description of Artificial Sequence: Synthetic oligonucleotide
gcctggctacaagaactgacgaggacag

SEQ ID NO: 296417 - DNA, 28 bp, Artificial Sequence
  Description of Artificial Sequence: Synthetic oligonucleotide
cctggctacaagaactgacgaggacagc

SEQ ID NO: 296418 - DNA, 29 bp, Artificial Sequence
  Description of Artificial Sequence: Synthetic oligonucleotide
ctggctacaagaactgacgaggacagcac

SEQ ID NO: 296419 - DNA, 31 bp, Artificial Sequence
  Description of Artificial Sequence: Synthetic oligonucleotide
tggctacaagaactgacgaggacagcacaac

SEQ ID NO: 296420 - DNA, 30 bp, Artificial Sequence
  Description of Artificial Sequence: Synthetic oligonucleotide
ggctacaagaactgacgaggacagcacaac

SEQ ID NO: 296421 - DNA, 31 bp, Artificial Sequence
  Description of Artificial Sequence: Synthetic oligonucleotide
gctacaagaactgacgaggacagcacaactg

SEQ ID NO: 296422 - DNA, 31 bp, Artificial Sequence
  Description of Artificial Sequence: Synthetic oligonucleotide
ctacaagaactgacgaggacagcacaactgc

SEQ ID NO: 296423 - DNA, 34 bp, Artificial Sequence
  Description of Artificial Sequence: Synthetic oligonucleotide
tacaagaactgacgaggacagcacaactgcattc

SEQ ID NO: 296424 - DNA, 33 bp, Artificial Sequence
  Description of Artificial Sequence: Synthetic oligonucleotide
acaagaactgacgaggacagcacaactgcattc

SEQ ID NO: 296425 - DNA, 32 bp, Artificial Sequence
  Description of Artificial Sequence: Synthetic oligonucleotide
caagaactgacgaggacagcacaactgcattc

SEQ ID NO: 296426 - DNA, 32 bp, Artificial Sequence
  Description of Artificial Sequence: Synthetic oligonucleotide
aagaactgacgaggacagcacaactgcattcc

SEQ ID NO: 296427 - DNA, 31 bp, Artificial Sequence
  Description of Artificial Sequence: Synthetic oligonucleotide
agaactgacgaggacagcacaactgcattcc

SEQ ID NO: 296428 - DNA, 30 bp, Artificial Sequence
  Description of Artificial Sequence: Synthetic oligonucleotide
gaactgacgaggacagcacaactgcattcc

SEQ ID NO: 296429 - DNA, 31 bp, Artificial Sequence
  Description of Artificial Sequence: Synthetic oligonucleotide
aactgacgaggacagcacaactgcattccac

SEQ ID NO: 296430 - DNA, 30 bp, Artificial Sequence
  Description of Artificial Sequence: Synthetic oligonucleotide
actgacgaggacagcacaactgcattccac

SEQ ID NO: 296431 - DNA, 29 bp, Artificial Sequence
  Description of Artificial Sequence: Synthetic oligonucleotide
ctgacgaggacagcacaactgcattccac

SEQ ID NO: 296432 - DNA, 30 bp, Artificial Sequence
  Description of Artificial Sequence: Synthetic oligonucleotide
tgacgaggacagcacaactgcattccactg

SEQ ID NO: 296433 - DNA, 29 bp, Artificial Sequence
  Description of Artificial Sequence: Synthetic oligonucleotide
gacgaggacagcacaactgcattccactg

SEQ ID NO: 296434 - DNA, 29 bp, Artificial Sequence
  Description of Artificial Sequence: Synthetic oligonucleotide
acgaggacagcacaactgcattccactgg

SEQ ID NO: 296435 - DNA, 28 bp, Artificial Sequence
  Description of Artificial Sequence: Synthetic oligonucleotide
cgaggacagcacaactgcattccactgg

SEQ ID NO: 296436 - DNA, 28 bp, Artificial Sequence
  Description of Artificial Sequence: Synthetic oligonucleotide
gaggacagcacaactgcattccactggg

SEQ ID NO: 296437 - DNA, 28 bp, Artificial Sequence
  Description of Artificial Sequence: Synthetic oligonucleotide
aggacagcacaactgcattccactgggc

SEQ ID NO: 296438 - DNA, 27 bp, Artificial Sequence
  Description of Artificial Sequence: Synthetic oligonucleotide
ggacagcacaactgcattccactgggc

SEQ ID NO: 296439 - DNA, 29 bp, Artificial Sequence
  Description of Artificial Sequence: Synthetic oligonucleotide
gacagcacaactgcattccactgggcaag

SEQ ID NO: 296440 - DNA, 29 bp, Artificial Sequence
  Description of Artificial Sequence: Synthetic oligonucleotide
acagcacaactgcattccactgggcaagc

SEQ ID NO: 296441 - DNA, 28 bp, Artificial Sequence
  Description of Artificial Sequence: Synthetic oligonucleotide
cagcacaactgcattccactgggcaagc

SEQ ID NO: 296442 - DNA, 29 bp, Artificial Sequence
  Description of Artificial Sequence: Synthetic oligonucleotide
agcacaactgcattccactgggcaagctc

SEQ ID NO: 296443 - DNA, 28 bp, Artificial Sequence
  Description of Artificial Sequence: Synthetic oligonucleotide
gcacaactgcattccactgggcaagctc

SEQ ID NO: 296444 - DNA, 29 bp, Artificial Sequence
  Description of Artificial Sequence: Synthetic oligonucleotide
cacaactgcattccactgggcaagctcag

SEQ ID NO: 296445 - DNA, 29 bp, Artificial Sequence
  Description of Artificial Sequence: Synthetic oligonucleotide
acaactgcattccactgggcaagctcagc

SEQ ID NO: 296446 - DNA, 28 bp, Artificial Sequence
  Description of Artificial Sequence: Synthetic oligonucleotide
caactgcattccactgggcaagctcagc

SEQ ID NO: 296447 - DNA, 29 bp, Artificial Sequence
  Description of Artificial Sequence: Synthetic oligonucleotide
aactgcattccactgggcaagctcagctg

SEQ ID NO: 296448 - DNA, 28 bp, Artificial Sequence
  Description of Artificial Sequence: Synthetic oligonucleotide
actgcattccactgggcaagctcagctg

SEQ ID NO: 296449 - DNA, 27 bp, Artificial Sequence
  Description of Artificial Sequence: Synthetic oligonucleotide
ctgcattccactgggcaagctcagctg

SEQ ID NO: 296450 - DNA, 27 bp, Artificial Sequence
  Description of Artificial Sequence: Synthetic oligonucleotide
tgcattccactgggcaagctcagctgc

SEQ ID NO: 296451 - DNA, 27 bp, Artificial Sequence
  Description of Artificial Sequence: Synthetic oligonucleotide
gcattccactgggcaagctcagctgca

SEQ ID NO: 296452 - DNA, 27 bp, Artificial Sequence
  Description of Artificial Sequence: Synthetic oligonucleotide
cattccactgggcaagctcagctgcac

SEQ ID NO: 296453 - DNA, 30 bp, Artificial Sequence
  Description of Artificial Sequence: Synthetic oligonucleotide
attccactgggcaagctcagctgcacatac

SEQ ID NO: 296454 - DNA, 29 bp, Artificial Sequence
  Description of Artificial Sequence: Synthetic oligonucleotide
ttccactgggcaagctcagctgcacatac

SEQ ID NO: 296455 - DNA, 28 bp, Artificial Sequence
  Description of Artificial Sequence: Synthetic oligonucleotide
tccactgggcaagctcagctgcacatac

SEQ ID NO: 296456 - DNA, 27 bp, Artificial Sequence
  Description of Artificial Sequence: Synthetic oligonucleotide
ccactgggcaagctcagctgcacatac

SEQ ID NO: 296457 - DNA, 28 bp, Artificial Sequence
  Description of Artificial Sequence: Synthetic oligonucleotide
cactgggcaagctcagctgcacatacag

SEQ ID NO: 296458 - DNA, 33 bp, Artificial Sequence
  Description of Artificial Sequence: Synthetic oligonucleotide
actgggcaagctcagctgcacatacagatattg

SEQ ID NO: 296459 - DNA, 32 bp, Artificial Sequence
  Description of Artificial Sequence: Synthetic oligonucleotide
ctgggcaagctcagctgcacatacagatattg

SEQ ID NO: 296460 - DNA, 34 bp, Artificial Sequence
  Description of Artificial Sequence: Synthetic oligonucleotide
tgggcaagctcagctgcacatacagatattgttg

SEQ ID NO: 296461 - DNA, 33 bp, Artificial Sequence
  Description of Artificial Sequence: Synthetic oligonucleotide
gggcaagctcagctgcacatacagatattgttg

SEQ ID NO: 296462 - DNA, 40 bp, Artificial Sequence
  Description of Artificial Sequence: Synthetic oligonucleotide
ggcaagctcagctgcacatacagatattgttgaaattttg

SEQ ID NO: 296463 - DNA, 42 bp, Artificial Sequence
  Description of Artificial Sequence: Synthetic oligonucleotide
gcaagctcagctgcacatacagatattgttgaaattttgttg

SEQ ID NO: 296464 - DNA, 42 bp, Artificial Sequence
  Description of Artificial Sequence: Synthetic oligonucleotide
caagctcagctgcacatacagatattgttgaaattttgttgc

SEQ ID NO: 296465 - DNA, 44 bp, Artificial Sequence
  Description of Artificial Sequence: Synthetic oligonucleotide
aagctcagctgcacatacagatattgttgaaattttgttgctac

SEQ ID NO: 296466 - DNA, 43 bp, Artificial Sequence
  Description of Artificial Sequence: Synthetic oligonucleotide
agctcagctgcacatacagatattgttgaaattttgttgctac

SEQ ID NO: 296467 - DNA, 42 bp, Artificial Sequence
  Description of Artificial Sequence: Synthetic oligonucleotide
gctcagctgcacatacagatattgttgaaattttgttgctac

SEQ ID NO: 296468 - DNA, 44 bp, Artificial Sequence
  Description of Artificial Sequence: Synthetic oligonucleotide
ctcagctgcacatacagatattgttgaaattttgttgctacttg

SEQ ID NO: 296469 - DNA, 44 bp, Artificial Sequence
  Description of Artificial Sequence: Synthetic oligonucleotide
tcagctgcacatacagatattgttgaaattttgttgctacttgg

SEQ ID NO: 296470 - DNA, 43 bp, Artificial Sequence
  Description of Artificial Sequence: Synthetic oligonucleotide
cagctgcacatacagatattgttgaaattttgttgctacttgg

SEQ ID NO: 296471 - DNA, 44 bp, Artificial Sequence
  Description of Artificial Sequence: Synthetic oligonucleotide
agctgcacatacagatattgttgaaattttgttgctacttggag

SEQ ID NO: 296472 - DNA, 43 bp, Artificial Sequence
  Description of Artificial Sequence: Synthetic oligonucleotide
gctgcacatacagatattgttgaaattttgttgctacttggag

SEQ ID NO: 296473 - DNA, 44 bp, Artificial Sequence
  Description of Artificial Sequence: Synthetic oligonucleotide
ctgcacatacagatattgttgaaattttgttgctacttggagtc

SEQ ID NO: 296474 - DNA, 44 bp, Artificial Sequence
  Description of Artificial Sequence: Synthetic oligonucleotide
tgcacatacagatattgttgaaattttgttgctacttggagtcc

SEQ ID NO: 296475 - DNA, 43 bp, Artificial Sequence
  Description of Artificial Sequence: Synthetic oligonucleotide
gcacatacagatattgttgaaattttgttgctacttggagtcc

SEQ ID NO: 296476 - DNA, 43 bp, Artificial Sequence
  Description of Artificial Sequence: Synthetic oligonucleotide
cacatacagatattgttgaaattttgttgctacttggagtccc

SEQ ID NO: 296477 - DNA, 44 bp, Artificial Sequence
  Description of Artificial Sequence: Synthetic oligonucleotide
acatacagatattgttgaaattttgttgctacttggagtcccag

SEQ ID NO: 296478 - DNA, 43 bp, Artificial Sequence
  Description of Artificial Sequence: Synthetic oligonucleotide
catacagatattgttgaaattttgttgctacttggagtcccag

SEQ ID NO: 296479 - DNA, 44 bp, Artificial Sequence
  Description of Artificial Sequence: Synthetic oligonucleotide
atacagatattgttgaaattttgttgctacttggagtcccagtg

SEQ ID NO: 296480 - DNA, 43 bp, Artificial Sequence
  Description of Artificial Sequence: Synthetic oligonucleotide
tacagatattgttgaaattttgttgctacttggagtcccagtg

SEQ ID NO: 296481 - DNA, 42 bp, Artificial Sequence
  Description of Artificial Sequence: Synthetic oligonucleotide
acagatattgttgaaattttgttgctacttggagtcccagtg

SEQ ID NO: 296482 - DNA, 41 bp, Artificial Sequence
  Description of Artificial Sequence: Synthetic oligonucleotide
cagatattgttgaaattttgttgctacttggagtcccagtg

SEQ ID NO: 296483 - DNA, 44 bp, Artificial Sequence
  Description of Artificial Sequence: Synthetic oligonucleotide
agatattgttgaaattttgttgctacttggagtcccagtgaatc

SEQ ID NO: 296484 - DNA, 43 bp, Artificial Sequence
  Description of Artificial Sequence: Synthetic oligonucleotide
gatattgttgaaattttgttgctacttggagtcccagtgaatc

SEQ ID NO: 296485 - DNA, 48 bp, Artificial Sequence
  Description of Artificial Sequence: Synthetic oligonucleotide
atattgttgaaattttgttgctacttggagtcccagtgaatcataaag

SEQ ID NO: 296486 - DNA, 47 bp, Artificial Sequence
  Description of Artificial Sequence: Synthetic oligonucleotide
tattgttgaaattttgttgctacttggagtcccagtgaatcataaag

SEQ ID NO: 296487 - DNA, 46 bp, Artificial Sequence
  Description of Artificial Sequence: Synthetic oligonucleotide
attgttgaaattttgttgctacttggagtcccagtgaatcataaag

SEQ ID NO: 296488 - DNA, 45 bp, Artificial Sequence
  Description of Artificial Sequence: Synthetic oligonucleotide
ttgttgaaattttgttgctacttggagtcccagtgaatcataaag

SEQ ID NO: 296489 - DNA, 44 bp, Artificial Sequence
  Description of Artificial Sequence: Synthetic oligonucleotide
tgttgaaattttgttgctacttggagtcccagtgaatcataaag

SEQ ID NO: 296490 - DNA, 43 bp, Artificial Sequence
  Description of Artificial Sequence: Synthetic oligonucleotide
gttgaaattttgttgctacttggagtcccagtgaatcataaag

SEQ ID NO: 296491 - DNA, 44 bp, Artificial Sequence
  Description of Artificial Sequence: Synthetic oligonucleotide
ttgaaattttgttgctacttggagtcccagtgaatcataaagac

SEQ ID NO: 296492 - DNA, 43 bp, Artificial Sequence
  Description of Artificial Sequence: Synthetic oligonucleotide
tgaaattttgttgctacttggagtcccagtgaatcataaagac

SEQ ID NO: 296493 - DNA, 42 bp, Artificial Sequence
  Description of Artificial Sequence: Synthetic oligonucleotide
gaaattttgttgctacttggagtcccagtgaatcataaagac

SEQ ID NO: 296494 - DNA, 42 bp, Artificial Sequence
  Description of Artificial Sequence: Synthetic oligonucleotide
aaattttgttgctacttggagtcccagtgaatcataaagacg

SEQ ID NO: 296495 - DNA, 41 bp, Artificial Sequence
  Description of Artificial Sequence: Synthetic oligonucleotide
aattttgttgctacttggagtcccagtgaatcataaagacg

SEQ ID NO: 296496 - DNA, 40 bp, Artificial Sequence
  Description of Artificial Sequence: Synthetic oligonucleotide
attttgttgctacttggagtcccagtgaatcataaagacg

SEQ ID NO: 296497 - DNA, 39 bp, Artificial Sequence
  Description of Artificial Sequence: Synthetic oligonucleotide
ttttgttgctacttggagtcccagtgaatcataaagacg

SEQ ID NO: 296498 - DNA, 38 bp, Artificial Sequence
  Description of Artificial Sequence: Synthetic oligonucleotide
tttgttgctacttggagtcccagtgaatcataaagacg

SEQ ID NO: 296499 - DNA, 37 bp, Artificial Sequence
  Description of Artificial Sequence: Synthetic oligonucleotide
ttgttgctacttggagtcccagtgaatcataaagacg

SEQ ID NO: 296500 - DNA, 36 bp, Artificial Sequence
  Description of Artificial Sequence: Synthetic oligonucleotide
tgttgctacttggagtcccagtgaatcataaagacg

SEQ ID NO: 296501 - DNA, 35 bp, Artificial Sequence
  Description of Artificial Sequence: Synthetic oligonucleotide
gttgctacttggagtcccagtgaatcataaagacg

SEQ ID NO: 296502 - DNA, 37 bp, Artificial Sequence
  Description of Artificial Sequence: Synthetic oligonucleotide
ttgctacttggagtcccagtgaatcataaagacgttg

SEQ ID NO: 296503 - DNA, 36 bp, Artificial Sequence
  Description of Artificial Sequence: Synthetic oligonucleotide
tgctacttggagtcccagtgaatcataaagacgttg

SEQ ID NO: 296504 - DNA, 35 bp, Artificial Sequence
  Description of Artificial Sequence: Synthetic oligonucleotide
gctacttggagtcccagtgaatcataaagacgttg

SEQ ID NO: 296505 - DNA, 35 bp, Artificial Sequence
  Description of Artificial Sequence: Synthetic oligonucleotide
ctacttggagtcccagtgaatcataaagacgttgc

SEQ ID NO: 296506 - DNA, 36 bp, Artificial Sequence
  Description of Artificial Sequence: Synthetic oligonucleotide
tacttggagtcccagtgaatcataaagacgttgcag

SEQ ID NO: 296507 - DNA, 35 bp, Artificial Sequence
  Description of Artificial Sequence: Synthetic oligonucleotide
acttggagtcccagtgaatcataaagacgttgcag

SEQ ID NO: 296508 - DNA, 34 bp, Artificial Sequence
  Description of Artificial Sequence: Synthetic oligonucleotide
cttggagtcccagtgaatcataaagacgttgcag

SEQ ID NO: 296509 - DNA, 34 bp, Artificial Sequence
  Description of Artificial Sequence: Synthetic oligonucleotide
ttggagtcccagtgaatcataaagacgttgcagg

SEQ ID NO: 296510 - DNA, 33 bp, Artificial Sequence
  Description of Artificial Sequence: Synthetic oligonucleotide
tggagtcccagtgaatcataaagacgttgcagg

SEQ ID NO: 296511 - DNA, 32 bp, Artificial Sequence
  Description of Artificial Sequence: Synthetic oligonucleotide
ggagtcccagtgaatcataaagacgttgcagg

SEQ ID NO: 296512 - DNA, 34 bp, Artificial Sequence
  Description of Artificial Sequence: Synthetic oligonucleotide
gagtcccagtgaatcataaagacgttgcaggttg

SEQ ID NO: 296513 - DNA, 34 bp, Artificial Sequence
  Description of Artificial Sequence: Synthetic oligonucleotide
agtcccagtgaatcataaagacgttgcaggttgc

SEQ ID NO: 296514 - DNA, 33 bp, Artificial Sequence
  Description of Artificial Sequence: Synthetic oligonucleotide
gtcccagtgaatcataaagacgttgcaggttgc

SEQ ID NO: 296515 - DNA, 34 bp, Artificial Sequence
  Description of Artificial Sequence: Synthetic oligonucleotide
tcccagtgaatcataaagacgttgcaggttgctc

SEQ ID NO: 296516 - DNA, 33 bp, Artificial Sequence
  Description of Artificial Sequence: Synthetic oligonucleotide
cccagtgaatcataaagacgttgcaggttgctc

SEQ ID NO: 296517 - DNA, 34 bp, Artificial Sequence
  Description of Artificial Sequence: Synthetic oligonucleotide
ccagtgaatcataaagacgttgcaggttgctctc

SEQ ID NO: 296518 - DNA, 34 bp, Artificial Sequence
  Description of Artificial Sequence: Synthetic oligonucleotide
cagtgaatcataaagacgttgcaggttgctctcc

SEQ ID NO: 296519 - DNA, 35 bp, Artificial Sequence
  Description of Artificial Sequence: Synthetic oligonucleotide
agtgaatcataaagacgttgcaggttgctctcctc

SEQ ID NO: 296520 - DNA, 34 bp, Artificial Sequence
  Description of Artificial Sequence: Synthetic oligonucleotide
gtgaatcataaagacgttgcaggttgctctcctc

SEQ ID NO: 296521 - DNA, 36 bp, Artificial Sequence
  Description of Artificial Sequence: Synthetic oligonucleotide
tgaatcataaagacgttgcaggttgctctcctcttg

SEQ ID NO: 296522 - DNA, 35 bp, Artificial Sequence
  Description of Artificial Sequence: Synthetic oligonucleotide
gaatcataaagacgttgcaggttgctctcctcttg

SEQ ID NO: 296523 - DNA, 40 bp, Artificial Sequence
  Description of Artificial Sequence: Synthetic oligonucleotide
aatcataaagacgttgcaggttgctctcctcttgatattg

SEQ ID NO: 296524 - DNA, 39 bp, Artificial Sequence
  Description of Artificial Sequence: Synthetic oligonucleotide
atcataaagacgttgcaggttgctctcctcttgatattg

SEQ ID NO: 296525 - DNA, 38 bp, Artificial Sequence
  Description of Artificial Sequence: Synthetic oligonucleotide
tcataaagacgttgcaggttgctctcctcttgatattg

SEQ ID NO: 296526 - DNA, 37 bp, Artificial Sequence
  Description of Artificial Sequence: Synthetic oligonucleotide
cataaagacgttgcaggttgctctcctcttgatattg

SEQ ID NO: 296527 - DNA, 37 bp, Artificial Sequence
  Description of Artificial Sequence: Synthetic oligonucleotide
ataaagacgttgcaggttgctctcctcttgatattgc

SEQ ID NO: 296528 - DNA, 36 bp, Artificial Sequence
  Description of Artificial Sequence: Synthetic oligonucleotide
taaagacgttgcaggttgctctcctcttgatattgc

SEQ ID NO: 296529 - DNA, 35 bp, Artificial Sequence
  Description of Artificial Sequence: Synthetic oligonucleotide
aaagacgttgcaggttgctctcctcttgatattgc

SEQ ID NO: 296530 - DNA, 34 bp, Artificial Sequence
  Description of Artificial Sequence: Synthetic oligonucleotide
aagacgttgcaggttgctctcctcttgatattgc

SEQ ID NO: 296531 - DNA, 33 bp, Artificial Sequence
  Description of Artificial Sequence: Synthetic oligonucleotide
agacgttgcaggttgctctcctcttgatattgc

SEQ ID NO: 296532 - DNA, 32 bp, Artificial Sequence
  Description of Artificial Sequence: Synthetic oligonucleotide
gacgttgcaggttgctctcctcttgatattgc

SEQ ID NO: 296533 - DNA, 32 bp, Artificial Sequence
  Description of Artificial Sequence: Synthetic oligonucleotide
acgttgcaggttgctctcctcttgatattgcg

SEQ ID NO: 296534 - DNA, 31 bp, Artificial Sequence
  Description of Artificial Sequence: Synthetic oligonucleotide
cgttgcaggttgctctcctcttgatattgcg

SEQ ID NO: 296535 - DNA, 31 bp, Artificial Sequence
  Description of Artificial Sequence: Synthetic oligonucleotide
gttgcaggttgctctcctcttgatattgcgg

SEQ ID NO: 296536 - DNA, 31 bp, Artificial Sequence
  Description of Artificial Sequence: Synthetic oligonucleotide
ttgcaggttgctctcctcttgatattgcggg

SEQ ID NO: 296537 - DNA, 30 bp, Artificial Sequence
  Description of Artificial Sequence: Synthetic oligonucleotide
tgcaggttgctctcctcttgatattgcggg

SEQ ID NO: 296538 - DNA, 29 bp, Artificial Sequence
  Description of Artificial Sequence: Synthetic oligonucleotide
gcaggttgctctcctcttgatattgcggg

SEQ ID NO: 296539 - DNA, 31 bp, Artificial Sequence
  Description of Artificial Sequence: Synthetic oligonucleotide
caggttgctctcctcttgatattgcgggttc

SEQ ID NO: 296540 - DNA, 32 bp, Artificial Sequence
  Description of Artificial Sequence: Synthetic oligonucleotide
aggttgctctcctcttgatattgcgggttctg

SEQ ID NO: 296541 - DNA, 31 bp, Artificial Sequence
  Description of Artificial Sequence: Synthetic oligonucleotide
ggttgctctcctcttgatattgcgggttctg

SEQ ID NO: 296542 - DNA, 31 bp, Artificial Sequence
  Description of Artificial Sequence: Synthetic oligonucleotide
gttgctctcctcttgatattgcgggttctgc

SEQ ID NO: 296543 - DNA, 32 bp, Artificial Sequence
  Description of Artificial Sequence: Synthetic oligonucleotide
ttgctctcctcttgatattgcgggttctgctg

SEQ ID NO: 296544 - DNA, 31 bp, Artificial Sequence
  Description of Artificial Sequence: Synthetic oligonucleotide
tgctctcctcttgatattgcgggttctgctg

SEQ ID NO: 296545 - DNA, 30 bp, Artificial Sequence
  Description of Artificial Sequence: Synthetic oligonucleotide
gctctcctcttgatattgcgggttctgctg

SEQ ID NO: 296546 - DNA, 30 bp, Artificial Sequence
  Description of Artificial Sequence: Synthetic oligonucleotide
ctctcctcttgatattgcgggttctgctgg

SEQ ID NO: 296547 - DNA, 30 bp, Artificial Sequence
  Description of Artificial Sequence: Synthetic oligonucleotide
tctcctcttgatattgcgggttctgctggg

SEQ ID NO: 296548 - DNA, 29 bp, Artificial Sequence
  Description of Artificial Sequence: Synthetic oligonucleotide
ctcctcttgatattgcgggttctgctggg

SEQ ID NO: 296549 - DNA, 29 bp, Artificial Sequence
  Description of Artificial Sequence: Synthetic oligonucleotide
tcctcttgatattgcgggttctgctgggc

SEQ ID NO: 296550 - DNA, 28 bp, Artificial Sequence
  Description of Artificial Sequence: Synthetic oligonucleotide
cctcttgatattgcgggttctgctgggc

SEQ ID NO: 296551 - DNA, 28 bp, Artificial Sequence
  Description of Artificial Sequence: Synthetic oligonucleotide
ctcttgatattgcgggttctgctgggcg

SEQ ID NO: 296552 - DNA, 28 bp, Artificial Sequence
  Description of Artificial Sequence: Synthetic oligonucleotide
tcttgatattgcgggttctgctgggcgg

SEQ ID NO: 296553 - DNA, 27 bp, Artificial Sequence
  Description of Artificial Sequence: Synthetic oligonucleotide
cttgatattgcgggttctgctgggcgg

SEQ ID NO: 296554 - DNA, 27 bp, Artificial Sequence
  Description of Artificial Sequence: Synthetic oligonucleotide
ttgatattgcgggttctgctgggcggg

SEQ ID NO: 296555 - DNA, 27 bp, Artificial Sequence
  Description of Artificial Sequence: Synthetic oligonucleotide
tgatattgcgggttctgctgggcggga

SEQ ID NO: 296556 - DNA, 27 bp, Artificial Sequence
  Description of Artificial Sequence: Synthetic oligonucleotide
gatattgcgggttctgctgggcgggat

SEQ ID NO: 296557 - DNA, 27 bp, Artificial Sequence
  Description of Artificial Sequence: Synthetic oligonucleotide
atattgcgggttctgctgggcgggatg

SEQ ID NO: 296558 - DNA, 27 bp, Artificial Sequence
  Description of Artificial Sequence: Synthetic oligonucleotide
tattgcgggttctgctgggcgggatga

SEQ ID NO: 296559 - DNA, 26 bp, Artificial Sequence
  Description of Artificial Sequence: Synthetic oligonucleotide
attgcgggttctgctgggcgggatga

SEQ ID NO: 296560 - DNA, 25 bp, Artificial Sequence
  Description of Artificial Sequence: Synthetic oligonucleotide
ttgcgggttctgctgggcgggatga

SEQ ID NO: 296561 - DNA, 24 bp, Artificial Sequence
  Description of Artificial Sequence: Synthetic oligonucleotide
tgcgggttctgctgggcgggatga

SEQ ID NO: 296562 - DNA, 23 bp, Artificial Sequence
  Description of Artificial Sequence: Synthetic oligonucleotide
gcgggttctgctgggcgggatga

SEQ ID NO: 296563 - DNA, 26 bp, Artificial Sequence
  Description of Artificial Sequence: Synthetic oligonucleotide
cgggttctgctgggcgggatgagttt

SEQ ID NO: 296564 - DNA, 27 bp, Artificial Sequence
  Description of Artificial Sequence: Synthetic oligonucleotide
gggttctgctgggcgggatgagtttgt

SEQ ID NO: 296565 - DNA, 31 bp, Artificial Sequence
  Description of Artificial Sequence: Synthetic oligonucleotide
ggttctgctgggcgggatgagtttgtaaaag

SEQ ID NO: 296566 - DNA, 31 bp, Artificial Sequence
  Description of Artificial Sequence: Synthetic oligonucleotide
gttctgctgggcgggatgagtttgtaaaagg

SEQ ID NO: 296567 - DNA, 31 bp, Artificial Sequence
  Description of Artificial Sequence: Synthetic oligonucleotide
ttctgctgggcgggatgagtttgtaaaaggc

SEQ ID NO: 296568 - DNA, 30 bp, Artificial Sequence
  Description of Artificial Sequence: Synthetic oligonucleotide
tctgctgggcgggatgagtttgtaaaaggc

SEQ ID NO: 296569 - DNA, 29 bp, Artificial Sequence
  Description of Artificial Sequence: Synthetic oligonucleotide
ctgctgggcgggatgagtttgtaaaaggc

SEQ ID NO: 296570 - DNA, 29 bp, Artificial Sequence
  Description of Artificial Sequence: Synthetic oligonucleotide
tgctgggcgggatgagtttgtaaaaggcc

SEQ ID NO: 296571 - DNA, 28 bp, Artificial Sequence
  Description of Artificial Sequence: Synthetic oligonucleotide
gctgggcgggatgagtttgtaaaaggcc

SEQ ID NO: 296572 - DNA, 30 bp, Artificial Sequence
  Description of Artificial Sequence: Synthetic oligonucleotide
ctgggcgggatgagtttgtaaaaggccttc

SEQ ID NO: 296573 - DNA, 31 bp, Artificial Sequence
  Description of Artificial Sequence: Synthetic oligonucleotide
tgggcgggatgagtttgtaaaaggccttctg

SEQ ID NO: 296574 - DNA, 30 bp, Artificial Sequence
  Description of Artificial Sequence: Synthetic oligonucleotide
gggcgggatgagtttgtaaaaggccttctg

SEQ ID NO: 296575 - DNA, 30 bp, Artificial Sequence
  Description of Artificial Sequence: Synthetic oligonucleotide
ggcgggatgagtttgtaaaaggccttctgg

SEQ ID NO: 296576 - DNA, 30 bp, Artificial Sequence
  Description of Artificial Sequence: Synthetic oligonucleotide
gcgggatgagtttgtaaaaggccttctggg

SEQ ID NO: 296577 - DNA, 34 bp, Artificial Sequence
  Description of Artificial Sequence: Synthetic oligonucleotide
cgggatgagtttgtaaaaggccttctgggtaaag

SEQ ID NO: 296578 - DNA, 34 bp, Artificial Sequence
  Description of Artificial Sequence: Synthetic oligonucleotide
gggatgagtttgtaaaaggccttctgggtaaagg

SEQ ID NO: 296579 - DNA, 35 bp, Artificial Sequence
  Description of Artificial Sequence: Synthetic oligonucleotide
ggatgagtttgtaaaaggccttctgggtaaaggtg

SEQ ID NO: 296580 - DNA, 35 bp, Artificial Sequence
  Description of Artificial Sequence: Synthetic oligonucleotide
gatgagtttgtaaaaggccttctgggtaaaggtgc

SEQ ID NO: 296581 - DNA, 36 bp, Artificial Sequence
  Description of Artificial Sequence: Synthetic oligonucleotide
atgagtttgtaaaaggccttctgggtaaaggtgctg

SEQ ID NO: 296582 - DNA, 35 bp, Artificial Sequence
  Description of Artificial Sequence: Synthetic oligonucleotide
tgagtttgtaaaaggccttctgggtaaaggtgctg

SEQ ID NO: 296583 - DNA, 34 bp, Artificial Sequence
  Description of Artificial Sequence: Synthetic oligonucleotide
gagtttgtaaaaggccttctgggtaaaggtgctg

SEQ ID NO: 296584 - DNA, 36 bp, Artificial Sequence
  Description of Artificial Sequence: Synthetic oligonucleotide
agtttgtaaaaggccttctgggtaaaggtgctgaag

SEQ ID NO: 296585 - DNA, 35 bp, Artificial Sequence
  Description of Artificial Sequence: Synthetic oligonucleotide
gtttgtaaaaggccttctgggtaaaggtgctgaag

SEQ ID NO: 296586 - DNA, 36 bp, Artificial Sequence
  Description of Artificial Sequence: Synthetic oligonucleotide
tttgtaaaaggccttctgggtaaaggtgctgaagtg

SEQ ID NO: 296587 - DNA, 35 bp, Artificial Sequence
  Description of Artificial Sequence: Synthetic oligonucleotide
ttgtaaaaggccttctgggtaaaggtgctgaagtg

SEQ ID NO: 296588 - DNA, 34 bp, Artificial Sequence
  Description of Artificial Sequence: Synthetic oligonucleotide
tgtaaaaggccttctgggtaaaggtgctgaagtg

SEQ ID NO: 296589 - DNA, 33 bp, Artificial Sequence
  Description of Artificial Sequence: Synthetic oligonucleotide
gtaaaaggccttctgggtaaaggtgctgaagtg

SEQ ID NO: 296590 - DNA, 36 bp, Artificial Sequence
  Description of Artificial Sequence: Synthetic oligonucleotide
taaaaggccttctgggtaaaggtgctgaagtgaatg

SEQ ID NO: 296591 - DNA, 35 bp, Artificial Sequence
  Description of Artificial Sequence: Synthetic oligonucleotide
aaaaggccttctgggtaaaggtgctgaagtgaatg

SEQ ID NO: 296592 - DNA, 34 bp, Artificial Sequence
  Description of Artificial Sequence: Synthetic oligonucleotide
aaaggccttctgggtaaaggtgctgaagtgaatg

SEQ ID NO: 296593 - DNA, 33 bp, Artificial Sequence
  Description of Artificial Sequence: Synthetic oligonucleotide
aaggccttctgggtaaaggtgctgaagtgaatg

SEQ ID NO: 296594 - DNA, 32 bp, Artificial Sequence
  Description of Artificial Sequence: Synthetic oligonucleotide
aggccttctgggtaaaggtgctgaagtgaatg

SEQ ID NO: 296595 - DNA, 31 bp, Artificial Sequence
  Description of Artificial Sequence: Synthetic oligonucleotide
ggccttctgggtaaaggtgctgaagtgaatg

SEQ ID NO: 296596 - DNA, 31 bp, Artificial Sequence
  Description of Artificial Sequence: Synthetic oligonucleotide
gccttctgggtaaaggtgctgaagtgaatgg

SEQ ID NO: 296597 - DNA, 32 bp, Artificial Sequence
  Description of Artificial Sequence: Synthetic oligonucleotide
ccttctgggtaaaggtgctgaagtgaatggtg

SEQ ID NO: 296598 - DNA, 33 bp, Artificial Sequence
  Description of Artificial Sequence: Synthetic oligonucleotide
cttctgggtaaaggtgctgaagtgaatggtgtc

SEQ ID NO: 296599 - DNA, 36 bp, Artificial Sequence
  Description of Artificial Sequence: Synthetic oligonucleotide
ttctgggtaaaggtgctgaagtgaatggtgtcaatc

SEQ ID NO: 296600 - DNA, 35 bp, Artificial Sequence
  Description of Artificial Sequence: Synthetic oligonucleotide
tctgggtaaaggtgctgaagtgaatggtgtcaatc

SEQ ID NO: 296601 - DNA, 34 bp, Artificial Sequence
  Description of Artificial Sequence: Synthetic oligonucleotide
ctgggtaaaggtgctgaagtgaatggtgtcaatc

SEQ ID NO: 296602 - DNA, 39 bp, Artificial Sequence
  Description of Artificial Sequence: Synthetic oligonucleotide
tgggtaaaggtgctgaagtgaatggtgtcaatcataatg

SEQ ID NO: 296603 - DNA, 38 bp, Artificial Sequence
  Description of Artificial Sequence: Synthetic oligonucleotide
gggtaaaggtgctgaagtgaatggtgtcaatcataatg

SEQ ID NO: 296604 - DNA, 38 bp, Artificial Sequence
  Description of Artificial Sequence: Synthetic oligonucleotide
ggtaaaggtgctgaagtgaatggtgtcaatcataatgg

SEQ ID NO: 296605 - DNA, 38 bp, Artificial Sequence
  Description of Artificial Sequence: Synthetic oligonucleotide
gtaaaggtgctgaagtgaatggtgtcaatcataatggc

SEQ ID NO: 296606 - DNA, 39 bp, Artificial Sequence
  Description of Artificial Sequence: Synthetic oligonucleotide
taaaggtgctgaagtgaatggtgtcaatcataatggctg

SEQ ID NO: 296607 - DNA, 38 bp, Artificial Sequence
  Description of Artificial Sequence: Synthetic oligonucleotide
aaaggtgctgaagtgaatggtgtcaatcataatggctg

SEQ ID NO: 296608 - DNA, 37 bp, Artificial Sequence
  Description of Artificial Sequence: Synthetic oligonucleotide
aaggtgctgaagtgaatggtgtcaatcataatggctg

SEQ ID NO: 296609 - DNA, 36 bp, Artificial Sequence
  Description of Artificial Sequence: Synthetic oligonucleotide
aggtgctgaagtgaatggtgtcaatcataatggctg

SEQ ID NO: 296610 - DNA, 35 bp, Artificial Sequence
  Description of Artificial Sequence: Synthetic oligonucleotide
ggtgctgaagtgaatggtgtcaatcataatggctg

SEQ ID NO: 296611 - DNA, 37 bp, Artificial Sequence
  Description of Artificial Sequence: Synthetic oligonucleotide
gtgctgaagtgaatggtgtcaatcataatggctgttc

SEQ ID NO: 296612 - DNA, 38 bp, Artificial Sequence
  Description of Artificial Sequence: Synthetic oligonucleotide
tgctgaagtgaatggtgtcaatcataatggctgttctc

SEQ ID NO: 296613 - DNA, 37 bp, Artificial Sequence
  Description of Artificial Sequence: Synthetic oligonucleotide
gctgaagtgaatggtgtcaatcataatggctgttctc

SEQ ID NO: 296614 - DNA, 37 bp, Artificial Sequence
  Description of Artificial Sequence: Synthetic oligonucleotide
ctgaagtgaatggtgtcaatcataatggctgttctcc

SEQ ID NO: 296615 - DNA, 37 bp, Artificial Sequence
  Description of Artificial Sequence: Synthetic oligonucleotide
tgaagtgaatggtgtcaatcataatggctgttctccc

SEQ ID NO: 296616 - DNA, 36 bp, Artificial Sequence
  Description of Artificial Sequence: Synthetic oligonucleotide
gaagtgaatggtgtcaatcataatggctgttctccc

SEQ ID NO: 296617 - DNA, 39 bp, Artificial Sequence
  Description of Artificial Sequence: Synthetic oligonucleotide
aagtgaatggtgtcaatcataatggctgttctcccttac

SEQ ID NO: 296618 - DNA, 38 bp, Artificial Sequence
  Description of Artificial Sequence: Synthetic oligonucleotide
agtgaatggtgtcaatcataatggctgttctcccttac

SEQ ID NO: 296619 - DNA, 37 bp, Artificial Sequence
  Description of Artificial Sequence: Synthetic oligonucleotide
gtgaatggtgtcaatcataatggctgttctcccttac

SEQ ID NO: 296620 - DNA, 42 bp, Artificial Sequence
  Description of Artificial Sequence: Synthetic oligonucleotide
tgaatggtgtcaatcataatggctgttctcccttactttatg

SEQ ID NO: 296621 - DNA, 41 bp, Artificial Sequence
  Description of Artificial Sequence: Synthetic oligonucleotide
gaatggtgtcaatcataatggctgttctcccttactttatg

SEQ ID NO: 296622 - DNA, 41 bp, Artificial Sequence
  Description of Artificial Sequence: Synthetic oligonucleotide
aatggtgtcaatcataatggctgttctcccttactttatgc

SEQ ID NO: 296623 - DNA, 40 bp, Artificial Sequence
  Description of Artificial Sequence: Synthetic oligonucleotide
atggtgtcaatcataatggctgttctcccttactttatgc

SEQ ID NO: 296624 - DNA, 39 bp, Artificial Sequence
  Description of Artificial Sequence: Synthetic oligonucleotide
tggtgtcaatcataatggctgttctcccttactttatgc

SEQ ID NO: 296625 - DNA, 38 bp, Artificial Sequence
  Description of Artificial Sequence: Synthetic oligonucleotide
ggtgtcaatcataatggctgttctcccttactttatgc

SEQ ID NO: 296626 - DNA, 39 bp, Artificial Sequence
  Description of Artificial Sequence: Synthetic oligonucleotide
gtgtcaatcataatggctgttctcccttactttatgcag

SEQ ID NO: 296627 - DNA, 39 bp, Artificial Sequence
  Description of Artificial Sequence: Synthetic oligonucleotide
tgtcaatcataatggctgttctcccttactttatgcagc

SEQ ID NO: 296628 - DNA, 38 bp, Artificial Sequence
  Description of Artificial Sequence: Synthetic oligonucleotide
gtcaatcataatggctgttctcccttactttatgcagc

SEQ ID NO: 296629 - DNA, 40 bp, Artificial Sequence
  Description of Artificial Sequence: Synthetic oligonucleotide
tcaatcataatggctgttctcccttactttatgcagcatc

SEQ ID NO: 296630 - DNA, 39 bp, Artificial Sequence
  Description of Artificial Sequence: Synthetic oligonucleotide
caatcataatggctgttctcccttactttatgcagcatc

SEQ ID NO: 296631 - DNA, 39 bp, Artificial Sequence
  Description of Artificial Sequence: Synthetic oligonucleotide
aatcataatggctgttctcccttactttatgcagcatcg

SEQ ID NO: 296632 - DNA, 38 bp, Artificial Sequence
  Description of Artificial Sequence: Synthetic oligonucleotide
atcataatggctgttctcccttactttatgcagcatcg

SEQ ID NO: 296633 - DNA, 37 bp, Artificial Sequence
  Description of Artificial Sequence: Synthetic oligonucleotide
tcataatggctgttctcccttactttatgcagcatcg

SEQ ID NO: 296634 - DNA, 36 bp, Artificial Sequence
  Description of Artificial Sequence: Synthetic oligonucleotide
cataatggctgttctcccttactttatgcagcatcg

SEQ ID NO: 296635 - DNA, 41 bp, Artificial Sequence
  Description of Artificial Sequence: Synthetic oligonucleotide
ataatggctgttctcccttactttatgcagcatcgaaaaac

SEQ ID NO: 296636 - DNA, 40 bp, Artificial Sequence
  Description of Artificial Sequence: Synthetic oligonucleotide
taatggctgttctcccttactttatgcagcatcgaaaaac

SEQ ID NO: 296637 - DNA, 39 bp, Artificial Sequence
  Description of Artificial Sequence: Synthetic oligonucleotide
aatggctgttctcccttactttatgcagcatcgaaaaac

SEQ ID NO: 296638 - DNA, 38 bp, Artificial Sequence
  Description of Artificial Sequence: Synthetic oligonucleotide
atggctgttctcccttactttatgcagcatcgaaaaac

SEQ ID NO: 296639 - DNA, 37 bp, Artificial Sequence
  Description of Artificial Sequence: Synthetic oligonucleotide
tggctgttctcccttactttatgcagcatcgaaaaac

SEQ ID NO: 296640 - DNA, 36 bp, Artificial Sequence
  Description of Artificial Sequence: Synthetic oligonucleotide
ggctgttctcccttactttatgcagcatcgaaaaac

SEQ ID NO: 296641 - DNA, 37 bp, Artificial Sequence
  Description of Artificial Sequence: Synthetic oligonucleotide
gctgttctcccttactttatgcagcatcgaaaaactg

SEQ ID NO: 296642 - DNA, 37 bp, Artificial Sequence
  Description of Artificial Sequence: Synthetic oligonucleotide
ctgttctcccttactttatgcagcatcgaaaaactgg

SEQ ID NO: 296643 - DNA, 37 bp, Artificial Sequence
  Description of Artificial Sequence: Synthetic oligonucleotide
tgttctcccttactttatgcagcatcgaaaaactggc

SEQ ID NO: 296644 - DNA, 36 bp, Artificial Sequence
  Description of Artificial Sequence: Synthetic oligonucleotide
gttctcccttactttatgcagcatcgaaaaactggc

SEQ ID NO: 296645 - DNA, 38 bp, Artificial Sequence
  Description of Artificial Sequence: Synthetic oligonucleotide
ttctcccttactttatgcagcatcgaaaaactggcatg

SEQ ID NO: 296646 - DNA, 37 bp, Artificial Sequence
  Description of Artificial Sequence: Synthetic oligonucleotide
tctcccttactttatgcagcatcgaaaaactggcatg

SEQ ID NO: 296647 - DNA, 36 bp, Artificial Sequence
  Description of Artificial Sequence: Synthetic oligonucleotide
ctcccttactttatgcagcatcgaaaaactggcatg

SEQ ID NO: 296648 - DNA, 37 bp, Artificial Sequence
  Description of Artificial Sequence: Synthetic oligonucleotide
tcccttactttatgcagcatcgaaaaactggcatgag

SEQ ID NO: 296649 - DNA, 36 bp, Artificial Sequence
  Description of Artificial Sequence: Synthetic oligonucleotide
cccttactttatgcagcatcgaaaaactggcatgag

SEQ ID NO: 296650 - DNA, 38 bp, Artificial Sequence
  Description of Artificial Sequence: Synthetic oligonucleotide
ccttactttatgcagcatcgaaaaactggcatgagaac

SEQ ID NO: 296651 - DNA, 38 bp, Artificial Sequence
  Description of Artificial Sequence: Synthetic oligonucleotide
cttactttatgcagcatcgaaaaactggcatgagaacg

SEQ ID NO: 296652 - DNA, 38 bp, Artificial Sequence
  Description of Artificial Sequence: Synthetic oligonucleotide
ttactttatgcagcatcgaaaaactggcatgagaacgc

SEQ ID NO: 296653 - DNA, 37 bp, Artificial Sequence
  Description of Artificial Sequence: Synthetic oligonucleotide
tactttatgcagcatcgaaaaactggcatgagaacgc

SEQ ID NO: 296654 - DNA, 36 bp, Artificial Sequence
  Description of Artificial Sequence: Synthetic oligonucleotide
actttatgcagcatcgaaaaactggcatgagaacgc

SEQ ID NO: 296655 - DNA, 35 bp, Artificial Sequence
  Description of Artificial Sequence: Synthetic oligonucleotide
ctttatgcagcatcgaaaaactggcatgagaacgc

SEQ ID NO: 296656 - DNA, 36 bp, Artificial Sequence
  Description of Artificial Sequence: Synthetic oligonucleotide
tttatgcagcatcgaaaaactggcatgagaacgctg

SEQ ID NO: 296657 - DNA, 35 bp, Artificial Sequence
  Description of Artificial Sequence: Synthetic oligonucleotide
ttatgcagcatcgaaaaactggcatgagaacgctg

SEQ ID NO: 296658 - DNA, 34 bp, Artificial Sequence
  Description of Artificial Sequence: Synthetic oligonucleotide
tatgcagcatcgaaaaactggcatgagaacgctg

SEQ ID NO: 296659 - DNA, 33 bp, Artificial Sequence
  Description of Artificial Sequence: Synthetic oligonucleotide
atgcagcatcgaaaaactggcatgagaacgctg

SEQ ID NO: 296660 - DNA, 32 bp, Artificial Sequence
  Description of Artificial Sequence: Synthetic oligonucleotide
tgcagcatcgaaaaactggcatgagaacgctg

SEQ ID NO: 296661 - DNA, 31 bp, Artificial Sequence
  Description of Artificial Sequence: Synthetic oligonucleotide
gcagcatcgaaaaactggcatgagaacgctg

SEQ ID NO: 296662 - DNA, 32 bp, Artificial Sequence
  Description of Artificial Sequence: Synthetic oligonucleotide
cagcatcgaaaaactggcatgagaacgctgtc

SEQ ID NO: 296663 - DNA, 34 bp, Artificial Sequence
  Description of Artificial Sequence: Synthetic oligonucleotide
agcatcgaaaaactggcatgagaacgctgtcatc

SEQ ID NO: 296664 - DNA, 33 bp, Artificial Sequence
  Description of Artificial Sequence: Synthetic oligonucleotide
gcatcgaaaaactggcatgagaacgctgtcatc

SEQ ID NO: 296665 - DNA, 36 bp, Artificial Sequence
  Description of Artificial Sequence: Synthetic oligonucleotide
catcgaaaaactggcatgagaacgctgtcatcttac

SEQ ID NO: 296666 - DNA, 37 bp, Artificial Sequence
  Description of Artificial Sequence: Synthetic oligonucleotide
atcgaaaaactggcatgagaacgctgtcatcttactg

SEQ ID NO: 296667 - DNA, 36 bp, Artificial Sequence
  Description of Artificial Sequence: Synthetic oligonucleotide
tcgaaaaactggcatgagaacgctgtcatcttactg

SEQ ID NO: 296668 - DNA, 35 bp, Artificial Sequence
  Description of Artificial Sequence: Synthetic oligonucleotide
cgaaaaactggcatgagaacgctgtcatcttactg

SEQ ID NO: 296669 - DNA, 35 bp, Artificial Sequence
  Description of Artificial Sequence: Synthetic oligonucleotide
gaaaaactggcatgagaacgctgtcatcttactgg

SEQ ID NO: 296670 - DNA, 37 bp, Artificial Sequence
  Description of Artificial Sequence: Synthetic oligonucleotide
aaaaactggcatgagaacgctgtcatcttactggaac

SEQ ID NO: 296671 - DNA, 36 bp, Artificial Sequence
  Description of Artificial Sequence: Synthetic oligonucleotide
aaaactggcatgagaacgctgtcatcttactggaac

SEQ ID NO: 296672 - DNA, 35 bp, Artificial Sequence
  Description of Artificial Sequence: Synthetic oligonucleotide
aaactggcatgagaacgctgtcatcttactggaac

SEQ ID NO: 296673 - DNA, 34 bp, Artificial Sequence
  Description of Artificial Sequence: Synthetic oligonucleotide
aactggcatgagaacgctgtcatcttactggaac

SEQ ID NO: 296674 - DNA, 33 bp, Artificial Sequence
  Description of Artificial Sequence: Synthetic oligonucleotide
actggcatgagaacgctgtcatcttactggaac

SEQ ID NO: 296675 - DNA, 32 bp, Artificial Sequence
  Description of Artificial Sequence: Synthetic oligonucleotide
ctggcatgagaacgctgtcatcttactggaac

SEQ ID NO: 296676 - DNA, 32 bp, Artificial Sequence
  Description of Artificial Sequence: Synthetic oligonucleotide
tggcatgagaacgctgtcatcttactggaacg

SEQ ID NO: 296677 - DNA, 31 bp, Artificial Sequence
  Description of Artificial Sequence: Synthetic oligonucleotide
ggcatgagaacgctgtcatcttactggaacg

SEQ ID NO: 296678 - DNA, 31 bp, Artificial Sequence
  Description of Artificial Sequence: Synthetic oligonucleotide
gcatgagaacgctgtcatcttactggaacgc

SEQ ID NO: 296679 - DNA, 31 bp, Artificial Sequence
  Description of Artificial Sequence: Synthetic oligonucleotide
catgagaacgctgtcatcttactggaacgcg

SEQ ID NO: 296680 - DNA, 31 bp, Artificial Sequence
  Description of Artificial Sequence: Synthetic oligonucleotide
atgagaacgctgtcatcttactggaacgcgg

SEQ ID NO: 296681 - DNA, 30 bp, Artificial Sequence
  Description of Artificial Sequence: Synthetic oligonucleotide
tgagaacgctgtcatcttactggaacgcgg

SEQ ID NO: 296682 - DNA, 29 bp, Artificial Sequence
  Description of Artificial Sequence: Synthetic oligonucleotide
gagaacgctgtcatcttactggaacgcgg

SEQ ID NO: 296683 - DNA, 29 bp, Artificial Sequence
  Description of Artificial Sequence: Synthetic oligonucleotide
agaacgctgtcatcttactggaacgcggg

SEQ ID NO: 296684 - DNA, 28 bp, Artificial Sequence
  Description of Artificial Sequence: Synthetic oligonucleotide
gaacgctgtcatcttactggaacgcggg

SEQ ID NO: 296685 - DNA, 28 bp, Artificial Sequence
  Description of Artificial Sequence: Synthetic oligonucleotide
aacgctgtcatcttactggaacgcgggg

SEQ ID NO: 296686 - DNA, 27 bp, Artificial Sequence
  Description of Artificial Sequence: Synthetic oligonucleotide
acgctgtcatcttactggaacgcgggg

SEQ ID NO: 296687 - DNA, 26 bp, Artificial Sequence
  Description of Artificial Sequence: Synthetic oligonucleotide
cgctgtcatcttactggaacgcgggg

SEQ ID NO: 296688 - DNA, 27 bp, Artificial Sequence
  Description of Artificial Sequence: Synthetic oligonucleotide
gctgtcatcttactggaacgcggggct

SEQ ID NO: 296689 - DNA, 30 bp, Artificial Sequence
  Description of Artificial Sequence: Synthetic oligonucleotide
ctgtcatcttactggaacgcggggctattc

SEQ ID NO: 296690 - DNA, 30 bp, Artificial Sequence
  Description of Artificial Sequence: Synthetic oligonucleotide
tgtcatcttactggaacgcggggctattcc

SEQ ID NO: 296691 - DNA, 29 bp, Artificial Sequence
  Description of Artificial Sequence: Synthetic oligonucleotide
gtcatcttactggaacgcggggctattcc

SEQ ID NO: 296692 - DNA, 30 bp, Artificial Sequence
  Description of Artificial Sequence: Synthetic oligonucleotide
tcatcttactggaacgcggggctattccag

SEQ ID NO: 296693 - DNA, 29 bp, Artificial Sequence
  Description of Artificial Sequence: Synthetic oligonucleotide
catcttactggaacgcggggctattccag

SEQ ID NO: 296694 - DNA, 31 bp, Artificial Sequence
  Description of Artificial Sequence: Synthetic oligonucleotide
atcttactggaacgcggggctattccagatg

SEQ ID NO: 296695 - DNA, 30 bp, Artificial Sequence
  Description of Artificial Sequence: Synthetic oligonucleotide
tcttactggaacgcggggctattccagatg

SEQ ID NO: 296696 - DNA, 29 bp, Artificial Sequence
  Description of Artificial Sequence: Synthetic oligonucleotide
cttactggaacgcggggctattccagatg

SEQ ID NO: 296697 - DNA, 29 bp, Artificial Sequence
  Description of Artificial Sequence: Synthetic oligonucleotide
ttactggaacgcggggctattccagatgc

SEQ ID NO: 296698 - DNA, 28 bp, Artificial Sequence
  Description of Artificial Sequence: Synthetic oligonucleotide
tactggaacgcggggctattccagatgc

SEQ ID NO: 296699 - DNA, 27 bp, Artificial Sequence
  Description of Artificial Sequence: Synthetic oligonucleotide
actggaacgcggggctattccagatgc

SEQ ID NO: 296700 - DNA, 27 bp, Artificial Sequence
  Description of Artificial Sequence: Synthetic oligonucleotide
ctggaacgcggggctattccagatgca

SEQ ID NO: 296701 - DNA, 29 bp, Artificial Sequence
  Description of Artificial Sequence: Synthetic oligonucleotide
tggaacgcggggctattccagatgcaaag

SEQ ID NO: 296702 - DNA, 28 bp, Artificial Sequence
  Description of Artificial Sequence: Synthetic oligonucleotide
ggaacgcggggctattccagatgcaaag

SEQ ID NO: 296703 - DNA, 28 bp, Artificial Sequence
  Description of Artificial Sequence: Synthetic oligonucleotide
gaacgcggggctattccagatgcaaagg

SEQ ID NO: 296704 - DNA, 29 bp, Artificial Sequence
  Description of Artificial Sequence: Synthetic oligonucleotide
aacgcggggctattccagatgcaaaggac

SEQ ID NO: 296705 - DNA, 28 bp, Artificial Sequence
  Description of Artificial Sequence: Synthetic oligonucleotide
acgcggggctattccagatgcaaaggac

SEQ ID NO: 296706 - DNA, 27 bp, Artificial Sequence
  Description of Artificial Sequence: Synthetic oligonucleotide
cgcggggctattccagatgcaaaggac

SEQ ID NO: 296707 - DNA, 27 bp, Artificial Sequence
  Description of Artificial Sequence: Synthetic oligonucleotide
gcggggctattccagatgcaaaggacc

SEQ ID NO: 296708 - DNA, 32 bp, Artificial Sequence
  Description of Artificial Sequence: Synthetic oligonucleotide
cggggctattccagatgcaaaggaccataatg

SEQ ID NO: 296709 - DNA, 33 bp, Artificial Sequence
  Description of Artificial Sequence: Synthetic oligonucleotide
ggggctattccagatgcaaaggaccataatgag

SEQ ID NO: 296710 - DNA, 33 bp, Artificial Sequence
  Description of Artificial Sequence: Synthetic oligonucleotide
gggctattccagatgcaaaggaccataatgagg

SEQ ID NO: 296711 - DNA, 33 bp, Artificial Sequence
  Description of Artificial Sequence: Synthetic oligonucleotide
ggctattccagatgcaaaggaccataatgaggc

SEQ ID NO: 296712 - DNA, 35 bp, Artificial Sequence
  Description of Artificial Sequence: Synthetic oligonucleotide
gctattccagatgcaaaggaccataatgaggctag

SEQ ID NO: 296713 - DNA, 36 bp, Artificial Sequence
  Description of Artificial Sequence: Synthetic oligonucleotide
ctattccagatgcaaaggaccataatgaggctagag

SEQ ID NO: 296714 - DNA, 36 bp, Artificial Sequence
  Description of Artificial Sequence: Synthetic oligonucleotide
tattccagatgcaaaggaccataatgaggctagagc

SEQ ID NO: 296715 - DNA, 35 bp, Artificial Sequence
  Description of Artificial Sequence: Synthetic oligonucleotide
attccagatgcaaaggaccataatgaggctagagc

SEQ ID NO: 296716 - DNA, 34 bp, Artificial Sequence
  Description of Artificial Sequence: Synthetic oligonucleotide
ttccagatgcaaaggaccataatgaggctagagc

SEQ ID NO: 296717 - DNA, 33 bp, Artificial Sequence
  Description of Artificial Sequence: Synthetic oligonucleotide
tccagatgcaaaggaccataatgaggctagagc

SEQ ID NO: 296718 - DNA, 32 bp, Artificial Sequence
  Description of Artificial Sequence: Synthetic oligonucleotide
ccagatgcaaaggaccataatgaggctagagc

SEQ ID NO: 296719 - DNA, 35 bp, Artificial Sequence
  Description of Artificial Sequence: Synthetic oligonucleotide
cagatgcaaaggaccataatgaggctagagcaatg

SEQ ID NO: 296720 - DNA, 35 bp, Artificial Sequence
  Description of Artificial Sequence: Synthetic oligonucleotide
agatgcaaaggaccataatgaggctagagcaatgc

SEQ ID NO: 296721 - DNA, 34 bp, Artificial Sequence
  Description of Artificial Sequence: Synthetic oligonucleotide
gatgcaaaggaccataatgaggctagagcaatgc

SEQ ID NO: 296722 - DNA, 35 bp, Artificial Sequence
  Description of Artificial Sequence: Synthetic oligonucleotide
atgcaaaggaccataatgaggctagagcaatgcag

SEQ ID NO: 296723 - DNA, 34 bp, Artificial Sequence
  Description of Artificial Sequence: Synthetic oligonucleotide
tgcaaaggaccataatgaggctagagcaatgcag

SEQ ID NO: 296724 - DNA, 33 bp, Artificial Sequence
  Description of Artificial Sequence: Synthetic oligonucleotide
gcaaaggaccataatgaggctagagcaatgcag

SEQ ID NO: 296725 - DNA, 33 bp, Artificial Sequence
  Description of Artificial Sequence: Synthetic oligonucleotide
caaaggaccataatgaggctagagcaatgcagc

SEQ ID NO: 296726 - DNA, 33 bp, Artificial Sequence
  Description of Artificial Sequence: Synthetic oligonucleotide
aaaggaccataatgaggctagagcaatgcagcg

SEQ ID NO: 296727 - DNA, 32 bp, Artificial Sequence
  Description of Artificial Sequence: Synthetic oligonucleotide
aaggaccataatgaggctagagcaatgcagcg

SEQ ID NO: 296728 - DNA, 31 bp, Artificial Sequence
  Description of Artificial Sequence: Synthetic oligonucleotide
aggaccataatgaggctagagcaatgcagcg

SEQ ID NO: 296729 - DNA, 30 bp, Artificial Sequence
  Description of Artificial Sequence: Synthetic oligonucleotide
ggaccataatgaggctagagcaatgcagcg

SEQ ID NO: 296730 - DNA, 30 bp, Artificial Sequence
  Description of Artificial Sequence: Synthetic oligonucleotide
gaccataatgaggctagagcaatgcagcgg

SEQ ID NO: 296731 - DNA, 30 bp, Artificial Sequence
  Description of Artificial Sequence: Synthetic oligonucleotide
accataatgaggctagagcaatgcagcggg

SEQ ID NO: 296732 - DNA, 29 bp, Artificial Sequence
  Description of Artificial Sequence: Synthetic oligonucleotide
ccataatgaggctagagcaatgcagcggg

SEQ ID NO: 296733 - DNA, 29 bp, Artificial Sequence
  Description of Artificial Sequence: Synthetic oligonucleotide
cataatgaggctagagcaatgcagcgggc

SEQ ID NO: 296734 - DNA, 30 bp, Artificial Sequence
  Description of Artificial Sequence: Synthetic oligonucleotide
ataatgaggctagagcaatgcagcgggcag

SEQ ID NO: 296735 - DNA, 29 bp, Artificial Sequence
  Description of Artificial Sequence: Synthetic oligonucleotide
taatgaggctagagcaatgcagcgggcag

SEQ ID NO: 296736 - DNA, 28 bp, Artificial Sequence
  Description of Artificial Sequence: Synthetic oligonucleotide
aatgaggctagagcaatgcagcgggcag

SEQ ID NO: 296737 - DNA, 27 bp, Artificial Sequence
  Description of Artificial Sequence: Synthetic oligonucleotide
atgaggctagagcaatgcagcgggcag

SEQ ID NO: 296738 - DNA, 26 bp, Artificial Sequence
  Description of Artificial Sequence: Synthetic oligonucleotide
tgaggctagagcaatgcagcgggcag

SEQ ID NO: 296739 - DNA, 25 bp, Artificial Sequence
  Description of Artificial Sequence: Synthetic oligonucleotide
gaggctagagcaatgcagcgggcag

SEQ ID NO: 296740 - DNA, 26 bp, Artificial Sequence
  Description of Artificial Sequence: Synthetic oligonucleotide
aggctagagcaatgcagcgggcagca

SEQ ID NO: 296741 - DNA, 25 bp, Artificial Sequence
  Description of Artificial Sequence: Synthetic oligonucleotide
ggctagagcaatgcagcgggcagca

SEQ ID NO: 296742 - DNA, 25 bp, Artificial Sequence
  Description of Artificial Sequence: Synthetic oligonucleotide
gctagagcaatgcagcgggcagcac

SEQ ID NO: 296743 - DNA, 25 bp, Artificial Sequence
  Description of Artificial Sequence: Synthetic oligonucleotide
ctagagcaatgcagcgggcagcacc

SEQ ID NO: 296744 - DNA, 27 bp, Artificial Sequence
  Description of Artificial Sequence: Synthetic oligonucleotide
tagagcaatgcagcgggcagcacccaa

SEQ ID NO: 296745 - DNA, 26 bp, Artificial Sequence
  Description of Artificial Sequence: Synthetic oligonucleotide
agagcaatgcagcgggcagcacccaa

SEQ ID NO: 296746 - DNA, 25 bp, Artificial Sequence
  Description of Artificial Sequence: Synthetic oligonucleotide
gagcaatgcagcgggcagcacccaa

SEQ ID NO: 296747 - DNA, 25 bp, Artificial Sequence
  Description of Artificial Sequence: Synthetic oligonucleotide
agcaatgcagcgggcagcacccaag

SEQ ID NO: 296748 - DNA, 24 bp, Artificial Sequence
  Description of Artificial Sequence: Synthetic oligonucleotide
gcaatgcagcgggcagcacccaag

SEQ ID NO: 296749 - DNA, 24 bp, Artificial Sequence
  Description of Artificial Sequence: Synthetic oligonucleotide
caatgcagcgggcagcacccaagg

SEQ ID NO: 296750 - DNA, 27 bp, Artificial Sequence
  Description of Artificial Sequence: Synthetic oligonucleotide
aatgcagcgggcagcacccaagggtat

SEQ ID NO: 296751 - DNA, 26 bp, Artificial Sequence
  Description of Artificial Sequence: Synthetic oligonucleotide
atgcagcgggcagcacccaagggtat

SEQ ID NO: 296752 - DNA, 25 bp, Artificial Sequence
  Description of Artificial Sequence: Synthetic oligonucleotide
tgcagcgggcagcacccaagggtat

SEQ ID NO: 296753 - DNA, 24 bp, Artificial Sequence
  Description of Artificial Sequence: Synthetic oligonucleotide
gcagcgggcagcacccaagggtat

SEQ ID NO: 296754 - DNA, 26 bp, Artificial Sequence
  Description of Artificial Sequence: Synthetic oligonucleotide
cagcgggcagcacccaagggtatctt

SEQ ID NO: 296755 - DNA, 27 bp, Artificial Sequence
  Description of Artificial Sequence: Synthetic oligonucleotide
agcgggcagcacccaagggtatcttga

SEQ ID NO: 296756 - DNA, 27 bp, Artificial Sequence
  Description of Artificial Sequence: Synthetic oligonucleotide
gcgggcagcacccaagggtatcttgaa

SEQ ID NO: 296757 - DNA, 27 bp, Artificial Sequence
  Description of Artificial Sequence: Synthetic oligonucleotide
cgggcagcacccaagggtatcttgaag

SEQ ID NO: 296758 - DNA, 29 bp, Artificial Sequence
  Description of Artificial Sequence: Synthetic oligonucleotide
gggcagcacccaagggtatcttgaagatc

SEQ ID NO: 296759 - DNA, 32 bp, Artificial Sequence
  Description of Artificial Sequence: Synthetic oligonucleotide
ggcagcacccaagggtatcttgaagatcattc

SEQ ID NO: 296760 - DNA, 36 bp, Artificial Sequence
  Description of Artificial Sequence: Synthetic oligonucleotide
gcagcacccaagggtatcttgaagatcattcatatc

SEQ ID NO: 296761 - DNA, 36 bp, Artificial Sequence
  Description of Artificial Sequence: Synthetic oligonucleotide
cagcacccaagggtatcttgaagatcattcatatcg

SEQ ID NO: 296762 - DNA, 38 bp, Artificial Sequence
  Description of Artificial Sequence: Synthetic oligonucleotide
agcacccaagggtatcttgaagatcattcatatcgttc

SEQ ID NO: 296763 - DNA, 37 bp, Artificial Sequence
  Description of Artificial Sequence: Synthetic oligonucleotide
gcacccaagggtatcttgaagatcattcatatcgttc

SEQ ID NO: 296764 - DNA, 38 bp, Artificial Sequence
  Description of Artificial Sequence: Synthetic oligonucleotide
cacccaagggtatcttgaagatcattcatatcgttctg

SEQ ID NO: 296765 - DNA, 40 bp, Artificial Sequence
  Description of Artificial Sequence: Synthetic oligonucleotide
acccaagggtatcttgaagatcattcatatcgttctgtac

SEQ ID NO: 296766 - DNA, 39 bp, Artificial Sequence
  Description of Artificial Sequence: Synthetic oligonucleotide
cccaagggtatcttgaagatcattcatatcgttctgtac

SEQ ID NO: 296767 - DNA, 41 bp, Artificial Sequence
  Description of Artificial Sequence: Synthetic oligonucleotide
ccaagggtatcttgaagatcattcatatcgttctgtacttc

SEQ ID NO: 296768 - DNA, 44 bp, Artificial Sequence
  Description of Artificial Sequence: Synthetic oligonucleotide
caagggtatcttgaagatcattcatatcgttctgtacttcaaag

SEQ ID NO: 296769 - DNA, 44 bp, Artificial Sequence
  Description of Artificial Sequence: Synthetic oligonucleotide
aagggtatcttgaagatcattcatatcgttctgtacttcaaagc

SEQ ID NO: 296770 - DNA, 43 bp, Artificial Sequence
  Description of Artificial Sequence: Synthetic oligonucleotide
agggtatcttgaagatcattcatatcgttctgtacttcaaagc

SEQ ID NO: 296771 - DNA, 42 bp, Artificial Sequence
  Description of Artificial Sequence: Synthetic oligonucleotide
gggtatcttgaagatcattcatatcgttctgtacttcaaagc

SEQ ID NO: 296772 - DNA, 44 bp, Artificial Sequence
  Description of Artificial Sequence: Synthetic oligonucleotide
ggtatcttgaagatcattcatatcgttctgtacttcaaagcatc

SEQ ID NO: 296773 - DNA, 44 bp, Artificial Sequence
  Description of Artificial Sequence: Synthetic oligonucleotide
gtatcttgaagatcattcatatcgttctgtacttcaaagcatcg

SEQ ID NO: 296774 - DNA, 45 bp, Artificial Sequence
  Description of Artificial Sequence: Synthetic oligonucleotide
tatcttgaagatcattcatatcgttctgtacttcaaagcatcgac

SEQ ID NO: 296775 - DNA, 44 bp, Artificial Sequence
  Description of Artificial Sequence: Synthetic oligonucleotide
atcttgaagatcattcatatcgttctgtacttcaaagcatcgac

SEQ ID NO: 296776 - DNA, 43 bp, Artificial Sequence
  Description of Artificial Sequence: Synthetic oligonucleotide
tcttgaagatcattcatatcgttctgtacttcaaagcatcgac

SEQ ID NO: 296777 - DNA, 42 bp, Artificial Sequence
  Description of Artificial Sequence: Synthetic oligonucleotide
cttgaagatcattcatatcgttctgtacttcaaagcatcgac

SEQ ID NO: 296778 - DNA, 45 bp, Artificial Sequence
  Description of Artificial Sequence: Synthetic oligonucleotide
ttgaagatcattcatatcgttctgtacttcaaagcatcgacaaac

SEQ ID NO: 296779 - DNA, 44 bp, Artificial Sequence
  Description of Artificial Sequence: Synthetic oligonucleotide
tgaagatcattcatatcgttctgtacttcaaagcatcgacaaac

SEQ ID NO: 296780 - DNA, 43 bp, Artificial Sequence
  Description of Artificial Sequence: Synthetic oligonucleotide
gaagatcattcatatcgttctgtacttcaaagcatcgacaaac

SEQ ID NO: 296781 - DNA, 45 bp, Artificial Sequence
  Description of Artificial Sequence: Synthetic oligonucleotide
aagatcattcatatcgttctgtacttcaaagcatcgacaaacatc

SEQ ID NO: 296782 - DNA, 44 bp, Artificial Sequence
  Description of Artificial Sequence: Synthetic oligonucleotide
agatcattcatatcgttctgtacttcaaagcatcgacaaacatc

SEQ ID NO: 296783 - DNA, 43 bp, Artificial Sequence
  Description of Artificial Sequence: Synthetic oligonucleotide
gatcattcatatcgttctgtacttcaaagcatcgacaaacatc

SEQ ID NO: 296784 - DNA, 43 bp, Artificial Sequence
  Description of Artificial Sequence: Synthetic oligonucleotide
atcattcatatcgttctgtacttcaaagcatcgacaaacatcg

SEQ ID NO: 296785 - DNA, 42 bp, Artificial Sequence
  Description of Artificial Sequence: Synthetic oligonucleotide
tcattcatatcgttctgtacttcaaagcatcgacaaacatcg

SEQ ID NO: 296786 - DNA, 41 bp, Artificial Sequence
  Description of Artificial Sequence: Synthetic oligonucleotide
cattcatatcgttctgtacttcaaagcatcgacaaacatcg

SEQ ID NO: 296787 - DNA, 43 bp, Artificial Sequence
  Description of Artificial Sequence: Synthetic oligonucleotide
attcatatcgttctgtacttcaaagcatcgacaaacatcgaag

SEQ ID NO: 296788 - DNA, 42 bp, Artificial Sequence
  Description of Artificial Sequence: Synthetic oligonucleotide
ttcatatcgttctgtacttcaaagcatcgacaaacatcgaag

SEQ ID NO: 296789 - DNA, 41 bp, Artificial Sequence
  Description of Artificial Sequence: Synthetic oligonucleotide
tcatatcgttctgtacttcaaagcatcgacaaacatcgaag

SEQ ID NO: 296790 - DNA, 40 bp, Artificial Sequence
  Description of Artificial Sequence: Synthetic oligonucleotide
catatcgttctgtacttcaaagcatcgacaaacatcgaag

SEQ ID NO: 296791 - DNA, 41 bp, Artificial Sequence
  Description of Artificial Sequence: Synthetic oligonucleotide
atatcgttctgtacttcaaagcatcgacaaacatcgaagac

SEQ ID NO: 296792 - DNA, 40 bp, Artificial Sequence
  Description of Artificial Sequence: Synthetic oligonucleotide
tatcgttctgtacttcaaagcatcgacaaacatcgaagac

SEQ ID NO: 296793 - DNA, 39 bp, Artificial Sequence
  Description of Artificial Sequence: Synthetic oligonucleotide
atcgttctgtacttcaaagcatcgacaaacatcgaagac

SEQ ID NO: 296794 - DNA, 38 bp, Artificial Sequence
  Description of Artificial Sequence: Synthetic oligonucleotide
tcgttctgtacttcaaagcatcgacaaacatcgaagac

SEQ ID NO: 296795 - DNA, 37 bp, Artificial Sequence
  Description of Artificial Sequence: Synthetic oligonucleotide
cgttctgtacttcaaagcatcgacaaacatcgaagac

SEQ ID NO: 296796 - DNA, 38 bp, Artificial Sequence
  Description of Artificial Sequence: Synthetic oligonucleotide
gttctgtacttcaaagcatcgacaaacatcgaagacac

SEQ ID NO: 296797 - DNA, 39 bp, Artificial Sequence
  Description of Artificial Sequence: Synthetic oligonucleotide
ttctgtacttcaaagcatcgacaaacatcgaagacactg

SEQ ID NO: 296798 - DNA, 38 bp, Artificial Sequence
  Description of Artificial Sequence: Synthetic oligonucleotide
tctgtacttcaaagcatcgacaaacatcgaagacactg

SEQ ID NO: 296799 - DNA, 37 bp, Artificial Sequence
  Description of Artificial Sequence: Synthetic oligonucleotide
ctgtacttcaaagcatcgacaaacatcgaagacactg

SEQ ID NO: 296800 - DNA, 38 bp, Artificial Sequence
  Description of Artificial Sequence: Synthetic oligonucleotide
tgtacttcaaagcatcgacaaacatcgaagacactgtg

SEQ ID NO: 296801 - DNA, 37 bp, Artificial Sequence
  Description of Artificial Sequence: Synthetic oligonucleotide
gtacttcaaagcatcgacaaacatcgaagacactgtg

SEQ ID NO: 296802 - DNA, 37 bp, Artificial Sequence
  Description of Artificial Sequence: Synthetic oligonucleotide
tacttcaaagcatcgacaaacatcgaagacactgtgg

SEQ ID NO: 296803 - DNA, 36 bp, Artificial Sequence
  Description of Artificial Sequence: Synthetic oligonucleotide
acttcaaagcatcgacaaacatcgaagacactgtgg

SEQ ID NO: 296804 - DNA, 35 bp, Artificial Sequence
  Description of Artificial Sequence: Synthetic oligonucleotide
cttcaaagcatcgacaaacatcgaagacactgtgg

SEQ ID NO: 296805 - DNA, 35 bp, Artificial Sequence
  Description of Artificial Sequence: Synthetic oligonucleotide
ttcaaagcatcgacaaacatcgaagacactgtggg

SEQ ID NO: 296806 - DNA, 34 bp, Artificial Sequence
  Description of Artificial Sequence: Synthetic oligonucleotide
tcaaagcatcgacaaacatcgaagacactgtggg

SEQ ID NO: 296807 - DNA, 33 bp, Artificial Sequence
  Description of Artificial Sequence: Synthetic oligonucleotide
caaagcatcgacaaacatcgaagacactgtggg

SEQ ID NO: 296808 - DNA, 36 bp, Artificial Sequence
  Description of Artificial Sequence: Synthetic oligonucleotide
aaagcatcgacaaacatcgaagacactgtgggtaac

SEQ ID NO: 296809 - DNA, 35 bp, Artificial Sequence
  Description of Artificial Sequence: Synthetic oligonucleotide
aagcatcgacaaacatcgaagacactgtgggtaac

SEQ ID NO: 296810 - DNA, 34 bp, Artificial Sequence
  Description of Artificial Sequence: Synthetic oligonucleotide
agcatcgacaaacatcgaagacactgtgggtaac

SEQ ID NO: 296811 - DNA, 33 bp, Artificial Sequence
  Description of Artificial Sequence: Synthetic oligonucleotide
gcatcgacaaacatcgaagacactgtgggtaac

SEQ ID NO: 296812 - DNA, 34 bp, Artificial Sequence
  Description of Artificial Sequence: Synthetic oligonucleotide
catcgacaaacatcgaagacactgtgggtaacac

SEQ ID NO: 296813 - DNA, 35 bp, Artificial Sequence
  Description of Artificial Sequence: Synthetic oligonucleotide
atcgacaaacatcgaagacactgtgggtaacacac

SEQ ID NO: 296814 - DNA, 34 bp, Artificial Sequence
  Description of Artificial Sequence: Synthetic oligonucleotide
tcgacaaacatcgaagacactgtgggtaacacac

SEQ ID NO: 296815 - DNA, 33 bp, Artificial Sequence
  Description of Artificial Sequence: Synthetic oligonucleotide
cgacaaacatcgaagacactgtgggtaacacac

SEQ ID NO: 296816 - DNA, 33 bp, Artificial Sequence
  Description of Artificial Sequence: Synthetic oligonucleotide
gacaaacatcgaagacactgtgggtaacacacc

SEQ ID NO: 296817 - DNA, 34 bp, Artificial Sequence
  Description of Artificial Sequence: Synthetic oligonucleotide
acaaacatcgaagacactgtgggtaacacacctc

SEQ ID NO: 296818 - DNA, 33 bp, Artificial Sequence
  Description of Artificial Sequence: Synthetic oligonucleotide
caaacatcgaagacactgtgggtaacacacctc

SEQ ID NO: 296819 - DNA, 35 bp, Artificial Sequence
  Description of Artificial Sequence: Synthetic oligonucleotide
aaacatcgaagacactgtgggtaacacacctctac

SEQ ID NO: 296820 - DNA, 34 bp, Artificial Sequence
  Description of Artificial Sequence: Synthetic oligonucleotide
aacatcgaagacactgtgggtaacacacctctac

SEQ ID NO: 296821 - DNA, 33 bp, Artificial Sequence
  Description of Artificial Sequence: Synthetic oligonucleotide
acatcgaagacactgtgggtaacacacctctac

SEQ ID NO: 296822 - DNA, 32 bp, Artificial Sequence
  Description of Artificial Sequence: Synthetic oligonucleotide
catcgaagacactgtgggtaacacacctctac

SEQ ID NO: 296823 - DNA, 33 bp, Artificial Sequence
  Description of Artificial Sequence: Synthetic oligonucleotide
atcgaagacactgtgggtaacacacctctacac

SEQ ID NO: 296824 - DNA, 32 bp, Artificial Sequence
  Description of Artificial Sequence: Synthetic oligonucleotide
tcgaagacactgtgggtaacacacctctacac

SEQ ID NO: 296825 - DNA, 31 bp, Artificial Sequence
  Description of Artificial Sequence: Synthetic oligonucleotide
cgaagacactgtgggtaacacacctctacac

SEQ ID NO: 296826 - DNA, 34 bp, Artificial Sequence
  Description of Artificial Sequence: Synthetic oligonucleotide
gaagacactgtgggtaacacacctctacacatag

SEQ ID NO: 296827 - DNA, 34 bp, Artificial Sequence
  Description of Artificial Sequence: Synthetic oligonucleotide
aagacactgtgggtaacacacctctacacatagc

SEQ ID NO: 296828 - DNA, 33 bp, Artificial Sequence
  Description of Artificial Sequence: Synthetic oligonucleotide
agacactgtgggtaacacacctctacacatagc

SEQ ID NO: 296829 - DNA, 32 bp, Artificial Sequence
  Description of Artificial Sequence: Synthetic oligonucleotide
gacactgtgggtaacacacctctacacatagc

SEQ ID NO: 296830 - DNA, 32 bp, Artificial Sequence
  Description of Artificial Sequence: Synthetic oligonucleotide
acactgtgggtaacacacctctacacatagcc

SEQ ID NO: 296831 - DNA, 31 bp, Artificial Sequence
  Description of Artificial Sequence: Synthetic oligonucleotide
cactgtgggtaacacacctctacacatagcc

SEQ ID NO: 296832 - DNA, 32 bp, Artificial Sequence
  Description of Artificial Sequence: Synthetic oligonucleotide
actgtgggtaacacacctctacacatagcctg

SEQ ID NO: 296833 - DNA, 31 bp, Artificial Sequence
  Description of Artificial Sequence: Synthetic oligonucleotide
ctgtgggtaacacacctctacacatagcctg

SEQ ID NO: 296834 - DNA, 32 bp, Artificial Sequence
  Description of Artificial Sequence: Synthetic oligonucleotide
tgtgggtaacacacctctacacatagcctgtg

SEQ ID NO: 296835 - DNA, 31 bp, Artificial Sequence
  Description of Artificial Sequence: Synthetic oligonucleotide
gtgggtaacacacctctacacatagcctgtg

SEQ ID NO: 296836 - DNA, 33 bp, Artificial Sequence
  Description of Artificial Sequence: Synthetic oligonucleotide
tgggtaacacacctctacacatagcctgtgttg

SEQ ID NO: 296837 - DNA, 32 bp, Artificial Sequence
  Description of Artificial Sequence: Synthetic oligonucleotide
gggtaacacacctctacacatagcctgtgttg

SEQ ID NO: 296838 - DNA, 33 bp, Artificial Sequence
  Description of Artificial Sequence: Synthetic oligonucleotide
ggtaacacacctctacacatagcctgtgttgag

SEQ ID NO: 296839 - DNA, 33 bp, Artificial Sequence
  Description of Artificial Sequence: Synthetic oligonucleotide
gtaacacacctctacacatagcctgtgttgagg

SEQ ID NO: 296840 - DNA, 34 bp, Artificial Sequence
  Description of Artificial Sequence: Synthetic oligonucleotide
taacacacctctacacatagcctgtgttgaggag

SEQ ID NO: 296841 - DNA, 33 bp, Artificial Sequence
  Description of Artificial Sequence: Synthetic oligonucleotide
aacacacctctacacatagcctgtgttgaggag

SEQ ID NO: 296842 - DNA, 32 bp, Artificial Sequence
  Description of Artificial Sequence: Synthetic oligonucleotide
acacacctctacacatagcctgtgttgaggag

SEQ ID NO: 296843 - DNA, 31 bp, Artificial Sequence
  Description of Artificial Sequence: Synthetic oligonucleotide
cacacctctacacatagcctgtgttgaggag

SEQ ID NO: 296844 - DNA, 32 bp, Artificial Sequence
  Description of Artificial Sequence: Synthetic oligonucleotide
acacctctacacatagcctgtgttgaggagag

SEQ ID NO: 296845 - DNA, 31 bp, Artificial Sequence
  Description of Artificial Sequence: Synthetic oligonucleotide
cacctctacacatagcctgtgttgaggagag

SEQ ID NO: 296846 - DNA, 32 bp, Artificial Sequence
  Description of Artificial Sequence: Synthetic oligonucleotide
acctctacacatagcctgtgttgaggagagtg

SEQ ID NO: 296847 - DNA, 31 bp, Artificial Sequence
  Description of Artificial Sequence: Synthetic oligonucleotide
cctctacacatagcctgtgttgaggagagtg

SEQ ID NO: 296848 - DNA, 32 bp, Artificial Sequence
  Description of Artificial Sequence: Synthetic oligonucleotide
ctctacacatagcctgtgttgaggagagtgtg

SEQ ID NO: 296849 - DNA, 32 bp, Artificial Sequence
  Description of Artificial Sequence: Synthetic oligonucleotide
tctacacatagcctgtgttgaggagagtgtgg

SEQ ID NO: 296850 - DNA, 31 bp, Artificial Sequence
  Description of Artificial Sequence: Synthetic oligonucleotide
ctacacatagcctgtgttgaggagagtgtgg

SEQ ID NO: 296851 - DNA, 33 bp, Artificial Sequence
  Description of Artificial Sequence: Synthetic oligonucleotide
tacacatagcctgtgttgaggagagtgtggaag

SEQ ID NO: 296852 - DNA, 32 bp, Artificial Sequence
  Description of Artificial Sequence: Synthetic oligonucleotide
acacatagcctgtgttgaggagagtgtggaag

SEQ ID NO: 296853 - DNA, 31 bp, Artificial Sequence
  Description of Artificial Sequence: Synthetic oligonucleotide
cacatagcctgtgttgaggagagtgtggaag

SEQ ID NO: 296854 - DNA, 33 bp, Artificial Sequence
  Description of Artificial Sequence: Synthetic oligonucleotide
acatagcctgtgttgaggagagtgtggaagaac

SEQ ID NO: 296855 - DNA, 32 bp, Artificial Sequence
  Description of Artificial Sequence: Synthetic oligonucleotide
catagcctgtgttgaggagagtgtggaagaac

SEQ ID NO: 296856 - DNA, 32 bp, Artificial Sequence
  Description of Artificial Sequence: Synthetic oligonucleotide
atagcctgtgttgaggagagtgtggaagaacc

SEQ ID NO: 296857 - DNA, 31 bp, Artificial Sequence
  Description of Artificial Sequence: Synthetic oligonucleotide
tagcctgtgttgaggagagtgtggaagaacc

SEQ ID NO: 296858 - DNA, 30 bp, Artificial Sequence
  Description of Artificial Sequence: Synthetic oligonucleotide
agcctgtgttgaggagagtgtggaagaacc

SEQ ID NO: 296859 - DNA, 29 bp, Artificial Sequence
  Description of Artificial Sequence: Synthetic oligonucleotide
gcctgtgttgaggagagtgtggaagaacc

SEQ ID NO: 296860 - DNA, 33 bp, Artificial Sequence
  Description of Artificial Sequence: Synthetic oligonucleotide
cctgtgttgaggagagtgtggaagaaccaaaac

SEQ ID NO: 296861 - DNA, 34 bp, Artificial Sequence
  Description of Artificial Sequence: Synthetic oligonucleotide
ctgtgttgaggagagtgtggaagaaccaaaactg

SEQ ID NO: 296862 - DNA, 34 bp, Artificial Sequence
  Description of Artificial Sequence: Synthetic oligonucleotide
tgtgttgaggagagtgtggaagaaccaaaactgc

SEQ ID NO: 296863 - DNA, 33 bp, Artificial Sequence
  Description of Artificial Sequence: Synthetic oligonucleotide
gtgttgaggagagtgtggaagaaccaaaactgc

SEQ ID NO: 296864 - DNA, 34 bp, Artificial Sequence
  Description of Artificial Sequence: Synthetic oligonucleotide
tgttgaggagagtgtggaagaaccaaaactgcag

SEQ ID NO: 296865 - DNA, 33 bp, Artificial Sequence
  Description of Artificial Sequence: Synthetic oligonucleotide
gttgaggagagtgtggaagaaccaaaactgcag

SEQ ID NO: 296866 - DNA, 33 bp, Artificial Sequence
  Description of Artificial Sequence: Synthetic oligonucleotide
ttgaggagagtgtggaagaaccaaaactgcagg

SEQ ID NO: 296867 - DNA, 32 bp, Artificial Sequence
  Description of Artificial Sequence: Synthetic oligonucleotide
tgaggagagtgtggaagaaccaaaactgcagg

SEQ ID NO: 296868 - DNA, 31 bp, Artificial Sequence
  Description of Artificial Sequence: Synthetic oligonucleotide
gaggagagtgtggaagaaccaaaactgcagg

SEQ ID NO: 296869 - DNA, 32 bp, Artificial Sequence
  Description of Artificial Sequence: Synthetic oligonucleotide
aggagagtgtggaagaaccaaaactgcaggtg

SEQ ID NO: 296870 - DNA, 31 bp, Artificial Sequence
  Description of Artificial Sequence: Synthetic oligonucleotide
ggagagtgtggaagaaccaaaactgcaggtg

SEQ ID NO: 296871 - DNA, 32 bp, Artificial Sequence
  Description of Artificial Sequence: Synthetic oligonucleotide
gagagtgtggaagaaccaaaactgcaggtgtc

SEQ ID NO: 296872 - DNA, 32 bp, Artificial Sequence
  Description of Artificial Sequence: Synthetic oligonucleotide
agagtgtggaagaaccaaaactgcaggtgtcc

SEQ ID NO: 296873 - DNA, 31 bp, Artificial Sequence
  Description of Artificial Sequence: Synthetic oligonucleotide
gagtgtggaagaaccaaaactgcaggtgtcc

SEQ ID NO: 296874 - DNA, 31 bp, Artificial Sequence
  Description of Artificial Sequence: Synthetic oligonucleotide
agtgtggaagaaccaaaactgcaggtgtccc

SEQ ID NO: 296875 - DNA, 30 bp, Artificial Sequence
  Description of Artificial Sequence: Synthetic oligonucleotide
gtgtggaagaaccaaaactgcaggtgtccc

SEQ ID NO: 296876 - DNA, 32 bp, Artificial Sequence
  Description of Artificial Sequence: Synthetic oligonucleotide
tgtggaagaaccaaaactgcaggtgtcccatg

SEQ ID NO: 296877 - DNA, 31 bp, Artificial Sequence
  Description of Artificial Sequence: Synthetic oligonucleotide
gtggaagaaccaaaactgcaggtgtcccatg

SEQ ID NO: 296878 - DNA, 31 bp, Artificial Sequence
  Description of Artificial Sequence: Synthetic oligonucleotide
tggaagaaccaaaactgcaggtgtcccatgg

SEQ ID NO: 296879 - DNA, 30 bp, Artificial Sequence
  Description of Artificial Sequence: Synthetic oligonucleotide
ggaagaaccaaaactgcaggtgtcccatgg

SEQ ID NO: 296880 - DNA, 31 bp, Artificial Sequence
  Description of Artificial Sequence: Synthetic oligonucleotide
gaagaaccaaaactgcaggtgtcccatggag

SEQ ID NO: 296881 - DNA, 31 bp, Artificial Sequence
  Description of Artificial Sequence: Synthetic oligonucleotide
aagaaccaaaactgcaggtgtcccatggagc

SEQ ID NO: 296882 - DNA, 30 bp, Artificial Sequence
  Description of Artificial Sequence: Synthetic oligonucleotide
agaaccaaaactgcaggtgtcccatggagc

SEQ ID NO: 296883 - DNA, 29 bp, Artificial Sequence
  Description of Artificial Sequence: Synthetic oligonucleotide
gaaccaaaactgcaggtgtcccatggagc

SEQ ID NO: 296884 - DNA, 31 bp, Artificial Sequence
  Description of Artificial Sequence: Synthetic oligonucleotide
aaccaaaactgcaggtgtcccatggagcaag

SEQ ID NO: 296885 - DNA, 30 bp, Artificial Sequence
  Description of Artificial Sequence: Synthetic oligonucleotide
accaaaactgcaggtgtcccatggagcaag

SEQ ID NO: 296886 - DNA, 29 bp, Artificial Sequence
  Description of Artificial Sequence: Synthetic oligonucleotide
ccaaaactgcaggtgtcccatggagcaag

SEQ ID NO: 296887 - DNA, 35 bp, Artificial Sequence
  Description of Artificial Sequence: Synthetic oligonucleotide
caaaactgcaggtgtcccatggagcaagtttttac

SEQ ID NO: 296888 - DNA, 38 bp, Artificial Sequence
  Description of Artificial Sequence: Synthetic oligonucleotide
aaaactgcaggtgtcccatggagcaagtttttacattg

SEQ ID NO: 296889 - DNA, 37 bp, Artificial Sequence
  Description of Artificial Sequence: Synthetic oligonucleotide
aaactgcaggtgtcccatggagcaagtttttacattg

SEQ ID NO: 296890 - DNA, 36 bp, Artificial Sequence
  Description of Artificial Sequence: Synthetic oligonucleotide
aactgcaggtgtcccatggagcaagtttttacattg

SEQ ID NO: 296891 - DNA, 35 bp, Artificial Sequence
  Description of Artificial Sequence: Synthetic oligonucleotide
actgcaggtgtcccatggagcaagtttttacattg

SEQ ID NO: 296892 - DNA, 34 bp, Artificial Sequence
  Description of Artificial Sequence: Synthetic oligonucleotide
ctgcaggtgtcccatggagcaagtttttacattg

SEQ ID NO: 296893 - DNA, 35 bp, Artificial Sequence
  Description of Artificial Sequence: Synthetic oligonucleotide
tgcaggtgtcccatggagcaagtttttacattgtg

SEQ ID NO: 296894 - DNA, 34 bp, Artificial Sequence
  Description of Artificial Sequence: Synthetic oligonucleotide
gcaggtgtcccatggagcaagtttttacattgtg

SEQ ID NO: 296895 - DNA, 40 bp, Artificial Sequence
  Description of Artificial Sequence: Synthetic oligonucleotide
caggtgtcccatggagcaagtttttacattgtgaataaag

SEQ ID NO: 296896 - DNA, 42 bp, Artificial Sequence
  Description of Artificial Sequence: Synthetic oligonucleotide
aggtgtcccatggagcaagtttttacattgtgaataaagatg

SEQ ID NO: 296897 - DNA, 41 bp, Artificial Sequence
  Description of Artificial Sequence: Synthetic oligonucleotide
ggtgtcccatggagcaagtttttacattgtgaataaagatg

SEQ ID NO: 296898 - DNA, 45 bp, Artificial Sequence
  Description of Artificial Sequence: Synthetic oligonucleotide
gtgtcccatggagcaagtttttacattgtgaataaagatgaaaag

SEQ ID NO: 296899 - DNA, 46 bp, Artificial Sequence
  Description of Artificial Sequence: Synthetic oligonucleotide
tgtcccatggagcaagtttttacattgtgaataaagatgaaaagac

SEQ ID NO: 296900 - DNA, 45 bp, Artificial Sequence
  Description of Artificial Sequence: Synthetic oligonucleotide
gtcccatggagcaagtttttacattgtgaataaagatgaaaagac

SEQ ID NO: 296901 - DNA, 46 bp, Artificial Sequence
  Description of Artificial Sequence: Synthetic oligonucleotide
tcccatggagcaagtttttacattgtgaataaagatgaaaagacag

SEQ ID NO: 296902 - DNA, 45 bp, Artificial Sequence
  Description of Artificial Sequence: Synthetic oligonucleotide
cccatggagcaagtttttacattgtgaataaagatgaaaagacag

SEQ ID NO: 296903 - DNA, 45 bp, Artificial Sequence
  Description of Artificial Sequence: Synthetic oligonucleotide
ccatggagcaagtttttacattgtgaataaagatgaaaagacagc

SEQ ID NO: 296904 - DNA, 45 bp, Artificial Sequence
  Description of Artificial Sequence: Synthetic oligonucleotide
catggagcaagtttttacattgtgaataaagatgaaaagacagcc

SEQ ID NO: 296905 - DNA, 45 bp, Artificial Sequence
  Description of Artificial Sequence: Synthetic oligonucleotide
atggagcaagtttttacattgtgaataaagatgaaaagacagccc

SEQ ID NO: 296906 - DNA, 44 bp, Artificial Sequence
  Description of Artificial Sequence: Synthetic oligonucleotide
tggagcaagtttttacattgtgaataaagatgaaaagacagccc

SEQ ID NO: 296907 - DNA, 43 bp, Artificial Sequence
  Description of Artificial Sequence: Synthetic oligonucleotide
ggagcaagtttttacattgtgaataaagatgaaaagacagccc

SEQ ID NO: 296908 - DNA, 44 bp, Artificial Sequence
  Description of Artificial Sequence: Synthetic oligonucleotide
gagcaagtttttacattgtgaataaagatgaaaagacagccctg

SEQ ID NO: 296909 - DNA, 44 bp, Artificial Sequence
  Description of Artificial Sequence: Synthetic oligonucleotide
agcaagtttttacattgtgaataaagatgaaaagacagccctgc

SEQ ID NO: 296910 - DNA, 43 bp, Artificial Sequence
  Description of Artificial Sequence: Synthetic oligonucleotide
gcaagtttttacattgtgaataaagatgaaaagacagccctgc

SEQ ID NO: 296911 - DNA, 45 bp, Artificial Sequence
  Description of Artificial Sequence: Synthetic oligonucleotide
caagtttttacattgtgaataaagatgaaaagacagccctgcaag

SEQ ID NO: 296912 - DNA, 46 bp, Artificial Sequence
  Description of Artificial Sequence: Synthetic oligonucleotide
aagtttttacattgtgaataaagatgaaaagacagccctgcaagag

SEQ ID NO: 296913 - DNA, 45 bp, Artificial Sequence
  Description of Artificial Sequence: Synthetic oligonucleotide
agtttttacattgtgaataaagatgaaaagacagccctgcaagag

SEQ ID NO: 296914 - DNA, 44 bp, Artificial Sequence
  Description of Artificial Sequence: Synthetic oligonucleotide
gtttttacattgtgaataaagatgaaaagacagccctgcaagag

SEQ ID NO: 296915 - DNA, 44 bp, Artificial Sequence
  Description of Artificial Sequence: Synthetic oligonucleotide
tttttacattgtgaataaagatgaaaagacagccctgcaagagg

SEQ ID NO: 296916 - DNA, 43 bp, Artificial Sequence
  Description of Artificial Sequence: Synthetic oligonucleotide
ttttacattgtgaataaagatgaaaagacagccctgcaagagg

SEQ ID NO: 296917 - DNA, 42 bp, Artificial Sequence
  Description of Artificial Sequence: Synthetic oligonucleotide
tttacattgtgaataaagatgaaaagacagccctgcaagagg

SEQ ID NO: 296918 - DNA, 41 bp, Artificial Sequence
  Description of Artificial Sequence: Synthetic oligonucleotide
ttacattgtgaataaagatgaaaagacagccctgcaagagg

SEQ ID NO: 296919 - DNA, 40 bp, Artificial Sequence
  Description of Artificial Sequence: Synthetic oligonucleotide
tacattgtgaataaagatgaaaagacagccctgcaagagg

SEQ ID NO: 296920 - DNA, 39 bp, Artificial Sequence
  Description of Artificial Sequence: Synthetic oligonucleotide
acattgtgaataaagatgaaaagacagccctgcaagagg

SEQ ID NO: 296921 - DNA, 38 bp, Artificial Sequence
  Description of Artificial Sequence: Synthetic oligonucleotide
cattgtgaataaagatgaaaagacagccctgcaagagg

SEQ ID NO: 296922 - DNA, 38 bp, Artificial Sequence
  Description of Artificial Sequence: Synthetic oligonucleotide
attgtgaataaagatgaaaagacagccctgcaagaggc

SEQ ID NO: 296923 - DNA, 37 bp, Artificial Sequence
  Description of Artificial Sequence: Synthetic oligonucleotide
ttgtgaataaagatgaaaagacagccctgcaagaggc

SEQ ID NO: 296924 - DNA, 36 bp, Artificial Sequence
  Description of Artificial Sequence: Synthetic oligonucleotide
tgtgaataaagatgaaaagacagccctgcaagaggc

SEQ ID NO: 296925 - DNA, 35 bp, Artificial Sequence
  Description of Artificial Sequence: Synthetic oligonucleotide
gtgaataaagatgaaaagacagccctgcaagaggc

SEQ ID NO: 296926 - DNA, 35 bp, Artificial Sequence
  Description of Artificial Sequence: Synthetic oligonucleotide
tgaataaagatgaaaagacagccctgcaagaggcc

SEQ ID NO: 296927 - DNA, 34 bp, Artificial Sequence
  Description of Artificial Sequence: Synthetic oligonucleotide
gaataaagatgaaaagacagccctgcaagaggcc

SEQ ID NO: 296928 - DNA, 37 bp, Artificial Sequence
  Description of Artificial Sequence: Synthetic oligonucleotide
aataaagatgaaaagacagccctgcaagaggccaaag

SEQ ID NO: 296929 - DNA, 36 bp, Artificial Sequence
  Description of Artificial Sequence: Synthetic oligonucleotide
ataaagatgaaaagacagccctgcaagaggccaaag

SEQ ID NO: 296930 - DNA, 35 bp, Artificial Sequence
  Description of Artificial Sequence: Synthetic oligonucleotide
taaagatgaaaagacagccctgcaagaggccaaag

SEQ ID NO: 296931 - DNA, 34 bp, Artificial Sequence
  Description of Artificial Sequence: Synthetic oligonucleotide
aaagatgaaaagacagccctgcaagaggccaaag

SEQ ID NO: 296932 - DNA, 33 bp, Artificial Sequence
  Description of Artificial Sequence: Synthetic oligonucleotide
aagatgaaaagacagccctgcaagaggccaaag

SEQ ID NO: 296933 - DNA, 32 bp, Artificial Sequence
  Description of Artificial Sequence: Synthetic oligonucleotide
agatgaaaagacagccctgcaagaggccaaag

SEQ ID NO: 296934 - DNA, 31 bp, Artificial Sequence
  Description of Artificial Sequence: Synthetic oligonucleotide
gatgaaaagacagccctgcaagaggccaaag

SEQ ID NO: 296935 - DNA, 31 bp, Artificial Sequence
  Description of Artificial Sequence: Synthetic oligonucleotide
atgaaaagacagccctgcaagaggccaaagg

SEQ ID NO: 296936 - DNA, 30 bp, Artificial Sequence
  Description of Artificial Sequence: Synthetic oligonucleotide
tgaaaagacagccctgcaagaggccaaagg

SEQ ID NO: 296937 - DNA, 29 bp, Artificial Sequence
  Description of Artificial Sequence: Synthetic oligonucleotide
gaaaagacagccctgcaagaggccaaagg

SEQ ID NO: 296938 - DNA, 30 bp, Artificial Sequence
  Description of Artificial Sequence: Synthetic oligonucleotide
aaaagacagccctgcaagaggccaaaggag

SEQ ID NO: 296939 - DNA, 29 bp, Artificial Sequence
  Description of Artificial Sequence: Synthetic oligonucleotide
aaagacagccctgcaagaggccaaaggag

SEQ ID NO: 296940 - DNA, 28 bp, Artificial Sequence
  Description of Artificial Sequence: Synthetic oligonucleotide
aagacagccctgcaagaggccaaaggag

SEQ ID NO: 296941 - DNA, 27 bp, Artificial Sequence
  Description of Artificial Sequence: Synthetic oligonucleotide
agacagccctgcaagaggccaaaggag

SEQ ID NO: 296942 - DNA, 26 bp, Artificial Sequence
  Description of Artificial Sequence: Synthetic oligonucleotide
gacagccctgcaagaggccaaaggag

SEQ ID NO: 296943 - DNA, 26 bp, Artificial Sequence
  Description of Artificial Sequence: Synthetic oligonucleotide
acagccctgcaagaggccaaaggagg

SEQ ID NO: 296944 - DNA, 25 bp, Artificial Sequence
  Description of Artificial Sequence: Synthetic oligonucleotide
cagccctgcaagaggccaaaggagg

SEQ ID NO: 296945 - DNA, 25 bp, Artificial Sequence
  Description of Artificial Sequence: Synthetic oligonucleotide
agccctgcaagaggccaaaggaggc

SEQ ID NO: 296946 - DNA, 24 bp, Artificial Sequence
  Description of Artificial Sequence: Synthetic oligonucleotide
gccctgcaagaggccaaaggaggc

SEQ ID NO: 296947 - DNA, 25 bp, Artificial Sequence
  Description of Artificial Sequence: Synthetic oligonucleotide
ccctgcaagaggccaaaggaggcct

SEQ ID NO: 296948 - DNA, 25 bp, Artificial Sequence
  Description of Artificial Sequence: Synthetic oligonucleotide
cctgcaagaggccaaaggaggcctg

SEQ ID NO: 296949 - DNA, 25 bp, Artificial Sequence
  Description of Artificial Sequence: Synthetic oligonucleotide
ctgcaagaggccaaaggaggcctgg

SEQ ID NO: 296950 - DNA, 27 bp, Artificial Sequence
  Description of Artificial Sequence: Synthetic oligonucleotide
tgcaagaggccaaaggaggcctgggta

SEQ ID NO: 296951 - DNA, 27 bp, Artificial Sequence
  Description of Artificial Sequence: Synthetic oligonucleotide
gcaagaggccaaaggaggcctgggtat

SEQ ID NO: 296952 - DNA, 31 bp, Artificial Sequence
  Description of Artificial Sequence: Synthetic oligonucleotide
caagaggccaaaggaggcctgggtataatac

SEQ ID NO: 296953 - DNA, 32 bp, Artificial Sequence
  Description of Artificial Sequence: Synthetic oligonucleotide
aagaggccaaaggaggcctgggtataatactc

SEQ ID NO: 296954 - DNA, 31 bp, Artificial Sequence
  Description of Artificial Sequence: Synthetic oligonucleotide
agaggccaaaggaggcctgggtataatactc

SEQ ID NO: 296955 - DNA, 30 bp, Artificial Sequence
  Description of Artificial Sequence: Synthetic oligonucleotide
gaggccaaaggaggcctgggtataatactc

SEQ ID NO: 296956 - DNA, 32 bp, Artificial Sequence
  Description of Artificial Sequence: Synthetic oligonucleotide
aggccaaaggaggcctgggtataatactcatg

SEQ ID NO: 296957 - DNA, 31 bp, Artificial Sequence
  Description of Artificial Sequence: Synthetic oligonucleotide
ggccaaaggaggcctgggtataatactcatg

SEQ ID NO: 296958 - DNA, 32 bp, Artificial Sequence
  Description of Artificial Sequence: Synthetic oligonucleotide
gccaaaggaggcctgggtataatactcatgag

SEQ ID NO: 296959 - DNA, 35 bp, Artificial Sequence
  Description of Artificial Sequence: Synthetic oligonucleotide
ccaaaggaggcctgggtataatactcatgagaatg

SEQ ID NO: 296960 - DNA, 35 bp, Artificial Sequence
  Description of Artificial Sequence: Synthetic oligonucleotide
caaaggaggcctgggtataatactcatgagaatgg

SEQ ID NO: 296961 - DNA, 36 bp, Artificial Sequence
  Description of Artificial Sequence: Synthetic oligonucleotide
aaaggaggcctgggtataatactcatgagaatggtc

SEQ ID NO: 296962 - DNA, 35 bp, Artificial Sequence
  Description of Artificial Sequence: Synthetic oligonucleotide
aaggaggcctgggtataatactcatgagaatggtc

SEQ ID NO: 296963 - DNA, 34 bp, Artificial Sequence
  Description of Artificial Sequence: Synthetic oligonucleotide
aggaggcctgggtataatactcatgagaatggtc

SEQ ID NO: 296964 - DNA, 33 bp, Artificial Sequence
  Description of Artificial Sequence: Synthetic oligonucleotide
ggaggcctgggtataatactcatgagaatggtc

SEQ ID NO: 296965 - DNA, 33 bp, Artificial Sequence
  Description of Artificial Sequence: Synthetic oligonucleotide
gaggcctgggtataatactcatgagaatggtcg

SEQ ID NO: 296966 - DNA, 35 bp, Artificial Sequence
  Description of Artificial Sequence: Synthetic oligonucleotide
aggcctgggtataatactcatgagaatggtcgaag

SEQ ID NO: 296967 - DNA, 34 bp, Artificial Sequence
  Description of Artificial Sequence: Synthetic oligonucleotide
ggcctgggtataatactcatgagaatggtcgaag

SEQ ID NO: 296968 - DNA, 34 bp, Artificial Sequence
  Description of Artificial Sequence: Synthetic oligonucleotide
gcctgggtataatactcatgagaatggtcgaagg

SEQ ID NO: 296969 - DNA, 20 bp, Artificial Sequence
  Description of Artificial Sequence: Synthetic oligonucleotide
atggcggcgccggcggtgga

SEQ ID NO: 296970 - DNA, 20 bp, Artificial Sequence
  Description of Artificial Sequence: Synthetic oligonucleotide
tggcggcgccggcggtggat

SEQ ID NO: 296971 - DNA, 20 bp, Artificial Sequence
  Description of Artificial Sequence: Synthetic oligonucleotide
ggcggcgccggcggtggatt

SEQ ID NO: 296972 - DNA, 20 bp, Artificial Sequence
  Description of Artificial Sequence: Synthetic oligonucleotide
gcggcgccggcggtggagtt

SEQ ID NO: 296973 - DNA, 20 bp, Artificial Sequence
  Description of Artificial Sequence: Synthetic oligonucleotide
cggcgccggcggtggaggat

SEQ ID NO: 296974 - DNA, 21 bp, Artificial Sequence
  Description of Artificial Sequence: Synthetic oligonucleotide
ggcgccggcggtggaggagtt

SEQ ID NO: 296975 - DNA, 21 bp, Artificial Sequence
  Description of Artificial Sequence: Synthetic oligonucleotide
gcgccggcggtggaggagttc

SEQ ID NO: 296976 - DNA, 22 bp, Artificial Sequence
  Description of Artificial Sequence: Synthetic oligonucleotide
cgccggcggtggaggagttcca

SEQ ID NO: 296977 - DNA, 23 bp, Artificial Sequence
  Description of Artificial Sequence: Synthetic oligonucleotide
gccggcggtggaggagttccaca

SEQ ID NO: 296978 - DNA, 24 bp, Artificial Sequence
  Description of Artificial Sequence: Synthetic oligonucleotide
ccggcggtggaggagttccacaga

SEQ ID NO: 296979 - DNA, 24 bp, Artificial Sequence
  Description of Artificial Sequence: Synthetic oligonucleotide
cggcggtggaggagttccacagag

SEQ ID NO: 296980 - DNA, 24 bp, Artificial Sequence
  Description of Artificial Sequence: Synthetic oligonucleotide
ggcggtggaggagttccacagagc

SEQ ID NO: 296981 - DNA, 24 bp, Artificial Sequence
  Description of Artificial Sequence: Synthetic oligonucleotide
gcggtggaggagttccacagagcc

SEQ ID NO: 296982 - DNA, 25 bp, Artificial Sequence
  Description of Artificial Sequence: Synthetic oligonucleotide
cggtggaggagttccacagagccca

SEQ ID NO: 296983 - DNA, 26 bp, Artificial Sequence
  Description of Artificial Sequence: Synthetic oligonucleotide
ggtggaggagttccacagagcccaga

SEQ ID NO: 296984 - DNA, 27 bp, Artificial Sequence
  Description of Artificial Sequence: Synthetic oligonucleotide
gtggaggagttccacagagcccagact

SEQ ID NO: 296985 - DNA, 27 bp, Artificial Sequence
  Description of Artificial Sequence: Synthetic oligonucleotide
tggaggagttccacagagcccagactc

SEQ ID NO: 296986 - DNA, 27 bp, Artificial Sequence
  Description of Artificial Sequence: Synthetic oligonucleotide
ggaggagttccacagagcccagactct

SEQ ID NO: 296987 - DNA, 28 bp, Artificial Sequence
  Description of Artificial Sequence: Synthetic oligonucleotide
gaggagttccacagagcccagactctac

SEQ ID NO: 296988 - DNA, 29 bp, Artificial Sequence
  Description of Artificial Sequence: Synthetic oligonucleotide
aggagttccacagagcccagactctactc

SEQ ID NO: 296989 - DNA, 28 bp, Artificial Sequence
  Description of Artificial Sequence: Synthetic oligonucleotide
ggagttccacagagcccagactctactc

SEQ ID NO: 296990 - DNA, 29 bp, Artificial Sequence
  Description of Artificial Sequence: Synthetic oligonucleotide
gagttccacagagcccagactctactcac

SEQ ID NO: 296991 - DNA, 29 bp, Artificial Sequence
  Description of Artificial Sequence: Synthetic oligonucleotide
agttccacagagcccagactctactcacc

SEQ ID NO: 296992 - DNA, 28 bp, Artificial Sequence
  Description of Artificial Sequence: Synthetic oligonucleotide
gttccacagagcccagactctactcacc

SEQ ID NO: 296993 - DNA, 29 bp, Artificial Sequence
  Description of Artificial Sequence: Synthetic oligonucleotide
ttccacagagcccagactctactcaccac

SEQ ID NO: 296994 - DNA, 28 bp, Artificial Sequence
  Description of Artificial Sequence: Synthetic oligonucleotide
tccacagagcccagactctactcaccac

SEQ ID NO: 296995 - DNA, 27 bp, Artificial Sequence
  Description of Artificial Sequence: Synthetic oligonucleotide
ccacagagcccagactctactcaccac

SEQ ID NO: 296996 - DNA, 27 bp, Artificial Sequence
  Description of Artificial Sequence: Synthetic oligonucleotide
cacagagcccagactctactcaccacc

SEQ ID NO: 296997 - DNA, 27 bp, Artificial Sequence
  Description of Artificial Sequence: Synthetic oligonucleotide
acagagcccagactctactcaccaccg

SEQ ID NO: 296998 - DNA, 27 bp, Artificial Sequence
  Description of Artificial Sequence: Synthetic oligonucleotide
cagagcccagactctactcaccaccga

SEQ ID NO: 296999 - DNA, 27 bp, Artificial Sequence
  Description of Artificial Sequence: Synthetic oligonucleotide
agagcccagactctactcaccaccgac

SEQ ID NO: 297000 - DNA, 26 bp, Artificial Sequence
  Description of Artificial Sequence: Synthetic oligonucleotide
gagcccagactctactcaccaccgac

SEQ ID NO: 297001 - DNA, 26 bp, Artificial Sequence
  Description of Artificial Sequence: Synthetic oligonucleotide
agcccagactctactcaccaccgacc

SEQ ID NO: 297002 - DNA, 25 bp, Artificial Sequence
  Description of Artificial Sequence: Synthetic oligonucleotide
gcccagactctactcaccaccgacc

SEQ ID NO: 297003 - DNA, 25 bp, Artificial Sequence
  Description of Artificial Sequence: Synthetic oligonucleotide
cccagactctactcaccaccgaccg

SEQ ID NO: 297004 - DNA, 25 bp, Artificial Sequence
  Description of Artificial Sequence: Synthetic oligonucleotide
ccagactctactcaccaccgaccgc

SEQ ID NO: 297005 - DNA, 26 bp, Artificial Sequence
  Description of Artificial Sequence: Synthetic oligonucleotide
cagactctactcaccaccgaccgcga

SEQ ID NO: 297006 - DNA, 26 bp, Artificial Sequence
  Description of Artificial Sequence: Synthetic oligonucleotide
agactctactcaccaccgaccgcgag

SEQ ID NO: 297007 - DNA, 25 bp, Artificial Sequence
  Description of Artificial Sequence: Synthetic oligonucleotide
gactctactcaccaccgaccgcgag

SEQ ID NO: 297008 - DNA, 25 bp, Artificial Sequence
  Description of Artificial Sequence: Synthetic oligonucleotide
actctactcaccaccgaccgcgagg

SEQ ID NO: 297009 - DNA, 24 bp, Artificial Sequence
  Description of Artificial Sequence: Synthetic oligonucleotide
ctctactcaccaccgaccgcgagg

SEQ ID NO: 297010 - DNA, 24 bp, Artificial Sequence
  Description of Artificial Sequence: Synthetic oligonucleotide
tctactcaccaccgaccgcgaggc

SEQ ID NO: 297011 - DNA, 23 bp, Artificial Sequence
  Description of Artificial Sequence: Synthetic oligonucleotide
ctactcaccaccgaccgcgaggc

SEQ ID NO: 297012 - DNA, 24 bp, Artificial Sequence
  Description of Artificial Sequence: Synthetic oligonucleotide
tactcaccaccgaccgcgaggcct

SEQ ID NO: 297013 - DNA, 23 bp, Artificial Sequence
  Description of Artificial Sequence: Synthetic oligonucleotide
actcaccaccgaccgcgaggcct

SEQ ID NO: 297014 - DNA, 22 bp, Artificial Sequence
  Description of Artificial Sequence: Synthetic oligonucleotide
ctcaccaccgaccgcgaggcct

SEQ ID NO: 297015 - DNA, 22 bp, Artificial Sequence
  Description of Artificial Sequence: Synthetic oligonucleotide
tcaccaccgaccgcgaggcctc

SEQ ID NO: 297016 - DNA, 21 bp, Artificial Sequence
  Description of Artificial Sequence: Synthetic oligonucleotide
caccaccgaccgcgaggcctc

SEQ ID NO: 297017 - DNA, 23 bp, Artificial Sequence
  Description of Artificial Sequence: Synthetic oligonucleotide
accaccgaccgcgaggcctcctt

SEQ ID NO: 297018 - DNA, 22 bp, Artificial Sequence
  Description of Artificial Sequence: Synthetic oligonucleotide
ccaccgaccgcgaggcctcctt

SEQ ID NO: 297019 - DNA, 22 bp, Artificial Sequence
  Description of Artificial Sequence: Synthetic oligonucleotide
caccgaccgcgaggcctccttc

SEQ ID NO: 297020 - DNA, 23 bp, Artificial Sequence
  Description of Artificial Sequence: Synthetic oligonucleotide
accgaccgcgaggcctccttcga

SEQ ID NO: 297021 - DNA, 22 bp, Artificial Sequence
  Description of Artificial Sequence: Synthetic oligonucleotide
ccgaccgcgaggcctccttcga

SEQ ID NO: 297022 - DNA, 24 bp, Artificial Sequence
  Description of Artificial Sequence: Synthetic oligonucleotide
cgaccgcgaggcctccttcgacat

SEQ ID NO: 297023 - DNA, 24 bp, Artificial Sequence
  Description of Artificial Sequence: Synthetic oligonucleotide
gaccgcgaggcctccttcgacatc

SEQ ID NO: 297024 - DNA, 25 bp, Artificial Sequence
  Description of Artificial Sequence: Synthetic oligonucleotide
accgcgaggcctccttcgacatcca

SEQ ID NO: 297025 - DNA, 24 bp, Artificial Sequence
  Description of Artificial Sequence: Synthetic oligonucleotide
ccgcgaggcctccttcgacatcca

SEQ ID NO: 297026 - DNA, 24 bp, Artificial Sequence
  Description of Artificial Sequence: Synthetic oligonucleotide
cgcgaggcctccttcgacatccac

SEQ ID NO: 297027 - DNA, 25 bp, Artificial Sequence
  Description of Artificial Sequence: Synthetic oligonucleotide
gcgaggcctccttcgacatccacca

SEQ ID NO: 297028 - DNA, 26 bp, Artificial Sequence
  Description of Artificial Sequence: Synthetic oligonucleotide
cgaggcctccttcgacatccaccact

SEQ ID NO: 297029 - DNA, 26 bp, Artificial Sequence
  Description of Artificial Sequence: Synthetic oligonucleotide
gaggcctccttcgacatccaccactc

SEQ ID NO: 297030 - DNA, 27 bp, Artificial Sequence
  Description of Artificial Sequence: Synthetic oligonucleotide
aggcctccttcgacatccaccactcca

SEQ ID NO: 297031 - DNA, 27 bp, Artificial Sequence
  Description of Artificial Sequence: Synthetic oligonucleotide
ggcctccttcgacatccaccactccat

SEQ ID NO: 297032 - DNA, 27 bp, Artificial Sequence
  Description of Artificial Sequence: Synthetic oligonucleotide
gcctccttcgacatccaccactccatg

SEQ ID NO: 297033 - DNA, 27 bp, Artificial Sequence
  Description of Artificial Sequence: Synthetic oligonucleotide
cctccttcgacatccaccactccatgg

SEQ ID NO: 297034 - DNA, 28 bp, Artificial Sequence
  Description of Artificial Sequence: Synthetic oligonucleotide
ctccttcgacatccaccactccatggtg

SEQ ID NO: 297035 - DNA, 30 bp, Artificial Sequence
  Description of Artificial Sequence: Synthetic oligonucleotide
tccttcgacatccaccactccatggtgaag

SEQ ID NO: 297036 - DNA, 29 bp, Artificial Sequence
  Description of Artificial Sequence: Synthetic oligonucleotide
ccttcgacatccaccactccatggtgaag

SEQ ID NO: 297037 - DNA, 29 bp, Artificial Sequence
  Description of Artificial Sequence: Synthetic oligonucleotide
cttcgacatccaccactccatggtgaagc

SEQ ID NO: 297038 - DNA, 29 bp, Artificial Sequence
  Description of Artificial Sequence: Synthetic oligonucleotide
ttcgacatccaccactccatggtgaagcg

SEQ ID NO: 297039 - DNA, 28 bp, Artificial Sequence
  Description of Artificial Sequence: Synthetic oligonucleotide
tcgacatccaccactccatggtgaagcg

SEQ ID NO: 297040 - DNA, 27 bp, Artificial Sequence
  Description of Artificial Sequence: Synthetic oligonucleotide
cgacatccaccactccatggtgaagcg

SEQ ID NO: 297041 - DNA, 28 bp, Artificial Sequence
  Description of Artificial Sequence: Synthetic oligonucleotide
gacatccaccactccatggtgaagcgtc

SEQ ID NO: 297042 - DNA, 29 bp, Artificial Sequence
  Description of Artificial Sequence: Synthetic oligonucleotide
acatccaccactccatggtgaagcgtcac

SEQ ID NO: 297043 - DNA, 28 bp, Artificial Sequence
  Description of Artificial Sequence: Synthetic oligonucleotide
catccaccactccatggtgaagcgtcac

SEQ ID NO: 297044 - DNA, 31 bp, Artificial Sequence
  Description of Artificial Sequence: Synthetic oligonucleotide
atccaccactccatggtgaagcgtcacattc

SEQ ID NO: 297045 - DNA, 30 bp, Artificial Sequence
  Description of Artificial Sequence: Synthetic oligonucleotide
tccaccactccatggtgaagcgtcacattc

SEQ ID NO: 297046 - DNA, 29 bp, Artificial Sequence
  Description of Artificial Sequence: Synthetic oligonucleotide
ccaccactccatggtgaagcgtcacattc

SEQ ID NO: 297047 - DNA, 30 bp, Artificial Sequence
  Description of Artificial Sequence: Synthetic oligonucleotide
caccactccatggtgaagcgtcacattcag

SEQ ID NO: 297048 - DNA, 30 bp, Artificial Sequence
  Description of Artificial Sequence: Synthetic oligonucleotide
accactccatggtgaagcgtcacattcagg

SEQ ID NO: 297049 - DNA, 29 bp, Artificial Sequence
  Description of Artificial Sequence: Synthetic oligonucleotide
ccactccatggtgaagcgtcacattcagg

SEQ ID NO: 297050 - DNA, 33 bp, Artificial Sequence
  Description of Artificial Sequence: Synthetic oligonucleotide
cactccatggtgaagcgtcacattcaggtaaac

SEQ ID NO: 297051 - DNA, 33 bp, Artificial Sequence
  Description of Artificial Sequence: Synthetic oligonucleotide
actccatggtgaagcgtcacattcaggtaaacg

SEQ ID NO: 297052 - DNA, 32 bp, Artificial Sequence
  Description of Artificial Sequence: Synthetic oligonucleotide
ctccatggtgaagcgtcacattcaggtaaacg

SEQ ID NO: 297053 - DNA, 34 bp, Artificial Sequence
  Description of Artificial Sequence: Synthetic oligonucleotide
tccatggtgaagcgtcacattcaggtaaacgatg

SEQ ID NO: 297054 - DNA, 33 bp, Artificial Sequence
  Description of Artificial Sequence: Synthetic oligonucleotide
ccatggtgaagcgtcacattcaggtaaacgatg

SEQ ID NO: 297055 - DNA, 35 bp, Artificial Sequence
  Description of Artificial Sequence: Synthetic oligonucleotide
catggtgaagcgtcacattcaggtaaacgatgatg

SEQ ID NO: 297056 - DNA, 36 bp, Artificial Sequence
  Description of Artificial Sequence: Synthetic oligonucleotide
atggtgaagcgtcacattcaggtaaacgatgatgag

SEQ ID NO: 297057 - DNA, 35 bp, Artificial Sequence
  Description of Artificial Sequence: Synthetic oligonucleotide
tggtgaagcgtcacattcaggtaaacgatgatgag

SEQ ID NO: 297058 - DNA, 34 bp, Artificial Sequence
  Description of Artificial Sequence: Synthetic oligonucleotide
ggtgaagcgtcacattcaggtaaacgatgatgag

SEQ ID NO: 297059 - DNA, 34 bp, Artificial Sequence
  Description of Artificial Sequence: Synthetic oligonucleotide
gtgaagcgtcacattcaggtaaacgatgatgagg

SEQ ID NO: 297060 - DNA, 34 bp, Artificial Sequence
  Description of Artificial Sequence: Synthetic oligonucleotide
tgaagcgtcacattcaggtaaacgatgatgaggc

SEQ ID NO: 297061 - DNA, 33 bp, Artificial Sequence
  Description of Artificial Sequence: Synthetic oligonucleotide
gaagcgtcacattcaggtaaacgatgatgaggc

SEQ ID NO: 297062 - DNA, 34 bp, Artificial Sequence
  Description of Artificial Sequence: Synthetic oligonucleotide
aagcgtcacattcaggtaaacgatgatgaggcag

SEQ ID NO: 297063 - DNA, 33 bp, Artificial Sequence
  Description of Artificial Sequence: Synthetic oligonucleotide
agcgtcacattcaggtaaacgatgatgaggcag

SEQ ID NO: 297064 - DNA, 32 bp, Artificial Sequence
  Description of Artificial Sequence: Synthetic oligonucleotide
gcgtcacattcaggtaaacgatgatgaggcag

SEQ ID NO: 297065 - DNA, 33 bp, Artificial Sequence
  Description of Artificial Sequence: Synthetic oligonucleotide
cgtcacattcaggtaaacgatgatgaggcagtg

SEQ ID NO: 297066 - DNA, 33 bp, Artificial Sequence
  Description of Artificial Sequence: Synthetic oligonucleotide
gtcacattcaggtaaacgatgatgaggcagtgg

SEQ ID NO: 297067 - DNA, 35 bp, Artificial Sequence
  Description of Artificial Sequence: Synthetic oligonucleotide
tcacattcaggtaaacgatgatgaggcagtggaag

SEQ ID NO: 297068 - DNA, 34 bp, Artificial Sequence
  Description of Artificial Sequence: Synthetic oligonucleotide
cacattcaggtaaacgatgatgaggcagtggaag

SEQ ID NO: 297069 - DNA, 35 bp, Artificial Sequence
  Description of Artificial Sequence: Synthetic oligonucleotide
acattcaggtaaacgatgatgaggcagtggaagtc

SEQ ID NO: 297070 - DNA, 34 bp, Artificial Sequence
  Description of Artificial Sequence: Synthetic oligonucleotide
cattcaggtaaacgatgatgaggcagtggaagtc

SEQ ID NO: 297071 - DNA, 37 bp, Artificial Sequence
  Description of Artificial Sequence: Synthetic oligonucleotide
attcaggtaaacgatgatgaggcagtggaagtcaaag

SEQ ID NO: 297072 - DNA, 36 bp, Artificial Sequence
  Description of Artificial Sequence: Synthetic oligonucleotide
ttcaggtaaacgatgatgaggcagtggaagtcaaag

SEQ ID NO: 297073 - DNA, 35 bp, Artificial Sequence
  Description of Artificial Sequence: Synthetic oligonucleotide
tcaggtaaacgatgatgaggcagtggaagtcaaag

SEQ ID NO: 297074 - DNA, 34 bp, Artificial Sequence
  Description of Artificial Sequence: Synthetic oligonucleotide
caggtaaacgatgatgaggcagtggaagtcaaag

SEQ ID NO: 297075 - DNA, 35 bp, Artificial Sequence
  Description of Artificial Sequence: Synthetic oligonucleotide
aggtaaacgatgatgaggcagtggaagtcaaagtg

SEQ ID NO: 297076 - DNA, 34 bp, Artificial Sequence
  Description of Artificial Sequence: Synthetic oligonucleotide
ggtaaacgatgatgaggcagtggaagtcaaagtg

SEQ ID NO: 297077 - DNA, 34 bp, Artificial Sequence
  Description of Artificial Sequence: Synthetic oligonucleotide
gtaaacgatgatgaggcagtggaagtcaaagtgc

SEQ ID NO: 297078 - DNA, 35 bp, Artificial Sequence
  Description of Artificial Sequence: Synthetic oligonucleotide
taaacgatgatgaggcagtggaagtcaaagtgcag

SEQ ID NO: 297079 - DNA, 34 bp, Artificial Sequence
  Description of Artificial Sequence: Synthetic oligonucleotide
aaacgatgatgaggcagtggaagtcaaagtgcag

SEQ ID NO: 297080 - DNA, 33 bp, Artificial Sequence
  Description of Artificial Sequence: Synthetic oligonucleotide
aacgatgatgaggcagtggaagtcaaagtgcag

SEQ ID NO: 297081 - DNA, 32 bp, Artificial Sequence
  Description of Artificial Sequence: Synthetic oligonucleotide
acgatgatgaggcagtggaagtcaaagtgcag

SEQ ID NO: 297082 - DNA, 31 bp, Artificial Sequence
  Description of Artificial Sequence: Synthetic oligonucleotide
cgatgatgaggcagtggaagtcaaagtgcag

SEQ ID NO: 297083 - DNA, 32 bp, Artificial Sequence
  Description of Artificial Sequence: Synthetic oligonucleotide
gatgatgaggcagtggaagtcaaagtgcagag

SEQ ID NO: 297084 - DNA, 32 bp, Artificial Sequence
  Description of Artificial Sequence: Synthetic oligonucleotide
atgatgaggcagtggaagtcaaagtgcagagc

SEQ ID NO: 297085 - DNA, 31 bp, Artificial Sequence
  Description of Artificial Sequence: Synthetic oligonucleotide
tgatgaggcagtggaagtcaaagtgcagagc

SEQ ID NO: 297086 - DNA, 30 bp, Artificial Sequence
  Description of Artificial Sequence: Synthetic oligonucleotide
gatgaggcagtggaagtcaaagtgcagagc

SEQ ID NO: 297087 - DNA, 32 bp, Artificial Sequence
  Description of Artificial Sequence: Synthetic oligonucleotide
atgaggcagtggaagtcaaagtgcagagcatg

SEQ ID NO: 297088 - DNA, 31 bp, Artificial Sequence
  Description of Artificial Sequence: Synthetic oligonucleotide
tgaggcagtggaagtcaaagtgcagagcatg

SEQ ID NO: 297089 - DNA, 30 bp, Artificial Sequence
  Description of Artificial Sequence: Synthetic oligonucleotide
gaggcagtggaagtcaaagtgcagagcatg

SEQ ID NO: 297090 - DNA, 30 bp, Artificial Sequence
  Description of Artificial Sequence: Synthetic oligonucleotide
aggcagtggaagtcaaagtgcagagcatgc

SEQ ID NO: 297091 - DNA, 29 bp, Artificial Sequence
  Description of Artificial Sequence: Synthetic oligonucleotide
ggcagtggaagtcaaagtgcagagcatgc

SEQ ID NO: 297092 - DNA, 30 bp, Artificial Sequence
  Description of Artificial Sequence: Synthetic oligonucleotide
gcagtggaagtcaaagtgcagagcatgctg

SEQ ID NO: 297093 - DNA, 30 bp, Artificial Sequence
  Description of Artificial Sequence: Synthetic oligonucleotide
cagtggaagtcaaagtgcagagcatgctgg

SEQ ID NO: 297094 - DNA, 32 bp, Artificial Sequence
  Description of Artificial Sequence: Synthetic oligonucleotide
agtggaagtcaaagtgcagagcatgctggaac

SEQ ID NO: 297095 - DNA, 31 bp, Artificial Sequence
  Description of Artificial Sequence: Synthetic oligonucleotide
gtggaagtcaaagtgcagagcatgctggaac

SEQ ID NO: 297096 - DNA, 32 bp, Artificial Sequence
  Description of Artificial Sequence: Synthetic oligonucleotide
tggaagtcaaagtgcagagcatgctggaactg

SEQ ID NO: 297097 - DNA, 31 bp, Artificial Sequence
  Description of Artificial Sequence: Synthetic oligonucleotide
ggaagtcaaagtgcagagcatgctggaactg

SEQ ID NO: 297098 - DNA, 31 bp, Artificial Sequence
  Description of Artificial Sequence: Synthetic oligonucleotide
gaagtcaaagtgcagagcatgctggaactgc

SEQ ID NO: 297099 - DNA, 31 bp, Artificial Sequence
  Description of Artificial Sequence: Synthetic oligonucleotide
aagtcaaagtgcagagcatgctggaactgcg

SEQ ID NO: 297100 - DNA, 30 bp, Artificial Sequence
  Description of Artificial Sequence: Synthetic oligonucleotide
agtcaaagtgcagagcatgctggaactgcg

SEQ ID NO: 297101 - DNA, 29 bp, Artificial Sequence
  Description of Artificial Sequence: Synthetic oligonucleotide
gtcaaagtgcagagcatgctggaactgcg

SEQ ID NO: 297102 - DNA, 31 bp, Artificial Sequence
  Description of Artificial Sequence: Synthetic oligonucleotide
tcaaagtgcagagcatgctggaactgcgatc

SEQ ID NO: 297103 - DNA, 30 bp, Artificial Sequence
  Description of Artificial Sequence: Synthetic oligonucleotide
caaagtgcagagcatgctggaactgcgatc

SEQ ID NO: 297104 - DNA, 31 bp, Artificial Sequence
  Description of Artificial Sequence: Synthetic oligonucleotide
aaagtgcagagcatgctggaactgcgatctc

SEQ ID NO: 297105 - DNA, 30 bp, Artificial Sequence
  Description of Artificial Sequence: Synthetic oligonucleotide
aagtgcagagcatgctggaactgcgatctc

SEQ ID NO: 297106 - DNA, 29 bp, Artificial Sequence
  Description of Artificial Sequence: Synthetic oligonucleotide
agtgcagagcatgctggaactgcgatctc

SEQ ID NO: 297107 - DNA, 28 bp, Artificial Sequence
  Description of Artificial Sequence: Synthetic oligonucleotide
gtgcagagcatgctggaactgcgatctc

SEQ ID NO: 297108 - DNA, 29 bp, Artificial Sequence
  Description of Artificial Sequence: Synthetic oligonucleotide
tgcagagcatgctggaactgcgatctctc

SEQ ID NO: 297109 - DNA, 28 bp, Artificial Sequence
  Description of Artificial Sequence: Synthetic oligonucleotide
gcagagcatgctggaactgcgatctctc

SEQ ID NO: 297110 - DNA, 28 bp, Artificial Sequence
  Description of Artificial Sequence: Synthetic oligonucleotide
cagagcatgctggaactgcgatctctcc

SEQ ID NO: 297111 - DNA, 29 bp, Artificial Sequence
  Description of Artificial Sequence: Synthetic oligonucleotide
agagcatgctggaactgcgatctctccag

SEQ ID NO: 297112 - DNA, 28 bp, Artificial Sequence
  Description of Artificial Sequence: Synthetic oligonucleotide
gagcatgctggaactgcgatctctccag

SEQ ID NO: 297113 - DNA, 28 bp, Artificial Sequence
  Description of Artificial Sequence: Synthetic oligonucleotide
agcatgctggaactgcgatctctccagg

SEQ ID NO: 297114 - DNA, 27 bp, Artificial Sequence
  Description of Artificial Sequence: Synthetic oligonucleotide
gcatgctggaactgcgatctctccagg

SEQ ID NO: 297115 - DNA, 27 bp, Artificial Sequence
  Description of Artificial Sequence: Synthetic oligonucleotide
catgctggaactgcgatctctccaggc

SEQ ID NO: 297116 - DNA, 30 bp, Artificial Sequence
  Description of Artificial Sequence: Synthetic oligonucleotide
atgctggaactgcgatctctccaggcaaag

SEQ ID NO: 297117 - DNA, 29 bp, Artificial Sequence
  Description of Artificial Sequence: Synthetic oligonucleotide
tgctggaactgcgatctctccaggcaaag

SEQ ID NO: 297118 - DNA, 28 bp, Artificial Sequence
  Description of Artificial Sequence: Synthetic oligonucleotide
gctggaactgcgatctctccaggcaaag

SEQ ID NO: 297119 - DNA, 29 bp, Artificial Sequence
  Description of Artificial Sequence: Synthetic oligonucleotide
ctggaactgcgatctctccaggcaaagac

SEQ ID NO: 297120 - DNA, 30 bp, Artificial Sequence
  Description of Artificial Sequence: Synthetic oligonucleotide
tggaactgcgatctctccaggcaaagacag

SEQ ID NO: 297121 - DNA, 29 bp, Artificial Sequence
  Description of Artificial Sequence: Synthetic oligonucleotide
ggaactgcgatctctccaggcaaagacag

SEQ ID NO: 297122 - DNA, 29 bp, Artificial Sequence
  Description of Artificial Sequence: Synthetic oligonucleotide
gaactgcgatctctccaggcaaagacagg

SEQ ID NO: 297123 - DNA, 30 bp, Artificial Sequence
  Description of Artificial Sequence: Synthetic oligonucleotide
aactgcgatctctccaggcaaagacaggac

SEQ ID NO: 297124 - DNA, 29 bp, Artificial Sequence
  Description of Artificial Sequence: Synthetic oligonucleotide
actgcgatctctccaggcaaagacaggac

SEQ ID NO: 297125 - DNA, 28 bp, Artificial Sequence
  Description of Artificial Sequence: Synthetic oligonucleotide
ctgcgatctctccaggcaaagacaggac

SEQ ID NO: 297126 - DNA, 30 bp, Artificial Sequence
  Description of Artificial Sequence: Synthetic oligonucleotide
tgcgatctctccaggcaaagacaggacaag

SEQ ID NO: 297127 - DNA, 29 bp, Artificial Sequence
  Description of Artificial Sequence: Synthetic oligonucleotide
gcgatctctccaggcaaagacaggacaag

SEQ ID NO: 297128 - DNA, 29 bp, Artificial Sequence
  Description of Artificial Sequence: Synthetic oligonucleotide
cgatctctccaggcaaagacaggacaagc

SEQ ID NO: 297129 - DNA, 30 bp, Artificial Sequence
  Description of Artificial Sequence: Synthetic oligonucleotide
gatctctccaggcaaagacaggacaagctc

SEQ ID NO: 297130 - DNA, 30 bp, Artificial Sequence
  Description of Artificial Sequence: Synthetic oligonucleotide
atctctccaggcaaagacaggacaagctcc

SEQ ID NO: 297131 - DNA, 29 bp, Artificial Sequence
  Description of Artificial Sequence: Synthetic oligonucleotide
tctctccaggcaaagacaggacaagctcc

SEQ ID NO: 297132 - DNA, 28 bp, Artificial Sequence
  Description of Artificial Sequence: Synthetic oligonucleotide
ctctccaggcaaagacaggacaagctcc

SEQ ID NO: 297133 - DNA, 29 bp, Artificial Sequence
  Description of Artificial Sequence: Synthetic oligonucleotide
tctccaggcaaagacaggacaagctccag

SEQ ID NO: 297134 - DNA, 28 bp, Artificial Sequence
  Description of Artificial Sequence: Synthetic oligonucleotide
ctccaggcaaagacaggacaagctccag

SEQ ID NO: 297135 - DNA, 29 bp, Artificial Sequence
  Description of Artificial Sequence: Synthetic oligonucleotide
tccaggcaaagacaggacaagctccagag

SEQ ID NO: 297136 - DNA, 28 bp, Artificial Sequence
  Description of Artificial Sequence: Synthetic oligonucleotide
ccaggcaaagacaggacaagctccagag

SEQ ID NO: 297137 - DNA, 28 bp, Artificial Sequence
  Description of Artificial Sequence: Synthetic oligonucleotide
caggcaaagacaggacaagctccagagc

SEQ ID NO: 297138 - DNA, 30 bp, Artificial Sequence
  Description of Artificial Sequence: Synthetic oligonucleotide
aggcaaagacaggacaagctccagagcttg

SEQ ID NO: 297139 - DNA, 29 bp, Artificial Sequence
  Description of Artificial Sequence: Synthetic oligonucleotide
ggcaaagacaggacaagctccagagcttg

SEQ ID NO: 297140 - DNA, 29 bp, Artificial Sequence
  Description of Artificial Sequence: Synthetic oligonucleotide
gcaaagacaggacaagctccagagcttgc

SEQ ID NO: 297141 - DNA, 30 bp, Artificial Sequence
  Description of Artificial Sequence: Synthetic oligonucleotide
caaagacaggacaagctccagagcttgcag

SEQ ID NO: 297142 - DNA, 30 bp, Artificial Sequence
  Description of Artificial Sequence: Synthetic oligonucleotide
aaagacaggacaagctccagagcttgcagg

SEQ ID NO: 297143 - DNA, 29 bp, Artificial Sequence
  Description of Artificial Sequence: Synthetic oligonucleotide
aagacaggacaagctccagagcttgcagg

SEQ ID NO: 297144 - DNA, 28 bp, Artificial Sequence
  Description of Artificial Sequence: Synthetic oligonucleotide
agacaggacaagctccagagcttgcagg

SEQ ID NO: 297145 - DNA, 27 bp, Artificial Sequence
  Description of Artificial Sequence: Synthetic oligonucleotide
gacaggacaagctccagagcttgcagg

SEQ ID NO: 297146 - DNA, 28 bp, Artificial Sequence
  Description of Artificial Sequence: Synthetic oligonucleotide
acaggacaagctccagagcttgcaggac

SEQ ID NO: 297147 - DNA, 27 bp, Artificial Sequence
  Description of Artificial Sequence: Synthetic oligonucleotide
caggacaagctccagagcttgcaggac

SEQ ID NO: 297148 - DNA, 28 bp, Artificial Sequence
  Description of Artificial Sequence: Synthetic oligonucleotide
aggacaagctccagagcttgcaggactc

SEQ ID NO: 297149 - DNA, 27 bp, Artificial Sequence
  Description of Artificial Sequence: Synthetic oligonucleotide
ggacaagctccagagcttgcaggactc

SEQ ID NO: 297150 - DNA, 27 bp, Artificial Sequence
  Description of Artificial Sequence: Synthetic oligonucleotide
gacaagctccagagcttgcaggactcc

SEQ ID NO: 297151 - DNA, 28 bp, Artificial Sequence
  Description of Artificial Sequence: Synthetic oligonucleotide
acaagctccagagcttgcaggactcctc

SEQ ID NO: 297152 - DNA, 27 bp, Artificial Sequence
  Description of Artificial Sequence: Synthetic oligonucleotide
caagctccagagcttgcaggactcctc

SEQ ID NO: 297153 - DNA, 29 bp, Artificial Sequence
  Description of Artificial Sequence: Synthetic oligonucleotide
aagctccagagcttgcaggactcctcaag

SEQ ID NO: 297154 - DNA, 28 bp, Artificial Sequence
  Description of Artificial Sequence: Synthetic oligonucleotide
agctccagagcttgcaggactcctcaag

SEQ ID NO: 297155 - DNA, 27 bp, Artificial Sequence
  Description of Artificial Sequence: Synthetic oligonucleotide
gctccagagcttgcaggactcctcaag

SEQ ID NO: 297156 - DNA, 30 bp, Artificial Sequence
  Description of Artificial Sequence: Synthetic oligonucleotide
ctccagagcttgcaggactcctcaagtatg

SEQ ID NO: 297157 - DNA, 32 bp, Artificial Sequence
  Description of Artificial Sequence: Synthetic oligonucleotide
tccagagcttgcaggactcctcaagtatgtag

SEQ ID NO: 297158 - DNA, 31 bp, Artificial Sequence
  Description of Artificial Sequence: Synthetic oligonucleotide
ccagagcttgcaggactcctcaagtatgtag

SEQ ID NO: 297159 - DNA, 31 bp, Artificial Sequence
  Description of Artificial Sequence: Synthetic oligonucleotide
cagagcttgcaggactcctcaagtatgtagg

SEQ ID NO: 297160 - DNA, 32 bp, Artificial Sequence
  Description of Artificial Sequence: Synthetic oligonucleotide
agagcttgcaggactcctcaagtatgtaggac

SEQ ID NO: 297161 - DNA, 31 bp, Artificial Sequence
  Description of Artificial Sequence: Synthetic oligonucleotide
gagcttgcaggactcctcaagtatgtaggac

SEQ ID NO: 297162 - DNA, 31 bp, Artificial Sequence
  Description of Artificial Sequence: Synthetic oligonucleotide
agcttgcaggactcctcaagtatgtaggacc

SEQ ID NO: 297163 - DNA, 30 bp, Artificial Sequence
  Description of Artificial Sequence: Synthetic oligonucleotide
gcttgcaggactcctcaagtatgtaggacc

SEQ ID NO: 297164 - DNA, 30 bp, Artificial Sequence
  Description of Artificial Sequence: Synthetic oligonucleotide
cttgcaggactcctcaagtatgtaggaccc

SEQ ID NO: 297165 - DNA, 32 bp, Artificial Sequence
  Description of Artificial Sequence: Synthetic oligonucleotide
ttgcaggactcctcaagtatgtaggacccttc

SEQ ID NO: 297166 - DNA, 31 bp, Artificial Sequence
  Description of Artificial Sequence: Synthetic oligonucleotide
tgcaggactcctcaagtatgtaggacccttc

SEQ ID NO: 297167 - DNA, 30 bp, Artificial Sequence
  Description of Artificial Sequence: Synthetic oligonucleotide
gcaggactcctcaagtatgtaggacccttc

SEQ ID NO: 297168 - DNA, 32 bp, Artificial Sequence
  Description of Artificial Sequence: Synthetic oligonucleotide
caggactcctcaagtatgtaggacccttctag

SEQ ID NO: 297169 - DNA, 36 bp, Artificial Sequence
  Description of Artificial Sequence: Synthetic oligonucleotide
aggactcctcaagtatgtaggacccttctagaattc

SEQ ID NO: 297170 - DNA, 35 bp, Artificial Sequence
  Description of Artificial Sequence: Synthetic oligonucleotide
ggactcctcaagtatgtaggacccttctagaattc

SEQ ID NO: 297171 - DNA, 35 bp, Artificial Sequence
  Description of Artificial Sequence: Synthetic oligonucleotide
gactcctcaagtatgtaggacccttctagaattcc

SEQ ID NO: 297172 - DNA, 37 bp, Artificial Sequence
  Description of Artificial Sequence: Synthetic oligonucleotide
actcctcaagtatgtaggacccttctagaattccatg

SEQ ID NO: 297173 - DNA, 36 bp, Artificial Sequence
  Description of Artificial Sequence: Synthetic oligonucleotide
ctcctcaagtatgtaggacccttctagaattccatg

SEQ ID NO: 297174 - DNA, 37 bp, Artificial Sequence
  Description of Artificial Sequence: Synthetic oligonucleotide
tcctcaagtatgtaggacccttctagaattccatgag

SEQ ID NO: 297175 - DNA, 36 bp, Artificial Sequence
  Description of Artificial Sequence: Synthetic oligonucleotide
cctcaagtatgtaggacccttctagaattccatgag

SEQ ID NO: 297176 - DNA, 36 bp, Artificial Sequence
  Description of Artificial Sequence: Synthetic oligonucleotide
ctcaagtatgtaggacccttctagaattccatgagc

SEQ ID NO: 297177 - DNA, 38 bp, Artificial Sequence
  Description of Artificial Sequence: Synthetic oligonucleotide
tcaagtatgtaggacccttctagaattccatgagcaag

SEQ ID NO: 297178 - DNA, 37 bp, Artificial Sequence
  Description of Artificial Sequence: Synthetic oligonucleotide
caagtatgtaggacccttctagaattccatgagcaag

SEQ ID NO: 297179 - DNA, 37 bp, Artificial Sequence
  Description of Artificial Sequence: Synthetic oligonucleotide
aagtatgtaggacccttctagaattccatgagcaagg

SEQ ID NO: 297180 - DNA, 36 bp, Artificial Sequence
  Description of Artificial Sequence: Synthetic oligonucleotide
agtatgtaggacccttctagaattccatgagcaagg

SEQ ID NO: 297181 - DNA, 35 bp, Artificial Sequence
  Description of Artificial Sequence: Synthetic oligonucleotide
gtatgtaggacccttctagaattccatgagcaagg

SEQ ID NO: 297182 - DNA, 35 bp, Artificial Sequence
  Description of Artificial Sequence: Synthetic oligonucleotide
tatgtaggacccttctagaattccatgagcaaggc

SEQ ID NO: 297183 - DNA, 34 bp, Artificial Sequence
  Description of Artificial Sequence: Synthetic oligonucleotide
atgtaggacccttctagaattccatgagcaaggc

SEQ ID NO: 297184 - DNA, 33 bp, Artificial Sequence
  Description of Artificial Sequence: Synthetic oligonucleotide
tgtaggacccttctagaattccatgagcaaggc

SEQ ID NO: 297185 - DNA, 32 bp, Artificial Sequence
  Description of Artificial Sequence: Synthetic oligonucleotide
gtaggacccttctagaattccatgagcaaggc

SEQ ID NO: 297186 - DNA, 36 bp, Artificial Sequence
  Description of Artificial Sequence: Synthetic oligonucleotide
taggacccttctagaattccatgagcaaggcttaag

SEQ ID NO: 297187 - DNA, 35 bp, Artificial Sequence
  Description of Artificial Sequence: Synthetic oligonucleotide
aggacccttctagaattccatgagcaaggcttaag

SEQ ID NO: 297188 - DNA, 34 bp, Artificial Sequence
  Description of Artificial Sequence: Synthetic oligonucleotide
ggacccttctagaattccatgagcaaggcttaag

SEQ ID NO: 297189 - DNA, 34 bp, Artificial Sequence
  Description of Artificial Sequence: Synthetic oligonucleotide
gacccttctagaattccatgagcaaggcttaagc

SEQ ID NO: 297190 - DNA, 35 bp, Artificial Sequence
  Description of Artificial Sequence: Synthetic oligonucleotide
acccttctagaattccatgagcaaggcttaagcag

SEQ ID NO: 297191 - DNA, 34 bp, Artificial Sequence
  Description of Artificial Sequence: Synthetic oligonucleotide
cccttctagaattccatgagcaaggcttaagcag

SEQ ID NO: 297192 - DNA, 34 bp, Artificial Sequence
  Description of Artificial Sequence: Synthetic oligonucleotide
ccttctagaattccatgagcaaggcttaagcagc

SEQ ID NO: 297193 - DNA, 35 bp, Artificial Sequence
  Description of Artificial Sequence: Synthetic oligonucleotide
cttctagaattccatgagcaaggcttaagcagctc

SEQ ID NO: 297194 - DNA, 35 bp, Artificial Sequence
  Description of Artificial Sequence: Synthetic oligonucleotide
ttctagaattccatgagcaaggcttaagcagctcc

SEQ ID NO: 297195 - DNA, 34 bp, Artificial Sequence
  Description of Artificial Sequence: Synthetic oligonucleotide
tctagaattccatgagcaaggcttaagcagctcc

SEQ ID NO: 297196 - DNA, 33 bp, Artificial Sequence
  Description of Artificial Sequence: Synthetic oligonucleotide
ctagaattccatgagcaaggcttaagcagctcc

SEQ ID NO: 297197 - DNA, 33 bp, Artificial Sequence
  Description of Artificial Sequence: Synthetic oligonucleotide
tagaattccatgagcaaggcttaagcagctccc

SEQ ID NO: 297198 - DNA, 32 bp, Artificial Sequence
  Description of Artificial Sequence: Synthetic oligonucleotide
agaattccatgagcaaggcttaagcagctccc

SEQ ID NO: 297199 - DNA, 31 bp, Artificial Sequence
  Description of Artificial Sequence: Synthetic oligonucleotide
gaattccatgagcaaggcttaagcagctccc

SEQ ID NO: 297200 - DNA, 31 bp, Artificial Sequence
  Description of Artificial Sequence: Synthetic oligonucleotide
aattccatgagcaaggcttaagcagctcccc

SEQ ID NO: 297201 - DNA, 30 bp, Artificial Sequence
  Description of Artificial Sequence: Synthetic oligonucleotide
attccatgagcaaggcttaagcagctcccc

SEQ ID NO: 297202 - DNA, 29 bp, Artificial Sequence
  Description of Artificial Sequence: Synthetic oligonucleotide
ttccatgagcaaggcttaagcagctcccc

SEQ ID NO: 297203 - DNA, 28 bp, Artificial Sequence
  Description of Artificial Sequence: Synthetic oligonucleotide
tccatgagcaaggcttaagcagctcccc

SEQ ID NO: 297204 - DNA, 27 bp, Artificial Sequence
  Description of Artificial Sequence: Synthetic oligonucleotide
ccatgagcaaggcttaagcagctcccc

SEQ ID NO: 297205 - DNA, 28 bp, Artificial Sequence
  Description of Artificial Sequence: Synthetic oligonucleotide
catgagcaaggcttaagcagctcccctg

SEQ ID NO: 297206 - DNA, 28 bp, Artificial Sequence
  Description of Artificial Sequence: Synthetic oligonucleotide
atgagcaaggcttaagcagctcccctgg

SEQ ID NO: 297207 - DNA, 27 bp, Artificial Sequence
  Description of Artificial Sequence: Synthetic oligonucleotide
tgagcaaggcttaagcagctcccctgg

SEQ ID NO: 297208 - DNA, 27 bp, Artificial Sequence
  Description of Artificial Sequence: Synthetic oligonucleotide
gagcaaggcttaagcagctcccctggt

SEQ ID NO: 297209 - DNA, 27 bp, Artificial Sequence
  Description of Artificial Sequence: Synthetic oligonucleotide
agcaaggcttaagcagctcccctggtc

SEQ ID NO: 297210 - DNA, 26 bp, Artificial Sequence
  Description of Artificial Sequence: Synthetic oligonucleotide
gcaaggcttaagcagctcccctggtc

SEQ ID NO: 297211 - DNA, 26 bp, Artificial Sequence
  Description of Artificial Sequence: Synthetic oligonucleotide
caaggcttaagcagctcccctggtcc

SEQ ID NO: 297212 - DNA, 27 bp, Artificial Sequence
  Description of Artificial Sequence: Synthetic oligonucleotide
aaggcttaagcagctcccctggtccgt

SEQ ID NO: 297213 - DNA, 27 bp, Artificial Sequence
  Description of Artificial Sequence: Synthetic oligonucleotide
aggcttaagcagctcccctggtccgtt

SEQ ID NO: 297214 - DNA, 26 bp, Artificial Sequence
  Description of Artificial Sequence: Synthetic oligonucleotide
ggcttaagcagctcccctggtccgtt

SEQ ID NO: 297215 - DNA, 27 bp, Artificial Sequence
  Description of Artificial Sequence: Synthetic oligonucleotide
gcttaagcagctcccctggtccgttct

SEQ ID NO: 297216 - DNA, 27 bp, Artificial Sequence
  Description of Artificial Sequence: Synthetic oligonucleotide
cttaagcagctcccctggtccgttctc

SEQ ID NO: 297217 - DNA, 29 bp, Artificial Sequence
  Description of Artificial Sequence: Synthetic oligonucleotide
ttaagcagctcccctggtccgttctcttc

SEQ ID NO: 297218 - DNA, 28 bp, Artificial Sequence
  Description of Artificial Sequence: Synthetic oligonucleotide
taagcagctcccctggtccgttctcttc

SEQ ID NO: 297219 - DNA, 27 bp, Artificial Sequence
  Description of Artificial Sequence: Synthetic oligonucleotide
aagcagctcccctggtccgttctcttc

SEQ ID NO: 297220 - DNA, 27 bp, Artificial Sequence
  Description of Artificial Sequence: Synthetic oligonucleotide
agcagctcccctggtccgttctcttct

SEQ ID NO: 297221 - DNA, 27 bp, Artificial Sequence
  Description of Artificial Sequence: Synthetic oligonucleotide
gcagctcccctggtccgttctcttctt

SEQ ID NO: 297222 - DNA, 27 bp, Artificial Sequence
  Description of Artificial Sequence: Synthetic oligonucleotide
cagctcccctggtccgttctcttcttc

SEQ ID NO: 297223 - DNA, 29 bp, Artificial Sequence
  Description of Artificial Sequence: Synthetic oligonucleotide
agctcccctggtccgttctcttcttcatc

SEQ ID NO: 297224 - DNA, 28 bp, Artificial Sequence
  Description of Artificial Sequence: Synthetic oligonucleotide
gctcccctggtccgttctcttcttcatc

SEQ ID NO: 297225 - DNA, 29 bp, Artificial Sequence
  Description of Artificial Sequence: Synthetic oligonucleotide
ctcccctggtccgttctcttcttcatctg

SEQ ID NO: 297226 - DNA, 32 bp, Artificial Sequence
  Description of Artificial Sequence: Synthetic oligonucleotide
tcccctggtccgttctcttcttcatctgtttc

SEQ ID NO: 297227 - DNA, 31 bp, Artificial Sequence
  Description of Artificial Sequence: Synthetic oligonucleotide
cccctggtccgttctcttcttcatctgtttc

SEQ ID NO: 297228 - DNA, 33 bp, Artificial Sequence
  Description of Artificial Sequence: Synthetic oligonucleotide
ccctggtccgttctcttcttcatctgtttcatg

SEQ ID NO: 297229 - DNA, 37 bp, Artificial Sequence
  Description of Artificial Sequence: Synthetic oligonucleotide
cctggtccgttctcttcttcatctgtttcatgatatg

SEQ ID NO: 297230 - DNA, 37 bp, Artificial Sequence
  Description of Artificial Sequence: Synthetic oligonucleotide
ctggtccgttctcttcttcatctgtttcatgatatgg

SEQ ID NO: 297231 - DNA, 39 bp, Artificial Sequence
  Description of Artificial Sequence: Synthetic oligonucleotide
tggtccgttctcttcttcatctgtttcatgatatggatg

SEQ ID NO: 297232 - DNA, 38 bp, Artificial Sequence
  Description of Artificial Sequence: Synthetic oligonucleotide
ggtccgttctcttcttcatctgtttcatgatatggatg

SEQ ID NO: 297233 - DNA, 38 bp, Artificial Sequence
  Description of Artificial Sequence: Synthetic oligonucleotide
gtccgttctcttcttcatctgtttcatgatatggatgc

SEQ ID NO: 297234 - DNA, 39 bp, Artificial Sequence
  Description of Artificial Sequence: Synthetic oligonucleotide
tccgttctcttcttcatctgtttcatgatatggatgcag

SEQ ID NO: 297235 - DNA, 38 bp, Artificial Sequence
  Description of Artificial Sequence: Synthetic oligonucleotide
ccgttctcttcttcatctgtttcatgatatggatgcag

SEQ ID NO: 297236 - DNA, 38 bp, Artificial Sequence
  Description of Artificial Sequence: Synthetic oligonucleotide
cgttctcttcttcatctgtttcatgatatggatgcagc

SEQ ID NO: 297237 - DNA, 40 bp, Artificial Sequence
  Description of Artificial Sequence: Synthetic oligonucleotide
gttctcttcttcatctgtttcatgatatggatgcagctac

SEQ ID NO: 297238 - DNA, 41 bp, Artificial Sequence
  Description of Artificial Sequence: Synthetic oligonucleotide
ttctcttcttcatctgtttcatgatatggatgcagctacac

SEQ ID NO: 297239 - DNA, 40 bp, Artificial Sequence
  Description of Artificial Sequence: Synthetic oligonucleotide
tctcttcttcatctgtttcatgatatggatgcagctacac

SEQ ID NO: 297240 - DNA, 39 bp, Artificial Sequence
  Description of Artificial Sequence: Synthetic oligonucleotide
ctcttcttcatctgtttcatgatatggatgcagctacac

SEQ ID NO: 297241 - DNA, 39 bp, Artificial Sequence
  Description of Artificial Sequence: Synthetic oligonucleotide
tcttcttcatctgtttcatgatatggatgcagctacacg

SEQ ID NO: 297242 - DNA, 38 bp, Artificial Sequence
  Description of Artificial Sequence: Synthetic oligonucleotide
cttcttcatctgtttcatgatatggatgcagctacacg

SEQ ID NO: 297243 - DNA, 38 bp, Artificial Sequence
  Description of Artificial Sequence: Synthetic oligonucleotide
ttcttcatctgtttcatgatatggatgcagctacacgg

SEQ ID NO: 297244 - DNA, 37 bp, Artificial Sequence
  Description of Artificial Sequence: Synthetic oligonucleotide
tcttcatctgtttcatgatatggatgcagctacacgg

SEQ ID NO: 297245 - DNA, 36 bp, Artificial Sequence
  Description of Artificial Sequence: Synthetic oligonucleotide
cttcatctgtttcatgatatggatgcagctacacgg

SEQ ID NO: 297246 - DNA, 36 bp, Artificial Sequence
  Description of Artificial Sequence: Synthetic oligonucleotide
ttcatctgtttcatgatatggatgcagctacacggc

SEQ ID NO: 297247 - DNA, 35 bp, Artificial Sequence
  Description of Artificial Sequence: Synthetic oligonucleotide
tcatctgtttcatgatatggatgcagctacacggc

SEQ ID NO: 297248 - DNA, 34 bp, Artificial Sequence
  Description of Artificial Sequence: Synthetic oligonucleotide
catctgtttcatgatatggatgcagctacacggc

SEQ ID NO: 297249 - DNA, 35 bp, Artificial Sequence
  Description of Artificial Sequence: Synthetic oligonucleotide
atctgtttcatgatatggatgcagctacacggcag

SEQ ID NO: 297250 - DNA, 34 bp, Artificial Sequence
  Description of Artificial Sequence: Synthetic oligonucleotide
tctgtttcatgatatggatgcagctacacggcag

SEQ ID NO: 297251 - DNA, 33 bp, Artificial Sequence
  Description of Artificial Sequence: Synthetic oligonucleotide
ctgtttcatgatatggatgcagctacacggcag

SEQ ID NO: 297252 - DNA, 33 bp, Artificial Sequence
  Description of Artificial Sequence: Synthetic oligonucleotide
tgtttcatgatatggatgcagctacacggcagg

SEQ ID NO: 297253 - DNA, 32 bp, Artificial Sequence
  Description of Artificial Sequence: Synthetic oligonucleotide
gtttcatgatatggatgcagctacacggcagg

SEQ ID NO: 297254 - DNA, 33 bp, Artificial Sequence
  Description of Artificial Sequence: Synthetic oligonucleotide
tttcatgatatggatgcagctacacggcaggag

SEQ ID NO: 297255 - DNA, 32 bp, Artificial Sequence
  Description of Artificial Sequence: Synthetic oligonucleotide
ttcatgatatggatgcagctacacggcaggag

SEQ ID NO: 297256 - DNA, 31 bp, Artificial Sequence
  Description of Artificial Sequence: Synthetic oligonucleotide
tcatgatatggatgcagctacacggcaggag

SEQ ID NO: 297257 - DNA, 30 bp, Artificial Sequence
  Description of Artificial Sequence: Synthetic oligonucleotide
catgatatggatgcagctacacggcaggag

SEQ ID NO: 297258 - DNA, 30 bp, Artificial Sequence
  Description of Artificial Sequence: Synthetic oligonucleotide
atgatatggatgcagctacacggcaggagg

SEQ ID NO: 297259 - DNA, 29 bp, Artificial Sequence
  Description of Artificial Sequence: Synthetic oligonucleotide
tgatatggatgcagctacacggcaggagg

SEQ ID NO: 297260 - DNA, 28 bp, Artificial Sequence
  Description of Artificial Sequence: Synthetic oligonucleotide
gatatggatgcagctacacggcaggagg

SEQ ID NO: 297261 - DNA, 29 bp, Artificial Sequence
  Description of Artificial Sequence: Synthetic oligonucleotide
atatggatgcagctacacggcaggaggac

SEQ ID NO: 297262 - DNA, 28 bp, Artificial Sequence
  Description of Artificial Sequence: Synthetic oligonucleotide
tatggatgcagctacacggcaggaggac

SEQ ID NO: 297263 - DNA, 27 bp, Artificial Sequence
  Description of Artificial Sequence: Synthetic oligonucleotide
atggatgcagctacacggcaggaggac

SEQ ID NO: 297264 - DNA, 26 bp, Artificial Sequence
  Description of Artificial Sequence: Synthetic oligonucleotide
tggatgcagctacacggcaggaggac

SEQ ID NO: 297265 - DNA, 25 bp, Artificial Sequence
  Description of Artificial Sequence: Synthetic oligonucleotide
ggatgcagctacacggcaggaggac

SEQ ID NO: 297266 - DNA, 26 bp, Artificial Sequence
  Description of Artificial Sequence: Synthetic oligonucleotide
gatgcagctacacggcaggaggacga

SEQ ID NO: 297267 - DNA, 26 bp, Artificial Sequence
  Description of Artificial Sequence: Synthetic oligonucleotide
atgcagctacacggcaggaggacgag

SEQ ID NO: 297268 - DNA, 25 bp, Artificial Sequence
  Description of Artificial Sequence: Synthetic oligonucleotide
tgcagctacacggcaggaggacgag

SEQ ID NO: 297269 - DNA, 24 bp, Artificial Sequence
  Description of Artificial Sequence: Synthetic oligonucleotide
gcagctacacggcaggaggacgag

SEQ ID NO: 297270 - DNA, 25 bp, Artificial Sequence
  Description of Artificial Sequence: Synthetic oligonucleotide
cagctacacggcaggaggacgagct

SEQ ID NO: 297271 - DNA, 26 bp, Artificial Sequence
  Description of Artificial Sequence: Synthetic oligonucleotide
agctacacggcaggaggacgagctgt

SEQ ID NO: 297272 - DNA, 25 bp, Artificial Sequence
  Description of Artificial Sequence: Synthetic oligonucleotide
gctacacggcaggaggacgagctgt

SEQ ID NO: 297273 - DNA, 27 bp, Artificial Sequence
  Description of Artificial Sequence: Synthetic oligonucleotide
ctacacggcaggaggacgagctgtgat

SEQ ID NO: 297274 - DNA, 29 bp, Artificial Sequence
  Description of Artificial Sequence: Synthetic oligonucleotide
tacacggcaggaggacgagctgtgattag

SEQ ID NO: 297275 - DNA, 28 bp, Artificial Sequence
  Description of Artificial Sequence: Synthetic oligonucleotide
acacggcaggaggacgagctgtgattag

SEQ ID NO: 297276 - DNA, 27 bp, Artificial Sequence
  Description of Artificial Sequence: Synthetic oligonucleotide
cacggcaggaggacgagctgtgattag

SEQ ID NO: 297277 - DNA, 28 bp, Artificial Sequence
  Description of Artificial Sequence: Synthetic oligonucleotide
acggcaggaggacgagctgtgattagag

SEQ ID NO: 297278 - DNA, 27 bp, Artificial Sequence
  Description of Artificial Sequence: Synthetic oligonucleotide
cggcaggaggacgagctgtgattagag

SEQ ID NO: 297279 - DNA, 28 bp, Artificial Sequence
  Description of Artificial Sequence: Synthetic oligonucleotide
ggcaggaggacgagctgtgattagagtg

SEQ ID NO: 297280 - DNA, 28 bp, Artificial Sequence
  Description of Artificial Sequence: Synthetic oligonucleotide
gcaggaggacgagctgtgattagagtgc

SEQ ID NO: 297281 - DNA, 30 bp, Artificial Sequence
  Description of Artificial Sequence: Synthetic oligonucleotide
caggaggacgagctgtgattagagtgcttc

SEQ ID NO: 297282 - DNA, 30 bp, Artificial Sequence
  Description of Artificial Sequence: Synthetic oligonucleotide
aggaggacgagctgtgattagagtgcttcg

SEQ ID NO: 297283 - DNA, 29 bp, Artificial Sequence
  Description of Artificial Sequence: Synthetic oligonucleotide
ggaggacgagctgtgattagagtgcttcg

SEQ ID NO: 297284 - DNA, 32 bp, Artificial Sequence
  Description of Artificial Sequence: Synthetic oligonucleotide
gaggacgagctgtgattagagtgcttcgaatg

SEQ ID NO: 297285 - DNA, 32 bp, Artificial Sequence
  Description of Artificial Sequence: Synthetic oligonucleotide
aggacgagctgtgattagagtgcttcgaatgg

SEQ ID NO: 297286 - DNA, 31 bp, Artificial Sequence
  Description of Artificial Sequence: Synthetic oligonucleotide
ggacgagctgtgattagagtgcttcgaatgg

SEQ ID NO: 297287 - DNA, 31 bp, Artificial Sequence
  Description of Artificial Sequence: Synthetic oligonucleotide
gacgagctgtgattagagtgcttcgaatggg

SEQ ID NO: 297288 - DNA, 31 bp, Artificial Sequence
  Description of Artificial Sequence: Synthetic oligonucleotide
acgagctgtgattagagtgcttcgaatgggg

SEQ ID NO: 297289 - DNA, 30 bp, Artificial Sequence
  Description of Artificial Sequence: Synthetic oligonucleotide
cgagctgtgattagagtgcttcgaatgggg

SEQ ID NO: 297290 - DNA, 30 bp, Artificial Sequence
  Description of Artificial Sequence: Synthetic oligonucleotide
gagctgtgattagagtgcttcgaatggggc

SEQ ID NO: 297291 - DNA, 32 bp, Artificial Sequence
  Description of Artificial Sequence: Synthetic oligonucleotide
agctgtgattagagtgcttcgaatggggcaag

SEQ ID NO: 297292 - DNA, 31 bp, Artificial Sequence
  Description of Artificial Sequence: Synthetic oligonucleotide
gctgtgattagagtgcttcgaatggggcaag

SEQ ID NO: 297293 - DNA, 32 bp, Artificial Sequence
  Description of Artificial Sequence: Synthetic oligonucleotide
ctgtgattagagtgcttcgaatggggcaagtc

SEQ ID NO: 297294 - DNA, 33 bp, Artificial Sequence
  Description of Artificial Sequence: Synthetic oligonucleotide
tgtgattagagtgcttcgaatggggcaagtcag

SEQ ID NO: 297295 - DNA, 32 bp, Artificial Sequence
  Description of Artificial Sequence: Synthetic oligonucleotide
gtgattagagtgcttcgaatggggcaagtcag

SEQ ID NO: 297296 - DNA, 33 bp, Artificial Sequence
  Description of Artificial Sequence: Synthetic oligonucleotide
tgattagagtgcttcgaatggggcaagtcagac

SEQ ID NO: 297297 - DNA, 32 bp, Artificial Sequence
  Description of Artificial Sequence: Synthetic oligonucleotide
gattagagtgcttcgaatggggcaagtcagac

SEQ ID NO: 297298 - DNA, 36 bp, Artificial Sequence
  Description of Artificial Sequence: Synthetic oligonucleotide
attagagtgcttcgaatggggcaagtcagacaaaag

SEQ ID NO: 297299 - DNA, 35 bp, Artificial Sequence
  Description of Artificial Sequence: Synthetic oligonucleotide
ttagagtgcttcgaatggggcaagtcagacaaaag

SEQ ID NO: 297300 - DNA, 34 bp, Artificial Sequence
  Description of Artificial Sequence: Synthetic oligonucleotide
tagagtgcttcgaatggggcaagtcagacaaaag

SEQ ID NO: 297301 - DNA, 33 bp, Artificial Sequence
  Description of Artificial Sequence: Synthetic oligonucleotide
agagtgcttcgaatggggcaagtcagacaaaag

SEQ ID NO: 297302 - DNA, 32 bp, Artificial Sequence
  Description of Artificial Sequence: Synthetic oligonucleotide
gagtgcttcgaatggggcaagtcagacaaaag

SEQ ID NO: 297303 - DNA, 34 bp, Artificial Sequence
  Description of Artificial Sequence: Synthetic oligonucleotide
agtgcttcgaatggggcaagtcagacaaaagaac

SEQ ID NO: 297304 - DNA, 33 bp, Artificial Sequence
  Description of Artificial Sequence: Synthetic oligonucleotide
gtgcttcgaatggggcaagtcagacaaaagaac

SEQ ID NO: 297305 - DNA, 36 bp, Artificial Sequence
  Description of Artificial Sequence: Synthetic oligonucleotide
tgcttcgaatggggcaagtcagacaaaagaactatc

SEQ ID NO: 297306 - DNA, 35 bp, Artificial Sequence
  Description of Artificial Sequence: Synthetic oligonucleotide
gcttcgaatggggcaagtcagacaaaagaactatc

SEQ ID NO: 297307 - DNA, 38 bp, Artificial Sequence
  Description of Artificial Sequence: Synthetic oligonucleotide
cttcgaatggggcaagtcagacaaaagaactatcttac

SEQ ID NO: 297308 - DNA, 38 bp, Artificial Sequence
  Description of Artificial Sequence: Synthetic oligonucleotide
ttcgaatggggcaagtcagacaaaagaactatcttacg

SEQ ID NO: 297309 - DNA, 37 bp, Artificial Sequence
  Description of Artificial Sequence: Synthetic oligonucleotide
tcgaatggggcaagtcagacaaaagaactatcttacg

SEQ ID NO: 297310 - DNA, 36 bp, Artificial Sequence
  Description of Artificial Sequence: Synthetic oligonucleotide
cgaatggggcaagtcagacaaaagaactatcttacg

SEQ ID NO: 297311 - DNA, 36 bp, Artificial Sequence
  Description of Artificial Sequence: Synthetic oligonucleotide
gaatggggcaagtcagacaaaagaactatcttacgc

SEQ ID NO: 297312 - DNA, 36 bp, Artificial Sequence
  Description of Artificial Sequence: Synthetic oligonucleotide
aatggggcaagtcagacaaaagaactatcttacgcc

SEQ ID NO: 297313 - DNA, 35 bp, Artificial Sequence
  Description of Artificial Sequence: Synthetic oligonucleotide
atggggcaagtcagacaaaagaactatcttacgcc

SEQ ID NO: 297314 - DNA, 34 bp, Artificial Sequence
  Description of Artificial Sequence: Synthetic oligonucleotide
tggggcaagtcagacaaaagaactatcttacgcc

SEQ ID NO: 297315 - DNA, 33 bp, Artificial Sequence
  Description of Artificial Sequence: Synthetic oligonucleotide
ggggcaagtcagacaaaagaactatcttacgcc

SEQ ID NO: 297316 - DNA, 35 bp, Artificial Sequence
  Description of Artificial Sequence: Synthetic oligonucleotide
gggcaagtcagacaaaagaactatcttacgcctag

SEQ ID NO: 297317 - DNA, 35 bp, Artificial Sequence
  Description of Artificial Sequence: Synthetic oligonucleotide
ggcaagtcagacaaaagaactatcttacgcctagc

SEQ ID NO: 297318 - DNA, 38 bp, Artificial Sequence
  Description of Artificial Sequence: Synthetic oligonucleotide
gcaagtcagacaaaagaactatcttacgcctagctttg

SEQ ID NO: 297319 - DNA, 38 bp, Artificial Sequence
  Description of Artificial Sequence: Synthetic oligonucleotide
caagtcagacaaaagaactatcttacgcctagctttgg

SEQ ID NO: 297320 - DNA, 39 bp, Artificial Sequence
  Description of Artificial Sequence: Synthetic oligonucleotide
aagtcagacaaaagaactatcttacgcctagctttggac

SEQ ID NO: 297321 - DNA, 38 bp, Artificial Sequence
  Description of Artificial Sequence: Synthetic oligonucleotide
agtcagacaaaagaactatcttacgcctagctttggac

SEQ ID NO: 297322 - DNA, 37 bp, Artificial Sequence
  Description of Artificial Sequence: Synthetic oligonucleotide
gtcagacaaaagaactatcttacgcctagctttggac

SEQ ID NO: 297323 - DNA, 37 bp, Artificial Sequence
  Description of Artificial Sequence: Synthetic oligonucleotide
tcagacaaaagaactatcttacgcctagctttggacg

SEQ ID NO: 297324 - DNA, 36 bp, Artificial Sequence
  Description of Artificial Sequence: Synthetic oligonucleotide
cagacaaaagaactatcttacgcctagctttggacg

SEQ ID NO: 297325 - DNA, 36 bp, Artificial Sequence
  Description of Artificial Sequence: Synthetic oligonucleotide
agacaaaagaactatcttacgcctagctttggacgc

SEQ ID NO: 297326 - DNA, 35 bp, Artificial Sequence
  Description of Artificial Sequence: Synthetic oligonucleotide
gacaaaagaactatcttacgcctagctttggacgc

SEQ ID NO: 297327 - DNA, 37 bp, Artificial Sequence
  Description of Artificial Sequence: Synthetic oligonucleotide
acaaaagaactatcttacgcctagctttggacgcaag

SEQ ID NO: 297328 - DNA, 36 bp, Artificial Sequence
  Description of Artificial Sequence: Synthetic oligonucleotide
caaaagaactatcttacgcctagctttggacgcaag

SEQ ID NO: 297329 - DNA, 37 bp, Artificial Sequence
  Description of Artificial Sequence: Synthetic oligonucleotide
aaaagaactatcttacgcctagctttggacgcaagac

SEQ ID NO: 297330 - DNA, 36 bp, Artificial Sequence
  Description of Artificial Sequence: Synthetic oligonucleotide
aaagaactatcttacgcctagctttggacgcaagac

SEQ ID NO: 297331 - DNA, 35 bp, Artificial Sequence
  Description of Artificial Sequence: Synthetic oligonucleotide
aagaactatcttacgcctagctttggacgcaagac

SEQ ID NO: 297332 - DNA, 34 bp, Artificial Sequence
  Description of Artificial Sequence: Synthetic oligonucleotide
agaactatcttacgcctagctttggacgcaagac

SEQ ID NO: 297333 - DNA, 33 bp, Artificial Sequence
  Description of Artificial Sequence: Synthetic oligonucleotide
gaactatcttacgcctagctttggacgcaagac

SEQ ID NO: 297334 - DNA, 34 bp, Artificial Sequence
  Description of Artificial Sequence: Synthetic oligonucleotide
aactatcttacgcctagctttggacgcaagactg

SEQ ID NO: 297335 - DNA, 33 bp, Artificial Sequence
  Description of Artificial Sequence: Synthetic oligonucleotide
actatcttacgcctagctttggacgcaagactg

SEQ ID NO: 297336 - DNA, 32 bp, Artificial Sequence
  Description of Artificial Sequence: Synthetic oligonucleotide
ctatcttacgcctagctttggacgcaagactg

SEQ ID NO: 297337 - DNA, 32 bp, Artificial Sequence
  Description of Artificial Sequence: Synthetic oligonucleotide
tatcttacgcctagctttggacgcaagactgc

SEQ ID NO: 297338 - DNA, 31 bp, Artificial Sequence
  Description of Artificial Sequence: Synthetic oligonucleotide
atcttacgcctagctttggacgcaagactgc

SEQ ID NO: 297339 - DNA, 30 bp, Artificial Sequence
  Description of Artificial Sequence: Synthetic oligonucleotide
tcttacgcctagctttggacgcaagactgc

SEQ ID NO: 297340 - DNA, 29 bp, Artificial Sequence
  Description of Artificial Sequence: Synthetic oligonucleotide
cttacgcctagctttggacgcaagactgc

SEQ ID NO: 297341 - DNA, 30 bp, Artificial Sequence
  Description of Artificial Sequence: Synthetic oligonucleotide
ttacgcctagctttggacgcaagactgctg

SEQ ID NO: 297342 - DNA, 29 bp, Artificial Sequence
  Description of Artificial Sequence: Synthetic oligonucleotide
tacgcctagctttggacgcaagactgctg

SEQ ID NO: 297343 - DNA, 28 bp, Artificial Sequence
  Description of Artificial Sequence: Synthetic oligonucleotide
acgcctagctttggacgcaagactgctg

SEQ ID NO: 297344 - DNA, 27 bp, Artificial Sequence
  Description of Artificial Sequence: Synthetic oligonucleotide
cgcctagctttggacgcaagactgctg

SEQ ID NO: 297345 - DNA, 28 bp, Artificial Sequence
  Description of Artificial Sequence: Synthetic oligonucleotide
gcctagctttggacgcaagactgctgtc

SEQ ID NO: 297346 - DNA, 31 bp, Artificial Sequence
  Description of Artificial Sequence: Synthetic oligonucleotide
cctagctttggacgcaagactgctgtctttg

SEQ ID NO: 297347 - DNA, 33 bp, Artificial Sequence
  Description of Artificial Sequence: Synthetic oligonucleotide
ctagctttggacgcaagactgctgtctttgttc

SEQ ID NO: 297348 - DNA, 36 bp, Artificial Sequence
  Description of Artificial Sequence: Synthetic oligonucleotide
tagctttggacgcaagactgctgtctttgttctttg

SEQ ID NO: 297349 - DNA, 35 bp, Artificial Sequence
  Description of Artificial Sequence: Synthetic oligonucleotide
agctttggacgcaagactgctgtctttgttctttg

SEQ ID NO: 297350 - DNA, 34 bp, Artificial Sequence
  Description of Artificial Sequence: Synthetic oligonucleotide
gctttggacgcaagactgctgtctttgttctttg

SEQ ID NO: 297351 - DNA, 37 bp, Artificial Sequence
  Description of Artificial Sequence: Synthetic oligonucleotide
ctttggacgcaagactgctgtctttgttctttgatac

SEQ ID NO: 297352 - DNA, 37 bp, Artificial Sequence
  Description of Artificial Sequence: Synthetic oligonucleotide
tttggacgcaagactgctgtctttgttctttgatacg

SEQ ID NO: 297353 - DNA, 36 bp, Artificial Sequence
  Description of Artificial Sequence: Synthetic oligonucleotide
ttggacgcaagactgctgtctttgttctttgatacg

SEQ ID NO: 297354 - DNA, 35 bp, Artificial Sequence
  Description of Artificial Sequence: Synthetic oligonucleotide
tggacgcaagactgctgtctttgttctttgatacg

SEQ ID NO: 297355 - DNA, 34 bp, Artificial Sequence
  Description of Artificial Sequence: Synthetic oligonucleotide
ggacgcaagactgctgtctttgttctttgatacg

SEQ ID NO: 297356 - DNA, 36 bp, Artificial Sequence
  Description of Artificial Sequence: Synthetic oligonucleotide
gacgcaagactgctgtctttgttctttgatacgaag

SEQ ID NO: 297357 - DNA, 37 bp, Artificial Sequence
  Description of Artificial Sequence: Synthetic oligonucleotide
acgcaagactgctgtctttgttctttgatacgaagag

SEQ ID NO: 297358 - DNA, 36 bp, Artificial Sequence
  Description of Artificial Sequence: Synthetic oligonucleotide
cgcaagactgctgtctttgttctttgatacgaagag

SEQ ID NO: 297359 - DNA, 36 bp, Artificial Sequence
  Description of Artificial Sequence: Synthetic oligonucleotide
gcaagactgctgtctttgttctttgatacgaagagg

SEQ ID NO: 297360 - DNA, 38 bp, Artificial Sequence
  Description of Artificial Sequence: Synthetic oligonucleotide
caagactgctgtctttgttctttgatacgaagaggtac

SEQ ID NO: 297361 - DNA, 38 bp, Artificial Sequence
  Description of Artificial Sequence: Synthetic oligonucleotide
aagactgctgtctttgttctttgatacgaagaggtacg

SEQ ID NO: 297362 - DNA, 37 bp, Artificial Sequence
  Description of Artificial Sequence: Synthetic oligonucleotide
agactgctgtctttgttctttgatacgaagaggtacg

SEQ ID NO: 297363 - DNA, 36 bp, Artificial Sequence
  Description of Artificial Sequence: Synthetic oligonucleotide
gactgctgtctttgttctttgatacgaagaggtacg

SEQ ID NO: 297364 - DNA, 37 bp, Artificial Sequence
  Description of Artificial Sequence: Synthetic oligonucleotide
actgctgtctttgttctttgatacgaagaggtacgag

SEQ ID NO: 297365 - DNA, 36 bp, Artificial Sequence
  Description of Artificial Sequence: Synthetic oligonucleotide
ctgctgtctttgttctttgatacgaagaggtacgag

SEQ ID NO: 297366 - DNA, 36 bp, Artificial Sequence
  Description of Artificial Sequence: Synthetic oligonucleotide
tgctgtctttgttctttgatacgaagaggtacgagg

SEQ ID NO: 297367 - DNA, 35 bp, Artificial Sequence
  Description of Artificial Sequence: Synthetic oligonucleotide
gctgtctttgttctttgatacgaagaggtacgagg

SEQ ID NO: 297368 - DNA, 37 bp, Artificial Sequence
  Description of Artificial Sequence: Synthetic oligonucleotide
ctgtctttgttctttgatacgaagaggtacgaggaag

SEQ ID NO: 297369 - DNA, 37 bp, Artificial Sequence
  Description of Artificial Sequence: Synthetic oligonucleotide
tgtctttgttctttgatacgaagaggtacgaggaagc

SEQ ID NO: 297370 - DNA, 36 bp, Artificial Sequence
  Description of Artificial Sequence: Synthetic oligonucleotide
gtctttgttctttgatacgaagaggtacgaggaagc

SEQ ID NO: 297371 - DNA, 39 bp, Artificial Sequence
  Description of Artificial Sequence: Synthetic oligonucleotide
tctttgttctttgatacgaagaggtacgaggaagcatag

SEQ ID NO: 297372 - DNA, 38 bp, Artificial Sequence
  Description of Artificial Sequence: Synthetic oligonucleotide
ctttgttctttgatacgaagaggtacgaggaagcatag

SEQ ID NO: 297373 - DNA, 38 bp, Artificial Sequence
  Description of Artificial Sequence: Synthetic oligonucleotide
tttgttctttgatacgaagaggtacgaggaagcatagc

SEQ ID NO: 297374 - DNA, 37 bp, Artificial Sequence
  Description of Artificial Sequence: Synthetic oligonucleotide
ttgttctttgatacgaagaggtacgaggaagcatagc

SEQ ID NO: 297375 - DNA, 36 bp, Artificial Sequence
  Description of Artificial Sequence: Synthetic oligonucleotide
tgttctttgatacgaagaggtacgaggaagcatagc

SEQ ID NO: 297376 - DNA, 35 bp, Artificial Sequence
  Description of Artificial Sequence: Synthetic oligonucleotide
gttctttgatacgaagaggtacgaggaagcatagc

SEQ ID NO: 297377 - DNA, 39 bp, Artificial Sequence
  Description of Artificial Sequence: Synthetic oligonucleotide
ttctttgatacgaagaggtacgaggaagcatagcatttg

SEQ ID NO: 297378 - DNA, 38 bp, Artificial Sequence
  Description of Artificial Sequence: Synthetic oligonucleotide
tctttgatacgaagaggtacgaggaagcatagcatttg

SEQ ID NO: 297379 - DNA, 37 bp, Artificial Sequence
  Description of Artificial Sequence: Synthetic oligonucleotide
ctttgatacgaagaggtacgaggaagcatagcatttg

SEQ ID NO: 297380 - DNA, 37 bp, Artificial Sequence
  Description of Artificial Sequence: Synthetic oligonucleotide
tttgatacgaagaggtacgaggaagcatagcatttgg

SEQ ID NO: 297381 - DNA, 36 bp, Artificial Sequence
  Description of Artificial Sequence: Synthetic oligonucleotide
ttgatacgaagaggtacgaggaagcatagcatttgg

SEQ ID NO: 297382 - DNA, 35 bp, Artificial Sequence
  Description of Artificial Sequence: Synthetic oligonucleotide
tgatacgaagaggtacgaggaagcatagcatttgg

SEQ ID NO: 297383 - DNA, 34 bp, Artificial Sequence
  Description of Artificial Sequence: Synthetic oligonucleotide
gatacgaagaggtacgaggaagcatagcatttgg

SEQ ID NO: 297384 - DNA, 34 bp, Artificial Sequence
  Description of Artificial Sequence: Synthetic oligonucleotide
atacgaagaggtacgaggaagcatagcatttggg

SEQ ID NO: 297385 - DNA, 33 bp, Artificial Sequence
  Description of Artificial Sequence: Synthetic oligonucleotide
tacgaagaggtacgaggaagcatagcatttggg

SEQ ID NO: 297386 - DNA, 32 bp, Artificial Sequence
  Description of Artificial Sequence: Synthetic oligonucleotide
acgaagaggtacgaggaagcatagcatttggg

SEQ ID NO: 297387 - DNA, 31 bp, Artificial Sequence
  Description of Artificial Sequence: Synthetic oligonucleotide
cgaagaggtacgaggaagcatagcatttggg

SEQ ID NO: 297388 - DNA, 33 bp, Artificial Sequence
  Description of Artificial Sequence: Synthetic oligonucleotide
gaagaggtacgaggaagcatagcatttgggatc

SEQ ID NO: 297389 - DNA, 34 bp, Artificial Sequence
  Description of Artificial Sequence: Synthetic oligonucleotide
aagaggtacgaggaagcatagcatttgggatctc

SEQ ID NO: 297390 - DNA, 33 bp, Artificial Sequence
  Description of Artificial Sequence: Synthetic oligonucleotide
agaggtacgaggaagcatagcatttgggatctc

SEQ ID NO: 297391 - DNA, 32 bp, Artificial Sequence
  Description of Artificial Sequence: Synthetic oligonucleotide
gaggtacgaggaagcatagcatttgggatctc

SEQ ID NO: 297392 - DNA, 33 bp, Artificial Sequence
  Description of Artificial Sequence: Synthetic oligonucleotide
aggtacgaggaagcatagcatttgggatctcag

SEQ ID NO: 297393 - DNA, 32 bp, Artificial Sequence
  Description of Artificial Sequence: Synthetic oligonucleotide
ggtacgaggaagcatagcatttgggatctcag

SEQ ID NO: 297394 - DNA, 32 bp, Artificial Sequence
  Description of Artificial Sequence: Synthetic oligonucleotide
gtacgaggaagcatagcatttgggatctcagc

SEQ ID NO: 297395 - DNA, 33 bp, Artificial Sequence
  Description of Artificial Sequence: Synthetic oligonucleotide
tacgaggaagcatagcatttgggatctcagctg

SEQ ID NO: 297396 - DNA, 32 bp, Artificial Sequence
  Description of Artificial Sequence: Synthetic oligonucleotide
acgaggaagcatagcatttgggatctcagctg

SEQ ID NO: 297397 - DNA, 31 bp, Artificial Sequence
  Description of Artificial Sequence: Synthetic oligonucleotide
cgaggaagcatagcatttgggatctcagctg

SEQ ID NO: 297398 - DNA, 31 bp, Artificial Sequence
  Description of Artificial Sequence: Synthetic oligonucleotide
gaggaagcatagcatttgggatctcagctgg

SEQ ID NO: 297399 - DNA, 32 bp, Artificial Sequence
  Description of Artificial Sequence: Synthetic oligonucleotide
aggaagcatagcatttgggatctcagctggtg

SEQ ID NO: 297400 - DNA, 31 bp, Artificial Sequence
  Description of Artificial Sequence: Synthetic oligonucleotide
ggaagcatagcatttgggatctcagctggtg

SEQ ID NO: 297401 - DNA, 31 bp, Artificial Sequence
  Description of Artificial Sequence: Synthetic oligonucleotide
gaagcatagcatttgggatctcagctggtgc

SEQ ID NO: 297402 - DNA, 31 bp, Artificial Sequence
  Description of Artificial Sequence: Synthetic oligonucleotide
aagcatagcatttgggatctcagctggtgcg

SEQ ID NO: 297403 - DNA, 30 bp, Artificial Sequence
  Description of Artificial Sequence: Synthetic oligonucleotide
agcatagcatttgggatctcagctggtgcg

SEQ ID NO: 297404 - DNA, 29 bp, Artificial Sequence
  Description of Artificial Sequence: Synthetic oligonucleotide
gcatagcatttgggatctcagctggtgcg

SEQ ID NO: 297405 - DNA, 29 bp, Artificial Sequence
  Description of Artificial Sequence: Synthetic oligonucleotide
catagcatttgggatctcagctggtgcgg

SEQ ID NO: 297406 - DNA, 29 bp, Artificial Sequence
  Description of Artificial Sequence: Synthetic oligonucleotide
atagcatttgggatctcagctggtgcggg

SEQ ID NO: 297407 - DNA, 28 bp, Artificial Sequence
  Description of Artificial Sequence: Synthetic oligonucleotide
tagcatttgggatctcagctggtgcggg

SEQ ID NO: 297408 - DNA, 27 bp, Artificial Sequence
  Description of Artificial Sequence: Synthetic oligonucleotide
agcatttgggatctcagctggtgcggg

SEQ ID NO: 297409 - DNA, 27 bp, Artificial Sequence
  Description of Artificial Sequence: Synthetic oligonucleotide
gcatttgggatctcagctggtgcggga

SEQ ID NO: 297410 - DNA, 27 bp, Artificial Sequence
  Description of Artificial Sequence: Synthetic oligonucleotide
catttgggatctcagctggtgcgggag

SEQ ID NO: 297411 - DNA, 29 bp, Artificial Sequence
  Description of Artificial Sequence: Synthetic oligonucleotide
atttgggatctcagctggtgcgggagtag

SEQ ID NO: 297412 - DNA, 28 bp, Artificial Sequence
  Description of Artificial Sequence: Synthetic oligonucleotide
tttgggatctcagctggtgcgggagtag

SEQ ID NO: 297413 - DNA, 27 bp, Artificial Sequence
  Description of Artificial Sequence: Synthetic oligonucleotide
ttgggatctcagctggtgcgggagtag

SEQ ID NO: 297414 - DNA, 27 bp, Artificial Sequence
  Description of Artificial Sequence: Synthetic oligonucleotide
tgggatctcagctggtgcgggagtaga

SEQ ID NO: 297415 - DNA, 27 bp, Artificial Sequence
  Description of Artificial Sequence: Synthetic oligonucleotide
gggatctcagctggtgcgggagtagaa

SEQ ID NO: 297416 - DNA, 30 bp, Artificial Sequence
  Description of Artificial Sequence: Synthetic oligonucleotide
ggatctcagctggtgcgggagtagaaaaag

SEQ ID NO: 297417 - DNA, 32 bp, Artificial Sequence
  Description of Artificial Sequence: Synthetic oligonucleotide
gatctcagctggtgcgggagtagaaaaagatc

SEQ ID NO: 297418 - DNA, 32 bp, Artificial Sequence
  Description of Artificial Sequence: Synthetic oligonucleotide
atctcagctggtgcgggagtagaaaaagatcg

SEQ ID NO: 297419 - DNA, 31 bp, Artificial Sequence
  Description of Artificial Sequence: Synthetic oligonucleotide
tctcagctggtgcgggagtagaaaaagatcg

SEQ ID NO: 297420 - DNA, 30 bp, Artificial Sequence
  Description of Artificial Sequence: Synthetic oligonucleotide
ctcagctggtgcgggagtagaaaaagatcg

SEQ ID NO: 297421 - DNA, 31 bp, Artificial Sequence
  Description of Artificial Sequence: Synthetic oligonucleotide
tcagctggtgcgggagtagaaaaagatcgac

SEQ ID NO: 297422 - DNA, 30 bp, Artificial Sequence
  Description of Artificial Sequence: Synthetic oligonucleotide
cagctggtgcgggagtagaaaaagatcgac

SEQ ID NO: 297423 - DNA, 30 bp, Artificial Sequence
  Description of Artificial Sequence: Synthetic oligonucleotide
agctggtgcgggagtagaaaaagatcgacg

SEQ ID NO: 297424 - DNA, 29 bp, Artificial Sequence
  Description of Artificial Sequence: Synthetic oligonucleotide
gctggtgcgggagtagaaaaagatcgacg

SEQ ID NO: 297425 - DNA, 30 bp, Artificial Sequence
  Description of Artificial Sequence: Synthetic oligonucleotide
ctggtgcgggagtagaaaaagatcgacgac

SEQ ID NO: 297426 - DNA, 33 bp, Artificial Sequence
  Description of Artificial Sequence: Synthetic oligonucleotide
tggtgcgggagtagaaaaagatcgacgacaaac

SEQ ID NO: 297427 - DNA, 32 bp, Artificial Sequence
  Description of Artificial Sequence: Synthetic oligonucleotide
ggtgcgggagtagaaaaagatcgacgacaaac

SEQ ID NO: 297428 - DNA, 32 bp, Artificial Sequence
  Description of Artificial Sequence: Synthetic oligonucleotide
gtgcgggagtagaaaaagatcgacgacaaacc

SEQ ID NO: 297429 - DNA, 33 bp, Artificial Sequence
  Description of Artificial Sequence: Synthetic oligonucleotide
tgcgggagtagaaaaagatcgacgacaaacctc

SEQ ID NO: 297430 - DNA, 32 bp, Artificial Sequence
  Description of Artificial Sequence: Synthetic oligonucleotide
gcgggagtagaaaaagatcgacgacaaacctc

SEQ ID NO: 297431 - DNA, 36 bp, Artificial Sequence
  Description of Artificial Sequence: Synthetic oligonucleotide
cgggagtagaaaaagatcgacgacaaacctcttttg

SEQ ID NO: 297432 - DNA, 36 bp, Artificial Sequence
  Description of Artificial Sequence: Synthetic oligonucleotide
gggagtagaaaaagatcgacgacaaacctcttttgg

SEQ ID NO: 297433 - DNA, 37 bp, Artificial Sequence
  Description of Artificial Sequence: Synthetic oligonucleotide
ggagtagaaaaagatcgacgacaaacctcttttggag

SEQ ID NO: 297434 - DNA, 37 bp, Artificial Sequence
  Description of Artificial Sequence: Synthetic oligonucleotide
gagtagaaaaagatcgacgacaaacctcttttggagg

SEQ ID NO: 297435 - DNA, 39 bp, Artificial Sequence
  Description of Artificial Sequence: Synthetic oligonucleotide
agtagaaaaagatcgacgacaaacctcttttggaggaag

SEQ ID NO: 297436 - DNA, 38 bp, Artificial Sequence
  Description of Artificial Sequence: Synthetic oligonucleotide
gtagaaaaagatcgacgacaaacctcttttggaggaag

SEQ ID NO: 297437 - DNA, 40 bp, Artificial Sequence
  Description of Artificial Sequence: Synthetic oligonucleotide
tagaaaaagatcgacgacaaacctcttttggaggaagtac

SEQ ID NO: 297438 - DNA, 39 bp, Artificial Sequence
  Description of Artificial Sequence: Synthetic oligonucleotide
agaaaaagatcgacgacaaacctcttttggaggaagtac

SEQ ID NO: 297439 - DNA, 38 bp, Artificial Sequence
  Description of Artificial Sequence: Synthetic oligonucleotide
gaaaaagatcgacgacaaacctcttttggaggaagtac

SEQ ID NO: 297440 - DNA, 39 bp, Artificial Sequence
  Description of Artificial Sequence: Synthetic oligonucleotide
aaaaagatcgacgacaaacctcttttggaggaagtacac

SEQ ID NO: 297441 - DNA, 38 bp, Artificial Sequence
  Description of Artificial Sequence: Synthetic oligonucleotide
aaaagatcgacgacaaacctcttttggaggaagtacac

SEQ ID NO: 297442 - DNA, 37 bp, Artificial Sequence
  Description of Artificial Sequence: Synthetic oligonucleotide
aaagatcgacgacaaacctcttttggaggaagtacac

SEQ ID NO: 297443 - DNA, 36 bp, Artificial Sequence
  Description of Artificial Sequence: Synthetic oligonucleotide
aagatcgacgacaaacctcttttggaggaagtacac

SEQ ID NO: 297444 - DNA, 35 bp, Artificial Sequence
  Description of Artificial Sequence: Synthetic oligonucleotide
agatcgacgacaaacctcttttggaggaagtacac

SEQ ID NO: 297445 - DNA, 34 bp, Artificial Sequence
  Description of Artificial Sequence: Synthetic oligonucleotide
gatcgacgacaaacctcttttggaggaagtacac

SEQ ID NO: 297446 - DNA, 34 bp, Artificial Sequence
  Description of Artificial Sequence: Synthetic oligonucleotide
atcgacgacaaacctcttttggaggaagtacacc

SEQ ID NO: 297447 - DNA, 33 bp, Artificial Sequence
  Description of Artificial Sequence: Synthetic oligonucleotide
tcgacgacaaacctcttttggaggaagtacacc

SEQ ID NO: 297448 - DNA, 32 bp, Artificial Sequence
  Description of Artificial Sequence: Synthetic oligonucleotide
cgacgacaaacctcttttggaggaagtacacc

SEQ ID NO: 297449 - DNA, 37 bp, Artificial Sequence
  Description of Artificial Sequence: Synthetic oligonucleotide
gacgacaaacctcttttggaggaagtacaccttttag

SEQ ID NO: 297450 - DNA, 40 bp, Artificial Sequence
  Description of Artificial Sequence: Synthetic oligonucleotide
acgacaaacctcttttggaggaagtacaccttttagaatg

SEQ ID NO: 297451 - DNA, 39 bp, Artificial Sequence
  Description of Artificial Sequence: Synthetic oligonucleotide
cgacaaacctcttttggaggaagtacaccttttagaatg

SEQ ID NO: 297452 - DNA, 39 bp, Artificial Sequence
  Description of Artificial Sequence: Synthetic oligonucleotide
gacaaacctcttttggaggaagtacaccttttagaatgc

SEQ ID NO: 297453 - DNA, 43 bp, Artificial Sequence
  Description of Artificial Sequence: Synthetic oligonucleotide
acaaacctcttttggaggaagtacaccttttagaatgcaaaac

SEQ ID NO: 297454 - DNA, 42 bp, Artificial Sequence
  Description of Artificial Sequence: Synthetic oligonucleotide
caaacctcttttggaggaagtacaccttttagaatgcaaaac

SEQ ID NO: 297455 - DNA, 45 bp, Artificial Sequence
  Description of Artificial Sequence: Synthetic oligonucleotide
aaacctcttttggaggaagtacaccttttagaatgcaaaacattc

SEQ ID NO: 297456 - DNA, 44 bp, Artificial Sequence
  Description of Artificial Sequence: Synthetic oligonucleotide
aacctcttttggaggaagtacaccttttagaatgcaaaacattc

SEQ ID NO: 297457 - DNA, 43 bp, Artificial Sequence
  Description of Artificial Sequence: Synthetic oligonucleotide
acctcttttggaggaagtacaccttttagaatgcaaaacattc

SEQ ID NO: 297458 - DNA, 42 bp, Artificial Sequence
  Description of Artificial Sequence: Synthetic oligonucleotide
cctcttttggaggaagtacaccttttagaatgcaaaacattc

SEQ ID NO: 297459 - DNA, 42 bp, Artificial Sequence
  Description of Artificial Sequence: Synthetic oligonucleotide
ctcttttggaggaagtacaccttttagaatgcaaaacattcc

SEQ ID NO: 297460 - DNA, 44 bp, Artificial Sequence
  Description of Artificial Sequence: Synthetic oligonucleotide
tcttttggaggaagtacaccttttagaatgcaaaacattccatg

SEQ ID NO: 297461 - DNA, 43 bp, Artificial Sequence
  Description of Artificial Sequence: Synthetic oligonucleotide
cttttggaggaagtacaccttttagaatgcaaaacattccatg

SEQ ID NO: 297462 - DNA, 43 bp, Artificial Sequence
  Description of Artificial Sequence: Synthetic oligonucleotide
ttttggaggaagtacaccttttagaatgcaaaacattccatgc

SEQ ID NO: 297463 - DNA, 42 bp, Artificial Sequence
  Description of Artificial Sequence: Synthetic oligonucleotide
tttggaggaagtacaccttttagaatgcaaaacattccatgc

SEQ ID NO: 297464 - DNA, 41 bp, Artificial Sequence
  Description of Artificial Sequence: Synthetic oligonucleotide
ttggaggaagtacaccttttagaatgcaaaacattccatgc

SEQ ID NO: 297465 - DNA, 40 bp, Artificial Sequence
  Description of Artificial Sequence: Synthetic oligonucleotide
tggaggaagtacaccttttagaatgcaaaacattccatgc

SEQ ID NO: 297466 - DNA, 39 bp, Artificial Sequence
  Description of Artificial Sequence: Synthetic oligonucleotide
ggaggaagtacaccttttagaatgcaaaacattccatgc

SEQ ID NO: 297467 - DNA, 39 bp, Artificial Sequence
  Description of Artificial Sequence: Synthetic oligonucleotide
gaggaagtacaccttttagaatgcaaaacattccatgcc

SEQ ID NO: 297468 - DNA, 39 bp, Artificial Sequence
  Description of Artificial Sequence: Synthetic oligonucleotide
aggaagtacaccttttagaatgcaaaacattccatgccc

SEQ ID NO: 297469 - DNA, 38 bp, Artificial Sequence
  Description of Artificial Sequence: Synthetic oligonucleotide
ggaagtacaccttttagaatgcaaaacattccatgccc

SEQ ID NO: 297470 - DNA, 39 bp, Artificial Sequence
  Description of Artificial Sequence: Synthetic oligonucleotide
gaagtacaccttttagaatgcaaaacattccatgccctc

SEQ ID NO: 297471 - DNA, 40 bp, Artificial Sequence
  Description of Artificial Sequence: Synthetic oligonucleotide
aagtacaccttttagaatgcaaaacattccatgccctcag

SEQ ID NO: 297472 - DNA, 39 bp, Artificial Sequence
  Description of Artificial Sequence: Synthetic oligonucleotide
agtacaccttttagaatgcaaaacattccatgccctcag

SEQ ID NO: 297473 - DNA, 38 bp, Artificial Sequence
  Description of Artificial Sequence: Synthetic oligonucleotide
gtacaccttttagaatgcaaaacattccatgccctcag

SEQ ID NO: 297474 - DNA, 38 bp, Artificial Sequence
  Description of Artificial Sequence: Synthetic oligonucleotide
tacaccttttagaatgcaaaacattccatgccctcagc

SEQ ID NO: 297475 - DNA, 37 bp, Artificial Sequence
  Description of Artificial Sequence: Synthetic oligonucleotide
acaccttttagaatgcaaaacattccatgccctcagc

SEQ ID NO: 297476 - DNA, 36 bp, Artificial Sequence
  Description of Artificial Sequence: Synthetic oligonucleotide
caccttttagaatgcaaaacattccatgccctcagc

SEQ ID NO: 297477 - DNA, 38 bp, Artificial Sequence
  Description of Artificial Sequence: Synthetic oligonucleotide
accttttagaatgcaaaacattccatgccctcagcaac

SEQ ID NO: 297478 - DNA, 37 bp, Artificial Sequence
  Description of Artificial Sequence: Synthetic oligonucleotide
ccttttagaatgcaaaacattccatgccctcagcaac

SEQ ID NO: 297479 - DNA, 37 bp, Artificial Sequence
  Description of Artificial Sequence: Synthetic oligonucleotide
cttttagaatgcaaaacattccatgccctcagcaacc

SEQ ID NO: 297480 - DNA, 38 bp, Artificial Sequence
  Description of Artificial Sequence: Synthetic oligonucleotide
ttttagaatgcaaaacattccatgccctcagcaacctg

SEQ ID NO: 297481 - DNA, 37 bp, Artificial Sequence
  Description of Artificial Sequence: Synthetic oligonucleotide
tttagaatgcaaaacattccatgccctcagcaacctg

SEQ ID NO: 297482 - DNA, 36 bp, Artificial Sequence
  Description of Artificial Sequence: Synthetic oligonucleotide
ttagaatgcaaaacattccatgccctcagcaacctg

SEQ ID NO: 297483 - DNA, 35 bp, Artificial Sequence
  Description of Artificial Sequence: Synthetic oligonucleotide
tagaatgcaaaacattccatgccctcagcaacctg

SEQ ID NO: 297484 - DNA, 34 bp, Artificial Sequence
  Description of Artificial Sequence: Synthetic oligonucleotide
agaatgcaaaacattccatgccctcagcaacctg

SEQ ID NO: 297485 - DNA, 33 bp, Artificial Sequence
  Description of Artificial Sequence: Synthetic oligonucleotide
gaatgcaaaacattccatgccctcagcaacctg

SEQ ID NO: 297486 - DNA, 33 bp, Artificial Sequence
  Description of Artificial Sequence: Synthetic oligonucleotide
aatgcaaaacattccatgccctcagcaacctgg

SEQ ID NO: 297487 - DNA, 32 bp, Artificial Sequence
  Description of Artificial Sequence: Synthetic oligonucleotide
atgcaaaacattccatgccctcagcaacctgg

SEQ ID NO: 297488 - DNA, 31 bp, Artificial Sequence
  Description of Artificial Sequence: Synthetic oligonucleotide
tgcaaaacattccatgccctcagcaacctgg

SEQ ID NO: 297489 - DNA, 30 bp, Artificial Sequence
  Description of Artificial Sequence: Synthetic oligonucleotide
gcaaaacattccatgccctcagcaacctgg

SEQ ID NO: 297490 - DNA, 30 bp, Artificial Sequence
  Description of Artificial Sequence: Synthetic oligonucleotide
caaaacattccatgccctcagcaacctggc

SEQ ID NO: 297491 - DNA, 30 bp, Artificial Sequence
  Description of Artificial Sequence: Synthetic oligonucleotide
aaaacattccatgccctcagcaacctggcg

SEQ ID NO: 297492 - DNA, 29 bp, Artificial Sequence
  Description of Artificial Sequence: Synthetic oligonucleotide
aaacattccatgccctcagcaacctggcg

SEQ ID NO: 297493 - DNA, 28 bp, Artificial Sequence
  Description of Artificial Sequence: Synthetic oligonucleotide
aacattccatgccctcagcaacctggcg

SEQ ID NO: 297494 - DNA, 27 bp, Artificial Sequence
  Description of Artificial Sequence: Synthetic oligonucleotide
acattccatgccctcagcaacctggcg

SEQ ID NO: 297495 - DNA, 27 bp, Artificial Sequence
  Description of Artificial Sequence: Synthetic oligonucleotide
cattccatgccctcagcaacctggcga

SEQ ID NO: 297496 - DNA, 29 bp, Artificial Sequence
  Description of Artificial Sequence: Synthetic oligonucleotide
attccatgccctcagcaacctggcgaaag

SEQ ID NO: 297497 - DNA, 28 bp, Artificial Sequence
  Description of Artificial Sequence: Synthetic oligonucleotide
ttccatgccctcagcaacctggcgaaag

SEQ ID NO: 297498 - DNA, 27 bp, Artificial Sequence
  Description of Artificial Sequence: Synthetic oligonucleotide
tccatgccctcagcaacctggcgaaag

SEQ ID NO: 297499 - DNA, 26 bp, Artificial Sequence
  Description of Artificial Sequence: Synthetic oligonucleotide
ccatgccctcagcaacctggcgaaag

SEQ ID NO: 297500 - DNA, 26 bp, Artificial Sequence
  Description of Artificial Sequence: Synthetic oligonucleotide
catgccctcagcaacctggcgaaagc

SEQ ID NO: 297501 - DNA, 26 bp, Artificial Sequence
  Description of Artificial Sequence: Synthetic oligonucleotide
atgccctcagcaacctggcgaaagcc

SEQ ID NO: 297502 - DNA, 25 bp, Artificial Sequence
  Description of Artificial Sequence: Synthetic oligonucleotide
tgccctcagcaacctggcgaaagcc

SEQ ID NO: 297503 - DNA, 24 bp, Artificial Sequence
  Description of Artificial Sequence: Synthetic oligonucleotide
gccctcagcaacctggcgaaagcc

SEQ ID NO: 297504 - DNA, 24 bp, Artificial Sequence
  Description of Artificial Sequence: Synthetic oligonucleotide
ccctcagcaacctggcgaaagccc

SEQ ID NO: 297505 - DNA, 25 bp, Artificial Sequence
  Description of Artificial Sequence: Synthetic oligonucleotide
cctcagcaacctggcgaaagcccca

SEQ ID NO: 297506 - DNA, 25 bp, Artificial Sequence
  Description of Artificial Sequence: Synthetic oligonucleotide
ctcagcaacctggcgaaagccccag

SEQ ID NO: 297507 - DNA, 26 bp, Artificial Sequence
  Description of Artificial Sequence: Synthetic oligonucleotide
tcagcaacctggcgaaagccccagct

SEQ ID NO: 297508 - DNA, 25 bp, Artificial Sequence
  Description of Artificial Sequence: Synthetic oligonucleotide
cagcaacctggcgaaagccccagct

SEQ ID NO: 297509 - DNA, 25 bp, Artificial Sequence
  Description of Artificial Sequence: Synthetic oligonucleotide
agcaacctggcgaaagccccagctg

SEQ ID NO: 297510 - DNA, 24 bp, Artificial Sequence
  Description of Artificial Sequence: Synthetic oligonucleotide
gcaacctggcgaaagccccagctg

SEQ ID NO: 297511 - DNA, 24 bp, Artificial Sequence
  Description of Artificial Sequence: Synthetic oligonucleotide
caacctggcgaaagccccagctgc

SEQ ID NO: 297512 - DNA, 27 bp, Artificial Sequence
  Description of Artificial Sequence: Synthetic oligonucleotide
aacctggcgaaagccccagctgccttt

SEQ ID NO: 297513 - DNA, 27 bp, Artificial Sequence
  Description of Artificial Sequence: Synthetic oligonucleotide
acctggcgaaagccccagctgccttta

SEQ ID NO: 297514 - DNA, 26 bp, Artificial Sequence
  Description of Artificial Sequence: Synthetic oligonucleotide
cctggcgaaagccccagctgccttta

SEQ ID NO: 297515 - DNA, 27 bp, Artificial Sequence
  Description of Artificial Sequence: Synthetic oligonucleotide
ctggcgaaagccccagctgcctttact

SEQ ID NO: 297516 - DNA, 28 bp, Artificial Sequence
  Description of Artificial Sequence: Synthetic oligonucleotide
tggcgaaagccccagctgcctttacttc

SEQ ID NO: 297517 - DNA, 27 bp, Artificial Sequence
  Description of Artificial Sequence: Synthetic oligonucleotide
ggcgaaagccccagctgcctttacttc

SEQ ID NO: 297518 - DNA, 28 bp, Artificial Sequence
  Description of Artificial Sequence: Synthetic oligonucleotide
gcgaaagccccagctgcctttacttctg

SEQ ID NO: 297519 - DNA, 28 bp, Artificial Sequence
  Description of Artificial Sequence: Synthetic oligonucleotide
cgaaagccccagctgcctttacttctgc

SEQ ID NO: 297520 - DNA, 29 bp, Artificial Sequence
  Description of Artificial Sequence: Synthetic oligonucleotide
gaaagccccagctgcctttacttctgctg

SEQ ID NO: 297521 - DNA, 29 bp, Artificial Sequence
  Description of Artificial Sequence: Synthetic oligonucleotide
aaagccccagctgcctttacttctgctgg

SEQ ID NO: 297522 - DNA, 28 bp, Artificial Sequence
  Description of Artificial Sequence: Synthetic oligonucleotide
aagccccagctgcctttacttctgctgg

SEQ ID NO: 297523 - DNA, 27 bp, Artificial Sequence
  Description of Artificial Sequence: Synthetic oligonucleotide
agccccagctgcctttacttctgctgg

SEQ ID NO: 297524 - DNA, 27 bp, Artificial Sequence
  Description of Artificial Sequence: Synthetic oligonucleotide
gccccagctgcctttacttctgctgga

SEQ ID NO: 297525 - DNA, 28 bp, Artificial Sequence
  Description of Artificial Sequence: Synthetic oligonucleotide
ccccagctgcctttacttctgctggaac

SEQ ID NO: 297526 - DNA, 28 bp, Artificial Sequence
  Description of Artificial Sequence: Synthetic oligonucleotide
cccagctgcctttacttctgctggaacc

SEQ ID NO: 297527 - DNA, 29 bp, Artificial Sequence
  Description of Artificial Sequence: Synthetic oligonucleotide
ccagctgcctttacttctgctggaaccac

SEQ ID NO: 297528 - DNA, 30 bp, Artificial Sequence
  Description of Artificial Sequence: Synthetic oligonucleotide
cagctgcctttacttctgctggaaccacag

SEQ ID NO: 297529 - DNA, 30 bp, Artificial Sequence
  Description of Artificial Sequence: Synthetic oligonucleotide
agctgcctttacttctgctggaaccacagg

SEQ ID NO: 297530 - DNA, 29 bp, Artificial Sequence
  Description of Artificial Sequence: Synthetic oligonucleotide
gctgcctttacttctgctggaaccacagg

SEQ ID NO: 297531 - DNA, 33 bp, Artificial Sequence
  Description of Artificial Sequence: Synthetic oligonucleotide
ctgcctttacttctgctggaaccacaggaaatg

SEQ ID NO: 297532 - DNA, 33 bp, Artificial Sequence
  Description of Artificial Sequence: Synthetic oligonucleotide
tgcctttacttctgctggaaccacaggaaatgc

SEQ ID NO: 297533 - DNA, 32 bp, Artificial Sequence
  Description of Artificial Sequence: Synthetic oligonucleotide
gcctttacttctgctggaaccacaggaaatgc

SEQ ID NO: 297534 - DNA, 32 bp, Artificial Sequence
  Description of Artificial Sequence: Synthetic oligonucleotide
cctttacttctgctggaaccacaggaaatgcc

SEQ ID NO: 297535 - DNA, 34 bp, Artificial Sequence
  Description of Artificial Sequence: Synthetic oligonucleotide
ctttacttctgctggaaccacaggaaatgccatg

SEQ ID NO: 297536 - DNA, 36 bp, Artificial Sequence
  Description of Artificial Sequence: Synthetic oligonucleotide
tttacttctgctggaaccacaggaaatgccatgtac

SEQ ID NO: 297537 - DNA, 35 bp, Artificial Sequence
  Description of Artificial Sequence: Synthetic oligonucleotide
ttacttctgctggaaccacaggaaatgccatgtac

SEQ ID NO: 297538 - DNA, 34 bp, Artificial Sequence
  Description of Artificial Sequence: Synthetic oligonucleotide
tacttctgctggaaccacaggaaatgccatgtac

SEQ ID NO: 297539 - DNA, 33 bp, Artificial Sequence
  Description of Artificial Sequence: Synthetic oligonucleotide
acttctgctggaaccacaggaaatgccatgtac

SEQ ID NO: 297540 - DNA, 32 bp, Artificial Sequence
  Description of Artificial Sequence: Synthetic oligonucleotide
cttctgctggaaccacaggaaatgccatgtac

SEQ ID NO: 297541 - DNA, 33 bp, Artificial Sequence
  Description of Artificial Sequence: Synthetic oligonucleotide
ttctgctggaaccacaggaaatgccatgtactg

SEQ ID NO: 297542 - DNA, 32 bp, Artificial Sequence
  Description of Artificial Sequence: Synthetic oligonucleotide
tctgctggaaccacaggaaatgccatgtactg

SEQ ID NO: 297543 - DNA, 31 bp, Artificial Sequence
  Description of Artificial Sequence: Synthetic oligonucleotide
ctgctggaaccacaggaaatgccatgtactg

SEQ ID NO: 297544 - DNA, 31 bp, Artificial Sequence
  Description of Artificial Sequence: Synthetic oligonucleotide
tgctggaaccacaggaaatgccatgtactgc

SEQ ID NO: 297545 - DNA, 30 bp, Artificial Sequence
  Description of Artificial Sequence: Synthetic oligonucleotide
gctggaaccacaggaaatgccatgtactgc

SEQ ID NO: 297546 - DNA, 30 bp, Artificial Sequence
  Description of Artificial Sequence: Synthetic oligonucleotide
ctggaaccacaggaaatgccatgtactgcc

SEQ ID NO: 297547 - DNA, 30 bp, Artificial Sequence
  Description of Artificial Sequence: Synthetic oligonucleotide
tggaaccacaggaaatgccatgtactgccc

SEQ ID NO: 297548 - DNA, 29 bp, Artificial Sequence
  Description of Artificial Sequence: Synthetic oligonucleotide
ggaaccacaggaaatgccatgtactgccc

SEQ ID NO: 297549 - DNA, 29 bp, Artificial Sequence
  Description of Artificial Sequence: Synthetic oligonucleotide
gaaccacaggaaatgccatgtactgcccc

SEQ ID NO: 297550 - DNA, 29 bp, Artificial Sequence
  Description of Artificial Sequence: Synthetic oligonucleotide
aaccacaggaaatgccatgtactgccccg

SEQ ID NO: 297551 - DNA, 28 bp, Artificial Sequence
  Description of Artificial Sequence: Synthetic oligonucleotide
accacaggaaatgccatgtactgccccg

SEQ ID NO: 297552 - DNA, 27 bp, Artificial Sequence
  Description of Artificial Sequence: Synthetic oligonucleotide
ccacaggaaatgccatgtactgccccg

SEQ ID NO: 297553 - DNA, 27 bp, Artificial Sequence
  Description of Artificial Sequence: Synthetic oligonucleotide
cacaggaaatgccatgtactgccccgc

SEQ ID NO: 297554 - DNA, 33 bp, Artificial Sequence
  Description of Artificial Sequence: Synthetic oligonucleotide
acaggaaatgccatgtactgccccgctaaattg

SEQ ID NO: 297555 - DNA, 32 bp, Artificial Sequence
  Description of Artificial Sequence: Synthetic oligonucleotide
caggaaatgccatgtactgccccgctaaattg

SEQ ID NO: 297556 - DNA, 32 bp, Artificial Sequence
  Description of Artificial Sequence: Synthetic oligonucleotide
aggaaatgccatgtactgccccgctaaattgc

SEQ ID NO: 297557 - DNA, 31 bp, Artificial Sequence
  Description of Artificial Sequence: Synthetic oligonucleotide
ggaaatgccatgtactgccccgctaaattgc

SEQ ID NO: 297558 - DNA, 32 bp, Artificial Sequence
  Description of Artificial Sequence: Synthetic oligonucleotide
gaaatgccatgtactgccccgctaaattgctg

SEQ ID NO: 297559 - DNA, 32 bp, Artificial Sequence
  Description of Artificial Sequence: Synthetic oligonucleotide
aaatgccatgtactgccccgctaaattgctgg

SEQ ID NO: 297560 - DNA, 31 bp, Artificial Sequence
  Description of Artificial Sequence: Synthetic oligonucleotide
aatgccatgtactgccccgctaaattgctgg

SEQ ID NO: 297561 - DNA, 30 bp, Artificial Sequence
  Description of Artificial Sequence: Synthetic oligonucleotide
atgccatgtactgccccgctaaattgctgg

SEQ ID NO: 297562 - DNA, 29 bp, Artificial Sequence
  Description of Artificial Sequence: Synthetic oligonucleotide
tgccatgtactgccccgctaaattgctgg

SEQ ID NO: 297563 - DNA, 28 bp, Artificial Sequence
  Description of Artificial Sequence: Synthetic oligonucleotide
gccatgtactgccccgctaaattgctgg

SEQ ID NO: 297564 - DNA, 28 bp, Artificial Sequence
  Description of Artificial Sequence: Synthetic oligonucleotide
ccatgtactgccccgctaaattgctggc

SEQ ID NO: 297565 - DNA, 28 bp, Artificial Sequence
  Description of Artificial Sequence: Synthetic oligonucleotide
catgtactgccccgctaaattgctggcc

SEQ ID NO: 297566 - DNA, 29 bp, Artificial Sequence
  Description of Artificial Sequence: Synthetic oligonucleotide
atgtactgccccgctaaattgctggccac

SEQ ID NO: 297567 - DNA, 28 bp, Artificial Sequence
  Description of Artificial Sequence: Synthetic oligonucleotide
tgtactgccccgctaaattgctggccac

SEQ ID NO: 297568 - DNA, 27 bp, Artificial Sequence
  Description of Artificial Sequence: Synthetic oligonucleotide
gtactgccccgctaaattgctggccac

SEQ ID NO: 297569 - DNA, 27 bp, Artificial Sequence
  Description of Artificial Sequence: Synthetic oligonucleotide
tactgccccgctaaattgctggccacc

SEQ ID NO: 297570 - DNA, 27 bp, Artificial Sequence
  Description of Artificial Sequence: Synthetic oligonucleotide
actgccccgctaaattgctggccacct

SEQ ID NO: 297571 - DNA, 27 bp, Artificial Sequence
  Description of Artificial Sequence: Synthetic oligonucleotide
ctgccccgctaaattgctggccacctt

SEQ ID NO: 297572 - DNA, 27 bp, Artificial Sequence
  Description of Artificial Sequence: Synthetic oligonucleotide
tgccccgctaaattgctggccaccttc

SEQ ID NO: 297573 - DNA, 26 bp, Artificial Sequence
  Description of Artificial Sequence: Synthetic oligonucleotide
gccccgctaaattgctggccaccttc

SEQ ID NO: 297574 - DNA, 27 bp, Artificial Sequence
  Description of Artificial Sequence: Synthetic oligonucleotide
ccccgctaaattgctggccaccttcga

SEQ ID NO: 297575 - DNA, 27 bp, Artificial Sequence
  Description of Artificial Sequence: Synthetic oligonucleotide
cccgctaaattgctggccaccttcgac

SEQ ID NO: 297576 - DNA, 29 bp, Artificial Sequence
  Description of Artificial Sequence: Synthetic oligonucleotide
ccgctaaattgctggccaccttcgacatg

SEQ ID NO: 297577 - DNA, 29 bp, Artificial Sequence
  Description of Artificial Sequence: Synthetic oligonucleotide
cgctaaattgctggccaccttcgacatgc

SEQ ID NO: 297578 - DNA, 30 bp, Artificial Sequence
  Description of Artificial Sequence: Synthetic oligonucleotide
gctaaattgctggccaccttcgacatgcag

SEQ ID NO: 297579 - DNA, 31 bp, Artificial Sequence
  Description of Artificial Sequence: Synthetic oligonucleotide
ctaaattgctggccaccttcgacatgcagac

SEQ ID NO: 297580 - DNA, 31 bp, Artificial Sequence
  Description of Artificial Sequence: Synthetic oligonucleotide
taaattgctggccaccttcgacatgcagacg

SEQ ID NO: 297581 - DNA, 30 bp, Artificial Sequence
  Description of Artificial Sequence: Synthetic oligonucleotide
aaattgctggccaccttcgacatgcagacg

SEQ ID NO: 297582 - DNA, 29 bp, Artificial Sequence
  Description of Artificial Sequence: Synthetic oligonucleotide
aattgctggccaccttcgacatgcagacg

SEQ ID NO: 297583 - DNA, 28 bp, Artificial Sequence
  Description of Artificial Sequence: Synthetic oligonucleotide
attgctggccaccttcgacatgcagacg

SEQ ID NO: 297584 - DNA, 27 bp, Artificial Sequence
  Description of Artificial Sequence: Synthetic oligonucleotide
ttgctggccaccttcgacatgcagacg

SEQ ID NO: 297585 - DNA, 26 bp, Artificial Sequence
  Description of Artificial Sequence: Synthetic oligonucleotide
tgctggccaccttcgacatgcagacg

SEQ ID NO: 297586 - DNA, 25 bp, Artificial Sequence
  Description of Artificial Sequence: Synthetic oligonucleotide
gctggccaccttcgacatgcagacg

SEQ ID NO: 297587 - DNA, 25 bp, Artificial Sequence
  Description of Artificial Sequence: Synthetic oligonucleotide
ctggccaccttcgacatgcagacgg

SEQ ID NO: 297588 - DNA, 27 bp, Artificial Sequence
  Description of Artificial Sequence: Synthetic oligonucleotide
tggccaccttcgacatgcagacgggta

SEQ ID NO: 297589 - DNA, 27 bp, Artificial Sequence
  Description of Artificial Sequence: Synthetic oligonucleotide
ggccaccttcgacatgcagacgggtat

SEQ ID NO: 297590 - DNA, 30 bp, Artificial Sequence
  Description of Artificial Sequence: Synthetic oligonucleotide
gccaccttcgacatgcagacgggtattaac

SEQ ID NO: 297591 - DNA, 30 bp, Artificial Sequence
  Description of Artificial Sequence: Synthetic oligonucleotide
ccaccttcgacatgcagacgggtattaacc

SEQ ID NO: 297592 - DNA, 32 bp, Artificial Sequence
  Description of Artificial Sequence: Synthetic oligonucleotide
caccttcgacatgcagacgggtattaaccatg

SEQ ID NO: 297593 - DNA, 32 bp, Artificial Sequence
  Description of Artificial Sequence: Synthetic oligonucleotide
accttcgacatgcagacgggtattaaccatgc

SEQ ID NO: 297594 - DNA, 31 bp, Artificial Sequence
  Description of Artificial Sequence: Synthetic oligonucleotide
ccttcgacatgcagacgggtattaaccatgc

SEQ ID NO: 297595 - DNA, 32 bp, Artificial Sequence
  Description of Artificial Sequence: Synthetic oligonucleotide
cttcgacatgcagacgggtattaaccatgcag

SEQ ID NO: 297596 - DNA, 32 bp, Artificial Sequence
  Description of Artificial Sequence: Synthetic oligonucleotide
ttcgacatgcagacgggtattaaccatgcagc

SEQ ID NO: 297597 - DNA, 31 bp, Artificial Sequence
  Description of Artificial Sequence: Synthetic oligonucleotide
tcgacatgcagacgggtattaaccatgcagc

SEQ ID NO: 297598 - DNA, 30 bp, Artificial Sequence
  Description of Artificial Sequence: Synthetic oligonucleotide
cgacatgcagacgggtattaaccatgcagc

SEQ ID NO: 297599 - DNA, 31 bp, Artificial Sequence
  Description of Artificial Sequence: Synthetic oligonucleotide
gacatgcagacgggtattaaccatgcagctg

SEQ ID NO: 297600 - DNA, 33 bp, Artificial Sequence
  Description of Artificial Sequence: Synthetic oligonucleotide
acatgcagacgggtattaaccatgcagctgaag

SEQ ID NO: 297601 - DNA, 32 bp, Artificial Sequence
  Description of Artificial Sequence: Synthetic oligonucleotide
catgcagacgggtattaaccatgcagctgaag

SEQ ID NO: 297602 - DNA, 33 bp, Artificial Sequence
  Description of Artificial Sequence: Synthetic oligonucleotide
atgcagacgggtattaaccatgcagctgaagag

SEQ ID NO: 297603 - DNA, 32 bp, Artificial Sequence
  Description of Artificial Sequence: Synthetic oligonucleotide
tgcagacgggtattaaccatgcagctgaagag

SEQ ID NO: 297604 - DNA, 31 bp, Artificial Sequence
  Description of Artificial Sequence: Synthetic oligonucleotide
gcagacgggtattaaccatgcagctgaagag

SEQ ID NO: 297605 - DNA, 33 bp, Artificial Sequence
  Description of Artificial Sequence: Synthetic oligonucleotide
cagacgggtattaaccatgcagctgaagagaag

SEQ ID NO: 297606 - DNA, 33 bp, Artificial Sequence
  Description of Artificial Sequence: Synthetic oligonucleotide
agacgggtattaaccatgcagctgaagagaagc

SEQ ID NO: 297607 - DNA, 32 bp, Artificial Sequence
  Description of Artificial Sequence: Synthetic oligonucleotide
gacgggtattaaccatgcagctgaagagaagc

SEQ ID NO: 297608 - DNA, 33 bp, Artificial Sequence
  Description of Artificial Sequence: Synthetic oligonucleotide
acgggtattaaccatgcagctgaagagaagcac

SEQ ID NO: 297609 - DNA, 32 bp, Artificial Sequence
  Description of Artificial Sequence: Synthetic oligonucleotide
cgggtattaaccatgcagctgaagagaagcac

SEQ ID NO: 297610 - DNA, 33 bp, Artificial Sequence
  Description of Artificial Sequence: Synthetic oligonucleotide
gggtattaaccatgcagctgaagagaagcactg

SEQ ID NO: 297611 - DNA, 33 bp, Artificial Sequence
  Description of Artificial Sequence: Synthetic oligonucleotide
ggtattaaccatgcagctgaagagaagcactgg

SEQ ID NO: 297612 - DNA, 37 bp, Artificial Sequence
  Description of Artificial Sequence: Synthetic oligonucleotide
gtattaaccatgcagctgaagagaagcactggaaaag

SEQ ID NO: 297613 - DNA, 38 bp, Artificial Sequence
  Description of Artificial Sequence: Synthetic oligonucleotide
tattaaccatgcagctgaagagaagcactggaaaagtg

SEQ ID NO: 297614 - DNA, 37 bp, Artificial Sequence
  Description of Artificial Sequence: Synthetic oligonucleotide
attaaccatgcagctgaagagaagcactggaaaagtg

SEQ ID NO: 297615 - DNA, 36 bp, Artificial Sequence
  Description of Artificial Sequence: Synthetic oligonucleotide
ttaaccatgcagctgaagagaagcactggaaaagtg

SEQ ID NO: 297616 - DNA, 35 bp, Artificial Sequence
  Description of Artificial Sequence: Synthetic oligonucleotide
taaccatgcagctgaagagaagcactggaaaagtg

SEQ ID NO: 297617 - DNA, 34 bp, Artificial Sequence
  Description of Artificial Sequence: Synthetic oligonucleotide
aaccatgcagctgaagagaagcactggaaaagtg

SEQ ID NO: 297618 - DNA, 33 bp, Artificial Sequence
  Description of Artificial Sequence: Synthetic oligonucleotide
accatgcagctgaagagaagcactggaaaagtg

SEQ ID NO: 297619 - DNA, 32 bp, Artificial Sequence
  Description of Artificial Sequence: Synthetic oligonucleotide
ccatgcagctgaagagaagcactggaaaagtg

SEQ ID NO: 297620 - DNA, 32 bp, Artificial Sequence
  Description of Artificial Sequence: Synthetic oligonucleotide
catgcagctgaagagaagcactggaaaagtgc

SEQ ID NO: 297621 - DNA, 32 bp, Artificial Sequence
  Description of Artificial Sequence: Synthetic oligonucleotide
atgcagctgaagagaagcactggaaaagtgcg

SEQ ID NO: 297622 - DNA, 31 bp, Artificial Sequence
  Description of Artificial Sequence: Synthetic oligonucleotide
tgcagctgaagagaagcactggaaaagtgcg

SEQ ID NO: 297623 - DNA, 30 bp, Artificial Sequence
  Description of Artificial Sequence: Synthetic oligonucleotide
gcagctgaagagaagcactggaaaagtgcg

SEQ ID NO: 297624 - DNA, 32 bp, Artificial Sequence
  Description of Artificial Sequence: Synthetic oligonucleotide
cagctgaagagaagcactggaaaagtgcgtac

SEQ ID NO: 297625 - DNA, 33 bp, Artificial Sequence
  Description of Artificial Sequence: Synthetic oligonucleotide
agctgaagagaagcactggaaaagtgcgtactc

SEQ ID NO: 297626 - DNA, 32 bp, Artificial Sequence
  Description of Artificial Sequence: Synthetic oligonucleotide
gctgaagagaagcactggaaaagtgcgtactc

SEQ ID NO: 297627 - DNA, 35 bp, Artificial Sequence
  Description of Artificial Sequence: Synthetic oligonucleotide
ctgaagagaagcactggaaaagtgcgtactcttac

SEQ ID NO: 297628 - DNA, 37 bp, Artificial Sequence
  Description of Artificial Sequence: Synthetic oligonucleotide
tgaagagaagcactggaaaagtgcgtactcttacttc

SEQ ID NO: 297629 - DNA, 36 bp, Artificial Sequence
  Description of Artificial Sequence: Synthetic oligonucleotide
gaagagaagcactggaaaagtgcgtactcttacttc

SEQ ID NO: 297630 - DNA, 39 bp, Artificial Sequence
  Description of Artificial Sequence: Synthetic oligonucleotide
aagagaagcactggaaaagtgcgtactcttacttctatc

SEQ ID NO: 297631 - DNA, 38 bp, Artificial Sequence
  Description of Artificial Sequence: Synthetic oligonucleotide
agagaagcactggaaaagtgcgtactcttacttctatc

SEQ ID NO: 297632 - DNA, 37 bp, Artificial Sequence
  Description of Artificial Sequence: Synthetic oligonucleotide
gagaagcactggaaaagtgcgtactcttacttctatc

SEQ ID NO: 297633 - DNA, 38 bp, Artificial Sequence
  Description of Artificial Sequence: Synthetic oligonucleotide
agaagcactggaaaagtgcgtactcttacttctatcag

SEQ ID NO: 297634 - DNA, 37 bp, Artificial Sequence
  Description of Artificial Sequence: Synthetic oligonucleotide
gaagcactggaaaagtgcgtactcttacttctatcag

SEQ ID NO: 297635 - DNA, 37 bp, Artificial Sequence
  Description of Artificial Sequence: Synthetic oligonucleotide
aagcactggaaaagtgcgtactcttacttctatcagg

SEQ ID NO: 297636 - DNA, 36 bp, Artificial Sequence
  Description of Artificial Sequence: Synthetic oligonucleotide
agcactggaaaagtgcgtactcttacttctatcagg

SEQ ID NO: 297637 - DNA, 35 bp, Artificial Sequence
  Description of Artificial Sequence: Synthetic oligonucleotide
gcactggaaaagtgcgtactcttacttctatcagg

SEQ ID NO: 297638 - DNA, 35 bp, Artificial Sequence
  Description of Artificial Sequence: Synthetic oligonucleotide
cactggaaaagtgcgtactcttacttctatcaggc

SEQ ID NO: 297639 - DNA, 39 bp, Artificial Sequence
  Description of Artificial Sequence: Synthetic oligonucleotide
actggaaaagtgcgtactcttacttctatcaggcatttg

SEQ ID NO: 297640 - DNA, 38 bp, Artificial Sequence
  Description of Artificial Sequence: Synthetic oligonucleotide
ctggaaaagtgcgtactcttacttctatcaggcatttg

SEQ ID NO: 297641 - DNA, 39 bp, Artificial Sequence
  Description of Artificial Sequence: Synthetic oligonucleotide
tggaaaagtgcgtactcttacttctatcaggcatttgtg

SEQ ID NO: 297642 - DNA, 38 bp, Artificial Sequence
  Description of Artificial Sequence: Synthetic oligonucleotide
ggaaaagtgcgtactcttacttctatcaggcatttgtg

SEQ ID NO: 297643 - DNA, 38 bp, Artificial Sequence
  Description of Artificial Sequence: Synthetic oligonucleotide
gaaaagtgcgtactcttacttctatcaggcatttgtgg

SEQ ID NO: 297644 - DNA, 38 bp, Artificial Sequence
  Description of Artificial Sequence: Synthetic oligonucleotide
aaaagtgcgtactcttacttctatcaggcatttgtggg

SEQ ID NO: 297645 - DNA, 37 bp, Artificial Sequence
  Description of Artificial Sequence: Synthetic oligonucleotide
aaagtgcgtactcttacttctatcaggcatttgtggg

SEQ ID NO: 297646 - DNA, 36 bp, Artificial Sequence
  Description of Artificial Sequence: Synthetic oligonucleotide
aagtgcgtactcttacttctatcaggcatttgtggg

SEQ ID NO: 297647 - DNA, 35 bp, Artificial Sequence
  Description of Artificial Sequence: Synthetic oligonucleotide
agtgcgtactcttacttctatcaggcatttgtggg

SEQ ID NO: 297648 - DNA, 34 bp, Artificial Sequence
  Description of Artificial Sequence: Synthetic oligonucleotide
gtgcgtactcttacttctatcaggcatttgtggg

SEQ ID NO: 297649 - DNA, 38 bp, Artificial Sequence
  Description of Artificial Sequence: Synthetic oligonucleotide
tgcgtactcttacttctatcaggcatttgtgggttatg

SEQ ID NO: 297650 - DNA, 37 bp, Artificial Sequence
  Description of Artificial Sequence: Synthetic oligonucleotide
gcgtactcttacttctatcaggcatttgtgggttatg

SEQ ID NO: 297651 - DNA, 38 bp, Artificial Sequence
  Description of Artificial Sequence: Synthetic oligonucleotide
cgtactcttacttctatcaggcatttgtgggttatgag

SEQ ID NO: 297652 - DNA, 39 bp, Artificial Sequence
  Description of Artificial Sequence: Synthetic oligonucleotide
gtactcttacttctatcaggcatttgtgggttatgagtc

SEQ ID NO: 297653 - DNA, 39 bp, Artificial Sequence
  Description of Artificial Sequence: Synthetic oligonucleotide
tactcttacttctatcaggcatttgtgggttatgagtcc

SEQ ID NO: 297654 - DNA, 38 bp, Artificial Sequence
  Description of Artificial Sequence: Synthetic oligonucleotide
actcttacttctatcaggcatttgtgggttatgagtcc

SEQ ID NO: 297655 - DNA, 37 bp, Artificial Sequence
  Description of Artificial Sequence: Synthetic oligonucleotide
ctcttacttctatcaggcatttgtgggttatgagtcc

SEQ ID NO: 297656 - DNA, 39 bp, Artificial Sequence
  Description of Artificial Sequence: Synthetic oligonucleotide
tcttacttctatcaggcatttgtgggttatgagtccatc

SEQ ID NO: 297657 - DNA, 38 bp, Artificial Sequence
  Description of Artificial Sequence: Synthetic oligonucleotide
cttacttctatcaggcatttgtgggttatgagtccatc

SEQ ID NO: 297658 - DNA, 38 bp, Artificial Sequence
  Description of Artificial Sequence: Synthetic oligonucleotide
ttacttctatcaggcatttgtgggttatgagtccatcg

SEQ ID NO: 297659 - DNA, 37 bp, Artificial Sequence
  Description of Artificial Sequence: Synthetic oligonucleotide
tacttctatcaggcatttgtgggttatgagtccatcg

SEQ ID NO: 297660 - DNA, 36 bp, Artificial Sequence
  Description of Artificial Sequence: Synthetic oligonucleotide
acttctatcaggcatttgtgggttatgagtccatcg

SEQ ID NO: 297661 - DNA, 35 bp, Artificial Sequence
  Description of Artificial Sequence: Synthetic oligonucleotide
cttctatcaggcatttgtgggttatgagtccatcg

SEQ ID NO: 297662 - DNA, 36 bp, Artificial Sequence
  Description of Artificial Sequence: Synthetic oligonucleotide
ttctatcaggcatttgtgggttatgagtccatcgac

SEQ ID NO: 297663 - DNA, 35 bp, Artificial Sequence
  Description of Artificial Sequence: Synthetic oligonucleotide
tctatcaggcatttgtgggttatgagtccatcgac

SEQ ID NO: 297664 - DNA, 34 bp, Artificial Sequence
  Description of Artificial Sequence: Synthetic oligonucleotide
ctatcaggcatttgtgggttatgagtccatcgac

SEQ ID NO: 297665 - DNA, 35 bp, Artificial Sequence
  Description of Artificial Sequence: Synthetic oligonucleotide
tatcaggcatttgtgggttatgagtccatcgactg

SEQ ID NO: 297666 - DNA, 34 bp, Artificial Sequence
  Description of Artificial Sequence: Synthetic oligonucleotide
atcaggcatttgtgggttatgagtccatcgactg

SEQ ID NO: 297667 - DNA, 33 bp, Artificial Sequence
  Description of Artificial Sequence: Synthetic oligonucleotide
tcaggcatttgtgggttatgagtccatcgactg

SEQ ID NO: 297668 - DNA, 32 bp, Artificial Sequence
  Description of Artificial Sequence: Synthetic oligonucleotide
caggcatttgtgggttatgagtccatcgactg

SEQ ID NO: 297669 - DNA, 32 bp, Artificial Sequence
  Description of Artificial Sequence: Synthetic oligonucleotide
aggcatttgtgggttatgagtccatcgactgc

SEQ ID NO: 297670 - DNA, 31 bp, Artificial Sequence
  Description of Artificial Sequence: Synthetic oligonucleotide
ggcatttgtgggttatgagtccatcgactgc

SEQ ID NO: 297671 - DNA, 31 bp, Artificial Sequence
  Description of Artificial Sequence: Synthetic oligonucleotide
gcatttgtgggttatgagtccatcgactgcc

SEQ ID NO: 297672 - DNA, 31 bp, Artificial Sequence
  Description of Artificial Sequence: Synthetic oligonucleotide
catttgtgggttatgagtccatcgactgccc

SEQ ID NO: 297673 - DNA, 31 bp, Artificial Sequence
  Description of Artificial Sequence: Synthetic oligonucleotide
atttgtgggttatgagtccatcgactgcccc

SEQ ID NO: 297674 - DNA, 30 bp, Artificial Sequence
  Description of Artificial Sequence: Synthetic oligonucleotide
tttgtgggttatgagtccatcgactgcccc

SEQ ID NO: 297675 - DNA, 29 bp, Artificial Sequence
  Description of Artificial Sequence: Synthetic oligonucleotide
ttgtgggttatgagtccatcgactgcccc

SEQ ID NO: 297676 - DNA, 28 bp, Artificial Sequence
  Description of Artificial Sequence: Synthetic oligonucleotide
tgtgggttatgagtccatcgactgcccc

SEQ ID NO: 297677 - DNA, 27 bp, Artificial Sequence
  Description of Artificial Sequence: Synthetic oligonucleotide
gtgggttatgagtccatcgactgcccc

SEQ ID NO: 297678 - DNA, 29 bp, Artificial Sequence
  Description of Artificial Sequence: Synthetic oligonucleotide
tgggttatgagtccatcgactgccccaag

SEQ ID NO: 297679 - DNA, 28 bp, Artificial Sequence
  Description of Artificial Sequence: Synthetic oligonucleotide
gggttatgagtccatcgactgccccaag

SEQ ID NO: 297680 - DNA, 28 bp, Artificial Sequence
  Description of Artificial Sequence: Synthetic oligonucleotide
ggttatgagtccatcgactgccccaagg

SEQ ID NO: 297681 - DNA, 28 bp, Artificial Sequence
  Description of Artificial Sequence: Synthetic oligonucleotide
gttatgagtccatcgactgccccaaggg

SEQ ID NO: 297682 - DNA, 28 bp, Artificial Sequence
  Description of Artificial Sequence: Synthetic oligonucleotide
ttatgagtccatcgactgccccaagggc

SEQ ID NO: 297683 - DNA, 27 bp, Artificial Sequence
  Description of Artificial Sequence: Synthetic oligonucleotide
tatgagtccatcgactgccccaagggc

SEQ ID NO: 297684 - DNA, 27 bp, Artificial Sequence
  Description of Artificial Sequence: Synthetic oligonucleotide
atgagtccatcgactgccccaagggca

SEQ ID NO: 297685 - DNA, 27 bp, Artificial Sequence
  Description of Artificial Sequence: Synthetic oligonucleotide
tgagtccatcgactgccccaagggcat

SEQ ID NO: 297686 - DNA, 26 bp, Artificial Sequence
  Description of Artificial Sequence: Synthetic oligonucleotide
gagtccatcgactgccccaagggcat

SEQ ID NO: 297687 - DNA, 27 bp, Artificial Sequence
  Description of Artificial Sequence: Synthetic oligonucleotide
agtccatcgactgccccaagggcatca

SEQ ID NO: 297688 - DNA, 26 bp, Artificial Sequence
  Description of Artificial Sequence: Synthetic oligonucleotide
gtccatcgactgccccaagggcatca

SEQ ID NO: 297689 - DNA, 27 bp, Artificial Sequence
  Description of Artificial Sequence: Synthetic oligonucleotide
tccatcgactgccccaagggcatcaca

SEQ ID NO: 297690 - DNA, 27 bp, Artificial Sequence
  Description of Artificial Sequence: Synthetic oligonucleotide
ccatcgactgccccaagggcatcacat

SEQ ID NO: 297691 - DNA, 27 bp, Artificial Sequence
  Description of Artificial Sequence: Synthetic oligonucleotide
catcgactgccccaagggcatcacatc

SEQ ID NO: 297692 - DNA, 28 bp, Artificial Sequence
  Description of Artificial Sequence: Synthetic oligonucleotide
atcgactgccccaagggcatcacatcac

SEQ ID NO: 297693 - DNA, 27 bp, Artificial Sequence
  Description of Artificial Sequence: Synthetic oligonucleotide
tcgactgccccaagggcatcacatcac

SEQ ID NO: 297694 - DNA, 27 bp, Artificial Sequence
  Description of Artificial Sequence: Synthetic oligonucleotide
cgactgccccaagggcatcacatcact

SEQ ID NO: 297695 - DNA, 27 bp, Artificial Sequence
  Description of Artificial Sequence: Synthetic oligonucleotide
gactgccccaagggcatcacatcactg

SEQ ID NO: 297696 - DNA, 29 bp, Artificial Sequence
  Description of Artificial Sequence: Synthetic oligonucleotide
actgccccaagggcatcacatcactgaag

SEQ ID NO: 297697 - DNA, 28 bp, Artificial Sequence
  Description of Artificial Sequence: Synthetic oligonucleotide
ctgccccaagggcatcacatcactgaag

SEQ ID NO: 297698 - DNA, 30 bp, Artificial Sequence
  Description of Artificial Sequence: Synthetic oligonucleotide
tgccccaagggcatcacatcactgaagtac

SEQ ID NO: 297699 - DNA, 29 bp, Artificial Sequence
  Description of Artificial Sequence: Synthetic oligonucleotide
gccccaagggcatcacatcactgaagtac

SEQ ID NO: 297700 - DNA, 31 bp, Artificial Sequence
  Description of Artificial Sequence: Synthetic oligonucleotide
ccccaagggcatcacatcactgaagtacttg

SEQ ID NO: 297701 - DNA, 33 bp, Artificial Sequence
  Description of Artificial Sequence: Synthetic oligonucleotide
cccaagggcatcacatcactgaagtacttgttg

SEQ ID NO: 297702 - DNA, 33 bp, Artificial Sequence
  Description of Artificial Sequence: Synthetic oligonucleotide
ccaagggcatcacatcactgaagtacttgttgc

SEQ ID NO: 297703 - DNA, 34 bp, Artificial Sequence
  Description of Artificial Sequence: Synthetic oligonucleotide
caagggcatcacatcactgaagtacttgttgctg

SEQ ID NO: 297704 - DNA, 35 bp, Artificial Sequence
  Description of Artificial Sequence: Synthetic oligonucleotide
aagggcatcacatcactgaagtacttgttgctgtc

SEQ ID NO: 297705 - DNA, 34 bp, Artificial Sequence
  Description of Artificial Sequence: Synthetic oligonucleotide
agggcatcacatcactgaagtacttgttgctgtc

SEQ ID NO: 297706 - DNA, 33 bp, Artificial Sequence
  Description of Artificial Sequence: Synthetic oligonucleotide
gggcatcacatcactgaagtacttgttgctgtc

SEQ ID NO: 297707 - DNA, 33 bp, Artificial Sequence
  Description of Artificial Sequence: Synthetic oligonucleotide
ggcatcacatcactgaagtacttgttgctgtcc

SEQ ID NO: 297708 - DNA, 38 bp, Artificial Sequence
  Description of Artificial Sequence: Synthetic oligonucleotide
gcatcacatcactgaagtacttgttgctgtccaaaatc

SEQ ID NO: 297709 - DNA, 40 bp, Artificial Sequence
  Description of Artificial Sequence: Synthetic oligonucleotide
catcacatcactgaagtacttgttgctgtccaaaatcatc

SEQ ID NO: 297710 - DNA, 40 bp, Artificial Sequence
  Description of Artificial Sequence: Synthetic oligonucleotide
atcacatcactgaagtacttgttgctgtccaaaatcatcc

SEQ ID NO: 297711 - DNA, 39 bp, Artificial Sequence
  Description of Artificial Sequence: Synthetic oligonucleotide
tcacatcactgaagtacttgttgctgtccaaaatcatcc

SEQ ID NO: 297712 - DNA, 38 bp, Artificial Sequence
  Description of Artificial Sequence: Synthetic oligonucleotide
cacatcactgaagtacttgttgctgtccaaaatcatcc

SEQ ID NO: 297713 - DNA, 39 bp, Artificial Sequence
  Description of Artificial Sequence: Synthetic oligonucleotide
acatcactgaagtacttgttgctgtccaaaatcatcctc

SEQ ID NO: 297714 - DNA, 38 bp, Artificial Sequence
  Description of Artificial Sequence: Synthetic oligonucleotide
catcactgaagtacttgttgctgtccaaaatcatcctc

SEQ ID NO: 297715 - DNA, 40 bp, Artificial Sequence
  Description of Artificial Sequence: Synthetic oligonucleotide
atcactgaagtacttgttgctgtccaaaatcatcctcaac

SEQ ID NO: 297716 - DNA, 39 bp, Artificial Sequence
  Description of Artificial Sequence: Synthetic oligonucleotide
tcactgaagtacttgttgctgtccaaaatcatcctcaac

SEQ ID NO: 297717 - DNA, 38 bp, Artificial Sequence
  Description of Artificial Sequence: Synthetic oligonucleotide
cactgaagtacttgttgctgtccaaaatcatcctcaac

SEQ ID NO: 297718 - DNA, 39 bp, Artificial Sequence
  Description of Artificial Sequence: Synthetic oligonucleotide
actgaagtacttgttgctgtccaaaatcatcctcaacac

SEQ ID NO: 297719 - DNA, 38 bp, Artificial Sequence
  Description of Artificial Sequence: Synthetic oligonucleotide
ctgaagtacttgttgctgtccaaaatcatcctcaacac

SEQ ID NO: 297720 - DNA, 38 bp, Artificial Sequence
  Description of Artificial Sequence: Synthetic oligonucleotide
tgaagtacttgttgctgtccaaaatcatcctcaacacc

SEQ ID NO: 297721 - DNA, 37 bp, Artificial Sequence
  Description of Artificial Sequence: Synthetic oligonucleotide
gaagtacttgttgctgtccaaaatcatcctcaacacc

SEQ ID NO: 297722 - DNA, 37 bp, Artificial Sequence
  Description of Artificial Sequence: Synthetic oligonucleotide
aagtacttgttgctgtccaaaatcatcctcaacaccg

SEQ ID NO: 297723 - DNA, 36 bp, Artificial Sequence
  Description of Artificial Sequence: Synthetic oligonucleotide
agtacttgttgctgtccaaaatcatcctcaacaccg

SEQ ID NO: 297724 - DNA, 35 bp, Artificial Sequence
  Description of Artificial Sequence: Synthetic oligonucleotide
gtacttgttgctgtccaaaatcatcctcaacaccg

SEQ ID NO: 297725 - DNA, 35 bp, Artificial Sequence
  Description of Artificial Sequence: Synthetic oligonucleotide
tacttgttgctgtccaaaatcatcctcaacaccgc

SEQ ID NO: 297726 - DNA, 34 bp, Artificial Sequence
  Description of Artificial Sequence: Synthetic oligonucleotide
acttgttgctgtccaaaatcatcctcaacaccgc

SEQ ID NO: 297727 - DNA, 33 bp, Artificial Sequence
  Description of Artificial Sequence: Synthetic oligonucleotide
cttgttgctgtccaaaatcatcctcaacaccgc

SEQ ID NO: 297728 - DNA, 34 bp, Artificial Sequence
  Description of Artificial Sequence: Synthetic oligonucleotide
ttgttgctgtccaaaatcatcctcaacaccgcag

SEQ ID NO: 297729 - DNA, 33 bp, Artificial Sequence
  Description of Artificial Sequence: Synthetic oligonucleotide
tgttgctgtccaaaatcatcctcaacaccgcag

SEQ ID NO: 297730 - DNA, 32 bp, Artificial Sequence
  Description of Artificial Sequence: Synthetic oligonucleotide
gttgctgtccaaaatcatcctcaacaccgcag

SEQ ID NO: 297731 - DNA, 34 bp, Artificial Sequence
  Description of Artificial Sequence: Synthetic oligonucleotide
ttgctgtccaaaatcatcctcaacaccgcagaag

SEQ ID NO: 297732 - DNA, 33 bp, Artificial Sequence
  Description of Artificial Sequence: Synthetic oligonucleotide
tgctgtccaaaatcatcctcaacaccgcagaag

SEQ ID NO: 297733 - DNA, 32 bp, Artificial Sequence
  Description of Artificial Sequence: Synthetic oligonucleotide
gctgtccaaaatcatcctcaacaccgcagaag

SEQ ID NO: 297734 - DNA, 34 bp, Artificial Sequence
  Description of Artificial Sequence: Synthetic oligonucleotide
ctgtccaaaatcatcctcaacaccgcagaagatg

SEQ ID NO: 297735 - DNA, 35 bp, Artificial Sequence
  Description of Artificial Sequence: Synthetic oligonucleotide
tgtccaaaatcatcctcaacaccgcagaagatgac

SEQ ID NO: 297736 - DNA, 34 bp, Artificial Sequence
  Description of Artificial Sequence: Synthetic oligonucleotide
gtccaaaatcatcctcaacaccgcagaagatgac

SEQ ID NO: 297737 - DNA, 34 bp, Artificial Sequence
  Description of Artificial Sequence: Synthetic oligonucleotide
tccaaaatcatcctcaacaccgcagaagatgacc

SEQ ID NO: 297738 - DNA, 33 bp, Artificial Sequence
  Description of Artificial Sequence: Synthetic oligonucleotide
ccaaaatcatcctcaacaccgcagaagatgacc

SEQ ID NO: 297739 - DNA, 34 bp, Artificial Sequence
  Description of Artificial Sequence: Synthetic oligonucleotide
caaaatcatcctcaacaccgcagaagatgaccag

SEQ ID NO: 297740 - DNA, 34 bp, Artificial Sequence
  Description of Artificial Sequence: Synthetic oligonucleotide
aaaatcatcctcaacaccgcagaagatgaccagg

SEQ ID NO: 297741 - DNA, 33 bp, Artificial Sequence
  Description of Artificial Sequence: Synthetic oligonucleotide
aaatcatcctcaacaccgcagaagatgaccagg

SEQ ID NO: 297742 - DNA, 32 bp, Artificial Sequence
  Description of Artificial Sequence: Synthetic oligonucleotide
aatcatcctcaacaccgcagaagatgaccagg

SEQ ID NO: 297743 - DNA, 31 bp, Artificial Sequence
  Description of Artificial Sequence: Synthetic oligonucleotide
atcatcctcaacaccgcagaagatgaccagg

SEQ ID NO: 297744 - DNA, 30 bp, Artificial Sequence
  Description of Artificial Sequence: Synthetic oligonucleotide
tcatcctcaacaccgcagaagatgaccagg

SEQ ID NO: 297745 - DNA, 29 bp, Artificial Sequence
  Description of Artificial Sequence: Synthetic oligonucleotide
catcctcaacaccgcagaagatgaccagg

SEQ ID NO: 297746 - DNA, 29 bp, Artificial Sequence
  Description of Artificial Sequence: Synthetic oligonucleotide
atcctcaacaccgcagaagatgaccaggc

SEQ ID NO: 297747 - DNA, 28 bp, Artificial Sequence
  Description of Artificial Sequence: Synthetic oligonucleotide
tcctcaacaccgcagaagatgaccaggc

SEQ ID NO: 297748 - DNA, 27 bp, Artificial Sequence
  Description of Artificial Sequence: Synthetic oligonucleotide
cctcaacaccgcagaagatgaccaggc

SEQ ID NO: 297749 - DNA, 30 bp, Artificial Sequence
  Description of Artificial Sequence: Synthetic oligonucleotide
ctcaacaccgcagaagatgaccaggctttc

SEQ ID NO: 297750 - DNA, 30 bp, Artificial Sequence
  Description of Artificial Sequence: Synthetic oligonucleotide
tcaacaccgcagaagatgaccaggctttcg

SEQ ID NO: 297751 - DNA, 29 bp, Artificial Sequence
  Description of Artificial Sequence: Synthetic oligonucleotide
caacaccgcagaagatgaccaggctttcg

SEQ ID NO: 297752 - DNA, 30 bp, Artificial Sequence
  Description of Artificial Sequence: Synthetic oligonucleotide
aacaccgcagaagatgaccaggctttcgtg

SEQ ID NO: 297753 - DNA, 29 bp, Artificial Sequence
  Description of Artificial Sequence: Synthetic oligonucleotide
acaccgcagaagatgaccaggctttcgtg

SEQ ID NO: 297754 - DNA, 28 bp, Artificial Sequence
  Description of Artificial Sequence: Synthetic oligonucleotide
caccgcagaagatgaccaggctttcgtg

SEQ ID NO: 297755 - DNA, 29 bp, Artificial Sequence
  Description of Artificial Sequence: Synthetic oligonucleotide
accgcagaagatgaccaggctttcgtgag

SEQ ID NO: 297756 - DNA, 28 bp, Artificial Sequence
  Description of Artificial Sequence: Synthetic oligonucleotide
ccgcagaagatgaccaggctttcgtgag

SEQ ID NO: 297757 - DNA, 28 bp, Artificial Sequence
  Description of Artificial Sequence: Synthetic oligonucleotide
cgcagaagatgaccaggctttcgtgagc

SEQ ID NO: 297758 - DNA, 28 bp, Artificial Sequence
  Description of Artificial Sequence: Synthetic oligonucleotide
gcagaagatgaccaggctttcgtgagcg

SEQ ID NO: 297759 - DNA, 28 bp, Artificial Sequence
  Description of Artificial Sequence: Synthetic oligonucleotide
cagaagatgaccaggctttcgtgagcgg

SEQ ID NO: 297760 - DNA, 28 bp, Artificial Sequence
  Description of Artificial Sequence: Synthetic oligonucleotide
agaagatgaccaggctttcgtgagcggg

SEQ ID NO: 297761 - DNA, 27 bp, Artificial Sequence
  Description of Artificial Sequence: Synthetic oligonucleotide
gaagatgaccaggctttcgtgagcggg

SEQ ID NO: 297762 - DNA, 29 bp, Artificial Sequence
  Description of Artificial Sequence: Synthetic oligonucleotide
aagatgaccaggctttcgtgagcgggtag

SEQ ID NO: 297763 - DNA, 28 bp, Artificial Sequence
  Description of Artificial Sequence: Synthetic oligonucleotide
agatgaccaggctttcgtgagcgggtag

SEQ ID NO: 297764 - DNA, 27 bp, Artificial Sequence
  Description of Artificial Sequence: Synthetic oligonucleotide
gatgaccaggctttcgtgagcgggtag

SEQ ID NO: 297765 - DNA, 27 bp, Artificial Sequence
  Description of Artificial Sequence: Synthetic oligonucleotide
atgaccaggctttcgtgagcgggtagc

SEQ ID NO: 297766 - DNA, 27 bp, Artificial Sequence
  Description of Artificial Sequence: Synthetic oligonucleotide
tgaccaggctttcgtgagcgggtagct

SEQ ID NO: 297767 - DNA, 27 bp, Artificial Sequence
  Description of Artificial Sequence: Synthetic oligonucleotide
gaccaggctttcgtgagcgggtagctt

SEQ ID NO: 297768 - DNA, 27 bp, Artificial Sequence
  Description of Artificial Sequence: Synthetic oligonucleotide
accaggctttcgtgagcgggtagcttg

SEQ ID NO: 297769 - DNA, 26 bp, Artificial Sequence
  Description of Artificial Sequence: Synthetic oligonucleotide
ccaggctttcgtgagcgggtagcttg

SEQ ID NO: 297770 - DNA, 27 bp, Artificial Sequence
  Description of Artificial Sequence: Synthetic oligonucleotide
caggctttcgtgagcgggtagcttgca

SEQ ID NO: 297771 - DNA, 27 bp, Artificial Sequence
  Description of Artificial Sequence: Synthetic oligonucleotide
aggctttcgtgagcgggtagcttgcac

SEQ ID NO: 297772 - DNA, 27 bp, Artificial Sequence
  Description of Artificial Sequence: Synthetic oligonucleotide
ggctttcgtgagcgggtagcttgcaca

SEQ ID NO: 297773 - DNA, 28 bp, Artificial Sequence
  Description of Artificial Sequence: Synthetic oligonucleotide
gctttcgtgagcgggtagcttgcacatc

SEQ ID NO: 297774 - DNA, 28 bp, Artificial Sequence
  Description of Artificial Sequence: Synthetic oligonucleotide
ctttcgtgagcgggtagcttgcacatcg

SEQ ID NO: 297775 - DNA, 28 bp, Artificial Sequence
  Description of Artificial Sequence: Synthetic oligonucleotide
tttcgtgagcgggtagcttgcacatcgg

SEQ ID NO: 297776 - DNA, 27 bp, Artificial Sequence
  Description of Artificial Sequence: Synthetic oligonucleotide
ttcgtgagcgggtagcttgcacatcgg

SEQ ID NO: 297777 - DNA, 27 bp, Artificial Sequence
  Description of Artificial Sequence: Synthetic oligonucleotide
tcgtgagcgggtagcttgcacatcggt

SEQ ID NO: 297778 - DNA, 27 bp, Artificial Sequence
  Description of Artificial Sequence: Synthetic oligonucleotide
cgtgagcgggtagcttgcacatcggta

SEQ ID NO: 297779 - DNA, 28 bp, Artificial Sequence
  Description of Artificial Sequence: Synthetic oligonucleotide
gtgagcgggtagcttgcacatcggtatg

SEQ ID NO: 297780 - DNA, 28 bp, Artificial Sequence
  Description of Artificial Sequence: Synthetic oligonucleotide
tgagcgggtagcttgcacatcggtatgc

SEQ ID NO: 297781 - DNA, 27 bp, Artificial Sequence
  Description of Artificial Sequence: Synthetic oligonucleotide
gagcgggtagcttgcacatcggtatgc

SEQ ID NO: 297782 - DNA, 28 bp, Artificial Sequence
  Description of Artificial Sequence: Synthetic oligonucleotide
agcgggtagcttgcacatcggtatgctg

SEQ ID NO: 297783 - DNA, 27 bp, Artificial Sequence
  Description of Artificial Sequence: Synthetic oligonucleotide
gcgggtagcttgcacatcggtatgctg

SEQ ID NO: 297784 - DNA, 27 bp, Artificial Sequence
  Description of Artificial Sequence: Synthetic oligonucleotide
cgggtagcttgcacatcggtatgctgg

SEQ ID NO: 297785 - DNA, 27 bp, Artificial Sequence
  Description of Artificial Sequence: Synthetic oligonucleotide
gggtagcttgcacatcggtatgctggg

SEQ ID NO: 297786 - DNA, 28 bp, Artificial Sequence
  Description of Artificial Sequence: Synthetic oligonucleotide
ggtagcttgcacatcggtatgctgggag

SEQ ID NO: 297787 - DNA, 28 bp, Artificial Sequence
  Description of Artificial Sequence: Synthetic oligonucleotide
gtagcttgcacatcggtatgctgggagg

SEQ ID NO: 297788 - DNA, 28 bp, Artificial Sequence
  Description of Artificial Sequence: Synthetic oligonucleotide
tagcttgcacatcggtatgctgggaggc

SEQ ID NO: 297789 - DNA, 27 bp, Artificial Sequence
  Description of Artificial Sequence: Synthetic oligonucleotide
agcttgcacatcggtatgctgggaggc

SEQ ID NO: 297790 - DNA, 27 bp, Artificial Sequence
  Description of Artificial Sequence: Synthetic oligonucleotide
gcttgcacatcggtatgctgggaggca

SEQ ID NO: 297791 - DNA, 27 bp, Artificial Sequence
  Description of Artificial Sequence: Synthetic oligonucleotide
cttgcacatcggtatgctgggaggcag

SEQ ID NO: 297792 - DNA, 28 bp, Artificial Sequence
  Description of Artificial Sequence: Synthetic oligonucleotide
ttgcacatcggtatgctgggaggcagtc

SEQ ID NO: 297793 - DNA, 27 bp, Artificial Sequence
  Description of Artificial Sequence: Synthetic oligonucleotide
tgcacatcggtatgctgggaggcagtc

SEQ ID NO: 297794 - DNA, 27 bp, Artificial Sequence
  Description of Artificial Sequence: Synthetic oligonucleotide
gcacatcggtatgctgggaggcagtca

SEQ ID NO: 297795 - DNA, 27 bp, Artificial Sequence
  Description of Artificial Sequence: Synthetic oligonucleotide
cacatcggtatgctgggaggcagtcag

SEQ ID NO: 297796 - DNA, 29 bp, Artificial Sequence
  Description of Artificial Sequence: Synthetic oligonucleotide
acatcggtatgctgggaggcagtcagaag

SEQ ID NO: 297797 - DNA, 28 bp, Artificial Sequence
  Description of Artificial Sequence: Synthetic oligonucleotide
catcggtatgctgggaggcagtcagaag

SEQ ID NO: 297798 - DNA, 28 bp, Artificial Sequence
  Description of Artificial Sequence: Synthetic oligonucleotide
atcggtatgctgggaggcagtcagaagc

SEQ ID NO: 297799 - DNA, 27 bp, Artificial Sequence
  Description of Artificial Sequence: Synthetic oligonucleotide
tcggtatgctgggaggcagtcagaagc

SEQ ID NO: 297800 - DNA, 27 bp, Artificial Sequence
  Description of Artificial Sequence: Synthetic oligonucleotide
cggtatgctgggaggcagtcagaagca

SEQ ID NO: 297801 - DNA, 34 bp, Artificial Sequence
  Description of Artificial Sequence: Synthetic oligonucleotide
ggtatgctgggaggcagtcagaagcataaaaatg

SEQ ID NO: 297802 - DNA, 34 bp, Artificial Sequence
  Description of Artificial Sequence: Synthetic oligonucleotide
gtatgctgggaggcagtcagaagcataaaaatgc

SEQ ID NO: 297803 - DNA, 34 bp, Artificial Sequence
  Description of Artificial Sequence: Synthetic oligonucleotide
tatgctgggaggcagtcagaagcataaaaatgcg

SEQ ID NO: 297804 - DNA, 33 bp, Artificial Sequence
  Description of Artificial Sequence: Synthetic oligonucleotide
atgctgggaggcagtcagaagcataaaaatgcg

SEQ ID NO: 297805 - DNA, 32 bp, Artificial Sequence
  Description of Artificial Sequence: Synthetic oligonucleotide
tgctgggaggcagtcagaagcataaaaatgcg

SEQ ID NO: 297806 - DNA, 31 bp, Artificial Sequence
  Description of Artificial Sequence: Synthetic oligonucleotide
gctgggaggcagtcagaagcataaaaatgcg

SEQ ID NO: 297807 - DNA, 32 bp, Artificial Sequence
  Description of Artificial Sequence: Synthetic oligonucleotide
ctgggaggcagtcagaagcataaaaatgcgtc

SEQ ID NO: 297808 - DNA, 32 bp, Artificial Sequence
  Description of Artificial Sequence: Synthetic oligonucleotide
tgggaggcagtcagaagcataaaaatgcgtcg

SEQ ID NO: 297809 - DNA, 31 bp, Artificial Sequence
  Description of Artificial Sequence: Synthetic oligonucleotide
gggaggcagtcagaagcataaaaatgcgtcg

SEQ ID NO: 297810 - DNA, 31 bp, Artificial Sequence
  Description of Artificial Sequence: Synthetic oligonucleotide
ggaggcagtcagaagcataaaaatgcgtcgc

SEQ ID NO: 297811 - DNA, 32 bp, Artificial Sequence
  Description of Artificial Sequence: Synthetic oligonucleotide
gaggcagtcagaagcataaaaatgcgtcgctc

SEQ ID NO: 297812 - DNA, 33 bp, Artificial Sequence
  Description of Artificial Sequence: Synthetic oligonucleotide
aggcagtcagaagcataaaaatgcgtcgctcag

SEQ ID NO: 297813 - DNA, 32 bp, Artificial Sequence
  Description of Artificial Sequence: Synthetic oligonucleotide
ggcagtcagaagcataaaaatgcgtcgctcag

SEQ ID NO: 297814 - DNA, 32 bp, Artificial Sequence
  Description of Artificial Sequence: Synthetic oligonucleotide
gcagtcagaagcataaaaatgcgtcgctcagg

SEQ ID NO: 297815 - DNA, 32 bp, Artificial Sequence
  Description of Artificial Sequence: Synthetic oligonucleotide
cagtcagaagcataaaaatgcgtcgctcaggc

SEQ ID NO: 297816 - DNA, 34 bp, Artificial Sequence
  Description of Artificial Sequence: Synthetic oligonucleotide
agtcagaagcataaaaatgcgtcgctcaggcttg

SEQ ID NO: 297817 - DNA, 33 bp, Artificial Sequence
  Description of Artificial Sequence: Synthetic oligonucleotide
gtcagaagcataaaaatgcgtcgctcaggcttg

SEQ ID NO: 297818 - DNA, 33 bp, Artificial Sequence
  Description of Artificial Sequence: Synthetic oligonucleotide
tcagaagcataaaaatgcgtcgctcaggcttgc

SEQ ID NO: 297819 - DNA, 32 bp, Artificial Sequence
  Description of Artificial Sequence: Synthetic oligonucleotide
cagaagcataaaaatgcgtcgctcaggcttgc

SEQ ID NO: 297820 - DNA, 34 bp, Artificial Sequence
  Description of Artificial Sequence: Synthetic oligonucleotide
agaagcataaaaatgcgtcgctcaggcttgcaag

SEQ ID NO: 297821 - DNA, 33 bp, Artificial Sequence
  Description of Artificial Sequence: Synthetic oligonucleotide
gaagcataaaaatgcgtcgctcaggcttgcaag

SEQ ID NO: 297822 - DNA, 35 bp, Artificial Sequence
  Description of Artificial Sequence: Synthetic oligonucleotide
aagcataaaaatgcgtcgctcaggcttgcaagaac

SEQ ID NO: 297823 - DNA, 34 bp, Artificial Sequence
  Description of Artificial Sequence: Synthetic oligonucleotide
agcataaaaatgcgtcgctcaggcttgcaagaac

SEQ ID NO: 297824 - DNA, 33 bp, Artificial Sequence
  Description of Artificial Sequence: Synthetic oligonucleotide
gcataaaaatgcgtcgctcaggcttgcaagaac

SEQ ID NO: 297825 - DNA, 34 bp, Artificial Sequence
  Description of Artificial Sequence: Synthetic oligonucleotide
cataaaaatgcgtcgctcaggcttgcaagaacac

SEQ ID NO: 297826 - DNA, 36 bp, Artificial Sequence
  Description of Artificial Sequence: Synthetic oligonucleotide
ataaaaatgcgtcgctcaggcttgcaagaacacatc

SEQ ID NO: 297827 - DNA, 35 bp, Artificial Sequence
  Description of Artificial Sequence: Synthetic oligonucleotide
taaaaatgcgtcgctcaggcttgcaagaacacatc

SEQ ID NO: 297828 - DNA, 34 bp, Artificial Sequence
  Description of Artificial Sequence: Synthetic oligonucleotide
aaaaatgcgtcgctcaggcttgcaagaacacatc

SEQ ID NO: 297829 - DNA, 33 bp, Artificial Sequence
  Description of Artificial Sequence: Synthetic oligonucleotide
aaaatgcgtcgctcaggcttgcaagaacacatc

SEQ ID NO: 297830 - DNA, 32 bp, Artificial Sequence
  Description of Artificial Sequence: Synthetic oligonucleotide
aaatgcgtcgctcaggcttgcaagaacacatc

SEQ ID NO: 297831 - DNA, 31 bp, Artificial Sequence
  Description of Artificial Sequence: Synthetic oligonucleotide
aatgcgtcgctcaggcttgcaagaacacatc

SEQ ID NO: 297832 - DNA, 30 bp, Artificial Sequence
  Description of Artificial Sequence: Synthetic oligonucleotide
atgcgtcgctcaggcttgcaagaacacatc

SEQ ID NO: 297833 - DNA, 29 bp, Artificial Sequence
  Description of Artificial Sequence: Synthetic oligonucleotide
tgcgtcgctcaggcttgcaagaacacatc

SEQ ID NO: 297834 - DNA, 28 bp, Artificial Sequence
  Description of Artificial Sequence: Synthetic oligonucleotide
gcgtcgctcaggcttgcaagaacacatc

SEQ ID NO: 297835 - DNA, 29 bp, Artificial Sequence
  Description of Artificial Sequence: Synthetic oligonucleotide
cgtcgctcaggcttgcaagaacacatcac

SEQ ID NO: 297836 - DNA, 30 bp, Artificial Sequence
  Description of Artificial Sequence: Synthetic oligonucleotide
gtcgctcaggcttgcaagaacacatcactg

SEQ ID NO: 297837 - DNA, 30 bp, Artificial Sequence
  Description of Artificial Sequence: Synthetic oligonucleotide
tcgctcaggcttgcaagaacacatcactgg

SEQ ID NO: 297838 - DNA, 29 bp, Artificial Sequence
  Description of Artificial Sequence: Synthetic oligonucleotide
cgctcaggcttgcaagaacacatcactgg

SEQ ID NO: 297839 - DNA, 29 bp, Artificial Sequence
  Description of Artificial Sequence: Synthetic oligonucleotide
gctcaggcttgcaagaacacatcactggc

SEQ ID NO: 297840 - DNA, 30 bp, Artificial Sequence
  Description of Artificial Sequence: Synthetic oligonucleotide
ctcaggcttgcaagaacacatcactggctg

SEQ ID NO: 297841 - DNA, 35 bp, Artificial Sequence
  Description of Artificial Sequence: Synthetic oligonucleotide
tcaggcttgcaagaacacatcactggctgattttg

SEQ ID NO: 297842 - DNA, 34 bp, Artificial Sequence
  Description of Artificial Sequence: Synthetic oligonucleotide
caggcttgcaagaacacatcactggctgattttg

SEQ ID NO: 297843 - DNA, 38 bp, Artificial Sequence
  Description of Artificial Sequence: Synthetic oligonucleotide
aggcttgcaagaacacatcactggctgattttgaatag

SEQ ID NO: 297844 - DNA, 37 bp, Artificial Sequence
  Description of Artificial Sequence: Synthetic oligonucleotide
ggcttgcaagaacacatcactggctgattttgaatag

SEQ ID NO: 297845 - DNA, 37 bp, Artificial Sequence
  Description of Artificial Sequence: Synthetic oligonucleotide
gcttgcaagaacacatcactggctgattttgaatagg

SEQ ID NO: 297846 - DNA, 37 bp, Artificial Sequence
  Description of Artificial Sequence: Synthetic oligonucleotide
cttgcaagaacacatcactggctgattttgaataggc

SEQ ID NO: 297847 - DNA, 38 bp, Artificial Sequence
  Description of Artificial Sequence: Synthetic oligonucleotide
ttgcaagaacacatcactggctgattttgaataggctc

SEQ ID NO: 297848 - DNA, 37 bp, Artificial Sequence
  Description of Artificial Sequence: Synthetic oligonucleotide
tgcaagaacacatcactggctgattttgaataggctc

SEQ ID NO: 297849 - DNA, 36 bp, Artificial Sequence
  Description of Artificial Sequence: Synthetic oligonucleotide
gcaagaacacatcactggctgattttgaataggctc

SEQ ID NO: 297850 - DNA, 37 bp, Artificial Sequence
  Description of Artificial Sequence: Synthetic oligonucleotide
caagaacacatcactggctgattttgaataggctctg

SEQ ID NO: 297851 - DNA, 38 bp, Artificial Sequence
  Description of Artificial Sequence: Synthetic oligonucleotide
aagaacacatcactggctgattttgaataggctctgag

SEQ ID NO: 297852 - DNA, 37 bp, Artificial Sequence
  Description of Artificial Sequence: Synthetic oligonucleotide
agaacacatcactggctgattttgaataggctctgag

SEQ ID NO: 297853 - DNA, 36 bp, Artificial Sequence
  Description of Artificial Sequence: Synthetic oligonucleotide
gaacacatcactggctgattttgaataggctctgag

SEQ ID NO: 297854 - DNA, 37 bp, Artificial Sequence
  Description of Artificial Sequence: Synthetic oligonucleotide
aacacatcactggctgattttgaataggctctgagag

SEQ ID NO: 297855 - DNA, 36 bp, Artificial Sequence
  Description of Artificial Sequence: Synthetic oligonucleotide
acacatcactggctgattttgaataggctctgagag

SEQ ID NO: 297856 - DNA, 35 bp, Artificial Sequence
  Description of Artificial Sequence: Synthetic oligonucleotide
cacatcactggctgattttgaataggctctgagag

SEQ ID NO: 297857 - DNA, 39 bp, Artificial Sequence
  Description of Artificial Sequence: Synthetic oligonucleotide
acatcactggctgattttgaataggctctgagagattac

SEQ ID NO: 297858 - DNA, 38 bp, Artificial Sequence
  Description of Artificial Sequence: Synthetic oligonucleotide
catcactggctgattttgaataggctctgagagattac

SEQ ID NO: 297859 - DNA, 38 bp, Artificial Sequence
  Description of Artificial Sequence: Synthetic oligonucleotide
atcactggctgattttgaataggctctgagagattacc

SEQ ID NO: 297860 - DNA, 37 bp, Artificial Sequence
  Description of Artificial Sequence: Synthetic oligonucleotide
tcactggctgattttgaataggctctgagagattacc

SEQ ID NO: 297861 - DNA, 36 bp, Artificial Sequence
  Description of Artificial Sequence: Synthetic oligonucleotide
cactggctgattttgaataggctctgagagattacc

SEQ ID NO: 297862 - DNA, 36 bp, Artificial Sequence
  Description of Artificial Sequence: Synthetic oligonucleotide
actggctgattttgaataggctctgagagattaccg

SEQ ID NO: 297863 - DNA, 35 bp, Artificial Sequence
  Description of Artificial Sequence: Synthetic oligonucleotide
ctggctgattttgaataggctctgagagattaccg

SEQ ID NO: 297864 - DNA, 35 bp, Artificial Sequence
  Description of Artificial Sequence: Synthetic oligonucleotide
tggctgattttgaataggctctgagagattaccgc

SEQ ID NO: 297865 - DNA, 34 bp, Artificial Sequence
  Description of Artificial Sequence: Synthetic oligonucleotide
ggctgattttgaataggctctgagagattaccgc

SEQ ID NO: 297866 - DNA, 34 bp, Artificial Sequence
  Description of Artificial Sequence: Synthetic oligonucleotide
gctgattttgaataggctctgagagattaccgcg

SEQ ID NO: 297867 - DNA, 34 bp, Artificial Sequence
  Description of Artificial Sequence: Synthetic oligonucleotide
ctgattttgaataggctctgagagattaccgcgc

SEQ ID NO: 297868 - DNA, 35 bp, Artificial Sequence
  Description of Artificial Sequence: Synthetic oligonucleotide
tgattttgaataggctctgagagattaccgcgcag

SEQ ID NO: 297869 - DNA, 34 bp, Artificial Sequence
  Description of Artificial Sequence: Synthetic oligonucleotide
gattttgaataggctctgagagattaccgcgcag

SEQ ID NO: 297870 - DNA, 35 bp, Artificial Sequence
  Description of Artificial Sequence: Synthetic oligonucleotide
attttgaataggctctgagagattaccgcgcagag

SEQ ID NO: 297871 - DNA, 34 bp, Artificial Sequence
  Description of Artificial Sequence: Synthetic oligonucleotide
ttttgaataggctctgagagattaccgcgcagag

SEQ ID NO: 297872 - DNA, 33 bp, Artificial Sequence
  Description of Artificial Sequence: Synthetic oligonucleotide
tttgaataggctctgagagattaccgcgcagag

SEQ ID NO: 297873 - DNA, 32 bp, Artificial Sequence
  Description of Artificial Sequence: Synthetic oligonucleotide
ttgaataggctctgagagattaccgcgcagag

SEQ ID NO: 297874 - DNA, 31 bp, Artificial Sequence
  Description of Artificial Sequence: Synthetic oligonucleotide
tgaataggctctgagagattaccgcgcagag

SEQ ID NO: 297875 - DNA, 30 bp, Artificial Sequence
  Description of Artificial Sequence: Synthetic oligonucleotide
gaataggctctgagagattaccgcgcagag

SEQ ID NO: 297876 - DNA, 30 bp, Artificial Sequence
  Description of Artificial Sequence: Synthetic oligonucleotide
aataggctctgagagattaccgcgcagagc

SEQ ID NO: 297877 - DNA, 29 bp, Artificial Sequence
  Description of Artificial Sequence: Synthetic oligonucleotide
ataggctctgagagattaccgcgcagagc

SEQ ID NO: 297878 - DNA, 28 bp, Artificial Sequence
  Description of Artificial Sequence: Synthetic oligonucleotide
taggctctgagagattaccgcgcagagc

SEQ ID NO: 297879 - DNA, 27 bp, Artificial Sequence
  Description of Artificial Sequence: Synthetic oligonucleotide
aggctctgagagattaccgcgcagagc

SEQ ID NO: 297880 - DNA, 27 bp, Artificial Sequence
  Description of Artificial Sequence: Synthetic oligonucleotide
ggctctgagagattaccgcgcagagct

SEQ ID NO: 297881 - DNA, 27 bp, Artificial Sequence
  Description of Artificial Sequence: Synthetic oligonucleotide
gctctgagagattaccgcgcagagctc

SEQ ID NO: 297882 - DNA, 27 bp, Artificial Sequence
  Description of Artificial Sequence: Synthetic oligonucleotide
ctctgagagattaccgcgcagagctcg

SEQ ID NO: 297883 - DNA, 27 bp, Artificial Sequence
  Description of Artificial Sequence: Synthetic oligonucleotide
tctgagagattaccgcgcagagctcgg

SEQ ID NO: 297884 - DNA, 26 bp, Artificial Sequence
  Description of Artificial Sequence: Synthetic oligonucleotide
ctgagagattaccgcgcagagctcgg

SEQ ID NO: 297885 - DNA, 26 bp, Artificial Sequence
  Description of Artificial Sequence: Synthetic oligonucleotide
tgagagattaccgcgcagagctcggg

SEQ ID NO: 297886 - DNA, 25 bp, Artificial Sequence
  Description of Artificial Sequence: Synthetic oligonucleotide
gagagattaccgcgcagagctcggg

SEQ ID NO: 297887 - DNA, 27 bp, Artificial Sequence
  Description of Artificial Sequence: Synthetic oligonucleotide
agagattaccgcgcagagctcggggat

SEQ ID NO: 297888 - DNA, 26 bp, Artificial Sequence
  Description of Artificial Sequence: Synthetic oligonucleotide
gagattaccgcgcagagctcggggat

SEQ ID NO: 297889 - DNA, 27 bp, Artificial Sequence
  Description of Artificial Sequence: Synthetic oligonucleotide
agattaccgcgcagagctcggggatga

SEQ ID NO: 297890 - DNA, 26 bp, Artificial Sequence
  Description of Artificial Sequence: Synthetic oligonucleotide
gattaccgcgcagagctcggggatga

SEQ ID NO: 297891 - DNA, 26 bp, Artificial Sequence
  Description of Artificial Sequence: Synthetic oligonucleotide
attaccgcgcagagctcggggatgac

SEQ ID NO: 297892 - DNA, 25 bp, Artificial Sequence
  Description of Artificial Sequence: Synthetic oligonucleotide
ttaccgcgcagagctcggggatgac

SEQ ID NO: 297893 - DNA, 24 bp, Artificial Sequence
  Description of Artificial Sequence: Synthetic oligonucleotide
taccgcgcagagctcggggatgac

SEQ ID NO: 297894 - DNA, 23 bp, Artificial Sequence
  Description of Artificial Sequence: Synthetic oligonucleotide
accgcgcagagctcggggatgac

SEQ ID NO: 297895 - DNA, 22 bp, Artificial Sequence
  Description of Artificial Sequence: Synthetic oligonucleotide
ccgcgcagagctcggggatgac

SEQ ID NO: 297896 - DNA, 22 bp, Artificial Sequence
  Description of Artificial Sequence: Synthetic oligonucleotide
cgcgcagagctcggggatgacc

SEQ ID NO: 297897 - DNA, 25 bp, Artificial Sequence
  Description of Artificial Sequence: Synthetic oligonucleotide
gcgcagagctcggggatgaccgaat

SEQ ID NO: 297898 - DNA, 27 bp, Artificial Sequence
  Description of Artificial Sequence: Synthetic oligonucleotide
cgcagagctcggggatgaccgaatcat

SEQ ID NO: 297899 - DNA, 27 bp, Artificial Sequence
  Description of Artificial Sequence: Synthetic oligonucleotide
gcagagctcggggatgaccgaatcatc

SEQ ID NO: 297900 - DNA, 28 bp, Artificial Sequence
  Description of Artificial Sequence: Synthetic oligonucleotide
cagagctcggggatgaccgaatcatcag

SEQ ID NO: 297901 - DNA, 28 bp, Artificial Sequence
  Description of Artificial Sequence: Synthetic oligonucleotide
agagctcggggatgaccgaatcatcagg

SEQ ID NO: 297902 - DNA, 27 bp, Artificial Sequence
  Description of Artificial Sequence: Synthetic oligonucleotide
gagctcggggatgaccgaatcatcagg

SEQ ID NO: 297903 - DNA, 28 bp, Artificial Sequence
  Description of Artificial Sequence: Synthetic oligonucleotide
agctcggggatgaccgaatcatcaggac

SEQ ID NO: 297904 - DNA, 27 bp, Artificial Sequence
  Description of Artificial Sequence: Synthetic oligonucleotide
gctcggggatgaccgaatcatcaggac

SEQ ID NO: 297905 - DNA, 28 bp, Artificial Sequence
  Description of Artificial Sequence: Synthetic oligonucleotide
ctcggggatgaccgaatcatcaggacac

SEQ ID NO: 297906 - DNA, 29 bp, Artificial Sequence
  Description of Artificial Sequence: Synthetic oligonucleotide
tcggggatgaccgaatcatcaggacacac

SEQ ID NO: 297907 - DNA, 28 bp, Artificial Sequence
  Description of Artificial Sequence: Synthetic oligonucleotide
cggggatgaccgaatcatcaggacacac

SEQ ID NO: 297908 - DNA, 30 bp, Artificial Sequence
  Description of Artificial Sequence: Synthetic oligonucleotide
ggggatgaccgaatcatcaggacacacttg

SEQ ID NO: 297909 - DNA, 30 bp, Artificial Sequence
  Description of Artificial Sequence: Synthetic oligonucleotide
gggatgaccgaatcatcaggacacacttgc

SEQ ID NO: 297910 - DNA, 30 bp, Artificial Sequence
  Description of Artificial Sequence: Synthetic oligonucleotide
ggatgaccgaatcatcaggacacacttgcc

SEQ ID NO: 297911 - DNA, 30 bp, Artificial Sequence
  Description of Artificial Sequence: Synthetic oligonucleotide
gatgaccgaatcatcaggacacacttgccc

SEQ ID NO: 297912 - DNA, 32 bp, Artificial Sequence
  Description of Artificial Sequence: Synthetic oligonucleotide
atgaccgaatcatcaggacacacttgcccaag

SEQ ID NO: 297913 - DNA, 31 bp, Artificial Sequence
  Description of Artificial Sequence: Synthetic oligonucleotide
tgaccgaatcatcaggacacacttgcccaag

SEQ ID NO: 297914 - DNA, 30 bp, Artificial Sequence
  Description of Artificial Sequence: Synthetic oligonucleotide
gaccgaatcatcaggacacacttgcccaag

SEQ ID NO: 297915 - DNA, 32 bp, Artificial Sequence
  Description of Artificial Sequence: Synthetic oligonucleotide
accgaatcatcaggacacacttgcccaagttg

SEQ ID NO: 297916 - DNA, 31 bp, Artificial Sequence
  Description of Artificial Sequence: Synthetic oligonucleotide
ccgaatcatcaggacacacttgcccaagttg

SEQ ID NO: 297917 - DNA, 34 bp, Artificial Sequence
  Description of Artificial Sequence: Synthetic oligonucleotide
cgaatcatcaggacacacttgcccaagttgtttg

SEQ ID NO: 297918 - DNA, 38 bp, Artificial Sequence
  Description of Artificial Sequence: Synthetic oligonucleotide
gaatcatcaggacacacttgcccaagttgtttgataac

SEQ ID NO: 297919 - DNA, 41 bp, Artificial Sequence
  Description of Artificial Sequence: Synthetic oligonucleotide
aatcatcaggacacacttgcccaagttgtttgataactttc

SEQ ID NO: 297920 - DNA, 40 bp, Artificial Sequence
  Description of Artificial Sequence: Synthetic oligonucleotide
atcatcaggacacacttgcccaagttgtttgataactttc

SEQ ID NO: 297921 - DNA, 39 bp, Artificial Sequence
  Description of Artificial Sequence: Synthetic oligonucleotide
tcatcaggacacacttgcccaagttgtttgataactttc

SEQ ID NO: 297922 - DNA, 38 bp, Artificial Sequence
  Description of Artificial Sequence: Synthetic oligonucleotide
catcaggacacacttgcccaagttgtttgataactttc

SEQ ID NO: 297923 - DNA, 40 bp, Artificial Sequence
  Description of Artificial Sequence: Synthetic oligonucleotide
atcaggacacacttgcccaagttgtttgataactttctag

SEQ ID NO: 297924 - DNA, 39 bp, Artificial Sequence
  Description of Artificial Sequence: Synthetic oligonucleotide
tcaggacacacttgcccaagttgtttgataactttctag

SEQ ID NO: 297925 - DNA, 38 bp, Artificial Sequence
  Description of Artificial Sequence: Synthetic oligonucleotide
caggacacacttgcccaagttgtttgataactttctag

SEQ ID NO: 297926 - DNA, 40 bp, Artificial Sequence
  Description of Artificial Sequence: Synthetic oligonucleotide
aggacacacttgcccaagttgtttgataactttctagaac

SEQ ID NO: 297927 - DNA, 39 bp, Artificial Sequence
  Description of Artificial Sequence: Synthetic oligonucleotide
ggacacacttgcccaagttgtttgataactttctagaac

SEQ ID NO: 297928 - DNA, 40 bp, Artificial Sequence
  Description of Artificial Sequence: Synthetic oligonucleotide
gacacacttgcccaagttgtttgataactttctagaacag

SEQ ID NO: 297929 - DNA, 43 bp, Artificial Sequence
  Description of Artificial Sequence: Synthetic oligonucleotide
acacacttgcccaagttgtttgataactttctagaacagtatc

SEQ ID NO: 297930 - DNA, 42 bp, Artificial Sequence
  Description of Artificial Sequence: Synthetic oligonucleotide
cacacttgcccaagttgtttgataactttctagaacagtatc

SEQ ID NO: 297931 - DNA, 43 bp, Artificial Sequence
  Description of Artificial Sequence: Synthetic oligonucleotide
acacttgcccaagttgtttgataactttctagaacagtatctg

SEQ ID NO: 297932 - DNA, 42 bp, Artificial Sequence
  Description of Artificial Sequence: Synthetic oligonucleotide
cacttgcccaagttgtttgataactttctagaacagtatctg

SEQ ID NO: 297933 - DNA, 44 bp, Artificial Sequence
  Description of Artificial Sequence: Synthetic oligonucleotide
acttgcccaagttgtttgataactttctagaacagtatctgatc

SEQ ID NO: 297934 - DNA, 43 bp, Artificial Sequence
  Description of Artificial Sequence: Synthetic oligonucleotide
cttgcccaagttgtttgataactttctagaacagtatctgatc

SEQ ID NO: 297935 - DNA, 43 bp, Artificial Sequence
  Description of Artificial Sequence: Synthetic oligonucleotide
ttgcccaagttgtttgataactttctagaacagtatctgatcc

SEQ ID NO: 297936 - DNA, 42 bp, Artificial Sequence
  Description of Artificial Sequence: Synthetic oligonucleotide
tgcccaagttgtttgataactttctagaacagtatctgatcc

SEQ ID NO: 297937 - DNA, 41 bp, Artificial Sequence
  Description of Artificial Sequence: Synthetic oligonucleotide
gcccaagttgtttgataactttctagaacagtatctgatcc

SEQ ID NO: 297938 - DNA, 41 bp, Artificial Sequence
  Description of Artificial Sequence: Synthetic oligonucleotide
cccaagttgtttgataactttctagaacagtatctgatccc

SEQ ID NO: 297939 - DNA, 42 bp, Artificial Sequence
  Description of Artificial Sequence: Synthetic oligonucleotide
ccaagttgtttgataactttctagaacagtatctgatcccag

SEQ ID NO: 297940 - DNA, 43 bp, Artificial Sequence
  Description of Artificial Sequence: Synthetic oligonucleotide
caagttgtttgataactttctagaacagtatctgatcccagtc

SEQ ID NO: 297941 - DNA, 46 bp, Artificial Sequence
  Description of Artificial Sequence: Synthetic oligonucleotide
aagttgtttgataactttctagaacagtatctgatcccagtcattg

SEQ ID NO: 297942 - DNA, 45 bp, Artificial Sequence
  Description of Artificial Sequence: Synthetic oligonucleotide
agttgtttgataactttctagaacagtatctgatcccagtcattg

SEQ ID NO: 297943 - DNA, 44 bp, Artificial Sequence
  Description of Artificial Sequence: Synthetic oligonucleotide
gttgtttgataactttctagaacagtatctgatcccagtcattg

SEQ ID NO: 297944 - DNA, 45 bp, Artificial Sequence
  Description of Artificial Sequence: Synthetic oligonucleotide
ttgtttgataactttctagaacagtatctgatcccagtcattgac

SEQ ID NO: 297945 - DNA, 44 bp, Artificial Sequence
  Description of Artificial Sequence: Synthetic oligonucleotide
tgtttgataactttctagaacagtatctgatcccagtcattgac

SEQ ID NO: 297946 - DNA, 43 bp, Artificial Sequence
  Description of Artificial Sequence: Synthetic oligonucleotide
gtttgataactttctagaacagtatctgatcccagtcattgac

SEQ ID NO: 297947 - DNA, 43 bp, Artificial Sequence
  Description of Artificial Sequence: Synthetic oligonucleotide
tttgataactttctagaacagtatctgatcccagtcattgacc

SEQ ID NO: 297948 - DNA, 42 bp, Artificial Sequence
  Description of Artificial Sequence: Synthetic oligonucleotide
ttgataactttctagaacagtatctgatcccagtcattgacc

SEQ ID NO: 297949 - DNA, 41 bp, Artificial Sequence
  Description of Artificial Sequence: Synthetic oligonucleotide
tgataactttctagaacagtatctgatcccagtcattgacc

SEQ ID NO: 297950 - DNA, 40 bp, Artificial Sequence
  Description of Artificial Sequence: Synthetic oligonucleotide
gataactttctagaacagtatctgatcccagtcattgacc

SEQ ID NO: 297951 - DNA, 40 bp, Artificial Sequence
  Description of Artificial Sequence: Synthetic oligonucleotide
ataactttctagaacagtatctgatcccagtcattgaccc

SEQ ID NO: 297952 - DNA, 39 bp, Artificial Sequence
  Description of Artificial Sequence: Synthetic oligonucleotide
taactttctagaacagtatctgatcccagtcattgaccc

SEQ ID NO: 297953 - DNA, 38 bp, Artificial Sequence
  Description of Artificial Sequence: Synthetic oligonucleotide
aactttctagaacagtatctgatcccagtcattgaccc

SEQ ID NO: 297954 - DNA, 37 bp, Artificial Sequence
  Description of Artificial Sequence: Synthetic oligonucleotide
actttctagaacagtatctgatcccagtcattgaccc

SEQ ID NO: 297955 - DNA, 36 bp, Artificial Sequence
  Description of Artificial Sequence: Synthetic oligonucleotide
ctttctagaacagtatctgatcccagtcattgaccc

SEQ ID NO: 297956 - DNA, 41 bp, Artificial Sequence
  Description of Artificial Sequence: Synthetic oligonucleotide
tttctagaacagtatctgatcccagtcattgaccctttttc

SEQ ID NO: 297957 - DNA, 40 bp, Artificial Sequence
  Description of Artificial Sequence: Synthetic oligonucleotide
ttctagaacagtatctgatcccagtcattgaccctttttc

SEQ ID NO: 297958 - DNA, 39 bp, Artificial Sequence
  Description of Artificial Sequence: Synthetic oligonucleotide
tctagaacagtatctgatcccagtcattgaccctttttc

SEQ ID NO: 297959 - DNA, 38 bp, Artificial Sequence
  Description of Artificial Sequence: Synthetic oligonucleotide
ctagaacagtatctgatcccagtcattgaccctttttc

SEQ ID NO: 297960 - DNA, 38 bp, Artificial Sequence
  Description of Artificial Sequence: Synthetic oligonucleotide
tagaacagtatctgatcccagtcattgaccctttttcc

SEQ ID NO: 297961 - DNA, 37 bp, Artificial Sequence
  Description of Artificial Sequence: Synthetic oligonucleotide
agaacagtatctgatcccagtcattgaccctttttcc

SEQ ID NO: 297962 - DNA, 36 bp, Artificial Sequence
  Description of Artificial Sequence: Synthetic oligonucleotide
gaacagtatctgatcccagtcattgaccctttttcc

SEQ ID NO: 297963 - DNA, 37 bp, Artificial Sequence
  Description of Artificial Sequence: Synthetic oligonucleotide
aacagtatctgatcccagtcattgaccctttttcctg

SEQ ID NO: 297964 - DNA, 36 bp, Artificial Sequence
  Description of Artificial Sequence: Synthetic oligonucleotide
acagtatctgatcccagtcattgaccctttttcctg

SEQ ID NO: 297965 - DNA, 35 bp, Artificial Sequence
  Description of Artificial Sequence: Synthetic oligonucleotide
cagtatctgatcccagtcattgaccctttttcctg

SEQ ID NO: 297966 - DNA, 36 bp, Artificial Sequence
  Description of Artificial Sequence: Synthetic oligonucleotide
agtatctgatcccagtcattgaccctttttcctgag

SEQ ID NO: 297967 - DNA, 35 bp, Artificial Sequence
  Description of Artificial Sequence: Synthetic oligonucleotide
gtatctgatcccagtcattgaccctttttcctgag

SEQ ID NO: 297968 - DNA, 37 bp, Artificial Sequence
  Description of Artificial Sequence: Synthetic oligonucleotide
tatctgatcccagtcattgaccctttttcctgagtac

SEQ ID NO: 297969 - DNA, 36 bp, Artificial Sequence
  Description of Artificial Sequence: Synthetic oligonucleotide
atctgatcccagtcattgaccctttttcctgagtac

SEQ ID NO: 297970 - DNA, 35 bp, Artificial Sequence
  Description of Artificial Sequence: Synthetic oligonucleotide
tctgatcccagtcattgaccctttttcctgagtac

SEQ ID NO: 297971 - DNA, 34 bp, Artificial Sequence
  Description of Artificial Sequence: Synthetic oligonucleotide
ctgatcccagtcattgaccctttttcctgagtac

SEQ ID NO: 297972 - DNA, 35 bp, Artificial Sequence
  Description of Artificial Sequence: Synthetic oligonucleotide
tgatcccagtcattgaccctttttcctgagtacag

SEQ ID NO: 297973 - DNA, 34 bp, Artificial Sequence
  Description of Artificial Sequence: Synthetic oligonucleotide
gatcccagtcattgaccctttttcctgagtacag

SEQ ID NO: 297974 - DNA, 37 bp, Artificial Sequence
  Description of Artificial Sequence: Synthetic oligonucleotide
atcccagtcattgaccctttttcctgagtacagaatg

SEQ ID NO: 297975 - DNA, 36 bp, Artificial Sequence
  Description of Artificial Sequence: Synthetic oligonucleotide
tcccagtcattgaccctttttcctgagtacagaatg

SEQ ID NO: 297976 - DNA, 35 bp, Artificial Sequence
  Description of Artificial Sequence: Synthetic oligonucleotide
cccagtcattgaccctttttcctgagtacagaatg

SEQ ID NO: 297977 - DNA, 37 bp, Artificial Sequence
  Description of Artificial Sequence: Synthetic oligonucleotide
ccagtcattgaccctttttcctgagtacagaatgaac

SEQ ID NO: 297978 - DNA, 38 bp, Artificial Sequence
  Description of Artificial Sequence: Synthetic oligonucleotide
cagtcattgaccctttttcctgagtacagaatgaacac

SEQ ID NO: 297979 - DNA, 42 bp, Artificial Sequence
  Description of Artificial Sequence: Synthetic oligonucleotide
agtcattgaccctttttcctgagtacagaatgaacacatttc

SEQ ID NO: 297980 - DNA, 41 bp, Artificial Sequence
  Description of Artificial Sequence: Synthetic oligonucleotide
gtcattgaccctttttcctgagtacagaatgaacacatttc

SEQ ID NO: 297981 - DNA, 43 bp, Artificial Sequence
  Description of Artificial Sequence: Synthetic oligonucleotide
tcattgaccctttttcctgagtacagaatgaacacatttctag

SEQ ID NO: 297982 - DNA, 42 bp, Artificial Sequence
  Description of Artificial Sequence: Synthetic oligonucleotide
cattgaccctttttcctgagtacagaatgaacacatttctag

SEQ ID NO: 297983 - DNA, 43 bp, Artificial Sequence
  Description of Artificial Sequence: Synthetic oligonucleotide
attgaccctttttcctgagtacagaatgaacacatttctagtc

SEQ ID NO: 297984 - DNA, 42 bp, Artificial Sequence
  Description of Artificial Sequence: Synthetic oligonucleotide
ttgaccctttttcctgagtacagaatgaacacatttctagtc

SEQ ID NO: 297985 - DNA, 41 bp, Artificial Sequence
  Description of Artificial Sequence: Synthetic oligonucleotide
tgaccctttttcctgagtacagaatgaacacatttctagtc

SEQ ID NO: 297986 - DNA, 40 bp, Artificial Sequence
  Description of Artificial Sequence: Synthetic oligonucleotide
gaccctttttcctgagtacagaatgaacacatttctagtc

SEQ ID NO: 297987 - DNA, 41 bp, Artificial Sequence
  Description of Artificial Sequence: Synthetic oligonucleotide
accctttttcctgagtacagaatgaacacatttctagtctc

SEQ ID NO: 297988 - DNA, 40 bp, Artificial Sequence
  Description of Artificial Sequence: Synthetic oligonucleotide
ccctttttcctgagtacagaatgaacacatttctagtctc

SEQ ID NO: 297989 - DNA, 42 bp, Artificial Sequence
  Description of Artificial Sequence: Synthetic oligonucleotide
cctttttcctgagtacagaatgaacacatttctagtctcttc

SEQ ID NO: 297990 - DNA, 45 bp, Artificial Sequence
  Description of Artificial Sequence: Synthetic oligonucleotide
ctttttcctgagtacagaatgaacacatttctagtctcttcaaac

SEQ ID NO: 297991 - DNA, 46 bp, Artificial Sequence
  Description of Artificial Sequence: Synthetic oligonucleotide
tttttcctgagtacagaatgaacacatttctagtctcttcaaactc

SEQ ID NO: 297992 - DNA, 45 bp, Artificial Sequence
  Description of Artificial Sequence: Synthetic oligonucleotide
ttttcctgagtacagaatgaacacatttctagtctcttcaaactc

SEQ ID NO: 297993 - DNA, 44 bp, Artificial Sequence
  Description of Artificial Sequence: Synthetic oligonucleotide
tttcctgagtacagaatgaacacatttctagtctcttcaaactc

SEQ ID NO: 297994 - DNA, 43 bp, Artificial Sequence
  Description of Artificial Sequence: Synthetic oligonucleotide
ttcctgagtacagaatgaacacatttctagtctcttcaaactc

SEQ ID NO: 297995 - DNA, 42 bp, Artificial Sequence
  Description of Artificial Sequence: Synthetic oligonucleotide
tcctgagtacagaatgaacacatttctagtctcttcaaactc

SEQ ID NO: 297996 - DNA, 41 bp, Artificial Sequence
  Description of Artificial Sequence: Synthetic oligonucleotide
cctgagtacagaatgaacacatttctagtctcttcaaactc

SEQ ID NO: 297997 - DNA, 42 bp, Artificial Sequence
  Description of Artificial Sequence: Synthetic oligonucleotide
ctgagtacagaatgaacacatttctagtctcttcaaactctg

SEQ ID NO: 297998 - DNA, 42 bp, Artificial Sequence
  Description of Artificial Sequence: Synthetic oligonucleotide
tgagtacagaatgaacacatttctagtctcttcaaactctgc

SEQ ID NO: 297999 - DNA, 41 bp, Artificial Sequence
  Description of Artificial Sequence: Synthetic oligonucleotide
gagtacagaatgaacacatttctagtctcttcaaactctgc

SEQ ID NO: 298000 - DNA, 43 bp, Artificial Sequence
  Description of Artificial Sequence: Synthetic oligonucleotide
agtacagaatgaacacatttctagtctcttcaaactctgcaag

SEQ ID NO: 298001 - DNA, 42 bp, Artificial Sequence
  Description of Artificial Sequence: Synthetic oligonucleotide
gtacagaatgaacacatttctagtctcttcaaactctgcaag

SEQ ID NO: 298002 - DNA, 42 bp, Artificial Sequence
  Description of Artificial Sequence: Synthetic oligonucleotide
tacagaatgaacacatttctagtctcttcaaactctgcaagg

SEQ ID NO: 298003 - DNA, 41 bp, Artificial Sequence
  Description of Artificial Sequence: Synthetic oligonucleotide
acagaatgaacacatttctagtctcttcaaactctgcaagg

SEQ ID NO: 298004 - DNA, 40 bp, Artificial Sequence
  Description of Artificial Sequence: Synthetic oligonucleotide
cagaatgaacacatttctagtctcttcaaactctgcaagg

SEQ ID NO: 298005 - DNA, 40 bp, Artificial Sequence
  Description of Artificial Sequence: Synthetic oligonucleotide
agaatgaacacatttctagtctcttcaaactctgcaaggc

SEQ ID NO: 298006 - DNA, 39 bp, Artificial Sequence
  Description of Artificial Sequence: Synthetic oligonucleotide
gaatgaacacatttctagtctcttcaaactctgcaaggc

SEQ ID NO: 298007 - DNA, 39 bp, Artificial Sequence
  Description of Artificial Sequence: Synthetic oligonucleotide
aatgaacacatttctagtctcttcaaactctgcaaggcc

SEQ ID NO: 298008 - DNA, 38 bp, Artificial Sequence
  Description of Artificial Sequence: Synthetic oligonucleotide
atgaacacatttctagtctcttcaaactctgcaaggcc

SEQ ID NO: 298009 - DNA, 37 bp, Artificial Sequence
  Description of Artificial Sequence: Synthetic oligonucleotide
tgaacacatttctagtctcttcaaactctgcaaggcc

SEQ ID NO: 298010 - DNA, 36 bp, Artificial Sequence
  Description of Artificial Sequence: Synthetic oligonucleotide
gaacacatttctagtctcttcaaactctgcaaggcc

SEQ ID NO: 298011 - DNA, 36 bp, Artificial Sequence
  Description of Artificial Sequence: Synthetic oligonucleotide
aacacatttctagtctcttcaaactctgcaaggccg

SEQ ID NO: 298012 - DNA, 35 bp, Artificial Sequence
  Description of Artificial Sequence: Synthetic oligonucleotide
acacatttctagtctcttcaaactctgcaaggccg

SEQ ID NO: 298013 - DNA, 34 bp, Artificial Sequence
  Description of Artificial Sequence: Synthetic oligonucleotide
cacatttctagtctcttcaaactctgcaaggccg

SEQ ID NO: 298014 - DNA, 35 bp, Artificial Sequence
  Description of Artificial Sequence: Synthetic oligonucleotide
acatttctagtctcttcaaactctgcaaggccgag

SEQ ID NO: 298015 - DNA, 34 bp, Artificial Sequence
  Description of Artificial Sequence: Synthetic oligonucleotide
catttctagtctcttcaaactctgcaaggccgag

SEQ ID NO: 298016 - DNA, 34 bp, Artificial Sequence
  Description of Artificial Sequence: Synthetic oligonucleotide
atttctagtctcttcaaactctgcaaggccgagg

SEQ ID NO: 298017 - DNA, 33 bp, Artificial Sequence
  Description of Artificial Sequence: Synthetic oligonucleotide
tttctagtctcttcaaactctgcaaggccgagg

SEQ ID NO: 298018 - DNA, 32 bp, Artificial Sequence
  Description of Artificial Sequence: Synthetic oligonucleotide
ttctagtctcttcaaactctgcaaggccgagg

SEQ ID NO: 298019 - DNA, 31 bp, Artificial Sequence
  Description of Artificial Sequence: Synthetic oligonucleotide
tctagtctcttcaaactctgcaaggccgagg

SEQ ID NO: 298020 - DNA, 30 bp, Artificial Sequence
  Description of Artificial Sequence: Synthetic oligonucleotide
ctagtctcttcaaactctgcaaggccgagg

SEQ ID NO: 298021 - DNA, 31 bp, Artificial Sequence
  Description of Artificial Sequence: Synthetic oligonucleotide
tagtctcttcaaactctgcaaggccgaggtg

SEQ ID NO: 298022 - DNA, 30 bp, Artificial Sequence
  Description of Artificial Sequence: Synthetic oligonucleotide
agtctcttcaaactctgcaaggccgaggtg

SEQ ID NO: 298023 - DNA, 29 bp, Artificial Sequence
  Description of Artificial Sequence: Synthetic oligonucleotide
gtctcttcaaactctgcaaggccgaggtg

SEQ ID NO: 298024 - DNA, 29 bp, Artificial Sequence
  Description of Artificial Sequence: Synthetic oligonucleotide
tctcttcaaactctgcaaggccgaggtgg

SEQ ID NO: 298025 - DNA, 28 bp, Artificial Sequence
  Description of Artificial Sequence: Synthetic oligonucleotide
ctcttcaaactctgcaaggccgaggtgg

SEQ ID NO: 298026 - DNA, 31 bp, Artificial Sequence
  Description of Artificial Sequence: Synthetic oligonucleotide
tcttcaaactctgcaaggccgaggtggaaag

SEQ ID NO: 298027 - DNA, 30 bp, Artificial Sequence
  Description of Artificial Sequence: Synthetic oligonucleotide
cttcaaactctgcaaggccgaggtggaaag

SEQ ID NO: 298028 - DNA, 30 bp, Artificial Sequence
  Description of Artificial Sequence: Synthetic oligonucleotide
ttcaaactctgcaaggccgaggtggaaagg

SEQ ID NO: 298029 - DNA, 29 bp, Artificial Sequence
  Description of Artificial Sequence: Synthetic oligonucleotide
tcaaactctgcaaggccgaggtggaaagg

SEQ ID NO: 298030 - DNA, 28 bp, Artificial Sequence
  Description of Artificial Sequence: Synthetic oligonucleotide
caaactctgcaaggccgaggtggaaagg

SEQ ID NO: 298031 - DNA, 35 bp, Artificial Sequence
  Description of Artificial Sequence: Synthetic oligonucleotide
aaactctgcaaggccgaggtggaaaggtaattatc

SEQ ID NO: 298032 - DNA, 34 bp, Artificial Sequence
  Description of Artificial Sequence: Synthetic oligonucleotide
aactctgcaaggccgaggtggaaaggtaattatc

SEQ ID NO: 298033 - DNA, 33 bp, Artificial Sequence
  Description of Artificial Sequence: Synthetic oligonucleotide
actctgcaaggccgaggtggaaaggtaattatc

SEQ ID NO: 298034 - DNA, 32 bp, Artificial Sequence
  Description of Artificial Sequence: Synthetic oligonucleotide
ctctgcaaggccgaggtggaaaggtaattatc

SEQ ID NO: 298035 - DNA, 33 bp, Artificial Sequence
  Description of Artificial Sequence: Synthetic oligonucleotide
tctgcaaggccgaggtggaaaggtaattatcac

SEQ ID NO: 298036 - DNA, 32 bp, Artificial Sequence
  Description of Artificial Sequence: Synthetic oligonucleotide
ctgcaaggccgaggtggaaaggtaattatcac

SEQ ID NO: 298037 - DNA, 33 bp, Artificial Sequence
  Description of Artificial Sequence: Synthetic oligonucleotide
tgcaaggccgaggtggaaaggtaattatcactg

SEQ ID NO: 298038 - DNA, 32 bp, Artificial Sequence
  Description of Artificial Sequence: Synthetic oligonucleotide
gcaaggccgaggtggaaaggtaattatcactg

SEQ ID NO: 298039 - DNA, 34 bp, Artificial Sequence
  Description of Artificial Sequence: Synthetic oligonucleotide
caaggccgaggtggaaaggtaattatcactgatg

SEQ ID NO: 298040 - DNA, 37 bp, Artificial Sequence
  Description of Artificial Sequence: Synthetic oligonucleotide
aaggccgaggtggaaaggtaattatcactgatgattc

SEQ ID NO: 298041 - DNA, 36 bp, Artificial Sequence
  Description of Artificial Sequence: Synthetic oligonucleotide
aggccgaggtggaaaggtaattatcactgatgattc

SEQ ID NO: 298042 - DNA, 35 bp, Artificial Sequence
  Description of Artificial Sequence: Synthetic oligonucleotide
ggccgaggtggaaaggtaattatcactgatgattc

SEQ ID NO: 298043 - DNA, 37 bp, Artificial Sequence
  Description of Artificial Sequence: Synthetic oligonucleotide
gccgaggtggaaaggtaattatcactgatgattctag

SEQ ID NO: 298044 - DNA, 38 bp, Artificial Sequence
  Description of Artificial Sequence: Synthetic oligonucleotide
ccgaggtggaaaggtaattatcactgatgattctagac

SEQ ID NO: 298045 - DNA, 40 bp, Artificial Sequence
  Description of Artificial Sequence: Synthetic oligonucleotide
cgaggtggaaaggtaattatcactgatgattctagacaag

SEQ ID NO: 298046 - DNA, 46 bp, Artificial Sequence
  Description of Artificial Sequence: Synthetic oligonucleotide
gaggtggaaaggtaattatcactgatgattctagacaagaaaattc

SEQ ID NO: 298047 - DNA, 48 bp, Artificial Sequence
  Description of Artificial Sequence: Synthetic oligonucleotide
aggtggaaaggtaattatcactgatgattctagacaagaaaattcatg

SEQ ID NO: 298048 - DNA, 47 bp, Artificial Sequence
  Description of Artificial Sequence: Synthetic oligonucleotide
ggtggaaaggtaattatcactgatgattctagacaagaaaattcatg

SEQ ID NO: 298049 - DNA, 47 bp, Artificial Sequence
  Description of Artificial Sequence: Synthetic oligonucleotide
gtggaaaggtaattatcactgatgattctagacaagaaaattcatgg

SEQ ID NO: 298050 - DNA, 47 bp, Artificial Sequence
  Description of Artificial Sequence: Synthetic oligonucleotide
tggaaaggtaattatcactgatgattctagacaagaaaattcatggg

SEQ ID NO: 298051 - DNA, 46 bp, Artificial Sequence
  Description of Artificial Sequence: Synthetic oligonucleotide
ggaaaggtaattatcactgatgattctagacaagaaaattcatggg

SEQ ID NO: 298052 - DNA, 51 bp, Artificial Sequence
  Description of Artificial Sequence: Synthetic oligonucleotide
gaaaggtaattatcactgatgattctagacaagaaaattcatgggaatttg

SEQ ID NO: 298053 - DNA, 51 bp, Artificial Sequence
  Description of Artificial Sequence: Synthetic oligonucleotide
aaaggtaattatcactgatgattctagacaagaaaattcatgggaatttgg

SEQ ID NO: 298054 - DNA, 50 bp, Artificial Sequence
  Description of Artificial Sequence: Synthetic oligonucleotide
aaggtaattatcactgatgattctagacaagaaaattcatgggaatttgg

SEQ ID NO: 298055 - DNA, 49 bp, Artificial Sequence
  Description of Artificial Sequence: Synthetic oligonucleotide
aggtaattatcactgatgattctagacaagaaaattcatgggaatttgg

SEQ ID NO: 298056 - DNA, 48 bp, Artificial Sequence
  Description of Artificial Sequence: Synthetic oligonucleotide
ggtaattatcactgatgattctagacaagaaaattcatgggaatttgg

SEQ ID NO: 298057 - DNA, 49 bp, Artificial Sequence
  Description of Artificial Sequence: Synthetic oligonucleotide
gtaattatcactgatgattctagacaagaaaattcatgggaatttggac

SEQ ID NO: 298058 - DNA, 49 bp, Artificial Sequence
  Description of Artificial Sequence: Synthetic oligonucleotide
taattatcactgatgattctagacaagaaaattcatgggaatttggacc

SEQ ID NO: 298059 - DNA, 48 bp, Artificial Sequence
  Description of Artificial Sequence: Synthetic oligonucleotide
aattatcactgatgattctagacaagaaaattcatgggaatttggacc

SEQ ID NO: 298060 - DNA, 47 bp, Artificial Sequence
  Description of Artificial Sequence: Synthetic oligonucleotide
attatcactgatgattctagacaagaaaattcatgggaatttggacc

SEQ ID NO: 298061 - DNA, 46 bp, Artificial Sequence
  Description of Artificial Sequence: Synthetic oligonucleotide
ttatcactgatgattctagacaagaaaattcatgggaatttggacc

SEQ ID NO: 298062 - DNA, 45 bp, Artificial Sequence
  Description of Artificial Sequence: Synthetic oligonucleotide
tatcactgatgattctagacaagaaaattcatgggaatttggacc

SEQ ID NO: 298063 - DNA, 44 bp, Artificial Sequence
  Description of Artificial Sequence: Synthetic oligonucleotide
atcactgatgattctagacaagaaaattcatgggaatttggacc

SEQ ID NO: 298064 - DNA, 43 bp, Artificial Sequence
  Description of Artificial Sequence: Synthetic oligonucleotide
tcactgatgattctagacaagaaaattcatgggaatttggacc

SEQ ID NO: 298065 - DNA, 42 bp, Artificial Sequence
  Description of Artificial Sequence: Synthetic oligonucleotide
cactgatgattctagacaagaaaattcatgggaatttggacc

SEQ ID NO: 298066 - DNA, 43 bp, Artificial Sequence
  Description of Artificial Sequence: Synthetic oligonucleotide
actgatgattctagacaagaaaattcatgggaatttggaccac

SEQ ID NO: 298067 - DNA, 42 bp, Artificial Sequence
  Description of Artificial Sequence: Synthetic oligonucleotide
ctgatgattctagacaagaaaattcatgggaatttggaccac

SEQ ID NO: 298068 - DNA, 42 bp, Artificial Sequence
  Description of Artificial Sequence: Synthetic oligonucleotide
tgatgattctagacaagaaaattcatgggaatttggaccacg

SEQ ID NO: 298069 - DNA, 41 bp, Artificial Sequence
  Description of Artificial Sequence: Synthetic oligonucleotide
gatgattctagacaagaaaattcatgggaatttggaccacg

SEQ ID NO: 298070 - DNA, 41 bp, Artificial Sequence
  Description of Artificial Sequence: Synthetic oligonucleotide
atgattctagacaagaaaattcatgggaatttggaccacgg

SEQ ID NO: 298071 - DNA, 40 bp, Artificial Sequence
  Description of Artificial Sequence: Synthetic oligonucleotide
tgattctagacaagaaaattcatgggaatttggaccacgg

SEQ ID NO: 298072 - DNA, 39 bp, Artificial Sequence
  Description of Artificial Sequence: Synthetic oligonucleotide
gattctagacaagaaaattcatgggaatttggaccacgg

SEQ ID NO: 298073 - DNA, 39 bp, Artificial Sequence
  Description of Artificial Sequence: Synthetic oligonucleotide
attctagacaagaaaattcatgggaatttggaccacggg

SEQ ID NO: 298074 - DNA, 38 bp, Artificial Sequence
  Description of Artificial Sequence: Synthetic oligonucleotide
ttctagacaagaaaattcatgggaatttggaccacggg

SEQ ID NO: 298075 - DNA, 37 bp, Artificial Sequence
  Description of Artificial Sequence: Synthetic oligonucleotide
tctagacaagaaaattcatgggaatttggaccacggg

SEQ ID NO: 298076 - DNA, 36 bp, Artificial Sequence
  Description of Artificial Sequence: Synthetic oligonucleotide
ctagacaagaaaattcatgggaatttggaccacggg

SEQ ID NO: 298077 - DNA, 36 bp, Artificial Sequence
  Description of Artificial Sequence: Synthetic oligonucleotide
tagacaagaaaattcatgggaatttggaccacgggg

SEQ ID NO: 298078 - DNA, 35 bp, Artificial Sequence
  Description of Artificial Sequence: Synthetic oligonucleotide
agacaagaaaattcatgggaatttggaccacgggg

SEQ ID NO: 298079 - DNA, 34 bp, Artificial Sequence
  Description of Artificial Sequence: Synthetic oligonucleotide
gacaagaaaattcatgggaatttggaccacgggg

SEQ ID NO: 298080 - DNA, 35 bp, Artificial Sequence
  Description of Artificial Sequence: Synthetic oligonucleotide
acaagaaaattcatgggaatttggaccacggggag

SEQ ID NO: 298081 - DNA, 34 bp, Artificial Sequence
  Description of Artificial Sequence: Synthetic oligonucleotide
caagaaaattcatgggaatttggaccacggggag

SEQ ID NO: 298082 - DNA, 34 bp, Artificial Sequence
  Description of Artificial Sequence: Synthetic oligonucleotide
aagaaaattcatgggaatttggaccacggggagg

SEQ ID NO: 298083 - DNA, 33 bp, Artificial Sequence
  Description of Artificial Sequence: Synthetic oligonucleotide
agaaaattcatgggaatttggaccacggggagg

SEQ ID NO: 298084 - DNA, 32 bp, Artificial Sequence
  Description of Artificial Sequence: Synthetic oligonucleotide
gaaaattcatgggaatttggaccacggggagg

SEQ ID NO: 298085 - DNA, 32 bp, Artificial Sequence
  Description of Artificial Sequence: Synthetic oligonucleotide
aaaattcatgggaatttggaccacggggaggg

SEQ ID NO: 298086 - DNA, 31 bp, Artificial Sequence
  Description of Artificial Sequence: Synthetic oligonucleotide
aaattcatgggaatttggaccacggggaggg

SEQ ID NO: 298087 - DNA, 30 bp, Artificial Sequence
  Description of Artificial Sequence: Synthetic oligonucleotide
aattcatgggaatttggaccacggggaggg

SEQ ID NO: 298088 - DNA, 29 bp, Artificial Sequence
  Description of Artificial Sequence: Synthetic oligonucleotide
attcatgggaatttggaccacggggaggg

SEQ ID NO: 298089 - DNA, 28 bp, Artificial Sequence
  Description of Artificial Sequence: Synthetic oligonucleotide
ttcatgggaatttggaccacggggaggg

SEQ ID NO: 298090 - DNA, 27 bp, Artificial Sequence
  Description of Artificial Sequence: Synthetic oligonucleotide
tcatgggaatttggaccacggggaggg

SEQ ID NO: 298091 - DNA, 27 bp, Artificial Sequence
  Description of Artificial Sequence: Synthetic oligonucleotide
catgggaatttggaccacggggagggt

SEQ ID NO: 298092 - DNA, 27 bp, Artificial Sequence
  Description of Artificial Sequence: Synthetic oligonucleotide
atgggaatttggaccacggggagggtc

SEQ ID NO: 298093 - DNA, 27 bp, Artificial Sequence
  Description of Artificial Sequence: Synthetic oligonucleotide
tgggaatttggaccacggggagggtct

SEQ ID NO: 298094 - DNA, 26 bp, Artificial Sequence
  Description of Artificial Sequence: Synthetic oligonucleotide
gggaatttggaccacggggagggtct

SEQ ID NO: 298095 - DNA, 26 bp, Artificial Sequence
  Description of Artificial Sequence: Synthetic oligonucleotide
ggaatttggaccacggggagggtctc

SEQ ID NO: 298096 - DNA, 27 bp, Artificial Sequence
  Description of Artificial Sequence: Synthetic oligonucleotide
gaatttggaccacggggagggtctcct

SEQ ID NO: 298097 - DNA, 27 bp, Artificial Sequence
  Description of Artificial Sequence: Synthetic oligonucleotide
aatttggaccacggggagggtctcctg

SEQ ID NO: 298098 - DNA, 27 bp, Artificial Sequence
  Description of Artificial Sequence: Synthetic oligonucleotide
atttggaccacggggagggtctcctga

SEQ ID NO: 298099 - DNA, 27 bp, Artificial Sequence
  Description of Artificial Sequence: Synthetic oligonucleotide
tttggaccacggggagggtctcctgat

SEQ ID NO: 298100 - DNA, 27 bp, Artificial Sequence
  Description of Artificial Sequence: Synthetic oligonucleotide
ttggaccacggggagggtctcctgatt

SEQ ID NO: 298101 - DNA, 27 bp, Artificial Sequence
  Description of Artificial Sequence: Synthetic oligonucleotide
tggaccacggggagggtctcctgatta

SEQ ID NO: 298102 - DNA, 27 bp, Artificial Sequence
  Description of Artificial Sequence: Synthetic oligonucleotide
ggaccacggggagggtctcctgattaa

SEQ ID NO: 298103 - DNA, 30 bp, Artificial Sequence
  Description of Artificial Sequence: Synthetic oligonucleotide
gaccacggggagggtctcctgattaatttc

SEQ ID NO: 298104 - DNA, 30 bp, Artificial Sequence
  Description of Artificial Sequence: Synthetic oligonucleotide
accacggggagggtctcctgattaatttcg

SEQ ID NO: 298105 - DNA, 29 bp, Artificial Sequence
  Description of Artificial Sequence: Synthetic oligonucleotide
ccacggggagggtctcctgattaatttcg

SEQ ID NO: 298106 - DNA, 31 bp, Artificial Sequence
  Description of Artificial Sequence: Synthetic oligonucleotide
cacggggagggtctcctgattaatttcgatg

SEQ ID NO: 298107 - DNA, 33 bp, Artificial Sequence
  Description of Artificial Sequence: Synthetic oligonucleotide
acggggagggtctcctgattaatttcgatgatc

SEQ ID NO: 298108 - DNA, 32 bp, Artificial Sequence
  Description of Artificial Sequence: Synthetic oligonucleotide
cggggagggtctcctgattaatttcgatgatc

SEQ ID NO: 298109 - DNA, 32 bp, Artificial Sequence
  Description of Artificial Sequence: Synthetic oligonucleotide
ggggagggtctcctgattaatttcgatgatcc

SEQ ID NO: 298110 - DNA, 32 bp, Artificial Sequence
  Description of Artificial Sequence: Synthetic oligonucleotide
gggagggtctcctgattaatttcgatgatccc

SEQ ID NO: 298111 - DNA, 32 bp, Artificial Sequence
  Description of Artificial Sequence: Synthetic oligonucleotide
ggagggtctcctgattaatttcgatgatcccc

SEQ ID NO: 298112 - DNA, 32 bp, Artificial Sequence
  Description of Artificial Sequence: Synthetic oligonucleotide
gagggtctcctgattaatttcgatgatccccc

SEQ ID NO: 298113 - DNA, 33 bp, Artificial Sequence
  Description of Artificial Sequence: Synthetic oligonucleotide
agggtctcctgattaatttcgatgatcccccag

SEQ ID NO: 298114 - DNA, 32 bp, Artificial Sequence
  Description of Artificial Sequence: Synthetic oligonucleotide
gggtctcctgattaatttcgatgatcccccag

SEQ ID NO: 298115 - DNA, 34 bp, Artificial Sequence
  Description of Artificial Sequence: Synthetic oligonucleotide
ggtctcctgattaatttcgatgatcccccagtac

SEQ ID NO: 298116 - DNA, 40 bp, Artificial Sequence
  Description of Artificial Sequence: Synthetic oligonucleotide
gtctcctgattaatttcgatgatcccccagtacataaaac

SEQ ID NO: 298117 - DNA, 43 bp, Artificial Sequence
  Description of Artificial Sequence: Synthetic oligonucleotide
tctcctgattaatttcgatgatcccccagtacataaaactttc

SEQ ID NO: 298118 - DNA, 42 bp, Artificial Sequence
  Description of Artificial Sequence: Synthetic oligonucleotide
ctcctgattaatttcgatgatcccccagtacataaaactttc

SEQ ID NO: 298119 - DNA, 42 bp, Artificial Sequence
  Description of Artificial Sequence: Synthetic oligonucleotide
tcctgattaatttcgatgatcccccagtacataaaactttcg

SEQ ID NO: 298120 - DNA, 41 bp, Artificial Sequence
  Description of Artificial Sequence: Synthetic oligonucleotide
cctgattaatttcgatgatcccccagtacataaaactttcg

SEQ ID NO: 298121 - DNA, 43 bp, Artificial Sequence
  Description of Artificial Sequence: Synthetic oligonucleotide
ctgattaatttcgatgatcccccagtacataaaactttcgaag

SEQ ID NO: 298122 - DNA, 43 bp, Artificial Sequence
  Description of Artificial Sequence: Synthetic oligonucleotide
tgattaatttcgatgatcccccagtacataaaactttcgaagc

SEQ ID NO: 298123 - DNA, 42 bp, Artificial Sequence
  Description of Artificial Sequence: Synthetic oligonucleotide
gattaatttcgatgatcccccagtacataaaactttcgaagc

SEQ ID NO: 298124 - DNA, 43 bp, Artificial Sequence
  Description of Artificial Sequence: Synthetic oligonucleotide
attaatttcgatgatcccccagtacataaaactttcgaagctg

SEQ ID NO: 298125 - DNA, 42 bp, Artificial Sequence
  Description of Artificial Sequence: Synthetic oligonucleotide
ttaatttcgatgatcccccagtacataaaactttcgaagctg

SEQ ID NO: 298126 - DNA, 41 bp, Artificial Sequence
  Description of Artificial Sequence: Synthetic oligonucleotide
taatttcgatgatcccccagtacataaaactttcgaagctg

SEQ ID NO: 298127 - DNA, 40 bp, Artificial Sequence
  Description of Artificial Sequence: Synthetic oligonucleotide
aatttcgatgatcccccagtacataaaactttcgaagctg

SEQ ID NO: 298128 - DNA, 39 bp, Artificial Sequence
  Description of Artificial Sequence: Synthetic oligonucleotide
atttcgatgatcccccagtacataaaactttcgaagctg

SEQ ID NO: 298129 - DNA, 38 bp, Artificial Sequence
  Description of Artificial Sequence: Synthetic oligonucleotide
tttcgatgatcccccagtacataaaactttcgaagctg

SEQ ID NO: 298130 - DNA, 37 bp, Artificial Sequence
  Description of Artificial Sequence: Synthetic oligonucleotide
ttcgatgatcccccagtacataaaactttcgaagctg

SEQ ID NO: 298131 - DNA, 36 bp, Artificial Sequence
  Description of Artificial Sequence: Synthetic oligonucleotide
tcgatgatcccccagtacataaaactttcgaagctg

SEQ ID NO: 298132 - DNA, 35 bp, Artificial Sequence
  Description of Artificial Sequence: Synthetic oligonucleotide
cgatgatcccccagtacataaaactttcgaagctg

SEQ ID NO: 298133 - DNA, 35 bp, Artificial Sequence
  Description of Artificial Sequence: Synthetic oligonucleotide
gatgatcccccagtacataaaactttcgaagctgc

SEQ ID NO: 298134 - DNA, 36 bp, Artificial Sequence
  Description of Artificial Sequence: Synthetic oligonucleotide
atgatcccccagtacataaaactttcgaagctgcac

SEQ ID NO: 298135 - DNA, 35 bp, Artificial Sequence
  Description of Artificial Sequence: Synthetic oligonucleotide
tgatcccccagtacataaaactttcgaagctgcac

SEQ ID NO: 298136 - DNA, 34 bp, Artificial Sequence
  Description of Artificial Sequence: Synthetic oligonucleotide
gatcccccagtacataaaactttcgaagctgcac

SEQ ID NO: 298137 - DNA, 35 bp, Artificial Sequence
  Description of Artificial Sequence: Synthetic oligonucleotide
atcccccagtacataaaactttcgaagctgcactg

SEQ ID NO: 298138 - DNA, 34 bp, Artificial Sequence
  Description of Artificial Sequence: Synthetic oligonucleotide
tcccccagtacataaaactttcgaagctgcactg

SEQ ID NO: 298139 - DNA, 33 bp, Artificial Sequence
  Description of Artificial Sequence: Synthetic oligonucleotide
cccccagtacataaaactttcgaagctgcactg

SEQ ID NO: 298140 - DNA, 33 bp, Artificial Sequence
  Description of Artificial Sequence: Synthetic oligonucleotide
ccccagtacataaaactttcgaagctgcactgg

SEQ ID NO: 298141 - DNA, 36 bp, Artificial Sequence
  Description of Artificial Sequence: Synthetic oligonucleotide
cccagtacataaaactttcgaagctgcactggaaac

SEQ ID NO: 298142 - DNA, 40 bp, Artificial Sequence
  Description of Artificial Sequence: Synthetic oligonucleotide
ccagtacataaaactttcgaagctgcactggaaacatttc

SEQ ID NO: 298143 - DNA, 41 bp, Artificial Sequence
  Description of Artificial Sequence: Synthetic oligonucleotide
cagtacataaaactttcgaagctgcactggaaacatttcag

SEQ ID NO: 298144 - DNA, 43 bp, Artificial Sequence
  Description of Artificial Sequence: Synthetic oligonucleotide
agtacataaaactttcgaagctgcactggaaacatttcagaac

SEQ ID NO: 298145 - DNA, 42 bp, Artificial Sequence
  Description of Artificial Sequence: Synthetic oligonucleotide
gtacataaaactttcgaagctgcactggaaacatttcagaac

SEQ ID NO: 298146 - DNA, 44 bp, Artificial Sequence
  Description of Artificial Sequence: Synthetic oligonucleotide
tacataaaactttcgaagctgcactggaaacatttcagaacaag

SEQ ID NO: 298147 - DNA, 43 bp, Artificial Sequence
  Description of Artificial Sequence: Synthetic oligonucleotide
acataaaactttcgaagctgcactggaaacatttcagaacaag

SEQ ID NO: 298148 - DNA, 42 bp, Artificial Sequence
  Description of Artificial Sequence: Synthetic oligonucleotide
cataaaactttcgaagctgcactggaaacatttcagaacaag

SEQ ID NO: 298149 - DNA, 43 bp, Artificial Sequence
  Description of Artificial Sequence: Synthetic oligonucleotide
ataaaactttcgaagctgcactggaaacatttcagaacaagag

SEQ ID NO: 298150 - DNA, 42 bp, Artificial Sequence
  Description of Artificial Sequence: Synthetic oligonucleotide
taaaactttcgaagctgcactggaaacatttcagaacaagag

SEQ ID NO: 298151 - DNA, 41 bp, Artificial Sequence
  Description of Artificial Sequence: Synthetic oligonucleotide
aaaactttcgaagctgcactggaaacatttcagaacaagag

SEQ ID NO: 298152 - DNA, 40 bp, Artificial Sequence
  Description of Artificial Sequence: Synthetic oligonucleotide
aaactttcgaagctgcactggaaacatttcagaacaagag

SEQ ID NO: 298153 - DNA, 39 bp, Artificial Sequence
  Description of Artificial Sequence: Synthetic oligonucleotide
aactttcgaagctgcactggaaacatttcagaacaagag

SEQ ID NO: 298154 - DNA, 38 bp, Artificial Sequence
  Description of Artificial Sequence: Synthetic oligonucleotide
actttcgaagctgcactggaaacatttcagaacaagag

SEQ ID NO: 298155 - DNA, 37 bp, Artificial Sequence
  Description of Artificial Sequence: Synthetic oligonucleotide
ctttcgaagctgcactggaaacatttcagaacaagag

SEQ ID NO: 298156 - DNA, 37 bp, Artificial Sequence
  Description of Artificial Sequence: Synthetic oligonucleotide
tttcgaagctgcactggaaacatttcagaacaagagc

SEQ ID NO: 298157 - DNA, 36 bp, Artificial Sequence
  Description of Artificial Sequence: Synthetic oligonucleotide
ttcgaagctgcactggaaacatttcagaacaagagc

SEQ ID NO: 298158 - DNA, 35 bp, Artificial Sequence
  Description of Artificial Sequence: Synthetic oligonucleotide
tcgaagctgcactggaaacatttcagaacaagagc

SEQ ID NO: 298159 - DNA, 34 bp, Artificial Sequence
  Description of Artificial Sequence: Synthetic oligonucleotide
cgaagctgcactggaaacatttcagaacaagagc

SEQ ID NO: 298160 - DNA, 37 bp, Artificial Sequence
  Description of Artificial Sequence: Synthetic oligonucleotide
gaagctgcactggaaacatttcagaacaagagcaaag

SEQ ID NO: 298161 - DNA, 39 bp, Artificial Sequence
  Description of Artificial Sequence: Synthetic oligonucleotide
aagctgcactggaaacatttcagaacaagagcaaagttg

SEQ ID NO: 298162 - DNA, 38 bp, Artificial Sequence
  Description of Artificial Sequence: Synthetic oligonucleotide
agctgcactggaaacatttcagaacaagagcaaagttg

SEQ ID NO: 298163 - DNA, 37 bp, Artificial Sequence
  Description of Artificial Sequence: Synthetic oligonucleotide
gctgcactggaaacatttcagaacaagagcaaagttg

SEQ ID NO: 298164 - DNA, 38 bp, Artificial Sequence
  Description of Artificial Sequence: Synthetic oligonucleotide
ctgcactggaaacatttcagaacaagagcaaagttgtg

SEQ ID NO: 298165 - DNA, 38 bp, Artificial Sequence
  Description of Artificial Sequence: Synthetic oligonucleotide
tgcactggaaacatttcagaacaagagcaaagttgtgg

SEQ ID NO: 298166 - DNA, 37 bp, Artificial Sequence
  Description of Artificial Sequence: Synthetic oligonucleotide
gcactggaaacatttcagaacaagagcaaagttgtgg

SEQ ID NO: 298167 - DNA, 40 bp, Artificial Sequence
  Description of Artificial Sequence: Synthetic oligonucleotide
cactggaaacatttcagaacaagagcaaagttgtggattc

SEQ ID NO: 298168 - DNA, 40 bp, Artificial Sequence
  Description of Artificial Sequence: Synthetic oligonucleotide
actggaaacatttcagaacaagagcaaagttgtggattcc

SEQ ID NO: 298169 - DNA, 39 bp, Artificial Sequence
  Description of Artificial Sequence: Synthetic oligonucleotide
ctggaaacatttcagaacaagagcaaagttgtggattcc

SEQ ID NO: 298170 - DNA, 39 bp, Artificial Sequence
  Description of Artificial Sequence: Synthetic oligonucleotide
tggaaacatttcagaacaagagcaaagttgtggattccg

SEQ ID NO: 298171 - DNA, 38 bp, Artificial Sequence
  Description of Artificial Sequence: Synthetic oligonucleotide
ggaaacatttcagaacaagagcaaagttgtggattccg

SEQ ID NO: 298172 - DNA, 39 bp, Artificial Sequence
  Description of Artificial Sequence: Synthetic oligonucleotide
gaaacatttcagaacaagagcaaagttgtggattccgtc

SEQ ID NO: 298173 - DNA, 41 bp, Artificial Sequence
  Description of Artificial Sequence: Synthetic oligonucleotide
aaacatttcagaacaagagcaaagttgtggattccgtctac

SEQ ID NO: 298174 - DNA, 40 bp, Artificial Sequence
  Description of Artificial Sequence: Synthetic oligonucleotide
aacatttcagaacaagagcaaagttgtggattccgtctac

SEQ ID NO: 298175 - DNA, 39 bp, Artificial Sequence
  Description of Artificial Sequence: Synthetic oligonucleotide
acatttcagaacaagagcaaagttgtggattccgtctac

SEQ ID NO: 298176 - DNA, 38 bp, Artificial Sequence
  Description of Artificial Sequence: Synthetic oligonucleotide
catttcagaacaagagcaaagttgtggattccgtctac

SEQ ID NO: 298177 - DNA, 40 bp, Artificial Sequence
  Description of Artificial Sequence: Synthetic oligonucleotide
atttcagaacaagagcaaagttgtggattccgtctacaac

SEQ ID NO: 298178 - DNA, 39 bp, Artificial Sequence
  Description of Artificial Sequence: Synthetic oligonucleotide
tttcagaacaagagcaaagttgtggattccgtctacaac

SEQ ID NO: 298179 - DNA, 38 bp, Artificial Sequence
  Description of Artificial Sequence: Synthetic oligonucleotide
ttcagaacaagagcaaagttgtggattccgtctacaac

SEQ ID NO: 298180 - DNA, 37 bp, Artificial Sequence
  Description of Artificial Sequence: Synthetic oligonucleotide
tcagaacaagagcaaagttgtggattccgtctacaac

SEQ ID NO: 298181 - DNA, 36 bp, Artificial Sequence
  Description of Artificial Sequence: Synthetic oligonucleotide
cagaacaagagcaaagttgtggattccgtctacaac

SEQ ID NO: 298182 - DNA, 39 bp, Artificial Sequence
  Description of Artificial Sequence: Synthetic oligonucleotide
agaacaagagcaaagttgtggattccgtctacaacatag

SEQ ID NO: 298183 - DNA, 38 bp, Artificial Sequence
  Description of Artificial Sequence: Synthetic oligonucleotide
gaacaagagcaaagttgtggattccgtctacaacatag

SEQ ID NO: 298184 - DNA, 38 bp, Artificial Sequence
  Description of Artificial Sequence: Synthetic oligonucleotide
aacaagagcaaagttgtggattccgtctacaacatagc

SEQ ID NO: 298185 - DNA, 37 bp, Artificial Sequence
  Description of Artificial Sequence: Synthetic oligonucleotide
acaagagcaaagttgtggattccgtctacaacatagc

SEQ ID NO: 298186 - DNA, 36 bp, Artificial Sequence
  Description of Artificial Sequence: Synthetic oligonucleotide
caagagcaaagttgtggattccgtctacaacatagc

SEQ ID NO: 298187 - DNA, 36 bp, Artificial Sequence
  Description of Artificial Sequence: Synthetic oligonucleotide
aagagcaaagttgtggattccgtctacaacatagcc

SEQ ID NO: 298188 - DNA, 35 bp, Artificial Sequence
  Description of Artificial Sequence: Synthetic oligonucleotide
agagcaaagttgtggattccgtctacaacatagcc

SEQ ID NO: 298189 - DNA, 34 bp, Artificial Sequence
  Description of Artificial Sequence: Synthetic oligonucleotide
gagcaaagttgtggattccgtctacaacatagcc

SEQ ID NO: 298190 - DNA, 36 bp, Artificial Sequence
  Description of Artificial Sequence: Synthetic oligonucleotide
agcaaagttgtggattccgtctacaacatagccaag

SEQ ID NO: 298191 - DNA, 35 bp, Artificial Sequence
  Description of Artificial Sequence: Synthetic oligonucleotide
gcaaagttgtggattccgtctacaacatagccaag

SEQ ID NO: 298192 - DNA, 38 bp, Artificial Sequence
  Description of Artificial Sequence: Synthetic oligonucleotide
caaagttgtggattccgtctacaacatagccaagaatc

SEQ ID NO: 298193 - DNA, 39 bp, Artificial Sequence
  Description of Artificial Sequence: Synthetic oligonucleotide
aaagttgtggattccgtctacaacatagccaagaatctg

SEQ ID NO: 298194 - DNA, 38 bp, Artificial Sequence
  Description of Artificial Sequence: Synthetic oligonucleotide
aagttgtggattccgtctacaacatagccaagaatctg

SEQ ID NO: 298195 - DNA, 37 bp, Artificial Sequence
  Description of Artificial Sequence: Synthetic oligonucleotide
agttgtggattccgtctacaacatagccaagaatctg

SEQ ID NO: 298196 - DNA, 36 bp, Artificial Sequence
  Description of Artificial Sequence: Synthetic oligonucleotide
gttgtggattccgtctacaacatagccaagaatctg

SEQ ID NO: 298197 - DNA, 37 bp, Artificial Sequence
  Description of Artificial Sequence: Synthetic oligonucleotide
ttgtggattccgtctacaacatagccaagaatctgac

SEQ ID NO: 298198 - DNA, 36 bp, Artificial Sequence
  Description of Artificial Sequence: Synthetic oligonucleotide
tgtggattccgtctacaacatagccaagaatctgac

SEQ ID NO: 298199 - DNA, 35 bp, Artificial Sequence
  Description of Artificial Sequence: Synthetic oligonucleotide
gtggattccgtctacaacatagccaagaatctgac

SEQ ID NO: 298200 - DNA, 38 bp, Artificial Sequence
  Description of Artificial Sequence: Synthetic oligonucleotide
tggattccgtctacaacatagccaagaatctgacatag

SEQ ID NO: 298201 - DNA, 21 bp, Artificial Sequence
  Description of Artificial Sequence: Synthetic oligonucleotide
atgccggacggcgcctcggag

SEQ ID NO: 298202 - DNA, 20 bp, Artificial Sequence
  Description of Artificial Sequence: Synthetic oligonucleotide
tgccggacggcgcctcggag

SEQ ID NO: 298203 - DNA, 20 bp, Artificial Sequence
  Description of Artificial Sequence: Synthetic oligonucleotide
gccggacggcgcctcggagt

SEQ ID NO: 298204 - DNA, 20 bp, Artificial Sequence
  Description of Artificial Sequence: Synthetic oligonucleotide
ccggacggcgcctcggagct

SEQ ID NO: 298205 - DNA, 20 bp, Artificial Sequence
  Description of Artificial Sequence: Synthetic oligonucleotide
cggacggcgcctcggagcgt

SEQ ID NO: 298206 - DNA, 20 bp, Artificial Sequence
  Description of Artificial Sequence: Synthetic oligonucleotide
ggacggcgcctcggagcgct

SEQ ID NO: 298207 - DNA, 20 bp, Artificial Sequence
  Description of Artificial Sequence: Synthetic oligonucleotide
gacggcgcctcggagcgcgt

SEQ ID NO: 298208 - DNA, 20 bp, Artificial Sequence
  Description of Artificial Sequence: Synthetic oligonucleotide
acggcgcctcggagcgcgct

SEQ ID NO: 298209 - DNA, 20 bp, Artificial Sequence
  Description of Artificial Sequence: Synthetic oligonucleotide
cggcgcctcggagcgcgctt

SEQ ID NO: 298210 - DNA, 20 bp, Artificial Sequence
  Description of Artificial Sequence: Synthetic oligonucleotide
ggcgcctcggagcgcgctga

SEQ ID NO: 298211 - DNA, 20 bp, Artificial Sequence
  Description of Artificial Sequence: Synthetic oligonucleotide
gcgcctcggagcgcgctgac

SEQ ID NO: 298212 - DNA, 20 bp, Artificial Sequence
  Description of Artificial Sequence: Synthetic oligonucleotide
cgcctcggagcgcgctgacg

SEQ ID NO: 298213 - DNA, 20 bp, Artificial Sequence
  Description of Artificial Sequence: Synthetic oligonucleotide
gcctcggagcgcgctgacgg

SEQ ID NO: 298214 - DNA, 20 bp, Artificial Sequence
  Description of Artificial Sequence: Synthetic oligonucleotide
cctcggagcgcgctgacggg

SEQ ID NO: 298215 - DNA, 20 bp, Artificial Sequence
  Description of Artificial Sequence: Synthetic oligonucleotide
ctcggagcgcgctgacgggg

SEQ ID NO: 298216 - DNA, 20 bp, Artificial Sequence
  Description of Artificial Sequence: Synthetic oligonucleotide
tcggagcgcgctgacggggg

SEQ ID NO: 298217 - DNA, 20 bp, Artificial Sequence
  Description of Artificial Sequence: Synthetic oligonucleotide
cggagcgcgctgacgggggt

SEQ ID NO: 298218 - DNA, 21 bp, Artificial Sequence
  Description of Artificial Sequence: Synthetic oligonucleotide
ggagcgcgctgacgggggcat

SEQ ID NO: 298219 - DNA, 21 bp, Artificial Sequence
  Description of Artificial Sequence: Synthetic oligonucleotide
gagcgcgctgacgggggcatc

SEQ ID NO: 298220 - DNA, 22 bp, Artificial Sequence
  Description of Artificial Sequence: Synthetic oligonucleotide
agcgcgctgacgggggcatcgt

SEQ ID NO: 298221 - DNA, 21 bp, Artificial Sequence
  Description of Artificial Sequence: Synthetic oligonucleotide
gcgcgctgacgggggcatcgt

SEQ ID NO: 298222 - DNA, 23 bp, Artificial Sequence
  Description of Artificial Sequence: Synthetic oligonucleotide
cgcgctgacgggggcatcgtcat

SEQ ID NO: 298223 - DNA, 25 bp, Artificial Sequence
  Description of Artificial Sequence: Synthetic oligonucleotide
gcgctgacgggggcatcgtcatgat

SEQ ID NO: 298224 - DNA, 25 bp, Artificial Sequence
  Description of Artificial Sequence: Synthetic oligonucleotide
cgctgacgggggcatcgtcatgatg

SEQ ID NO: 298225 - DNA, 26 bp, Artificial Sequence
  Description of Artificial Sequence: Synthetic oligonucleotide
gctgacgggggcatcgtcatgatgga

SEQ ID NO: 298226 - DNA, 26 bp, Artificial Sequence
  Description of Artificial Sequence: Synthetic oligonucleotide
ctgacgggggcatcgtcatgatggag

SEQ ID NO: 298227 - DNA, 27 bp, Artificial Sequence
  Description of Artificial Sequence: Synthetic oligonucleotide
tgacgggggcatcgtcatgatggaggt

SEQ ID NO: 298228 - DNA, 26 bp, Artificial Sequence
  Description of Artificial Sequence: Synthetic oligonucleotide
gacgggggcatcgtcatgatggaggt

SEQ ID NO: 298229 - DNA, 26 bp, Artificial Sequence
  Description of Artificial Sequence: Synthetic oligonucleotide
acgggggcatcgtcatgatggaggtc

SEQ ID NO: 298230 - DNA, 25 bp, Artificial Sequence
  Description of Artificial Sequence: Synthetic oligonucleotide
cgggggcatcgtcatgatggaggtc

SEQ ID NO: 298231 - DNA, 26 bp, Artificial Sequence
  Description of Artificial Sequence: Synthetic oligonucleotide
gggggcatcgtcatgatggaggtcga

SEQ ID NO: 298232 - DNA, 27 bp, Artificial Sequence
  Description of Artificial Sequence: Synthetic oligonucleotide
ggggcatcgtcatgatggaggtcgact

SEQ ID NO: 298233 - DNA, 28 bp, Artificial Sequence
  Description of Artificial Sequence: Synthetic oligonucleotide
gggcatcgtcatgatggaggtcgactac

SEQ ID NO: 298234 - DNA, 29 bp, Artificial Sequence
  Description of Artificial Sequence: Synthetic oligonucleotide
ggcatcgtcatgatggaggtcgactacag

SEQ ID NO: 298235 - DNA, 29 bp, Artificial Sequence
  Description of Artificial Sequence: Synthetic oligonucleotide
gcatcgtcatgatggaggtcgactacagc

SEQ ID NO: 298236 - DNA, 29 bp, Artificial Sequence
  Description of Artificial Sequence: Synthetic oligonucleotide
catcgtcatgatggaggtcgactacagcc

SEQ ID NO: 298237 - DNA, 29 bp, Artificial Sequence
  Description of Artificial Sequence: Synthetic oligonucleotide
atcgtcatgatggaggtcgactacagccc

SEQ ID NO: 298238 - DNA, 28 bp, Artificial Sequence
  Description of Artificial Sequence: Synthetic oligonucleotide
tcgtcatgatggaggtcgactacagccc

SEQ ID NO: 298239 - DNA, 27 bp, Artificial Sequence
  Description of Artificial Sequence: Synthetic oligonucleotide
cgtcatgatggaggtcgactacagccc

SEQ ID NO: 298240 - DNA, 27 bp, Artificial Sequence
  Description of Artificial Sequence: Synthetic oligonucleotide
gtcatgatggaggtcgactacagcccc

SEQ ID NO: 298241 - DNA, 28 bp, Artificial Sequence
  Description of Artificial Sequence: Synthetic oligonucleotide
tcatgatggaggtcgactacagccccac

SEQ ID NO: 298242 - DNA, 27 bp, Artificial Sequence
  Description of Artificial Sequence: Synthetic oligonucleotide
catgatggaggtcgactacagccccac

SEQ ID NO: 298243 - DNA, 27 bp, Artificial Sequence
  Description of Artificial Sequence: Synthetic oligonucleotide
atgatggaggtcgactacagccccacg

SEQ ID NO: 298244 - DNA, 26 bp, Artificial Sequence
  Description of Artificial Sequence: Synthetic oligonucleotide
tgatggaggtcgactacagccccacg

SEQ ID NO: 298245 - DNA, 25 bp, Artificial Sequence
  Description of Artificial Sequence: Synthetic oligonucleotide
gatggaggtcgactacagccccacg

SEQ ID NO: 298246 - DNA, 26 bp, Artificial Sequence
  Description of Artificial Sequence: Synthetic oligonucleotide
atggaggtcgactacagccccacggt

SEQ ID NO: 298247 - DNA, 25 bp, Artificial Sequence
  Description of Artificial Sequence: Synthetic oligonucleotide
tggaggtcgactacagccccacggt

SEQ ID NO: 298248 - DNA, 24 bp, Artificial Sequence
  Description of Artificial Sequence: Synthetic oligonucleotide
ggaggtcgactacagccccacggt

SEQ ID NO: 298249 - DNA, 24 bp, Artificial Sequence
  Description of Artificial Sequence: Synthetic oligonucleotide
gaggtcgactacagccccacggtg

SEQ ID NO: 298250 - DNA, 26 bp, Artificial Sequence
  Description of Artificial Sequence: Synthetic oligonucleotide
aggtcgactacagccccacggtggtt

SEQ ID NO: 298251 - DNA, 25 bp, Artificial Sequence
  Description of Artificial Sequence: Synthetic oligonucleotide
ggtcgactacagccccacggtggtt

SEQ ID NO: 298252 - DNA, 26 bp, Artificial Sequence
  Description of Artificial Sequence: Synthetic oligonucleotide
gtcgactacagccccacggtggttca

SEQ ID NO: 298253 - DNA, 26 bp, Artificial Sequence
  Description of Artificial Sequence: Synthetic oligonucleotide
tcgactacagccccacggtggttcag

SEQ ID NO: 298254 - DNA, 25 bp, Artificial Sequence
  Description of Artificial Sequence: Synthetic oligonucleotide
cgactacagccccacggtggttcag

SEQ ID NO: 298255 - DNA, 25 bp, Artificial Sequence
  Description of Artificial Sequence: Synthetic oligonucleotide
gactacagccccacggtggttcagc

SEQ ID NO: 298256 - DNA, 25 bp, Artificial Sequence
  Description of Artificial Sequence: Synthetic oligonucleotide
actacagccccacggtggttcagcg

SEQ ID NO: 298257 - DNA, 24 bp, Artificial Sequence
  Description of Artificial Sequence: Synthetic oligonucleotide
ctacagccccacggtggttcagcg

SEQ ID NO: 298258 - DNA, 24 bp, Artificial Sequence
  Description of Artificial Sequence: Synthetic oligonucleotide
tacagccccacggtggttcagcgc

SEQ ID NO: 298259 - DNA, 23 bp, Artificial Sequence
  Description of Artificial Sequence: Synthetic oligonucleotide
acagccccacggtggttcagcgc

SEQ ID NO: 298260 - DNA, 22 bp, Artificial Sequence
  Description of Artificial Sequence: Synthetic oligonucleotide
cagccccacggtggttcagcgc

SEQ ID NO: 298261 - DNA, 24 bp, Artificial Sequence
  Description of Artificial Sequence: Synthetic oligonucleotide
agccccacggtggttcagcgcctt

SEQ ID NO: 298262 - DNA, 23 bp, Artificial Sequence
  Description of Artificial Sequence: Synthetic oligonucleotide
gccccacggtggttcagcgcctt

SEQ ID NO: 298263 - DNA, 23 bp, Artificial Sequence
  Description of Artificial Sequence: Synthetic oligonucleotide
ccccacggtggttcagcgccttc

SEQ ID NO: 298264 - DNA, 23 bp, Artificial Sequence
  Description of Artificial Sequence: Synthetic oligonucleotide
cccacggtggttcagcgccttcc

SEQ ID NO: 298265 - DNA, 23 bp, Artificial Sequence
  Description of Artificial Sequence: Synthetic oligonucleotide
ccacggtggttcagcgccttccc

SEQ ID NO: 298266 - DNA, 24 bp, Artificial Sequence
  Description of Artificial Sequence: Synthetic oligonucleotide
cacggtggttcagcgccttcccga

SEQ ID NO: 298267 - DNA, 25 bp, Artificial Sequence
  Description of Artificial Sequence: Synthetic oligonucleotide
acggtggttcagcgccttcccgagt

SEQ ID NO: 298268 - DNA, 24 bp, Artificial Sequence
  Description of Artificial Sequence: Synthetic oligonucleotide
cggtggttcagcgccttcccgagt

SEQ ID NO: 298269 - DNA, 25 bp, Artificial Sequence
  Description of Artificial Sequence: Synthetic oligonucleotide
ggtggttcagcgccttcccgagtgt

SEQ ID NO: 298270 - DNA, 25 bp, Artificial Sequence
  Description of Artificial Sequence: Synthetic oligonucleotide
gtggttcagcgccttcccgagtgtc

SEQ ID NO: 298271 - DNA, 25 bp, Artificial Sequence
  Description of Artificial Sequence: Synthetic oligonucleotide
tggttcagcgccttcccgagtgtcc

SEQ ID NO: 298272 - DNA, 24 bp, Artificial Sequence
  Description of Artificial Sequence: Synthetic oligonucleotide
ggttcagcgccttcccgagtgtcc

SEQ ID NO: 298273 - DNA, 26 bp, Artificial Sequence
  Description of Artificial Sequence: Synthetic oligonucleotide
gttcagcgccttcccgagtgtccgaa

SEQ ID NO: 298274 - DNA, 26 bp, Artificial Sequence
  Description of Artificial Sequence: Synthetic oligonucleotide
ttcagcgccttcccgagtgtccgaag

SEQ ID NO: 298275 - DNA, 25 bp, Artificial Sequence
  Description of Artificial Sequence: Synthetic oligonucleotide
tcagcgccttcccgagtgtccgaag

SEQ ID NO: 298276 - DNA, 24 bp, Artificial Sequence
  Description of Artificial Sequence: Synthetic oligonucleotide
cagcgccttcccgagtgtccgaag

SEQ ID NO: 298277 - DNA, 26 bp, Artificial Sequence
  Description of Artificial Sequence: Synthetic oligonucleotide
agcgccttcccgagtgtccgaagcta

SEQ ID NO: 298278 - DNA, 25 bp, Artificial Sequence
  Description of Artificial Sequence: Synthetic oligonucleotide
gcgccttcccgagtgtccgaagcta

SEQ ID NO: 298279 - DNA, 25 bp, Artificial Sequence
  Description of Artificial Sequence: Synthetic oligonucleotide
cgccttcccgagtgtccgaagctag

SEQ ID NO: 298280 - DNA, 25 bp, Artificial Sequence
  Description of Artificial Sequence: Synthetic oligonucleotide
gccttcccgagtgtccgaagctagg

SEQ ID NO: 298281 - DNA, 27 bp, Artificial Sequence
  Description of Artificial Sequence: Synthetic oligonucleotide
ccttcccgagtgtccgaagctaggcaa

SEQ ID NO: 298282 - DNA, 27 bp, Artificial Sequence
  Description of Artificial Sequence: Synthetic oligonucleotide
cttcccgagtgtccgaagctaggcaag

SEQ ID NO: 298283 - DNA, 27 bp, Artificial Sequence
  Description of Artificial Sequence: Synthetic oligonucleotide
ttcccgagtgtccgaagctaggcaagg

SEQ ID NO: 298284 - DNA, 27 bp, Artificial Sequence
  Description of Artificial Sequence: Synthetic oligonucleotide
tcccgagtgtccgaagctaggcaagga

SEQ ID NO: 298285 - DNA, 27 bp, Artificial Sequence
  Description of Artificial Sequence: Synthetic oligonucleotide
cccgagtgtccgaagctaggcaaggaa

SEQ ID NO: 298286 - DNA, 27 bp, Artificial Sequence
  Description of Artificial Sequence: Synthetic oligonucleotide
ccgagtgtccgaagctaggcaaggaag

SEQ ID NO: 298287 - DNA, 27 bp, Artificial Sequence
  Description of Artificial Sequence: Synthetic oligonucleotide
cgagtgtccgaagctaggcaaggaagg

SEQ ID NO: 298288 - DNA, 29 bp, Artificial Sequence
  Description of Artificial Sequence: Synthetic oligonucleotide
gagtgtccgaagctaggcaaggaaggtag

SEQ ID NO: 298289 - DNA, 30 bp, Artificial Sequence
  Description of Artificial Sequence: Synthetic oligonucleotide
agtgtccgaagctaggcaaggaaggtagac

SEQ ID NO: 298290 - DNA, 29 bp, Artificial Sequence
  Description of Artificial Sequence: Synthetic oligonucleotide
gtgtccgaagctaggcaaggaaggtagac

SEQ ID NO: 298291 - DNA, 31 bp, Artificial Sequence
  Description of Artificial Sequence: Synthetic oligonucleotide
tgtccgaagctaggcaaggaaggtagacttc

SEQ ID NO: 298292 - DNA, 30 bp, Artificial Sequence
  Description of Artificial Sequence: Synthetic oligonucleotide
gtccgaagctaggcaaggaaggtagacttc

SEQ ID NO: 298293 - DNA, 32 bp, Artificial Sequence
  Description of Artificial Sequence: Synthetic oligonucleotide
tccgaagctaggcaaggaaggtagacttcaac

SEQ ID NO: 298294 - DNA, 31 bp, Artificial Sequence
  Description of Artificial Sequence: Synthetic oligonucleotide
ccgaagctaggcaaggaaggtagacttcaac

SEQ ID NO: 298295 - DNA, 33 bp, Artificial Sequence
  Description of Artificial Sequence: Synthetic oligonucleotide
cgaagctaggcaaggaaggtagacttcaacaag

SEQ ID NO: 298296 - DNA, 34 bp, Artificial Sequence
  Description of Artificial Sequence: Synthetic oligonucleotide
gaagctaggcaaggaaggtagacttcaacaagtc

SEQ ID NO: 298297 - DNA, 37 bp, Artificial Sequence
  Description of Artificial Sequence: Synthetic oligonucleotide
aagctaggcaaggaaggtagacttcaacaagtcattg

SEQ ID NO: 298298 - DNA, 36 bp, Artificial Sequence
  Description of Artificial Sequence: Synthetic oligonucleotide
agctaggcaaggaaggtagacttcaacaagtcattg

SEQ ID NO: 298299 - DNA, 35 bp, Artificial Sequence
  Description of Artificial Sequence: Synthetic oligonucleotide
gctaggcaaggaaggtagacttcaacaagtcattg

SEQ ID NO: 298300 - DNA, 38 bp, Artificial Sequence
  Description of Artificial Sequence: Synthetic oligonucleotide
ctaggcaaggaaggtagacttcaacaagtcattgtaac

SEQ ID NO: 298301 - DNA, 38 bp, Artificial Sequence
  Description of Artificial Sequence: Synthetic oligonucleotide
taggcaaggaaggtagacttcaacaagtcattgtaacc

SEQ ID NO: 298302 - DNA, 37 bp, Artificial Sequence
  Description of Artificial Sequence: Synthetic oligonucleotide
aggcaaggaaggtagacttcaacaagtcattgtaacc

SEQ ID NO: 298303 - DNA, 36 bp, Artificial Sequence
  Description of Artificial Sequence: Synthetic oligonucleotide
ggcaaggaaggtagacttcaacaagtcattgtaacc

SEQ ID NO: 298304 - DNA, 36 bp, Artificial Sequence
  Description of Artificial Sequence: Synthetic oligonucleotide
gcaaggaaggtagacttcaacaagtcattgtaaccc

SEQ ID NO: 298305 - DNA, 38 bp, Artificial Sequence
  Description of Artificial Sequence: Synthetic oligonucleotide
caaggaaggtagacttcaacaagtcattgtaacccttc

SEQ ID NO: 298306 - DNA, 39 bp, Artificial Sequence
  Description of Artificial Sequence: Synthetic oligonucleotide
aaggaaggtagacttcaacaagtcattgtaacccttctg

SEQ ID NO: 298307 - DNA, 38 bp, Artificial Sequence
  Description of Artificial Sequence: Synthetic oligonucleotide
aggaaggtagacttcaacaagtcattgtaacccttctg

SEQ ID NO: 298308 - DNA, 37 bp, Artificial Sequence
  Description of Artificial Sequence: Synthetic oligonucleotide
ggaaggtagacttcaacaagtcattgtaacccttctg

SEQ ID NO: 298309 - DNA, 38 bp, Artificial Sequence
  Description of Artificial Sequence: Synthetic oligonucleotide
gaaggtagacttcaacaagtcattgtaacccttctgtc

SEQ ID NO: 298310 - DNA, 39 bp, Artificial Sequence
  Description of Artificial Sequence: Synthetic oligonucleotide
aaggtagacttcaacaagtcattgtaacccttctgtctc

SEQ ID NO: 298311 - DNA, 38 bp, Artificial Sequence
  Description of Artificial Sequence: Synthetic oligonucleotide
aggtagacttcaacaagtcattgtaacccttctgtctc

SEQ ID NO: 298312 - DNA, 37 bp, Artificial Sequence
  Description of Artificial Sequence: Synthetic oligonucleotide
ggtagacttcaacaagtcattgtaacccttctgtctc

SEQ ID NO: 298313 - DNA, 38 bp, Artificial Sequence
  Description of Artificial Sequence: Synthetic oligonucleotide
gtagacttcaacaagtcattgtaacccttctgtctctg

SEQ ID NO: 298314 - DNA, 38 bp, Artificial Sequence
  Description of Artificial Sequence: Synthetic oligonucleotide
tagacttcaacaagtcattgtaacccttctgtctctgg

SEQ ID NO: 298315 - DNA, 37 bp, Artificial Sequence
  Description of Artificial Sequence: Synthetic oligonucleotide
agacttcaacaagtcattgtaacccttctgtctctgg

SEQ ID NO: 298316 - DNA, 36 bp, Artificial Sequence
  Description of Artificial Sequence: Synthetic oligonucleotide
gacttcaacaagtcattgtaacccttctgtctctgg

SEQ ID NO: 298317 - DNA, 40 bp, Artificial Sequence
  Description of Artificial Sequence: Synthetic oligonucleotide
acttcaacaagtcattgtaacccttctgtctctggaatag

SEQ ID NO: 298318 - DNA, 39 bp, Artificial Sequence
  Description of Artificial Sequence: Synthetic oligonucleotide
cttcaacaagtcattgtaacccttctgtctctggaatag

SEQ ID NO: 298319 - DNA, 39 bp, Artificial Sequence
  Description of Artificial Sequence: Synthetic oligonucleotide
ttcaacaagtcattgtaacccttctgtctctggaatagc

SEQ ID NO: 298320 - DNA, 38 bp, Artificial Sequence
  Description of Artificial Sequence: Synthetic oligonucleotide
tcaacaagtcattgtaacccttctgtctctggaatagc

SEQ ID NO: 298321 - DNA, 37 bp, Artificial Sequence
  Description of Artificial Sequence: Synthetic oligonucleotide
caacaagtcattgtaacccttctgtctctggaatagc

SEQ ID NO: 298322 - DNA, 38 bp, Artificial Sequence
  Description of Artificial Sequence: Synthetic oligonucleotide
aacaagtcattgtaacccttctgtctctggaatagcag

SEQ ID NO: 298323 - DNA, 37 bp, Artificial Sequence
  Description of Artificial Sequence: Synthetic oligonucleotide
acaagtcattgtaacccttctgtctctggaatagcag

SEQ ID NO: 298324 - DNA, 36 bp, Artificial Sequence
  Description of Artificial Sequence: Synthetic oligonucleotide
caagtcattgtaacccttctgtctctggaatagcag

SEQ ID NO: 298325 - DNA, 37 bp, Artificial Sequence
  Description of Artificial Sequence: Synthetic oligonucleotide
aagtcattgtaacccttctgtctctggaatagcagac

SEQ ID NO: 298326 - DNA, 36 bp, Artificial Sequence
  Description of Artificial Sequence: Synthetic oligonucleotide
agtcattgtaacccttctgtctctggaatagcagac

SEQ ID NO: 298327 - DNA, 35 bp, Artificial Sequence
  Description of Artificial Sequence: Synthetic oligonucleotide
gtcattgtaacccttctgtctctggaatagcagac

SEQ ID NO: 298328 - DNA, 36 bp, Artificial Sequence
  Description of Artificial Sequence: Synthetic oligonucleotide
tcattgtaacccttctgtctctggaatagcagactc

SEQ ID NO: 298329 - DNA, 35 bp, Artificial Sequence
  Description of Artificial Sequence: Synthetic oligonucleotide
cattgtaacccttctgtctctggaatagcagactc

SEQ ID NO: 298330 - DNA, 35 bp, Artificial Sequence
  Description of Artificial Sequence: Synthetic oligonucleotide
attgtaacccttctgtctctggaatagcagactcc

SEQ ID NO: 298331 - DNA, 34 bp, Artificial Sequence
  Description of Artificial Sequence: Synthetic oligonucleotide
ttgtaacccttctgtctctggaatagcagactcc

SEQ ID NO: 298332 - DNA, 33 bp, Artificial Sequence
  Description of Artificial Sequence: Synthetic oligonucleotide
tgtaacccttctgtctctggaatagcagactcc

SEQ ID NO: 298333 - DNA, 32 bp, Artificial Sequence
  Description of Artificial Sequence: Synthetic oligonucleotide
gtaacccttctgtctctggaatagcagactcc

SEQ ID NO: 298334 - DNA, 34 bp, Artificial Sequence
  Description of Artificial Sequence: Synthetic oligonucleotide
taacccttctgtctctggaatagcagactcctac

SEQ ID NO: 298335 - DNA, 33 bp, Artificial Sequence
  Description of Artificial Sequence: Synthetic oligonucleotide
aacccttctgtctctggaatagcagactcctac

SEQ ID NO: 298336 - DNA, 32 bp, Artificial Sequence
  Description of Artificial Sequence: Synthetic oligonucleotide
acccttctgtctctggaatagcagactcctac

SEQ ID NO: 298337 - DNA, 31 bp, Artificial Sequence
  Description of Artificial Sequence: Synthetic oligonucleotide
cccttctgtctctggaatagcagactcctac

SEQ ID NO: 298338 - DNA, 32 bp, Artificial Sequence
  Description of Artificial Sequence: Synthetic oligonucleotide
ccttctgtctctggaatagcagactcctactg

SEQ ID NO: 298339 - DNA, 32 bp, Artificial Sequence
  Description of Artificial Sequence: Synthetic oligonucleotide
cttctgtctctggaatagcagactcctactgc

SEQ ID NO: 298340 - DNA, 34 bp, Artificial Sequence
  Description of Artificial Sequence: Synthetic oligonucleotide
ttctgtctctggaatagcagactcctactgcttc

SEQ ID NO: 298341 - DNA, 33 bp, Artificial Sequence
  Description of Artificial Sequence: Synthetic oligonucleotide
tctgtctctggaatagcagactcctactgcttc

SEQ ID NO: 298342 - DNA, 32 bp, Artificial Sequence
  Description of Artificial Sequence: Synthetic oligonucleotide
ctgtctctggaatagcagactcctactgcttc

SEQ ID NO: 298343 - DNA, 32 bp, Artificial Sequence
  Description of Artificial Sequence: Synthetic oligonucleotide
tgtctctggaatagcagactcctactgcttcg

SEQ ID NO: 298344 - DNA, 31 bp, Artificial Sequence
  Description of Artificial Sequence: Synthetic oligonucleotide
gtctctggaatagcagactcctactgcttcg

SEQ ID NO: 298345 - DNA, 31 bp, Artificial Sequence
  Description of Artificial Sequence: Synthetic oligonucleotide
tctctggaatagcagactcctactgcttcgg

SEQ ID NO: 298346 - DNA, 30 bp, Artificial Sequence
  Description of Artificial Sequence: Synthetic oligonucleotide
ctctggaatagcagactcctactgcttcgg

SEQ ID NO: 298347 - DNA, 34 bp, Artificial Sequence
  Description of Artificial Sequence: Synthetic oligonucleotide
tctggaatagcagactcctactgcttcggatatg

SEQ ID NO: 298348 - DNA, 33 bp, Artificial Sequence
  Description of Artificial Sequence: Synthetic oligonucleotide
ctggaatagcagactcctactgcttcggatatg

SEQ ID NO: 298349 - DNA, 33 bp, Artificial Sequence
  Description of Artificial Sequence: Synthetic oligonucleotide
tggaatagcagactcctactgcttcggatatgg

SEQ ID NO: 298350 - DNA, 32 bp, Artificial Sequence
  Description of Artificial Sequence: Synthetic oligonucleotide
ggaatagcagactcctactgcttcggatatgg

SEQ ID NO: 298351 - DNA, 35 bp, Artificial Sequence
  Description of Artificial Sequence: Synthetic oligonucleotide
gaatagcagactcctactgcttcggatatggtaac

SEQ ID NO: 298352 - DNA, 35 bp, Artificial Sequence
  Description of Artificial Sequence: Synthetic oligonucleotide
aatagcagactcctactgcttcggatatggtaacg

SEQ ID NO: 298353 - DNA, 34 bp, Artificial Sequence
  Description of Artificial Sequence: Synthetic oligonucleotide
atagcagactcctactgcttcggatatggtaacg

SEQ ID NO: 298354 - DNA, 33 bp, Artificial Sequence
  Description of Artificial Sequence: Synthetic oligonucleotide
tagcagactcctactgcttcggatatggtaacg

SEQ ID NO: 298355 - DNA, 32 bp, Artificial Sequence
  Description of Artificial Sequence: Synthetic oligonucleotide
agcagactcctactgcttcggatatggtaacg

SEQ ID NO: 298356 - DNA, 31 bp, Artificial Sequence
  Description of Artificial Sequence: Synthetic oligonucleotide
gcagactcctactgcttcggatatggtaacg

SEQ ID NO: 298357 - DNA, 32 bp, Artificial Sequence
  Description of Artificial Sequence: Synthetic oligonucleotide
cagactcctactgcttcggatatggtaacgac

SEQ ID NO: 298358 - DNA, 34 bp, Artificial Sequence
  Description of Artificial Sequence: Synthetic oligonucleotide
agactcctactgcttcggatatggtaacgacatc

SEQ ID NO: 298359 - DNA, 33 bp, Artificial Sequence
  Description of Artificial Sequence: Synthetic oligonucleotide
gactcctactgcttcggatatggtaacgacatc

SEQ ID NO: 298360 - DNA, 33 bp, Artificial Sequence
  Description of Artificial Sequence: Synthetic oligonucleotide
actcctactgcttcggatatggtaacgacatcc

SEQ ID NO: 298361 - DNA, 32 bp, Artificial Sequence
  Description of Artificial Sequence: Synthetic oligonucleotide
ctcctactgcttcggatatggtaacgacatcc

SEQ ID NO: 298362 - DNA, 32 bp, Artificial Sequence
  Description of Artificial Sequence: Synthetic oligonucleotide
tcctactgcttcggatatggtaacgacatccc

SEQ ID NO: 298363 - DNA, 31 bp, Artificial Sequence
  Description of Artificial Sequence: Synthetic oligonucleotide
cctactgcttcggatatggtaacgacatccc

SEQ ID NO: 298364 - DNA, 31 bp, Artificial Sequence
  Description of Artificial Sequence: Synthetic oligonucleotide
ctactgcttcggatatggtaacgacatcccc

SEQ ID NO: 298365 - DNA, 34 bp, Artificial Sequence
  Description of Artificial Sequence: Synthetic oligonucleotide
tactgcttcggatatggtaacgacatcccctatc

SEQ ID NO: 298366 - DNA, 33 bp, Artificial Sequence
  Description of Artificial Sequence: Synthetic oligonucleotide
actgcttcggatatggtaacgacatcccctatc

SEQ ID NO: 298367 - DNA, 32 bp, Artificial Sequence
  Description of Artificial Sequence: Synthetic oligonucleotide
ctgcttcggatatggtaacgacatcccctatc

SEQ ID NO: 298368 - DNA, 35 bp, Artificial Sequence
  Description of Artificial Sequence: Synthetic oligonucleotide
tgcttcggatatggtaacgacatcccctatcttag

SEQ ID NO: 298369 - DNA, 34 bp, Artificial Sequence
  Description of Artificial Sequence: Synthetic oligonucleotide
gcttcggatatggtaacgacatcccctatcttag

SEQ ID NO: 298370 - DNA, 36 bp, Artificial Sequence
  Description of Artificial Sequence: Synthetic oligonucleotide
cttcggatatggtaacgacatcccctatcttagtag

SEQ ID NO: 298371 - DNA, 36 bp, Artificial Sequence
  Description of Artificial Sequence: Synthetic oligonucleotide
ttcggatatggtaacgacatcccctatcttagtagc

SEQ ID NO: 298372 - DNA, 35 bp, Artificial Sequence
  Description of Artificial Sequence: Synthetic oligonucleotide
tcggatatggtaacgacatcccctatcttagtagc

SEQ ID NO: 298373 - DNA, 34 bp, Artificial Sequence
  Description of Artificial Sequence: Synthetic oligonucleotide
cggatatggtaacgacatcccctatcttagtagc

SEQ ID NO: 298374 - DNA, 35 bp, Artificial Sequence
  Description of Artificial Sequence: Synthetic oligonucleotide
ggatatggtaacgacatcccctatcttagtagcag

SEQ ID NO: 298375 - DNA, 37 bp, Artificial Sequence
  Description of Artificial Sequence: Synthetic oligonucleotide
gatatggtaacgacatcccctatcttagtagcagtag

SEQ ID NO: 298376 - DNA, 38 bp, Artificial Sequence
  Description of Artificial Sequence: Synthetic oligonucleotide
atatggtaacgacatcccctatcttagtagcagtagtg

SEQ ID NO: 298377 - DNA, 37 bp, Artificial Sequence
  Description of Artificial Sequence: Synthetic oligonucleotide
tatggtaacgacatcccctatcttagtagcagtagtg

SEQ ID NO: 298378 - DNA, 36 bp, Artificial Sequence
  Description of Artificial Sequence: Synthetic oligonucleotide
atggtaacgacatcccctatcttagtagcagtagtg

SEQ ID NO: 298379 - DNA, 35 bp, Artificial Sequence
  Description of Artificial Sequence: Synthetic oligonucleotide
tggtaacgacatcccctatcttagtagcagtagtg

SEQ ID NO: 298380 - DNA, 34 bp, Artificial Sequence
  Description of Artificial Sequence: Synthetic oligonucleotide
ggtaacgacatcccctatcttagtagcagtagtg

SEQ ID NO: 298381 - DNA, 36 bp, Artificial Sequence
  Description of Artificial Sequence: Synthetic oligonucleotide
gtaacgacatcccctatcttagtagcagtagtgtag

SEQ ID NO: 298382 - DNA, 38 bp, Artificial Sequence
  Description of Artificial Sequence: Synthetic oligonucleotide
taacgacatcccctatcttagtagcagtagtgtagatg

SEQ ID NO: 298383 - DNA, 37 bp, Artificial Sequence
  Description of Artificial Sequence: Synthetic oligonucleotide
aacgacatcccctatcttagtagcagtagtgtagatg

SEQ ID NO: 298384 - DNA, 36 bp, Artificial Sequence
  Description of Artificial Sequence: Synthetic oligonucleotide
acgacatcccctatcttagtagcagtagtgtagatg

SEQ ID NO: 298385 - DNA, 35 bp, Artificial Sequence
  Description of Artificial Sequence: Synthetic oligonucleotide
cgacatcccctatcttagtagcagtagtgtagatg

SEQ ID NO: 298386 - DNA, 36 bp, Artificial Sequence
  Description of Artificial Sequence: Synthetic oligonucleotide
gacatcccctatcttagtagcagtagtgtagatgtg

SEQ ID NO: 298387 - DNA, 36 bp, Artificial Sequence
  Description of Artificial Sequence: Synthetic oligonucleotide
acatcccctatcttagtagcagtagtgtagatgtgc

SEQ ID NO: 298388 - DNA, 35 bp, Artificial Sequence
  Description of Artificial Sequence: Synthetic oligonucleotide
catcccctatcttagtagcagtagtgtagatgtgc

SEQ ID NO: 298389 - DNA, 38 bp, Artificial Sequence
  Description of Artificial Sequence: Synthetic oligonucleotide
atcccctatcttagtagcagtagtgtagatgtgctttg

SEQ ID NO: 298390 - DNA, 37 bp, Artificial Sequence
  Description of Artificial Sequence: Synthetic oligonucleotide
tcccctatcttagtagcagtagtgtagatgtgctttg

SEQ ID NO: 298391 - DNA, 36 bp, Artificial Sequence
  Description of Artificial Sequence: Synthetic oligonucleotide
cccctatcttagtagcagtagtgtagatgtgctttg

SEQ ID NO: 298392 - DNA, 37 bp, Artificial Sequence
  Description of Artificial Sequence: Synthetic oligonucleotide
ccctatcttagtagcagtagtgtagatgtgctttgag

SEQ ID NO: 298393 - DNA, 37 bp, Artificial Sequence
  Description of Artificial Sequence: Synthetic oligonucleotide
cctatcttagtagcagtagtgtagatgtgctttgagg

SEQ ID NO: 298394 - DNA, 37 bp, Artificial Sequence
  Description of Artificial Sequence: Synthetic oligonucleotide
ctatcttagtagcagtagtgtagatgtgctttgaggc

SEQ ID NO: 298395 - DNA, 41 bp, Artificial Sequence
  Description of Artificial Sequence: Synthetic oligonucleotide
tatcttagtagcagtagtgtagatgtgctttgaggctaatg

SEQ ID NO: 298396 - DNA, 40 bp, Artificial Sequence
  Description of Artificial Sequence: Synthetic oligonucleotide
atcttagtagcagtagtgtagatgtgctttgaggctaatg

SEQ ID NO: 298397 - DNA, 39 bp, Artificial Sequence
  Description of Artificial Sequence: Synthetic oligonucleotide
tcttagtagcagtagtgtagatgtgctttgaggctaatg

SEQ ID NO: 298398 - DNA, 38 bp, Artificial Sequence
  Description of Artificial Sequence: Synthetic oligonucleotide
cttagtagcagtagtgtagatgtgctttgaggctaatg

SEQ ID NO: 298399 - DNA, 41 bp, Artificial Sequence
  Description of Artificial Sequence: Synthetic oligonucleotide
ttagtagcagtagtgtagatgtgctttgaggctaatgaatg

SEQ ID NO: 298400 - DNA, 40 bp, Artificial Sequence
  Description of Artificial Sequence: Synthetic oligonucleotide
tagtagcagtagtgtagatgtgctttgaggctaatgaatg

SEQ ID NO: 298401 - DNA, 39 bp, Artificial Sequence
  Description of Artificial Sequence: Synthetic oligonucleotide
agtagcagtagtgtagatgtgctttgaggctaatgaatg

SEQ ID NO: 298402 - DNA, 38 bp, Artificial Sequence
  Description of Artificial Sequence: Synthetic oligonucleotide
gtagcagtagtgtagatgtgctttgaggctaatgaatg

SEQ ID NO: 298403 - DNA, 38 bp, Artificial Sequence
  Description of Artificial Sequence: Synthetic oligonucleotide
tagcagtagtgtagatgtgctttgaggctaatgaatgg

SEQ ID NO: 298404 - DNA, 37 bp, Artificial Sequence
  Description of Artificial Sequence: Synthetic oligonucleotide
agcagtagtgtagatgtgctttgaggctaatgaatgg

SEQ ID NO: 298405 - DNA, 36 bp, Artificial Sequence
  Description of Artificial Sequence: Synthetic oligonucleotide
gcagtagtgtagatgtgctttgaggctaatgaatgg

SEQ ID NO: 298406 - DNA, 36 bp, Artificial Sequence
  Description of Artificial Sequence: Synthetic oligonucleotide
cagtagtgtagatgtgctttgaggctaatgaatggg

SEQ ID NO: 298407 - DNA, 41 bp, Artificial Sequence
  Description of Artificial Sequence: Synthetic oligonucleotide
agtagtgtagatgtgctttgaggctaatgaatgggatatac

SEQ ID NO: 298408 - DNA, 40 bp, Artificial Sequence
  Description of Artificial Sequence: Synthetic oligonucleotide
gtagtgtagatgtgctttgaggctaatgaatgggatatac

SEQ ID NO: 298409 - DNA, 45 bp, Artificial Sequence
  Description of Artificial Sequence: Synthetic oligonucleotide
tagtgtagatgtgctttgaggctaatgaatgggatatacttaatg

SEQ ID NO: 298410 - DNA, 44 bp, Artificial Sequence
  Description of Artificial Sequence: Synthetic oligonucleotide
agtgtagatgtgctttgaggctaatgaatgggatatacttaatg

SEQ ID NO: 298411 - DNA, 43 bp, Artificial Sequence
  Description of Artificial Sequence: Synthetic oligonucleotide
gtgtagatgtgctttgaggctaatgaatgggatatacttaatg

SEQ ID NO: 298412 - DNA, 53 bp, Artificial Sequence
  Description of Artificial Sequence: Synthetic oligonucleotide
tgtagatgtgctttgaggctaatgaatgggatatacttaatgtaaatattatc

SEQ ID NO: 298413 - DNA, 52 bp, Artificial Sequence
  Description of Artificial Sequence: Synthetic oligonucleotide
gtagatgtgctttgaggctaatgaatgggatatacttaatgtaaatattatc

SEQ ID NO: 298414 - DNA, 52 bp, Artificial Sequence
  Description of Artificial Sequence: Synthetic oligonucleotide
tagatgtgctttgaggctaatgaatgggatatacttaatgtaaatattatcc

SEQ ID NO: 298415 - DNA, 51 bp, Artificial Sequence
  Description of Artificial Sequence: Synthetic oligonucleotide
agatgtgctttgaggctaatgaatgggatatacttaatgtaaatattatcc

SEQ ID NO: 298416 - DNA, 50 bp, Artificial Sequence
  Description of Artificial Sequence: Synthetic oligonucleotide
gatgtgctttgaggctaatgaatgggatatacttaatgtaaatattatcc

SEQ ID NO: 298417 - DNA, 54 bp, Artificial Sequence
  Description of Artificial Sequence: Synthetic oligonucleotide
atgtgctttgaggctaatgaatgggatatacttaatgtaaatattatccttttg

SEQ ID NO: 298418 - DNA, 53 bp, Artificial Sequence
  Description of Artificial Sequence: Synthetic oligonucleotide
tgtgctttgaggctaatgaatgggatatacttaatgtaaatattatccttttg

SEQ ID NO: 298419 - DNA, 52 bp, Artificial Sequence
  Description of Artificial Sequence: Synthetic oligonucleotide
gtgctttgaggctaatgaatgggatatacttaatgtaaatattatccttttg

SEQ ID NO: 298420 - DNA, 53 bp, Artificial Sequence
  Description of Artificial Sequence: Synthetic oligonucleotide
tgctttgaggctaatgaatgggatatacttaatgtaaatattatccttttgtc

SEQ ID NO: 298421 - DNA, 52 bp, Artificial Sequence
  Description of Artificial Sequence: Synthetic oligonucleotide
gctttgaggctaatgaatgggatatacttaatgtaaatattatccttttgtc

SEQ ID NO: 298422 - DNA, 52 bp, Artificial Sequence
  Description of Artificial Sequence: Synthetic oligonucleotide
ctttgaggctaatgaatgggatatacttaatgtaaatattatccttttgtcc

SEQ ID NO: 298423 - DNA, 56 bp, Artificial Sequence
  Description of Artificial Sequence: Synthetic oligonucleotide
tttgaggctaatgaatgggatatacttaatgtaaatattatccttttgtcctaaag

SEQ ID NO: 298424 - DNA, 55 bp, Artificial Sequence
  Description of Artificial Sequence: Synthetic oligonucleotide
ttgaggctaatgaatgggatatacttaatgtaaatattatccttttgtcctaaag

SEQ ID NO: 298425 - DNA, 54 bp, Artificial Sequence
  Description of Artificial Sequence: Synthetic oligonucleotide
tgaggctaatgaatgggatatacttaatgtaaatattatccttttgtcctaaag

SEQ ID NO: 298426 - DNA, 53 bp, Artificial Sequence
  Description of Artificial Sequence: Synthetic oligonucleotide
gaggctaatgaatgggatatacttaatgtaaatattatccttttgtcctaaag

SEQ ID NO: 298427 - DNA, 53 bp, Artificial Sequence
  Description of Artificial Sequence: Synthetic oligonucleotide
aggctaatgaatgggatatacttaatgtaaatattatccttttgtcctaaagg

SEQ ID NO: 298428 - DNA, 52 bp, Artificial Sequence
  Description of Artificial Sequence: Synthetic oligonucleotide
ggctaatgaatgggatatacttaatgtaaatattatccttttgtcctaaagg

SEQ ID NO: 298429 - DNA, 52 bp, Artificial Sequence
  Description of Artificial Sequence: Synthetic oligonucleotide
gctaatgaatgggatatacttaatgtaaatattatccttttgtcctaaaggc

SEQ ID NO: 298430 - DNA, 52 bp, Artificial Sequence
  Description of Artificial Sequence: Synthetic oligonucleotide
ctaatgaatgggatatacttaatgtaaatattatccttttgtcctaaaggcg

SEQ ID NO: 298431 - DNA, 52 bp, Artificial Sequence
  Description of Artificial Sequence: Synthetic oligonucleotide
taatgaatgggatatacttaatgtaaatattatccttttgtcctaaaggcgg

SEQ ID NO: 298432 - DNA, 51 bp, Artificial Sequence
  Description of Artificial Sequence: Synthetic oligonucleotide
aatgaatgggatatacttaatgtaaatattatccttttgtcctaaaggcgg

SEQ ID NO: 298433 - DNA, 50 bp, Artificial Sequence
  Description of Artificial Sequence: Synthetic oligonucleotide
atgaatgggatatacttaatgtaaatattatccttttgtcctaaaggcgg

SEQ ID NO: 298434 - DNA, 49 bp, Artificial Sequence
  Description of Artificial Sequence: Synthetic oligonucleotide
tgaatgggatatacttaatgtaaatattatccttttgtcctaaaggcgg

SEQ ID NO: 298435 - DNA, 48 bp, Artificial Sequence
  Description of Artificial Sequence: Synthetic oligonucleotide
gaatgggatatacttaatgtaaatattatccttttgtcctaaaggcgg

SEQ ID NO: 298436 - DNA, 49 bp, Artificial Sequence
  Description of Artificial Sequence: Synthetic oligonucleotide
aatgggatatacttaatgtaaatattatccttttgtcctaaaggcggac

SEQ ID NO: 298437 - DNA, 48 bp, Artificial Sequence
  Description of Artificial Sequence: Synthetic oligonucleotide
atgggatatacttaatgtaaatattatccttttgtcctaaaggcggac

SEQ ID NO: 298438 - DNA, 47 bp, Artificial Sequence
  Description of Artificial Sequence: Synthetic oligonucleotide
tgggatatacttaatgtaaatattatccttttgtcctaaaggcggac

SEQ ID NO: 298439 - DNA, 46 bp, Artificial Sequence
  Description of Artificial Sequence: Synthetic oligonucleotide
gggatatacttaatgtaaatattatccttttgtcctaaaggcggac

SEQ ID NO: 298440 - DNA, 47 bp, Artificial Sequence
  Description of Artificial Sequence: Synthetic oligonucleotide
ggatatacttaatgtaaatattatccttttgtcctaaaggcggactc

SEQ ID NO: 298441 - DNA, 48 bp, Artificial Sequence
  Description of Artificial Sequence: Synthetic oligonucleotide
gatatacttaatgtaaatattatccttttgtcctaaaggcggactcag

SEQ ID NO: 298442 - DNA, 54 bp, Artificial Sequence
  Description of Artificial Sequence: Synthetic oligonucleotide
atatacttaatgtaaatattatccttttgtcctaaaggcggactcagttaaatc

SEQ ID NO: 298443 - DNA, 53 bp, Artificial Sequence
  Description of Artificial Sequence: Synthetic oligonucleotide
tatacttaatgtaaatattatccttttgtcctaaaggcggactcagttaaatc

SEQ ID NO: 298444 - DNA, 52 bp, Artificial Sequence
  Description of Artificial Sequence: Synthetic oligonucleotide
atacttaatgtaaatattatccttttgtcctaaaggcggactcagttaaatc

SEQ ID NO: 298445 - DNA, 51 bp, Artificial Sequence
  Description of Artificial Sequence: Synthetic oligonucleotide
tacttaatgtaaatattatccttttgtcctaaaggcggactcagttaaatc

SEQ ID NO: 298446 - DNA, 50 bp, Artificial Sequence
  Description of Artificial Sequence: Synthetic oligonucleotide
acttaatgtaaatattatccttttgtcctaaaggcggactcagttaaatc

SEQ ID NO: 298447 - DNA, 49 bp, Artificial Sequence
  Description of Artificial Sequence: Synthetic oligonucleotide
cttaatgtaaatattatccttttgtcctaaaggcggactcagttaaatc

SEQ ID NO: 298448 - DNA, 51 bp, Artificial Sequence
  Description of Artificial Sequence: Synthetic oligonucleotide
ttaatgtaaatattatccttttgtcctaaaggcggactcagttaaatcaag

SEQ ID NO: 298449 - DNA, 50 bp, Artificial Sequence
  Description of Artificial Sequence: Synthetic oligonucleotide
taatgtaaatattatccttttgtcctaaaggcggactcagttaaatcaag

SEQ ID NO: 298450 - DNA, 49 bp, Artificial Sequence
  Description of Artificial Sequence: Synthetic oligonucleotide
aatgtaaatattatccttttgtcctaaaggcggactcagttaaatcaag

SEQ ID NO: 298451 - DNA, 48 bp, Artificial Sequence
  Description of Artificial Sequence: Synthetic oligonucleotide
atgtaaatattatccttttgtcctaaaggcggactcagttaaatcaag

SEQ ID NO: 298452 - DNA, 47 bp, Artificial Sequence
  Description of Artificial Sequence: Synthetic oligonucleotide
tgtaaatattatccttttgtcctaaaggcggactcagttaaatcaag

SEQ ID NO: 298453 - DNA, 46 bp, Artificial Sequence
  Description of Artificial Sequence: Synthetic oligonucleotide
gtaaatattatccttttgtcctaaaggcggactcagttaaatcaag

SEQ ID NO: 298454 - DNA, 46 bp, Artificial Sequence
  Description of Artificial Sequence: Synthetic oligonucleotide
taaatattatccttttgtcctaaaggcggactcagttaaatcaagc

SEQ ID NO: 298455 - DNA, 45 bp, Artificial Sequence
  Description of Artificial Sequence: Synthetic oligonucleotide
aaatattatccttttgtcctaaaggcggactcagttaaatcaagc

SEQ ID NO: 298456 - DNA, 44 bp, Artificial Sequence
  Description of Artificial Sequence: Synthetic oligonucleotide
aatattatccttttgtcctaaaggcggactcagttaaatcaagc

SEQ ID NO: 298457 - DNA, 43 bp, Artificial Sequence
  Description of Artificial Sequence: Synthetic oligonucleotide
atattatccttttgtcctaaaggcggactcagttaaatcaagc

SEQ ID NO: 298458 - DNA, 42 bp, Artificial Sequence
  Description of Artificial Sequence: Synthetic oligonucleotide
tattatccttttgtcctaaaggcggactcagttaaatcaagc

SEQ ID NO: 298459 - DNA, 41 bp, Artificial Sequence
  Description of Artificial Sequence: Synthetic oligonucleotide
attatccttttgtcctaaaggcggactcagttaaatcaagc

SEQ ID NO: 298460 - DNA, 40 bp, Artificial Sequence
  Description of Artificial Sequence: Synthetic oligonucleotide
ttatccttttgtcctaaaggcggactcagttaaatcaagc

SEQ ID NO: 298461 - DNA, 39 bp, Artificial Sequence
  Description of Artificial Sequence: Synthetic oligonucleotide
tatccttttgtcctaaaggcggactcagttaaatcaagc

SEQ ID NO: 298462 - DNA, 38 bp, Artificial Sequence
  Description of Artificial Sequence: Synthetic oligonucleotide
atccttttgtcctaaaggcggactcagttaaatcaagc

SEQ ID NO: 298463 - DNA, 37 bp, Artificial Sequence
  Description of Artificial Sequence: Synthetic oligonucleotide
tccttttgtcctaaaggcggactcagttaaatcaagc

SEQ ID NO: 298464 - DNA, 36 bp, Artificial Sequence
  Description of Artificial Sequence: Synthetic oligonucleotide
ccttttgtcctaaaggcggactcagttaaatcaagc

SEQ ID NO: 298465 - DNA, 37 bp, Artificial Sequence
  Description of Artificial Sequence: Synthetic oligonucleotide
cttttgtcctaaaggcggactcagttaaatcaagctg

SEQ ID NO: 298466 - DNA, 39 bp, Artificial Sequence
  Description of Artificial Sequence: Synthetic oligonucleotide
ttttgtcctaaaggcggactcagttaaatcaagctgttc

SEQ ID NO: 298467 - DNA, 38 bp, Artificial Sequence
  Description of Artificial Sequence: Synthetic oligonucleotide
tttgtcctaaaggcggactcagttaaatcaagctgttc

SEQ ID NO: 298468 - DNA, 37 bp, Artificial Sequence
  Description of Artificial Sequence: Synthetic oligonucleotide
ttgtcctaaaggcggactcagttaaatcaagctgttc

SEQ ID NO: 298469 - DNA, 36 bp, Artificial Sequence
  Description of Artificial Sequence: Synthetic oligonucleotide
tgtcctaaaggcggactcagttaaatcaagctgttc

SEQ ID NO: 298470 - DNA, 35 bp, Artificial Sequence
  Description of Artificial Sequence: Synthetic oligonucleotide
gtcctaaaggcggactcagttaaatcaagctgttc

SEQ ID NO: 298471 - DNA, 35 bp, Artificial Sequence
  Description of Artificial Sequence: Synthetic oligonucleotide
tcctaaaggcggactcagttaaatcaagctgttcc

SEQ ID NO: 298472 - DNA, 34 bp, Artificial Sequence
  Description of Artificial Sequence: Synthetic oligonucleotide
cctaaaggcggactcagttaaatcaagctgttcc

SEQ ID NO: 298473 - DNA, 34 bp, Artificial Sequence
  Description of Artificial Sequence: Synthetic oligonucleotide
ctaaaggcggactcagttaaatcaagctgttccc

SEQ ID NO: 298474 - DNA, 39 bp, Artificial Sequence
  Description of Artificial Sequence: Synthetic oligonucleotide
taaaggcggactcagttaaatcaagctgttcccaaaatg

SEQ ID NO: 298475 - DNA, 38 bp, Artificial Sequence
  Description of Artificial Sequence: Synthetic oligonucleotide
aaaggcggactcagttaaatcaagctgttcccaaaatg

SEQ ID NO: 298476 - DNA, 37 bp, Artificial Sequence
  Description of Artificial Sequence: Synthetic oligonucleotide
aaggcggactcagttaaatcaagctgttcccaaaatg

SEQ ID NO: 298477 - DNA, 36 bp, Artificial Sequence
  Description of Artificial Sequence: Synthetic oligonucleotide
aggcggactcagttaaatcaagctgttcccaaaatg

SEQ ID NO: 298478 - DNA, 35 bp, Artificial Sequence
  Description of Artificial Sequence: Synthetic oligonucleotide
ggcggactcagttaaatcaagctgttcccaaaatg

SEQ ID NO: 298479 - DNA, 35 bp, Artificial Sequence
  Description of Artificial Sequence: Synthetic oligonucleotide
gcggactcagttaaatcaagctgttcccaaaatgg

SEQ ID NO: 298480 - DNA, 37 bp, Artificial Sequence
  Description of Artificial Sequence: Synthetic oligonucleotide
cggactcagttaaatcaagctgttcccaaaatggatc

SEQ ID NO: 298481 - DNA, 39 bp, Artificial Sequence
  Description of Artificial Sequence: Synthetic oligonucleotide
ggactcagttaaatcaagctgttcccaaaatggatcaac

SEQ ID NO: 298482 - DNA, 40 bp, Artificial Sequence
  Description of Artificial Sequence: Synthetic oligonucleotide
gactcagttaaatcaagctgttcccaaaatggatcaacag

SEQ ID NO: 298483 - DNA, 41 bp, Artificial Sequence
  Description of Artificial Sequence: Synthetic oligonucleotide
actcagttaaatcaagctgttcccaaaatggatcaacagtg

SEQ ID NO: 298484 - DNA, 40 bp, Artificial Sequence
  Description of Artificial Sequence: Synthetic oligonucleotide
ctcagttaaatcaagctgttcccaaaatggatcaacagtg

SEQ ID NO: 298485 - DNA, 40 bp, Artificial Sequence
  Description of Artificial Sequence: Synthetic oligonucleotide
tcagttaaatcaagctgttcccaaaatggatcaacagtgg

SEQ ID NO: 298486 - DNA, 39 bp, Artificial Sequence
  Description of Artificial Sequence: Synthetic oligonucleotide
cagttaaatcaagctgttcccaaaatggatcaacagtgg

SEQ ID NO: 298487 - DNA, 40 bp, Artificial Sequence
  Description of Artificial Sequence: Synthetic oligonucleotide
agttaaatcaagctgttcccaaaatggatcaacagtggtg

SEQ ID NO: 298488 - DNA, 39 bp, Artificial Sequence
  Description of Artificial Sequence: Synthetic oligonucleotide
gttaaatcaagctgttcccaaaatggatcaacagtggtg

SEQ ID NO: 298489 - DNA, 41 bp, Artificial Sequence
  Description of Artificial Sequence: Synthetic oligonucleotide
ttaaatcaagctgttcccaaaatggatcaacagtggtgtac

SEQ ID NO: 298490 - DNA, 40 bp, Artificial Sequence
  Description of Artificial Sequence: Synthetic oligonucleotide
taaatcaagctgttcccaaaatggatcaacagtggtgtac

SEQ ID NO: 298491 - DNA, 39 bp, Artificial Sequence
  Description of Artificial Sequence: Synthetic oligonucleotide
aaatcaagctgttcccaaaatggatcaacagtggtgtac

SEQ ID NO: 298492 - DNA, 38 bp, Artificial Sequence
  Description of Artificial Sequence: Synthetic oligonucleotide
aatcaagctgttcccaaaatggatcaacagtggtgtac

SEQ ID NO: 298493 - DNA, 37 bp, Artificial Sequence
  Description of Artificial Sequence: Synthetic oligonucleotide
atcaagctgttcccaaaatggatcaacagtggtgtac

SEQ ID NO: 298494 - DNA, 36 bp, Artificial Sequence
  Description of Artificial Sequence: Synthetic oligonucleotide
tcaagctgttcccaaaatggatcaacagtggtgtac

SEQ ID NO: 298495 - DNA, 35 bp, Artificial Sequence
  Description of Artificial Sequence: Synthetic oligonucleotide
caagctgttcccaaaatggatcaacagtggtgtac

SEQ ID NO: 298496 - DNA, 39 bp, Artificial Sequence
  Description of Artificial Sequence: Synthetic oligonucleotide
aagctgttcccaaaatggatcaacagtggtgtacttatc

SEQ ID NO: 298497 - DNA, 38 bp, Artificial Sequence
  Description of Artificial Sequence: Synthetic oligonucleotide
agctgttcccaaaatggatcaacagtggtgtacttatc

SEQ ID NO: 298498 - DNA, 37 bp, Artificial Sequence
  Description of Artificial Sequence: Synthetic oligonucleotide
gctgttcccaaaatggatcaacagtggtgtacttatc

SEQ ID NO: 298499 - DNA, 39 bp, Artificial Sequence
  Description of Artificial Sequence: Synthetic oligonucleotide
ctgttcccaaaatggatcaacagtggtgtacttatcttg

SEQ ID NO: 298500 - DNA, 40 bp, Artificial Sequence
  Description of Artificial Sequence: Synthetic oligonucleotide
tgttcccaaaatggatcaacagtggtgtacttatcttgag

SEQ ID NO: 298501 - DNA, 39 bp, Artificial Sequence
  Description of Artificial Sequence: Synthetic oligonucleotide
gttcccaaaatggatcaacagtggtgtacttatcttgag

SEQ ID NO: 298502 - DNA, 39 bp, Artificial Sequence
  Description of Artificial Sequence: Synthetic oligonucleotide
ttcccaaaatggatcaacagtggtgtacttatcttgagg

SEQ ID NO: 298503 - DNA, 38 bp, Artificial Sequence
  Description of Artificial Sequence: Synthetic oligonucleotide
tcccaaaatggatcaacagtggtgtacttatcttgagg

SEQ ID NO: 298504 - DNA, 37 bp, Artificial Sequence
  Description of Artificial Sequence: Synthetic oligonucleotide
cccaaaatggatcaacagtggtgtacttatcttgagg

SEQ ID NO: 298505 - DNA, 41 bp, Artificial Sequence
  Description of Artificial Sequence: Synthetic oligonucleotide
ccaaaatggatcaacagtggtgtacttatcttgaggaaaac

SEQ ID NO: 298506 - DNA, 42 bp, Artificial Sequence
  Description of Artificial Sequence: Synthetic oligonucleotide
caaaatggatcaacagtggtgtacttatcttgaggaaaacac

SEQ ID NO: 298507 - DNA, 43 bp, Artificial Sequence
  Description of Artificial Sequence: Synthetic oligonucleotide
aaaatggatcaacagtggtgtacttatcttgaggaaaacacag

SEQ ID NO: 298508 - DNA, 42 bp, Artificial Sequence
  Description of Artificial Sequence: Synthetic oligonucleotide
aaatggatcaacagtggtgtacttatcttgaggaaaacacag

SEQ ID NO: 298509 - DNA, 41 bp, Artificial Sequence
  Description of Artificial Sequence: Synthetic oligonucleotide
aatggatcaacagtggtgtacttatcttgaggaaaacacag

SEQ ID NO: 298510 - DNA, 40 bp, Artificial Sequence
  Description of Artificial Sequence: Synthetic oligonucleotide
atggatcaacagtggtgtacttatcttgaggaaaacacag

SEQ ID NO: 298511 - DNA, 39 bp, Artificial Sequence
  Description of Artificial Sequence: Synthetic oligonucleotide
tggatcaacagtggtgtacttatcttgaggaaaacacag

SEQ ID NO: 298512 - DNA, 38 bp, Artificial Sequence
  Description of Artificial Sequence: Synthetic oligonucleotide
ggatcaacagtggtgtacttatcttgaggaaaacacag

SEQ ID NO: 298513 - DNA, 39 bp, Artificial Sequence
  Description of Artificial Sequence: Synthetic oligonucleotide
gatcaacagtggtgtacttatcttgaggaaaacacagac

SEQ ID NO: 298514 - DNA, 39 bp, Artificial Sequence
  Description of Artificial Sequence: Synthetic oligonucleotide
atcaacagtggtgtacttatcttgaggaaaacacagacc

SEQ ID NO: 298515 - DNA, 38 bp, Artificial Sequence
  Description of Artificial Sequence: Synthetic oligonucleotide
tcaacagtggtgtacttatcttgaggaaaacacagacc

SEQ ID NO: 298516 - DNA, 37 bp, Artificial Sequence
  Description of Artificial Sequence: Synthetic oligonucleotide
caacagtggtgtacttatcttgaggaaaacacagacc

SEQ ID NO: 298517 - DNA, 39 bp, Artificial Sequence
  Description of Artificial Sequence: Synthetic oligonucleotide
aacagtggtgtacttatcttgaggaaaacacagacctac

SEQ ID NO: 298518 - DNA, 38 bp, Artificial Sequence
  Description of Artificial Sequence: Synthetic oligonucleotide
acagtggtgtacttatcttgaggaaaacacagacctac

SEQ ID NO: 298519 - DNA, 37 bp, Artificial Sequence
  Description of Artificial Sequence: Synthetic oligonucleotide
cagtggtgtacttatcttgaggaaaacacagacctac

SEQ ID NO: 298520 - DNA, 37 bp, Artificial Sequence
  Description of Artificial Sequence: Synthetic oligonucleotide
agtggtgtacttatcttgaggaaaacacagacctacc

SEQ ID NO: 298521 - DNA, 36 bp, Artificial Sequence
  Description of Artificial Sequence: Synthetic oligonucleotide
gtggtgtacttatcttgaggaaaacacagacctacc

SEQ ID NO: 298522 - DNA, 39 bp, Artificial Sequence
  Description of Artificial Sequence: Synthetic oligonucleotide
tggtgtacttatcttgaggaaaacacagacctacctatc

SEQ ID NO: 298523 - DNA, 38 bp, Artificial Sequence
  Description of Artificial Sequence: Synthetic oligonucleotide
ggtgtacttatcttgaggaaaacacagacctacctatc

SEQ ID NO: 298524 - DNA, 41 bp, Artificial Sequence
  Description of Artificial Sequence: Synthetic oligonucleotide
gtgtacttatcttgaggaaaacacagacctacctatcaaag

SEQ ID NO: 298525 - DNA, 43 bp, Artificial Sequence
  Description of Artificial Sequence: Synthetic oligonucleotide
tgtacttatcttgaggaaaacacagacctacctatcaaagttc

SEQ ID NO: 298526 - DNA, 42 bp, Artificial Sequence
  Description of Artificial Sequence: Synthetic oligonucleotide
gtacttatcttgaggaaaacacagacctacctatcaaagttc

SEQ ID NO: 298527 - DNA, 42 bp, Artificial Sequence
  Description of Artificial Sequence: Synthetic oligonucleotide
tacttatcttgaggaaaacacagacctacctatcaaagttcg

SEQ ID NO: 298528 - DNA, 41 bp, Artificial Sequence
  Description of Artificial Sequence: Synthetic oligonucleotide
acttatcttgaggaaaacacagacctacctatcaaagttcg

SEQ ID NO: 298529 - DNA, 40 bp, Artificial Sequence
  Description of Artificial Sequence: Synthetic oligonucleotide
cttatcttgaggaaaacacagacctacctatcaaagttcg

SEQ ID NO: 298530 - DNA, 47 bp, Artificial Sequence
  Description of Artificial Sequence: Synthetic oligonucleotide
ttatcttgaggaaaacacagacctacctatcaaagttcgattaaatg

SEQ ID NO: 298531 - DNA, 46 bp, Artificial Sequence
  Description of Artificial Sequence: Synthetic oligonucleotide
tatcttgaggaaaacacagacctacctatcaaagttcgattaaatg

SEQ ID NO: 298532 - DNA, 45 bp, Artificial Sequence
  Description of Artificial Sequence: Synthetic oligonucleotide
atcttgaggaaaacacagacctacctatcaaagttcgattaaatg

SEQ ID NO: 298533 - DNA, 44 bp, Artificial Sequence
  Description of Artificial Sequence: Synthetic oligonucleotide
tcttgaggaaaacacagacctacctatcaaagttcgattaaatg

SEQ ID NO: 298534 - DNA, 43 bp, Artificial Sequence
  Description of Artificial Sequence: Synthetic oligonucleotide
cttgaggaaaacacagacctacctatcaaagttcgattaaatg

SEQ ID NO: 298535 - DNA, 46 bp, Artificial Sequence
  Description of Artificial Sequence: Synthetic oligonucleotide
ttgaggaaaacacagacctacctatcaaagttcgattaaatgatac

SEQ ID NO: 298536 - DNA, 45 bp, Artificial Sequence
  Description of Artificial Sequence: Synthetic oligonucleotide
tgaggaaaacacagacctacctatcaaagttcgattaaatgatac

SEQ ID NO: 298537 - DNA, 44 bp, Artificial Sequence
  Description of Artificial Sequence: Synthetic oligonucleotide
gaggaaaacacagacctacctatcaaagttcgattaaatgatac

SEQ ID NO: 298538 - DNA, 45 bp, Artificial Sequence
  Description of Artificial Sequence: Synthetic oligonucleotide
aggaaaacacagacctacctatcaaagttcgattaaatgatactc

SEQ ID NO: 298539 - DNA, 44 bp, Artificial Sequence
  Description of Artificial Sequence: Synthetic oligonucleotide
ggaaaacacagacctacctatcaaagttcgattaaatgatactc

SEQ ID NO: 298540 - DNA, 46 bp, Artificial Sequence
  Description of Artificial Sequence: Synthetic oligonucleotide
gaaaacacagacctacctatcaaagttcgattaaatgatactcttc

SEQ ID NO: 298541 - DNA, 46 bp, Artificial Sequence
  Description of Artificial Sequence: Synthetic oligonucleotide
aaaacacagacctacctatcaaagttcgattaaatgatactcttcg

SEQ ID NO: 298542 - DNA, 45 bp, Artificial Sequence
  Description of Artificial Sequence: Synthetic oligonucleotide
aaacacagacctacctatcaaagttcgattaaatgatactcttcg

SEQ ID NO: 298543 - DNA, 44 bp, Artificial Sequence
  Description of Artificial Sequence: Synthetic oligonucleotide
aacacagacctacctatcaaagttcgattaaatgatactcttcg

SEQ ID NO: 298544 - DNA, 43 bp, Artificial Sequence
  Description of Artificial Sequence: Synthetic oligonucleotide
acacagacctacctatcaaagttcgattaaatgatactcttcg

SEQ ID NO: 298545 - DNA, 42 bp, Artificial Sequence
  Description of Artificial Sequence: Synthetic oligonucleotide
cacagacctacctatcaaagttcgattaaatgatactcttcg

SEQ ID NO: 298546 - DNA, 45 bp, Artificial Sequence
  Description of Artificial Sequence: Synthetic oligonucleotide
acagacctacctatcaaagttcgattaaatgatactcttcgaatg

SEQ ID NO: 298547 - DNA, 44 bp, Artificial Sequence
  Description of Artificial Sequence: Synthetic oligonucleotide
cagacctacctatcaaagttcgattaaatgatactcttcgaatg

SEQ ID NO: 298548 - DNA, 44 bp, Artificial Sequence
  Description of Artificial Sequence: Synthetic oligonucleotide
agacctacctatcaaagttcgattaaatgatactcttcgaatgg

SEQ ID NO: 298549 - DNA, 43 bp, Artificial Sequence
  Description of Artificial Sequence: Synthetic oligonucleotide
gacctacctatcaaagttcgattaaatgatactcttcgaatgg

SEQ ID NO: 298550 - DNA, 46 bp, Artificial Sequence
  Description of Artificial Sequence: Synthetic oligonucleotide
acctacctatcaaagttcgattaaatgatactcttcgaatggtttc

SEQ ID NO: 298551 - DNA, 45 bp, Artificial Sequence
  Description of Artificial Sequence: Synthetic oligonucleotide
cctacctatcaaagttcgattaaatgatactcttcgaatggtttc

SEQ ID NO: 298552 - DNA, 45 bp, Artificial Sequence
  Description of Artificial Sequence: Synthetic oligonucleotide
ctacctatcaaagttcgattaaatgatactcttcgaatggtttcc

SEQ ID NO: 298553 - DNA, 45 bp, Artificial Sequence
  Description of Artificial Sequence: Synthetic oligonucleotide
tacctatcaaagttcgattaaatgatactcttcgaatggtttccg

SEQ ID NO: 298554 - DNA, 44 bp, Artificial Sequence
  Description of Artificial Sequence: Synthetic oligonucleotide
acctatcaaagttcgattaaatgatactcttcgaatggtttccg

SEQ ID NO: 298555 - DNA, 43 bp, Artificial Sequence
  Description of Artificial Sequence: Synthetic oligonucleotide
cctatcaaagttcgattaaatgatactcttcgaatggtttccg

SEQ ID NO: 298556 - DNA, 45 bp, Artificial Sequence
  Description of Artificial Sequence: Synthetic oligonucleotide
ctatcaaagttcgattaaatgatactcttcgaatggtttccgaag

SEQ ID NO: 298557 - DNA, 45 bp, Artificial Sequence
  Description of Artificial Sequence: Synthetic oligonucleotide
tatcaaagttcgattaaatgatactcttcgaatggtttccgaagg

SEQ ID NO: 298558 - DNA, 44 bp, Artificial Sequence
  Description of Artificial Sequence: Synthetic oligonucleotide
atcaaagttcgattaaatgatactcttcgaatggtttccgaagg

SEQ ID NO: 298559 - DNA, 43 bp, Artificial Sequence
  Description of Artificial Sequence: Synthetic oligonucleotide
tcaaagttcgattaaatgatactcttcgaatggtttccgaagg

SEQ ID NO: 298560 - DNA, 42 bp, Artificial Sequence
  Description of Artificial Sequence: Synthetic oligonucleotide
caaagttcgattaaatgatactcttcgaatggtttccgaagg

SEQ ID NO: 298561 - DNA, 42 bp, Artificial Sequence
  Description of Artificial Sequence: Synthetic oligonucleotide
aaagttcgattaaatgatactcttcgaatggtttccgaaggc

SEQ ID NO: 298562 - DNA, 41 bp, Artificial Sequence
  Description of Artificial Sequence: Synthetic oligonucleotide
aagttcgattaaatgatactcttcgaatggtttccgaaggc

SEQ ID NO: 298563 - DNA, 40 bp, Artificial Sequence
  Description of Artificial Sequence: Synthetic oligonucleotide
agttcgattaaatgatactcttcgaatggtttccgaaggc

SEQ ID NO: 298564 - DNA, 39 bp, Artificial Sequence
  Description of Artificial Sequence: Synthetic oligonucleotide
gttcgattaaatgatactcttcgaatggtttccgaaggc

SEQ ID NO: 298565 - DNA, 41 bp, Artificial Sequence
  Description of Artificial Sequence: Synthetic oligonucleotide
ttcgattaaatgatactcttcgaatggtttccgaaggcatg

SEQ ID NO: 298566 - DNA, 40 bp, Artificial Sequence
  Description of Artificial Sequence: Synthetic oligonucleotide
tcgattaaatgatactcttcgaatggtttccgaaggcatg

SEQ ID NO: 298567 - DNA, 39 bp, Artificial Sequence
  Description of Artificial Sequence: Synthetic oligonucleotide
cgattaaatgatactcttcgaatggtttccgaaggcatg

SEQ ID NO: 298568 - DNA, 45 bp, Artificial Sequence
  Description of Artificial Sequence: Synthetic oligonucleotide
gattaaatgatactcttcgaatggtttccgaaggcatgatttatg

SEQ ID NO: 298569 - DNA, 47 bp, Artificial Sequence
  Description of Artificial Sequence: Synthetic oligonucleotide
attaaatgatactcttcgaatggtttccgaaggcatgatttatgtag

SEQ ID NO: 298570 - DNA, 46 bp, Artificial Sequence
  Description of Artificial Sequence: Synthetic oligonucleotide
ttaaatgatactcttcgaatggtttccgaaggcatgatttatgtag

SEQ ID NO: 298571 - DNA, 45 bp, Artificial Sequence
  Description of Artificial Sequence: Synthetic oligonucleotide
taaatgatactcttcgaatggtttccgaaggcatgatttatgtag

SEQ ID NO: 298572 - DNA, 44 bp, Artificial Sequence
  Description of Artificial Sequence: Synthetic oligonucleotide
aaatgatactcttcgaatggtttccgaaggcatgatttatgtag

SEQ ID NO: 298573 - DNA, 43 bp, Artificial Sequence
  Description of Artificial Sequence: Synthetic oligonucleotide
aatgatactcttcgaatggtttccgaaggcatgatttatgtag

SEQ ID NO: 298574 - DNA, 42 bp, Artificial Sequence
  Description of Artificial Sequence: Synthetic oligonucleotide
atgatactcttcgaatggtttccgaaggcatgatttatgtag

SEQ ID NO: 298575 - DNA, 41 bp, Artificial Sequence
  Description of Artificial Sequence: Synthetic oligonucleotide
tgatactcttcgaatggtttccgaaggcatgatttatgtag

SEQ ID NO: 298576 - DNA, 40 bp, Artificial Sequence
  Description of Artificial Sequence: Synthetic oligonucleotide
gatactcttcgaatggtttccgaaggcatgatttatgtag

SEQ ID NO: 298577 - DNA, 45 bp, Artificial Sequence
  Description of Artificial Sequence: Synthetic oligonucleotide
atactcttcgaatggtttccgaaggcatgatttatgtagaaattg

SEQ ID NO: 298578 - DNA, 44 bp, Artificial Sequence
  Description of Artificial Sequence: Synthetic oligonucleotide
tactcttcgaatggtttccgaaggcatgatttatgtagaaattg

SEQ ID NO: 298579 - DNA, 43 bp, Artificial Sequence
  Description of Artificial Sequence: Synthetic oligonucleotide
actcttcgaatggtttccgaaggcatgatttatgtagaaattg

SEQ ID NO: 298580 - DNA, 42 bp, Artificial Sequence
  Description of Artificial Sequence: Synthetic oligonucleotide
ctcttcgaatggtttccgaaggcatgatttatgtagaaattg

SEQ ID NO: 298581 - DNA, 43 bp, Artificial Sequence
  Description of Artificial Sequence: Synthetic oligonucleotide
tcttcgaatggtttccgaaggcatgatttatgtagaaattgag

SEQ ID NO: 298582 - DNA, 42 bp, Artificial Sequence
  Description of Artificial Sequence: Synthetic oligonucleotide
cttcgaatggtttccgaaggcatgatttatgtagaaattgag

SEQ ID NO: 298583 - DNA, 42 bp, Artificial Sequence
  Description of Artificial Sequence: Synthetic oligonucleotide
ttcgaatggtttccgaaggcatgatttatgtagaaattgagg

SEQ ID NO: 298584 - DNA, 41 bp, Artificial Sequence
  Description of Artificial Sequence: Synthetic oligonucleotide
tcgaatggtttccgaaggcatgatttatgtagaaattgagg

SEQ ID NO: 298585 - DNA, 40 bp, Artificial Sequence
  Description of Artificial Sequence: Synthetic oligonucleotide
cgaatggtttccgaaggcatgatttatgtagaaattgagg

SEQ ID NO: 298586 - DNA, 40 bp, Artificial Sequence
  Description of Artificial Sequence: Synthetic oligonucleotide
gaatggtttccgaaggcatgatttatgtagaaattgaggg

SEQ ID NO: 298587 - DNA, 41 bp, Artificial Sequence
  Description of Artificial Sequence: Synthetic oligonucleotide
aatggtttccgaaggcatgatttatgtagaaattgagggtg

SEQ ID NO: 298588 - DNA, 40 bp, Artificial Sequence
  Description of Artificial Sequence: Synthetic oligonucleotide
atggtttccgaaggcatgatttatgtagaaattgagggtg

SEQ ID NO: 298589 - DNA, 39 bp, Artificial Sequence
  Description of Artificial Sequence: Synthetic oligonucleotide
tggtttccgaaggcatgatttatgtagaaattgagggtg

SEQ ID NO: 298590 - DNA, 38 bp, Artificial Sequence
  Description of Artificial Sequence: Synthetic oligonucleotide
ggtttccgaaggcatgatttatgtagaaattgagggtg

SEQ ID NO: 298591 - DNA, 38 bp, Artificial Sequence
  Description of Artificial Sequence: Synthetic oligonucleotide
gtttccgaaggcatgatttatgtagaaattgagggtgc

SEQ ID NO: 298592 - DNA, 38 bp, Artificial Sequence
  Description of Artificial Sequence: Synthetic oligonucleotide
tttccgaaggcatgatttatgtagaaattgagggtgcg

SEQ ID NO: 298593 - DNA, 37 bp, Artificial Sequence
  Description of Artificial Sequence: Synthetic oligonucleotide
ttccgaaggcatgatttatgtagaaattgagggtgcg

SEQ ID NO: 298594 - DNA, 36 bp, Artificial Sequence
  Description of Artificial Sequence: Synthetic oligonucleotide
tccgaaggcatgatttatgtagaaattgagggtgcg

SEQ ID NO: 298595 - DNA, 35 bp, Artificial Sequence
  Description of Artificial Sequence: Synthetic oligonucleotide
ccgaaggcatgatttatgtagaaattgagggtgcg

SEQ ID NO: 298596 - DNA, 35 bp, Artificial Sequence
  Description of Artificial Sequence: Synthetic oligonucleotide
cgaaggcatgatttatgtagaaattgagggtgcgc

SEQ ID NO: 298597 - DNA, 35 bp, Artificial Sequence
  Description of Artificial Sequence: Synthetic oligonucleotide
gaaggcatgatttatgtagaaattgagggtgcgcg

SEQ ID NO: 298598 - DNA, 36 bp, Artificial Sequence
  Description of Artificial Sequence: Synthetic oligonucleotide
aaggcatgatttatgtagaaattgagggtgcgcgac

SEQ ID NO: 298599 - DNA, 35 bp, Artificial Sequence
  Description of Artificial Sequence: Synthetic oligonucleotide
aggcatgatttatgtagaaattgagggtgcgcgac

SEQ ID NO: 298600 - DNA, 34 bp, Artificial Sequence
  Description of Artificial Sequence: Synthetic oligonucleotide
ggcatgatttatgtagaaattgagggtgcgcgac

SEQ ID NO: 298601 - DNA, 35 bp, Artificial Sequence
  Description of Artificial Sequence: Synthetic oligonucleotide
gcatgatttatgtagaaattgagggtgcgcgacag

SEQ ID NO: 298602 - DNA, 36 bp, Artificial Sequence
  Description of Artificial Sequence: Synthetic oligonucleotide
catgatttatgtagaaattgagggtgcgcgacagac

SEQ ID NO: 298603 - DNA, 41 bp, Artificial Sequence
  Description of Artificial Sequence: Synthetic oligonucleotide
atgatttatgtagaaattgagggtgcgcgacagactaaaac

SEQ ID NO: 298604 - DNA, 40 bp, Artificial Sequence
  Description of Artificial Sequence: Synthetic oligonucleotide
tgatttatgtagaaattgagggtgcgcgacagactaaaac

SEQ ID NO: 298605 - DNA, 39 bp, Artificial Sequence
  Description of Artificial Sequence: Synthetic oligonucleotide
gatttatgtagaaattgagggtgcgcgacagactaaaac

SEQ ID NO: 298606 - DNA, 43 bp, Artificial Sequence
  Description of Artificial Sequence: Synthetic oligonucleotide
atttatgtagaaattgagggtgcgcgacagactaaaactttag

SEQ ID NO: 298607 - DNA, 42 bp, Artificial Sequence
  Description of Artificial Sequence: Synthetic oligonucleotide
tttatgtagaaattgagggtgcgcgacagactaaaactttag

SEQ ID NO: 298608 - DNA, 41 bp, Artificial Sequence
  Description of Artificial Sequence: Synthetic oligonucleotide
ttatgtagaaattgagggtgcgcgacagactaaaactttag

SEQ ID NO: 298609 - DNA, 40 bp, Artificial Sequence
  Description of Artificial Sequence: Synthetic oligonucleotide
tatgtagaaattgagggtgcgcgacagactaaaactttag

SEQ ID NO: 298610 - DNA, 39 bp, Artificial Sequence
  Description of Artificial Sequence: Synthetic oligonucleotide
atgtagaaattgagggtgcgcgacagactaaaactttag

SEQ ID NO: 298611 - DNA, 38 bp, Artificial Sequence
  Description of Artificial Sequence: Synthetic oligonucleotide
tgtagaaattgagggtgcgcgacagactaaaactttag

SEQ ID NO: 298612 - DNA, 37 bp, Artificial Sequence
  Description of Artificial Sequence: Synthetic oligonucleotide
gtagaaattgagggtgcgcgacagactaaaactttag

SEQ ID NO: 298613 - DNA, 37 bp, Artificial Sequence
  Description of Artificial Sequence: Synthetic oligonucleotide
tagaaattgagggtgcgcgacagactaaaactttagc

SEQ ID NO: 298614 - DNA, 36 bp, Artificial Sequence
  Description of Artificial Sequence: Synthetic oligonucleotide
agaaattgagggtgcgcgacagactaaaactttagc

SEQ ID NO: 298615 - DNA, 35 bp, Artificial Sequence
  Description of Artificial Sequence: Synthetic oligonucleotide
gaaattgagggtgcgcgacagactaaaactttagc

SEQ ID NO: 298616 - DNA, 37 bp, Artificial Sequence
  Description of Artificial Sequence: Synthetic oligonucleotide
aaattgagggtgcgcgacagactaaaactttagcaac

SEQ ID NO: 298617 - DNA, 36 bp, Artificial Sequence
  Description of Artificial Sequence: Synthetic oligonucleotide
aattgagggtgcgcgacagactaaaactttagcaac

SEQ ID NO: 298618 - DNA, 35 bp, Artificial Sequence
  Description of Artificial Sequence: Synthetic oligonucleotide
attgagggtgcgcgacagactaaaactttagcaac

SEQ ID NO: 298619 - DNA, 34 bp, Artificial Sequence
  Description of Artificial Sequence: Synthetic oligonucleotide
ttgagggtgcgcgacagactaaaactttagcaac

SEQ ID NO: 298620 - DNA, 33 bp, Artificial Sequence
  Description of Artificial Sequence: Synthetic oligonucleotide
tgagggtgcgcgacagactaaaactttagcaac

SEQ ID NO: 298621 - DNA, 32 bp, Artificial Sequence
  Description of Artificial Sequence: Synthetic oligonucleotide
gagggtgcgcgacagactaaaactttagcaac

SEQ ID NO: 298622 - DNA, 39 bp, Artificial Sequence
  Description of Artificial Sequence: Synthetic oligonucleotide
agggtgcgcgacagactaaaactttagcaactttaaaag

SEQ ID NO: 298623 - DNA, 38 bp, Artificial Sequence
  Description of Artificial Sequence: Synthetic oligonucleotide
gggtgcgcgacagactaaaactttagcaactttaaaag

SEQ ID NO: 298624 - DNA, 40 bp, Artificial Sequence
  Description of Artificial Sequence: Synthetic oligonucleotide
ggtgcgcgacagactaaaactttagcaactttaaaagaac

SEQ ID NO: 298625 - DNA, 45 bp, Artificial Sequence
  Description of Artificial Sequence: Synthetic oligonucleotide
gtgcgcgacagactaaaactttagcaactttaaaagaactaaatg

SEQ ID NO: 298626 - DNA, 45 bp, Artificial Sequence
  Description of Artificial Sequence: Synthetic oligonucleotide
tgcgcgacagactaaaactttagcaactttaaaagaactaaatgg

SEQ ID NO: 298627 - DNA, 44 bp, Artificial Sequence
  Description of Artificial Sequence: Synthetic oligonucleotide
gcgcgacagactaaaactttagcaactttaaaagaactaaatgg

SEQ ID NO: 298628 - DNA, 45 bp, Artificial Sequence
  Description of Artificial Sequence: Synthetic oligonucleotide
cgcgacagactaaaactttagcaactttaaaagaactaaatggtg

SEQ ID NO: 298629 - DNA, 47 bp, Artificial Sequence
  Description of Artificial Sequence: Synthetic oligonucleotide
gcgacagactaaaactttagcaactttaaaagaactaaatggtgaag

SEQ ID NO: 298630 - DNA, 48 bp, Artificial Sequence
  Description of Artificial Sequence: Synthetic oligonucleotide
cgacagactaaaactttagcaactttaaaagaactaaatggtgaagtg

SEQ ID NO: 298631 - DNA, 51 bp, Artificial Sequence
  Description of Artificial Sequence: Synthetic oligonucleotide
gacagactaaaactttagcaactttaaaagaactaaatggtgaagtgaaag

SEQ ID NO: 298632 - DNA, 52 bp, Artificial Sequence
  Description of Artificial Sequence: Synthetic oligonucleotide
acagactaaaactttagcaactttaaaagaactaaatggtgaagtgaaagag

SEQ ID NO: 298633 - DNA, 51 bp, Artificial Sequence
  Description of Artificial Sequence: Synthetic oligonucleotide
cagactaaaactttagcaactttaaaagaactaaatggtgaagtgaaagag

SEQ ID NO: 298634 - DNA, 51 bp, Artificial Sequence
  Description of Artificial Sequence: Synthetic oligonucleotide
agactaaaactttagcaactttaaaagaactaaatggtgaagtgaaagagc

SEQ ID NO: 298635 - DNA, 50 bp, Artificial Sequence
  Description of Artificial Sequence: Synthetic oligonucleotide
gactaaaactttagcaactttaaaagaactaaatggtgaagtgaaagagc

SEQ ID NO: 298636 - DNA, 50 bp, Artificial Sequence
  Description of Artificial Sequence: Synthetic oligonucleotide
actaaaactttagcaactttaaaagaactaaatggtgaagtgaaagagcc

SEQ ID NO: 298637 - DNA, 49 bp, Artificial Sequence
  Description of Artificial Sequence: Synthetic oligonucleotide
ctaaaactttagcaactttaaaagaactaaatggtgaagtgaaagagcc

SEQ ID NO: 298638 - DNA, 50 bp, Artificial Sequence
  Description of Artificial Sequence: Synthetic oligonucleotide
taaaactttagcaactttaaaagaactaaatggtgaagtgaaagagccag

SEQ ID NO: 298639 - DNA, 49 bp, Artificial Sequence
  Description of Artificial Sequence: Synthetic oligonucleotide
aaaactttagcaactttaaaagaactaaatggtgaagtgaaagagccag

SEQ ID NO: 298640 - DNA, 48 bp, Artificial Sequence
  Description of Artificial Sequence: Synthetic oligonucleotide
aaactttagcaactttaaaagaactaaatggtgaagtgaaagagccag

SEQ ID NO: 298641 - DNA, 47 bp, Artificial Sequence
  Description of Artificial Sequence: Synthetic oligonucleotide
aactttagcaactttaaaagaactaaatggtgaagtgaaagagccag

SEQ ID NO: 298642 - DNA, 46 bp, Artificial Sequence
  Description of Artificial Sequence: Synthetic oligonucleotide
actttagcaactttaaaagaactaaatggtgaagtgaaagagccag

SEQ ID NO: 298643 - DNA, 45 bp, Artificial Sequence
  Description of Artificial Sequence: Synthetic oligonucleotide
ctttagcaactttaaaagaactaaatggtgaagtgaaagagccag

SEQ ID NO: 298644 - DNA, 45 bp, Artificial Sequence
  Description of Artificial Sequence: Synthetic oligonucleotide
tttagcaactttaaaagaactaaatggtgaagtgaaagagccagc

SEQ ID NO: 298645 - DNA, 44 bp, Artificial Sequence
  Description of Artificial Sequence: Synthetic oligonucleotide
ttagcaactttaaaagaactaaatggtgaagtgaaagagccagc

SEQ ID NO: 298646 - DNA, 43 bp, Artificial Sequence
  Description of Artificial Sequence: Synthetic oligonucleotide
tagcaactttaaaagaactaaatggtgaagtgaaagagccagc

SEQ ID NO: 298647 - DNA, 42 bp, Artificial Sequence
  Description of Artificial Sequence: Synthetic oligonucleotide
agcaactttaaaagaactaaatggtgaagtgaaagagccagc

SEQ ID NO: 298648 - DNA, 41 bp, Artificial Sequence
  Description of Artificial Sequence: Synthetic oligonucleotide
gcaactttaaaagaactaaatggtgaagtgaaagagccagc

SEQ ID NO: 298649 - DNA, 41 bp, Artificial Sequence
  Description of Artificial Sequence: Synthetic oligonucleotide
caactttaaaagaactaaatggtgaagtgaaagagccagcc

SEQ ID NO: 298650 - DNA, 42 bp, Artificial Sequence
  Description of Artificial Sequence: Synthetic oligonucleotide
aactttaaaagaactaaatggtgaagtgaaagagccagcctc

SEQ ID NO: 298651 - DNA, 41 bp, Artificial Sequence
  Description of Artificial Sequence: Synthetic oligonucleotide
actttaaaagaactaaatggtgaagtgaaagagccagcctc

SEQ ID NO: 298652 - DNA, 40 bp, Artificial Sequence
  Description of Artificial Sequence: Synthetic oligonucleotide
ctttaaaagaactaaatggtgaagtgaaagagccagcctc

SEQ ID NO: 298653 - DNA, 40 bp, Artificial Sequence
  Description of Artificial Sequence: Synthetic oligonucleotide
tttaaaagaactaaatggtgaagtgaaagagccagcctcc

SEQ ID NO: 298654 - DNA, 39 bp, Artificial Sequence
  Description of Artificial Sequence: Synthetic oligonucleotide
ttaaaagaactaaatggtgaagtgaaagagccagcctcc

SEQ ID NO: 298655 - DNA, 38 bp, Artificial Sequence
  Description of Artificial Sequence: Synthetic oligonucleotide
taaaagaactaaatggtgaagtgaaagagccagcctcc

SEQ ID NO: 298656 - DNA, 37 bp, Artificial Sequence
  Description of Artificial Sequence: Synthetic oligonucleotide
aaaagaactaaatggtgaagtgaaagagccagcctcc

SEQ ID NO: 298657 - DNA, 36 bp, Artificial Sequence
  Description of Artificial Sequence: Synthetic oligonucleotide
aaagaactaaatggtgaagtgaaagagccagcctcc

SEQ ID NO: 298658 - DNA, 35 bp, Artificial Sequence
  Description of Artificial Sequence: Synthetic oligonucleotide
aagaactaaatggtgaagtgaaagagccagcctcc

SEQ ID NO: 298659 - DNA, 34 bp, Artificial Sequence
  Description of Artificial Sequence: Synthetic oligonucleotide
agaactaaatggtgaagtgaaagagccagcctcc

SEQ ID NO: 298660 - DNA, 33 bp, Artificial Sequence
  Description of Artificial Sequence: Synthetic oligonucleotide
gaactaaatggtgaagtgaaagagccagcctcc

SEQ ID NO: 298661 - DNA, 39 bp, Artificial Sequence
  Description of Artificial Sequence: Synthetic oligonucleotide
aactaaatggtgaagtgaaagagccagcctccaatttac

SEQ ID NO: 298662 - DNA, 38 bp, Artificial Sequence
  Description of Artificial Sequence: Synthetic oligonucleotide
actaaatggtgaagtgaaagagccagcctccaatttac

SEQ ID NO: 298663 - DNA, 37 bp, Artificial Sequence
  Description of Artificial Sequence: Synthetic oligonucleotide
ctaaatggtgaagtgaaagagccagcctccaatttac

SEQ ID NO: 298664 - DNA, 38 bp, Artificial Sequence
  Description of Artificial Sequence: Synthetic oligonucleotide
taaatggtgaagtgaaagagccagcctccaatttacag

SEQ ID NO: 298665 - DNA, 37 bp, Artificial Sequence
  Description of Artificial Sequence: Synthetic oligonucleotide
aaatggtgaagtgaaagagccagcctccaatttacag

SEQ ID NO: 298666 - DNA, 36 bp, Artificial Sequence
  Description of Artificial Sequence: Synthetic oligonucleotide
aatggtgaagtgaaagagccagcctccaatttacag

SEQ ID NO: 298667 - DNA, 35 bp, Artificial Sequence
  Description of Artificial Sequence: Synthetic oligonucleotide
atggtgaagtgaaagagccagcctccaatttacag

SEQ ID NO: 298668 - DNA, 34 bp, Artificial Sequence
  Description of Artificial Sequence: Synthetic oligonucleotide
tggtgaagtgaaagagccagcctccaatttacag

SEQ ID NO: 298669 - DNA, 33 bp, Artificial Sequence
  Description of Artificial Sequence: Synthetic oligonucleotide
ggtgaagtgaaagagccagcctccaatttacag

SEQ ID NO: 298670 - DNA, 33 bp, Artificial Sequence
  Description of Artificial Sequence: Synthetic oligonucleotide
gtgaagtgaaagagccagcctccaatttacagg

SEQ ID NO: 298671 - DNA, 34 bp, Artificial Sequence
  Description of Artificial Sequence: Synthetic oligonucleotide
tgaagtgaaagagccagcctccaatttacaggac

SEQ ID NO: 298672 - DNA, 33 bp, Artificial Sequence
  Description of Artificial Sequence: Synthetic oligonucleotide
gaagtgaaagagccagcctccaatttacaggac

SEQ ID NO: 298673 - DNA, 36 bp, Artificial Sequence
  Description of Artificial Sequence: Synthetic oligonucleotide
aagtgaaagagccagcctccaatttacaggacttac

SEQ ID NO: 298674 - DNA, 35 bp, Artificial Sequence
  Description of Artificial Sequence: Synthetic oligonucleotide
agtgaaagagccagcctccaatttacaggacttac

SEQ ID NO: 298675 - DNA, 34 bp, Artificial Sequence
  Description of Artificial Sequence: Synthetic oligonucleotide
gtgaaagagccagcctccaatttacaggacttac

SEQ ID NO: 298676 - DNA, 35 bp, Artificial Sequence
  Description of Artificial Sequence: Synthetic oligonucleotide
tgaaagagccagcctccaatttacaggacttacag

SEQ ID NO: 298677 - DNA, 34 bp, Artificial Sequence
  Description of Artificial Sequence: Synthetic oligonucleotide
gaaagagccagcctccaatttacaggacttacag

SEQ ID NO: 298678 - DNA, 34 bp, Artificial Sequence
  Description of Artificial Sequence: Synthetic oligonucleotide
aaagagccagcctccaatttacaggacttacagg

SEQ ID NO: 298679 - DNA, 33 bp, Artificial Sequence
  Description of Artificial Sequence: Synthetic oligonucleotide
aagagccagcctccaatttacaggacttacagg

SEQ ID NO: 298680 - DNA, 32 bp, Artificial Sequence
  Description of Artificial Sequence: Synthetic oligonucleotide
agagccagcctccaatttacaggacttacagg

SEQ ID NO: 298681 - DNA, 31 bp, Artificial Sequence
  Description of Artificial Sequence: Synthetic oligonucleotide
gagccagcctccaatttacaggacttacagg

SEQ ID NO: 298682 - DNA, 32 bp, Artificial Sequence
  Description of Artificial Sequence: Synthetic oligonucleotide
agccagcctccaatttacaggacttacaggtg

SEQ ID NO: 298683 - DNA, 31 bp, Artificial Sequence
  Description of Artificial Sequence: Synthetic oligonucleotide
gccagcctccaatttacaggacttacaggtg

SEQ ID NO: 298684 - DNA, 31 bp, Artificial Sequence
  Description of Artificial Sequence: Synthetic oligonucleotide
ccagcctccaatttacaggacttacaggtgc

SEQ ID NO: 298685 - DNA, 34 bp, Artificial Sequence
  Description of Artificial Sequence: Synthetic oligonucleotide
cagcctccaatttacaggacttacaggtgcaaac

SEQ ID NO: 298686 - DNA, 34 bp, Artificial Sequence
  Description of Artificial Sequence: Synthetic oligonucleotide
agcctccaatttacaggacttacaggtgcaaacc

SEQ ID NO: 298687 - DNA, 33 bp, Artificial Sequence
  Description of Artificial Sequence: Synthetic oligonucleotide
gcctccaatttacaggacttacaggtgcaaacc

SEQ ID NO: 298688 - DNA, 35 bp, Artificial Sequence
  Description of Artificial Sequence: Synthetic oligonucleotide
cctccaatttacaggacttacaggtgcaaacctac

SEQ ID NO: 298689 - DNA, 35 bp, Artificial Sequence
  Description of Artificial Sequence: Synthetic oligonucleotide
ctccaatttacaggacttacaggtgcaaacctacg

SEQ ID NO: 298690 - DNA, 35 bp, Artificial Sequence
  Description of Artificial Sequence: Synthetic oligonucleotide
tccaatttacaggacttacaggtgcaaacctacgc

SEQ ID NO: 298691 - DNA, 34 bp, Artificial Sequence
  Description of Artificial Sequence: Synthetic oligonucleotide
ccaatttacaggacttacaggtgcaaacctacgc

SEQ ID NO: 298692 - DNA, 34 bp, Artificial Sequence
  Description of Artificial Sequence: Synthetic oligonucleotide
caatttacaggacttacaggtgcaaacctacgcg

SEQ ID NO: 298693 - DNA, 35 bp, Artificial Sequence
  Description of Artificial Sequence: Synthetic oligonucleotide
aatttacaggacttacaggtgcaaacctacgcgtc

SEQ ID NO: 298694 - DNA, 34 bp, Artificial Sequence
  Description of Artificial Sequence: Synthetic oligonucleotide
atttacaggacttacaggtgcaaacctacgcgtc

SEQ ID NO: 298695 - DNA, 33 bp, Artificial Sequence
  Description of Artificial Sequence: Synthetic oligonucleotide
tttacaggacttacaggtgcaaacctacgcgtc

SEQ ID NO: 298696 - DNA, 32 bp, Artificial Sequence
  Description of Artificial Sequence: Synthetic oligonucleotide
ttacaggacttacaggtgcaaacctacgcgtc

SEQ ID NO: 298697 - DNA, 31 bp, Artificial Sequence
  Description of Artificial Sequence: Synthetic oligonucleotide
tacaggacttacaggtgcaaacctacgcgtc

SEQ ID NO: 298698 - DNA, 30 bp, Artificial Sequence
  Description of Artificial Sequence: Synthetic oligonucleotide
acaggacttacaggtgcaaacctacgcgtc

SEQ ID NO: 298699 - DNA, 29 bp, Artificial Sequence
  Description of Artificial Sequence: Synthetic oligonucleotide
caggacttacaggtgcaaacctacgcgtc

SEQ ID NO: 298700 - DNA, 32 bp, Artificial Sequence
  Description of Artificial Sequence: Synthetic oligonucleotide
aggacttacaggtgcaaacctacgcgtcaatg

SEQ ID NO: 298701 - DNA, 31 bp, Artificial Sequence
  Description of Artificial Sequence: Synthetic oligonucleotide
ggacttacaggtgcaaacctacgcgtcaatg

SEQ ID NO: 298702 - DNA, 31 bp, Artificial Sequence
  Description of Artificial Sequence: Synthetic oligonucleotide
gacttacaggtgcaaacctacgcgtcaatgg

SEQ ID NO: 298703 - DNA, 35 bp, Artificial Sequence
  Description of Artificial Sequence: Synthetic oligonucleotide
acttacaggtgcaaacctacgcgtcaatggataag

SEQ ID NO: 298704 - DNA, 34 bp, Artificial Sequence
  Description of Artificial Sequence: Synthetic oligonucleotide
cttacaggtgcaaacctacgcgtcaatggataag

SEQ ID NO: 298705 - DNA, 37 bp, Artificial Sequence
  Description of Artificial Sequence: Synthetic oligonucleotide
ttacaggtgcaaacctacgcgtcaatggataagaaag

SEQ ID NO: 298706 - DNA, 36 bp, Artificial Sequence
  Description of Artificial Sequence: Synthetic oligonucleotide
tacaggtgcaaacctacgcgtcaatggataagaaag

SEQ ID NO: 298707 - DNA, 35 bp, Artificial Sequence
  Description of Artificial Sequence: Synthetic oligonucleotide
acaggtgcaaacctacgcgtcaatggataagaaag

SEQ ID NO: 298708 - DNA, 34 bp, Artificial Sequence
  Description of Artificial Sequence: Synthetic oligonucleotide
caggtgcaaacctacgcgtcaatggataagaaag

SEQ ID NO: 298709 - DNA, 35 bp, Artificial Sequence
  Description of Artificial Sequence: Synthetic oligonucleotide
aggtgcaaacctacgcgtcaatggataagaaagag

SEQ ID NO: 298710 - DNA, 34 bp, Artificial Sequence
  Description of Artificial Sequence: Synthetic oligonucleotide
ggtgcaaacctacgcgtcaatggataagaaagag

SEQ ID NO: 298711 - DNA, 34 bp, Artificial Sequence
  Description of Artificial Sequence: Synthetic oligonucleotide
gtgcaaacctacgcgtcaatggataagaaagagg

SEQ ID NO: 298712 - DNA, 34 bp, Artificial Sequence
  Description of Artificial Sequence: Synthetic oligonucleotide
tgcaaacctacgcgtcaatggataagaaagaggg

SEQ ID NO: 298713 - DNA, 33 bp, Artificial Sequence
  Description of Artificial Sequence: Synthetic oligonucleotide
gcaaacctacgcgtcaatggataagaaagaggg

SEQ ID NO: 298714 - DNA, 34 bp, Artificial Sequence
  Description of Artificial Sequence: Synthetic oligonucleotide
caaacctacgcgtcaatggataagaaagagggag

SEQ ID NO: 298715 - DNA, 35 bp, Artificial Sequence
  Description of Artificial Sequence: Synthetic oligonucleotide
aaacctacgcgtcaatggataagaaagagggagtg

SEQ ID NO: 298716 - DNA, 34 bp, Artificial Sequence
  Description of Artificial Sequence: Synthetic oligonucleotide
aacctacgcgtcaatggataagaaagagggagtg

SEQ ID NO: 298717 - DNA, 33 bp, Artificial Sequence
  Description of Artificial Sequence: Synthetic oligonucleotide
acctacgcgtcaatggataagaaagagggagtg

SEQ ID NO: 298718 - DNA, 32 bp, Artificial Sequence
  Description of Artificial Sequence: Synthetic oligonucleotide
cctacgcgtcaatggataagaaagagggagtg

SEQ ID NO: 298719 - DNA, 32 bp, Artificial Sequence
  Description of Artificial Sequence: Synthetic oligonucleotide
ctacgcgtcaatggataagaaagagggagtgg

SEQ ID NO: 298720 - DNA, 42 bp, Artificial Sequence
  Description of Artificial Sequence: Synthetic oligonucleotide
tacgcgtcaatggataagaaagagggagtggaatatattttg

SEQ ID NO: 298721 - DNA, 41 bp, Artificial Sequence
  Description of Artificial Sequence: Synthetic oligonucleotide
acgcgtcaatggataagaaagagggagtggaatatattttg

SEQ ID NO: 298722 - DNA, 40 bp, Artificial Sequence
  Description of Artificial Sequence: Synthetic oligonucleotide
cgcgtcaatggataagaaagagggagtggaatatattttg

SEQ ID NO: 298723 - DNA, 40 bp, Artificial Sequence
  Description of Artificial Sequence: Synthetic oligonucleotide
gcgtcaatggataagaaagagggagtggaatatattttgg

SEQ ID NO: 298724 - DNA, 41 bp, Artificial Sequence
  Description of Artificial Sequence: Synthetic oligonucleotide
cgtcaatggataagaaagagggagtggaatatattttggac

SEQ ID NO: 298725 - DNA, 41 bp, Artificial Sequence
  Description of Artificial Sequence: Synthetic oligonucleotide
gtcaatggataagaaagagggagtggaatatattttggacc

SEQ ID NO: 298726 - DNA, 45 bp, Artificial Sequence
  Description of Artificial Sequence: Synthetic oligonucleotide
tcaatggataagaaagagggagtggaatatattttggaccaaatg

SEQ ID NO: 298727 - DNA, 44 bp, Artificial Sequence
  Description of Artificial Sequence: Synthetic oligonucleotide
caatggataagaaagagggagtggaatatattttggaccaaatg

SEQ ID NO: 298728 - DNA, 45 bp, Artificial Sequence
  Description of Artificial Sequence: Synthetic oligonucleotide
aatggataagaaagagggagtggaatatattttggaccaaatgag

SEQ ID NO: 298729 - DNA, 44 bp, Artificial Sequence
  Description of Artificial Sequence: Synthetic oligonucleotide
atggataagaaagagggagtggaatatattttggaccaaatgag

SEQ ID NO: 298730 - DNA, 43 bp, Artificial Sequence
  Description of Artificial Sequence: Synthetic oligonucleotide
tggataagaaagagggagtggaatatattttggaccaaatgag

SEQ ID NO: 298731 - DNA, 42 bp, Artificial Sequence
  Description of Artificial Sequence: Synthetic oligonucleotide
ggataagaaagagggagtggaatatattttggaccaaatgag

SEQ ID NO: 298732 - DNA, 42 bp, Artificial Sequence
  Description of Artificial Sequence: Synthetic oligonucleotide
gataagaaagagggagtggaatatattttggaccaaatgagg

SEQ ID NO: 298733 - DNA, 42 bp, Artificial Sequence
  Description of Artificial Sequence: Synthetic oligonucleotide
ataagaaagagggagtggaatatattttggaccaaatgaggg

SEQ ID NO: 298734 - DNA, 41 bp, Artificial Sequence
  Description of Artificial Sequence: Synthetic oligonucleotide
taagaaagagggagtggaatatattttggaccaaatgaggg

SEQ ID NO: 298735 - DNA, 40 bp, Artificial Sequence
  Description of Artificial Sequence: Synthetic oligonucleotide
aagaaagagggagtggaatatattttggaccaaatgaggg

SEQ ID NO: 298736 - DNA, 39 bp, Artificial Sequence
  Description of Artificial Sequence: Synthetic oligonucleotide
agaaagagggagtggaatatattttggaccaaatgaggg

SEQ ID NO: 298737 - DNA, 38 bp, Artificial Sequence
  Description of Artificial Sequence: Synthetic oligonucleotide
gaaagagggagtggaatatattttggaccaaatgaggg

SEQ ID NO: 298738 - DNA, 39 bp, Artificial Sequence
  Description of Artificial Sequence: Synthetic oligonucleotide
aaagagggagtggaatatattttggaccaaatgagggtc

SEQ ID NO: 298739 - DNA, 38 bp, Artificial Sequence
  Description of Artificial Sequence: Synthetic oligonucleotide
aagagggagtggaatatattttggaccaaatgagggtc

SEQ ID NO: 298740 - DNA, 37 bp, Artificial Sequence
  Description of Artificial Sequence: Synthetic oligonucleotide
agagggagtggaatatattttggaccaaatgagggtc

SEQ ID NO: 298741 - DNA, 36 bp, Artificial Sequence
  Description of Artificial Sequence: Synthetic oligonucleotide
gagggagtggaatatattttggaccaaatgagggtc

SEQ ID NO: 298742 - DNA, 37 bp, Artificial Sequence
  Description of Artificial Sequence: Synthetic oligonucleotide
agggagtggaatatattttggaccaaatgagggtctg

SEQ ID NO: 298743 - DNA, 36 bp, Artificial Sequence
  Description of Artificial Sequence: Synthetic oligonucleotide
gggagtggaatatattttggaccaaatgagggtctg

SEQ ID NO: 298744 - DNA, 36 bp, Artificial Sequence
  Description of Artificial Sequence: Synthetic oligonucleotide
ggagtggaatatattttggaccaaatgagggtctgc

SEQ ID NO: 298745 - DNA, 36 bp, Artificial Sequence
  Description of Artificial Sequence: Synthetic oligonucleotide
gagtggaatatattttggaccaaatgagggtctgcc

SEQ ID NO: 298746 - DNA, 38 bp, Artificial Sequence
  Description of Artificial Sequence: Synthetic oligonucleotide
agtggaatatattttggaccaaatgagggtctgcctag

SEQ ID NO: 298747 - DNA, 37 bp, Artificial Sequence
  Description of Artificial Sequence: Synthetic oligonucleotide
gtggaatatattttggaccaaatgagggtctgcctag

SEQ ID NO: 298748 - DNA, 37 bp, Artificial Sequence
  Description of Artificial Sequence: Synthetic oligonucleotide
tggaatatattttggaccaaatgagggtctgcctagg

SEQ ID NO: 298749 - DNA, 36 bp, Artificial Sequence
  Description of Artificial Sequence: Synthetic oligonucleotide
ggaatatattttggaccaaatgagggtctgcctagg

SEQ ID NO: 298750 - DNA, 37 bp, Artificial Sequence
  Description of Artificial Sequence: Synthetic oligonucleotide
gaatatattttggaccaaatgagggtctgcctaggtg

SEQ ID NO: 298751 - DNA, 38 bp, Artificial Sequence
  Description of Artificial Sequence: Synthetic oligonucleotide
aatatattttggaccaaatgagggtctgcctaggtgtg

SEQ ID NO: 298752 - DNA, 37 bp, Artificial Sequence
  Description of Artificial Sequence: Synthetic oligonucleotide
atatattttggaccaaatgagggtctgcctaggtgtg

SEQ ID NO: 298753 - DNA, 36 bp, Artificial Sequence
  Description of Artificial Sequence: Synthetic oligonucleotide
tatattttggaccaaatgagggtctgcctaggtgtg

SEQ ID NO: 298754 - DNA, 35 bp, Artificial Sequence
  Description of Artificial Sequence: Synthetic oligonucleotide
atattttggaccaaatgagggtctgcctaggtgtg

SEQ ID NO: 298755 - DNA, 34 bp, Artificial Sequence
  Description of Artificial Sequence: Synthetic oligonucleotide
tattttggaccaaatgagggtctgcctaggtgtg

SEQ ID NO: 298756 - DNA, 33 bp, Artificial Sequence
  Description of Artificial Sequence: Synthetic oligonucleotide
attttggaccaaatgagggtctgcctaggtgtg

SEQ ID NO: 298757 - DNA, 32 bp, Artificial Sequence
  Description of Artificial Sequence: Synthetic oligonucleotide
ttttggaccaaatgagggtctgcctaggtgtg

SEQ ID NO: 298758 - DNA, 31 bp, Artificial Sequence
  Description of Artificial Sequence: Synthetic oligonucleotide
tttggaccaaatgagggtctgcctaggtgtg

SEQ ID NO: 298759 - DNA, 30 bp, Artificial Sequence
  Description of Artificial Sequence: Synthetic oligonucleotide
ttggaccaaatgagggtctgcctaggtgtg

SEQ ID NO: 298760 - DNA, 29 bp, Artificial Sequence
  Description of Artificial Sequence: Synthetic oligonucleotide
tggaccaaatgagggtctgcctaggtgtg

SEQ ID NO: 298761 - DNA, 28 bp, Artificial Sequence
  Description of Artificial Sequence: Synthetic oligonucleotide
ggaccaaatgagggtctgcctaggtgtg

SEQ ID NO: 298762 - DNA, 30 bp, Artificial Sequence
  Description of Artificial Sequence: Synthetic oligonucleotide
gaccaaatgagggtctgcctaggtgtgaag

SEQ ID NO: 298763 - DNA, 30 bp, Artificial Sequence
  Description of Artificial Sequence: Synthetic oligonucleotide
accaaatgagggtctgcctaggtgtgaagg

SEQ ID NO: 298764 - DNA, 29 bp, Artificial Sequence
  Description of Artificial Sequence: Synthetic oligonucleotide
ccaaatgagggtctgcctaggtgtgaagg

SEQ ID NO: 298765 - DNA, 33 bp, Artificial Sequence
  Description of Artificial Sequence: Synthetic oligonucleotide
caaatgagggtctgcctaggtgtgaaggaatac

SEQ ID NO: 298766 - DNA, 36 bp, Artificial Sequence
  Description of Artificial Sequence: Synthetic oligonucleotide
aaatgagggtctgcctaggtgtgaaggaatacattc

SEQ ID NO: 298767 - DNA, 35 bp, Artificial Sequence
  Description of Artificial Sequence: Synthetic oligonucleotide
aatgagggtctgcctaggtgtgaaggaatacattc

SEQ ID NO: 298768 - DNA, 34 bp, Artificial Sequence
  Description of Artificial Sequence: Synthetic oligonucleotide
atgagggtctgcctaggtgtgaaggaatacattc

SEQ ID NO: 298769 - DNA, 33 bp, Artificial Sequence
  Description of Artificial Sequence: Synthetic oligonucleotide
tgagggtctgcctaggtgtgaaggaatacattc

SEQ ID NO: 298770 - DNA, 32 bp, Artificial Sequence
  Description of Artificial Sequence: Synthetic oligonucleotide
gagggtctgcctaggtgtgaaggaatacattc

SEQ ID NO: 298771 - DNA, 32 bp, Artificial Sequence
  Description of Artificial Sequence: Synthetic oligonucleotide
agggtctgcctaggtgtgaaggaatacattcg

SEQ ID NO: 298772 - DNA, 31 bp, Artificial Sequence
  Description of Artificial Sequence: Synthetic oligonucleotide
gggtctgcctaggtgtgaaggaatacattcg

SEQ ID NO: 298773 - DNA, 33 bp, Artificial Sequence
  Description of Artificial Sequence: Synthetic oligonucleotide
ggtctgcctaggtgtgaaggaatacattcgatc

SEQ ID NO: 298774 - DNA, 34 bp, Artificial Sequence
  Description of Artificial Sequence: Synthetic oligonucleotide
gtctgcctaggtgtgaaggaatacattcgatcac

SEQ ID NO: 298775 - DNA, 38 bp, Artificial Sequence
  Description of Artificial Sequence: Synthetic oligonucleotide
tctgcctaggtgtgaaggaatacattcgatcacaaatc

SEQ ID NO: 298776 - DNA, 37 bp, Artificial Sequence
  Description of Artificial Sequence: Synthetic oligonucleotide
ctgcctaggtgtgaaggaatacattcgatcacaaatc

SEQ ID NO: 298777 - DNA, 39 bp, Artificial Sequence
  Description of Artificial Sequence: Synthetic oligonucleotide
tgcctaggtgtgaaggaatacattcgatcacaaatcaac

SEQ ID NO: 298778 - DNA, 38 bp, Artificial Sequence
  Description of Artificial Sequence: Synthetic oligonucleotide
gcctaggtgtgaaggaatacattcgatcacaaatcaac

SEQ ID NO: 298779 - DNA, 39 bp, Artificial Sequence
  Description of Artificial Sequence: Synthetic oligonucleotide
cctaggtgtgaaggaatacattcgatcacaaatcaacag

SEQ ID NO: 298780 - DNA, 39 bp, Artificial Sequence
  Description of Artificial Sequence: Synthetic oligonucleotide
ctaggtgtgaaggaatacattcgatcacaaatcaacagc

SEQ ID NO: 298781 - DNA, 41 bp, Artificial Sequence
  Description of Artificial Sequence: Synthetic oligonucleotide
taggtgtgaaggaatacattcgatcacaaatcaacagcaag

SEQ ID NO: 298782 - DNA, 40 bp, Artificial Sequence
  Description of Artificial Sequence: Synthetic oligonucleotide
aggtgtgaaggaatacattcgatcacaaatcaacagcaag

SEQ ID NO: 298783 - DNA, 39 bp, Artificial Sequence
  Description of Artificial Sequence: Synthetic oligonucleotide
ggtgtgaaggaatacattcgatcacaaatcaacagcaag

SEQ ID NO: 298784 - DNA, 47 bp, Artificial Sequence
  Description of Artificial Sequence: Synthetic oligonucleotide
gtgtgaaggaatacattcgatcacaaatcaacagcaagaatattaac

SEQ ID NO: 298785 - DNA, 48 bp, Artificial Sequence
  Description of Artificial Sequence: Synthetic oligonucleotide
tgtgaaggaatacattcgatcacaaatcaacagcaagaatattaacac

SEQ ID NO: 298786 - DNA, 47 bp, Artificial Sequence
  Description of Artificial Sequence: Synthetic oligonucleotide
gtgaaggaatacattcgatcacaaatcaacagcaagaatattaacac

SEQ ID NO: 298787 - DNA, 47 bp, Artificial Sequence
  Description of Artificial Sequence: Synthetic oligonucleotide
tgaaggaatacattcgatcacaaatcaacagcaagaatattaacacc

SEQ ID NO: 298788 - DNA, 46 bp, Artificial Sequence
  Description of Artificial Sequence: Synthetic oligonucleotide
gaaggaatacattcgatcacaaatcaacagcaagaatattaacacc

SEQ ID NO: 298789 - DNA, 54 bp, Artificial Sequence
  Description of Artificial Sequence: Synthetic oligonucleotide
aaggaatacattcgatcacaaatcaacagcaagaatattaacacctaatttttc

SEQ ID NO: 298790 - DNA, 53 bp, Artificial Sequence
  Description of Artificial Sequence: Synthetic oligonucleotide
aggaatacattcgatcacaaatcaacagcaagaatattaacacctaatttttc

SEQ ID NO: 298791 - DNA, 52 bp, Artificial Sequence
  Description of Artificial Sequence: Synthetic oligonucleotide
ggaatacattcgatcacaaatcaacagcaagaatattaacacctaatttttc

SEQ ID NO: 298792 - DNA, 52 bp, Artificial Sequence
  Description of Artificial Sequence: Synthetic oligonucleotide
gaatacattcgatcacaaatcaacagcaagaatattaacacctaatttttcc

SEQ ID NO: 298793 - DNA, 53 bp, Artificial Sequence
  Description of Artificial Sequence: Synthetic oligonucleotide
aatacattcgatcacaaatcaacagcaagaatattaacacctaatttttcctg

SEQ ID NO: 298794 - DNA, 52 bp, Artificial Sequence
  Description of Artificial Sequence: Synthetic oligonucleotide
atacattcgatcacaaatcaacagcaagaatattaacacctaatttttcctg

SEQ ID NO: 298795 - DNA, 51 bp, Artificial Sequence
  Description of Artificial Sequence: Synthetic oligonucleotide
tacattcgatcacaaatcaacagcaagaatattaacacctaatttttcctg

SEQ ID NO: 298796 - DNA, 50 bp, Artificial Sequence
  Description of Artificial Sequence: Synthetic oligonucleotide
acattcgatcacaaatcaacagcaagaatattaacacctaatttttcctg

SEQ ID NO: 298797 - DNA, 49 bp, Artificial Sequence
  Description of Artificial Sequence: Synthetic oligonucleotide
cattcgatcacaaatcaacagcaagaatattaacacctaatttttcctg

SEQ ID NO: 298798 - DNA, 49 bp, Artificial Sequence
  Description of Artificial Sequence: Synthetic oligonucleotide
attcgatcacaaatcaacagcaagaatattaacacctaatttttcctgg

SEQ ID NO: 298799 - DNA, 48 bp, Artificial Sequence
  Description of Artificial Sequence: Synthetic oligonucleotide
ttcgatcacaaatcaacagcaagaatattaacacctaatttttcctgg

SEQ ID NO: 298800 - DNA, 47 bp, Artificial Sequence
  Description of Artificial Sequence: Synthetic oligonucleotide
tcgatcacaaatcaacagcaagaatattaacacctaatttttcctgg

SEQ ID NO: 298801 - DNA, 46 bp, Artificial Sequence
  Description of Artificial Sequence: Synthetic oligonucleotide
cgatcacaaatcaacagcaagaatattaacacctaatttttcctgg

SEQ ID NO: 298802 - DNA, 48 bp, Artificial Sequence
  Description of Artificial Sequence: Synthetic oligonucleotide
gatcacaaatcaacagcaagaatattaacacctaatttttcctggaag

SEQ ID NO: 298803 - DNA, 54 bp, Artificial Sequence
  Description of Artificial Sequence: Synthetic oligonucleotide
atcacaaatcaacagcaagaatattaacacctaatttttcctggaagaaaaaac

SEQ ID NO: 298804 - DNA, 53 bp, Artificial Sequence
  Description of Artificial Sequence: Synthetic oligonucleotide
tcacaaatcaacagcaagaatattaacacctaatttttcctggaagaaaaaac

SEQ ID NO: 298805 - DNA, 52 bp, Artificial Sequence
  Description of Artificial Sequence: Synthetic oligonucleotide
cacaaatcaacagcaagaatattaacacctaatttttcctggaagaaaaaac

SEQ ID NO: 298806 - DNA, 53 bp, Artificial Sequence
  Description of Artificial Sequence: Synthetic oligonucleotide
acaaatcaacagcaagaatattaacacctaatttttcctggaagaaaaaacag

SEQ ID NO: 298807 - DNA, 52 bp, Artificial Sequence
  Description of Artificial Sequence: Synthetic oligonucleotide
caaatcaacagcaagaatattaacacctaatttttcctggaagaaaaaacag

SEQ ID NO: 298808 - DNA, 53 bp, Artificial Sequence
  Description of Artificial Sequence: Synthetic oligonucleotide
aaatcaacagcaagaatattaacacctaatttttcctggaagaaaaaacagag

SEQ ID NO: 298809 - DNA, 52 bp, Artificial Sequence
  Description of Artificial Sequence: Synthetic oligonucleotide
aatcaacagcaagaatattaacacctaatttttcctggaagaaaaaacagag

SEQ ID NO: 298810 - DNA, 51 bp, Artificial Sequence
  Description of Artificial Sequence: Synthetic oligonucleotide
atcaacagcaagaatattaacacctaatttttcctggaagaaaaaacagag

SEQ ID NO: 298811 - DNA, 50 bp, Artificial Sequence
  Description of Artificial Sequence: Synthetic oligonucleotide
tcaacagcaagaatattaacacctaatttttcctggaagaaaaaacagag

SEQ ID NO: 298812 - DNA, 49 bp, Artificial Sequence
  Description of Artificial Sequence: Synthetic oligonucleotide
caacagcaagaatattaacacctaatttttcctggaagaaaaaacagag

SEQ ID NO: 298813 - DNA, 57 bp, Artificial Sequence
  Description of Artificial Sequence: Synthetic oligonucleotide
aacagcaagaatattaacacctaatttttcctggaagaaaaaacagagaaaataaag

SEQ ID NO: 298814 - DNA, 56 bp, Artificial Sequence
  Description of Artificial Sequence: Synthetic oligonucleotide
acagcaagaatattaacacctaatttttcctggaagaaaaaacagagaaaataaag

SEQ ID NO: 298815 - DNA, 55 bp, Artificial Sequence
  Description of Artificial Sequence: Synthetic oligonucleotide
cagcaagaatattaacacctaatttttcctggaagaaaaaacagagaaaataaag

SEQ ID NO: 298816 - DNA, 57 bp, Artificial Sequence
  Description of Artificial Sequence: Synthetic oligonucleotide
agcaagaatattaacacctaatttttcctggaagaaaaaacagagaaaataaagttg

SEQ ID NO: 298817 - DNA, 56 bp, Artificial Sequence
  Description of Artificial Sequence: Synthetic oligonucleotide
gcaagaatattaacacctaatttttcctggaagaaaaaacagagaaaataaagttg

SEQ ID NO: 298818 - DNA, 58 bp, Artificial Sequence
  Description of Artificial Sequence: Synthetic oligonucleotide
caagaatattaacacctaatttttcctggaagaaaaaacagagaaaataaagttgatg

SEQ ID NO: 298819 - DNA, 60 bp, Artificial Sequence
  Description of Artificial Sequence: Synthetic oligonucleotide
aagaatattaacacctaatttttcctggaagaaaaaacagagaaaataaagttgatgtac

SEQ ID NO: 298820 - DNA, 59 bp, Artificial Sequence
  Description of Artificial Sequence: Synthetic oligonucleotide
agaatattaacacctaatttttcctggaagaaaaaacagagaaaataaagttgatgtac

SEQ ID NO: 298821 - DNA, 58 bp, Artificial Sequence
  Description of Artificial Sequence: Synthetic oligonucleotide
gaatattaacacctaatttttcctggaagaaaaaacagagaaaataaagttgatgtac

SEQ ID NO: 298822 - DNA, 60 bp, Artificial Sequence
  Description of Artificial Sequence: Synthetic oligonucleotide
aatattaacacctaatttttcctggaagaaaaaacagagaaaataaagttgatgtactat

SEQ ID NO: 298823 - DNA, 60 bp, Artificial Sequence
  Description of Artificial Sequence: Synthetic oligonucleotide
atattaacacctaatttttcctggaagaaaaaacagagaaaataaagttgatgtactata

SEQ ID NO: 298824 - DNA, 60 bp, Artificial Sequence
  Description of Artificial Sequence: Synthetic oligonucleotide
tattaacacctaatttttcctggaagaaaaaacagagaaaataaagttgatgtactataa

SEQ ID NO: 298825 - DNA, 60 bp, Artificial Sequence
  Description of Artificial Sequence: Synthetic oligonucleotide
attaacacctaatttttcctggaagaaaaaacagagaaaataaagttgatgtactataaa

SEQ ID NO: 298826 - DNA, 60 bp, Artificial Sequence
  Description of Artificial Sequence: Synthetic oligonucleotide
ttaacacctaatttttcctggaagaaaaaacagagaaaataaagttgatgtactataaat

SEQ ID NO: 298827 - DNA, 60 bp, Artificial Sequence
  Description of Artificial Sequence: Synthetic oligonucleotide
taacacctaatttttcctggaagaaaaaacagagaaaataaagttgatgtactataaatt

SEQ ID NO: 298828 - DNA, 60 bp, Artificial Sequence
  Description of Artificial Sequence: Synthetic oligonucleotide
aacacctaatttttcctggaagaaaaaacagagaaaataaagttgatgtactataaatta

SEQ ID NO: 298829 - DNA, 60 bp, Artificial Sequence
  Description of Artificial Sequence: Synthetic oligonucleotide
acacctaatttttcctggaagaaaaaacagagaaaataaagttgatgtactataaattaa

SEQ ID NO: 298830 - DNA, 60 bp, Artificial Sequence
  Description of Artificial Sequence: Synthetic oligonucleotide
cacctaatttttcctggaagaaaaaacagagaaaataaagttgatgtactataaattaat

SEQ ID NO: 298831 - DNA, 60 bp, Artificial Sequence
  Description of Artificial Sequence: Synthetic oligonucleotide
acctaatttttcctggaagaaaaaacagagaaaataaagttgatgtactataaattaatg

SEQ ID NO: 298832 - DNA, 60 bp, Artificial Sequence
  Description of Artificial Sequence: Synthetic oligonucleotide
cctaatttttcctggaagaaaaaacagagaaaataaagttgatgtactataaattaatga

SEQ ID NO: 298833 - DNA, 60 bp, Artificial Sequence
  Description of Artificial Sequence: Synthetic oligonucleotide
ctaatttttcctggaagaaaaaacagagaaaataaagttgatgtactataaattaatgat

SEQ ID NO: 298834 - DNA, 60 bp, Artificial Sequence
  Description of Artificial Sequence: Synthetic oligonucleotide
taatttttcctggaagaaaaaacagagaaaataaagttgatgtactataaattaatgatt

SEQ ID NO: 298835 - DNA, 60 bp, Artificial Sequence
  Description of Artificial Sequence: Synthetic oligonucleotide
aatttttcctggaagaaaaaacagagaaaataaagttgatgtactataaattaatgattg

SEQ ID NO: 298836 - DNA, 60 bp, Artificial Sequence
  Description of Artificial Sequence: Synthetic oligonucleotide
atttttcctggaagaaaaaacagagaaaataaagttgatgtactataaattaatgattga

SEQ ID NO: 298837 - DNA, 60 bp, Artificial Sequence
  Description of Artificial Sequence: Synthetic oligonucleotide
tttttcctggaagaaaaaacagagaaaataaagttgatgtactataaattaatgattgag

SEQ ID NO: 298838 - DNA, 60 bp, Artificial Sequence
  Description of Artificial Sequence: Synthetic oligonucleotide
ttttcctggaagaaaaaacagagaaaataaagttgatgtactataaattaatgattgagc

SEQ ID NO: 298839 - DNA, 59 bp, Artificial Sequence
  Description of Artificial Sequence: Synthetic oligonucleotide
tttcctggaagaaaaaacagagaaaataaagttgatgtactataaattaatgattgagc

SEQ ID NO: 298840 - DNA, 58 bp, Artificial Sequence
  Description of Artificial Sequence: Synthetic oligonucleotide
ttcctggaagaaaaaacagagaaaataaagttgatgtactataaattaatgattgagc

SEQ ID NO: 298841 - DNA, 57 bp, Artificial Sequence
  Description of Artificial Sequence: Synthetic oligonucleotide
tcctggaagaaaaaacagagaaaataaagttgatgtactataaattaatgattgagc

SEQ ID NO: 298842 - DNA, 56 bp, Artificial Sequence
  Description of Artificial Sequence: Synthetic oligonucleotide
cctggaagaaaaaacagagaaaataaagttgatgtactataaattaatgattgagc

SEQ ID NO: 298843 - DNA, 57 bp, Artificial Sequence
  Description of Artificial Sequence: Synthetic oligonucleotide
ctggaagaaaaaacagagaaaataaagttgatgtactataaattaatgattgagctg

SEQ ID NO: 298844 - DNA, 57 bp, Artificial Sequence
  Description of Artificial Sequence: Synthetic oligonucleotide
tggaagaaaaaacagagaaaataaagttgatgtactataaattaatgattgagctgg

SEQ ID NO: 298845 - DNA, 56 bp, Artificial Sequence
  Description of Artificial Sequence: Synthetic oligonucleotide
ggaagaaaaaacagagaaaataaagttgatgtactataaattaatgattgagctgg

SEQ ID NO: 298846 - DNA, 58 bp, Artificial Sequence
  Description of Artificial Sequence: Synthetic oligonucleotide
gaagaaaaaacagagaaaataaagttgatgtactataaattaatgattgagctggatc

SEQ ID NO: 298847 - DNA, 60 bp, Artificial Sequence
  Description of Artificial Sequence: Synthetic oligonucleotide
aagaaaaaacagagaaaataaagttgatgtactataaattaatgattgagctggatctac

SEQ ID NO: 298848 - DNA, 59 bp, Artificial Sequence
  Description of Artificial Sequence: Synthetic oligonucleotide
agaaaaaacagagaaaataaagttgatgtactataaattaatgattgagctggatctac

SEQ ID NO: 298849 - DNA, 58 bp, Artificial Sequence
  Description of Artificial Sequence: Synthetic oligonucleotide
gaaaaaacagagaaaataaagttgatgtactataaattaatgattgagctggatctac

SEQ ID NO: 298850 - DNA, 60 bp, Artificial Sequence
  Description of Artificial Sequence: Synthetic oligonucleotide
aaaaaacagagaaaataaagttgatgtactataaattaatgattgagctggatctacatg

SEQ ID NO: 298851 - DNA, 59 bp, Artificial Sequence
  Description of Artificial Sequence: Synthetic oligonucleotide
aaaaacagagaaaataaagttgatgtactataaattaatgattgagctggatctacatg

SEQ ID NO: 298852 - DNA, 58 bp, Artificial Sequence
  Description of Artificial Sequence: Synthetic oligonucleotide
aaaacagagaaaataaagttgatgtactataaattaatgattgagctggatctacatg

SEQ ID NO: 298853 - DNA, 57 bp, Artificial Sequence
  Description of Artificial Sequence: Synthetic oligonucleotide
aaacagagaaaataaagttgatgtactataaattaatgattgagctggatctacatg

SEQ ID NO: 298854 - DNA, 56 bp, Artificial Sequence
  Description of Artificial Sequence: Synthetic oligonucleotide
aacagagaaaataaagttgatgtactataaattaatgattgagctggatctacatg

SEQ ID NO: 298855 - DNA, 55 bp, Artificial Sequence
  Description of Artificial Sequence: Synthetic oligonucleotide
acagagaaaataaagttgatgtactataaattaatgattgagctggatctacatg

SEQ ID NO: 298856 - DNA, 54 bp, Artificial Sequence
  Description of Artificial Sequence: Synthetic oligonucleotide
cagagaaaataaagttgatgtactataaattaatgattgagctggatctacatg

SEQ ID NO: 298857 - DNA, 55 bp, Artificial Sequence
  Description of Artificial Sequence: Synthetic oligonucleotide
agagaaaataaagttgatgtactataaattaatgattgagctggatctacatgag

SEQ ID NO: 298858 - DNA, 54 bp, Artificial Sequence
  Description of Artificial Sequence: Synthetic oligonucleotide
gagaaaataaagttgatgtactataaattaatgattgagctggatctacatgag

SEQ ID NO: 298859 - DNA, 54 bp, Artificial Sequence
  Description of Artificial Sequence: Synthetic oligonucleotide
agaaaataaagttgatgtactataaattaatgattgagctggatctacatgagg

SEQ ID NO: 298860 - DNA, 53 bp, Artificial Sequence
  Description of Artificial Sequence: Synthetic oligonucleotide
gaaaataaagttgatgtactataaattaatgattgagctggatctacatgagg

SEQ ID NO: 298861 - DNA, 53 bp, Artificial Sequence
  Description of Artificial Sequence: Synthetic oligonucleotide
aaaataaagttgatgtactataaattaatgattgagctggatctacatgaggg

SEQ ID NO: 298862 - DNA, 52 bp, Artificial Sequence
  Description of Artificial Sequence: Synthetic oligonucleotide
aaataaagttgatgtactataaattaatgattgagctggatctacatgaggg

SEQ ID NO: 298863 - DNA, 51 bp, Artificial Sequence
  Description of Artificial Sequence: Synthetic oligonucleotide
aataaagttgatgtactataaattaatgattgagctggatctacatgaggg

SEQ ID NO: 298864 - DNA, 50 bp, Artificial Sequence
  Description of Artificial Sequence: Synthetic oligonucleotide
ataaagttgatgtactataaattaatgattgagctggatctacatgaggg

SEQ ID NO: 298865 - DNA, 49 bp, Artificial Sequence
  Description of Artificial Sequence: Synthetic oligonucleotide
taaagttgatgtactataaattaatgattgagctggatctacatgaggg

SEQ ID NO: 298866 - DNA, 48 bp, Artificial Sequence
  Description of Artificial Sequence: Synthetic oligonucleotide
aaagttgatgtactataaattaatgattgagctggatctacatgaggg

SEQ ID NO: 298867 - DNA, 47 bp, Artificial Sequence
  Description of Artificial Sequence: Synthetic oligonucleotide
aagttgatgtactataaattaatgattgagctggatctacatgaggg

SEQ ID NO: 298868 - DNA, 46 bp, Artificial Sequence
  Description of Artificial Sequence: Synthetic oligonucleotide
agttgatgtactataaattaatgattgagctggatctacatgaggg

SEQ ID NO: 298869 - DNA, 45 bp, Artificial Sequence
  Description of Artificial Sequence: Synthetic oligonucleotide
gttgatgtactataaattaatgattgagctggatctacatgaggg

SEQ ID NO: 298870 - DNA, 47 bp, Artificial Sequence
  Description of Artificial Sequence: Synthetic oligonucleotide
ttgatgtactataaattaatgattgagctggatctacatgagggttc

SEQ ID NO: 298871 - DNA, 46 bp, Artificial Sequence
  Description of Artificial Sequence: Synthetic oligonucleotide
tgatgtactataaattaatgattgagctggatctacatgagggttc

SEQ ID NO: 298872 - DNA, 45 bp, Artificial Sequence
  Description of Artificial Sequence: Synthetic oligonucleotide
gatgtactataaattaatgattgagctggatctacatgagggttc

SEQ ID NO: 298873 - DNA, 45 bp, Artificial Sequence
  Description of Artificial Sequence: Synthetic oligonucleotide
atgtactataaattaatgattgagctggatctacatgagggttcc

SEQ ID NO: 298874 - DNA, 44 bp, Artificial Sequence
  Description of Artificial Sequence: Synthetic oligonucleotide
tgtactataaattaatgattgagctggatctacatgagggttcc

SEQ ID NO: 298875 - DNA, 43 bp, Artificial Sequence
  Description of Artificial Sequence: Synthetic oligonucleotide
gtactataaattaatgattgagctggatctacatgagggttcc

SEQ ID NO: 298876 - DNA, 48 bp, Artificial Sequence
  Description of Artificial Sequence: Synthetic oligonucleotide
tactataaattaatgattgagctggatctacatgagggttcctatttg

SEQ ID NO: 298877 - DNA, 47 bp, Artificial Sequence
  Description of Artificial Sequence: Synthetic oligonucleotide
actataaattaatgattgagctggatctacatgagggttcctatttg

SEQ ID NO: 298878 - DNA, 46 bp, Artificial Sequence
  Description of Artificial Sequence: Synthetic oligonucleotide
ctataaattaatgattgagctggatctacatgagggttcctatttg

SEQ ID NO: 298879 - DNA, 47 bp, Artificial Sequence
  Description of Artificial Sequence: Synthetic oligonucleotide
tataaattaatgattgagctggatctacatgagggttcctatttgac

SEQ ID NO: 298880 - DNA, 46 bp, Artificial Sequence
  Description of Artificial Sequence: Synthetic oligonucleotide
ataaattaatgattgagctggatctacatgagggttcctatttgac

SEQ ID NO: 298881 - DNA, 45 bp, Artificial Sequence
  Description of Artificial Sequence: Synthetic oligonucleotide
taaattaatgattgagctggatctacatgagggttcctatttgac

SEQ ID NO: 298882 - DNA, 44 bp, Artificial Sequence
  Description of Artificial Sequence: Synthetic oligonucleotide
aaattaatgattgagctggatctacatgagggttcctatttgac

SEQ ID NO: 298883 - DNA, 43 bp, Artificial Sequence
  Description of Artificial Sequence: Synthetic oligonucleotide
aattaatgattgagctggatctacatgagggttcctatttgac

SEQ ID NO: 298884 - DNA, 42 bp, Artificial Sequence
  Description of Artificial Sequence: Synthetic oligonucleotide
attaatgattgagctggatctacatgagggttcctatttgac

SEQ ID NO: 298885 - DNA, 41 bp, Artificial Sequence
  Description of Artificial Sequence: Synthetic oligonucleotide
ttaatgattgagctggatctacatgagggttcctatttgac

SEQ ID NO: 298886 - DNA, 40 bp, Artificial Sequence
  Description of Artificial Sequence: Synthetic oligonucleotide
taatgattgagctggatctacatgagggttcctatttgac

SEQ ID NO: 298887 - DNA, 39 bp, Artificial Sequence
  Description of Artificial Sequence: Synthetic oligonucleotide
aatgattgagctggatctacatgagggttcctatttgac

SEQ ID NO: 298888 - DNA, 38 bp, Artificial Sequence
  Description of Artificial Sequence: Synthetic oligonucleotide
atgattgagctggatctacatgagggttcctatttgac

SEQ ID NO: 298889 - DNA, 37 bp, Artificial Sequence
  Description of Artificial Sequence: Synthetic oligonucleotide
tgattgagctggatctacatgagggttcctatttgac

SEQ ID NO: 298890 - DNA, 36 bp, Artificial Sequence
  Description of Artificial Sequence: Synthetic oligonucleotide
gattgagctggatctacatgagggttcctatttgac

SEQ ID NO: 298891 - DNA, 41 bp, Artificial Sequence
  Description of Artificial Sequence: Synthetic oligonucleotide
attgagctggatctacatgagggttcctatttgactatttg

SEQ ID NO: 298892 - DNA, 40 bp, Artificial Sequence
  Description of Artificial Sequence: Synthetic oligonucleotide
ttgagctggatctacatgagggttcctatttgactatttg

SEQ ID NO: 298893 - DNA, 39 bp, Artificial Sequence
  Description of Artificial Sequence: Synthetic oligonucleotide
tgagctggatctacatgagggttcctatttgactatttg

SEQ ID NO: 298894 - DNA, 38 bp, Artificial Sequence
  Description of Artificial Sequence: Synthetic oligonucleotide
gagctggatctacatgagggttcctatttgactatttg

SEQ ID NO: 298895 - DNA, 41 bp, Artificial Sequence
  Description of Artificial Sequence: Synthetic oligonucleotide
agctggatctacatgagggttcctatttgactatttgtatg

SEQ ID NO: 298896 - DNA, 40 bp, Artificial Sequence
  Description of Artificial Sequence: Synthetic oligonucleotide
gctggatctacatgagggttcctatttgactatttgtatg

SEQ ID NO: 298897 - DNA, 40 bp, Artificial Sequence
  Description of Artificial Sequence: Synthetic oligonucleotide
ctggatctacatgagggttcctatttgactatttgtatgc

SEQ ID NO: 298898 - DNA, 41 bp, Artificial Sequence
  Description of Artificial Sequence: Synthetic oligonucleotide
tggatctacatgagggttcctatttgactatttgtatgcac

SEQ ID NO: 298899 - DNA, 40 bp, Artificial Sequence
  Description of Artificial Sequence: Synthetic oligonucleotide
ggatctacatgagggttcctatttgactatttgtatgcac

SEQ ID NO: 298900 - DNA, 42 bp, Artificial Sequence
  Description of Artificial Sequence: Synthetic oligonucleotide
gatctacatgagggttcctatttgactatttgtatgcactac

SEQ ID NO: 298901 - DNA, 43 bp, Artificial Sequence
  Description of Artificial Sequence: Synthetic oligonucleotide
atctacatgagggttcctatttgactatttgtatgcactacag

SEQ ID NO: 298902 - DNA, 42 bp, Artificial Sequence
  Description of Artificial Sequence: Synthetic oligonucleotide
tctacatgagggttcctatttgactatttgtatgcactacag

SEQ ID NO: 298903 - DNA, 41 bp, Artificial Sequence
  Description of Artificial Sequence: Synthetic oligonucleotide
ctacatgagggttcctatttgactatttgtatgcactacag

SEQ ID NO: 298904 - DNA, 42 bp, Artificial Sequence
  Description of Artificial Sequence: Synthetic oligonucleotide
tacatgagggttcctatttgactatttgtatgcactacagtg

SEQ ID NO: 298905 - DNA, 41 bp, Artificial Sequence
  Description of Artificial Sequence: Synthetic oligonucleotide
acatgagggttcctatttgactatttgtatgcactacagtg

SEQ ID NO: 298906 - DNA, 40 bp, Artificial Sequence
  Description of Artificial Sequence: Synthetic oligonucleotide
catgagggttcctatttgactatttgtatgcactacagtg

SEQ ID NO: 298907 - DNA, 40 bp, Artificial Sequence
  Description of Artificial Sequence: Synthetic oligonucleotide
atgagggttcctatttgactatttgtatgcactacagtgc

SEQ ID NO: 298908 - DNA, 39 bp, Artificial Sequence
  Description of Artificial Sequence: Synthetic oligonucleotide
tgagggttcctatttgactatttgtatgcactacagtgc

SEQ ID NO: 298909 - DNA, 38 bp, Artificial Sequence
  Description of Artificial Sequence: Synthetic oligonucleotide
gagggttcctatttgactatttgtatgcactacagtgc

SEQ ID NO: 298910 - DNA, 45 bp, Artificial Sequence
  Description of Artificial Sequence: Synthetic oligonucleotide
agggttcctatttgactatttgtatgcactacagtgcaatatatc

SEQ ID NO: 298911 - DNA, 44 bp, Artificial Sequence
  Description of Artificial Sequence: Synthetic oligonucleotide
gggttcctatttgactatttgtatgcactacagtgcaatatatc

SEQ ID NO: 298912 - DNA, 47 bp, Artificial Sequence
  Description of Artificial Sequence: Synthetic oligonucleotide
ggttcctatttgactatttgtatgcactacagtgcaatatatcatac

SEQ ID NO: 298913 - DNA, 48 bp, Artificial Sequence
  Description of Artificial Sequence: Synthetic oligonucleotide
gttcctatttgactatttgtatgcactacagtgcaatatatcatactc

SEQ ID NO: 298914 - DNA, 48 bp, Artificial Sequence
  Description of Artificial Sequence: Synthetic oligonucleotide
ttcctatttgactatttgtatgcactacagtgcaatatatcatactcc

SEQ ID NO: 298915 - DNA, 47 bp, Artificial Sequence
  Description of Artificial Sequence: Synthetic oligonucleotide
tcctatttgactatttgtatgcactacagtgcaatatatcatactcc

SEQ ID NO: 298916 - DNA, 46 bp, Artificial Sequence
  Description of Artificial Sequence: Synthetic oligonucleotide
cctatttgactatttgtatgcactacagtgcaatatatcatactcc

SEQ ID NO: 298917 - DNA, 46 bp, Artificial Sequence
  Description of Artificial Sequence: Synthetic oligonucleotide
ctatttgactatttgtatgcactacagtgcaatatatcatactccc

SEQ ID NO: 298918 - DNA, 47 bp, Artificial Sequence
  Description of Artificial Sequence: Synthetic oligonucleotide
tatttgactatttgtatgcactacagtgcaatatatcatactccctc

SEQ ID NO: 298919 - DNA, 46 bp, Artificial Sequence
  Description of Artificial Sequence: Synthetic oligonucleotide
atttgactatttgtatgcactacagtgcaatatatcatactccctc

SEQ ID NO: 298920 - DNA, 45 bp, Artificial Sequence
  Description of Artificial Sequence: Synthetic oligonucleotide
tttgactatttgtatgcactacagtgcaatatatcatactccctc

SEQ ID NO: 298921 - DNA, 44 bp, Artificial Sequence
  Description of Artificial Sequence: Synthetic oligonucleotide
ttgactatttgtatgcactacagtgcaatatatcatactccctc

SEQ ID NO: 298922 - DNA, 43 bp, Artificial Sequence
  Description of Artificial Sequence: Synthetic oligonucleotide
tgactatttgtatgcactacagtgcaatatatcatactccctc

SEQ ID NO: 298923 - DNA, 42 bp, Artificial Sequence
  Description of Artificial Sequence: Synthetic oligonucleotide
gactatttgtatgcactacagtgcaatatatcatactccctc

SEQ ID NO: 298924 - DNA, 46 bp, Artificial Sequence
  Description of Artificial Sequence: Synthetic oligonucleotide
actatttgtatgcactacagtgcaatatatcatactccctctatac

SEQ ID NO: 298925 - DNA, 45 bp, Artificial Sequence
  Description of Artificial Sequence: Synthetic oligonucleotide
ctatttgtatgcactacagtgcaatatatcatactccctctatac

SEQ ID NO: 298926 - DNA, 46 bp, Artificial Sequence
  Description of Artificial Sequence: Synthetic oligonucleotide
tatttgtatgcactacagtgcaatatatcatactccctctatacag

SEQ ID NO: 298927 - DNA, 45 bp, Artificial Sequence
  Description of Artificial Sequence: Synthetic oligonucleotide
atttgtatgcactacagtgcaatatatcatactccctctatacag

SEQ ID NO: 298928 - DNA, 44 bp, Artificial Sequence
  Description of Artificial Sequence: Synthetic oligonucleotide
tttgtatgcactacagtgcaatatatcatactccctctatacag

SEQ ID NO: 298929 - DNA, 43 bp, Artificial Sequence
  Description of Artificial Sequence: Synthetic oligonucleotide
ttgtatgcactacagtgcaatatatcatactccctctatacag

SEQ ID NO: 298930 - DNA, 42 bp, Artificial Sequence
  Description of Artificial Sequence: Synthetic oligonucleotide
tgtatgcactacagtgcaatatatcatactccctctatacag

SEQ ID NO: 298931 - DNA, 41 bp, Artificial Sequence
  Description of Artificial Sequence: Synthetic oligonucleotide
gtatgcactacagtgcaatatatcatactccctctatacag

SEQ ID NO: 298932 - DNA, 41 bp, Artificial Sequence
  Description of Artificial Sequence: Synthetic oligonucleotide
tatgcactacagtgcaatatatcatactccctctatacagg

SEQ ID NO: 298933 - DNA, 40 bp, Artificial Sequence
  Description of Artificial Sequence: Synthetic oligonucleotide
atgcactacagtgcaatatatcatactccctctatacagg

SEQ ID NO: 298934 - DNA, 39 bp, Artificial Sequence
  Description of Artificial Sequence: Synthetic oligonucleotide
tgcactacagtgcaatatatcatactccctctatacagg

SEQ ID NO: 298935 - DNA, 38 bp, Artificial Sequence
  Description of Artificial Sequence: Synthetic oligonucleotide
gcactacagtgcaatatatcatactccctctatacagg

SEQ ID NO: 298936 - DNA, 38 bp, Artificial Sequence
  Description of Artificial Sequence: Synthetic oligonucleotide
cactacagtgcaatatatcatactccctctatacaggc

SEQ ID NO: 298937 - DNA, 39 bp, Artificial Sequence
  Description of Artificial Sequence: Synthetic oligonucleotide
actacagtgcaatatatcatactccctctatacaggctg

SEQ ID NO: 298938 - DNA, 38 bp, Artificial Sequence
  Description of Artificial Sequence: Synthetic oligonucleotide
ctacagtgcaatatatcatactccctctatacaggctg

SEQ ID NO: 298939 - DNA, 41 bp, Artificial Sequence
  Description of Artificial Sequence: Synthetic oligonucleotide
tacagtgcaatatatcatactccctctatacaggctgaaag

SEQ ID NO: 298940 - DNA, 40 bp, Artificial Sequence
  Description of Artificial Sequence: Synthetic oligonucleotide
acagtgcaatatatcatactccctctatacaggctgaaag

SEQ ID NO: 298941 - DNA, 39 bp, Artificial Sequence
  Description of Artificial Sequence: Synthetic oligonucleotide
cagtgcaatatatcatactccctctatacaggctgaaag

SEQ ID NO: 298942 - DNA, 40 bp, Artificial Sequence
  Description of Artificial Sequence: Synthetic oligonucleotide
agtgcaatatatcatactccctctatacaggctgaaagtg

SEQ ID NO: 298943 - DNA, 39 bp, Artificial Sequence
  Description of Artificial Sequence: Synthetic oligonucleotide
gtgcaatatatcatactccctctatacaggctgaaagtg

SEQ ID NO: 298944 - DNA, 45 bp, Artificial Sequence
  Description of Artificial Sequence: Synthetic oligonucleotide
tgcaatatatcatactccctctatacaggctgaaagtgaataatg

SEQ ID NO: 298945 - DNA, 44 bp, Artificial Sequence
  Description of Artificial Sequence: Synthetic oligonucleotide
gcaatatatcatactccctctatacaggctgaaagtgaataatg

SEQ ID NO: 298946 - DNA, 44 bp, Artificial Sequence
  Description of Artificial Sequence: Synthetic oligonucleotide
caatatatcatactccctctatacaggctgaaagtgaataatgg

SEQ ID NO: 298947 - DNA, 44 bp, Artificial Sequence
  Description of Artificial Sequence: Synthetic oligonucleotide
aatatatcatactccctctatacaggctgaaagtgaataatggc

SEQ ID NO: 298948 - DNA, 43 bp, Artificial Sequence
  Description of Artificial Sequence: Synthetic oligonucleotide
atatatcatactccctctatacaggctgaaagtgaataatggc

SEQ ID NO: 298949 - DNA, 42 bp, Artificial Sequence
  Description of Artificial Sequence: Synthetic oligonucleotide
tatatcatactccctctatacaggctgaaagtgaataatggc

SEQ ID NO: 298950 - DNA, 41 bp, Artificial Sequence
  Description of Artificial Sequence: Synthetic oligonucleotide
atatcatactccctctatacaggctgaaagtgaataatggc

SEQ ID NO: 298951 - DNA, 40 bp, Artificial Sequence
  Description of Artificial Sequence: Synthetic oligonucleotide
tatcatactccctctatacaggctgaaagtgaataatggc

SEQ ID NO: 298952 - DNA, 39 bp, Artificial Sequence
  Description of Artificial Sequence: Synthetic oligonucleotide
atcatactccctctatacaggctgaaagtgaataatggc

SEQ ID NO: 298953 - DNA, 38 bp, Artificial Sequence
  Description of Artificial Sequence: Synthetic oligonucleotide
tcatactccctctatacaggctgaaagtgaataatggc

SEQ ID NO: 298954 - DNA, 37 bp, Artificial Sequence
  Description of Artificial Sequence: Synthetic oligonucleotide
catactccctctatacaggctgaaagtgaataatggc

SEQ ID NO: 298955 - DNA, 38 bp, Artificial Sequence
  Description of Artificial Sequence: Synthetic oligonucleotide
atactccctctatacaggctgaaagtgaataatggcag

SEQ ID NO: 298956 - DNA, 37 bp, Artificial Sequence
  Description of Artificial Sequence: Synthetic oligonucleotide
tactccctctatacaggctgaaagtgaataatggcag

SEQ ID NO: 298957 - DNA, 36 bp, Artificial Sequence
  Description of Artificial Sequence: Synthetic oligonucleotide
actccctctatacaggctgaaagtgaataatggcag

SEQ ID NO: 298958 - DNA, 35 bp, Artificial Sequence
  Description of Artificial Sequence: Synthetic oligonucleotide
ctccctctatacaggctgaaagtgaataatggcag

SEQ ID NO: 298959 - DNA, 35 bp, Artificial Sequence
  Description of Artificial Sequence: Synthetic oligonucleotide
tccctctatacaggctgaaagtgaataatggcagc

SEQ ID NO: 298960 - DNA, 34 bp, Artificial Sequence
  Description of Artificial Sequence: Synthetic oligonucleotide
ccctctatacaggctgaaagtgaataatggcagc

SEQ ID NO: 298961 - DNA, 35 bp, Artificial Sequence
  Description of Artificial Sequence: Synthetic oligonucleotide
cctctatacaggctgaaagtgaataatggcagctg

SEQ ID NO: 298962 - DNA, 35 bp, Artificial Sequence
  Description of Artificial Sequence: Synthetic oligonucleotide
ctctatacaggctgaaagtgaataatggcagctgg

SEQ ID NO: 298963 - DNA, 35 bp, Artificial Sequence
  Description of Artificial Sequence: Synthetic oligonucleotide
tctatacaggctgaaagtgaataatggcagctggc

SEQ ID NO: 298964 - DNA, 34 bp, Artificial Sequence
  Description of Artificial Sequence: Synthetic oligonucleotide
ctatacaggctgaaagtgaataatggcagctggc

SEQ ID NO: 298965 - DNA, 35 bp, Artificial Sequence
  Description of Artificial Sequence: Synthetic oligonucleotide
tatacaggctgaaagtgaataatggcagctggctc

SEQ ID NO: 298966 - DNA, 34 bp, Artificial Sequence
  Description of Artificial Sequence: Synthetic oligonucleotide
atacaggctgaaagtgaataatggcagctggctc

SEQ ID NO: 298967 - DNA, 33 bp, Artificial Sequence
  Description of Artificial Sequence: Synthetic oligonucleotide
tacaggctgaaagtgaataatggcagctggctc

SEQ ID NO: 298968 - DNA, 32 bp, Artificial Sequence
  Description of Artificial Sequence: Synthetic oligonucleotide
acaggctgaaagtgaataatggcagctggctc

SEQ ID NO: 298969 - DNA, 31 bp, Artificial Sequence
  Description of Artificial Sequence: Synthetic oligonucleotide
caggctgaaagtgaataatggcagctggctc

SEQ ID NO: 298970 - DNA, 32 bp, Artificial Sequence
  Description of Artificial Sequence: Synthetic oligonucleotide
aggctgaaagtgaataatggcagctggctctg

SEQ ID NO: 298971 - DNA, 31 bp, Artificial Sequence
  Description of Artificial Sequence: Synthetic oligonucleotide
ggctgaaagtgaataatggcagctggctctg

SEQ ID NO: 298972 - DNA, 33 bp, Artificial Sequence
  Description of Artificial Sequence: Synthetic oligonucleotide
gctgaaagtgaataatggcagctggctctgaac

SEQ ID NO: 298973 - DNA, 34 bp, Artificial Sequence
  Description of Artificial Sequence: Synthetic oligonucleotide
ctgaaagtgaataatggcagctggctctgaacag

SEQ ID NO: 298974 - DNA, 35 bp, Artificial Sequence
  Description of Artificial Sequence: Synthetic oligonucleotide
tgaaagtgaataatggcagctggctctgaacagtg

SEQ ID NO: 298975 - DNA, 34 bp, Artificial Sequence
  Description of Artificial Sequence: Synthetic oligonucleotide
gaaagtgaataatggcagctggctctgaacagtg

SEQ ID NO: 298976 - DNA, 36 bp, Artificial Sequence
  Description of Artificial Sequence: Synthetic oligonucleotide
aaagtgaataatggcagctggctctgaacagtgttg

SEQ ID NO: 298977 - DNA, 35 bp, Artificial Sequence
  Description of Artificial Sequence: Synthetic oligonucleotide
aagtgaataatggcagctggctctgaacagtgttg

SEQ ID NO: 298978 - DNA, 34 bp, Artificial Sequence
  Description of Artificial Sequence: Synthetic oligonucleotide
agtgaataatggcagctggctctgaacagtgttg

SEQ ID NO: 298979 - DNA, 33 bp, Artificial Sequence
  Description of Artificial Sequence: Synthetic oligonucleotide
gtgaataatggcagctggctctgaacagtgttg

SEQ ID NO: 298980 - DNA, 35 bp, Artificial Sequence
  Description of Artificial Sequence: Synthetic oligonucleotide
tgaataatggcagctggctctgaacagtgttgtag

SEQ ID NO: 298981 - DNA, 34 bp, Artificial Sequence
  Description of Artificial Sequence: Synthetic oligonucleotide
gaataatggcagctggctctgaacagtgttgtag

SEQ ID NO: 298982 - DNA, 35 bp, Artificial Sequence
  Description of Artificial Sequence: Synthetic oligonucleotide
aataatggcagctggctctgaacagtgttgtagtc

SEQ ID NO: 298983 - DNA, 34 bp, Artificial Sequence
  Description of Artificial Sequence: Synthetic oligonucleotide
ataatggcagctggctctgaacagtgttgtagtc

SEQ ID NO: 298984 - DNA, 33 bp, Artificial Sequence
  Description of Artificial Sequence: Synthetic oligonucleotide
taatggcagctggctctgaacagtgttgtagtc

SEQ ID NO: 298985 - DNA, 32 bp, Artificial Sequence
  Description of Artificial Sequence: Synthetic oligonucleotide
aatggcagctggctctgaacagtgttgtagtc

SEQ ID NO: 298986 - DNA, 31 bp, Artificial Sequence
  Description of Artificial Sequence: Synthetic oligonucleotide
atggcagctggctctgaacagtgttgtagtc

SEQ ID NO: 298987 - DNA, 30 bp, Artificial Sequence
  Description of Artificial Sequence: Synthetic oligonucleotide
tggcagctggctctgaacagtgttgtagtc

SEQ ID NO: 298988 - DNA, 29 bp, Artificial Sequence
  Description of Artificial Sequence: Synthetic oligonucleotide
ggcagctggctctgaacagtgttgtagtc

SEQ ID NO: 298989 - DNA, 32 bp, Artificial Sequence
  Description of Artificial Sequence: Synthetic oligonucleotide
gcagctggctctgaacagtgttgtagtctatg

SEQ ID NO: 298990 - DNA, 36 bp, Artificial Sequence
  Description of Artificial Sequence: Synthetic oligonucleotide
cagctggctctgaacagtgttgtagtctatgttaac

SEQ ID NO: 298991 - DNA, 36 bp, Artificial Sequence
  Description of Artificial Sequence: Synthetic oligonucleotide
agctggctctgaacagtgttgtagtctatgttaacc

SEQ ID NO: 298992 - DNA, 35 bp, Artificial Sequence
  Description of Artificial Sequence: Synthetic oligonucleotide
gctggctctgaacagtgttgtagtctatgttaacc

SEQ ID NO: 298993 - DNA, 36 bp, Artificial Sequence
  Description of Artificial Sequence: Synthetic oligonucleotide
ctggctctgaacagtgttgtagtctatgttaacctg

SEQ ID NO: 298994 - DNA, 36 bp, Artificial Sequence
  Description of Artificial Sequence: Synthetic oligonucleotide
tggctctgaacagtgttgtagtctatgttaacctgg

SEQ ID NO: 298995 - DNA, 35 bp, Artificial Sequence
  Description of Artificial Sequence: Synthetic oligonucleotide
ggctctgaacagtgttgtagtctatgttaacctgg

SEQ ID NO: 298996 - DNA, 35 bp, Artificial Sequence
  Description of Artificial Sequence: Synthetic oligonucleotide
gctctgaacagtgttgtagtctatgttaacctggc

SEQ ID NO: 298997 - DNA, 36 bp, Artificial Sequence
  Description of Artificial Sequence: Synthetic oligonucleotide
ctctgaacagtgttgtagtctatgttaacctggctc

SEQ ID NO: 298998 - DNA, 36 bp, Artificial Sequence
  Description of Artificial Sequence: Synthetic oligonucleotide
tctgaacagtgttgtagtctatgttaacctggctcc

SEQ ID NO: 298999 - DNA, 35 bp, Artificial Sequence
  Description of Artificial Sequence: Synthetic oligonucleotide
ctgaacagtgttgtagtctatgttaacctggctcc

SEQ ID NO: 299000 - DNA, 39 bp, Artificial Sequence
  Description of Artificial Sequence: Synthetic oligonucleotide
tgaacagtgttgtagtctatgttaacctggctccatttg

SEQ ID NO: 299001 - DNA, 38 bp, Artificial Sequence
  Description of Artificial Sequence: Synthetic oligonucleotide
gaacagtgttgtagtctatgttaacctggctccatttg

SEQ ID NO: 299002 - DNA, 39 bp, Artificial Sequence
  Description of Artificial Sequence: Synthetic oligonucleotide
aacagtgttgtagtctatgttaacctggctccatttgac

SEQ ID NO: 299003 - DNA, 38 bp, Artificial Sequence
  Description of Artificial Sequence: Synthetic oligonucleotide
acagtgttgtagtctatgttaacctggctccatttgac

SEQ ID NO: 299004 - DNA, 37 bp, Artificial Sequence
  Description of Artificial Sequence: Synthetic oligonucleotide
cagtgttgtagtctatgttaacctggctccatttgac

SEQ ID NO: 299005 - DNA, 40 bp, Artificial Sequence
  Description of Artificial Sequence: Synthetic oligonucleotide
agtgttgtagtctatgttaacctggctccatttgacaatc

SEQ ID NO: 299006 - DNA, 39 bp, Artificial Sequence
  Description of Artificial Sequence: Synthetic oligonucleotide
gtgttgtagtctatgttaacctggctccatttgacaatc

SEQ ID NO: 299007 - DNA, 41 bp, Artificial Sequence
  Description of Artificial Sequence: Synthetic oligonucleotide
tgttgtagtctatgttaacctggctccatttgacaatcaac

SEQ ID NO: 299008 - DNA, 40 bp, Artificial Sequence
  Description of Artificial Sequence: Synthetic oligonucleotide
gttgtagtctatgttaacctggctccatttgacaatcaac

SEQ ID NO: 299009 - DNA, 41 bp, Artificial Sequence
  Description of Artificial Sequence: Synthetic oligonucleotide
ttgtagtctatgttaacctggctccatttgacaatcaacag

SEQ ID NO: 299010 - DNA, 40 bp, Artificial Sequence
  Description of Artificial Sequence: Synthetic oligonucleotide
tgtagtctatgttaacctggctccatttgacaatcaacag

SEQ ID NO: 299011 - DNA, 39 bp, Artificial Sequence
  Description of Artificial Sequence: Synthetic oligonucleotide
gtagtctatgttaacctggctccatttgacaatcaacag

SEQ ID NO: 299012 - DNA, 40 bp, Artificial Sequence
  Description of Artificial Sequence: Synthetic oligonucleotide
tagtctatgttaacctggctccatttgacaatcaacagtc

SEQ ID NO: 299013 - DNA, 39 bp, Artificial Sequence
  Description of Artificial Sequence: Synthetic oligonucleotide
agtctatgttaacctggctccatttgacaatcaacagtc

SEQ ID NO: 299014 - DNA, 38 bp, Artificial Sequence
  Description of Artificial Sequence: Synthetic oligonucleotide
gtctatgttaacctggctccatttgacaatcaacagtc

SEQ ID NO: 299015 - DNA, 39 bp, Artificial Sequence
  Description of Artificial Sequence: Synthetic oligonucleotide
tctatgttaacctggctccatttgacaatcaacagtcag

SEQ ID NO: 299016 - DNA, 38 bp, Artificial Sequence
  Description of Artificial Sequence: Synthetic oligonucleotide
ctatgttaacctggctccatttgacaatcaacagtcag

SEQ ID NO: 299017 - DNA, 42 bp, Artificial Sequence
  Description of Artificial Sequence: Synthetic oligonucleotide
tatgttaacctggctccatttgacaatcaacagtcagttttg

SEQ ID NO: 299018 - DNA, 41 bp, Artificial Sequence
  Description of Artificial Sequence: Synthetic oligonucleotide
atgttaacctggctccatttgacaatcaacagtcagttttg

SEQ ID NO: 299019 - DNA, 40 bp, Artificial Sequence
  Description of Artificial Sequence: Synthetic oligonucleotide
tgttaacctggctccatttgacaatcaacagtcagttttg

SEQ ID NO: 299020 - DNA, 39 bp, Artificial Sequence
  Description of Artificial Sequence: Synthetic oligonucleotide
gttaacctggctccatttgacaatcaacagtcagttttg

SEQ ID NO: 299021 - DNA, 39 bp, Artificial Sequence
  Description of Artificial Sequence: Synthetic oligonucleotide
ttaacctggctccatttgacaatcaacagtcagttttgg

SEQ ID NO: 299022 - DNA, 38 bp, Artificial Sequence
  Description of Artificial Sequence: Synthetic oligonucleotide
taacctggctccatttgacaatcaacagtcagttttgg

SEQ ID NO: 299023 - DNA, 37 bp, Artificial Sequence
  Description of Artificial Sequence: Synthetic oligonucleotide
aacctggctccatttgacaatcaacagtcagttttgg

SEQ ID NO: 299024 - DNA, 36 bp, Artificial Sequence
  Description of Artificial Sequence: Synthetic oligonucleotide
acctggctccatttgacaatcaacagtcagttttgg

SEQ ID NO: 299025 - DNA, 35 bp, Artificial Sequence
  Description of Artificial Sequence: Synthetic oligonucleotide
cctggctccatttgacaatcaacagtcagttttgg

SEQ ID NO: 299026 - DNA, 37 bp, Artificial Sequence
  Description of Artificial Sequence: Synthetic oligonucleotide
ctggctccatttgacaatcaacagtcagttttggttc

SEQ ID NO: 299027 - DNA, 38 bp, Artificial Sequence
  Description of Artificial Sequence: Synthetic oligonucleotide
tggctccatttgacaatcaacagtcagttttggttcag

SEQ ID NO: 299028 - DNA, 37 bp, Artificial Sequence
  Description of Artificial Sequence: Synthetic oligonucleotide
ggctccatttgacaatcaacagtcagttttggttcag

SEQ ID NO: 299029 - DNA, 37 bp, Artificial Sequence
  Description of Artificial Sequence: Synthetic oligonucleotide
gctccatttgacaatcaacagtcagttttggttcagc

SEQ ID NO: 299030 - DNA, 37 bp, Artificial Sequence
  Description of Artificial Sequence: Synthetic oligonucleotide
ctccatttgacaatcaacagtcagttttggttcagcg

SEQ ID NO: 299031 - DNA, 42 bp, Artificial Sequence
  Description of Artificial Sequence: Synthetic oligonucleotide
tccatttgacaatcaacagtcagttttggttcagcgaataag

SEQ ID NO: 299032 - DNA, 41 bp, Artificial Sequence
  Description of Artificial Sequence: Synthetic oligonucleotide
ccatttgacaatcaacagtcagttttggttcagcgaataag

SEQ ID NO: 299033 - DNA, 42 bp, Artificial Sequence
  Description of Artificial Sequence: Synthetic oligonucleotide
catttgacaatcaacagtcagttttggttcagcgaataagtc

SEQ ID NO: 299034 - DNA, 42 bp, Artificial Sequence
  Description of Artificial Sequence: Synthetic oligonucleotide
atttgacaatcaacagtcagttttggttcagcgaataagtcg

SEQ ID NO: 299035 - DNA, 41 bp, Artificial Sequence
  Description of Artificial Sequence: Synthetic oligonucleotide
tttgacaatcaacagtcagttttggttcagcgaataagtcg

SEQ ID NO: 299036 - DNA, 40 bp, Artificial Sequence
  Description of Artificial Sequence: Synthetic oligonucleotide
ttgacaatcaacagtcagttttggttcagcgaataagtcg

SEQ ID NO: 299037 - DNA, 39 bp, Artificial Sequence
  Description of Artificial Sequence: Synthetic oligonucleotide
tgacaatcaacagtcagttttggttcagcgaataagtcg

SEQ ID NO: 299038 - DNA, 38 bp, Artificial Sequence
  Description of Artificial Sequence: Synthetic oligonucleotide
gacaatcaacagtcagttttggttcagcgaataagtcg

SEQ ID NO: 299039 - DNA, 39 bp, Artificial Sequence
  Description of Artificial Sequence: Synthetic oligonucleotide
acaatcaacagtcagttttggttcagcgaataagtcgtg

SEQ ID NO: 299040 - DNA, 38 bp, Artificial Sequence
  Description of Artificial Sequence: Synthetic oligonucleotide
caatcaacagtcagttttggttcagcgaataagtcgtg

SEQ ID NO: 299041 - DNA, 39 bp, Artificial Sequence
  Description of Artificial Sequence: Synthetic oligonucleotide
aatcaacagtcagttttggttcagcgaataagtcgtgac

SEQ ID NO: 299042 - DNA, 38 bp, Artificial Sequence
  Description of Artificial Sequence: Synthetic oligonucleotide
atcaacagtcagttttggttcagcgaataagtcgtgac

SEQ ID NO: 299043 - DNA, 37 bp, Artificial Sequence
  Description of Artificial Sequence: Synthetic oligonucleotide
tcaacagtcagttttggttcagcgaataagtcgtgac

SEQ ID NO: 299044 - DNA, 36 bp, Artificial Sequence
  Description of Artificial Sequence: Synthetic oligonucleotide
caacagtcagttttggttcagcgaataagtcgtgac

SEQ ID NO: 299045 - DNA, 38 bp, Artificial Sequence
  Description of Artificial Sequence: Synthetic oligonucleotide
aacagtcagttttggttcagcgaataagtcgtgacaag

SEQ ID NO: 299046 - DNA, 37 bp, Artificial Sequence
  Description of Artificial Sequence: Synthetic oligonucleotide
acagtcagttttggttcagcgaataagtcgtgacaag

SEQ ID NO: 299047 - DNA, 36 bp, Artificial Sequence
  Description of Artificial Sequence: Synthetic oligonucleotide
cagtcagttttggttcagcgaataagtcgtgacaag

SEQ ID NO: 299048 - DNA, 38 bp, Artificial Sequence
  Description of Artificial Sequence: Synthetic oligonucleotide
agtcagttttggttcagcgaataagtcgtgacaagatg

SEQ ID NO: 299049 - DNA, 37 bp, Artificial Sequence
  Description of Artificial Sequence: Synthetic oligonucleotide
gtcagttttggttcagcgaataagtcgtgacaagatg

SEQ ID NO: 299050 - DNA, 40 bp, Artificial Sequence
  Description of Artificial Sequence: Synthetic oligonucleotide
tcagttttggttcagcgaataagtcgtgacaagatgttag

SEQ ID NO: 299051 - DNA, 39 bp, Artificial Sequence
  Description of Artificial Sequence: Synthetic oligonucleotide
cagttttggttcagcgaataagtcgtgacaagatgttag

SEQ ID NO: 299052 - DNA, 41 bp, Artificial Sequence
  Description of Artificial Sequence: Synthetic oligonucleotide
agttttggttcagcgaataagtcgtgacaagatgttagaag

SEQ ID NO: 299053 - DNA, 40 bp, Artificial Sequence
  Description of Artificial Sequence: Synthetic oligonucleotide
gttttggttcagcgaataagtcgtgacaagatgttagaag

SEQ ID NO: 299054 - DNA, 45 bp, Artificial Sequence
  Description of Artificial Sequence: Synthetic oligonucleotide
ttttggttcagcgaataagtcgtgacaagatgttagaagatattc

SEQ ID NO: 299055 - DNA, 44 bp, Artificial Sequence
  Description of Artificial Sequence: Synthetic oligonucleotide
tttggttcagcgaataagtcgtgacaagatgttagaagatattc

SEQ ID NO: 299056 - DNA, 43 bp, Artificial Sequence
  Description of Artificial Sequence: Synthetic oligonucleotide
ttggttcagcgaataagtcgtgacaagatgttagaagatattc

SEQ ID NO: 299057 - DNA, 42 bp, Artificial Sequence
  Description of Artificial Sequence: Synthetic oligonucleotide
tggttcagcgaataagtcgtgacaagatgttagaagatattc

SEQ ID NO: 299058 - DNA, 41 bp, Artificial Sequence
  Description of Artificial Sequence: Synthetic oligonucleotide
ggttcagcgaataagtcgtgacaagatgttagaagatattc

SEQ ID NO: 299059 - DNA, 41 bp, Artificial Sequence
  Description of Artificial Sequence: Synthetic oligonucleotide
gttcagcgaataagtcgtgacaagatgttagaagatattcc

SEQ ID NO: 299060 - DNA, 41 bp, Artificial Sequence
  Description of Artificial Sequence: Synthetic oligonucleotide
ttcagcgaataagtcgtgacaagatgttagaagatattccc

SEQ ID NO: 299061 - DNA, 40 bp, Artificial Sequence
  Description of Artificial Sequence: Synthetic oligonucleotide
tcagcgaataagtcgtgacaagatgttagaagatattccc

SEQ ID NO: 299062 - DNA, 39 bp, Artificial Sequence
  Description of Artificial Sequence: Synthetic oligonucleotide
cagcgaataagtcgtgacaagatgttagaagatattccc

SEQ ID NO: 299063 - DNA, 44 bp, Artificial Sequence
  Description of Artificial Sequence: Synthetic oligonucleotide
agcgaataagtcgtgacaagatgttagaagatattcccaaaaac

SEQ ID NO: 299064 - DNA, 43 bp, Artificial Sequence
  Description of Artificial Sequence: Synthetic oligonucleotide
gcgaataagtcgtgacaagatgttagaagatattcccaaaaac

SEQ ID NO: 299065 - DNA, 45 bp, Artificial Sequence
  Description of Artificial Sequence: Synthetic oligonucleotide
cgaataagtcgtgacaagatgttagaagatattcccaaaaacaag

SEQ ID NO: 299066 - DNA, 45 bp, Artificial Sequence
  Description of Artificial Sequence: Synthetic oligonucleotide
gaataagtcgtgacaagatgttagaagatattcccaaaaacaagg

SEQ ID NO: 299067 - DNA, 47 bp, Artificial Sequence
  Description of Artificial Sequence: Synthetic oligonucleotide
aataagtcgtgacaagatgttagaagatattcccaaaaacaaggatc

SEQ ID NO: 299068 - DNA, 46 bp, Artificial Sequence
  Description of Artificial Sequence: Synthetic oligonucleotide
ataagtcgtgacaagatgttagaagatattcccaaaaacaaggatc

SEQ ID NO: 299069 - DNA, 45 bp, Artificial Sequence
  Description of Artificial Sequence: Synthetic oligonucleotide
taagtcgtgacaagatgttagaagatattcccaaaaacaaggatc

SEQ ID NO: 299070 - DNA, 44 bp, Artificial Sequence
  Description of Artificial Sequence: Synthetic oligonucleotide
aagtcgtgacaagatgttagaagatattcccaaaaacaaggatc

SEQ ID NO: 299071 - DNA, 43 bp, Artificial Sequence
  Description of Artificial Sequence: Synthetic oligonucleotide
agtcgtgacaagatgttagaagatattcccaaaaacaaggatc

SEQ ID NO: 299072 - DNA, 42 bp, Artificial Sequence
  Description of Artificial Sequence: Synthetic oligonucleotide
gtcgtgacaagatgttagaagatattcccaaaaacaaggatc

SEQ ID NO: 299073 - DNA, 49 bp, Artificial Sequence
  Description of Artificial Sequence: Synthetic oligonucleotide
tcgtgacaagatgttagaagatattcccaaaaacaaggatcatttaaag

SEQ ID NO: 299074 - DNA, 48 bp, Artificial Sequence
  Description of Artificial Sequence: Synthetic oligonucleotide
cgtgacaagatgttagaagatattcccaaaaacaaggatcatttaaag

SEQ ID NO: 299075 - DNA, 48 bp, Artificial Sequence
  Description of Artificial Sequence: Synthetic oligonucleotide
gtgacaagatgttagaagatattcccaaaaacaaggatcatttaaagc

SEQ ID NO: 299076 - DNA, 54 bp, Artificial Sequence
  Description of Artificial Sequence: Synthetic oligonucleotide
tgacaagatgttagaagatattcccaaaaacaaggatcatttaaagctatttac

SEQ ID NO: 299077 - DNA, 53 bp, Artificial Sequence
  Description of Artificial Sequence: Synthetic oligonucleotide
gacaagatgttagaagatattcccaaaaacaaggatcatttaaagctatttac

SEQ ID NO: 299078 - DNA, 53 bp, Artificial Sequence
  Description of Artificial Sequence: Synthetic oligonucleotide
acaagatgttagaagatattcccaaaaacaaggatcatttaaagctatttacc

SEQ ID NO: 299079 - DNA, 52 bp, Artificial Sequence
  Description of Artificial Sequence: Synthetic oligonucleotide
caagatgttagaagatattcccaaaaacaaggatcatttaaagctatttacc

SEQ ID NO: 299080 - DNA, 53 bp, Artificial Sequence
  Description of Artificial Sequence: Synthetic oligonucleotide
aagatgttagaagatattcccaaaaacaaggatcatttaaagctatttaccac

SEQ ID NO: 299081 - DNA, 52 bp, Artificial Sequence
  Description of Artificial Sequence: Synthetic oligonucleotide
agatgttagaagatattcccaaaaacaaggatcatttaaagctatttaccac

SEQ ID NO: 299082 - DNA, 51 bp, Artificial Sequence
  Description of Artificial Sequence: Synthetic oligonucleotide
gatgttagaagatattcccaaaaacaaggatcatttaaagctatttaccac

SEQ ID NO: 299083 - DNA, 54 bp, Artificial Sequence
  Description of Artificial Sequence: Synthetic oligonucleotide
atgttagaagatattcccaaaaacaaggatcatttaaagctatttaccacattg

SEQ ID NO: 299084 - DNA, 53 bp, Artificial Sequence
  Description of Artificial Sequence: Synthetic oligonucleotide
tgttagaagatattcccaaaaacaaggatcatttaaagctatttaccacattg

SEQ ID NO: 299085 - DNA, 52 bp, Artificial Sequence
  Description of Artificial Sequence: Synthetic oligonucleotide
gttagaagatattcccaaaaacaaggatcatttaaagctatttaccacattg

SEQ ID NO: 299086 - DNA, 52 bp, Artificial Sequence
  Description of Artificial Sequence: Synthetic oligonucleotide
ttagaagatattcccaaaaacaaggatcatttaaagctatttaccacattgg

SEQ ID NO: 299087 - DNA, 51 bp, Artificial Sequence
  Description of Artificial Sequence: Synthetic oligonucleotide
tagaagatattcccaaaaacaaggatcatttaaagctatttaccacattgg

SEQ ID NO: 299088 - DNA, 50 bp, Artificial Sequence
  Description of Artificial Sequence: Synthetic oligonucleotide
agaagatattcccaaaaacaaggatcatttaaagctatttaccacattgg

SEQ ID NO: 299089 - DNA, 49 bp, Artificial Sequence
  Description of Artificial Sequence: Synthetic oligonucleotide
gaagatattcccaaaaacaaggatcatttaaagctatttaccacattgg

SEQ ID NO: 299090 - DNA, 50 bp, Artificial Sequence
  Description of Artificial Sequence: Synthetic oligonucleotide
aagatattcccaaaaacaaggatcatttaaagctatttaccacattggag

SEQ ID NO: 299091 - DNA, 49 bp, Artificial Sequence
  Description of Artificial Sequence: Synthetic oligonucleotide
agatattcccaaaaacaaggatcatttaaagctatttaccacattggag

SEQ ID NO: 299092 - DNA, 48 bp, Artificial Sequence
  Description of Artificial Sequence: Synthetic oligonucleotide
gatattcccaaaaacaaggatcatttaaagctatttaccacattggag

SEQ ID NO: 299093 - DNA, 50 bp, Artificial Sequence
  Description of Artificial Sequence: Synthetic oligonucleotide
atattcccaaaaacaaggatcatttaaagctatttaccacattggagttg

SEQ ID NO: 299094 - DNA, 49 bp, Artificial Sequence
  Description of Artificial Sequence: Synthetic oligonucleotide
tattcccaaaaacaaggatcatttaaagctatttaccacattggagttg

SEQ ID NO: 299095 - DNA, 48 bp, Artificial Sequence
  Description of Artificial Sequence: Synthetic oligonucleotide
attcccaaaaacaaggatcatttaaagctatttaccacattggagttg

SEQ ID NO: 299096 - DNA, 47 bp, Artificial Sequence
  Description of Artificial Sequence: Synthetic oligonucleotide
ttcccaaaaacaaggatcatttaaagctatttaccacattggagttg

SEQ ID NO: 299097 - DNA, 46 bp, Artificial Sequence
  Description of Artificial Sequence: Synthetic oligonucleotide
tcccaaaaacaaggatcatttaaagctatttaccacattggagttg

SEQ ID NO: 299098 - DNA, 45 bp, Artificial Sequence
  Description of Artificial Sequence: Synthetic oligonucleotide
cccaaaaacaaggatcatttaaagctatttaccacattggagttg

SEQ ID NO: 299099 - DNA, 47 bp, Artificial Sequence
  Description of Artificial Sequence: Synthetic oligonucleotide
ccaaaaacaaggatcatttaaagctatttaccacattggagttgaag

SEQ ID NO: 299100 - DNA, 47 bp, Artificial Sequence
  Description of Artificial Sequence: Synthetic oligonucleotide
caaaaacaaggatcatttaaagctatttaccacattggagttgaagc

SEQ ID NO: 299101 - DNA, 47 bp, Artificial Sequence
  Description of Artificial Sequence: Synthetic oligonucleotide
aaaaacaaggatcatttaaagctatttaccacattggagttgaagcg

SEQ ID NO: 299102 - DNA, 46 bp, Artificial Sequence
  Description of Artificial Sequence: Synthetic oligonucleotide
aaaacaaggatcatttaaagctatttaccacattggagttgaagcg

SEQ ID NO: 299103 - DNA, 45 bp, Artificial Sequence
  Description of Artificial Sequence: Synthetic oligonucleotide
aaacaaggatcatttaaagctatttaccacattggagttgaagcg

SEQ ID NO: 299104 - DNA, 44 bp, Artificial Sequence
  Description of Artificial Sequence: Synthetic oligonucleotide
aacaaggatcatttaaagctatttaccacattggagttgaagcg

SEQ ID NO: 299105 - DNA, 43 bp, Artificial Sequence
  Description of Artificial Sequence: Synthetic oligonucleotide
acaaggatcatttaaagctatttaccacattggagttgaagcg

SEQ ID NO: 299106 - DNA, 42 bp, Artificial Sequence
  Description of Artificial Sequence: Synthetic oligonucleotide
caaggatcatttaaagctatttaccacattggagttgaagcg

SEQ ID NO: 299107 - DNA, 44 bp, Artificial Sequence
  Description of Artificial Sequence: Synthetic oligonucleotide
aaggatcatttaaagctatttaccacattggagttgaagcgttg

SEQ ID NO: 299108 - DNA, 43 bp, Artificial Sequence
  Description of Artificial Sequence: Synthetic oligonucleotide
aggatcatttaaagctatttaccacattggagttgaagcgttg

SEQ ID NO: 299109 - DNA, 42 bp, Artificial Sequence
  Description of Artificial Sequence: Synthetic oligonucleotide
ggatcatttaaagctatttaccacattggagttgaagcgttg

SEQ ID NO: 299110 - DNA, 42 bp, Artificial Sequence
  Description of Artificial Sequence: Synthetic oligonucleotide
gatcatttaaagctatttaccacattggagttgaagcgttgg

SEQ ID NO: 299111 - DNA, 43 bp, Artificial Sequence
  Description of Artificial Sequence: Synthetic oligonucleotide
atcatttaaagctatttaccacattggagttgaagcgttggtc

SEQ ID NO: 299112 - DNA, 42 bp, Artificial Sequence
  Description of Artificial Sequence: Synthetic oligonucleotide
tcatttaaagctatttaccacattggagttgaagcgttggtc

SEQ ID NO: 299113 - DNA, 41 bp, Artificial Sequence
  Description of Artificial Sequence: Synthetic oligonucleotide
catttaaagctatttaccacattggagttgaagcgttggtc

SEQ ID NO: 299114 - DNA, 41 bp, Artificial Sequence
  Description of Artificial Sequence: Synthetic oligonucleotide
atttaaagctatttaccacattggagttgaagcgttggtcg

SEQ ID NO: 299115 - DNA, 40 bp, Artificial Sequence
  Description of Artificial Sequence: Synthetic oligonucleotide
tttaaagctatttaccacattggagttgaagcgttggtcg

SEQ ID NO: 299116 - DNA, 39 bp, Artificial Sequence
  Description of Artificial Sequence: Synthetic oligonucleotide
ttaaagctatttaccacattggagttgaagcgttggtcg

SEQ ID NO: 299117 - DNA, 38 bp, Artificial Sequence
  Description of Artificial Sequence: Synthetic oligonucleotide
taaagctatttaccacattggagttgaagcgttggtcg

SEQ ID NO: 299118 - DNA, 37 bp, Artificial Sequence
  Description of Artificial Sequence: Synthetic oligonucleotide
aaagctatttaccacattggagttgaagcgttggtcg

SEQ ID NO: 299119 - DNA, 36 bp, Artificial Sequence
  Description of Artificial Sequence: Synthetic oligonucleotide
aagctatttaccacattggagttgaagcgttggtcg

SEQ ID NO: 299120 - DNA, 35 bp, Artificial Sequence
  Description of Artificial Sequence: Synthetic oligonucleotide
agctatttaccacattggagttgaagcgttggtcg

SEQ ID NO: 299121 - DNA, 34 bp, Artificial Sequence
  Description of Artificial Sequence: Synthetic oligonucleotide
gctatttaccacattggagttgaagcgttggtcg

SEQ ID NO: 299122 - DNA, 35 bp, Artificial Sequence
  Description of Artificial Sequence: Synthetic oligonucleotide
ctatttaccacattggagttgaagcgttggtcgac

SEQ ID NO: 299123 - DNA, 36 bp, Artificial Sequence
  Description of Artificial Sequence: Synthetic oligonucleotide
tatttaccacattggagttgaagcgttggtcgacac

SEQ ID NO: 299124 - DNA, 35 bp, Artificial Sequence
  Description of Artificial Sequence: Synthetic oligonucleotide
atttaccacattggagttgaagcgttggtcgacac

SEQ ID NO: 299125 - DNA, 34 bp, Artificial Sequence
  Description of Artificial Sequence: Synthetic oligonucleotide
tttaccacattggagttgaagcgttggtcgacac

SEQ ID NO: 299126 - DNA, 33 bp, Artificial Sequence
  Description of Artificial Sequence: Synthetic oligonucleotide
ttaccacattggagttgaagcgttggtcgacac

SEQ ID NO: 299127 - DNA, 32 bp, Artificial Sequence
  Description of Artificial Sequence: Synthetic oligonucleotide
taccacattggagttgaagcgttggtcgacac

SEQ ID NO: 299128 - DNA, 31 bp, Artificial Sequence
  Description of Artificial Sequence: Synthetic oligonucleotide
accacattggagttgaagcgttggtcgacac

SEQ ID NO: 299129 - DNA, 30 bp, Artificial Sequence
  Description of Artificial Sequence: Synthetic oligonucleotide
ccacattggagttgaagcgttggtcgacac

SEQ ID NO: 299130 - DNA, 32 bp, Artificial Sequence
  Description of Artificial Sequence: Synthetic oligonucleotide
cacattggagttgaagcgttggtcgacacttg

SEQ ID NO: 299131 - DNA, 34 bp, Artificial Sequence
  Description of Artificial Sequence: Synthetic oligonucleotide
acattggagttgaagcgttggtcgacacttgttc

SEQ ID NO: 299132 - DNA, 33 bp, Artificial Sequence
  Description of Artificial Sequence: Synthetic oligonucleotide
cattggagttgaagcgttggtcgacacttgttc

SEQ ID NO: 299133 - DNA, 34 bp, Artificial Sequence
  Description of Artificial Sequence: Synthetic oligonucleotide
attggagttgaagcgttggtcgacacttgttcag

SEQ ID NO: 299134 - DNA, 33 bp, Artificial Sequence
  Description of Artificial Sequence: Synthetic oligonucleotide
ttggagttgaagcgttggtcgacacttgttcag

SEQ ID NO: 299135 - DNA, 32 bp, Artificial Sequence
  Description of Artificial Sequence: Synthetic oligonucleotide
tggagttgaagcgttggtcgacacttgttcag

SEQ ID NO: 299136 - DNA, 31 bp, Artificial Sequence
  Description of Artificial Sequence: Synthetic oligonucleotide
ggagttgaagcgttggtcgacacttgttcag

SEQ ID NO: 299137 - DNA, 31 bp, Artificial Sequence
  Description of Artificial Sequence: Synthetic oligonucleotide
gagttgaagcgttggtcgacacttgttcagg

SEQ ID NO: 299138 - DNA, 32 bp, Artificial Sequence
  Description of Artificial Sequence: Synthetic oligonucleotide
agttgaagcgttggtcgacacttgttcaggac

SEQ ID NO: 299139 - DNA, 31 bp, Artificial Sequence
  Description of Artificial Sequence: Synthetic oligonucleotide
gttgaagcgttggtcgacacttgttcaggac

SEQ ID NO: 299140 - DNA, 34 bp, Artificial Sequence
  Description of Artificial Sequence: Synthetic oligonucleotide
ttgaagcgttggtcgacacttgttcaggactatg

SEQ ID NO: 299141 - DNA, 33 bp, Artificial Sequence
  Description of Artificial Sequence: Synthetic oligonucleotide
tgaagcgttggtcgacacttgttcaggactatg

SEQ ID NO: 299142 - DNA, 32 bp, Artificial Sequence
  Description of Artificial Sequence: Synthetic oligonucleotide
gaagcgttggtcgacacttgttcaggactatg

SEQ ID NO: 299143 - DNA, 32 bp, Artificial Sequence
  Description of Artificial Sequence: Synthetic oligonucleotide
aagcgttggtcgacacttgttcaggactatgc

SEQ ID NO: 299144 - DNA, 31 bp, Artificial Sequence
  Description of Artificial Sequence: Synthetic oligonucleotide
agcgttggtcgacacttgttcaggactatgc

SEQ ID NO: 299145 - DNA, 30 bp, Artificial Sequence
  Description of Artificial Sequence: Synthetic oligonucleotide
gcgttggtcgacacttgttcaggactatgc

SEQ ID NO: 299146 - DNA, 33 bp, Artificial Sequence
  Description of Artificial Sequence: Synthetic oligonucleotide
cgttggtcgacacttgttcaggactatgcaatg

SEQ ID NO: 299147 - DNA, 33 bp, Artificial Sequence
  Description of Artificial Sequence: Synthetic oligonucleotide
gttggtcgacacttgttcaggactatgcaatgg

SEQ ID NO: 299148 - DNA, 39 bp, Artificial Sequence
  Description of Artificial Sequence: Synthetic oligonucleotide
ttggtcgacacttgttcaggactatgcaatggaatttag

SEQ ID NO: 299149 - DNA, 38 bp, Artificial Sequence
  Description of Artificial Sequence: Synthetic oligonucleotide
tggtcgacacttgttcaggactatgcaatggaatttag

SEQ ID NO: 299150 - DNA, 37 bp, Artificial Sequence
  Description of Artificial Sequence: Synthetic oligonucleotide
ggtcgacacttgttcaggactatgcaatggaatttag

SEQ ID NO: 299151 - DNA, 41 bp, Artificial Sequence
  Description of Artificial Sequence: Synthetic oligonucleotide
gtcgacacttgttcaggactatgcaatggaatttagaaaag

SEQ ID NO: 299152 - DNA, 41 bp, Artificial Sequence
  Description of Artificial Sequence: Synthetic oligonucleotide
tcgacacttgttcaggactatgcaatggaatttagaaaagg

SEQ ID NO: 299153 - DNA, 40 bp, Artificial Sequence
  Description of Artificial Sequence: Synthetic oligonucleotide
cgacacttgttcaggactatgcaatggaatttagaaaagg

SEQ ID NO: 299154 - DNA, 42 bp, Artificial Sequence
  Description of Artificial Sequence: Synthetic oligonucleotide
gacacttgttcaggactatgcaatggaatttagaaaaggtac

SEQ ID NO: 299155 - DNA, 42 bp, Artificial Sequence
  Description of Artificial Sequence: Synthetic oligonucleotide
acacttgttcaggactatgcaatggaatttagaaaaggtacc

SEQ ID NO: 299156 - DNA, 41 bp, Artificial Sequence
  Description of Artificial Sequence: Synthetic oligonucleotide
cacttgttcaggactatgcaatggaatttagaaaaggtacc

SEQ ID NO: 299157 - DNA, 41 bp, Artificial Sequence
  Description of Artificial Sequence: Synthetic oligonucleotide
acttgttcaggactatgcaatggaatttagaaaaggtaccc

SEQ ID NO: 299158 - DNA, 40 bp, Artificial Sequence
  Description of Artificial Sequence: Synthetic oligonucleotide
cttgttcaggactatgcaatggaatttagaaaaggtaccc

SEQ ID NO: 299159 - DNA, 42 bp, Artificial Sequence
  Description of Artificial Sequence: Synthetic oligonucleotide
ttgttcaggactatgcaatggaatttagaaaaggtacccttg

SEQ ID NO: 299160 - DNA, 41 bp, Artificial Sequence
  Description of Artificial Sequence: Synthetic oligonucleotide
tgttcaggactatgcaatggaatttagaaaaggtacccttg

SEQ ID NO: 299161 - DNA, 40 bp, Artificial Sequence
  Description of Artificial Sequence: Synthetic oligonucleotide
gttcaggactatgcaatggaatttagaaaaggtacccttg

SEQ ID NO: 299162 - DNA, 41 bp, Artificial Sequence
  Description of Artificial Sequence: Synthetic oligonucleotide
ttcaggactatgcaatggaatttagaaaaggtacccttgag

SEQ ID NO: 299163 - DNA, 40 bp, Artificial Sequence
  Description of Artificial Sequence: Synthetic oligonucleotide
tcaggactatgcaatggaatttagaaaaggtacccttgag

SEQ ID NO: 299164 - DNA, 39 bp, Artificial Sequence
  Description of Artificial Sequence: Synthetic oligonucleotide
caggactatgcaatggaatttagaaaaggtacccttgag

SEQ ID NO: 299165 - DNA, 40 bp, Artificial Sequence
  Description of Artificial Sequence: Synthetic oligonucleotide
aggactatgcaatggaatttagaaaaggtacccttgagac

SEQ ID NO: 299166 - DNA, 39 bp, Artificial Sequence
  Description of Artificial Sequence: Synthetic oligonucleotide
ggactatgcaatggaatttagaaaaggtacccttgagac

SEQ ID NO: 299167 - DNA, 40 bp, Artificial Sequence
  Description of Artificial Sequence: Synthetic oligonucleotide
gactatgcaatggaatttagaaaaggtacccttgagactc

SEQ ID NO: 299168 - DNA, 40 bp, Artificial Sequence
  Description of Artificial Sequence: Synthetic oligonucleotide
actatgcaatggaatttagaaaaggtacccttgagactcc

SEQ ID NO: 299169 - DNA, 39 bp, Artificial Sequence
  Description of Artificial Sequence: Synthetic oligonucleotide
ctatgcaatggaatttagaaaaggtacccttgagactcc

SEQ ID NO: 299170 - DNA, 40 bp, Artificial Sequence
  Description of Artificial Sequence: Synthetic oligonucleotide
tatgcaatggaatttagaaaaggtacccttgagactcctg

SEQ ID NO: 299171 - DNA, 39 bp, Artificial Sequence
  Description of Artificial Sequence: Synthetic oligonucleotide
atgcaatggaatttagaaaaggtacccttgagactcctg

SEQ ID NO: 299172 - DNA, 38 bp, Artificial Sequence
  Description of Artificial Sequence: Synthetic oligonucleotide
tgcaatggaatttagaaaaggtacccttgagactcctg

SEQ ID NO: 299173 - DNA, 37 bp, Artificial Sequence
  Description of Artificial Sequence: Synthetic oligonucleotide
gcaatggaatttagaaaaggtacccttgagactcctg

SEQ ID NO: 299174 - DNA, 37 bp, Artificial Sequence
  Description of Artificial Sequence: Synthetic oligonucleotide
caatggaatttagaaaaggtacccttgagactcctgc

SEQ ID NO: 299175 - DNA, 39 bp, Artificial Sequence
  Description of Artificial Sequence: Synthetic oligonucleotide
aatggaatttagaaaaggtacccttgagactcctgcaac

SEQ ID NO: 299176 - DNA, 38 bp, Artificial Sequence
  Description of Artificial Sequence: Synthetic oligonucleotide
atggaatttagaaaaggtacccttgagactcctgcaac

SEQ ID NO: 299177 - DNA, 37 bp, Artificial Sequence
  Description of Artificial Sequence: Synthetic oligonucleotide
tggaatttagaaaaggtacccttgagactcctgcaac

SEQ ID NO: 299178 - DNA, 36 bp, Artificial Sequence
  Description of Artificial Sequence: Synthetic oligonucleotide
ggaatttagaaaaggtacccttgagactcctgcaac

SEQ ID NO: 299179 - DNA, 36 bp, Artificial Sequence
  Description of Artificial Sequence: Synthetic oligonucleotide
gaatttagaaaaggtacccttgagactcctgcaacc

SEQ ID NO: 299180 - DNA, 36 bp, Artificial Sequence
  Description of Artificial Sequence: Synthetic oligonucleotide
aatttagaaaaggtacccttgagactcctgcaaccg

SEQ ID NO: 299181 - DNA, 35 bp, Artificial Sequence
  Description of Artificial Sequence: Synthetic oligonucleotide
atttagaaaaggtacccttgagactcctgcaaccg

SEQ ID NO: 299182 - DNA, 34 bp, Artificial Sequence
  Description of Artificial Sequence: Synthetic oligonucleotide
tttagaaaaggtacccttgagactcctgcaaccg

SEQ ID NO: 299183 - DNA, 33 bp, Artificial Sequence
  Description of Artificial Sequence: Synthetic oligonucleotide
ttagaaaaggtacccttgagactcctgcaaccg

SEQ ID NO: 299184 - DNA, 32 bp, Artificial Sequence
  Description of Artificial Sequence: Synthetic oligonucleotide
tagaaaaggtacccttgagactcctgcaaccg

SEQ ID NO: 299185 - DNA, 31 bp, Artificial Sequence
  Description of Artificial Sequence: Synthetic oligonucleotide
agaaaaggtacccttgagactcctgcaaccg

SEQ ID NO: 299186 - DNA, 30 bp, Artificial Sequence
  Description of Artificial Sequence: Synthetic oligonucleotide
gaaaaggtacccttgagactcctgcaaccg

SEQ ID NO: 299187 - DNA, 32 bp, Artificial Sequence
  Description of Artificial Sequence: Synthetic oligonucleotide
aaaaggtacccttgagactcctgcaaccgatg

SEQ ID NO: 299188 - DNA, 31 bp, Artificial Sequence
  Description of Artificial Sequence: Synthetic oligonucleotide
aaaggtacccttgagactcctgcaaccgatg

SEQ ID NO: 299189 - DNA, 30 bp, Artificial Sequence
  Description of Artificial Sequence: Synthetic oligonucleotide
aaggtacccttgagactcctgcaaccgatg

SEQ ID NO: 299190 - DNA, 29 bp, Artificial Sequence
  Description of Artificial Sequence: Synthetic oligonucleotide
aggtacccttgagactcctgcaaccgatg

SEQ ID NO: 299191 - DNA, 28 bp, Artificial Sequence
  Description of Artificial Sequence: Synthetic oligonucleotide
ggtacccttgagactcctgcaaccgatg

SEQ ID NO: 299192 - DNA, 33 bp, Artificial Sequence
  Description of Artificial Sequence: Synthetic oligonucleotide
gtacccttgagactcctgcaaccgatgtttttc

SEQ ID NO: 299193 - DNA, 33 bp, Artificial Sequence
  Description of Artificial Sequence: Synthetic oligonucleotide
tacccttgagactcctgcaaccgatgtttttcg

SEQ ID NO: 299194 - DNA, 32 bp, Artificial Sequence
  Description of Artificial Sequence: Synthetic oligonucleotide
acccttgagactcctgcaaccgatgtttttcg

SEQ ID NO: 299195 - DNA, 31 bp, Artificial Sequence
  Description of Artificial Sequence: Synthetic oligonucleotide
cccttgagactcctgcaaccgatgtttttcg

SEQ ID NO: 299196 - DNA, 33 bp, Artificial Sequence
  Description of Artificial Sequence: Synthetic oligonucleotide
ccttgagactcctgcaaccgatgtttttcgttc

SEQ ID NO: 299197 - DNA, 35 bp, Artificial Sequence
  Description of Artificial Sequence: Synthetic oligonucleotide
cttgagactcctgcaaccgatgtttttcgttctac

SEQ ID NO: 299198 - DNA, 36 bp, Artificial Sequence
  Description of Artificial Sequence: Synthetic oligonucleotide
ttgagactcctgcaaccgatgtttttcgttctacag

SEQ ID NO: 299199 - DNA, 35 bp, Artificial Sequence
  Description of Artificial Sequence: Synthetic oligonucleotide
tgagactcctgcaaccgatgtttttcgttctacag

SEQ ID NO: 299200 - DNA, 34 bp, Artificial Sequence
  Description of Artificial Sequence: Synthetic oligonucleotide
gagactcctgcaaccgatgtttttcgttctacag

SEQ ID NO: 299201 - DNA, 35 bp, Artificial Sequence
  Description of Artificial Sequence: Synthetic oligonucleotide
agactcctgcaaccgatgtttttcgttctacagtg

SEQ ID NO: 299202 - DNA, 34 bp, Artificial Sequence
  Description of Artificial Sequence: Synthetic oligonucleotide
gactcctgcaaccgatgtttttcgttctacagtg

SEQ ID NO: 299203 - DNA, 34 bp, Artificial Sequence
  Description of Artificial Sequence: Synthetic oligonucleotide
actcctgcaaccgatgtttttcgttctacagtgg

SEQ ID NO: 299204 - DNA, 33 bp, Artificial Sequence
  Description of Artificial Sequence: Synthetic oligonucleotide
ctcctgcaaccgatgtttttcgttctacagtgg

SEQ ID NO: 299205 - DNA, 35 bp, Artificial Sequence
  Description of Artificial Sequence: Synthetic oligonucleotide
tcctgcaaccgatgtttttcgttctacagtggaag

SEQ ID NO: 299206 - DNA, 34 bp, Artificial Sequence
  Description of Artificial Sequence: Synthetic oligonucleotide
cctgcaaccgatgtttttcgttctacagtggaag

SEQ ID NO: 299207 - DNA, 34 bp, Artificial Sequence
  Description of Artificial Sequence: Synthetic oligonucleotide
ctgcaaccgatgtttttcgttctacagtggaagg

SEQ ID NO: 299208 - DNA, 35 bp, Artificial Sequence
  Description of Artificial Sequence: Synthetic oligonucleotide
tgcaaccgatgtttttcgttctacagtggaaggtg

SEQ ID NO: 299209 - DNA, 34 bp, Artificial Sequence
  Description of Artificial Sequence: Synthetic oligonucleotide
gcaaccgatgtttttcgttctacagtggaaggtg

SEQ ID NO: 299210 - DNA, 40 bp, Artificial Sequence
  Description of Artificial Sequence: Synthetic oligonucleotide
caaccgatgtttttcgttctacagtggaaggtgataaaag

SEQ ID NO: 299211 - DNA, 40 bp, Artificial Sequence
  Description of Artificial Sequence: Synthetic oligonucleotide
aaccgatgtttttcgttctacagtggaaggtgataaaagg

SEQ ID NO: 299212 - DNA, 39 bp, Artificial Sequence
  Description of Artificial Sequence: Synthetic oligonucleotide
accgatgtttttcgttctacagtggaaggtgataaaagg

SEQ ID NO: 299213 - DNA, 38 bp, Artificial Sequence
  Description of Artificial Sequence: Synthetic oligonucleotide
ccgatgtttttcgttctacagtggaaggtgataaaagg

SEQ ID NO: 299214 - DNA, 39 bp, Artificial Sequence
  Description of Artificial Sequence: Synthetic oligonucleotide
cgatgtttttcgttctacagtggaaggtgataaaaggtg

SEQ ID NO: 299215 - DNA, 39 bp, Artificial Sequence
  Description of Artificial Sequence: Synthetic oligonucleotide
gatgtttttcgttctacagtggaaggtgataaaaggtgg

SEQ ID NO: 299216 - DNA, 42 bp, Artificial Sequence
  Description of Artificial Sequence: Synthetic oligonucleotide
atgtttttcgttctacagtggaaggtgataaaaggtggtaag

SEQ ID NO: 299217 - DNA, 41 bp, Artificial Sequence
  Description of Artificial Sequence: Synthetic oligonucleotide
tgtttttcgttctacagtggaaggtgataaaaggtggtaag

SEQ ID NO: 299218 - DNA, 40 bp, Artificial Sequence
  Description of Artificial Sequence: Synthetic oligonucleotide
gtttttcgttctacagtggaaggtgataaaaggtggtaag

SEQ ID NO: 299219 - DNA, 41 bp, Artificial Sequence
  Description of Artificial Sequence: Synthetic oligonucleotide
tttttcgttctacagtggaaggtgataaaaggtggtaagac

SEQ ID NO: 299220 - DNA, 40 bp, Artificial Sequence
  Description of Artificial Sequence: Synthetic oligonucleotide
ttttcgttctacagtggaaggtgataaaaggtggtaagac

SEQ ID NO: 299221 - DNA, 39 bp, Artificial Sequence
  Description of Artificial Sequence: Synthetic oligonucleotide
tttcgttctacagtggaaggtgataaaaggtggtaagac

SEQ ID NO: 299222 - DNA, 38 bp, Artificial Sequence
  Description of Artificial Sequence: Synthetic oligonucleotide
ttcgttctacagtggaaggtgataaaaggtggtaagac

SEQ ID NO: 299223 - DNA, 37 bp, Artificial Sequence
  Description of Artificial Sequence: Synthetic oligonucleotide
tcgttctacagtggaaggtgataaaaggtggtaagac

SEQ ID NO: 299224 - DNA, 36 bp, Artificial Sequence
  Description of Artificial Sequence: Synthetic oligonucleotide
cgttctacagtggaaggtgataaaaggtggtaagac

SEQ ID NO: 299225 - DNA, 38 bp, Artificial Sequence
  Description of Artificial Sequence: Synthetic oligonucleotide
gttctacagtggaaggtgataaaaggtggtaagacttg

SEQ ID NO: 299226 - DNA, 40 bp, Artificial Sequence
  Description of Artificial Sequence: Synthetic oligonucleotide
ttctacagtggaaggtgataaaaggtggtaagacttgatg

SEQ ID NO: 299227 - DNA, 39 bp, Artificial Sequence
  Description of Artificial Sequence: Synthetic oligonucleotide
tctacagtggaaggtgataaaaggtggtaagacttgatg

SEQ ID NO: 299228 - DNA, 38 bp, Artificial Sequence
  Description of Artificial Sequence: Synthetic oligonucleotide
ctacagtggaaggtgataaaaggtggtaagacttgatg

SEQ ID NO: 299229 - DNA, 40 bp, Artificial Sequence
  Description of Artificial Sequence: Synthetic oligonucleotide
tacagtggaaggtgataaaaggtggtaagacttgatgaac

SEQ ID NO: 299230 - DNA, 39 bp, Artificial Sequence
  Description of Artificial Sequence: Synthetic oligonucleotide
acagtggaaggtgataaaaggtggtaagacttgatgaac

SEQ ID NO: 299231 - DNA, 38 bp, Artificial Sequence
  Description of Artificial Sequence: Synthetic oligonucleotide
cagtggaaggtgataaaaggtggtaagacttgatgaac

SEQ ID NO: 299232 - DNA, 39 bp, Artificial Sequence
  Description of Artificial Sequence: Synthetic oligonucleotide
agtggaaggtgataaaaggtggtaagacttgatgaacag

SEQ ID NO: 299233 - DNA, 38 bp, Artificial Sequence
  Description of Artificial Sequence: Synthetic oligonucleotide
gtggaaggtgataaaaggtggtaagacttgatgaacag

SEQ ID NO: 299234 - DNA, 39 bp, Artificial Sequence
  Description of Artificial Sequence: Synthetic oligonucleotide
tggaaggtgataaaaggtggtaagacttgatgaacagag

SEQ ID NO: 299235 - DNA, 38 bp, Artificial Sequence
  Description of Artificial Sequence: Synthetic oligonucleotide
ggaaggtgataaaaggtggtaagacttgatgaacagag

SEQ ID NO: 299236 - DNA, 40 bp, Artificial Sequence
  Description of Artificial Sequence: Synthetic oligonucleotide
gaaggtgataaaaggtggtaagacttgatgaacagagtag

SEQ ID NO: 299237 - DNA, 42 bp, Artificial Sequence
  Description of Artificial Sequence: Synthetic oligonucleotide
aaggtgataaaaggtggtaagacttgatgaacagagtagttg

SEQ ID NO: 299238 - DNA, 41 bp, Artificial Sequence
  Description of Artificial Sequence: Synthetic oligonucleotide
aggtgataaaaggtggtaagacttgatgaacagagtagttg

SEQ ID NO: 299239 - DNA, 40 bp, Artificial Sequence
  Description of Artificial Sequence: Synthetic oligonucleotide
ggtgataaaaggtggtaagacttgatgaacagagtagttg

SEQ ID NO: 299240 - DNA, 42 bp, Artificial Sequence
  Description of Artificial Sequence: Synthetic oligonucleotide
gtgataaaaggtggtaagacttgatgaacagagtagttgaac

SEQ ID NO: 299241 - DNA, 51 bp, Artificial Sequence
  Description of Artificial Sequence: Synthetic oligonucleotide
tgataaaaggtggtaagacttgatgaacagagtagttgaacattatattag

SEQ ID NO: 299242 - DNA, 50 bp, Artificial Sequence
  Description of Artificial Sequence: Synthetic oligonucleotide
gataaaaggtggtaagacttgatgaacagagtagttgaacattatattag

SEQ ID NO: 299243 - DNA, 56 bp, Artificial Sequence
  Description of Artificial Sequence: Synthetic oligonucleotide
ataaaaggtggtaagacttgatgaacagagtagttgaacattatattagaaaaatg

SEQ ID NO: 299244 - DNA, 55 bp, Artificial Sequence
  Description of Artificial Sequence: Synthetic oligonucleotide
taaaaggtggtaagacttgatgaacagagtagttgaacattatattagaaaaatg

SEQ ID NO: 299245 - DNA, 54 bp, Artificial Sequence
  Description of Artificial Sequence: Synthetic oligonucleotide
aaaaggtggtaagacttgatgaacagagtagttgaacattatattagaaaaatg

SEQ ID NO: 299246 - DNA, 53 bp, Artificial Sequence
  Description of Artificial Sequence: Synthetic oligonucleotide
aaaggtggtaagacttgatgaacagagtagttgaacattatattagaaaaatg

SEQ ID NO: 299247 - DNA, 52 bp, Artificial Sequence
  Description of Artificial Sequence: Synthetic oligonucleotide
aaggtggtaagacttgatgaacagagtagttgaacattatattagaaaaatg

SEQ ID NO: 299248 - DNA, 51 bp, Artificial Sequence
  Description of Artificial Sequence: Synthetic oligonucleotide
aggtggtaagacttgatgaacagagtagttgaacattatattagaaaaatg

SEQ ID NO: 299249 - DNA, 50 bp, Artificial Sequence
  Description of Artificial Sequence: Synthetic oligonucleotide
ggtggtaagacttgatgaacagagtagttgaacattatattagaaaaatg

SEQ ID NO: 299250 - DNA, 50 bp, Artificial Sequence
  Description of Artificial Sequence: Synthetic oligonucleotide
gtggtaagacttgatgaacagagtagttgaacattatattagaaaaatgg

SEQ ID NO: 299251 - DNA, 50 bp, Artificial Sequence
  Description of Artificial Sequence: Synthetic oligonucleotide
tggtaagacttgatgaacagagtagttgaacattatattagaaaaatggc

SEQ ID NO: 299252 - DNA, 49 bp, Artificial Sequence
  Description of Artificial Sequence: Synthetic oligonucleotide
ggtaagacttgatgaacagagtagttgaacattatattagaaaaatggc

SEQ ID NO: 299253 - DNA, 49 bp, Artificial Sequence
  Description of Artificial Sequence: Synthetic oligonucleotide
gtaagacttgatgaacagagtagttgaacattatattagaaaaatggcc

SEQ ID NO: 299254 - DNA, 51 bp, Artificial Sequence
  Description of Artificial Sequence: Synthetic oligonucleotide
taagacttgatgaacagagtagttgaacattatattagaaaaatggccaac

SEQ ID NO: 299255 - DNA, 50 bp, Artificial Sequence
  Description of Artificial Sequence: Synthetic oligonucleotide
aagacttgatgaacagagtagttgaacattatattagaaaaatggccaac

SEQ ID NO: 299256 - DNA, 49 bp, Artificial Sequence
  Description of Artificial Sequence: Synthetic oligonucleotide
agacttgatgaacagagtagttgaacattatattagaaaaatggccaac

SEQ ID NO: 299257 - DNA, 48 bp, Artificial Sequence
  Description of Artificial Sequence: Synthetic oligonucleotide
gacttgatgaacagagtagttgaacattatattagaaaaatggccaac

SEQ ID NO: 299258 - DNA, 55 bp, Artificial Sequence
  Description of Artificial Sequence: Synthetic oligonucleotide
acttgatgaacagagtagttgaacattatattagaaaaatggccaactattatac

SEQ ID NO: 299259 - DNA, 54 bp, Artificial Sequence
  Description of Artificial Sequence: Synthetic oligonucleotide
cttgatgaacagagtagttgaacattatattagaaaaatggccaactattatac

SEQ ID NO: 299260 - DNA, 55 bp, Artificial Sequence
  Description of Artificial Sequence: Synthetic oligonucleotide
ttgatgaacagagtagttgaacattatattagaaaaatggccaactattatactg

SEQ ID NO: 299261 - DNA, 54 bp, Artificial Sequence
  Description of Artificial Sequence: Synthetic oligonucleotide
tgatgaacagagtagttgaacattatattagaaaaatggccaactattatactg

SEQ ID NO: 299262 - DNA, 53 bp, Artificial Sequence
  Description of Artificial Sequence: Synthetic oligonucleotide
gatgaacagagtagttgaacattatattagaaaaatggccaactattatactg

SEQ ID NO: 299263 - DNA, 53 bp, Artificial Sequence
  Description of Artificial Sequence: Synthetic oligonucleotide
atgaacagagtagttgaacattatattagaaaaatggccaactattatactgg

SEQ ID NO: 299264 - DNA, 52 bp, Artificial Sequence
  Description of Artificial Sequence: Synthetic oligonucleotide
tgaacagagtagttgaacattatattagaaaaatggccaactattatactgg

SEQ ID NO: 299265 - DNA, 51 bp, Artificial Sequence
  Description of Artificial Sequence: Synthetic oligonucleotide
gaacagagtagttgaacattatattagaaaaatggccaactattatactgg

SEQ ID NO: 299266 - DNA, 51 bp, Artificial Sequence
  Description of Artificial Sequence: Synthetic oligonucleotide
aacagagtagttgaacattatattagaaaaatggccaactattatactggg

SEQ ID NO: 299267 - DNA, 50 bp, Artificial Sequence
  Description of Artificial Sequence: Synthetic oligonucleotide
acagagtagttgaacattatattagaaaaatggccaactattatactggg

SEQ ID NO: 299268 - DNA, 49 bp, Artificial Sequence
  Description of Artificial Sequence: Synthetic oligonucleotide
cagagtagttgaacattatattagaaaaatggccaactattatactggg

SEQ ID NO: 299269 - DNA, 53 bp, Artificial Sequence
  Description of Artificial Sequence: Synthetic oligonucleotide
agagtagttgaacattatattagaaaaatggccaactattatactgggataac

SEQ ID NO: 299270 - DNA, 52 bp, Artificial Sequence
  Description of Artificial Sequence: Synthetic oligonucleotide
gagtagttgaacattatattagaaaaatggccaactattatactgggataac

SEQ ID NO: 299271 - DNA, 55 bp, Artificial Sequence
  Description of Artificial Sequence: Synthetic oligonucleotide
agtagttgaacattatattagaaaaatggccaactattatactgggataacaaag

SEQ ID NO: 299272 - DNA, 54 bp, Artificial Sequence
  Description of Artificial Sequence: Synthetic oligonucleotide
gtagttgaacattatattagaaaaatggccaactattatactgggataacaaag

SEQ ID NO: 299273 - DNA, 58 bp, Artificial Sequence
  Description of Artificial Sequence: Synthetic oligonucleotide
tagttgaacattatattagaaaaatggccaactattatactgggataacaaagaaaag

SEQ ID NO: 299274 - DNA, 57 bp, Artificial Sequence
  Description of Artificial Sequence: Synthetic oligonucleotide
agttgaacattatattagaaaaatggccaactattatactgggataacaaagaaaag

SEQ ID NO: 299275 - DNA, 56 bp, Artificial Sequence
  Description of Artificial Sequence: Synthetic oligonucleotide
gttgaacattatattagaaaaatggccaactattatactgggataacaaagaaaag

SEQ ID NO: 299276 - DNA, 56 bp, Artificial Sequence
  Description of Artificial Sequence: Synthetic oligonucleotide
ttgaacattatattagaaaaatggccaactattatactgggataacaaagaaaagg

SEQ ID NO: 299277 - DNA, 55 bp, Artificial Sequence
  Description of Artificial Sequence: Synthetic oligonucleotide
tgaacattatattagaaaaatggccaactattatactgggataacaaagaaaagg

SEQ ID NO: 299278 - DNA, 54 bp, Artificial Sequence
  Description of Artificial Sequence: Synthetic oligonucleotide
gaacattatattagaaaaatggccaactattatactgggataacaaagaaaagg

SEQ ID NO: 299279 - DNA, 56 bp, Artificial Sequence
  Description of Artificial Sequence: Synthetic oligonucleotide
aacattatattagaaaaatggccaactattatactgggataacaaagaaaaggatc

SEQ ID NO: 299280 - DNA, 55 bp, Artificial Sequence
  Description of Artificial Sequence: Synthetic oligonucleotide
acattatattagaaaaatggccaactattatactgggataacaaagaaaaggatc

SEQ ID NO: 299281 - DNA, 54 bp, Artificial Sequence
  Description of Artificial Sequence: Synthetic oligonucleotide
cattatattagaaaaatggccaactattatactgggataacaaagaaaaggatc

SEQ ID NO: 299282 - DNA, 54 bp, Artificial Sequence
  Description of Artificial Sequence: Synthetic oligonucleotide
attatattagaaaaatggccaactattatactgggataacaaagaaaaggatcg

SEQ ID NO: 299283 - DNA, 53 bp, Artificial Sequence
  Description of Artificial Sequence: Synthetic oligonucleotide
ttatattagaaaaatggccaactattatactgggataacaaagaaaaggatcg

SEQ ID NO: 299284 - DNA, 52 bp, Artificial Sequence
  Description of Artificial Sequence: Synthetic oligonucleotide
tatattagaaaaatggccaactattatactgggataacaaagaaaaggatcg

SEQ ID NO: 299285 - DNA, 51 bp, Artificial Sequence
  Description of Artificial Sequence: Synthetic oligonucleotide
atattagaaaaatggccaactattatactgggataacaaagaaaaggatcg

SEQ ID NO: 299286 - DNA, 50 bp, Artificial Sequence
  Description of Artificial Sequence: Synthetic oligonucleotide
tattagaaaaatggccaactattatactgggataacaaagaaaaggatcg

SEQ ID NO: 299287 - DNA, 49 bp, Artificial Sequence
  Description of Artificial Sequence: Synthetic oligonucleotide
attagaaaaatggccaactattatactgggataacaaagaaaaggatcg

SEQ ID NO: 299288 - DNA, 48 bp, Artificial Sequence
  Description of Artificial Sequence: Synthetic oligonucleotide
ttagaaaaatggccaactattatactgggataacaaagaaaaggatcg

SEQ ID NO: 299289 - DNA, 47 bp, Artificial Sequence
  Description of Artificial Sequence: Synthetic oligonucleotide
tagaaaaatggccaactattatactgggataacaaagaaaaggatcg

SEQ ID NO: 299290 - DNA, 46 bp, Artificial Sequence
  Description of Artificial Sequence: Synthetic oligonucleotide
agaaaaatggccaactattatactgggataacaaagaaaaggatcg

SEQ ID NO: 299291 - DNA, 45 bp, Artificial Sequence
  Description of Artificial Sequence: Synthetic oligonucleotide
gaaaaatggccaactattatactgggataacaaagaaaaggatcg

SEQ ID NO: 299292 - DNA, 45 bp, Artificial Sequence
  Description of Artificial Sequence: Synthetic oligonucleotide
aaaaatggccaactattatactgggataacaaagaaaaggatcgc

SEQ ID NO: 299293 - DNA, 44 bp, Artificial Sequence
  Description of Artificial Sequence: Synthetic oligonucleotide
aaaatggccaactattatactgggataacaaagaaaaggatcgc

SEQ ID NO: 299294 - DNA, 43 bp, Artificial Sequence
  Description of Artificial Sequence: Synthetic oligonucleotide
aaatggccaactattatactgggataacaaagaaaaggatcgc

SEQ ID NO: 299295 - DNA, 42 bp, Artificial Sequence
  Description of Artificial Sequence: Synthetic oligonucleotide
aatggccaactattatactgggataacaaagaaaaggatcgc

SEQ ID NO: 299296 - DNA, 41 bp, Artificial Sequence
  Description of Artificial Sequence: Synthetic oligonucleotide
atggccaactattatactgggataacaaagaaaaggatcgc

SEQ ID NO: 299297 - DNA, 40 bp, Artificial Sequence
  Description of Artificial Sequence: Synthetic oligonucleotide
tggccaactattatactgggataacaaagaaaaggatcgc

SEQ ID NO: 299298 - DNA, 39 bp, Artificial Sequence
  Description of Artificial Sequence: Synthetic oligonucleotide
ggccaactattatactgggataacaaagaaaaggatcgc

SEQ ID NO: 299299 - DNA, 40 bp, Artificial Sequence
  Description of Artificial Sequence: Synthetic oligonucleotide
gccaactattatactgggataacaaagaaaaggatcgcac

SEQ ID NO: 299300 - DNA, 41 bp, Artificial Sequence
  Description of Artificial Sequence: Synthetic oligonucleotide
ccaactattatactgggataacaaagaaaaggatcgcacag

SEQ ID NO: 299301 - DNA, 41 bp, Artificial Sequence
  Description of Artificial Sequence: Synthetic oligonucleotide
caactattatactgggataacaaagaaaaggatcgcacagc

SEQ ID NO: 299302 - DNA, 43 bp, Artificial Sequence
  Description of Artificial Sequence: Synthetic oligonucleotide
aactattatactgggataacaaagaaaaggatcgcacagcttg

SEQ ID NO: 299303 - DNA, 42 bp, Artificial Sequence
  Description of Artificial Sequence: Synthetic oligonucleotide
actattatactgggataacaaagaaaaggatcgcacagcttg

SEQ ID NO: 299304 - DNA, 41 bp, Artificial Sequence
  Description of Artificial Sequence: Synthetic oligonucleotide
ctattatactgggataacaaagaaaaggatcgcacagcttg

SEQ ID NO: 299305 - DNA, 42 bp, Artificial Sequence
  Description of Artificial Sequence: Synthetic oligonucleotide
tattatactgggataacaaagaaaaggatcgcacagcttgtg

SEQ ID NO: 299306 - DNA, 41 bp, Artificial Sequence
  Description of Artificial Sequence: Synthetic oligonucleotide
attatactgggataacaaagaaaaggatcgcacagcttgtg

SEQ ID NO: 299307 - DNA, 40 bp, Artificial Sequence
  Description of Artificial Sequence: Synthetic oligonucleotide
ttatactgggataacaaagaaaaggatcgcacagcttgtg

SEQ ID NO: 299308 - DNA, 39 bp, Artificial Sequence
  Description of Artificial Sequence: Synthetic oligonucleotide
tatactgggataacaaagaaaaggatcgcacagcttgtg

SEQ ID NO: 299309 - DNA, 38 bp, Artificial Sequence
  Description of Artificial Sequence: Synthetic oligonucleotide
atactgggataacaaagaaaaggatcgcacagcttgtg

SEQ ID NO: 299310 - DNA, 37 bp, Artificial Sequence
  Description of Artificial Sequence: Synthetic oligonucleotide
tactgggataacaaagaaaaggatcgcacagcttgtg

SEQ ID NO: 299311 - DNA, 36 bp, Artificial Sequence
  Description of Artificial Sequence: Synthetic oligonucleotide
actgggataacaaagaaaaggatcgcacagcttgtg

SEQ ID NO: 299312 - DNA, 35 bp, Artificial Sequence
  Description of Artificial Sequence: Synthetic oligonucleotide
ctgggataacaaagaaaaggatcgcacagcttgtg

SEQ ID NO: 299313 - DNA, 35 bp, Artificial Sequence
  Description of Artificial Sequence: Synthetic oligonucleotide
tgggataacaaagaaaaggatcgcacagcttgtgg

SEQ ID NO: 299314 - DNA, 34 bp, Artificial Sequence
  Description of Artificial Sequence: Synthetic oligonucleotide
gggataacaaagaaaaggatcgcacagcttgtgg

SEQ ID NO: 299315 - DNA, 36 bp, Artificial Sequence
  Description of Artificial Sequence: Synthetic oligonucleotide
ggataacaaagaaaaggatcgcacagcttgtggatc

SEQ ID NO: 299316 - DNA, 39 bp, Artificial Sequence
  Description of Artificial Sequence: Synthetic oligonucleotide
gataacaaagaaaaggatcgcacagcttgtggatctatg

SEQ ID NO: 299317 - DNA, 40 bp, Artificial Sequence
  Description of Artificial Sequence: Synthetic oligonucleotide
ataacaaagaaaaggatcgcacagcttgtggatctatgtg

SEQ ID NO: 299318 - DNA, 39 bp, Artificial Sequence
  Description of Artificial Sequence: Synthetic oligonucleotide
taacaaagaaaaggatcgcacagcttgtggatctatgtg

SEQ ID NO: 299319 - DNA, 38 bp, Artificial Sequence
  Description of Artificial Sequence: Synthetic oligonucleotide
aacaaagaaaaggatcgcacagcttgtggatctatgtg

SEQ ID NO: 299320 - DNA, 37 bp, Artificial Sequence
  Description of Artificial Sequence: Synthetic oligonucleotide
acaaagaaaaggatcgcacagcttgtggatctatgtg

SEQ ID NO: 299321 - DNA, 36 bp, Artificial Sequence
  Description of Artificial Sequence: Synthetic oligonucleotide
caaagaaaaggatcgcacagcttgtggatctatgtg

SEQ ID NO: 299322 - DNA, 38 bp, Artificial Sequence
  Description of Artificial Sequence: Synthetic oligonucleotide
aaagaaaaggatcgcacagcttgtggatctatgtgttg

SEQ ID NO: 299323 - DNA, 37 bp, Artificial Sequence
  Description of Artificial Sequence: Synthetic oligonucleotide
aagaaaaggatcgcacagcttgtggatctatgtgttg

SEQ ID NO: 299324 - DNA, 36 bp, Artificial Sequence
  Description of Artificial Sequence: Synthetic oligonucleotide
agaaaaggatcgcacagcttgtggatctatgtgttg

SEQ ID NO: 299325 - DNA, 35 bp, Artificial Sequence
  Description of Artificial Sequence: Synthetic oligonucleotide
gaaaaggatcgcacagcttgtggatctatgtgttg

SEQ ID NO: 299326 - DNA, 37 bp, Artificial Sequence
  Description of Artificial Sequence: Synthetic oligonucleotide
aaaaggatcgcacagcttgtggatctatgtgttgatg

SEQ ID NO: 299327 - DNA, 36 bp, Artificial Sequence
  Description of Artificial Sequence: Synthetic oligonucleotide
aaaggatcgcacagcttgtggatctatgtgttgatg

SEQ ID NO: 299328 - DNA, 35 bp, Artificial Sequence
  Description of Artificial Sequence: Synthetic oligonucleotide
aaggatcgcacagcttgtggatctatgtgttgatg

SEQ ID NO: 299329 - DNA, 34 bp, Artificial Sequence
  Description of Artificial Sequence: Synthetic oligonucleotide
aggatcgcacagcttgtggatctatgtgttgatg

SEQ ID NO: 299330 - DNA, 33 bp, Artificial Sequence
  Description of Artificial Sequence: Synthetic oligonucleotide
ggatcgcacagcttgtggatctatgtgttgatg

SEQ ID NO: 299331 - DNA, 34 bp, Artificial Sequence
  Description of Artificial Sequence: Synthetic oligonucleotide
gatcgcacagcttgtggatctatgtgttgatgac

SEQ ID NO: 299332 - DNA, 35 bp, Artificial Sequence
  Description of Artificial Sequence: Synthetic oligonucleotide
atcgcacagcttgtggatctatgtgttgatgactc

SEQ ID NO: 299333 - DNA, 34 bp, Artificial Sequence
  Description of Artificial Sequence: Synthetic oligonucleotide
tcgcacagcttgtggatctatgtgttgatgactc

SEQ ID NO: 299334 - DNA, 33 bp, Artificial Sequence
  Description of Artificial Sequence: Synthetic oligonucleotide
cgcacagcttgtggatctatgtgttgatgactc

SEQ ID NO: 299335 - DNA, 33 bp, Artificial Sequence
  Description of Artificial Sequence: Synthetic oligonucleotide
gcacagcttgtggatctatgtgttgatgactcc

SEQ ID NO: 299336 - DNA, 33 bp, Artificial Sequence
  Description of Artificial Sequence: Synthetic oligonucleotide
cacagcttgtggatctatgtgttgatgactccg

SEQ ID NO: 299337 - DNA, 35 bp, Artificial Sequence
  Description of Artificial Sequence: Synthetic oligonucleotide
acagcttgtggatctatgtgttgatgactccgaag

SEQ ID NO: 299338 - DNA, 34 bp, Artificial Sequence
  Description of Artificial Sequence: Synthetic oligonucleotide
cagcttgtggatctatgtgttgatgactccgaag

SEQ ID NO: 299339 - DNA, 34 bp, Artificial Sequence
  Description of Artificial Sequence: Synthetic oligonucleotide
agcttgtggatctatgtgttgatgactccgaagc

SEQ ID NO: 299340 - DNA, 33 bp, Artificial Sequence
  Description of Artificial Sequence: Synthetic oligonucleotide
gcttgtggatctatgtgttgatgactccgaagc

SEQ ID NO: 299341 - DNA, 33 bp, Artificial Sequence
  Description of Artificial Sequence: Synthetic oligonucleotide
cttgtggatctatgtgttgatgactccgaagcc

SEQ ID NO: 299342 - DNA, 36 bp, Artificial Sequence
  Description of Artificial Sequence: Synthetic oligonucleotide
ttgtggatctatgtgttgatgactccgaagccattc

SEQ ID NO: 299343 - DNA, 35 bp, Artificial Sequence
  Description of Artificial Sequence: Synthetic oligonucleotide
tgtggatctatgtgttgatgactccgaagccattc

SEQ ID NO: 299344 - DNA, 34 bp, Artificial Sequence
  Description of Artificial Sequence: Synthetic oligonucleotide
gtggatctatgtgttgatgactccgaagccattc

SEQ ID NO: 299345 - DNA, 35 bp, Artificial Sequence
  Description of Artificial Sequence: Synthetic oligonucleotide
tggatctatgtgttgatgactccgaagccattctc

SEQ ID NO: 299346 - DNA, 34 bp, Artificial Sequence
  Description of Artificial Sequence: Synthetic oligonucleotide
ggatctatgtgttgatgactccgaagccattctc

SEQ ID NO: 299347 - DNA, 35 bp, Artificial Sequence
  Description of Artificial Sequence: Synthetic oligonucleotide
gatctatgtgttgatgactccgaagccattctctc

SEQ ID NO: 299348 - DNA, 39 bp, Artificial Sequence
  Description of Artificial Sequence: Synthetic oligonucleotide
atctatgtgttgatgactccgaagccattctctcaattc

SEQ ID NO: 299349 - DNA, 38 bp, Artificial Sequence
  Description of Artificial Sequence: Synthetic oligonucleotide
tctatgtgttgatgactccgaagccattctctcaattc

SEQ ID NO: 299350 - DNA, 37 bp, Artificial Sequence
  Description of Artificial Sequence: Synthetic oligonucleotide
ctatgtgttgatgactccgaagccattctctcaattc

SEQ ID NO: 299351 - DNA, 39 bp, Artificial Sequence
  Description of Artificial Sequence: Synthetic oligonucleotide
tatgtgttgatgactccgaagccattctctcaattctag

SEQ ID NO: 299352 - DNA, 38 bp, Artificial Sequence
  Description of Artificial Sequence: Synthetic oligonucleotide
atgtgttgatgactccgaagccattctctcaattctag

SEQ ID NO: 299353 - DNA, 37 bp, Artificial Sequence
  Description of Artificial Sequence: Synthetic oligonucleotide
tgtgttgatgactccgaagccattctctcaattctag

SEQ ID NO: 299354 - DNA, 36 bp, Artificial Sequence
  Description of Artificial Sequence: Synthetic oligonucleotide
gtgttgatgactccgaagccattctctcaattctag

SEQ ID NO: 299355 - DNA, 38 bp, Artificial Sequence
  Description of Artificial Sequence: Synthetic oligonucleotide
tgttgatgactccgaagccattctctcaattctagtag

SEQ ID NO: 299356 - DNA, 37 bp, Artificial Sequence
  Description of Artificial Sequence: Synthetic oligonucleotide
gttgatgactccgaagccattctctcaattctagtag

SEQ ID NO: 299357 - DNA, 41 bp, Artificial Sequence
  Description of Artificial Sequence: Synthetic oligonucleotide
ttgatgactccgaagccattctctcaattctagtagtaaac

SEQ ID NO: 299358 - DNA, 40 bp, Artificial Sequence
  Description of Artificial Sequence: Synthetic oligonucleotide
tgatgactccgaagccattctctcaattctagtagtaaac

SEQ ID NO: 299359 - DNA, 39 bp, Artificial Sequence
  Description of Artificial Sequence: Synthetic oligonucleotide
gatgactccgaagccattctctcaattctagtagtaaac

SEQ ID NO: 299360 - DNA, 41 bp, Artificial Sequence
  Description of Artificial Sequence: Synthetic oligonucleotide
atgactccgaagccattctctcaattctagtagtaaacaag

SEQ ID NO: 299361 - DNA, 40 bp, Artificial Sequence
  Description of Artificial Sequence: Synthetic oligonucleotide
tgactccgaagccattctctcaattctagtagtaaacaag

SEQ ID NO: 299362 - DNA, 39 bp, Artificial Sequence
  Description of Artificial Sequence: Synthetic oligonucleotide
gactccgaagccattctctcaattctagtagtaaacaag

SEQ ID NO: 299363 - DNA, 40 bp, Artificial Sequence
  Description of Artificial Sequence: Synthetic oligonucleotide
actccgaagccattctctcaattctagtagtaaacaagac

SEQ ID NO: 299364 - DNA, 39 bp, Artificial Sequence
  Description of Artificial Sequence: Synthetic oligonucleotide
ctccgaagccattctctcaattctagtagtaaacaagac

SEQ ID NO: 299365 - DNA, 39 bp, Artificial Sequence
  Description of Artificial Sequence: Synthetic oligonucleotide
tccgaagccattctctcaattctagtagtaaacaagacc

SEQ ID NO: 299366 - DNA, 38 bp, Artificial Sequence
  Description of Artificial Sequence: Synthetic oligonucleotide
ccgaagccattctctcaattctagtagtaaacaagacc

SEQ ID NO: 299367 - DNA, 40 bp, Artificial Sequence
  Description of Artificial Sequence: Synthetic oligonucleotide
cgaagccattctctcaattctagtagtaaacaagaccttc

SEQ ID NO: 299368 - DNA, 43 bp, Artificial Sequence
  Description of Artificial Sequence: Synthetic oligonucleotide
gaagccattctctcaattctagtagtaaacaagaccttctttg

SEQ ID NO: 299369 - DNA, 43 bp, Artificial Sequence
  Description of Artificial Sequence: Synthetic oligonucleotide
aagccattctctcaattctagtagtaaacaagaccttctttgc

SEQ ID NO: 299370 - DNA, 42 bp, Artificial Sequence
  Description of Artificial Sequence: Synthetic oligonucleotide
agccattctctcaattctagtagtaaacaagaccttctttgc

SEQ ID NO: 299371 - DNA, 41 bp, Artificial Sequence
  Description of Artificial Sequence: Synthetic oligonucleotide
gccattctctcaattctagtagtaaacaagaccttctttgc

SEQ ID NO: 299372 - DNA, 45 bp, Artificial Sequence
  Description of Artificial Sequence: Synthetic oligonucleotide
ccattctctcaattctagtagtaaacaagaccttctttgctatag

SEQ ID NO: 299373 - DNA, 47 bp, Artificial Sequence
  Description of Artificial Sequence: Synthetic oligonucleotide
cattctctcaattctagtagtaaacaagaccttctttgctatagtag

SEQ ID NO: 299374 - DNA, 48 bp, Artificial Sequence
  Description of Artificial Sequence: Synthetic oligonucleotide
attctctcaattctagtagtaaacaagaccttctttgctatagtagac

SEQ ID NO: 299375 - DNA, 47 bp, Artificial Sequence
  Description of Artificial Sequence: Synthetic oligonucleotide
ttctctcaattctagtagtaaacaagaccttctttgctatagtagac

SEQ ID NO: 299376 - DNA, 46 bp, Artificial Sequence
  Description of Artificial Sequence: Synthetic oligonucleotide
tctctcaattctagtagtaaacaagaccttctttgctatagtagac

SEQ ID NO: 299377 - DNA, 45 bp, Artificial Sequence
  Description of Artificial Sequence: Synthetic oligonucleotide
ctctcaattctagtagtaaacaagaccttctttgctatagtagac

SEQ ID NO: 299378 - DNA, 46 bp, Artificial Sequence
  Description of Artificial Sequence: Synthetic oligonucleotide
tctcaattctagtagtaaacaagaccttctttgctatagtagacag

SEQ ID NO: 299379 - DNA, 45 bp, Artificial Sequence
  Description of Artificial Sequence: Synthetic oligonucleotide
ctcaattctagtagtaaacaagaccttctttgctatagtagacag

SEQ ID NO: 299380 - DNA, 49 bp, Artificial Sequence
  Description of Artificial Sequence: Synthetic oligonucleotide
tcaattctagtagtaaacaagaccttctttgctatagtagacagtttag

SEQ ID NO: 299381 - DNA, 48 bp, Artificial Sequence
  Description of Artificial Sequence: Synthetic oligonucleotide
caattctagtagtaaacaagaccttctttgctatagtagacagtttag

SEQ ID NO: 299382 - DNA, 48 bp, Artificial Sequence
  Description of Artificial Sequence: Synthetic oligonucleotide
aattctagtagtaaacaagaccttctttgctatagtagacagtttagc

SEQ ID NO: 299383 - DNA, 47 bp, Artificial Sequence
  Description of Artificial Sequence: Synthetic oligonucleotide
attctagtagtaaacaagaccttctttgctatagtagacagtttagc

SEQ ID NO: 299384 - DNA, 46 bp, Artificial Sequence
  Description of Artificial Sequence: Synthetic oligonucleotide
ttctagtagtaaacaagaccttctttgctatagtagacagtttagc

SEQ ID NO: 299385 - DNA, 45 bp, Artificial Sequence
  Description of Artificial Sequence: Synthetic oligonucleotide
tctagtagtaaacaagaccttctttgctatagtagacagtttagc

SEQ ID NO: 299386 - DNA, 44 bp, Artificial Sequence
  Description of Artificial Sequence: Synthetic oligonucleotide
ctagtagtaaacaagaccttctttgctatagtagacagtttagc

SEQ ID NO: 299387 - DNA, 45 bp, Artificial Sequence
  Description of Artificial Sequence: Synthetic oligonucleotide
tagtagtaaacaagaccttctttgctatagtagacagtttagcag

SEQ ID NO: 299388 - DNA, 44 bp, Artificial Sequence
  Description of Artificial Sequence: Synthetic oligonucleotide
agtagtaaacaagaccttctttgctatagtagacagtttagcag

SEQ ID NO: 299389 - DNA, 43 bp, Artificial Sequence
  Description of Artificial Sequence: Synthetic oligonucleotide
gtagtaaacaagaccttctttgctatagtagacagtttagcag

SEQ ID NO: 299390 - DNA, 43 bp, Artificial Sequence
  Description of Artificial Sequence: Synthetic oligonucleotide
tagtaaacaagaccttctttgctatagtagacagtttagcagg

SEQ ID NO: 299391 - DNA, 42 bp, Artificial Sequence
  Description of Artificial Sequence: Synthetic oligonucleotide
agtaaacaagaccttctttgctatagtagacagtttagcagg

SEQ ID NO: 299392 - DNA, 41 bp, Artificial Sequence
  Description of Artificial Sequence: Synthetic oligonucleotide
gtaaacaagaccttctttgctatagtagacagtttagcagg

SEQ ID NO: 299393 - DNA, 47 bp, Artificial Sequence
  Description of Artificial Sequence: Synthetic oligonucleotide
taaacaagaccttctttgctatagtagacagtttagcaggatttatc

SEQ ID NO: 299394 - DNA, 46 bp, Artificial Sequence
  Description of Artificial Sequence: Synthetic oligonucleotide
aaacaagaccttctttgctatagtagacagtttagcaggatttatc

SEQ ID NO: 299395 - DNA, 45 bp, Artificial Sequence
  Description of Artificial Sequence: Synthetic oligonucleotide
aacaagaccttctttgctatagtagacagtttagcaggatttatc

SEQ ID NO: 299396 - DNA, 44 bp, Artificial Sequence
  Description of Artificial Sequence: Synthetic oligonucleotide
acaagaccttctttgctatagtagacagtttagcaggatttatc

SEQ ID NO: 299397 - DNA, 43 bp, Artificial Sequence
  Description of Artificial Sequence: Synthetic oligonucleotide
caagaccttctttgctatagtagacagtttagcaggatttatc

SEQ ID NO: 299398 - DNA, 45 bp, Artificial Sequence
  Description of Artificial Sequence: Synthetic oligonucleotide
aagaccttctttgctatagtagacagtttagcaggatttatcaac

SEQ ID NO: 299399 - DNA, 44 bp, Artificial Sequence
  Description of Artificial Sequence: Synthetic oligonucleotide
agaccttctttgctatagtagacagtttagcaggatttatcaac

SEQ ID NO: 299400 - DNA, 43 bp, Artificial Sequence
  Description of Artificial Sequence: Synthetic oligonucleotide
gaccttctttgctatagtagacagtttagcaggatttatcaac

SEQ ID NO: 299401 - DNA, 45 bp, Artificial Sequence
  Description of Artificial Sequence: Synthetic oligonucleotide
accttctttgctatagtagacagtttagcaggatttatcaactac

SEQ ID NO: 299402 - DNA, 44 bp, Artificial Sequence
  Description of Artificial Sequence: Synthetic oligonucleotide
ccttctttgctatagtagacagtttagcaggatttatcaactac

SEQ ID NO: 299403 - DNA, 44 bp, Artificial Sequence
  Description of Artificial Sequence: Synthetic oligonucleotide
cttctttgctatagtagacagtttagcaggatttatcaactacc

SEQ ID NO: 299404 - DNA, 45 bp, Artificial Sequence
  Description of Artificial Sequence: Synthetic oligonucleotide
ttctttgctatagtagacagtttagcaggatttatcaactaccag

SEQ ID NO: 299405 - DNA, 44 bp, Artificial Sequence
  Description of Artificial Sequence: Synthetic oligonucleotide
tctttgctatagtagacagtttagcaggatttatcaactaccag

SEQ ID NO: 299406 - DNA, 43 bp, Artificial Sequence
  Description of Artificial Sequence: Synthetic oligonucleotide
ctttgctatagtagacagtttagcaggatttatcaactaccag

SEQ ID NO: 299407 - DNA, 44 bp, Artificial Sequence
  Description of Artificial Sequence: Synthetic oligonucleotide
tttgctatagtagacagtttagcaggatttatcaactaccagag

SEQ ID NO: 299408 - DNA, 43 bp, Artificial Sequence
  Description of Artificial Sequence: Synthetic oligonucleotide
ttgctatagtagacagtttagcaggatttatcaactaccagag

SEQ ID NO: 299409 - DNA, 42 bp, Artificial Sequence
  Description of Artificial Sequence: Synthetic oligonucleotide
tgctatagtagacagtttagcaggatttatcaactaccagag

SEQ ID NO: 299410 - DNA, 41 bp, Artificial Sequence
  Description of Artificial Sequence: Synthetic oligonucleotide
gctatagtagacagtttagcaggatttatcaactaccagag

SEQ ID NO: 299411 - DNA, 42 bp, Artificial Sequence
  Description of Artificial Sequence: Synthetic oligonucleotide
ctatagtagacagtttagcaggatttatcaactaccagagac

SEQ ID NO: 299412 - DNA, 42 bp, Artificial Sequence
  Description of Artificial Sequence: Synthetic oligonucleotide
tatagtagacagtttagcaggatttatcaactaccagagacc

SEQ ID NO: 299413 - DNA, 41 bp, Artificial Sequence
  Description of Artificial Sequence: Synthetic oligonucleotide
atagtagacagtttagcaggatttatcaactaccagagacc

SEQ ID NO: 299414 - DNA, 40 bp, Artificial Sequence
  Description of Artificial Sequence: Synthetic oligonucleotide
tagtagacagtttagcaggatttatcaactaccagagacc

SEQ ID NO: 299415 - DNA, 39 bp, Artificial Sequence
  Description of Artificial Sequence: Synthetic oligonucleotide
agtagacagtttagcaggatttatcaactaccagagacc

SEQ ID NO: 299416 - DNA, 38 bp, Artificial Sequence
  Description of Artificial Sequence: Synthetic oligonucleotide
gtagacagtttagcaggatttatcaactaccagagacc

SEQ ID NO: 299417 - DNA, 38 bp, Artificial Sequence
  Description of Artificial Sequence: Synthetic oligonucleotide
tagacagtttagcaggatttatcaactaccagagaccg

SEQ ID NO: 299418 - DNA, 37 bp, Artificial Sequence
  Description of Artificial Sequence: Synthetic oligonucleotide
agacagtttagcaggatttatcaactaccagagaccg

SEQ ID NO: 299419 - DNA, 36 bp, Artificial Sequence
  Description of Artificial Sequence: Synthetic oligonucleotide
gacagtttagcaggatttatcaactaccagagaccg

SEQ ID NO: 299420 - DNA, 38 bp, Artificial Sequence
  Description of Artificial Sequence: Synthetic oligonucleotide
acagtttagcaggatttatcaactaccagagaccgaag

SEQ ID NO: 299421 - DNA, 37 bp, Artificial Sequence
  Description of Artificial Sequence: Synthetic oligonucleotide
cagtttagcaggatttatcaactaccagagaccgaag

SEQ ID NO: 299422 - DNA, 37 bp, Artificial Sequence
  Description of Artificial Sequence: Synthetic oligonucleotide
agtttagcaggatttatcaactaccagagaccgaagg

SEQ ID NO: 299423 - DNA, 36 bp, Artificial Sequence
  Description of Artificial Sequence: Synthetic oligonucleotide
gtttagcaggatttatcaactaccagagaccgaagg

SEQ ID NO: 299424 - DNA, 38 bp, Artificial Sequence
  Description of Artificial Sequence: Synthetic oligonucleotide
tttagcaggatttatcaactaccagagaccgaaggatc

SEQ ID NO: 299425 - DNA, 37 bp, Artificial Sequence
  Description of Artificial Sequence: Synthetic oligonucleotide
ttagcaggatttatcaactaccagagaccgaaggatc

SEQ ID NO: 299426 - DNA, 36 bp, Artificial Sequence
  Description of Artificial Sequence: Synthetic oligonucleotide
tagcaggatttatcaactaccagagaccgaaggatc

SEQ ID NO: 299427 - DNA, 35 bp, Artificial Sequence
  Description of Artificial Sequence: Synthetic oligonucleotide
agcaggatttatcaactaccagagaccgaaggatc

SEQ ID NO: 299428 - DNA, 34 bp, Artificial Sequence
  Description of Artificial Sequence: Synthetic oligonucleotide
gcaggatttatcaactaccagagaccgaaggatc

SEQ ID NO: 299429 - DNA, 34 bp, Artificial Sequence
  Description of Artificial Sequence: Synthetic oligonucleotide
caggatttatcaactaccagagaccgaaggatcc

SEQ ID NO: 299430 - DNA, 50 bp, Artificial Sequence
  Description of Artificial Sequence: Synthetic oligonucleotide
aggatttatcaactaccagagaccgaaggatccatataatttataaaatg

SEQ ID NO: 299431 - DNA, 49 bp, Artificial Sequence
  Description of Artificial Sequence: Synthetic oligonucleotide
ggatttatcaactaccagagaccgaaggatccatataatttataaaatg

SEQ ID NO: 299432 - DNA, 50 bp, Artificial Sequence
  Description of Artificial Sequence: Synthetic oligonucleotide
gatttatcaactaccagagaccgaaggatccatataatttataaaatgac

SEQ ID NO: 299433 - DNA, 51 bp, Artificial Sequence
  Description of Artificial Sequence: Synthetic oligonucleotide
atttatcaactaccagagaccgaaggatccatataatttataaaatgactg

SEQ ID NO: 299434 - DNA, 50 bp, Artificial Sequence
  Description of Artificial Sequence: Synthetic oligonucleotide
tttatcaactaccagagaccgaaggatccatataatttataaaatgactg

SEQ ID NO: 299435 - DNA, 49 bp, Artificial Sequence
  Description of Artificial Sequence: Synthetic oligonucleotide
ttatcaactaccagagaccgaaggatccatataatttataaaatgactg

SEQ ID NO: 299436 - DNA, 48 bp, Artificial Sequence
  Description of Artificial Sequence: Synthetic oligonucleotide
tatcaactaccagagaccgaaggatccatataatttataaaatgactg

SEQ ID NO: 299437 - DNA, 47 bp, Artificial Sequence
  Description of Artificial Sequence: Synthetic oligonucleotide
atcaactaccagagaccgaaggatccatataatttataaaatgactg

SEQ ID NO: 299438 - DNA, 46 bp, Artificial Sequence
  Description of Artificial Sequence: Synthetic oligonucleotide
tcaactaccagagaccgaaggatccatataatttataaaatgactg

SEQ ID NO: 299439 - DNA, 45 bp, Artificial Sequence
  Description of Artificial Sequence: Synthetic oligonucleotide
caactaccagagaccgaaggatccatataatttataaaatgactg

SEQ ID NO: 299440 - DNA, 45 bp, Artificial Sequence
  Description of Artificial Sequence: Synthetic oligonucleotide
aactaccagagaccgaaggatccatataatttataaaatgactgc

SEQ ID NO: 299441 - DNA, 44 bp, Artificial Sequence
  Description of Artificial Sequence: Synthetic oligonucleotide
actaccagagaccgaaggatccatataatttataaaatgactgc

SEQ ID NO: 299442 - DNA, 43 bp, Artificial Sequence
  Description of Artificial Sequence: Synthetic oligonucleotide
ctaccagagaccgaaggatccatataatttataaaatgactgc

SEQ ID NO: 299443 - DNA, 44 bp, Artificial Sequence
  Description of Artificial Sequence: Synthetic oligonucleotide
taccagagaccgaaggatccatataatttataaaatgactgctc

SEQ ID NO: 299444 - DNA, 43 bp, Artificial Sequence
  Description of Artificial Sequence: Synthetic oligonucleotide
accagagaccgaaggatccatataatttataaaatgactgctc

SEQ ID NO: 299445 - DNA, 42 bp, Artificial Sequence
  Description of Artificial Sequence: Synthetic oligonucleotide
ccagagaccgaaggatccatataatttataaaatgactgctc

SEQ ID NO: 299446 - DNA, 43 bp, Artificial Sequence
  Description of Artificial Sequence: Synthetic oligonucleotide
cagagaccgaaggatccatataatttataaaatgactgctctc

SEQ ID NO: 299447 - DNA, 44 bp, Artificial Sequence
  Description of Artificial Sequence: Synthetic oligonucleotide
agagaccgaaggatccatataatttataaaatgactgctctcag

SEQ ID NO: 299448 - DNA, 43 bp, Artificial Sequence
  Description of Artificial Sequence: Synthetic oligonucleotide
gagaccgaaggatccatataatttataaaatgactgctctcag

SEQ ID NO: 299449 - DNA, 46 bp, Artificial Sequence
  Description of Artificial Sequence: Synthetic oligonucleotide
agaccgaaggatccatataatttataaaatgactgctctcagaaag

SEQ ID NO: 299450 - DNA, 45 bp, Artificial Sequence
  Description of Artificial Sequence: Synthetic oligonucleotide
gaccgaaggatccatataatttataaaatgactgctctcagaaag

SEQ ID NO: 299451 - DNA, 46 bp, Artificial Sequence
  Description of Artificial Sequence: Synthetic oligonucleotide
accgaaggatccatataatttataaaatgactgctctcagaaagtg

SEQ ID NO: 299452 - DNA, 45 bp, Artificial Sequence
  Description of Artificial Sequence: Synthetic oligonucleotide
ccgaaggatccatataatttataaaatgactgctctcagaaagtg

SEQ ID NO: 299453 - DNA, 47 bp, Artificial Sequence
  Description of Artificial Sequence: Synthetic oligonucleotide
cgaaggatccatataatttataaaatgactgctctcagaaagtgaac

SEQ ID NO: 299454 - DNA, 48 bp, Artificial Sequence
  Description of Artificial Sequence: Synthetic oligonucleotide
gaaggatccatataatttataaaatgactgctctcagaaagtgaactc

SEQ ID NO: 299455 - DNA, 54 bp, Artificial Sequence
  Description of Artificial Sequence: Synthetic oligonucleotide
aaggatccatataatttataaaatgactgctctcagaaagtgaactcataaatg

SEQ ID NO: 299456 - DNA, 53 bp, Artificial Sequence
  Description of Artificial Sequence: Synthetic oligonucleotide
aggatccatataatttataaaatgactgctctcagaaagtgaactcataaatg

SEQ ID NO: 299457 - DNA, 52 bp, Artificial Sequence
  Description of Artificial Sequence: Synthetic oligonucleotide
ggatccatataatttataaaatgactgctctcagaaagtgaactcataaatg

SEQ ID NO: 299458 - DNA, 53 bp, Artificial Sequence
  Description of Artificial Sequence: Synthetic oligonucleotide
gatccatataatttataaaatgactgctctcagaaagtgaactcataaatgtc

SEQ ID NO: 299459 - DNA, 54 bp, Artificial Sequence
  Description of Artificial Sequence: Synthetic oligonucleotide
atccatataatttataaaatgactgctctcagaaagtgaactcataaatgtctc

SEQ ID NO: 299460 - DNA, 53 bp, Artificial Sequence
  Description of Artificial Sequence: Synthetic oligonucleotide
tccatataatttataaaatgactgctctcagaaagtgaactcataaatgtctc

SEQ ID NO: 299461 - DNA, 52 bp, Artificial Sequence
  Description of Artificial Sequence: Synthetic oligonucleotide
ccatataatttataaaatgactgctctcagaaagtgaactcataaatgtctc

SEQ ID NO: 299462 - DNA, 53 bp, Artificial Sequence
  Description of Artificial Sequence: Synthetic oligonucleotide
catataatttataaaatgactgctctcagaaagtgaactcataaatgtctctc

SEQ ID NO: 299463 - DNA, 53 bp, Artificial Sequence
  Description of Artificial Sequence: Synthetic oligonucleotide
atataatttataaaatgactgctctcagaaagtgaactcataaatgtctctcg

SEQ ID NO: 299464 - DNA, 52 bp, Artificial Sequence
  Description of Artificial Sequence: Synthetic oligonucleotide
tataatttataaaatgactgctctcagaaagtgaactcataaatgtctctcg

SEQ ID NO: 299465 - DNA, 51 bp, Artificial Sequence
  Description of Artificial Sequence: Synthetic oligonucleotide
ataatttataaaatgactgctctcagaaagtgaactcataaatgtctctcg

SEQ ID NO: 299466 - DNA, 50 bp, Artificial Sequence
  Description of Artificial Sequence: Synthetic oligonucleotide
taatttataaaatgactgctctcagaaagtgaactcataaatgtctctcg

SEQ ID NO: 299467 - DNA, 49 bp, Artificial Sequence
  Description of Artificial Sequence: Synthetic oligonucleotide
aatttataaaatgactgctctcagaaagtgaactcataaatgtctctcg

SEQ ID NO: 299468 - DNA, 48 bp, Artificial Sequence
  Description of Artificial Sequence: Synthetic oligonucleotide
atttataaaatgactgctctcagaaagtgaactcataaatgtctctcg

SEQ ID NO: 299469 - DNA, 47 bp, Artificial Sequence
  Description of Artificial Sequence: Synthetic oligonucleotide
tttataaaatgactgctctcagaaagtgaactcataaatgtctctcg

SEQ ID NO: 299470 - DNA, 46 bp, Artificial Sequence
  Description of Artificial Sequence: Synthetic oligonucleotide
ttataaaatgactgctctcagaaagtgaactcataaatgtctctcg

SEQ ID NO: 299471 - DNA, 45 bp, Artificial Sequence
  Description of Artificial Sequence: Synthetic oligonucleotide
tataaaatgactgctctcagaaagtgaactcataaatgtctctcg

SEQ ID NO: 299472 - DNA, 44 bp, Artificial Sequence
  Description of Artificial Sequence: Synthetic oligonucleotide
ataaaatgactgctctcagaaagtgaactcataaatgtctctcg

SEQ ID NO: 299473 - DNA, 43 bp, Artificial Sequence
  Description of Artificial Sequence: Synthetic oligonucleotide
taaaatgactgctctcagaaagtgaactcataaatgtctctcg

SEQ ID NO: 299474 - DNA, 42 bp, Artificial Sequence
  Description of Artificial Sequence: Synthetic oligonucleotide
aaaatgactgctctcagaaagtgaactcataaatgtctctcg

SEQ ID NO: 299475 - DNA, 41 bp, Artificial Sequence
  Description of Artificial Sequence: Synthetic oligonucleotide
aaatgactgctctcagaaagtgaactcataaatgtctctcg

SEQ ID NO: 299476 - DNA, 40 bp, Artificial Sequence
  Description of Artificial Sequence: Synthetic oligonucleotide
aatgactgctctcagaaagtgaactcataaatgtctctcg

SEQ ID NO: 299477 - DNA, 39 bp, Artificial Sequence
  Description of Artificial Sequence: Synthetic oligonucleotide
atgactgctctcagaaagtgaactcataaatgtctctcg

SEQ ID NO: 299478 - DNA, 38 bp, Artificial Sequence
  Description of Artificial Sequence: Synthetic oligonucleotide
tgactgctctcagaaagtgaactcataaatgtctctcg

SEQ ID NO: 299479 - DNA, 37 bp, Artificial Sequence
  Description of Artificial Sequence: Synthetic oligonucleotide
gactgctctcagaaagtgaactcataaatgtctctcg

SEQ ID NO: 299480 - DNA, 41 bp, Artificial Sequence
  Description of Artificial Sequence: Synthetic oligonucleotide
actgctctcagaaagtgaactcataaatgtctctcgttaac

SEQ ID NO: 299481 - DNA, 40 bp, Artificial Sequence
  Description of Artificial Sequence: Synthetic oligonucleotide
ctgctctcagaaagtgaactcataaatgtctctcgttaac

SEQ ID NO: 299482 - DNA, 44 bp, Artificial Sequence
  Description of Artificial Sequence: Synthetic oligonucleotide
tgctctcagaaagtgaactcataaatgtctctcgttaacaaatc

SEQ ID NO: 299483 - DNA, 43 bp, Artificial Sequence
  Description of Artificial Sequence: Synthetic oligonucleotide
gctctcagaaagtgaactcataaatgtctctcgttaacaaatc

SEQ ID NO: 299484 - DNA, 45 bp, Artificial Sequence
  Description of Artificial Sequence: Synthetic oligonucleotide
ctctcagaaagtgaactcataaatgtctctcgttaacaaatctac

SEQ ID NO: 299485 - DNA, 45 bp, Artificial Sequence
  Description of Artificial Sequence: Synthetic oligonucleotide
tctcagaaagtgaactcataaatgtctctcgttaacaaatctacg

SEQ ID NO: 299486 - DNA, 44 bp, Artificial Sequence
  Description of Artificial Sequence: Synthetic oligonucleotide
ctcagaaagtgaactcataaatgtctctcgttaacaaatctacg

SEQ ID NO: 299487 - DNA, 44 bp, Artificial Sequence
  Description of Artificial Sequence: Synthetic oligonucleotide
tcagaaagtgaactcataaatgtctctcgttaacaaatctacgc

SEQ ID NO: 299488 - DNA, 43 bp, Artificial Sequence
  Description of Artificial Sequence: Synthetic oligonucleotide
cagaaagtgaactcataaatgtctctcgttaacaaatctacgc

SEQ ID NO: 299489 - DNA, 45 bp, Artificial Sequence
  Description of Artificial Sequence: Synthetic oligonucleotide
agaaagtgaactcataaatgtctctcgttaacaaatctacgcatc

SEQ ID NO: 299490 - DNA, 44 bp, Artificial Sequence
  Description of Artificial Sequence: Synthetic oligonucleotide
gaaagtgaactcataaatgtctctcgttaacaaatctacgcatc

SEQ ID NO: 299491 - DNA, 45 bp, Artificial Sequence
  Description of Artificial Sequence: Synthetic oligonucleotide
aaagtgaactcataaatgtctctcgttaacaaatctacgcatcac

SEQ ID NO: 299492 - DNA, 44 bp, Artificial Sequence
  Description of Artificial Sequence: Synthetic oligonucleotide
aagtgaactcataaatgtctctcgttaacaaatctacgcatcac

SEQ ID NO: 299493 - DNA, 43 bp, Artificial Sequence
  Description of Artificial Sequence: Synthetic oligonucleotide
agtgaactcataaatgtctctcgttaacaaatctacgcatcac

SEQ ID NO: 299494 - DNA, 42 bp, Artificial Sequence
  Description of Artificial Sequence: Synthetic oligonucleotide
gtgaactcataaatgtctctcgttaacaaatctacgcatcac

SEQ ID NO: 299495 - DNA, 45 bp, Artificial Sequence
  Description of Artificial Sequence: Synthetic oligonucleotide
tgaactcataaatgtctctcgttaacaaatctacgcatcacatag

SEQ ID NO: 299496 - DNA, 44 bp, Artificial Sequence
  Description of Artificial Sequence: Synthetic oligonucleotide
gaactcataaatgtctctcgttaacaaatctacgcatcacatag

SEQ ID NO: 299497 - DNA, 44 bp, Artificial Sequence
  Description of Artificial Sequence: Synthetic oligonucleotide
aactcataaatgtctctcgttaacaaatctacgcatcacatagc

SEQ ID NO: 299498 - DNA, 43 bp, Artificial Sequence
  Description of Artificial Sequence: Synthetic oligonucleotide
actcataaatgtctctcgttaacaaatctacgcatcacatagc

SEQ ID NO: 299499 - DNA, 42 bp, Artificial Sequence
  Description of Artificial Sequence: Synthetic oligonucleotide
ctcataaatgtctctcgttaacaaatctacgcatcacatagc

SEQ ID NO: 299500 - DNA, 42 bp, Artificial Sequence
  Description of Artificial Sequence: Synthetic oligonucleotide
tcataaatgtctctcgttaacaaatctacgcatcacatagcc

SEQ ID NO: 299501 - DNA, 41 bp, Artificial Sequence
  Description of Artificial Sequence: Synthetic oligonucleotide
cataaatgtctctcgttaacaaatctacgcatcacatagcc

SEQ ID NO: 299502 - DNA, 44 bp, Artificial Sequence
  Description of Artificial Sequence: Synthetic oligonucleotide
ataaatgtctctcgttaacaaatctacgcatcacatagccaatg

SEQ ID NO: 299503 - DNA, 43 bp, Artificial Sequence
  Description of Artificial Sequence: Synthetic oligonucleotide
taaatgtctctcgttaacaaatctacgcatcacatagccaatg

SEQ ID NO: 299504 - DNA, 42 bp, Artificial Sequence
  Description of Artificial Sequence: Synthetic oligonucleotide
aaatgtctctcgttaacaaatctacgcatcacatagccaatg

SEQ ID NO: 299505 - DNA, 41 bp, Artificial Sequence
  Description of Artificial Sequence: Synthetic oligonucleotide
aatgtctctcgttaacaaatctacgcatcacatagccaatg

SEQ ID NO: 299506 - DNA, 40 bp, Artificial Sequence
  Description of Artificial Sequence: Synthetic oligonucleotide
atgtctctcgttaacaaatctacgcatcacatagccaatg

SEQ ID NO: 299507 - DNA, 39 bp, Artificial Sequence
  Description of Artificial Sequence: Synthetic oligonucleotide
tgtctctcgttaacaaatctacgcatcacatagccaatg

SEQ ID NO: 299508 - DNA, 38 bp, Artificial Sequence
  Description of Artificial Sequence: Synthetic oligonucleotide
gtctctcgttaacaaatctacgcatcacatagccaatg

SEQ ID NO: 299509 - DNA, 39 bp, Artificial Sequence
  Description of Artificial Sequence: Synthetic oligonucleotide
tctctcgttaacaaatctacgcatcacatagccaatgag

SEQ ID NO: 299510 - DNA, 38 bp, Artificial Sequence
  Description of Artificial Sequence: Synthetic oligonucleotide
ctctcgttaacaaatctacgcatcacatagccaatgag

SEQ ID NO: 299511 - DNA, 38 bp, Artificial Sequence
  Description of Artificial Sequence: Synthetic oligonucleotide
tctcgttaacaaatctacgcatcacatagccaatgagg

SEQ ID NO: 299512 - DNA, 37 bp, Artificial Sequence
  Description of Artificial Sequence: Synthetic oligonucleotide
ctcgttaacaaatctacgcatcacatagccaatgagg

SEQ ID NO: 299513 - DNA, 38 bp, Artificial Sequence
  Description of Artificial Sequence: Synthetic oligonucleotide
tcgttaacaaatctacgcatcacatagccaatgaggag

SEQ ID NO: 299514 - DNA, 37 bp, Artificial Sequence
  Description of Artificial Sequence: Synthetic oligonucleotide
cgttaacaaatctacgcatcacatagccaatgaggag

SEQ ID NO: 299515 - DNA, 39 bp, Artificial Sequence
  Description of Artificial Sequence: Synthetic oligonucleotide
gttaacaaatctacgcatcacatagccaatgaggagatg

SEQ ID NO: 299516 - DNA, 42 bp, Artificial Sequence
  Description of Artificial Sequence: Synthetic oligonucleotide
ttaacaaatctacgcatcacatagccaatgaggagatgttac

SEQ ID NO: 299517 - DNA, 41 bp, Artificial Sequence
  Description of Artificial Sequence: Synthetic oligonucleotide
taacaaatctacgcatcacatagccaatgaggagatgttac

SEQ ID NO: 299518 - DNA, 40 bp, Artificial Sequence
  Description of Artificial Sequence: Synthetic oligonucleotide
aacaaatctacgcatcacatagccaatgaggagatgttac

SEQ ID NO: 299519 - DNA, 39 bp, Artificial Sequence
  Description of Artificial Sequence: Synthetic oligonucleotide
acaaatctacgcatcacatagccaatgaggagatgttac

SEQ ID NO: 299520 - DNA, 38 bp, Artificial Sequence
  Description of Artificial Sequence: Synthetic oligonucleotide
caaatctacgcatcacatagccaatgaggagatgttac

SEQ ID NO: 299521 - DNA, 43 bp, Artificial Sequence
  Description of Artificial Sequence: Synthetic oligonucleotide
aaatctacgcatcacatagccaatgaggagatgttacataatc

SEQ ID NO: 299522 - DNA, 42 bp, Artificial Sequence
  Description of Artificial Sequence: Synthetic oligonucleotide
aatctacgcatcacatagccaatgaggagatgttacataatc

SEQ ID NO: 299523 - DNA, 41 bp, Artificial Sequence
  Description of Artificial Sequence: Synthetic oligonucleotide
atctacgcatcacatagccaatgaggagatgttacataatc

SEQ ID NO: 299524 - DNA, 40 bp, Artificial Sequence
  Description of Artificial Sequence: Synthetic oligonucleotide
tctacgcatcacatagccaatgaggagatgttacataatc

SEQ ID NO: 299525 - DNA, 39 bp, Artificial Sequence
  Description of Artificial Sequence: Synthetic oligonucleotide
ctacgcatcacatagccaatgaggagatgttacataatc

SEQ ID NO: 299526 - DNA, 41 bp, Artificial Sequence
  Description of Artificial Sequence: Synthetic oligonucleotide
tacgcatcacatagccaatgaggagatgttacataatcaac

SEQ ID NO: 299527 - DNA, 40 bp, Artificial Sequence
  Description of Artificial Sequence: Synthetic oligonucleotide
acgcatcacatagccaatgaggagatgttacataatcaac

SEQ ID NO: 299528 - DNA, 39 bp, Artificial Sequence
  Description of Artificial Sequence: Synthetic oligonucleotide
cgcatcacatagccaatgaggagatgttacataatcaac

SEQ ID NO: 299529 - DNA, 28 bp, Artificial Sequence
  Description of Artificial Sequence: Synthetic oligonucleotide
atgaaggtcgtaccggggttcctacagg

SEQ ID NO: 299530 - DNA, 27 bp, Artificial Sequence
  Description of Artificial Sequence: Synthetic oligonucleotide
tgaaggtcgtaccggggttcctacagg

SEQ ID NO: 299531 - DNA, 27 bp, Artificial Sequence
  Description of Artificial Sequence: Synthetic oligonucleotide
gaaggtcgtaccggggttcctacagga

SEQ ID NO: 299532 - DNA, 27 bp, Artificial Sequence
  Description of Artificial Sequence: Synthetic oligonucleotide
aaggtcgtaccggggttcctacaggag

SEQ ID NO: 299533 - DNA, 27 bp, Artificial Sequence
  Description of Artificial Sequence: Synthetic oligonucleotide
aggtcgtaccggggttcctacaggaga

SEQ ID NO: 299534 - DNA, 26 bp, Artificial Sequence
  Description of Artificial Sequence: Synthetic oligonucleotide
ggtcgtaccggggttcctacaggaga

SEQ ID NO: 299535 - DNA, 26 bp, Artificial Sequence
  Description of Artificial Sequence: Synthetic oligonucleotide
gtcgtaccggggttcctacaggagag

SEQ ID NO: 299536 - DNA, 26 bp, Artificial Sequence
  Description of Artificial Sequence: Synthetic oligonucleotide
tcgtaccggggttcctacaggagagc

SEQ ID NO: 299537 - DNA, 25 bp, Artificial Sequence
  Description of Artificial Sequence: Synthetic oligonucleotide
cgtaccggggttcctacaggagagc

SEQ ID NO: 299538 - DNA, 26 bp, Artificial Sequence
  Description of Artificial Sequence: Synthetic oligonucleotide
gtaccggggttcctacaggagagcca

SEQ ID NO: 299539 - DNA, 27 bp, Artificial Sequence
  Description of Artificial Sequence: Synthetic oligonucleotide
taccggggttcctacaggagagccaga

SEQ ID NO: 299540 - DNA, 27 bp, Artificial Sequence
  Description of Artificial Sequence: Synthetic oligonucleotide
accggggttcctacaggagagccagat

SEQ ID NO: 299541 - DNA, 26 bp, Artificial Sequence
  Description of Artificial Sequence: Synthetic oligonucleotide
ccggggttcctacaggagagccagat

SEQ ID NO: 299542 - DNA, 27 bp, Artificial Sequence
  Description of Artificial Sequence: Synthetic oligonucleotide
cggggttcctacaggagagccagatct

SEQ ID NO: 299543 - DNA, 27 bp, Artificial Sequence
  Description of Artificial Sequence: Synthetic oligonucleotide
ggggttcctacaggagagccagatctc

SEQ ID NO: 299544 - DNA, 27 bp, Artificial Sequence
  Description of Artificial Sequence: Synthetic oligonucleotide
gggttcctacaggagagccagatctcc

SEQ ID NO: 299545 - DNA, 27 bp, Artificial Sequence
  Description of Artificial Sequence: Synthetic oligonucleotide
ggttcctacaggagagccagatctccg

SEQ ID NO: 299546 - DNA, 27 bp, Artificial Sequence
  Description of Artificial Sequence: Synthetic oligonucleotide
gttcctacaggagagccagatctccgg

SEQ ID NO: 299547 - DNA, 27 bp, Artificial Sequence
  Description of Artificial Sequence: Synthetic oligonucleotide
ttcctacaggagagccagatctccggg

SEQ ID NO: 299548 - DNA, 26 bp, Artificial Sequence
  Description of Artificial Sequence: Synthetic oligonucleotide
tcctacaggagagccagatctccggg

SEQ ID NO: 299549 - DNA, 25 bp, Artificial Sequence
  Description of Artificial Sequence: Synthetic oligonucleotide
cctacaggagagccagatctccggg

SEQ ID NO: 299550 - DNA, 25 bp, Artificial Sequence
  Description of Artificial Sequence: Synthetic oligonucleotide
ctacaggagagccagatctccgggc

SEQ ID NO: 299551 - DNA, 25 bp, Artificial Sequence
  Description of Artificial Sequence: Synthetic oligonucleotide
tacaggagagccagatctccgggcc

SEQ ID NO: 299552 - DNA, 24 bp, Artificial Sequence
  Description of Artificial Sequence: Synthetic oligonucleotide
acaggagagccagatctccgggcc

SEQ ID NO: 299553 - DNA, 23 bp, Artificial Sequence
  Description of Artificial Sequence: Synthetic oligonucleotide
caggagagccagatctccgggcc

SEQ ID NO: 299554 - DNA, 23 bp, Artificial Sequence
  Description of Artificial Sequence: Synthetic oligonucleotide
aggagagccagatctccgggccg

SEQ ID NO: 299555 - DNA, 22 bp, Artificial Sequence
  Description of Artificial Sequence: Synthetic oligonucleotide
ggagagccagatctccgggccg

SEQ ID NO: 299556 - DNA, 22 bp, Artificial Sequence
  Description of Artificial Sequence: Synthetic oligonucleotide
gagagccagatctccgggccgg

SEQ ID NO: 299557 - DNA, 22 bp, Artificial Sequence
  Description of Artificial Sequence: Synthetic oligonucleotide
agagccagatctccgggccggg

SEQ ID NO: 299558 - DNA, 21 bp, Artificial Sequence
  Description of Artificial Sequence: Synthetic oligonucleotide
gagccagatctccgggccggg

SEQ ID NO: 299559 - DNA, 21 bp, Artificial Sequence
  Description of Artificial Sequence: Synthetic oligonucleotide
agccagatctccgggccgggg

SEQ ID NO: 299560 - DNA, 20 bp, Artificial Sequence
  Description of Artificial Sequence: Synthetic oligonucleotide
gccagatctccgggccgggg

SEQ ID NO: 299561 - DNA, 21 bp, Artificial Sequence
  Description of Artificial Sequence: Synthetic oligonucleotide
ccagatctccgggccggggca

SEQ ID NO: 299562 - DNA, 21 bp, Artificial Sequence
  Description of Artificial Sequence: Synthetic oligonucleotide
cagatctccgggccggggcag

SEQ ID NO: 299563 - DNA, 21 bp, Artificial Sequence
  Description of Artificial Sequence: Synthetic oligonucleotide
agatctccgggccggggcagc

SEQ ID NO: 299564 - DNA, 20 bp, Artificial Sequence
  Description of Artificial Sequence: Synthetic oligonucleotide
gatctccgggccggggcagc

SEQ ID NO: 299565 - DNA, 20 bp, Artificial Sequence
  Description of Artificial Sequence: Synthetic oligonucleotide
atctccgggccggggcagcc

SEQ ID NO: 299566 - DNA, 20 bp, Artificial Sequence
  Description of Artificial Sequence: Synthetic oligonucleotide
tctccgggccggggcagcct

SEQ ID NO: 299567 - DNA, 20 bp, Artificial Sequence
  Description of Artificial Sequence: Synthetic oligonucleotide
ctccgggccggggcagcctt

SEQ ID NO: 299568 - DNA, 20 bp, Artificial Sequence
  Description of Artificial Sequence: Synthetic oligonucleotide
tccgggccggggcagccctt

SEQ ID NO: 299569 - DNA, 20 bp, Artificial Sequence
  Description of Artificial Sequence: Synthetic oligonucleotide
ccgggccggggcagcccttt

SEQ ID NO: 299570 - DNA, 20 bp, Artificial Sequence
  Description of Artificial Sequence: Synthetic oligonucleotide
cgggccggggcagccccttt

SEQ ID NO: 299571 - DNA, 20 bp, Artificial Sequence
  Description of Artificial Sequence: Synthetic oligonucleotide
gggccggggcagcccccttt

SEQ ID NO: 299572 - DNA, 20 bp, Artificial Sequence
  Description of Artificial Sequence: Synthetic oligonucleotide
ggccggggcagccccctgtt

SEQ ID NO: 299573 - DNA, 20 bp, Artificial Sequence
  Description of Artificial Sequence: Synthetic oligonucleotide
gccggggcagccccctgtgt

SEQ ID NO: 299574 - DNA, 20 bp, Artificial Sequence
  Description of Artificial Sequence: Synthetic oligonucleotide
ccggggcagccccctgtgtg

SEQ ID NO: 299575 - DNA, 20 bp, Artificial Sequence
  Description of Artificial Sequence: Synthetic oligonucleotide
cggggcagccccctgtgtgg

SEQ ID NO: 299576 - DNA, 21 bp, Artificial Sequence
  Description of Artificial Sequence: Synthetic oligonucleotide
ggggcagccccctgtgtggct

SEQ ID NO: 299577 - DNA, 21 bp, Artificial Sequence
  Description of Artificial Sequence: Synthetic oligonucleotide
gggcagccccctgtgtggctc

SEQ ID NO: 299578 - DNA, 21 bp, Artificial Sequence
  Description of Artificial Sequence: Synthetic oligonucleotide
ggcagccccctgtgtggctcc

SEQ ID NO: 299579 - DNA, 22 bp, Artificial Sequence
  Description of Artificial Sequence: Synthetic oligonucleotide
gcagccccctgtgtggctccgt

SEQ ID NO: 299580 - DNA, 23 bp, Artificial Sequence
  Description of Artificial Sequence: Synthetic oligonucleotide
cagccccctgtgtggctccgtct

SEQ ID NO: 299581 - DNA, 23 bp, Artificial Sequence
  Description of Artificial Sequence: Synthetic oligonucleotide
agccccctgtgtggctccgtctg

SEQ ID NO: 299582 - DNA, 22 bp, Artificial Sequence
  Description of Artificial Sequence: Synthetic oligonucleotide
gccccctgtgtggctccgtctg

SEQ ID NO: 299583 - DNA, 23 bp, Artificial Sequence
  Description of Artificial Sequence: Synthetic oligonucleotide
ccccctgtgtggctccgtctgga

SEQ ID NO: 299584 - DNA, 23 bp, Artificial Sequence
  Description of Artificial Sequence: Synthetic oligonucleotide
cccctgtgtggctccgtctggac

SEQ ID NO: 299585 - DNA, 24 bp, Artificial Sequence
  Description of Artificial Sequence: Synthetic oligonucleotide
ccctgtgtggctccgtctggacga

SEQ ID NO: 299586 - DNA, 24 bp, Artificial Sequence
  Description of Artificial Sequence: Synthetic oligonucleotide
cctgtgtggctccgtctggacgag

SEQ ID NO: 299587 - DNA, 25 bp, Artificial Sequence
  Description of Artificial Sequence: Synthetic oligonucleotide
ctgtgtggctccgtctggacgagct

SEQ ID NO: 299588 - DNA, 27 bp, Artificial Sequence
  Description of Artificial Sequence: Synthetic oligonucleotide
tgtgtggctccgtctggacgagctcta

SEQ ID NO: 299589 - DNA, 26 bp, Artificial Sequence
  Description of Artificial Sequence: Synthetic oligonucleotide
gtgtggctccgtctggacgagctcta

SEQ ID NO: 299590 - DNA, 27 bp, Artificial Sequence
  Description of Artificial Sequence: Synthetic oligonucleotide
tgtggctccgtctggacgagctctact

SEQ ID NO: 299591 - DNA, 26 bp, Artificial Sequence
  Description of Artificial Sequence: Synthetic oligonucleotide
gtggctccgtctggacgagctctact

SEQ ID NO: 299592 - DNA, 26 bp, Artificial Sequence
  Description of Artificial Sequence: Synthetic oligonucleotide
tggctccgtctggacgagctctactc

SEQ ID NO: 299593 - DNA, 25 bp, Artificial Sequence
  Description of Artificial Sequence: Synthetic oligonucleotide
ggctccgtctggacgagctctactc

SEQ ID NO: 299594 - DNA, 27 bp, Artificial Sequence
  Description of Artificial Sequence: Synthetic oligonucleotide
gctccgtctggacgagctctactcgaa

SEQ ID NO: 299595 - DNA, 27 bp, Artificial Sequence
  Description of Artificial Sequence: Synthetic oligonucleotide
ctccgtctggacgagctctactcgaag

SEQ ID NO: 299596 - DNA, 29 bp, Artificial Sequence
  Description of Artificial Sequence: Synthetic oligonucleotide
tccgtctggacgagctctactcgaagaag

SEQ ID NO: 299597 - DNA, 28 bp, Artificial Sequence
  Description of Artificial Sequence: Synthetic oligonucleotide
ccgtctggacgagctctactcgaagaag

SEQ ID NO: 299598 - DNA, 33 bp, Artificial Sequence
  Description of Artificial Sequence: Synthetic oligonucleotide
cgtctggacgagctctactcgaagaagtatatg

SEQ ID NO: 299599 - DNA, 33 bp, Artificial Sequence
  Description of Artificial Sequence: Synthetic oligonucleotide
gtctggacgagctctactcgaagaagtatatgg

SEQ ID NO: 299600 - DNA, 34 bp, Artificial Sequence
  Description of Artificial Sequence: Synthetic oligonucleotide
tctggacgagctctactcgaagaagtatatggtg

SEQ ID NO: 299601 - DNA, 33 bp, Artificial Sequence
  Description of Artificial Sequence: Synthetic oligonucleotide
ctggacgagctctactcgaagaagtatatggtg

SEQ ID NO: 299602 - DNA, 33 bp, Artificial Sequence
  Description of Artificial Sequence: Synthetic oligonucleotide
tggacgagctctactcgaagaagtatatggtgg

SEQ ID NO: 299603 - DNA, 32 bp, Artificial Sequence
  Description of Artificial Sequence: Synthetic oligonucleotide
ggacgagctctactcgaagaagtatatggtgg

SEQ ID NO: 299604 - DNA, 32 bp, Artificial Sequence
  Description of Artificial Sequence: Synthetic oligonucleotide
gacgagctctactcgaagaagtatatggtggg

SEQ ID NO: 299605 - DNA, 34 bp, Artificial Sequence
  Description of Artificial Sequence: Synthetic oligonucleotide
acgagctctactcgaagaagtatatggtgggatc

SEQ ID NO: 299606 - DNA, 33 bp, Artificial Sequence
  Description of Artificial Sequence: Synthetic oligonucleotide
cgagctctactcgaagaagtatatggtgggatc

SEQ ID NO: 299607 - DNA, 34 bp, Artificial Sequence
  Description of Artificial Sequence: Synthetic oligonucleotide
gagctctactcgaagaagtatatggtgggatcag

SEQ ID NO: 299608 - DNA, 34 bp, Artificial Sequence
  Description of Artificial Sequence: Synthetic oligonucleotide
agctctactcgaagaagtatatggtgggatcagc

SEQ ID NO: 299609 - DNA, 33 bp, Artificial Sequence
  Description of Artificial Sequence: Synthetic oligonucleotide
gctctactcgaagaagtatatggtgggatcagc

SEQ ID NO: 299610 - DNA, 34 bp, Artificial Sequence
  Description of Artificial Sequence: Synthetic oligonucleotide
ctctactcgaagaagtatatggtgggatcagctg

SEQ ID NO: 299611 - DNA, 35 bp, Artificial Sequence
  Description of Artificial Sequence: Synthetic oligonucleotide
tctactcgaagaagtatatggtgggatcagctgac

SEQ ID NO: 299612 - DNA, 34 bp, Artificial Sequence
  Description of Artificial Sequence: Synthetic oligonucleotide
ctactcgaagaagtatatggtgggatcagctgac

SEQ ID NO: 299613 - DNA, 35 bp, Artificial Sequence
  Description of Artificial Sequence: Synthetic oligonucleotide
tactcgaagaagtatatggtgggatcagctgactc

SEQ ID NO: 299614 - DNA, 34 bp, Artificial Sequence
  Description of Artificial Sequence: Synthetic oligonucleotide
actcgaagaagtatatggtgggatcagctgactc

SEQ ID NO: 299615 - DNA, 33 bp, Artificial Sequence
  Description of Artificial Sequence: Synthetic oligonucleotide
ctcgaagaagtatatggtgggatcagctgactc

SEQ ID NO: 299616 - DNA, 35 bp, Artificial Sequence
  Description of Artificial Sequence: Synthetic oligonucleotide
tcgaagaagtatatggtgggatcagctgactcttc

SEQ ID NO: 299617 - DNA, 34 bp, Artificial Sequence
  Description of Artificial Sequence: Synthetic oligonucleotide
cgaagaagtatatggtgggatcagctgactcttc

SEQ ID NO: 299618 - DNA, 35 bp, Artificial Sequence
  Description of Artificial Sequence: Synthetic oligonucleotide
gaagaagtatatggtgggatcagctgactcttcag

SEQ ID NO: 299619 - DNA, 35 bp, Artificial Sequence
  Description of Artificial Sequence: Synthetic oligonucleotide
aagaagtatatggtgggatcagctgactcttcagg

SEQ ID NO: 299620 - DNA, 34 bp, Artificial Sequence
  Description of Artificial Sequence: Synthetic oligonucleotide
agaagtatatggtgggatcagctgactcttcagg

SEQ ID NO: 299621 - DNA, 33 bp, Artificial Sequence
  Description of Artificial Sequence: Synthetic oligonucleotide
gaagtatatggtgggatcagctgactcttcagg

SEQ ID NO: 299622 - DNA, 34 bp, Artificial Sequence
  Description of Artificial Sequence: Synthetic oligonucleotide
aagtatatggtgggatcagctgactcttcaggtg

SEQ ID NO: 299623 - DNA, 33 bp, Artificial Sequence
  Description of Artificial Sequence: Synthetic oligonucleotide
agtatatggtgggatcagctgactcttcaggtg

SEQ ID NO: 299624 - DNA, 32 bp, Artificial Sequence
  Description of Artificial Sequence: Synthetic oligonucleotide
gtatatggtgggatcagctgactcttcaggtg

SEQ ID NO: 299625 - DNA, 32 bp, Artificial Sequence
  Description of Artificial Sequence: Synthetic oligonucleotide
tatatggtgggatcagctgactcttcaggtgg

SEQ ID NO: 299626 - DNA, 31 bp, Artificial Sequence
  Description of Artificial Sequence: Synthetic oligonucleotide
atatggtgggatcagctgactcttcaggtgg

SEQ ID NO: 299627 - DNA, 30 bp, Artificial Sequence
  Description of Artificial Sequence: Synthetic oligonucleotide
tatggtgggatcagctgactcttcaggtgg

SEQ ID NO: 299628 - DNA, 29 bp, Artificial Sequence
  Description of Artificial Sequence: Synthetic oligonucleotide
atggtgggatcagctgactcttcaggtgg

SEQ ID NO: 299629 - DNA, 28 bp, Artificial Sequence
  Description of Artificial Sequence: Synthetic oligonucleotide
tggtgggatcagctgactcttcaggtgg

SEQ ID NO: 299630 - DNA, 27 bp, Artificial Sequence
  Description of Artificial Sequence: Synthetic oligonucleotide
ggtgggatcagctgactcttcaggtgg

SEQ ID NO: 299631 - DNA, 29 bp, Artificial Sequence
  Description of Artificial Sequence: Synthetic oligonucleotide
gtgggatcagctgactcttcaggtggttg

SEQ ID NO: 299632 - DNA, 34 bp, Artificial Sequence
  Description of Artificial Sequence: Synthetic oligonucleotide
tgggatcagctgactcttcaggtggttgattttc

SEQ ID NO: 299633 - DNA, 33 bp, Artificial Sequence
  Description of Artificial Sequence: Synthetic oligonucleotide
gggatcagctgactcttcaggtggttgattttc

SEQ ID NO: 299634 - DNA, 34 bp, Artificial Sequence
  Description of Artificial Sequence: Synthetic oligonucleotide
ggatcagctgactcttcaggtggttgattttctg

SEQ ID NO: 299635 - DNA, 34 bp, Artificial Sequence
  Description of Artificial Sequence: Synthetic oligonucleotide
gatcagctgactcttcaggtggttgattttctgc

SEQ ID NO: 299636 - DNA, 35 bp, Artificial Sequence
  Description of Artificial Sequence: Synthetic oligonucleotide
atcagctgactcttcaggtggttgattttctgcag

SEQ ID NO: 299637 - DNA, 34 bp, Artificial Sequence
  Description of Artificial Sequence: Synthetic oligonucleotide
tcagctgactcttcaggtggttgattttctgcag

SEQ ID NO: 299638 - DNA, 33 bp, Artificial Sequence
  Description of Artificial Sequence: Synthetic oligonucleotide
cagctgactcttcaggtggttgattttctgcag

SEQ ID NO: 299639 - DNA, 33 bp, Artificial Sequence
  Description of Artificial Sequence: Synthetic oligonucleotide
agctgactcttcaggtggttgattttctgcagg

SEQ ID NO: 299640 - DNA, 32 bp, Artificial Sequence
  Description of Artificial Sequence: Synthetic oligonucleotide
gctgactcttcaggtggttgattttctgcagg

SEQ ID NO: 299641 - DNA, 34 bp, Artificial Sequence
  Description of Artificial Sequence: Synthetic oligonucleotide
ctgactcttcaggtggttgattttctgcaggatc

SEQ ID NO: 299642 - DNA, 34 bp, Artificial Sequence
  Description of Artificial Sequence: Synthetic oligonucleotide
tgactcttcaggtggttgattttctgcaggatcc

SEQ ID NO: 299643 - DNA, 33 bp, Artificial Sequence
  Description of Artificial Sequence: Synthetic oligonucleotide
gactcttcaggtggttgattttctgcaggatcc

SEQ ID NO: 299644 - DNA, 33 bp, Artificial Sequence
  Description of Artificial Sequence: Synthetic oligonucleotide
actcttcaggtggttgattttctgcaggatccc

SEQ ID NO: 299645 - DNA, 32 bp, Artificial Sequence
  Description of Artificial Sequence: Synthetic oligonucleotide
ctcttcaggtggttgattttctgcaggatccc

SEQ ID NO: 299646 - DNA, 33 bp, Artificial Sequence
  Description of Artificial Sequence: Synthetic oligonucleotide
tcttcaggtggttgattttctgcaggatccctg

SEQ ID NO: 299647 - DNA, 32 bp, Artificial Sequence
  Description of Artificial Sequence: Synthetic oligonucleotide
cttcaggtggttgattttctgcaggatccctg

SEQ ID NO: 299648 - DNA, 32 bp, Artificial Sequence
  Description of Artificial Sequence: Synthetic oligonucleotide
ttcaggtggttgattttctgcaggatccctgc

SEQ ID NO: 299649 - DNA, 31 bp, Artificial Sequence
  Description of Artificial Sequence: Synthetic oligonucleotide
tcaggtggttgattttctgcaggatccctgc

SEQ ID NO: 299650 - DNA, 30 bp, Artificial Sequence
  Description of Artificial Sequence: Synthetic oligonucleotide
caggtggttgattttctgcaggatccctgc

SEQ ID NO: 299651 - DNA, 33 bp, Artificial Sequence
  Description of Artificial Sequence: Synthetic oligonucleotide
aggtggttgattttctgcaggatccctgctttg

SEQ ID NO: 299652 - DNA, 32 bp, Artificial Sequence
  Description of Artificial Sequence: Synthetic oligonucleotide
ggtggttgattttctgcaggatccctgctttg

SEQ ID NO: 299653 - DNA, 32 bp, Artificial Sequence
  Description of Artificial Sequence: Synthetic oligonucleotide
gtggttgattttctgcaggatccctgctttgg

SEQ ID NO: 299654 - DNA, 32 bp, Artificial Sequence
  Description of Artificial Sequence: Synthetic oligonucleotide
tggttgattttctgcaggatccctgctttggc

SEQ ID NO: 299655 - DNA, 31 bp, Artificial Sequence
  Description of Artificial Sequence: Synthetic oligonucleotide
ggttgattttctgcaggatccctgctttggc

SEQ ID NO: 299656 - DNA, 31 bp, Artificial Sequence
  Description of Artificial Sequence: Synthetic oligonucleotide
gttgattttctgcaggatccctgctttggcc

SEQ ID NO: 299657 - DNA, 33 bp, Artificial Sequence
  Description of Artificial Sequence: Synthetic oligonucleotide
ttgattttctgcaggatccctgctttggccaag

SEQ ID NO: 299658 - DNA, 32 bp, Artificial Sequence
  Description of Artificial Sequence: Synthetic oligonucleotide
tgattttctgcaggatccctgctttggccaag

SEQ ID NO: 299659 - DNA, 31 bp, Artificial Sequence
  Description of Artificial Sequence: Synthetic oligonucleotide
gattttctgcaggatccctgctttggccaag

SEQ ID NO: 299660 - DNA, 31 bp, Artificial Sequence
  Description of Artificial Sequence: Synthetic oligonucleotide
attttctgcaggatccctgctttggccaagg

SEQ ID NO: 299661 - DNA, 30 bp, Artificial Sequence
  Description of Artificial Sequence: Synthetic oligonucleotide
ttttctgcaggatccctgctttggccaagg

SEQ ID NO: 299662 - DNA, 29 bp, Artificial Sequence
  Description of Artificial Sequence: Synthetic oligonucleotide
tttctgcaggatccctgctttggccaagg

SEQ ID NO: 299663 - DNA, 28 bp, Artificial Sequence
  Description of Artificial Sequence: Synthetic oligonucleotide
ttctgcaggatccctgctttggccaagg

SEQ ID NO: 299664 - DNA, 27 bp, Artificial Sequence
  Description of Artificial Sequence: Synthetic oligonucleotide
tctgcaggatccctgctttggccaagg

SEQ ID NO: 299665 - DNA, 27 bp, Artificial Sequence
  Description of Artificial Sequence: Synthetic oligonucleotide
ctgcaggatccctgctttggccaagga

SEQ ID NO: 299666 - DNA, 27 bp, Artificial Sequence
  Description of Artificial Sequence: Synthetic oligonucleotide
tgcaggatccctgctttggccaaggag

SEQ ID NO: 299667 - DNA, 27 bp, Artificial Sequence
  Description of Artificial Sequence: Synthetic oligonucleotide
gcaggatccctgctttggccaaggaga

SEQ ID NO: 299668 - DNA, 28 bp, Artificial Sequence
  Description of Artificial Sequence: Synthetic oligonucleotide
caggatccctgctttggccaaggagatg

SEQ ID NO: 299669 - DNA, 28 bp, Artificial Sequence
  Description of Artificial Sequence: Synthetic oligonucleotide
aggatccctgctttggccaaggagatgc

SEQ ID NO: 299670 - DNA, 27 bp, Artificial Sequence
  Description of Artificial Sequence: Synthetic oligonucleotide
ggatccctgctttggccaaggagatgc

SEQ ID NO: 299671 - DNA, 28 bp, Artificial Sequence
  Description of Artificial Sequence: Synthetic oligonucleotide
gatccctgctttggccaaggagatgctc

SEQ ID NO: 299672 - DNA, 29 bp, Artificial Sequence
  Description of Artificial Sequence: Synthetic oligonucleotide
atccctgctttggccaaggagatgctctc

SEQ ID NO: 299673 - DNA, 28 bp, Artificial Sequence
  Description of Artificial Sequence: Synthetic oligonucleotide
tccctgctttggccaaggagatgctctc

SEQ ID NO: 299674 - DNA, 27 bp, Artificial Sequence
  Description of Artificial Sequence: Synthetic oligonucleotide
ccctgctttggccaaggagatgctctc

SEQ ID NO: 299675 - DNA, 32 bp, Artificial Sequence
  Description of Artificial Sequence: Synthetic oligonucleotide
cctgctttggccaaggagatgctctcattaac

SEQ ID NO: 299676 - DNA, 32 bp, Artificial Sequence
  Description of Artificial Sequence: Synthetic oligonucleotide
ctgctttggccaaggagatgctctcattaacc

SEQ ID NO: 299677 - DNA, 37 bp, Artificial Sequence
  Description of Artificial Sequence: Synthetic oligonucleotide
tgctttggccaaggagatgctctcattaacctttatc

SEQ ID NO: 299678 - DNA, 36 bp, Artificial Sequence
  Description of Artificial Sequence: Synthetic oligonucleotide
gctttggccaaggagatgctctcattaacctttatc

SEQ ID NO: 299679 - DNA, 40 bp, Artificial Sequence
  Description of Artificial Sequence: Synthetic oligonucleotide
ctttggccaaggagatgctctcattaacctttatcaaaac

SEQ ID NO: 299680 - DNA, 44 bp, Artificial Sequence
  Description of Artificial Sequence: Synthetic oligonucleotide
tttggccaaggagatgctctcattaacctttatcaaaactttag

SEQ ID NO: 299681 - DNA, 43 bp, Artificial Sequence
  Description of Artificial Sequence: Synthetic oligonucleotide
ttggccaaggagatgctctcattaacctttatcaaaactttag

SEQ ID NO: 299682 - DNA, 42 bp, Artificial Sequence
  Description of Artificial Sequence: Synthetic oligonucleotide
tggccaaggagatgctctcattaacctttatcaaaactttag

SEQ ID NO: 299683 - DNA, 41 bp, Artificial Sequence
  Description of Artificial Sequence: Synthetic oligonucleotide
ggccaaggagatgctctcattaacctttatcaaaactttag

SEQ ID NO: 299684 - DNA, 41 bp, Artificial Sequence
  Description of Artificial Sequence: Synthetic oligonucleotide
gccaaggagatgctctcattaacctttatcaaaactttagc

SEQ ID NO: 299685 - DNA, 42 bp, Artificial Sequence
  Description of Artificial Sequence: Synthetic oligonucleotide
ccaaggagatgctctcattaacctttatcaaaactttagctc

SEQ ID NO: 299686 - DNA, 43 bp, Artificial Sequence
  Description of Artificial Sequence: Synthetic oligonucleotide
caaggagatgctctcattaacctttatcaaaactttagctcag

SEQ ID NO: 299687 - DNA, 44 bp, Artificial Sequence
  Description of Artificial Sequence: Synthetic oligonucleotide
aaggagatgctctcattaacctttatcaaaactttagctcagtg

SEQ ID NO: 299688 - DNA, 43 bp, Artificial Sequence
  Description of Artificial Sequence: Synthetic oligonucleotide
aggagatgctctcattaacctttatcaaaactttagctcagtg

SEQ ID NO: 299689 - DNA, 42 bp, Artificial Sequence
  Description of Artificial Sequence: Synthetic oligonucleotide
ggagatgctctcattaacctttatcaaaactttagctcagtg

SEQ ID NO: 299690 - DNA, 47 bp, Artificial Sequence
  Description of Artificial Sequence: Synthetic oligonucleotide
gagatgctctcattaacctttatcaaaactttagctcagtgaattag

SEQ ID NO: 299691 - DNA, 49 bp, Artificial Sequence
  Description of Artificial Sequence: Synthetic oligonucleotide
agatgctctcattaacctttatcaaaactttagctcagtgaattagaac

SEQ ID NO: 299692 - DNA, 48 bp, Artificial Sequence
  Description of Artificial Sequence: Synthetic oligonucleotide
gatgctctcattaacctttatcaaaactttagctcagtgaattagaac

SEQ ID NO: 299693 - DNA, 49 bp, Artificial Sequence
  Description of Artificial Sequence: Synthetic oligonucleotide
atgctctcattaacctttatcaaaactttagctcagtgaattagaacac

SEQ ID NO: 299694 - DNA, 48 bp, Artificial Sequence
  Description of Artificial Sequence: Synthetic oligonucleotide
tgctctcattaacctttatcaaaactttagctcagtgaattagaacac

SEQ ID NO: 299695 - DNA, 47 bp, Artificial Sequence
  Description of Artificial Sequence: Synthetic oligonucleotide
gctctcattaacctttatcaaaactttagctcagtgaattagaacac

SEQ ID NO: 299696 - DNA, 48 bp, Artificial Sequence
  Description of Artificial Sequence: Synthetic oligonucleotide
ctctcattaacctttatcaaaactttagctcagtgaattagaacacag

SEQ ID NO: 299697 - DNA, 48 bp, Artificial Sequence
  Description of Artificial Sequence: Synthetic oligonucleotide
tctcattaacctttatcaaaactttagctcagtgaattagaacacagg

SEQ ID NO: 299698 - DNA, 47 bp, Artificial Sequence
  Description of Artificial Sequence: Synthetic oligonucleotide
ctcattaacctttatcaaaactttagctcagtgaattagaacacagg

SEQ ID NO: 299699 - DNA, 47 bp, Artificial Sequence
  Description of Artificial Sequence: Synthetic oligonucleotide
tcattaacctttatcaaaactttagctcagtgaattagaacacaggg

SEQ ID NO: 299700 - DNA, 46 bp, Artificial Sequence
  Description of Artificial Sequence: Synthetic oligonucleotide
cattaacctttatcaaaactttagctcagtgaattagaacacaggg

SEQ ID NO: 299701 - DNA, 47 bp, Artificial Sequence
  Description of Artificial Sequence: Synthetic oligonucleotide
attaacctttatcaaaactttagctcagtgaattagaacacagggag

SEQ ID NO: 299702 - DNA, 46 bp, Artificial Sequence
  Description of Artificial Sequence: Synthetic oligonucleotide
ttaacctttatcaaaactttagctcagtgaattagaacacagggag

SEQ ID NO: 299703 - DNA, 45 bp, Artificial Sequence
  Description of Artificial Sequence: Synthetic oligonucleotide
taacctttatcaaaactttagctcagtgaattagaacacagggag

SEQ ID NO: 299704 - DNA, 44 bp, Artificial Sequence
  Description of Artificial Sequence: Synthetic oligonucleotide
aacctttatcaaaactttagctcagtgaattagaacacagggag

SEQ ID NO: 299705 - DNA, 43 bp, Artificial Sequence
  Description of Artificial Sequence: Synthetic oligonucleotide
acctttatcaaaactttagctcagtgaattagaacacagggag

SEQ ID NO: 299706 - DNA, 42 bp, Artificial Sequence
  Description of Artificial Sequence: Synthetic oligonucleotide
cctttatcaaaactttagctcagtgaattagaacacagggag

SEQ ID NO: 299707 - DNA, 44 bp, Artificial Sequence
  Description of Artificial Sequence: Synthetic oligonucleotide
ctttatcaaaactttagctcagtgaattagaacacagggagaac

SEQ ID NO: 299708 - DNA, 44 bp, Artificial Sequence
  Description of Artificial Sequence: Synthetic oligonucleotide
tttatcaaaactttagctcagtgaattagaacacagggagaacc

SEQ ID NO: 299709 - DNA, 43 bp, Artificial Sequence
  Description of Artificial Sequence: Synthetic oligonucleotide
ttatcaaaactttagctcagtgaattagaacacagggagaacc

SEQ ID NO: 299710 - DNA, 42 bp, Artificial Sequence
  Description of Artificial Sequence: Synthetic oligonucleotide
tatcaaaactttagctcagtgaattagaacacagggagaacc

SEQ ID NO: 299711 - DNA, 41 bp, Artificial Sequence
  Description of Artificial Sequence: Synthetic oligonucleotide
atcaaaactttagctcagtgaattagaacacagggagaacc

SEQ ID NO: 299712 - DNA, 40 bp, Artificial Sequence
  Description of Artificial Sequence: Synthetic oligonucleotide
tcaaaactttagctcagtgaattagaacacagggagaacc

SEQ ID NO: 299713 - DNA, 39 bp, Artificial Sequence
  Description of Artificial Sequence: Synthetic oligonucleotide
caaaactttagctcagtgaattagaacacagggagaacc

SEQ ID NO: 299714 - DNA, 39 bp, Artificial Sequence
  Description of Artificial Sequence: Synthetic oligonucleotide
aaaactttagctcagtgaattagaacacagggagaaccc

SEQ ID NO: 299715 - DNA, 38 bp, Artificial Sequence
  Description of Artificial Sequence: Synthetic oligonucleotide
aaactttagctcagtgaattagaacacagggagaaccc

SEQ ID NO: 299716 - DNA, 37 bp, Artificial Sequence
  Description of Artificial Sequence: Synthetic oligonucleotide
aactttagctcagtgaattagaacacagggagaaccc

SEQ ID NO: 299717 - DNA, 36 bp, Artificial Sequence
  Description of Artificial Sequence: Synthetic oligonucleotide
actttagctcagtgaattagaacacagggagaaccc

SEQ ID NO: 299718 - DNA, 35 bp, Artificial Sequence
  Description of Artificial Sequence: Synthetic oligonucleotide
ctttagctcagtgaattagaacacagggagaaccc

SEQ ID NO: 299719 - DNA, 38 bp, Artificial Sequence
  Description of Artificial Sequence: Synthetic oligonucleotide
tttagctcagtgaattagaacacagggagaaccctttc

SEQ ID NO: 299720 - DNA, 37 bp, Artificial Sequence
  Description of Artificial Sequence: Synthetic oligonucleotide
ttagctcagtgaattagaacacagggagaaccctttc

SEQ ID NO: 299721 - DNA, 36 bp, Artificial Sequence
  Description of Artificial Sequence: Synthetic oligonucleotide
tagctcagtgaattagaacacagggagaaccctttc

SEQ ID NO: 299722 - DNA, 35 bp, Artificial Sequence
  Description of Artificial Sequence: Synthetic oligonucleotide
agctcagtgaattagaacacagggagaaccctttc

SEQ ID NO: 299723 - DNA, 34 bp, Artificial Sequence
  Description of Artificial Sequence: Synthetic oligonucleotide
gctcagtgaattagaacacagggagaaccctttc

SEQ ID NO: 299724 - DNA, 35 bp, Artificial Sequence
  Description of Artificial Sequence: Synthetic oligonucleotide
ctcagtgaattagaacacagggagaaccctttctc

SEQ ID NO: 299725 - DNA, 35 bp, Artificial Sequence
  Description of Artificial Sequence: Synthetic oligonucleotide
tcagtgaattagaacacagggagaaccctttctcc

SEQ ID NO: 299726 - DNA, 34 bp, Artificial Sequence
  Description of Artificial Sequence: Synthetic oligonucleotide
cagtgaattagaacacagggagaaccctttctcc

SEQ ID NO: 299727 - DNA, 34 bp, Artificial Sequence
  Description of Artificial Sequence: Synthetic oligonucleotide
agtgaattagaacacagggagaaccctttctccc

SEQ ID NO: 299728 - DNA, 33 bp, Artificial Sequence
  Description of Artificial Sequence: Synthetic oligonucleotide
gtgaattagaacacagggagaaccctttctccc

SEQ ID NO: 299729 - DNA, 34 bp, Artificial Sequence
  Description of Artificial Sequence: Synthetic oligonucleotide
tgaattagaacacagggagaaccctttctccctc

SEQ ID NO: 299730 - DNA, 33 bp, Artificial Sequence
  Description of Artificial Sequence: Synthetic oligonucleotide
gaattagaacacagggagaaccctttctccctc

SEQ ID NO: 299731 - DNA, 33 bp, Artificial Sequence
  Description of Artificial Sequence: Synthetic oligonucleotide
aattagaacacagggagaaccctttctccctcg

SEQ ID NO: 299732 - DNA, 32 bp, Artificial Sequence
  Description of Artificial Sequence: Synthetic oligonucleotide
attagaacacagggagaaccctttctccctcg

SEQ ID NO: 299733 - DNA, 31 bp, Artificial Sequence
  Description of Artificial Sequence: Synthetic oligonucleotide
ttagaacacagggagaaccctttctccctcg

SEQ ID NO: 299734 - DNA, 30 bp, Artificial Sequence
  Description of Artificial Sequence: Synthetic oligonucleotide
tagaacacagggagaaccctttctccctcg

SEQ ID NO: 299735 - DNA, 29 bp, Artificial Sequence
  Description of Artificial Sequence: Synthetic oligonucleotide
agaacacagggagaaccctttctccctcg

SEQ ID NO: 299736 - DNA, 28 bp, Artificial Sequence
  Description of Artificial Sequence: Synthetic oligonucleotide
gaacacagggagaaccctttctccctcg

SEQ ID NO: 299737 - DNA, 29 bp, Artificial Sequence
  Description of Artificial Sequence: Synthetic oligonucleotide
aacacagggagaaccctttctccctcgtg

SEQ ID NO: 299738 - DNA, 28 bp, Artificial Sequence
  Description of Artificial Sequence: Synthetic oligonucleotide
acacagggagaaccctttctccctcgtg

SEQ ID NO: 299739 - DNA, 27 bp, Artificial Sequence
  Description of Artificial Sequence: Synthetic oligonucleotide
cacagggagaaccctttctccctcgtg

SEQ ID NO: 299740 - DNA, 27 bp, Artificial Sequence
  Description of Artificial Sequence: Synthetic oligonucleotide
acagggagaaccctttctccctcgtgc

SEQ ID NO: 299741 - DNA, 27 bp, Artificial Sequence
  Description of Artificial Sequence: Synthetic oligonucleotide
cagggagaaccctttctccctcgtgca

SEQ ID NO: 299742 - DNA, 30 bp, Artificial Sequence
  Description of Artificial Sequence: Synthetic oligonucleotide
agggagaaccctttctccctcgtgcaaatc

SEQ ID NO: 299743 - DNA, 29 bp, Artificial Sequence
  Description of Artificial Sequence: Synthetic oligonucleotide
gggagaaccctttctccctcgtgcaaatc

SEQ ID NO: 299744 - DNA, 32 bp, Artificial Sequence
  Description of Artificial Sequence: Synthetic oligonucleotide
ggagaaccctttctccctcgtgcaaatcattc

SEQ ID NO: 299745 - DNA, 34 bp, Artificial Sequence
  Description of Artificial Sequence: Synthetic oligonucleotide
gagaaccctttctccctcgtgcaaatcattcatc

SEQ ID NO: 299746 - DNA, 36 bp, Artificial Sequence
  Description of Artificial Sequence: Synthetic oligonucleotide
agaaccctttctccctcgtgcaaatcattcatcatg

SEQ ID NO: 299747 - DNA, 35 bp, Artificial Sequence
  Description of Artificial Sequence: Synthetic oligonucleotide
gaaccctttctccctcgtgcaaatcattcatcatg

SEQ ID NO: 299748 - DNA, 37 bp, Artificial Sequence
  Description of Artificial Sequence: Synthetic oligonucleotide
aaccctttctccctcgtgcaaatcattcatcatgtag

SEQ ID NO: 299749 - DNA, 36 bp, Artificial Sequence
  Description of Artificial Sequence: Synthetic oligonucleotide
accctttctccctcgtgcaaatcattcatcatgtag

SEQ ID NO: 299750 - DNA, 35 bp, Artificial Sequence
  Description of Artificial Sequence: Synthetic oligonucleotide
ccctttctccctcgtgcaaatcattcatcatgtag

SEQ ID NO: 299751 - DNA, 38 bp, Artificial Sequence
  Description of Artificial Sequence: Synthetic oligonucleotide
cctttctccctcgtgcaaatcattcatcatgtagtaag

SEQ ID NO: 299752 - DNA, 39 bp, Artificial Sequence
  Description of Artificial Sequence: Synthetic oligonucleotide
ctttctccctcgtgcaaatcattcatcatgtagtaagac

SEQ ID NO: 299753 - DNA, 40 bp, Artificial Sequence
  Description of Artificial Sequence: Synthetic oligonucleotide
tttctccctcgtgcaaatcattcatcatgtagtaagacag

SEQ ID NO: 299754 - DNA, 39 bp, Artificial Sequence
  Description of Artificial Sequence: Synthetic oligonucleotide
ttctccctcgtgcaaatcattcatcatgtagtaagacag

SEQ ID NO: 299755 - DNA, 38 bp, Artificial Sequence
  Description of Artificial Sequence: Synthetic oligonucleotide
tctccctcgtgcaaatcattcatcatgtagtaagacag

SEQ ID NO: 299756 - DNA, 37 bp, Artificial Sequence
  Description of Artificial Sequence: Synthetic oligonucleotide
ctccctcgtgcaaatcattcatcatgtagtaagacag

SEQ ID NO: 299757 - DNA, 39 bp, Artificial Sequence
  Description of Artificial Sequence: Synthetic oligonucleotide
tccctcgtgcaaatcattcatcatgtagtaagacagatg

SEQ ID NO: 299758 - DNA, 38 bp, Artificial Sequence
  Description of Artificial Sequence: Synthetic oligonucleotide
ccctcgtgcaaatcattcatcatgtagtaagacagatg

SEQ ID NO: 299759 - DNA, 39 bp, Artificial Sequence
  Description of Artificial Sequence: Synthetic oligonucleotide
cctcgtgcaaatcattcatcatgtagtaagacagatgtc

SEQ ID NO: 299760 - DNA, 40 bp, Artificial Sequence
  Description of Artificial Sequence: Synthetic oligonucleotide
ctcgtgcaaatcattcatcatgtagtaagacagatgtctg

SEQ ID NO: 299761 - DNA, 42 bp, Artificial Sequence
  Description of Artificial Sequence: Synthetic oligonucleotide
tcgtgcaaatcattcatcatgtagtaagacagatgtctgatc

SEQ ID NO: 299762 - DNA, 41 bp, Artificial Sequence
  Description of Artificial Sequence: Synthetic oligonucleotide
cgtgcaaatcattcatcatgtagtaagacagatgtctgatc

SEQ ID NO: 299763 - DNA, 41 bp, Artificial Sequence
  Description of Artificial Sequence: Synthetic oligonucleotide
gtgcaaatcattcatcatgtagtaagacagatgtctgatcc

SEQ ID NO: 299764 - DNA, 45 bp, Artificial Sequence
  Description of Artificial Sequence: Synthetic oligonucleotide
tgcaaatcattcatcatgtagtaagacagatgtctgatcctattg

SEQ ID NO: 299765 - DNA, 44 bp, Artificial Sequence
  Description of Artificial Sequence: Synthetic oligonucleotide
gcaaatcattcatcatgtagtaagacagatgtctgatcctattg

SEQ ID NO: 299766 - DNA, 45 bp, Artificial Sequence
  Description of Artificial Sequence: Synthetic oligonucleotide
caaatcattcatcatgtagtaagacagatgtctgatcctattgtg

SEQ ID NO: 299767 - DNA, 45 bp, Artificial Sequence
  Description of Artificial Sequence: Synthetic oligonucleotide
aaatcattcatcatgtagtaagacagatgtctgatcctattgtgg

SEQ ID NO: 299768 - DNA, 44 bp, Artificial Sequence
  Description of Artificial Sequence: Synthetic oligonucleotide
aatcattcatcatgtagtaagacagatgtctgatcctattgtgg

SEQ ID NO: 299769 - DNA, 43 bp, Artificial Sequence
  Description of Artificial Sequence: Synthetic oligonucleotide
atcattcatcatgtagtaagacagatgtctgatcctattgtgg

SEQ ID NO: 299770 - DNA, 42 bp, Artificial Sequence
  Description of Artificial Sequence: Synthetic oligonucleotide
tcattcatcatgtagtaagacagatgtctgatcctattgtgg

SEQ ID NO: 299771 - DNA, 41 bp, Artificial Sequence
  Description of Artificial Sequence: Synthetic oligonucleotide
cattcatcatgtagtaagacagatgtctgatcctattgtgg

SEQ ID NO: 299772 - DNA, 41 bp, Artificial Sequence
  Description of Artificial Sequence: Synthetic oligonucleotide
attcatcatgtagtaagacagatgtctgatcctattgtggc

SEQ ID NO: 299773 - DNA, 40 bp, Artificial Sequence
  Description of Artificial Sequence: Synthetic oligonucleotide
ttcatcatgtagtaagacagatgtctgatcctattgtggc

SEQ ID NO: 299774 - DNA, 39 bp, Artificial Sequence
  Description of Artificial Sequence: Synthetic oligonucleotide
tcatcatgtagtaagacagatgtctgatcctattgtggc

SEQ ID NO: 299775 - DNA, 38 bp, Artificial Sequence
  Description of Artificial Sequence: Synthetic oligonucleotide
catcatgtagtaagacagatgtctgatcctattgtggc

SEQ ID NO: 299776 - DNA, 39 bp, Artificial Sequence
  Description of Artificial Sequence: Synthetic oligonucleotide
atcatgtagtaagacagatgtctgatcctattgtggctc

SEQ ID NO: 299777 - DNA, 38 bp, Artificial Sequence
  Description of Artificial Sequence: Synthetic oligonucleotide
tcatgtagtaagacagatgtctgatcctattgtggctc

SEQ ID NO: 299778 - DNA, 37 bp, Artificial Sequence
  Description of Artificial Sequence: Synthetic oligonucleotide
catgtagtaagacagatgtctgatcctattgtggctc

SEQ ID NO: 299779 - DNA, 40 bp, Artificial Sequence
  Description of Artificial Sequence: Synthetic oligonucleotide
atgtagtaagacagatgtctgatcctattgtggctctaac

SEQ ID NO: 299780 - DNA, 39 bp, Artificial Sequence
  Description of Artificial Sequence: Synthetic oligonucleotide
tgtagtaagacagatgtctgatcctattgtggctctaac

SEQ ID NO: 299781 - DNA, 38 bp, Artificial Sequence
  Description of Artificial Sequence: Synthetic oligonucleotide
gtagtaagacagatgtctgatcctattgtggctctaac

SEQ ID NO: 299782 - DNA, 42 bp, Artificial Sequence
  Description of Artificial Sequence: Synthetic oligonucleotide
tagtaagacagatgtctgatcctattgtggctctaacttttc

SEQ ID NO: 299783 - DNA, 41 bp, Artificial Sequence
  Description of Artificial Sequence: Synthetic oligonucleotide
agtaagacagatgtctgatcctattgtggctctaacttttc

SEQ ID NO: 299784 - DNA, 40 bp, Artificial Sequence
  Description of Artificial Sequence: Synthetic oligonucleotide
gtaagacagatgtctgatcctattgtggctctaacttttc

SEQ ID NO: 299785 - DNA, 41 bp, Artificial Sequence
  Description of Artificial Sequence: Synthetic oligonucleotide
taagacagatgtctgatcctattgtggctctaacttttctg

SEQ ID NO: 299786 - DNA, 40 bp, Artificial Sequence
  Description of Artificial Sequence: Synthetic oligonucleotide
aagacagatgtctgatcctattgtggctctaacttttctg

SEQ ID NO: 299787 - DNA, 39 bp, Artificial Sequence
  Description of Artificial Sequence: Synthetic oligonucleotide
agacagatgtctgatcctattgtggctctaacttttctg

SEQ ID NO: 299788 - DNA, 38 bp, Artificial Sequence
  Description of Artificial Sequence: Synthetic oligonucleotide
gacagatgtctgatcctattgtggctctaacttttctg

SEQ ID NO: 299789 - DNA, 38 bp, Artificial Sequence
  Description of Artificial Sequence: Synthetic oligonucleotide
acagatgtctgatcctattgtggctctaacttttctgc

SEQ ID NO: 299790 - DNA, 37 bp, Artificial Sequence
  Description of Artificial Sequence: Synthetic oligonucleotide
cagatgtctgatcctattgtggctctaacttttctgc

SEQ ID NO: 299791 - DNA, 41 bp, Artificial Sequence
  Description of Artificial Sequence: Synthetic oligonucleotide
agatgtctgatcctattgtggctctaacttttctgcaaaag

SEQ ID NO: 299792 - DNA, 40 bp, Artificial Sequence
  Description of Artificial Sequence: Synthetic oligonucleotide
gatgtctgatcctattgtggctctaacttttctgcaaaag

SEQ ID NO: 299793 - DNA, 41 bp, Artificial Sequence
  Description of Artificial Sequence: Synthetic oligonucleotide
atgtctgatcctattgtggctctaacttttctgcaaaagac

SEQ ID NO: 299794 - DNA, 40 bp, Artificial Sequence
  Description of Artificial Sequence: Synthetic oligonucleotide
tgtctgatcctattgtggctctaacttttctgcaaaagac

SEQ ID NO: 299795 - DNA, 39 bp, Artificial Sequence
  Description of Artificial Sequence: Synthetic oligonucleotide
gtctgatcctattgtggctctaacttttctgcaaaagac

SEQ ID NO: 299796 - DNA, 40 bp, Artificial Sequence
  Description of Artificial Sequence: Synthetic oligonucleotide
tctgatcctattgtggctctaacttttctgcaaaagactc

SEQ ID NO: 299797 - DNA, 39 bp, Artificial Sequence
  Description of Artificial Sequence: Synthetic oligonucleotide
ctgatcctattgtggctctaacttttctgcaaaagactc

SEQ ID NO: 299798 - DNA, 39 bp, Artificial Sequence
  Description of Artificial Sequence: Synthetic oligonucleotide
tgatcctattgtggctctaacttttctgcaaaagactcc

SEQ ID NO: 299799 - DNA, 38 bp, Artificial Sequence
  Description of Artificial Sequence: Synthetic oligonucleotide
gatcctattgtggctctaacttttctgcaaaagactcc

SEQ ID NO: 299800 - DNA, 39 bp, Artificial Sequence
  Description of Artificial Sequence: Synthetic oligonucleotide
atcctattgtggctctaacttttctgcaaaagactcctg

SEQ ID NO: 299801 - DNA, 38 bp, Artificial Sequence
  Description of Artificial Sequence: Synthetic oligonucleotide
tcctattgtggctctaacttttctgcaaaagactcctg

SEQ ID NO: 299802 - DNA, 37 bp, Artificial Sequence
  Description of Artificial Sequence: Synthetic oligonucleotide
cctattgtggctctaacttttctgcaaaagactcctg

SEQ ID NO: 299803 - DNA, 38 bp, Artificial Sequence
  Description of Artificial Sequence: Synthetic oligonucleotide
ctattgtggctctaacttttctgcaaaagactcctgag

SEQ ID NO: 299804 - DNA, 40 bp, Artificial Sequence
  Description of Artificial Sequence: Synthetic oligonucleotide
tattgtggctctaacttttctgcaaaagactcctgagaag

SEQ ID NO: 299805 - DNA, 39 bp, Artificial Sequence
  Description of Artificial Sequence: Synthetic oligonucleotide
attgtggctctaacttttctgcaaaagactcctgagaag

SEQ ID NO: 299806 - DNA, 38 bp, Artificial Sequence
  Description of Artificial Sequence: Synthetic oligonucleotide
ttgtggctctaacttttctgcaaaagactcctgagaag

SEQ ID NO: 299807 - DNA, 37 bp, Artificial Sequence
  Description of Artificial Sequence: Synthetic oligonucleotide
tgtggctctaacttttctgcaaaagactcctgagaag

SEQ ID NO: 299808 - DNA, 36 bp, Artificial Sequence
  Description of Artificial Sequence: Synthetic oligonucleotide
gtggctctaacttttctgcaaaagactcctgagaag

SEQ ID NO: 299809 - DNA, 36 bp, Artificial Sequence
  Description of Artificial Sequence: Synthetic oligonucleotide
tggctctaacttttctgcaaaagactcctgagaagg

SEQ ID NO: 299810 - DNA, 35 bp, Artificial Sequence
  Description of Artificial Sequence: Synthetic oligonucleotide
ggctctaacttttctgcaaaagactcctgagaagg

SEQ ID NO: 299811 - DNA, 36 bp, Artificial Sequence
  Description of Artificial Sequence: Synthetic oligonucleotide
gctctaacttttctgcaaaagactcctgagaaggtc

SEQ ID NO: 299812 - DNA, 40 bp, Artificial Sequence
  Description of Artificial Sequence: Synthetic oligonucleotide
ctctaacttttctgcaaaagactcctgagaaggtcaaaag

SEQ ID NO: 299813 - DNA, 42 bp, Artificial Sequence
  Description of Artificial Sequence: Synthetic oligonucleotide
tctaacttttctgcaaaagactcctgagaaggtcaaaagtag

SEQ ID NO: 299814 - DNA, 41 bp, Artificial Sequence
  Description of Artificial Sequence: Synthetic oligonucleotide
ctaacttttctgcaaaagactcctgagaaggtcaaaagtag

SEQ ID NO: 299815 - DNA, 42 bp, Artificial Sequence
  Description of Artificial Sequence: Synthetic oligonucleotide
taacttttctgcaaaagactcctgagaaggtcaaaagtagtc

SEQ ID NO: 299816 - DNA, 41 bp, Artificial Sequence
  Description of Artificial Sequence: Synthetic oligonucleotide
aacttttctgcaaaagactcctgagaaggtcaaaagtagtc

SEQ ID NO: 299817 - DNA, 40 bp, Artificial Sequence
  Description of Artificial Sequence: Synthetic oligonucleotide
acttttctgcaaaagactcctgagaaggtcaaaagtagtc

SEQ ID NO: 299818 - DNA, 39 bp, Artificial Sequence
  Description of Artificial Sequence: Synthetic oligonucleotide
cttttctgcaaaagactcctgagaaggtcaaaagtagtc

SEQ ID NO: 299819 - DNA, 41 bp, Artificial Sequence
  Description of Artificial Sequence: Synthetic oligonucleotide
ttttctgcaaaagactcctgagaaggtcaaaagtagtcatg

SEQ ID NO: 299820 - DNA, 40 bp, Artificial Sequence
  Description of Artificial Sequence: Synthetic oligonucleotide
tttctgcaaaagactcctgagaaggtcaaaagtagtcatg

SEQ ID NO: 299821 - DNA, 39 bp, Artificial Sequence
  Description of Artificial Sequence: Synthetic oligonucleotide
ttctgcaaaagactcctgagaaggtcaaaagtagtcatg

SEQ ID NO: 299822 - DNA, 38 bp, Artificial Sequence
  Description of Artificial Sequence: Synthetic oligonucleotide
tctgcaaaagactcctgagaaggtcaaaagtagtcatg

SEQ ID NO: 299823 - DNA, 37 bp, Artificial Sequence
  Description of Artificial Sequence: Synthetic oligonucleotide
ctgcaaaagactcctgagaaggtcaaaagtagtcatg

SEQ ID NO: 299824 - DNA, 38 bp, Artificial Sequence
  Description of Artificial Sequence: Synthetic oligonucleotide
tgcaaaagactcctgagaaggtcaaaagtagtcatgag

SEQ ID NO: 299825 - DNA, 37 bp, Artificial Sequence
  Description of Artificial Sequence: Synthetic oligonucleotide
gcaaaagactcctgagaaggtcaaaagtagtcatgag

SEQ ID NO: 299826 - DNA, 37 bp, Artificial Sequence
  Description of Artificial Sequence: Synthetic oligonucleotide
caaaagactcctgagaaggtcaaaagtagtcatgagg

SEQ ID NO: 299827 - DNA, 37 bp, Artificial Sequence
  Description of Artificial Sequence: Synthetic oligonucleotide
aaaagactcctgagaaggtcaaaagtagtcatgaggc

SEQ ID NO: 299828 - DNA, 36 bp, Artificial Sequence
  Description of Artificial Sequence: Synthetic oligonucleotide
aaagactcctgagaaggtcaaaagtagtcatgaggc

SEQ ID NO: 299829 - DNA, 35 bp, Artificial Sequence
  Description of Artificial Sequence: Synthetic oligonucleotide
aagactcctgagaaggtcaaaagtagtcatgaggc

SEQ ID NO: 299830 - DNA, 34 bp, Artificial Sequence
  Description of Artificial Sequence: Synthetic oligonucleotide
agactcctgagaaggtcaaaagtagtcatgaggc

SEQ ID NO: 299831 - DNA, 33 bp, Artificial Sequence
  Description of Artificial Sequence: Synthetic oligonucleotide
gactcctgagaaggtcaaaagtagtcatgaggc

SEQ ID NO: 299832 - DNA, 34 bp, Artificial Sequence
  Description of Artificial Sequence: Synthetic oligonucleotide
actcctgagaaggtcaaaagtagtcatgaggcag

SEQ ID NO: 299833 - DNA, 33 bp, Artificial Sequence
  Description of Artificial Sequence: Synthetic oligonucleotide
ctcctgagaaggtcaaaagtagtcatgaggcag

SEQ ID NO: 299834 - DNA, 34 bp, Artificial Sequence
  Description of Artificial Sequence: Synthetic oligonucleotide
tcctgagaaggtcaaaagtagtcatgaggcagag

SEQ ID NO: 299835 - DNA, 33 bp, Artificial Sequence
  Description of Artificial Sequence: Synthetic oligonucleotide
cctgagaaggtcaaaagtagtcatgaggcagag

SEQ ID NO: 299836 - DNA, 35 bp, Artificial Sequence
  Description of Artificial Sequence: Synthetic oligonucleotide
ctgagaaggtcaaaagtagtcatgaggcagagatc

SEQ ID NO: 299837 - DNA, 35 bp, Artificial Sequence
  Description of Artificial Sequence: Synthetic oligonucleotide
tgagaaggtcaaaagtagtcatgaggcagagatcc

SEQ ID NO: 299838 - DNA, 34 bp, Artificial Sequence
  Description of Artificial Sequence: Synthetic oligonucleotide
gagaaggtcaaaagtagtcatgaggcagagatcc

SEQ ID NO: 299839 - DNA, 35 bp, Artificial Sequence
  Description of Artificial Sequence: Synthetic oligonucleotide
agaaggtcaaaagtagtcatgaggcagagatcctg

SEQ ID NO: 299840 - DNA, 34 bp, Artificial Sequence
  Description of Artificial Sequence: Synthetic oligonucleotide
gaaggtcaaaagtagtcatgaggcagagatcctg

SEQ ID NO: 299841 - DNA, 35 bp, Artificial Sequence
  Description of Artificial Sequence: Synthetic oligonucleotide
aaggtcaaaagtagtcatgaggcagagatcctgtg

SEQ ID NO: 299842 - DNA, 34 bp, Artificial Sequence
  Description of Artificial Sequence: Synthetic oligonucleotide
aggtcaaaagtagtcatgaggcagagatcctgtg

SEQ ID NO: 299843 - DNA, 33 bp, Artificial Sequence
  Description of Artificial Sequence: Synthetic oligonucleotide
ggtcaaaagtagtcatgaggcagagatcctgtg

SEQ ID NO: 299844 - DNA, 38 bp, Artificial Sequence
  Description of Artificial Sequence: Synthetic oligonucleotide
gtcaaaagtagtcatgaggcagagatcctgtgaaaaac

SEQ ID NO: 299845 - DNA, 39 bp, Artificial Sequence
  Description of Artificial Sequence: Synthetic oligonucleotide
tcaaaagtagtcatgaggcagagatcctgtgaaaaacag

SEQ ID NO: 299846 - DNA, 38 bp, Artificial Sequence
  Description of Artificial Sequence: Synthetic oligonucleotide
caaaagtagtcatgaggcagagatcctgtgaaaaacag

SEQ ID NO: 299847 - DNA, 38 bp, Artificial Sequence
  Description of Artificial Sequence: Synthetic oligonucleotide
aaaagtagtcatgaggcagagatcctgtgaaaaacagc

SEQ ID NO: 299848 - DNA, 37 bp, Artificial Sequence
  Description of Artificial Sequence: Synthetic oligonucleotide
aaagtagtcatgaggcagagatcctgtgaaaaacagc

SEQ ID NO: 299849 - DNA, 36 bp, Artificial Sequence
  Description of Artificial Sequence: Synthetic oligonucleotide
aagtagtcatgaggcagagatcctgtgaaaaacagc

SEQ ID NO: 299850 - DNA, 35 bp, Artificial Sequence
  Description of Artificial Sequence: Synthetic oligonucleotide
agtagtcatgaggcagagatcctgtgaaaaacagc

SEQ ID NO: 299851 - DNA, 34 bp, Artificial Sequence
  Description of Artificial Sequence: Synthetic oligonucleotide
gtagtcatgaggcagagatcctgtgaaaaacagc

SEQ ID NO: 299852 - DNA, 38 bp, Artificial Sequence
  Description of Artificial Sequence: Synthetic oligonucleotide
tagtcatgaggcagagatcctgtgaaaaacagcatttg

SEQ ID NO: 299853 - DNA, 37 bp, Artificial Sequence
  Description of Artificial Sequence: Synthetic oligonucleotide
agtcatgaggcagagatcctgtgaaaaacagcatttg

SEQ ID NO: 299854 - DNA, 36 bp, Artificial Sequence
  Description of Artificial Sequence: Synthetic oligonucleotide
gtcatgaggcagagatcctgtgaaaaacagcatttg

SEQ ID NO: 299855 - DNA, 36 bp, Artificial Sequence
  Description of Artificial Sequence: Synthetic oligonucleotide
tcatgaggcagagatcctgtgaaaaacagcatttgg

SEQ ID NO: 299856 - DNA, 35 bp, Artificial Sequence
  Description of Artificial Sequence: Synthetic oligonucleotide
catgaggcagagatcctgtgaaaaacagcatttgg

SEQ ID NO: 299857 - DNA, 36 bp, Artificial Sequence
  Description of Artificial Sequence: Synthetic oligonucleotide
atgaggcagagatcctgtgaaaaacagcatttggag

SEQ ID NO: 299858 - DNA, 35 bp, Artificial Sequence
  Description of Artificial Sequence: Synthetic oligonucleotide
tgaggcagagatcctgtgaaaaacagcatttggag

SEQ ID NO: 299859 - DNA, 34 bp, Artificial Sequence
  Description of Artificial Sequence: Synthetic oligonucleotide
gaggcagagatcctgtgaaaaacagcatttggag

SEQ ID NO: 299860 - DNA, 34 bp, Artificial Sequence
  Description of Artificial Sequence: Synthetic oligonucleotide
aggcagagatcctgtgaaaaacagcatttggagc

SEQ ID NO: 299861 - DNA, 33 bp, Artificial Sequence
  Description of Artificial Sequence: Synthetic oligonucleotide
ggcagagatcctgtgaaaaacagcatttggagc

SEQ ID NO: 299862 - DNA, 34 bp, Artificial Sequence
  Description of Artificial Sequence: Synthetic oligonucleotide
gcagagatcctgtgaaaaacagcatttggagctc

SEQ ID NO: 299863 - DNA, 44 bp, Artificial Sequence
  Description of Artificial Sequence: Synthetic oligonucleotide
cagagatcctgtgaaaaacagcatttggagctcaaaaattaaag

SEQ ID NO: 299864 - DNA, 46 bp, Artificial Sequence
  Description of Artificial Sequence: Synthetic oligonucleotide
agagatcctgtgaaaaacagcatttggagctcaaaaattaaagatc

SEQ ID NO: 299865 - DNA, 45 bp, Artificial Sequence
  Description of Artificial Sequence: Synthetic oligonucleotide
gagatcctgtgaaaaacagcatttggagctcaaaaattaaagatc

SEQ ID NO: 299866 - DNA, 45 bp, Artificial Sequence
  Description of Artificial Sequence: Synthetic oligonucleotide
agatcctgtgaaaaacagcatttggagctcaaaaattaaagatcg

SEQ ID NO: 299867 - DNA, 44 bp, Artificial Sequence
  Description of Artificial Sequence: Synthetic oligonucleotide
gatcctgtgaaaaacagcatttggagctcaaaaattaaagatcg

SEQ ID NO: 299868 - DNA, 44 bp, Artificial Sequence
  Description of Artificial Sequence: Synthetic oligonucleotide
atcctgtgaaaaacagcatttggagctcaaaaattaaagatcgg

SEQ ID NO: 299869 - DNA, 43 bp, Artificial Sequence
  Description of Artificial Sequence: Synthetic oligonucleotide
tcctgtgaaaaacagcatttggagctcaaaaattaaagatcgg

SEQ ID NO: 299870 - DNA, 42 bp, Artificial Sequence
  Description of Artificial Sequence: Synthetic oligonucleotide
cctgtgaaaaacagcatttggagctcaaaaattaaagatcgg

SEQ ID NO: 299871 - DNA, 42 bp, Artificial Sequence
  Description of Artificial Sequence: Synthetic oligonucleotide
ctgtgaaaaacagcatttggagctcaaaaattaaagatcggg

SEQ ID NO: 299872 - DNA, 42 bp, Artificial Sequence
  Description of Artificial Sequence: Synthetic oligonucleotide
tgtgaaaaacagcatttggagctcaaaaattaaagatcgggg

SEQ ID NO: 299873 - DNA, 41 bp, Artificial Sequence
  Description of Artificial Sequence: Synthetic oligonucleotide
gtgaaaaacagcatttggagctcaaaaattaaagatcgggg

SEQ ID NO: 299874 - DNA, 42 bp, Artificial Sequence
  Description of Artificial Sequence: Synthetic oligonucleotide
tgaaaaacagcatttggagctcaaaaattaaagatcggggac

SEQ ID NO: 299875 - DNA, 41 bp, Artificial Sequence
  Description of Artificial Sequence: Synthetic oligonucleotide
gaaaaacagcatttggagctcaaaaattaaagatcggggac

SEQ ID NO: 299876 - DNA, 41 bp, Artificial Sequence
  Description of Artificial Sequence: Synthetic oligonucleotide
aaaaacagcatttggagctcaaaaattaaagatcggggacg

SEQ ID NO: 299877 - DNA, 40 bp, Artificial Sequence
  Description of Artificial Sequence: Synthetic oligonucleotide
aaaacagcatttggagctcaaaaattaaagatcggggacg

SEQ ID NO: 299878 - DNA, 39 bp, Artificial Sequence
  Description of Artificial Sequence: Synthetic oligonucleotide
aaacagcatttggagctcaaaaattaaagatcggggacg

SEQ ID NO: 299879 - DNA, 38 bp, Artificial Sequence
  Description of Artificial Sequence: Synthetic oligonucleotide
aacagcatttggagctcaaaaattaaagatcggggacg

SEQ ID NO: 299880 - DNA, 37 bp, Artificial Sequence
  Description of Artificial Sequence: Synthetic oligonucleotide
acagcatttggagctcaaaaattaaagatcggggacg

SEQ ID NO: 299881 - DNA, 36 bp, Artificial Sequence
  Description of Artificial Sequence: Synthetic oligonucleotide
cagcatttggagctcaaaaattaaagatcggggacg

SEQ ID NO: 299882 - DNA, 38 bp, Artificial Sequence
  Description of Artificial Sequence: Synthetic oligonucleotide
agcatttggagctcaaaaattaaagatcggggacgtac

SEQ ID NO: 299883 - DNA, 37 bp, Artificial Sequence
  Description of Artificial Sequence: Synthetic oligonucleotide
gcatttggagctcaaaaattaaagatcggggacgtac

SEQ ID NO: 299884 - DNA, 38 bp, Artificial Sequence
  Description of Artificial Sequence: Synthetic oligonucleotide
catttggagctcaaaaattaaagatcggggacgtacag

SEQ ID NO: 299885 - DNA, 38 bp, Artificial Sequence
  Description of Artificial Sequence: Synthetic oligonucleotide
atttggagctcaaaaattaaagatcggggacgtacagg

SEQ ID NO: 299886 - DNA, 37 bp, Artificial Sequence
  Description of Artificial Sequence: Synthetic oligonucleotide
tttggagctcaaaaattaaagatcggggacgtacagg

SEQ ID NO: 299887 - DNA, 36 bp, Artificial Sequence
  Description of Artificial Sequence: Synthetic oligonucleotide
ttggagctcaaaaattaaagatcggggacgtacagg

SEQ ID NO: 299888 - DNA, 35 bp, Artificial Sequence
  Description of Artificial Sequence: Synthetic oligonucleotide
tggagctcaaaaattaaagatcggggacgtacagg

SEQ ID NO: 299889 - DNA, 34 bp, Artificial Sequence
  Description of Artificial Sequence: Synthetic oligonucleotide
ggagctcaaaaattaaagatcggggacgtacagg

SEQ ID NO: 299890 - DNA, 37 bp, Artificial Sequence
  Description of Artificial Sequence: Synthetic oligonucleotide
gagctcaaaaattaaagatcggggacgtacaggttag

SEQ ID NO: 299891 - DNA, 40 bp, Artificial Sequence
  Description of Artificial Sequence: Synthetic oligonucleotide
agctcaaaaattaaagatcggggacgtacaggttagaaag

SEQ ID NO: 299892 - DNA, 39 bp, Artificial Sequence
  Description of Artificial Sequence: Synthetic oligonucleotide
gctcaaaaattaaagatcggggacgtacaggttagaaag

SEQ ID NO: 299893 - DNA, 39 bp, Artificial Sequence
  Description of Artificial Sequence: Synthetic oligonucleotide
ctcaaaaattaaagatcggggacgtacaggttagaaagg

SEQ ID NO: 299894 - DNA, 42 bp, Artificial Sequence
  Description of Artificial Sequence: Synthetic oligonucleotide
tcaaaaattaaagatcggggacgtacaggttagaaaggaaac

SEQ ID NO: 299895 - DNA, 41 bp, Artificial Sequence
  Description of Artificial Sequence: Synthetic oligonucleotide
caaaaattaaagatcggggacgtacaggttagaaaggaaac

SEQ ID NO: 299896 - DNA, 45 bp, Artificial Sequence
  Description of Artificial Sequence: Synthetic oligonucleotide
aaaaattaaagatcggggacgtacaggttagaaaggaaactattg

SEQ ID NO: 299897 - DNA, 44 bp, Artificial Sequence
  Description of Artificial Sequence: Synthetic oligonucleotide
aaaattaaagatcggggacgtacaggttagaaaggaaactattg

SEQ ID NO: 299898 - DNA, 43 bp, Artificial Sequence
  Description of Artificial Sequence: Synthetic oligonucleotide
aaattaaagatcggggacgtacaggttagaaaggaaactattg

SEQ ID NO: 299899 - DNA, 42 bp, Artificial Sequence
  Description of Artificial Sequence: Synthetic oligonucleotide
aattaaagatcggggacgtacaggttagaaaggaaactattg

SEQ ID NO: 299900 - DNA, 41 bp, Artificial Sequence
  Description of Artificial Sequence: Synthetic oligonucleotide
attaaagatcggggacgtacaggttagaaaggaaactattg

SEQ ID NO: 299901 - DNA, 40 bp, Artificial Sequence
  Description of Artificial Sequence: Synthetic oligonucleotide
ttaaagatcggggacgtacaggttagaaaggaaactattg

SEQ ID NO: 299902 - DNA, 39 bp, Artificial Sequence
  Description of Artificial Sequence: Synthetic oligonucleotide
taaagatcggggacgtacaggttagaaaggaaactattg

SEQ ID NO: 299903 - DNA, 38 bp, Artificial Sequence
  Description of Artificial Sequence: Synthetic oligonucleotide
aaagatcggggacgtacaggttagaaaggaaactattg

SEQ ID NO: 299904 - DNA, 37 bp, Artificial Sequence
  Description of Artificial Sequence: Synthetic oligonucleotide
aagatcggggacgtacaggttagaaaggaaactattg

SEQ ID NO: 299905 - DNA, 36 bp, Artificial Sequence
  Description of Artificial Sequence: Synthetic oligonucleotide
agatcggggacgtacaggttagaaaggaaactattg

SEQ ID NO: 299906 - DNA, 35 bp, Artificial Sequence
  Description of Artificial Sequence: Synthetic oligonucleotide
gatcggggacgtacaggttagaaaggaaactattg

SEQ ID NO: 299907 - DNA, 37 bp, Artificial Sequence
  Description of Artificial Sequence: Synthetic oligonucleotide
atcggggacgtacaggttagaaaggaaactattgaag

SEQ ID NO: 299908 - DNA, 36 bp, Artificial Sequence
  Description of Artificial Sequence: Synthetic oligonucleotide
tcggggacgtacaggttagaaaggaaactattgaag

SEQ ID NO: 299909 - DNA, 35 bp, Artificial Sequence
  Description of Artificial Sequence: Synthetic oligonucleotide
cggggacgtacaggttagaaaggaaactattgaag

SEQ ID NO: 299910 - DNA, 37 bp, Artificial Sequence
  Description of Artificial Sequence: Synthetic oligonucleotide
ggggacgtacaggttagaaaggaaactattgaagatc

SEQ ID NO: 299911 - DNA, 39 bp, Artificial Sequence
  Description of Artificial Sequence: Synthetic oligonucleotide
gggacgtacaggttagaaaggaaactattgaagatcttg

SEQ ID NO: 299912 - DNA, 41 bp, Artificial Sequence
  Description of Artificial Sequence: Synthetic oligonucleotide
ggacgtacaggttagaaaggaaactattgaagatcttgaag

SEQ ID NO: 299913 - DNA, 45 bp, Artificial Sequence
  Description of Artificial Sequence: Synthetic oligonucleotide
gacgtacaggttagaaaggaaactattgaagatcttgaagaaaag

SEQ ID NO: 299914 - DNA, 45 bp, Artificial Sequence
  Description of Artificial Sequence: Synthetic oligonucleotide
acgtacaggttagaaaggaaactattgaagatcttgaagaaaagc

SEQ ID NO: 299915 - DNA, 44 bp, Artificial Sequence
  Description of Artificial Sequence: Synthetic oligonucleotide
cgtacaggttagaaaggaaactattgaagatcttgaagaaaagc

SEQ ID NO: 299916 - DNA, 45 bp, Artificial Sequence
  Description of Artificial Sequence: Synthetic oligonucleotide
gtacaggttagaaaggaaactattgaagatcttgaagaaaagctc

SEQ ID NO: 299917 - DNA, 47 bp, Artificial Sequence
  Description of Artificial Sequence: Synthetic oligonucleotide
tacaggttagaaaggaaactattgaagatcttgaagaaaagctcaac

SEQ ID NO: 299918 - DNA, 46 bp, Artificial Sequence
  Description of Artificial Sequence: Synthetic oligonucleotide
acaggttagaaaggaaactattgaagatcttgaagaaaagctcaac

SEQ ID NO: 299919 - DNA, 45 bp, Artificial Sequence
  Description of Artificial Sequence: Synthetic oligonucleotide
caggttagaaaggaaactattgaagatcttgaagaaaagctcaac

SEQ ID NO: 299920 - DNA, 47 bp, Artificial Sequence
  Description of Artificial Sequence: Synthetic oligonucleotide
aggttagaaaggaaactattgaagatcttgaagaaaagctcaacaag

SEQ ID NO: 299921 - DNA, 46 bp, Artificial Sequence
  Description of Artificial Sequence: Synthetic oligonucleotide
ggttagaaaggaaactattgaagatcttgaagaaaagctcaacaag

SEQ ID NO: 299922 - DNA, 46 bp, Artificial Sequence
  Description of Artificial Sequence: Synthetic oligonucleotide
gttagaaaggaaactattgaagatcttgaagaaaagctcaacaagc

SEQ ID NO: 299923 - DNA, 48 bp, Artificial Sequence
  Description of Artificial Sequence: Synthetic oligonucleotide
ttagaaaggaaactattgaagatcttgaagaaaagctcaacaagcttc

SEQ ID NO: 299924 - DNA, 47 bp, Artificial Sequence
  Description of Artificial Sequence: Synthetic oligonucleotide
tagaaaggaaactattgaagatcttgaagaaaagctcaacaagcttc

SEQ ID NO: 299925 - DNA, 46 bp, Artificial Sequence
  Description of Artificial Sequence: Synthetic oligonucleotide
agaaaggaaactattgaagatcttgaagaaaagctcaacaagcttc

SEQ ID NO: 299926 - DNA, 45 bp, Artificial Sequence
  Description of Artificial Sequence: Synthetic oligonucleotide
gaaaggaaactattgaagatcttgaagaaaagctcaacaagcttc

SEQ ID NO: 299927 - DNA, 45 bp, Artificial Sequence
  Description of Artificial Sequence: Synthetic oligonucleotide
aaaggaaactattgaagatcttgaagaaaagctcaacaagcttcc

SEQ ID NO: 299928 - DNA, 44 bp, Artificial Sequence
  Description of Artificial Sequence: Synthetic oligonucleotide
aaggaaactattgaagatcttgaagaaaagctcaacaagcttcc

SEQ ID NO: 299929 - DNA, 43 bp, Artificial Sequence
  Description of Artificial Sequence: Synthetic oligonucleotide
aggaaactattgaagatcttgaagaaaagctcaacaagcttcc

SEQ ID NO: 299930 - DNA, 42 bp, Artificial Sequence
  Description of Artificial Sequence: Synthetic oligonucleotide
ggaaactattgaagatcttgaagaaaagctcaacaagcttcc

SEQ ID NO: 299931 - DNA, 43 bp, Artificial Sequence
  Description of Artificial Sequence: Synthetic oligonucleotide
gaaactattgaagatcttgaagaaaagctcaacaagcttcctg

SEQ ID NO: 299932 - DNA, 43 bp, Artificial Sequence
  Description of Artificial Sequence: Synthetic oligonucleotide
aaactattgaagatcttgaagaaaagctcaacaagcttcctgg

SEQ ID NO: 299933 - DNA, 42 bp, Artificial Sequence
  Description of Artificial Sequence: Synthetic oligonucleotide
aactattgaagatcttgaagaaaagctcaacaagcttcctgg

SEQ ID NO: 299934 - DNA, 41 bp, Artificial Sequence
  Description of Artificial Sequence: Synthetic oligonucleotide
actattgaagatcttgaagaaaagctcaacaagcttcctgg

SEQ ID NO: 299935 - DNA, 40 bp, Artificial Sequence
  Description of Artificial Sequence: Synthetic oligonucleotide
ctattgaagatcttgaagaaaagctcaacaagcttcctgg

SEQ ID NO: 299936 - DNA, 41 bp, Artificial Sequence
  Description of Artificial Sequence: Synthetic oligonucleotide
tattgaagatcttgaagaaaagctcaacaagcttcctggtc

SEQ ID NO: 299937 - DNA, 40 bp, Artificial Sequence
  Description of Artificial Sequence: Synthetic oligonucleotide
attgaagatcttgaagaaaagctcaacaagcttcctggtc

SEQ ID NO: 299938 - DNA, 39 bp, Artificial Sequence
  Description of Artificial Sequence: Synthetic oligonucleotide
ttgaagatcttgaagaaaagctcaacaagcttcctggtc

SEQ ID NO: 299939 - DNA, 38 bp, Artificial Sequence
  Description of Artificial Sequence: Synthetic oligonucleotide
tgaagatcttgaagaaaagctcaacaagcttcctggtc

SEQ ID NO: 299940 - DNA, 37 bp, Artificial Sequence
  Description of Artificial Sequence: Synthetic oligonucleotide
gaagatcttgaagaaaagctcaacaagcttcctggtc

SEQ ID NO: 299941 - DNA, 38 bp, Artificial Sequence
  Description of Artificial Sequence: Synthetic oligonucleotide
aagatcttgaagaaaagctcaacaagcttcctggtctg

SEQ ID NO: 299942 - DNA, 37 bp, Artificial Sequence
  Description of Artificial Sequence: Synthetic oligonucleotide
agatcttgaagaaaagctcaacaagcttcctggtctg

SEQ ID NO: 299943 - DNA, 36 bp, Artificial Sequence
  Description of Artificial Sequence: Synthetic oligonucleotide
gatcttgaagaaaagctcaacaagcttcctggtctg

SEQ ID NO: 299944 - DNA, 37 bp, Artificial Sequence
  Description of Artificial Sequence: Synthetic oligonucleotide
atcttgaagaaaagctcaacaagcttcctggtctgac

SEQ ID NO: 299945 - DNA, 36 bp, Artificial Sequence
  Description of Artificial Sequence: Synthetic oligonucleotide
tcttgaagaaaagctcaacaagcttcctggtctgac

SEQ ID NO: 299946 - DNA, 35 bp, Artificial Sequence
  Description of Artificial Sequence: Synthetic oligonucleotide
cttgaagaaaagctcaacaagcttcctggtctgac

SEQ ID NO: 299947 - DNA, 37 bp, Artificial Sequence
  Description of Artificial Sequence: Synthetic oligonucleotide
ttgaagaaaagctcaacaagcttcctggtctgacatc

SEQ ID NO: 299948 - DNA, 36 bp, Artificial Sequence
  Description of Artificial Sequence: Synthetic oligonucleotide
tgaagaaaagctcaacaagcttcctggtctgacatc

SEQ ID NO: 299949 - DNA, 35 bp, Artificial Sequence
  Description of Artificial Sequence: Synthetic oligonucleotide
gaagaaaagctcaacaagcttcctggtctgacatc

SEQ ID NO: 299950 - DNA, 35 bp, Artificial Sequence
  Description of Artificial Sequence: Synthetic oligonucleotide
aagaaaagctcaacaagcttcctggtctgacatcg

SEQ ID NO: 299951 - DNA, 34 bp, Artificial Sequence
  Description of Artificial Sequence: Synthetic oligonucleotide
agaaaagctcaacaagcttcctggtctgacatcg

SEQ ID NO: 299952 - DNA, 33 bp, Artificial Sequence
  Description of Artificial Sequence: Synthetic oligonucleotide
gaaaagctcaacaagcttcctggtctgacatcg

SEQ ID NO: 299953 - DNA, 33 bp, Artificial Sequence
  Description of Artificial Sequence: Synthetic oligonucleotide
aaaagctcaacaagcttcctggtctgacatcgg

SEQ ID NO: 299954 - DNA, 32 bp, Artificial Sequence
  Description of Artificial Sequence: Synthetic oligonucleotide
aaagctcaacaagcttcctggtctgacatcgg

SEQ ID NO: 299955 - DNA, 31 bp, Artificial Sequence
  Description of Artificial Sequence: Synthetic oligonucleotide
aagctcaacaagcttcctggtctgacatcgg

SEQ ID NO: 299956 - DNA, 30 bp, Artificial Sequence
  Description of Artificial Sequence: Synthetic oligonucleotide
agctcaacaagcttcctggtctgacatcgg

SEQ ID NO: 299957 - DNA, 29 bp, Artificial Sequence
  Description of Artificial Sequence: Synthetic oligonucleotide
gctcaacaagcttcctggtctgacatcgg

SEQ ID NO: 299958 - DNA, 31 bp, Artificial Sequence
  Description of Artificial Sequence: Synthetic oligonucleotide
ctcaacaagcttcctggtctgacatcggatc

SEQ ID NO: 299959 - DNA, 32 bp, Artificial Sequence
  Description of Artificial Sequence: Synthetic oligonucleotide
tcaacaagcttcctggtctgacatcggatcac

SEQ ID NO: 299960 - DNA, 31 bp, Artificial Sequence
  Description of Artificial Sequence: Synthetic oligonucleotide
caacaagcttcctggtctgacatcggatcac

SEQ ID NO: 299961 - DNA, 32 bp, Artificial Sequence
  Description of Artificial Sequence: Synthetic oligonucleotide
aacaagcttcctggtctgacatcggatcacag

SEQ ID NO: 299962 - DNA, 31 bp, Artificial Sequence
  Description of Artificial Sequence: Synthetic oligonucleotide
acaagcttcctggtctgacatcggatcacag

SEQ ID NO: 299963 - DNA, 30 bp, Artificial Sequence
  Description of Artificial Sequence: Synthetic oligonucleotide
caagcttcctggtctgacatcggatcacag

SEQ ID NO: 299964 - DNA, 31 bp, Artificial Sequence
  Description of Artificial Sequence: Synthetic oligonucleotide
aagcttcctggtctgacatcggatcacagtc

SEQ ID NO: 299965 - DNA, 30 bp, Artificial Sequence
  Description of Artificial Sequence: Synthetic oligonucleotide
agcttcctggtctgacatcggatcacagtc

SEQ ID NO: 299966 - DNA, 29 bp, Artificial Sequence
  Description of Artificial Sequence: Synthetic oligonucleotide
gcttcctggtctgacatcggatcacagtc

SEQ ID NO: 299967 - DNA, 29 bp, Artificial Sequence
  Description of Artificial Sequence: Synthetic oligonucleotide
cttcctggtctgacatcggatcacagtcg

SEQ ID NO: 299968 - DNA, 32 bp, Artificial Sequence
  Description of Artificial Sequence: Synthetic oligonucleotide
ttcctggtctgacatcggatcacagtcgattc

SEQ ID NO: 299969 - DNA, 31 bp, Artificial Sequence
  Description of Artificial Sequence: Synthetic oligonucleotide
tcctggtctgacatcggatcacagtcgattc

SEQ ID NO: 299970 - DNA, 30 bp, Artificial Sequence
  Description of Artificial Sequence: Synthetic oligonucleotide
cctggtctgacatcggatcacagtcgattc

SEQ ID NO: 299971 - DNA, 33 bp, Artificial Sequence
  Description of Artificial Sequence: Synthetic oligonucleotide
ctggtctgacatcggatcacagtcgattctatg

SEQ ID NO: 299972 - DNA, 35 bp, Artificial Sequence
  Description of Artificial Sequence: Synthetic oligonucleotide
tggtctgacatcggatcacagtcgattctatgatg

SEQ ID NO: 299973 - DNA, 34 bp, Artificial Sequence
  Description of Artificial Sequence: Synthetic oligonucleotide
ggtctgacatcggatcacagtcgattctatgatg

SEQ ID NO: 299974 - DNA, 35 bp, Artificial Sequence
  Description of Artificial Sequence: Synthetic oligonucleotide
gtctgacatcggatcacagtcgattctatgatgtc

SEQ ID NO: 299975 - DNA, 36 bp, Artificial Sequence
  Description of Artificial Sequence: Synthetic oligonucleotide
tctgacatcggatcacagtcgattctatgatgtctc

SEQ ID NO: 299976 - DNA, 35 bp, Artificial Sequence
  Description of Artificial Sequence: Synthetic oligonucleotide
ctgacatcggatcacagtcgattctatgatgtctc

SEQ ID NO: 299977 - DNA, 35 bp, Artificial Sequence
  Description of Artificial Sequence: Synthetic oligonucleotide
tgacatcggatcacagtcgattctatgatgtctcc

SEQ ID NO: 299978 - DNA, 34 bp, Artificial Sequence
  Description of Artificial Sequence: Synthetic oligonucleotide
gacatcggatcacagtcgattctatgatgtctcc

SEQ ID NO: 299979 - DNA, 35 bp, Artificial Sequence
  Description of Artificial Sequence: Synthetic oligonucleotide
acatcggatcacagtcgattctatgatgtctccag

SEQ ID NO: 299980 - DNA, 34 bp, Artificial Sequence
  Description of Artificial Sequence: Synthetic oligonucleotide
catcggatcacagtcgattctatgatgtctccag

SEQ ID NO: 299981 - DNA, 40 bp, Artificial Sequence
  Description of Artificial Sequence: Synthetic oligonucleotide
atcggatcacagtcgattctatgatgtctccagtatatac

SEQ ID NO: 299982 - DNA, 39 bp, Artificial Sequence
  Description of Artificial Sequence: Synthetic oligonucleotide
tcggatcacagtcgattctatgatgtctccagtatatac

SEQ ID NO: 299983 - DNA, 38 bp, Artificial Sequence
  Description of Artificial Sequence: Synthetic oligonucleotide
cggatcacagtcgattctatgatgtctccagtatatac

SEQ ID NO: 299984 - DNA, 41 bp, Artificial Sequence
  Description of Artificial Sequence: Synthetic oligonucleotide
ggatcacagtcgattctatgatgtctccagtatatactatc

SEQ ID NO: 299985 - DNA, 44 bp, Artificial Sequence
  Description of Artificial Sequence: Synthetic oligonucleotide
gatcacagtcgattctatgatgtctccagtatatactatcatac

SEQ ID NO: 299986 - DNA, 47 bp, Artificial Sequence
  Description of Artificial Sequence: Synthetic oligonucleotide
atcacagtcgattctatgatgtctccagtatatactatcatacaatc

SEQ ID NO: 299987 - DNA, 46 bp, Artificial Sequence
  Description of Artificial Sequence: Synthetic oligonucleotide
tcacagtcgattctatgatgtctccagtatatactatcatacaatc

SEQ ID NO: 299988 - DNA, 45 bp, Artificial Sequence
  Description of Artificial Sequence: Synthetic oligonucleotide
cacagtcgattctatgatgtctccagtatatactatcatacaatc

SEQ ID NO: 299989 - DNA, 45 bp, Artificial Sequence
  Description of Artificial Sequence: Synthetic oligonucleotide
acagtcgattctatgatgtctccagtatatactatcatacaatcg

SEQ ID NO: 299990 - DNA, 44 bp, Artificial Sequence
  Description of Artificial Sequence: Synthetic oligonucleotide
cagtcgattctatgatgtctccagtatatactatcatacaatcg

SEQ ID NO: 299991 - DNA, 44 bp, Artificial Sequence
  Description of Artificial Sequence: Synthetic oligonucleotide
agtcgattctatgatgtctccagtatatactatcatacaatcgg

SEQ ID NO: 299992 - DNA, 43 bp, Artificial Sequence
  Description of Artificial Sequence: Synthetic oligonucleotide
gtcgattctatgatgtctccagtatatactatcatacaatcgg

SEQ ID NO: 299993 - DNA, 46 bp, Artificial Sequence
  Description of Artificial Sequence: Synthetic oligonucleotide
tcgattctatgatgtctccagtatatactatcatacaatcggatac

SEQ ID NO: 299994 - DNA, 45 bp, Artificial Sequence
  Description of Artificial Sequence: Synthetic oligonucleotide
cgattctatgatgtctccagtatatactatcatacaatcggatac

SEQ ID NO: 299995 - DNA, 45 bp, Artificial Sequence
  Description of Artificial Sequence: Synthetic oligonucleotide
gattctatgatgtctccagtatatactatcatacaatcggatacc

SEQ ID NO: 299996 - DNA, 46 bp, Artificial Sequence
  Description of Artificial Sequence: Synthetic oligonucleotide
attctatgatgtctccagtatatactatcatacaatcggataccac

SEQ ID NO: 299997 - DNA, 45 bp, Artificial Sequence
  Description of Artificial Sequence: Synthetic oligonucleotide
ttctatgatgtctccagtatatactatcatacaatcggataccac

SEQ ID NO: 299998 - DNA, 44 bp, Artificial Sequence
  Description of Artificial Sequence: Synthetic oligonucleotide
tctatgatgtctccagtatatactatcatacaatcggataccac

SEQ ID NO: 299999 - DNA, 43 bp, Artificial Sequence
  Description of Artificial Sequence: Synthetic oligonucleotide
ctatgatgtctccagtatatactatcatacaatcggataccac

SEQ ID NO: 300000 - DNA, 43 bp, Artificial Sequence
  Description of Artificial Sequence: Synthetic oligonucleotide
tatgatgtctccagtatatactatcatacaatcggataccacg

SEQ ID NO: 300001 - DNA, 42 bp, Artificial Sequence
  Description of Artificial Sequence: Synthetic oligonucleotide
atgatgtctccagtatatactatcatacaatcggataccacg

SEQ ID NO: 300002 - DNA, 41 bp, Artificial Sequence
  Description of Artificial Sequence: Synthetic oligonucleotide
tgatgtctccagtatatactatcatacaatcggataccacg

SEQ ID NO: 300003 - DNA, 40 bp, Artificial Sequence
  Description of Artificial Sequence: Synthetic oligonucleotide
gatgtctccagtatatactatcatacaatcggataccacg

SEQ ID NO: 300004 - DNA, 40 bp, Artificial Sequence
  Description of Artificial Sequence: Synthetic oligonucleotide
atgtctccagtatatactatcatacaatcggataccacgc

SEQ ID NO: 300005 - DNA, 39 bp, Artificial Sequence
  Description of Artificial Sequence: Synthetic oligonucleotide
tgtctccagtatatactatcatacaatcggataccacgc

SEQ ID NO: 300006 - DNA, 38 bp, Artificial Sequence
  Description of Artificial Sequence: Synthetic oligonucleotide
gtctccagtatatactatcatacaatcggataccacgc

SEQ ID NO: 300007 - DNA, 38 bp, Artificial Sequence
  Description of Artificial Sequence: Synthetic oligonucleotide
tctccagtatatactatcatacaatcggataccacgcg

SEQ ID NO: 300008 - DNA, 37 bp, Artificial Sequence
  Description of Artificial Sequence: Synthetic oligonucleotide
ctccagtatatactatcatacaatcggataccacgcg

SEQ ID NO: 300009 - DNA, 38 bp, Artificial Sequence
  Description of Artificial Sequence: Synthetic oligonucleotide
tccagtatatactatcatacaatcggataccacgcgtg

SEQ ID NO: 300010 - DNA, 37 bp, Artificial Sequence
  Description of Artificial Sequence: Synthetic oligonucleotide
ccagtatatactatcatacaatcggataccacgcgtg

SEQ ID NO: 300011 - DNA, 37 bp, Artificial Sequence
  Description of Artificial Sequence: Synthetic oligonucleotide
cagtatatactatcatacaatcggataccacgcgtgc

SEQ ID NO: 300012 - DNA, 39 bp, Artificial Sequence
  Description of Artificial Sequence: Synthetic oligonucleotide
agtatatactatcatacaatcggataccacgcgtgctac

SEQ ID NO: 300013 - DNA, 38 bp, Artificial Sequence
  Description of Artificial Sequence: Synthetic oligonucleotide
gtatatactatcatacaatcggataccacgcgtgctac

SEQ ID NO: 300014 - DNA, 40 bp, Artificial Sequence
  Description of Artificial Sequence: Synthetic oligonucleotide
tatatactatcatacaatcggataccacgcgtgctactac

SEQ ID NO: 300015 - DNA, 39 bp, Artificial Sequence
  Description of Artificial Sequence: Synthetic oligonucleotide
atatactatcatacaatcggataccacgcgtgctactac

SEQ ID NO: 300016 - DNA, 38 bp, Artificial Sequence
  Description of Artificial Sequence: Synthetic oligonucleotide
tatactatcatacaatcggataccacgcgtgctactac

SEQ ID NO: 300017 - DNA, 37 bp, Artificial Sequence
  Description of Artificial Sequence: Synthetic oligonucleotide
atactatcatacaatcggataccacgcgtgctactac

SEQ ID NO: 300018 - DNA, 36 bp, Artificial Sequence
  Description of Artificial Sequence: Synthetic oligonucleotide
tactatcatacaatcggataccacgcgtgctactac

SEQ ID NO: 300019 - DNA, 35 bp, Artificial Sequence
  Description of Artificial Sequence: Synthetic oligonucleotide
actatcatacaatcggataccacgcgtgctactac

SEQ ID NO: 300020 - DNA, 34 bp, Artificial Sequence
  Description of Artificial Sequence: Synthetic oligonucleotide
ctatcatacaatcggataccacgcgtgctactac

SEQ ID NO: 300021 - DNA, 37 bp, Artificial Sequence
  Description of Artificial Sequence: Synthetic oligonucleotide
tatcatacaatcggataccacgcgtgctactacaatg

SEQ ID NO: 300022 - DNA, 36 bp, Artificial Sequence
  Description of Artificial Sequence: Synthetic oligonucleotide
atcatacaatcggataccacgcgtgctactacaatg

SEQ ID NO: 300023 - DNA, 35 bp, Artificial Sequence
  Description of Artificial Sequence: Synthetic oligonucleotide
tcatacaatcggataccacgcgtgctactacaatg

SEQ ID NO: 300024 - DNA, 34 bp, Artificial Sequence
  Description of Artificial Sequence: Synthetic oligonucleotide
catacaatcggataccacgcgtgctactacaatg

SEQ ID NO: 300025 - DNA, 36 bp, Artificial Sequence
  Description of Artificial Sequence: Synthetic oligonucleotide
atacaatcggataccacgcgtgctactacaatgatg

SEQ ID NO: 300026 - DNA, 35 bp, Artificial Sequence
  Description of Artificial Sequence: Synthetic oligonucleotide
tacaatcggataccacgcgtgctactacaatgatg

SEQ ID NO: 300027 - DNA, 34 bp, Artificial Sequence
  Description of Artificial Sequence: Synthetic oligonucleotide
acaatcggataccacgcgtgctactacaatgatg

SEQ ID NO: 300028 - DNA, 33 bp, Artificial Sequence
  Description of Artificial Sequence: Synthetic oligonucleotide
caatcggataccacgcgtgctactacaatgatg

SEQ ID NO: 300029 - DNA, 33 bp, Artificial Sequence
  Description of Artificial Sequence: Synthetic oligonucleotide
aatcggataccacgcgtgctactacaatgatgc

SEQ ID NO: 300030 - DNA, 32 bp, Artificial Sequence
  Description of Artificial Sequence: Synthetic oligonucleotide
atcggataccacgcgtgctactacaatgatgc

SEQ ID NO: 300031 - DNA, 31 bp, Artificial Sequence
  Description of Artificial Sequence: Synthetic oligonucleotide
tcggataccacgcgtgctactacaatgatgc

SEQ ID NO: 300032 - DNA, 30 bp, Artificial Sequence
  Description of Artificial Sequence: Synthetic oligonucleotide
cggataccacgcgtgctactacaatgatgc

SEQ ID NO: 300033 - DNA, 31 bp, Artificial Sequence
  Description of Artificial Sequence: Synthetic oligonucleotide
ggataccacgcgtgctactacaatgatgctc

SEQ ID NO: 300034 - DNA, 32 bp, Artificial Sequence
  Description of Artificial Sequence: Synthetic oligonucleotide
gataccacgcgtgctactacaatgatgctctg

SEQ ID NO: 300035 - DNA, 32 bp, Artificial Sequence
  Description of Artificial Sequence: Synthetic oligonucleotide
ataccacgcgtgctactacaatgatgctctgg

SEQ ID NO: 300036 - DNA, 31 bp, Artificial Sequence
  Description of Artificial Sequence: Synthetic oligonucleotide
taccacgcgtgctactacaatgatgctctgg

SEQ ID NO: 300037 - DNA, 30 bp, Artificial Sequence
  Description of Artificial Sequence: Synthetic oligonucleotide
accacgcgtgctactacaatgatgctctgg

SEQ ID NO: 300038 - DNA, 29 bp, Artificial Sequence
  Description of Artificial Sequence: Synthetic oligonucleotide
ccacgcgtgctactacaatgatgctctgg

SEQ ID NO: 300039 - DNA, 29 bp, Artificial Sequence
  Description of Artificial Sequence: Synthetic oligonucleotide
cacgcgtgctactacaatgatgctctggg

SEQ ID NO: 300040 - DNA, 29 bp, Artificial Sequence
  Description of Artificial Sequence: Synthetic oligonucleotide
acgcgtgctactacaatgatgctctgggg

SEQ ID NO: 300041 - DNA, 28 bp, Artificial Sequence
  Description of Artificial Sequence: Synthetic oligonucleotide
cgcgtgctactacaatgatgctctgggg

SEQ ID NO: 300042 - DNA, 33 bp, Artificial Sequence
  Description of Artificial Sequence: Synthetic oligonucleotide
gcgtgctactacaatgatgctctggggtttttg

SEQ ID NO: 300043 - DNA, 33 bp, Artificial Sequence
  Description of Artificial Sequence: Synthetic oligonucleotide
cgtgctactacaatgatgctctggggtttttgg

SEQ ID NO: 300044 - DNA, 33 bp, Artificial Sequence
  Description of Artificial Sequence: Synthetic oligonucleotide
gtgctactacaatgatgctctggggtttttggc

SEQ ID NO: 300045 - DNA, 33 bp, Artificial Sequence
  Description of Artificial Sequence: Synthetic oligonucleotide
tgctactacaatgatgctctggggtttttggcc

SEQ ID NO: 300046 - DNA, 32 bp, Artificial Sequence
  Description of Artificial Sequence: Synthetic oligonucleotide
gctactacaatgatgctctggggtttttggcc

SEQ ID NO: 300047 - DNA, 33 bp, Artificial Sequence
  Description of Artificial Sequence: Synthetic oligonucleotide
ctactacaatgatgctctggggtttttggcctg

SEQ ID NO: 300048 - DNA, 34 bp, Artificial Sequence
  Description of Artificial Sequence: Synthetic oligonucleotide
tactacaatgatgctctggggtttttggcctgtg

SEQ ID NO: 300049 - DNA, 33 bp, Artificial Sequence
  Description of Artificial Sequence: Synthetic oligonucleotide
actacaatgatgctctggggtttttggcctgtg

SEQ ID NO: 300050 - DNA, 32 bp, Artificial Sequence
  Description of Artificial Sequence: Synthetic oligonucleotide
ctacaatgatgctctggggtttttggcctgtg

SEQ ID NO: 300051 - DNA, 34 bp, Artificial Sequence
  Description of Artificial Sequence: Synthetic oligonucleotide
tacaatgatgctctggggtttttggcctgtgttg

SEQ ID NO: 300052 - DNA, 33 bp, Artificial Sequence
  Description of Artificial Sequence: Synthetic oligonucleotide
acaatgatgctctggggtttttggcctgtgttg

SEQ ID NO: 300053 - DNA, 32 bp, Artificial Sequence
  Description of Artificial Sequence: Synthetic oligonucleotide
caatgatgctctggggtttttggcctgtgttg

SEQ ID NO: 300054 - DNA, 33 bp, Artificial Sequence
  Description of Artificial Sequence: Synthetic oligonucleotide
aatgatgctctggggtttttggcctgtgttgag

SEQ ID NO: 300055 - DNA, 32 bp, Artificial Sequence
  Description of Artificial Sequence: Synthetic oligonucleotide
atgatgctctggggtttttggcctgtgttgag

SEQ ID NO: 300056 - DNA, 31 bp, Artificial Sequence
  Description of Artificial Sequence: Synthetic oligonucleotide
tgatgctctggggtttttggcctgtgttgag

SEQ ID NO: 300057 - DNA, 30 bp, Artificial Sequence
  Description of Artificial Sequence: Synthetic oligonucleotide
gatgctctggggtttttggcctgtgttgag

SEQ ID NO: 300058 - DNA, 32 bp, Artificial Sequence
  Description of Artificial Sequence: Synthetic oligonucleotide
atgctctggggtttttggcctgtgttgagatc

SEQ ID NO: 300059 - DNA, 31 bp, Artificial Sequence
  Description of Artificial Sequence: Synthetic oligonucleotide
tgctctggggtttttggcctgtgttgagatc

SEQ ID NO: 300060 - DNA, 30 bp, Artificial Sequence
  Description of Artificial Sequence: Synthetic oligonucleotide
gctctggggtttttggcctgtgttgagatc

SEQ ID NO: 300061 - DNA, 32 bp, Artificial Sequence
  Description of Artificial Sequence: Synthetic oligonucleotide
ctctggggtttttggcctgtgttgagatcaag

SEQ ID NO: 300062 - DNA, 32 bp, Artificial Sequence
  Description of Artificial Sequence: Synthetic oligonucleotide
tctggggtttttggcctgtgttgagatcaagg

SEQ ID NO: 300063 - DNA, 31 bp, Artificial Sequence
  Description of Artificial Sequence: Synthetic oligonucleotide
ctggggtttttggcctgtgttgagatcaagg

SEQ ID NO: 300064 - DNA, 33 bp, Artificial Sequence
  Description of Artificial Sequence: Synthetic oligonucleotide
tggggtttttggcctgtgttgagatcaaggatg

SEQ ID NO: 300065 - DNA, 32 bp, Artificial Sequence
  Description of Artificial Sequence: Synthetic oligonucleotide
ggggtttttggcctgtgttgagatcaaggatg

SEQ ID NO: 300066 - DNA, 34 bp, Artificial Sequence
  Description of Artificial Sequence: Synthetic oligonucleotide
gggtttttggcctgtgttgagatcaaggatgtac

SEQ ID NO: 300067 - DNA, 34 bp, Artificial Sequence
  Description of Artificial Sequence: Synthetic oligonucleotide
ggtttttggcctgtgttgagatcaaggatgtacc

SEQ ID NO: 300068 - DNA, 35 bp, Artificial Sequence
  Description of Artificial Sequence: Synthetic oligonucleotide
gtttttggcctgtgttgagatcaaggatgtaccag

SEQ ID NO: 300069 - DNA, 36 bp, Artificial Sequence
  Description of Artificial Sequence: Synthetic oligonucleotide
tttttggcctgtgttgagatcaaggatgtaccagtg

SEQ ID NO: 300070 - DNA, 35 bp, Artificial Sequence
  Description of Artificial Sequence: Synthetic oligonucleotide
ttttggcctgtgttgagatcaaggatgtaccagtg

SEQ ID NO: 300071 - DNA, 34 bp, Artificial Sequence
  Description of Artificial Sequence: Synthetic oligonucleotide
tttggcctgtgttgagatcaaggatgtaccagtg

SEQ ID NO: 300072 - DNA, 33 bp, Artificial Sequence
  Description of Artificial Sequence: Synthetic oligonucleotide
ttggcctgtgttgagatcaaggatgtaccagtg

SEQ ID NO: 300073 - DNA, 32 bp, Artificial Sequence
  Description of Artificial Sequence: Synthetic oligonucleotide
tggcctgtgttgagatcaaggatgtaccagtg

SEQ ID NO: 300074 - DNA, 31 bp, Artificial Sequence
  Description of Artificial Sequence: Synthetic oligonucleotide
ggcctgtgttgagatcaaggatgtaccagtg

SEQ ID NO: 300075 - DNA, 32 bp, Artificial Sequence
  Description of Artificial Sequence: Synthetic oligonucleotide
gcctgtgttgagatcaaggatgtaccagtgtg

SEQ ID NO: 300076 - DNA, 33 bp, Artificial Sequence
  Description of Artificial Sequence: Synthetic oligonucleotide
cctgtgttgagatcaaggatgtaccagtgtgtg

SEQ ID NO: 300077 - DNA, 34 bp, Artificial Sequence
  Description of Artificial Sequence: Synthetic oligonucleotide
ctgtgttgagatcaaggatgtaccagtgtgtgag

SEQ ID NO: 300078 - DNA, 34 bp, Artificial Sequence
  Description of Artificial Sequence: Synthetic oligonucleotide
tgtgttgagatcaaggatgtaccagtgtgtgagc

SEQ ID NO: 300079 - DNA, 33 bp, Artificial Sequence
  Description of Artificial Sequence: Synthetic oligonucleotide
gtgttgagatcaaggatgtaccagtgtgtgagc

SEQ ID NO: 300080 - DNA, 34 bp, Artificial Sequence
  Description of Artificial Sequence: Synthetic oligonucleotide
tgttgagatcaaggatgtaccagtgtgtgagcag

SEQ ID NO: 300081 - DNA, 33 bp, Artificial Sequence
  Description of Artificial Sequence: Synthetic oligonucleotide
gttgagatcaaggatgtaccagtgtgtgagcag

SEQ ID NO: 300082 - DNA, 33 bp, Artificial Sequence
  Description of Artificial Sequence: Synthetic oligonucleotide
ttgagatcaaggatgtaccagtgtgtgagcagc

SEQ ID NO: 300083 - DNA, 32 bp, Artificial Sequence
  Description of Artificial Sequence: Synthetic oligonucleotide
tgagatcaaggatgtaccagtgtgtgagcagc

SEQ ID NO: 300084 - DNA, 31 bp, Artificial Sequence
  Description of Artificial Sequence: Synthetic oligonucleotide
gagatcaaggatgtaccagtgtgtgagcagc

SEQ ID NO: 300085 - DNA, 32 bp, Artificial Sequence
  Description of Artificial Sequence: Synthetic oligonucleotide
agatcaaggatgtaccagtgtgtgagcagcac

SEQ ID NO: 300086 - DNA, 31 bp, Artificial Sequence
  Description of Artificial Sequence: Synthetic oligonucleotide
gatcaaggatgtaccagtgtgtgagcagcac

SEQ ID NO: 300087 - DNA, 31 bp, Artificial Sequence
  Description of Artificial Sequence: Synthetic oligonucleotide
atcaaggatgtaccagtgtgtgagcagcacg

SEQ ID NO: 300088 - DNA, 30 bp, Artificial Sequence
  Description of Artificial Sequence: Synthetic oligonucleotide
tcaaggatgtaccagtgtgtgagcagcacg

SEQ ID NO: 300089 - DNA, 29 bp, Artificial Sequence
  Description of Artificial Sequence: Synthetic oligonucleotide
caaggatgtaccagtgtgtgagcagcacg

SEQ ID NO: 300090 - DNA, 30 bp, Artificial Sequence
  Description of Artificial Sequence: Synthetic oligonucleotide
aaggatgtaccagtgtgtgagcagcacgag

SEQ ID NO: 300091 - DNA, 29 bp, Artificial Sequence
  Description of Artificial Sequence: Synthetic oligonucleotide
aggatgtaccagtgtgtgagcagcacgag

SEQ ID NO: 300092 - DNA, 28 bp, Artificial Sequence
  Description of Artificial Sequence: Synthetic oligonucleotide
ggatgtaccagtgtgtgagcagcacgag

SEQ ID NO: 300093 - DNA, 29 bp, Artificial Sequence
  Description of Artificial Sequence: Synthetic oligonucleotide
gatgtaccagtgtgtgagcagcacgagag

SEQ ID NO: 300094 - DNA, 30 bp, Artificial Sequence
  Description of Artificial Sequence: Synthetic oligonucleotide
atgtaccagtgtgtgagcagcacgagagag

SEQ ID NO: 300095 - DNA, 29 bp, Artificial Sequence
  Description of Artificial Sequence: Synthetic oligonucleotide
tgtaccagtgtgtgagcagcacgagagag

SEQ ID NO: 300096 - DNA, 28 bp, Artificial Sequence
  Description of Artificial Sequence: Synthetic oligonucleotide
gtaccagtgtgtgagcagcacgagagag

SEQ ID NO: 300097 - DNA, 28 bp, Artificial Sequence
  Description of Artificial Sequence: Synthetic oligonucleotide
taccagtgtgtgagcagcacgagagagc

SEQ ID NO: 300098 - DNA, 27 bp, Artificial Sequence
  Description of Artificial Sequence: Synthetic oligonucleotide
accagtgtgtgagcagcacgagagagc

SEQ ID NO: 300099 - DNA, 26 bp, Artificial Sequence
  Description of Artificial Sequence: Synthetic oligonucleotide
ccagtgtgtgagcagcacgagagagc

SEQ ID NO: 300100 - DNA, 27 bp, Artificial Sequence
  Description of Artificial Sequence: Synthetic oligonucleotide
cagtgtgtgagcagcacgagagagcca

SEQ ID NO: 300101 - DNA, 28 bp, Artificial Sequence
  Description of Artificial Sequence: Synthetic oligonucleotide
agtgtgtgagcagcacgagagagccatc

SEQ ID NO: 300102 - DNA, 27 bp, Artificial Sequence
  Description of Artificial Sequence: Synthetic oligonucleotide
gtgtgtgagcagcacgagagagccatc

SEQ ID NO: 300103 - DNA, 28 bp, Artificial Sequence
  Description of Artificial Sequence: Synthetic oligonucleotide
tgtgtgagcagcacgagagagccatcac

SEQ ID NO: 300104 - DNA, 27 bp, Artificial Sequence
  Description of Artificial Sequence: Synthetic oligonucleotide
gtgtgagcagcacgagagagccatcac

SEQ ID NO: 300105 - DNA, 27 bp, Artificial Sequence
  Description of Artificial Sequence: Synthetic oligonucleotide
tgtgagcagcacgagagagccatcacg

SEQ ID NO: 300106 - DNA, 26 bp, Artificial Sequence
  Description of Artificial Sequence: Synthetic oligonucleotide
gtgagcagcacgagagagccatcacg

SEQ ID NO: 300107 - DNA, 27 bp, Artificial Sequence
  Description of Artificial Sequence: Synthetic oligonucleotide
tgagcagcacgagagagccatcacgct

SEQ ID NO: 300108 - DNA, 26 bp, Artificial Sequence
  Description of Artificial Sequence: Synthetic oligonucleotide
gagcagcacgagagagccatcacgct

SEQ ID NO: 300109 - DNA, 26 bp, Artificial Sequence
  Description of Artificial Sequence: Synthetic oligonucleotide
agcagcacgagagagccatcacgctg

SEQ ID NO: 300110 - DNA, 25 bp, Artificial Sequence
  Description of Artificial Sequence: Synthetic oligonucleotide
gcagcacgagagagccatcacgctg

SEQ ID NO: 300111 - DNA, 25 bp, Artificial Sequence
  Description of Artificial Sequence: Synthetic oligonucleotide
cagcacgagagagccatcacgctgg

SEQ ID NO: 300112 - DNA, 25 bp, Artificial Sequence
  Description of Artificial Sequence: Synthetic oligonucleotide
agcacgagagagccatcacgctggc

SEQ ID NO: 300113 - DNA, 24 bp, Artificial Sequence
  Description of Artificial Sequence: Synthetic oligonucleotide
gcacgagagagccatcacgctggc

SEQ ID NO: 300114 - DNA, 24 bp, Artificial Sequence
  Description of Artificial Sequence: Synthetic oligonucleotide
cacgagagagccatcacgctggcg

SEQ ID NO: 300115 - DNA, 26 bp, Artificial Sequence
  Description of Artificial Sequence: Synthetic oligonucleotide
acgagagagccatcacgctggcgcta

SEQ ID NO: 300116 - DNA, 25 bp, Artificial Sequence
  Description of Artificial Sequence: Synthetic oligonucleotide
cgagagagccatcacgctggcgcta

SEQ ID NO: 300117 - DNA, 25 bp, Artificial Sequence
  Description of Artificial Sequence: Synthetic oligonucleotide
gagagagccatcacgctggcgctag

SEQ ID NO: 300118 - DNA, 26 bp, Artificial Sequence
  Description of Artificial Sequence: Synthetic oligonucleotide
agagagccatcacgctggcgctagca

SEQ ID NO: 300119 - DNA, 25 bp, Artificial Sequence
  Description of Artificial Sequence: Synthetic oligonucleotide
gagagccatcacgctggcgctagca

SEQ ID NO: 300120 - DNA, 25 bp, Artificial Sequence
  Description of Artificial Sequence: Synthetic oligonucleotide
agagccatcacgctggcgctagcag

SEQ ID NO: 300121 - DNA, 24 bp, Artificial Sequence
  Description of Artificial Sequence: Synthetic oligonucleotide
gagccatcacgctggcgctagcag

SEQ ID NO: 300122 - DNA, 25 bp, Artificial Sequence
  Description of Artificial Sequence: Synthetic oligonucleotide
agccatcacgctggcgctagcaggt

SEQ ID NO: 300123 - DNA, 24 bp, Artificial Sequence
  Description of Artificial Sequence: Synthetic oligonucleotide
gccatcacgctggcgctagcaggt

SEQ ID NO: 300124 - DNA, 26 bp, Artificial Sequence
  Description of Artificial Sequence: Synthetic oligonucleotide
ccatcacgctggcgctagcaggtctt

SEQ ID NO: 300125 - DNA, 27 bp, Artificial Sequence
  Description of Artificial Sequence: Synthetic oligonucleotide
catcacgctggcgctagcaggtcttct

SEQ ID NO: 300126 - DNA, 27 bp, Artificial Sequence
  Description of Artificial Sequence: Synthetic oligonucleotide
atcacgctggcgctagcaggtcttctc

SEQ ID NO: 300127 - DNA, 26 bp, Artificial Sequence
  Description of Artificial Sequence: Synthetic oligonucleotide
tcacgctggcgctagcaggtcttctc

SEQ ID NO: 300128 - DNA, 25 bp, Artificial Sequence
  Description of Artificial Sequence: Synthetic oligonucleotide
cacgctggcgctagcaggtcttctc

SEQ ID NO: 300129 - DNA, 25 bp, Artificial Sequence
  Description of Artificial Sequence: Synthetic oligonucleotide
acgctggcgctagcaggtcttctcg

SEQ ID NO: 300130 - DNA, 24 bp, Artificial Sequence
  Description of Artificial Sequence: Synthetic oligonucleotide
cgctggcgctagcaggtcttctcg

SEQ ID NO: 300131 - DNA, 24 bp, Artificial Sequence
  Description of Artificial Sequence: Synthetic oligonucleotide
gctggcgctagcaggtcttctcgg

SEQ ID NO: 300132 - DNA, 24 bp, Artificial Sequence
  Description of Artificial Sequence: Synthetic oligonucleotide
ctggcgctagcaggtcttctcggc

SEQ ID NO: 300133 - DNA, 25 bp, Artificial Sequence
  Description of Artificial Sequence: Synthetic oligonucleotide
tggcgctagcaggtcttctcggcca

SEQ ID NO: 300134 - DNA, 24 bp, Artificial Sequence
  Description of Artificial Sequence: Synthetic oligonucleotide
ggcgctagcaggtcttctcggcca

SEQ ID NO: 300135 - DNA, 24 bp, Artificial Sequence
  Description of Artificial Sequence: Synthetic oligonucleotide
gcgctagcaggtcttctcggccag

SEQ ID NO: 300136 - DNA, 24 bp, Artificial Sequence
  Description of Artificial Sequence: Synthetic oligonucleotide
cgctagcaggtcttctcggccagg

SEQ ID NO: 300137 - DNA, 25 bp, Artificial Sequence
  Description of Artificial Sequence: Synthetic oligonucleotide
gctagcaggtcttctcggccaggga

SEQ ID NO: 300138 - DNA, 27 bp, Artificial Sequence
  Description of Artificial Sequence: Synthetic oligonucleotide
ctagcaggtcttctcggccagggagtt

SEQ ID NO: 300139 - DNA, 32 bp, Artificial Sequence
  Description of Artificial Sequence: Synthetic oligonucleotide
tagcaggtcttctcggccagggagtttataac

SEQ ID NO: 300140 - DNA, 31 bp, Artificial Sequence
  Description of Artificial Sequence: Synthetic oligonucleotide
agcaggtcttctcggccagggagtttataac

SEQ ID NO: 300141 - DNA, 30 bp, Artificial Sequence
  Description of Artificial Sequence: Synthetic oligonucleotide
gcaggtcttctcggccagggagtttataac

SEQ ID NO: 300142 - DNA, 33 bp, Artificial Sequence
  Description of Artificial Sequence: Synthetic oligonucleotide
caggtcttctcggccagggagtttataactttg

SEQ ID NO: 300143 - DNA, 33 bp, Artificial Sequence
  Description of Artificial Sequence: Synthetic oligonucleotide
aggtcttctcggccagggagtttataactttgg

SEQ ID NO: 300144 - DNA, 32 bp, Artificial Sequence
  Description of Artificial Sequence: Synthetic oligonucleotide
ggtcttctcggccagggagtttataactttgg

SEQ ID NO: 300145 - DNA, 33 bp, Artificial Sequence
  Description of Artificial Sequence: Synthetic oligonucleotide
gtcttctcggccagggagtttataactttggtg

SEQ ID NO: 300146 - DNA, 35 bp, Artificial Sequence
  Description of Artificial Sequence: Synthetic oligonucleotide
tcttctcggccagggagtttataactttggtgaac

SEQ ID NO: 300147 - DNA, 34 bp, Artificial Sequence
  Description of Artificial Sequence: Synthetic oligonucleotide
cttctcggccagggagtttataactttggtgaac

SEQ ID NO: 300148 - DNA, 35 bp, Artificial Sequence
  Description of Artificial Sequence: Synthetic oligonucleotide
ttctcggccagggagtttataactttggtgaactc

SEQ ID NO: 300149 - DNA, 34 bp, Artificial Sequence
  Description of Artificial Sequence: Synthetic oligonucleotide
tctcggccagggagtttataactttggtgaactc

SEQ ID NO: 300150 - DNA, 33 bp, Artificial Sequence
  Description of Artificial Sequence: Synthetic oligonucleotide
ctcggccagggagtttataactttggtgaactc

SEQ ID NO: 300151 - DNA, 33 bp, Artificial Sequence
  Description of Artificial Sequence: Synthetic oligonucleotide
tcggccagggagtttataactttggtgaactcc

SEQ ID NO: 300152 - DNA, 32 bp, Artificial Sequence
  Description of Artificial Sequence: Synthetic oligonucleotide
cggccagggagtttataactttggtgaactcc

SEQ ID NO: 300153 - DNA, 33 bp, Artificial Sequence
  Description of Artificial Sequence: Synthetic oligonucleotide
ggccagggagtttataactttggtgaactcctc

SEQ ID NO: 300154 - DNA, 35 bp, Artificial Sequence
  Description of Artificial Sequence: Synthetic oligonucleotide
gccagggagtttataactttggtgaactcctcttg

SEQ ID NO: 300155 - DNA, 35 bp, Artificial Sequence
  Description of Artificial Sequence: Synthetic oligonucleotide
ccagggagtttataactttggtgaactcctcttgc

SEQ ID NO: 300156 - DNA, 36 bp, Artificial Sequence
  Description of Artificial Sequence: Synthetic oligonucleotide
cagggagtttataactttggtgaactcctcttgcac

SEQ ID NO: 300157 - DNA, 36 bp, Artificial Sequence
  Description of Artificial Sequence: Synthetic oligonucleotide
agggagtttataactttggtgaactcctcttgcacc

SEQ ID NO: 300158 - DNA, 35 bp, Artificial Sequence
  Description of Artificial Sequence: Synthetic oligonucleotide
gggagtttataactttggtgaactcctcttgcacc

SEQ ID NO: 300159 - DNA, 35 bp, Artificial Sequence
  Description of Artificial Sequence: Synthetic oligonucleotide
ggagtttataactttggtgaactcctcttgcaccc

SEQ ID NO: 300160 - DNA, 36 bp, Artificial Sequence
  Description of Artificial Sequence: Synthetic oligonucleotide
gagtttataactttggtgaactcctcttgcaccctg

SEQ ID NO: 300161 - DNA, 37 bp, Artificial Sequence
  Description of Artificial Sequence: Synthetic oligonucleotide
agtttataactttggtgaactcctcttgcaccctgag

SEQ ID NO: 300162 - DNA, 36 bp, Artificial Sequence
  Description of Artificial Sequence: Synthetic oligonucleotide
gtttataactttggtgaactcctcttgcaccctgag

SEQ ID NO: 300163 - DNA, 36 bp, Artificial Sequence
  Description of Artificial Sequence: Synthetic oligonucleotide
tttataactttggtgaactcctcttgcaccctgagc

SEQ ID NO: 300164 - DNA, 35 bp, Artificial Sequence
  Description of Artificial Sequence: Synthetic oligonucleotide
ttataactttggtgaactcctcttgcaccctgagc

SEQ ID NO: 300165 - DNA, 34 bp, Artificial Sequence
  Description of Artificial Sequence: Synthetic oligonucleotide
tataactttggtgaactcctcttgcaccctgagc

SEQ ID NO: 300166 - DNA, 33 bp, Artificial Sequence
  Description of Artificial Sequence: Synthetic oligonucleotide
ataactttggtgaactcctcttgcaccctgagc

SEQ ID NO: 300167 - DNA, 32 bp, Artificial Sequence
  Description of Artificial Sequence: Synthetic oligonucleotide
taactttggtgaactcctcttgcaccctgagc

SEQ ID NO: 300168 - DNA, 31 bp, Artificial Sequence
  Description of Artificial Sequence: Synthetic oligonucleotide
aactttggtgaactcctcttgcaccctgagc

SEQ ID NO: 300169 - DNA, 30 bp, Artificial Sequence
  Description of Artificial Sequence: Synthetic oligonucleotide
actttggtgaactcctcttgcaccctgagc

SEQ ID NO: 300170 - DNA, 29 bp, Artificial Sequence
  Description of Artificial Sequence: Synthetic oligonucleotide
ctttggtgaactcctcttgcaccctgagc

SEQ ID NO: 300171 - DNA, 30 bp, Artificial Sequence
  Description of Artificial Sequence: Synthetic oligonucleotide
tttggtgaactcctcttgcaccctgagctg

SEQ ID NO: 300172 - DNA, 29 bp, Artificial Sequence
  Description of Artificial Sequence: Synthetic oligonucleotide
ttggtgaactcctcttgcaccctgagctg

SEQ ID NO: 300173 - DNA, 28 bp, Artificial Sequence
  Description of Artificial Sequence: Synthetic oligonucleotide
tggtgaactcctcttgcaccctgagctg

SEQ ID NO: 300174 - DNA, 27 bp, Artificial Sequence
  Description of Artificial Sequence: Synthetic oligonucleotide
ggtgaactcctcttgcaccctgagctg

SEQ ID NO: 300175 - DNA, 27 bp, Artificial Sequence
  Description of Artificial Sequence: Synthetic oligonucleotide
gtgaactcctcttgcaccctgagctgg

SEQ ID NO: 300176 - DNA, 28 bp, Artificial Sequence
  Description of Artificial Sequence: Synthetic oligonucleotide
tgaactcctcttgcaccctgagctggag

SEQ ID NO: 300177 - DNA, 27 bp, Artificial Sequence
  Description of Artificial Sequence: Synthetic oligonucleotide
gaactcctcttgcaccctgagctggag

SEQ ID NO: 300178 - DNA, 28 bp, Artificial Sequence
  Description of Artificial Sequence: Synthetic oligonucleotide
aactcctcttgcaccctgagctggagtc

SEQ ID NO: 300179 - DNA, 27 bp, Artificial Sequence
  Description of Artificial Sequence: Synthetic oligonucleotide
actcctcttgcaccctgagctggagtc

SEQ ID NO: 300180 - DNA, 26 bp, Artificial Sequence
  Description of Artificial Sequence: Synthetic oligonucleotide
ctcctcttgcaccctgagctggagtc

SEQ ID NO: 300181 - DNA, 26 bp, Artificial Sequence
  Description of Artificial Sequence: Synthetic oligonucleotide
tcctcttgcaccctgagctggagtcg

SEQ ID NO: 300182 - DNA, 25 bp, Artificial Sequence
  Description of Artificial Sequence: Synthetic oligonucleotide
cctcttgcaccctgagctggagtcg

SEQ ID NO: 300183 - DNA, 26 bp, Artificial Sequence
  Description of Artificial Sequence: Synthetic oligonucleotide
ctcttgcaccctgagctggagtcgct

SEQ ID NO: 300184 - DNA, 27 bp, Artificial Sequence
  Description of Artificial Sequence: Synthetic oligonucleotide
tcttgcaccctgagctggagtcgctga

SEQ ID NO: 300185 - DNA, 26 bp, Artificial Sequence
  Description of Artificial Sequence: Synthetic oligonucleotide
cttgcaccctgagctggagtcgctga

SEQ ID NO: 300186 - DNA, 26 bp, Artificial Sequence
  Description of Artificial Sequence: Synthetic oligonucleotide
ttgcaccctgagctggagtcgctgag

SEQ ID NO: 300187 - DNA, 25 bp, Artificial Sequence
  Description of Artificial Sequence: Synthetic oligonucleotide
tgcaccctgagctggagtcgctgag

SEQ ID NO: 300188 - DNA, 24 bp, Artificial Sequence
  Description of Artificial Sequence: Synthetic oligonucleotide
gcaccctgagctggagtcgctgag

SEQ ID NO: 300189 - DNA, 27 bp, Artificial Sequence
  Description of Artificial Sequence: Synthetic oligonucleotide
caccctgagctggagtcgctgaggaat

SEQ ID NO: 300190 - DNA, 28 bp, Artificial Sequence
  Description of Artificial Sequence: Synthetic oligonucleotide
accctgagctggagtcgctgaggaattc

SEQ ID NO: 300191 - DNA, 27 bp, Artificial Sequence
  Description of Artificial Sequence: Synthetic oligonucleotide
ccctgagctggagtcgctgaggaattc

SEQ ID NO: 300192 - DNA, 28 bp, Artificial Sequence
  Description of Artificial Sequence: Synthetic oligonucleotide
cctgagctggagtcgctgaggaattctg

SEQ ID NO: 300193 - DNA, 29 bp, Artificial Sequence
  Description of Artificial Sequence: Synthetic oligonucleotide
ctgagctggagtcgctgaggaattctgac

SEQ ID NO: 300194 - DNA, 29 bp, Artificial Sequence
  Description of Artificial Sequence: Synthetic oligonucleotide
tgagctggagtcgctgaggaattctgacc

SEQ ID NO: 300195 - DNA, 28 bp, Artificial Sequence
  Description of Artificial Sequence: Synthetic oligonucleotide
gagctggagtcgctgaggaattctgacc

SEQ ID NO: 300196 - DNA, 28 bp, Artificial Sequence
  Description of Artificial Sequence: Synthetic oligonucleotide
agctggagtcgctgaggaattctgaccg

SEQ ID NO: 300197 - DNA, 27 bp, Artificial Sequence
  Description of Artificial Sequence: Synthetic oligonucleotide
gctggagtcgctgaggaattctgaccg

SEQ ID NO: 300198 - DNA, 27 bp, Artificial Sequence
  Description of Artificial Sequence: Synthetic oligonucleotide
ctggagtcgctgaggaattctgaccgg

SEQ ID NO: 300199 - DNA, 27 bp, Artificial Sequence
  Description of Artificial Sequence: Synthetic oligonucleotide
tggagtcgctgaggaattctgaccggc

SEQ ID NO: 300200 - DNA, 27 bp, Artificial Sequence
  Description of Artificial Sequence: Synthetic oligonucleotide
ggagtcgctgaggaattctgaccggct

SEQ ID NO: 300201 - DNA, 27 bp, Artificial Sequence
  Description of Artificial Sequence: Synthetic oligonucleotide
gagtcgctgaggaattctgaccggctg

SEQ ID NO: 300202 - DNA, 28 bp, Artificial Sequence
  Description of Artificial Sequence: Synthetic oligonucleotide
agtcgctgaggaattctgaccggctgtg

SEQ ID NO: 300203 - DNA, 27 bp, Artificial Sequence
  Description of Artificial Sequence: Synthetic oligonucleotide
gtcgctgaggaattctgaccggctgtg

SEQ ID NO: 300204 - DNA, 27 bp, Artificial Sequence
  Description of Artificial Sequence: Synthetic oligonucleotide
tcgctgaggaattctgaccggctgtgg

SEQ ID NO: 300205 - DNA, 26 bp, Artificial Sequence
  Description of Artificial Sequence: Synthetic oligonucleotide
cgctgaggaattctgaccggctgtgg

SEQ ID NO: 300206 - DNA, 27 bp, Artificial Sequence
  Description of Artificial Sequence: Synthetic oligonucleotide
gctgaggaattctgaccggctgtggct

SEQ ID NO: 300207 - DNA, 27 bp, Artificial Sequence
  Description of Artificial Sequence: Synthetic oligonucleotide
ctgaggaattctgaccggctgtggctg

SEQ ID NO: 300208 - DNA, 30 bp, Artificial Sequence
  Description of Artificial Sequence: Synthetic oligonucleotide
tgaggaattctgaccggctgtggctgatag

SEQ ID NO: 300209 - DNA, 29 bp, Artificial Sequence
  Description of Artificial Sequence: Synthetic oligonucleotide
gaggaattctgaccggctgtggctgatag

SEQ ID NO: 300210 - DNA, 30 bp, Artificial Sequence
  Description of Artificial Sequence: Synthetic oligonucleotide
aggaattctgaccggctgtggctgatagac

SEQ ID NO: 300211 - DNA, 29 bp, Artificial Sequence
  Description of Artificial Sequence: Synthetic oligonucleotide
ggaattctgaccggctgtggctgatagac

SEQ ID NO: 300212 - DNA, 30 bp, Artificial Sequence
  Description of Artificial Sequence: Synthetic oligonucleotide
gaattctgaccggctgtggctgatagacac

SEQ ID NO: 300213 - DNA, 30 bp, Artificial Sequence
  Description of Artificial Sequence: Synthetic oligonucleotide
aattctgaccggctgtggctgatagacacc

SEQ ID NO: 300214 - DNA, 29 bp, Artificial Sequence
  Description of Artificial Sequence: Synthetic oligonucleotide
attctgaccggctgtggctgatagacacc

SEQ ID NO: 300215 - DNA, 28 bp, Artificial Sequence
  Description of Artificial Sequence: Synthetic oligonucleotide
ttctgaccggctgtggctgatagacacc

SEQ ID NO: 300216 - DNA, 27 bp, Artificial Sequence
  Description of Artificial Sequence: Synthetic oligonucleotide
tctgaccggctgtggctgatagacacc

SEQ ID NO: 300217 - DNA, 26 bp, Artificial Sequence
  Description of Artificial Sequence: Synthetic oligonucleotide
ctgaccggctgtggctgatagacacc

SEQ ID NO: 300218 - DNA, 27 bp, Artificial Sequence
  Description of Artificial Sequence: Synthetic oligonucleotide
tgaccggctgtggctgatagacaccct

SEQ ID NO: 300219 - DNA, 26 bp, Artificial Sequence
  Description of Artificial Sequence: Synthetic oligonucleotide
gaccggctgtggctgatagacaccct

SEQ ID NO: 300220 - DNA, 27 bp, Artificial Sequence
  Description of Artificial Sequence: Synthetic oligonucleotide
accggctgtggctgatagacaccctca

SEQ ID NO: 300221 - DNA, 27 bp, Artificial Sequence
  Description of Artificial Sequence: Synthetic oligonucleotide
ccggctgtggctgatagacaccctcaa

SEQ ID NO: 300222 - DNA, 28 bp, Artificial Sequence
  Description of Artificial Sequence: Synthetic oligonucleotide
cggctgtggctgatagacaccctcaatg

SEQ ID NO: 300223 - DNA, 28 bp, Artificial Sequence
  Description of Artificial Sequence: Synthetic oligonucleotide
ggctgtggctgatagacaccctcaatgc

SEQ ID NO: 300224 - DNA, 28 bp, Artificial Sequence
  Description of Artificial Sequence: Synthetic oligonucleotide
gctgtggctgatagacaccctcaatgcc

SEQ ID NO: 300225 - DNA, 30 bp, Artificial Sequence
  Description of Artificial Sequence: Synthetic oligonucleotide
ctgtggctgatagacaccctcaatgccttc

SEQ ID NO: 300226 - DNA, 32 bp, Artificial Sequence
  Description of Artificial Sequence: Synthetic oligonucleotide
tgtggctgatagacaccctcaatgccttcatc

SEQ ID NO: 300227 - DNA, 31 bp, Artificial Sequence
  Description of Artificial Sequence: Synthetic oligonucleotide
gtggctgatagacaccctcaatgccttcatc

SEQ ID NO: 300228 - DNA, 32 bp, Artificial Sequence
  Description of Artificial Sequence: Synthetic oligonucleotide
tggctgatagacaccctcaatgccttcatcag

SEQ ID NO: 300229 - DNA, 31 bp, Artificial Sequence
  Description of Artificial Sequence: Synthetic oligonucleotide
ggctgatagacaccctcaatgccttcatcag

SEQ ID NO: 300230 - DNA, 32 bp, Artificial Sequence
  Description of Artificial Sequence: Synthetic oligonucleotide
gctgatagacaccctcaatgccttcatcagtg

SEQ ID NO: 300231 - DNA, 32 bp, Artificial Sequence
  Description of Artificial Sequence: Synthetic oligonucleotide
ctgatagacaccctcaatgccttcatcagtgg

SEQ ID NO: 300232 - DNA, 32 bp, Artificial Sequence
  Description of Artificial Sequence: Synthetic oligonucleotide
tgatagacaccctcaatgccttcatcagtggc

SEQ ID NO: 300233 - DNA, 31 bp, Artificial Sequence
  Description of Artificial Sequence: Synthetic oligonucleotide
gatagacaccctcaatgccttcatcagtggc

SEQ ID NO: 300234 - DNA, 33 bp, Artificial Sequence
  Description of Artificial Sequence: Synthetic oligonucleotide
atagacaccctcaatgccttcatcagtggcaag

SEQ ID NO: 300235 - DNA, 32 bp, Artificial Sequence
  Description of Artificial Sequence: Synthetic oligonucleotide
tagacaccctcaatgccttcatcagtggcaag

SEQ ID NO: 300236 - DNA, 31 bp, Artificial Sequence
  Description of Artificial Sequence: Synthetic oligonucleotide
agacaccctcaatgccttcatcagtggcaag

SEQ ID NO: 300237 - DNA, 30 bp, Artificial Sequence
  Description of Artificial Sequence: Synthetic oligonucleotide
gacaccctcaatgccttcatcagtggcaag

SEQ ID NO: 300238 - DNA, 30 bp, Artificial Sequence
  Description of Artificial Sequence: Synthetic oligonucleotide
acaccctcaatgccttcatcagtggcaagg

SEQ ID NO: 300239 - DNA, 29 bp, Artificial Sequence
  Description of Artificial Sequence: Synthetic oligonucleotide
caccctcaatgccttcatcagtggcaagg

SEQ ID NO: 300240 - DNA, 31 bp, Artificial Sequence
  Description of Artificial Sequence: Synthetic oligonucleotide
accctcaatgccttcatcagtggcaaggtag

SEQ ID NO: 300241 - DNA, 30 bp, Artificial Sequence
  Description of Artificial Sequence: Synthetic oligonucleotide
ccctcaatgccttcatcagtggcaaggtag

SEQ ID NO: 300242 - DNA, 31 bp, Artificial Sequence
  Description of Artificial Sequence: Synthetic oligonucleotide
cctcaatgccttcatcagtggcaaggtagag

SEQ ID NO: 300243 - DNA, 31 bp, Artificial Sequence
  Description of Artificial Sequence: Synthetic oligonucleotide
ctcaatgccttcatcagtggcaaggtagagc

SEQ ID NO: 300244 - DNA, 31 bp, Artificial Sequence
  Description of Artificial Sequence: Synthetic oligonucleotide
tcaatgccttcatcagtggcaaggtagagcg

SEQ ID NO: 300245 - DNA, 30 bp, Artificial Sequence
  Description of Artificial Sequence: Synthetic oligonucleotide
caatgccttcatcagtggcaaggtagagcg

SEQ ID NO: 300246 - DNA, 30 bp, Artificial Sequence
  Description of Artificial Sequence: Synthetic oligonucleotide
aatgccttcatcagtggcaaggtagagcgg

SEQ ID NO: 300247 - DNA, 29 bp, Artificial Sequence
  Description of Artificial Sequence: Synthetic oligonucleotide
atgccttcatcagtggcaaggtagagcgg

SEQ ID NO: 300248 - DNA, 28 bp, Artificial Sequence
  Description of Artificial Sequence: Synthetic oligonucleotide
tgccttcatcagtggcaaggtagagcgg

SEQ ID NO: 300249 - DNA, 27 bp, Artificial Sequence
  Description of Artificial Sequence: Synthetic oligonucleotide
gccttcatcagtggcaaggtagagcgg

SEQ ID NO: 300250 - DNA, 29 bp, Artificial Sequence
  Description of Artificial Sequence: Synthetic oligonucleotide
ccttcatcagtggcaaggtagagcggatc

SEQ ID NO: 300251 - DNA, 29 bp, Artificial Sequence
  Description of Artificial Sequence: Synthetic oligonucleotide
cttcatcagtggcaaggtagagcggatcc

SEQ ID NO: 300252 - DNA, 30 bp, Artificial Sequence
  Description of Artificial Sequence: Synthetic oligonucleotide
ttcatcagtggcaaggtagagcggatccag

SEQ ID NO: 300253 - DNA, 29 bp, Artificial Sequence
  Description of Artificial Sequence: Synthetic oligonucleotide
tcatcagtggcaaggtagagcggatccag

SEQ ID NO: 300254 - DNA, 28 bp, Artificial Sequence
  Description of Artificial Sequence: Synthetic oligonucleotide
catcagtggcaaggtagagcggatccag

SEQ ID NO: 300255 - DNA, 29 bp, Artificial Sequence
  Description of Artificial Sequence: Synthetic oligonucleotide
atcagtggcaaggtagagcggatccagac

SEQ ID NO: 300256 - DNA, 28 bp, Artificial Sequence
  Description of Artificial Sequence: Synthetic oligonucleotide
tcagtggcaaggtagagcggatccagac

SEQ ID NO: 300257 - DNA, 27 bp, Artificial Sequence
  Description of Artificial Sequence: Synthetic oligonucleotide
cagtggcaaggtagagcggatccagac

SEQ ID NO: 300258 - DNA, 28 bp, Artificial Sequence
  Description of Artificial Sequence: Synthetic oligonucleotide
agtggcaaggtagagcggatccagactc

SEQ ID NO: 300259 - DNA, 27 bp, Artificial Sequence
  Description of Artificial Sequence: Synthetic oligonucleotide
gtggcaaggtagagcggatccagactc

SEQ ID NO: 300260 - DNA, 28 bp, Artificial Sequence
  Description of Artificial Sequence: Synthetic oligonucleotide
tggcaaggtagagcggatccagactcag

SEQ ID NO: 300261 - DNA, 27 bp, Artificial Sequence
  Description of Artificial Sequence: Synthetic oligonucleotide
ggcaaggtagagcggatccagactcag

SEQ ID NO: 300262 - DNA, 29 bp, Artificial Sequence
  Description of Artificial Sequence: Synthetic oligonucleotide
gcaaggtagagcggatccagactcagaag

SEQ ID NO: 300263 - DNA, 30 bp, Artificial Sequence
  Description of Artificial Sequence: Synthetic oligonucleotide
caaggtagagcggatccagactcagaagac

SEQ ID NO: 300264 - DNA, 31 bp, Artificial Sequence
  Description of Artificial Sequence: Synthetic oligonucleotide
aaggtagagcggatccagactcagaagactg

SEQ ID NO: 300265 - DNA, 30 bp, Artificial Sequence
  Description of Artificial Sequence: Synthetic oligonucleotide
aggtagagcggatccagactcagaagactg

SEQ ID NO: 300266 - DNA, 29 bp, Artificial Sequence
  Description of Artificial Sequence: Synthetic oligonucleotide
ggtagagcggatccagactcagaagactg

SEQ ID NO: 300267 - DNA, 29 bp, Artificial Sequence
  Description of Artificial Sequence: Synthetic oligonucleotide
gtagagcggatccagactcagaagactgc

SEQ ID NO: 300268 - DNA, 29 bp, Artificial Sequence
  Description of Artificial Sequence: Synthetic oligonucleotide
tagagcggatccagactcagaagactgcg

SEQ ID NO: 300269 - DNA, 28 bp, Artificial Sequence
  Description of Artificial Sequence: Synthetic oligonucleotide
agagcggatccagactcagaagactgcg

SEQ ID NO: 300270 - DNA, 27 bp, Artificial Sequence
  Description of Artificial Sequence: Synthetic oligonucleotide
gagcggatccagactcagaagactgcg

SEQ ID NO: 300271 - DNA, 28 bp, Artificial Sequence
  Description of Artificial Sequence: Synthetic oligonucleotide
agcggatccagactcagaagactgcgtg

SEQ ID NO: 300272 - DNA, 27 bp, Artificial Sequence
  Description of Artificial Sequence: Synthetic oligonucleotide
gcggatccagactcagaagactgcgtg

SEQ ID NO: 300273 - DNA, 27 bp, Artificial Sequence
  Description of Artificial Sequence: Synthetic oligonucleotide
cggatccagactcagaagactgcgtgg

SEQ ID NO: 300274 - DNA, 27 bp, Artificial Sequence
  Description of Artificial Sequence: Synthetic oligonucleotide
ggatccagactcagaagactgcgtggg

SEQ ID NO: 300275 - DNA, 27 bp, Artificial Sequence
  Description of Artificial Sequence: Synthetic oligonucleotide
gatccagactcagaagactgcgtgggg

SEQ ID NO: 300276 - DNA, 27 bp, Artificial Sequence
  Description of Artificial Sequence: Synthetic oligonucleotide
atccagactcagaagactgcgtggggc

SEQ ID NO: 300277 - DNA, 26 bp, Artificial Sequence
  Description of Artificial Sequence: Synthetic oligonucleotide
tccagactcagaagactgcgtggggc

SEQ ID NO: 300278 - DNA, 25 bp, Artificial Sequence
  Description of Artificial Sequence: Synthetic oligonucleotide
ccagactcagaagactgcgtggggc

SEQ ID NO: 300279 - DNA, 26 bp, Artificial Sequence
  Description of Artificial Sequence: Synthetic oligonucleotide
cagactcagaagactgcgtggggcca

SEQ ID NO: 300280 - DNA, 26 bp, Artificial Sequence
  Description of Artificial Sequence: Synthetic oligonucleotide
agactcagaagactgcgtggggccag

SEQ ID NO: 300281 - DNA, 25 bp, Artificial Sequence
  Description of Artificial Sequence: Synthetic oligonucleotide
gactcagaagactgcgtggggccag

SEQ ID NO: 300282 - DNA, 26 bp, Artificial Sequence
  Description of Artificial Sequence: Synthetic oligonucleotide
actcagaagactgcgtggggccagga

SEQ ID NO: 300283 - DNA, 25 bp, Artificial Sequence
  Description of Artificial Sequence: Synthetic oligonucleotide
ctcagaagactgcgtggggccagga

SEQ ID NO: 300284 - DNA, 25 bp, Artificial Sequence
  Description of Artificial Sequence: Synthetic oligonucleotide
tcagaagactgcgtggggccaggag

SEQ ID NO: 300285 - DNA, 24 bp, Artificial Sequence
  Description of Artificial Sequence: Synthetic oligonucleotide
cagaagactgcgtggggccaggag

SEQ ID NO: 300286 - DNA, 24 bp, Artificial Sequence
  Description of Artificial Sequence: Synthetic oligonucleotide
agaagactgcgtggggccaggagc

SEQ ID NO: 300287 - DNA, 23 bp, Artificial Sequence
  Description of Artificial Sequence: Synthetic oligonucleotide
gaagactgcgtggggccaggagc

SEQ ID NO: 300288 - DNA, 24 bp, Artificial Sequence
  Description of Artificial Sequence: Synthetic oligonucleotide
aagactgcgtggggccaggagcct

SEQ ID NO: 300289 - DNA, 23 bp, Artificial Sequence
  Description of Artificial Sequence: Synthetic oligonucleotide
agactgcgtggggccaggagcct

SEQ ID NO: 300290 - DNA, 22 bp, Artificial Sequence
  Description of Artificial Sequence: Synthetic oligonucleotide
gactgcgtggggccaggagcct

SEQ ID NO: 300291 - DNA, 27 bp, Artificial Sequence
  Description of Artificial Sequence: Synthetic oligonucleotide
actgcgtggggccaggagcctgattaa

SEQ ID NO: 300292 - DNA, 26 bp, Artificial Sequence
  Description of Artificial Sequence: Synthetic oligonucleotide
ctgcgtggggccaggagcctgattaa

SEQ ID NO: 300293 - DNA, 26 bp, Artificial Sequence
  Description of Artificial Sequence: Synthetic oligonucleotide
tgcgtggggccaggagcctgattaag

SEQ ID NO: 300294 - DNA, 25 bp, Artificial Sequence
  Description of Artificial Sequence: Synthetic oligonucleotide
gcgtggggccaggagcctgattaag

SEQ ID NO: 300295 - DNA, 26 bp, Artificial Sequence
  Description of Artificial Sequence: Synthetic oligonucleotide
cgtggggccaggagcctgattaagca

SEQ ID NO: 300296 - DNA, 26 bp, Artificial Sequence
  Description of Artificial Sequence: Synthetic oligonucleotide
gtggggccaggagcctgattaagcag

SEQ ID NO: 300297 - DNA, 27 bp, Artificial Sequence
  Description of Artificial Sequence: Synthetic oligonucleotide
tggggccaggagcctgattaagcagct

SEQ ID NO: 300298 - DNA, 27 bp, Artificial Sequence
  Description of Artificial Sequence: Synthetic oligonucleotide
ggggccaggagcctgattaagcagcta

SEQ ID NO: 300299 - DNA, 29 bp, Artificial Sequence
  Description of Artificial Sequence: Synthetic oligonucleotide
gggccaggagcctgattaagcagctaaag

SEQ ID NO: 300300 - DNA, 31 bp, Artificial Sequence
  Description of Artificial Sequence: Synthetic oligonucleotide
ggccaggagcctgattaagcagctaaagaag

SEQ ID NO: 300301 - DNA, 31 bp, Artificial Sequence
  Description of Artificial Sequence: Synthetic oligonucleotide
gccaggagcctgattaagcagctaaagaagc

SEQ ID NO: 300302 - DNA, 31 bp, Artificial Sequence
  Description of Artificial Sequence: Synthetic oligonucleotide
ccaggagcctgattaagcagctaaagaagcc

SEQ ID NO: 300303 - DNA, 31 bp, Artificial Sequence
  Description of Artificial Sequence: Synthetic oligonucleotide
caggagcctgattaagcagctaaagaagccc

SEQ ID NO: 300304 - DNA, 32 bp, Artificial Sequence
  Description of Artificial Sequence: Synthetic oligonucleotide
aggagcctgattaagcagctaaagaagcccag

SEQ ID NO: 300305 - DNA, 31 bp, Artificial Sequence
  Description of Artificial Sequence: Synthetic oligonucleotide
ggagcctgattaagcagctaaagaagcccag

SEQ ID NO: 300306 - DNA, 31 bp, Artificial Sequence
  Description of Artificial Sequence: Synthetic oligonucleotide
gagcctgattaagcagctaaagaagcccagg

SEQ ID NO: 300307 - DNA, 33 bp, Artificial Sequence
  Description of Artificial Sequence: Synthetic oligonucleotide
agcctgattaagcagctaaagaagcccaggttc

SEQ ID NO: 300308 - DNA, 32 bp, Artificial Sequence
  Description of Artificial Sequence: Synthetic oligonucleotide
gcctgattaagcagctaaagaagcccaggttc

SEQ ID NO: 300309 - DNA, 33 bp, Artificial Sequence
  Description of Artificial Sequence: Synthetic oligonucleotide
cctgattaagcagctaaagaagcccaggttctg

SEQ ID NO: 300310 - DNA, 34 bp, Artificial Sequence
  Description of Artificial Sequence: Synthetic oligonucleotide
ctgattaagcagctaaagaagcccaggttctgag

SEQ ID NO: 300311 - DNA, 34 bp, Artificial Sequence
  Description of Artificial Sequence: Synthetic oligonucleotide
tgattaagcagctaaagaagcccaggttctgagg

SEQ ID NO: 300312 - DNA, 33 bp, Artificial Sequence
  Description of Artificial Sequence: Synthetic oligonucleotide
gattaagcagctaaagaagcccaggttctgagg

SEQ ID NO: 300313 - DNA, 39 bp, Artificial Sequence
  Description of Artificial Sequence: Synthetic oligonucleotide
attaagcagctaaagaagcccaggttctgaggataattc

SEQ ID NO: 300314 - DNA, 38 bp, Artificial Sequence
  Description of Artificial Sequence: Synthetic oligonucleotide
ttaagcagctaaagaagcccaggttctgaggataattc

SEQ ID NO: 300315 - DNA, 37 bp, Artificial Sequence
  Description of Artificial Sequence: Synthetic oligonucleotide
taagcagctaaagaagcccaggttctgaggataattc

SEQ ID NO: 300316 - DNA, 36 bp, Artificial Sequence
  Description of Artificial Sequence: Synthetic oligonucleotide
aagcagctaaagaagcccaggttctgaggataattc

SEQ ID NO: 300317 - DNA, 35 bp, Artificial Sequence
  Description of Artificial Sequence: Synthetic oligonucleotide
agcagctaaagaagcccaggttctgaggataattc

SEQ ID NO: 300318 - DNA, 34 bp, Artificial Sequence
  Description of Artificial Sequence: Synthetic oligonucleotide
gcagctaaagaagcccaggttctgaggataattc

SEQ ID NO: 300319 - DNA, 35 bp, Artificial Sequence
  Description of Artificial Sequence: Synthetic oligonucleotide
cagctaaagaagcccaggttctgaggataattcag

SEQ ID NO: 300320 - DNA, 37 bp, Artificial Sequence
  Description of Artificial Sequence: Synthetic oligonucleotide
agctaaagaagcccaggttctgaggataattcagttc

SEQ ID NO: 300321 - DNA, 36 bp, Artificial Sequence
  Description of Artificial Sequence: Synthetic oligonucleotide
gctaaagaagcccaggttctgaggataattcagttc

SEQ ID NO: 300322 - DNA, 38 bp, Artificial Sequence
  Description of Artificial Sequence: Synthetic oligonucleotide
ctaaagaagcccaggttctgaggataattcagttcttg

SEQ ID NO: 300323 - DNA, 39 bp, Artificial Sequence
  Description of Artificial Sequence: Synthetic oligonucleotide
taaagaagcccaggttctgaggataattcagttcttgtg

SEQ ID NO: 300324 - DNA, 38 bp, Artificial Sequence
  Description of Artificial Sequence: Synthetic oligonucleotide
aaagaagcccaggttctgaggataattcagttcttgtg

SEQ ID NO: 300325 - DNA, 37 bp, Artificial Sequence
  Description of Artificial Sequence: Synthetic oligonucleotide
aagaagcccaggttctgaggataattcagttcttgtg

SEQ ID NO: 300326 - DNA, 36 bp, Artificial Sequence
  Description of Artificial Sequence: Synthetic oligonucleotide
agaagcccaggttctgaggataattcagttcttgtg

SEQ ID NO: 300327 - DNA, 35 bp, Artificial Sequence
  Description of Artificial Sequence: Synthetic oligonucleotide
gaagcccaggttctgaggataattcagttcttgtg

SEQ ID NO: 300328 - DNA, 35 bp, Artificial Sequence
  Description of Artificial Sequence: Synthetic oligonucleotide
aagcccaggttctgaggataattcagttcttgtgc

SEQ ID NO: 300329 - DNA, 34 bp, Artificial Sequence
  Description of Artificial Sequence: Synthetic oligonucleotide
agcccaggttctgaggataattcagttcttgtgc

SEQ ID NO: 300330 - DNA, 33 bp, Artificial Sequence
  Description of Artificial Sequence: Synthetic oligonucleotide
gcccaggttctgaggataattcagttcttgtgc

SEQ ID NO: 300331 - DNA, 33 bp, Artificial Sequence
  Description of Artificial Sequence: Synthetic oligonucleotide
cccaggttctgaggataattcagttcttgtgcc

SEQ ID NO: 300332 - DNA, 34 bp, Artificial Sequence
  Description of Artificial Sequence: Synthetic oligonucleotide
ccaggttctgaggataattcagttcttgtgcctc

SEQ ID NO: 300333 - DNA, 36 bp, Artificial Sequence
  Description of Artificial Sequence: Synthetic oligonucleotide
caggttctgaggataattcagttcttgtgcctcttg

SEQ ID NO: 300334 - DNA, 36 bp, Artificial Sequence
  Description of Artificial Sequence: Synthetic oligonucleotide
aggttctgaggataattcagttcttgtgcctcttgg

SEQ ID NO: 300335 - DNA, 35 bp, Artificial Sequence
  Description of Artificial Sequence: Synthetic oligonucleotide
ggttctgaggataattcagttcttgtgcctcttgg

SEQ ID NO: 300336 - DNA, 36 bp, Artificial Sequence
  Description of Artificial Sequence: Synthetic oligonucleotide
gttctgaggataattcagttcttgtgcctcttggag

SEQ ID NO: 300337 - DNA, 38 bp, Artificial Sequence
  Description of Artificial Sequence: Synthetic oligonucleotide
ttctgaggataattcagttcttgtgcctcttggagatg

SEQ ID NO: 300338 - DNA, 37 bp, Artificial Sequence
  Description of Artificial Sequence: Synthetic oligonucleotide
tctgaggataattcagttcttgtgcctcttggagatg

SEQ ID NO: 300339 - DNA, 36 bp, Artificial Sequence
  Description of Artificial Sequence: Synthetic oligonucleotide
ctgaggataattcagttcttgtgcctcttggagatg

SEQ ID NO: 300340 - DNA, 37 bp, Artificial Sequence
  Description of Artificial Sequence: Synthetic oligonucleotide
tgaggataattcagttcttgtgcctcttggagatgag

SEQ ID NO: 300341 - DNA, 36 bp, Artificial Sequence
  Description of Artificial Sequence: Synthetic oligonucleotide
gaggataattcagttcttgtgcctcttggagatgag

SEQ ID NO: 300342 - DNA, 39 bp, Artificial Sequence
  Description of Artificial Sequence: Synthetic oligonucleotide
aggataattcagttcttgtgcctcttggagatgagtttc

SEQ ID NO: 300343 - DNA, 38 bp, Artificial Sequence
  Description of Artificial Sequence: Synthetic oligonucleotide
ggataattcagttcttgtgcctcttggagatgagtttc

SEQ ID NO: 300344 - DNA, 39 bp, Artificial Sequence
  Description of Artificial Sequence: Synthetic oligonucleotide
gataattcagttcttgtgcctcttggagatgagtttcac

SEQ ID NO: 300345 - DNA, 40 bp, Artificial Sequence
  Description of Artificial Sequence: Synthetic oligonucleotide
ataattcagttcttgtgcctcttggagatgagtttcacac

SEQ ID NO: 300346 - DNA, 39 bp, Artificial Sequence
  Description of Artificial Sequence: Synthetic oligonucleotide
taattcagttcttgtgcctcttggagatgagtttcacac

SEQ ID NO: 300347 - DNA, 38 bp, Artificial Sequence
  Description of Artificial Sequence: Synthetic oligonucleotide
aattcagttcttgtgcctcttggagatgagtttcacac

SEQ ID NO: 300348 - DNA, 37 bp, Artificial Sequence
  Description of Artificial Sequence: Synthetic oligonucleotide
attcagttcttgtgcctcttggagatgagtttcacac

SEQ ID NO: 300349 - DNA, 36 bp, Artificial Sequence
  Description of Artificial Sequence: Synthetic oligonucleotide
ttcagttcttgtgcctcttggagatgagtttcacac

SEQ ID NO: 300350 - DNA, 35 bp, Artificial Sequence
  Description of Artificial Sequence: Synthetic oligonucleotide
tcagttcttgtgcctcttggagatgagtttcacac

SEQ ID NO: 300351 - DNA, 34 bp, Artificial Sequence
  Description of Artificial Sequence: Synthetic oligonucleotide
cagttcttgtgcctcttggagatgagtttcacac

SEQ ID NO: 300352 - DNA, 34 bp, Artificial Sequence
  Description of Artificial Sequence: Synthetic oligonucleotide
agttcttgtgcctcttggagatgagtttcacacg

SEQ ID NO: 300353 - DNA, 33 bp, Artificial Sequence
  Description of Artificial Sequence: Synthetic oligonucleotide
gttcttgtgcctcttggagatgagtttcacacg

SEQ ID NO: 300354 - DNA, 34 bp, Artificial Sequence
  Description of Artificial Sequence: Synthetic oligonucleotide
ttcttgtgcctcttggagatgagtttcacacgtc

SEQ ID NO: 300355 - DNA, 33 bp, Artificial Sequence
  Description of Artificial Sequence: Synthetic oligonucleotide
tcttgtgcctcttggagatgagtttcacacgtc

SEQ ID NO: 300356 - DNA, 32 bp, Artificial Sequence
  Description of Artificial Sequence: Synthetic oligonucleotide
cttgtgcctcttggagatgagtttcacacgtc

SEQ ID NO: 300357 - DNA, 32 bp, Artificial Sequence
  Description of Artificial Sequence: Synthetic oligonucleotide
ttgtgcctcttggagatgagtttcacacgtcc

SEQ ID NO: 300358 - DNA, 31 bp, Artificial Sequence
  Description of Artificial Sequence: Synthetic oligonucleotide
tgtgcctcttggagatgagtttcacacgtcc

SEQ ID NO: 300359 - DNA, 30 bp, Artificial Sequence
  Description of Artificial Sequence: Synthetic oligonucleotide
gtgcctcttggagatgagtttcacacgtcc

SEQ ID NO: 300360 - DNA, 31 bp, Artificial Sequence
  Description of Artificial Sequence: Synthetic oligonucleotide
tgcctcttggagatgagtttcacacgtcctg

SEQ ID NO: 300361 - DNA, 30 bp, Artificial Sequence
  Description of Artificial Sequence: Synthetic oligonucleotide
gcctcttggagatgagtttcacacgtcctg

SEQ ID NO: 300362 - DNA, 30 bp, Artificial Sequence
  Description of Artificial Sequence: Synthetic oligonucleotide
cctcttggagatgagtttcacacgtcctgc

SEQ ID NO: 300363 - DNA, 30 bp, Artificial Sequence
  Description of Artificial Sequence: Synthetic oligonucleotide
ctcttggagatgagtttcacacgtcctgcc

SEQ ID NO: 300364 - DNA, 33 bp, Artificial Sequence
  Description of Artificial Sequence: Synthetic oligonucleotide
tcttggagatgagtttcacacgtcctgccaatg

SEQ ID NO: 300365 - DNA, 32 bp, Artificial Sequence
  Description of Artificial Sequence: Synthetic oligonucleotide
cttggagatgagtttcacacgtcctgccaatg

SEQ ID NO: 300366 - DNA, 33 bp, Artificial Sequence
  Description of Artificial Sequence: Synthetic oligonucleotide
ttggagatgagtttcacacgtcctgccaatgac

SEQ ID NO: 300367 - DNA, 32 bp, Artificial Sequence
  Description of Artificial Sequence: Synthetic oligonucleotide
tggagatgagtttcacacgtcctgccaatgac

SEQ ID NO: 300368 - DNA, 31 bp, Artificial Sequence
  Description of Artificial Sequence: Synthetic oligonucleotide
ggagatgagtttcacacgtcctgccaatgac

SEQ ID NO: 300369 - DNA, 32 bp, Artificial Sequence
  Description of Artificial Sequence: Synthetic oligonucleotide
gagatgagtttcacacgtcctgccaatgacag

SEQ ID NO: 300370 - DNA, 33 bp, Artificial Sequence
  Description of Artificial Sequence: Synthetic oligonucleotide
agatgagtttcacacgtcctgccaatgacagac

SEQ ID NO: 300371 - DNA, 32 bp, Artificial Sequence
  Description of Artificial Sequence: Synthetic oligonucleotide
gatgagtttcacacgtcctgccaatgacagac

SEQ ID NO: 300372 - DNA, 34 bp, Artificial Sequence
  Description of Artificial Sequence: Synthetic oligonucleotide
atgagtttcacacgtcctgccaatgacagacaac

SEQ ID NO: 300373 - DNA, 33 bp, Artificial Sequence
  Description of Artificial Sequence: Synthetic oligonucleotide
tgagtttcacacgtcctgccaatgacagacaac

SEQ ID NO: 300374 - DNA, 32 bp, Artificial Sequence
  Description of Artificial Sequence: Synthetic oligonucleotide
gagtttcacacgtcctgccaatgacagacaac

SEQ ID NO: 300375 - DNA, 33 bp, Artificial Sequence
  Description of Artificial Sequence: Synthetic oligonucleotide
agtttcacacgtcctgccaatgacagacaacac

SEQ ID NO: 300376 - DNA, 32 bp, Artificial Sequence
  Description of Artificial Sequence: Synthetic oligonucleotide
gtttcacacgtcctgccaatgacagacaacac

SEQ ID NO: 300377 - DNA, 33 bp, Artificial Sequence
  Description of Artificial Sequence: Synthetic oligonucleotide
tttcacacgtcctgccaatgacagacaacacac

SEQ ID NO: 300378 - DNA, 32 bp, Artificial Sequence
  Description of Artificial Sequence: Synthetic oligonucleotide
ttcacacgtcctgccaatgacagacaacacac

SEQ ID NO: 300379 - DNA, 31 bp, Artificial Sequence
  Description of Artificial Sequence: Synthetic oligonucleotide
tcacacgtcctgccaatgacagacaacacac

SEQ ID NO: 300380 - DNA, 30 bp, Artificial Sequence
  Description of Artificial Sequence: Synthetic oligonucleotide
cacacgtcctgccaatgacagacaacacac

SEQ ID NO: 300381 - DNA, 34 bp, Artificial Sequence
  Description of Artificial Sequence: Synthetic oligonucleotide
acacgtcctgccaatgacagacaacacacttttg

SEQ ID NO: 300382 - DNA, 33 bp, Artificial Sequence
  Description of Artificial Sequence: Synthetic oligonucleotide
cacgtcctgccaatgacagacaacacacttttg

SEQ ID NO: 300383 - DNA, 35 bp, Artificial Sequence
  Description of Artificial Sequence: Synthetic oligonucleotide
acgtcctgccaatgacagacaacacacttttgatg

SEQ ID NO: 300384 - DNA, 34 bp, Artificial Sequence
  Description of Artificial Sequence: Synthetic oligonucleotide
cgtcctgccaatgacagacaacacacttttgatg

SEQ ID NO: 300385 - DNA, 39 bp, Artificial Sequence
  Description of Artificial Sequence: Synthetic oligonucleotide
gtcctgccaatgacagacaacacacttttgatgaaattg

SEQ ID NO: 300386 - DNA, 39 bp, Artificial Sequence
  Description of Artificial Sequence: Synthetic oligonucleotide
tcctgccaatgacagacaacacacttttgatgaaattgc

SEQ ID NO: 300387 - DNA, 38 bp, Artificial Sequence
  Description of Artificial Sequence: Synthetic oligonucleotide
cctgccaatgacagacaacacacttttgatgaaattgc

SEQ ID NO: 300388 - DNA, 38 bp, Artificial Sequence
  Description of Artificial Sequence: Synthetic oligonucleotide
ctgccaatgacagacaacacacttttgatgaaattgcc

SEQ ID NO: 300389 - DNA, 42 bp, Artificial Sequence
  Description of Artificial Sequence: Synthetic oligonucleotide
tgccaatgacagacaacacacttttgatgaaattgcctaaag

SEQ ID NO: 300390 - DNA, 41 bp, Artificial Sequence
  Description of Artificial Sequence: Synthetic oligonucleotide
gccaatgacagacaacacacttttgatgaaattgcctaaag

SEQ ID NO: 300391 - DNA, 42 bp, Artificial Sequence
  Description of Artificial Sequence: Synthetic oligonucleotide
ccaatgacagacaacacacttttgatgaaattgcctaaagtg

SEQ ID NO: 300392 - DNA, 42 bp, Artificial Sequence
  Description of Artificial Sequence: Synthetic oligonucleotide
caatgacagacaacacacttttgatgaaattgcctaaagtgc

SEQ ID NO: 300393 - DNA, 48 bp, Artificial Sequence
  Description of Artificial Sequence: Synthetic oligonucleotide
aatgacagacaacacacttttgatgaaattgcctaaagtgctataatc

SEQ ID NO: 300394 - DNA, 47 bp, Artificial Sequence
  Description of Artificial Sequence: Synthetic oligonucleotide
atgacagacaacacacttttgatgaaattgcctaaagtgctataatc

SEQ ID NO: 300395 - DNA, 46 bp, Artificial Sequence
  Description of Artificial Sequence: Synthetic oligonucleotide
tgacagacaacacacttttgatgaaattgcctaaagtgctataatc

SEQ ID NO: 300396 - DNA, 45 bp, Artificial Sequence
  Description of Artificial Sequence: Synthetic oligonucleotide
gacagacaacacacttttgatgaaattgcctaaagtgctataatc

SEQ ID NO: 300397 - DNA, 46 bp, Artificial Sequence
  Description of Artificial Sequence: Synthetic oligonucleotide
acagacaacacacttttgatgaaattgcctaaagtgctataatcac

SEQ ID NO: 300398 - DNA, 45 bp, Artificial Sequence
  Description of Artificial Sequence: Synthetic oligonucleotide
cagacaacacacttttgatgaaattgcctaaagtgctataatcac

SEQ ID NO: 300399 - DNA, 46 bp, Artificial Sequence
  Description of Artificial Sequence: Synthetic oligonucleotide
agacaacacacttttgatgaaattgcctaaagtgctataatcacag

SEQ ID NO: 300400 - DNA, 45 bp, Artificial Sequence
  Description of Artificial Sequence: Synthetic oligonucleotide
gacaacacacttttgatgaaattgcctaaagtgctataatcacag

SEQ ID NO: 300401 - DNA, 46 bp, Artificial Sequence
  Description of Artificial Sequence: Synthetic oligonucleotide
acaacacacttttgatgaaattgcctaaagtgctataatcacagtc

SEQ ID NO: 300402 - DNA, 45 bp, Artificial Sequence
  Description of Artificial Sequence: Synthetic oligonucleotide
caacacacttttgatgaaattgcctaaagtgctataatcacagtc

SEQ ID NO: 300403 - DNA, 48 bp, Artificial Sequence
  Description of Artificial Sequence: Synthetic oligonucleotide
aacacacttttgatgaaattgcctaaagtgctataatcacagtcaatg

SEQ ID NO: 300404 - DNA, 47 bp, Artificial Sequence
  Description of Artificial Sequence: Synthetic oligonucleotide
acacacttttgatgaaattgcctaaagtgctataatcacagtcaatg

SEQ ID NO: 300405 - DNA, 46 bp, Artificial Sequence
  Description of Artificial Sequence: Synthetic oligonucleotide
cacacttttgatgaaattgcctaaagtgctataatcacagtcaatg

SEQ ID NO: 300406 - DNA, 47 bp, Artificial Sequence
  Description of Artificial Sequence: Synthetic oligonucleotide
acacttttgatgaaattgcctaaagtgctataatcacagtcaatgag

SEQ ID NO: 300407 - DNA, 46 bp, Artificial Sequence
  Description of Artificial Sequence: Synthetic oligonucleotide
cacttttgatgaaattgcctaaagtgctataatcacagtcaatgag

SEQ ID NO: 300408 - DNA, 46 bp, Artificial Sequence
  Description of Artificial Sequence: Synthetic oligonucleotide
acttttgatgaaattgcctaaagtgctataatcacagtcaatgagg

SEQ ID NO: 300409 - DNA, 45 bp, Artificial Sequence
  Description of Artificial Sequence: Synthetic oligonucleotide
cttttgatgaaattgcctaaagtgctataatcacagtcaatgagg

SEQ ID NO: 300410 - DNA, 46 bp, Artificial Sequence
  Description of Artificial Sequence: Synthetic oligonucleotide
ttttgatgaaattgcctaaagtgctataatcacagtcaatgaggtg

SEQ ID NO: 300411 - DNA, 45 bp, Artificial Sequence
  Description of Artificial Sequence: Synthetic oligonucleotide
tttgatgaaattgcctaaagtgctataatcacagtcaatgaggtg

SEQ ID NO: 300412 - DNA, 44 bp, Artificial Sequence
  Description of Artificial Sequence: Synthetic oligonucleotide
ttgatgaaattgcctaaagtgctataatcacagtcaatgaggtg

SEQ ID NO: 300413 - DNA, 43 bp, Artificial Sequence
  Description of Artificial Sequence: Synthetic oligonucleotide
tgatgaaattgcctaaagtgctataatcacagtcaatgaggtg

SEQ ID NO: 300414 - DNA, 42 bp, Artificial Sequence
  Description of Artificial Sequence: Synthetic oligonucleotide
gatgaaattgcctaaagtgctataatcacagtcaatgaggtg

SEQ ID NO: 300415 - DNA, 42 bp, Artificial Sequence
  Description of Artificial Sequence: Synthetic oligonucleotide
atgaaattgcctaaagtgctataatcacagtcaatgaggtgc

SEQ ID NO: 300416 - DNA, 41 bp, Artificial Sequence
  Description of Artificial Sequence: Synthetic oligonucleotide
tgaaattgcctaaagtgctataatcacagtcaatgaggtgc

SEQ ID NO: 300417 - DNA, 40 bp, Artificial Sequence
  Description of Artificial Sequence: Synthetic oligonucleotide
gaaattgcctaaagtgctataatcacagtcaatgaggtgc

SEQ ID NO: 300418 - DNA, 41 bp, Artificial Sequence
  Description of Artificial Sequence: Synthetic oligonucleotide
aaattgcctaaagtgctataatcacagtcaatgaggtgcag

SEQ ID NO: 300419 - DNA, 40 bp, Artificial Sequence
  Description of Artificial Sequence: Synthetic oligonucleotide
aattgcctaaagtgctataatcacagtcaatgaggtgcag

SEQ ID NO: 300420 - DNA, 39 bp, Artificial Sequence
  Description of Artificial Sequence: Synthetic oligonucleotide
attgcctaaagtgctataatcacagtcaatgaggtgcag

SEQ ID NO: 300421 - DNA, 38 bp, Artificial Sequence
  Description of Artificial Sequence: Synthetic oligonucleotide
ttgcctaaagtgctataatcacagtcaatgaggtgcag

SEQ ID NO: 300422 - DNA, 37 bp, Artificial Sequence
  Description of Artificial Sequence: Synthetic oligonucleotide
tgcctaaagtgctataatcacagtcaatgaggtgcag

SEQ ID NO: 300423 - DNA, 36 bp, Artificial Sequence
  Description of Artificial Sequence: Synthetic oligonucleotide
gcctaaagtgctataatcacagtcaatgaggtgcag

SEQ ID NO: 300424 - DNA, 36 bp, Artificial Sequence
  Description of Artificial Sequence: Synthetic oligonucleotide
cctaaagtgctataatcacagtcaatgaggtgcagc

SEQ ID NO: 300425 - DNA, 38 bp, Artificial Sequence
  Description of Artificial Sequence: Synthetic oligonucleotide
ctaaagtgctataatcacagtcaatgaggtgcagcttc

SEQ ID NO: 300426 - DNA, 39 bp, Artificial Sequence
  Description of Artificial Sequence: Synthetic oligonucleotide
taaagtgctataatcacagtcaatgaggtgcagcttctg

SEQ ID NO: 300427 - DNA, 38 bp, Artificial Sequence
  Description of Artificial Sequence: Synthetic oligonucleotide
aaagtgctataatcacagtcaatgaggtgcagcttctg

SEQ ID NO: 300428 - DNA, 37 bp, Artificial Sequence
  Description of Artificial Sequence: Synthetic oligonucleotide
aagtgctataatcacagtcaatgaggtgcagcttctg

SEQ ID NO: 300429 - DNA, 36 bp, Artificial Sequence
  Description of Artificial Sequence: Synthetic oligonucleotide
agtgctataatcacagtcaatgaggtgcagcttctg

SEQ ID NO: 300430 - DNA, 35 bp, Artificial Sequence
  Description of Artificial Sequence: Synthetic oligonucleotide
gtgctataatcacagtcaatgaggtgcagcttctg

SEQ ID NO: 300431 - DNA, 35 bp, Artificial Sequence
  Description of Artificial Sequence: Synthetic oligonucleotide
tgctataatcacagtcaatgaggtgcagcttctgg

SEQ ID NO: 300432 - DNA, 34 bp, Artificial Sequence
  Description of Artificial Sequence: Synthetic oligonucleotide
gctataatcacagtcaatgaggtgcagcttctgg

SEQ ID NO: 300433 - DNA, 35 bp, Artificial Sequence
  Description of Artificial Sequence: Synthetic oligonucleotide
ctataatcacagtcaatgaggtgcagcttctggag

SEQ ID NO: 300434 - DNA, 37 bp, Artificial Sequence
  Description of Artificial Sequence: Synthetic oligonucleotide
tataatcacagtcaatgaggtgcagcttctggagatg

SEQ ID NO: 300435 - DNA, 36 bp, Artificial Sequence
  Description of Artificial Sequence: Synthetic oligonucleotide
ataatcacagtcaatgaggtgcagcttctggagatg

SEQ ID NO: 300436 - DNA, 35 bp, Artificial Sequence
  Description of Artificial Sequence: Synthetic oligonucleotide
taatcacagtcaatgaggtgcagcttctggagatg

SEQ ID NO: 300437 - DNA, 34 bp, Artificial Sequence
  Description of Artificial Sequence: Synthetic oligonucleotide
aatcacagtcaatgaggtgcagcttctggagatg

SEQ ID NO: 300438 - DNA, 33 bp, Artificial Sequence
  Description of Artificial Sequence: Synthetic oligonucleotide
atcacagtcaatgaggtgcagcttctggagatg

SEQ ID NO: 300439 - DNA, 32 bp, Artificial Sequence
  Description of Artificial Sequence: Synthetic oligonucleotide
tcacagtcaatgaggtgcagcttctggagatg

SEQ ID NO: 300440 - DNA, 31 bp, Artificial Sequence
  Description of Artificial Sequence: Synthetic oligonucleotide
cacagtcaatgaggtgcagcttctggagatg

SEQ ID NO: 300441 - DNA, 33 bp, Artificial Sequence
  Description of Artificial Sequence: Synthetic oligonucleotide
acagtcaatgaggtgcagcttctggagatgaag

SEQ ID NO: 300442 - DNA, 32 bp, Artificial Sequence
  Description of Artificial Sequence: Synthetic oligonucleotide
cagtcaatgaggtgcagcttctggagatgaag

SEQ ID NO: 300443 - DNA, 32 bp, Artificial Sequence
  Description of Artificial Sequence: Synthetic oligonucleotide
agtcaatgaggtgcagcttctggagatgaagg

SEQ ID NO: 300444 - DNA, 31 bp, Artificial Sequence
  Description of Artificial Sequence: Synthetic oligonucleotide
gtcaatgaggtgcagcttctggagatgaagg

SEQ ID NO: 300445 - DNA, 31 bp, Artificial Sequence
  Description of Artificial Sequence: Synthetic oligonucleotide
tcaatgaggtgcagcttctggagatgaaggc

SEQ ID NO: 300446 - DNA, 30 bp, Artificial Sequence
  Description of Artificial Sequence: Synthetic oligonucleotide
caatgaggtgcagcttctggagatgaaggc

SEQ ID NO: 300447 - DNA, 30 bp, Artificial Sequence
  Description of Artificial Sequence: Synthetic oligonucleotide
aatgaggtgcagcttctggagatgaaggcg

SEQ ID NO: 300448 - DNA, 29 bp, Artificial Sequence
  Description of Artificial Sequence: Synthetic oligonucleotide
atgaggtgcagcttctggagatgaaggcg

SEQ ID NO: 300449 - DNA, 28 bp, Artificial Sequence
  Description of Artificial Sequence: Synthetic oligonucleotide
tgaggtgcagcttctggagatgaaggcg

SEQ ID NO: 300450 - DNA, 27 bp, Artificial Sequence
  Description of Artificial Sequence: Synthetic oligonucleotide
gaggtgcagcttctggagatgaaggcg

SEQ ID NO: 300451 - DNA, 27 bp, Artificial Sequence
  Description of Artificial Sequence: Synthetic oligonucleotide
aggtgcagcttctggagatgaaggcgc

SEQ ID NO: 300452 - DNA, 27 bp, Artificial Sequence
  Description of Artificial Sequence: Synthetic oligonucleotide
ggtgcagcttctggagatgaaggcgct

SEQ ID NO: 300453 - DNA, 29 bp, Artificial Sequence
  Description of Artificial Sequence: Synthetic oligonucleotide
gtgcagcttctggagatgaaggcgctttc

SEQ ID NO: 300454 - DNA, 29 bp, Artificial Sequence
  Description of Artificial Sequence: Synthetic oligonucleotide
tgcagcttctggagatgaaggcgctttcg

SEQ ID NO: 300455 - DNA, 28 bp, Artificial Sequence
  Description of Artificial Sequence: Synthetic oligonucleotide
gcagcttctggagatgaaggcgctttcg

SEQ ID NO: 300456 - DNA, 28 bp, Artificial Sequence
  Description of Artificial Sequence: Synthetic oligonucleotide
cagcttctggagatgaaggcgctttcgg

SEQ ID NO: 300457 - DNA, 29 bp, Artificial Sequence
  Description of Artificial Sequence: Synthetic oligonucleotide
agcttctggagatgaaggcgctttcggtg

SEQ ID NO: 300458 - DNA, 28 bp, Artificial Sequence
  Description of Artificial Sequence: Synthetic oligonucleotide
gcttctggagatgaaggcgctttcggtg

SEQ ID NO: 300459 - DNA, 28 bp, Artificial Sequence
  Description of Artificial Sequence: Synthetic oligonucleotide
cttctggagatgaaggcgctttcggtgc

SEQ ID NO: 300460 - DNA, 28 bp, Artificial Sequence
  Description of Artificial Sequence: Synthetic oligonucleotide
ttctggagatgaaggcgctttcggtgcg

SEQ ID NO: 300461 - DNA, 27 bp, Artificial Sequence
  Description of Artificial Sequence: Synthetic oligonucleotide
tctggagatgaaggcgctttcggtgcg

SEQ ID NO: 300462 - DNA, 26 bp, Artificial Sequence
  Description of Artificial Sequence: Synthetic oligonucleotide
ctggagatgaaggcgctttcggtgcg

SEQ ID NO: 300463 - DNA, 26 bp, Artificial Sequence
  Description of Artificial Sequence: Synthetic oligonucleotide
tggagatgaaggcgctttcggtgcgg

SEQ ID NO: 300464 - DNA, 25 bp, Artificial Sequence
  Description of Artificial Sequence: Synthetic oligonucleotide
ggagatgaaggcgctttcggtgcgg

SEQ ID NO: 300465 - DNA, 26 bp, Artificial Sequence
  Description of Artificial Sequence: Synthetic oligonucleotide
gagatgaaggcgctttcggtgcggct

SEQ ID NO: 300466 - DNA, 26 bp, Artificial Sequence
  Description of Artificial Sequence: Synthetic oligonucleotide
agatgaaggcgctttcggtgcggctg

SEQ ID NO: 300467 - DNA, 25 bp, Artificial Sequence
  Description of Artificial Sequence: Synthetic oligonucleotide
gatgaaggcgctttcggtgcggctg

SEQ ID NO: 300468 - DNA, 26 bp, Artificial Sequence
  Description of Artificial Sequence: Synthetic oligonucleotide
atgaaggcgctttcggtgcggctggt

SEQ ID NO: 300469 - DNA, 25 bp, Artificial Sequence
  Description of Artificial Sequence: Synthetic oligonucleotide
tgaaggcgctttcggtgcggctggt

SEQ ID NO: 300470 - DNA, 24 bp, Artificial Sequence
  Description of Artificial Sequence: Synthetic oligonucleotide
gaaggcgctttcggtgcggctggt

SEQ ID NO: 300471 - DNA, 27 bp, Artificial Sequence
  Description of Artificial Sequence: Synthetic oligonucleotide
aaggcgctttcggtgcggctggtgata

SEQ ID NO: 300472 - DNA, 26 bp, Artificial Sequence
  Description of Artificial Sequence: Synthetic oligonucleotide
aggcgctttcggtgcggctggtgata

SEQ ID NO: 300473 - DNA, 25 bp, Artificial Sequence
  Description of Artificial Sequence: Synthetic oligonucleotide
ggcgctttcggtgcggctggtgata

SEQ ID NO: 300474 - DNA, 25 bp, Artificial Sequence
  Description of Artificial Sequence: Synthetic oligonucleotide
gcgctttcggtgcggctggtgatag

SEQ ID NO: 300475 - DNA, 25 bp, Artificial Sequence
  Description of Artificial Sequence: Synthetic oligonucleotide
cgctttcggtgcggctggtgatagg

SEQ ID NO: 300476 - DNA, 26 bp, Artificial Sequence
  Description of Artificial Sequence: Synthetic oligonucleotide
gctttcggtgcggctggtgataggca

SEQ ID NO: 300477 - DNA, 27 bp, Artificial Sequence
  Description of Artificial Sequence: Synthetic oligonucleotide
ctttcggtgcggctggtgataggcagt

SEQ ID NO: 300478 - DNA, 30 bp, Artificial Sequence
  Description of Artificial Sequence: Synthetic oligonucleotide
tttcggtgcggctggtgataggcagtattg

SEQ ID NO: 300479 - DNA, 29 bp, Artificial Sequence
  Description of Artificial Sequence: Synthetic oligonucleotide
ttcggtgcggctggtgataggcagtattg

SEQ ID NO: 300480 - DNA, 28 bp, Artificial Sequence
  Description of Artificial Sequence: Synthetic oligonucleotide
tcggtgcggctggtgataggcagtattg

SEQ ID NO: 300481 - DNA, 27 bp, Artificial Sequence
  Description of Artificial Sequence: Synthetic oligonucleotide
cggtgcggctggtgataggcagtattg

SEQ ID NO: 300482 - DNA, 28 bp, Artificial Sequence
  Description of Artificial Sequence: Synthetic oligonucleotide
ggtgcggctggtgataggcagtattgac

SEQ ID NO: 300483 - DNA, 28 bp, Artificial Sequence
  Description of Artificial Sequence: Synthetic oligonucleotide
gtgcggctggtgataggcagtattgacg

SEQ ID NO: 300484 - DNA, 29 bp, Artificial Sequence
  Description of Artificial Sequence: Synthetic oligonucleotide
tgcggctggtgataggcagtattgacgag

SEQ ID NO: 300485 - DNA, 28 bp, Artificial Sequence
  Description of Artificial Sequence: Synthetic oligonucleotide
gcggctggtgataggcagtattgacgag

SEQ ID NO: 300486 - DNA, 28 bp, Artificial Sequence
  Description of Artificial Sequence: Synthetic oligonucleotide
cggctggtgataggcagtattgacgagg

SEQ ID NO: 300487 - DNA, 29 bp, Artificial Sequence
  Description of Artificial Sequence: Synthetic oligonucleotide
ggctggtgataggcagtattgacgaggtg

SEQ ID NO: 300488 - DNA, 29 bp, Artificial Sequence
  Description of Artificial Sequence: Synthetic oligonucleotide
gctggtgataggcagtattgacgaggtgc

SEQ ID NO: 300489 - DNA, 30 bp, Artificial Sequence
  Description of Artificial Sequence: Synthetic oligonucleotide
ctggtgataggcagtattgacgaggtgcac

SEQ ID NO: 300490 - DNA, 33 bp, Artificial Sequence
  Description of Artificial Sequence: Synthetic oligonucleotide
tggtgataggcagtattgacgaggtgcacaaac

SEQ ID NO: 300491 - DNA, 32 bp, Artificial Sequence
  Description of Artificial Sequence: Synthetic oligonucleotide
ggtgataggcagtattgacgaggtgcacaaac

SEQ ID NO: 300492 - DNA, 32 bp, Artificial Sequence
  Description of Artificial Sequence: Synthetic oligonucleotide
gtgataggcagtattgacgaggtgcacaaacg

SEQ ID NO: 300493 - DNA, 33 bp, Artificial Sequence
  Description of Artificial Sequence: Synthetic oligonucleotide
tgataggcagtattgacgaggtgcacaaacgag

SEQ ID NO: 300494 - DNA, 32 bp, Artificial Sequence
  Description of Artificial Sequence: Synthetic oligonucleotide
gataggcagtattgacgaggtgcacaaacgag

SEQ ID NO: 300495 - DNA, 33 bp, Artificial Sequence
  Description of Artificial Sequence: Synthetic oligonucleotide
ataggcagtattgacgaggtgcacaaacgagac

SEQ ID NO: 300496 - DNA, 32 bp, Artificial Sequence
  Description of Artificial Sequence: Synthetic oligonucleotide
taggcagtattgacgaggtgcacaaacgagac

SEQ ID NO: 300497 - DNA, 31 bp, Artificial Sequence
  Description of Artificial Sequence: Synthetic oligonucleotide
aggcagtattgacgaggtgcacaaacgagac

SEQ ID NO: 300498 - DNA, 30 bp, Artificial Sequence
  Description of Artificial Sequence: Synthetic oligonucleotide
ggcagtattgacgaggtgcacaaacgagac

SEQ ID NO: 300499 - DNA, 30 bp, Artificial Sequence
  Description of Artificial Sequence: Synthetic oligonucleotide
gcagtattgacgaggtgcacaaacgagacc

SEQ ID NO: 300500 - DNA, 31 bp, Artificial Sequence
  Description of Artificial Sequence: Synthetic oligonucleotide
cagtattgacgaggtgcacaaacgagaccac

SEQ ID NO: 300501 - DNA, 33 bp, Artificial Sequence
  Description of Artificial Sequence: Synthetic oligonucleotide
agtattgacgaggtgcacaaacgagaccacatg

SEQ ID NO: 300502 - DNA, 32 bp, Artificial Sequence
  Description of Artificial Sequence: Synthetic oligonucleotide
gtattgacgaggtgcacaaacgagaccacatg

SEQ ID NO: 300503 - DNA, 33 bp, Artificial Sequence
  Description of Artificial Sequence: Synthetic oligonucleotide
tattgacgaggtgcacaaacgagaccacatgac

SEQ ID NO: 300504 - DNA, 32 bp, Artificial Sequence
  Description of Artificial Sequence: Synthetic oligonucleotide
attgacgaggtgcacaaacgagaccacatgac

SEQ ID NO: 300505 - DNA, 31 bp, Artificial Sequence
  Description of Artificial Sequence: Synthetic oligonucleotide
ttgacgaggtgcacaaacgagaccacatgac

SEQ ID NO: 300506 - DNA, 30 bp, Artificial Sequence
  Description of Artificial Sequence: Synthetic oligonucleotide
tgacgaggtgcacaaacgagaccacatgac

SEQ ID NO: 300507 - DNA, 29 bp, Artificial Sequence
  Description of Artificial Sequence: Synthetic oligonucleotide
gacgaggtgcacaaacgagaccacatgac

SEQ ID NO: 300508 - DNA, 29 bp, Artificial Sequence
  Description of Artificial Sequence: Synthetic oligonucleotide
acgaggtgcacaaacgagaccacatgacg

SEQ ID NO: 300509 - DNA, 28 bp, Artificial Sequence
  Description of Artificial Sequence: Synthetic oligonucleotide
cgaggtgcacaaacgagaccacatgacg

SEQ ID NO: 300510 - DNA, 29 bp, Artificial Sequence
  Description of Artificial Sequence: Synthetic oligonucleotide
gaggtgcacaaacgagaccacatgacgtg

SEQ ID NO: 300511 - DNA, 29 bp, Artificial Sequence
  Description of Artificial Sequence: Synthetic oligonucleotide
aggtgcacaaacgagaccacatgacgtgg

SEQ ID NO: 300512 - DNA, 28 bp, Artificial Sequence
  Description of Artificial Sequence: Synthetic oligonucleotide
ggtgcacaaacgagaccacatgacgtgg

SEQ ID NO: 300513 - DNA, 28 bp, Artificial Sequence
  Description of Artificial Sequence: Synthetic oligonucleotide
gtgcacaaacgagaccacatgacgtggg

SEQ ID NO: 300514 - DNA, 29 bp, Artificial Sequence
  Description of Artificial Sequence: Synthetic oligonucleotide
tgcacaaacgagaccacatgacgtgggtg

SEQ ID NO: 300515 - DNA, 28 bp, Artificial Sequence
  Description of Artificial Sequence: Synthetic oligonucleotide
gcacaaacgagaccacatgacgtgggtg

SEQ ID NO: 300516 - DNA, 28 bp, Artificial Sequence
  Description of Artificial Sequence: Synthetic oligonucleotide
cacaaacgagaccacatgacgtgggtgc

SEQ ID NO: 300517 - DNA, 29 bp, Artificial Sequence
  Description of Artificial Sequence: Synthetic oligonucleotide
acaaacgagaccacatgacgtgggtgcag

SEQ ID NO: 300518 - DNA, 28 bp, Artificial Sequence
  Description of Artificial Sequence: Synthetic oligonucleotide
caaacgagaccacatgacgtgggtgcag

SEQ ID NO: 300519 - DNA, 28 bp, Artificial Sequence
  Description of Artificial Sequence: Synthetic oligonucleotide
aaacgagaccacatgacgtgggtgcagg

SEQ ID NO: 300520 - DNA, 27 bp, Artificial Sequence
  Description of Artificial Sequence: Synthetic oligonucleotide
aacgagaccacatgacgtgggtgcagg

SEQ ID NO: 300521 - DNA, 26 bp, Artificial Sequence
  Description of Artificial Sequence: Synthetic oligonucleotide
acgagaccacatgacgtgggtgcagg

SEQ ID NO: 300522 - DNA, 25 bp, Artificial Sequence
  Description of Artificial Sequence: Synthetic oligonucleotide
cgagaccacatgacgtgggtgcagg

SEQ ID NO: 300523 - DNA, 25 bp, Artificial Sequence
  Description of Artificial Sequence: Synthetic oligonucleotide
gagaccacatgacgtgggtgcaggc

SEQ ID NO: 300524 - DNA, 25 bp, Artificial Sequence
  Description of Artificial Sequence: Synthetic oligonucleotide
agaccacatgacgtgggtgcaggcc

SEQ ID NO: 300525 - DNA, 24 bp, Artificial Sequence
  Description of Artificial Sequence: Synthetic oligonucleotide
gaccacatgacgtgggtgcaggcc

SEQ ID NO: 300526 - DNA, 24 bp, Artificial Sequence
  Description of Artificial Sequence: Synthetic oligonucleotide
accacatgacgtgggtgcaggccc

SEQ ID NO: 300527 - DNA, 23 bp, Artificial Sequence
  Description of Artificial Sequence: Synthetic oligonucleotide
ccacatgacgtgggtgcaggccc

SEQ ID NO: 300528 - DNA, 24 bp, Artificial Sequence
  Description of Artificial Sequence: Synthetic oligonucleotide
cacatgacgtgggtgcaggcccga

SEQ ID NO: 300529 - DNA, 25 bp, Artificial Sequence
  Description of Artificial Sequence: Synthetic oligonucleotide
acatgacgtgggtgcaggcccgagt

SEQ ID NO: 300530 - DNA, 24 bp, Artificial Sequence
  Description of Artificial Sequence: Synthetic oligonucleotide
catgacgtgggtgcaggcccgagt

SEQ ID NO: 300531 - DNA, 26 bp, Artificial Sequence
  Description of Artificial Sequence: Synthetic oligonucleotide
atgacgtgggtgcaggcccgagtgta

SEQ ID NO: 300532 - DNA, 25 bp, Artificial Sequence
  Description of Artificial Sequence: Synthetic oligonucleotide
tgacgtgggtgcaggcccgagtgta

SEQ ID NO: 300533 - DNA, 24 bp, Artificial Sequence
  Description of Artificial Sequence: Synthetic oligonucleotide
gacgtgggtgcaggcccgagtgta

SEQ ID NO: 300534 - DNA, 24 bp, Artificial Sequence
  Description of Artificial Sequence: Synthetic oligonucleotide
acgtgggtgcaggcccgagtgtag

SEQ ID NO: 300535 - DNA, 23 bp, Artificial Sequence
  Description of Artificial Sequence: Synthetic oligonucleotide
cgtgggtgcaggcccgagtgtag

SEQ ID NO: 300536 - DNA, 27 bp, Artificial Sequence
  Description of Artificial Sequence: Synthetic oligonucleotide
gtgggtgcaggcccgagtgtaggattt

SEQ ID NO: 300537 - DNA, 27 bp, Artificial Sequence
  Description of Artificial Sequence: Synthetic oligonucleotide
tgggtgcaggcccgagtgtaggatttg

SEQ ID NO: 300538 - DNA, 26 bp, Artificial Sequence
  Description of Artificial Sequence: Synthetic oligonucleotide
gggtgcaggcccgagtgtaggatttg

SEQ ID NO: 300539 - DNA, 27 bp, Artificial Sequence
  Description of Artificial Sequence: Synthetic oligonucleotide
ggtgcaggcccgagtgtaggatttgca

SEQ ID NO: 300540 - DNA, 28 bp, Artificial Sequence
  Description of Artificial Sequence: Synthetic oligonucleotide
gtgcaggcccgagtgtaggatttgcatc

SEQ ID NO: 300541 - DNA, 29 bp, Artificial Sequence
  Description of Artificial Sequence: Synthetic oligonucleotide
tgcaggcccgagtgtaggatttgcatcag

SEQ ID NO: 300542 - DNA, 28 bp, Artificial Sequence
  Description of Artificial Sequence: Synthetic oligonucleotide
gcaggcccgagtgtaggatttgcatcag

SEQ ID NO: 300543 - DNA, 30 bp, Artificial Sequence
  Description of Artificial Sequence: Synthetic oligonucleotide
caggcccgagtgtaggatttgcatcagatc

SEQ ID NO: 300544 - DNA, 32 bp, Artificial Sequence
  Description of Artificial Sequence: Synthetic oligonucleotide
aggcccgagtgtaggatttgcatcagatcaag

SEQ ID NO: 300545 - DNA, 31 bp, Artificial Sequence
  Description of Artificial Sequence: Synthetic oligonucleotide
ggcccgagtgtaggatttgcatcagatcaag

SEQ ID NO: 300546 - DNA, 31 bp, Artificial Sequence
  Description of Artificial Sequence: Synthetic oligonucleotide
gcccgagtgtaggatttgcatcagatcaagc

SEQ ID NO: 300547 - DNA, 31 bp, Artificial Sequence
  Description of Artificial Sequence: Synthetic oligonucleotide
cccgagtgtaggatttgcatcagatcaagcg

SEQ ID NO: 300548 - DNA, 34 bp, Artificial Sequence
  Description of Artificial Sequence: Synthetic oligonucleotide
ccgagtgtaggatttgcatcagatcaagcgaatg

SEQ ID NO: 300549 - DNA, 36 bp, Artificial Sequence
  Description of Artificial Sequence: Synthetic oligonucleotide
cgagtgtaggatttgcatcagatcaagcgaatgaag

SEQ ID NO: 300550 - DNA, 36 bp, Artificial Sequence
  Description of Artificial Sequence: Synthetic oligonucleotide
gagtgtaggatttgcatcagatcaagcgaatgaagg

SEQ ID NO: 300551 - DNA, 37 bp, Artificial Sequence
  Description of Artificial Sequence: Synthetic oligonucleotide
agtgtaggatttgcatcagatcaagcgaatgaaggtc

SEQ ID NO: 300552 - DNA, 36 bp, Artificial Sequence
  Description of Artificial Sequence: Synthetic oligonucleotide
gtgtaggatttgcatcagatcaagcgaatgaaggtc

SEQ ID NO: 300553 - DNA, 36 bp, Artificial Sequence
  Description of Artificial Sequence: Synthetic oligonucleotide
tgtaggatttgcatcagatcaagcgaatgaaggtcc

SEQ ID NO: 300554 - DNA, 35 bp, Artificial Sequence
  Description of Artificial Sequence: Synthetic oligonucleotide
gtaggatttgcatcagatcaagcgaatgaaggtcc

SEQ ID NO: 300555 - DNA, 35 bp, Artificial Sequence
  Description of Artificial Sequence: Synthetic oligonucleotide
taggatttgcatcagatcaagcgaatgaaggtccg

SEQ ID NO: 300556 - DNA, 34 bp, Artificial Sequence
  Description of Artificial Sequence: Synthetic oligonucleotide
aggatttgcatcagatcaagcgaatgaaggtccg

SEQ ID NO: 300557 - DNA, 33 bp, Artificial Sequence
  Description of Artificial Sequence: Synthetic oligonucleotide
ggatttgcatcagatcaagcgaatgaaggtccg

SEQ ID NO: 300558 - DNA, 33 bp, Artificial Sequence
  Description of Artificial Sequence: Synthetic oligonucleotide
gatttgcatcagatcaagcgaatgaaggtccgc

SEQ ID NO: 300559 - DNA, 33 bp, Artificial Sequence
  Description of Artificial Sequence: Synthetic oligonucleotide
atttgcatcagatcaagcgaatgaaggtccgcc

SEQ ID NO: 300560 - DNA, 32 bp, Artificial Sequence
  Description of Artificial Sequence: Synthetic oligonucleotide
tttgcatcagatcaagcgaatgaaggtccgcc

SEQ ID NO: 300561 - DNA, 31 bp, Artificial Sequence
  Description of Artificial Sequence: Synthetic oligonucleotide
ttgcatcagatcaagcgaatgaaggtccgcc

SEQ ID NO: 300562 - DNA, 30 bp, Artificial Sequence
  Description of Artificial Sequence: Synthetic oligonucleotide
tgcatcagatcaagcgaatgaaggtccgcc

SEQ ID NO: 300563 - DNA, 29 bp, Artificial Sequence
  Description of Artificial Sequence: Synthetic oligonucleotide
gcatcagatcaagcgaatgaaggtccgcc

SEQ ID NO: 300564 - DNA, 30 bp, Artificial Sequence
  Description of Artificial Sequence: Synthetic oligonucleotide
catcagatcaagcgaatgaaggtccgcctg

SEQ ID NO: 300565 - DNA, 30 bp, Artificial Sequence
  Description of Artificial Sequence: Synthetic oligonucleotide
atcagatcaagcgaatgaaggtccgcctgg

SEQ ID NO: 300566 - DNA, 29 bp, Artificial Sequence
  Description of Artificial Sequence: Synthetic oligonucleotide
tcagatcaagcgaatgaaggtccgcctgg

SEQ ID NO: 300567 - DNA, 28 bp, Artificial Sequence
  Description of Artificial Sequence: Synthetic oligonucleotide
cagatcaagcgaatgaaggtccgcctgg

SEQ ID NO: 300568 - DNA, 29 bp, Artificial Sequence
  Description of Artificial Sequence: Synthetic oligonucleotide
agatcaagcgaatgaaggtccgcctggac

SEQ ID NO: 300569 - DNA, 28 bp, Artificial Sequence
  Description of Artificial Sequence: Synthetic oligonucleotide
gatcaagcgaatgaaggtccgcctggac

SEQ ID NO: 300570 - DNA, 30 bp, Artificial Sequence
  Description of Artificial Sequence: Synthetic oligonucleotide
atcaagcgaatgaaggtccgcctggacttc

SEQ ID NO: 300571 - DNA, 29 bp, Artificial Sequence
  Description of Artificial Sequence: Synthetic oligonucleotide
tcaagcgaatgaaggtccgcctggacttc

SEQ ID NO: 300572 - DNA, 28 bp, Artificial Sequence
  Description of Artificial Sequence: Synthetic oligonucleotide
caagcgaatgaaggtccgcctggacttc

SEQ ID NO: 300573 - DNA, 29 bp, Artificial Sequence
  Description of Artificial Sequence: Synthetic oligonucleotide
aagcgaatgaaggtccgcctggacttctg

SEQ ID NO: 300574 - DNA, 28 bp, Artificial Sequence
  Description of Artificial Sequence: Synthetic oligonucleotide
agcgaatgaaggtccgcctggacttctg

SEQ ID NO: 300575 - DNA, 27 bp, Artificial Sequence
  Description of Artificial Sequence: Synthetic oligonucleotide
gcgaatgaaggtccgcctggacttctg

SEQ ID NO: 300576 - DNA, 27 bp, Artificial Sequence
  Description of Artificial Sequence: Synthetic oligonucleotide
cgaatgaaggtccgcctggacttctgg

SEQ ID NO: 300577 - DNA, 28 bp, Artificial Sequence
  Description of Artificial Sequence: Synthetic oligonucleotide
gaatgaaggtccgcctggacttctggtg

SEQ ID NO: 300578 - DNA, 28 bp, Artificial Sequence
  Description of Artificial Sequence: Synthetic oligonucleotide
aatgaaggtccgcctggacttctggtgc

SEQ ID NO: 300579 - DNA, 27 bp, Artificial Sequence
  Description of Artificial Sequence: Synthetic oligonucleotide
atgaaggtccgcctggacttctggtgc

SEQ ID NO: 300580 - DNA, 27 bp, Artificial Sequence
  Description of Artificial Sequence: Synthetic oligonucleotide
tgaaggtccgcctggacttctggtgct

SEQ ID NO: 300581 - DNA, 26 bp, Artificial Sequence
  Description of Artificial Sequence: Synthetic oligonucleotide
gaaggtccgcctggacttctggtgct

SEQ ID NO: 300582 - DNA, 26 bp, Artificial Sequence
  Description of Artificial Sequence: Synthetic oligonucleotide
aaggtccgcctggacttctggtgctc

SEQ ID NO: 300583 - DNA, 25 bp, Artificial Sequence
  Description of Artificial Sequence: Synthetic oligonucleotide
aggtccgcctggacttctggtgctc

SEQ ID NO: 300584 - DNA, 24 bp, Artificial Sequence
  Description of Artificial Sequence: Synthetic oligonucleotide
ggtccgcctggacttctggtgctc

SEQ ID NO: 300585 - DNA, 24 bp, Artificial Sequence
  Description of Artificial Sequence: Synthetic oligonucleotide
gtccgcctggacttctggtgctcg

SEQ ID NO: 300586 - DNA, 26 bp, Artificial Sequence
  Description of Artificial Sequence: Synthetic oligonucleotide
tccgcctggacttctggtgctcggat

SEQ ID NO: 300587 - DNA, 25 bp, Artificial Sequence
  Description of Artificial Sequence: Synthetic oligonucleotide
ccgcctggacttctggtgctcggat

SEQ ID NO: 300588 - DNA, 26 bp, Artificial Sequence
  Description of Artificial Sequence: Synthetic oligonucleotide
cgcctggacttctggtgctcggatgt

SEQ ID NO: 300589 - DNA, 27 bp, Artificial Sequence
  Description of Artificial Sequence: Synthetic oligonucleotide
gcctggacttctggtgctcggatgtga

SEQ ID NO: 300590 - DNA, 28 bp, Artificial Sequence
  Description of Artificial Sequence: Synthetic oligonucleotide
cctggacttctggtgctcggatgtgatg

SEQ ID NO: 300591 - DNA, 29 bp, Artificial Sequence
  Description of Artificial Sequence: Synthetic oligonucleotide
ctggacttctggtgctcggatgtgatgag

SEQ ID NO: 300592 - DNA, 29 bp, Artificial Sequence
  Description of Artificial Sequence: Synthetic oligonucleotide
tggacttctggtgctcggatgtgatgagc

SEQ ID NO: 300593 - DNA, 28 bp, Artificial Sequence
  Description of Artificial Sequence: Synthetic oligonucleotide
ggacttctggtgctcggatgtgatgagc

SEQ ID NO: 300594 - DNA, 30 bp, Artificial Sequence
  Description of Artificial Sequence: Synthetic oligonucleotide
gacttctggtgctcggatgtgatgagcatg

SEQ ID NO: 300595 - DNA, 30 bp, Artificial Sequence
  Description of Artificial Sequence: Synthetic oligonucleotide
acttctggtgctcggatgtgatgagcatgg

SEQ ID NO: 300596 - DNA, 29 bp, Artificial Sequence
  Description of Artificial Sequence: Synthetic oligonucleotide
cttctggtgctcggatgtgatgagcatgg

SEQ ID NO: 300597 - DNA, 30 bp, Artificial Sequence
  Description of Artificial Sequence: Synthetic oligonucleotide
ttctggtgctcggatgtgatgagcatggac

SEQ ID NO: 300598 - DNA, 29 bp, Artificial Sequence
  Description of Artificial Sequence: Synthetic oligonucleotide
tctggtgctcggatgtgatgagcatggac

SEQ ID NO: 300599 - DNA, 28 bp, Artificial Sequence
  Description of Artificial Sequence: Synthetic oligonucleotide
ctggtgctcggatgtgatgagcatggac

SEQ ID NO: 300600 - DNA, 30 bp, Artificial Sequence
  Description of Artificial Sequence: Synthetic oligonucleotide
tggtgctcggatgtgatgagcatggacatg

SEQ ID NO: 300601 - DNA, 29 bp, Artificial Sequence
  Description of Artificial Sequence: Synthetic oligonucleotide
ggtgctcggatgtgatgagcatggacatg

SEQ ID NO: 300602 - DNA, 29 bp, Artificial Sequence
  Description of Artificial Sequence: Synthetic oligonucleotide
gtgctcggatgtgatgagcatggacatgc

SEQ ID NO: 300603 - DNA, 30 bp, Artificial Sequence
  Description of Artificial Sequence: Synthetic oligonucleotide
tgctcggatgtgatgagcatggacatgctg

SEQ ID NO: 300604 - DNA, 29 bp, Artificial Sequence
  Description of Artificial Sequence: Synthetic oligonucleotide
gctcggatgtgatgagcatggacatgctg

SEQ ID NO: 300605 - DNA, 29 bp, Artificial Sequence
  Description of Artificial Sequence: Synthetic oligonucleotide
ctcggatgtgatgagcatggacatgctgg

SEQ ID NO: 300606 - DNA, 30 bp, Artificial Sequence
  Description of Artificial Sequence: Synthetic oligonucleotide
tcggatgtgatgagcatggacatgctggtg

SEQ ID NO: 300607 - DNA, 29 bp, Artificial Sequence
  Description of Artificial Sequence: Synthetic oligonucleotide
cggatgtgatgagcatggacatgctggtg

SEQ ID NO: 300608 - DNA, 29 bp, Artificial Sequence
  Description of Artificial Sequence: Synthetic oligonucleotide
ggatgtgatgagcatggacatgctggtgc

SEQ ID NO: 300609 - DNA, 30 bp, Artificial Sequence
  Description of Artificial Sequence: Synthetic oligonucleotide
gatgtgatgagcatggacatgctggtgcag

SEQ ID NO: 300610 - DNA, 30 bp, Artificial Sequence
  Description of Artificial Sequence: Synthetic oligonucleotide
atgtgatgagcatggacatgctggtgcagc

SEQ ID NO: 300611 - DNA, 29 bp, Artificial Sequence
  Description of Artificial Sequence: Synthetic oligonucleotide
tgtgatgagcatggacatgctggtgcagc

SEQ ID NO: 300612 - DNA, 28 bp, Artificial Sequence
  Description of Artificial Sequence: Synthetic oligonucleotide
gtgatgagcatggacatgctggtgcagc

SEQ ID NO: 300613 - DNA, 29 bp, Artificial Sequence
  Description of Artificial Sequence: Synthetic oligonucleotide
tgatgagcatggacatgctggtgcagcac

SEQ ID NO: 300614 - DNA, 28 bp, Artificial Sequence
  Description of Artificial Sequence: Synthetic oligonucleotide
gatgagcatggacatgctggtgcagcac

SEQ ID NO: 300615 - DNA, 28 bp, Artificial Sequence
  Description of Artificial Sequence: Synthetic oligonucleotide
atgagcatggacatgctggtgcagcacc

SEQ ID NO: 300616 - DNA, 27 bp, Artificial Sequence
  Description of Artificial Sequence: Synthetic oligonucleotide
tgagcatggacatgctggtgcagcacc

SEQ ID NO: 300617 - DNA, 27 bp, Artificial Sequence
  Description of Artificial Sequence: Synthetic oligonucleotide
gagcatggacatgctggtgcagcacca

SEQ ID NO: 300618 - DNA, 27 bp, Artificial Sequence
  Description of Artificial Sequence: Synthetic oligonucleotide
agcatggacatgctggtgcagcaccag

SEQ ID NO: 300619 - DNA, 26 bp, Artificial Sequence
  Description of Artificial Sequence: Synthetic oligonucleotide
gcatggacatgctggtgcagcaccag

SEQ ID NO: 300620 - DNA, 26 bp, Artificial Sequence
  Description of Artificial Sequence: Synthetic oligonucleotide
catggacatgctggtgcagcaccagg

SEQ ID NO: 300621 - DNA, 26 bp, Artificial Sequence
  Description of Artificial Sequence: Synthetic oligonucleotide
atggacatgctggtgcagcaccaggg

SEQ ID NO: 300622 - DNA, 25 bp, Artificial Sequence
  Description of Artificial Sequence: Synthetic oligonucleotide
tggacatgctggtgcagcaccaggg

SEQ ID NO: 300623 - DNA, 24 bp, Artificial Sequence
  Description of Artificial Sequence: Synthetic oligonucleotide
ggacatgctggtgcagcaccaggg

SEQ ID NO: 300624 - DNA, 24 bp, Artificial Sequence
  Description of Artificial Sequence: Synthetic oligonucleotide
gacatgctggtgcagcaccagggc

SEQ ID NO: 300625 - DNA, 26 bp, Artificial Sequence
  Description of Artificial Sequence: Synthetic oligonucleotide
acatgctggtgcagcaccagggccat

SEQ ID NO: 300626 - DNA, 25 bp, Artificial Sequence
  Description of Artificial Sequence: Synthetic oligonucleotide
catgctggtgcagcaccagggccat

SEQ ID NO: 300627 - DNA, 26 bp, Artificial Sequence
  Description of Artificial Sequence: Synthetic oligonucleotide
atgctggtgcagcaccagggccatga

SEQ ID NO: 300628 - DNA, 25 bp, Artificial Sequence
  Description of Artificial Sequence: Synthetic oligonucleotide
tgctggtgcagcaccagggccatga

SEQ ID NO: 300629 - DNA, 24 bp, Artificial Sequence
  Description of Artificial Sequence: Synthetic oligonucleotide
gctggtgcagcaccagggccatga

SEQ ID NO: 300630 - DNA, 26 bp, Artificial Sequence
  Description of Artificial Sequence: Synthetic oligonucleotide
ctggtgcagcaccagggccatgacat

SEQ ID NO: 300631 - DNA, 26 bp, Artificial Sequence
  Description of Artificial Sequence: Synthetic oligonucleotide
tggtgcagcaccagggccatgacatg

SEQ ID NO: 300632 - DNA, 25 bp, Artificial Sequence
  Description of Artificial Sequence: Synthetic oligonucleotide
ggtgcagcaccagggccatgacatg

SEQ ID NO: 300633 - DNA, 26 bp, Artificial Sequence
  Description of Artificial Sequence: Synthetic oligonucleotide
gtgcagcaccagggccatgacatgct

SEQ ID NO: 300634 - DNA, 27 bp, Artificial Sequence
  Description of Artificial Sequence: Synthetic oligonucleotide
tgcagcaccagggccatgacatgctca

SEQ ID NO: 300635 - DNA, 26 bp, Artificial Sequence
  Description of Artificial Sequence: Synthetic oligonucleotide
gcagcaccagggccatgacatgctca

SEQ ID NO: 300636 - DNA, 26 bp, Artificial Sequence
  Description of Artificial Sequence: Synthetic oligonucleotide
cagcaccagggccatgacatgctcac

SEQ ID NO: 300637 - DNA, 27 bp, Artificial Sequence
  Description of Artificial Sequence: Synthetic oligonucleotide
agcaccagggccatgacatgctcacct

SEQ ID NO: 300638 - DNA, 27 bp, Artificial Sequence
  Description of Artificial Sequence: Synthetic oligonucleotide
gcaccagggccatgacatgctcaccta

SEQ ID NO: 300639 - DNA, 27 bp, Artificial Sequence
  Description of Artificial Sequence: Synthetic oligonucleotide
caccagggccatgacatgctcacctag

SEQ ID NO: 300640 - DNA, 34 bp, Artificial Sequence
  Description of Artificial Sequence: Synthetic oligonucleotide
atcgacagacttgttagacttgcaggaggtatcc

SEQ ID NO: 300641 - DNA, 33 bp, Artificial Sequence
  Description of Artificial Sequence: Synthetic oligonucleotide
tcgacagacttgttagacttgcaggaggtatcc

SEQ ID NO: 300642 - DNA, 32 bp, Artificial Sequence
  Description of Artificial Sequence: Synthetic oligonucleotide
cgacagacttgttagacttgcaggaggtatcc

SEQ ID NO: 300643 - DNA, 32 bp, Artificial Sequence
  Description of Artificial Sequence: Synthetic oligonucleotide
gacagacttgttagacttgcaggaggtatccc

SEQ ID NO: 300644 - DNA, 33 bp, Artificial Sequence
  Description of Artificial Sequence: Synthetic oligonucleotide
acagacttgttagacttgcaggaggtatccctg

SEQ ID NO: 300645 - DNA, 32 bp, Artificial Sequence
  Description of Artificial Sequence: Synthetic oligonucleotide
cagacttgttagacttgcaggaggtatccctg

SEQ ID NO: 300646 - DNA, 32 bp, Artificial Sequence
  Description of Artificial Sequence: Synthetic oligonucleotide
agacttgttagacttgcaggaggtatccctgg

SEQ ID NO: 300647 - DNA, 31 bp, Artificial Sequence
  Description of Artificial Sequence: Synthetic oligonucleotide
gacttgttagacttgcaggaggtatccctgg

SEQ ID NO: 300648 - DNA, 32 bp, Artificial Sequence
  Description of Artificial Sequence: Synthetic oligonucleotide
acttgttagacttgcaggaggtatccctggac

SEQ ID NO: 300649 - DNA, 31 bp, Artificial Sequence
  Description of Artificial Sequence: Synthetic oligonucleotide
cttgttagacttgcaggaggtatccctggac

SEQ ID NO: 300650 - DNA, 32 bp, Artificial Sequence
  Description of Artificial Sequence: Synthetic oligonucleotide
ttgttagacttgcaggaggtatccctggactg

SEQ ID NO: 300651 - DNA, 31 bp, Artificial Sequence
  Description of Artificial Sequence: Synthetic oligonucleotide
tgttagacttgcaggaggtatccctggactg

SEQ ID NO: 300652 - DNA, 30 bp, Artificial Sequence
  Description of Artificial Sequence: Synthetic oligonucleotide
gttagacttgcaggaggtatccctggactg

SEQ ID NO: 300653 - DNA, 30 bp, Artificial Sequence
  Description of Artificial Sequence: Synthetic oligonucleotide
ttagacttgcaggaggtatccctggactgc

SEQ ID NO: 300654 - DNA, 29 bp, Artificial Sequence
  Description of Artificial Sequence: Synthetic oligonucleotide
tagacttgcaggaggtatccctggactgc

SEQ ID NO: 300655 - DNA, 28 bp, Artificial Sequence
  Description of Artificial Sequence: Synthetic oligonucleotide
agacttgcaggaggtatccctggactgc

SEQ ID NO: 300656 - DNA, 27 bp, Artificial Sequence
  Description of Artificial Sequence: Synthetic oligonucleotide
gacttgcaggaggtatccctggactgc

SEQ ID NO: 300657 - DNA, 27 bp, Artificial Sequence
  Description of Artificial Sequence: Synthetic oligonucleotide
acttgcaggaggtatccctggactgcg

SEQ ID NO: 300658 - DNA, 26 bp, Artificial Sequence
  Description of Artificial Sequence: Synthetic oligonucleotide
cttgcaggaggtatccctggactgcg

SEQ ID NO: 300659 - DNA, 26 bp, Artificial Sequence
  Description of Artificial Sequence: Synthetic oligonucleotide
ttgcaggaggtatccctggactgcgc

SEQ ID NO: 300660 - DNA, 25 bp, Artificial Sequence
  Description of Artificial Sequence: Synthetic oligonucleotide
tgcaggaggtatccctggactgcgc

SEQ ID NO: 300661 - DNA, 24 bp, Artificial Sequence
  Description of Artificial Sequence: Synthetic oligonucleotide
gcaggaggtatccctggactgcgc

SEQ ID NO: 300662 - DNA, 25 bp, Artificial Sequence
  Description of Artificial Sequence: Synthetic oligonucleotide
caggaggtatccctggactgcgcca

SEQ ID NO: 300663 - DNA, 25 bp, Artificial Sequence
  Description of Artificial Sequence: Synthetic oligonucleotide
aggaggtatccctggactgcgccag

SEQ ID NO: 300664 - DNA, 24 bp, Artificial Sequence
  Description of Artificial Sequence: Synthetic oligonucleotide
ggaggtatccctggactgcgccag

SEQ ID NO: 300665 - DNA, 24 bp, Artificial Sequence
  Description of Artificial Sequence: Synthetic oligonucleotide
gaggtatccctggactgcgccagg

SEQ ID NO: 300666 - DNA, 24 bp, Artificial Sequence
  Description of Artificial Sequence: Synthetic oligonucleotide
aggtatccctggactgcgccaggg

SEQ ID NO: 300667 - DNA, 23 bp, Artificial Sequence
  Description of Artificial Sequence: Synthetic oligonucleotide
ggtatccctggactgcgccaggg

SEQ ID NO: 300668 - DNA, 23 bp, Artificial Sequence
  Description of Artificial Sequence: Synthetic oligonucleotide
gtatccctggactgcgccagggg

SEQ ID NO: 300669 - DNA, 23 bp, Artificial Sequence
  Description of Artificial Sequence: Synthetic oligonucleotide
tatccctggactgcgccaggggc

SEQ ID NO: 300670 - DNA, 22 bp, Artificial Sequence
  Description of Artificial Sequence: Synthetic oligonucleotide
atccctggactgcgccaggggc

SEQ ID NO: 300671 - DNA, 21 bp, Artificial Sequence
  Description of Artificial Sequence: Synthetic oligonucleotide
tccctggactgcgccaggggc

SEQ ID NO: 300672 - DNA, 20 bp, Artificial Sequence
  Description of Artificial Sequence: Synthetic oligonucleotide
ccctggactgcgccaggggc

SEQ ID NO: 300673 - DNA, 21 bp, Artificial Sequence
  Description of Artificial Sequence: Synthetic oligonucleotide
cctggactgcgccaggggcga

SEQ ID NO: 300674 - DNA, 21 bp, Artificial Sequence
  Description of Artificial Sequence: Synthetic oligonucleotide
ctggactgcgccaggggcgac

SEQ ID NO: 300675 - DNA, 23 bp, Artificial Sequence
  Description of Artificial Sequence: Synthetic oligonucleotide
tggactgcgccaggggcgaccta

SEQ ID NO: 300676 - DNA, 22 bp, Artificial Sequence
  Description of Artificial Sequence: Synthetic oligonucleotide
ggactgcgccaggggcgaccta

SEQ ID NO: 300677 - DNA, 23 bp, Artificial Sequence
  Description of Artificial Sequence: Synthetic oligonucleotide
gactgcgccaggggcgacctaca

SEQ ID NO: 300678 - DNA, 25 bp, Artificial Sequence
  Description of Artificial Sequence: Synthetic oligonucleotide
actgcgccaggggcgacctacagaa

SEQ ID NO: 300679 - DNA, 24 bp, Artificial Sequence
  Description of Artificial Sequence: Synthetic oligonucleotide
ctgcgccaggggcgacctacagaa

SEQ ID NO: 300680 - DNA, 24 bp, Artificial Sequence
  Description of Artificial Sequence: Synthetic oligonucleotide
tgcgccaggggcgacctacagaag

SEQ ID NO: 300681 - DNA, 23 bp, Artificial Sequence
  Description of Artificial Sequence: Synthetic oligonucleotide
gcgccaggggcgacctacagaag

SEQ ID NO: 300682 - DNA, 24 bp, Artificial Sequence
  Description of Artificial Sequence: Synthetic oligonucleotide
cgccaggggcgacctacagaagct

SEQ ID NO: 300683 - DNA, 24 bp, Artificial Sequence
  Description of Artificial Sequence: Synthetic oligonucleotide
gccaggggcgacctacagaagctc

SEQ ID NO: 300684 - DNA, 25 bp, Artificial Sequence
  Description of Artificial Sequence: Synthetic oligonucleotide
ccaggggcgacctacagaagctcct

SEQ ID NO: 300685 - DNA, 25 bp, Artificial Sequence
  Description of Artificial Sequence: Synthetic oligonucleotide
caggggcgacctacagaagctcctg

SEQ ID NO: 300686 - DNA, 26 bp, Artificial Sequence
  Description of Artificial Sequence: Synthetic oligonucleotide
aggggcgacctacagaagctcctgca

SEQ ID NO: 300687 - DNA, 25 bp, Artificial Sequence
  Description of Artificial Sequence: Synthetic oligonucleotide
ggggcgacctacagaagctcctgca

SEQ ID NO: 300688 - DNA, 26 bp, Artificial Sequence
  Description of Artificial Sequence: Synthetic oligonucleotide
gggcgacctacagaagctcctgcact

SEQ ID NO: 300689 - DNA, 26 bp, Artificial Sequence
  Description of Artificial Sequence: Synthetic oligonucleotide
ggcgacctacagaagctcctgcactg

SEQ ID NO: 300690 - DNA, 27 bp, Artificial Sequence
  Description of Artificial Sequence: Synthetic oligonucleotide
gcgacctacagaagctcctgcactgga

SEQ ID NO: 300691 - DNA, 27 bp, Artificial Sequence
  Description of Artificial Sequence: Synthetic oligonucleotide
cgacctacagaagctcctgcactggac

SEQ ID NO: 300692 - DNA, 28 bp, Artificial Sequence
  Description of Artificial Sequence: Synthetic oligonucleotide
gacctacagaagctcctgcactggacac

SEQ ID NO: 300693 - DNA, 29 bp, Artificial Sequence
  Description of Artificial Sequence: Synthetic oligonucleotide
acctacagaagctcctgcactggacacag

SEQ ID NO: 300694 - DNA, 28 bp, Artificial Sequence
  Description of Artificial Sequence: Synthetic oligonucleotide
cctacagaagctcctgcactggacacag

SEQ ID NO: 300695 - DNA, 28 bp, Artificial Sequence
  Description of Artificial Sequence: Synthetic oligonucleotide
ctacagaagctcctgcactggacacagg

SEQ ID NO: 300696 - DNA, 29 bp, Artificial Sequence
  Description of Artificial Sequence: Synthetic oligonucleotide
tacagaagctcctgcactggacacaggag

SEQ ID NO: 300697 - DNA, 28 bp, Artificial Sequence
  Description of Artificial Sequence: Synthetic oligonucleotide
acagaagctcctgcactggacacaggag

SEQ ID NO: 300698 - DNA, 27 bp, Artificial Sequence
  Description of Artificial Sequence: Synthetic oligonucleotide
cagaagctcctgcactggacacaggag

SEQ ID NO: 300699 - DNA, 29 bp, Artificial Sequence
  Description of Artificial Sequence: Synthetic oligonucleotide
agaagctcctgcactggacacaggagaac

SEQ ID NO: 300700 - DNA, 28 bp, Artificial Sequence
  Description of Artificial Sequence: Synthetic oligonucleotide
gaagctcctgcactggacacaggagaac

SEQ ID NO: 300701 - DNA, 30 bp, Artificial Sequence
  Description of Artificial Sequence: Synthetic oligonucleotide
aagctcctgcactggacacaggagaacaag

SEQ ID NO: 300702 - DNA, 29 bp, Artificial Sequence
  Description of Artificial Sequence: Synthetic oligonucleotide
agctcctgcactggacacaggagaacaag

SEQ ID NO: 300703 - DNA, 28 bp, Artificial Sequence
  Description of Artificial Sequence: Synthetic oligonucleotide
gctcctgcactggacacaggagaacaag

SEQ ID NO: 300704 - DNA, 29 bp, Artificial Sequence
  Description of Artificial Sequence: Synthetic oligonucleotide
ctcctgcactggacacaggagaacaagtg

SEQ ID NO: 300705 - DNA, 34 bp, Artificial Sequence
  Description of Artificial Sequence: Synthetic oligonucleotide
tcctgcactggacacaggagaacaagtgtatatc

SEQ ID NO: 300706 - DNA, 33 bp, Artificial Sequence
  Description of Artificial Sequence: Synthetic oligonucleotide
cctgcactggacacaggagaacaagtgtatatc

SEQ ID NO: 300707 - DNA, 34 bp, Artificial Sequence
  Description of Artificial Sequence: Synthetic oligonucleotide
ctgcactggacacaggagaacaagtgtatatctc

SEQ ID NO: 300708 - DNA, 36 bp, Artificial Sequence
  Description of Artificial Sequence: Synthetic oligonucleotide
tgcactggacacaggagaacaagtgtatatctctac

SEQ ID NO: 300709 - DNA, 35 bp, Artificial Sequence
  Description of Artificial Sequence: Synthetic oligonucleotide
gcactggacacaggagaacaagtgtatatctctac

SEQ ID NO: 300710 - DNA, 35 bp, Artificial Sequence
  Description of Artificial Sequence: Synthetic oligonucleotide
cactggacacaggagaacaagtgtatatctctacc

SEQ ID NO: 300711 - DNA, 35 bp, Artificial Sequence
  Description of Artificial Sequence: Synthetic oligonucleotide
actggacacaggagaacaagtgtatatctctaccc

SEQ ID NO: 300712 - DNA, 34 bp, Artificial Sequence
  Description of Artificial Sequence: Synthetic oligonucleotide
ctggacacaggagaacaagtgtatatctctaccc

SEQ ID NO: 300713 - DNA, 35 bp, Artificial Sequence
  Description of Artificial Sequence: Synthetic oligonucleotide
tggacacaggagaacaagtgtatatctctaccctg

SEQ ID NO: 300714 - DNA, 34 bp, Artificial Sequence
  Description of Artificial Sequence: Synthetic oligonucleotide
ggacacaggagaacaagtgtatatctctaccctg

SEQ ID NO: 300715 - DNA, 34 bp, Artificial Sequence
  Description of Artificial Sequence: Synthetic oligonucleotide
gacacaggagaacaagtgtatatctctaccctgg

SEQ ID NO: 300716 - DNA, 34 bp, Artificial Sequence
  Description of Artificial Sequence: Synthetic oligonucleotide
acacaggagaacaagtgtatatctctaccctggc

SEQ ID NO: 300717 - DNA, 33 bp, Artificial Sequence
  Description of Artificial Sequence: Synthetic oligonucleotide
cacaggagaacaagtgtatatctctaccctggc

SEQ ID NO: 300718 - DNA, 34 bp, Artificial Sequence
  Description of Artificial Sequence: Synthetic oligonucleotide
acaggagaacaagtgtatatctctaccctggcac

SEQ ID NO: 300719 - DNA, 33 bp, Artificial Sequence
  Description of Artificial Sequence: Synthetic oligonucleotide
caggagaacaagtgtatatctctaccctggcac

SEQ ID NO: 300720 - DNA, 34 bp, Artificial Sequence
  Description of Artificial Sequence: Synthetic oligonucleotide
aggagaacaagtgtatatctctaccctggcacag

SEQ ID NO: 300721 - DNA, 33 bp, Artificial Sequence
  Description of Artificial Sequence: Synthetic oligonucleotide
ggagaacaagtgtatatctctaccctggcacag

SEQ ID NO: 300722 - DNA, 41 bp, Artificial Sequence
  Description of Artificial Sequence: Synthetic oligonucleotide
gagaacaagtgtatatctctaccctggcacagttaaaaatc

SEQ ID NO: 300723 - DNA, 47 bp, Artificial Sequence
  Description of Artificial Sequence: Synthetic oligonucleotide
agaacaagtgtatatctctaccctggcacagttaaaaatcttaaaac

SEQ ID NO: 300724 - DNA, 46 bp, Artificial Sequence
  Description of Artificial Sequence: Synthetic oligonucleotide
gaacaagtgtatatctctaccctggcacagttaaaaatcttaaaac

SEQ ID NO: 300725 - DNA, 48 bp, Artificial Sequence
  Description of Artificial Sequence: Synthetic oligonucleotide
aacaagtgtatatctctaccctggcacagttaaaaatcttaaaacatc

SEQ ID NO: 300726 - DNA, 47 bp, Artificial Sequence
  Description of Artificial Sequence: Synthetic oligonucleotide
acaagtgtatatctctaccctggcacagttaaaaatcttaaaacatc

SEQ ID NO: 300727 - DNA, 46 bp, Artificial Sequence
  Description of Artificial Sequence: Synthetic oligonucleotide
caagtgtatatctctaccctggcacagttaaaaatcttaaaacatc

SEQ ID NO: 300728 - DNA, 46 bp, Artificial Sequence
  Description of Artificial Sequence: Synthetic oligonucleotide
aagtgtatatctctaccctggcacagttaaaaatcttaaaacatcg

SEQ ID NO: 300729 - DNA, 45 bp, Artificial Sequence
  Description of Artificial Sequence: Synthetic oligonucleotide
agtgtatatctctaccctggcacagttaaaaatcttaaaacatcg

SEQ ID NO: 300730 - DNA, 44 bp, Artificial Sequence
  Description of Artificial Sequence: Synthetic oligonucleotide
gtgtatatctctaccctggcacagttaaaaatcttaaaacatcg

SEQ ID NO: 300731 - DNA, 44 bp, Artificial Sequence
  Description of Artificial Sequence: Synthetic oligonucleotide
tgtatatctctaccctggcacagttaaaaatcttaaaacatcgc

SEQ ID NO: 300732 - DNA, 43 bp, Artificial Sequence
  Description of Artificial Sequence: Synthetic oligonucleotide
gtatatctctaccctggcacagttaaaaatcttaaaacatcgc

SEQ ID NO: 300733 - DNA, 43 bp, Artificial Sequence
  Description of Artificial Sequence: Synthetic oligonucleotide
tatatctctaccctggcacagttaaaaatcttaaaacatcgcc

SEQ ID NO: 300734 - DNA, 42 bp, Artificial Sequence
  Description of Artificial Sequence: Synthetic oligonucleotide
atatctctaccctggcacagttaaaaatcttaaaacatcgcc

SEQ ID NO: 300735 - DNA, 41 bp, Artificial Sequence
  Description of Artificial Sequence: Synthetic oligonucleotide
tatctctaccctggcacagttaaaaatcttaaaacatcgcc

SEQ ID NO: 300736 - DNA, 40 bp, Artificial Sequence
  Description of Artificial Sequence: Synthetic oligonucleotide
atctctaccctggcacagttaaaaatcttaaaacatcgcc

SEQ ID NO: 300737 - DNA, 39 bp, Artificial Sequence
  Description of Artificial Sequence: Synthetic oligonucleotide
tctctaccctggcacagttaaaaatcttaaaacatcgcc

SEQ ID NO: 300738 - DNA, 38 bp, Artificial Sequence
  Description of Artificial Sequence: Synthetic oligonucleotide
ctctaccctggcacagttaaaaatcttaaaacatcgcc

SEQ ID NO: 300739 - DNA, 38 bp, Artificial Sequence
  Description of Artificial Sequence: Synthetic oligonucleotide
tctaccctggcacagttaaaaatcttaaaacatcgccg

SEQ ID NO: 300740 - DNA, 37 bp, Artificial Sequence
  Description of Artificial Sequence: Synthetic oligonucleotide
ctaccctggcacagttaaaaatcttaaaacatcgccg

SEQ ID NO: 300741 - DNA, 38 bp, Artificial Sequence
  Description of Artificial Sequence: Synthetic oligonucleotide
taccctggcacagttaaaaatcttaaaacatcgccgtg

SEQ ID NO: 300742 - DNA, 37 bp, Artificial Sequence
  Description of Artificial Sequence: Synthetic oligonucleotide
accctggcacagttaaaaatcttaaaacatcgccgtg

SEQ ID NO: 300743 - DNA, 36 bp, Artificial Sequence
  Description of Artificial Sequence: Synthetic oligonucleotide
ccctggcacagttaaaaatcttaaaacatcgccgtg

SEQ ID NO: 300744 - DNA, 36 bp, Artificial Sequence
  Description of Artificial Sequence: Synthetic oligonucleotide
cctggcacagttaaaaatcttaaaacatcgccgtgc

SEQ ID NO: 300745 - DNA, 37 bp, Artificial Sequence
  Description of Artificial Sequence: Synthetic oligonucleotide
ctggcacagttaaaaatcttaaaacatcgccgtgctg

SEQ ID NO: 300746 - DNA, 37 bp, Artificial Sequence
  Description of Artificial Sequence: Synthetic oligonucleotide
tggcacagttaaaaatcttaaaacatcgccgtgctgc

SEQ ID NO: 300747 - DNA, 36 bp, Artificial Sequence
  Description of Artificial Sequence: Synthetic oligonucleotide
ggcacagttaaaaatcttaaaacatcgccgtgctgc

SEQ ID NO: 300748 - DNA, 37 bp, Artificial Sequence
  Description of Artificial Sequence: Synthetic oligonucleotide
gcacagttaaaaatcttaaaacatcgccgtgctgcag

SEQ ID NO: 300749 - DNA, 39 bp, Artificial Sequence
  Description of Artificial Sequence: Synthetic oligonucleotide
cacagttaaaaatcttaaaacatcgccgtgctgcagttc

SEQ ID NO: 300750 - DNA, 39 bp, Artificial Sequence
  Description of Artificial Sequence: Synthetic oligonucleotide
acagttaaaaatcttaaaacatcgccgtgctgcagttcc

SEQ ID NO: 300751 - DNA, 38 bp, Artificial Sequence
  Description of Artificial Sequence: Synthetic oligonucleotide
cagttaaaaatcttaaaacatcgccgtgctgcagttcc

SEQ ID NO: 300752 - DNA, 41 bp, Artificial Sequence
  Description of Artificial Sequence: Synthetic oligonucleotide
agttaaaaatcttaaaacatcgccgtgctgcagttccaatc

SEQ ID NO: 300753 - DNA, 40 bp, Artificial Sequence
  Description of Artificial Sequence: Synthetic oligonucleotide
gttaaaaatcttaaaacatcgccgtgctgcagttccaatc

SEQ ID NO: 300754 - DNA, 40 bp, Artificial Sequence
  Description of Artificial Sequence: Synthetic oligonucleotide
ttaaaaatcttaaaacatcgccgtgctgcagttccaatcg

SEQ ID NO: 300755 - DNA, 39 bp, Artificial Sequence
  Description of Artificial Sequence: Synthetic oligonucleotide
taaaaatcttaaaacatcgccgtgctgcagttccaatcg

SEQ ID NO: 300756 - DNA, 38 bp, Artificial Sequence
  Description of Artificial Sequence: Synthetic oligonucleotide
aaaaatcttaaaacatcgccgtgctgcagttccaatcg

SEQ ID NO: 300757 - DNA, 37 bp, Artificial Sequence
  Description of Artificial Sequence: Synthetic oligonucleotide
aaaatcttaaaacatcgccgtgctgcagttccaatcg

SEQ ID NO: 300758 - DNA, 36 bp, Artificial Sequence
  Description of Artificial Sequence: Synthetic oligonucleotide
aaatcttaaaacatcgccgtgctgcagttccaatcg

SEQ ID NO: 300759 - DNA, 35 bp, Artificial Sequence
  Description of Artificial Sequence: Synthetic oligonucleotide
aatcttaaaacatcgccgtgctgcagttccaatcg

SEQ ID NO: 300760 - DNA, 34 bp, Artificial Sequence
  Description of Artificial Sequence: Synthetic oligonucleotide
atcttaaaacatcgccgtgctgcagttccaatcg

SEQ ID NO: 300761 - DNA, 33 bp, Artificial Sequence
  Description of Artificial Sequence: Synthetic oligonucleotide
tcttaaaacatcgccgtgctgcagttccaatcg

SEQ ID NO: 300762 - DNA, 32 bp, Artificial Sequence
  Description of Artificial Sequence: Synthetic oligonucleotide
cttaaaacatcgccgtgctgcagttccaatcg

SEQ ID NO: 300763 - DNA, 34 bp, Artificial Sequence
  Description of Artificial Sequence: Synthetic oligonucleotide
ttaaaacatcgccgtgctgcagttccaatcgaag

SEQ ID NO: 300764 - DNA, 33 bp, Artificial Sequence
  Description of Artificial Sequence: Synthetic oligonucleotide
taaaacatcgccgtgctgcagttccaatcgaag

SEQ ID NO: 300765 - DNA, 32 bp, Artificial Sequence
  Description of Artificial Sequence: Synthetic oligonucleotide
aaaacatcgccgtgctgcagttccaatcgaag

SEQ ID NO: 300766 - DNA, 31 bp, Artificial Sequence
  Description of Artificial Sequence: Synthetic oligonucleotide
aaacatcgccgtgctgcagttccaatcgaag

SEQ ID NO: 300767 - DNA, 30 bp, Artificial Sequence
  Description of Artificial Sequence: Synthetic oligonucleotide
aacatcgccgtgctgcagttccaatcgaag

SEQ ID NO: 300768 - DNA, 29 bp, Artificial Sequence
  Description of Artificial Sequence: Synthetic oligonucleotide
acatcgccgtgctgcagttccaatcgaag

SEQ ID NO: 300769 - DNA, 28 bp, Artificial Sequence
  Description of Artificial Sequence: Synthetic oligonucleotide
catcgccgtgctgcagttccaatcgaag

SEQ ID NO: 300770 - DNA, 32 bp, Artificial Sequence
  Description of Artificial Sequence: Synthetic oligonucleotide
atcgccgtgctgcagttccaatcgaagttatg

SEQ ID NO: 300771 - DNA, 31 bp, Artificial Sequence
  Description of Artificial Sequence: Synthetic oligonucleotide
tcgccgtgctgcagttccaatcgaagttatg

SEQ ID NO: 300772 - DNA, 30 bp, Artificial Sequence
  Description of Artificial Sequence: Synthetic oligonucleotide
cgccgtgctgcagttccaatcgaagttatg

SEQ ID NO: 300773 - DNA, 30 bp, Artificial Sequence
  Description of Artificial Sequence: Synthetic oligonucleotide
gccgtgctgcagttccaatcgaagttatgc

SEQ ID NO: 300774 - DNA, 30 bp, Artificial Sequence
  Description of Artificial Sequence: Synthetic oligonucleotide
ccgtgctgcagttccaatcgaagttatgcg

SEQ ID NO: 300775 - DNA, 33 bp, Artificial Sequence
  Description of Artificial Sequence: Synthetic oligonucleotide
cgtgctgcagttccaatcgaagttatgcgtttg

SEQ ID NO: 300776 - DNA, 35 bp, Artificial Sequence
  Description of Artificial Sequence: Synthetic oligonucleotide
gtgctgcagttccaatcgaagttatgcgtttgatg

SEQ ID NO: 300777 - DNA, 35 bp, Artificial Sequence
  Description of Artificial Sequence: Synthetic oligonucleotide
tgctgcagttccaatcgaagttatgcgtttgatgc

SEQ ID NO: 300778 - DNA, 34 bp, Artificial Sequence
  Description of Artificial Sequence: Synthetic oligonucleotide
gctgcagttccaatcgaagttatgcgtttgatgc

SEQ ID NO: 300779 - DNA, 36 bp, Artificial Sequence
  Description of Artificial Sequence: Synthetic oligonucleotide
ctgcagttccaatcgaagttatgcgtttgatgcatg

SEQ ID NO: 300780 - DNA, 36 bp, Artificial Sequence
  Description of Artificial Sequence: Synthetic oligonucleotide
tgcagttccaatcgaagttatgcgtttgatgcatgg

SEQ ID NO: 300781 - DNA, 35 bp, Artificial Sequence
  Description of Artificial Sequence: Synthetic oligonucleotide
gcagttccaatcgaagttatgcgtttgatgcatgg

SEQ ID NO: 300782 - DNA, 36 bp, Artificial Sequence
  Description of Artificial Sequence: Synthetic oligonucleotide
cagttccaatcgaagttatgcgtttgatgcatggag

SEQ ID NO: 300783 - DNA, 41 bp, Artificial Sequence
  Description of Artificial Sequence: Synthetic oligonucleotide
agttccaatcgaagttatgcgtttgatgcatggagaattag

SEQ ID NO: 300784 - DNA, 40 bp, Artificial Sequence
  Description of Artificial Sequence: Synthetic oligonucleotide
gttccaatcgaagttatgcgtttgatgcatggagaattag

SEQ ID NO: 300785 - DNA, 42 bp, Artificial Sequence
  Description of Artificial Sequence: Synthetic oligonucleotide
ttccaatcgaagttatgcgtttgatgcatggagaattagttg

SEQ ID NO: 300786 - DNA, 41 bp, Artificial Sequence
  Description of Artificial Sequence: Synthetic oligonucleotide
tccaatcgaagttatgcgtttgatgcatggagaattagttg

SEQ ID NO: 300787 - DNA, 40 bp, Artificial Sequence
  Description of Artificial Sequence: Synthetic oligonucleotide
ccaatcgaagttatgcgtttgatgcatggagaattagttg

SEQ ID NO: 300788 - DNA, 42 bp, Artificial Sequence
  Description of Artificial Sequence: Synthetic oligonucleotide
caatcgaagttatgcgtttgatgcatggagaattagttgatg

SEQ ID NO: 300789 - DNA, 48 bp, Artificial Sequence
  Description of Artificial Sequence: Synthetic oligonucleotide
aatcgaagttatgcgtttgatgcatggagaattagttgatgataatac

SEQ ID NO: 300790 - DNA, 47 bp, Artificial Sequence
  Description of Artificial Sequence: Synthetic oligonucleotide
atcgaagttatgcgtttgatgcatggagaattagttgatgataatac

SEQ ID NO: 300791 - DNA, 46 bp, Artificial Sequence
  Description of Artificial Sequence: Synthetic oligonucleotide
tcgaagttatgcgtttgatgcatggagaattagttgatgataatac

SEQ ID NO: 300792 - DNA, 45 bp, Artificial Sequence
  Description of Artificial Sequence: Synthetic oligonucleotide
cgaagttatgcgtttgatgcatggagaattagttgatgataatac

SEQ ID NO: 300793 - DNA, 45 bp, Artificial Sequence
  Description of Artificial Sequence: Synthetic oligonucleotide
gaagttatgcgtttgatgcatggagaattagttgatgataatacc

SEQ ID NO: 300794 - DNA, 45 bp, Artificial Sequence
  Description of Artificial Sequence: Synthetic oligonucleotide
aagttatgcgtttgatgcatggagaattagttgatgataataccg

SEQ ID NO: 300795 - DNA, 44 bp, Artificial Sequence
  Description of Artificial Sequence: Synthetic oligonucleotide
agttatgcgtttgatgcatggagaattagttgatgataataccg

SEQ ID NO: 300796 - DNA, 43 bp, Artificial Sequence
  Description of Artificial Sequence: Synthetic oligonucleotide
gttatgcgtttgatgcatggagaattagttgatgataataccg

SEQ ID NO: 300797 - DNA, 44 bp, Artificial Sequence
  Description of Artificial Sequence: Synthetic oligonucleotide
ttatgcgtttgatgcatggagaattagttgatgataataccgtc

SEQ ID NO: 300798 - DNA, 43 bp, Artificial Sequence
  Description of Artificial Sequence: Synthetic oligonucleotide
tatgcgtttgatgcatggagaattagttgatgataataccgtc

SEQ ID NO: 300799 - DNA, 42 bp, Artificial Sequence
  Description of Artificial Sequence: Synthetic oligonucleotide
atgcgtttgatgcatggagaattagttgatgataataccgtc

SEQ ID NO: 300800 - DNA, 41 bp, Artificial Sequence
  Description of Artificial Sequence: Synthetic oligonucleotide
tgcgtttgatgcatggagaattagttgatgataataccgtc

SEQ ID NO: 300801 - DNA, 40 bp, Artificial Sequence
  Description of Artificial Sequence: Synthetic oligonucleotide
gcgtttgatgcatggagaattagttgatgataataccgtc

SEQ ID NO: 300802 - DNA, 41 bp, Artificial Sequence
  Description of Artificial Sequence: Synthetic oligonucleotide
cgtttgatgcatggagaattagttgatgataataccgtcac

SEQ ID NO: 300803 - DNA, 42 bp, Artificial Sequence
  Description of Artificial Sequence: Synthetic oligonucleotide
gtttgatgcatggagaattagttgatgataataccgtcacag

SEQ ID NO: 300804 - DNA, 43 bp, Artificial Sequence
  Description of Artificial Sequence: Synthetic oligonucleotide
tttgatgcatggagaattagttgatgataataccgtcacagtg

SEQ ID NO: 300805 - DNA, 42 bp, Artificial Sequence
  Description of Artificial Sequence: Synthetic oligonucleotide
ttgatgcatggagaattagttgatgataataccgtcacagtg

SEQ ID NO: 300806 - DNA, 41 bp, Artificial Sequence
  Description of Artificial Sequence: Synthetic oligonucleotide
tgatgcatggagaattagttgatgataataccgtcacagtg

SEQ ID NO: 300807 - DNA, 40 bp, Artificial Sequence
  Description of Artificial Sequence: Synthetic oligonucleotide
gatgcatggagaattagttgatgataataccgtcacagtg

SEQ ID NO: 300808 - DNA, 43 bp, Artificial Sequence
  Description of Artificial Sequence: Synthetic oligonucleotide
atgcatggagaattagttgatgataataccgtcacagtgattg

SEQ ID NO: 300809 - DNA, 42 bp, Artificial Sequence
  Description of Artificial Sequence: Synthetic oligonucleotide
tgcatggagaattagttgatgataataccgtcacagtgattg

SEQ ID NO: 300810 - DNA, 41 bp, Artificial Sequence
  Description of Artificial Sequence: Synthetic oligonucleotide
gcatggagaattagttgatgataataccgtcacagtgattg

SEQ ID NO: 300811 - DNA, 43 bp, Artificial Sequence
  Description of Artificial Sequence: Synthetic oligonucleotide
catggagaattagttgatgataataccgtcacagtgattgaag

SEQ ID NO: 300812 - DNA, 44 bp, Artificial Sequence
  Description of Artificial Sequence: Synthetic oligonucleotide
atggagaattagttgatgataataccgtcacagtgattgaagtg

SEQ ID NO: 300813 - DNA, 43 bp, Artificial Sequence
  Description of Artificial Sequence: Synthetic oligonucleotide
tggagaattagttgatgataataccgtcacagtgattgaagtg

SEQ ID NO: 300814 - DNA, 42 bp, Artificial Sequence
  Description of Artificial Sequence: Synthetic oligonucleotide
ggagaattagttgatgataataccgtcacagtgattgaagtg

SEQ ID NO: 300815 - DNA, 45 bp, Artificial Sequence
  Description of Artificial Sequence: Synthetic oligonucleotide
gagaattagttgatgataataccgtcacagtgattgaagtgtttg

SEQ ID NO: 300816 - DNA, 45 bp, Artificial Sequence
  Description of Artificial Sequence: Synthetic oligonucleotide
agaattagttgatgataataccgtcacagtgattgaagtgtttgc

SEQ ID NO: 300817 - DNA, 44 bp, Artificial Sequence
  Description of Artificial Sequence: Synthetic oligonucleotide
gaattagttgatgataataccgtcacagtgattgaagtgtttgc

SEQ ID NO: 300818 - DNA, 47 bp, Artificial Sequence
  Description of Artificial Sequence: Synthetic oligonucleotide
aattagttgatgataataccgtcacagtgattgaagtgtttgctttg

SEQ ID NO: 300819 - DNA, 46 bp, Artificial Sequence
  Description of Artificial Sequence: Synthetic oligonucleotide
attagttgatgataataccgtcacagtgattgaagtgtttgctttg

SEQ ID NO: 300820 - DNA, 45 bp, Artificial Sequence
  Description of Artificial Sequence: Synthetic oligonucleotide
ttagttgatgataataccgtcacagtgattgaagtgtttgctttg

SEQ ID NO: 300821 - DNA, 44 bp, Artificial Sequence
  Description of Artificial Sequence: Synthetic oligonucleotide
tagttgatgataataccgtcacagtgattgaagtgtttgctttg

SEQ ID NO: 300822 - DNA, 43 bp, Artificial Sequence
  Description of Artificial Sequence: Synthetic oligonucleotide
agttgatgataataccgtcacagtgattgaagtgtttgctttg

SEQ ID NO: 300823 - DNA, 42 bp, Artificial Sequence
  Description of Artificial Sequence: Synthetic oligonucleotide
gttgatgataataccgtcacagtgattgaagtgtttgctttg

SEQ ID NO: 300824 - DNA, 42 bp, Artificial Sequence
  Description of Artificial Sequence: Synthetic oligonucleotide
ttgatgataataccgtcacagtgattgaagtgtttgctttgc

SEQ ID NO: 300825 - DNA, 41 bp, Artificial Sequence
  Description of Artificial Sequence: Synthetic oligonucleotide
tgatgataataccgtcacagtgattgaagtgtttgctttgc

SEQ ID NO: 300826 - DNA, 40 bp, Artificial Sequence
  Description of Artificial Sequence: Synthetic oligonucleotide
gatgataataccgtcacagtgattgaagtgtttgctttgc

SEQ ID NO: 300827 - DNA, 40 bp, Artificial Sequence
  Description of Artificial Sequence: Synthetic oligonucleotide
atgataataccgtcacagtgattgaagtgtttgctttgcc

SEQ ID NO: 300828 - DNA, 39 bp, Artificial Sequence
  Description of Artificial Sequence: Synthetic oligonucleotide
tgataataccgtcacagtgattgaagtgtttgctttgcc

SEQ ID NO: 300829 - DNA, 38 bp, Artificial Sequence
  Description of Artificial Sequence: Synthetic oligonucleotide
gataataccgtcacagtgattgaagtgtttgctttgcc

SEQ ID NO: 300830 - DNA, 39 bp, Artificial Sequence
  Description of Artificial Sequence: Synthetic oligonucleotide
ataataccgtcacagtgattgaagtgtttgctttgccac

SEQ ID NO: 300831 - DNA, 38 bp, Artificial Sequence
  Description of Artificial Sequence: Synthetic oligonucleotide
taataccgtcacagtgattgaagtgtttgctttgccac

SEQ ID NO: 300832 - DNA, 37 bp, Artificial Sequence
  Description of Artificial Sequence: Synthetic oligonucleotide
aataccgtcacagtgattgaagtgtttgctttgccac

SEQ ID NO: 300833 - DNA, 36 bp, Artificial Sequence
  Description of Artificial Sequence: Synthetic oligonucleotide
ataccgtcacagtgattgaagtgtttgctttgccac

SEQ ID NO: 300834 - DNA, 35 bp, Artificial Sequence
  Description of Artificial Sequence: Synthetic oligonucleotide
taccgtcacagtgattgaagtgtttgctttgccac

SEQ ID NO: 300835 - DNA, 34 bp, Artificial Sequence
  Description of Artificial Sequence: Synthetic oligonucleotide
accgtcacagtgattgaagtgtttgctttgccac

SEQ ID NO: 300836 - DNA, 33 bp, Artificial Sequence
  Description of Artificial Sequence: Synthetic oligonucleotide
ccgtcacagtgattgaagtgtttgctttgccac

SEQ ID NO: 300837 - DNA, 34 bp, Artificial Sequence
  Description of Artificial Sequence: Synthetic oligonucleotide
cgtcacagtgattgaagtgtttgctttgccacag

SEQ ID NO: 300838 - DNA, 35 bp, Artificial Sequence
  Description of Artificial Sequence: Synthetic oligonucleotide
gtcacagtgattgaagtgtttgctttgccacagtg

SEQ ID NO: 300839 - DNA, 36 bp, Artificial Sequence
  Description of Artificial Sequence: Synthetic oligonucleotide
tcacagtgattgaagtgtttgctttgccacagtgag

SEQ ID NO: 300840 - DNA, 35 bp, Artificial Sequence
  Description of Artificial Sequence: Synthetic oligonucleotide
cacagtgattgaagtgtttgctttgccacagtgag

SEQ ID NO: 300841 - DNA, 35 bp, Artificial Sequence
  Description of Artificial Sequence: Synthetic oligonucleotide
acagtgattgaagtgtttgctttgccacagtgagg

SEQ ID NO: 300842 - DNA, 34 bp, Artificial Sequence
  Description of Artificial Sequence: Synthetic oligonucleotide
cagtgattgaagtgtttgctttgccacagtgagg

SEQ ID NO: 300843 - DNA, 36 bp, Artificial Sequence
  Description of Artificial Sequence: Synthetic oligonucleotide
agtgattgaagtgtttgctttgccacagtgaggaac

SEQ ID NO: 300844 - DNA, 35 bp, Artificial Sequence
  Description of Artificial Sequence: Synthetic oligonucleotide
gtgattgaagtgtttgctttgccacagtgaggaac

SEQ ID NO: 300845 - DNA, 36 bp, Artificial Sequence
  Description of Artificial Sequence: Synthetic oligonucleotide
tgattgaagtgtttgctttgccacagtgaggaacag

SEQ ID NO: 300846 - DNA, 35 bp, Artificial Sequence
  Description of Artificial Sequence: Synthetic oligonucleotide
gattgaagtgtttgctttgccacagtgaggaacag

SEQ ID NO: 300847 - DNA, 35 bp, Artificial Sequence
  Description of Artificial Sequence: Synthetic oligonucleotide
attgaagtgtttgctttgccacagtgaggaacagg

SEQ ID NO: 300848 - DNA, 34 bp, Artificial Sequence
  Description of Artificial Sequence: Synthetic oligonucleotide
ttgaagtgtttgctttgccacagtgaggaacagg

SEQ ID NO: 300849 - DNA, 33 bp, Artificial Sequence
  Description of Artificial Sequence: Synthetic oligonucleotide
tgaagtgtttgctttgccacagtgaggaacagg

SEQ ID NO: 300850 - DNA, 32 bp, Artificial Sequence
  Description of Artificial Sequence: Synthetic oligonucleotide
gaagtgtttgctttgccacagtgaggaacagg

SEQ ID NO: 300851 - DNA, 33 bp, Artificial Sequence
  Description of Artificial Sequence: Synthetic oligonucleotide
aagtgtttgctttgccacagtgaggaacaggag

SEQ ID NO: 300852 - DNA, 32 bp, Artificial Sequence
  Description of Artificial Sequence: Synthetic oligonucleotide
agtgtttgctttgccacagtgaggaacaggag

SEQ ID NO: 300853 - DNA, 31 bp, Artificial Sequence
  Description of Artificial Sequence: Synthetic oligonucleotide
gtgtttgctttgccacagtgaggaacaggag

SEQ ID NO: 300854 - DNA, 32 bp, Artificial Sequence
  Description of Artificial Sequence: Synthetic oligonucleotide
tgtttgctttgccacagtgaggaacaggagtc

SEQ ID NO: 300855 - DNA, 31 bp, Artificial Sequence
  Description of Artificial Sequence: Synthetic oligonucleotide
gtttgctttgccacagtgaggaacaggagtc

SEQ ID NO: 300856 - DNA, 32 bp, Artificial Sequence
  Description of Artificial Sequence: Synthetic oligonucleotide
tttgctttgccacagtgaggaacaggagtcag

SEQ ID NO: 300857 - DNA, 31 bp, Artificial Sequence
  Description of Artificial Sequence: Synthetic oligonucleotide
ttgctttgccacagtgaggaacaggagtcag

SEQ ID NO: 300858 - DNA, 30 bp, Artificial Sequence
  Description of Artificial Sequence: Synthetic oligonucleotide
tgctttgccacagtgaggaacaggagtcag

SEQ ID NO: 300859 - DNA, 29 bp, Artificial Sequence
  Description of Artificial Sequence: Synthetic oligonucleotide
gctttgccacagtgaggaacaggagtcag

SEQ ID NO: 300860 - DNA, 30 bp, Artificial Sequence
  Description of Artificial Sequence: Synthetic oligonucleotide
ctttgccacagtgaggaacaggagtcagtg

SEQ ID NO: 300861 - DNA, 31 bp, Artificial Sequence
  Description of Artificial Sequence: Synthetic oligonucleotide
tttgccacagtgaggaacaggagtcagtgtg

SEQ ID NO: 300862 - DNA, 30 bp, Artificial Sequence
  Description of Artificial Sequence: Synthetic oligonucleotide
ttgccacagtgaggaacaggagtcagtgtg

SEQ ID NO: 300863 - DNA, 29 bp, Artificial Sequence
  Description of Artificial Sequence: Synthetic oligonucleotide
tgccacagtgaggaacaggagtcagtgtg

SEQ ID NO: 300864 - DNA, 28 bp, Artificial Sequence
  Description of Artificial Sequence: Synthetic oligonucleotide
gccacagtgaggaacaggagtcagtgtg

SEQ ID NO: 300865 - DNA, 28 bp, Artificial Sequence
  Description of Artificial Sequence: Synthetic oligonucleotide
ccacagtgaggaacaggagtcagtgtgc

SEQ ID NO: 300866 - DNA, 29 bp, Artificial Sequence
  Description of Artificial Sequence: Synthetic oligonucleotide
cacagtgaggaacaggagtcagtgtgcag

SEQ ID NO: 300867 - DNA, 29 bp, Artificial Sequence
  Description of Artificial Sequence: Synthetic oligonucleotide
acagtgaggaacaggagtcagtgtgcagg

SEQ ID NO: 300868 - DNA, 28 bp, Artificial Sequence
  Description of Artificial Sequence: Synthetic oligonucleotide
cagtgaggaacaggagtcagtgtgcagg

SEQ ID NO: 300869 - DNA, 28 bp, Artificial Sequence
  Description of Artificial Sequence: Synthetic oligonucleotide
agtgaggaacaggagtcagtgtgcaggc

SEQ ID NO: 300870 - DNA, 27 bp, Artificial Sequence
  Description of Artificial Sequence: Synthetic oligonucleotide
gtgaggaacaggagtcagtgtgcaggc

SEQ ID NO: 300871 - DNA, 28 bp, Artificial Sequence
  Description of Artificial Sequence: Synthetic oligonucleotide
tgaggaacaggagtcagtgtgcaggcag

SEQ ID NO: 300872 - DNA, 27 bp, Artificial Sequence
  Description of Artificial Sequence: Synthetic oligonucleotide
gaggaacaggagtcagtgtgcaggcag

SEQ ID NO: 300873 - DNA, 29 bp, Artificial Sequence
  Description of Artificial Sequence: Synthetic oligonucleotide
aggaacaggagtcagtgtgcaggcagttg

SEQ ID NO: 300874 - DNA, 28 bp, Artificial Sequence
  Description of Artificial Sequence: Synthetic oligonucleotide
ggaacaggagtcagtgtgcaggcagttg

SEQ ID NO: 300875 - DNA, 30 bp, Artificial Sequence
  Description of Artificial Sequence: Synthetic oligonucleotide
gaacaggagtcagtgtgcaggcagttgttc

SEQ ID NO: 300876 - DNA, 30 bp, Artificial Sequence
  Description of Artificial Sequence: Synthetic oligonucleotide
aacaggagtcagtgtgcaggcagttgttcc

SEQ ID NO: 300877 - DNA, 29 bp, Artificial Sequence
  Description of Artificial Sequence: Synthetic oligonucleotide
acaggagtcagtgtgcaggcagttgttcc

SEQ ID NO: 300878 - DNA, 28 bp, Artificial Sequence
  Description of Artificial Sequence: Synthetic oligonucleotide
caggagtcagtgtgcaggcagttgttcc

SEQ ID NO: 300879 - DNA, 29 bp, Artificial Sequence
  Description of Artificial Sequence: Synthetic oligonucleotide
aggagtcagtgtgcaggcagttgttccag

SEQ ID NO: 300880 - DNA, 28 bp, Artificial Sequence
  Description of Artificial Sequence: Synthetic oligonucleotide
ggagtcagtgtgcaggcagttgttccag

SEQ ID NO: 300881 - DNA, 29 bp, Artificial Sequence
  Description of Artificial Sequence: Synthetic oligonucleotide
gagtcagtgtgcaggcagttgttccagtg

SEQ ID NO: 300882 - DNA, 31 bp, Artificial Sequence
  Description of Artificial Sequence: Synthetic oligonucleotide
agtcagtgtgcaggcagttgttccagtgttg

SEQ ID NO: 300883 - DNA, 30 bp, Artificial Sequence
  Description of Artificial Sequence: Synthetic oligonucleotide
gtcagtgtgcaggcagttgttccagtgttg

SEQ ID NO: 300884 - DNA, 30 bp, Artificial Sequence
  Description of Artificial Sequence: Synthetic oligonucleotide
tcagtgtgcaggcagttgttccagtgttgc

SEQ ID NO: 300885 - DNA, 29 bp, Artificial Sequence
  Description of Artificial Sequence: Synthetic oligonucleotide
cagtgtgcaggcagttgttccagtgttgc

SEQ ID NO: 300886 - DNA, 31 bp, Artificial Sequence
  Description of Artificial Sequence: Synthetic oligonucleotide
agtgtgcaggcagttgttccagtgttgcaag

SEQ ID NO: 300887 - DNA, 30 bp, Artificial Sequence
  Description of Artificial Sequence: Synthetic oligonucleotide
gtgtgcaggcagttgttccagtgttgcaag

SEQ ID NO: 300888 - DNA, 30 bp, Artificial Sequence
  Description of Artificial Sequence: Synthetic oligonucleotide
tgtgcaggcagttgttccagtgttgcaagc

SEQ ID NO: 300889 - DNA, 29 bp, Artificial Sequence
  Description of Artificial Sequence: Synthetic oligonucleotide
gtgcaggcagttgttccagtgttgcaagc

SEQ ID NO: 300890 - DNA, 35 bp, Artificial Sequence
  Description of Artificial Sequence: Synthetic oligonucleotide
tgcaggcagttgttccagtgttgcaagctaaattg

SEQ ID NO: 300891 - DNA, 34 bp, Artificial Sequence
  Description of Artificial Sequence: Synthetic oligonucleotide
gcaggcagttgttccagtgttgcaagctaaattg

SEQ ID NO: 300892 - DNA, 36 bp, Artificial Sequence
  Description of Artificial Sequence: Synthetic oligonucleotide
caggcagttgttccagtgttgcaagctaaattgttg

SEQ ID NO: 300893 - DNA, 36 bp, Artificial Sequence
  Description of Artificial Sequence: Synthetic oligonucleotide
aggcagttgttccagtgttgcaagctaaattgttgg

SEQ ID NO: 300894 - DNA, 35 bp, Artificial Sequence
  Description of Artificial Sequence: Synthetic oligonucleotide
ggcagttgttccagtgttgcaagctaaattgttgg

SEQ ID NO: 300895 - DNA, 39 bp, Artificial Sequence
  Description of Artificial Sequence: Synthetic oligonucleotide
gcagttgttccagtgttgcaagctaaattgttggataag

SEQ ID NO: 300896 - DNA, 41 bp, Artificial Sequence
  Description of Artificial Sequence: Synthetic oligonucleotide
cagttgttccagtgttgcaagctaaattgttggataagttg

SEQ ID NO: 300897 - DNA, 43 bp, Artificial Sequence
  Description of Artificial Sequence: Synthetic oligonucleotide
agttgttccagtgttgcaagctaaattgttggataagttgaag

SEQ ID NO: 300898 - DNA, 42 bp, Artificial Sequence
  Description of Artificial Sequence: Synthetic oligonucleotide
gttgttccagtgttgcaagctaaattgttggataagttgaag

SEQ ID NO: 300899 - DNA, 42 bp, Artificial Sequence
  Description of Artificial Sequence: Synthetic oligonucleotide
ttgttccagtgttgcaagctaaattgttggataagttgaagc

SEQ ID NO: 300900 - DNA, 41 bp, Artificial Sequence
  Description of Artificial Sequence: Synthetic oligonucleotide
tgttccagtgttgcaagctaaattgttggataagttgaagc

SEQ ID NO: 300901 - DNA, 40 bp, Artificial Sequence
  Description of Artificial Sequence: Synthetic oligonucleotide
gttccagtgttgcaagctaaattgttggataagttgaagc

SEQ ID NO: 300902 - DNA, 41 bp, Artificial Sequence
  Description of Artificial Sequence: Synthetic oligonucleotide
ttccagtgttgcaagctaaattgttggataagttgaagcac

SEQ ID NO: 300903 - DNA, 40 bp, Artificial Sequence
  Description of Artificial Sequence: Synthetic oligonucleotide
tccagtgttgcaagctaaattgttggataagttgaagcac

SEQ ID NO: 300904 - DNA, 39 bp, Artificial Sequence
  Description of Artificial Sequence: Synthetic oligonucleotide
ccagtgttgcaagctaaattgttggataagttgaagcac

SEQ ID NO: 300905 - DNA, 40 bp, Artificial Sequence
  Description of Artificial Sequence: Synthetic oligonucleotide
cagtgttgcaagctaaattgttggataagttgaagcacac

SEQ ID NO: 300906 - DNA, 41 bp, Artificial Sequence
  Description of Artificial Sequence: Synthetic oligonucleotide
agtgttgcaagctaaattgttggataagttgaagcacacag

SEQ ID NO: 300907 - DNA, 40 bp, Artificial Sequence
  Description of Artificial Sequence: Synthetic oligonucleotide
gtgttgcaagctaaattgttggataagttgaagcacacag

SEQ ID NO: 300908 - DNA, 40 bp, Artificial Sequence
  Description of Artificial Sequence: Synthetic oligonucleotide
tgttgcaagctaaattgttggataagttgaagcacacagg

SEQ ID NO: 300909 - DNA, 39 bp, Artificial Sequence
  Description of Artificial Sequence: Synthetic oligonucleotide
gttgcaagctaaattgttggataagttgaagcacacagg

SEQ ID NO: 300910 - DNA, 41 bp, Artificial Sequence
  Description of Artificial Sequence: Synthetic oligonucleotide
ttgcaagctaaattgttggataagttgaagcacacaggaag

SEQ ID NO: 300911 - DNA, 40 bp, Artificial Sequence
  Description of Artificial Sequence: Synthetic oligonucleotide
tgcaagctaaattgttggataagttgaagcacacaggaag

SEQ ID NO: 300912 - DNA, 39 bp, Artificial Sequence
  Description of Artificial Sequence: Synthetic oligonucleotide
gcaagctaaattgttggataagttgaagcacacaggaag

SEQ ID NO: 300913 - DNA, 39 bp, Artificial Sequence
  Description of Artificial Sequence: Synthetic oligonucleotide
caagctaaattgttggataagttgaagcacacaggaagg

SEQ ID NO: 300914 - DNA, 39 bp, Artificial Sequence
  Description of Artificial Sequence: Synthetic oligonucleotide
aagctaaattgttggataagttgaagcacacaggaaggg

SEQ ID NO: 300915 - DNA, 38 bp, Artificial Sequence
  Description of Artificial Sequence: Synthetic oligonucleotide
agctaaattgttggataagttgaagcacacaggaaggg

SEQ ID NO: 300916 - DNA, 37 bp, Artificial Sequence
  Description of Artificial Sequence: Synthetic oligonucleotide
gctaaattgttggataagttgaagcacacaggaaggg

SEQ ID NO: 300917 - DNA, 37 bp, Artificial Sequence
  Description of Artificial Sequence: Synthetic oligonucleotide
ctaaattgttggataagttgaagcacacaggaagggc

SEQ ID NO: 300918 - DNA, 37 bp, Artificial Sequence
  Description of Artificial Sequence: Synthetic oligonucleotide
taaattgttggataagttgaagcacacaggaagggcg

SEQ ID NO: 300919 - DNA, 36 bp, Artificial Sequence
  Description of Artificial Sequence: Synthetic oligonucleotide
aaattgttggataagttgaagcacacaggaagggcg

SEQ ID NO: 300920 - DNA, 35 bp, Artificial Sequence
  Description of Artificial Sequence: Synthetic oligonucleotide
aattgttggataagttgaagcacacaggaagggcg

SEQ ID NO: 300921 - DNA, 34 bp, Artificial Sequence
  Description of Artificial Sequence: Synthetic oligonucleotide
attgttggataagttgaagcacacaggaagggcg

SEQ ID NO: 300922 - DNA, 33 bp, Artificial Sequence
  Description of Artificial Sequence: Synthetic oligonucleotide
ttgttggataagttgaagcacacaggaagggcg

SEQ ID NO: 300923 - DNA, 32 bp, Artificial Sequence
  Description of Artificial Sequence: Synthetic oligonucleotide
tgttggataagttgaagcacacaggaagggcg

SEQ ID NO: 300924 - DNA, 31 bp, Artificial Sequence
  Description of Artificial Sequence: Synthetic oligonucleotide
gttggataagttgaagcacacaggaagggcg

SEQ ID NO: 300925 - DNA, 31 bp, Artificial Sequence
  Description of Artificial Sequence: Synthetic oligonucleotide
ttggataagttgaagcacacaggaagggcgg

SEQ ID NO: 300926 - DNA, 30 bp, Artificial Sequence
  Description of Artificial Sequence: Synthetic oligonucleotide
tggataagttgaagcacacaggaagggcgg

SEQ ID NO: 300927 - DNA, 29 bp, Artificial Sequence
  Description of Artificial Sequence: Synthetic oligonucleotide
ggataagttgaagcacacaggaagggcgg

SEQ ID NO: 300928 - DNA, 30 bp, Artificial Sequence
  Description of Artificial Sequence: Synthetic oligonucleotide
gataagttgaagcacacaggaagggcggag

SEQ ID NO: 300929 - DNA, 32 bp, Artificial Sequence
  Description of Artificial Sequence: Synthetic oligonucleotide
ataagttgaagcacacaggaagggcggagatg

SEQ ID NO: 300930 - DNA, 31 bp, Artificial Sequence
  Description of Artificial Sequence: Synthetic oligonucleotide
taagttgaagcacacaggaagggcggagatg

SEQ ID NO: 300931 - DNA, 30 bp, Artificial Sequence
  Description of Artificial Sequence: Synthetic oligonucleotide
aagttgaagcacacaggaagggcggagatg

SEQ ID NO: 300932 - DNA, 29 bp, Artificial Sequence
  Description of Artificial Sequence: Synthetic oligonucleotide
agttgaagcacacaggaagggcggagatg

SEQ ID NO: 300933 - DNA, 28 bp, Artificial Sequence
  Description of Artificial Sequence: Synthetic oligonucleotide
gttgaagcacacaggaagggcggagatg

SEQ ID NO: 300934 - DNA, 28 bp, Artificial Sequence
  Description of Artificial Sequence: Synthetic oligonucleotide
ttgaagcacacaggaagggcggagatgg

SEQ ID NO: 300935 - DNA, 27 bp, Artificial Sequence
  Description of Artificial Sequence: Synthetic oligonucleotide
tgaagcacacaggaagggcggagatgg

SEQ ID NO: 300936 - DNA, 27 bp, Artificial Sequence
  Description of Artificial Sequence: Synthetic oligonucleotide
gaagcacacaggaagggcggagatgga

SEQ ID NO: 300937 - DNA, 28 bp, Artificial Sequence
  Description of Artificial Sequence: Synthetic oligonucleotide
aagcacacaggaagggcggagatggatg

SEQ ID NO: 300938 - DNA, 27 bp, Artificial Sequence
  Description of Artificial Sequence: Synthetic oligonucleotide
agcacacaggaagggcggagatggatg

SEQ ID NO: 300939 - DNA, 27 bp, Artificial Sequence
  Description of Artificial Sequence: Synthetic oligonucleotide
gcacacaggaagggcggagatggatgt

SEQ ID NO: 300940 - DNA, 28 bp, Artificial Sequence
  Description of Artificial Sequence: Synthetic oligonucleotide
cacacaggaagggcggagatggatgttg

SEQ ID NO: 300941 - DNA, 28 bp, Artificial Sequence
  Description of Artificial Sequence: Synthetic oligonucleotide
acacaggaagggcggagatggatgttgg

SEQ ID NO: 300942 - DNA, 27 bp, Artificial Sequence
  Description of Artificial Sequence: Synthetic oligonucleotide
cacaggaagggcggagatggatgttgg

SEQ ID NO: 300943 - DNA, 29 bp, Artificial Sequence
  Description of Artificial Sequence: Synthetic oligonucleotide
acaggaagggcggagatggatgttggttg

SEQ ID NO: 300944 - DNA, 28 bp, Artificial Sequence
  Description of Artificial Sequence: Synthetic oligonucleotide
caggaagggcggagatggatgttggttg

SEQ ID NO: 300945 - DNA, 28 bp, Artificial Sequence
  Description of Artificial Sequence: Synthetic oligonucleotide
aggaagggcggagatggatgttggttgc

SEQ ID NO: 300946 - DNA, 27 bp, Artificial Sequence
  Description of Artificial Sequence: Synthetic oligonucleotide
ggaagggcggagatggatgttggttgc

SEQ ID NO: 300947 - DNA, 30 bp, Artificial Sequence
  Description of Artificial Sequence: Synthetic oligonucleotide
gaagggcggagatggatgttggttgctatc

SEQ ID NO: 300948 - DNA, 31 bp, Artificial Sequence
  Description of Artificial Sequence: Synthetic oligonucleotide
aagggcggagatggatgttggttgctatcac

SEQ ID NO: 300949 - DNA, 30 bp, Artificial Sequence
  Description of Artificial Sequence: Synthetic oligonucleotide
agggcggagatggatgttggttgctatcac

SEQ ID NO: 300950 - DNA, 29 bp, Artificial Sequence
  Description of Artificial Sequence: Synthetic oligonucleotide
gggcggagatggatgttggttgctatcac

SEQ ID NO: 300951 - DNA, 30 bp, Artificial Sequence
  Description of Artificial Sequence: Synthetic oligonucleotide
ggcggagatggatgttggttgctatcacag

SEQ ID NO: 300952 - DNA, 31 bp, Artificial Sequence
  Description of Artificial Sequence: Synthetic oligonucleotide
gcggagatggatgttggttgctatcacagtg

SEQ ID NO: 300953 - DNA, 32 bp, Artificial Sequence
  Description of Artificial Sequence: Synthetic oligonucleotide
cggagatggatgttggttgctatcacagtgac

SEQ ID NO: 300954 - DNA, 32 bp, Artificial Sequence
  Description of Artificial Sequence: Synthetic oligonucleotide
ggagatggatgttggttgctatcacagtgacc

SEQ ID NO: 300955 - DNA, 32 bp, Artificial Sequence
  Description of Artificial Sequence: Synthetic oligonucleotide
gagatggatgttggttgctatcacagtgaccc

SEQ ID NO: 300956 - DNA, 33 bp, Artificial Sequence
  Description of Artificial Sequence: Synthetic oligonucleotide
agatggatgttggttgctatcacagtgaccctg

SEQ ID NO: 300957 - DNA, 32 bp, Artificial Sequence
  Description of Artificial Sequence: Synthetic oligonucleotide
gatggatgttggttgctatcacagtgaccctg

SEQ ID NO: 300958 - DNA, 32 bp, Artificial Sequence
  Description of Artificial Sequence: Synthetic oligonucleotide
atggatgttggttgctatcacagtgaccctgg

SEQ ID NO: 300959 - DNA, 31 bp, Artificial Sequence
  Description of Artificial Sequence: Synthetic oligonucleotide
tggatgttggttgctatcacagtgaccctgg

SEQ ID NO: 300960 - DNA, 30 bp, Artificial Sequence
  Description of Artificial Sequence: Synthetic oligonucleotide
ggatgttggttgctatcacagtgaccctgg

SEQ ID NO: 300961 - DNA, 30 bp, Artificial Sequence
  Description of Artificial Sequence: Synthetic oligonucleotide
gatgttggttgctatcacagtgaccctggc

SEQ ID NO: 300962 - DNA, 33 bp, Artificial Sequence
  Description of Artificial Sequence: Synthetic oligonucleotide
atgttggttgctatcacagtgaccctggctatg

SEQ ID NO: 300963 - DNA, 32 bp, Artificial Sequence
  Description of Artificial Sequence: Synthetic oligonucleotide
tgttggttgctatcacagtgaccctggctatg

SEQ ID NO: 300964 - DNA, 31 bp, Artificial Sequence
  Description of Artificial Sequence: Synthetic oligonucleotide
gttggttgctatcacagtgaccctggctatg

SEQ ID NO: 300965 - DNA, 31 bp, Artificial Sequence
  Description of Artificial Sequence: Synthetic oligonucleotide
ttggttgctatcacagtgaccctggctatgg

SEQ ID NO: 300966 - DNA, 30 bp, Artificial Sequence
  Description of Artificial Sequence: Synthetic oligonucleotide
tggttgctatcacagtgaccctggctatgg

SEQ ID NO: 300967 - DNA, 29 bp, Artificial Sequence
  Description of Artificial Sequence: Synthetic oligonucleotide
ggttgctatcacagtgaccctggctatgg

SEQ ID NO: 300968 - DNA, 31 bp, Artificial Sequence
  Description of Artificial Sequence: Synthetic oligonucleotide
gttgctatcacagtgaccctggctatggttg

SEQ ID NO: 300969 - DNA, 33 bp, Artificial Sequence
  Description of Artificial Sequence: Synthetic oligonucleotide
ttgctatcacagtgaccctggctatggttgttg

SEQ ID NO: 300970 - DNA, 32 bp, Artificial Sequence
  Description of Artificial Sequence: Synthetic oligonucleotide
tgctatcacagtgaccctggctatggttgttg

SEQ ID NO: 300971 - DNA, 31 bp, Artificial Sequence
  Description of Artificial Sequence: Synthetic oligonucleotide
gctatcacagtgaccctggctatggttgttg

SEQ ID NO: 300972 - DNA, 31 bp, Artificial Sequence
  Description of Artificial Sequence: Synthetic oligonucleotide
ctatcacagtgaccctggctatggttgttgc

SEQ ID NO: 300973 - DNA, 31 bp, Artificial Sequence
  Description of Artificial Sequence: Synthetic oligonucleotide
tatcacagtgaccctggctatggttgttgcc

SEQ ID NO: 300974 - DNA, 30 bp, Artificial Sequence
  Description of Artificial Sequence: Synthetic oligonucleotide
atcacagtgaccctggctatggttgttgcc

SEQ ID NO: 300975 - DNA, 29 bp, Artificial Sequence
  Description of Artificial Sequence: Synthetic oligonucleotide
tcacagtgaccctggctatggttgttgcc

SEQ ID NO: 300976 - DNA, 28 bp, Artificial Sequence
  Description of Artificial Sequence: Synthetic oligonucleotide
cacagtgaccctggctatggttgttgcc

SEQ ID NO: 300977 - DNA, 31 bp, Artificial Sequence
  Description of Artificial Sequence: Synthetic oligonucleotide
acagtgaccctggctatggttgttgcctttc

SEQ ID NO: 300978 - DNA, 30 bp, Artificial Sequence
  Description of Artificial Sequence: Synthetic oligonucleotide
cagtgaccctggctatggttgttgcctttc

SEQ ID NO: 300979 - DNA, 31 bp, Artificial Sequence
  Description of Artificial Sequence: Synthetic oligonucleotide
agtgaccctggctatggttgttgcctttctg

SEQ ID NO: 300980 - DNA, 30 bp, Artificial Sequence
  Description of Artificial Sequence: Synthetic oligonucleotide
gtgaccctggctatggttgttgcctttctg

SEQ ID NO: 300981 - DNA, 30 bp, Artificial Sequence
  Description of Artificial Sequence: Synthetic oligonucleotide
tgaccctggctatggttgttgcctttctgg

SEQ ID NO: 300982 - DNA, 29 bp, Artificial Sequence
  Description of Artificial Sequence: Synthetic oligonucleotide
gaccctggctatggttgttgcctttctgg

SEQ ID NO: 300983 - DNA, 30 bp, Artificial Sequence
  Description of Artificial Sequence: Synthetic oligonucleotide
accctggctatggttgttgcctttctggtc

SEQ ID NO: 300984 - DNA, 29 bp, Artificial Sequence
  Description of Artificial Sequence: Synthetic oligonucleotide
ccctggctatggttgttgcctttctggtc

SEQ ID NO: 300985 - DNA, 30 bp, Artificial Sequence
  Description of Artificial Sequence: Synthetic oligonucleotide
cctggctatggttgttgcctttctggtctg

SEQ ID NO: 300986 - DNA, 30 bp, Artificial Sequence
  Description of Artificial Sequence: Synthetic oligonucleotide
ctggctatggttgttgcctttctggtctgg

SEQ ID NO: 300987 - DNA, 34 bp, Artificial Sequence
  Description of Artificial Sequence: Synthetic oligonucleotide
tggctatggttgttgcctttctggtctggatatc

SEQ ID NO: 300988 - DNA, 33 bp, Artificial Sequence
  Description of Artificial Sequence: Synthetic oligonucleotide
ggctatggttgttgcctttctggtctggatatc

SEQ ID NO: 300989 - DNA, 35 bp, Artificial Sequence
  Description of Artificial Sequence: Synthetic oligonucleotide
gctatggttgttgcctttctggtctggatatcatc

SEQ ID NO: 300990 - DNA, 36 bp, Artificial Sequence
  Description of Artificial Sequence: Synthetic oligonucleotide
ctatggttgttgcctttctggtctggatatcatcac

SEQ ID NO: 300991 - DNA, 37 bp, Artificial Sequence
  Description of Artificial Sequence: Synthetic oligonucleotide
tatggttgttgcctttctggtctggatatcatcactc

SEQ ID NO: 300992 - DNA, 36 bp, Artificial Sequence
  Description of Artificial Sequence: Synthetic oligonucleotide
atggttgttgcctttctggtctggatatcatcactc

SEQ ID NO: 300993 - DNA, 35 bp, Artificial Sequence
  Description of Artificial Sequence: Synthetic oligonucleotide
tggttgttgcctttctggtctggatatcatcactc

SEQ ID NO: 300994 - DNA, 34 bp, Artificial Sequence
  Description of Artificial Sequence: Synthetic oligonucleotide
ggttgttgcctttctggtctggatatcatcactc

SEQ ID NO: 300995 - DNA, 35 bp, Artificial Sequence
  Description of Artificial Sequence: Synthetic oligonucleotide
gttgttgcctttctggtctggatatcatcactcag

SEQ ID NO: 300996 - DNA, 35 bp, Artificial Sequence
  Description of Artificial Sequence: Synthetic oligonucleotide
ttgttgcctttctggtctggatatcatcactcagc

SEQ ID NO: 300997 - DNA, 34 bp, Artificial Sequence
  Description of Artificial Sequence: Synthetic oligonucleotide
tgttgcctttctggtctggatatcatcactcagc

SEQ ID NO: 300998 - DNA, 33 bp, Artificial Sequence
  Description of Artificial Sequence: Synthetic oligonucleotide
gttgcctttctggtctggatatcatcactcagc

SEQ ID NO: 300999 - DNA, 34 bp, Artificial Sequence
  Description of Artificial Sequence: Synthetic oligonucleotide
ttgcctttctggtctggatatcatcactcagcac

SEQ ID NO: 301000 - DNA, 33 bp, Artificial Sequence
  Description of Artificial Sequence: Synthetic oligonucleotide
tgcctttctggtctggatatcatcactcagcac

SEQ ID NO: 301001 - DNA, 32 bp, Artificial Sequence
  Description of Artificial Sequence: Synthetic oligonucleotide
gcctttctggtctggatatcatcactcagcac

SEQ ID NO: 301002 - DNA, 33 bp, Artificial Sequence
  Description of Artificial Sequence: Synthetic oligonucleotide
cctttctggtctggatatcatcactcagcacag

SEQ ID NO: 301003 - DNA, 33 bp, Artificial Sequence
  Description of Artificial Sequence: Synthetic oligonucleotide
ctttctggtctggatatcatcactcagcacagc

SEQ ID NO: 301004 - DNA, 36 bp, Artificial Sequence
  Description of Artificial Sequence: Synthetic oligonucleotide
tttctggtctggatatcatcactcagcacagctttg

SEQ ID NO: 301005 - DNA, 35 bp, Artificial Sequence
  Description of Artificial Sequence: Synthetic oligonucleotide
ttctggtctggatatcatcactcagcacagctttg

SEQ ID NO: 301006 - DNA, 34 bp, Artificial Sequence
  Description of Artificial Sequence: Synthetic oligonucleotide
tctggtctggatatcatcactcagcacagctttg

SEQ ID NO: 301007 - DNA, 33 bp, Artificial Sequence
  Description of Artificial Sequence: Synthetic oligonucleotide
ctggtctggatatcatcactcagcacagctttg

SEQ ID NO: 301008 - DNA, 35 bp, Artificial Sequence
  Description of Artificial Sequence: Synthetic oligonucleotide
tggtctggatatcatcactcagcacagctttgaac

SEQ ID NO: 301009 - DNA, 34 bp, Artificial Sequence
  Description of Artificial Sequence: Synthetic oligonucleotide
ggtctggatatcatcactcagcacagctttgaac

SEQ ID NO: 301010 - DNA, 34 bp, Artificial Sequence
  Description of Artificial Sequence: Synthetic oligonucleotide
gtctggatatcatcactcagcacagctttgaacc

SEQ ID NO: 301011 - DNA, 34 bp, Artificial Sequence
  Description of Artificial Sequence: Synthetic oligonucleotide
tctggatatcatcactcagcacagctttgaaccc

SEQ ID NO: 301012 - DNA, 33 bp, Artificial Sequence
  Description of Artificial Sequence: Synthetic oligonucleotide
ctggatatcatcactcagcacagctttgaaccc

SEQ ID NO: 301013 - DNA, 35 bp, Artificial Sequence
  Description of Artificial Sequence: Synthetic oligonucleotide
tggatatcatcactcagcacagctttgaacccttg

SEQ ID NO: 301014 - DNA, 34 bp, Artificial Sequence
  Description of Artificial Sequence: Synthetic oligonucleotide
ggatatcatcactcagcacagctttgaacccttg

SEQ ID NO: 301015 - DNA, 35 bp, Artificial Sequence
  Description of Artificial Sequence: Synthetic oligonucleotide
gatatcatcactcagcacagctttgaacccttgtc

SEQ ID NO: 301016 - DNA, 35 bp, Artificial Sequence
  Description of Artificial Sequence: Synthetic oligonucleotide
atatcatcactcagcacagctttgaacccttgtcg

SEQ ID NO: 301017 - DNA, 34 bp, Artificial Sequence
  Description of Artificial Sequence: Synthetic oligonucleotide
tatcatcactcagcacagctttgaacccttgtcg

SEQ ID NO: 301018 - DNA, 33 bp, Artificial Sequence
  Description of Artificial Sequence: Synthetic oligonucleotide
atcatcactcagcacagctttgaacccttgtcg

SEQ ID NO: 301019 - DNA, 32 bp, Artificial Sequence
  Description of Artificial Sequence: Synthetic oligonucleotide
tcatcactcagcacagctttgaacccttgtcg

SEQ ID NO: 301020 - DNA, 31 bp, Artificial Sequence
  Description of Artificial Sequence: Synthetic oligonucleotide
catcactcagcacagctttgaacccttgtcg

SEQ ID NO: 301021 - DNA, 31 bp, Artificial Sequence
  Description of Artificial Sequence: Synthetic oligonucleotide
atcactcagcacagctttgaacccttgtcgg

SEQ ID NO: 301022 - DNA, 30 bp, Artificial Sequence
  Description of Artificial Sequence: Synthetic oligonucleotide
tcactcagcacagctttgaacccttgtcgg

SEQ ID NO: 301023 - DNA, 29 bp, Artificial Sequence
  Description of Artificial Sequence: Synthetic oligonucleotide
cactcagcacagctttgaacccttgtcgg

SEQ ID NO: 301024 - DNA, 30 bp, Artificial Sequence
  Description of Artificial Sequence: Synthetic oligonucleotide
actcagcacagctttgaacccttgtcggtg

SEQ ID NO: 301025 - DNA, 29 bp, Artificial Sequence
  Description of Artificial Sequence: Synthetic oligonucleotide
ctcagcacagctttgaacccttgtcggtg

SEQ ID NO: 301026 - DNA, 30 bp, Artificial Sequence
  Description of Artificial Sequence: Synthetic oligonucleotide
tcagcacagctttgaacccttgtcggtgag

SEQ ID NO: 301027 - DNA, 29 bp, Artificial Sequence
  Description of Artificial Sequence: Synthetic oligonucleotide
cagcacagctttgaacccttgtcggtgag

SEQ ID NO: 301028 - DNA, 30 bp, Artificial Sequence
  Description of Artificial Sequence: Synthetic oligonucleotide
agcacagctttgaacccttgtcggtgagag

SEQ ID NO: 301029 - DNA, 29 bp, Artificial Sequence
  Description of Artificial Sequence: Synthetic oligonucleotide
gcacagctttgaacccttgtcggtgagag

SEQ ID NO: 301030 - DNA, 29 bp, Artificial Sequence
  Description of Artificial Sequence: Synthetic oligonucleotide
cacagctttgaacccttgtcggtgagagc

SEQ ID NO: 301031 - DNA, 30 bp, Artificial Sequence
  Description of Artificial Sequence: Synthetic oligonucleotide
acagctttgaacccttgtcggtgagagctg

SEQ ID NO: 301032 - DNA, 29 bp, Artificial Sequence
  Description of Artificial Sequence: Synthetic oligonucleotide
cagctttgaacccttgtcggtgagagctg

SEQ ID NO: 301033 - DNA, 30 bp, Artificial Sequence
  Description of Artificial Sequence: Synthetic oligonucleotide
agctttgaacccttgtcggtgagagctgtc

SEQ ID NO: 301034 - DNA, 29 bp, Artificial Sequence
  Description of Artificial Sequence: Synthetic oligonucleotide
gctttgaacccttgtcggtgagagctgtc

SEQ ID NO: 301035 - DNA, 29 bp, Artificial Sequence
  Description of Artificial Sequence: Synthetic oligonucleotide
ctttgaacccttgtcggtgagagctgtcg

SEQ ID NO: 301036 - DNA, 29 bp, Artificial Sequence
  Description of Artificial Sequence: Synthetic oligonucleotide
tttgaacccttgtcggtgagagctgtcgc

SEQ ID NO: 301037 - DNA, 28 bp, Artificial Sequence
  Description of Artificial Sequence: Synthetic oligonucleotide
ttgaacccttgtcggtgagagctgtcgc

SEQ ID NO: 301038 - DNA, 27 bp, Artificial Sequence
  Description of Artificial Sequence: Synthetic oligonucleotide
tgaacccttgtcggtgagagctgtcgc

SEQ ID NO: 301039 - DNA, 27 bp, Artificial Sequence
  Description of Artificial Sequence: Synthetic oligonucleotide
gaacccttgtcggtgagagctgtcgca

SEQ ID NO: 301040 - DNA, 27 bp, Artificial Sequence
  Description of Artificial Sequence: Synthetic oligonucleotide
aacccttgtcggtgagagctgtcgcag

SEQ ID NO: 301041 - DNA, 27 bp, Artificial Sequence
  Description of Artificial Sequence: Synthetic oligonucleotide
acccttgtcggtgagagctgtcgcagt

SEQ ID NO: 301042 - DNA, 26 bp, Artificial Sequence
  Description of Artificial Sequence: Synthetic oligonucleotide
cccttgtcggtgagagctgtcgcagt

SEQ ID NO: 301043 - DNA, 26 bp, Artificial Sequence
  Description of Artificial Sequence: Synthetic oligonucleotide
ccttgtcggtgagagctgtcgcagtg

SEQ ID NO: 301044 - DNA, 27 bp, Artificial Sequence
  Description of Artificial Sequence: Synthetic oligonucleotide
cttgtcggtgagagctgtcgcagtggt

SEQ ID NO: 301045 - DNA, 28 bp, Artificial Sequence
  Description of Artificial Sequence: Synthetic oligonucleotide
ttgtcggtgagagctgtcgcagtggttc

SEQ ID NO: 301046 - DNA, 27 bp, Artificial Sequence
  Description of Artificial Sequence: Synthetic oligonucleotide
tgtcggtgagagctgtcgcagtggttc

SEQ ID NO: 301047 - DNA, 27 bp, Artificial Sequence
  Description of Artificial Sequence: Synthetic oligonucleotide
gtcggtgagagctgtcgcagtggttct

SEQ ID NO: 301048 - DNA, 27 bp, Artificial Sequence
  Description of Artificial Sequence: Synthetic oligonucleotide
tcggtgagagctgtcgcagtggttctg

SEQ ID NO: 301049 - DNA, 26 bp, Artificial Sequence
  Description of Artificial Sequence: Synthetic oligonucleotide
cggtgagagctgtcgcagtggttctg

SEQ ID NO: 301050 - DNA, 27 bp, Artificial Sequence
  Description of Artificial Sequence: Synthetic oligonucleotide
ggtgagagctgtcgcagtggttctgga

SEQ ID NO: 301051 - DNA, 28 bp, Artificial Sequence
  Description of Artificial Sequence: Synthetic oligonucleotide
gtgagagctgtcgcagtggttctggatc

SEQ ID NO: 301052 - DNA, 28 bp, Artificial Sequence
  Description of Artificial Sequence: Synthetic oligonucleotide
tgagagctgtcgcagtggttctggatcc

SEQ ID NO: 301053 - DNA, 27 bp, Artificial Sequence
  Description of Artificial Sequence: Synthetic oligonucleotide
gagagctgtcgcagtggttctggatcc

SEQ ID NO: 301054 - DNA, 27 bp, Artificial Sequence
  Description of Artificial Sequence: Synthetic oligonucleotide
agagctgtcgcagtggttctggatccc

SEQ ID NO: 301055 - DNA, 27 bp, Artificial Sequence
  Description of Artificial Sequence: Synthetic oligonucleotide
gagctgtcgcagtggttctggatccca

SEQ ID NO: 301056 - DNA, 29 bp, Artificial Sequence
  Description of Artificial Sequence: Synthetic oligonucleotide
agctgtcgcagtggttctggatcccaatc

SEQ ID NO: 301057 - DNA, 28 bp, Artificial Sequence
  Description of Artificial Sequence: Synthetic oligonucleotide
gctgtcgcagtggttctggatcccaatc

SEQ ID NO: 301058 - DNA, 29 bp, Artificial Sequence
  Description of Artificial Sequence: Synthetic oligonucleotide
ctgtcgcagtggttctggatcccaatcag

SEQ ID NO: 301059 - DNA, 30 bp, Artificial Sequence
  Description of Artificial Sequence: Synthetic oligonucleotide
tgtcgcagtggttctggatcccaatcagag

SEQ ID NO: 301060 - DNA, 29 bp, Artificial Sequence
  Description of Artificial Sequence: Synthetic oligonucleotide
gtcgcagtggttctggatcccaatcagag

SEQ ID NO: 301061 - DNA, 30 bp, Artificial Sequence
  Description of Artificial Sequence: Synthetic oligonucleotide
tcgcagtggttctggatcccaatcagagtg

SEQ ID NO: 301062 - DNA, 29 bp, Artificial Sequence
  Description of Artificial Sequence: Synthetic oligonucleotide
cgcagtggttctggatcccaatcagagtg

SEQ ID NO: 301063 - DNA, 34 bp, Artificial Sequence
  Description of Artificial Sequence: Synthetic oligonucleotide
gcagtggttctggatcccaatcagagtgttaaag

SEQ ID NO: 301064 - DNA, 34 bp, Artificial Sequence
  Description of Artificial Sequence: Synthetic oligonucleotide
cagtggttctggatcccaatcagagtgttaaagg

SEQ ID NO: 301065 - DNA, 37 bp, Artificial Sequence
  Description of Artificial Sequence: Synthetic oligonucleotide
agtggttctggatcccaatcagagtgttaaaggaaag

SEQ ID NO: 301066 - DNA, 36 bp, Artificial Sequence
  Description of Artificial Sequence: Synthetic oligonucleotide
gtggttctggatcccaatcagagtgttaaaggaaag

SEQ ID NO: 301067 - DNA, 36 bp, Artificial Sequence
  Description of Artificial Sequence: Synthetic oligonucleotide
tggttctggatcccaatcagagtgttaaaggaaagc

SEQ ID NO: 301068 - DNA, 35 bp, Artificial Sequence
  Description of Artificial Sequence: Synthetic oligonucleotide
ggttctggatcccaatcagagtgttaaaggaaagc

SEQ ID NO: 301069 - DNA, 37 bp, Artificial Sequence
  Description of Artificial Sequence: Synthetic oligonucleotide
gttctggatcccaatcagagtgttaaaggaaagcttg

SEQ ID NO: 301070 - DNA, 42 bp, Artificial Sequence
  Description of Artificial Sequence: Synthetic oligonucleotide
ttctggatcccaatcagagtgttaaaggaaagcttgttattg

SEQ ID NO: 301071 - DNA, 41 bp, Artificial Sequence
  Description of Artificial Sequence: Synthetic oligonucleotide
tctggatcccaatcagagtgttaaaggaaagcttgttattg

SEQ ID NO: 301072 - DNA, 40 bp, Artificial Sequence
  Description of Artificial Sequence: Synthetic oligonucleotide
ctggatcccaatcagagtgttaaaggaaagcttgttattg

SEQ ID NO: 301073 - DNA, 42 bp, Artificial Sequence
  Description of Artificial Sequence: Synthetic oligonucleotide
tggatcccaatcagagtgttaaaggaaagcttgttattgttg

SEQ ID NO: 301074 - DNA, 41 bp, Artificial Sequence
  Description of Artificial Sequence: Synthetic oligonucleotide
ggatcccaatcagagtgttaaaggaaagcttgttattgttg

SEQ ID NO: 301075 - DNA, 41 bp, Artificial Sequence
  Description of Artificial Sequence: Synthetic oligonucleotide
gatcccaatcagagtgttaaaggaaagcttgttattgttgc

SEQ ID NO: 301076 - DNA, 41 bp, Artificial Sequence
  Description of Artificial Sequence: Synthetic oligonucleotide
atcccaatcagagtgttaaaggaaagcttgttattgttgcc

SEQ ID NO: 301077 - DNA, 40 bp, Artificial Sequence
  Description of Artificial Sequence: Synthetic oligonucleotide
tcccaatcagagtgttaaaggaaagcttgttattgttgcc

SEQ ID NO: 301078 - DNA, 39 bp, Artificial Sequence
  Description of Artificial Sequence: Synthetic oligonucleotide
cccaatcagagtgttaaaggaaagcttgttattgttgcc

SEQ ID NO: 301079 - DNA, 41 bp, Artificial Sequence
  Description of Artificial Sequence: Synthetic oligonucleotide
ccaatcagagtgttaaaggaaagcttgttattgttgccttc

SEQ ID NO: 301080 - DNA, 42 bp, Artificial Sequence
  Description of Artificial Sequence: Synthetic oligonucleotide
caatcagagtgttaaaggaaagcttgttattgttgccttcag

SEQ ID NO: 301081 - DNA, 45 bp, Artificial Sequence
  Description of Artificial Sequence: Synthetic oligonucleotide
aatcagagtgttaaaggaaagcttgttattgttgccttcagtttg

SEQ ID NO: 301082 - DNA, 44 bp, Artificial Sequence
  Description of Artificial Sequence: Synthetic oligonucleotide
atcagagtgttaaaggaaagcttgttattgttgccttcagtttg

SEQ ID NO: 301083 - DNA, 43 bp, Artificial Sequence
  Description of Artificial Sequence: Synthetic oligonucleotide
tcagagtgttaaaggaaagcttgttattgttgccttcagtttg

SEQ ID NO: 301084 - DNA, 42 bp, Artificial Sequence
  Description of Artificial Sequence: Synthetic oligonucleotide
cagagtgttaaaggaaagcttgttattgttgccttcagtttg

SEQ ID NO: 301085 - DNA, 44 bp, Artificial Sequence
  Description of Artificial Sequence: Synthetic oligonucleotide
agagtgttaaaggaaagcttgttattgttgccttcagtttgatc

SEQ ID NO: 301086 - DNA, 43 bp, Artificial Sequence
  Description of Artificial Sequence: Synthetic oligonucleotide
gagtgttaaaggaaagcttgttattgttgccttcagtttgatc

SEQ ID NO: 301087 - DNA, 46 bp, Artificial Sequence
  Description of Artificial Sequence: Synthetic oligonucleotide
agtgttaaaggaaagcttgttattgttgccttcagtttgatcaatc

SEQ ID NO: 301088 - DNA, 45 bp, Artificial Sequence
  Description of Artificial Sequence: Synthetic oligonucleotide
gtgttaaaggaaagcttgttattgttgccttcagtttgatcaatc

SEQ ID NO: 301089 - DNA, 45 bp, Artificial Sequence
  Description of Artificial Sequence: Synthetic oligonucleotide
tgttaaaggaaagcttgttattgttgccttcagtttgatcaatcc

SEQ ID NO: 301090 - DNA, 44 bp, Artificial Sequence
  Description of Artificial Sequence: Synthetic oligonucleotide
gttaaaggaaagcttgttattgttgccttcagtttgatcaatcc

SEQ ID NO: 301091 - DNA, 50 bp, Artificial Sequence
  Description of Artificial Sequence: Synthetic oligonucleotide
ttaaaggaaagcttgttattgttgccttcagtttgatcaatcctaatatg

SEQ ID NO: 301092 - DNA, 49 bp, Artificial Sequence
  Description of Artificial Sequence: Synthetic oligonucleotide
taaaggaaagcttgttattgttgccttcagtttgatcaatcctaatatg

SEQ ID NO: 301093 - DNA, 48 bp, Artificial Sequence
  Description of Artificial Sequence: Synthetic oligonucleotide
aaaggaaagcttgttattgttgccttcagtttgatcaatcctaatatg

SEQ ID NO: 301094 - DNA, 47 bp, Artificial Sequence
  Description of Artificial Sequence: Synthetic oligonucleotide
aaggaaagcttgttattgttgccttcagtttgatcaatcctaatatg

SEQ ID NO: 301095 - DNA, 46 bp, Artificial Sequence
  Description of Artificial Sequence: Synthetic oligonucleotide
aggaaagcttgttattgttgccttcagtttgatcaatcctaatatg

SEQ ID NO: 301096 - DNA, 45 bp, Artificial Sequence
  Description of Artificial Sequence: Synthetic oligonucleotide
ggaaagcttgttattgttgccttcagtttgatcaatcctaatatg

SEQ ID NO: 301097 - DNA, 47 bp, Artificial Sequence
  Description of Artificial Sequence: Synthetic oligonucleotide
gaaagcttgttattgttgccttcagtttgatcaatcctaatatgaag

SEQ ID NO: 301098 - DNA, 47 bp, Artificial Sequence
  Description of Artificial Sequence: Synthetic oligonucleotide
aaagcttgttattgttgccttcagtttgatcaatcctaatatgaagg

SEQ ID NO: 301099 - DNA, 46 bp, Artificial Sequence
  Description of Artificial Sequence: Synthetic oligonucleotide
aagcttgttattgttgccttcagtttgatcaatcctaatatgaagg

SEQ ID NO: 301100 - DNA, 45 bp, Artificial Sequence
  Description of Artificial Sequence: Synthetic oligonucleotide
agcttgttattgttgccttcagtttgatcaatcctaatatgaagg

SEQ ID NO: 301101 - DNA, 44 bp, Artificial Sequence
  Description of Artificial Sequence: Synthetic oligonucleotide
gcttgttattgttgccttcagtttgatcaatcctaatatgaagg

SEQ ID NO: 301102 - DNA, 45 bp, Artificial Sequence
  Description of Artificial Sequence: Synthetic oligonucleotide
cttgttattgttgccttcagtttgatcaatcctaatatgaaggtc

SEQ ID NO: 301103 - DNA, 48 bp, Artificial Sequence
  Description of Artificial Sequence: Synthetic oligonucleotide
ttgttattgttgccttcagtttgatcaatcctaatatgaaggtcttag

SEQ ID NO: 301104 - DNA, 47 bp, Artificial Sequence
  Description of Artificial Sequence: Synthetic oligonucleotide
tgttattgttgccttcagtttgatcaatcctaatatgaaggtcttag

SEQ ID NO: 301105 - DNA, 46 bp, Artificial Sequence
  Description of Artificial Sequence: Synthetic oligonucleotide
gttattgttgccttcagtttgatcaatcctaatatgaaggtcttag

SEQ ID NO: 301106 - DNA, 46 bp, Artificial Sequence
  Description of Artificial Sequence: Synthetic oligonucleotide
ttattgttgccttcagtttgatcaatcctaatatgaaggtcttagg

SEQ ID NO: 301107 - DNA, 45 bp, Artificial Sequence
  Description of Artificial Sequence: Synthetic oligonucleotide
tattgttgccttcagtttgatcaatcctaatatgaaggtcttagg

SEQ ID NO: 301108 - DNA, 44 bp, Artificial Sequence
  Description of Artificial Sequence: Synthetic oligonucleotide
attgttgccttcagtttgatcaatcctaatatgaaggtcttagg

SEQ ID NO: 301109 - DNA, 43 bp, Artificial Sequence
  Description of Artificial Sequence: Synthetic oligonucleotide
ttgttgccttcagtttgatcaatcctaatatgaaggtcttagg

SEQ ID NO: 301110 - DNA, 42 bp, Artificial Sequence
  Description of Artificial Sequence: Synthetic oligonucleotide
tgttgccttcagtttgatcaatcctaatatgaaggtcttagg

SEQ ID NO: 301111 - DNA, 41 bp, Artificial Sequence
  Description of Artificial Sequence: Synthetic oligonucleotide
gttgccttcagtttgatcaatcctaatatgaaggtcttagg

SEQ ID NO: 301112 - DNA, 42 bp, Artificial Sequence
  Description of Artificial Sequence: Synthetic oligonucleotide
ttgccttcagtttgatcaatcctaatatgaaggtcttaggtc

SEQ ID NO: 301113 - DNA, 41 bp, Artificial Sequence
  Description of Artificial Sequence: Synthetic oligonucleotide
tgccttcagtttgatcaatcctaatatgaaggtcttaggtc

SEQ ID NO: 301114 - DNA, 40 bp, Artificial Sequence
  Description of Artificial Sequence: Synthetic oligonucleotide
gccttcagtttgatcaatcctaatatgaaggtcttaggtc

SEQ ID NO: 301115 - DNA, 42 bp, Artificial Sequence
  Description of Artificial Sequence: Synthetic oligonucleotide
ccttcagtttgatcaatcctaatatgaaggtcttaggtcatg

SEQ ID NO: 301116 - DNA, 44 bp, Artificial Sequence
  Description of Artificial Sequence: Synthetic oligonucleotide
cttcagtttgatcaatcctaatatgaaggtcttaggtcatgaac

SEQ ID NO: 301117 - DNA, 44 bp, Artificial Sequence
  Description of Artificial Sequence: Synthetic oligonucleotide
ttcagtttgatcaatcctaatatgaaggtcttaggtcatgaacc

SEQ ID NO: 301118 - DNA, 43 bp, Artificial Sequence
  Description of Artificial Sequence: Synthetic oligonucleotide
tcagtttgatcaatcctaatatgaaggtcttaggtcatgaacc

SEQ ID NO: 301119 - DNA, 42 bp, Artificial Sequence
  Description of Artificial Sequence: Synthetic oligonucleotide
cagtttgatcaatcctaatatgaaggtcttaggtcatgaacc

SEQ ID NO: 301120 - DNA, 44 bp, Artificial Sequence
  Description of Artificial Sequence: Synthetic oligonucleotide
agtttgatcaatcctaatatgaaggtcttaggtcatgaaccatg

SEQ ID NO: 301121 - DNA, 43 bp, Artificial Sequence
  Description of Artificial Sequence: Synthetic oligonucleotide
gtttgatcaatcctaatatgaaggtcttaggtcatgaaccatg

SEQ ID NO: 301122 - DNA, 44 bp, Artificial Sequence
  Description of Artificial Sequence: Synthetic oligonucleotide
tttgatcaatcctaatatgaaggtcttaggtcatgaaccatgac

SEQ ID NO: 301123 - DNA, 43 bp, Artificial Sequence
  Description of Artificial Sequence: Synthetic oligonucleotide
ttgatcaatcctaatatgaaggtcttaggtcatgaaccatgac

SEQ ID NO: 301124 - DNA, 42 bp, Artificial Sequence
  Description of Artificial Sequence: Synthetic oligonucleotide
tgatcaatcctaatatgaaggtcttaggtcatgaaccatgac

SEQ ID NO: 301125 - DNA, 41 bp, Artificial Sequence
  Description of Artificial Sequence: Synthetic oligonucleotide
gatcaatcctaatatgaaggtcttaggtcatgaaccatgac

SEQ ID NO: 301126 - DNA, 44 bp, Artificial Sequence
  Description of Artificial Sequence: Synthetic oligonucleotide
atcaatcctaatatgaaggtcttaggtcatgaaccatgacaaac

SEQ ID NO: 301127 - DNA, 43 bp, Artificial Sequence
  Description of Artificial Sequence: Synthetic oligonucleotide
tcaatcctaatatgaaggtcttaggtcatgaaccatgacaaac

SEQ ID NO: 301128 - DNA, 42 bp, Artificial Sequence
  Description of Artificial Sequence: Synthetic oligonucleotide
caatcctaatatgaaggtcttaggtcatgaaccatgacaaac

SEQ ID NO: 301129 - DNA, 44 bp, Artificial Sequence
  Description of Artificial Sequence: Synthetic oligonucleotide
aatcctaatatgaaggtcttaggtcatgaaccatgacaaacaag

SEQ ID NO: 301130 - DNA, 43 bp, Artificial Sequence
  Description of Artificial Sequence: Synthetic oligonucleotide
atcctaatatgaaggtcttaggtcatgaaccatgacaaacaag

SEQ ID NO: 301131 - DNA, 42 bp, Artificial Sequence
  Description of Artificial Sequence: Synthetic oligonucleotide
tcctaatatgaaggtcttaggtcatgaaccatgacaaacaag

SEQ ID NO: 301132 - DNA, 41 bp, Artificial Sequence
  Description of Artificial Sequence: Synthetic oligonucleotide
cctaatatgaaggtcttaggtcatgaaccatgacaaacaag

SEQ ID NO: 301133 - DNA, 43 bp, Artificial Sequence
  Description of Artificial Sequence: Synthetic oligonucleotide
ctaatatgaaggtcttaggtcatgaaccatgacaaacaagttc

SEQ ID NO: 301134 - DNA, 43 bp, Artificial Sequence
  Description of Artificial Sequence: Synthetic oligonucleotide
taatatgaaggtcttaggtcatgaaccatgacaaacaagttcg

SEQ ID NO: 301135 - DNA, 42 bp, Artificial Sequence
  Description of Artificial Sequence: Synthetic oligonucleotide
aatatgaaggtcttaggtcatgaaccatgacaaacaagttcg

SEQ ID NO: 301136 - DNA, 41 bp, Artificial Sequence
  Description of Artificial Sequence: Synthetic oligonucleotide
atatgaaggtcttaggtcatgaaccatgacaaacaagttcg

SEQ ID NO: 301137 - DNA, 40 bp, Artificial Sequence
  Description of Artificial Sequence: Synthetic oligonucleotide
tatgaaggtcttaggtcatgaaccatgacaaacaagttcg

SEQ ID NO: 301138 - DNA, 39 bp, Artificial Sequence
  Description of Artificial Sequence: Synthetic oligonucleotide
atgaaggtcttaggtcatgaaccatgacaaacaagttcg

SEQ ID NO: 301139 - DNA, 38 bp, Artificial Sequence
  Description of Artificial Sequence: Synthetic oligonucleotide
tgaaggtcttaggtcatgaaccatgacaaacaagttcg

SEQ ID NO: 301140 - DNA, 37 bp, Artificial Sequence
  Description of Artificial Sequence: Synthetic oligonucleotide
gaaggtcttaggtcatgaaccatgacaaacaagttcg

SEQ ID NO: 301141 - DNA, 40 bp, Artificial Sequence
  Description of Artificial Sequence: Synthetic oligonucleotide
aaggtcttaggtcatgaaccatgacaaacaagttcgaatc

SEQ ID NO: 301142 - DNA, 39 bp, Artificial Sequence
  Description of Artificial Sequence: Synthetic oligonucleotide
aggtcttaggtcatgaaccatgacaaacaagttcgaatc

SEQ ID NO: 301143 - DNA, 38 bp, Artificial Sequence
  Description of Artificial Sequence: Synthetic oligonucleotide
ggtcttaggtcatgaaccatgacaaacaagttcgaatc

SEQ ID NO: 301144 - DNA, 39 bp, Artificial Sequence
  Description of Artificial Sequence: Synthetic oligonucleotide
gtcttaggtcatgaaccatgacaaacaagttcgaatctc

SEQ ID NO: 301145 - DNA, 39 bp, Artificial Sequence
  Description of Artificial Sequence: Synthetic oligonucleotide
tcttaggtcatgaaccatgacaaacaagttcgaatctcg

SEQ ID NO: 301146 - DNA, 38 bp, Artificial Sequence
  Description of Artificial Sequence: Synthetic oligonucleotide
cttaggtcatgaaccatgacaaacaagttcgaatctcg

SEQ ID NO: 301147 - DNA, 38 bp, Artificial Sequence
  Description of Artificial Sequence: Synthetic oligonucleotide
ttaggtcatgaaccatgacaaacaagttcgaatctcgg

SEQ ID NO: 301148 - DNA, 37 bp, Artificial Sequence
  Description of Artificial Sequence: Synthetic oligonucleotide
taggtcatgaaccatgacaaacaagttcgaatctcgg

SEQ ID NO: 301149 - DNA, 36 bp, Artificial Sequence
  Description of Artificial Sequence: Synthetic oligonucleotide
aggtcatgaaccatgacaaacaagttcgaatctcgg

SEQ ID NO: 301150 - DNA, 35 bp, Artificial Sequence
  Description of Artificial Sequence: Synthetic oligonucleotide
ggtcatgaaccatgacaaacaagttcgaatctcgg

SEQ ID NO: 301151 - DNA, 36 bp, Artificial Sequence
  Description of Artificial Sequence: Synthetic oligonucleotide
gtcatgaaccatgacaaacaagttcgaatctcggtc

SEQ ID NO: 301152 - DNA, 37 bp, Artificial Sequence
  Description of Artificial Sequence: Synthetic oligonucleotide
tcatgaaccatgacaaacaagttcgaatctcggtcac

SEQ ID NO: 301153 - DNA, 36 bp, Artificial Sequence
  Description of Artificial Sequence: Synthetic oligonucleotide
catgaaccatgacaaacaagttcgaatctcggtcac

SEQ ID NO: 301154 - DNA, 41 bp, Artificial Sequence
  Description of Artificial Sequence: Synthetic oligonucleotide
atgaaccatgacaaacaagttcgaatctcggtcacttatac

SEQ ID NO: 301155 - DNA, 40 bp, Artificial Sequence
  Description of Artificial Sequence: Synthetic oligonucleotide
tgaaccatgacaaacaagttcgaatctcggtcacttatac

SEQ ID NO: 301156 - DNA, 39 bp, Artificial Sequence
  Description of Artificial Sequence: Synthetic oligonucleotide
gaaccatgacaaacaagttcgaatctcggtcacttatac

SEQ ID NO: 301157 - DNA, 41 bp, Artificial Sequence
  Description of Artificial Sequence: Synthetic oligonucleotide
aaccatgacaaacaagttcgaatctcggtcacttatacaag

SEQ ID NO: 301158 - DNA, 40 bp, Artificial Sequence
  Description of Artificial Sequence: Synthetic oligonucleotide
accatgacaaacaagttcgaatctcggtcacttatacaag

SEQ ID NO: 301159 - DNA, 39 bp, Artificial Sequence
  Description of Artificial Sequence: Synthetic oligonucleotide
ccatgacaaacaagttcgaatctcggtcacttatacaag

SEQ ID NO: 301160 - DNA, 39 bp, Artificial Sequence
  Description of Artificial Sequence: Synthetic oligonucleotide
catgacaaacaagttcgaatctcggtcacttatacaagc

SEQ ID NO: 301161 - DNA, 39 bp, Artificial Sequence
  Description of Artificial Sequence: Synthetic oligonucleotide
atgacaaacaagttcgaatctcggtcacttatacaagcc

SEQ ID NO: 301162 - DNA, 38 bp, Artificial Sequence
  Description of Artificial Sequence: Synthetic oligonucleotide
tgacaaacaagttcgaatctcggtcacttatacaagcc

SEQ ID NO: 301163 - DNA, 37 bp, Artificial Sequence
  Description of Artificial Sequence: Synthetic oligonucleotide
gacaaacaagttcgaatctcggtcacttatacaagcc

SEQ ID NO: 301164 - DNA, 39 bp, Artificial Sequence
  Description of Artificial Sequence: Synthetic oligonucleotide
acaaacaagttcgaatctcggtcacttatacaagccatg

SEQ ID NO: 301165 - DNA, 38 bp, Artificial Sequence
  Description of Artificial Sequence: Synthetic oligonucleotide
caaacaagttcgaatctcggtcacttatacaagccatg

SEQ ID NO: 301166 - DNA, 41 bp, Artificial Sequence
  Description of Artificial Sequence: Synthetic oligonucleotide
aaacaagttcgaatctcggtcacttatacaagccatgtatc

SEQ ID NO: 301167 - DNA, 40 bp, Artificial Sequence
  Description of Artificial Sequence: Synthetic oligonucleotide
aacaagttcgaatctcggtcacttatacaagccatgtatc

SEQ ID NO: 301168 - DNA, 39 bp, Artificial Sequence
  Description of Artificial Sequence: Synthetic oligonucleotide
acaagttcgaatctcggtcacttatacaagccatgtatc

SEQ ID NO: 301169 - DNA, 38 bp, Artificial Sequence
  Description of Artificial Sequence: Synthetic oligonucleotide
caagttcgaatctcggtcacttatacaagccatgtatc

SEQ ID NO: 301170 - DNA, 38 bp, Artificial Sequence
  Description of Artificial Sequence: Synthetic oligonucleotide
aagttcgaatctcggtcacttatacaagccatgtatcc

SEQ ID NO: 301171 - DNA, 37 bp, Artificial Sequence
  Description of Artificial Sequence: Synthetic oligonucleotide
agttcgaatctcggtcacttatacaagccatgtatcc

SEQ ID NO: 301172 - DNA, 36 bp, Artificial Sequence
  Description of Artificial Sequence: Synthetic oligonucleotide
gttcgaatctcggtcacttatacaagccatgtatcc

SEQ ID NO: 301173 - DNA, 37 bp, Artificial Sequence
  Description of Artificial Sequence: Synthetic oligonucleotide
ttcgaatctcggtcacttatacaagccatgtatccag

SEQ ID NO: 301174 - DNA, 36 bp, Artificial Sequence
  Description of Artificial Sequence: Synthetic oligonucleotide
tcgaatctcggtcacttatacaagccatgtatccag

SEQ ID NO: 301175 - DNA, 35 bp, Artificial Sequence
  Description of Artificial Sequence: Synthetic oligonucleotide
cgaatctcggtcacttatacaagccatgtatccag

SEQ ID NO: 301176 - DNA, 35 bp, Artificial Sequence
  Description of Artificial Sequence: Synthetic oligonucleotide
gaatctcggtcacttatacaagccatgtatccagg

SEQ ID NO: 301177 - DNA, 35 bp, Artificial Sequence
  Description of Artificial Sequence: Synthetic oligonucleotide
aatctcggtcacttatacaagccatgtatccaggc

SEQ ID NO: 301178 - DNA, 34 bp, Artificial Sequence
  Description of Artificial Sequence: Synthetic oligonucleotide
atctcggtcacttatacaagccatgtatccaggc

SEQ ID NO: 301179 - DNA, 33 bp, Artificial Sequence
  Description of Artificial Sequence: Synthetic oligonucleotide
tctcggtcacttatacaagccatgtatccaggc

SEQ ID NO: 301180 - DNA, 32 bp, Artificial Sequence
  Description of Artificial Sequence: Synthetic oligonucleotide
ctcggtcacttatacaagccatgtatccaggc

SEQ ID NO: 301181 - DNA, 39 bp, Artificial Sequence
  Description of Artificial Sequence: Synthetic oligonucleotide
tcggtcacttatacaagccatgtatccaggctttaattc

SEQ ID NO: 301182 - DNA, 38 bp, Artificial Sequence
  Description of Artificial Sequence: Synthetic oligonucleotide
cggtcacttatacaagccatgtatccaggctttaattc

SEQ ID NO: 301183 - DNA, 40 bp, Artificial Sequence
  Description of Artificial Sequence: Synthetic oligonucleotide
ggtcacttatacaagccatgtatccaggctttaattcatc

SEQ ID NO: 301184 - DNA, 40 bp, Artificial Sequence
  Description of Artificial Sequence: Synthetic oligonucleotide
gtcacttatacaagccatgtatccaggctttaattcatcg

SEQ ID NO: 301185 - DNA, 41 bp, Artificial Sequence
  Description of Artificial Sequence: Synthetic oligonucleotide
tcacttatacaagccatgtatccaggctttaattcatcgac

SEQ ID NO: 301186 - DNA, 40 bp, Artificial Sequence
  Description of Artificial Sequence: Synthetic oligonucleotide
cacttatacaagccatgtatccaggctttaattcatcgac

SEQ ID NO: 301187 - DNA, 44 bp, Artificial Sequence
  Description of Artificial Sequence: Synthetic oligonucleotide
acttatacaagccatgtatccaggctttaattcatcgactaaac

SEQ ID NO: 301188 - DNA, 43 bp, Artificial Sequence
  Description of Artificial Sequence: Synthetic oligonucleotide
cttatacaagccatgtatccaggctttaattcatcgactaaac

SEQ ID NO: 301189 - DNA, 44 bp, Artificial Sequence
  Description of Artificial Sequence: Synthetic oligonucleotide
ttatacaagccatgtatccaggctttaattcatcgactaaacac

SEQ ID NO: 301190 - DNA, 43 bp, Artificial Sequence
  Description of Artificial Sequence: Synthetic oligonucleotide
tatacaagccatgtatccaggctttaattcatcgactaaacac

SEQ ID NO: 301191 - DNA, 42 bp, Artificial Sequence
  Description of Artificial Sequence: Synthetic oligonucleotide
atacaagccatgtatccaggctttaattcatcgactaaacac

SEQ ID NO: 301192 - DNA, 41 bp, Artificial Sequence
  Description of Artificial Sequence: Synthetic oligonucleotide
tacaagccatgtatccaggctttaattcatcgactaaacac

SEQ ID NO: 301193 - DNA, 40 bp, Artificial Sequence
  Description of Artificial Sequence: Synthetic oligonucleotide
acaagccatgtatccaggctttaattcatcgactaaacac

SEQ ID NO: 301194 - DNA, 39 bp, Artificial Sequence
  Description of Artificial Sequence: Synthetic oligonucleotide
caagccatgtatccaggctttaattcatcgactaaacac

SEQ ID NO: 301195 - DNA, 40 bp, Artificial Sequence
  Description of Artificial Sequence: Synthetic oligonucleotide
aagccatgtatccaggctttaattcatcgactaaacacac

SEQ ID NO: 301196 - DNA, 39 bp, Artificial Sequence
  Description of Artificial Sequence: Synthetic oligonucleotide
agccatgtatccaggctttaattcatcgactaaacacac

SEQ ID NO: 301197 - DNA, 38 bp, Artificial Sequence
  Description of Artificial Sequence: Synthetic oligonucleotide
gccatgtatccaggctttaattcatcgactaaacacac

SEQ ID NO: 301198 - DNA, 45 bp, Artificial Sequence
  Description of Artificial Sequence: Synthetic oligonucleotide
ccatgtatccaggctttaattcatcgactaaacacacattattag

SEQ ID NO: 301199 - DNA, 46 bp, Artificial Sequence
  Description of Artificial Sequence: Synthetic oligonucleotide
catgtatccaggctttaattcatcgactaaacacacattattagtc

SEQ ID NO: 301200 - DNA, 46 bp, Artificial Sequence
  Description of Artificial Sequence: Synthetic oligonucleotide
atgtatccaggctttaattcatcgactaaacacacattattagtcc

SEQ ID NO: 301201 - DNA, 45 bp, Artificial Sequence
  Description of Artificial Sequence: Synthetic oligonucleotide
tgtatccaggctttaattcatcgactaaacacacattattagtcc

SEQ ID NO: 301202 - DNA, 44 bp, Artificial Sequence
  Description of Artificial Sequence: Synthetic oligonucleotide
gtatccaggctttaattcatcgactaaacacacattattagtcc

SEQ ID NO: 301203 - DNA, 48 bp, Artificial Sequence
  Description of Artificial Sequence: Synthetic oligonucleotide
tatccaggctttaattcatcgactaaacacacattattagtccattac

SEQ ID NO: 301204 - DNA, 47 bp, Artificial Sequence
  Description of Artificial Sequence: Synthetic oligonucleotide
atccaggctttaattcatcgactaaacacacattattagtccattac

SEQ ID NO: 301205 - DNA, 46 bp, Artificial Sequence
  Description of Artificial Sequence: Synthetic oligonucleotide
tccaggctttaattcatcgactaaacacacattattagtccattac

SEQ ID NO: 301206 - DNA, 45 bp, Artificial Sequence
  Description of Artificial Sequence: Synthetic oligonucleotide
ccaggctttaattcatcgactaaacacacattattagtccattac

SEQ ID NO: 301207 - DNA, 51 bp, Artificial Sequence
  Description of Artificial Sequence: Synthetic oligonucleotide
caggctttaattcatcgactaaacacacattattagtccattacttttaac

SEQ ID NO: 301208 - DNA, 54 bp, Artificial Sequence
  Description of Artificial Sequence: Synthetic oligonucleotide
aggctttaattcatcgactaaacacacattattagtccattacttttaactatc

SEQ ID NO: 301209 - DNA, 53 bp, Artificial Sequence
  Description of Artificial Sequence: Synthetic oligonucleotide
ggctttaattcatcgactaaacacacattattagtccattacttttaactatc

SEQ ID NO: 301210 - DNA, 53 bp, Artificial Sequence
  Description of Artificial Sequence: Synthetic oligonucleotide
gctttaattcatcgactaaacacacattattagtccattacttttaactatcc

SEQ ID NO: 301211 - DNA, 53 bp, Artificial Sequence
  Description of Artificial Sequence: Synthetic oligonucleotide
ctttaattcatcgactaaacacacattattagtccattacttttaactatccg

SEQ ID NO: 301212 - DNA, 59 bp, Artificial Sequence
  Description of Artificial Sequence: Synthetic oligonucleotide
tttaattcatcgactaaacacacattattagtccattacttttaactatccgaaaaatg

SEQ ID NO: 301213 - DNA, 58 bp, Artificial Sequence
  Description of Artificial Sequence: Synthetic oligonucleotide
ttaattcatcgactaaacacacattattagtccattacttttaactatccgaaaaatg

SEQ ID NO: 301214 - DNA, 57 bp, Artificial Sequence
  Description of Artificial Sequence: Synthetic oligonucleotide
taattcatcgactaaacacacattattagtccattacttttaactatccgaaaaatg

SEQ ID NO: 301215 - DNA, 56 bp, Artificial Sequence
  Description of Artificial Sequence: Synthetic oligonucleotide
aattcatcgactaaacacacattattagtccattacttttaactatccgaaaaatg

SEQ ID NO: 301216 - DNA, 55 bp, Artificial Sequence
  Description of Artificial Sequence: Synthetic oligonucleotide
attcatcgactaaacacacattattagtccattacttttaactatccgaaaaatg

SEQ ID NO: 301217 - DNA, 54 bp, Artificial Sequence
  Description of Artificial Sequence: Synthetic oligonucleotide
ttcatcgactaaacacacattattagtccattacttttaactatccgaaaaatg

SEQ ID NO: 301218 - DNA, 53 bp, Artificial Sequence
  Description of Artificial Sequence: Synthetic oligonucleotide
tcatcgactaaacacacattattagtccattacttttaactatccgaaaaatg

SEQ ID NO: 301219 - DNA, 52 bp, Artificial Sequence
  Description of Artificial Sequence: Synthetic oligonucleotide
catcgactaaacacacattattagtccattacttttaactatccgaaaaatg

SEQ ID NO: 301220 - DNA, 54 bp, Artificial Sequence
  Description of Artificial Sequence: Synthetic oligonucleotide
atcgactaaacacacattattagtccattacttttaactatccgaaaaatgatc

SEQ ID NO: 301221 - DNA, 53 bp, Artificial Sequence
  Description of Artificial Sequence: Synthetic oligonucleotide
tcgactaaacacacattattagtccattacttttaactatccgaaaaatgatc

SEQ ID NO: 301222 - DNA, 52 bp, Artificial Sequence
  Description of Artificial Sequence: Synthetic oligonucleotide
cgactaaacacacattattagtccattacttttaactatccgaaaaatgatc

SEQ ID NO: 301223 - DNA, 53 bp, Artificial Sequence
  Description of Artificial Sequence: Synthetic oligonucleotide
gactaaacacacattattagtccattacttttaactatccgaaaaatgatctg

SEQ ID NO: 301224 - DNA, 53 bp, Artificial Sequence
  Description of Artificial Sequence: Synthetic oligonucleotide
actaaacacacattattagtccattacttttaactatccgaaaaatgatctgg

SEQ ID NO: 301225 - DNA, 52 bp, Artificial Sequence
  Description of Artificial Sequence: Synthetic oligonucleotide
ctaaacacacattattagtccattacttttaactatccgaaaaatgatctgg

SEQ ID NO: 301226 - DNA, 54 bp, Artificial Sequence
  Description of Artificial Sequence: Synthetic oligonucleotide
taaacacacattattagtccattacttttaactatccgaaaaatgatctggaac

SEQ ID NO: 301227 - DNA, 53 bp, Artificial Sequence
  Description of Artificial Sequence: Synthetic oligonucleotide
aaacacacattattagtccattacttttaactatccgaaaaatgatctggaac

SEQ ID NO: 301228 - DNA, 52 bp, Artificial Sequence
  Description of Artificial Sequence: Synthetic oligonucleotide
aacacacattattagtccattacttttaactatccgaaaaatgatctggaac

SEQ ID NO: 301229 - DNA, 51 bp, Artificial Sequence
  Description of Artificial Sequence: Synthetic oligonucleotide
acacacattattagtccattacttttaactatccgaaaaatgatctggaac

SEQ ID NO: 301230 - DNA, 50 bp, Artificial Sequence
  Description of Artificial Sequence: Synthetic oligonucleotide
cacacattattagtccattacttttaactatccgaaaaatgatctggaac

SEQ ID NO: 301231 - DNA, 51 bp, Artificial Sequence
  Description of Artificial Sequence: Synthetic oligonucleotide
acacattattagtccattacttttaactatccgaaaaatgatctggaacag

SEQ ID NO: 301232 - DNA, 50 bp, Artificial Sequence
  Description of Artificial Sequence: Synthetic oligonucleotide
cacattattagtccattacttttaactatccgaaaaatgatctggaacag

SEQ ID NO: 301233 - DNA, 52 bp, Artificial Sequence
  Description of Artificial Sequence: Synthetic oligonucleotide
acattattagtccattacttttaactatccgaaaaatgatctggaacagtag

SEQ ID NO: 301234 - DNA, 51 bp, Artificial Sequence
  Description of Artificial Sequence: Synthetic oligonucleotide
cattattagtccattacttttaactatccgaaaaatgatctggaacagtag

SEQ ID NO: 301235 - DNA, 53 bp, Artificial Sequence
  Description of Artificial Sequence: Synthetic oligonucleotide
attattagtccattacttttaactatccgaaaaatgatctggaacagtagatg

SEQ ID NO: 301236 - DNA, 52 bp, Artificial Sequence
  Description of Artificial Sequence: Synthetic oligonucleotide
ttattagtccattacttttaactatccgaaaaatgatctggaacagtagatg

SEQ ID NO: 301237 - DNA, 51 bp, Artificial Sequence
  Description of Artificial Sequence: Synthetic oligonucleotide
tattagtccattacttttaactatccgaaaaatgatctggaacagtagatg

SEQ ID NO: 301238 - DNA, 50 bp, Artificial Sequence
  Description of Artificial Sequence: Synthetic oligonucleotide
attagtccattacttttaactatccgaaaaatgatctggaacagtagatg

SEQ ID NO: 301239 - DNA, 49 bp, Artificial Sequence
  Description of Artificial Sequence: Synthetic oligonucleotide
ttagtccattacttttaactatccgaaaaatgatctggaacagtagatg

SEQ ID NO: 301240 - DNA, 48 bp, Artificial Sequence
  Description of Artificial Sequence: Synthetic oligonucleotide
tagtccattacttttaactatccgaaaaatgatctggaacagtagatg

SEQ ID NO: 301241 - DNA, 47 bp, Artificial Sequence
  Description of Artificial Sequence: Synthetic oligonucleotide
agtccattacttttaactatccgaaaaatgatctggaacagtagatg

SEQ ID NO: 301242 - DNA, 46 bp, Artificial Sequence
  Description of Artificial Sequence: Synthetic oligonucleotide
gtccattacttttaactatccgaaaaatgatctggaacagtagatg

SEQ ID NO: 301243 - DNA, 48 bp, Artificial Sequence
  Description of Artificial Sequence: Synthetic oligonucleotide
tccattacttttaactatccgaaaaatgatctggaacagtagatgttg

SEQ ID NO: 301244 - DNA, 47 bp, Artificial Sequence
  Description of Artificial Sequence: Synthetic oligonucleotide
ccattacttttaactatccgaaaaatgatctggaacagtagatgttg

SEQ ID NO: 301245 - DNA, 47 bp, Artificial Sequence
  Description of Artificial Sequence: Synthetic oligonucleotide
cattacttttaactatccgaaaaatgatctggaacagtagatgttgc

SEQ ID NO: 301246 - DNA, 54 bp, Artificial Sequence
  Description of Artificial Sequence: Synthetic oligonucleotide
attacttttaactatccgaaaaatgatctggaacagtagatgttgcaaaatttg

SEQ ID NO: 301247 - DNA, 53 bp, Artificial Sequence
  Description of Artificial Sequence: Synthetic oligonucleotide
ttacttttaactatccgaaaaatgatctggaacagtagatgttgcaaaatttg

SEQ ID NO: 301248 - DNA, 52 bp, Artificial Sequence
  Description of Artificial Sequence: Synthetic oligonucleotide
tacttttaactatccgaaaaatgatctggaacagtagatgttgcaaaatttg

SEQ ID NO: 301249 - DNA, 51 bp, Artificial Sequence
  Description of Artificial Sequence: Synthetic oligonucleotide
acttttaactatccgaaaaatgatctggaacagtagatgttgcaaaatttg

SEQ ID NO: 301250 - DNA, 50 bp, Artificial Sequence
  Description of Artificial Sequence: Synthetic oligonucleotide
cttttaactatccgaaaaatgatctggaacagtagatgttgcaaaatttg

SEQ ID NO: 301251 - DNA, 50 bp, Artificial Sequence
  Description of Artificial Sequence: Synthetic oligonucleotide
ttttaactatccgaaaaatgatctggaacagtagatgttgcaaaatttgc

SEQ ID NO: 301252 - DNA, 49 bp, Artificial Sequence
  Description of Artificial Sequence: Synthetic oligonucleotide
tttaactatccgaaaaatgatctggaacagtagatgttgcaaaatttgc

SEQ ID NO: 301253 - DNA, 48 bp, Artificial Sequence
  Description of Artificial Sequence: Synthetic oligonucleotide
ttaactatccgaaaaatgatctggaacagtagatgttgcaaaatttgc

SEQ ID NO: 301254 - DNA, 47 bp, Artificial Sequence
  Description of Artificial Sequence: Synthetic oligonucleotide
taactatccgaaaaatgatctggaacagtagatgttgcaaaatttgc

SEQ ID NO: 301255 - DNA, 46 bp, Artificial Sequence
  Description of Artificial Sequence: Synthetic oligonucleotide
aactatccgaaaaatgatctggaacagtagatgttgcaaaatttgc

SEQ ID NO: 301256 - DNA, 45 bp, Artificial Sequence
  Description of Artificial Sequence: Synthetic oligonucleotide
actatccgaaaaatgatctggaacagtagatgttgcaaaatttgc

SEQ ID NO: 301257 - DNA, 44 bp, Artificial Sequence
  Description of Artificial Sequence: Synthetic oligonucleotide
ctatccgaaaaatgatctggaacagtagatgttgcaaaatttgc

SEQ ID NO: 301258 - DNA, 48 bp, Artificial Sequence
  Description of Artificial Sequence: Synthetic oligonucleotide
tatccgaaaaatgatctggaacagtagatgttgcaaaatttgcaaaag

SEQ ID NO: 301259 - DNA, 47 bp, Artificial Sequence
  Description of Artificial Sequence: Synthetic oligonucleotide
atccgaaaaatgatctggaacagtagatgttgcaaaatttgcaaaag

SEQ ID NO: 301260 - DNA, 46 bp, Artificial Sequence
  Description of Artificial Sequence: Synthetic oligonucleotide
tccgaaaaatgatctggaacagtagatgttgcaaaatttgcaaaag

SEQ ID NO: 301261 - DNA, 45 bp, Artificial Sequence
  Description of Artificial Sequence: Synthetic oligonucleotide
ccgaaaaatgatctggaacagtagatgttgcaaaatttgcaaaag

SEQ ID NO: 301262 - DNA, 47 bp, Artificial Sequence
  Description of Artificial Sequence: Synthetic oligonucleotide
cgaaaaatgatctggaacagtagatgttgcaaaatttgcaaaagaag

SEQ ID NO: 301263 - DNA, 48 bp, Artificial Sequence
  Description of Artificial Sequence: Synthetic oligonucleotide
gaaaaatgatctggaacagtagatgttgcaaaatttgcaaaagaagag

SEQ ID NO: 301264 - DNA, 50 bp, Artificial Sequence
  Description of Artificial Sequence: Synthetic oligonucleotide
aaaaatgatctggaacagtagatgttgcaaaatttgcaaaagaagagtag

SEQ ID NO: 301265 - DNA, 49 bp, Artificial Sequence
  Description of Artificial Sequence: Synthetic oligonucleotide
aaaatgatctggaacagtagatgttgcaaaatttgcaaaagaagagtag

SEQ ID NO: 301266 - DNA, 48 bp, Artificial Sequence
  Description of Artificial Sequence: Synthetic oligonucleotide
aaatgatctggaacagtagatgttgcaaaatttgcaaaagaagagtag

SEQ ID NO: 301267 - DNA, 47 bp, Artificial Sequence
  Description of Artificial Sequence: Synthetic oligonucleotide
aatgatctggaacagtagatgttgcaaaatttgcaaaagaagagtag

SEQ ID NO: 301268 - DNA, 46 bp, Artificial Sequence
  Description of Artificial Sequence: Synthetic oligonucleotide
atgatctggaacagtagatgttgcaaaatttgcaaaagaagagtag

SEQ ID NO: 301269 - DNA, 45 bp, Artificial Sequence
  Description of Artificial Sequence: Synthetic oligonucleotide
tgatctggaacagtagatgttgcaaaatttgcaaaagaagagtag

SEQ ID NO: 301270 - DNA, 44 bp, Artificial Sequence
  Description of Artificial Sequence: Synthetic oligonucleotide
gatctggaacagtagatgttgcaaaatttgcaaaagaagagtag

SEQ ID NO: 301271 - DNA, 44 bp, Artificial Sequence
  Description of Artificial Sequence: Synthetic oligonucleotide
atctggaacagtagatgttgcaaaatttgcaaaagaagagtagg

SEQ ID NO: 301272 - DNA, 43 bp, Artificial Sequence
  Description of Artificial Sequence: Synthetic oligonucleotide
tctggaacagtagatgttgcaaaatttgcaaaagaagagtagg

SEQ ID NO: 301273 - DNA, 42 bp, Artificial Sequence
  Description of Artificial Sequence: Synthetic oligonucleotide
ctggaacagtagatgttgcaaaatttgcaaaagaagagtagg

SEQ ID NO: 301274 - DNA, 44 bp, Artificial Sequence
  Description of Artificial Sequence: Synthetic oligonucleotide
tggaacagtagatgttgcaaaatttgcaaaagaagagtaggatg

SEQ ID NO: 301275 - DNA, 43 bp, Artificial Sequence
  Description of Artificial Sequence: Synthetic oligonucleotide
ggaacagtagatgttgcaaaatttgcaaaagaagagtaggatg

SEQ ID NO: 301276 - DNA, 43 bp, Artificial Sequence
  Description of Artificial Sequence: Synthetic oligonucleotide
gaacagtagatgttgcaaaatttgcaaaagaagagtaggatgg

SEQ ID NO: 301277 - DNA, 45 bp, Artificial Sequence
  Description of Artificial Sequence: Synthetic oligonucleotide
aacagtagatgttgcaaaatttgcaaaagaagagtaggatggaag

SEQ ID NO: 301278 - DNA, 44 bp, Artificial Sequence
  Description of Artificial Sequence: Synthetic oligonucleotide
acagtagatgttgcaaaatttgcaaaagaagagtaggatggaag

SEQ ID NO: 301279 - DNA, 43 bp, Artificial Sequence
  Description of Artificial Sequence: Synthetic oligonucleotide
cagtagatgttgcaaaatttgcaaaagaagagtaggatggaag

SEQ ID NO: 301280 - DNA, 43 bp, Artificial Sequence
  Description of Artificial Sequence: Synthetic oligonucleotide
agtagatgttgcaaaatttgcaaaagaagagtaggatggaagc

SEQ ID NO: 301281 - DNA, 42 bp, Artificial Sequence
  Description of Artificial Sequence: Synthetic oligonucleotide
gtagatgttgcaaaatttgcaaaagaagagtaggatggaagc

SEQ ID NO: 301282 - DNA, 45 bp, Artificial Sequence
  Description of Artificial Sequence: Synthetic oligonucleotide
tagatgttgcaaaatttgcaaaagaagagtaggatggaagctttg

SEQ ID NO: 301283 - DNA, 44 bp, Artificial Sequence
  Description of Artificial Sequence: Synthetic oligonucleotide
agatgttgcaaaatttgcaaaagaagagtaggatggaagctttg

SEQ ID NO: 301284 - DNA, 43 bp, Artificial Sequence
  Description of Artificial Sequence: Synthetic oligonucleotide
gatgttgcaaaatttgcaaaagaagagtaggatggaagctttg

SEQ ID NO: 301285 - DNA, 44 bp, Artificial Sequence
  Description of Artificial Sequence: Synthetic oligonucleotide
atgttgcaaaatttgcaaaagaagagtaggatggaagctttgac

SEQ ID NO: 301286 - DNA, 43 bp, Artificial Sequence
  Description of Artificial Sequence: Synthetic oligonucleotide
tgttgcaaaatttgcaaaagaagagtaggatggaagctttgac

SEQ ID NO: 301287 - DNA, 42 bp, Artificial Sequence
  Description of Artificial Sequence: Synthetic oligonucleotide
gttgcaaaatttgcaaaagaagagtaggatggaagctttgac

SEQ ID NO: 301288 - DNA, 43 bp, Artificial Sequence
  Description of Artificial Sequence: Synthetic oligonucleotide
ttgcaaaatttgcaaaagaagagtaggatggaagctttgacac

SEQ ID NO: 301289 - DNA, 42 bp, Artificial Sequence
  Description of Artificial Sequence: Synthetic oligonucleotide
tgcaaaatttgcaaaagaagagtaggatggaagctttgacac

SEQ ID NO: 301290 - DNA, 41 bp, Artificial Sequence
  Description of Artificial Sequence: Synthetic oligonucleotide
gcaaaatttgcaaaagaagagtaggatggaagctttgacac

SEQ ID NO: 301291 - DNA, 43 bp, Artificial Sequence
  Description of Artificial Sequence: Synthetic oligonucleotide
caaaatttgcaaaagaagagtaggatggaagctttgacactac

SEQ ID NO: 301292 - DNA, 44 bp, Artificial Sequence
  Description of Artificial Sequence: Synthetic oligonucleotide
aaaatttgcaaaagaagagtaggatggaagctttgacactacag

SEQ ID NO: 301293 - DNA, 43 bp, Artificial Sequence
  Description of Artificial Sequence: Synthetic oligonucleotide
aaatttgcaaaagaagagtaggatggaagctttgacactacag

SEQ ID NO: 301294 - DNA, 42 bp, Artificial Sequence
  Description of Artificial Sequence: Synthetic oligonucleotide
aatttgcaaaagaagagtaggatggaagctttgacactacag

SEQ ID NO: 301295 - DNA, 41 bp, Artificial Sequence
  Description of Artificial Sequence: Synthetic oligonucleotide
atttgcaaaagaagagtaggatggaagctttgacactacag

SEQ ID NO: 301296 - DNA, 40 bp, Artificial Sequence
  Description of Artificial Sequence: Synthetic oligonucleotide
tttgcaaaagaagagtaggatggaagctttgacactacag

SEQ ID NO: 301297 - DNA, 39 bp, Artificial Sequence
  Description of Artificial Sequence: Synthetic oligonucleotide
ttgcaaaagaagagtaggatggaagctttgacactacag

SEQ ID NO: 301298 - DNA, 38 bp, Artificial Sequence
  Description of Artificial Sequence: Synthetic oligonucleotide
tgcaaaagaagagtaggatggaagctttgacactacag

SEQ ID NO: 301299 - DNA, 37 bp, Artificial Sequence
  Description of Artificial Sequence: Synthetic oligonucleotide
gcaaaagaagagtaggatggaagctttgacactacag

SEQ ID NO: 301300 - DNA, 37 bp, Artificial Sequence
  Description of Artificial Sequence: Synthetic oligonucleotide
caaaagaagagtaggatggaagctttgacactacagg

SEQ ID NO: 301301 - DNA, 38 bp, Artificial Sequence
  Description of Artificial Sequence: Synthetic oligonucleotide
aaaagaagagtaggatggaagctttgacactacaggac

SEQ ID NO: 301302 - DNA, 37 bp, Artificial Sequence
  Description of Artificial Sequence: Synthetic oligonucleotide
aaagaagagtaggatggaagctttgacactacaggac

SEQ ID NO: 301303 - DNA, 36 bp, Artificial Sequence
  Description of Artificial Sequence: Synthetic oligonucleotide
aagaagagtaggatggaagctttgacactacaggac

SEQ ID NO: 301304 - DNA, 35 bp, Artificial Sequence
  Description of Artificial Sequence: Synthetic oligonucleotide
agaagagtaggatggaagctttgacactacaggac

SEQ ID NO: 301305 - DNA, 34 bp, Artificial Sequence
  Description of Artificial Sequence: Synthetic oligonucleotide
gaagagtaggatggaagctttgacactacaggac

SEQ ID NO: 301306 - DNA, 36 bp, Artificial Sequence
  Description of Artificial Sequence: Synthetic oligonucleotide
aagagtaggatggaagctttgacactacaggactac

SEQ ID NO: 301307 - DNA, 35 bp, Artificial Sequence
  Description of Artificial Sequence: Synthetic oligonucleotide
agagtaggatggaagctttgacactacaggactac

SEQ ID NO: 301308 - DNA, 34 bp, Artificial Sequence
  Description of Artificial Sequence: Synthetic oligonucleotide
gagtaggatggaagctttgacactacaggactac

SEQ ID NO: 301309 - DNA, 35 bp, Artificial Sequence
  Description of Artificial Sequence: Synthetic oligonucleotide
agtaggatggaagctttgacactacaggactactg

SEQ ID NO: 301310 - DNA, 34 bp, Artificial Sequence
  Description of Artificial Sequence: Synthetic oligonucleotide
gtaggatggaagctttgacactacaggactactg

SEQ ID NO: 301311 - DNA, 35 bp, Artificial Sequence
  Description of Artificial Sequence: Synthetic oligonucleotide
taggatggaagctttgacactacaggactactgtg

SEQ ID NO: 301312 - DNA, 34 bp, Artificial Sequence
  Description of Artificial Sequence: Synthetic oligonucleotide
aggatggaagctttgacactacaggactactgtg

SEQ ID NO: 301313 - DNA, 33 bp, Artificial Sequence
  Description of Artificial Sequence: Synthetic oligonucleotide
ggatggaagctttgacactacaggactactgtg

SEQ ID NO: 301314 - DNA, 35 bp, Artificial Sequence
  Description of Artificial Sequence: Synthetic oligonucleotide
gatggaagctttgacactacaggactactgtgaac

SEQ ID NO: 301315 - DNA, 38 bp, Artificial Sequence
  Description of Artificial Sequence: Synthetic oligonucleotide
atggaagctttgacactacaggactactgtgaacattc

SEQ ID NO: 301316 - DNA, 37 bp, Artificial Sequence
  Description of Artificial Sequence: Synthetic oligonucleotide
tggaagctttgacactacaggactactgtgaacattc

SEQ ID NO: 301317 - DNA, 36 bp, Artificial Sequence
  Description of Artificial Sequence: Synthetic oligonucleotide
ggaagctttgacactacaggactactgtgaacattc

SEQ ID NO: 301318 - DNA, 40 bp, Artificial Sequence
  Description of Artificial Sequence: Synthetic oligonucleotide
gaagctttgacactacaggactactgtgaacattctaaac

SEQ ID NO: 301319 - DNA, 41 bp, Artificial Sequence
  Description of Artificial Sequence: Synthetic oligonucleotide
aagctttgacactacaggactactgtgaacattctaaacac

SEQ ID NO: 301320 - DNA, 40 bp, Artificial Sequence
  Description of Artificial Sequence: Synthetic oligonucleotide
agctttgacactacaggactactgtgaacattctaaacac

SEQ ID NO: 301321 - DNA, 39 bp, Artificial Sequence
  Description of Artificial Sequence: Synthetic oligonucleotide
gctttgacactacaggactactgtgaacattctaaacac

SEQ ID NO: 301322 - DNA, 42 bp, Artificial Sequence
  Description of Artificial Sequence: Synthetic oligonucleotide
ctttgacactacaggactactgtgaacattctaaacacaaag

SEQ ID NO: 301323 - DNA, 45 bp, Artificial Sequence
  Description of Artificial Sequence: Synthetic oligonucleotide
tttgacactacaggactactgtgaacattctaaacacaaagaatc

SEQ ID NO: 301324 - DNA, 44 bp, Artificial Sequence
  Description of Artificial Sequence: Synthetic oligonucleotide
ttgacactacaggactactgtgaacattctaaacacaaagaatc

SEQ ID NO: 301325 - DNA, 43 bp, Artificial Sequence
  Description of Artificial Sequence: Synthetic oligonucleotide
tgacactacaggactactgtgaacattctaaacacaaagaatc

SEQ ID NO: 301326 - DNA, 42 bp, Artificial Sequence
  Description of Artificial Sequence: Synthetic oligonucleotide
gacactacaggactactgtgaacattctaaacacaaagaatc

SEQ ID NO: 301327 - DNA, 43 bp, Artificial Sequence
  Description of Artificial Sequence: Synthetic oligonucleotide
acactacaggactactgtgaacattctaaacacaaagaatcag

SEQ ID NO: 301328 - DNA, 42 bp, Artificial Sequence
  Description of Artificial Sequence: Synthetic oligonucleotide
cactacaggactactgtgaacattctaaacacaaagaatcag

SEQ ID NO: 301329 - DNA, 43 bp, Artificial Sequence
  Description of Artificial Sequence: Synthetic oligonucleotide
actacaggactactgtgaacattctaaacacaaagaatcagtg

SEQ ID NO: 301330 - DNA, 42 bp, Artificial Sequence
  Description of Artificial Sequence: Synthetic oligonucleotide
ctacaggactactgtgaacattctaaacacaaagaatcagtg

SEQ ID NO: 301331 - DNA, 42 bp, Artificial Sequence
  Description of Artificial Sequence: Synthetic oligonucleotide
tacaggactactgtgaacattctaaacacaaagaatcagtgc

SEQ ID NO: 301332 - DNA, 41 bp, Artificial Sequence
  Description of Artificial Sequence: Synthetic oligonucleotide
acaggactactgtgaacattctaaacacaaagaatcagtgc

SEQ ID NO: 301333 - DNA, 40 bp, Artificial Sequence
  Description of Artificial Sequence: Synthetic oligonucleotide
caggactactgtgaacattctaaacacaaagaatcagtgc

SEQ ID NO: 301334 - DNA, 45 bp, Artificial Sequence
  Description of Artificial Sequence: Synthetic oligonucleotide
aggactactgtgaacattctaaacacaaagaatcagtgctaaaag

SEQ ID NO: 301335 - DNA, 44 bp, Artificial Sequence
  Description of Artificial Sequence: Synthetic oligonucleotide
ggactactgtgaacattctaaacacaaagaatcagtgctaaaag

SEQ ID NO: 301336 - DNA, 45 bp, Artificial Sequence
  Description of Artificial Sequence: Synthetic oligonucleotide
gactactgtgaacattctaaacacaaagaatcagtgctaaaagag

SEQ ID NO: 301337 - DNA, 47 bp, Artificial Sequence
  Description of Artificial Sequence: Synthetic oligonucleotide
actactgtgaacattctaaacacaaagaatcagtgctaaaagagaag

SEQ ID NO: 301338 - DNA, 46 bp, Artificial Sequence
  Description of Artificial Sequence: Synthetic oligonucleotide
ctactgtgaacattctaaacacaaagaatcagtgctaaaagagaag

SEQ ID NO: 301339 - DNA, 48 bp, Artificial Sequence
  Description of Artificial Sequence: Synthetic oligonucleotide
tactgtgaacattctaaacacaaagaatcagtgctaaaagagaagttg

SEQ ID NO: 301340 - DNA, 47 bp, Artificial Sequence
  Description of Artificial Sequence: Synthetic oligonucleotide
actgtgaacattctaaacacaaagaatcagtgctaaaagagaagttg

SEQ ID NO: 301341 - DNA, 46 bp, Artificial Sequence
  Description of Artificial Sequence: Synthetic oligonucleotide
ctgtgaacattctaaacacaaagaatcagtgctaaaagagaagttg

SEQ ID NO: 301342 - DNA, 46 bp, Artificial Sequence
  Description of Artificial Sequence: Synthetic oligonucleotide
tgtgaacattctaaacacaaagaatcagtgctaaaagagaagttgg

SEQ ID NO: 301343 - DNA, 45 bp, Artificial Sequence
  Description of Artificial Sequence: Synthetic oligonucleotide
gtgaacattctaaacacaaagaatcagtgctaaaagagaagttgg

SEQ ID NO: 301344 - DNA, 50 bp, Artificial Sequence
  Description of Artificial Sequence: Synthetic oligonucleotide
tgaacattctaaacacaaagaatcagtgctaaaagagaagttggaatttg

SEQ ID NO: 301345 - DNA, 49 bp, Artificial Sequence
  Description of Artificial Sequence: Synthetic oligonucleotide
gaacattctaaacacaaagaatcagtgctaaaagagaagttggaatttg

SEQ ID NO: 301346 - DNA, 49 bp, Artificial Sequence
  Description of Artificial Sequence: Synthetic oligonucleotide
aacattctaaacacaaagaatcagtgctaaaagagaagttggaatttgc

SEQ ID NO: 301347 - DNA, 48 bp, Artificial Sequence
  Description of Artificial Sequence: Synthetic oligonucleotide
acattctaaacacaaagaatcagtgctaaaagagaagttggaatttgc

SEQ ID NO: 301348 - DNA, 47 bp, Artificial Sequence
  Description of Artificial Sequence: Synthetic oligonucleotide
cattctaaacacaaagaatcagtgctaaaagagaagttggaatttgc

SEQ ID NO: 301349 - DNA, 47 bp, Artificial Sequence
  Description of Artificial Sequence: Synthetic oligonucleotide
attctaaacacaaagaatcagtgctaaaagagaagttggaatttgcc

SEQ ID NO: 301350 - DNA, 46 bp, Artificial Sequence
  Description of Artificial Sequence: Synthetic oligonucleotide
ttctaaacacaaagaatcagtgctaaaagagaagttggaatttgcc

SEQ ID NO: 301351 - DNA, 45 bp, Artificial Sequence
  Description of Artificial Sequence: Synthetic oligonucleotide
tctaaacacaaagaatcagtgctaaaagagaagttggaatttgcc

SEQ ID NO: 301352 - DNA, 44 bp, Artificial Sequence
  Description of Artificial Sequence: Synthetic oligonucleotide
ctaaacacaaagaatcagtgctaaaagagaagttggaatttgcc

SEQ ID NO: 301353 - DNA, 46 bp, Artificial Sequence
  Description of Artificial Sequence: Synthetic oligonucleotide
taaacacaaagaatcagtgctaaaagagaagttggaatttgccaag

SEQ ID NO: 301354 - DNA, 45 bp, Artificial Sequence
  Description of Artificial Sequence: Synthetic oligonucleotide
aaacacaaagaatcagtgctaaaagagaagttggaatttgccaag

SEQ ID NO: 301355 - DNA, 44 bp, Artificial Sequence
  Description of Artificial Sequence: Synthetic oligonucleotide
aacacaaagaatcagtgctaaaagagaagttggaatttgccaag

SEQ ID NO: 301356 - DNA, 43 bp, Artificial Sequence
  Description of Artificial Sequence: Synthetic oligonucleotide
acacaaagaatcagtgctaaaagagaagttggaatttgccaag

SEQ ID NO: 301357 - DNA, 42 bp, Artificial Sequence
  Description of Artificial Sequence: Synthetic oligonucleotide
cacaaagaatcagtgctaaaagagaagttggaatttgccaag

SEQ ID NO: 301358 - DNA, 47 bp, Artificial Sequence
  Description of Artificial Sequence: Synthetic oligonucleotide
acaaagaatcagtgctaaaagagaagttggaatttgccaagaataac

SEQ ID NO: 301359 - DNA, 46 bp, Artificial Sequence
  Description of Artificial Sequence: Synthetic oligonucleotide
caaagaatcagtgctaaaagagaagttggaatttgccaagaataac

SEQ ID NO: 301360 - DNA, 51 bp, Artificial Sequence
  Description of Artificial Sequence: Synthetic oligonucleotide
aaagaatcagtgctaaaagagaagttggaatttgccaagaataacaataag

SEQ ID NO: 301361 - DNA, 50 bp, Artificial Sequence
  Description of Artificial Sequence: Synthetic oligonucleotide
aagaatcagtgctaaaagagaagttggaatttgccaagaataacaataag

SEQ ID NO: 301362 - DNA, 49 bp, Artificial Sequence
  Description of Artificial Sequence: Synthetic oligonucleotide
agaatcagtgctaaaagagaagttggaatttgccaagaataacaataag

SEQ ID NO: 301363 - DNA, 48 bp, Artificial Sequence
  Description of Artificial Sequence: Synthetic oligonucleotide
gaatcagtgctaaaagagaagttggaatttgccaagaataacaataag

SEQ ID NO: 301364 - DNA, 48 bp, Artificial Sequence
  Description of Artificial Sequence: Synthetic oligonucleotide
aatcagtgctaaaagagaagttggaatttgccaagaataacaataagg

SEQ ID NO: 301365 - DNA, 47 bp, Artificial Sequence
  Description of Artificial Sequence: Synthetic oligonucleotide
atcagtgctaaaagagaagttggaatttgccaagaataacaataagg

SEQ ID NO: 301366 - DNA, 46 bp, Artificial Sequence
  Description of Artificial Sequence: Synthetic oligonucleotide
tcagtgctaaaagagaagttggaatttgccaagaataacaataagg

SEQ ID NO: 301367 - DNA, 45 bp, Artificial Sequence
  Description of Artificial Sequence: Synthetic oligonucleotide
cagtgctaaaagagaagttggaatttgccaagaataacaataagg

SEQ ID NO: 301368 - DNA, 45 bp, Artificial Sequence
  Description of Artificial Sequence: Synthetic oligonucleotide
agtgctaaaagagaagttggaatttgccaagaataacaataaggg

SEQ ID NO: 301369 - DNA, 44 bp, Artificial Sequence
  Description of Artificial Sequence: Synthetic oligonucleotide
gtgctaaaagagaagttggaatttgccaagaataacaataaggg

SEQ ID NO: 301370 - DNA, 45 bp, Artificial Sequence
  Description of Artificial Sequence: Synthetic oligonucleotide
tgctaaaagagaagttggaatttgccaagaataacaataagggtg

SEQ ID NO: 301371 - DNA, 44 bp, Artificial Sequence
  Description of Artificial Sequence: Synthetic oligonucleotide
gctaaaagagaagttggaatttgccaagaataacaataagggtg

SEQ ID NO: 301372 - DNA, 46 bp, Artificial Sequence
  Description of Artificial Sequence: Synthetic oligonucleotide
ctaaaagagaagttggaatttgccaagaataacaataagggtgtag

SEQ ID NO: 301373 - DNA, 48 bp, Artificial Sequence
  Description of Artificial Sequence: Synthetic oligonucleotide
taaaagagaagttggaatttgccaagaataacaataagggtgtagaag

SEQ ID NO: 301374 - DNA, 47 bp, Artificial Sequence
  Description of Artificial Sequence: Synthetic oligonucleotide
aaaagagaagttggaatttgccaagaataacaataagggtgtagaag

SEQ ID NO: 301375 - DNA, 46 bp, Artificial Sequence
  Description of Artificial Sequence: Synthetic oligonucleotide
aaagagaagttggaatttgccaagaataacaataagggtgtagaag

SEQ ID NO: 301376 - DNA, 45 bp, Artificial Sequence
  Description of Artificial Sequence: Synthetic oligonucleotide
aagagaagttggaatttgccaagaataacaataagggtgtagaag

SEQ ID NO: 301377 - DNA, 44 bp, Artificial Sequence
  Description of Artificial Sequence: Synthetic oligonucleotide
agagaagttggaatttgccaagaataacaataagggtgtagaag

SEQ ID NO: 301378 - DNA, 43 bp, Artificial Sequence
  Description of Artificial Sequence: Synthetic oligonucleotide
gagaagttggaatttgccaagaataacaataagggtgtagaag

SEQ ID NO: 301379 - DNA, 45 bp, Artificial Sequence
  Description of Artificial Sequence: Synthetic oligonucleotide
agaagttggaatttgccaagaataacaataagggtgtagaagatg

SEQ ID NO: 301380 - DNA, 44 bp, Artificial Sequence
  Description of Artificial Sequence: Synthetic oligonucleotide
gaagttggaatttgccaagaataacaataagggtgtagaagatg

SEQ ID NO: 301381 - DNA, 46 bp, Artificial Sequence
  Description of Artificial Sequence: Synthetic oligonucleotide
aagttggaatttgccaagaataacaataagggtgtagaagatgaag

SEQ ID NO: 301382 - DNA, 45 bp, Artificial Sequence
  Description of Artificial Sequence: Synthetic oligonucleotide
agttggaatttgccaagaataacaataagggtgtagaagatgaag

SEQ ID NO: 301383 - DNA, 44 bp, Artificial Sequence
  Description of Artificial Sequence: Synthetic oligonucleotide
gttggaatttgccaagaataacaataagggtgtagaagatgaag

SEQ ID NO: 301384 - DNA, 48 bp, Artificial Sequence
  Description of Artificial Sequence: Synthetic oligonucleotide
ttggaatttgccaagaataacaataagggtgtagaagatgaagataag

SEQ ID NO: 301385 - DNA, 47 bp, Artificial Sequence
  Description of Artificial Sequence: Synthetic oligonucleotide
tggaatttgccaagaataacaataagggtgtagaagatgaagataag

SEQ ID NO: 301386 - DNA, 46 bp, Artificial Sequence
  Description of Artificial Sequence: Synthetic oligonucleotide
ggaatttgccaagaataacaataagggtgtagaagatgaagataag

SEQ ID NO: 301387 - DNA, 48 bp, Artificial Sequence
  Description of Artificial Sequence: Synthetic oligonucleotide
gaatttgccaagaataacaataagggtgtagaagatgaagataagttg

SEQ ID NO: 301388 - DNA, 49 bp, Artificial Sequence
  Description of Artificial Sequence: Synthetic oligonucleotide
aatttgccaagaataacaataagggtgtagaagatgaagataagttgac

SEQ ID NO: 301389 - DNA, 48 bp, Artificial Sequence
  Description of Artificial Sequence: Synthetic oligonucleotide
atttgccaagaataacaataagggtgtagaagatgaagataagttgac

SEQ ID NO: 301390 - DNA, 47 bp, Artificial Sequence
  Description of Artificial Sequence: Synthetic oligonucleotide
tttgccaagaataacaataagggtgtagaagatgaagataagttgac

SEQ ID NO: 301391 - DNA, 46 bp, Artificial Sequence
  Description of Artificial Sequence: Synthetic oligonucleotide
ttgccaagaataacaataagggtgtagaagatgaagataagttgac

SEQ ID NO: 301392 - DNA, 45 bp, Artificial Sequence
  Description of Artificial Sequence: Synthetic oligonucleotide
tgccaagaataacaataagggtgtagaagatgaagataagttgac

SEQ ID NO: 301393 - DNA, 44 bp, Artificial Sequence
  Description of Artificial Sequence: Synthetic oligonucleotide
gccaagaataacaataagggtgtagaagatgaagataagttgac

SEQ ID NO: 301394 - DNA, 45 bp, Artificial Sequence
  Description of Artificial Sequence: Synthetic oligonucleotide
ccaagaataacaataagggtgtagaagatgaagataagttgacac

SEQ ID NO: 301395 - DNA, 45 bp, Artificial Sequence
  Description of Artificial Sequence: Synthetic oligonucleotide
caagaataacaataagggtgtagaagatgaagataagttgacacc

SEQ ID NO: 301396 - DNA, 46 bp, Artificial Sequence
  Description of Artificial Sequence: Synthetic oligonucleotide
aagaataacaataagggtgtagaagatgaagataagttgacacctg

SEQ ID NO: 301397 - DNA, 45 bp, Artificial Sequence
  Description of Artificial Sequence: Synthetic oligonucleotide
agaataacaataagggtgtagaagatgaagataagttgacacctg

SEQ ID NO: 301398 - DNA, 44 bp, Artificial Sequence
  Description of Artificial Sequence: Synthetic oligonucleotide
gaataacaataagggtgtagaagatgaagataagttgacacctg

SEQ ID NO: 301399 - DNA, 46 bp, Artificial Sequence
  Description of Artificial Sequence: Synthetic oligonucleotide
aataacaataagggtgtagaagatgaagataagttgacacctgtac

SEQ ID NO: 301400 - DNA, 45 bp, Artificial Sequence
  Description of Artificial Sequence: Synthetic oligonucleotide
ataacaataagggtgtagaagatgaagataagttgacacctgtac

SEQ ID NO: 301401 - DNA, 44 bp, Artificial Sequence
  Description of Artificial Sequence: Synthetic oligonucleotide
taacaataagggtgtagaagatgaagataagttgacacctgtac

SEQ ID NO: 301402 - DNA, 43 bp, Artificial Sequence
  Description of Artificial Sequence: Synthetic oligonucleotide
aacaataagggtgtagaagatgaagataagttgacacctgtac

SEQ ID NO: 301403 - DNA, 42 bp, Artificial Sequence
  Description of Artificial Sequence: Synthetic oligonucleotide
acaataagggtgtagaagatgaagataagttgacacctgtac

SEQ ID NO: 301404 - DNA, 41 bp, Artificial Sequence
  Description of Artificial Sequence: Synthetic oligonucleotide
caataagggtgtagaagatgaagataagttgacacctgtac

SEQ ID NO: 301405 - DNA, 42 bp, Artificial Sequence
  Description of Artificial Sequence: Synthetic oligonucleotide
aataagggtgtagaagatgaagataagttgacacctgtacag

SEQ ID NO: 301406 - DNA, 41 bp, Artificial Sequence
  Description of Artificial Sequence: Synthetic oligonucleotide
ataagggtgtagaagatgaagataagttgacacctgtacag

SEQ ID NO: 301407 - DNA, 40 bp, Artificial Sequence
  Description of Artificial Sequence: Synthetic oligonucleotide
taagggtgtagaagatgaagataagttgacacctgtacag

SEQ ID NO: 301408 - DNA, 39 bp, Artificial Sequence
  Description of Artificial Sequence: Synthetic oligonucleotide
aagggtgtagaagatgaagataagttgacacctgtacag

SEQ ID NO: 301409 - DNA, 38 bp, Artificial Sequence
  Description of Artificial Sequence: Synthetic oligonucleotide
agggtgtagaagatgaagataagttgacacctgtacag

SEQ ID NO: 301410 - DNA, 37 bp, Artificial Sequence
  Description of Artificial Sequence: Synthetic oligonucleotide
gggtgtagaagatgaagataagttgacacctgtacag

SEQ ID NO: 301411 - DNA, 37 bp, Artificial Sequence
  Description of Artificial Sequence: Synthetic oligonucleotide
ggtgtagaagatgaagataagttgacacctgtacagc

SEQ ID NO: 301412 - DNA, 38 bp, Artificial Sequence
  Description of Artificial Sequence: Synthetic oligonucleotide
gtgtagaagatgaagataagttgacacctgtacagctg

SEQ ID NO: 301413 - DNA, 38 bp, Artificial Sequence
  Description of Artificial Sequence: Synthetic oligonucleotide
tgtagaagatgaagataagttgacacctgtacagctgg

SEQ ID NO: 301414 - DNA, 37 bp, Artificial Sequence
  Description of Artificial Sequence: Synthetic oligonucleotide
gtagaagatgaagataagttgacacctgtacagctgg

SEQ ID NO: 301415 - DNA, 37 bp, Artificial Sequence
  Description of Artificial Sequence: Synthetic oligonucleotide
tagaagatgaagataagttgacacctgtacagctggc

SEQ ID NO: 301416 - DNA, 36 bp, Artificial Sequence
  Description of Artificial Sequence: Synthetic oligonucleotide
agaagatgaagataagttgacacctgtacagctggc

SEQ ID NO: 301417 - DNA, 35 bp, Artificial Sequence
  Description of Artificial Sequence: Synthetic oligonucleotide
gaagatgaagataagttgacacctgtacagctggc

SEQ ID NO: 301418 - DNA, 41 bp, Artificial Sequence
  Description of Artificial Sequence: Synthetic oligonucleotide
aagatgaagataagttgacacctgtacagctggctataaag

SEQ ID NO: 301419 - DNA, 40 bp, Artificial Sequence
  Description of Artificial Sequence: Synthetic oligonucleotide
agatgaagataagttgacacctgtacagctggctataaag

SEQ ID NO: 301420 - DNA, 39 bp, Artificial Sequence
  Description of Artificial Sequence: Synthetic oligonucleotide
gatgaagataagttgacacctgtacagctggctataaag

SEQ ID NO: 301421 - DNA, 42 bp, Artificial Sequence
  Description of Artificial Sequence: Synthetic oligonucleotide
atgaagataagttgacacctgtacagctggctataaagaatc

SEQ ID NO: 301422 - DNA, 41 bp, Artificial Sequence
  Description of Artificial Sequence: Synthetic oligonucleotide
tgaagataagttgacacctgtacagctggctataaagaatc

SEQ ID NO: 301423 - DNA, 40 bp, Artificial Sequence
  Description of Artificial Sequence: Synthetic oligonucleotide
gaagataagttgacacctgtacagctggctataaagaatc

SEQ ID NO: 301424 - DNA, 42 bp, Artificial Sequence
  Description of Artificial Sequence: Synthetic oligonucleotide
aagataagttgacacctgtacagctggctataaagaatcttg

SEQ ID NO: 301425 - DNA, 41 bp, Artificial Sequence
  Description of Artificial Sequence: Synthetic oligonucleotide
agataagttgacacctgtacagctggctataaagaatcttg

SEQ ID NO: 301426 - DNA, 40 bp, Artificial Sequence
  Description of Artificial Sequence: Synthetic oligonucleotide
gataagttgacacctgtacagctggctataaagaatcttg

SEQ ID NO: 301427 - DNA, 40 bp, Artificial Sequence
  Description of Artificial Sequence: Synthetic oligonucleotide
ataagttgacacctgtacagctggctataaagaatcttgg

SEQ ID NO: 301428 - DNA, 39 bp, Artificial Sequence
  Description of Artificial Sequence: Synthetic oligonucleotide
taagttgacacctgtacagctggctataaagaatcttgg

SEQ ID NO: 301429 - DNA, 38 bp, Artificial Sequence
  Description of Artificial Sequence: Synthetic oligonucleotide
aagttgacacctgtacagctggctataaagaatcttgg

SEQ ID NO: 301430 - DNA, 37 bp, Artificial Sequence
  Description of Artificial Sequence: Synthetic oligonucleotide
agttgacacctgtacagctggctataaagaatcttgg

SEQ ID NO: 301431 - DNA, 36 bp, Artificial Sequence
  Description of Artificial Sequence: Synthetic oligonucleotide
gttgacacctgtacagctggctataaagaatcttgg

SEQ ID NO: 301432 - DNA, 36 bp, Artificial Sequence
  Description of Artificial Sequence: Synthetic oligonucleotide
ttgacacctgtacagctggctataaagaatcttggc

SEQ ID NO: 301433 - DNA, 35 bp, Artificial Sequence
  Description of Artificial Sequence: Synthetic oligonucleotide
tgacacctgtacagctggctataaagaatcttggc

SEQ ID NO: 301434 - DNA, 34 bp, Artificial Sequence
  Description of Artificial Sequence: Synthetic oligonucleotide
gacacctgtacagctggctataaagaatcttggc

SEQ ID NO: 301435 - DNA, 36 bp, Artificial Sequence
  Description of Artificial Sequence: Synthetic oligonucleotide
acacctgtacagctggctataaagaatcttggcaag

SEQ ID NO: 301436 - DNA, 35 bp, Artificial Sequence
  Description of Artificial Sequence: Synthetic oligonucleotide
cacctgtacagctggctataaagaatcttggcaag

SEQ ID NO: 301437 - DNA, 35 bp, Artificial Sequence
  Description of Artificial Sequence: Synthetic oligonucleotide
acctgtacagctggctataaagaatcttggcaagc

SEQ ID NO: 301438 - DNA, 34 bp, Artificial Sequence
  Description of Artificial Sequence: Synthetic oligonucleotide
cctgtacagctggctataaagaatcttggcaagc

SEQ ID NO: 301439 - DNA, 35 bp, Artificial Sequence
  Description of Artificial Sequence: Synthetic oligonucleotide
ctgtacagctggctataaagaatcttggcaagctg

SEQ ID NO: 301440 - DNA, 35 bp, Artificial Sequence
  Description of Artificial Sequence: Synthetic oligonucleotide
tgtacagctggctataaagaatcttggcaagctgg

SEQ ID NO: 301441 - DNA, 34 bp, Artificial Sequence
  Description of Artificial Sequence: Synthetic oligonucleotide
gtacagctggctataaagaatcttggcaagctgg

SEQ ID NO: 301442 - DNA, 35 bp, Artificial Sequence
  Description of Artificial Sequence: Synthetic oligonucleotide
tacagctggctataaagaatcttggcaagctggac

SEQ ID NO: 301443 - DNA, 34 bp, Artificial Sequence
  Description of Artificial Sequence: Synthetic oligonucleotide
acagctggctataaagaatcttggcaagctggac

SEQ ID NO: 301444 - DNA, 33 bp, Artificial Sequence
  Description of Artificial Sequence: Synthetic oligonucleotide
cagctggctataaagaatcttggcaagctggac

SEQ ID NO: 301445 - DNA, 33 bp, Artificial Sequence
  Description of Artificial Sequence: Synthetic oligonucleotide
agctggctataaagaatcttggcaagctggacc

SEQ ID NO: 301446 - DNA, 32 bp, Artificial Sequence
  Description of Artificial Sequence: Synthetic oligonucleotide
gctggctataaagaatcttggcaagctggacc

SEQ ID NO: 301447 - DNA, 32 bp, Artificial Sequence
  Description of Artificial Sequence: Synthetic oligonucleotide
ctggctataaagaatcttggcaagctggaccc

SEQ ID NO: 301448 - DNA, 32 bp, Artificial Sequence
  Description of Artificial Sequence: Synthetic oligonucleotide
tggctataaagaatcttggcaagctggacccc

SEQ ID NO: 301449 - DNA, 31 bp, Artificial Sequence
  Description of Artificial Sequence: Synthetic oligonucleotide
ggctataaagaatcttggcaagctggacccc

SEQ ID NO: 301450 - DNA, 34 bp, Artificial Sequence
  Description of Artificial Sequence: Synthetic oligonucleotide
gctataaagaatcttggcaagctggaccccaatc

SEQ ID NO: 301451 - DNA, 34 bp, Artificial Sequence
  Description of Artificial Sequence: Synthetic oligonucleotide
ctataaagaatcttggcaagctggaccccaatcg

SEQ ID NO: 301452 - DNA, 35 bp, Artificial Sequence
  Description of Artificial Sequence: Synthetic oligonucleotide
tataaagaatcttggcaagctggaccccaatcgtc

SEQ ID NO: 301453 - DNA, 34 bp, Artificial Sequence
  Description of Artificial Sequence: Synthetic oligonucleotide
ataaagaatcttggcaagctggaccccaatcgtc

SEQ ID NO: 301454 - DNA, 33 bp, Artificial Sequence
  Description of Artificial Sequence: Synthetic oligonucleotide
taaagaatcttggcaagctggaccccaatcgtc

SEQ ID NO: 301455 - DNA, 32 bp, Artificial Sequence
  Description of Artificial Sequence: Synthetic oligonucleotide
aaagaatcttggcaagctggaccccaatcgtc

SEQ ID NO: 301456 - DNA, 31 bp, Artificial Sequence
  Description of Artificial Sequence: Synthetic oligonucleotide
aagaatcttggcaagctggaccccaatcgtc

SEQ ID NO: 301457 - DNA, 30 bp, Artificial Sequence
  Description of Artificial Sequence: Synthetic oligonucleotide
agaatcttggcaagctggaccccaatcgtc

SEQ ID NO: 301458 - DNA, 29 bp, Artificial Sequence
  Description of Artificial Sequence: Synthetic oligonucleotide
gaatcttggcaagctggaccccaatcgtc

SEQ ID NO: 301459 - DNA, 33 bp, Artificial Sequence
  Description of Artificial Sequence: Synthetic oligonucleotide
aatcttggcaagctggaccccaatcgtcatttg

SEQ ID NO: 301460 - DNA, 32 bp, Artificial Sequence
  Description of Artificial Sequence: Synthetic oligonucleotide
atcttggcaagctggaccccaatcgtcatttg

SEQ ID NO: 301461 - DNA, 31 bp, Artificial Sequence
  Description of Artificial Sequence: Synthetic oligonucleotide
tcttggcaagctggaccccaatcgtcatttg

SEQ ID NO: 301462 - DNA, 30 bp, Artificial Sequence
  Description of Artificial Sequence: Synthetic oligonucleotide
cttggcaagctggaccccaatcgtcatttg

SEQ ID NO: 301463 - DNA, 30 bp, Artificial Sequence
  Description of Artificial Sequence: Synthetic oligonucleotide
ttggcaagctggaccccaatcgtcatttgc

SEQ ID NO: 301464 - DNA, 29 bp, Artificial Sequence
  Description of Artificial Sequence: Synthetic oligonucleotide
tggcaagctggaccccaatcgtcatttgc

SEQ ID NO: 301465 - DNA, 28 bp, Artificial Sequence
  Description of Artificial Sequence: Synthetic oligonucleotide
ggcaagctggaccccaatcgtcatttgc

SEQ ID NO: 301466 - DNA, 29 bp, Artificial Sequence
  Description of Artificial Sequence: Synthetic oligonucleotide
gcaagctggaccccaatcgtcatttgcag

SEQ ID NO: 301467 - DNA, 29 bp, Artificial Sequence
  Description of Artificial Sequence: Synthetic oligonucleotide
caagctggaccccaatcgtcatttgcagg

SEQ ID NO: 301468 - DNA, 31 bp, Artificial Sequence
  Description of Artificial Sequence: Synthetic oligonucleotide
aagctggaccccaatcgtcatttgcaggaac

SEQ ID NO: 301469 - DNA, 30 bp, Artificial Sequence
  Description of Artificial Sequence: Synthetic oligonucleotide
agctggaccccaatcgtcatttgcaggaac

SEQ ID NO: 301470 - DNA, 29 bp, Artificial Sequence
  Description of Artificial Sequence: Synthetic oligonucleotide
gctggaccccaatcgtcatttgcaggaac

SEQ ID NO: 301471 - DNA, 31 bp, Artificial Sequence
  Description of Artificial Sequence: Synthetic oligonucleotide
ctggaccccaatcgtcatttgcaggaacatg

SEQ ID NO: 301472 - DNA, 32 bp, Artificial Sequence
  Description of Artificial Sequence: Synthetic oligonucleotide
tggaccccaatcgtcatttgcaggaacatgag

SEQ ID NO: 301473 - DNA, 31 bp, Artificial Sequence
  Description of Artificial Sequence: Synthetic oligonucleotide
ggaccccaatcgtcatttgcaggaacatgag

SEQ ID NO: 301474 - DNA, 31 bp, Artificial Sequence
  Description of Artificial Sequence: Synthetic oligonucleotide
gaccccaatcgtcatttgcaggaacatgagg

SEQ ID NO: 301475 - DNA, 33 bp, Artificial Sequence
  Description of Artificial Sequence: Synthetic oligonucleotide
accccaatcgtcatttgcaggaacatgaggatg

SEQ ID NO: 301476 - DNA, 32 bp, Artificial Sequence
  Description of Artificial Sequence: Synthetic oligonucleotide
ccccaatcgtcatttgcaggaacatgaggatg

SEQ ID NO: 301477 - DNA, 34 bp, Artificial Sequence
  Description of Artificial Sequence: Synthetic oligonucleotide
cccaatcgtcatttgcaggaacatgaggatgtac

SEQ ID NO: 301478 - DNA, 38 bp, Artificial Sequence
  Description of Artificial Sequence: Synthetic oligonucleotide
ccaatcgtcatttgcaggaacatgaggatgtactaatg

SEQ ID NO: 301479 - DNA, 39 bp, Artificial Sequence
  Description of Artificial Sequence: Synthetic oligonucleotide
caatcgtcatttgcaggaacatgaggatgtactaatgac

SEQ ID NO: 301480 - DNA, 39 bp, Artificial Sequence
  Description of Artificial Sequence: Synthetic oligonucleotide
aatcgtcatttgcaggaacatgaggatgtactaatgacc

SEQ ID NO: 301481 - DNA, 38 bp, Artificial Sequence
  Description of Artificial Sequence: Synthetic oligonucleotide
atcgtcatttgcaggaacatgaggatgtactaatgacc

SEQ ID NO: 301482 - DNA, 37 bp, Artificial Sequence
  Description of Artificial Sequence: Synthetic oligonucleotide
tcgtcatttgcaggaacatgaggatgtactaatgacc

SEQ ID NO: 301483 - DNA, 36 bp, Artificial Sequence
  Description of Artificial Sequence: Synthetic oligonucleotide
cgtcatttgcaggaacatgaggatgtactaatgacc

SEQ ID NO: 301484 - DNA, 37 bp, Artificial Sequence
  Description of Artificial Sequence: Synthetic oligonucleotide
gtcatttgcaggaacatgaggatgtactaatgacctc

SEQ ID NO: 301485 - DNA, 44 bp, Artificial Sequence
  Description of Artificial Sequence: Synthetic oligonucleotide
tcatttgcaggaacatgaggatgtactaatgacctcatatattg

SEQ ID NO: 301486 - DNA, 43 bp, Artificial Sequence
  Description of Artificial Sequence: Synthetic oligonucleotide
catttgcaggaacatgaggatgtactaatgacctcatatattg

SEQ ID NO: 301487 - DNA, 44 bp, Artificial Sequence
  Description of Artificial Sequence: Synthetic oligonucleotide
atttgcaggaacatgaggatgtactaatgacctcatatattgtc

SEQ ID NO: 301488 - DNA, 43 bp, Artificial Sequence
  Description of Artificial Sequence: Synthetic oligonucleotide
tttgcaggaacatgaggatgtactaatgacctcatatattgtc

SEQ ID NO: 301489 - DNA, 42 bp, Artificial Sequence
  Description of Artificial Sequence: Synthetic oligonucleotide
ttgcaggaacatgaggatgtactaatgacctcatatattgtc

SEQ ID NO: 301490 - DNA, 41 bp, Artificial Sequence
  Description of Artificial Sequence: Synthetic oligonucleotide
tgcaggaacatgaggatgtactaatgacctcatatattgtc

SEQ ID NO: 301491 - DNA, 40 bp, Artificial Sequence
  Description of Artificial Sequence: Synthetic oligonucleotide
gcaggaacatgaggatgtactaatgacctcatatattgtc

SEQ ID NO: 301492 - DNA, 40 bp, Artificial Sequence
  Description of Artificial Sequence: Synthetic oligonucleotide
caggaacatgaggatgtactaatgacctcatatattgtcc

SEQ ID NO: 301493 - DNA, 41 bp, Artificial Sequence
  Description of Artificial Sequence: Synthetic oligonucleotide
aggaacatgaggatgtactaatgacctcatatattgtcctg

SEQ ID NO: 301494 - DNA, 40 bp, Artificial Sequence
  Description of Artificial Sequence: Synthetic oligonucleotide
ggaacatgaggatgtactaatgacctcatatattgtcctg

SEQ ID NO: 301495 - DNA, 41 bp, Artificial Sequence
  Description of Artificial Sequence: Synthetic oligonucleotide
gaacatgaggatgtactaatgacctcatatattgtcctgtg

SEQ ID NO: 301496 - DNA, 45 bp, Artificial Sequence
  Description of Artificial Sequence: Synthetic oligonucleotide
aacatgaggatgtactaatgacctcatatattgtcctgtgtttag

SEQ ID NO: 301497 - DNA, 44 bp, Artificial Sequence
  Description of Artificial Sequence: Synthetic oligonucleotide
acatgaggatgtactaatgacctcatatattgtcctgtgtttag

SEQ ID NO: 301498 - DNA, 43 bp, Artificial Sequence
  Description of Artificial Sequence: Synthetic oligonucleotide
catgaggatgtactaatgacctcatatattgtcctgtgtttag

SEQ ID NO: 301499 - DNA, 43 bp, Artificial Sequence
  Description of Artificial Sequence: Synthetic oligonucleotide
atgaggatgtactaatgacctcatatattgtcctgtgtttagc

SEQ ID NO: 301500 - DNA, 42 bp, Artificial Sequence
  Description of Artificial Sequence: Synthetic oligonucleotide
tgaggatgtactaatgacctcatatattgtcctgtgtttagc

SEQ ID NO: 301501 - DNA, 41 bp, Artificial Sequence
  Description of Artificial Sequence: Synthetic oligonucleotide
gaggatgtactaatgacctcatatattgtcctgtgtttagc

SEQ ID NO: 301502 - DNA, 42 bp, Artificial Sequence
  Description of Artificial Sequence: Synthetic oligonucleotide
aggatgtactaatgacctcatatattgtcctgtgtttagctg

SEQ ID NO: 301503 - DNA, 41 bp, Artificial Sequence
  Description of Artificial Sequence: Synthetic oligonucleotide
ggatgtactaatgacctcatatattgtcctgtgtttagctg

SEQ ID NO: 301504 - DNA, 41 bp, Artificial Sequence
  Description of Artificial Sequence: Synthetic oligonucleotide
gatgtactaatgacctcatatattgtcctgtgtttagctgc

SEQ ID NO: 301505 - DNA, 44 bp, Artificial Sequence
  Description of Artificial Sequence: Synthetic oligonucleotide
atgtactaatgacctcatatattgtcctgtgtttagctgctatg

SEQ ID NO: 301506 - DNA, 43 bp, Artificial Sequence
  Description of Artificial Sequence: Synthetic oligonucleotide
tgtactaatgacctcatatattgtcctgtgtttagctgctatg

SEQ ID NO: 301507 - DNA, 42 bp, Artificial Sequence
  Description of Artificial Sequence: Synthetic oligonucleotide
gtactaatgacctcatatattgtcctgtgtttagctgctatg

SEQ ID NO: 301508 - DNA, 44 bp, Artificial Sequence
  Description of Artificial Sequence: Synthetic oligonucleotide
tactaatgacctcatatattgtcctgtgtttagctgctatgttg

SEQ ID NO: 301509 - DNA, 43 bp, Artificial Sequence
  Description of Artificial Sequence: Synthetic oligonucleotide
actaatgacctcatatattgtcctgtgtttagctgctatgttg

SEQ ID NO: 301510 - DNA, 42 bp, Artificial Sequence
  Description of Artificial Sequence: Synthetic oligonucleotide
ctaatgacctcatatattgtcctgtgtttagctgctatgttg

SEQ ID NO: 301511 - DNA, 42 bp, Artificial Sequence
  Description of Artificial Sequence: Synthetic oligonucleotide
taatgacctcatatattgtcctgtgtttagctgctatgttgc

SEQ ID NO: 301512 - DNA, 41 bp, Artificial Sequence
  Description of Artificial Sequence: Synthetic oligonucleotide
aatgacctcatatattgtcctgtgtttagctgctatgttgc

SEQ ID NO: 301513 - DNA, 40 bp, Artificial Sequence
  Description of Artificial Sequence: Synthetic oligonucleotide
atgacctcatatattgtcctgtgtttagctgctatgttgc

SEQ ID NO: 301514 - DNA, 39 bp, Artificial Sequence
  Description of Artificial Sequence: Synthetic oligonucleotide
tgacctcatatattgtcctgtgtttagctgctatgttgc

SEQ ID NO: 301515 - DNA, 38 bp, Artificial Sequence
  Description of Artificial Sequence: Synthetic oligonucleotide
gacctcatatattgtcctgtgtttagctgctatgttgc

SEQ ID NO: 301516 - DNA, 41 bp, Artificial Sequence
  Description of Artificial Sequence: Synthetic oligonucleotide
acctcatatattgtcctgtgtttagctgctatgttgcatac

SEQ ID NO: 301517 - DNA, 40 bp, Artificial Sequence
  Description of Artificial Sequence: Synthetic oligonucleotide
cctcatatattgtcctgtgtttagctgctatgttgcatac

SEQ ID NO: 301518 - DNA, 41 bp, Artificial Sequence
  Description of Artificial Sequence: Synthetic oligonucleotide
ctcatatattgtcctgtgtttagctgctatgttgcatactg

SEQ ID NO: 301519 - DNA, 42 bp, Artificial Sequence
  Description of Artificial Sequence: Synthetic oligonucleotide
tcatatattgtcctgtgtttagctgctatgttgcatactgtc

SEQ ID NO: 301520 - DNA, 41 bp, Artificial Sequence
  Description of Artificial Sequence: Synthetic oligonucleotide
catatattgtcctgtgtttagctgctatgttgcatactgtc

SEQ ID NO: 301521 - DNA, 41 bp, Artificial Sequence
  Description of Artificial Sequence: Synthetic oligonucleotide
atatattgtcctgtgtttagctgctatgttgcatactgtcg

SEQ ID NO: 301522 - DNA, 40 bp, Artificial Sequence
  Description of Artificial Sequence: Synthetic oligonucleotide
tatattgtcctgtgtttagctgctatgttgcatactgtcg

SEQ ID NO: 301523 - DNA, 39 bp, Artificial Sequence
  Description of Artificial Sequence: Synthetic oligonucleotide
atattgtcctgtgtttagctgctatgttgcatactgtcg

SEQ ID NO: 301524 - DNA, 38 bp, Artificial Sequence
  Description of Artificial Sequence: Synthetic oligonucleotide
tattgtcctgtgtttagctgctatgttgcatactgtcg

SEQ ID NO: 301525 - DNA, 37 bp, Artificial Sequence
  Description of Artificial Sequence: Synthetic oligonucleotide
attgtcctgtgtttagctgctatgttgcatactgtcg

SEQ ID NO: 301526 - DNA, 36 bp, Artificial Sequence
  Description of Artificial Sequence: Synthetic oligonucleotide
ttgtcctgtgtttagctgctatgttgcatactgtcg

SEQ ID NO: 301527 - DNA, 35 bp, Artificial Sequence
  Description of Artificial Sequence: Synthetic oligonucleotide
tgtcctgtgtttagctgctatgttgcatactgtcg

SEQ ID NO: 301528 - DNA, 34 bp, Artificial Sequence
  Description of Artificial Sequence: Synthetic oligonucleotide
gtcctgtgtttagctgctatgttgcatactgtcg

SEQ ID NO: 301529 - DNA, 24 bp, Artificial Sequence
  Description of Artificial Sequence: Synthetic oligonucleotide
atggggctgcgcccggtctatctg

SEQ ID NO: 301530 - DNA, 23 bp, Artificial Sequence
  Description of Artificial Sequence: Synthetic oligonucleotide
tggggctgcgcccggtctatctg

SEQ ID NO: 301531 - DNA, 22 bp, Artificial Sequence
  Description of Artificial Sequence: Synthetic oligonucleotide
ggggctgcgcccggtctatctg

SEQ ID NO: 301532 - DNA, 24 bp, Artificial Sequence
  Description of Artificial Sequence: Synthetic oligonucleotide
gggctgcgcccggtctatctgctt

SEQ ID NO: 301533 - DNA, 25 bp, Artificial Sequence
  Description of Artificial Sequence: Synthetic oligonucleotide
ggctgcgcccggtctatctgcttct

SEQ ID NO: 301534 - DNA, 25 bp, Artificial Sequence
  Description of Artificial Sequence: Synthetic oligonucleotide
gctgcgcccggtctatctgcttctc

SEQ ID NO: 301535 - DNA, 25 bp, Artificial Sequence
  Description of Artificial Sequence: Synthetic oligonucleotide
ctgcgcccggtctatctgcttctcg

SEQ ID NO: 301536 - DNA, 26 bp, Artificial Sequence
  Description of Artificial Sequence: Synthetic oligonucleotide
tgcgcccggtctatctgcttctcgct

SEQ ID NO: 301537 - DNA, 25 bp, Artificial Sequence
  Description of Artificial Sequence: Synthetic oligonucleotide
gcgcccggtctatctgcttctcgct

SEQ ID NO: 301538 - DNA, 25 bp, Artificial Sequence
  Description of Artificial Sequence: Synthetic oligonucleotide
cgcccggtctatctgcttctcgctg

SEQ ID NO: 301539 - DNA, 25 bp, Artificial Sequence
  Description of Artificial Sequence: Synthetic oligonucleotide
gcccggtctatctgcttctcgctgg

SEQ ID NO: 301540 - DNA, 27 bp, Artificial Sequence
  Description of Artificial Sequence: Synthetic oligonucleotide
cccggtctatctgcttctcgctggcat

SEQ ID NO: 301541 - DNA, 27 bp, Artificial Sequence
  Description of Artificial Sequence: Synthetic oligonucleotide
ccggtctatctgcttctcgctggcatc

SEQ ID NO: 301542 - DNA, 29 bp, Artificial Sequence
  Description of Artificial Sequence: Synthetic oligonucleotide
cggtctatctgcttctcgctggcatcatc

SEQ ID NO: 301543 - DNA, 29 bp, Artificial Sequence
  Description of Artificial Sequence: Synthetic oligonucleotide
ggtctatctgcttctcgctggcatcatcc

SEQ ID NO: 301544 - DNA, 29 bp, Artificial Sequence
  Description of Artificial Sequence: Synthetic oligonucleotide
gtctatctgcttctcgctggcatcatccc

SEQ ID NO: 301545 - DNA, 33 bp, Artificial Sequence
  Description of Artificial Sequence: Synthetic oligonucleotide
tctatctgcttctcgctggcatcatcccttttg

SEQ ID NO: 301546 - DNA, 32 bp, Artificial Sequence
  Description of Artificial Sequence: Synthetic oligonucleotide
ctatctgcttctcgctggcatcatcccttttg

SEQ ID NO: 301547 - DNA, 32 bp, Artificial Sequence
  Description of Artificial Sequence: Synthetic oligonucleotide
tatctgcttctcgctggcatcatcccttttgg

SEQ ID NO: 301548 - DNA, 31 bp, Artificial Sequence
  Description of Artificial Sequence: Synthetic oligonucleotide
atctgcttctcgctggcatcatcccttttgg

SEQ ID NO: 301549 - DNA, 30 bp, Artificial Sequence
  Description of Artificial Sequence: Synthetic oligonucleotide
tctgcttctcgctggcatcatcccttttgg

SEQ ID NO: 301550 - DNA, 29 bp, Artificial Sequence
  Description of Artificial Sequence: Synthetic oligonucleotide
ctgcttctcgctggcatcatcccttttgg

SEQ ID NO: 301551 - DNA, 30 bp, Artificial Sequence
  Description of Artificial Sequence: Synthetic oligonucleotide
tgcttctcgctggcatcatcccttttggac

SEQ ID NO: 301552 - DNA, 29 bp, Artificial Sequence
  Description of Artificial Sequence: Synthetic oligonucleotide
gcttctcgctggcatcatcccttttggac

SEQ ID NO: 301553 - DNA, 29 bp, Artificial Sequence
  Description of Artificial Sequence: Synthetic oligonucleotide
cttctcgctggcatcatcccttttggacc

SEQ ID NO: 301554 - DNA, 30 bp, Artificial Sequence
  Description of Artificial Sequence: Synthetic oligonucleotide
ttctcgctggcatcatcccttttggacctc

SEQ ID NO: 301555 - DNA, 29 bp, Artificial Sequence
  Description of Artificial Sequence: Synthetic oligonucleotide
tctcgctggcatcatcccttttggacctc

SEQ ID NO: 301556 - DNA, 28 bp, Artificial Sequence
  Description of Artificial Sequence: Synthetic oligonucleotide
ctcgctggcatcatcccttttggacctc

SEQ ID NO: 301557 - DNA, 28 bp, Artificial Sequence
  Description of Artificial Sequence: Synthetic oligonucleotide
tcgctggcatcatcccttttggacctcc

SEQ ID NO: 301558 - DNA, 27 bp, Artificial Sequence
  Description of Artificial Sequence: Synthetic oligonucleotide
cgctggcatcatcccttttggacctcc

SEQ ID NO: 301559 - DNA, 27 bp, Artificial Sequence
  Description of Artificial Sequence: Synthetic oligonucleotide
gctggcatcatcccttttggacctccg

SEQ ID NO: 301560 - DNA, 27 bp, Artificial Sequence
  Description of Artificial Sequence: Synthetic oligonucleotide
ctggcatcatcccttttggacctccgg

SEQ ID NO: 301561 - DNA, 27 bp, Artificial Sequence
  Description of Artificial Sequence: Synthetic oligonucleotide
tggcatcatcccttttggacctccggg

SEQ ID NO: 301562 - DNA, 27 bp, Artificial Sequence
  Description of Artificial Sequence: Synthetic oligonucleotide
ggcatcatcccttttggacctccgggt

SEQ ID NO: 301563 - DNA, 27 bp, Artificial Sequence
  Description of Artificial Sequence: Synthetic oligonucleotide
gcatcatcccttttggacctccgggtg

SEQ ID NO: 301564 - DNA, 27 bp, Artificial Sequence
  Description of Artificial Sequence: Synthetic oligonucleotide
catcatcccttttggacctccgggtgc

SEQ ID NO: 301565 - DNA, 28 bp, Artificial Sequence
  Description of Artificial Sequence: Synthetic oligonucleotide
atcatcccttttggacctccgggtgctg

SEQ ID NO: 301566 - DNA, 27 bp, Artificial Sequence
  Description of Artificial Sequence: Synthetic oligonucleotide
tcatcccttttggacctccgggtgctg

SEQ ID NO: 301567 - DNA, 26 bp, Artificial Sequence
  Description of Artificial Sequence: Synthetic oligonucleotide
catcccttttggacctccgggtgctg

SEQ ID NO: 301568 - DNA, 27 bp, Artificial Sequence
  Description of Artificial Sequence: Synthetic oligonucleotide
atcccttttggacctccgggtgctgct

SEQ ID NO: 301569 - DNA, 26 bp, Artificial Sequence
  Description of Artificial Sequence: Synthetic oligonucleotide
tcccttttggacctccgggtgctgct

SEQ ID NO: 301570 - DNA, 25 bp, Artificial Sequence
  Description of Artificial Sequence: Synthetic oligonucleotide
cccttttggacctccgggtgctgct

SEQ ID NO: 301571 - DNA, 25 bp, Artificial Sequence
  Description of Artificial Sequence: Synthetic oligonucleotide
ccttttggacctccgggtgctgctg

SEQ ID NO: 301572 - DNA, 26 bp, Artificial Sequence
  Description of Artificial Sequence: Synthetic oligonucleotide
cttttggacctccgggtgctgctgct

SEQ ID NO: 301573 - DNA, 27 bp, Artificial Sequence
  Description of Artificial Sequence: Synthetic oligonucleotide
ttttggacctccgggtgctgctgctca

SEQ ID NO: 301574 - DNA, 26 bp, Artificial Sequence
  Description of Artificial Sequence: Synthetic oligonucleotide
tttggacctccgggtgctgctgctca

SEQ ID NO: 301575 - DNA, 25 bp, Artificial Sequence
  Description of Artificial Sequence: Synthetic oligonucleotide
ttggacctccgggtgctgctgctca

SEQ ID NO: 301576 - DNA, 24 bp, Artificial Sequence
  Description of Artificial Sequence: Synthetic oligonucleotide
tggacctccgggtgctgctgctca

SEQ ID NO: 301577 - DNA, 23 bp, Artificial Sequence
  Description of Artificial Sequence: Synthetic oligonucleotide
ggacctccgggtgctgctgctca

SEQ ID NO: 301578 - DNA, 23 bp, Artificial Sequence
  Description of Artificial Sequence: Synthetic oligonucleotide
gacctccgggtgctgctgctcag

SEQ ID NO: 301579 - DNA, 23 bp, Artificial Sequence
  Description of Artificial Sequence: Synthetic oligonucleotide
acctccgggtgctgctgctcagc

SEQ ID NO: 301580 - DNA, 22 bp, Artificial Sequence
  Description of Artificial Sequence: Synthetic oligonucleotide
cctccgggtgctgctgctcagc

SEQ ID NO: 301581 - DNA, 22 bp, Artificial Sequence
  Description of Artificial Sequence: Synthetic oligonucleotide
ctccgggtgctgctgctcagcc

SEQ ID NO: 301582 - DNA, 22 bp, Artificial Sequence
  Description of Artificial Sequence: Synthetic oligonucleotide
tccgggtgctgctgctcagccc

SEQ ID NO: 301583 - DNA, 21 bp, Artificial Sequence
  Description of Artificial Sequence: Synthetic oligonucleotide
ccgggtgctgctgctcagccc

SEQ ID NO: 301584 - DNA, 22 bp, Artificial Sequence
  Description of Artificial Sequence: Synthetic oligonucleotide
cgggtgctgctgctcagcccca

SEQ ID NO: 301585 - DNA, 23 bp, Artificial Sequence
  Description of Artificial Sequence: Synthetic oligonucleotide
gggtgctgctgctcagccccaca

SEQ ID NO: 301586 - DNA, 24 bp, Artificial Sequence
  Description of Artificial Sequence: Synthetic oligonucleotide
ggtgctgctgctcagccccacact

SEQ ID NO: 301587 - DNA, 26 bp, Artificial Sequence
  Description of Artificial Sequence: Synthetic oligonucleotide
gtgctgctgctcagccccacactctt

SEQ ID NO: 301588 - DNA, 26 bp, Artificial Sequence
  Description of Artificial Sequence: Synthetic oligonucleotide
tgctgctgctcagccccacactcttc

SEQ ID NO: 301589 - DNA, 25 bp, Artificial Sequence
  Description of Artificial Sequence: Synthetic oligonucleotide
gctgctgctcagccccacactcttc

SEQ ID NO: 301590 - DNA, 27 bp, Artificial Sequence
  Description of Artificial Sequence: Synthetic oligonucleotide
ctgctgctcagccccacactcttcgtt

SEQ ID NO: 301591 - DNA, 31 bp, Artificial Sequence
  Description of Artificial Sequence: Synthetic oligonucleotide
tgctgctcagccccacactcttcgttaaaac

SEQ ID NO: 301592 - DNA, 30 bp, Artificial Sequence
  Description of Artificial Sequence: Synthetic oligonucleotide
gctgctcagccccacactcttcgttaaaac

SEQ ID NO: 301593 - DNA, 30 bp, Artificial Sequence
  Description of Artificial Sequence: Synthetic oligonucleotide
ctgctcagccccacactcttcgttaaaacc

SEQ ID NO: 301594 - DNA, 31 bp, Artificial Sequence
  Description of Artificial Sequence: Synthetic oligonucleotide
tgctcagccccacactcttcgttaaaacctc

SEQ ID NO: 301595 - DNA, 30 bp, Artificial Sequence
  Description of Artificial Sequence: Synthetic oligonucleotide
gctcagccccacactcttcgttaaaacctc

SEQ ID NO: 301596 - DNA, 31 bp, Artificial Sequence
  Description of Artificial Sequence: Synthetic oligonucleotide
ctcagccccacactcttcgttaaaacctcac

SEQ ID NO: 301597 - DNA, 31 bp, Artificial Sequence
  Description of Artificial Sequence: Synthetic oligonucleotide
tcagccccacactcttcgttaaaacctcacg

SEQ ID NO: 301598 - DNA, 30 bp, Artificial Sequence
  Description of Artificial Sequence: Synthetic oligonucleotide
cagccccacactcttcgttaaaacctcacg

SEQ ID NO: 301599 - DNA, 30 bp, Artificial Sequence
  Description of Artificial Sequence: Synthetic oligonucleotide
agccccacactcttcgttaaaacctcacgc

SEQ ID NO: 301600 - DNA, 29 bp, Artificial Sequence
  Description of Artificial Sequence: Synthetic oligonucleotide
gccccacactcttcgttaaaacctcacgc

SEQ ID NO: 301601 - DNA, 30 bp, Artificial Sequence
  Description of Artificial Sequence: Synthetic oligonucleotide
ccccacactcttcgttaaaacctcacgctg

SEQ ID NO: 301602 - DNA, 30 bp, Artificial Sequence
  Description of Artificial Sequence: Synthetic oligonucleotide
cccacactcttcgttaaaacctcacgctgc

SEQ ID NO: 301603 - DNA, 31 bp, Artificial Sequence
  Description of Artificial Sequence: Synthetic oligonucleotide
ccacactcttcgttaaaacctcacgctgctg

SEQ ID NO: 301604 - DNA, 32 bp, Artificial Sequence
  Description of Artificial Sequence: Synthetic oligonucleotide
cacactcttcgttaaaacctcacgctgctgtc

SEQ ID NO: 301605 - DNA, 32 bp, Artificial Sequence
  Description of Artificial Sequence: Synthetic oligonucleotide
acactcttcgttaaaacctcacgctgctgtcc

SEQ ID NO: 301606 - DNA, 31 bp, Artificial Sequence
  Description of Artificial Sequence: Synthetic oligonucleotide
cactcttcgttaaaacctcacgctgctgtcc

SEQ ID NO: 301607 - DNA, 32 bp, Artificial Sequence
  Description of Artificial Sequence: Synthetic oligonucleotide
actcttcgttaaaacctcacgctgctgtcctc

SEQ ID NO: 301608 - DNA, 31 bp, Artificial Sequence
  Description of Artificial Sequence: Synthetic oligonucleotide
ctcttcgttaaaacctcacgctgctgtcctc

SEQ ID NO: 301609 - DNA, 31 bp, Artificial Sequence
  Description of Artificial Sequence: Synthetic oligonucleotide
tcttcgttaaaacctcacgctgctgtcctcg

SEQ ID NO: 301610 - DNA, 30 bp, Artificial Sequence
  Description of Artificial Sequence: Synthetic oligonucleotide
cttcgttaaaacctcacgctgctgtcctcg

SEQ ID NO: 301611 - DNA, 30 bp, Artificial Sequence
  Description of Artificial Sequence: Synthetic oligonucleotide
ttcgttaaaacctcacgctgctgtcctcgg

SEQ ID NO: 301612 - DNA, 29 bp, Artificial Sequence
  Description of Artificial Sequence: Synthetic oligonucleotide
tcgttaaaacctcacgctgctgtcctcgg

SEQ ID NO: 301613 - DNA, 28 bp, Artificial Sequence
  Description of Artificial Sequence: Synthetic oligonucleotide
cgttaaaacctcacgctgctgtcctcgg

SEQ ID NO: 301614 - DNA, 30 bp, Artificial Sequence
  Description of Artificial Sequence: Synthetic oligonucleotide
gttaaaacctcacgctgctgtcctcggatg

SEQ ID NO: 301615 - DNA, 30 bp, Artificial Sequence
  Description of Artificial Sequence: Synthetic oligonucleotide
ttaaaacctcacgctgctgtcctcggatgg

SEQ ID NO: 301616 - DNA, 29 bp, Artificial Sequence
  Description of Artificial Sequence: Synthetic oligonucleotide
taaaacctcacgctgctgtcctcggatgg

SEQ ID NO: 301617 - DNA, 28 bp, Artificial Sequence
  Description of Artificial Sequence: Synthetic oligonucleotide
aaaacctcacgctgctgtcctcggatgg

SEQ ID NO: 301618 - DNA, 27 bp, Artificial Sequence
  Description of Artificial Sequence: Synthetic oligonucleotide
aaacctcacgctgctgtcctcggatgg

SEQ ID NO: 301619 - DNA, 27 bp, Artificial Sequence
  Description of Artificial Sequence: Synthetic oligonucleotide
aacctcacgctgctgtcctcggatgga

SEQ ID NO: 301620 - DNA, 27 bp, Artificial Sequence
  Description of Artificial Sequence: Synthetic oligonucleotide
acctcacgctgctgtcctcggatggat

SEQ ID NO: 301621 - DNA, 26 bp, Artificial Sequence
  Description of Artificial Sequence: Synthetic oligonucleotide
cctcacgctgctgtcctcggatggat

SEQ ID NO: 301622 - DNA, 27 bp, Artificial Sequence
  Description of Artificial Sequence: Synthetic oligonucleotide
ctcacgctgctgtcctcggatggatca

SEQ ID NO: 301623 - DNA, 27 bp, Artificial Sequence
  Description of Artificial Sequence: Synthetic oligonucleotide
tcacgctgctgtcctcggatggatcag

SEQ ID NO: 301624 - DNA, 27 bp, Artificial Sequence
  Description of Artificial Sequence: Synthetic oligonucleotide
cacgctgctgtcctcggatggatcagt

SEQ ID NO: 301625 - DNA, 27 bp, Artificial Sequence
  Description of Artificial Sequence: Synthetic oligonucleotide
acgctgctgtcctcggatggatcagtg

SEQ ID NO: 301626 - DNA, 26 bp, Artificial Sequence
  Description of Artificial Sequence: Synthetic oligonucleotide
cgctgctgtcctcggatggatcagtg

SEQ ID NO: 301627 - DNA, 27 bp, Artificial Sequence
  Description of Artificial Sequence: Synthetic oligonucleotide
gctgctgtcctcggatggatcagtgca

SEQ ID NO: 301628 - DNA, 27 bp, Artificial Sequence
  Description of Artificial Sequence: Synthetic oligonucleotide
ctgctgtcctcggatggatcagtgcag

SEQ ID NO: 301629 - DNA, 28 bp, Artificial Sequence
  Description of Artificial Sequence: Synthetic oligonucleotide
tgctgtcctcggatggatcagtgcagtc

SEQ ID NO: 301630 - DNA, 27 bp, Artificial Sequence
  Description of Artificial Sequence: Synthetic oligonucleotide
gctgtcctcggatggatcagtgcagtc

SEQ ID NO: 301631 - DNA, 28 bp, Artificial Sequence
  Description of Artificial Sequence: Synthetic oligonucleotide
ctgtcctcggatggatcagtgcagtcac

SEQ ID NO: 301632 - DNA, 28 bp, Artificial Sequence
  Description of Artificial Sequence: Synthetic oligonucleotide
tgtcctcggatggatcagtgcagtcacg

SEQ ID NO: 301633 - DNA, 27 bp, Artificial Sequence
  Description of Artificial Sequence: Synthetic oligonucleotide
gtcctcggatggatcagtgcagtcacg

SEQ ID NO: 301634 - DNA, 27 bp, Artificial Sequence
  Description of Artificial Sequence: Synthetic oligonucleotide
tcctcggatggatcagtgcagtcacgg

SEQ ID NO: 301635 - DNA, 27 bp, Artificial Sequence
  Description of Artificial Sequence: Synthetic oligonucleotide
cctcggatggatcagtgcagtcacggt

SEQ ID NO: 301636 - DNA, 29 bp, Artificial Sequence
  Description of Artificial Sequence: Synthetic oligonucleotide
ctcggatggatcagtgcagtcacggtttc

SEQ ID NO: 301637 - DNA, 31 bp, Artificial Sequence
  Description of Artificial Sequence: Synthetic oligonucleotide
tcggatggatcagtgcagtcacggtttcttg

SEQ ID NO: 301638 - DNA, 30 bp, Artificial Sequence
  Description of Artificial Sequence: Synthetic oligonucleotide
cggatggatcagtgcagtcacggtttcttg

SEQ ID NO: 301639 - DNA, 30 bp, Artificial Sequence
  Description of Artificial Sequence: Synthetic oligonucleotide
ggatggatcagtgcagtcacggtttcttgg

SEQ ID NO: 301640 - DNA, 31 bp, Artificial Sequence
  Description of Artificial Sequence: Synthetic oligonucleotide
gatggatcagtgcagtcacggtttcttggtg

SEQ ID NO: 301641 - DNA, 32 bp, Artificial Sequence
  Description of Artificial Sequence: Synthetic oligonucleotide
atggatcagtgcagtcacggtttcttggtgag

SEQ ID NO: 301642 - DNA, 31 bp, Artificial Sequence
  Description of Artificial Sequence: Synthetic oligonucleotide
tggatcagtgcagtcacggtttcttggtgag

SEQ ID NO: 301643 - DNA, 30 bp, Artificial Sequence
  Description of Artificial Sequence: Synthetic oligonucleotide
ggatcagtgcagtcacggtttcttggtgag

SEQ ID NO: 301644 - DNA, 30 bp, Artificial Sequence
  Description of Artificial Sequence: Synthetic oligonucleotide
gatcagtgcagtcacggtttcttggtgagg

SEQ ID NO: 301645 - DNA, 32 bp, Artificial Sequence
  Description of Artificial Sequence: Synthetic oligonucleotide
atcagtgcagtcacggtttcttggtgaggtac

SEQ ID NO: 301646 - DNA, 31 bp, Artificial Sequence
  Description of Artificial Sequence: Synthetic oligonucleotide
tcagtgcagtcacggtttcttggtgaggtac

SEQ ID NO: 301647 - DNA, 30 bp, Artificial Sequence
  Description of Artificial Sequence: Synthetic oligonucleotide
cagtgcagtcacggtttcttggtgaggtac

SEQ ID NO: 301648 - DNA, 32 bp, Artificial Sequence
  Description of Artificial Sequence: Synthetic oligonucleotide
agtgcagtcacggtttcttggtgaggtacaac

SEQ ID NO: 301649 - DNA, 31 bp, Artificial Sequence
  Description of Artificial Sequence: Synthetic oligonucleotide
gtgcagtcacggtttcttggtgaggtacaac

SEQ ID NO: 301650 - DNA, 32 bp, Artificial Sequence
  Description of Artificial Sequence: Synthetic oligonucleotide
tgcagtcacggtttcttggtgaggtacaactg

SEQ ID NO: 301651 - DNA, 31 bp, Artificial Sequence
  Description of Artificial Sequence: Synthetic oligonucleotide
gcagtcacggtttcttggtgaggtacaactg

SEQ ID NO: 301652 - DNA, 31 bp, Artificial Sequence
  Description of Artificial Sequence: Synthetic oligonucleotide
cagtcacggtttcttggtgaggtacaactgg

SEQ ID NO: 301653 - DNA, 33 bp, Artificial Sequence
  Description of Artificial Sequence: Synthetic oligonucleotide
agtcacggtttcttggtgaggtacaactggatg

SEQ ID NO: 301654 - DNA, 32 bp, Artificial Sequence
  Description of Artificial Sequence: Synthetic oligonucleotide
gtcacggtttcttggtgaggtacaactggatg

SEQ ID NO: 301655 - DNA, 32 bp, Artificial Sequence
  Description of Artificial Sequence: Synthetic oligonucleotide
tcacggtttcttggtgaggtacaactggatgg

SEQ ID NO: 301656 - DNA, 31 bp, Artificial Sequence
  Description of Artificial Sequence: Synthetic oligonucleotide
cacggtttcttggtgaggtacaactggatgg

SEQ ID NO: 301657 - DNA, 32 bp, Artificial Sequence
  Description of Artificial Sequence: Synthetic oligonucleotide
acggtttcttggtgaggtacaactggatggtg

SEQ ID NO: 301658 - DNA, 31 bp, Artificial Sequence
  Description of Artificial Sequence: Synthetic oligonucleotide
cggtttcttggtgaggtacaactggatggtg

SEQ ID NO: 301659 - DNA, 32 bp, Artificial Sequence
  Description of Artificial Sequence: Synthetic oligonucleotide
ggtttcttggtgaggtacaactggatggtgag

SEQ ID NO: 301660 - DNA, 32 bp, Artificial Sequence
  Description of Artificial Sequence: Synthetic oligonucleotide
gtttcttggtgaggtacaactggatggtgagc

SEQ ID NO: 301661 - DNA, 32 bp, Artificial Sequence
  Description of Artificial Sequence: Synthetic oligonucleotide
tttcttggtgaggtacaactggatggtgagcc

SEQ ID NO: 301662 - DNA, 31 bp, Artificial Sequence
  Description of Artificial Sequence: Synthetic oligonucleotide
ttcttggtgaggtacaactggatggtgagcc

SEQ ID NO: 301663 - DNA, 30 bp, Artificial Sequence
  Description of Artificial Sequence: Synthetic oligonucleotide
tcttggtgaggtacaactggatggtgagcc

SEQ ID NO: 301664 - DNA, 29 bp, Artificial Sequence
  Description of Artificial Sequence: Synthetic oligonucleotide
cttggtgaggtacaactggatggtgagcc

SEQ ID NO: 301665 - DNA, 29 bp, Artificial Sequence
  Description of Artificial Sequence: Synthetic oligonucleotide
ttggtgaggtacaactggatggtgagccc

SEQ ID NO: 301666 - DNA, 28 bp, Artificial Sequence
  Description of Artificial Sequence: Synthetic oligonucleotide
tggtgaggtacaactggatggtgagccc

SEQ ID NO: 301667 - DNA, 27 bp, Artificial Sequence
  Description of Artificial Sequence: Synthetic oligonucleotide
ggtgaggtacaactggatggtgagccc

SEQ ID NO: 301668 - DNA, 29 bp, Artificial Sequence
  Description of Artificial Sequence: Synthetic oligonucleotide
gtgaggtacaactggatggtgagcccttc

SEQ ID NO: 301669 - DNA, 29 bp, Artificial Sequence
  Description of Artificial Sequence: Synthetic oligonucleotide
tgaggtacaactggatggtgagcccttcc

SEQ ID NO: 301670 - DNA, 28 bp, Artificial Sequence
  Description of Artificial Sequence: Synthetic oligonucleotide
gaggtacaactggatggtgagcccttcc

SEQ ID NO: 301671 - DNA, 29 bp, Artificial Sequence
  Description of Artificial Sequence: Synthetic oligonucleotide
aggtacaactggatggtgagcccttccag

SEQ ID NO: 301672 - DNA, 28 bp, Artificial Sequence
  Description of Artificial Sequence: Synthetic oligonucleotide
ggtacaactggatggtgagcccttccag

SEQ ID NO: 301673 - DNA, 28 bp, Artificial Sequence
  Description of Artificial Sequence: Synthetic oligonucleotide
gtacaactggatggtgagcccttccagc

SEQ ID NO: 301674 - DNA, 28 bp, Artificial Sequence
  Description of Artificial Sequence: Synthetic oligonucleotide
tacaactggatggtgagcccttccagcg

SEQ ID NO: 301675 - DNA, 27 bp, Artificial Sequence
  Description of Artificial Sequence: Synthetic oligonucleotide
acaactggatggtgagcccttccagcg

SEQ ID NO: 301676 - DNA, 26 bp, Artificial Sequence
  Description of Artificial Sequence: Synthetic oligonucleotide
caactggatggtgagcccttccagcg

SEQ ID NO: 301677 - DNA, 27 bp, Artificial Sequence
  Description of Artificial Sequence: Synthetic oligonucleotide
aactggatggtgagcccttccagcgct

SEQ ID NO: 301678 - DNA, 27 bp, Artificial Sequence
  Description of Artificial Sequence: Synthetic oligonucleotide
actggatggtgagcccttccagcgcta

SEQ ID NO: 301679 - DNA, 27 bp, Artificial Sequence
  Description of Artificial Sequence: Synthetic oligonucleotide
ctggatggtgagcccttccagcgctat

SEQ ID NO: 301680 - DNA, 27 bp, Artificial Sequence
  Description of Artificial Sequence: Synthetic oligonucleotide
tggatggtgagcccttccagcgctatg

SEQ ID NO: 301681 - DNA, 27 bp, Artificial Sequence
  Description of Artificial Sequence: Synthetic oligonucleotide
ggatggtgagcccttccagcgctatga

SEQ ID NO: 301682 - DNA, 27 bp, Artificial Sequence
  Description of Artificial Sequence: Synthetic oligonucleotide
gatggtgagcccttccagcgctatgag

SEQ ID NO: 301683 - DNA, 28 bp, Artificial Sequence
  Description of Artificial Sequence: Synthetic oligonucleotide
atggtgagcccttccagcgctatgagag

SEQ ID NO: 301684 - DNA, 27 bp, Artificial Sequence
  Description of Artificial Sequence: Synthetic oligonucleotide
tggtgagcccttccagcgctatgagag

SEQ ID NO: 301685 - DNA, 26 bp, Artificial Sequence
  Description of Artificial Sequence: Synthetic oligonucleotide
ggtgagcccttccagcgctatgagag

SEQ ID NO: 301686 - DNA, 26 bp, Artificial Sequence
  Description of Artificial Sequence: Synthetic oligonucleotide
gtgagcccttccagcgctatgagagg

SEQ ID NO: 301687 - DNA, 27 bp, Artificial Sequence
  Description of Artificial Sequence: Synthetic oligonucleotide
tgagcccttccagcgctatgagaggca

SEQ ID NO: 301688 - DNA, 26 bp, Artificial Sequence
  Description of Artificial Sequence: Synthetic oligonucleotide
gagcccttccagcgctatgagaggca

SEQ ID NO: 301689 - DNA, 27 bp, Artificial Sequence
  Description of Artificial Sequence: Synthetic oligonucleotide
agcccttccagcgctatgagaggcaga

SEQ ID NO: 301690 - DNA, 27 bp, Artificial Sequence
  Description of Artificial Sequence: Synthetic oligonucleotide
gcccttccagcgctatgagaggcagaa

SEQ ID NO: 301691 - DNA, 29 bp, Artificial Sequence
  Description of Artificial Sequence: Synthetic oligonucleotide
cccttccagcgctatgagaggcagaaaag

SEQ ID NO: 301692 - DNA, 29 bp, Artificial Sequence
  Description of Artificial Sequence: Synthetic oligonucleotide
ccttccagcgctatgagaggcagaaaagc

SEQ ID NO: 301693 - DNA, 30 bp, Artificial Sequence
  Description of Artificial Sequence: Synthetic oligonucleotide
cttccagcgctatgagaggcagaaaagcag

SEQ ID NO: 301694 - DNA, 30 bp, Artificial Sequence
  Description of Artificial Sequence: Synthetic oligonucleotide
ttccagcgctatgagaggcagaaaagcagg

SEQ ID NO: 301695 - DNA, 29 bp, Artificial Sequence
  Description of Artificial Sequence: Synthetic oligonucleotide
tccagcgctatgagaggcagaaaagcagg

SEQ ID NO: 301696 - DNA, 28 bp, Artificial Sequence
  Description of Artificial Sequence: Synthetic oligonucleotide
ccagcgctatgagaggcagaaaagcagg

SEQ ID NO: 301697 - DNA, 28 bp, Artificial Sequence
  Description of Artificial Sequence: Synthetic oligonucleotide
cagcgctatgagaggcagaaaagcaggg

SEQ ID NO: 301698 - DNA, 28 bp, Artificial Sequence
  Description of Artificial Sequence: Synthetic oligonucleotide
agcgctatgagaggcagaaaagcagggc

SEQ ID NO: 301699 - DNA, 27 bp, Artificial Sequence
  Description of Artificial Sequence: Synthetic oligonucleotide
gcgctatgagaggcagaaaagcagggc

SEQ ID NO: 301700 - DNA, 30 bp, Artificial Sequence
  Description of Artificial Sequence: Synthetic oligonucleotide
cgctatgagaggcagaaaagcagggcaatg

SEQ ID NO: 301701 - DNA, 30 bp, Artificial Sequence
  Description of Artificial Sequence: Synthetic oligonucleotide
gctatgagaggcagaaaagcagggcaatgc

SEQ ID NO: 301702 - DNA, 30 bp, Artificial Sequence
  Description of Artificial Sequence: Synthetic oligonucleotide
ctatgagaggcagaaaagcagggcaatgcc

SEQ ID NO: 301703 - DNA, 30 bp, Artificial Sequence
  Description of Artificial Sequence: Synthetic oligonucleotide
tatgagaggcagaaaagcagggcaatgccc

SEQ ID NO: 301704 - DNA, 29 bp, Artificial Sequence
  Description of Artificial Sequence: Synthetic oligonucleotide
atgagaggcagaaaagcagggcaatgccc

SEQ ID NO: 301705 - DNA, 28 bp, Artificial Sequence
  Description of Artificial Sequence: Synthetic oligonucleotide
tgagaggcagaaaagcagggcaatgccc

SEQ ID NO: 301706 - DNA, 27 bp, Artificial Sequence
  Description of Artificial Sequence: Synthetic oligonucleotide
gagaggcagaaaagcagggcaatgccc

SEQ ID NO: 301707 - DNA, 27 bp, Artificial Sequence
  Description of Artificial Sequence: Synthetic oligonucleotide
agaggcagaaaagcagggcaatgcccc

SEQ ID NO: 301708 - DNA, 27 bp, Artificial Sequence
  Description of Artificial Sequence: Synthetic oligonucleotide
gaggcagaaaagcagggcaatgcccca

SEQ ID NO: 301709 - DNA, 27 bp, Artificial Sequence
  Description of Artificial Sequence: Synthetic oligonucleotide
aggcagaaaagcagggcaatgccccag

SEQ ID NO: 301710 - DNA, 26 bp, Artificial Sequence
  Description of Artificial Sequence: Synthetic oligonucleotide
ggcagaaaagcagggcaatgccccag

SEQ ID NO: 301711 - DNA, 26 bp, Artificial Sequence
  Description of Artificial Sequence: Synthetic oligonucleotide
gcagaaaagcagggcaatgccccagg

SEQ ID NO: 301712 - DNA, 27 bp, Artificial Sequence
  Description of Artificial Sequence: Synthetic oligonucleotide
cagaaaagcagggcaatgccccagggt

SEQ ID NO: 301713 - DNA, 27 bp, Artificial Sequence
  Description of Artificial Sequence: Synthetic oligonucleotide
agaaaagcagggcaatgccccagggtc

SEQ ID NO: 301714 - DNA, 27 bp, Artificial Sequence
  Description of Artificial Sequence: Synthetic oligonucleotide
gaaaagcagggcaatgccccagggtca

SEQ ID NO: 301715 - DNA, 27 bp, Artificial Sequence
  Description of Artificial Sequence: Synthetic oligonucleotide
aaaagcagggcaatgccccagggtcag

SEQ ID NO: 301716 - DNA, 27 bp, Artificial Sequence
  Description of Artificial Sequence: Synthetic oligonucleotide
aaagcagggcaatgccccagggtcagt

SEQ ID NO: 301717 - DNA, 26 bp, Artificial Sequence
  Description of Artificial Sequence: Synthetic oligonucleotide
aagcagggcaatgccccagggtcagt

SEQ ID NO: 301718 - DNA, 25 bp, Artificial Sequence
  Description of Artificial Sequence: Synthetic oligonucleotide
agcagggcaatgccccagggtcagt

SEQ ID NO: 301719 - DNA, 24 bp, Artificial Sequence
  Description of Artificial Sequence: Synthetic oligonucleotide
gcagggcaatgccccagggtcagt

SEQ ID NO: 301720 - DNA, 24 bp, Artificial Sequence
  Description of Artificial Sequence: Synthetic oligonucleotide
cagggcaatgccccagggtcagtg

SEQ ID NO: 301721 - DNA, 24 bp, Artificial Sequence
  Description of Artificial Sequence: Synthetic oligonucleotide
agggcaatgccccagggtcagtgg

SEQ ID NO: 301722 - DNA, 23 bp, Artificial Sequence
  Description of Artificial Sequence: Synthetic oligonucleotide
gggcaatgccccagggtcagtgg

SEQ ID NO: 301723 - DNA, 23 bp, Artificial Sequence
  Description of Artificial Sequence: Synthetic oligonucleotide
ggcaatgccccagggtcagtggg

SEQ ID NO: 301724 - DNA, 24 bp, Artificial Sequence
  Description of Artificial Sequence: Synthetic oligonucleotide
gcaatgccccagggtcagtgggca

SEQ ID NO: 301725 - DNA, 26 bp, Artificial Sequence
  Description of Artificial Sequence: Synthetic oligonucleotide
caatgccccagggtcagtgggcacaa

SEQ ID NO: 301726 - DNA, 27 bp, Artificial Sequence
  Description of Artificial Sequence: Synthetic oligonucleotide
aatgccccagggtcagtgggcacaaga

SEQ ID NO: 301727 - DNA, 27 bp, Artificial Sequence
  Description of Artificial Sequence: Synthetic oligonucleotide
atgccccagggtcagtgggcacaagat

SEQ ID NO: 301728 - DNA, 26 bp, Artificial Sequence
  Description of Artificial Sequence: Synthetic oligonucleotide
tgccccagggtcagtgggcacaagat

SEQ ID NO: 301729 - DNA, 25 bp, Artificial Sequence
  Description of Artificial Sequence: Synthetic oligonucleotide
gccccagggtcagtgggcacaagat

SEQ ID NO: 301730 - DNA, 26 bp, Artificial Sequence
  Description of Artificial Sequence: Synthetic oligonucleotide
ccccagggtcagtgggcacaagatgt

SEQ ID NO: 301731 - DNA, 26 bp, Artificial Sequence
  Description of Artificial Sequence: Synthetic oligonucleotide
cccagggtcagtgggcacaagatgtc

SEQ ID NO: 301732 - DNA, 27 bp, Artificial Sequence
  Description of Artificial Sequence: Synthetic oligonucleotide
ccagggtcagtgggcacaagatgtcca

SEQ ID NO: 301733 - DNA, 27 bp, Artificial Sequence
  Description of Artificial Sequence: Synthetic oligonucleotide
cagggtcagtgggcacaagatgtccag

SEQ ID NO: 301734 - DNA, 27 bp, Artificial Sequence
  Description of Artificial Sequence: Synthetic oligonucleotide
agggtcagtgggcacaagatgtccagg

SEQ ID NO: 301735 - DNA, 26 bp, Artificial Sequence
  Description of Artificial Sequence: Synthetic oligonucleotide
gggtcagtgggcacaagatgtccagg

SEQ ID NO: 301736 - DNA, 27 bp, Artificial Sequence
  Description of Artificial Sequence: Synthetic oligonucleotide
ggtcagtgggcacaagatgtccaggga

SEQ ID NO: 301737 - DNA, 32 bp, Artificial Sequence
  Description of Artificial Sequence: Synthetic oligonucleotide
gtcagtgggcacaagatgtccagggaaataac

SEQ ID NO: 301738 - DNA, 33 bp, Artificial Sequence
  Description of Artificial Sequence: Synthetic oligonucleotide
tcagtgggcacaagatgtccagggaaataacac

SEQ ID NO: 301739 - DNA, 32 bp, Artificial Sequence
  Description of Artificial Sequence: Synthetic oligonucleotide
cagtgggcacaagatgtccagggaaataacac

SEQ ID NO: 301740 - DNA, 34 bp, Artificial Sequence
  Description of Artificial Sequence: Synthetic oligonucleotide
agtgggcacaagatgtccagggaaataacacatg

SEQ ID NO: 301741 - DNA, 33 bp, Artificial Sequence
  Description of Artificial Sequence: Synthetic oligonucleotide
gtgggcacaagatgtccagggaaataacacatg

SEQ ID NO: 301742 - DNA, 33 bp, Artificial Sequence
  Description of Artificial Sequence: Synthetic oligonucleotide
tgggcacaagatgtccagggaaataacacatgg

SEQ ID NO: 301743 - DNA, 32 bp, Artificial Sequence
  Description of Artificial Sequence: Synthetic oligonucleotide
gggcacaagatgtccagggaaataacacatgg

SEQ ID NO: 301744 - DNA, 32 bp, Artificial Sequence
  Description of Artificial Sequence: Synthetic oligonucleotide
ggcacaagatgtccagggaaataacacatggg

SEQ ID NO: 301745 - DNA, 33 bp, Artificial Sequence
  Description of Artificial Sequence: Synthetic oligonucleotide
gcacaagatgtccagggaaataacacatgggac

SEQ ID NO: 301746 - DNA, 34 bp, Artificial Sequence
  Description of Artificial Sequence: Synthetic oligonucleotide
cacaagatgtccagggaaataacacatgggactg

SEQ ID NO: 301747 - DNA, 35 bp, Artificial Sequence
  Description of Artificial Sequence: Synthetic oligonucleotide
acaagatgtccagggaaataacacatgggactgag

SEQ ID NO: 301748 - DNA, 34 bp, Artificial Sequence
  Description of Artificial Sequence: Synthetic oligonucleotide
caagatgtccagggaaataacacatgggactgag

SEQ ID NO: 301749 - DNA, 35 bp, Artificial Sequence
  Description of Artificial Sequence: Synthetic oligonucleotide
aagatgtccagggaaataacacatgggactgagag

SEQ ID NO: 301750 - DNA, 34 bp, Artificial Sequence
  Description of Artificial Sequence: Synthetic oligonucleotide
agatgtccagggaaataacacatgggactgagag

SEQ ID NO: 301751 - DNA, 33 bp, Artificial Sequence
  Description of Artificial Sequence: Synthetic oligonucleotide
gatgtccagggaaataacacatgggactgagag

SEQ ID NO: 301752 - DNA, 34 bp, Artificial Sequence
  Description of Artificial Sequence: Synthetic oligonucleotide
atgtccagggaaataacacatgggactgagagac

SEQ ID NO: 301753 - DNA, 33 bp, Artificial Sequence
  Description of Artificial Sequence: Synthetic oligonucleotide
tgtccagggaaataacacatgggactgagagac

SEQ ID NO: 301754 - DNA, 32 bp, Artificial Sequence
  Description of Artificial Sequence: Synthetic oligonucleotide
gtccagggaaataacacatgggactgagagac

SEQ ID NO: 301755 - DNA, 32 bp, Artificial Sequence
  Description of Artificial Sequence: Synthetic oligonucleotide
tccagggaaataacacatgggactgagagacc

SEQ ID NO: 301756 - DNA, 31 bp, Artificial Sequence
  Description of Artificial Sequence: Synthetic oligonucleotide
ccagggaaataacacatgggactgagagacc

SEQ ID NO: 301757 - DNA, 32 bp, Artificial Sequence
  Description of Artificial Sequence: Synthetic oligonucleotide
cagggaaataacacatgggactgagagaccac

SEQ ID NO: 301758 - DNA, 32 bp, Artificial Sequence
  Description of Artificial Sequence: Synthetic oligonucleotide
agggaaataacacatgggactgagagaccacg

SEQ ID NO: 301759 - DNA, 31 bp, Artificial Sequence
  Description of Artificial Sequence: Synthetic oligonucleotide
gggaaataacacatgggactgagagaccacg

SEQ ID NO: 301760 - DNA, 31 bp, Artificial Sequence
  Description of Artificial Sequence: Synthetic oligonucleotide
ggaaataacacatgggactgagagaccacgg

SEQ ID NO: 301761 - DNA, 32 bp, Artificial Sequence
  Description of Artificial Sequence: Synthetic oligonucleotide
gaaataacacatgggactgagagaccacggac

SEQ ID NO: 301762 - DNA, 34 bp, Artificial Sequence
  Description of Artificial Sequence: Synthetic oligonucleotide
aaataacacatgggactgagagaccacggacttg

SEQ ID NO: 301763 - DNA, 33 bp, Artificial Sequence
  Description of Artificial Sequence: Synthetic oligonucleotide
aataacacatgggactgagagaccacggacttg

SEQ ID NO: 301764 - DNA, 32 bp, Artificial Sequence
  Description of Artificial Sequence: Synthetic oligonucleotide
ataacacatgggactgagagaccacggacttg

SEQ ID NO: 301765 - DNA, 31 bp, Artificial Sequence
  Description of Artificial Sequence: Synthetic oligonucleotide
taacacatgggactgagagaccacggacttg

SEQ ID NO: 301766 - DNA, 30 bp, Artificial Sequence
  Description of Artificial Sequence: Synthetic oligonucleotide
aacacatgggactgagagaccacggacttg

SEQ ID NO: 301767 - DNA, 29 bp, Artificial Sequence
  Description of Artificial Sequence: Synthetic oligonucleotide
acacatgggactgagagaccacggacttg

SEQ ID NO: 301768 - DNA, 28 bp, Artificial Sequence
  Description of Artificial Sequence: Synthetic oligonucleotide
cacatgggactgagagaccacggacttg

SEQ ID NO: 301769 - DNA, 29 bp, Artificial Sequence
  Description of Artificial Sequence: Synthetic oligonucleotide
acatgggactgagagaccacggacttgac

SEQ ID NO: 301770 - DNA, 28 bp, Artificial Sequence
  Description of Artificial Sequence: Synthetic oligonucleotide
catgggactgagagaccacggacttgac

SEQ ID NO: 301771 - DNA, 29 bp, Artificial Sequence
  Description of Artificial Sequence: Synthetic oligonucleotide
atgggactgagagaccacggacttgactg

SEQ ID NO: 301772 - DNA, 28 bp, Artificial Sequence
  Description of Artificial Sequence: Synthetic oligonucleotide
tgggactgagagaccacggacttgactg

SEQ ID NO: 301773 - DNA, 27 bp, Artificial Sequence
  Description of Artificial Sequence: Synthetic oligonucleotide
gggactgagagaccacggacttgactg

SEQ ID NO: 301774 - DNA, 27 bp, Artificial Sequence
  Description of Artificial Sequence: Synthetic oligonucleotide
ggactgagagaccacggacttgactgg

SEQ ID NO: 301775 - DNA, 27 bp, Artificial Sequence
  Description of Artificial Sequence: Synthetic oligonucleotide
gactgagagaccacggacttgactggg

SEQ ID NO: 301776 - DNA, 29 bp, Artificial Sequence
  Description of Artificial Sequence: Synthetic oligonucleotide
actgagagaccacggacttgactgggaac

SEQ ID NO: 301777 - DNA, 28 bp, Artificial Sequence
  Description of Artificial Sequence: Synthetic oligonucleotide
ctgagagaccacggacttgactgggaac

SEQ ID NO: 301778 - DNA, 28 bp, Artificial Sequence
  Description of Artificial Sequence: Synthetic oligonucleotide
tgagagaccacggacttgactgggaacg

SEQ ID NO: 301779 - DNA, 27 bp, Artificial Sequence
  Description of Artificial Sequence: Synthetic oligonucleotide
gagagaccacggacttgactgggaacg

SEQ ID NO: 301780 - DNA, 27 bp, Artificial Sequence
  Description of Artificial Sequence: Synthetic oligonucleotide
agagaccacggacttgactgggaacgg

SEQ ID NO: 301781 - DNA, 27 bp, Artificial Sequence
  Description of Artificial Sequence: Synthetic oligonucleotide
gagaccacggacttgactgggaacgga

SEQ ID NO: 301782 - DNA, 29 bp, Artificial Sequence
  Description of Artificial Sequence: Synthetic oligonucleotide
agaccacggacttgactgggaacggatag

SEQ ID NO: 301783 - DNA, 28 bp, Artificial Sequence
  Description of Artificial Sequence: Synthetic oligonucleotide
gaccacggacttgactgggaacggatag

SEQ ID NO: 301784 - DNA, 28 bp, Artificial Sequence
  Description of Artificial Sequence: Synthetic oligonucleotide
accacggacttgactgggaacggatagg

SEQ ID NO: 301785 - DNA, 27 bp, Artificial Sequence
  Description of Artificial Sequence: Synthetic oligonucleotide
ccacggacttgactgggaacggatagg

SEQ ID NO: 301786 - DNA, 28 bp, Artificial Sequence
  Description of Artificial Sequence: Synthetic oligonucleotide
cacggacttgactgggaacggataggac

SEQ ID NO: 301787 - DNA, 28 bp, Artificial Sequence
  Description of Artificial Sequence: Synthetic oligonucleotide
acggacttgactgggaacggataggacc

SEQ ID NO: 301788 - DNA, 27 bp, Artificial Sequence
  Description of Artificial Sequence: Synthetic oligonucleotide
cggacttgactgggaacggataggacc

SEQ ID NO: 301789 - DNA, 28 bp, Artificial Sequence
  Description of Artificial Sequence: Synthetic oligonucleotide
ggacttgactgggaacggataggacctc

SEQ ID NO: 301790 - DNA, 29 bp, Artificial Sequence
  Description of Artificial Sequence: Synthetic oligonucleotide
gacttgactgggaacggataggacctcac

SEQ ID NO: 301791 - DNA, 29 bp, Artificial Sequence
  Description of Artificial Sequence: Synthetic oligonucleotide
acttgactgggaacggataggacctcacg

SEQ ID NO: 301792 - DNA, 28 bp, Artificial Sequence
  Description of Artificial Sequence: Synthetic oligonucleotide
cttgactgggaacggataggacctcacg

SEQ ID NO: 301793 - DNA, 30 bp, Artificial Sequence
  Description of Artificial Sequence: Synthetic oligonucleotide
ttgactgggaacggataggacctcacgatg

SEQ ID NO: 301794 - DNA, 29 bp, Artificial Sequence
  Description of Artificial Sequence: Synthetic oligonucleotide
tgactgggaacggataggacctcacgatg

SEQ ID NO: 301795 - DNA, 28 bp, Artificial Sequence
  Description of Artificial Sequence: Synthetic oligonucleotide
gactgggaacggataggacctcacgatg

SEQ ID NO: 301796 - DNA, 29 bp, Artificial Sequence
  Description of Artificial Sequence: Synthetic oligonucleotide
actgggaacggataggacctcacgatgac

SEQ ID NO: 301797 - DNA, 28 bp, Artificial Sequence
  Description of Artificial Sequence: Synthetic oligonucleotide
ctgggaacggataggacctcacgatgac

SEQ ID NO: 301798 - DNA, 28 bp, Artificial Sequence
  Description of Artificial Sequence: Synthetic oligonucleotide
tgggaacggataggacctcacgatgacc

SEQ ID NO: 301799 - DNA, 27 bp, Artificial Sequence
  Description of Artificial Sequence: Synthetic oligonucleotide
gggaacggataggacctcacgatgacc

SEQ ID NO: 301800 - DNA, 27 bp, Artificial Sequence
  Description of Artificial Sequence: Synthetic oligonucleotide
ggaacggataggacctcacgatgaccc

SEQ ID NO: 301801 - DNA, 28 bp, Artificial Sequence
  Description of Artificial Sequence: Synthetic oligonucleotide
gaacggataggacctcacgatgaccctc

SEQ ID NO: 301802 - DNA, 28 bp, Artificial Sequence
  Description of Artificial Sequence: Synthetic oligonucleotide
aacggataggacctcacgatgaccctcg

SEQ ID NO: 301803 - DNA, 27 bp, Artificial Sequence
  Description of Artificial Sequence: Synthetic oligonucleotide
acggataggacctcacgatgaccctcg

SEQ ID NO: 301804 - DNA, 26 bp, Artificial Sequence
  Description of Artificial Sequence: Synthetic oligonucleotide
cggataggacctcacgatgaccctcg

SEQ ID NO: 301805 - DNA, 27 bp, Artificial Sequence
  Description of Artificial Sequence: Synthetic oligonucleotide
ggataggacctcacgatgaccctcgct

SEQ ID NO: 301806 - DNA, 27 bp, Artificial Sequence
  Description of Artificial Sequence: Synthetic oligonucleotide
gataggacctcacgatgaccctcgctc

SEQ ID NO: 301807 - DNA, 31 bp, Artificial Sequence
  Description of Artificial Sequence: Synthetic oligonucleotide
ataggacctcacgatgaccctcgctcatatc

SEQ ID NO: 301808 - DNA, 30 bp, Artificial Sequence
  Description of Artificial Sequence: Synthetic oligonucleotide
taggacctcacgatgaccctcgctcatatc

SEQ ID NO: 301809 - DNA, 29 bp, Artificial Sequence
  Description of Artificial Sequence: Synthetic oligonucleotide
aggacctcacgatgaccctcgctcatatc

SEQ ID NO: 301810 - DNA, 28 bp, Artificial Sequence
  Description of Artificial Sequence: Synthetic oligonucleotide
ggacctcacgatgaccctcgctcatatc

SEQ ID NO: 301811 - DNA, 30 bp, Artificial Sequence
  Description of Artificial Sequence: Synthetic oligonucleotide
gacctcacgatgaccctcgctcatatctag

SEQ ID NO: 301812 - DNA, 30 bp, Artificial Sequence
  Description of Artificial Sequence: Synthetic oligonucleotide
acctcacgatgaccctcgctcatatctagg

SEQ ID NO: 301813 - DNA, 29 bp, Artificial Sequence
  Description of Artificial Sequence: Synthetic oligonucleotide
cctcacgatgaccctcgctcatatctagg

SEQ ID NO: 301814 - DNA, 30 bp, Artificial Sequence
  Description of Artificial Sequence: Synthetic oligonucleotide
ctcacgatgaccctcgctcatatctaggac

SEQ ID NO: 301815 - DNA, 30 bp, Artificial Sequence
  Description of Artificial Sequence: Synthetic oligonucleotide
tcacgatgaccctcgctcatatctaggacc

SEQ ID NO: 301816 - DNA, 29 bp, Artificial Sequence
  Description of Artificial Sequence: Synthetic oligonucleotide
cacgatgaccctcgctcatatctaggacc

SEQ ID NO: 301817 - DNA, 30 bp, Artificial Sequence
  Description of Artificial Sequence: Synthetic oligonucleotide
acgatgaccctcgctcatatctaggaccag

SEQ ID NO: 301818 - DNA, 29 bp, Artificial Sequence
  Description of Artificial Sequence: Synthetic oligonucleotide
cgatgaccctcgctcatatctaggaccag

SEQ ID NO: 301819 - DNA, 32 bp, Artificial Sequence
  Description of Artificial Sequence: Synthetic oligonucleotide
gatgaccctcgctcatatctaggaccagatag

SEQ ID NO: 301820 - DNA, 34 bp, Artificial Sequence
  Description of Artificial Sequence: Synthetic oligonucleotide
atgaccctcgctcatatctaggaccagatagaag

SEQ ID NO: 301821 - DNA, 33 bp, Artificial Sequence
  Description of Artificial Sequence: Synthetic oligonucleotide
tgaccctcgctcatatctaggaccagatagaag

SEQ ID NO: 301822 - DNA, 32 bp, Artificial Sequence
  Description of Artificial Sequence: Synthetic oligonucleotide
gaccctcgctcatatctaggaccagatagaag

SEQ ID NO: 301823 - DNA, 32 bp, Artificial Sequence
  Description of Artificial Sequence: Synthetic oligonucleotide
accctcgctcatatctaggaccagatagaagg

SEQ ID NO: 301824 - DNA, 31 bp, Artificial Sequence
  Description of Artificial Sequence: Synthetic oligonucleotide
ccctcgctcatatctaggaccagatagaagg

SEQ ID NO: 301825 - DNA, 31 bp, Artificial Sequence
  Description of Artificial Sequence: Synthetic oligonucleotide
cctcgctcatatctaggaccagatagaaggc

SEQ ID NO: 301826 - DNA, 33 bp, Artificial Sequence
  Description of Artificial Sequence: Synthetic oligonucleotide
ctcgctcatatctaggaccagatagaaggcttc

SEQ ID NO: 301827 - DNA, 33 bp, Artificial Sequence
  Description of Artificial Sequence: Synthetic oligonucleotide
tcgctcatatctaggaccagatagaaggcttcc

SEQ ID NO: 301828 - DNA, 32 bp, Artificial Sequence
  Description of Artificial Sequence: Synthetic oligonucleotide
cgctcatatctaggaccagatagaaggcttcc

SEQ ID NO: 301829 - DNA, 35 bp, Artificial Sequence
  Description of Artificial Sequence: Synthetic oligonucleotide
gctcatatctaggaccagatagaaggcttccattc

SEQ ID NO: 301830 - DNA, 35 bp, Artificial Sequence
  Description of Artificial Sequence: Synthetic oligonucleotide
ctcatatctaggaccagatagaaggcttccattcc

SEQ ID NO: 301831 - DNA, 35 bp, Artificial Sequence
  Description of Artificial Sequence: Synthetic oligonucleotide
tcatatctaggaccagatagaaggcttccattccc

SEQ ID NO: 301832 - DNA, 34 bp, Artificial Sequence
  Description of Artificial Sequence: Synthetic oligonucleotide
catatctaggaccagatagaaggcttccattccc

SEQ ID NO: 301833 - DNA, 35 bp, Artificial Sequence
  Description of Artificial Sequence: Synthetic oligonucleotide
atatctaggaccagatagaaggcttccattccctc

SEQ ID NO: 301834 - DNA, 34 bp, Artificial Sequence
  Description of Artificial Sequence: Synthetic oligonucleotide
tatctaggaccagatagaaggcttccattccctc

SEQ ID NO: 301835 - DNA, 33 bp, Artificial Sequence
  Description of Artificial Sequence: Synthetic oligonucleotide
atctaggaccagatagaaggcttccattccctc

SEQ ID NO: 301836 - DNA, 32 bp, Artificial Sequence
  Description of Artificial Sequence: Synthetic oligonucleotide
tctaggaccagatagaaggcttccattccctc

SEQ ID NO: 301837 - DNA, 31 bp, Artificial Sequence
  Description of Artificial Sequence: Synthetic oligonucleotide
ctaggaccagatagaaggcttccattccctc

SEQ ID NO: 301838 - DNA, 31 bp, Artificial Sequence
  Description of Artificial Sequence: Synthetic oligonucleotide
taggaccagatagaaggcttccattccctcg

SEQ ID NO: 301839 - DNA, 30 bp, Artificial Sequence
  Description of Artificial Sequence: Synthetic oligonucleotide
aggaccagatagaaggcttccattccctcg

SEQ ID NO: 301840 - DNA, 29 bp, Artificial Sequence
  Description of Artificial Sequence: Synthetic oligonucleotide
ggaccagatagaaggcttccattccctcg

SEQ ID NO: 301841 - DNA, 30 bp, Artificial Sequence
  Description of Artificial Sequence: Synthetic oligonucleotide
gaccagatagaaggcttccattccctcgag

SEQ ID NO: 301842 - DNA, 30 bp, Artificial Sequence
  Description of Artificial Sequence: Synthetic oligonucleotide
accagatagaaggcttccattccctcgagg

SEQ ID NO: 301843 - DNA, 29 bp, Artificial Sequence
  Description of Artificial Sequence: Synthetic oligonucleotide
ccagatagaaggcttccattccctcgagg

SEQ ID NO: 301844 - DNA, 30 bp, Artificial Sequence
  Description of Artificial Sequence: Synthetic oligonucleotide
cagatagaaggcttccattccctcgaggag

SEQ ID NO: 301845 - DNA, 34 bp, Artificial Sequence
  Description of Artificial Sequence: Synthetic oligonucleotide
agatagaaggcttccattccctcgaggagattac

SEQ ID NO: 301846 - DNA, 33 bp, Artificial Sequence
  Description of Artificial Sequence: Synthetic oligonucleotide
gatagaaggcttccattccctcgaggagattac

SEQ ID NO: 301847 - DNA, 33 bp, Artificial Sequence
  Description of Artificial Sequence: Synthetic oligonucleotide
atagaaggcttccattccctcgaggagattacg

SEQ ID NO: 301848 - DNA, 32 bp, Artificial Sequence
  Description of Artificial Sequence: Synthetic oligonucleotide
tagaaggcttccattccctcgaggagattacg

SEQ ID NO: 301849 - DNA, 31 bp, Artificial Sequence
  Description of Artificial Sequence: Synthetic oligonucleotide
agaaggcttccattccctcgaggagattacg

SEQ ID NO: 301850 - DNA, 30 bp, Artificial Sequence
  Description of Artificial Sequence: Synthetic oligonucleotide
gaaggcttccattccctcgaggagattacg

SEQ ID NO: 301851 - DNA, 30 bp, Artificial Sequence
  Description of Artificial Sequence: Synthetic oligonucleotide
aaggcttccattccctcgaggagattacgg

SEQ ID NO: 301852 - DNA, 29 bp, Artificial Sequence
  Description of Artificial Sequence: Synthetic oligonucleotide
aggcttccattccctcgaggagattacgg

SEQ ID NO: 301853 - DNA, 28 bp, Artificial Sequence
  Description of Artificial Sequence: Synthetic oligonucleotide
ggcttccattccctcgaggagattacgg

SEQ ID NO: 301854 - DNA, 29 bp, Artificial Sequence
  Description of Artificial Sequence: Synthetic oligonucleotide
gcttccattccctcgaggagattacggtc

SEQ ID NO: 301855 - DNA, 30 bp, Artificial Sequence
  Description of Artificial Sequence: Synthetic oligonucleotide
cttccattccctcgaggagattacggtctg

SEQ ID NO: 301856 - DNA, 31 bp, Artificial Sequence
  Description of Artificial Sequence: Synthetic oligonucleotide
ttccattccctcgaggagattacggtctgtg

SEQ ID NO: 301857 - DNA, 30 bp, Artificial Sequence
  Description of Artificial Sequence: Synthetic oligonucleotide
tccattccctcgaggagattacggtctgtg

SEQ ID NO: 301858 - DNA, 29 bp, Artificial Sequence
  Description of Artificial Sequence: Synthetic oligonucleotide
ccattccctcgaggagattacggtctgtg

SEQ ID NO: 301859 - DNA, 30 bp, Artificial Sequence
  Description of Artificial Sequence: Synthetic oligonucleotide
cattccctcgaggagattacggtctgtgac

SEQ ID NO: 301860 - DNA, 32 bp, Artificial Sequence
  Description of Artificial Sequence: Synthetic oligonucleotide
attccctcgaggagattacggtctgtgacatc

SEQ ID NO: 301861 - DNA, 31 bp, Artificial Sequence
  Description of Artificial Sequence: Synthetic oligonucleotide
ttccctcgaggagattacggtctgtgacatc

SEQ ID NO: 301862 - DNA, 30 bp, Artificial Sequence
  Description of Artificial Sequence: Synthetic oligonucleotide
tccctcgaggagattacggtctgtgacatc

SEQ ID NO: 301863 - DNA, 29 bp, Artificial Sequence
  Description of Artificial Sequence: Synthetic oligonucleotide
ccctcgaggagattacggtctgtgacatc

SEQ ID NO: 301864 - DNA, 29 bp, Artificial Sequence
  Description of Artificial Sequence: Synthetic oligonucleotide
cctcgaggagattacggtctgtgacatcc

SEQ ID NO: 301865 - DNA, 31 bp, Artificial Sequence
  Description of Artificial Sequence: Synthetic oligonucleotide
ctcgaggagattacggtctgtgacatccatg

SEQ ID NO: 301866 - DNA, 33 bp, Artificial Sequence
  Description of Artificial Sequence: Synthetic oligonucleotide
tcgaggagattacggtctgtgacatccatgaac

SEQ ID NO: 301867 - DNA, 32 bp, Artificial Sequence
  Description of Artificial Sequence: Synthetic oligonucleotide
cgaggagattacggtctgtgacatccatgaac

SEQ ID NO: 301868 - DNA, 33 bp, Artificial Sequence
  Description of Artificial Sequence: Synthetic oligonucleotide
gaggagattacggtctgtgacatccatgaacac

SEQ ID NO: 301869 - DNA, 35 bp, Artificial Sequence
  Description of Artificial Sequence: Synthetic oligonucleotide
aggagattacggtctgtgacatccatgaacacaac

SEQ ID NO: 301870 - DNA, 34 bp, Artificial Sequence
  Description of Artificial Sequence: Synthetic oligonucleotide
ggagattacggtctgtgacatccatgaacacaac

SEQ ID NO: 301871 - DNA, 35 bp, Artificial Sequence
  Description of Artificial Sequence: Synthetic oligonucleotide
gagattacggtctgtgacatccatgaacacaacag

SEQ ID NO: 301872 - DNA, 35 bp, Artificial Sequence
  Description of Artificial Sequence: Synthetic oligonucleotide
agattacggtctgtgacatccatgaacacaacagc

SEQ ID NO: 301873 - DNA, 34 bp, Artificial Sequence
  Description of Artificial Sequence: Synthetic oligonucleotide
gattacggtctgtgacatccatgaacacaacagc

SEQ ID NO: 301874 - DNA, 35 bp, Artificial Sequence
  Description of Artificial Sequence: Synthetic oligonucleotide
attacggtctgtgacatccatgaacacaacagcag

SEQ ID NO: 301875 - DNA, 34 bp, Artificial Sequence
  Description of Artificial Sequence: Synthetic oligonucleotide
ttacggtctgtgacatccatgaacacaacagcag

SEQ ID NO: 301876 - DNA, 33 bp, Artificial Sequence
  Description of Artificial Sequence: Synthetic oligonucleotide
tacggtctgtgacatccatgaacacaacagcag

SEQ ID NO: 301877 - DNA, 32 bp, Artificial Sequence
  Description of Artificial Sequence: Synthetic oligonucleotide
acggtctgtgacatccatgaacacaacagcag

SEQ ID NO: 301878 - DNA, 31 bp, Artificial Sequence
  Description of Artificial Sequence: Synthetic oligonucleotide
cggtctgtgacatccatgaacacaacagcag

SEQ ID NO: 301879 - DNA, 31 bp, Artificial Sequence
  Description of Artificial Sequence: Synthetic oligonucleotide
ggtctgtgacatccatgaacacaacagcagc

SEQ ID NO: 301880 - DNA, 32 bp, Artificial Sequence
  Description of Artificial Sequence: Synthetic oligonucleotide
gtctgtgacatccatgaacacaacagcagcag

SEQ ID NO: 301881 - DNA, 32 bp, Artificial Sequence
  Description of Artificial Sequence: Synthetic oligonucleotide
tctgtgacatccatgaacacaacagcagcagg

SEQ ID NO: 301882 - DNA, 31 bp, Artificial Sequence
  Description of Artificial Sequence: Synthetic oligonucleotide
ctgtgacatccatgaacacaacagcagcagg

SEQ ID NO: 301883 - DNA, 32 bp, Artificial Sequence
  Description of Artificial Sequence: Synthetic oligonucleotide
tgtgacatccatgaacacaacagcagcaggag

SEQ ID NO: 301884 - DNA, 31 bp, Artificial Sequence
  Description of Artificial Sequence: Synthetic oligonucleotide
gtgacatccatgaacacaacagcagcaggag

SEQ ID NO: 301885 - DNA, 31 bp, Artificial Sequence
  Description of Artificial Sequence: Synthetic oligonucleotide
tgacatccatgaacacaacagcagcaggagc

SEQ ID NO: 301886 - DNA, 30 bp, Artificial Sequence
  Description of Artificial Sequence: Synthetic oligonucleotide
gacatccatgaacacaacagcagcaggagc

SEQ ID NO: 301887 - DNA, 31 bp, Artificial Sequence
  Description of Artificial Sequence: Synthetic oligonucleotide
acatccatgaacacaacagcagcaggagctc

SEQ ID NO: 301888 - DNA, 30 bp, Artificial Sequence
  Description of Artificial Sequence: Synthetic oligonucleotide
catccatgaacacaacagcagcaggagctc

SEQ ID NO: 301889 - DNA, 30 bp, Artificial Sequence
  Description of Artificial Sequence: Synthetic oligonucleotide
atccatgaacacaacagcagcaggagctcg

SEQ ID NO: 301890 - DNA, 29 bp, Artificial Sequence
  Description of Artificial Sequence: Synthetic oligonucleotide
tccatgaacacaacagcagcaggagctcg

SEQ ID NO: 301891 - DNA, 28 bp, Artificial Sequence
  Description of Artificial Sequence: Synthetic oligonucleotide
ccatgaacacaacagcagcaggagctcg

SEQ ID NO: 301892 - DNA, 28 bp, Artificial Sequence
  Description of Artificial Sequence: Synthetic oligonucleotide
catgaacacaacagcagcaggagctcgc

SEQ ID NO: 301893 - DNA, 29 bp, Artificial Sequence
  Description of Artificial Sequence: Synthetic oligonucleotide
atgaacacaacagcagcaggagctcgcag

SEQ ID NO: 301894 - DNA, 28 bp, Artificial Sequence
  Description of Artificial Sequence: Synthetic oligonucleotide
tgaacacaacagcagcaggagctcgcag

SEQ ID NO: 301895 - DNA, 27 bp, Artificial Sequence
  Description of Artificial Sequence: Synthetic oligonucleotide
gaacacaacagcagcaggagctcgcag

SEQ ID NO: 301896 - DNA, 27 bp, Artificial Sequence
  Description of Artificial Sequence: Synthetic oligonucleotide
aacacaacagcagcaggagctcgcagc

SEQ ID NO: 301897 - DNA, 27 bp, Artificial Sequence
  Description of Artificial Sequence: Synthetic oligonucleotide
acacaacagcagcaggagctcgcagca

SEQ ID NO: 301898 - DNA, 27 bp, Artificial Sequence
  Description of Artificial Sequence: Synthetic oligonucleotide
cacaacagcagcaggagctcgcagcat

SEQ ID NO: 301899 - DNA, 29 bp, Artificial Sequence
  Description of Artificial Sequence: Synthetic oligonucleotide
acaacagcagcaggagctcgcagcatttc

SEQ ID NO: 301900 - DNA, 28 bp, Artificial Sequence
  Description of Artificial Sequence: Synthetic oligonucleotide
caacagcagcaggagctcgcagcatttc

SEQ ID NO: 301901 - DNA, 30 bp, Artificial Sequence
  Description of Artificial Sequence: Synthetic oligonucleotide
aacagcagcaggagctcgcagcatttcaac

SEQ ID NO: 301902 - DNA, 29 bp, Artificial Sequence
  Description of Artificial Sequence: Synthetic oligonucleotide
acagcagcaggagctcgcagcatttcaac

SEQ ID NO: 301903 - DNA, 28 bp, Artificial Sequence
  Description of Artificial Sequence: Synthetic oligonucleotide
cagcagcaggagctcgcagcatttcaac

SEQ ID NO: 301904 - DNA, 30 bp, Artificial Sequence
  Description of Artificial Sequence: Synthetic oligonucleotide
agcagcaggagctcgcagcatttcaactac

SEQ ID NO: 301905 - DNA, 29 bp, Artificial Sequence
  Description of Artificial Sequence: Synthetic oligonucleotide
gcagcaggagctcgcagcatttcaactac

SEQ ID NO: 301906 - DNA, 29 bp, Artificial Sequence
  Description of Artificial Sequence: Synthetic oligonucleotide
cagcaggagctcgcagcatttcaactacg

SEQ ID NO: 301907 - DNA, 31 bp, Artificial Sequence
  Description of Artificial Sequence: Synthetic oligonucleotide
agcaggagctcgcagcatttcaactacgatg

SEQ ID NO: 301908 - DNA, 30 bp, Artificial Sequence
  Description of Artificial Sequence: Synthetic oligonucleotide
gcaggagctcgcagcatttcaactacgatg

SEQ ID NO: 301909 - DNA, 30 bp, Artificial Sequence
  Description of Artificial Sequence: Synthetic oligonucleotide
caggagctcgcagcatttcaactacgatgc

SEQ ID NO: 301910 - DNA, 30 bp, Artificial Sequence
  Description of Artificial Sequence: Synthetic oligonucleotide
aggagctcgcagcatttcaactacgatgcg

SEQ ID NO: 301911 - DNA, 29 bp, Artificial Sequence
  Description of Artificial Sequence: Synthetic oligonucleotide
ggagctcgcagcatttcaactacgatgcg

SEQ ID NO: 301912 - DNA, 29 bp, Artificial Sequence
  Description of Artificial Sequence: Synthetic oligonucleotide
gagctcgcagcatttcaactacgatgcgg

SEQ ID NO: 301913 - DNA, 30 bp, Artificial Sequence
  Description of Artificial Sequence: Synthetic oligonucleotide
agctcgcagcatttcaactacgatgcggag

SEQ ID NO: 301914 - DNA, 29 bp, Artificial Sequence
  Description of Artificial Sequence: Synthetic oligonucleotide
gctcgcagcatttcaactacgatgcggag

SEQ ID NO: 301915 - DNA, 29 bp, Artificial Sequence
  Description of Artificial Sequence: Synthetic oligonucleotide
ctcgcagcatttcaactacgatgcggagc

SEQ ID NO: 301916 - DNA, 30 bp, Artificial Sequence
  Description of Artificial Sequence: Synthetic oligonucleotide
tcgcagcatttcaactacgatgcggagctc

SEQ ID NO: 301917 - DNA, 29 bp, Artificial Sequence
  Description of Artificial Sequence: Synthetic oligonucleotide
cgcagcatttcaactacgatgcggagctc

SEQ ID NO: 301918 - DNA, 31 bp, Artificial Sequence
  Description of Artificial Sequence: Synthetic oligonucleotide
gcagcatttcaactacgatgcggagctcttg

SEQ ID NO: 301919 - DNA, 31 bp, Artificial Sequence
  Description of Artificial Sequence: Synthetic oligonucleotide
cagcatttcaactacgatgcggagctcttgc

SEQ ID NO: 301920 - DNA, 32 bp, Artificial Sequence
  Description of Artificial Sequence: Synthetic oligonucleotide
agcatttcaactacgatgcggagctcttgctc

SEQ ID NO: 301921 - DNA, 31 bp, Artificial Sequence
  Description of Artificial Sequence: Synthetic oligonucleotide
gcatttcaactacgatgcggagctcttgctc

SEQ ID NO: 301922 - DNA, 32 bp, Artificial Sequence
  Description of Artificial Sequence: Synthetic oligonucleotide
catttcaactacgatgcggagctcttgctctc

SEQ ID NO: 301923 - DNA, 32 bp, Artificial Sequence
  Description of Artificial Sequence: Synthetic oligonucleotide
atttcaactacgatgcggagctcttgctctcc

SEQ ID NO: 301924 - DNA, 31 bp, Artificial Sequence
  Description of Artificial Sequence: Synthetic oligonucleotide
tttcaactacgatgcggagctcttgctctcc

SEQ ID NO: 301925 - DNA, 30 bp, Artificial Sequence
  Description of Artificial Sequence: Synthetic oligonucleotide
ttcaactacgatgcggagctcttgctctcc

SEQ ID NO: 301926 - DNA, 29 bp, Artificial Sequence
  Description of Artificial Sequence: Synthetic oligonucleotide
tcaactacgatgcggagctcttgctctcc

SEQ ID NO: 301927 - DNA, 28 bp, Artificial Sequence
  Description of Artificial Sequence: Synthetic oligonucleotide
caactacgatgcggagctcttgctctcc

SEQ ID NO: 301928 - DNA, 28 bp, Artificial Sequence
  Description of Artificial Sequence: Synthetic oligonucleotide
aactacgatgcggagctcttgctctccc

SEQ ID NO: 301929 - DNA, 27 bp, Artificial Sequence
  Description of Artificial Sequence: Synthetic oligonucleotide
actacgatgcggagctcttgctctccc

SEQ ID NO: 301930 - DNA, 27 bp, Artificial Sequence
  Description of Artificial Sequence: Synthetic oligonucleotide
ctacgatgcggagctcttgctctccca

SEQ ID NO: 301931 - DNA, 30 bp, Artificial Sequence
  Description of Artificial Sequence: Synthetic oligonucleotide
tacgatgcggagctcttgctctcccaatac

SEQ ID NO: 301932 - DNA, 29 bp, Artificial Sequence
  Description of Artificial Sequence: Synthetic oligonucleotide
acgatgcggagctcttgctctcccaatac

SEQ ID NO: 301933 - DNA, 28 bp, Artificial Sequence
  Description of Artificial Sequence: Synthetic oligonucleotide
cgatgcggagctcttgctctcccaatac

SEQ ID NO: 301934 - DNA, 28 bp, Artificial Sequence
  Description of Artificial Sequence: Synthetic oligonucleotide
gatgcggagctcttgctctcccaatacc

SEQ ID NO: 301935 - DNA, 29 bp, Artificial Sequence
  Description of Artificial Sequence: Synthetic oligonucleotide
atgcggagctcttgctctcccaatacctg

SEQ ID NO: 301936 - DNA, 28 bp, Artificial Sequence
  Description of Artificial Sequence: Synthetic oligonucleotide
tgcggagctcttgctctcccaatacctg

SEQ ID NO: 301937 - DNA, 27 bp, Artificial Sequence
  Description of Artificial Sequence: Synthetic oligonucleotide
gcggagctcttgctctcccaatacctg

SEQ ID NO: 301938 - DNA, 27 bp, Artificial Sequence
  Description of Artificial Sequence: Synthetic oligonucleotide
cggagctcttgctctcccaatacctgg

SEQ ID NO: 301939 - DNA, 28 bp, Artificial Sequence
  Description of Artificial Sequence: Synthetic oligonucleotide
ggagctcttgctctcccaatacctggag

SEQ ID NO: 301940 - DNA, 29 bp, Artificial Sequence
  Description of Artificial Sequence: Synthetic oligonucleotide
gagctcttgctctcccaatacctggagag

SEQ ID NO: 301941 - DNA, 30 bp, Artificial Sequence
  Description of Artificial Sequence: Synthetic oligonucleotide
agctcttgctctcccaatacctggagagtg

SEQ ID NO: 301942 - DNA, 29 bp, Artificial Sequence
  Description of Artificial Sequence: Synthetic oligonucleotide
gctcttgctctcccaatacctggagagtg

SEQ ID NO: 301943 - DNA, 30 bp, Artificial Sequence
  Description of Artificial Sequence: Synthetic oligonucleotide
ctcttgctctcccaatacctggagagtgag

SEQ ID NO: 301944 - DNA, 30 bp, Artificial Sequence
  Description of Artificial Sequence: Synthetic oligonucleotide
tcttgctctcccaatacctggagagtgagg

SEQ ID NO: 301945 - DNA, 29 bp, Artificial Sequence
  Description of Artificial Sequence: Synthetic oligonucleotide
cttgctctcccaatacctggagagtgagg

SEQ ID NO: 301946 - DNA, 32 bp, Artificial Sequence
  Description of Artificial Sequence: Synthetic oligonucleotide
ttgctctcccaatacctggagagtgaggaatg

SEQ ID NO: 301947 - DNA, 31 bp, Artificial Sequence
  Description of Artificial Sequence: Synthetic oligonucleotide
tgctctcccaatacctggagagtgaggaatg

SEQ ID NO: 301948 - DNA, 30 bp, Artificial Sequence
  Description of Artificial Sequence: Synthetic oligonucleotide
gctctcccaatacctggagagtgaggaatg

SEQ ID NO: 301949 - DNA, 30 bp, Artificial Sequence
  Description of Artificial Sequence: Synthetic oligonucleotide
ctctcccaatacctggagagtgaggaatgc

SEQ ID NO: 301950 - DNA, 31 bp, Artificial Sequence
  Description of Artificial Sequence: Synthetic oligonucleotide
tctcccaatacctggagagtgaggaatgcac

SEQ ID NO: 301951 - DNA, 30 bp, Artificial Sequence
  Description of Artificial Sequence: Synthetic oligonucleotide
ctcccaatacctggagagtgaggaatgcac

SEQ ID NO: 301952 - DNA, 31 bp, Artificial Sequence
  Description of Artificial Sequence: Synthetic oligonucleotide
tcccaatacctggagagtgaggaatgcacag

SEQ ID NO: 301953 - DNA, 30 bp, Artificial Sequence
  Description of Artificial Sequence: Synthetic oligonucleotide
cccaatacctggagagtgaggaatgcacag

SEQ ID NO: 301954 - DNA, 31 bp, Artificial Sequence
  Description of Artificial Sequence: Synthetic oligonucleotide
ccaatacctggagagtgaggaatgcacagtg

SEQ ID NO: 301955 - DNA, 31 bp, Artificial Sequence
  Description of Artificial Sequence: Synthetic oligonucleotide
caatacctggagagtgaggaatgcacagtgc

SEQ ID NO: 301956 - DNA, 31 bp, Artificial Sequence
  Description of Artificial Sequence: Synthetic oligonucleotide
aatacctggagagtgaggaatgcacagtgcc

SEQ ID NO: 301957 - DNA, 30 bp, Artificial Sequence
  Description of Artificial Sequence: Synthetic oligonucleotide
atacctggagagtgaggaatgcacagtgcc

SEQ ID NO: 301958 - DNA, 29 bp, Artificial Sequence
  Description of Artificial Sequence: Synthetic oligonucleotide
tacctggagagtgaggaatgcacagtgcc

SEQ ID NO: 301959 - DNA, 28 bp, Artificial Sequence
  Description of Artificial Sequence: Synthetic oligonucleotide
acctggagagtgaggaatgcacagtgcc

SEQ ID NO: 301960 - DNA, 27 bp, Artificial Sequence
  Description of Artificial Sequence: Synthetic oligonucleotide
cctggagagtgaggaatgcacagtgcc

SEQ ID NO: 301961 - DNA, 27 bp, Artificial Sequence
  Description of Artificial Sequence: Synthetic oligonucleotide
ctggagagtgaggaatgcacagtgccc

SEQ ID NO: 301962 - DNA, 27 bp, Artificial Sequence
  Description of Artificial Sequence: Synthetic oligonucleotide
tggagagtgaggaatgcacagtgcccg

SEQ ID NO: 301963 - DNA, 27 bp, Artificial Sequence
  Description of Artificial Sequence: Synthetic oligonucleotide
ggagagtgaggaatgcacagtgcccga

SEQ ID NO: 301964 - DNA, 27 bp, Artificial Sequence
  Description of Artificial Sequence: Synthetic oligonucleotide
gagagtgaggaatgcacagtgcccgag

SEQ ID NO: 301965 - DNA, 28 bp, Artificial Sequence
  Description of Artificial Sequence: Synthetic oligonucleotide
agagtgaggaatgcacagtgcccgagtc

SEQ ID NO: 301966 - DNA, 27 bp, Artificial Sequence
  Description of Artificial Sequence: Synthetic oligonucleotide
gagtgaggaatgcacagtgcccgagtc

SEQ ID NO: 301967 - DNA, 27 bp, Artificial Sequence
  Description of Artificial Sequence: Synthetic oligonucleotide
agtgaggaatgcacagtgcccgagtcc

SEQ ID NO: 301968 - DNA, 27 bp, Artificial Sequence
  Description of Artificial Sequence: Synthetic oligonucleotide
gtgaggaatgcacagtgcccgagtcct

SEQ ID NO: 301969 - DNA, 27 bp, Artificial Sequence
  Description of Artificial Sequence: Synthetic oligonucleotide
tgaggaatgcacagtgcccgagtcctc

SEQ ID NO: 301970 - DNA, 26 bp, Artificial Sequence
  Description of Artificial Sequence: Synthetic oligonucleotide
gaggaatgcacagtgcccgagtcctc

SEQ ID NO: 301971 - DNA, 27 bp, Artificial Sequence
  Description of Artificial Sequence: Synthetic oligonucleotide
aggaatgcacagtgcccgagtcctcca

SEQ ID NO: 301972 - DNA, 26 bp, Artificial Sequence
  Description of Artificial Sequence: Synthetic oligonucleotide
ggaatgcacagtgcccgagtcctcca

SEQ ID NO: 301973 - DNA, 27 bp, Artificial Sequence
  Description of Artificial Sequence: Synthetic oligonucleotide
gaatgcacagtgcccgagtcctccaca

SEQ ID NO: 301974 - DNA, 27 bp, Artificial Sequence
  Description of Artificial Sequence: Synthetic oligonucleotide
aatgcacagtgcccgagtcctccacag

SEQ ID NO: 301975 - DNA, 26 bp, Artificial Sequence
  Description of Artificial Sequence: Synthetic oligonucleotide
atgcacagtgcccgagtcctccacag

SEQ ID NO: 301976 - DNA, 25 bp, Artificial Sequence
  Description of Artificial Sequence: Synthetic oligonucleotide
tgcacagtgcccgagtcctccacag

SEQ ID NO: 301977 - DNA, 24 bp, Artificial Sequence
  Description of Artificial Sequence: Synthetic oligonucleotide
gcacagtgcccgagtcctccacag

SEQ ID NO: 301978 - DNA, 25 bp, Artificial Sequence
  Description of Artificial Sequence: Synthetic oligonucleotide
cacagtgcccgagtcctccacagct

SEQ ID NO: 301979 - DNA, 26 bp, Artificial Sequence
  Description of Artificial Sequence: Synthetic oligonucleotide
acagtgcccgagtcctccacagctca

SEQ ID NO: 301980 - DNA, 25 bp, Artificial Sequence
  Description of Artificial Sequence: Synthetic oligonucleotide
cagtgcccgagtcctccacagctca

SEQ ID NO: 301981 - DNA, 26 bp, Artificial Sequence
  Description of Artificial Sequence: Synthetic oligonucleotide
agtgcccgagtcctccacagctcaga

SEQ ID NO: 301982 - DNA, 25 bp, Artificial Sequence
  Description of Artificial Sequence: Synthetic oligonucleotide
gtgcccgagtcctccacagctcaga

SEQ ID NO: 301983 - DNA, 25 bp, Artificial Sequence
  Description of Artificial Sequence: Synthetic oligonucleotide
tgcccgagtcctccacagctcagac

SEQ ID NO: 301984 - DNA, 24 bp, Artificial Sequence
  Description of Artificial Sequence: Synthetic oligonucleotide
gcccgagtcctccacagctcagac

SEQ ID NO: 301985 - DNA, 26 bp, Artificial Sequence
  Description of Artificial Sequence: Synthetic oligonucleotide
cccgagtcctccacagctcagacgtt

SEQ ID NO: 301986 - DNA, 26 bp, Artificial Sequence
  Description of Artificial Sequence: Synthetic oligonucleotide
ccgagtcctccacagctcagacgttg

SEQ ID NO: 301987 - DNA, 26 bp, Artificial Sequence
  Description of Artificial Sequence: Synthetic oligonucleotide
cgagtcctccacagctcagacgttgg

SEQ ID NO: 301988 - DNA, 26 bp, Artificial Sequence
  Description of Artificial Sequence: Synthetic oligonucleotide
gagtcctccacagctcagacgttggc

SEQ ID NO: 301989 - DNA, 27 bp, Artificial Sequence
  Description of Artificial Sequence: Synthetic oligonucleotide
agtcctccacagctcagacgttggcca

SEQ ID NO: 301990 - DNA, 27 bp, Artificial Sequence
  Description of Artificial Sequence: Synthetic oligonucleotide
gtcctccacagctcagacgttggccat

SEQ ID NO: 301991 - DNA, 27 bp, Artificial Sequence
  Description of Artificial Sequence: Synthetic oligonucleotide
tcctccacagctcagacgttggccatg

SEQ ID NO: 301992 - DNA, 27 bp, Artificial Sequence
  Description of Artificial Sequence: Synthetic oligonucleotide
cctccacagctcagacgttggccatgt

SEQ ID NO: 301993 - DNA, 28 bp, Artificial Sequence
  Description of Artificial Sequence: Synthetic oligonucleotide
ctccacagctcagacgttggccatgtac

SEQ ID NO: 301994 - DNA, 28 bp, Artificial Sequence
  Description of Artificial Sequence: Synthetic oligonucleotide
tccacagctcagacgttggccatgtacg

SEQ ID NO: 301995 - DNA, 27 bp, Artificial Sequence
  Description of Artificial Sequence: Synthetic oligonucleotide
ccacagctcagacgttggccatgtacg

SEQ ID NO: 301996 - DNA, 28 bp, Artificial Sequence
  Description of Artificial Sequence: Synthetic oligonucleotide
cacagctcagacgttggccatgtacgtc

SEQ ID NO: 301997 - DNA, 29 bp, Artificial Sequence
  Description of Artificial Sequence: Synthetic oligonucleotide
acagctcagacgttggccatgtacgtcag

SEQ ID NO: 301998 - DNA, 28 bp, Artificial Sequence
  Description of Artificial Sequence: Synthetic oligonucleotide
cagctcagacgttggccatgtacgtcag

SEQ ID NO: 301999 - DNA, 28 bp, Artificial Sequence
  Description of Artificial Sequence: Synthetic oligonucleotide
agctcagacgttggccatgtacgtcagg

SEQ ID NO: 302000 - DNA, 27 bp, Artificial Sequence
  Description of Artificial Sequence: Synthetic oligonucleotide
gctcagacgttggccatgtacgtcagg

SEQ ID NO: 302001 - DNA, 32 bp, Artificial Sequence
  Description of Artificial Sequence: Synthetic oligonucleotide
ctcagacgttggccatgtacgtcaggattttc

SEQ ID NO: 302002 - DNA, 34 bp, Artificial Sequence
  Description of Artificial Sequence: Synthetic oligonucleotide
tcagacgttggccatgtacgtcaggattttcttg

SEQ ID NO: 302003 - DNA, 33 bp, Artificial Sequence
  Description of Artificial Sequence: Synthetic oligonucleotide
cagacgttggccatgtacgtcaggattttcttg

SEQ ID NO: 302004 - DNA, 35 bp, Artificial Sequence
  Description of Artificial Sequence: Synthetic oligonucleotide
agacgttggccatgtacgtcaggattttcttgaac

SEQ ID NO: 302005 - DNA, 34 bp, Artificial Sequence
  Description of Artificial Sequence: Synthetic oligonucleotide
gacgttggccatgtacgtcaggattttcttgaac

SEQ ID NO: 302006 - DNA, 34 bp, Artificial Sequence
  Description of Artificial Sequence: Synthetic oligonucleotide
acgttggccatgtacgtcaggattttcttgaacg

SEQ ID NO: 302007 - DNA, 33 bp, Artificial Sequence
  Description of Artificial Sequence: Synthetic oligonucleotide
cgttggccatgtacgtcaggattttcttgaacg

SEQ ID NO: 302008 - DNA, 35 bp, Artificial Sequence
  Description of Artificial Sequence: Synthetic oligonucleotide
gttggccatgtacgtcaggattttcttgaacgaag

SEQ ID NO: 302009 - DNA, 37 bp, Artificial Sequence
  Description of Artificial Sequence: Synthetic oligonucleotide
ttggccatgtacgtcaggattttcttgaacgaagatg

SEQ ID NO: 302010 - DNA, 36 bp, Artificial Sequence
  Description of Artificial Sequence: Synthetic oligonucleotide
tggccatgtacgtcaggattttcttgaacgaagatg

SEQ ID NO: 302011 - DNA, 35 bp, Artificial Sequence
  Description of Artificial Sequence: Synthetic oligonucleotide
ggccatgtacgtcaggattttcttgaacgaagatg

SEQ ID NO: 302012 - DNA, 35 bp, Artificial Sequence
  Description of Artificial Sequence: Synthetic oligonucleotide
gccatgtacgtcaggattttcttgaacgaagatgc

SEQ ID NO: 302013 - DNA, 35 bp, Artificial Sequence
  Description of Artificial Sequence: Synthetic oligonucleotide
ccatgtacgtcaggattttcttgaacgaagatgcc

SEQ ID NO: 302014 - DNA, 37 bp, Artificial Sequence
  Description of Artificial Sequence: Synthetic oligonucleotide
catgtacgtcaggattttcttgaacgaagatgccttg

SEQ ID NO: 302015 - DNA, 39 bp, Artificial Sequence
  Description of Artificial Sequence: Synthetic oligonucleotide
atgtacgtcaggattttcttgaacgaagatgccttgaag

SEQ ID NO: 302016 - DNA, 38 bp, Artificial Sequence
  Description of Artificial Sequence: Synthetic oligonucleotide
tgtacgtcaggattttcttgaacgaagatgccttgaag

SEQ ID NO: 302017 - DNA, 37 bp, Artificial Sequence
  Description of Artificial Sequence: Synthetic oligonucleotide
gtacgtcaggattttcttgaacgaagatgccttgaag

SEQ ID NO: 302018 - DNA, 38 bp, Artificial Sequence
  Description of Artificial Sequence: Synthetic oligonucleotide
tacgtcaggattttcttgaacgaagatgccttgaagac

SEQ ID NO: 302019 - DNA, 37 bp, Artificial Sequence
  Description of Artificial Sequence: Synthetic oligonucleotide
acgtcaggattttcttgaacgaagatgccttgaagac

SEQ ID NO: 302020 - DNA, 36 bp, Artificial Sequence
  Description of Artificial Sequence: Synthetic oligonucleotide
cgtcaggattttcttgaacgaagatgccttgaagac

SEQ ID NO: 302021 - DNA, 36 bp, Artificial Sequence
  Description of Artificial Sequence: Synthetic oligonucleotide
gtcaggattttcttgaacgaagatgccttgaagacc

SEQ ID NO: 302022 - DNA, 38 bp, Artificial Sequence
  Description of Artificial Sequence: Synthetic oligonucleotide
tcaggattttcttgaacgaagatgccttgaagaccatg

SEQ ID NO: 302023 - DNA, 37 bp, Artificial Sequence
  Description of Artificial Sequence: Synthetic oligonucleotide
caggattttcttgaacgaagatgccttgaagaccatg

SEQ ID NO: 302024 - DNA, 38 bp, Artificial Sequence
  Description of Artificial Sequence: Synthetic oligonucleotide
aggattttcttgaacgaagatgccttgaagaccatgac

SEQ ID NO: 302025 - DNA, 37 bp, Artificial Sequence
  Description of Artificial Sequence: Synthetic oligonucleotide
ggattttcttgaacgaagatgccttgaagaccatgac

SEQ ID NO: 302026 - DNA, 38 bp, Artificial Sequence
  Description of Artificial Sequence: Synthetic oligonucleotide
gattttcttgaacgaagatgccttgaagaccatgacac

SEQ ID NO: 302027 - DNA, 39 bp, Artificial Sequence
  Description of Artificial Sequence: Synthetic oligonucleotide
attttcttgaacgaagatgccttgaagaccatgacacac

SEQ ID NO: 302028 - DNA, 38 bp, Artificial Sequence
  Description of Artificial Sequence: Synthetic oligonucleotide
ttttcttgaacgaagatgccttgaagaccatgacacac

SEQ ID NO: 302029 - DNA, 37 bp, Artificial Sequence
  Description of Artificial Sequence: Synthetic oligonucleotide
tttcttgaacgaagatgccttgaagaccatgacacac

SEQ ID NO: 302030 - DNA, 36 bp, Artificial Sequence
  Description of Artificial Sequence: Synthetic oligonucleotide
ttcttgaacgaagatgccttgaagaccatgacacac

SEQ ID NO: 302031 - DNA, 35 bp, Artificial Sequence
  Description of Artificial Sequence: Synthetic oligonucleotide
tcttgaacgaagatgccttgaagaccatgacacac

SEQ ID NO: 302032 - DNA, 34 bp, Artificial Sequence
  Description of Artificial Sequence: Synthetic oligonucleotide
cttgaacgaagatgccttgaagaccatgacacac

SEQ ID NO: 302033 - DNA, 37 bp, Artificial Sequence
  Description of Artificial Sequence: Synthetic oligonucleotide
ttgaacgaagatgccttgaagaccatgacacactaac

SEQ ID NO: 302034 - DNA, 36 bp, Artificial Sequence
  Description of Artificial Sequence: Synthetic oligonucleotide
tgaacgaagatgccttgaagaccatgacacactaac

SEQ ID NO: 302035 - DNA, 35 bp, Artificial Sequence
  Description of Artificial Sequence: Synthetic oligonucleotide
gaacgaagatgccttgaagaccatgacacactaac

SEQ ID NO: 302036 - DNA, 36 bp, Artificial Sequence
  Description of Artificial Sequence: Synthetic oligonucleotide
aacgaagatgccttgaagaccatgacacactaacac

SEQ ID NO: 302037 - DNA, 35 bp, Artificial Sequence
  Description of Artificial Sequence: Synthetic oligonucleotide
acgaagatgccttgaagaccatgacacactaacac

SEQ ID NO: 302038 - DNA, 34 bp, Artificial Sequence
  Description of Artificial Sequence: Synthetic oligonucleotide
cgaagatgccttgaagaccatgacacactaacac

SEQ ID NO: 302039 - DNA, 34 bp, Artificial Sequence
  Description of Artificial Sequence: Synthetic oligonucleotide
gaagatgccttgaagaccatgacacactaacacg

SEQ ID NO: 302040 - DNA, 34 bp, Artificial Sequence
  Description of Artificial Sequence: Synthetic oligonucleotide
aagatgccttgaagaccatgacacactaacacgc

SEQ ID NO: 302041 - DNA, 33 bp, Artificial Sequence
  Description of Artificial Sequence: Synthetic oligonucleotide
agatgccttgaagaccatgacacactaacacgc

SEQ ID NO: 302042 - DNA, 32 bp, Artificial Sequence
  Description of Artificial Sequence: Synthetic oligonucleotide
gatgccttgaagaccatgacacactaacacgc

SEQ ID NO: 302043 - DNA, 35 bp, Artificial Sequence
  Description of Artificial Sequence: Synthetic oligonucleotide
atgccttgaagaccatgacacactaacacgctatg

SEQ ID NO: 302044 - DNA, 34 bp, Artificial Sequence
  Description of Artificial Sequence: Synthetic oligonucleotide
tgccttgaagaccatgacacactaacacgctatg

SEQ ID NO: 302045 - DNA, 33 bp, Artificial Sequence
  Description of Artificial Sequence: Synthetic oligonucleotide
gccttgaagaccatgacacactaacacgctatg

SEQ ID NO: 302046 - DNA, 33 bp, Artificial Sequence
  Description of Artificial Sequence: Synthetic oligonucleotide
ccttgaagaccatgacacactaacacgctatgg

SEQ ID NO: 302047 - DNA, 35 bp, Artificial Sequence
  Description of Artificial Sequence: Synthetic oligonucleotide
cttgaagaccatgacacactaacacgctatggatg

SEQ ID NO: 302048 - DNA, 35 bp, Artificial Sequence
  Description of Artificial Sequence: Synthetic oligonucleotide
ttgaagaccatgacacactaacacgctatggatgc

SEQ ID NO: 302049 - DNA, 34 bp, Artificial Sequence
  Description of Artificial Sequence: Synthetic oligonucleotide
tgaagaccatgacacactaacacgctatggatgc

SEQ ID NO: 302050 - DNA, 33 bp, Artificial Sequence
  Description of Artificial Sequence: Synthetic oligonucleotide
gaagaccatgacacactaacacgctatggatgc

SEQ ID NO: 302051 - DNA, 34 bp, Artificial Sequence
  Description of Artificial Sequence: Synthetic oligonucleotide
aagaccatgacacactaacacgctatggatgcag

SEQ ID NO: 302052 - DNA, 33 bp, Artificial Sequence
  Description of Artificial Sequence: Synthetic oligonucleotide
agaccatgacacactaacacgctatggatgcag

SEQ ID NO: 302053 - DNA, 32 bp, Artificial Sequence
  Description of Artificial Sequence: Synthetic oligonucleotide
gaccatgacacactaacacgctatggatgcag

SEQ ID NO: 302054 - DNA, 33 bp, Artificial Sequence
  Description of Artificial Sequence: Synthetic oligonucleotide
accatgacacactaacacgctatggatgcagac

SEQ ID NO: 302055 - DNA, 32 bp, Artificial Sequence
  Description of Artificial Sequence: Synthetic oligonucleotide
ccatgacacactaacacgctatggatgcagac

SEQ ID NO: 302056 - DNA, 33 bp, Artificial Sequence
  Description of Artificial Sequence: Synthetic oligonucleotide
catgacacactaacacgctatggatgcagactc

SEQ ID NO: 302057 - DNA, 33 bp, Artificial Sequence
  Description of Artificial Sequence: Synthetic oligonucleotide
atgacacactaacacgctatggatgcagactcc

SEQ ID NO: 302058 - DNA, 32 bp, Artificial Sequence
  Description of Artificial Sequence: Synthetic oligonucleotide
tgacacactaacacgctatggatgcagactcc

SEQ ID NO: 302059 - DNA, 31 bp, Artificial Sequence
  Description of Artificial Sequence: Synthetic oligonucleotide
gacacactaacacgctatggatgcagactcc

SEQ ID NO: 302060 - DNA, 31 bp, Artificial Sequence
  Description of Artificial Sequence: Synthetic oligonucleotide
acacactaacacgctatggatgcagactccc

SEQ ID NO: 302061 - DNA, 30 bp, Artificial Sequence
  Description of Artificial Sequence: Synthetic oligonucleotide
cacactaacacgctatggatgcagactccc

SEQ ID NO: 302062 - DNA, 31 bp, Artificial Sequence
  Description of Artificial Sequence: Synthetic oligonucleotide
acactaacacgctatggatgcagactccctg

SEQ ID NO: 302063 - DNA, 30 bp, Artificial Sequence
  Description of Artificial Sequence: Synthetic oligonucleotide
cactaacacgctatggatgcagactccctg

SEQ ID NO: 302064 - DNA, 30 bp, Artificial Sequence
  Description of Artificial Sequence: Synthetic oligonucleotide
actaacacgctatggatgcagactccctgc

SEQ ID NO: 302065 - DNA, 29 bp, Artificial Sequence
  Description of Artificial Sequence: Synthetic oligonucleotide
ctaacacgctatggatgcagactccctgc

SEQ ID NO: 302066 - DNA, 30 bp, Artificial Sequence
  Description of Artificial Sequence: Synthetic oligonucleotide
taacacgctatggatgcagactccctgcag

SEQ ID NO: 302067 - DNA, 29 bp, Artificial Sequence
  Description of Artificial Sequence: Synthetic oligonucleotide
aacacgctatggatgcagactccctgcag

SEQ ID NO: 302068 - DNA, 28 bp, Artificial Sequence
  Description of Artificial Sequence: Synthetic oligonucleotide
acacgctatggatgcagactccctgcag

SEQ ID NO: 302069 - DNA, 27 bp, Artificial Sequence
  Description of Artificial Sequence: Synthetic oligonucleotide
cacgctatggatgcagactccctgcag

SEQ ID NO: 302070 - DNA, 27 bp, Artificial Sequence
  Description of Artificial Sequence: Synthetic oligonucleotide
acgctatggatgcagactccctgcagg

SEQ ID NO: 302071 - DNA, 27 bp, Artificial Sequence
  Description of Artificial Sequence: Synthetic oligonucleotide
cgctatggatgcagactccctgcagga

SEQ ID NO: 302072 - DNA, 28 bp, Artificial Sequence
  Description of Artificial Sequence: Synthetic oligonucleotide
gctatggatgcagactccctgcaggatc

SEQ ID NO: 302073 - DNA, 30 bp, Artificial Sequence
  Description of Artificial Sequence: Synthetic oligonucleotide
ctatggatgcagactccctgcaggatctac

SEQ ID NO: 302074 - DNA, 30 bp, Artificial Sequence
  Description of Artificial Sequence: Synthetic oligonucleotide
tatggatgcagactccctgcaggatctacg

SEQ ID NO: 302075 - DNA, 29 bp, Artificial Sequence
  Description of Artificial Sequence: Synthetic oligonucleotide
atggatgcagactccctgcaggatctacg

SEQ ID NO: 302076 - DNA, 28 bp, Artificial Sequence
  Description of Artificial Sequence: Synthetic oligonucleotide
tggatgcagactccctgcaggatctacg

SEQ ID NO: 302077 - DNA, 27 bp, Artificial Sequence
  Description of Artificial Sequence: Synthetic oligonucleotide
ggatgcagactccctgcaggatctacg

SEQ ID NO: 302078 - DNA, 27 bp, Artificial Sequence
  Description of Artificial Sequence: Synthetic oligonucleotide
gatgcagactccctgcaggatctacgg

SEQ ID NO: 302079 - DNA, 27 bp, Artificial Sequence
  Description of Artificial Sequence: Synthetic oligonucleotide
atgcagactccctgcaggatctacggc

SEQ ID NO: 302080 - DNA, 26 bp, Artificial Sequence
  Description of Artificial Sequence: Synthetic oligonucleotide
tgcagactccctgcaggatctacggc

SEQ ID NO: 302081 - DNA, 25 bp, Artificial Sequence
  Description of Artificial Sequence: Synthetic oligonucleotide
gcagactccctgcaggatctacggc

SEQ ID NO: 302082 - DNA, 27 bp, Artificial Sequence
  Description of Artificial Sequence: Synthetic oligonucleotide
cagactccctgcaggatctacggcgaa

SEQ ID NO: 302083 - DNA, 29 bp, Artificial Sequence
  Description of Artificial Sequence: Synthetic oligonucleotide
agactccctgcaggatctacggcgaaatc

SEQ ID NO: 302084 - DNA, 28 bp, Artificial Sequence
  Description of Artificial Sequence: Synthetic oligonucleotide
gactccctgcaggatctacggcgaaatc

SEQ ID NO: 302085 - DNA, 30 bp, Artificial Sequence
  Description of Artificial Sequence: Synthetic oligonucleotide
actccctgcaggatctacggcgaaatctag

SEQ ID NO: 302086 - DNA, 29 bp, Artificial Sequence
  Description of Artificial Sequence: Synthetic oligonucleotide
ctccctgcaggatctacggcgaaatctag

SEQ ID NO: 302087 - DNA, 32 bp, Artificial Sequence
  Description of Artificial Sequence: Synthetic oligonucleotide
tccctgcaggatctacggcgaaatctagaatg

SEQ ID NO: 302088 - DNA, 31 bp, Artificial Sequence
  Description of Artificial Sequence: Synthetic oligonucleotide
ccctgcaggatctacggcgaaatctagaatg

SEQ ID NO: 302089 - DNA, 31 bp, Artificial Sequence
  Description of Artificial Sequence: Synthetic oligonucleotide
cctgcaggatctacggcgaaatctagaatgc

SEQ ID NO: 302090 - DNA, 31 bp, Artificial Sequence
  Description of Artificial Sequence: Synthetic oligonucleotide
ctgcaggatctacggcgaaatctagaatgcg

SEQ ID NO: 302091 - DNA, 31 bp, Artificial Sequence
  Description of Artificial Sequence: Synthetic oligonucleotide
tgcaggatctacggcgaaatctagaatgcgg

SEQ ID NO: 302092 - DNA, 30 bp, Artificial Sequence
  Description of Artificial Sequence: Synthetic oligonucleotide
gcaggatctacggcgaaatctagaatgcgg

SEQ ID NO: 302093 - DNA, 30 bp, Artificial Sequence
  Description of Artificial Sequence: Synthetic oligonucleotide
caggatctacggcgaaatctagaatgcggc

SEQ ID NO: 302094 - DNA, 30 bp, Artificial Sequence
  Description of Artificial Sequence: Synthetic oligonucleotide
aggatctacggcgaaatctagaatgcggcg

SEQ ID NO: 302095 - DNA, 29 bp, Artificial Sequence
  Description of Artificial Sequence: Synthetic oligonucleotide
ggatctacggcgaaatctagaatgcggcg

SEQ ID NO: 302096 - DNA, 31 bp, Artificial Sequence
  Description of Artificial Sequence: Synthetic oligonucleotide
gatctacggcgaaatctagaatgcggcgtag

SEQ ID NO: 302097 - DNA, 32 bp, Artificial Sequence
  Description of Artificial Sequence: Synthetic oligonucleotide
atctacggcgaaatctagaatgcggcgtagtg

SEQ ID NO: 302098 - DNA, 31 bp, Artificial Sequence
  Description of Artificial Sequence: Synthetic oligonucleotide
tctacggcgaaatctagaatgcggcgtagtg

SEQ ID NO: 302099 - DNA, 30 bp, Artificial Sequence
  Description of Artificial Sequence: Synthetic oligonucleotide
ctacggcgaaatctagaatgcggcgtagtg

SEQ ID NO: 302100 - DNA, 30 bp, Artificial Sequence
  Description of Artificial Sequence: Synthetic oligonucleotide
tacggcgaaatctagaatgcggcgtagtgc

SEQ ID NO: 302101 - DNA, 29 bp, Artificial Sequence
  Description of Artificial Sequence: Synthetic oligonucleotide
acggcgaaatctagaatgcggcgtagtgc

SEQ ID NO: 302102 - DNA, 28 bp, Artificial Sequence
  Description of Artificial Sequence: Synthetic oligonucleotide
cggcgaaatctagaatgcggcgtagtgc

SEQ ID NO: 302103 - DNA, 29 bp, Artificial Sequence
  Description of Artificial Sequence: Synthetic oligonucleotide
ggcgaaatctagaatgcggcgtagtgctg

SEQ ID NO: 302104 - DNA, 30 bp, Artificial Sequence
  Description of Artificial Sequence: Synthetic oligonucleotide
gcgaaatctagaatgcggcgtagtgctgag

SEQ ID NO: 302105 - DNA, 30 bp, Artificial Sequence
  Description of Artificial Sequence: Synthetic oligonucleotide
cgaaatctagaatgcggcgtagtgctgagg

SEQ ID NO: 302106 - DNA, 31 bp, Artificial Sequence
  Description of Artificial Sequence: Synthetic oligonucleotide
gaaatctagaatgcggcgtagtgctgaggag

SEQ ID NO: 302107 - DNA, 33 bp, Artificial Sequence
  Description of Artificial Sequence: Synthetic oligonucleotide
aaatctagaatgcggcgtagtgctgaggagatc

SEQ ID NO: 302108 - DNA, 32 bp, Artificial Sequence
  Description of Artificial Sequence: Synthetic oligonucleotide
aatctagaatgcggcgtagtgctgaggagatc

SEQ ID NO: 302109 - DNA, 31 bp, Artificial Sequence
  Description of Artificial Sequence: Synthetic oligonucleotide
atctagaatgcggcgtagtgctgaggagatc

SEQ ID NO: 302110 - DNA, 30 bp, Artificial Sequence
  Description of Artificial Sequence: Synthetic oligonucleotide
tctagaatgcggcgtagtgctgaggagatc

SEQ ID NO: 302111 - DNA, 29 bp, Artificial Sequence
  Description of Artificial Sequence: Synthetic oligonucleotide
ctagaatgcggcgtagtgctgaggagatc

SEQ ID NO: 302112 - DNA, 30 bp, Artificial Sequence
  Description of Artificial Sequence: Synthetic oligonucleotide
tagaatgcggcgtagtgctgaggagatcag

SEQ ID NO: 302113 - DNA, 29 bp, Artificial Sequence
  Description of Artificial Sequence: Synthetic oligonucleotide
agaatgcggcgtagtgctgaggagatcag

SEQ ID NO: 302114 - DNA, 28 bp, Artificial Sequence
  Description of Artificial Sequence: Synthetic oligonucleotide
gaatgcggcgtagtgctgaggagatcag

SEQ ID NO: 302115 - DNA, 29 bp, Artificial Sequence
  Description of Artificial Sequence: Synthetic oligonucleotide
aatgcggcgtagtgctgaggagatcagtg

SEQ ID NO: 302116 - DNA, 28 bp, Artificial Sequence
  Description of Artificial Sequence: Synthetic oligonucleotide
atgcggcgtagtgctgaggagatcagtg

SEQ ID NO: 302117 - DNA, 27 bp, Artificial Sequence
  Description of Artificial Sequence: Synthetic oligonucleotide
tgcggcgtagtgctgaggagatcagtg

SEQ ID NO: 302118 - DNA, 26 bp, Artificial Sequence
  Description of Artificial Sequence: Synthetic oligonucleotide
gcggcgtagtgctgaggagatcagtg

SEQ ID NO: 302119 - DNA, 26 bp, Artificial Sequence
  Description of Artificial Sequence: Synthetic oligonucleotide
cggcgtagtgctgaggagatcagtgc

SEQ ID NO: 302120 - DNA, 26 bp, Artificial Sequence
  Description of Artificial Sequence: Synthetic oligonucleotide
ggcgtagtgctgaggagatcagtgcc

SEQ ID NO: 302121 - DNA, 26 bp, Artificial Sequence
  Description of Artificial Sequence: Synthetic oligonucleotide
gcgtagtgctgaggagatcagtgccc

SEQ ID NO: 302122 - DNA, 26 bp, Artificial Sequence
  Description of Artificial Sequence: Synthetic oligonucleotide
cgtagtgctgaggagatcagtgcccc

SEQ ID NO: 302123 - DNA, 26 bp, Artificial Sequence
  Description of Artificial Sequence: Synthetic oligonucleotide
gtagtgctgaggagatcagtgccccg

SEQ ID NO: 302124 - DNA, 27 bp, Artificial Sequence
  Description of Artificial Sequence: Synthetic oligonucleotide
tagtgctgaggagatcagtgccccgca

SEQ ID NO: 302125 - DNA, 27 bp, Artificial Sequence
  Description of Artificial Sequence: Synthetic oligonucleotide
agtgctgaggagatcagtgccccgcat

SEQ ID NO: 302126 - DNA, 26 bp, Artificial Sequence
  Description of Artificial Sequence: Synthetic oligonucleotide
gtgctgaggagatcagtgccccgcat

SEQ ID NO: 302127 - DNA, 26 bp, Artificial Sequence
  Description of Artificial Sequence: Synthetic oligonucleotide
tgctgaggagatcagtgccccgcatg

SEQ ID NO: 302128 - DNA, 25 bp, Artificial Sequence
  Description of Artificial Sequence: Synthetic oligonucleotide
gctgaggagatcagtgccccgcatg

SEQ ID NO: 302129 - DNA, 26 bp, Artificial Sequence
  Description of Artificial Sequence: Synthetic oligonucleotide
ctgaggagatcagtgccccgcatggt

SEQ ID NO: 302130 - DNA, 27 bp, Artificial Sequence
  Description of Artificial Sequence: Synthetic oligonucleotide
tgaggagatcagtgccccgcatggtga

SEQ ID NO: 302131 - DNA, 27 bp, Artificial Sequence
  Description of Artificial Sequence: Synthetic oligonucleotide
gaggagatcagtgccccgcatggtgaa

SEQ ID NO: 302132 - DNA, 28 bp, Artificial Sequence
  Description of Artificial Sequence: Synthetic oligonucleotide
aggagatcagtgccccgcatggtgaaag

SEQ ID NO: 302133 - DNA, 27 bp, Artificial Sequence
  Description of Artificial Sequence: Synthetic oligonucleotide
ggagatcagtgccccgcatggtgaaag

SEQ ID NO: 302134 - DNA, 28 bp, Artificial Sequence
  Description of Artificial Sequence: Synthetic oligonucleotide
gagatcagtgccccgcatggtgaaagtc

SEQ ID NO: 302135 - DNA, 29 bp, Artificial Sequence
  Description of Artificial Sequence: Synthetic oligonucleotide
agatcagtgccccgcatggtgaaagtcac

SEQ ID NO: 302136 - DNA, 28 bp, Artificial Sequence
  Description of Artificial Sequence: Synthetic oligonucleotide
gatcagtgccccgcatggtgaaagtcac

SEQ ID NO: 302137 - DNA, 28 bp, Artificial Sequence
  Description of Artificial Sequence: Synthetic oligonucleotide
atcagtgccccgcatggtgaaagtcacc

SEQ ID NO: 302138 - DNA, 27 bp, Artificial Sequence
  Description of Artificial Sequence: Synthetic oligonucleotide
tcagtgccccgcatggtgaaagtcacc

SEQ ID NO: 302139 - DNA, 26 bp, Artificial Sequence
  Description of Artificial Sequence: Synthetic oligonucleotide
cagtgccccgcatggtgaaagtcacc

SEQ ID NO: 302140 - DNA, 26 bp, Artificial Sequence
  Description of Artificial Sequence: Synthetic oligonucleotide
agtgccccgcatggtgaaagtcaccc

SEQ ID NO: 302141 - DNA, 25 bp, Artificial Sequence
  Description of Artificial Sequence: Synthetic oligonucleotide
gtgccccgcatggtgaaagtcaccc

SEQ ID NO: 302142 - DNA, 25 bp, Artificial Sequence
  Description of Artificial Sequence: Synthetic oligonucleotide
tgccccgcatggtgaaagtcacccg

SEQ ID NO: 302143 - DNA, 24 bp, Artificial Sequence
  Description of Artificial Sequence: Synthetic oligonucleotide
gccccgcatggtgaaagtcacccg

SEQ ID NO: 302144 - DNA, 25 bp, Artificial Sequence
  Description of Artificial Sequence: Synthetic oligonucleotide
ccccgcatggtgaaagtcacccgct

SEQ ID NO: 302145 - DNA, 25 bp, Artificial Sequence
  Description of Artificial Sequence: Synthetic oligonucleotide
cccgcatggtgaaagtcacccgctg

SEQ ID NO: 302146 - DNA, 25 bp, Artificial Sequence
  Description of Artificial Sequence: Synthetic oligonucleotide
ccgcatggtgaaagtcacccgctgc

SEQ ID NO: 302147 - DNA, 26 bp, Artificial Sequence
  Description of Artificial Sequence: Synthetic oligonucleotide
cgcatggtgaaagtcacccgctgcga

SEQ ID NO: 302148 - DNA, 26 bp, Artificial Sequence
  Description of Artificial Sequence: Synthetic oligonucleotide
gcatggtgaaagtcacccgctgcgag

SEQ ID NO: 302149 - DNA, 26 bp, Artificial Sequence
  Description of Artificial Sequence: Synthetic oligonucleotide
catggtgaaagtcacccgctgcgagg

SEQ ID NO: 302150 - DNA, 26 bp, Artificial Sequence
  Description of Artificial Sequence: Synthetic oligonucleotide
atggtgaaagtcacccgctgcgaggc

SEQ ID NO: 302151 - DNA, 25 bp, Artificial Sequence
  Description of Artificial Sequence: Synthetic oligonucleotide
tggtgaaagtcacccgctgcgaggc

SEQ ID NO: 302152 - DNA, 24 bp, Artificial Sequence
  Description of Artificial Sequence: Synthetic oligonucleotide
ggtgaaagtcacccgctgcgaggc

SEQ ID NO: 302153 - DNA, 25 bp, Artificial Sequence
  Description of Artificial Sequence: Synthetic oligonucleotide
gtgaaagtcacccgctgcgaggcct

SEQ ID NO: 302154 - DNA, 26 bp, Artificial Sequence
  Description of Artificial Sequence: Synthetic oligonucleotide
tgaaagtcacccgctgcgaggcctga

SEQ ID NO: 302155 - DNA, 25 bp, Artificial Sequence
  Description of Artificial Sequence: Synthetic oligonucleotide
gaaagtcacccgctgcgaggcctga

SEQ ID NO: 302156 - DNA, 26 bp, Artificial Sequence
  Description of Artificial Sequence: Synthetic oligonucleotide
aaagtcacccgctgcgaggcctgaga

SEQ ID NO: 302157 - DNA, 25 bp, Artificial Sequence
  Description of Artificial Sequence: Synthetic oligonucleotide
aagtcacccgctgcgaggcctgaga

SEQ ID NO: 302158 - DNA, 24 bp, Artificial Sequence
  Description of Artificial Sequence: Synthetic oligonucleotide
agtcacccgctgcgaggcctgaga

SEQ ID NO: 302159 - DNA, 23 bp, Artificial Sequence
  Description of Artificial Sequence: Synthetic oligonucleotide
gtcacccgctgcgaggcctgaga

SEQ ID NO: 302160 - DNA, 23 bp, Artificial Sequence
  Description of Artificial Sequence: Synthetic oligonucleotide
tcacccgctgcgaggcctgagag

SEQ ID NO: 302161 - DNA, 22 bp, Artificial Sequence
  Description of Artificial Sequence: Synthetic oligonucleotide
cacccgctgcgaggcctgagag

SEQ ID NO: 302162 - DNA, 22 bp, Artificial Sequence
  Description of Artificial Sequence: Synthetic oligonucleotide
acccgctgcgaggcctgagagg

SEQ ID NO: 302163 - DNA, 21 bp, Artificial Sequence
  Description of Artificial Sequence: Synthetic oligonucleotide
cccgctgcgaggcctgagagg

SEQ ID NO: 302164 - DNA, 21 bp, Artificial Sequence
  Description of Artificial Sequence: Synthetic oligonucleotide
ccgctgcgaggcctgagaggg

SEQ ID NO: 302165 - DNA, 23 bp, Artificial Sequence
  Description of Artificial Sequence: Synthetic oligonucleotide
cgctgcgaggcctgagagggcaa

SEQ ID NO: 302166 - DNA, 25 bp, Artificial Sequence
  Description of Artificial Sequence: Synthetic oligonucleotide
gctgcgaggcctgagagggcaagat

SEQ ID NO: 302167 - DNA, 26 bp, Artificial Sequence
  Description of Artificial Sequence: Synthetic oligonucleotide
ctgcgaggcctgagagggcaagatca

SEQ ID NO: 302168 - DNA, 26 bp, Artificial Sequence
  Description of Artificial Sequence: Synthetic oligonucleotide
tgcgaggcctgagagggcaagatcac

SEQ ID NO: 302169 - DNA, 25 bp, Artificial Sequence
  Description of Artificial Sequence: Synthetic oligonucleotide
gcgaggcctgagagggcaagatcac

SEQ ID NO: 302170 - DNA, 25 bp, Artificial Sequence
  Description of Artificial Sequence: Synthetic oligonucleotide
cgaggcctgagagggcaagatcacc

SEQ ID NO: 302171 - DNA, 26 bp, Artificial Sequence
  Description of Artificial Sequence: Synthetic oligonucleotide
gaggcctgagagggcaagatcaccgt

SEQ ID NO: 302172 - DNA, 27 bp, Artificial Sequence
  Description of Artificial Sequence: Synthetic oligonucleotide
aggcctgagagggcaagatcaccgtgt

SEQ ID NO: 302173 - DNA, 26 bp, Artificial Sequence
  Description of Artificial Sequence: Synthetic oligonucleotide
ggcctgagagggcaagatcaccgtgt

SEQ ID NO: 302174 - DNA, 27 bp, Artificial Sequence
  Description of Artificial Sequence: Synthetic oligonucleotide
gcctgagagggcaagatcaccgtgtca

SEQ ID NO: 302175 - DNA, 28 bp, Artificial Sequence
  Description of Artificial Sequence: Synthetic oligonucleotide
cctgagagggcaagatcaccgtgtcatg

SEQ ID NO: 302176 - DNA, 28 bp, Artificial Sequence
  Description of Artificial Sequence: Synthetic oligonucleotide
ctgagagggcaagatcaccgtgtcatgc

SEQ ID NO: 302177 - DNA, 29 bp, Artificial Sequence
  Description of Artificial Sequence: Synthetic oligonucleotide
tgagagggcaagatcaccgtgtcatgcag

SEQ ID NO: 302178 - DNA, 28 bp, Artificial Sequence
  Description of Artificial Sequence: Synthetic oligonucleotide
gagagggcaagatcaccgtgtcatgcag

SEQ ID NO: 302179 - DNA, 28 bp, Artificial Sequence
  Description of Artificial Sequence: Synthetic oligonucleotide
agagggcaagatcaccgtgtcatgcagg

SEQ ID NO: 302180 - DNA, 27 bp, Artificial Sequence
  Description of Artificial Sequence: Synthetic oligonucleotide
gagggcaagatcaccgtgtcatgcagg

SEQ ID NO: 302181 - DNA, 27 bp, Artificial Sequence
  Description of Artificial Sequence: Synthetic oligonucleotide
agggcaagatcaccgtgtcatgcaggg

SEQ ID NO: 302182 - DNA, 26 bp, Artificial Sequence
  Description of Artificial Sequence: Synthetic oligonucleotide
gggcaagatcaccgtgtcatgcaggg

SEQ ID NO: 302183 - DNA, 27 bp, Artificial Sequence
  Description of Artificial Sequence: Synthetic oligonucleotide
ggcaagatcaccgtgtcatgcaggggt

SEQ ID NO: 302184 - DNA, 28 bp, Artificial Sequence
  Description of Artificial Sequence: Synthetic oligonucleotide
gcaagatcaccgtgtcatgcaggggttc

SEQ ID NO: 302185 - DNA, 28 bp, Artificial Sequence
  Description of Artificial Sequence: Synthetic oligonucleotide
caagatcaccgtgtcatgcaggggttcc

SEQ ID NO: 302186 - DNA, 29 bp, Artificial Sequence
  Description of Artificial Sequence: Synthetic oligonucleotide
aagatcaccgtgtcatgcaggggttccag

SEQ ID NO: 302187 - DNA, 28 bp, Artificial Sequence
  Description of Artificial Sequence: Synthetic oligonucleotide
agatcaccgtgtcatgcaggggttccag

SEQ ID NO: 302188 - DNA, 27 bp, Artificial Sequence
  Description of Artificial Sequence: Synthetic oligonucleotide
gatcaccgtgtcatgcaggggttccag

SEQ ID NO: 302189 - DNA, 27 bp, Artificial Sequence
  Description of Artificial Sequence: Synthetic oligonucleotide
atcaccgtgtcatgcaggggttccagc

SEQ ID NO: 302190 - DNA, 27 bp, Artificial Sequence
  Description of Artificial Sequence: Synthetic oligonucleotide
tcaccgtgtcatgcaggggttccagct

SEQ ID NO: 302191 - DNA, 27 bp, Artificial Sequence
  Description of Artificial Sequence: Synthetic oligonucleotide
caccgtgtcatgcaggggttccagctt

SEQ ID NO: 302192 - DNA, 27 bp, Artificial Sequence
  Description of Artificial Sequence: Synthetic oligonucleotide
accgtgtcatgcaggggttccagcttg

SEQ ID NO: 302193 - DNA, 27 bp, Artificial Sequence
  Description of Artificial Sequence: Synthetic oligonucleotide
ccgtgtcatgcaggggttccagcttgt

SEQ ID NO: 302194 - DNA, 29 bp, Artificial Sequence
  Description of Artificial Sequence: Synthetic oligonucleotide
cgtgtcatgcaggggttccagcttgtatc

SEQ ID NO: 302195 - DNA, 29 bp, Artificial Sequence
  Description of Artificial Sequence: Synthetic oligonucleotide
gtgtcatgcaggggttccagcttgtatcc

SEQ ID NO: 302196 - DNA, 29 bp, Artificial Sequence
  Description of Artificial Sequence: Synthetic oligonucleotide
tgtcatgcaggggttccagcttgtatccc

SEQ ID NO: 302197 - DNA, 28 bp, Artificial Sequence
  Description of Artificial Sequence: Synthetic oligonucleotide
gtcatgcaggggttccagcttgtatccc

SEQ ID NO: 302198 - DNA, 28 bp, Artificial Sequence
  Description of Artificial Sequence: Synthetic oligonucleotide
tcatgcaggggttccagcttgtatcccc

SEQ ID NO: 302199 - DNA, 27 bp, Artificial Sequence
  Description of Artificial Sequence: Synthetic oligonucleotide
catgcaggggttccagcttgtatcccc

SEQ ID NO: 302200 - DNA, 27 bp, Artificial Sequence
  Description of Artificial Sequence: Synthetic oligonucleotide
atgcaggggttccagcttgtatccccg

SEQ ID NO: 302201 - DNA, 26 bp, Artificial Sequence
  Description of Artificial Sequence: Synthetic oligonucleotide
tgcaggggttccagcttgtatccccg

SEQ ID NO: 302202 - DNA, 25 bp, Artificial Sequence
  Description of Artificial Sequence: Synthetic oligonucleotide
gcaggggttccagcttgtatccccg

SEQ ID NO: 302203 - DNA, 27 bp, Artificial Sequence
  Description of Artificial Sequence: Synthetic oligonucleotide
caggggttccagcttgtatccccggta

SEQ ID NO: 302204 - DNA, 30 bp, Artificial Sequence
  Description of Artificial Sequence: Synthetic oligonucleotide
aggggttccagcttgtatccccggtatatc

SEQ ID NO: 302205 - DNA, 29 bp, Artificial Sequence
  Description of Artificial Sequence: Synthetic oligonucleotide
ggggttccagcttgtatccccggtatatc

SEQ ID NO: 302206 - DNA, 32 bp, Artificial Sequence
  Description of Artificial Sequence: Synthetic oligonucleotide
gggttccagcttgtatccccggtatatcatac

SEQ ID NO: 302207 - DNA, 33 bp, Artificial Sequence
  Description of Artificial Sequence: Synthetic oligonucleotide
ggttccagcttgtatccccggtatatcatacag

SEQ ID NO: 302208 - DNA, 34 bp, Artificial Sequence
  Description of Artificial Sequence: Synthetic oligonucleotide
gttccagcttgtatccccggtatatcatacagac

SEQ ID NO: 302209 - DNA, 34 bp, Artificial Sequence
  Description of Artificial Sequence: Synthetic oligonucleotide
ttccagcttgtatccccggtatatcatacagacc

SEQ ID NO: 302210 - DNA, 33 bp, Artificial Sequence
  Description of Artificial Sequence: Synthetic oligonucleotide
tccagcttgtatccccggtatatcatacagacc

SEQ ID NO: 302211 - DNA, 32 bp, Artificial Sequence
  Description of Artificial Sequence: Synthetic oligonucleotide
ccagcttgtatccccggtatatcatacagacc

SEQ ID NO: 302212 - DNA, 33 bp, Artificial Sequence
  Description of Artificial Sequence: Synthetic oligonucleotide
cagcttgtatccccggtatatcatacagacctg

SEQ ID NO: 302213 - DNA, 33 bp, Artificial Sequence
  Description of Artificial Sequence: Synthetic oligonucleotide
agcttgtatccccggtatatcatacagacctgg

SEQ ID NO: 302214 - DNA, 32 bp, Artificial Sequence
  Description of Artificial Sequence: Synthetic oligonucleotide
gcttgtatccccggtatatcatacagacctgg

SEQ ID NO: 302215 - DNA, 32 bp, Artificial Sequence
  Description of Artificial Sequence: Synthetic oligonucleotide
cttgtatccccggtatatcatacagacctggc

SEQ ID NO: 302216 - DNA, 32 bp, Artificial Sequence
  Description of Artificial Sequence: Synthetic oligonucleotide
ttgtatccccggtatatcatacagacctggcg

SEQ ID NO: 302217 - DNA, 31 bp, Artificial Sequence
  Description of Artificial Sequence: Synthetic oligonucleotide
tgtatccccggtatatcatacagacctggcg

SEQ ID NO: 302218 - DNA, 30 bp, Artificial Sequence
  Description of Artificial Sequence: Synthetic oligonucleotide
gtatccccggtatatcatacagacctggcg

SEQ ID NO: 302219 - DNA, 31 bp, Artificial Sequence
  Description of Artificial Sequence: Synthetic oligonucleotide
tatccccggtatatcatacagacctggcgac

SEQ ID NO: 302220 - DNA, 30 bp, Artificial Sequence
  Description of Artificial Sequence: Synthetic oligonucleotide
atccccggtatatcatacagacctggcgac

SEQ ID NO: 302221 - DNA, 29 bp, Artificial Sequence
  Description of Artificial Sequence: Synthetic oligonucleotide
tccccggtatatcatacagacctggcgac

SEQ ID NO: 302222 - DNA, 28 bp, Artificial Sequence
  Description of Artificial Sequence: Synthetic oligonucleotide
ccccggtatatcatacagacctggcgac

SEQ ID NO: 302223 - DNA, 29 bp, Artificial Sequence
  Description of Artificial Sequence: Synthetic oligonucleotide
cccggtatatcatacagacctggcgacag

SEQ ID NO: 302224 - DNA, 29 bp, Artificial Sequence
  Description of Artificial Sequence: Synthetic oligonucleotide
ccggtatatcatacagacctggcgacagg

SEQ ID NO: 302225 - DNA, 31 bp, Artificial Sequence
  Description of Artificial Sequence: Synthetic oligonucleotide
cggtatatcatacagacctggcgacaggatg

SEQ ID NO: 302226 - DNA, 31 bp, Artificial Sequence
  Description of Artificial Sequence: Synthetic oligonucleotide
ggtatatcatacagacctggcgacaggatgg

SEQ ID NO: 302227 - DNA, 31 bp, Artificial Sequence
  Description of Artificial Sequence: Synthetic oligonucleotide
gtatatcatacagacctggcgacaggatggg

SEQ ID NO: 302228 - DNA, 31 bp, Artificial Sequence
  Description of Artificial Sequence: Synthetic oligonucleotide
tatatcatacagacctggcgacaggatgggc

SEQ ID NO: 302229 - DNA, 30 bp, Artificial Sequence
  Description of Artificial Sequence: Synthetic oligonucleotide
atatcatacagacctggcgacaggatgggc

SEQ ID NO: 302230 - DNA, 29 bp, Artificial Sequence
  Description of Artificial Sequence: Synthetic oligonucleotide
tatcatacagacctggcgacaggatgggc

SEQ ID NO: 302231 - DNA, 28 bp, Artificial Sequence
  Description of Artificial Sequence: Synthetic oligonucleotide
atcatacagacctggcgacaggatgggc

SEQ ID NO: 302232 - DNA, 27 bp, Artificial Sequence
  Description of Artificial Sequence: Synthetic oligonucleotide
tcatacagacctggcgacaggatgggc

SEQ ID NO: 302233 - DNA, 27 bp, Artificial Sequence
  Description of Artificial Sequence: Synthetic oligonucleotide
catacagacctggcgacaggatgggct

SEQ ID NO: 302234 - DNA, 29 bp, Artificial Sequence
  Description of Artificial Sequence: Synthetic oligonucleotide
atacagacctggcgacaggatgggctatc

SEQ ID NO: 302235 - DNA, 28 bp, Artificial Sequence
  Description of Artificial Sequence: Synthetic oligonucleotide
tacagacctggcgacaggatgggctatc

SEQ ID NO: 302236 - DNA, 27 bp, Artificial Sequence
  Description of Artificial Sequence: Synthetic oligonucleotide
acagacctggcgacaggatgggctatc

SEQ ID NO: 302237 - DNA, 27 bp, Artificial Sequence
  Description of Artificial Sequence: Synthetic oligonucleotide
cagacctggcgacaggatgggctatct

SEQ ID NO: 302238 - DNA, 29 bp, Artificial Sequence
  Description of Artificial Sequence: Synthetic oligonucleotide
agacctggcgacaggatgggctatctttg

SEQ ID NO: 302239 - DNA, 28 bp, Artificial Sequence
  Description of Artificial Sequence: Synthetic oligonucleotide
gacctggcgacaggatgggctatctttg

SEQ ID NO: 302240 - DNA, 29 bp, Artificial Sequence
  Description of Artificial Sequence: Synthetic oligonucleotide
acctggcgacaggatgggctatctttgac

SEQ ID NO: 302241 - DNA, 28 bp, Artificial Sequence
  Description of Artificial Sequence: Synthetic oligonucleotide
cctggcgacaggatgggctatctttgac

SEQ ID NO: 302242 - DNA, 28 bp, Artificial Sequence
  Description of Artificial Sequence: Synthetic oligonucleotide
ctggcgacaggatgggctatctttgacc

SEQ ID NO: 302243 - DNA, 28 bp, Artificial Sequence
  Description of Artificial Sequence: Synthetic oligonucleotide
tggcgacaggatgggctatctttgaccc

SEQ ID NO: 302244 - DNA, 27 bp, Artificial Sequence
  Description of Artificial Sequence: Synthetic oligonucleotide
ggcgacaggatgggctatctttgaccc

SEQ ID NO: 302245 - DNA, 28 bp, Artificial Sequence
  Description of Artificial Sequence: Synthetic oligonucleotide
gcgacaggatgggctatctttgacccac

SEQ ID NO: 302246 - DNA, 28 bp, Artificial Sequence
  Description of Artificial Sequence: Synthetic oligonucleotide
cgacaggatgggctatctttgacccacg

SEQ ID NO: 302247 - DNA, 29 bp, Artificial Sequence
  Description of Artificial Sequence: Synthetic oligonucleotide
gacaggatgggctatctttgacccacgac

SEQ ID NO: 302248 - DNA, 30 bp, Artificial Sequence
  Description of Artificial Sequence: Synthetic oligonucleotide
acaggatgggctatctttgacccacgacac

SEQ ID NO: 302249 - DNA, 29 bp, Artificial Sequence
  Description of Artificial Sequence: Synthetic oligonucleotide
caggatgggctatctttgacccacgacac

SEQ ID NO: 302250 - DNA, 29 bp, Artificial Sequence
  Description of Artificial Sequence: Synthetic oligonucleotide
aggatgggctatctttgacccacgacacg

SEQ ID NO: 302251 - DNA, 28 bp, Artificial Sequence
  Description of Artificial Sequence: Synthetic oligonucleotide
ggatgggctatctttgacccacgacacg

SEQ ID NO: 302252 - DNA, 28 bp, Artificial Sequence
  Description of Artificial Sequence: Synthetic oligonucleotide
gatgggctatctttgacccacgacacgc

SEQ ID NO: 302253 - DNA, 29 bp, Artificial Sequence
  Description of Artificial Sequence: Synthetic oligonucleotide
atgggctatctttgacccacgacacgcag

SEQ ID NO: 302254 - DNA, 28 bp, Artificial Sequence
  Description of Artificial Sequence: Synthetic oligonucleotide
tgggctatctttgacccacgacacgcag

SEQ ID NO: 302255 - DNA, 27 bp, Artificial Sequence
  Description of Artificial Sequence: Synthetic oligonucleotide
gggctatctttgacccacgacacgcag

SEQ ID NO: 302256 - DNA, 27 bp, Artificial Sequence
  Description of Artificial Sequence: Synthetic oligonucleotide
ggctatctttgacccacgacacgcagc

SEQ ID NO: 302257 - DNA, 28 bp, Artificial Sequence
  Description of Artificial Sequence: Synthetic oligonucleotide
gctatctttgacccacgacacgcagcag

SEQ ID NO: 302258 - DNA, 29 bp, Artificial Sequence
  Description of Artificial Sequence: Synthetic oligonucleotide
ctatctttgacccacgacacgcagcagtg

SEQ ID NO: 302259 - DNA, 29 bp, Artificial Sequence
  Description of Artificial Sequence: Synthetic oligonucleotide
tatctttgacccacgacacgcagcagtgg

SEQ ID NO: 302260 - DNA, 28 bp, Artificial Sequence
  Description of Artificial Sequence: Synthetic oligonucleotide
atctttgacccacgacacgcagcagtgg

SEQ ID NO: 302261 - DNA, 27 bp, Artificial Sequence
  Description of Artificial Sequence: Synthetic oligonucleotide
tctttgacccacgacacgcagcagtgg

SEQ ID NO: 302262 - DNA, 26 bp, Artificial Sequence
  Description of Artificial Sequence: Synthetic oligonucleotide
ctttgacccacgacacgcagcagtgg

SEQ ID NO: 302263 - DNA, 26 bp, Artificial Sequence
  Description of Artificial Sequence: Synthetic oligonucleotide
tttgacccacgacacgcagcagtggc

SEQ ID NO: 302264 - DNA, 25 bp, Artificial Sequence
  Description of Artificial Sequence: Synthetic oligonucleotide
ttgacccacgacacgcagcagtggc

SEQ ID NO: 302265 - DNA, 24 bp, Artificial Sequence
  Description of Artificial Sequence: Synthetic oligonucleotide
tgacccacgacacgcagcagtggc

SEQ ID NO: 302266 - DNA, 23 bp, Artificial Sequence
  Description of Artificial Sequence: Synthetic oligonucleotide
gacccacgacacgcagcagtggc

SEQ ID NO: 302267 - DNA, 23 bp, Artificial Sequence
  Description of Artificial Sequence: Synthetic oligonucleotide
acccacgacacgcagcagtggcg

SEQ ID NO: 302268 - DNA, 22 bp, Artificial Sequence
  Description of Artificial Sequence: Synthetic oligonucleotide
cccacgacacgcagcagtggcg

SEQ ID NO: 302269 - DNA, 22 bp, Artificial Sequence
  Description of Artificial Sequence: Synthetic oligonucleotide
ccacgacacgcagcagtggcgg

SEQ ID NO: 302270 - DNA, 24 bp, Artificial Sequence
  Description of Artificial Sequence: Synthetic oligonucleotide
cacgacacgcagcagtggcgggat

SEQ ID NO: 302271 - DNA, 25 bp, Artificial Sequence
  Description of Artificial Sequence: Synthetic oligonucleotide
acgacacgcagcagtggcgggatgt

SEQ ID NO: 302272 - DNA, 24 bp, Artificial Sequence
  Description of Artificial Sequence: Synthetic oligonucleotide
cgacacgcagcagtggcgggatgt

SEQ ID NO: 302273 - DNA, 24 bp, Artificial Sequence
  Description of Artificial Sequence: Synthetic oligonucleotide
gacacgcagcagtggcgggatgtc

SEQ ID NO: 302274 - DNA, 25 bp, Artificial Sequence
  Description of Artificial Sequence: Synthetic oligonucleotide
acacgcagcagtggcgggatgtcca

SEQ ID NO: 302275 - DNA, 24 bp, Artificial Sequence
  Description of Artificial Sequence: Synthetic oligonucleotide
cacgcagcagtggcgggatgtcca

SEQ ID NO: 302276 - DNA, 24 bp, Artificial Sequence
  Description of Artificial Sequence: Synthetic oligonucleotide
acgcagcagtggcgggatgtccag

SEQ ID NO: 302277 - DNA, 23 bp, Artificial Sequence
  Description of Artificial Sequence: Synthetic oligonucleotide
cgcagcagtggcgggatgtccag

SEQ ID NO: 302278 - DNA, 23 bp, Artificial Sequence
  Description of Artificial Sequence: Synthetic oligonucleotide
gcagcagtggcgggatgtccagc

SEQ ID NO: 302279 - DNA, 24 bp, Artificial Sequence
  Description of Artificial Sequence: Synthetic oligonucleotide
cagcagtggcgggatgtccagcct

SEQ ID NO: 302280 - DNA, 26 bp, Artificial Sequence
  Description of Artificial Sequence: Synthetic oligonucleotide
agcagtggcgggatgtccagcctgat

SEQ ID NO: 302281 - DNA, 25 bp, Artificial Sequence
  Description of Artificial Sequence: Synthetic oligonucleotide
gcagtggcgggatgtccagcctgat

SEQ ID NO: 302282 - DNA, 25 bp, Artificial Sequence
  Description of Artificial Sequence: Synthetic oligonucleotide
cagtggcgggatgtccagcctgatg

SEQ ID NO: 302283 - DNA, 25 bp, Artificial Sequence
  Description of Artificial Sequence: Synthetic oligonucleotide
agtggcgggatgtccagcctgatgg

SEQ ID NO: 302284 - DNA, 24 bp, Artificial Sequence
  Description of Artificial Sequence: Synthetic oligonucleotide
gtggcgggatgtccagcctgatgg

SEQ ID NO: 302285 - DNA, 27 bp, Artificial Sequence
  Description of Artificial Sequence: Synthetic oligonucleotide
tggcgggatgtccagcctgatggcaat

SEQ ID NO: 302286 - DNA, 26 bp, Artificial Sequence
  Description of Artificial Sequence: Synthetic oligonucleotide
ggcgggatgtccagcctgatggcaat

SEQ ID NO: 302287 - DNA, 26 bp, Artificial Sequence
  Description of Artificial Sequence: Synthetic oligonucleotide
gcgggatgtccagcctgatggcaatg

SEQ ID NO: 302288 - DNA, 27 bp, Artificial Sequence
  Description of Artificial Sequence: Synthetic oligonucleotide
cgggatgtccagcctgatggcaatgga

SEQ ID NO: 302289 - DNA, 28 bp, Artificial Sequence
  Description of Artificial Sequence: Synthetic oligonucleotide
gggatgtccagcctgatggcaatggaac

SEQ ID NO: 302290 - DNA, 28 bp, Artificial Sequence
  Description of Artificial Sequence: Synthetic oligonucleotide
ggatgtccagcctgatggcaatggaacc

SEQ ID NO: 302291 - DNA, 30 bp, Artificial Sequence
  Description of Artificial Sequence: Synthetic oligonucleotide
gatgtccagcctgatggcaatggaaccaac

SEQ ID NO: 302292 - DNA, 30 bp, Artificial Sequence
  Description of Artificial Sequence: Synthetic oligonucleotide
atgtccagcctgatggcaatggaaccaacc

SEQ ID NO: 302293 - DNA, 29 bp, Artificial Sequence
  Description of Artificial Sequence: Synthetic oligonucleotide
tgtccagcctgatggcaatggaaccaacc

SEQ ID NO: 302294 - DNA, 28 bp, Artificial Sequence
  Description of Artificial Sequence: Synthetic oligonucleotide
gtccagcctgatggcaatggaaccaacc

SEQ ID NO: 302295 - DNA, 29 bp, Artificial Sequence
  Description of Artificial Sequence: Synthetic oligonucleotide
tccagcctgatggcaatggaaccaaccag

SEQ ID NO: 302296 - DNA, 28 bp, Artificial Sequence
  Description of Artificial Sequence: Synthetic oligonucleotide
ccagcctgatggcaatggaaccaaccag

SEQ ID NO: 302297 - DNA, 29 bp, Artificial Sequence
  Description of Artificial Sequence: Synthetic oligonucleotide
cagcctgatggcaatggaaccaaccagac

SEQ ID NO: 302298 - DNA, 29 bp, Artificial Sequence
  Description of Artificial Sequence: Synthetic oligonucleotide
agcctgatggcaatggaaccaaccagacc

SEQ ID NO: 302299 - DNA, 28 bp, Artificial Sequence
  Description of Artificial Sequence: Synthetic oligonucleotide
gcctgatggcaatggaaccaaccagacc

SEQ ID NO: 302300 - DNA, 29 bp, Artificial Sequence
  Description of Artificial Sequence: Synthetic oligonucleotide
cctgatggcaatggaaccaaccagacctc

SEQ ID NO: 302301 - DNA, 29 bp, Artificial Sequence
  Description of Artificial Sequence: Synthetic oligonucleotide
ctgatggcaatggaaccaaccagacctcg

SEQ ID NO: 302302 - DNA, 29 bp, Artificial Sequence
  Description of Artificial Sequence: Synthetic oligonucleotide
tgatggcaatggaaccaaccagacctcgg

SEQ ID NO: 302303 - DNA, 28 bp, Artificial Sequence
  Description of Artificial Sequence: Synthetic oligonucleotide
gatggcaatggaaccaaccagacctcgg

SEQ ID NO: 302304 - DNA, 29 bp, Artificial Sequence
  Description of Artificial Sequence: Synthetic oligonucleotide
atggcaatggaaccaaccagacctcggtg

SEQ ID NO: 302305 - DNA, 28 bp, Artificial Sequence
  Description of Artificial Sequence: Synthetic oligonucleotide
tggcaatggaaccaaccagacctcggtg

SEQ ID NO: 302306 - DNA, 27 bp, Artificial Sequence
  Description of Artificial Sequence: Synthetic oligonucleotide
ggcaatggaaccaaccagacctcggtg

SEQ ID NO: 302307 - DNA, 27 bp, Artificial Sequence
  Description of Artificial Sequence: Synthetic oligonucleotide
gcaatggaaccaaccagacctcggtgg

SEQ ID NO: 302308 - DNA, 27 bp, Artificial Sequence
  Description of Artificial Sequence: Synthetic oligonucleotide
caatggaaccaaccagacctcggtggc

SEQ ID NO: 302309 - DNA, 27 bp, Artificial Sequence
  Description of Artificial Sequence: Synthetic oligonucleotide
aatggaaccaaccagacctcggtggcc

SEQ ID NO: 302310 - DNA, 27 bp, Artificial Sequence
  Description of Artificial Sequence: Synthetic oligonucleotide
atggaaccaaccagacctcggtggcca

SEQ ID NO: 302311 - DNA, 26 bp, Artificial Sequence
  Description of Artificial Sequence: Synthetic oligonucleotide
tggaaccaaccagacctcggtggcca

SEQ ID NO: 302312 - DNA, 25 bp, Artificial Sequence
  Description of Artificial Sequence: Synthetic oligonucleotide
ggaaccaaccagacctcggtggcca

SEQ ID NO: 302313 - DNA, 25 bp, Artificial Sequence
  Description of Artificial Sequence: Synthetic oligonucleotide
gaaccaaccagacctcggtggccac

SEQ ID NO: 302314 - DNA, 26 bp, Artificial Sequence
  Description of Artificial Sequence: Synthetic oligonucleotide
aaccaaccagacctcggtggccacga

SEQ ID NO: 302315 - DNA, 25 bp, Artificial Sequence
  Description of Artificial Sequence: Synthetic oligonucleotide
accaaccagacctcggtggccacga

SEQ ID NO: 302316 - DNA, 24 bp, Artificial Sequence
  Description of Artificial Sequence: Synthetic oligonucleotide
ccaaccagacctcggtggccacga

SEQ ID NO: 302317 - DNA, 24 bp, Artificial Sequence
  Description of Artificial Sequence: Synthetic oligonucleotide
caaccagacctcggtggccacgag

SEQ ID NO: 302318 - DNA, 27 bp, Artificial Sequence
  Description of Artificial Sequence: Synthetic oligonucleotide
aaccagacctcggtggccacgaggatt

SEQ ID NO: 302319 - DNA, 27 bp, Artificial Sequence
  Description of Artificial Sequence: Synthetic oligonucleotide
accagacctcggtggccacgaggattt

SEQ ID NO: 302320 - DNA, 26 bp, Artificial Sequence
  Description of Artificial Sequence: Synthetic oligonucleotide
ccagacctcggtggccacgaggattt

SEQ ID NO: 302321 - DNA, 26 bp, Artificial Sequence
  Description of Artificial Sequence: Synthetic oligonucleotide
cagacctcggtggccacgaggatttg

SEQ ID NO: 302322 - DNA, 26 bp, Artificial Sequence
  Description of Artificial Sequence: Synthetic oligonucleotide
agacctcggtggccacgaggatttgc

SEQ ID NO: 302323 - DNA, 25 bp, Artificial Sequence
  Description of Artificial Sequence: Synthetic oligonucleotide
gacctcggtggccacgaggatttgc

SEQ ID NO: 302324 - DNA, 25 bp, Artificial Sequence
  Description of Artificial Sequence: Synthetic oligonucleotide
acctcggtggccacgaggatttgcg

SEQ ID NO: 302325 - DNA, 24 bp, Artificial Sequence
  Description of Artificial Sequence: Synthetic oligonucleotide
cctcggtggccacgaggatttgcg

SEQ ID NO: 302326 - DNA, 25 bp, Artificial Sequence
  Description of Artificial Sequence: Synthetic oligonucleotide
ctcggtggccacgaggatttgcgga

SEQ ID NO: 302327 - DNA, 25 bp, Artificial Sequence
  Description of Artificial Sequence: Synthetic oligonucleotide
tcggtggccacgaggatttgcggag

SEQ ID NO: 302328 - DNA, 24 bp, Artificial Sequence
  Description of Artificial Sequence: Synthetic oligonucleotide
cggtggccacgaggatttgcggag

SEQ ID NO: 302329 - DNA, 25 bp, Artificial Sequence
  Description of Artificial Sequence: Synthetic oligonucleotide
ggtggccacgaggatttgcggagga

SEQ ID NO: 302330 - DNA, 26 bp, Artificial Sequence
  Description of Artificial Sequence: Synthetic oligonucleotide
gtggccacgaggatttgcggaggaga

SEQ ID NO: 302331 - DNA, 26 bp, Artificial Sequence
  Description of Artificial Sequence: Synthetic oligonucleotide
tggccacgaggatttgcggaggagag

SEQ ID NO: 302332 - DNA, 25 bp, Artificial Sequence
  Description of Artificial Sequence: Synthetic oligonucleotide
ggccacgaggatttgcggaggagag

SEQ ID NO: 302333 - DNA, 26 bp, Artificial Sequence
  Description of Artificial Sequence: Synthetic oligonucleotide
gccacgaggatttgcggaggagaggt

SEQ ID NO: 302334 - DNA, 26 bp, Artificial Sequence
  Description of Artificial Sequence: Synthetic oligonucleotide
ccacgaggatttgcggaggagaggtg

SEQ ID NO: 302335 - DNA, 27 bp, Artificial Sequence
  Description of Artificial Sequence: Synthetic oligonucleotide
cacgaggatttgcggaggagaggtgca

SEQ ID NO: 302336 - DNA, 27 bp, Artificial Sequence
  Description of Artificial Sequence: Synthetic oligonucleotide
acgaggatttgcggaggagaggtgcag

SEQ ID NO: 302337 - DNA, 27 bp, Artificial Sequence
  Description of Artificial Sequence: Synthetic oligonucleotide
cgaggatttgcggaggagaggtgcaga

SEQ ID NO: 302338 - DNA, 27 bp, Artificial Sequence
  Description of Artificial Sequence: Synthetic oligonucleotide
gaggatttgcggaggagaggtgcagag

SEQ ID NO: 302339 - DNA, 27 bp, Artificial Sequence
  Description of Artificial Sequence: Synthetic oligonucleotide
aggatttgcggaggagaggtgcagagg

SEQ ID NO: 302340 - DNA, 27 bp, Artificial Sequence
  Description of Artificial Sequence: Synthetic oligonucleotide
ggatttgcggaggagaggtgcagaggt

SEQ ID NO: 302341 - DNA, 28 bp, Artificial Sequence
  Description of Artificial Sequence: Synthetic oligonucleotide
gatttgcggaggagaggtgcagaggttg

SEQ ID NO: 302342 - DNA, 30 bp, Artificial Sequence
  Description of Artificial Sequence: Synthetic oligonucleotide
atttgcggaggagaggtgcagaggttgatc

SEQ ID NO: 302343 - DNA, 29 bp, Artificial Sequence
  Description of Artificial Sequence: Synthetic oligonucleotide
tttgcggaggagaggtgcagaggttgatc

SEQ ID NO: 302344 - DNA, 28 bp, Artificial Sequence
  Description of Artificial Sequence: Synthetic oligonucleotide
ttgcggaggagaggtgcagaggttgatc

SEQ ID NO: 302345 - DNA, 27 bp, Artificial Sequence
  Description of Artificial Sequence: Synthetic oligonucleotide
tgcggaggagaggtgcagaggttgatc

SEQ ID NO: 302346 - DNA, 27 bp, Artificial Sequence
  Description of Artificial Sequence: Synthetic oligonucleotide
gcggaggagaggtgcagaggttgatca

SEQ ID NO: 302347 - DNA, 27 bp, Artificial Sequence
  Description of Artificial Sequence: Synthetic oligonucleotide
cggaggagaggtgcagaggttgatcac

SEQ ID NO: 302348 - DNA, 27 bp, Artificial Sequence
  Description of Artificial Sequence: Synthetic oligonucleotide
ggaggagaggtgcagaggttgatcacc

SEQ ID NO: 302349 - DNA, 27 bp, Artificial Sequence
  Description of Artificial Sequence: Synthetic oligonucleotide
gaggagaggtgcagaggttgatcaccg

SEQ ID NO: 302350 - DNA, 28 bp, Artificial Sequence
  Description of Artificial Sequence: Synthetic oligonucleotide
aggagaggtgcagaggttgatcaccgtg

SEQ ID NO: 302351 - DNA, 27 bp, Artificial Sequence
  Description of Artificial Sequence: Synthetic oligonucleotide
ggagaggtgcagaggttgatcaccgtg

SEQ ID NO: 302352 - DNA, 28 bp, Artificial Sequence
  Description of Artificial Sequence: Synthetic oligonucleotide
gagaggtgcagaggttgatcaccgtgtc

SEQ ID NO: 302353 - DNA, 30 bp, Artificial Sequence
  Description of Artificial Sequence: Synthetic oligonucleotide
agaggtgcagaggttgatcaccgtgtcatg

SEQ ID NO: 302354 - DNA, 29 bp, Artificial Sequence
  Description of Artificial Sequence: Synthetic oligonucleotide
gaggtgcagaggttgatcaccgtgtcatg

SEQ ID NO: 302355 - DNA, 29 bp, Artificial Sequence
  Description of Artificial Sequence: Synthetic oligonucleotide
aggtgcagaggttgatcaccgtgtcatgc

SEQ ID NO: 302356 - DNA, 28 bp, Artificial Sequence
  Description of Artificial Sequence: Synthetic oligonucleotide
ggtgcagaggttgatcaccgtgtcatgc

SEQ ID NO: 302357 - DNA, 29 bp, Artificial Sequence
  Description of Artificial Sequence: Synthetic oligonucleotide
gtgcagaggttgatcaccgtgtcatgcag

SEQ ID NO: 302358 - DNA, 29 bp, Artificial Sequence
  Description of Artificial Sequence: Synthetic oligonucleotide
tgcagaggttgatcaccgtgtcatgcagg

SEQ ID NO: 302359 - DNA, 28 bp, Artificial Sequence
  Description of Artificial Sequence: Synthetic oligonucleotide
gcagaggttgatcaccgtgtcatgcagg

SEQ ID NO: 302360 - DNA, 28 bp, Artificial Sequence
  Description of Artificial Sequence: Synthetic oligonucleotide
cagaggttgatcaccgtgtcatgcaggg

SEQ ID NO: 302361 - DNA, 28 bp, Artificial Sequence
  Description of Artificial Sequence: Synthetic oligonucleotide
agaggttgatcaccgtgtcatgcagggg

SEQ ID NO: 302362 - DNA, 27 bp, Artificial Sequence
  Description of Artificial Sequence: Synthetic oligonucleotide
gaggttgatcaccgtgtcatgcagggg

SEQ ID NO: 302363 - DNA, 29 bp, Artificial Sequence
  Description of Artificial Sequence: Synthetic oligonucleotide
aggttgatcaccgtgtcatgcaggggttc

SEQ ID NO: 302364 - DNA, 28 bp, Artificial Sequence
  Description of Artificial Sequence: Synthetic oligonucleotide
ggttgatcaccgtgtcatgcaggggttc

SEQ ID NO: 302365 - DNA, 28 bp, Artificial Sequence
  Description of Artificial Sequence: Synthetic oligonucleotide
gttgatcaccgtgtcatgcaggggttcc

SEQ ID NO: 302366 - DNA, 29 bp, Artificial Sequence
  Description of Artificial Sequence: Synthetic oligonucleotide
ttgatcaccgtgtcatgcaggggttccag

SEQ ID NO: 302367 - DNA, 28 bp, Artificial Sequence
  Description of Artificial Sequence: Synthetic oligonucleotide
tgatcaccgtgtcatgcaggggttccag

SEQ ID NO: 302368 - DNA, 29 bp, Artificial Sequence
  Description of Artificial Sequence: Synthetic oligonucleotide
cccggtatatcatacagacctggcgactg

SEQ ID NO: 302369 - DNA, 29 bp, Artificial Sequence
  Description of Artificial Sequence: Synthetic oligonucleotide
ccggtatatcatacagacctggcgactgg

SEQ ID NO: 302370 - DNA, 30 bp, Artificial Sequence
  Description of Artificial Sequence: Synthetic oligonucleotide
cggtatatcatacagacctggcgactggtg

SEQ ID NO: 302371 - DNA, 30 bp, Artificial Sequence
  Description of Artificial Sequence: Synthetic oligonucleotide
ggtatatcatacagacctggcgactggtgc

SEQ ID NO: 302372 - DNA, 32 bp, Artificial Sequence
  Description of Artificial Sequence: Synthetic oligonucleotide
gtatatcatacagacctggcgactggtgcttg

SEQ ID NO: 302373 - DNA, 33 bp, Artificial Sequence
  Description of Artificial Sequence: Synthetic oligonucleotide
tatatcatacagacctggcgactggtgcttgag

SEQ ID NO: 302374 - DNA, 32 bp, Artificial Sequence
  Description of Artificial Sequence: Synthetic oligonucleotide
atatcatacagacctggcgactggtgcttgag

SEQ ID NO: 302375 - DNA, 31 bp, Artificial Sequence
  Description of Artificial Sequence: Synthetic oligonucleotide
tatcatacagacctggcgactggtgcttgag

SEQ ID NO: 302376 - DNA, 30 bp, Artificial Sequence
  Description of Artificial Sequence: Synthetic oligonucleotide
atcatacagacctggcgactggtgcttgag

SEQ ID NO: 302377 - DNA, 29 bp, Artificial Sequence
  Description of Artificial Sequence: Synthetic oligonucleotide
tcatacagacctggcgactggtgcttgag

SEQ ID NO: 302378 - DNA, 28 bp, Artificial Sequence
  Description of Artificial Sequence: Synthetic oligonucleotide
catacagacctggcgactggtgcttgag

SEQ ID NO: 302379 - DNA, 29 bp, Artificial Sequence
  Description of Artificial Sequence: Synthetic oligonucleotide
atacagacctggcgactggtgcttgagag

SEQ ID NO: 302380 - DNA, 28 bp, Artificial Sequence
  Description of Artificial Sequence: Synthetic oligonucleotide
tacagacctggcgactggtgcttgagag

SEQ ID NO: 302381 - DNA, 27 bp, Artificial Sequence
  Description of Artificial Sequence: Synthetic oligonucleotide
acagacctggcgactggtgcttgagag

SEQ ID NO: 302382 - DNA, 27 bp, Artificial Sequence
  Description of Artificial Sequence: Synthetic oligonucleotide
cagacctggcgactggtgcttgagagt

SEQ ID NO: 302383 - DNA, 27 bp, Artificial Sequence
  Description of Artificial Sequence: Synthetic oligonucleotide
agacctggcgactggtgcttgagagtc

SEQ ID NO: 302384 - DNA, 27 bp, Artificial Sequence
  Description of Artificial Sequence: Synthetic oligonucleotide
gacctggcgactggtgcttgagagtca

SEQ ID NO: 302385 - DNA, 29 bp, Artificial Sequence
  Description of Artificial Sequence: Synthetic oligonucleotide
acctggcgactggtgcttgagagtcattc

SEQ ID NO: 302386 - DNA, 28 bp, Artificial Sequence
  Description of Artificial Sequence: Synthetic oligonucleotide
cctggcgactggtgcttgagagtcattc

SEQ ID NO: 302387 - DNA, 28 bp, Artificial Sequence
  Description of Artificial Sequence: Synthetic oligonucleotide
ctggcgactggtgcttgagagtcattcg

SEQ ID NO: 302388 - DNA, 28 bp, Artificial Sequence
  Description of Artificial Sequence: Synthetic oligonucleotide
tggcgactggtgcttgagagtcattcgc

SEQ ID NO: 302389 - DNA, 27 bp, Artificial Sequence
  Description of Artificial Sequence: Synthetic oligonucleotide
ggcgactggtgcttgagagtcattcgc

SEQ ID NO: 302390 - DNA, 28 bp, Artificial Sequence
  Description of Artificial Sequence: Synthetic oligonucleotide
gcgactggtgcttgagagtcattcgcag

SEQ ID NO: 302391 - DNA, 29 bp, Artificial Sequence
  Description of Artificial Sequence: Synthetic oligonucleotide
cgactggtgcttgagagtcattcgcagac

SEQ ID NO: 302392 - DNA, 32 bp, Artificial Sequence
  Description of Artificial Sequence: Synthetic oligonucleotide
gactggtgcttgagagtcattcgcagacattg

SEQ ID NO: 302393 - DNA, 32 bp, Artificial Sequence
  Description of Artificial Sequence: Synthetic oligonucleotide
actggtgcttgagagtcattcgcagacattgc

SEQ ID NO: 302394 - DNA, 31 bp, Artificial Sequence
  Description of Artificial Sequence: Synthetic oligonucleotide
ctggtgcttgagagtcattcgcagacattgc

SEQ ID NO: 302395 - DNA, 33 bp, Artificial Sequence
  Description of Artificial Sequence: Synthetic oligonucleotide
tggtgcttgagagtcattcgcagacattgcatg

SEQ ID NO: 302396 - DNA, 32 bp, Artificial Sequence
  Description of Artificial Sequence: Synthetic oligonucleotide
ggtgcttgagagtcattcgcagacattgcatg

SEQ ID NO: 302397 - DNA, 35 bp, Artificial Sequence
  Description of Artificial Sequence: Synthetic oligonucleotide
gtgcttgagagtcattcgcagacattgcatgtttc

SEQ ID NO: 302398 - DNA, 36 bp, Artificial Sequence
  Description of Artificial Sequence: Synthetic oligonucleotide
tgcttgagagtcattcgcagacattgcatgtttctc

SEQ ID NO: 302399 - DNA, 35 bp, Artificial Sequence
  Description of Artificial Sequence: Synthetic oligonucleotide
gcttgagagtcattcgcagacattgcatgtttctc

SEQ ID NO: 302400 - DNA, 35 bp, Artificial Sequence
  Description of Artificial Sequence: Synthetic oligonucleotide
cttgagagtcattcgcagacattgcatgtttctcc

SEQ ID NO: 302401 - DNA, 36 bp, Artificial Sequence
  Description of Artificial Sequence: Synthetic oligonucleotide
ttgagagtcattcgcagacattgcatgtttctcctg

SEQ ID NO: 302402 - DNA, 35 bp, Artificial Sequence
  Description of Artificial Sequence: Synthetic oligonucleotide
tgagagtcattcgcagacattgcatgtttctcctg

SEQ ID NO: 302403 - DNA, 34 bp, Artificial Sequence
  Description of Artificial Sequence: Synthetic oligonucleotide
gagagtcattcgcagacattgcatgtttctcctg

SEQ ID NO: 302404 - DNA, 36 bp, Artificial Sequence
  Description of Artificial Sequence: Synthetic oligonucleotide
agagtcattcgcagacattgcatgtttctcctgttg

SEQ ID NO: 302405 - DNA, 35 bp, Artificial Sequence
  Description of Artificial Sequence: Synthetic oligonucleotide
gagtcattcgcagacattgcatgtttctcctgttg

SEQ ID NO: 302406 - DNA, 35 bp, Artificial Sequence
  Description of Artificial Sequence: Synthetic oligonucleotide
agtcattcgcagacattgcatgtttctcctgttgc

SEQ ID NO: 302407 - DNA, 34 bp, Artificial Sequence
  Description of Artificial Sequence: Synthetic oligonucleotide
gtcattcgcagacattgcatgtttctcctgttgc

SEQ ID NO: 302408 - DNA, 35 bp, Artificial Sequence
  Description of Artificial Sequence: Synthetic oligonucleotide
tcattcgcagacattgcatgtttctcctgttgctg

SEQ ID NO: 302409 - DNA, 34 bp, Artificial Sequence
  Description of Artificial Sequence: Synthetic oligonucleotide
cattcgcagacattgcatgtttctcctgttgctg

SEQ ID NO: 302410 - DNA, 34 bp, Artificial Sequence
  Description of Artificial Sequence: Synthetic oligonucleotide
attcgcagacattgcatgtttctcctgttgctgg

SEQ ID NO: 302411 - DNA, 33 bp, Artificial Sequence
  Description of Artificial Sequence: Synthetic oligonucleotide
ttcgcagacattgcatgtttctcctgttgctgg

SEQ ID NO: 302412 - DNA, 32 bp, Artificial Sequence
  Description of Artificial Sequence: Synthetic oligonucleotide
tcgcagacattgcatgtttctcctgttgctgg

SEQ ID NO: 302413 - DNA, 31 bp, Artificial Sequence
  Description of Artificial Sequence: Synthetic oligonucleotide
cgcagacattgcatgtttctcctgttgctgg

SEQ ID NO: 302414 - DNA, 32 bp, Artificial Sequence
  Description of Artificial Sequence: Synthetic oligonucleotide
gcagacattgcatgtttctcctgttgctggtg

SEQ ID NO: 302415 - DNA, 32 bp, Artificial Sequence
  Description of Artificial Sequence: Synthetic oligonucleotide
cagacattgcatgtttctcctgttgctggtgg

SEQ ID NO: 302416 - DNA, 32 bp, Artificial Sequence
  Description of Artificial Sequence: Synthetic oligonucleotide
agacattgcatgtttctcctgttgctggtggc

SEQ ID NO: 302417 - DNA, 31 bp, Artificial Sequence
  Description of Artificial Sequence: Synthetic oligonucleotide
gacattgcatgtttctcctgttgctggtggc

SEQ ID NO: 302418 - DNA, 32 bp, Artificial Sequence
  Description of Artificial Sequence: Synthetic oligonucleotide
acattgcatgtttctcctgttgctggtggctg

SEQ ID NO: 302419 - DNA, 31 bp, Artificial Sequence
  Description of Artificial Sequence: Synthetic oligonucleotide
cattgcatgtttctcctgttgctggtggctg

SEQ ID NO: 302420 - DNA, 31 bp, Artificial Sequence
  Description of Artificial Sequence: Synthetic oligonucleotide
attgcatgtttctcctgttgctggtggctgc

SEQ ID NO: 302421 - DNA, 30 bp, Artificial Sequence
  Description of Artificial Sequence: Synthetic oligonucleotide
ttgcatgtttctcctgttgctggtggctgc

SEQ ID NO: 302422 - DNA, 29 bp, Artificial Sequence
  Description of Artificial Sequence: Synthetic oligonucleotide
tgcatgtttctcctgttgctggtggctgc

SEQ ID NO: 302423 - DNA, 28 bp, Artificial Sequence
  Description of Artificial Sequence: Synthetic oligonucleotide
gcatgtttctcctgttgctggtggctgc

SEQ ID NO: 302424 - DNA, 29 bp, Artificial Sequence
  Description of Artificial Sequence: Synthetic oligonucleotide
catgtttctcctgttgctggtggctgcag

SEQ ID NO: 302425 - DNA, 29 bp, Artificial Sequence
  Description of Artificial Sequence: Synthetic oligonucleotide
atgtttctcctgttgctggtggctgcagc

SEQ ID NO: 302426 - DNA, 28 bp, Artificial Sequence
  Description of Artificial Sequence: Synthetic oligonucleotide
tgtttctcctgttgctggtggctgcagc

SEQ ID NO: 302427 - DNA, 27 bp, Artificial Sequence
  Description of Artificial Sequence: Synthetic oligonucleotide
gtttctcctgttgctggtggctgcagc

SEQ ID NO: 302428 - DNA, 34 bp, Artificial Sequence
  Description of Artificial Sequence: Synthetic oligonucleotide
tttctcctgttgctggtggctgcagctatttttc

SEQ ID NO: 302429 - DNA, 33 bp, Artificial Sequence
  Description of Artificial Sequence: Synthetic oligonucleotide
ttctcctgttgctggtggctgcagctatttttc

SEQ ID NO: 302430 - DNA, 32 bp, Artificial Sequence
  Description of Artificial Sequence: Synthetic oligonucleotide
tctcctgttgctggtggctgcagctatttttc

SEQ ID NO: 302431 - DNA, 31 bp, Artificial Sequence
  Description of Artificial Sequence: Synthetic oligonucleotide
ctcctgttgctggtggctgcagctatttttc

SEQ ID NO: 302432 - DNA, 44 bp, Artificial Sequence
  Description of Artificial Sequence: Synthetic oligonucleotide
tcctgttgctggtggctgcagctatttttcttattattaatttc

SEQ ID NO: 302433 - DNA, 43 bp, Artificial Sequence
  Description of Artificial Sequence: Synthetic oligonucleotide
cctgttgctggtggctgcagctatttttcttattattaatttc

SEQ ID NO: 302434 - DNA, 46 bp, Artificial Sequence
  Description of Artificial Sequence: Synthetic oligonucleotide
ctgttgctggtggctgcagctatttttcttattattaatttctatg

SEQ ID NO: 302435 - DNA, 47 bp, Artificial Sequence
  Description of Artificial Sequence: Synthetic oligonucleotide
tgttgctggtggctgcagctatttttcttattattaatttctatgtg

SEQ ID NO: 302436 - DNA, 46 bp, Artificial Sequence
  Description of Artificial Sequence: Synthetic oligonucleotide
gttgctggtggctgcagctatttttcttattattaatttctatgtg

SEQ ID NO: 302437 - DNA, 46 bp, Artificial Sequence
  Description of Artificial Sequence: Synthetic oligonucleotide
ttgctggtggctgcagctatttttcttattattaatttctatgtgc

SEQ ID NO: 302438 - DNA, 45 bp, Artificial Sequence
  Description of Artificial Sequence: Synthetic oligonucleotide
tgctggtggctgcagctatttttcttattattaatttctatgtgc

SEQ ID NO: 302439 - DNA, 44 bp, Artificial Sequence
  Description of Artificial Sequence: Synthetic oligonucleotide
gctggtggctgcagctatttttcttattattaatttctatgtgc

SEQ ID NO: 302440 - DNA, 44 bp, Artificial Sequence
  Description of Artificial Sequence: Synthetic oligonucleotide
ctggtggctgcagctatttttcttattattaatttctatgtgcg

SEQ ID NO: 302441 - DNA, 46 bp, Artificial Sequence
  Description of Artificial Sequence: Synthetic oligonucleotide
tggtggctgcagctatttttcttattattaatttctatgtgcgttg

SEQ ID NO: 302442 - DNA, 45 bp, Artificial Sequence
  Description of Artificial Sequence: Synthetic oligonucleotide
ggtggctgcagctatttttcttattattaatttctatgtgcgttg

SEQ ID NO: 302443 - DNA, 47 bp, Artificial Sequence
  Description of Artificial Sequence: Synthetic oligonucleotide
gtggctgcagctatttttcttattattaatttctatgtgcgttgttg

SEQ ID NO: 302444 - DNA, 50 bp, Artificial Sequence
  Description of Artificial Sequence: Synthetic oligonucleotide
tggctgcagctatttttcttattattaatttctatgtgcgttgttgttag

SEQ ID NO: 302445 - DNA, 49 bp, Artificial Sequence
  Description of Artificial Sequence: Synthetic oligonucleotide
ggctgcagctatttttcttattattaatttctatgtgcgttgttgttag

SEQ ID NO: 302446 - DNA, 51 bp, Artificial Sequence
  Description of Artificial Sequence: Synthetic oligonucleotide
gctgcagctatttttcttattattaatttctatgtgcgttgttgttagaag

SEQ ID NO: 302447 - DNA, 55 bp, Artificial Sequence
  Description of Artificial Sequence: Synthetic oligonucleotide
ctgcagctatttttcttattattaatttctatgtgcgttgttgttagaagaaaag

SEQ ID NO: 302448 - DNA, 57 bp, Artificial Sequence
  Description of Artificial Sequence: Synthetic oligonucleotide
tgcagctatttttcttattattaatttctatgtgcgttgttgttagaagaaaagatc

SEQ ID NO: 302449 - DNA, 56 bp, Artificial Sequence
  Description of Artificial Sequence: Synthetic oligonucleotide
gcagctatttttcttattattaatttctatgtgcgttgttgttagaagaaaagatc

SEQ ID NO: 302450 - DNA, 57 bp, Artificial Sequence
  Description of Artificial Sequence: Synthetic oligonucleotide
cagctatttttcttattattaatttctatgtgcgttgttgttagaagaaaagatcag

SEQ ID NO: 302451 - DNA, 57 bp, Artificial Sequence
  Description of Artificial Sequence: Synthetic oligonucleotide
agctatttttcttattattaatttctatgtgcgttgttgttagaagaaaagatcagc

SEQ ID NO: 302452 - DNA, 56 bp, Artificial Sequence
  Description of Artificial Sequence: Synthetic oligonucleotide
gctatttttcttattattaatttctatgtgcgttgttgttagaagaaaagatcagc

SEQ ID NO: 302453 - DNA, 57 bp, Artificial Sequence
  Description of Artificial Sequence: Synthetic oligonucleotide
ctatttttcttattattaatttctatgtgcgttgttgttagaagaaaagatcagctg

SEQ ID NO: 302454 - DNA, 57 bp, Artificial Sequence
  Description of Artificial Sequence: Synthetic oligonucleotide
tatttttcttattattaatttctatgtgcgttgttgttagaagaaaagatcagctgc

SEQ ID NO: 302455 - DNA, 56 bp, Artificial Sequence
  Description of Artificial Sequence: Synthetic oligonucleotide
atttttcttattattaatttctatgtgcgttgttgttagaagaaaagatcagctgc

SEQ ID NO: 302456 - DNA, 55 bp, Artificial Sequence
  Description of Artificial Sequence: Synthetic oligonucleotide
tttttcttattattaatttctatgtgcgttgttgttagaagaaaagatcagctgc

SEQ ID NO: 302457 - DNA, 54 bp, Artificial Sequence
  Description of Artificial Sequence: Synthetic oligonucleotide
ttttcttattattaatttctatgtgcgttgttgttagaagaaaagatcagctgc

SEQ ID NO: 302458 - DNA, 53 bp, Artificial Sequence
  Description of Artificial Sequence: Synthetic oligonucleotide
tttcttattattaatttctatgtgcgttgttgttagaagaaaagatcagctgc

SEQ ID NO: 302459 - DNA, 52 bp, Artificial Sequence
  Description of Artificial Sequence: Synthetic oligonucleotide
ttcttattattaatttctatgtgcgttgttgttagaagaaaagatcagctgc

SEQ ID NO: 302460 - DNA, 51 bp, Artificial Sequence
  Description of Artificial Sequence: Synthetic oligonucleotide
tcttattattaatttctatgtgcgttgttgttagaagaaaagatcagctgc

SEQ ID NO: 302461 - DNA, 50 bp, Artificial Sequence
  Description of Artificial Sequence: Synthetic oligonucleotide
cttattattaatttctatgtgcgttgttgttagaagaaaagatcagctgc

SEQ ID NO: 302462 - DNA, 51 bp, Artificial Sequence
  Description of Artificial Sequence: Synthetic oligonucleotide
ttattattaatttctatgtgcgttgttgttagaagaaaagatcagctgctg

SEQ ID NO: 302463 - DNA, 50 bp, Artificial Sequence
  Description of Artificial Sequence: Synthetic oligonucleotide
tattattaatttctatgtgcgttgttgttagaagaaaagatcagctgctg

SEQ ID NO: 302464 - DNA, 49 bp, Artificial Sequence
  Description of Artificial Sequence: Synthetic oligonucleotide
attattaatttctatgtgcgttgttgttagaagaaaagatcagctgctg

SEQ ID NO: 302465 - DNA, 48 bp, Artificial Sequence
  Description of Artificial Sequence: Synthetic oligonucleotide
ttattaatttctatgtgcgttgttgttagaagaaaagatcagctgctg

SEQ ID NO: 302466 - DNA, 47 bp, Artificial Sequence
  Description of Artificial Sequence: Synthetic oligonucleotide
tattaatttctatgtgcgttgttgttagaagaaaagatcagctgctg

SEQ ID NO: 302467 - DNA, 46 bp, Artificial Sequence
  Description of Artificial Sequence: Synthetic oligonucleotide
attaatttctatgtgcgttgttgttagaagaaaagatcagctgctg

SEQ ID NO: 302468 - DNA, 45 bp, Artificial Sequence
  Description of Artificial Sequence: Synthetic oligonucleotide
ttaatttctatgtgcgttgttgttagaagaaaagatcagctgctg

SEQ ID NO: 302469 - DNA, 44 bp, Artificial Sequence
  Description of Artificial Sequence: Synthetic oligonucleotide
taatttctatgtgcgttgttgttagaagaaaagatcagctgctg

SEQ ID NO: 302470 - DNA, 43 bp, Artificial Sequence
  Description of Artificial Sequence: Synthetic oligonucleotide
aatttctatgtgcgttgttgttagaagaaaagatcagctgctg

SEQ ID NO: 302471 - DNA, 42 bp, Artificial Sequence
  Description of Artificial Sequence: Synthetic oligonucleotide
atttctatgtgcgttgttgttagaagaaaagatcagctgctg

SEQ ID NO: 302472 - DNA, 41 bp, Artificial Sequence
  Description of Artificial Sequence: Synthetic oligonucleotide
tttctatgtgcgttgttgttagaagaaaagatcagctgctg

SEQ ID NO: 302473 - DNA, 40 bp, Artificial Sequence
  Description of Artificial Sequence: Synthetic oligonucleotide
ttctatgtgcgttgttgttagaagaaaagatcagctgctg

SEQ ID NO: 302474 - DNA, 39 bp, Artificial Sequence
  Description of Artificial Sequence: Synthetic oligonucleotide
tctatgtgcgttgttgttagaagaaaagatcagctgctg

SEQ ID NO: 302475 - DNA, 38 bp, Artificial Sequence
  Description of Artificial Sequence: Synthetic oligonucleotide
ctatgtgcgttgttgttagaagaaaagatcagctgctg

SEQ ID NO: 302476 - DNA, 39 bp, Artificial Sequence
  Description of Artificial Sequence: Synthetic oligonucleotide
tatgtgcgttgttgttagaagaaaagatcagctgctgag

SEQ ID NO: 302477 - DNA, 38 bp, Artificial Sequence
  Description of Artificial Sequence: Synthetic oligonucleotide
atgtgcgttgttgttagaagaaaagatcagctgctgag

SEQ ID NO: 302478 - DNA, 37 bp, Artificial Sequence
  Description of Artificial Sequence: Synthetic oligonucleotide
tgtgcgttgttgttagaagaaaagatcagctgctgag

SEQ ID NO: 302479 - DNA, 36 bp, Artificial Sequence
  Description of Artificial Sequence: Synthetic oligonucleotide
gtgcgttgttgttagaagaaaagatcagctgctgag

SEQ ID NO: 302480 - DNA, 36 bp, Artificial Sequence
  Description of Artificial Sequence: Synthetic oligonucleotide
tgcgttgttgttagaagaaaagatcagctgctgagg

SEQ ID NO: 302481 - DNA, 35 bp, Artificial Sequence
  Description of Artificial Sequence: Synthetic oligonucleotide
gcgttgttgttagaagaaaagatcagctgctgagg

SEQ ID NO: 302482 - DNA, 35 bp, Artificial Sequence
  Description of Artificial Sequence: Synthetic oligonucleotide
cgttgttgttagaagaaaagatcagctgctgaggg

SEQ ID NO: 302483 - DNA, 36 bp, Artificial Sequence
  Description of Artificial Sequence: Synthetic oligonucleotide
gttgttgttagaagaaaagatcagctgctgagggtc

SEQ ID NO: 302484 - DNA, 36 bp, Artificial Sequence
  Description of Artificial Sequence: Synthetic oligonucleotide
ttgttgttagaagaaaagatcagctgctgagggtcc

SEQ ID NO: 302485 - DNA, 35 bp, Artificial Sequence
  Description of Artificial Sequence: Synthetic oligonucleotide
tgttgttagaagaaaagatcagctgctgagggtcc

SEQ ID NO: 302486 - DNA, 34 bp, Artificial Sequence
  Description of Artificial Sequence: Synthetic oligonucleotide
gttgttagaagaaaagatcagctgctgagggtcc

SEQ ID NO: 302487 - DNA, 35 bp, Artificial Sequence
  Description of Artificial Sequence: Synthetic oligonucleotide
ttgttagaagaaaagatcagctgctgagggtccac

SEQ ID NO: 302488 - DNA, 34 bp, Artificial Sequence
  Description of Artificial Sequence: Synthetic oligonucleotide
tgttagaagaaaagatcagctgctgagggtccac

SEQ ID NO: 302489 - DNA, 33 bp, Artificial Sequence
  Description of Artificial Sequence: Synthetic oligonucleotide
gttagaagaaaagatcagctgctgagggtccac

SEQ ID NO: 302490 - DNA, 34 bp, Artificial Sequence
  Description of Artificial Sequence: Synthetic oligonucleotide
ttagaagaaaagatcagctgctgagggtccacag

SEQ ID NO: 302491 - DNA, 33 bp, Artificial Sequence
  Description of Artificial Sequence: Synthetic oligonucleotide
tagaagaaaagatcagctgctgagggtccacag

SEQ ID NO: 302492 - DNA, 32 bp, Artificial Sequence
  Description of Artificial Sequence: Synthetic oligonucleotide
agaagaaaagatcagctgctgagggtccacag

SEQ ID NO: 302493 - DNA, 31 bp, Artificial Sequence
  Description of Artificial Sequence: Synthetic oligonucleotide
gaagaaaagatcagctgctgagggtccacag

SEQ ID NO: 302494 - DNA, 31 bp, Artificial Sequence
  Description of Artificial Sequence: Synthetic oligonucleotide
aagaaaagatcagctgctgagggtccacagc

SEQ ID NO: 302495 - DNA, 30 bp, Artificial Sequence
  Description of Artificial Sequence: Synthetic oligonucleotide
agaaaagatcagctgctgagggtccacagc

SEQ ID NO: 302496 - DNA, 29 bp, Artificial Sequence
  Description of Artificial Sequence: Synthetic oligonucleotide
gaaaagatcagctgctgagggtccacagc

SEQ ID NO: 302497 - DNA, 30 bp, Artificial Sequence
  Description of Artificial Sequence: Synthetic oligonucleotide
aaaagatcagctgctgagggtccacagctc

SEQ ID NO: 302498 - DNA, 29 bp, Artificial Sequence
  Description of Artificial Sequence: Synthetic oligonucleotide
aaagatcagctgctgagggtccacagctc

SEQ ID NO: 302499 - DNA, 28 bp, Artificial Sequence
  Description of Artificial Sequence: Synthetic oligonucleotide
aagatcagctgctgagggtccacagctc

SEQ ID NO: 302500 - DNA, 27 bp, Artificial Sequence
  Description of Artificial Sequence: Synthetic oligonucleotide
agatcagctgctgagggtccacagctc

SEQ ID NO: 302501 - DNA, 26 bp, Artificial Sequence
  Description of Artificial Sequence: Synthetic oligonucleotide
gatcagctgctgagggtccacagctc

SEQ ID NO: 302502 - DNA, 27 bp, Artificial Sequence
  Description of Artificial Sequence: Synthetic oligonucleotide
atcagctgctgagggtccacagctcgt

SEQ ID NO: 302503 - DNA, 26 bp, Artificial Sequence
  Description of Artificial Sequence: Synthetic oligonucleotide
tcagctgctgagggtccacagctcgt

SEQ ID NO: 302504 - DNA, 25 bp, Artificial Sequence
  Description of Artificial Sequence: Synthetic oligonucleotide
cagctgctgagggtccacagctcgt

SEQ ID NO: 302505 - DNA, 26 bp, Artificial Sequence
  Description of Artificial Sequence: Synthetic oligonucleotide
agctgctgagggtccacagctcgtga

SEQ ID NO: 302506 - DNA, 25 bp, Artificial Sequence
  Description of Artificial Sequence: Synthetic oligonucleotide
gctgctgagggtccacagctcgtga

SEQ ID NO: 302507 - DNA, 25 bp, Artificial Sequence
  Description of Artificial Sequence: Synthetic oligonucleotide
ctgctgagggtccacagctcgtgac

SEQ ID NO: 302508 - DNA, 25 bp, Artificial Sequence
  Description of Artificial Sequence: Synthetic oligonucleotide
tgctgagggtccacagctcgtgacc

SEQ ID NO: 302509 - DNA, 24 bp, Artificial Sequence
  Description of Artificial Sequence: Synthetic oligonucleotide
gctgagggtccacagctcgtgacc

SEQ ID NO: 302510 - DNA, 25 bp, Artificial Sequence
  Description of Artificial Sequence: Synthetic oligonucleotide
ctgagggtccacagctcgtgaccct

SEQ ID NO: 302511 - DNA, 25 bp, Artificial Sequence
  Description of Artificial Sequence: Synthetic oligonucleotide
tgagggtccacagctcgtgaccctg

SEQ ID NO: 302512 - DNA, 24 bp, Artificial Sequence
  Description of Artificial Sequence: Synthetic oligonucleotide
gagggtccacagctcgtgaccctg

SEQ ID NO: 302513 - DNA, 25 bp, Artificial Sequence
  Description of Artificial Sequence: Synthetic oligonucleotide
agggtccacagctcgtgaccctgca

SEQ ID NO: 302514 - DNA, 24 bp, Artificial Sequence
  Description of Artificial Sequence: Synthetic oligonucleotide
gggtccacagctcgtgaccctgca

SEQ ID NO: 302515 - DNA, 24 bp, Artificial Sequence
  Description of Artificial Sequence: Synthetic oligonucleotide
ggtccacagctcgtgaccctgcag

SEQ ID NO: 302516 - DNA, 25 bp, Artificial Sequence
  Description of Artificial Sequence: Synthetic oligonucleotide
gtccacagctcgtgaccctgcaggt

SEQ ID NO: 302517 - DNA, 25 bp, Artificial Sequence
  Description of Artificial Sequence: Synthetic oligonucleotide
tccacagctcgtgaccctgcaggtg

SEQ ID NO: 302518 - DNA, 24 bp, Artificial Sequence
  Description of Artificial Sequence: Synthetic oligonucleotide
ccacagctcgtgaccctgcaggtg

SEQ ID NO: 302519 - DNA, 25 bp, Artificial Sequence
  Description of Artificial Sequence: Synthetic oligonucleotide
cacagctcgtgaccctgcaggtgct

SEQ ID NO: 302520 - DNA, 25 bp, Artificial Sequence
  Description of Artificial Sequence: Synthetic oligonucleotide
acagctcgtgaccctgcaggtgctg

SEQ ID NO: 302521 - DNA, 24 bp, Artificial Sequence
  Description of Artificial Sequence: Synthetic oligonucleotide
cagctcgtgaccctgcaggtgctg

SEQ ID NO: 302522 - DNA, 26 bp, Artificial Sequence
  Description of Artificial Sequence: Synthetic oligonucleotide
agctcgtgaccctgcaggtgctggat

SEQ ID NO: 302523 - DNA, 25 bp, Artificial Sequence
  Description of Artificial Sequence: Synthetic oligonucleotide
gctcgtgaccctgcaggtgctggat

SEQ ID NO: 302524 - DNA, 27 bp, Artificial Sequence
  Description of Artificial Sequence: Synthetic oligonucleotide
ctcgtgaccctgcaggtgctggatcaa

SEQ ID NO: 302525 - DNA, 27 bp, Artificial Sequence
  Description of Artificial Sequence: Synthetic oligonucleotide
tcgtgaccctgcaggtgctggatcaag

SEQ ID NO: 302526 - DNA, 27 bp, Artificial Sequence
  Description of Artificial Sequence: Synthetic oligonucleotide
cgtgaccctgcaggtgctggatcaaga

SEQ ID NO: 302527 - DNA, 27 bp, Artificial Sequence
  Description of Artificial Sequence: Synthetic oligonucleotide
gtgaccctgcaggtgctggatcaagac

SEQ ID NO: 302528 - DNA, 27 bp, Artificial Sequence
  Description of Artificial Sequence: Synthetic oligonucleotide
tgaccctgcaggtgctggatcaagacc

SEQ ID NO: 302529 - DNA, 26 bp, Artificial Sequence
  Description of Artificial Sequence: Synthetic oligonucleotide
gaccctgcaggtgctggatcaagacc

SEQ ID NO: 302530 - DNA, 27 bp, Artificial Sequence
  Description of Artificial Sequence: Synthetic oligonucleotide
accctgcaggtgctggatcaagaccca

SEQ ID NO: 302531 - DNA, 26 bp, Artificial Sequence
  Description of Artificial Sequence: Synthetic oligonucleotide
ccctgcaggtgctggatcaagaccca

SEQ ID NO: 302532 - DNA, 27 bp, Artificial Sequence
  Description of Artificial Sequence: Synthetic oligonucleotide
cctgcaggtgctggatcaagacccagt

SEQ ID NO: 302533 - DNA, 28 bp, Artificial Sequence
  Description of Artificial Sequence: Synthetic oligonucleotide
ctgcaggtgctggatcaagacccagttg

SEQ ID NO: 302534 - DNA, 28 bp, Artificial Sequence
  Description of Artificial Sequence: Synthetic oligonucleotide
tgcaggtgctggatcaagacccagttgc

SEQ ID NO: 302535 - DNA, 27 bp, Artificial Sequence
  Description of Artificial Sequence: Synthetic oligonucleotide
gcaggtgctggatcaagacccagttgc

SEQ ID NO: 302536 - DNA, 27 bp, Artificial Sequence
  Description of Artificial Sequence: Synthetic oligonucleotide
caggtgctggatcaagacccagttgcg

SEQ ID NO: 302537 - DNA, 28 bp, Artificial Sequence
  Description of Artificial Sequence: Synthetic oligonucleotide
aggtgctggatcaagacccagttgcgac

SEQ ID NO: 302538 - DNA, 27 bp, Artificial Sequence
  Description of Artificial Sequence: Synthetic oligonucleotide
ggtgctggatcaagacccagttgcgac

SEQ ID NO: 302539 - DNA, 27 bp, Artificial Sequence
  Description of Artificial Sequence: Synthetic oligonucleotide
gtgctggatcaagacccagttgcgacg

SEQ ID NO: 302540 - DNA, 28 bp, Artificial Sequence
  Description of Artificial Sequence: Synthetic oligonucleotide
tgctggatcaagacccagttgcgacgag

SEQ ID NO: 302541 - DNA, 27 bp, Artificial Sequence
  Description of Artificial Sequence: Synthetic oligonucleotide
gctggatcaagacccagttgcgacgag

SEQ ID NO: 302542 - DNA, 28 bp, Artificial Sequence
  Description of Artificial Sequence: Synthetic oligonucleotide
ctggatcaagacccagttgcgacgagtg

SEQ ID NO: 302543 - DNA, 29 bp, Artificial Sequence
  Description of Artificial Sequence: Synthetic oligonucleotide
tggatcaagacccagttgcgacgagtgag

SEQ ID NO: 302544 - DNA, 28 bp, Artificial Sequence
  Description of Artificial Sequence: Synthetic oligonucleotide
ggatcaagacccagttgcgacgagtgag

SEQ ID NO: 302545 - DNA, 28 bp, Artificial Sequence
  Description of Artificial Sequence: Synthetic oligonucleotide
gatcaagacccagttgcgacgagtgagc

SEQ ID NO: 302546 - DNA, 29 bp, Artificial Sequence
  Description of Artificial Sequence: Synthetic oligonucleotide
atcaagacccagttgcgacgagtgagcac

SEQ ID NO: 302547 - DNA, 28 bp, Artificial Sequence
  Description of Artificial Sequence: Synthetic oligonucleotide
tcaagacccagttgcgacgagtgagcac

SEQ ID NO: 302548 - DNA, 27 bp, Artificial Sequence
  Description of Artificial Sequence: Synthetic oligonucleotide
caagacccagttgcgacgagtgagcac

SEQ ID NO: 302549 - DNA, 28 bp, Artificial Sequence
  Description of Artificial Sequence: Synthetic oligonucleotide
aagacccagttgcgacgagtgagcacag

SEQ ID NO: 302550 - DNA, 27 bp, Artificial Sequence
  Description of Artificial Sequence: Synthetic oligonucleotide
agacccagttgcgacgagtgagcacag

SEQ ID NO: 302551 - DNA, 26 bp, Artificial Sequence
  Description of Artificial Sequence: Synthetic oligonucleotide
gacccagttgcgacgagtgagcacag

SEQ ID NO: 302552 - DNA, 26 bp, Artificial Sequence
  Description of Artificial Sequence: Synthetic oligonucleotide
acccagttgcgacgagtgagcacagg

SEQ ID NO: 302553 - DNA, 25 bp, Artificial Sequence
  Description of Artificial Sequence: Synthetic oligonucleotide
cccagttgcgacgagtgagcacagg

SEQ ID NO: 302554 - DNA, 27 bp, Artificial Sequence
  Description of Artificial Sequence: Synthetic oligonucleotide
ccagttgcgacgagtgagcacagggat

SEQ ID NO: 302555 - DNA, 27 bp, Artificial Sequence
  Description of Artificial Sequence: Synthetic oligonucleotide
cagttgcgacgagtgagcacagggatc

SEQ ID NO: 302556 - DNA, 27 bp, Artificial Sequence
  Description of Artificial Sequence: Synthetic oligonucleotide
agttgcgacgagtgagcacagggatcc

SEQ ID NO: 302557 - DNA, 26 bp, Artificial Sequence
  Description of Artificial Sequence: Synthetic oligonucleotide
gttgcgacgagtgagcacagggatcc

SEQ ID NO: 302558 - DNA, 27 bp, Artificial Sequence
  Description of Artificial Sequence: Synthetic oligonucleotide
ttgcgacgagtgagcacagggatccca

SEQ ID NO: 302559 - DNA, 26 bp, Artificial Sequence
  Description of Artificial Sequence: Synthetic oligonucleotide
tgcgacgagtgagcacagggatccca

SEQ ID NO: 302560 - DNA, 25 bp, Artificial Sequence
  Description of Artificial Sequence: Synthetic oligonucleotide
gcgacgagtgagcacagggatccca

SEQ ID NO: 302561 - DNA, 26 bp, Artificial Sequence
  Description of Artificial Sequence: Synthetic oligonucleotide
cgacgagtgagcacagggatcccaca

SEQ ID NO: 302562 - DNA, 27 bp, Artificial Sequence
  Description of Artificial Sequence: Synthetic oligonucleotide
gacgagtgagcacagggatcccacaca

SEQ ID NO: 302563 - DNA, 27 bp, Artificial Sequence
  Description of Artificial Sequence: Synthetic oligonucleotide
acgagtgagcacagggatcccacacag

SEQ ID NO: 302564 - DNA, 26 bp, Artificial Sequence
  Description of Artificial Sequence: Synthetic oligonucleotide
cgagtgagcacagggatcccacacag

SEQ ID NO: 302565 - DNA, 27 bp, Artificial Sequence
  Description of Artificial Sequence: Synthetic oligonucleotide
gagtgagcacagggatcccacacagca

SEQ ID NO: 302566 - DNA, 27 bp, Artificial Sequence
  Description of Artificial Sequence: Synthetic oligonucleotide
agtgagcacagggatcccacacagcac

SEQ ID NO: 302567 - DNA, 26 bp, Artificial Sequence
  Description of Artificial Sequence: Synthetic oligonucleotide
gtgagcacagggatcccacacagcac

SEQ ID NO: 302568 - DNA, 26 bp, Artificial Sequence
  Description of Artificial Sequence: Synthetic oligonucleotide
tgagcacagggatcccacacagcacg

SEQ ID NO: 302569 - DNA, 25 bp, Artificial Sequence
  Description of Artificial Sequence: Synthetic oligonucleotide
gagcacagggatcccacacagcacg

SEQ ID NO: 302570 - DNA, 27 bp, Artificial Sequence
  Description of Artificial Sequence: Synthetic oligonucleotide
agcacagggatcccacacagcacggat

SEQ ID NO: 302571 - DNA, 27 bp, Artificial Sequence
  Description of Artificial Sequence: Synthetic oligonucleotide
gcacagggatcccacacagcacggatt

SEQ ID NO: 302572 - DNA, 28 bp, Artificial Sequence
  Description of Artificial Sequence: Synthetic oligonucleotide
cacagggatcccacacagcacggatttc

SEQ ID NO: 302573 - DNA, 29 bp, Artificial Sequence
  Description of Artificial Sequence: Synthetic oligonucleotide
acagggatcccacacagcacggatttcac

SEQ ID NO: 302574 - DNA, 28 bp, Artificial Sequence
  Description of Artificial Sequence: Synthetic oligonucleotide
cagggatcccacacagcacggatttcac

SEQ ID NO: 302575 - DNA, 28 bp, Artificial Sequence
  Description of Artificial Sequence: Synthetic oligonucleotide
agggatcccacacagcacggatttcacc

SEQ ID NO: 302576 - DNA, 27 bp, Artificial Sequence
  Description of Artificial Sequence: Synthetic oligonucleotide
gggatcccacacagcacggatttcacc

SEQ ID NO: 302577 - DNA, 27 bp, Artificial Sequence
  Description of Artificial Sequence: Synthetic oligonucleotide
ggatcccacacagcacggatttcaccc

SEQ ID NO: 302578 - DNA, 28 bp, Artificial Sequence
  Description of Artificial Sequence: Synthetic oligonucleotide
gatcccacacagcacggatttcaccctc

SEQ ID NO: 302579 - DNA, 29 bp, Artificial Sequence
  Description of Artificial Sequence: Synthetic oligonucleotide
atcccacacagcacggatttcaccctctg

SEQ ID NO: 302580 - DNA, 28 bp, Artificial Sequence
  Description of Artificial Sequence: Synthetic oligonucleotide
tcccacacagcacggatttcaccctctg

SEQ ID NO: 302581 - DNA, 27 bp, Artificial Sequence
  Description of Artificial Sequence: Synthetic oligonucleotide
cccacacagcacggatttcaccctctg

SEQ ID NO: 302582 - DNA, 29 bp, Artificial Sequence
  Description of Artificial Sequence: Synthetic oligonucleotide
ccacacagcacggatttcaccctctgatg

SEQ ID NO: 302583 - DNA, 30 bp, Artificial Sequence
  Description of Artificial Sequence: Synthetic oligonucleotide
cacacagcacggatttcaccctctgatgac

SEQ ID NO: 302584 - DNA, 31 bp, Artificial Sequence
  Description of Artificial Sequence: Synthetic oligonucleotide
acacagcacggatttcaccctctgatgacag

SEQ ID NO: 302585 - DNA, 30 bp, Artificial Sequence
  Description of Artificial Sequence: Synthetic oligonucleotide
cacagcacggatttcaccctctgatgacag

SEQ ID NO: 302586 - DNA, 30 bp, Artificial Sequence
  Description of Artificial Sequence: Synthetic oligonucleotide
acagcacggatttcaccctctgatgacagc

SEQ ID NO: 302587 - DNA, 29 bp, Artificial Sequence
  Description of Artificial Sequence: Synthetic oligonucleotide
cagcacggatttcaccctctgatgacagc

SEQ ID NO: 302588 - DNA, 30 bp, Artificial Sequence
  Description of Artificial Sequence: Synthetic oligonucleotide
agcacggatttcaccctctgatgacagctc

SEQ ID NO: 302589 - DNA, 29 bp, Artificial Sequence
  Description of Artificial Sequence: Synthetic oligonucleotide
gcacggatttcaccctctgatgacagctc

SEQ ID NO: 302590 - DNA, 31 bp, Artificial Sequence
  Description of Artificial Sequence: Synthetic oligonucleotide
cacggatttcaccctctgatgacagctcttg

SEQ ID NO: 302591 - DNA, 31 bp, Artificial Sequence
  Description of Artificial Sequence: Synthetic oligonucleotide
acggatttcaccctctgatgacagctcttgc

SEQ ID NO: 302592 - DNA, 30 bp, Artificial Sequence
  Description of Artificial Sequence: Synthetic oligonucleotide
cggatttcaccctctgatgacagctcttgc

SEQ ID NO: 302593 - DNA, 30 bp, Artificial Sequence
  Description of Artificial Sequence: Synthetic oligonucleotide
ggatttcaccctctgatgacagctcttgcg

SEQ ID NO: 302594 - DNA, 31 bp, Artificial Sequence
  Description of Artificial Sequence: Synthetic oligonucleotide
gatttcaccctctgatgacagctcttgcgtc

SEQ ID NO: 302595 - DNA, 31 bp, Artificial Sequence
  Description of Artificial Sequence: Synthetic oligonucleotide
atttcaccctctgatgacagctcttgcgtcc

SEQ ID NO: 302596 - DNA, 30 bp, Artificial Sequence
  Description of Artificial Sequence: Synthetic oligonucleotide
tttcaccctctgatgacagctcttgcgtcc

SEQ ID NO: 302597 - DNA, 29 bp, Artificial Sequence
  Description of Artificial Sequence: Synthetic oligonucleotide
ttcaccctctgatgacagctcttgcgtcc

SEQ ID NO: 302598 - DNA, 28 bp, Artificial Sequence
  Description of Artificial Sequence: Synthetic oligonucleotide
tcaccctctgatgacagctcttgcgtcc

SEQ ID NO: 302599 - DNA, 27 bp, Artificial Sequence
  Description of Artificial Sequence: Synthetic oligonucleotide
caccctctgatgacagctcttgcgtcc

SEQ ID NO: 302600 - DNA, 28 bp, Artificial Sequence
  Description of Artificial Sequence: Synthetic oligonucleotide
accctctgatgacagctcttgcgtccac

SEQ ID NO: 302601 - DNA, 27 bp, Artificial Sequence
  Description of Artificial Sequence: Synthetic oligonucleotide
ccctctgatgacagctcttgcgtccac

SEQ ID NO: 302602 - DNA, 28 bp, Artificial Sequence
  Description of Artificial Sequence: Synthetic oligonucleotide
cctctgatgacagctcttgcgtccactg

SEQ ID NO: 302603 - DNA, 28 bp, Artificial Sequence
  Description of Artificial Sequence: Synthetic oligonucleotide
ctctgatgacagctcttgcgtccactgg

SEQ ID NO: 302604 - DNA, 28 bp, Artificial Sequence
  Description of Artificial Sequence: Synthetic oligonucleotide
tctgatgacagctcttgcgtccactggg

SEQ ID NO: 302605 - DNA, 27 bp, Artificial Sequence
  Description of Artificial Sequence: Synthetic oligonucleotide
ctgatgacagctcttgcgtccactggg

SEQ ID NO: 302606 - DNA, 28 bp, Artificial Sequence
  Description of Artificial Sequence: Synthetic oligonucleotide
tgatgacagctcttgcgtccactgggtc

SEQ ID NO: 302607 - DNA, 27 bp, Artificial Sequence
  Description of Artificial Sequence: Synthetic oligonucleotide
gatgacagctcttgcgtccactgggtc

SEQ ID NO: 302608 - DNA, 27 bp, Artificial Sequence
  Description of Artificial Sequence: Synthetic oligonucleotide
atgacagctcttgcgtccactgggtcc

SEQ ID NO: 302609 - DNA, 27 bp, Artificial Sequence
  Description of Artificial Sequence: Synthetic oligonucleotide
tgacagctcttgcgtccactgggtcca

SEQ ID NO: 302610 - DNA, 26 bp, Artificial Sequence
  Description of Artificial Sequence: Synthetic oligonucleotide
gacagctcttgcgtccactgggtcca

SEQ ID NO: 302611 - DNA, 27 bp, Artificial Sequence
  Description of Artificial Sequence: Synthetic oligonucleotide
acagctcttgcgtccactgggtccact

SEQ ID NO: 302612 - DNA, 26 bp, Artificial Sequence
  Description of Artificial Sequence: Synthetic oligonucleotide
cagctcttgcgtccactgggtccact

SEQ ID NO: 302613 - DNA, 27 bp, Artificial Sequence
  Description of Artificial Sequence: Synthetic oligonucleotide
agctcttgcgtccactgggtccactga

SEQ ID NO: 302614 - DNA, 26 bp, Artificial Sequence
  Description of Artificial Sequence: Synthetic oligonucleotide
gctcttgcgtccactgggtccactga

SEQ ID NO: 302615 - DNA, 26 bp, Artificial Sequence
  Description of Artificial Sequence: Synthetic oligonucleotide
ctcttgcgtccactgggtccactgag

SEQ ID NO: 302616 - DNA, 26 bp, Artificial Sequence
  Description of Artificial Sequence: Synthetic oligonucleotide
tcttgcgtccactgggtccactgagc

SEQ ID NO: 302617 - DNA, 25 bp, Artificial Sequence
  Description of Artificial Sequence: Synthetic oligonucleotide
cttgcgtccactgggtccactgagc

SEQ ID NO: 302618 - DNA, 25 bp, Artificial Sequence
  Description of Artificial Sequence: Synthetic oligonucleotide
ttgcgtccactgggtccactgagcg

SEQ ID NO: 302619 - DNA, 24 bp, Artificial Sequence
  Description of Artificial Sequence: Synthetic oligonucleotide
tgcgtccactgggtccactgagcg

SEQ ID NO: 302620 - DNA, 23 bp, Artificial Sequence
  Description of Artificial Sequence: Synthetic oligonucleotide
gcgtccactgggtccactgagcg

SEQ ID NO: 302621 - DNA, 24 bp, Artificial Sequence
  Description of Artificial Sequence: Synthetic oligonucleotide
cgtccactgggtccactgagcgca

SEQ ID NO: 302622 - DNA, 24 bp, Artificial Sequence
  Description of Artificial Sequence: Synthetic oligonucleotide
gtccactgggtccactgagcgcac

SEQ ID NO: 302623 - DNA, 26 bp, Artificial Sequence
  Description of Artificial Sequence: Synthetic oligonucleotide
tccactgggtccactgagcgcaccta

SEQ ID NO: 302624 - DNA, 25 bp, Artificial Sequence
  Description of Artificial Sequence: Synthetic oligonucleotide
ccactgggtccactgagcgcaccta

SEQ ID NO: 302625 - DNA, 25 bp, Artificial Sequence
  Description of Artificial Sequence: Synthetic oligonucleotide
cactgggtccactgagcgcacctag

SEQ ID NO: 302626 - DNA, 21 bp, Artificial Sequence
  Description of Artificial Sequence: Synthetic oligonucleotide
atggggctgcgccgggtccag

SEQ ID NO: 302627 - DNA, 20 bp, Artificial Sequence
  Description of Artificial Sequence: Synthetic oligonucleotide
tggggctgcgccgggtccag

SEQ ID NO: 302628 - DNA, 20 bp, Artificial Sequence
  Description of Artificial Sequence: Synthetic oligonucleotide
ggggctgcgccgggtccagt

SEQ ID NO: 302629 - DNA, 20 bp, Artificial Sequence
  Description of Artificial Sequence: Synthetic oligonucleotide
gggctgcgccgggtccagct

SEQ ID NO: 302630 - DNA, 23 bp, Artificial Sequence
  Description of Artificial Sequence: Synthetic oligonucleotide
ggctgcgccgggtccagctgttt

SEQ ID NO: 302631 - DNA, 24 bp, Artificial Sequence
  Description of Artificial Sequence: Synthetic oligonucleotide
gctgcgccgggtccagctgtttct

SEQ ID NO: 302632 - DNA, 24 bp, Artificial Sequence
  Description of Artificial Sequence: Synthetic oligonucleotide
ctgcgccgggtccagctgtttctc

SEQ ID NO: 302633 - DNA, 24 bp, Artificial Sequence
  Description of Artificial Sequence: Synthetic oligonucleotide
tgcgccgggtccagctgtttctcg

SEQ ID NO: 302634 - DNA, 23 bp, Artificial Sequence
  Description of Artificial Sequence: Synthetic oligonucleotide
gcgccgggtccagctgtttctcg

SEQ ID NO: 302635 - DNA, 23 bp, Artificial Sequence
  Description of Artificial Sequence: Synthetic oligonucleotide
cgccgggtccagctgtttctcgc

SEQ ID NO: 302636 - DNA, 23 bp, Artificial Sequence
  Description of Artificial Sequence: Synthetic oligonucleotide
gccgggtccagctgtttctcgcc

SEQ ID NO: 302637 - DNA, 24 bp, Artificial Sequence
  Description of Artificial Sequence: Synthetic oligonucleotide
ccgggtccagctgtttctcgccgt

SEQ ID NO: 302638 - DNA, 24 bp, Artificial Sequence
  Description of Artificial Sequence: Synthetic oligonucleotide
cgggtccagctgtttctcgccgtc

SEQ ID NO: 302639 - DNA, 24 bp, Artificial Sequence
  Description of Artificial Sequence: Synthetic oligonucleotide
gggtccagctgtttctcgccgtcg

SEQ ID NO: 302640 - DNA, 24 bp, Artificial Sequence
  Description of Artificial Sequence: Synthetic oligonucleotide
ggtccagctgtttctcgccgtcgc

SEQ ID NO: 302641 - DNA, 26 bp, Artificial Sequence
  Description of Artificial Sequence: Synthetic oligonucleotide
gtccagctgtttctcgccgtcgccat

SEQ ID NO: 302642 - DNA, 26 bp, Artificial Sequence
  Description of Artificial Sequence: Synthetic oligonucleotide
tccagctgtttctcgccgtcgccatc

SEQ ID NO: 302643 - DNA, 25 bp, Artificial Sequence
  Description of Artificial Sequence: Synthetic oligonucleotide
ccagctgtttctcgccgtcgccatc

SEQ ID NO: 302644 - DNA, 25 bp, Artificial Sequence
  Description of Artificial Sequence: Synthetic oligonucleotide
cagctgtttctcgccgtcgccatcc

SEQ ID NO: 302645 - DNA, 27 bp, Artificial Sequence
  Description of Artificial Sequence: Synthetic oligonucleotide
agctgtttctcgccgtcgccatccctt

SEQ ID NO: 302646 - DNA, 27 bp, Artificial Sequence
  Description of Artificial Sequence: Synthetic oligonucleotide
gctgtttctcgccgtcgccatcccttt

SEQ ID NO: 302647 - DNA, 28 bp, Artificial Sequence
  Description of Artificial Sequence: Synthetic oligonucleotide
ctgtttctcgccgtcgccatcccttttg

SEQ ID NO: 302648 - DNA, 28 bp, Artificial Sequence
  Description of Artificial Sequence: Synthetic oligonucleotide
tgtttctcgccgtcgccatcccttttgg

SEQ ID NO: 302649 - DNA, 27 bp, Artificial Sequence
  Description of Artificial Sequence: Synthetic oligonucleotide
gtttctcgccgtcgccatcccttttgg

SEQ ID NO: 302650 - DNA, 28 bp, Artificial Sequence
  Description of Artificial Sequence: Synthetic oligonucleotide
tttctcgccgtcgccatcccttttggac

SEQ ID NO: 302651 - DNA, 27 bp, Artificial Sequence
  Description of Artificial Sequence: Synthetic oligonucleotide
ttctcgccgtcgccatcccttttggac

SEQ ID NO: 302652 - DNA, 26 bp, Artificial Sequence
  Description of Artificial Sequence: Synthetic oligonucleotide
tctcgccgtcgccatcccttttggac

SEQ ID NO: 302653 - DNA, 25 bp, Artificial Sequence
  Description of Artificial Sequence: Synthetic oligonucleotide
ctcgccgtcgccatcccttttggac

SEQ ID NO: 302654 - DNA, 25 bp, Artificial Sequence
  Description of Artificial Sequence: Synthetic oligonucleotide
tcgccgtcgccatcccttttggacc

SEQ ID NO: 302655 - DNA, 24 bp, Artificial Sequence
  Description of Artificial Sequence: Synthetic oligonucleotide
cgccgtcgccatcccttttggacc

SEQ ID NO: 302656 - DNA, 24 bp, Artificial Sequence
  Description of Artificial Sequence: Synthetic oligonucleotide
gccgtcgccatcccttttggaccc

SEQ ID NO: 302657 - DNA, 24 bp, Artificial Sequence
  Description of Artificial Sequence: Synthetic oligonucleotide
ccgtcgccatcccttttggacccc

SEQ ID NO: 302658 - DNA, 24 bp, Artificial Sequence
  Description of Artificial Sequence: Synthetic oligonucleotide
cgtcgccatcccttttggaccccc

SEQ ID NO: 302659 - DNA, 24 bp, Artificial Sequence
  Description of Artificial Sequence: Synthetic oligonucleotide
gtcgccatcccttttggacccccg

SEQ ID NO: 302660 - DNA, 24 bp, Artificial Sequence
  Description of Artificial Sequence: Synthetic oligonucleotide
tcgccatcccttttggacccccgg

SEQ ID NO: 302661 - DNA, 23 bp, Artificial Sequence
  Description of Artificial Sequence: Synthetic oligonucleotide
cgccatcccttttggacccccgg

SEQ ID NO: 302662 - DNA, 24 bp, Artificial Sequence
  Description of Artificial Sequence: Synthetic oligonucleotide
gccatcccttttggacccccggct

SEQ ID NO: 302663 - DNA, 24 bp, Artificial Sequence
  Description of Artificial Sequence: Synthetic oligonucleotide
ccatcccttttggacccccggctg

SEQ ID NO: 302664 - DNA, 24 bp, Artificial Sequence
  Description of Artificial Sequence: Synthetic oligonucleotide
catcccttttggacccccggctgc

SEQ ID NO: 302665 - DNA, 24 bp, Artificial Sequence
  Description of Artificial Sequence: Synthetic oligonucleotide
atcccttttggacccccggctgcc

SEQ ID NO: 302666 - DNA, 23 bp, Artificial Sequence
  Description of Artificial Sequence: Synthetic oligonucleotide
tcccttttggacccccggctgcc

SEQ ID NO: 302667 - DNA, 22 bp, Artificial Sequence
  Description of Artificial Sequence: Synthetic oligonucleotide
cccttttggacccccggctgcc

SEQ ID NO: 302668 - DNA, 22 bp, Artificial Sequence
  Description of Artificial Sequence: Synthetic oligonucleotide
ccttttggacccccggctgccg

SEQ ID NO: 302669 - DNA, 22 bp, Artificial Sequence
  Description of Artificial Sequence: Synthetic oligonucleotide
cttttggacccccggctgccgc

SEQ ID NO: 302670 - DNA, 22 bp, Artificial Sequence
  Description of Artificial Sequence: Synthetic oligonucleotide
ttttggacccccggctgccgcc

SEQ ID NO: 302671 - DNA, 21 bp, Artificial Sequence
  Description of Artificial Sequence: Synthetic oligonucleotide
tttggacccccggctgccgcc

SEQ ID NO: 302672 - DNA, 20 bp, Artificial Sequence
  Description of Artificial Sequence: Synthetic oligonucleotide
ttggacccccggctgccgcc

SEQ ID NO: 302673 - DNA, 20 bp, Artificial Sequence
  Description of Artificial Sequence: Synthetic oligonucleotide
tggacccccggctgccgcct

SEQ ID NO: 302674 - DNA, 20 bp, Artificial Sequence
  Description of Artificial Sequence: Synthetic oligonucleotide
ggacccccggctgccgcctt

SEQ ID NO: 302675 - DNA, 20 bp, Artificial Sequence
  Description of Artificial Sequence: Synthetic oligonucleotide
gacccccggctgccgccgtt

SEQ ID NO: 302676 - DNA, 20 bp, Artificial Sequence
  Description of Artificial Sequence: Synthetic oligonucleotide
acccccggctgccgccgctt

SEQ ID NO: 302677 - DNA, 20 bp, Artificial Sequence
  Description of Artificial Sequence: Synthetic oligonucleotide
cccccggctgccgccgcttt

SEQ ID NO: 302678 - DNA, 20 bp, Artificial Sequence
  Description of Artificial Sequence: Synthetic oligonucleotide
ccccggctgccgccgctcat

SEQ ID NO: 302679 - DNA, 20 bp, Artificial Sequence
  Description of Artificial Sequence: Synthetic oligonucleotide
cccggctgccgccgctcagt

SEQ ID NO: 302680 - DNA, 20 bp, Artificial Sequence
  Description of Artificial Sequence: Synthetic oligonucleotide
ccggctgccgccgctcagct

SEQ ID NO: 302681 - DNA, 20 bp, Artificial Sequence
  Description of Artificial Sequence: Synthetic oligonucleotide
cggctgccgccgctcagcct

SEQ ID NO: 302682 - DNA, 20 bp, Artificial Sequence
  Description of Artificial Sequence: Synthetic oligonucleotide
ggctgccgccgctcagccct

SEQ ID NO: 302683 - DNA, 20 bp, Artificial Sequence
  Description of Artificial Sequence: Synthetic oligonucleotide
gctgccgccgctcagcccca

SEQ ID NO: 302684 - DNA, 21 bp, Artificial Sequence
  Description of Artificial Sequence: Synthetic oligonucleotide
ctgccgccgctcagccccaca

SEQ ID NO: 302685 - DNA, 22 bp, Artificial Sequence
  Description of Artificial Sequence: Synthetic oligonucleotide
tgccgccgctcagccccacact

SEQ ID NO: 302686 - DNA, 21 bp, Artificial Sequence
  Description of Artificial Sequence: Synthetic oligonucleotide
gccgccgctcagccccacact

SEQ ID NO: 302687 - DNA, 23 bp, Artificial Sequence
  Description of Artificial Sequence: Synthetic oligonucleotide
ccgccgctcagccccacactctt

SEQ ID NO: 302688 - DNA, 23 bp, Artificial Sequence
  Description of Artificial Sequence: Synthetic oligonucleotide
cgccgctcagccccacactcttc

SEQ ID NO: 302689 - DNA, 26 bp, Artificial Sequence
  Description of Artificial Sequence: Synthetic oligonucleotide
gccgctcagccccacactcttcgtta

SEQ ID NO: 302690 - DNA, 27 bp, Artificial Sequence
  Description of Artificial Sequence: Synthetic oligonucleotide
ccgctcagccccacactcttcgttaga

SEQ ID NO: 302691 - DNA, 28 bp, Artificial Sequence
  Description of Artificial Sequence: Synthetic oligonucleotide
cgctcagccccacactcttcgttagaac

SEQ ID NO: 302692 - DNA, 28 bp, Artificial Sequence
  Description of Artificial Sequence: Synthetic oligonucleotide
gctcagccccacactcttcgttagaacc

SEQ ID NO: 302693 - DNA, 29 bp, Artificial Sequence
  Description of Artificial Sequence: Synthetic oligonucleotide
ctcagccccacactcttcgttagaacctc

SEQ ID NO: 302694 - DNA, 31 bp, Artificial Sequence
  Description of Artificial Sequence: Synthetic oligonucleotide
tcagccccacactcttcgttagaacctcatg

SEQ ID NO: 302695 - DNA, 30 bp, Artificial Sequence
  Description of Artificial Sequence: Synthetic oligonucleotide
cagccccacactcttcgttagaacctcatg

SEQ ID NO: 302696 - DNA, 30 bp, Artificial Sequence
  Description of Artificial Sequence: Synthetic oligonucleotide
agccccacactcttcgttagaacctcatgc

SEQ ID NO: 302697 - DNA, 29 bp, Artificial Sequence
  Description of Artificial Sequence: Synthetic oligonucleotide
gccccacactcttcgttagaacctcatgc

SEQ ID NO: 302698 - DNA, 30 bp, Artificial Sequence
  Description of Artificial Sequence: Synthetic oligonucleotide
ccccacactcttcgttagaacctcatgctg

SEQ ID NO: 302699 - DNA, 30 bp, Artificial Sequence
  Description of Artificial Sequence: Synthetic oligonucleotide
cccacactcttcgttagaacctcatgctgc

SEQ ID NO: 302700 - DNA, 31 bp, Artificial Sequence
  Description of Artificial Sequence: Synthetic oligonucleotide
ccacactcttcgttagaacctcatgctgctg

SEQ ID NO: 302701 - DNA, 32 bp, Artificial Sequence
  Description of Artificial Sequence: Synthetic oligonucleotide
cacactcttcgttagaacctcatgctgctgtc

SEQ ID NO: 302702 - DNA, 32 bp, Artificial Sequence
  Description of Artificial Sequence: Synthetic oligonucleotide
acactcttcgttagaacctcatgctgctgtcc

SEQ ID NO: 302703 - DNA, 31 bp, Artificial Sequence
  Description of Artificial Sequence: Synthetic oligonucleotide
cactcttcgttagaacctcatgctgctgtcc

SEQ ID NO: 302704 - DNA, 31 bp, Artificial Sequence
  Description of Artificial Sequence: Synthetic oligonucleotide
actcttcgttagaacctcatgctgctgtccc

SEQ ID NO: 302705 - DNA, 30 bp, Artificial Sequence
  Description of Artificial Sequence: Synthetic oligonucleotide
ctcttcgttagaacctcatgctgctgtccc

SEQ ID NO: 302706 - DNA, 31 bp, Artificial Sequence
  Description of Artificial Sequence: Synthetic oligonucleotide
tcttcgttagaacctcatgctgctgtccctg

SEQ ID NO: 302707 - DNA, 30 bp, Artificial Sequence
  Description of Artificial Sequence: Synthetic oligonucleotide
cttcgttagaacctcatgctgctgtccctg

SEQ ID NO: 302708 - DNA, 30 bp, Artificial Sequence
  Description of Artificial Sequence: Synthetic oligonucleotide
ttcgttagaacctcatgctgctgtccctgg

SEQ ID NO: 302709 - DNA, 29 bp, Artificial Sequence
  Description of Artificial Sequence: Synthetic oligonucleotide
tcgttagaacctcatgctgctgtccctgg

SEQ ID NO: 302710 - DNA, 28 bp, Artificial Sequence
  Description of Artificial Sequence: Synthetic oligonucleotide
cgttagaacctcatgctgctgtccctgg

SEQ ID NO: 302711 - DNA, 30 bp, Artificial Sequence
  Description of Artificial Sequence: Synthetic oligonucleotide
gttagaacctcatgctgctgtccctggatg

SEQ ID NO: 302712 - DNA, 30 bp, Artificial Sequence
  Description of Artificial Sequence: Synthetic oligonucleotide
ttagaacctcatgctgctgtccctggatgg

SEQ ID NO: 302713 - DNA, 29 bp, Artificial Sequence
  Description of Artificial Sequence: Synthetic oligonucleotide
tagaacctcatgctgctgtccctggatgg

SEQ ID NO: 302714 - DNA, 28 bp, Artificial Sequence
  Description of Artificial Sequence: Synthetic oligonucleotide
agaacctcatgctgctgtccctggatgg

SEQ ID NO: 302715 - DNA, 27 bp, Artificial Sequence
  Description of Artificial Sequence: Synthetic oligonucleotide
gaacctcatgctgctgtccctggatgg

SEQ ID NO: 302716 - DNA, 29 bp, Artificial Sequence
  Description of Artificial Sequence: Synthetic oligonucleotide
aacctcatgctgctgtccctggatggatc

SEQ ID NO: 302717 - DNA, 28 bp, Artificial Sequence
  Description of Artificial Sequence: Synthetic oligonucleotide
acctcatgctgctgtccctggatggatc

SEQ ID NO: 302718 - DNA, 27 bp, Artificial Sequence
  Description of Artificial Sequence: Synthetic oligonucleotide
cctcatgctgctgtccctggatggatc

SEQ ID NO: 302719 - DNA, 28 bp, Artificial Sequence
  Description of Artificial Sequence: Synthetic oligonucleotide
ctcatgctgctgtccctggatggatcag

SEQ ID NO: 302720 - DNA, 29 bp, Artificial Sequence
  Description of Artificial Sequence: Synthetic oligonucleotide
tcatgctgctgtccctggatggatcagtg

SEQ ID NO: 302721 - DNA, 28 bp, Artificial Sequence
  Description of Artificial Sequence: Synthetic oligonucleotide
catgctgctgtccctggatggatcagtg

SEQ ID NO: 302722 - DNA, 28 bp, Artificial Sequence
  Description of Artificial Sequence: Synthetic oligonucleotide
atgctgctgtccctggatggatcagtgc

SEQ ID NO: 302723 - DNA, 27 bp, Artificial Sequence
  Description of Artificial Sequence: Synthetic oligonucleotide
tgctgctgtccctggatggatcagtgc

SEQ ID NO: 302724 - DNA, 27 bp, Artificial Sequence
  Description of Artificial Sequence: Synthetic oligonucleotide
gctgctgtccctggatggatcagtgca

SEQ ID NO: 302725 - DNA, 27 bp, Artificial Sequence
  Description of Artificial Sequence: Synthetic oligonucleotide
ctgctgtccctggatggatcagtgcag

SEQ ID NO: 302726 - DNA, 28 bp, Artificial Sequence
  Description of Artificial Sequence: Synthetic oligonucleotide
tgctgtccctggatggatcagtgcagtc

SEQ ID NO: 302727 - DNA, 27 bp, Artificial Sequence
  Description of Artificial Sequence: Synthetic oligonucleotide
gctgtccctggatggatcagtgcagtc

SEQ ID NO: 302728 - DNA, 28 bp, Artificial Sequence
  Description of Artificial Sequence: Synthetic oligonucleotide
ctgtccctggatggatcagtgcagtcac

SEQ ID NO: 302729 - DNA, 28 bp, Artificial Sequence
  Description of Artificial Sequence: Synthetic oligonucleotide
tgtccctggatggatcagtgcagtcacg

SEQ ID NO: 302730 - DNA, 27 bp, Artificial Sequence
  Description of Artificial Sequence: Synthetic oligonucleotide
gtccctggatggatcagtgcagtcacg

SEQ ID NO: 302731 - DNA, 27 bp, Artificial Sequence
  Description of Artificial Sequence: Synthetic oligonucleotide
tccctggatggatcagtgcagtcacgg

SEQ ID NO: 302732 - DNA, 27 bp, Artificial Sequence
  Description of Artificial Sequence: Synthetic oligonucleotide
ccctggatggatcagtgcagtcacggt

SEQ ID NO: 302733 - DNA, 29 bp, Artificial Sequence
  Description of Artificial Sequence: Synthetic oligonucleotide
cctggatggatcagtgcagtcacggtttc

SEQ ID NO: 302734 - DNA, 30 bp, Artificial Sequence
  Description of Artificial Sequence: Synthetic oligonucleotide
ctggatggatcagtgcagtcacggtttctc

SEQ ID NO: 302735 - DNA, 30 bp, Artificial Sequence
  Description of Artificial Sequence: Synthetic oligonucleotide
tggatggatcagtgcagtcacggtttctcg

SEQ ID NO: 302736 - DNA, 29 bp, Artificial Sequence
  Description of Artificial Sequence: Synthetic oligonucleotide
ggatggatcagtgcagtcacggtttctcg

SEQ ID NO: 302737 - DNA, 29 bp, Artificial Sequence
  Description of Artificial Sequence: Synthetic oligonucleotide
gatggatcagtgcagtcacggtttctcgg

SEQ ID NO: 302738 - DNA, 30 bp, Artificial Sequence
  Description of Artificial Sequence: Synthetic oligonucleotide
atggatcagtgcagtcacggtttctcggtg

SEQ ID NO: 302739 - DNA, 29 bp, Artificial Sequence
  Description of Artificial Sequence: Synthetic oligonucleotide
tggatcagtgcagtcacggtttctcggtg

SEQ ID NO: 302740 - DNA, 28 bp, Artificial Sequence
  Description of Artificial Sequence: Synthetic oligonucleotide
ggatcagtgcagtcacggtttctcggtg

SEQ ID NO: 302741 - DNA, 29 bp, Artificial Sequence
  Description of Artificial Sequence: Synthetic oligonucleotide
gatcagtgcagtcacggtttctcggtgag

SEQ ID NO: 302742 - DNA, 29 bp, Artificial Sequence
  Description of Artificial Sequence: Synthetic oligonucleotide
atcagtgcagtcacggtttctcggtgagg

SEQ ID NO: 302743 - DNA, 28 bp, Artificial Sequence
  Description of Artificial Sequence: Synthetic oligonucleotide
tcagtgcagtcacggtttctcggtgagg

SEQ ID NO: 302744 - DNA, 27 bp, Artificial Sequence
  Description of Artificial Sequence: Synthetic oligonucleotide
cagtgcagtcacggtttctcggtgagg

SEQ ID NO: 302745 - DNA, 27 bp, Artificial Sequence
  Description of Artificial Sequence: Synthetic oligonucleotide
agtgcagtcacggtttctcggtgaggg

SEQ ID NO: 302746 - DNA, 27 bp, Artificial Sequence
  Description of Artificial Sequence: Synthetic oligonucleotide
gtgcagtcacggtttctcggtgaggga

SEQ ID NO: 302747 - DNA, 27 bp, Artificial Sequence
  Description of Artificial Sequence: Synthetic oligonucleotide
tgcagtcacggtttctcggtgagggac

SEQ ID NO: 302748 - DNA, 27 bp, Artificial Sequence
  Description of Artificial Sequence: Synthetic oligonucleotide
gcagtcacggtttctcggtgagggaca

SEQ ID NO: 302749 - DNA, 28 bp, Artificial Sequence
  Description of Artificial Sequence: Synthetic oligonucleotide
cagtcacggtttctcggtgagggacaac

SEQ ID NO: 302750 - DNA, 29 bp, Artificial Sequence
  Description of Artificial Sequence: Synthetic oligonucleotide
agtcacggtttctcggtgagggacaactg

SEQ ID NO: 302751 - DNA, 28 bp, Artificial Sequence
  Description of Artificial Sequence: Synthetic oligonucleotide
gtcacggtttctcggtgagggacaactg

SEQ ID NO: 302752 - DNA, 28 bp, Artificial Sequence
  Description of Artificial Sequence: Synthetic oligonucleotide
tcacggtttctcggtgagggacaactgg

SEQ ID NO: 302753 - DNA, 27 bp, Artificial Sequence
  Description of Artificial Sequence: Synthetic oligonucleotide
cacggtttctcggtgagggacaactgg

SEQ ID NO: 302754 - DNA, 29 bp, Artificial Sequence
  Description of Artificial Sequence: Synthetic oligonucleotide
acggtttctcggtgagggacaactggatg

SEQ ID NO: 302755 - DNA, 28 bp, Artificial Sequence
  Description of Artificial Sequence: Synthetic oligonucleotide
cggtttctcggtgagggacaactggatg

SEQ ID NO: 302756 - DNA, 28 bp, Artificial Sequence
  Description of Artificial Sequence: Synthetic oligonucleotide
ggtttctcggtgagggacaactggatgg

SEQ ID NO: 302757 - DNA, 29 bp, Artificial Sequence
  Description of Artificial Sequence: Synthetic oligonucleotide
gtttctcggtgagggacaactggatggtg

SEQ ID NO: 302758 - DNA, 30 bp, Artificial Sequence
  Description of Artificial Sequence: Synthetic oligonucleotide
tttctcggtgagggacaactggatggtgag

SEQ ID NO: 302759 - DNA, 29 bp, Artificial Sequence
  Description of Artificial Sequence: Synthetic oligonucleotide
ttctcggtgagggacaactggatggtgag

SEQ ID NO: 302760 - DNA, 28 bp, Artificial Sequence
  Description of Artificial Sequence: Synthetic oligonucleotide
tctcggtgagggacaactggatggtgag

SEQ ID NO: 302761 - DNA, 27 bp, Artificial Sequence
  Description of Artificial Sequence: Synthetic oligonucleotide
ctcggtgagggacaactggatggtgag

SEQ ID NO: 302762 - DNA, 27 bp, Artificial Sequence
  Description of Artificial Sequence: Synthetic oligonucleotide
tcggtgagggacaactggatggtgagc

SEQ ID NO: 302763 - DNA, 26 bp, Artificial Sequence
  Description of Artificial Sequence: Synthetic oligonucleotide
cggtgagggacaactggatggtgagc

SEQ ID NO: 302764 - DNA, 26 bp, Artificial Sequence
  Description of Artificial Sequence: Synthetic oligonucleotide
ggtgagggacaactggatggtgagcc

SEQ ID NO: 302765 - DNA, 27 bp, Artificial Sequence
  Description of Artificial Sequence: Synthetic oligonucleotide
gtgagggacaactggatggtgagccct

SEQ ID NO: 302766 - DNA, 28 bp, Artificial Sequence
  Description of Artificial Sequence: Synthetic oligonucleotide
tgagggacaactggatggtgagcccttc

SEQ ID NO: 302767 - DNA, 27 bp, Artificial Sequence
  Description of Artificial Sequence: Synthetic oligonucleotide
gagggacaactggatggtgagcccttc

SEQ ID NO: 302768 - DNA, 27 bp, Artificial Sequence
  Description of Artificial Sequence: Synthetic oligonucleotide
agggacaactggatggtgagcccttcc

SEQ ID NO: 302769 - DNA, 27 bp, Artificial Sequence
  Description of Artificial Sequence: Synthetic oligonucleotide
gggacaactggatggtgagcccttcca

SEQ ID NO: 302770 - DNA, 27 bp, Artificial Sequence
  Description of Artificial Sequence: Synthetic oligonucleotide
ggacaactggatggtgagcccttccag

SEQ ID NO: 302771 - DNA, 27 bp, Artificial Sequence
  Description of Artificial Sequence: Synthetic oligonucleotide
gacaactggatggtgagcccttccagc

SEQ ID NO: 302772 - DNA, 28 bp, Artificial Sequence
  Description of Artificial Sequence: Synthetic oligonucleotide
cccttccagcgctatgagaggcagaaag

SEQ ID NO: 302773 - DNA, 28 bp, Artificial Sequence
  Description of Artificial Sequence: Synthetic oligonucleotide
ccttccagcgctatgagaggcagaaagg

SEQ ID NO: 302774 - DNA, 28 bp, Artificial Sequence
  Description of Artificial Sequence: Synthetic oligonucleotide
cttccagcgctatgagaggcagaaaggc

SEQ ID NO: 302775 - DNA, 29 bp, Artificial Sequence
  Description of Artificial Sequence: Synthetic oligonucleotide
ttccagcgctatgagaggcagaaaggcag

SEQ ID NO: 302776 - DNA, 28 bp, Artificial Sequence
  Description of Artificial Sequence: Synthetic oligonucleotide
tccagcgctatgagaggcagaaaggcag

SEQ ID NO: 302777 - DNA, 27 bp, Artificial Sequence
  Description of Artificial Sequence: Synthetic oligonucleotide
ccagcgctatgagaggcagaaaggcag

SEQ ID NO: 302778 - DNA, 27 bp, Artificial Sequence
  Description of Artificial Sequence: Synthetic oligonucleotide
cagcgctatgagaggcagaaaggcagg

SEQ ID NO: 302779 - DNA, 27 bp, Artificial Sequence
  Description of Artificial Sequence: Synthetic oligonucleotide
agcgctatgagaggcagaaaggcaggg

SEQ ID NO: 302780 - DNA, 26 bp, Artificial Sequence
  Description of Artificial Sequence: Synthetic oligonucleotide
gcgctatgagaggcagaaaggcaggg

SEQ ID NO: 302781 - DNA, 27 bp, Artificial Sequence
  Description of Artificial Sequence: Synthetic oligonucleotide
cgctatgagaggcagaaaggcagggca

SEQ ID NO: 302782 - DNA, 29 bp, Artificial Sequence
  Description of Artificial Sequence: Synthetic oligonucleotide
gctatgagaggcagaaaggcagggcaatg

SEQ ID NO: 302783 - DNA, 29 bp, Artificial Sequence
  Description of Artificial Sequence: Synthetic oligonucleotide
ctatgagaggcagaaaggcagggcaatgc

SEQ ID NO: 302784 - DNA, 29 bp, Artificial Sequence
  Description of Artificial Sequence: Synthetic oligonucleotide
tatgagaggcagaaaggcagggcaatgcc

SEQ ID NO: 302785 - DNA, 28 bp, Artificial Sequence
  Description of Artificial Sequence: Synthetic oligonucleotide
atgagaggcagaaaggcagggcaatgcc

SEQ ID NO: 302786 - DNA, 27 bp, Artificial Sequence
  Description of Artificial Sequence: Synthetic oligonucleotide
tgagaggcagaaaggcagggcaatgcc

SEQ ID NO: 302787 - DNA, 26 bp, Artificial Sequence
  Description of Artificial Sequence: Synthetic oligonucleotide
gagaggcagaaaggcagggcaatgcc

SEQ ID NO: 302788 - DNA, 26 bp, Artificial Sequence
  Description of Artificial Sequence: Synthetic oligonucleotide
agaggcagaaaggcagggcaatgccc

SEQ ID NO: 302789 - DNA, 25 bp, Artificial Sequence
  Description of Artificial Sequence: Synthetic oligonucleotide
gaggcagaaaggcagggcaatgccc

SEQ ID NO: 302790 - DNA, 26 bp, Artificial Sequence
  Description of Artificial Sequence: Synthetic oligonucleotide
aggcagaaaggcagggcaatgcccca

SEQ ID NO: 302791 - DNA, 25 bp, Artificial Sequence
  Description of Artificial Sequence: Synthetic oligonucleotide
ggcagaaaggcagggcaatgcccca

SEQ ID NO: 302792 - DNA, 25 bp, Artificial Sequence
  Description of Artificial Sequence: Synthetic oligonucleotide
gcagaaaggcagggcaatgccccag

SEQ ID NO: 302793 - DNA, 25 bp, Artificial Sequence
  Description of Artificial Sequence: Synthetic oligonucleotide
cagaaaggcagggcaatgccccagg

SEQ ID NO: 302794 - DNA, 26 bp, Artificial Sequence
  Description of Artificial Sequence: Synthetic oligonucleotide
agaaaggcagggcaatgccccagggt

SEQ ID NO: 302795 - DNA, 25 bp, Artificial Sequence
  Description of Artificial Sequence: Synthetic oligonucleotide
gaaaggcagggcaatgccccagggt

SEQ ID NO: 302796 - DNA, 26 bp, Artificial Sequence
  Description of Artificial Sequence: Synthetic oligonucleotide
aaaggcagggcaatgccccagggtca

SEQ ID NO: 302797 - DNA, 25 bp, Artificial Sequence
  Description of Artificial Sequence: Synthetic oligonucleotide
aaggcagggcaatgccccagggtca

SEQ ID NO: 302798 - DNA, 24 bp, Artificial Sequence
  Description of Artificial Sequence: Synthetic oligonucleotide
aggcagggcaatgccccagggtca

SEQ ID NO: 302799 - DNA, 23 bp, Artificial Sequence
  Description of Artificial Sequence: Synthetic oligonucleotide
ggcagggcaatgccccagggtca

SEQ ID NO: 302800 - DNA, 27 bp, Artificial Sequence
  Description of Artificial Sequence: Synthetic oligonucleotide
gtcagtgggcacaagatgtccagggag

SEQ ID NO: 302801 - DNA, 27 bp, Artificial Sequence
  Description of Artificial Sequence: Synthetic oligonucleotide
tcagtgggcacaagatgtccagggagc

SEQ ID NO: 302802 - DNA, 27 bp, Artificial Sequence
  Description of Artificial Sequence: Synthetic oligonucleotide
cagtgggcacaagatgtccagggagct

SEQ ID NO: 302803 - DNA, 27 bp, Artificial Sequence
  Description of Artificial Sequence: Synthetic oligonucleotide
agtgggcacaagatgtccagggagctg

SEQ ID NO: 302804 - DNA, 27 bp, Artificial Sequence
  Description of Artificial Sequence: Synthetic oligonucleotide
gtgggcacaagatgtccagggagctga

SEQ ID NO: 302805 - DNA, 27 bp, Artificial Sequence
  Description of Artificial Sequence: Synthetic oligonucleotide
tgggcacaagatgtccagggagctgac

SEQ ID NO: 302806 - DNA, 27 bp, Artificial Sequence
  Description of Artificial Sequence: Synthetic oligonucleotide
gggcacaagatgtccagggagctgaca

SEQ ID NO: 302807 - DNA, 27 bp, Artificial Sequence
  Description of Artificial Sequence: Synthetic oligonucleotide
ggcacaagatgtccagggagctgacac

SEQ ID NO: 302808 - DNA, 27 bp, Artificial Sequence
  Description of Artificial Sequence: Synthetic oligonucleotide
gcacaagatgtccagggagctgacacc

SEQ ID NO: 302809 - DNA, 28 bp, Artificial Sequence
  Description of Artificial Sequence: Synthetic oligonucleotide
cacaagatgtccagggagctgacacctg

SEQ ID NO: 302810 - DNA, 28 bp, Artificial Sequence
  Description of Artificial Sequence: Synthetic oligonucleotide
acaagatgtccagggagctgacacctgg

SEQ ID NO: 302811 - DNA, 27 bp, Artificial Sequence
  Description of Artificial Sequence: Synthetic oligonucleotide
caagatgtccagggagctgacacctgg

SEQ ID NO: 302812 - DNA, 27 bp, Artificial Sequence
  Description of Artificial Sequence: Synthetic oligonucleotide
aagatgtccagggagctgacacctggg

SEQ ID NO: 302813 - DNA, 27 bp, Artificial Sequence
  Description of Artificial Sequence: Synthetic oligonucleotide
agatgtccagggagctgacacctggga

SEQ ID NO: 302814 - DNA, 26 bp, Artificial Sequence
  Description of Artificial Sequence: Synthetic oligonucleotide
gatgtccagggagctgacacctggga

SEQ ID NO: 302815 - DNA, 27 bp, Artificial Sequence
  Description of Artificial Sequence: Synthetic oligonucleotide
atgtccagggagctgacacctgggact

SEQ ID NO: 302816 - DNA, 26 bp, Artificial Sequence
  Description of Artificial Sequence: Synthetic oligonucleotide
tgtccagggagctgacacctgggact

SEQ ID NO: 302817 - DNA, 25 bp, Artificial Sequence
  Description of Artificial Sequence: Synthetic oligonucleotide
gtccagggagctgacacctgggact

SEQ ID NO: 302818 - DNA, 26 bp, Artificial Sequence
  Description of Artificial Sequence: Synthetic oligonucleotide
tccagggagctgacacctgggactca

SEQ ID NO: 302819 - DNA, 25 bp, Artificial Sequence
  Description of Artificial Sequence: Synthetic oligonucleotide
ccagggagctgacacctgggactca

SEQ ID NO: 302820 - DNA, 26 bp, Artificial Sequence
  Description of Artificial Sequence: Synthetic oligonucleotide
cagggagctgacacctgggactcaga

SEQ ID NO: 302821 - DNA, 27 bp, Artificial Sequence
  Description of Artificial Sequence: Synthetic oligonucleotide
agggagctgacacctgggactcagaga

SEQ ID NO: 302822 - DNA, 26 bp, Artificial Sequence
  Description of Artificial Sequence: Synthetic oligonucleotide
gggagctgacacctgggactcagaga

SEQ ID NO: 302823 - DNA, 26 bp, Artificial Sequence
  Description of Artificial Sequence: Synthetic oligonucleotide
ggagctgacacctgggactcagagac

SEQ ID NO: 302824 - DNA, 26 bp, Artificial Sequence
  Description of Artificial Sequence: Synthetic oligonucleotide
gagctgacacctgggactcagagacc

SEQ ID NO: 302825 - DNA, 27 bp, Artificial Sequence
  Description of Artificial Sequence: Synthetic oligonucleotide
agctgacacctgggactcagagaccgt

SEQ ID NO: 302826 - DNA, 26 bp, Artificial Sequence
  Description of Artificial Sequence: Synthetic oligonucleotide
gctgacacctgggactcagagaccgt

SEQ ID NO: 302827 - DNA, 26 bp, Artificial Sequence
  Description of Artificial Sequence: Synthetic oligonucleotide
ctgacacctgggactcagagaccgtg

SEQ ID NO: 302828 - DNA, 27 bp, Artificial Sequence
  Description of Artificial Sequence: Synthetic oligonucleotide
tgacacctgggactcagagaccgtgga

SEQ ID NO: 302829 - DNA, 26 bp, Artificial Sequence
  Description of Artificial Sequence: Synthetic oligonucleotide
gacacctgggactcagagaccgtgga

SEQ ID NO: 302830 - DNA, 27 bp, Artificial Sequence
  Description of Artificial Sequence: Synthetic oligonucleotide
acacctgggactcagagaccgtggact

SEQ ID NO: 302831 - DNA, 27 bp, Artificial Sequence
  Description of Artificial Sequence: Synthetic oligonucleotide
cacctgggactcagagaccgtggactt

SEQ ID NO: 302832 - DNA, 27 bp, Artificial Sequence
  Description of Artificial Sequence: Synthetic oligonucleotide
acctgggactcagagaccgtggacttg

SEQ ID NO: 302833 - DNA, 27 bp, Artificial Sequence
  Description of Artificial Sequence: Synthetic oligonucleotide
cctgggactcagagaccgtggacttga

SEQ ID NO: 302834 - DNA, 27 bp, Artificial Sequence
  Description of Artificial Sequence: Synthetic oligonucleotide
ctgggactcagagaccgtggacttgac

SEQ ID NO: 302835 - DNA, 28 bp, Artificial Sequence
  Description of Artificial Sequence: Synthetic oligonucleotide
tgggactcagagaccgtggacttgactg

SEQ ID NO: 302836 - DNA, 27 bp, Artificial Sequence
  Description of Artificial Sequence: Synthetic oligonucleotide
gggactcagagaccgtggacttgactg

SEQ ID NO: 302837 - DNA, 28 bp, Artificial Sequence
  Description of Artificial Sequence: Synthetic oligonucleotide
ggactcagagaccgtggacttgactgag

SEQ ID NO: 302838 - DNA, 31 bp, Artificial Sequence
  Description of Artificial Sequence: Synthetic oligonucleotide
gactcagagaccgtggacttgactgagaatg

SEQ ID NO: 302839 - DNA, 31 bp, Artificial Sequence
  Description of Artificial Sequence: Synthetic oligonucleotide
actcagagaccgtggacttgactgagaatgg

SEQ ID NO: 302840 - DNA, 30 bp, Artificial Sequence
  Description of Artificial Sequence: Synthetic oligonucleotide
ctcagagaccgtggacttgactgagaatgg

SEQ ID NO: 302841 - DNA, 30 bp, Artificial Sequence
  Description of Artificial Sequence: Synthetic oligonucleotide
tcagagaccgtggacttgactgagaatggg

SEQ ID NO: 302842 - DNA, 29 bp, Artificial Sequence
  Description of Artificial Sequence: Synthetic oligonucleotide
cagagaccgtggacttgactgagaatggg

SEQ ID NO: 302843 - DNA, 29 bp, Artificial Sequence
  Description of Artificial Sequence: Synthetic oligonucleotide
agagaccgtggacttgactgagaatgggg

SEQ ID NO: 302844 - DNA, 28 bp, Artificial Sequence
  Description of Artificial Sequence: Synthetic oligonucleotide
gagaccgtggacttgactgagaatgggg

SEQ ID NO: 302845 - DNA, 30 bp, Artificial Sequence
  Description of Artificial Sequence: Synthetic oligonucleotide
agaccgtggacttgactgagaatggggaag

SEQ ID NO: 302846 - DNA, 29 bp, Artificial Sequence
  Description of Artificial Sequence: Synthetic oligonucleotide
gaccgtggacttgactgagaatggggaag

SEQ ID NO: 302847 - DNA, 30 bp, Artificial Sequence
  Description of Artificial Sequence: Synthetic oligonucleotide
accgtggacttgactgagaatggggaagac

SEQ ID NO: 302848 - DNA, 29 bp, Artificial Sequence
  Description of Artificial Sequence: Synthetic oligonucleotide
ccgtggacttgactgagaatggggaagac

SEQ ID NO: 302849 - DNA, 29 bp, Artificial Sequence
  Description of Artificial Sequence: Synthetic oligonucleotide
cgtggacttgactgagaatggggaagacc

SEQ ID NO: 302850 - DNA, 30 bp, Artificial Sequence
  Description of Artificial Sequence: Synthetic oligonucleotide
gtggacttgactgagaatggggaagacctc

SEQ ID NO: 302851 - DNA, 31 bp, Artificial Sequence
  Description of Artificial Sequence: Synthetic oligonucleotide
tggacttgactgagaatggggaagacctcac

SEQ ID NO: 302852 - DNA, 30 bp, Artificial Sequence
  Description of Artificial Sequence: Synthetic oligonucleotide
ggacttgactgagaatggggaagacctcac

SEQ ID NO: 302853 - DNA, 30 bp, Artificial Sequence
  Description of Artificial Sequence: Synthetic oligonucleotide
gacttgactgagaatggggaagacctcacg

SEQ ID NO: 302854 - DNA, 31 bp, Artificial Sequence
  Description of Artificial Sequence: Synthetic oligonucleotide
acttgactgagaatggggaagacctcacgag

SEQ ID NO: 302855 - DNA, 30 bp, Artificial Sequence
  Description of Artificial Sequence: Synthetic oligonucleotide
cttgactgagaatggggaagacctcacgag

SEQ ID NO: 302856 - DNA, 30 bp, Artificial Sequence
  Description of Artificial Sequence: Synthetic oligonucleotide
ttgactgagaatggggaagacctcacgagg

SEQ ID NO: 302857 - DNA, 29 bp, Artificial Sequence
  Description of Artificial Sequence: Synthetic oligonucleotide
tgactgagaatggggaagacctcacgagg

SEQ ID NO: 302858 - DNA, 28 bp, Artificial Sequence
  Description of Artificial Sequence: Synthetic oligonucleotide
gactgagaatggggaagacctcacgagg

SEQ ID NO: 302859 - DNA, 29 bp, Artificial Sequence
  Description of Artificial Sequence: Synthetic oligonucleotide
actgagaatggggaagacctcacgaggac

SEQ ID NO: 302860 - DNA, 28 bp, Artificial Sequence
  Description of Artificial Sequence: Synthetic oligonucleotide
ctgagaatggggaagacctcacgaggac

SEQ ID NO: 302861 - DNA, 28 bp, Artificial Sequence
  Description of Artificial Sequence: Synthetic oligonucleotide
tgagaatggggaagacctcacgaggacc

SEQ ID NO: 302862 - DNA, 27 bp, Artificial Sequence
  Description of Artificial Sequence: Synthetic oligonucleotide
gagaatggggaagacctcacgaggacc

SEQ ID NO: 302863 - DNA, 27 bp, Artificial Sequence
  Description of Artificial Sequence: Synthetic oligonucleotide
agaatggggaagacctcacgaggaccc

SEQ ID NO: 302864 - DNA, 27 bp, Artificial Sequence
  Description of Artificial Sequence: Synthetic oligonucleotide
gaatggggaagacctcacgaggaccct

SEQ ID NO: 302865 - DNA, 27 bp, Artificial Sequence
  Description of Artificial Sequence: Synthetic oligonucleotide
aatggggaagacctcacgaggaccctc

SEQ ID NO: 302866 - DNA, 27 bp, Artificial Sequence
  Description of Artificial Sequence: Synthetic oligonucleotide
atggggaagacctcacgaggaccctca

SEQ ID NO: 302867 - DNA, 26 bp, Artificial Sequence
  Description of Artificial Sequence: Synthetic oligonucleotide
tggggaagacctcacgaggaccctca

SEQ ID NO: 302868 - DNA, 25 bp, Artificial Sequence
  Description of Artificial Sequence: Synthetic oligonucleotide
ggggaagacctcacgaggaccctca

SEQ ID NO: 302869 - DNA, 26 bp, Artificial Sequence
  Description of Artificial Sequence: Synthetic oligonucleotide
gggaagacctcacgaggaccctcact

SEQ ID NO: 302870 - DNA, 27 bp, Artificial Sequence
  Description of Artificial Sequence: Synthetic oligonucleotide
ggaagacctcacgaggaccctcactca

SEQ ID NO: 302871 - DNA, 30 bp, Artificial Sequence
  Description of Artificial Sequence: Synthetic oligonucleotide
gaagacctcacgaggaccctcactcatatc

SEQ ID NO: 302872 - DNA, 32 bp, Artificial Sequence
  Description of Artificial Sequence: Synthetic oligonucleotide
aagacctcacgaggaccctcactcatatctag

SEQ ID NO: 302873 - DNA, 31 bp, Artificial Sequence
  Description of Artificial Sequence: Synthetic oligonucleotide
agacctcacgaggaccctcactcatatctag

SEQ ID NO: 302874 - DNA, 30 bp, Artificial Sequence
  Description of Artificial Sequence: Synthetic oligonucleotide
gacctcacgaggaccctcactcatatctag

SEQ ID NO: 302875 - DNA, 30 bp, Artificial Sequence
  Description of Artificial Sequence: Synthetic oligonucleotide
acctcacgaggaccctcactcatatctagg

SEQ ID NO: 302876 - DNA, 29 bp, Artificial Sequence
  Description of Artificial Sequence: Synthetic oligonucleotide
cctcacgaggaccctcactcatatctagg

SEQ ID NO: 302877 - DNA, 30 bp, Artificial Sequence
  Description of Artificial Sequence: Synthetic oligonucleotide
ctcacgaggaccctcactcatatctaggac

SEQ ID NO: 302878 - DNA, 30 bp, Artificial Sequence
  Description of Artificial Sequence: Synthetic oligonucleotide
tcacgaggaccctcactcatatctaggacc

SEQ ID NO: 302879 - DNA, 29 bp, Artificial Sequence
  Description of Artificial Sequence: Synthetic oligonucleotide
cacgaggaccctcactcatatctaggacc

SEQ ID NO: 302880 - DNA, 30 bp, Artificial Sequence
  Description of Artificial Sequence: Synthetic oligonucleotide
acgaggaccctcactcatatctaggaccag

SEQ ID NO: 302881 - DNA, 29 bp, Artificial Sequence
  Description of Artificial Sequence: Synthetic oligonucleotide
cgaggaccctcactcatatctaggaccag

SEQ ID NO: 302882 - DNA, 32 bp, Artificial Sequence
  Description of Artificial Sequence: Synthetic oligonucleotide
gaggaccctcactcatatctaggaccagatag

SEQ ID NO: 302883 - DNA, 32 bp, Artificial Sequence
  Description of Artificial Sequence: Synthetic oligonucleotide
aggaccctcactcatatctaggaccagatagg

SEQ ID NO: 302884 - DNA, 31 bp, Artificial Sequence
  Description of Artificial Sequence: Synthetic oligonucleotide
ggaccctcactcatatctaggaccagatagg

SEQ ID NO: 302885 - DNA, 32 bp, Artificial Sequence
  Description of Artificial Sequence: Synthetic oligonucleotide
gaccctcactcatatctaggaccagataggag

SEQ ID NO: 302886 - DNA, 32 bp, Artificial Sequence
  Description of Artificial Sequence: Synthetic oligonucleotide
accctcactcatatctaggaccagataggagg

SEQ ID NO: 302887 - DNA, 31 bp, Artificial Sequence
  Description of Artificial Sequence: Synthetic oligonucleotide
ccctcactcatatctaggaccagataggagg

SEQ ID NO: 302888 - DNA, 31 bp, Artificial Sequence
  Description of Artificial Sequence: Synthetic oligonucleotide
cctcactcatatctaggaccagataggaggc

SEQ ID NO: 302889 - DNA, 33 bp, Artificial Sequence
  Description of Artificial Sequence: Synthetic oligonucleotide
ctcactcatatctaggaccagataggaggcttc

SEQ ID NO: 302890 - DNA, 33 bp, Artificial Sequence
  Description of Artificial Sequence: Synthetic oligonucleotide
tcactcatatctaggaccagataggaggcttcc

SEQ ID NO: 302891 - DNA, 32 bp, Artificial Sequence
  Description of Artificial Sequence: Synthetic oligonucleotide
cactcatatctaggaccagataggaggcttcc

SEQ ID NO: 302892 - DNA, 35 bp, Artificial Sequence
  Description of Artificial Sequence: Synthetic oligonucleotide
actcatatctaggaccagataggaggcttccattc

SEQ ID NO: 302893 - DNA, 34 bp, Artificial Sequence
  Description of Artificial Sequence: Synthetic oligonucleotide
ctcatatctaggaccagataggaggcttccattc

SEQ ID NO: 302894 - DNA, 34 bp, Artificial Sequence
  Description of Artificial Sequence: Synthetic oligonucleotide
tcatatctaggaccagataggaggcttccattcc

SEQ ID NO: 302895 - DNA, 33 bp, Artificial Sequence
  Description of Artificial Sequence: Synthetic oligonucleotide
catatctaggaccagataggaggcttccattcc

SEQ ID NO: 302896 - DNA, 33 bp, Artificial Sequence
  Description of Artificial Sequence: Synthetic oligonucleotide
atatctaggaccagataggaggcttccattccc

SEQ ID NO: 302897 - DNA, 32 bp, Artificial Sequence
  Description of Artificial Sequence: Synthetic oligonucleotide
tatctaggaccagataggaggcttccattccc

SEQ ID NO: 302898 - DNA, 31 bp, Artificial Sequence
  Description of Artificial Sequence: Synthetic oligonucleotide
atctaggaccagataggaggcttccattccc

SEQ ID NO: 302899 - DNA, 30 bp, Artificial Sequence
  Description of Artificial Sequence: Synthetic oligonucleotide
tctaggaccagataggaggcttccattccc

SEQ ID NO: 302900 - DNA, 29 bp, Artificial Sequence
  Description of Artificial Sequence: Synthetic oligonucleotide
ctaggaccagataggaggcttccattccc

SEQ ID NO: 302901 - DNA, 30 bp, Artificial Sequence
  Description of Artificial Sequence: Synthetic oligonucleotide
taggaccagataggaggcttccattccctc

SEQ ID NO: 302902 - DNA, 29 bp, Artificial Sequence
  Description of Artificial Sequence: Synthetic oligonucleotide
aggaccagataggaggcttccattccctc

SEQ ID NO: 302903 - DNA, 28 bp, Artificial Sequence
  Description of Artificial Sequence: Synthetic oligonucleotide
ggaccagataggaggcttccattccctc

SEQ ID NO: 302904 - DNA, 28 bp, Artificial Sequence
  Description of Artificial Sequence: Synthetic oligonucleotide
gaccagataggaggcttccattccctcg

SEQ ID NO: 302905 - DNA, 29 bp, Artificial Sequence
  Description of Artificial Sequence: Synthetic oligonucleotide
accagataggaggcttccattccctcgag

SEQ ID NO: 302906 - DNA, 28 bp, Artificial Sequence
  Description of Artificial Sequence: Synthetic oligonucleotide
ccagataggaggcttccattccctcgag

SEQ ID NO: 302907 - DNA, 28 bp, Artificial Sequence
  Description of Artificial Sequence: Synthetic oligonucleotide
cagataggaggcttccattccctcgagg

SEQ ID NO: 302908 - DNA, 29 bp, Artificial Sequence
  Description of Artificial Sequence: Synthetic oligonucleotide
agataggaggcttccattccctcgaggag

SEQ ID NO: 302909 - DNA, 28 bp, Artificial Sequence
  Description of Artificial Sequence: Synthetic oligonucleotide
gataggaggcttccattccctcgaggag

SEQ ID NO: 302910 - DNA, 32 bp, Artificial Sequence
  Description of Artificial Sequence: Synthetic oligonucleotide
ataggaggcttccattccctcgaggagattac

SEQ ID NO: 302911 - DNA, 31 bp, Artificial Sequence
  Description of Artificial Sequence: Synthetic oligonucleotide
taggaggcttccattccctcgaggagattac

SEQ ID NO: 302912 - DNA, 30 bp, Artificial Sequence
  Description of Artificial Sequence: Synthetic oligonucleotide
aggaggcttccattccctcgaggagattac

SEQ ID NO: 302913 - DNA, 29 bp, Artificial Sequence
  Description of Artificial Sequence: Synthetic oligonucleotide
ggaggcttccattccctcgaggagattac

SEQ ID NO: 302914 - DNA, 29 bp, Artificial Sequence
  Description of Artificial Sequence: Synthetic oligonucleotide
gaggcttccattccctcgaggagattacg

SEQ ID NO: 302915 - DNA, 32 bp, Artificial Sequence
  Description of Artificial Sequence: Synthetic oligonucleotide
attccctcgaggagattacggtctgtgacatg

SEQ ID NO: 302916 - DNA, 31 bp, Artificial Sequence
  Description of Artificial Sequence: Synthetic oligonucleotide
ttccctcgaggagattacggtctgtgacatg

SEQ ID NO: 302917 - DNA, 30 bp, Artificial Sequence
  Description of Artificial Sequence: Synthetic oligonucleotide
tccctcgaggagattacggtctgtgacatg

SEQ ID NO: 302918 - DNA, 29 bp, Artificial Sequence
  Description of Artificial Sequence: Synthetic oligonucleotide
ccctcgaggagattacggtctgtgacatg

SEQ ID NO: 302919 - DNA, 29 bp, Artificial Sequence
  Description of Artificial Sequence: Synthetic oligonucleotide
cctcgaggagattacggtctgtgacatgc

SEQ ID NO: 302920 - DNA, 31 bp, Artificial Sequence
  Description of Artificial Sequence: Synthetic oligonucleotide
ctcgaggagattacggtctgtgacatgcatg

SEQ ID NO: 302921 - DNA, 33 bp, Artificial Sequence
  Description of Artificial Sequence: Synthetic oligonucleotide
tcgaggagattacggtctgtgacatgcatgaac

SEQ ID NO: 302922 - DNA, 32 bp, Artificial Sequence
  Description of Artificial Sequence: Synthetic oligonucleotide
cgaggagattacggtctgtgacatgcatgaac

SEQ ID NO: 302923 - DNA, 33 bp, Artificial Sequence
  Description of Artificial Sequence: Synthetic oligonucleotide
gaggagattacggtctgtgacatgcatgaacac

SEQ ID NO: 302924 - DNA, 34 bp, Artificial Sequence
  Description of Artificial Sequence: Synthetic oligonucleotide
aggagattacggtctgtgacatgcatgaacacag

SEQ ID NO: 302925 - DNA, 33 bp, Artificial Sequence
  Description of Artificial Sequence: Synthetic oligonucleotide
ggagattacggtctgtgacatgcatgaacacag

SEQ ID NO: 302926 - DNA, 33 bp, Artificial Sequence
  Description of Artificial Sequence: Synthetic oligonucleotide
gagattacggtctgtgacatgcatgaacacagc

SEQ ID NO: 302927 - DNA, 34 bp, Artificial Sequence
  Description of Artificial Sequence: Synthetic oligonucleotide
agattacggtctgtgacatgcatgaacacagcag

SEQ ID NO: 302928 - DNA, 33 bp, Artificial Sequence
  Description of Artificial Sequence: Synthetic oligonucleotide
gattacggtctgtgacatgcatgaacacagcag

SEQ ID NO: 302929 - DNA, 33 bp, Artificial Sequence
  Description of Artificial Sequence: Synthetic oligonucleotide
attacggtctgtgacatgcatgaacacagcagc

SEQ ID NO: 302930 - DNA, 32 bp, Artificial Sequence
  Description of Artificial Sequence: Synthetic oligonucleotide
ttacggtctgtgacatgcatgaacacagcagc

SEQ ID NO: 302931 - DNA, 31 bp, Artificial Sequence
  Description of Artificial Sequence: Synthetic oligonucleotide
tacggtctgtgacatgcatgaacacagcagc

SEQ ID NO: 302932 - DNA, 30 bp, Artificial Sequence
  Description of Artificial Sequence: Synthetic oligonucleotide
acggtctgtgacatgcatgaacacagcagc

SEQ ID NO: 302933 - DNA, 29 bp, Artificial Sequence
  Description of Artificial Sequence: Synthetic oligonucleotide
cggtctgtgacatgcatgaacacagcagc

SEQ ID NO: 302934 - DNA, 30 bp, Artificial Sequence
  Description of Artificial Sequence: Synthetic oligonucleotide
ggtctgtgacatgcatgaacacagcagcag

SEQ ID NO: 302935 - DNA, 30 bp, Artificial Sequence
  Description of Artificial Sequence: Synthetic oligonucleotide
gtctgtgacatgcatgaacacagcagcagc

SEQ ID NO: 302936 - DNA, 31 bp, Artificial Sequence
  Description of Artificial Sequence: Synthetic oligonucleotide
tctgtgacatgcatgaacacagcagcagcag

SEQ ID NO: 302937 - DNA, 30 bp, Artificial Sequence
  Description of Artificial Sequence: Synthetic oligonucleotide
ctgtgacatgcatgaacacagcagcagcag

SEQ ID NO: 302938 - DNA, 30 bp, Artificial Sequence
  Description of Artificial Sequence: Synthetic oligonucleotide
tgtgacatgcatgaacacagcagcagcagg

SEQ ID NO: 302939 - DNA, 29 bp, Artificial Sequence
  Description of Artificial Sequence: Synthetic oligonucleotide
gtgacatgcatgaacacagcagcagcagg

SEQ ID NO: 302940 - DNA, 29 bp, Artificial Sequence
  Description of Artificial Sequence: Synthetic oligonucleotide
tgacatgcatgaacacagcagcagcaggg

SEQ ID NO: 302941 - DNA, 28 bp, Artificial Sequence
  Description of Artificial Sequence: Synthetic oligonucleotide
gacatgcatgaacacagcagcagcaggg

SEQ ID NO: 302942 - DNA, 28 bp, Artificial Sequence
  Description of Artificial Sequence: Synthetic oligonucleotide
acatgcatgaacacagcagcagcagggg

SEQ ID NO: 302943 - DNA, 27 bp, Artificial Sequence
  Description of Artificial Sequence: Synthetic oligonucleotide
catgcatgaacacagcagcagcagggg

SEQ ID NO: 302944 - DNA, 27 bp, Artificial Sequence
  Description of Artificial Sequence: Synthetic oligonucleotide
atgcatgaacacagcagcagcaggggc

SEQ ID NO: 302945 - DNA, 27 bp, Artificial Sequence
  Description of Artificial Sequence: Synthetic oligonucleotide
tgcatgaacacagcagcagcaggggct

SEQ ID NO: 302946 - DNA, 26 bp, Artificial Sequence
  Description of Artificial Sequence: Synthetic oligonucleotide
gcatgaacacagcagcagcaggggct

SEQ ID NO: 302947 - DNA, 26 bp, Artificial Sequence
  Description of Artificial Sequence: Synthetic oligonucleotide
catgaacacagcagcagcaggggctc

SEQ ID NO: 302948 - DNA, 26 bp, Artificial Sequence
  Description of Artificial Sequence: Synthetic oligonucleotide
atgaacacagcagcagcaggggctcg

SEQ ID NO: 302949 - DNA, 25 bp, Artificial Sequence
  Description of Artificial Sequence: Synthetic oligonucleotide
tgaacacagcagcagcaggggctcg

SEQ ID NO: 302950 - DNA, 24 bp, Artificial Sequence
  Description of Artificial Sequence: Synthetic oligonucleotide
gaacacagcagcagcaggggctcg

SEQ ID NO: 302951 - DNA, 24 bp, Artificial Sequence
  Description of Artificial Sequence: Synthetic oligonucleotide
aacacagcagcagcaggggctcgc

SEQ ID NO: 302952 - DNA, 23 bp, Artificial Sequence
  Description of Artificial Sequence: Synthetic oligonucleotide
acacagcagcagcaggggctcgc

SEQ ID NO: 302953 - DNA, 22 bp, Artificial Sequence
  Description of Artificial Sequence: Synthetic oligonucleotide
cacagcagcagcaggggctcgc

SEQ ID NO: 302954 - DNA, 22 bp, Artificial Sequence
  Description of Artificial Sequence: Synthetic oligonucleotide
acagcagcagcaggggctcgcg

SEQ ID NO: 302955 - DNA, 21 bp, Artificial Sequence
  Description of Artificial Sequence: Synthetic oligonucleotide
cagcagcagcaggggctcgcg

SEQ ID NO: 302956 - DNA, 21 bp, Artificial Sequence
  Description of Artificial Sequence: Synthetic oligonucleotide
agcagcagcaggggctcgcgg

SEQ ID NO: 302957 - DNA, 20 bp, Artificial Sequence
  Description of Artificial Sequence: Synthetic oligonucleotide
gcagcagcaggggctcgcgg

SEQ ID NO: 302958 - DNA, 24 bp, Artificial Sequence
  Description of Artificial Sequence: Synthetic oligonucleotide
cagcagcaggggctcgcggcattt

SEQ ID NO: 302959 - DNA, 26 bp, Artificial Sequence
  Description of Artificial Sequence: Synthetic oligonucleotide
agcagcaggggctcgcggcatttcaa

SEQ ID NO: 302960 - DNA, 25 bp, Artificial Sequence
  Description of Artificial Sequence: Synthetic oligonucleotide
gcagcaggggctcgcggcatttcaa

SEQ ID NO: 302961 - DNA, 27 bp, Artificial Sequence
  Description of Artificial Sequence: Synthetic oligonucleotide
cagcaggggctcgcggcatttcaacta

SEQ ID NO: 302962 - DNA, 27 bp, Artificial Sequence
  Description of Artificial Sequence: Synthetic oligonucleotide
agcaggggctcgcggcatttcaactac

SEQ ID NO: 302963 - DNA, 27 bp, Artificial Sequence
  Description of Artificial Sequence: Synthetic oligonucleotide
gcaggggctcgcggcatttcaactaca

SEQ ID NO: 302964 - DNA, 29 bp, Artificial Sequence
  Description of Artificial Sequence: Synthetic oligonucleotide
caggggctcgcggcatttcaactacaatg

SEQ ID NO: 302965 - DNA, 29 bp, Artificial Sequence
  Description of Artificial Sequence: Synthetic oligonucleotide
aggggctcgcggcatttcaactacaatgc

SEQ ID NO: 302966 - DNA, 28 bp, Artificial Sequence
  Description of Artificial Sequence: Synthetic oligonucleotide
ggggctcgcggcatttcaactacaatgc

SEQ ID NO: 302967 - DNA, 28 bp, Artificial Sequence
  Description of Artificial Sequence: Synthetic oligonucleotide
gggctcgcggcatttcaactacaatgcg

SEQ ID NO: 302968 - DNA, 28 bp, Artificial Sequence
  Description of Artificial Sequence: Synthetic oligonucleotide
ggctcgcggcatttcaactacaatgcgg

SEQ ID NO: 302969 - DNA, 29 bp, Artificial Sequence
  Description of Artificial Sequence: Synthetic oligonucleotide
gctcgcggcatttcaactacaatgcggag

SEQ ID NO: 302970 - DNA, 29 bp, Artificial Sequence
  Description of Artificial Sequence: Synthetic oligonucleotide
ctcgcggcatttcaactacaatgcggagc

SEQ ID NO: 302971 - DNA, 30 bp, Artificial Sequence
  Description of Artificial Sequence: Synthetic oligonucleotide
tcgcggcatttcaactacaatgcggagctc

SEQ ID NO: 302972 - DNA, 29 bp, Artificial Sequence
  Description of Artificial Sequence: Synthetic oligonucleotide
cgcggcatttcaactacaatgcggagctc

SEQ ID NO: 302973 - DNA, 31 bp, Artificial Sequence
  Description of Artificial Sequence: Synthetic oligonucleotide
gcggcatttcaactacaatgcggagctcttg

SEQ ID NO: 302974 - DNA, 31 bp, Artificial Sequence
  Description of Artificial Sequence: Synthetic oligonucleotide
cggcatttcaactacaatgcggagctcttgc

SEQ ID NO: 302975 - DNA, 32 bp, Artificial Sequence
  Description of Artificial Sequence: Synthetic oligonucleotide
ggcatttcaactacaatgcggagctcttgctc

SEQ ID NO: 302976 - DNA, 33 bp, Artificial Sequence
  Description of Artificial Sequence: Synthetic oligonucleotide
gcatttcaactacaatgcggagctcttgctctc

SEQ ID NO: 302977 - DNA, 33 bp, Artificial Sequence
  Description of Artificial Sequence: Synthetic oligonucleotide
catttcaactacaatgcggagctcttgctctcc

SEQ ID NO: 302978 - DNA, 33 bp, Artificial Sequence
  Description of Artificial Sequence: Synthetic oligonucleotide
atttcaactacaatgcggagctcttgctctccc

SEQ ID NO: 302979 - DNA, 32 bp, Artificial Sequence
  Description of Artificial Sequence: Synthetic oligonucleotide
tttcaactacaatgcggagctcttgctctccc

SEQ ID NO: 302980 - DNA, 31 bp, Artificial Sequence
  Description of Artificial Sequence: Synthetic oligonucleotide
ttcaactacaatgcggagctcttgctctccc

SEQ ID NO: 302981 - DNA, 30 bp, Artificial Sequence
  Description of Artificial Sequence: Synthetic oligonucleotide
tcaactacaatgcggagctcttgctctccc

SEQ ID NO: 302982 - DNA, 29 bp, Artificial Sequence
  Description of Artificial Sequence: Synthetic oligonucleotide
caactacaatgcggagctcttgctctccc

SEQ ID NO: 302983 - DNA, 33 bp, Artificial Sequence
  Description of Artificial Sequence: Synthetic oligonucleotide
aactacaatgcggagctcttgctctcccaatac

SEQ ID NO: 302984 - DNA, 32 bp, Artificial Sequence
  Description of Artificial Sequence: Synthetic oligonucleotide
actacaatgcggagctcttgctctcccaatac

SEQ ID NO: 302985 - DNA, 31 bp, Artificial Sequence
  Description of Artificial Sequence: Synthetic oligonucleotide
ctacaatgcggagctcttgctctcccaatac

SEQ ID NO: 302986 - DNA, 31 bp, Artificial Sequence
  Description of Artificial Sequence: Synthetic oligonucleotide
tacaatgcggagctcttgctctcccaatacc

SEQ ID NO: 302987 - DNA, 30 bp, Artificial Sequence
  Description of Artificial Sequence: Synthetic oligonucleotide
acaatgcggagctcttgctctcccaatacc

SEQ ID NO: 302988 - DNA, 29 bp, Artificial Sequence
  Description of Artificial Sequence: Synthetic oligonucleotide
caatgcggagctcttgctctcccaatacc

SEQ ID NO: 302989 - DNA, 30 bp, Artificial Sequence
  Description of Artificial Sequence: Synthetic oligonucleotide
aatgcggagctcttgctctcccaatacctg

SEQ ID NO: 302990 - DNA, 30 bp, Artificial Sequence
  Description of Artificial Sequence: Synthetic oligonucleotide
agctcttgctctcccaatacctggagagtc

SEQ ID NO: 302991 - DNA, 29 bp, Artificial Sequence
  Description of Artificial Sequence: Synthetic oligonucleotide
gctcttgctctcccaatacctggagagtc

SEQ ID NO: 302992 - DNA, 31 bp, Artificial Sequence
  Description of Artificial Sequence: Synthetic oligonucleotide
ctcttgctctcccaatacctggagagtcaag

SEQ ID NO: 302993 - DNA, 34 bp, Artificial Sequence
  Description of Artificial Sequence: Synthetic oligonucleotide
tcttgctctcccaatacctggagagtcaagaatc

SEQ ID NO: 302994 - DNA, 33 bp, Artificial Sequence
  Description of Artificial Sequence: Synthetic oligonucleotide
cttgctctcccaatacctggagagtcaagaatc

SEQ ID NO: 302995 - DNA, 33 bp, Artificial Sequence
  Description of Artificial Sequence: Synthetic oligonucleotide
ttgctctcccaatacctggagagtcaagaatcc

SEQ ID NO: 302996 - DNA, 32 bp, Artificial Sequence
  Description of Artificial Sequence: Synthetic oligonucleotide
tgctctcccaatacctggagagtcaagaatcc

SEQ ID NO: 302997 - DNA, 31 bp, Artificial Sequence
  Description of Artificial Sequence: Synthetic oligonucleotide
gctctcccaatacctggagagtcaagaatcc

SEQ ID NO: 302998 - DNA, 32 bp, Artificial Sequence
  Description of Artificial Sequence: Synthetic oligonucleotide
ctctcccaatacctggagagtcaagaatccac

SEQ ID NO: 302999 - DNA, 33 bp, Artificial Sequence
  Description of Artificial Sequence: Synthetic oligonucleotide
tctcccaatacctggagagtcaagaatccacag

SEQ ID NO: 303000 - DNA, 32 bp, Artificial Sequence
  Description of Artificial Sequence: Synthetic oligonucleotide
ctcccaatacctggagagtcaagaatccacag

SEQ ID NO: 303001 - DNA, 33 bp, Artificial Sequence
  Description of Artificial Sequence: Synthetic oligonucleotide
tcccaatacctggagagtcaagaatccacagtg

SEQ ID NO: 303002 - DNA, 32 bp, Artificial Sequence
  Description of Artificial Sequence: Synthetic oligonucleotide
cccaatacctggagagtcaagaatccacagtg

SEQ ID NO: 303003 - DNA, 32 bp, Artificial Sequence
  Description of Artificial Sequence: Synthetic oligonucleotide
ccaatacctggagagtcaagaatccacagtgc

SEQ ID NO: 303004 - DNA, 32 bp, Artificial Sequence
  Description of Artificial Sequence: Synthetic oligonucleotide
caatacctggagagtcaagaatccacagtgcc

SEQ ID NO: 303005 - DNA, 32 bp, Artificial Sequence
  Description of Artificial Sequence: Synthetic oligonucleotide
aatacctggagagtcaagaatccacagtgccc

SEQ ID NO: 303006 - DNA, 31 bp, Artificial Sequence
  Description of Artificial Sequence: Synthetic oligonucleotide
atacctggagagtcaagaatccacagtgccc

SEQ ID NO: 303007 - DNA, 30 bp, Artificial Sequence
  Description of Artificial Sequence: Synthetic oligonucleotide
tacctggagagtcaagaatccacagtgccc

SEQ ID NO: 303008 - DNA, 29 bp, Artificial Sequence
  Description of Artificial Sequence: Synthetic oligonucleotide
acctggagagtcaagaatccacagtgccc

SEQ ID NO: 303009 - DNA, 28 bp, Artificial Sequence
  Description of Artificial Sequence: Synthetic oligonucleotide
cctggagagtcaagaatccacagtgccc

SEQ ID NO: 303010 - DNA, 28 bp, Artificial Sequence
  Description of Artificial Sequence: Synthetic oligonucleotide
ctggagagtcaagaatccacagtgcccg

SEQ ID NO: 303011 - DNA, 29 bp, Artificial Sequence
  Description of Artificial Sequence: Synthetic oligonucleotide
tggagagtcaagaatccacagtgcccgag

SEQ ID NO: 303012 - DNA, 28 bp, Artificial Sequence
  Description of Artificial Sequence: Synthetic oligonucleotide
ggagagtcaagaatccacagtgcccgag

SEQ ID NO: 303013 - DNA, 29 bp, Artificial Sequence
  Description of Artificial Sequence: Synthetic oligonucleotide
gagagtcaagaatccacagtgcccgagtc

SEQ ID NO: 303014 - DNA, 29 bp, Artificial Sequence
  Description of Artificial Sequence: Synthetic oligonucleotide
agagtcaagaatccacagtgcccgagtcc

SEQ ID NO: 303015 - DNA, 28 bp, Artificial Sequence
  Description of Artificial Sequence: Synthetic oligonucleotide
gagtcaagaatccacagtgcccgagtcc

SEQ ID NO: 303016 - DNA, 29 bp, Artificial Sequence
  Description of Artificial Sequence: Synthetic oligonucleotide
agtcaagaatccacagtgcccgagtcctc

SEQ ID NO: 303017 - DNA, 28 bp, Artificial Sequence
  Description of Artificial Sequence: Synthetic oligonucleotide
gtcaagaatccacagtgcccgagtcctc

SEQ ID NO: 303018 - DNA, 28 bp, Artificial Sequence
  Description of Artificial Sequence: Synthetic oligonucleotide
tcaagaatccacagtgcccgagtcctcc

SEQ ID NO: 303019 - DNA, 27 bp, Artificial Sequence
  Description of Artificial Sequence: Synthetic oligonucleotide
caagaatccacagtgcccgagtcctcc

SEQ ID NO: 303020 - DNA, 28 bp, Artificial Sequence
  Description of Artificial Sequence: Synthetic oligonucleotide
aagaatccacagtgcccgagtcctccac

SEQ ID NO: 303021 - DNA, 27 bp, Artificial Sequence
  Description of Artificial Sequence: Synthetic oligonucleotide
agaatccacagtgcccgagtcctccac

SEQ ID NO: 303022 - DNA, 27 bp, Artificial Sequence
  Description of Artificial Sequence: Synthetic oligonucleotide
gaatccacagtgcccgagtcctccaca

SEQ ID NO: 303023 - DNA, 27 bp, Artificial Sequence
  Description of Artificial Sequence: Synthetic oligonucleotide
aatccacagtgcccgagtcctccacag

SEQ ID NO: 303024 - DNA, 26 bp, Artificial Sequence
  Description of Artificial Sequence: Synthetic oligonucleotide
atccacagtgcccgagtcctccacag

SEQ ID NO: 303025 - DNA, 25 bp, Artificial Sequence
  Description of Artificial Sequence: Synthetic oligonucleotide
tccacagtgcccgagtcctccacag

SEQ ID NO: 303026 - DNA, 24 bp, Artificial Sequence
  Description of Artificial Sequence: Synthetic oligonucleotide
ccacagtgcccgagtcctccacag

SEQ ID NO: 303027 - DNA, 27 bp, Artificial Sequence
  Description of Artificial Sequence: Synthetic oligonucleotide
gagtcctccacagctcagacgttggct

SEQ ID NO: 303028 - DNA, 29 bp, Artificial Sequence
  Description of Artificial Sequence: Synthetic oligonucleotide
agtcctccacagctcagacgttggctatg

SEQ ID NO: 303029 - DNA, 28 bp, Artificial Sequence
  Description of Artificial Sequence: Synthetic oligonucleotide
gtcctccacagctcagacgttggctatg

SEQ ID NO: 303030 - DNA, 30 bp, Artificial Sequence
  Description of Artificial Sequence: Synthetic oligonucleotide
tcctccacagctcagacgttggctatgtac

SEQ ID NO: 303031 - DNA, 29 bp, Artificial Sequence
  Description of Artificial Sequence: Synthetic oligonucleotide
cctccacagctcagacgttggctatgtac

SEQ ID NO: 303032 - DNA, 29 bp, Artificial Sequence
  Description of Artificial Sequence: Synthetic oligonucleotide
ctccacagctcagacgttggctatgtacg

SEQ ID NO: 303033 - DNA, 30 bp, Artificial Sequence
  Description of Artificial Sequence: Synthetic oligonucleotide
tccacagctcagacgttggctatgtacgtc

SEQ ID NO: 303034 - DNA, 29 bp, Artificial Sequence
  Description of Artificial Sequence: Synthetic oligonucleotide
ccacagctcagacgttggctatgtacgtc

SEQ ID NO: 303035 - DNA, 30 bp, Artificial Sequence
  Description of Artificial Sequence: Synthetic oligonucleotide
cacagctcagacgttggctatgtacgtcac

SEQ ID NO: 303036 - DNA, 36 bp, Artificial Sequence
  Description of Artificial Sequence: Synthetic oligonucleotide
acagctcagacgttggctatgtacgtcacaattttc

SEQ ID NO: 303037 - DNA, 35 bp, Artificial Sequence
  Description of Artificial Sequence: Synthetic oligonucleotide
cagctcagacgttggctatgtacgtcacaattttc

SEQ ID NO: 303038 - DNA, 36 bp, Artificial Sequence
  Description of Artificial Sequence: Synthetic oligonucleotide
agctcagacgttggctatgtacgtcacaattttctg

SEQ ID NO: 303039 - DNA, 35 bp, Artificial Sequence
  Description of Artificial Sequence: Synthetic oligonucleotide
gctcagacgttggctatgtacgtcacaattttctg

SEQ ID NO: 303040 - DNA, 35 bp, Artificial Sequence
  Description of Artificial Sequence: Synthetic oligonucleotide
ctcagacgttggctatgtacgtcacaattttctgg

SEQ ID NO: 303041 - DNA, 37 bp, Artificial Sequence
  Description of Artificial Sequence: Synthetic oligonucleotide
tcagacgttggctatgtacgtcacaattttctggaac

SEQ ID NO: 303042 - DNA, 36 bp, Artificial Sequence
  Description of Artificial Sequence: Synthetic oligonucleotide
cagacgttggctatgtacgtcacaattttctggaac

SEQ ID NO: 303043 - DNA, 36 bp, Artificial Sequence
  Description of Artificial Sequence: Synthetic oligonucleotide
agacgttggctatgtacgtcacaattttctggaacg

SEQ ID NO: 303044 - DNA, 35 bp, Artificial Sequence
  Description of Artificial Sequence: Synthetic oligonucleotide
gacgttggctatgtacgtcacaattttctggaacg

SEQ ID NO: 303045 - DNA, 37 bp, Artificial Sequence
  Description of Artificial Sequence: Synthetic oligonucleotide
acgttggctatgtacgtcacaattttctggaacgaag

SEQ ID NO: 303046 - DNA, 36 bp, Artificial Sequence
  Description of Artificial Sequence: Synthetic oligonucleotide
cgttggctatgtacgtcacaattttctggaacgaag

SEQ ID NO: 303047 - DNA, 38 bp, Artificial Sequence
  Description of Artificial Sequence: Synthetic oligonucleotide
gttggctatgtacgtcacaattttctggaacgaagatg

SEQ ID NO: 303048 - DNA, 38 bp, Artificial Sequence
  Description of Artificial Sequence: Synthetic oligonucleotide
ttggctatgtacgtcacaattttctggaacgaagatgc

SEQ ID NO: 303049 - DNA, 37 bp, Artificial Sequence
  Description of Artificial Sequence: Synthetic oligonucleotide
tggctatgtacgtcacaattttctggaacgaagatgc

SEQ ID NO: 303050 - DNA, 36 bp, Artificial Sequence
  Description of Artificial Sequence: Synthetic oligonucleotide
ggctatgtacgtcacaattttctggaacgaagatgc

SEQ ID NO: 303051 - DNA, 36 bp, Artificial Sequence
  Description of Artificial Sequence: Synthetic oligonucleotide
gctatgtacgtcacaattttctggaacgaagatgcc

SEQ ID NO: 303052 - DNA, 38 bp, Artificial Sequence
  Description of Artificial Sequence: Synthetic oligonucleotide
ctatgtacgtcacaattttctggaacgaagatgccttg

SEQ ID NO: 303053 - DNA, 40 bp, Artificial Sequence
  Description of Artificial Sequence: Synthetic oligonucleotide
tatgtacgtcacaattttctggaacgaagatgccttgaag

SEQ ID NO: 303054 - DNA, 39 bp, Artificial Sequence
  Description of Artificial Sequence: Synthetic oligonucleotide
atgtacgtcacaattttctggaacgaagatgccttgaag

SEQ ID NO: 303055 - DNA, 38 bp, Artificial Sequence
  Description of Artificial Sequence: Synthetic oligonucleotide
tgtacgtcacaattttctggaacgaagatgccttgaag

SEQ ID NO: 303056 - DNA, 37 bp, Artificial Sequence
  Description of Artificial Sequence: Synthetic oligonucleotide
gtacgtcacaattttctggaacgaagatgccttgaag

SEQ ID NO: 303057 - DNA, 38 bp, Artificial Sequence
  Description of Artificial Sequence: Synthetic oligonucleotide
tacgtcacaattttctggaacgaagatgccttgaagac

SEQ ID NO: 303058 - DNA, 37 bp, Artificial Sequence
  Description of Artificial Sequence: Synthetic oligonucleotide
acgtcacaattttctggaacgaagatgccttgaagac

SEQ ID NO: 303059 - DNA, 36 bp, Artificial Sequence
  Description of Artificial Sequence: Synthetic oligonucleotide
cgtcacaattttctggaacgaagatgccttgaagac

SEQ ID NO: 303060 - DNA, 36 bp, Artificial Sequence
  Description of Artificial Sequence: Synthetic oligonucleotide
gtcacaattttctggaacgaagatgccttgaagacc

SEQ ID NO: 303061 - DNA, 38 bp, Artificial Sequence
  Description of Artificial Sequence: Synthetic oligonucleotide
tcacaattttctggaacgaagatgccttgaagaccatg

SEQ ID NO: 303062 - DNA, 37 bp, Artificial Sequence
  Description of Artificial Sequence: Synthetic oligonucleotide
cacaattttctggaacgaagatgccttgaagaccatg

SEQ ID NO: 303063 - DNA, 38 bp, Artificial Sequence
  Description of Artificial Sequence: Synthetic oligonucleotide
acaattttctggaacgaagatgccttgaagaccatgac

SEQ ID NO: 303064 - DNA, 37 bp, Artificial Sequence
  Description of Artificial Sequence: Synthetic oligonucleotide
caattttctggaacgaagatgccttgaagaccatgac

SEQ ID NO: 303065 - DNA, 38 bp, Artificial Sequence
  Description of Artificial Sequence: Synthetic oligonucleotide
aattttctggaacgaagatgccttgaagaccatgacac

SEQ ID NO: 303066 - DNA, 37 bp, Artificial Sequence
  Description of Artificial Sequence: Synthetic oligonucleotide
attttctggaacgaagatgccttgaagaccatgacac

SEQ ID NO: 303067 - DNA, 36 bp, Artificial Sequence
  Description of Artificial Sequence: Synthetic oligonucleotide
ttttctggaacgaagatgccttgaagaccatgacac

SEQ ID NO: 303068 - DNA, 35 bp, Artificial Sequence
  Description of Artificial Sequence: Synthetic oligonucleotide
tttctggaacgaagatgccttgaagaccatgacac

SEQ ID NO: 303069 - DNA, 34 bp, Artificial Sequence
  Description of Artificial Sequence: Synthetic oligonucleotide
ttctggaacgaagatgccttgaagaccatgacac

SEQ ID NO: 303070 - DNA, 33 bp, Artificial Sequence
  Description of Artificial Sequence: Synthetic oligonucleotide
tctggaacgaagatgccttgaagaccatgacac

SEQ ID NO: 303071 - DNA, 32 bp, Artificial Sequence
  Description of Artificial Sequence: Synthetic oligonucleotide
ctggaacgaagatgccttgaagaccatgacac

SEQ ID NO: 303072 - DNA, 33 bp, Artificial Sequence
  Description of Artificial Sequence: Synthetic oligonucleotide
tggaacgaagatgccttgaagaccatgacacac

SEQ ID NO: 303073 - DNA, 32 bp, Artificial Sequence
  Description of Artificial Sequence: Synthetic oligonucleotide
ggaacgaagatgccttgaagaccatgacacac

SEQ ID NO: 303074 - DNA, 35 bp, Artificial Sequence
  Description of Artificial Sequence: Synthetic oligonucleotide
aacgaagatgccttgaagaccatgacacactaacg

SEQ ID NO: 303075 - DNA, 34 bp, Artificial Sequence
  Description of Artificial Sequence: Synthetic oligonucleotide
acgaagatgccttgaagaccatgacacactaacg

SEQ ID NO: 303076 - DNA, 33 bp, Artificial Sequence
  Description of Artificial Sequence: Synthetic oligonucleotide
cgaagatgccttgaagaccatgacacactaacg

SEQ ID NO: 303077 - DNA, 33 bp, Artificial Sequence
  Description of Artificial Sequence: Synthetic oligonucleotide
gaagatgccttgaagaccatgacacactaacgc

SEQ ID NO: 303078 - DNA, 33 bp, Artificial Sequence
  Description of Artificial Sequence: Synthetic oligonucleotide
aagatgccttgaagaccatgacacactaacgcg

SEQ ID NO: 303079 - DNA, 32 bp, Artificial Sequence
  Description of Artificial Sequence: Synthetic oligonucleotide
agatgccttgaagaccatgacacactaacgcg

SEQ ID NO: 303080 - DNA, 31 bp, Artificial Sequence
  Description of Artificial Sequence: Synthetic oligonucleotide
gatgccttgaagaccatgacacactaacgcg

SEQ ID NO: 303081 - DNA, 31 bp, Artificial Sequence
  Description of Artificial Sequence: Synthetic oligonucleotide
atgccttgaagaccatgacacactaacgcgc

SEQ ID NO: 303082 - DNA, 30 bp, Artificial Sequence
  Description of Artificial Sequence: Synthetic oligonucleotide
tgccttgaagaccatgacacactaacgcgc

SEQ ID NO: 303083 - DNA, 29 bp, Artificial Sequence
  Description of Artificial Sequence: Synthetic oligonucleotide
gccttgaagaccatgacacactaacgcgc

SEQ ID NO: 303084 - DNA, 32 bp, Artificial Sequence
  Description of Artificial Sequence: Synthetic oligonucleotide
ccttgaagaccatgacacactaacgcgctatg

SEQ ID NO: 303085 - DNA, 32 bp, Artificial Sequence
  Description of Artificial Sequence: Synthetic oligonucleotide
cttgaagaccatgacacactaacgcgctatgg

SEQ ID NO: 303086 - DNA, 33 bp, Artificial Sequence
  Description of Artificial Sequence: Synthetic oligonucleotide
ttgaagaccatgacacactaacgcgctatggag

SEQ ID NO: 303087 - DNA, 32 bp, Artificial Sequence
  Description of Artificial Sequence: Synthetic oligonucleotide
tgaagaccatgacacactaacgcgctatggag

SEQ ID NO: 303088 - DNA, 31 bp, Artificial Sequence
  Description of Artificial Sequence: Synthetic oligonucleotide
gaagaccatgacacactaacgcgctatggag

SEQ ID NO: 303089 - DNA, 31 bp, Artificial Sequence
  Description of Artificial Sequence: Synthetic oligonucleotide
aagaccatgacacactaacgcgctatggagg

SEQ ID NO: 303090 - DNA, 30 bp, Artificial Sequence
  Description of Artificial Sequence: Synthetic oligonucleotide
agaccatgacacactaacgcgctatggagg

SEQ ID NO: 303091 - DNA, 29 bp, Artificial Sequence
  Description of Artificial Sequence: Synthetic oligonucleotide
gaccatgacacactaacgcgctatggagg

SEQ ID NO: 303092 - DNA, 29 bp, Artificial Sequence
  Description of Artificial Sequence: Synthetic oligonucleotide
accatgacacactaacgcgctatggaggc

SEQ ID NO: 303093 - DNA, 28 bp, Artificial Sequence
  Description of Artificial Sequence: Synthetic oligonucleotide
ccatgacacactaacgcgctatggaggc

SEQ ID NO: 303094 - DNA, 29 bp, Artificial Sequence
  Description of Artificial Sequence: Synthetic oligonucleotide
catgacacactaacgcgctatggaggcag

SEQ ID NO: 303095 - DNA, 30 bp, Artificial Sequence
  Description of Artificial Sequence: Synthetic oligonucleotide
atgacacactaacgcgctatggaggcagac

SEQ ID NO: 303096 - DNA, 29 bp, Artificial Sequence
  Description of Artificial Sequence: Synthetic oligonucleotide
tgacacactaacgcgctatggaggcagac

SEQ ID NO: 303097 - DNA, 28 bp, Artificial Sequence
  Description of Artificial Sequence: Synthetic oligonucleotide
gacacactaacgcgctatggaggcagac

SEQ ID NO: 303098 - DNA, 29 bp, Artificial Sequence
  Description of Artificial Sequence: Synthetic oligonucleotide
acacactaacgcgctatggaggcagactc

SEQ ID NO: 303099 - DNA, 28 bp, Artificial Sequence
  Description of Artificial Sequence: Synthetic oligonucleotide
cacactaacgcgctatggaggcagactc

SEQ ID NO: 303100 - DNA, 28 bp, Artificial Sequence
  Description of Artificial Sequence: Synthetic oligonucleotide
acactaacgcgctatggaggcagactcc

SEQ ID NO: 303101 - DNA, 27 bp, Artificial Sequence
  Description of Artificial Sequence: Synthetic oligonucleotide
cactaacgcgctatggaggcagactcc

SEQ ID NO: 303102 - DNA, 27 bp, Artificial Sequence
  Description of Artificial Sequence: Synthetic oligonucleotide
actaacgcgctatggaggcagactccc

SEQ ID NO: 303103 - DNA, 27 bp, Artificial Sequence
  Description of Artificial Sequence: Synthetic oligonucleotide
ctaacgcgctatggaggcagactccct

SEQ ID NO: 303104 - DNA, 27 bp, Artificial Sequence
  Description of Artificial Sequence: Synthetic oligonucleotide
taacgcgctatggaggcagactccctg

SEQ ID NO: 303105 - DNA, 26 bp, Artificial Sequence
  Description of Artificial Sequence: Synthetic oligonucleotide
aacgcgctatggaggcagactccctg

SEQ ID NO: 303106 - DNA, 25 bp, Artificial Sequence
  Description of Artificial Sequence: Synthetic oligonucleotide
acgcgctatggaggcagactccctg

SEQ ID NO: 303107 - DNA, 24 bp, Artificial Sequence
  Description of Artificial Sequence: Synthetic oligonucleotide
cgcgctatggaggcagactccctg

SEQ ID NO: 303108 - DNA, 25 bp, Artificial Sequence
  Description of Artificial Sequence: Synthetic oligonucleotide
gcgctatggaggcagactccctgca

SEQ ID NO: 303109 - DNA, 27 bp, Artificial Sequence
  Description of Artificial Sequence: Synthetic oligonucleotide
cgctatggaggcagactccctgcagaa

SEQ ID NO: 303110 - DNA, 28 bp, Artificial Sequence
  Description of Artificial Sequence: Synthetic oligonucleotide
gctatggaggcagactccctgcagaatc

SEQ ID NO: 303111 - DNA, 30 bp, Artificial Sequence
  Description of Artificial Sequence: Synthetic oligonucleotide
ctatggaggcagactccctgcagaatctac

SEQ ID NO: 303112 - DNA, 31 bp, Artificial Sequence
  Description of Artificial Sequence: Synthetic oligonucleotide
tatggaggcagactccctgcagaatctacag

SEQ ID NO: 303113 - DNA, 30 bp, Artificial Sequence
  Description of Artificial Sequence: Synthetic oligonucleotide
atggaggcagactccctgcagaatctacag

SEQ ID NO: 303114 - DNA, 29 bp, Artificial Sequence
  Description of Artificial Sequence: Synthetic oligonucleotide
tggaggcagactccctgcagaatctacag

SEQ ID NO: 303115 - DNA, 28 bp, Artificial Sequence
  Description of Artificial Sequence: Synthetic oligonucleotide
ggaggcagactccctgcagaatctacag

SEQ ID NO: 303116 - DNA, 28 bp, Artificial Sequence
  Description of Artificial Sequence: Synthetic oligonucleotide
gaggcagactccctgcagaatctacagc

SEQ ID NO: 303117 - DNA, 28 bp, Artificial Sequence
  Description of Artificial Sequence: Synthetic oligonucleotide
aggcagactccctgcagaatctacagcg

SEQ ID NO: 303118 - DNA, 27 bp, Artificial Sequence
  Description of Artificial Sequence: Synthetic oligonucleotide
ggcagactccctgcagaatctacagcg

SEQ ID NO: 303119 - DNA, 31 bp, Artificial Sequence
  Description of Artificial Sequence: Synthetic oligonucleotide
gcagactccctgcagaatctacagcgaaatc

SEQ ID NO: 303120 - DNA, 32 bp, Artificial Sequence
  Description of Artificial Sequence: Synthetic oligonucleotide
cagactccctgcagaatctacagcgaaatctg

SEQ ID NO: 303121 - DNA, 36 bp, Artificial Sequence
  Description of Artificial Sequence: Synthetic oligonucleotide
agactccctgcagaatctacagcgaaatctgaaatg

SEQ ID NO: 303122 - DNA, 35 bp, Artificial Sequence
  Description of Artificial Sequence: Synthetic oligonucleotide
gactccctgcagaatctacagcgaaatctgaaatg

SEQ ID NO: 303123 - DNA, 35 bp, Artificial Sequence
  Description of Artificial Sequence: Synthetic oligonucleotide
actccctgcagaatctacagcgaaatctgaaatgc

SEQ ID NO: 303124 - DNA, 34 bp, Artificial Sequence
  Description of Artificial Sequence: Synthetic oligonucleotide
ctccctgcagaatctacagcgaaatctgaaatgc

SEQ ID NO: 303125 - DNA, 34 bp, Artificial Sequence
  Description of Artificial Sequence: Synthetic oligonucleotide
tccctgcagaatctacagcgaaatctgaaatgcg

SEQ ID NO: 303126 - DNA, 33 bp, Artificial Sequence
  Description of Artificial Sequence: Synthetic oligonucleotide
ccctgcagaatctacagcgaaatctgaaatgcg

SEQ ID NO: 303127 - DNA, 33 bp, Artificial Sequence
  Description of Artificial Sequence: Synthetic oligonucleotide
cctgcagaatctacagcgaaatctgaaatgcgg

SEQ ID NO: 303128 - DNA, 33 bp, Artificial Sequence
  Description of Artificial Sequence: Synthetic oligonucleotide
ctgcagaatctacagcgaaatctgaaatgcggg

SEQ ID NO: 303129 - DNA, 33 bp, Artificial Sequence
  Description of Artificial Sequence: Synthetic oligonucleotide
tgcagaatctacagcgaaatctgaaatgcgggg

SEQ ID NO: 303130 - DNA, 32 bp, Artificial Sequence
  Description of Artificial Sequence: Synthetic oligonucleotide
gcagaatctacagcgaaatctgaaatgcgggg

SEQ ID NO: 303131 - DNA, 33 bp, Artificial Sequence
  Description of Artificial Sequence: Synthetic oligonucleotide
cagaatctacagcgaaatctgaaatgcggggtg

SEQ ID NO: 303132 - DNA, 33 bp, Artificial Sequence
  Description of Artificial Sequence: Synthetic oligonucleotide
agaatctacagcgaaatctgaaatgcggggtgg

SEQ ID NO: 303133 - DNA, 32 bp, Artificial Sequence
  Description of Artificial Sequence: Synthetic oligonucleotide
gaatctacagcgaaatctgaaatgcggggtgg

SEQ ID NO: 303134 - DNA, 32 bp, Artificial Sequence
  Description of Artificial Sequence: Synthetic oligonucleotide
aatctacagcgaaatctgaaatgcggggtggc

SEQ ID NO: 303135 - DNA, 31 bp, Artificial Sequence
  Description of Artificial Sequence: Synthetic oligonucleotide
atctacagcgaaatctgaaatgcggggtggc

SEQ ID NO: 303136 - DNA, 30 bp, Artificial Sequence
  Description of Artificial Sequence: Synthetic oligonucleotide
tctacagcgaaatctgaaatgcggggtggc

SEQ ID NO: 303137 - DNA, 29 bp, Artificial Sequence
  Description of Artificial Sequence: Synthetic oligonucleotide
ctacagcgaaatctgaaatgcggggtggc

SEQ ID NO: 303138 - DNA, 29 bp, Artificial Sequence
  Description of Artificial Sequence: Synthetic oligonucleotide
tacagcgaaatctgaaatgcggggtggcg

SEQ ID NO: 303139 - DNA, 28 bp, Artificial Sequence
  Description of Artificial Sequence: Synthetic oligonucleotide
acagcgaaatctgaaatgcggggtggcg

SEQ ID NO: 303140 - DNA, 27 bp, Artificial Sequence
  Description of Artificial Sequence: Synthetic oligonucleotide
cagcgaaatctgaaatgcggggtggcg

SEQ ID NO: 303141 - DNA, 29 bp, Artificial Sequence
  Description of Artificial Sequence: Synthetic oligonucleotide
agcgaaatctgaaatgcggggtggcgatc

SEQ ID NO: 303142 - DNA, 28 bp, Artificial Sequence
  Description of Artificial Sequence: Synthetic oligonucleotide
gcgaaatctgaaatgcggggtggcgatc

SEQ ID NO: 303143 - DNA, 29 bp, Artificial Sequence
  Description of Artificial Sequence: Synthetic oligonucleotide
cgaaatctgaaatgcggggtggcgatcag

SEQ ID NO: 303144 - DNA, 29 bp, Artificial Sequence
  Description of Artificial Sequence: Synthetic oligonucleotide
gaaatctgaaatgcggggtggcgatcagg

SEQ ID NO: 303145 - DNA, 30 bp, Artificial Sequence
  Description of Artificial Sequence: Synthetic oligonucleotide
aaatctgaaatgcggggtggcgatcaggag

SEQ ID NO: 303146 - DNA, 29 bp, Artificial Sequence
  Description of Artificial Sequence: Synthetic oligonucleotide
aatctgaaatgcggggtggcgatcaggag

SEQ ID NO: 303147 - DNA, 28 bp, Artificial Sequence
  Description of Artificial Sequence: Synthetic oligonucleotide
atctgaaatgcggggtggcgatcaggag

SEQ ID NO: 303148 - DNA, 27 bp, Artificial Sequence
  Description of Artificial Sequence: Synthetic oligonucleotide
tctgaaatgcggggtggcgatcaggag

SEQ ID NO: 303149 - DNA, 27 bp, Artificial Sequence
  Description of Artificial Sequence: Synthetic oligonucleotide
ctgaaatgcggggtggcgatcaggaga

SEQ ID NO: 303150 - DNA, 28 bp, Artificial Sequence
  Description of Artificial Sequence: Synthetic oligonucleotide
tgaaatgcggggtggcgatcaggagatc

SEQ ID NO: 303151 - DNA, 27 bp, Artificial Sequence
  Description of Artificial Sequence: Synthetic oligonucleotide
gaaatgcggggtggcgatcaggagatc

SEQ ID NO: 303152 - DNA, 28 bp, Artificial Sequence
  Description of Artificial Sequence: Synthetic oligonucleotide
aaatgcggggtggcgatcaggagatcag

SEQ ID NO: 303153 - DNA, 27 bp, Artificial Sequence
  Description of Artificial Sequence: Synthetic oligonucleotide
aatgcggggtggcgatcaggagatcag

SEQ ID NO: 303154 - DNA, 27 bp, Artificial Sequence
  Description of Artificial Sequence: Synthetic oligonucleotide
atgcggggtggcgatcaggagatcagt

SEQ ID NO: 303155 - DNA, 26 bp, Artificial Sequence
  Description of Artificial Sequence: Synthetic oligonucleotide
tgcggggtggcgatcaggagatcagt

SEQ ID NO: 303156 - DNA, 25 bp, Artificial Sequence
  Description of Artificial Sequence: Synthetic oligonucleotide
gcggggtggcgatcaggagatcagt

SEQ ID NO: 303157 - DNA, 25 bp, Artificial Sequence
  Description of Artificial Sequence: Synthetic oligonucleotide
cggggtggcgatcaggagatcagtg

SEQ ID NO: 303158 - DNA, 25 bp, Artificial Sequence
  Description of Artificial Sequence: Synthetic oligonucleotide
ggggtggcgatcaggagatcagtgc

SEQ ID NO: 303159 - DNA, 25 bp, Artificial Sequence
  Description of Artificial Sequence: Synthetic oligonucleotide
gggtggcgatcaggagatcagtgcc

SEQ ID NO: 303160 - DNA, 25 bp, Artificial Sequence
  Description of Artificial Sequence: Synthetic oligonucleotide
ggtggcgatcaggagatcagtgccc

SEQ ID NO: 303161 - DNA, 25 bp, Artificial Sequence
  Description of Artificial Sequence: Synthetic oligonucleotide
gtggcgatcaggagatcagtgcccc

SEQ ID NO: 303162 - DNA, 25 bp, Artificial Sequence
  Description of Artificial Sequence: Synthetic oligonucleotide
tggcgatcaggagatcagtgccccg

SEQ ID NO: 303163 - DNA, 24 bp, Artificial Sequence
  Description of Artificial Sequence: Synthetic oligonucleotide
ggcgatcaggagatcagtgccccg

SEQ ID NO: 303164 - DNA, 26 bp, Artificial Sequence
  Description of Artificial Sequence: Synthetic oligonucleotide
gcgatcaggagatcagtgccccgcat

SEQ ID NO: 303165 - DNA, 26 bp, Artificial Sequence
  Description of Artificial Sequence: Synthetic oligonucleotide
cgatcaggagatcagtgccccgcatg

SEQ ID NO: 303166 - DNA, 27 bp, Artificial Sequence
  Description of Artificial Sequence: Synthetic oligonucleotide
gatcaggagatcagtgccccgcatggt

SEQ ID NO: 303167 - DNA, 27 bp, Artificial Sequence
  Description of Artificial Sequence: Synthetic oligonucleotide
atcaggagatcagtgccccgcatggtg

SEQ ID NO: 303168 - DNA, 27 bp, Artificial Sequence
  Description of Artificial Sequence: Synthetic oligonucleotide
tcaggagatcagtgccccgcatggtga

SEQ ID NO: 303169 - DNA, 27 bp, Artificial Sequence
  Description of Artificial Sequence: Synthetic oligonucleotide
caggagatcagtgccccgcatggtgaa

SEQ ID NO: 303170 - DNA, 27 bp, Artificial Sequence
  Description of Artificial Sequence: Synthetic oligonucleotide
cagtgccccgcatggtgaaagtcacct

SEQ ID NO: 303171 - DNA, 27 bp, Artificial Sequence
  Description of Artificial Sequence: Synthetic oligonucleotide
agtgccccgcatggtgaaagtcacctg

SEQ ID NO: 303172 - DNA, 26 bp, Artificial Sequence
  Description of Artificial Sequence: Synthetic oligonucleotide
gtgccccgcatggtgaaagtcacctg

SEQ ID NO: 303173 - DNA, 27 bp, Artificial Sequence
  Description of Artificial Sequence: Synthetic oligonucleotide
tgccccgcatggtgaaagtcacctgct

SEQ ID NO: 303174 - DNA, 26 bp, Artificial Sequence
  Description of Artificial Sequence: Synthetic oligonucleotide
gccccgcatggtgaaagtcacctgct

SEQ ID NO: 303175 - DNA, 26 bp, Artificial Sequence
  Description of Artificial Sequence: Synthetic oligonucleotide
ccccgcatggtgaaagtcacctgctg

SEQ ID NO: 303176 - DNA, 26 bp, Artificial Sequence
  Description of Artificial Sequence: Synthetic oligonucleotide
cccgcatggtgaaagtcacctgctgc

SEQ ID NO: 303177 - DNA, 27 bp, Artificial Sequence
  Description of Artificial Sequence: Synthetic oligonucleotide
ccgcatggtgaaagtcacctgctgcga

SEQ ID NO: 303178 - DNA, 27 bp, Artificial Sequence
  Description of Artificial Sequence: Synthetic oligonucleotide
cgcatggtgaaagtcacctgctgcgag

SEQ ID NO: 303179 - DNA, 27 bp, Artificial Sequence
  Description of Artificial Sequence: Synthetic oligonucleotide
gcatggtgaaagtcacctgctgcgagg

SEQ ID NO: 303180 - DNA, 28 bp, Artificial Sequence
  Description of Artificial Sequence: Synthetic oligonucleotide
catggtgaaagtcacctgctgcgaggtc

SEQ ID NO: 303181 - DNA, 29 bp, Artificial Sequence
  Description of Artificial Sequence: Synthetic oligonucleotide
atggtgaaagtcacctgctgcgaggtctg

SEQ ID NO: 303182 - DNA, 28 bp, Artificial Sequence
  Description of Artificial Sequence: Synthetic oligonucleotide
tggtgaaagtcacctgctgcgaggtctg

SEQ ID NO: 303183 - DNA, 27 bp, Artificial Sequence
  Description of Artificial Sequence: Synthetic oligonucleotide
ggtgaaagtcacctgctgcgaggtctg

SEQ ID NO: 303184 - DNA, 28 bp, Artificial Sequence
  Description of Artificial Sequence: Synthetic oligonucleotide
gtgaaagtcacctgctgcgaggtctgag

SEQ ID NO: 303185 - DNA, 29 bp, Artificial Sequence
  Description of Artificial Sequence: Synthetic oligonucleotide
tgaaagtcacctgctgcgaggtctgagag

SEQ ID NO: 303186 - DNA, 28 bp, Artificial Sequence
  Description of Artificial Sequence: Synthetic oligonucleotide
gaaagtcacctgctgcgaggtctgagag

SEQ ID NO: 303187 - DNA, 28 bp, Artificial Sequence
  Description of Artificial Sequence: Synthetic oligonucleotide
aaagtcacctgctgcgaggtctgagagg

SEQ ID NO: 303188 - DNA, 27 bp, Artificial Sequence
  Description of Artificial Sequence: Synthetic oligonucleotide
aagtcacctgctgcgaggtctgagagg

SEQ ID NO: 303189 - DNA, 26 bp, Artificial Sequence
  Description of Artificial Sequence: Synthetic oligonucleotide
agtcacctgctgcgaggtctgagagg

SEQ ID NO: 303190 - DNA, 25 bp, Artificial Sequence
  Description of Artificial Sequence: Synthetic oligonucleotide
gtcacctgctgcgaggtctgagagg

SEQ ID NO: 303191 - DNA, 25 bp, Artificial Sequence
  Description of Artificial Sequence: Synthetic oligonucleotide
tcacctgctgcgaggtctgagaggg

SEQ ID NO: 303192 - DNA, 24 bp, Artificial Sequence
  Description of Artificial Sequence: Synthetic oligonucleotide
cacctgctgcgaggtctgagaggg

SEQ ID NO: 303193 - DNA, 26 bp, Artificial Sequence
  Description of Artificial Sequence: Synthetic oligonucleotide
acctgctgcgaggtctgagagggcaa

SEQ ID NO: 303194 - DNA, 25 bp, Artificial Sequence
  Description of Artificial Sequence: Synthetic oligonucleotide
cctgctgcgaggtctgagagggcaa

SEQ ID NO: 303195 - DNA, 27 bp, Artificial Sequence
  Description of Artificial Sequence: Synthetic oligonucleotide
ctgctgcgaggtctgagagggcaagat

SEQ ID NO: 303196 - DNA, 27 bp, Artificial Sequence
  Description of Artificial Sequence: Synthetic oligonucleotide
tgctgcgaggtctgagagggcaagatc

SEQ ID NO: 303197 - DNA, 27 bp, Artificial Sequence
  Description of Artificial Sequence: Synthetic oligonucleotide
gctgcgaggtctgagagggcaagatca

SEQ ID NO: 303198 - DNA, 27 bp, Artificial Sequence
  Description of Artificial Sequence: Synthetic oligonucleotide
ctgcgaggtctgagagggcaagatcac

SEQ ID NO: 303199 - DNA, 27 bp, Artificial Sequence
  Description of Artificial Sequence: Synthetic oligonucleotide
tgcgaggtctgagagggcaagatcacc

SEQ ID NO: 303200 - DNA, 26 bp, Artificial Sequence
  Description of Artificial Sequence: Synthetic oligonucleotide
gcgaggtctgagagggcaagatcacc

SEQ ID NO: 303201 - DNA, 27 bp, Artificial Sequence
  Description of Artificial Sequence: Synthetic oligonucleotide
cgaggtctgagagggcaagatcaccgt

SEQ ID NO: 303202 - DNA, 27 bp, Artificial Sequence
  Description of Artificial Sequence: Synthetic oligonucleotide
gaggtctgagagggcaagatcaccgtg

SEQ ID NO: 303203 - DNA, 28 bp, Artificial Sequence
  Description of Artificial Sequence: Synthetic oligonucleotide
aggtctgagagggcaagatcaccgtgtc

SEQ ID NO: 303204 - DNA, 27 bp, Artificial Sequence
  Description of Artificial Sequence: Synthetic oligonucleotide
ggtctgagagggcaagatcaccgtgtc

SEQ ID NO: 303205 - DNA, 29 bp, Artificial Sequence
  Description of Artificial Sequence: Synthetic oligonucleotide
gtctgagagggcaagatcaccgtgtcatg

SEQ ID NO: 303206 - DNA, 29 bp, Artificial Sequence
  Description of Artificial Sequence: Synthetic oligonucleotide
tctgagagggcaagatcaccgtgtcatgc

SEQ ID NO: 303207 - DNA, 30 bp, Artificial Sequence
  Description of Artificial Sequence: Synthetic oligonucleotide
gggttccagcttgtatccccggtatatcac

SEQ ID NO: 303208 - DNA, 31 bp, Artificial Sequence
  Description of Artificial Sequence: Synthetic oligonucleotide
ggttccagcttgtatccccggtatatcacac

SEQ ID NO: 303209 - DNA, 32 bp, Artificial Sequence
  Description of Artificial Sequence: Synthetic oligonucleotide
gttccagcttgtatccccggtatatcacacag

SEQ ID NO: 303210 - DNA, 33 bp, Artificial Sequence
  Description of Artificial Sequence: Synthetic oligonucleotide
ttccagcttgtatccccggtatatcacacagac

SEQ ID NO: 303211 - DNA, 32 bp, Artificial Sequence
  Description of Artificial Sequence: Synthetic oligonucleotide
tccagcttgtatccccggtatatcacacagac

SEQ ID NO: 303212 - DNA, 31 bp, Artificial Sequence
  Description of Artificial Sequence: Synthetic oligonucleotide
ccagcttgtatccccggtatatcacacagac

SEQ ID NO: 303213 - DNA, 31 bp, Artificial Sequence
  Description of Artificial Sequence: Synthetic oligonucleotide
cagcttgtatccccggtatatcacacagacc

SEQ ID NO: 303214 - DNA, 32 bp, Artificial Sequence
  Description of Artificial Sequence: Synthetic oligonucleotide
agcttgtatccccggtatatcacacagacctg

SEQ ID NO: 303215 - DNA, 31 bp, Artificial Sequence
  Description of Artificial Sequence: Synthetic oligonucleotide
gcttgtatccccggtatatcacacagacctg

SEQ ID NO: 303216 - DNA, 31 bp, Artificial Sequence
  Description of Artificial Sequence: Synthetic oligonucleotide
cttgtatccccggtatatcacacagacctgg

SEQ ID NO: 303217 - DNA, 31 bp, Artificial Sequence
  Description of Artificial Sequence: Synthetic oligonucleotide
ttgtatccccggtatatcacacagacctggc

SEQ ID NO: 303218 - DNA, 30 bp, Artificial Sequence
  Description of Artificial Sequence: Synthetic oligonucleotide
tgtatccccggtatatcacacagacctggc

SEQ ID NO: 303219 - DNA, 29 bp, Artificial Sequence
  Description of Artificial Sequence: Synthetic oligonucleotide
gtatccccggtatatcacacagacctggc

SEQ ID NO: 303220 - DNA, 29 bp, Artificial Sequence
  Description of Artificial Sequence: Synthetic oligonucleotide
tatccccggtatatcacacagacctggcg

SEQ ID NO: 303221 - DNA, 28 bp, Artificial Sequence
  Description of Artificial Sequence: Synthetic oligonucleotide
atccccggtatatcacacagacctggcg

SEQ ID NO: 303222 - DNA, 27 bp, Artificial Sequence
  Description of Artificial Sequence: Synthetic oligonucleotide
tccccggtatatcacacagacctggcg

SEQ ID NO: 303223 - DNA, 27 bp, Artificial Sequence
  Description of Artificial Sequence: Synthetic oligonucleotide
ccccggtatatcacacagacctggcga

SEQ ID NO: 303224 - DNA, 27 bp, Artificial Sequence
  Description of Artificial Sequence: Synthetic oligonucleotide
cccggtatatcacacagacctggcgac

SEQ ID NO: 303225 - DNA, 28 bp, Artificial Sequence
  Description of Artificial Sequence: Synthetic oligonucleotide
ccggtatatcacacagacctggcgacag

SEQ ID NO: 303226 - DNA, 28 bp, Artificial Sequence
  Description of Artificial Sequence: Synthetic oligonucleotide
cggtatatcacacagacctggcgacagg

SEQ ID NO: 303227 - DNA, 30 bp, Artificial Sequence
  Description of Artificial Sequence: Synthetic oligonucleotide
ggtatatcacacagacctggcgacaggatg

SEQ ID NO: 303228 - DNA, 30 bp, Artificial Sequence
  Description of Artificial Sequence: Synthetic oligonucleotide
gtatatcacacagacctggcgacaggatgg

SEQ ID NO: 303229 - DNA, 30 bp, Artificial Sequence
  Description of Artificial Sequence: Synthetic oligonucleotide
tatatcacacagacctggcgacaggatggg

SEQ ID NO: 303230 - DNA, 29 bp, Artificial Sequence
  Description of Artificial Sequence: Synthetic oligonucleotide
atatcacacagacctggcgacaggatggg

SEQ ID NO: 303231 - DNA, 28 bp, Artificial Sequence
  Description of Artificial Sequence: Synthetic oligonucleotide
tatcacacagacctggcgacaggatggg

SEQ ID NO: 303232 - DNA, 27 bp, Artificial Sequence
  Description of Artificial Sequence: Synthetic oligonucleotide
atcacacagacctggcgacaggatggg

SEQ ID NO: 303233 - DNA, 26 bp, Artificial Sequence
  Description of Artificial Sequence: Synthetic oligonucleotide
tcacacagacctggcgacaggatggg

SEQ ID NO: 303234 - DNA, 25 bp, Artificial Sequence
  Description of Artificial Sequence: Synthetic oligonucleotide
cacacagacctggcgacaggatggg

SEQ ID NO: 303235 - DNA, 27 bp, Artificial Sequence
  Description of Artificial Sequence: Synthetic oligonucleotide
acacagacctggcgacaggatgggcta

SEQ ID NO: 303236 - DNA, 27 bp, Artificial Sequence
  Description of Artificial Sequence: Synthetic oligonucleotide
cacagacctggcgacaggatgggctat

SEQ ID NO: 303237 - DNA, 30 bp, Artificial Sequence
  Description of Artificial Sequence: Synthetic oligonucleotide
cgacaggatgggctatctttgacccacaac

SEQ ID NO: 303238 - DNA, 31 bp, Artificial Sequence
  Description of Artificial Sequence: Synthetic oligonucleotide
gacaggatgggctatctttgacccacaacac

SEQ ID NO: 303239 - DNA, 31 bp, Artificial Sequence
  Description of Artificial Sequence: Synthetic oligonucleotide
acaggatgggctatctttgacccacaacacg

SEQ ID NO: 303240 - DNA, 30 bp, Artificial Sequence
  Description of Artificial Sequence: Synthetic oligonucleotide
caggatgggctatctttgacccacaacacg

SEQ ID NO: 303241 - DNA, 30 bp, Artificial Sequence
  Description of Artificial Sequence: Synthetic oligonucleotide
aggatgggctatctttgacccacaacacgc

SEQ ID NO: 303242 - DNA, 29 bp, Artificial Sequence
  Description of Artificial Sequence: Synthetic oligonucleotide
ggatgggctatctttgacccacaacacgc

SEQ ID NO: 303243 - DNA, 30 bp, Artificial Sequence
  Description of Artificial Sequence: Synthetic oligonucleotide
gatgggctatctttgacccacaacacgcag

SEQ ID NO: 303244 - DNA, 30 bp, Artificial Sequence
  Description of Artificial Sequence: Synthetic oligonucleotide
atgggctatctttgacccacaacacgcagc

SEQ ID NO: 303245 - DNA, 29 bp, Artificial Sequence
  Description of Artificial Sequence: Synthetic oligonucleotide
tgggctatctttgacccacaacacgcagc

SEQ ID NO: 303246 - DNA, 28 bp, Artificial Sequence
  Description of Artificial Sequence: Synthetic oligonucleotide
gggctatctttgacccacaacacgcagc

SEQ ID NO: 303247 - DNA, 29 bp, Artificial Sequence
  Description of Artificial Sequence: Synthetic oligonucleotide
ggctatctttgacccacaacacgcagcag

SEQ ID NO: 303248 - DNA, 30 bp, Artificial Sequence
  Description of Artificial Sequence: Synthetic oligonucleotide
gctatctttgacccacaacacgcagcagtg

SEQ ID NO: 303249 - DNA, 30 bp, Artificial Sequence
  Description of Artificial Sequence: Synthetic oligonucleotide
ctatctttgacccacaacacgcagcagtgg

SEQ ID NO: 303250 - DNA, 30 bp, Artificial Sequence
  Description of Artificial Sequence: Synthetic oligonucleotide
tatctttgacccacaacacgcagcagtggc

SEQ ID NO: 303251 - DNA, 29 bp, Artificial Sequence
  Description of Artificial Sequence: Synthetic oligonucleotide
atctttgacccacaacacgcagcagtggc

SEQ ID NO: 303252 - DNA, 28 bp, Artificial Sequence
  Description of Artificial Sequence: Synthetic oligonucleotide
tctttgacccacaacacgcagcagtggc

SEQ ID NO: 303253 - DNA, 27 bp, Artificial Sequence
  Description of Artificial Sequence: Synthetic oligonucleotide
ctttgacccacaacacgcagcagtggc

SEQ ID NO: 303254 - DNA, 27 bp, Artificial Sequence
  Description of Artificial Sequence: Synthetic oligonucleotide
tttgacccacaacacgcagcagtggcg

SEQ ID NO: 303255 - DNA, 26 bp, Artificial Sequence
  Description of Artificial Sequence: Synthetic oligonucleotide
ttgacccacaacacgcagcagtggcg

SEQ ID NO: 303256 - DNA, 25 bp, Artificial Sequence
  Description of Artificial Sequence: Synthetic oligonucleotide
tgacccacaacacgcagcagtggcg

SEQ ID NO: 303257 - DNA, 24 bp, Artificial Sequence
  Description of Artificial Sequence: Synthetic oligonucleotide
gacccacaacacgcagcagtggcg

SEQ ID NO: 303258 - DNA, 24 bp, Artificial Sequence
  Description of Artificial Sequence: Synthetic oligonucleotide
acccacaacacgcagcagtggcgg

SEQ ID NO: 303259 - DNA, 23 bp, Artificial Sequence
  Description of Artificial Sequence: Synthetic oligonucleotide
cccacaacacgcagcagtggcgg

SEQ ID NO: 303260 - DNA, 25 bp, Artificial Sequence
  Description of Artificial Sequence: Synthetic oligonucleotide
ccacaacacgcagcagtggcgggat

SEQ ID NO: 303261 - DNA, 26 bp, Artificial Sequence
  Description of Artificial Sequence: Synthetic oligonucleotide
cacaacacgcagcagtggcgggatgt

SEQ ID NO: 303262 - DNA, 26 bp, Artificial Sequence
  Description of Artificial Sequence: Synthetic oligonucleotide
acaacacgcagcagtggcgggatgtc

SEQ ID NO: 303263 - DNA, 25 bp, Artificial Sequence
  Description of Artificial Sequence: Synthetic oligonucleotide
caacacgcagcagtggcgggatgtc

SEQ ID NO: 303264 - DNA, 26 bp, Artificial Sequence
  Description of Artificial Sequence: Synthetic oligonucleotide
aacacgcagcagtggcgggatgtcca

SEQ ID NO: 303265 - DNA, 26 bp, Artificial Sequence
  Description of Artificial Sequence: Synthetic oligonucleotide
accagacctcggtggccacgaggatt

SEQ ID NO: 303266 - DNA, 25 bp, Artificial Sequence
  Description of Artificial Sequence: Synthetic oligonucleotide
ccagacctcggtggccacgaggatt

SEQ ID NO: 303267 - DNA, 25 bp, Artificial Sequence
  Description of Artificial Sequence: Synthetic oligonucleotide
cagacctcggtggccacgaggattc

SEQ ID NO: 303268 - DNA, 25 bp, Artificial Sequence
  Description of Artificial Sequence: Synthetic oligonucleotide
agacctcggtggccacgaggattcg

SEQ ID NO: 303269 - DNA, 24 bp, Artificial Sequence
  Description of Artificial Sequence: Synthetic oligonucleotide
gacctcggtggccacgaggattcg

SEQ ID NO: 303270 - DNA, 24 bp, Artificial Sequence
  Description of Artificial Sequence: Synthetic oligonucleotide
acctcggtggccacgaggattcgc

SEQ ID NO: 303271 - DNA, 23 bp, Artificial Sequence
  Description of Artificial Sequence: Synthetic oligonucleotide
cctcggtggccacgaggattcgc

SEQ ID NO: 303272 - DNA, 25 bp, Artificial Sequence
  Description of Artificial Sequence: Synthetic oligonucleotide
ctcggtggccacgaggattcgcgaa

SEQ ID NO: 303273 - DNA, 25 bp, Artificial Sequence
  Description of Artificial Sequence: Synthetic oligonucleotide
tcggtggccacgaggattcgcgaag

SEQ ID NO: 303274 - DNA, 24 bp, Artificial Sequence
  Description of Artificial Sequence: Synthetic oligonucleotide
cggtggccacgaggattcgcgaag

SEQ ID NO: 303275 - DNA, 25 bp, Artificial Sequence
  Description of Artificial Sequence: Synthetic oligonucleotide
ggtggccacgaggattcgcgaagga

SEQ ID NO: 303276 - DNA, 26 bp, Artificial Sequence
  Description of Artificial Sequence: Synthetic oligonucleotide
gtggccacgaggattcgcgaaggaga

SEQ ID NO: 303277 - DNA, 26 bp, Artificial Sequence
  Description of Artificial Sequence: Synthetic oligonucleotide
tggccacgaggattcgcgaaggagag

SEQ ID NO: 303278 - DNA, 25 bp, Artificial Sequence
  Description of Artificial Sequence: Synthetic oligonucleotide
ggccacgaggattcgcgaaggagag

SEQ ID NO: 303279 - DNA, 26 bp, Artificial Sequence
  Description of Artificial Sequence: Synthetic oligonucleotide
gccacgaggattcgcgaaggagaggt

SEQ ID NO: 303280 - DNA, 26 bp, Artificial Sequence
  Description of Artificial Sequence: Synthetic oligonucleotide
ccacgaggattcgcgaaggagaggtg

SEQ ID NO: 303281 - DNA, 27 bp, Artificial Sequence
  Description of Artificial Sequence: Synthetic oligonucleotide
cacgaggattcgcgaaggagaggtgca

SEQ ID NO: 303282 - DNA, 27 bp, Artificial Sequence
  Description of Artificial Sequence: Synthetic oligonucleotide
acgaggattcgcgaaggagaggtgcag

SEQ ID NO: 303283 - DNA, 27 bp, Artificial Sequence
  Description of Artificial Sequence: Synthetic oligonucleotide
cgaggattcgcgaaggagaggtgcaga

SEQ ID NO: 303284 - DNA, 27 bp, Artificial Sequence
  Description of Artificial Sequence: Synthetic oligonucleotide
gaggattcgcgaaggagaggtgcagag

SEQ ID NO: 303285 - DNA, 27 bp, Artificial Sequence
  Description of Artificial Sequence: Synthetic oligonucleotide
aggattcgcgaaggagaggtgcagagg

SEQ ID NO: 303286 - DNA, 27 bp, Artificial Sequence
  Description of Artificial Sequence: Synthetic oligonucleotide
ggattcgcgaaggagaggtgcagaggt

SEQ ID NO: 303287 - DNA, 28 bp, Artificial Sequence
  Description of Artificial Sequence: Synthetic oligonucleotide
gattcgcgaaggagaggtgcagaggttg

SEQ ID NO: 303288 - DNA, 29 bp, Artificial Sequence
  Description of Artificial Sequence: Synthetic oligonucleotide
attcgcgaaggagaggtgcagaggttgac

SEQ ID NO: 303289 - DNA, 28 bp, Artificial Sequence
  Description of Artificial Sequence: Synthetic oligonucleotide
ttcgcgaaggagaggtgcagaggttgac

SEQ ID NO: 303290 - DNA, 27 bp, Artificial Sequence
  Description of Artificial Sequence: Synthetic oligonucleotide
tcgcgaaggagaggtgcagaggttgac

SEQ ID NO: 303291 - DNA, 26 bp, Artificial Sequence
  Description of Artificial Sequence: Synthetic oligonucleotide
cgcgaaggagaggtgcagaggttgac

SEQ ID NO: 303292 - DNA, 27 bp, Artificial Sequence
  Description of Artificial Sequence: Synthetic oligonucleotide
gcgaaggagaggtgcagaggttgacct

SEQ ID NO: 303293 - DNA, 27 bp, Artificial Sequence
  Description of Artificial Sequence: Synthetic oligonucleotide
cgaaggagaggtgcagaggttgacctg

SEQ ID NO: 303294 - DNA, 27 bp, Artificial Sequence
  Description of Artificial Sequence: Synthetic oligonucleotide
gaaggagaggtgcagaggttgacctgc

SEQ ID NO: 303295 - DNA, 29 bp, Artificial Sequence
  Description of Artificial Sequence: Synthetic oligonucleotide
aaggagaggtgcagaggttgacctgctac

SEQ ID NO: 303296 - DNA, 28 bp, Artificial Sequence
  Description of Artificial Sequence: Synthetic oligonucleotide
aggagaggtgcagaggttgacctgctac

SEQ ID NO: 303297 - DNA, 27 bp, Artificial Sequence
  Description of Artificial Sequence: Synthetic oligonucleotide
ggagaggtgcagaggttgacctgctac

SEQ ID NO: 303298 - DNA, 29 bp, Artificial Sequence
  Description of Artificial Sequence: Synthetic oligonucleotide
gagaggtgcagaggttgacctgctacttg

SEQ ID NO: 303299 - DNA, 29 bp, Artificial Sequence
  Description of Artificial Sequence: Synthetic oligonucleotide
agaggtgcagaggttgacctgctacttgg

SEQ ID NO: 303300 - DNA, 28 bp, Artificial Sequence
  Description of Artificial Sequence: Synthetic oligonucleotide
gaggtgcagaggttgacctgctacttgg

SEQ ID NO: 303301 - DNA, 30 bp, Artificial Sequence
  Description of Artificial Sequence: Synthetic oligonucleotide
aggtgcagaggttgacctgctacttggaac

SEQ ID NO: 303302 - DNA, 29 bp, Artificial Sequence
  Description of Artificial Sequence: Synthetic oligonucleotide
ggtgcagaggttgacctgctacttggaac

SEQ ID NO: 303303 - DNA, 30 bp, Artificial Sequence
  Description of Artificial Sequence: Synthetic oligonucleotide
gtgcagaggttgacctgctacttggaacac

SEQ ID NO: 303304 - DNA, 31 bp, Artificial Sequence
  Description of Artificial Sequence: Synthetic oligonucleotide
tgcagaggttgacctgctacttggaacacac

SEQ ID NO: 303305 - DNA, 30 bp, Artificial Sequence
  Description of Artificial Sequence: Synthetic oligonucleotide
gcagaggttgacctgctacttggaacacac

SEQ ID NO: 303306 - DNA, 30 bp, Artificial Sequence
  Description of Artificial Sequence: Synthetic oligonucleotide
cagaggttgacctgctacttggaacacacc

SEQ ID NO: 303307 - DNA, 30 bp, Artificial Sequence
  Description of Artificial Sequence: Synthetic oligonucleotide
agaggttgacctgctacttggaacacaccg

SEQ ID NO: 303308 - DNA, 29 bp, Artificial Sequence
  Description of Artificial Sequence: Synthetic oligonucleotide
gaggttgacctgctacttggaacacaccg

SEQ ID NO: 303309 - DNA, 29 bp, Artificial Sequence
  Description of Artificial Sequence: Synthetic oligonucleotide
aggttgacctgctacttggaacacaccgg

SEQ ID NO: 303310 - DNA, 28 bp, Artificial Sequence
  Description of Artificial Sequence: Synthetic oligonucleotide
ggttgacctgctacttggaacacaccgg

SEQ ID NO: 303311 - DNA, 28 bp, Artificial Sequence
  Description of Artificial Sequence: Synthetic oligonucleotide
gttgacctgctacttggaacacaccggg

SEQ ID NO: 303312 - DNA, 31 bp, Artificial Sequence
  Description of Artificial Sequence: Synthetic oligonucleotide
ttgacctgctacttggaacacaccgggaatc

SEQ ID NO: 303313 - DNA, 30 bp, Artificial Sequence
  Description of Artificial Sequence: Synthetic oligonucleotide
tgacctgctacttggaacacaccgggaatc

SEQ ID NO: 303314 - DNA, 29 bp, Artificial Sequence
  Description of Artificial Sequence: Synthetic oligonucleotide
gacctgctacttggaacacaccgggaatc

SEQ ID NO: 303315 - DNA, 30 bp, Artificial Sequence
  Description of Artificial Sequence: Synthetic oligonucleotide
acctgctacttggaacacaccgggaatcag

SEQ ID NO: 303316 - DNA, 29 bp, Artificial Sequence
  Description of Artificial Sequence: Synthetic oligonucleotide
cctgctacttggaacacaccgggaatcag

SEQ ID NO: 303317 - DNA, 29 bp, Artificial Sequence
  Description of Artificial Sequence: Synthetic oligonucleotide
ctgctacttggaacacaccgggaatcagg

SEQ ID NO: 303318 - DNA, 29 bp, Artificial Sequence
  Description of Artificial Sequence: Synthetic oligonucleotide
tgctacttggaacacaccgggaatcaggg

SEQ ID NO: 303319 - DNA, 28 bp, Artificial Sequence
  Description of Artificial Sequence: Synthetic oligonucleotide
gctacttggaacacaccgggaatcaggg

SEQ ID NO: 303320 - DNA, 28 bp, Artificial Sequence
  Description of Artificial Sequence: Synthetic oligonucleotide
ctacttggaacacaccgggaatcagggc

SEQ ID NO: 303321 - DNA, 29 bp, Artificial Sequence
  Description of Artificial Sequence: Synthetic oligonucleotide
tacttggaacacaccgggaatcagggcac

SEQ ID NO: 303322 - DNA, 28 bp, Artificial Sequence
  Description of Artificial Sequence: Synthetic oligonucleotide
acttggaacacaccgggaatcagggcac

SEQ ID NO: 303323 - DNA, 27 bp, Artificial Sequence
  Description of Artificial Sequence: Synthetic oligonucleotide
cttggaacacaccgggaatcagggcac

SEQ ID NO: 303324 - DNA, 28 bp, Artificial Sequence
  Description of Artificial Sequence: Synthetic oligonucleotide
ttggaacacaccgggaatcagggcactc

SEQ ID NO: 303325 - DNA, 27 bp, Artificial Sequence
  Description of Artificial Sequence: Synthetic oligonucleotide
tggaacacaccgggaatcagggcactc

SEQ ID NO: 303326 - DNA, 27 bp, Artificial Sequence
  Description of Artificial Sequence: Synthetic oligonucleotide
ggaacacaccgggaatcagggcactca

SEQ ID NO: 303327 - DNA, 27 bp, Artificial Sequence
  Description of Artificial Sequence: Synthetic oligonucleotide
gaacacaccgggaatcagggcactcac

SEQ ID NO: 303328 - DNA, 27 bp, Artificial Sequence
  Description of Artificial Sequence: Synthetic oligonucleotide
aacacaccgggaatcagggcactcacg

SEQ ID NO: 303329 - DNA, 26 bp, Artificial Sequence
  Description of Artificial Sequence: Synthetic oligonucleotide
acacaccgggaatcagggcactcacg

SEQ ID NO: 303330 - DNA, 25 bp, Artificial Sequence
  Description of Artificial Sequence: Synthetic oligonucleotide
cacaccgggaatcagggcactcacg

SEQ ID NO: 303331 - DNA, 26 bp, Artificial Sequence
  Description of Artificial Sequence: Synthetic oligonucleotide
acaccgggaatcagggcactcacgct

SEQ ID NO: 303332 - DNA, 25 bp, Artificial Sequence
  Description of Artificial Sequence: Synthetic oligonucleotide
caccgggaatcagggcactcacgct

SEQ ID NO: 303333 - DNA, 26 bp, Artificial Sequence
  Description of Artificial Sequence: Synthetic oligonucleotide
accgggaatcagggcactcacgctgt

SEQ ID NO: 303334 - DNA, 25 bp, Artificial Sequence
  Description of Artificial Sequence: Synthetic oligonucleotide
ccgggaatcagggcactcacgctgt

SEQ ID NO: 303335 - DNA, 25 bp, Artificial Sequence
  Description of Artificial Sequence: Synthetic oligonucleotide
cgggaatcagggcactcacgctgtg

SEQ ID NO: 303336 - DNA, 25 bp, Artificial Sequence
  Description of Artificial Sequence: Synthetic oligonucleotide
gggaatcagggcactcacgctgtgc

SEQ ID NO: 303337 - DNA, 25 bp, Artificial Sequence
  Description of Artificial Sequence: Synthetic oligonucleotide
ggaatcagggcactcacgctgtgcc

SEQ ID NO: 303338 - DNA, 26 bp, Artificial Sequence
  Description of Artificial Sequence: Synthetic oligonucleotide
gaatcagggcactcacgctgtgccct

SEQ ID NO: 303339 - DNA, 27 bp, Artificial Sequence
  Description of Artificial Sequence: Synthetic oligonucleotide
aatcagggcactcacgctgtgccctgt

SEQ ID NO: 303340 - DNA, 26 bp, Artificial Sequence
  Description of Artificial Sequence: Synthetic oligonucleotide
atcagggcactcacgctgtgccctgt

SEQ ID NO: 303341 - DNA, 25 bp, Artificial Sequence
  Description of Artificial Sequence: Synthetic oligonucleotide
tcagggcactcacgctgtgccctgt

SEQ ID NO: 303342 - DNA, 24 bp, Artificial Sequence
  Description of Artificial Sequence: Synthetic oligonucleotide
cagggcactcacgctgtgccctgt

SEQ ID NO: 303343 - DNA, 24 bp, Artificial Sequence
  Description of Artificial Sequence: Synthetic oligonucleotide
agggcactcacgctgtgccctgtg

SEQ ID NO: 303344 - DNA, 23 bp, Artificial Sequence
  Description of Artificial Sequence: Synthetic oligonucleotide
gggcactcacgctgtgccctgtg

SEQ ID NO: 303345 - DNA, 23 bp, Artificial Sequence
  Description of Artificial Sequence: Synthetic oligonucleotide
ggcactcacgctgtgccctgtgg

SEQ ID NO: 303346 - DNA, 25 bp, Artificial Sequence
  Description of Artificial Sequence: Synthetic oligonucleotide
gcactcacgctgtgccctgtgggaa

SEQ ID NO: 303347 - DNA, 25 bp, Artificial Sequence
  Description of Artificial Sequence: Synthetic oligonucleotide
cactcacgctgtgccctgtgggaag

SEQ ID NO: 303348 - DNA, 25 bp, Artificial Sequence
  Description of Artificial Sequence: Synthetic oligonucleotide
actcacgctgtgccctgtgggaagg

SEQ ID NO: 303349 - DNA, 24 bp, Artificial Sequence
  Description of Artificial Sequence: Synthetic oligonucleotide
ctcacgctgtgccctgtgggaagg

SEQ ID NO: 303350 - DNA, 24 bp, Artificial Sequence
  Description of Artificial Sequence: Synthetic oligonucleotide
tcacgctgtgccctgtgggaaggc

SEQ ID NO: 303351 - DNA, 23 bp, Artificial Sequence
  Description of Artificial Sequence: Synthetic oligonucleotide
cacgctgtgccctgtgggaaggc

SEQ ID NO: 303352 - DNA, 23 bp, Artificial Sequence
  Description of Artificial Sequence: Synthetic oligonucleotide
acgctgtgccctgtgggaaggcc

SEQ ID NO: 303353 - DNA, 22 bp, Artificial Sequence
  Description of Artificial Sequence: Synthetic oligonucleotide
cgctgtgccctgtgggaaggcc

SEQ ID NO: 303354 - DNA, 23 bp, Artificial Sequence
  Description of Artificial Sequence: Synthetic oligonucleotide
gctgtgccctgtgggaaggccct

SEQ ID NO: 303355 - DNA, 23 bp, Artificial Sequence
  Description of Artificial Sequence: Synthetic oligonucleotide
ctgtgccctgtgggaaggccctg

SEQ ID NO: 303356 - DNA, 24 bp, Artificial Sequence
  Description of Artificial Sequence: Synthetic oligonucleotide
tgtgccctgtgggaaggccctggt

SEQ ID NO: 303357 - DNA, 23 bp, Artificial Sequence
  Description of Artificial Sequence: Synthetic oligonucleotide
gtgccctgtgggaaggccctggt

SEQ ID NO: 303358 - DNA, 23 bp, Artificial Sequence
  Description of Artificial Sequence: Synthetic oligonucleotide
tgccctgtgggaaggccctggtg

SEQ ID NO: 303359 - DNA, 22 bp, Artificial Sequence
  Description of Artificial Sequence: Synthetic oligonucleotide
gccctgtgggaaggccctggtg

SEQ ID NO: 303360 - DNA, 24 bp, Artificial Sequence
  Description of Artificial Sequence: Synthetic oligonucleotide
ccctgtgggaaggccctggtgctt

SEQ ID NO: 303361 - DNA, 25 bp, Artificial Sequence
  Description of Artificial Sequence: Synthetic oligonucleotide
cctgtgggaaggccctggtgcttga

SEQ ID NO: 303362 - DNA, 26 bp, Artificial Sequence
  Description of Artificial Sequence: Synthetic oligonucleotide
ctgtgggaaggccctggtgcttgaga

SEQ ID NO: 303363 - DNA, 27 bp, Artificial Sequence
  Description of Artificial Sequence: Synthetic oligonucleotide
tgtgggaaggccctggtgcttgagagt

SEQ ID NO: 303364 - DNA, 26 bp, Artificial Sequence
  Description of Artificial Sequence: Synthetic oligonucleotide
gtgggaaggccctggtgcttgagagt

SEQ ID NO: 303365 - DNA, 27 bp, Artificial Sequence
  Description of Artificial Sequence: Synthetic oligonucleotide
tgggaaggccctggtgcttgagagtca

SEQ ID NO: 303366 - DNA, 27 bp, Artificial Sequence
  Description of Artificial Sequence: Synthetic oligonucleotide
gggaaggccctggtgcttgagagtcaa

SEQ ID NO: 303367 - DNA, 27 bp, Artificial Sequence
  Description of Artificial Sequence: Synthetic oligonucleotide
ggaaggccctggtgcttgagagtcaac

SEQ ID NO: 303368 - DNA, 27 bp, Artificial Sequence
  Description of Artificial Sequence: Synthetic oligonucleotide
gaaggccctggtgcttgagagtcaacc

SEQ ID NO: 303369 - DNA, 27 bp, Artificial Sequence
  Description of Artificial Sequence: Synthetic oligonucleotide
aaggccctggtgcttgagagtcaaccg

SEQ ID NO: 303370 - DNA, 27 bp, Artificial Sequence
  Description of Artificial Sequence: Synthetic oligonucleotide
aggccctggtgcttgagagtcaaccga

SEQ ID NO: 303371 - DNA, 26 bp, Artificial Sequence
  Description of Artificial Sequence: Synthetic oligonucleotide
ggccctggtgcttgagagtcaaccga

SEQ ID NO: 303372 - DNA, 27 bp, Artificial Sequence
  Description of Artificial Sequence: Synthetic oligonucleotide
gccctggtgcttgagagtcaaccgaca

SEQ ID NO: 303373 - DNA, 27 bp, Artificial Sequence
  Description of Artificial Sequence: Synthetic oligonucleotide
ccctggtgcttgagagtcaaccgacag

SEQ ID NO: 303374 - DNA, 28 bp, Artificial Sequence
  Description of Artificial Sequence: Synthetic oligonucleotide
cctggtgcttgagagtcaaccgacagac

SEQ ID NO: 303375 - DNA, 31 bp, Artificial Sequence
  Description of Artificial Sequence: Synthetic oligonucleotide
ctggtgcttgagagtcaaccgacagacttac

SEQ ID NO: 303376 - DNA, 31 bp, Artificial Sequence
  Description of Artificial Sequence: Synthetic oligonucleotide
tggtgcttgagagtcaaccgacagacttacc

SEQ ID NO: 303377 - DNA, 30 bp, Artificial Sequence
  Description of Artificial Sequence: Synthetic oligonucleotide
ggtgcttgagagtcaaccgacagacttacc

SEQ ID NO: 303378 - DNA, 34 bp, Artificial Sequence
  Description of Artificial Sequence: Synthetic oligonucleotide
gtgcttgagagtcaaccgacagacttaccatatg

SEQ ID NO: 303379 - DNA, 37 bp, Artificial Sequence
  Description of Artificial Sequence: Synthetic oligonucleotide
tgcttgagagtcaaccgacagacttaccatatgttac

SEQ ID NO: 303380 - DNA, 36 bp, Artificial Sequence
  Description of Artificial Sequence: Synthetic oligonucleotide
gcttgagagtcaaccgacagacttaccatatgttac

SEQ ID NO: 303381 - DNA, 37 bp, Artificial Sequence
  Description of Artificial Sequence: Synthetic oligonucleotide
cttgagagtcaaccgacagacttaccatatgttactg

SEQ ID NO: 303382 - DNA, 37 bp, Artificial Sequence
  Description of Artificial Sequence: Synthetic oligonucleotide
ttgagagtcaaccgacagacttaccatatgttactgc

SEQ ID NO: 303383 - DNA, 36 bp, Artificial Sequence
  Description of Artificial Sequence: Synthetic oligonucleotide
tgagagtcaaccgacagacttaccatatgttactgc

SEQ ID NO: 303384 - DNA, 35 bp, Artificial Sequence
  Description of Artificial Sequence: Synthetic oligonucleotide
gagagtcaaccgacagacttaccatatgttactgc

SEQ ID NO: 303385 - DNA, 36 bp, Artificial Sequence
  Description of Artificial Sequence: Synthetic oligonucleotide
agagtcaaccgacagacttaccatatgttactgctg

SEQ ID NO: 303386 - DNA, 35 bp, Artificial Sequence
  Description of Artificial Sequence: Synthetic oligonucleotide
gagtcaaccgacagacttaccatatgttactgctg

SEQ ID NO: 303387 - DNA, 35 bp, Artificial Sequence
  Description of Artificial Sequence: Synthetic oligonucleotide
agtcaaccgacagacttaccatatgttactgctgc

SEQ ID NO: 303388 - DNA, 34 bp, Artificial Sequence
  Description of Artificial Sequence: Synthetic oligonucleotide
gtcaaccgacagacttaccatatgttactgctgc

SEQ ID NO: 303389 - DNA, 37 bp, Artificial Sequence
  Description of Artificial Sequence: Synthetic oligonucleotide
tcaaccgacagacttaccatatgttactgctgctaag

SEQ ID NO: 303390 - DNA, 36 bp, Artificial Sequence
  Description of Artificial Sequence: Synthetic oligonucleotide
caaccgacagacttaccatatgttactgctgctaag

SEQ ID NO: 303391 - DNA, 36 bp, Artificial Sequence
  Description of Artificial Sequence: Synthetic oligonucleotide
aaccgacagacttaccatatgttactgctgctaagc

SEQ ID NO: 303392 - DNA, 35 bp, Artificial Sequence
  Description of Artificial Sequence: Synthetic oligonucleotide
accgacagacttaccatatgttactgctgctaagc

SEQ ID NO: 303393 - DNA, 34 bp, Artificial Sequence
  Description of Artificial Sequence: Synthetic oligonucleotide
ccgacagacttaccatatgttactgctgctaagc

SEQ ID NO: 303394 - DNA, 34 bp, Artificial Sequence
  Description of Artificial Sequence: Synthetic oligonucleotide
cgacagacttaccatatgttactgctgctaagcc

SEQ ID NO: 303395 - DNA, 36 bp, Artificial Sequence
  Description of Artificial Sequence: Synthetic oligonucleotide
gacagacttaccatatgttactgctgctaagccatg

SEQ ID NO: 303396 - DNA, 40 bp, Artificial Sequence
  Description of Artificial Sequence: Synthetic oligonucleotide
acagacttaccatatgttactgctgctaagccatgtttag

SEQ ID NO: 303397 - DNA, 39 bp, Artificial Sequence
  Description of Artificial Sequence: Synthetic oligonucleotide
cagacttaccatatgttactgctgctaagccatgtttag

SEQ ID NO: 303398 - DNA, 53 bp, Artificial Sequence
  Description of Artificial Sequence: Synthetic oligonucleotide
agacttaccatatgttactgctgctaagccatgtttagttattatttttattc

SEQ ID NO: 303399 - DNA, 52 bp, Artificial Sequence
  Description of Artificial Sequence: Synthetic oligonucleotide
gacttaccatatgttactgctgctaagccatgtttagttattatttttattc

SEQ ID NO: 303400 - DNA, 53 bp, Artificial Sequence
  Description of Artificial Sequence: Synthetic oligonucleotide
acttaccatatgttactgctgctaagccatgtttagttattatttttattctc

SEQ ID NO: 303401 - DNA, 52 bp, Artificial Sequence
  Description of Artificial Sequence: Synthetic oligonucleotide
cttaccatatgttactgctgctaagccatgtttagttattatttttattctc

SEQ ID NO: 303402 - DNA, 53 bp, Artificial Sequence
  Description of Artificial Sequence: Synthetic oligonucleotide
ttaccatatgttactgctgctaagccatgtttagttattatttttattctctc

SEQ ID NO: 303403 - DNA, 52 bp, Artificial Sequence
  Description of Artificial Sequence: Synthetic oligonucleotide
taccatatgttactgctgctaagccatgtttagttattatttttattctctc

SEQ ID NO: 303404 - DNA, 51 bp, Artificial Sequence
  Description of Artificial Sequence: Synthetic oligonucleotide
accatatgttactgctgctaagccatgtttagttattatttttattctctc

SEQ ID NO: 303405 - DNA, 50 bp, Artificial Sequence
  Description of Artificial Sequence: Synthetic oligonucleotide
ccatatgttactgctgctaagccatgtttagttattatttttattctctc

SEQ ID NO: 303406 - DNA, 51 bp, Artificial Sequence
  Description of Artificial Sequence: Synthetic oligonucleotide
catatgttactgctgctaagccatgtttagttattatttttattctctctg

SEQ ID NO: 303407 - DNA, 52 bp, Artificial Sequence
  Description of Artificial Sequence: Synthetic oligonucleotide
atatgttactgctgctaagccatgtttagttattatttttattctctctgtc

SEQ ID NO: 303408 - DNA, 51 bp, Artificial Sequence
  Description of Artificial Sequence: Synthetic oligonucleotide
tatgttactgctgctaagccatgtttagttattatttttattctctctgtc

SEQ ID NO: 303409 - DNA, 50 bp, Artificial Sequence
  Description of Artificial Sequence: Synthetic oligonucleotide
atgttactgctgctaagccatgtttagttattatttttattctctctgtc

SEQ ID NO: 303410 - DNA, 49 bp, Artificial Sequence
  Description of Artificial Sequence: Synthetic oligonucleotide
tgttactgctgctaagccatgtttagttattatttttattctctctgtc

SEQ ID NO: 303411 - DNA, 48 bp, Artificial Sequence
  Description of Artificial Sequence: Synthetic oligonucleotide
gttactgctgctaagccatgtttagttattatttttattctctctgtc

SEQ ID NO: 303412 - DNA, 48 bp, Artificial Sequence
  Description of Artificial Sequence: Synthetic oligonucleotide
ttactgctgctaagccatgtttagttattatttttattctctctgtcc

SEQ ID NO: 303413 - DNA, 47 bp, Artificial Sequence
  Description of Artificial Sequence: Synthetic oligonucleotide
tactgctgctaagccatgtttagttattatttttattctctctgtcc

SEQ ID NO: 303414 - DNA, 46 bp, Artificial Sequence
  Description of Artificial Sequence: Synthetic oligonucleotide
actgctgctaagccatgtttagttattatttttattctctctgtcc

SEQ ID NO: 303415 - DNA, 45 bp, Artificial Sequence
  Description of Artificial Sequence: Synthetic oligonucleotide
ctgctgctaagccatgtttagttattatttttattctctctgtcc

SEQ ID NO: 303416 - DNA, 45 bp, Artificial Sequence
  Description of Artificial Sequence: Synthetic oligonucleotide
tgctgctaagccatgtttagttattatttttattctctctgtccc

SEQ ID NO: 303417 - DNA, 44 bp, Artificial Sequence
  Description of Artificial Sequence: Synthetic oligonucleotide
gctgctaagccatgtttagttattatttttattctctctgtccc

SEQ ID NO: 303418 - DNA, 46 bp, Artificial Sequence
  Description of Artificial Sequence: Synthetic oligonucleotide
ctgctaagccatgtttagttattatttttattctctctgtcccttg

SEQ ID NO: 303419 - DNA, 48 bp, Artificial Sequence
  Description of Artificial Sequence: Synthetic oligonucleotide
tgctaagccatgtttagttattatttttattctctctgtcccttgatg

SEQ ID NO: 303420 - DNA, 47 bp, Artificial Sequence
  Description of Artificial Sequence: Synthetic oligonucleotide
gctaagccatgtttagttattatttttattctctctgtcccttgatg

SEQ ID NO: 303421 - DNA, 47 bp, Artificial Sequence
  Description of Artificial Sequence: Synthetic oligonucleotide
ctaagccatgtttagttattatttttattctctctgtcccttgatgc

SEQ ID NO: 303422 - DNA, 49 bp, Artificial Sequence
  Description of Artificial Sequence: Synthetic oligonucleotide
taagccatgtttagttattatttttattctctctgtcccttgatgcaag

SEQ ID NO: 303423 - DNA, 48 bp, Artificial Sequence
  Description of Artificial Sequence: Synthetic oligonucleotide
aagccatgtttagttattatttttattctctctgtcccttgatgcaag

SEQ ID NO: 303424 - DNA, 47 bp, Artificial Sequence
  Description of Artificial Sequence: Synthetic oligonucleotide
agccatgtttagttattatttttattctctctgtcccttgatgcaag

SEQ ID NO: 303425 - DNA, 46 bp, Artificial Sequence
  Description of Artificial Sequence: Synthetic oligonucleotide
gccatgtttagttattatttttattctctctgtcccttgatgcaag

SEQ ID NO: 303426 - DNA, 48 bp, Artificial Sequence
  Description of Artificial Sequence: Synthetic oligonucleotide
ccatgtttagttattatttttattctctctgtcccttgatgcaagaag

SEQ ID NO: 303427 - DNA, 52 bp, Artificial Sequence
  Description of Artificial Sequence: Synthetic oligonucleotide
catgtttagttattatttttattctctctgtcccttgatgcaagaagtaaac

SEQ ID NO: 303428 - DNA, 54 bp, Artificial Sequence
  Description of Artificial Sequence: Synthetic oligonucleotide
atgtttagttattatttttattctctctgtcccttgatgcaagaagtaaacatc

SEQ ID NO: 303429 - DNA, 53 bp, Artificial Sequence
  Description of Artificial Sequence: Synthetic oligonucleotide
tgtttagttattatttttattctctctgtcccttgatgcaagaagtaaacatc

SEQ ID NO: 303430 - DNA, 52 bp, Artificial Sequence
  Description of Artificial Sequence: Synthetic oligonucleotide
gtttagttattatttttattctctctgtcccttgatgcaagaagtaaacatc

SEQ ID NO: 303431 - DNA, 53 bp, Artificial Sequence
  Description of Artificial Sequence: Synthetic oligonucleotide
tttagttattatttttattctctctgtcccttgatgcaagaagtaaacatcag

SEQ ID NO: 303432 - DNA, 52 bp, Artificial Sequence
  Description of Artificial Sequence: Synthetic oligonucleotide
ttagttattatttttattctctctgtcccttgatgcaagaagtaaacatcag

SEQ ID NO: 303433 - DNA, 51 bp, Artificial Sequence
  Description of Artificial Sequence: Synthetic oligonucleotide
tagttattatttttattctctctgtcccttgatgcaagaagtaaacatcag

SEQ ID NO: 303434 - DNA, 50 bp, Artificial Sequence
  Description of Artificial Sequence: Synthetic oligonucleotide
agttattatttttattctctctgtcccttgatgcaagaagtaaacatcag

SEQ ID NO: 303435 - DNA, 49 bp, Artificial Sequence
  Description of Artificial Sequence: Synthetic oligonucleotide
gttattatttttattctctctgtcccttgatgcaagaagtaaacatcag

SEQ ID NO: 303436 - DNA, 49 bp, Artificial Sequence
  Description of Artificial Sequence: Synthetic oligonucleotide
ttattatttttattctctctgtcccttgatgcaagaagtaaacatcagg

SEQ ID NO: 303437 - DNA, 48 bp, Artificial Sequence
  Description of Artificial Sequence: Synthetic oligonucleotide
tattatttttattctctctgtcccttgatgcaagaagtaaacatcagg

SEQ ID NO: 303438 - DNA, 47 bp, Artificial Sequence
  Description of Artificial Sequence: Synthetic oligonucleotide
attatttttattctctctgtcccttgatgcaagaagtaaacatcagg

SEQ ID NO: 303439 - DNA, 46 bp, Artificial Sequence
  Description of Artificial Sequence: Synthetic oligonucleotide
ttatttttattctctctgtcccttgatgcaagaagtaaacatcagg

SEQ ID NO: 303440 - DNA, 45 bp, Artificial Sequence
  Description of Artificial Sequence: Synthetic oligonucleotide
tatttttattctctctgtcccttgatgcaagaagtaaacatcagg

SEQ ID NO: 303441 - DNA, 44 bp, Artificial Sequence
  Description of Artificial Sequence: Synthetic oligonucleotide
atttttattctctctgtcccttgatgcaagaagtaaacatcagg

SEQ ID NO: 303442 - DNA, 43 bp, Artificial Sequence
  Description of Artificial Sequence: Synthetic oligonucleotide
tttttattctctctgtcccttgatgcaagaagtaaacatcagg

SEQ ID NO: 303443 - DNA, 42 bp, Artificial Sequence
  Description of Artificial Sequence: Synthetic oligonucleotide
ttttattctctctgtcccttgatgcaagaagtaaacatcagg

SEQ ID NO: 303444 - DNA, 41 bp, Artificial Sequence
  Description of Artificial Sequence: Synthetic oligonucleotide
tttattctctctgtcccttgatgcaagaagtaaacatcagg

SEQ ID NO: 303445 - DNA, 40 bp, Artificial Sequence
  Description of Artificial Sequence: Synthetic oligonucleotide
ttattctctctgtcccttgatgcaagaagtaaacatcagg

SEQ ID NO: 303446 - DNA, 39 bp, Artificial Sequence
  Description of Artificial Sequence: Synthetic oligonucleotide
tattctctctgtcccttgatgcaagaagtaaacatcagg

SEQ ID NO: 303447 - DNA, 38 bp, Artificial Sequence
  Description of Artificial Sequence: Synthetic oligonucleotide
attctctctgtcccttgatgcaagaagtaaacatcagg

SEQ ID NO: 303448 - DNA, 37 bp, Artificial Sequence
  Description of Artificial Sequence: Synthetic oligonucleotide
ttctctctgtcccttgatgcaagaagtaaacatcagg

SEQ ID NO: 303449 - DNA, 36 bp, Artificial Sequence
  Description of Artificial Sequence: Synthetic oligonucleotide
tctctctgtcccttgatgcaagaagtaaacatcagg

SEQ ID NO: 303450 - DNA, 35 bp, Artificial Sequence
  Description of Artificial Sequence: Synthetic oligonucleotide
ctctctgtcccttgatgcaagaagtaaacatcagg

SEQ ID NO: 303451 - DNA, 35 bp, Artificial Sequence
  Description of Artificial Sequence: Synthetic oligonucleotide
tctctgtcccttgatgcaagaagtaaacatcaggg

SEQ ID NO: 303452 - DNA, 34 bp, Artificial Sequence
  Description of Artificial Sequence: Synthetic oligonucleotide
ctctgtcccttgatgcaagaagtaaacatcaggg

SEQ ID NO: 303453 - DNA, 34 bp, Artificial Sequence
  Description of Artificial Sequence: Synthetic oligonucleotide
tctgtcccttgatgcaagaagtaaacatcagggg

SEQ ID NO: 303454 - DNA, 33 bp, Artificial Sequence
  Description of Artificial Sequence: Synthetic oligonucleotide
ctgtcccttgatgcaagaagtaaacatcagggg

SEQ ID NO: 303455 - DNA, 33 bp, Artificial Sequence
  Description of Artificial Sequence: Synthetic oligonucleotide
tgtcccttgatgcaagaagtaaacatcaggggc

SEQ ID NO: 303456 - DNA, 32 bp, Artificial Sequence
  Description of Artificial Sequence: Synthetic oligonucleotide
gtcccttgatgcaagaagtaaacatcaggggc

SEQ ID NO: 303457 - DNA, 33 bp, Artificial Sequence
  Description of Artificial Sequence: Synthetic oligonucleotide
tcccttgatgcaagaagtaaacatcaggggcag

SEQ ID NO: 303458 - DNA, 32 bp, Artificial Sequence
  Description of Artificial Sequence: Synthetic oligonucleotide
cccttgatgcaagaagtaaacatcaggggcag

SEQ ID NO: 303459 - DNA, 33 bp, Artificial Sequence
  Description of Artificial Sequence: Synthetic oligonucleotide
ccttgatgcaagaagtaaacatcaggggcagag

SEQ ID NO: 303460 - DNA, 33 bp, Artificial Sequence
  Description of Artificial Sequence: Synthetic oligonucleotide
cttgatgcaagaagtaaacatcaggggcagagg

SEQ ID NO: 303461 - DNA, 33 bp, Artificial Sequence
  Description of Artificial Sequence: Synthetic oligonucleotide
ttgatgcaagaagtaaacatcaggggcagaggg

SEQ ID NO: 303462 - DNA, 32 bp, Artificial Sequence
  Description of Artificial Sequence: Synthetic oligonucleotide
tgatgcaagaagtaaacatcaggggcagaggg

SEQ ID NO: 303463 - DNA, 31 bp, Artificial Sequence
  Description of Artificial Sequence: Synthetic oligonucleotide
gatgcaagaagtaaacatcaggggcagaggg

SEQ ID NO: 303464 - DNA, 32 bp, Artificial Sequence
  Description of Artificial Sequence: Synthetic oligonucleotide
atgcaagaagtaaacatcaggggcagagggac

SEQ ID NO: 303465 - DNA, 31 bp, Artificial Sequence
  Description of Artificial Sequence: Synthetic oligonucleotide
tgcaagaagtaaacatcaggggcagagggac

SEQ ID NO: 303466 - DNA, 30 bp, Artificial Sequence
  Description of Artificial Sequence: Synthetic oligonucleotide
gcaagaagtaaacatcaggggcagagggac

SEQ ID NO: 303467 - DNA, 30 bp, Artificial Sequence
  Description of Artificial Sequence: Synthetic oligonucleotide
caagaagtaaacatcaggggcagagggacc

SEQ ID NO: 303468 - DNA, 31 bp, Artificial Sequence
  Description of Artificial Sequence: Synthetic oligonucleotide
aagaagtaaacatcaggggcagagggaccag

SEQ ID NO: 303469 - DNA, 30 bp, Artificial Sequence
  Description of Artificial Sequence: Synthetic oligonucleotide
agaagtaaacatcaggggcagagggaccag

SEQ ID NO: 303470 - DNA, 29 bp, Artificial Sequence
  Description of Artificial Sequence: Synthetic oligonucleotide
gaagtaaacatcaggggcagagggaccag

SEQ ID NO: 303471 - DNA, 30 bp, Artificial Sequence
  Description of Artificial Sequence: Synthetic oligonucleotide
aagtaaacatcaggggcagagggaccagag

SEQ ID NO: 303472 - DNA, 29 bp, Artificial Sequence
  Description of Artificial Sequence: Synthetic oligonucleotide
agtaaacatcaggggcagagggaccagag

SEQ ID NO: 303473 - DNA, 28 bp, Artificial Sequence
  Description of Artificial Sequence: Synthetic oligonucleotide
gtaaacatcaggggcagagggaccagag

SEQ ID NO: 303474 - DNA, 28 bp, Artificial Sequence
  Description of Artificial Sequence: Synthetic oligonucleotide
taaacatcaggggcagagggaccagagc

SEQ ID NO: 303475 - DNA, 27 bp, Artificial Sequence
  Description of Artificial Sequence: Synthetic oligonucleotide
aaacatcaggggcagagggaccagagc

SEQ ID NO: 303476 - DNA, 27 bp, Artificial Sequence
  Description of Artificial Sequence: Synthetic oligonucleotide
aacatcaggggcagagggaccagagct

SEQ ID NO: 303477 - DNA, 27 bp, Artificial Sequence
  Description of Artificial Sequence: Synthetic oligonucleotide
acatcaggggcagagggaccagagctt

SEQ ID NO: 303478 - DNA, 26 bp, Artificial Sequence
  Description of Artificial Sequence: Synthetic oligonucleotide
catcaggggcagagggaccagagctt

SEQ ID NO: 303479 - DNA, 27 bp, Artificial Sequence
  Description of Artificial Sequence: Synthetic oligonucleotide
atcaggggcagagggaccagagcttct

SEQ ID NO: 303480 - DNA, 26 bp, Artificial Sequence
  Description of Artificial Sequence: Synthetic oligonucleotide
tcaggggcagagggaccagagcttct

SEQ ID NO: 303481 - DNA, 25 bp, Artificial Sequence
  Description of Artificial Sequence: Synthetic oligonucleotide
caggggcagagggaccagagcttct

SEQ ID NO: 303482 - DNA, 26 bp, Artificial Sequence
  Description of Artificial Sequence: Synthetic oligonucleotide
aggggcagagggaccagagcttctga

SEQ ID NO: 303483 - DNA, 25 bp, Artificial Sequence
  Description of Artificial Sequence: Synthetic oligonucleotide
ggggcagagggaccagagcttctga

SEQ ID NO: 303484 - DNA, 25 bp, Artificial Sequence
  Description of Artificial Sequence: Synthetic oligonucleotide
gggcagagggaccagagcttctgag

SEQ ID NO: 303485 - DNA, 25 bp, Artificial Sequence
  Description of Artificial Sequence: Synthetic oligonucleotide
ggcagagggaccagagcttctgagc

SEQ ID NO: 303486 - DNA, 26 bp, Artificial Sequence
  Description of Artificial Sequence: Synthetic oligonucleotide
gcagagggaccagagcttctgagcct

SEQ ID NO: 303487 - DNA, 26 bp, Artificial Sequence
  Description of Artificial Sequence: Synthetic oligonucleotide
cagagggaccagagcttctgagcctg

SEQ ID NO: 303488 - DNA, 27 bp, Artificial Sequence
  Description of Artificial Sequence: Synthetic oligonucleotide
agagggaccagagcttctgagcctgct

SEQ ID NO: 303489 - DNA, 26 bp, Artificial Sequence
  Description of Artificial Sequence: Synthetic oligonucleotide
gagggaccagagcttctgagcctgct

SEQ ID NO: 303490 - DNA, 26 bp, Artificial Sequence
  Description of Artificial Sequence: Synthetic oligonucleotide
agggaccagagcttctgagcctgctg

SEQ ID NO: 303491 - DNA, 25 bp, Artificial Sequence
  Description of Artificial Sequence: Synthetic oligonucleotide
gggaccagagcttctgagcctgctg

SEQ ID NO: 303492 - DNA, 26 bp, Artificial Sequence
  Description of Artificial Sequence: Synthetic oligonucleotide
ggaccagagcttctgagcctgctggt

SEQ ID NO: 303493 - DNA, 26 bp, Artificial Sequence
  Description of Artificial Sequence: Synthetic oligonucleotide
gaccagagcttctgagcctgctggtc

SEQ ID NO: 303494 - DNA, 27 bp, Artificial Sequence
  Description of Artificial Sequence: Synthetic oligonucleotide
accagagcttctgagcctgctggtcct

SEQ ID NO: 303495 - DNA, 26 bp, Artificial Sequence
  Description of Artificial Sequence: Synthetic oligonucleotide
ccagagcttctgagcctgctggtcct

SEQ ID NO: 303496 - DNA, 26 bp, Artificial Sequence
  Description of Artificial Sequence: Synthetic oligonucleotide
cagagcttctgagcctgctggtcctg

SEQ ID NO: 303497 - DNA, 27 bp, Artificial Sequence
  Description of Artificial Sequence: Synthetic oligonucleotide
agagcttctgagcctgctggtcctgga

SEQ ID NO: 303498 - DNA, 27 bp, Artificial Sequence
  Description of Artificial Sequence: Synthetic oligonucleotide
gagcttctgagcctgctggtcctggaa

SEQ ID NO: 303499 - DNA, 27 bp, Artificial Sequence
  Description of Artificial Sequence: Synthetic oligonucleotide
agcttctgagcctgctggtcctggaac

SEQ ID NO: 303500 - DNA, 27 bp, Artificial Sequence
  Description of Artificial Sequence: Synthetic oligonucleotide
gcttctgagcctgctggtcctggaaca

SEQ ID NO: 303501 - DNA, 28 bp, Artificial Sequence
  Description of Artificial Sequence: Synthetic oligonucleotide
cttctgagcctgctggtcctggaacaac

SEQ ID NO: 303502 - DNA, 29 bp, Artificial Sequence
  Description of Artificial Sequence: Synthetic oligonucleotide
ttctgagcctgctggtcctggaacaacac

SEQ ID NO: 303503 - DNA, 28 bp, Artificial Sequence
  Description of Artificial Sequence: Synthetic oligonucleotide
tctgagcctgctggtcctggaacaacac

SEQ ID NO: 303504 - DNA, 27 bp, Artificial Sequence
  Description of Artificial Sequence: Synthetic oligonucleotide
ctgagcctgctggtcctggaacaacac

SEQ ID NO: 303505 - DNA, 27 bp, Artificial Sequence
  Description of Artificial Sequence: Synthetic oligonucleotide
tgagcctgctggtcctggaacaacacc

SEQ ID NO: 303506 - DNA, 26 bp, Artificial Sequence
  Description of Artificial Sequence: Synthetic oligonucleotide
gagcctgctggtcctggaacaacacc

SEQ ID NO: 303507 - DNA, 27 bp, Artificial Sequence
  Description of Artificial Sequence: Synthetic oligonucleotide
agcctgctggtcctggaacaacaccca

SEQ ID NO: 303508 - DNA, 26 bp, Artificial Sequence
  Description of Artificial Sequence: Synthetic oligonucleotide
gcctgctggtcctggaacaacaccca

SEQ ID NO: 303509 - DNA, 27 bp, Artificial Sequence
  Description of Artificial Sequence: Synthetic oligonucleotide
cctgctggtcctggaacaacacccact

SEQ ID NO: 303510 - DNA, 28 bp, Artificial Sequence
  Description of Artificial Sequence: Synthetic oligonucleotide
ctgctggtcctggaacaacacccacttg

SEQ ID NO: 303511 - DNA, 28 bp, Artificial Sequence
  Description of Artificial Sequence: Synthetic oligonucleotide
tgctggtcctggaacaacacccacttgg

SEQ ID NO: 303512 - DNA, 27 bp, Artificial Sequence
  Description of Artificial Sequence: Synthetic oligonucleotide
gctggtcctggaacaacacccacttgg

SEQ ID NO: 303513 - DNA, 27 bp, Artificial Sequence
  Description of Artificial Sequence: Synthetic oligonucleotide
ctggtcctggaacaacacccacttggg

SEQ ID NO: 303514 - DNA, 28 bp, Artificial Sequence
  Description of Artificial Sequence: Synthetic oligonucleotide
tggtcctggaacaacacccacttgggac

SEQ ID NO: 303515 - DNA, 27 bp, Artificial Sequence
  Description of Artificial Sequence: Synthetic oligonucleotide
ggtcctggaacaacacccacttgggac

SEQ ID NO: 303516 - DNA, 28 bp, Artificial Sequence
  Description of Artificial Sequence: Synthetic oligonucleotide
gtcctggaacaacacccacttgggacag

SEQ ID NO: 303517 - DNA, 28 bp, Artificial Sequence
  Description of Artificial Sequence: Synthetic oligonucleotide
tcctggaacaacacccacttgggacagc

SEQ ID NO: 303518 - DNA, 27 bp, Artificial Sequence
  Description of Artificial Sequence: Synthetic oligonucleotide
cctggaacaacacccacttgggacagc

SEQ ID NO: 303519 - DNA, 28 bp, Artificial Sequence
  Description of Artificial Sequence: Synthetic oligonucleotide
ctggaacaacacccacttgggacagcag

SEQ ID NO: 303520 - DNA, 29 bp, Artificial Sequence
  Description of Artificial Sequence: Synthetic oligonucleotide
tggaacaacacccacttgggacagcagac

SEQ ID NO: 303521 - DNA, 28 bp, Artificial Sequence
  Description of Artificial Sequence: Synthetic oligonucleotide
ggaacaacacccacttgggacagcagac

SEQ ID NO: 303522 - DNA, 28 bp, Artificial Sequence
  Description of Artificial Sequence: Synthetic oligonucleotide
gaacaacacccacttgggacagcagacc

SEQ ID NO: 303523 - DNA, 29 bp, Artificial Sequence
  Description of Artificial Sequence: Synthetic oligonucleotide
aacaacacccacttgggacagcagaccac

SEQ ID NO: 303524 - DNA, 28 bp, Artificial Sequence
  Description of Artificial Sequence: Synthetic oligonucleotide
acaacacccacttgggacagcagaccac

SEQ ID NO: 303525 - DNA, 27 bp, Artificial Sequence
  Description of Artificial Sequence: Synthetic oligonucleotide
caacacccacttgggacagcagaccac

SEQ ID NO: 303526 - DNA, 28 bp, Artificial Sequence
  Description of Artificial Sequence: Synthetic oligonucleotide
aacacccacttgggacagcagaccacag

SEQ ID NO: 303527 - DNA, 27 bp, Artificial Sequence
  Description of Artificial Sequence: Synthetic oligonucleotide
acacccacttgggacagcagaccacag

SEQ ID NO: 303528 - DNA, 26 bp, Artificial Sequence
  Description of Artificial Sequence: Synthetic oligonucleotide
cacccacttgggacagcagaccacag

SEQ ID NO: 303529 - DNA, 26 bp, Artificial Sequence
  Description of Artificial Sequence: Synthetic oligonucleotide
acccacttgggacagcagaccacagc

SEQ ID NO: 303530 - DNA, 25 bp, Artificial Sequence
  Description of Artificial Sequence: Synthetic oligonucleotide
cccacttgggacagcagaccacagc

SEQ ID NO: 303531 - DNA, 27 bp, Artificial Sequence
  Description of Artificial Sequence: Synthetic oligonucleotide
ccacttgggacagcagaccacagcgat

SEQ ID NO: 303532 - DNA, 27 bp, Artificial Sequence
  Description of Artificial Sequence: Synthetic oligonucleotide
cacttgggacagcagaccacagcgatg

SEQ ID NO: 303533 - DNA, 27 bp, Artificial Sequence
  Description of Artificial Sequence: Synthetic oligonucleotide
acttgggacagcagaccacagcgatgc

SEQ ID NO: 303534 - DNA, 27 bp, Artificial Sequence
  Description of Artificial Sequence: Synthetic oligonucleotide
cttgggacagcagaccacagcgatgca

SEQ ID NO: 303535 - DNA, 27 bp, Artificial Sequence
  Description of Artificial Sequence: Synthetic oligonucleotide
ttgggacagcagaccacagcgatgcag

SEQ ID NO: 303536 - DNA, 26 bp, Artificial Sequence
  Description of Artificial Sequence: Synthetic oligonucleotide
tgggacagcagaccacagcgatgcag

SEQ ID NO: 303537 - DNA, 25 bp, Artificial Sequence
  Description of Artificial Sequence: Synthetic oligonucleotide
gggacagcagaccacagcgatgcag

SEQ ID NO: 303538 - DNA, 26 bp, Artificial Sequence
  Description of Artificial Sequence: Synthetic oligonucleotide
ggacagcagaccacagcgatgcagca

SEQ ID NO: 303539 - DNA, 27 bp, Artificial Sequence
  Description of Artificial Sequence: Synthetic oligonucleotide
gacagcagaccacagcgatgcagcaga

SEQ ID NO: 303540 - DNA, 27 bp, Artificial Sequence
  Description of Artificial Sequence: Synthetic oligonucleotide
acagcagaccacagcgatgcagcagag

SEQ ID NO: 303541 - DNA, 26 bp, Artificial Sequence
  Description of Artificial Sequence: Synthetic oligonucleotide
cagcagaccacagcgatgcagcagag

SEQ ID NO: 303542 - DNA, 27 bp, Artificial Sequence
  Description of Artificial Sequence: Synthetic oligonucleotide
agcagaccacagcgatgcagcagagct

SEQ ID NO: 303543 - DNA, 26 bp, Artificial Sequence
  Description of Artificial Sequence: Synthetic oligonucleotide
gcagaccacagcgatgcagcagagct

SEQ ID NO: 303544 - DNA, 26 bp, Artificial Sequence
  Description of Artificial Sequence: Synthetic oligonucleotide
cagaccacagcgatgcagcagagctg

SEQ ID NO: 303545 - DNA, 26 bp, Artificial Sequence
  Description of Artificial Sequence: Synthetic oligonucleotide
agaccacagcgatgcagcagagctgg

SEQ ID NO: 303546 - DNA, 25 bp, Artificial Sequence
  Description of Artificial Sequence: Synthetic oligonucleotide
gaccacagcgatgcagcagagctgg

SEQ ID NO: 303547 - DNA, 27 bp, Artificial Sequence
  Description of Artificial Sequence: Synthetic oligonucleotide
accacagcgatgcagcagagctgggat

SEQ ID NO: 303548 - DNA, 27 bp, Artificial Sequence
  Description of Artificial Sequence: Synthetic oligonucleotide
ccacagcgatgcagcagagctgggata

SEQ ID NO: 303549 - DNA, 28 bp, Artificial Sequence
  Description of Artificial Sequence: Synthetic oligonucleotide
cacagcgatgcagcagagctgggatatc

SEQ ID NO: 303550 - DNA, 29 bp, Artificial Sequence
  Description of Artificial Sequence: Synthetic oligonucleotide
acagcgatgcagcagagctgggatatcag

SEQ ID NO: 303551 - DNA, 28 bp, Artificial Sequence
  Description of Artificial Sequence: Synthetic oligonucleotide
cagcgatgcagcagagctgggatatcag

SEQ ID NO: 303552 - DNA, 28 bp, Artificial Sequence
  Description of Artificial Sequence: Synthetic oligonucleotide
agcgatgcagcagagctgggatatcagc

SEQ ID NO: 303553 - DNA, 27 bp, Artificial Sequence
  Description of Artificial Sequence: Synthetic oligonucleotide
gcgatgcagcagagctgggatatcagc

SEQ ID NO: 303554 - DNA, 27 bp, Artificial Sequence
  Description of Artificial Sequence: Synthetic oligonucleotide
cgatgcagcagagctgggatatcagcc

SEQ ID NO: 303555 - DNA, 28 bp, Artificial Sequence
  Description of Artificial Sequence: Synthetic oligonucleotide
gatgcagcagagctgggatatcagcctc

SEQ ID NO: 303556 - DNA, 29 bp, Artificial Sequence
  Description of Artificial Sequence: Synthetic oligonucleotide
atgcagcagagctgggatatcagcctctc

SEQ ID NO: 303557 - DNA, 28 bp, Artificial Sequence
  Description of Artificial Sequence: Synthetic oligonucleotide
tgcagcagagctgggatatcagcctctc

SEQ ID NO: 303558 - DNA, 27 bp, Artificial Sequence
  Description of Artificial Sequence: Synthetic oligonucleotide
gcagcagagctgggatatcagcctctc

SEQ ID NO: 303559 - DNA, 29 bp, Artificial Sequence
  Description of Artificial Sequence: Synthetic oligonucleotide
cagcagagctgggatatcagcctctcatg

SEQ ID NO: 303560 - DNA, 30 bp, Artificial Sequence
  Description of Artificial Sequence: Synthetic oligonucleotide
agcagagctgggatatcagcctctcatgtc

SEQ ID NO: 303561 - DNA, 29 bp, Artificial Sequence
  Description of Artificial Sequence: Synthetic oligonucleotide
gcagagctgggatatcagcctctcatgtc

SEQ ID NO: 303562 - DNA, 30 bp, Artificial Sequence
  Description of Artificial Sequence: Synthetic oligonucleotide
cagagctgggatatcagcctctcatgtcag

SEQ ID NO: 303563 - DNA, 30 bp, Artificial Sequence
  Description of Artificial Sequence: Synthetic oligonucleotide
agagctgggatatcagcctctcatgtcagc

SEQ ID NO: 303564 - DNA, 29 bp, Artificial Sequence
  Description of Artificial Sequence: Synthetic oligonucleotide
gagctgggatatcagcctctcatgtcagc

SEQ ID NO: 303565 - DNA, 31 bp, Artificial Sequence
  Description of Artificial Sequence: Synthetic oligonucleotide
agctgggatatcagcctctcatgtcagcttc

SEQ ID NO: 303566 - DNA, 30 bp, Artificial Sequence
  Description of Artificial Sequence: Synthetic oligonucleotide
gctgggatatcagcctctcatgtcagcttc

SEQ ID NO: 303567 - DNA, 31 bp, Artificial Sequence
  Description of Artificial Sequence: Synthetic oligonucleotide
ctgggatatcagcctctcatgtcagcttctg

SEQ ID NO: 303568 - DNA, 31 bp, Artificial Sequence
  Description of Artificial Sequence: Synthetic oligonucleotide
tgggatatcagcctctcatgtcagcttctgg

SEQ ID NO: 303569 - DNA, 30 bp, Artificial Sequence
  Description of Artificial Sequence: Synthetic oligonucleotide
gggatatcagcctctcatgtcagcttctgg

SEQ ID NO: 303570 - DNA, 30 bp, Artificial Sequence
  Description of Artificial Sequence: Synthetic oligonucleotide
ggatatcagcctctcatgtcagcttctggg

SEQ ID NO: 303571 - DNA, 31 bp, Artificial Sequence
  Description of Artificial Sequence: Synthetic oligonucleotide
gatatcagcctctcatgtcagcttctgggtc

SEQ ID NO: 303572 - DNA, 31 bp, Artificial Sequence
  Description of Artificial Sequence: Synthetic oligonucleotide
atatcagcctctcatgtcagcttctgggtcc

SEQ ID NO: 303573 - DNA, 30 bp, Artificial Sequence
  Description of Artificial Sequence: Synthetic oligonucleotide
tatcagcctctcatgtcagcttctgggtcc

SEQ ID NO: 303574 - DNA, 29 bp, Artificial Sequence
  Description of Artificial Sequence: Synthetic oligonucleotide
atcagcctctcatgtcagcttctgggtcc

SEQ ID NO: 303575 - DNA, 28 bp, Artificial Sequence
  Description of Artificial Sequence: Synthetic oligonucleotide
tcagcctctcatgtcagcttctgggtcc

SEQ ID NO: 303576 - DNA, 27 bp, Artificial Sequence
  Description of Artificial Sequence: Synthetic oligonucleotide
cagcctctcatgtcagcttctgggtcc

SEQ ID NO: 303577 - DNA, 28 bp, Artificial Sequence
  Description of Artificial Sequence: Synthetic oligonucleotide
agcctctcatgtcagcttctgggtccag

SEQ ID NO: 303578 - DNA, 27 bp, Artificial Sequence
  Description of Artificial Sequence: Synthetic oligonucleotide
gcctctcatgtcagcttctgggtccag

SEQ ID NO: 303579 - DNA, 28 bp, Artificial Sequence
  Description of Artificial Sequence: Synthetic oligonucleotide
cctctcatgtcagcttctgggtccagtg

SEQ ID NO: 303580 - DNA, 28 bp, Artificial Sequence
  Description of Artificial Sequence: Synthetic oligonucleotide
ctctcatgtcagcttctgggtccagtgg

SEQ ID NO: 303581 - DNA, 30 bp, Artificial Sequence
  Description of Artificial Sequence: Synthetic oligonucleotide
tctcatgtcagcttctgggtccagtggttc

SEQ ID NO: 303582 - DNA, 29 bp, Artificial Sequence
  Description of Artificial Sequence: Synthetic oligonucleotide
ctcatgtcagcttctgggtccagtggttc

SEQ ID NO: 303583 - DNA, 29 bp, Artificial Sequence
  Description of Artificial Sequence: Synthetic oligonucleotide
tcatgtcagcttctgggtccagtggttcc

SEQ ID NO: 303584 - DNA, 28 bp, Artificial Sequence
  Description of Artificial Sequence: Synthetic oligonucleotide
catgtcagcttctgggtccagtggttcc

SEQ ID NO: 303585 - DNA, 29 bp, Artificial Sequence
  Description of Artificial Sequence: Synthetic oligonucleotide
atgtcagcttctgggtccagtggttccac

SEQ ID NO: 303586 - DNA, 28 bp, Artificial Sequence
  Description of Artificial Sequence: Synthetic oligonucleotide
tgtcagcttctgggtccagtggttccac

SEQ ID NO: 303587 - DNA, 27 bp, Artificial Sequence
  Description of Artificial Sequence: Synthetic oligonucleotide
gtcagcttctgggtccagtggttccac

SEQ ID NO: 303588 - DNA, 28 bp, Artificial Sequence
  Description of Artificial Sequence: Synthetic oligonucleotide
tcagcttctgggtccagtggttccacag

SEQ ID NO: 303589 - DNA, 27 bp, Artificial Sequence
  Description of Artificial Sequence: Synthetic oligonucleotide
cagcttctgggtccagtggttccacag

SEQ ID NO: 303590 - DNA, 28 bp, Artificial Sequence
  Description of Artificial Sequence: Synthetic oligonucleotide
agcttctgggtccagtggttccacagag

SEQ ID NO: 303591 - DNA, 27 bp, Artificial Sequence
  Description of Artificial Sequence: Synthetic oligonucleotide
gcttctgggtccagtggttccacagag

SEQ ID NO: 303592 - DNA, 27 bp, Artificial Sequence
  Description of Artificial Sequence: Synthetic oligonucleotide
cttctgggtccagtggttccacagagg

SEQ ID NO: 303593 - DNA, 27 bp, Artificial Sequence
  Description of Artificial Sequence: Synthetic oligonucleotide
ttctgggtccagtggttccacagaggg

SEQ ID NO: 303594 - DNA, 26 bp, Artificial Sequence
  Description of Artificial Sequence: Synthetic oligonucleotide
tctgggtccagtggttccacagaggg

SEQ ID NO: 303595 - DNA, 25 bp, Artificial Sequence
  Description of Artificial Sequence: Synthetic oligonucleotide
ctgggtccagtggttccacagaggg

SEQ ID NO: 303596 - DNA, 25 bp, Artificial Sequence
  Description of Artificial Sequence: Synthetic oligonucleotide
tgggtccagtggttccacagagggc

SEQ ID NO: 303597 - DNA, 24 bp, Artificial Sequence
  Description of Artificial Sequence: Synthetic oligonucleotide
gggtccagtggttccacagagggc

SEQ ID NO: 303598 - DNA, 24 bp, Artificial Sequence
  Description of Artificial Sequence: Synthetic oligonucleotide
ggtccagtggttccacagagggcg

SEQ ID NO: 303599 - DNA, 24 bp, Artificial Sequence
  Description of Artificial Sequence: Synthetic oligonucleotide
gtccagtggttccacagagggcgc

SEQ ID NO: 303600 - DNA, 26 bp, Artificial Sequence
  Description of Artificial Sequence: Synthetic oligonucleotide
tccagtggttccacagagggcgccaa

SEQ ID NO: 303601 - DNA, 25 bp, Artificial Sequence
  Description of Artificial Sequence: Synthetic oligonucleotide
ccagtggttccacagagggcgccaa

SEQ ID NO: 303602 - DNA, 25 bp, Artificial Sequence
  Description of Artificial Sequence: Synthetic oligonucleotide
cagtggttccacagagggcgccaag

SEQ ID NO: 303603 - DNA, 45 bp, Artificial Sequence
  Description of Artificial Sequence: Synthetic oligonucleotide
atgttccatacttctgcaaaggttaattctcacagaaaagcaatg

SEQ ID NO: 303604 - DNA, 44 bp, Artificial Sequence
  Description of Artificial Sequence: Synthetic oligonucleotide
tgttccatacttctgcaaaggttaattctcacagaaaagcaatg

SEQ ID NO: 303605 - DNA, 43 bp, Artificial Sequence
  Description of Artificial Sequence: Synthetic oligonucleotide
gttccatacttctgcaaaggttaattctcacagaaaagcaatg

SEQ ID NO: 303606 - DNA, 48 bp, Artificial Sequence
  Description of Artificial Sequence: Synthetic oligonucleotide
ttccatacttctgcaaaggttaattctcacagaaaagcaatgtttatc

SEQ ID NO: 303607 - DNA, 47 bp, Artificial Sequence
  Description of Artificial Sequence: Synthetic oligonucleotide
tccatacttctgcaaaggttaattctcacagaaaagcaatgtttatc

SEQ ID NO: 303608 - DNA, 46 bp, Artificial Sequence
  Description of Artificial Sequence: Synthetic oligonucleotide
ccatacttctgcaaaggttaattctcacagaaaagcaatgtttatc

SEQ ID NO: 303609 - DNA, 49 bp, Artificial Sequence
  Description of Artificial Sequence: Synthetic oligonucleotide
catacttctgcaaaggttaattctcacagaaaagcaatgtttatcattc

SEQ ID NO: 303610 - DNA, 50 bp, Artificial Sequence
  Description of Artificial Sequence: Synthetic oligonucleotide
atacttctgcaaaggttaattctcacagaaaagcaatgtttatcattcac

SEQ ID NO: 303611 - DNA, 49 bp, Artificial Sequence
  Description of Artificial Sequence: Synthetic oligonucleotide
tacttctgcaaaggttaattctcacagaaaagcaatgtttatcattcac

SEQ ID NO: 303612 - DNA, 48 bp, Artificial Sequence
  Description of Artificial Sequence: Synthetic oligonucleotide
acttctgcaaaggttaattctcacagaaaagcaatgtttatcattcac

SEQ ID NO: 303613 - DNA, 47 bp, Artificial Sequence
  Description of Artificial Sequence: Synthetic oligonucleotide
cttctgcaaaggttaattctcacagaaaagcaatgtttatcattcac

SEQ ID NO: 303614 - DNA, 48 bp, Artificial Sequence
  Description of Artificial Sequence: Synthetic oligonucleotide
ttctgcaaaggttaattctcacagaaaagcaatgtttatcattcacag

SEQ ID NO: 303615 - DNA, 47 bp, Artificial Sequence
  Description of Artificial Sequence: Synthetic oligonucleotide
tctgcaaaggttaattctcacagaaaagcaatgtttatcattcacag

SEQ ID NO: 303616 - DNA, 46 bp, Artificial Sequence
  Description of Artificial Sequence: Synthetic oligonucleotide
ctgcaaaggttaattctcacagaaaagcaatgtttatcattcacag

SEQ ID NO: 303617 - DNA, 47 bp, Artificial Sequence
  Description of Artificial Sequence: Synthetic oligonucleotide
tgcaaaggttaattctcacagaaaagcaatgtttatcattcacagtg

SEQ ID NO: 303618 - DNA, 46 bp, Artificial Sequence
  Description of Artificial Sequence: Synthetic oligonucleotide
gcaaaggttaattctcacagaaaagcaatgtttatcattcacagtg

SEQ ID NO: 303619 - DNA, 46 bp, Artificial Sequence
  Description of Artificial Sequence: Synthetic oligonucleotide
caaaggttaattctcacagaaaagcaatgtttatcattcacagtgg

SEQ ID NO: 303620 - DNA, 52 bp, Artificial Sequence
  Description of Artificial Sequence: Synthetic oligonucleotide
aaaggttaattctcacagaaaagcaatgtttatcattcacagtggattttac

SEQ ID NO: 303621 - DNA, 51 bp, Artificial Sequence
  Description of Artificial Sequence: Synthetic oligonucleotide
aaggttaattctcacagaaaagcaatgtttatcattcacagtggattttac

SEQ ID NO: 303622 - DNA, 50 bp, Artificial Sequence
  Description of Artificial Sequence: Synthetic oligonucleotide
aggttaattctcacagaaaagcaatgtttatcattcacagtggattttac

SEQ ID NO: 303623 - DNA, 49 bp, Artificial Sequence
  Description of Artificial Sequence: Synthetic oligonucleotide
ggttaattctcacagaaaagcaatgtttatcattcacagtggattttac

SEQ ID NO: 303624 - DNA, 50 bp, Artificial Sequence
  Description of Artificial Sequence: Synthetic oligonucleotide
gttaattctcacagaaaagcaatgtttatcattcacagtggattttacag

SEQ ID NO: 303625 - DNA, 50 bp, Artificial Sequence
  Description of Artificial Sequence: Synthetic oligonucleotide
ttaattctcacagaaaagcaatgtttatcattcacagtggattttacagc

SEQ ID NO: 303626 - DNA, 49 bp, Artificial Sequence
  Description of Artificial Sequence: Synthetic oligonucleotide
taattctcacagaaaagcaatgtttatcattcacagtggattttacagc

SEQ ID NO: 303627 - DNA, 48 bp, Artificial Sequence
  Description of Artificial Sequence: Synthetic oligonucleotide
aattctcacagaaaagcaatgtttatcattcacagtggattttacagc

SEQ ID NO: 303628 - DNA, 47 bp, Artificial Sequence
  Description of Artificial Sequence: Synthetic oligonucleotide
attctcacagaaaagcaatgtttatcattcacagtggattttacagc

SEQ ID NO: 303629 - DNA, 46 bp, Artificial Sequence
  Description of Artificial Sequence: Synthetic oligonucleotide
ttctcacagaaaagcaatgtttatcattcacagtggattttacagc

SEQ ID NO: 303630 - DNA, 45 bp, Artificial Sequence
  Description of Artificial Sequence: Synthetic oligonucleotide
tctcacagaaaagcaatgtttatcattcacagtggattttacagc

SEQ ID NO: 303631 - DNA, 44 bp, Artificial Sequence
  Description of Artificial Sequence: Synthetic oligonucleotide
ctcacagaaaagcaatgtttatcattcacagtggattttacagc

SEQ ID NO: 303632 - DNA, 48 bp, Artificial Sequence
  Description of Artificial Sequence: Synthetic oligonucleotide
tcacagaaaagcaatgtttatcattcacagtggattttacagcttaac

SEQ ID NO: 303633 - DNA, 47 bp, Artificial Sequence
  Description of Artificial Sequence: Synthetic oligonucleotide
cacagaaaagcaatgtttatcattcacagtggattttacagcttaac

SEQ ID NO: 303634 - DNA, 48 bp, Artificial Sequence
  Description of Artificial Sequence: Synthetic oligonucleotide
acagaaaagcaatgtttatcattcacagtggattttacagcttaacag

SEQ ID NO: 303635 - DNA, 47 bp, Artificial Sequence
  Description of Artificial Sequence: Synthetic oligonucleotide
cagaaaagcaatgtttatcattcacagtggattttacagcttaacag

SEQ ID NO: 303636 - DNA, 47 bp, Artificial Sequence
  Description of Artificial Sequence: Synthetic oligonucleotide
agaaaagcaatgtttatcattcacagtggattttacagcttaacagg

SEQ ID NO: 303637 - DNA, 46 bp, Artificial Sequence
  Description of Artificial Sequence: Synthetic oligonucleotide
gaaaagcaatgtttatcattcacagtggattttacagcttaacagg

SEQ ID NO: 303638 - DNA, 46 bp, Artificial Sequence
  Description of Artificial Sequence: Synthetic oligonucleotide
aaaagcaatgtttatcattcacagtggattttacagcttaacaggc

SEQ ID NO: 303639 - DNA, 45 bp, Artificial Sequence
  Description of Artificial Sequence: Synthetic oligonucleotide
aaagcaatgtttatcattcacagtggattttacagcttaacaggc

SEQ ID NO: 303640 - DNA, 44 bp, Artificial Sequence
  Description of Artificial Sequence: Synthetic oligonucleotide
aagcaatgtttatcattcacagtggattttacagcttaacaggc

SEQ ID NO: 303641 - DNA, 43 bp, Artificial Sequence
  Description of Artificial Sequence: Synthetic oligonucleotide
agcaatgtttatcattcacagtggattttacagcttaacaggc

SEQ ID NO: 303642 - DNA, 42 bp, Artificial Sequence
  Description of Artificial Sequence: Synthetic oligonucleotide
gcaatgtttatcattcacagtggattttacagcttaacaggc

SEQ ID NO: 303643 - DNA, 44 bp, Artificial Sequence
  Description of Artificial Sequence: Synthetic oligonucleotide
caatgtttatcattcacagtggattttacagcttaacaggcatc

SEQ ID NO: 303644 - DNA, 46 bp, Artificial Sequence
  Description of Artificial Sequence: Synthetic oligonucleotide
aatgtttatcattcacagtggattttacagcttaacaggcatcttg

SEQ ID NO: 303645 - DNA, 45 bp, Artificial Sequence
  Description of Artificial Sequence: Synthetic oligonucleotide
atgtttatcattcacagtggattttacagcttaacaggcatcttg

SEQ ID NO: 303646 - DNA, 44 bp, Artificial Sequence
  Description of Artificial Sequence: Synthetic oligonucleotide
tgtttatcattcacagtggattttacagcttaacaggcatcttg

SEQ ID NO: 303647 - DNA, 43 bp, Artificial Sequence
  Description of Artificial Sequence: Synthetic oligonucleotide
gtttatcattcacagtggattttacagcttaacaggcatcttg

SEQ ID NO: 303648 - DNA, 43 bp, Artificial Sequence
  Description of Artificial Sequence: Synthetic oligonucleotide
tttatcattcacagtggattttacagcttaacaggcatcttgc

SEQ ID NO: 303649 - DNA, 42 bp, Artificial Sequence
  Description of Artificial Sequence: Synthetic oligonucleotide
ttatcattcacagtggattttacagcttaacaggcatcttgc

SEQ ID NO: 303650 - DNA, 41 bp, Artificial Sequence
  Description of Artificial Sequence: Synthetic oligonucleotide
tatcattcacagtggattttacagcttaacaggcatcttgc

SEQ ID NO: 303651 - DNA, 40 bp, Artificial Sequence
  Description of Artificial Sequence: Synthetic oligonucleotide
atcattcacagtggattttacagcttaacaggcatcttgc

SEQ ID NO: 303652 - DNA, 39 bp, Artificial Sequence
  Description of Artificial Sequence: Synthetic oligonucleotide
tcattcacagtggattttacagcttaacaggcatcttgc

SEQ ID NO: 303653 - DNA, 38 bp, Artificial Sequence
  Description of Artificial Sequence: Synthetic oligonucleotide
cattcacagtggattttacagcttaacaggcatcttgc

SEQ ID NO: 303654 - DNA, 38 bp, Artificial Sequence
  Description of Artificial Sequence: Synthetic oligonucleotide
attcacagtggattttacagcttaacaggcatcttgcc

SEQ ID NO: 303655 - DNA, 37 bp, Artificial Sequence
  Description of Artificial Sequence: Synthetic oligonucleotide
ttcacagtggattttacagcttaacaggcatcttgcc

SEQ ID NO: 303656 - DNA, 36 bp, Artificial Sequence
  Description of Artificial Sequence: Synthetic oligonucleotide
tcacagtggattttacagcttaacaggcatcttgcc

SEQ ID NO: 303657 - DNA, 35 bp, Artificial Sequence
  Description of Artificial Sequence: Synthetic oligonucleotide
cacagtggattttacagcttaacaggcatcttgcc

SEQ ID NO: 303658 - DNA, 35 bp, Artificial Sequence
  Description of Artificial Sequence: Synthetic oligonucleotide
acagtggattttacagcttaacaggcatcttgccg

SEQ ID NO: 303659 - DNA, 34 bp, Artificial Sequence
  Description of Artificial Sequence: Synthetic oligonucleotide
cagtggattttacagcttaacaggcatcttgccg

SEQ ID NO: 303660 - DNA, 34 bp, Artificial Sequence
  Description of Artificial Sequence: Synthetic oligonucleotide
agtggattttacagcttaacaggcatcttgccgc

SEQ ID NO: 303661 - DNA, 33 bp, Artificial Sequence
  Description of Artificial Sequence: Synthetic oligonucleotide
gtggattttacagcttaacaggcatcttgccgc

SEQ ID NO: 303662 - DNA, 39 bp, Artificial Sequence
  Description of Artificial Sequence: Synthetic oligonucleotide
tggattttacagcttaacaggcatcttgccgcaaatatg

SEQ ID NO: 303663 - DNA, 38 bp, Artificial Sequence
  Description of Artificial Sequence: Synthetic oligonucleotide
ggattttacagcttaacaggcatcttgccgcaaatatg

SEQ ID NO: 303664 - DNA, 38 bp, Artificial Sequence
  Description of Artificial Sequence: Synthetic oligonucleotide
gattttacagcttaacaggcatcttgccgcaaatatgc

SEQ ID NO: 303665 - DNA, 42 bp, Artificial Sequence
  Description of Artificial Sequence: Synthetic oligonucleotide
attttacagcttaacaggcatcttgccgcaaatatgcttttg

SEQ ID NO: 303666 - DNA, 41 bp, Artificial Sequence
  Description of Artificial Sequence: Synthetic oligonucleotide
ttttacagcttaacaggcatcttgccgcaaatatgcttttg

SEQ ID NO: 303667 - DNA, 40 bp, Artificial Sequence
  Description of Artificial Sequence: Synthetic oligonucleotide
tttacagcttaacaggcatcttgccgcaaatatgcttttg

SEQ ID NO: 303668 - DNA, 39 bp, Artificial Sequence
  Description of Artificial Sequence: Synthetic oligonucleotide
ttacagcttaacaggcatcttgccgcaaatatgcttttg

SEQ ID NO: 303669 - DNA, 38 bp, Artificial Sequence
  Description of Artificial Sequence: Synthetic oligonucleotide
tacagcttaacaggcatcttgccgcaaatatgcttttg

SEQ ID NO: 303670 - DNA, 37 bp, Artificial Sequence
  Description of Artificial Sequence: Synthetic oligonucleotide
acagcttaacaggcatcttgccgcaaatatgcttttg

SEQ ID NO: 303671 - DNA, 36 bp, Artificial Sequence
  Description of Artificial Sequence: Synthetic oligonucleotide
cagcttaacaggcatcttgccgcaaatatgcttttg

SEQ ID NO: 303672 - DNA, 38 bp, Artificial Sequence
  Description of Artificial Sequence: Synthetic oligonucleotide
agcttaacaggcatcttgccgcaaatatgcttttgttc

SEQ ID NO: 303673 - DNA, 37 bp, Artificial Sequence
  Description of Artificial Sequence: Synthetic oligonucleotide
gcttaacaggcatcttgccgcaaatatgcttttgttc

SEQ ID NO: 303674 - DNA, 38 bp, Artificial Sequence
  Description of Artificial Sequence: Synthetic oligonucleotide
cttaacaggcatcttgccgcaaatatgcttttgttctc

SEQ ID NO: 303675 - DNA, 39 bp, Artificial Sequence
  Description of Artificial Sequence: Synthetic oligonucleotide
ttaacaggcatcttgccgcaaatatgcttttgttctctg

SEQ ID NO: 303676 - DNA, 38 bp, Artificial Sequence
  Description of Artificial Sequence: Synthetic oligonucleotide
taacaggcatcttgccgcaaatatgcttttgttctctg

SEQ ID NO: 303677 - DNA, 37 bp, Artificial Sequence
  Description of Artificial Sequence: Synthetic oligonucleotide
aacaggcatcttgccgcaaatatgcttttgttctctg

SEQ ID NO: 303678 - DNA, 36 bp, Artificial Sequence
  Description of Artificial Sequence: Synthetic oligonucleotide
acaggcatcttgccgcaaatatgcttttgttctctg

SEQ ID NO: 303679 - DNA, 35 bp, Artificial Sequence
  Description of Artificial Sequence: Synthetic oligonucleotide
caggcatcttgccgcaaatatgcttttgttctctg

SEQ ID NO: 303680 - DNA, 37 bp, Artificial Sequence
  Description of Artificial Sequence: Synthetic oligonucleotide
aggcatcttgccgcaaatatgcttttgttctctgttc

SEQ ID NO: 303681 - DNA, 36 bp, Artificial Sequence
  Description of Artificial Sequence: Synthetic oligonucleotide
ggcatcttgccgcaaatatgcttttgttctctgttc

SEQ ID NO: 303682 - DNA, 37 bp, Artificial Sequence
  Description of Artificial Sequence: Synthetic oligonucleotide
gcatcttgccgcaaatatgcttttgttctctgttctc

SEQ ID NO: 303683 - DNA, 38 bp, Artificial Sequence
  Description of Artificial Sequence: Synthetic oligonucleotide
catcttgccgcaaatatgcttttgttctctgttctcag

SEQ ID NO: 303684 - DNA, 39 bp, Artificial Sequence
  Description of Artificial Sequence: Synthetic oligonucleotide
atcttgccgcaaatatgcttttgttctctgttctcagtc

SEQ ID NO: 303685 - DNA, 38 bp, Artificial Sequence
  Description of Artificial Sequence: Synthetic oligonucleotide
tcttgccgcaaatatgcttttgttctctgttctcagtc

SEQ ID NO: 303686 - DNA, 37 bp, Artificial Sequence
  Description of Artificial Sequence: Synthetic oligonucleotide
cttgccgcaaatatgcttttgttctctgttctcagtc

SEQ ID NO: 303687 - DNA, 37 bp, Artificial Sequence
  Description of Artificial Sequence: Synthetic oligonucleotide
ttgccgcaaatatgcttttgttctctgttctcagtcc

SEQ ID NO: 303688 - DNA, 36 bp, Artificial Sequence
  Description of Artificial Sequence: Synthetic oligonucleotide
tgccgcaaatatgcttttgttctctgttctcagtcc

SEQ ID NO: 303689 - DNA, 35 bp, Artificial Sequence
  Description of Artificial Sequence: Synthetic oligonucleotide
gccgcaaatatgcttttgttctctgttctcagtcc

SEQ ID NO: 303690 - DNA, 35 bp, Artificial Sequence
  Description of Artificial Sequence: Synthetic oligonucleotide
ccgcaaatatgcttttgttctctgttctcagtccc

SEQ ID NO: 303691 - DNA, 37 bp, Artificial Sequence
  Description of Artificial Sequence: Synthetic oligonucleotide
cgcaaatatgcttttgttctctgttctcagtcccatc

SEQ ID NO: 303692 - DNA, 39 bp, Artificial Sequence
  Description of Artificial Sequence: Synthetic oligonucleotide
gcaaatatgcttttgttctctgttctcagtcccatctag

SEQ ID NO: 303693 - DNA, 43 bp, Artificial Sequence
  Description of Artificial Sequence: Synthetic oligonucleotide
caaatatgcttttgttctctgttctcagtcccatctagtaatc

SEQ ID NO: 303694 - DNA, 44 bp, Artificial Sequence
  Description of Artificial Sequence: Synthetic oligonucleotide
aaatatgcttttgttctctgttctcagtcccatctagtaatcac

SEQ ID NO: 303695 - DNA, 43 bp, Artificial Sequence
  Description of Artificial Sequence: Synthetic oligonucleotide
aatatgcttttgttctctgttctcagtcccatctagtaatcac

SEQ ID NO: 303696 - DNA, 42 bp, Artificial Sequence
  Description of Artificial Sequence: Synthetic oligonucleotide
atatgcttttgttctctgttctcagtcccatctagtaatcac

SEQ ID NO: 303697 - DNA, 41 bp, Artificial Sequence
  Description of Artificial Sequence: Synthetic oligonucleotide
tatgcttttgttctctgttctcagtcccatctagtaatcac

SEQ ID NO: 303698 - DNA, 40 bp, Artificial Sequence
  Description of Artificial Sequence: Synthetic oligonucleotide
atgcttttgttctctgttctcagtcccatctagtaatcac

SEQ ID NO: 303699 - DNA, 39 bp, Artificial Sequence
  Description of Artificial Sequence: Synthetic oligonucleotide
tgcttttgttctctgttctcagtcccatctagtaatcac

SEQ ID NO: 303700 - DNA, 38 bp, Artificial Sequence
  Description of Artificial Sequence: Synthetic oligonucleotide
gcttttgttctctgttctcagtcccatctagtaatcac

SEQ ID NO: 303701 - DNA, 40 bp, Artificial Sequence
  Description of Artificial Sequence: Synthetic oligonucleotide
cttttgttctctgttctcagtcccatctagtaatcacttc

SEQ ID NO: 303702 - DNA, 41 bp, Artificial Sequence
  Description of Artificial Sequence: Synthetic oligonucleotide
ttttgttctctgttctcagtcccatctagtaatcacttcag

SEQ ID NO: 303703 - DNA, 40 bp, Artificial Sequence
  Description of Artificial Sequence: Synthetic oligonucleotide
tttgttctctgttctcagtcccatctagtaatcacttcag

SEQ ID NO: 303704 - DNA, 39 bp, Artificial Sequence
  Description of Artificial Sequence: Synthetic oligonucleotide
ttgttctctgttctcagtcccatctagtaatcacttcag

SEQ ID NO: 303705 - DNA, 38 bp, Artificial Sequence
  Description of Artificial Sequence: Synthetic oligonucleotide
tgttctctgttctcagtcccatctagtaatcacttcag

SEQ ID NO: 303706 - DNA, 37 bp, Artificial Sequence
  Description of Artificial Sequence: Synthetic oligonucleotide
gttctctgttctcagtcccatctagtaatcacttcag

SEQ ID NO: 303707 - DNA, 38 bp, Artificial Sequence
  Description of Artificial Sequence: Synthetic oligonucleotide
ttctctgttctcagtcccatctagtaatcacttcagtg

SEQ ID NO: 303708 - DNA, 37 bp, Artificial Sequence
  Description of Artificial Sequence: Synthetic oligonucleotide
tctctgttctcagtcccatctagtaatcacttcagtg

SEQ ID NO: 303709 - DNA, 36 bp, Artificial Sequence
  Description of Artificial Sequence: Synthetic oligonucleotide
ctctgttctcagtcccatctagtaatcacttcagtg

SEQ ID NO: 303710 - DNA, 37 bp, Artificial Sequence
  Description of Artificial Sequence: Synthetic oligonucleotide
tctgttctcagtcccatctagtaatcacttcagtgag

SEQ ID NO: 303711 - DNA, 36 bp, Artificial Sequence
  Description of Artificial Sequence: Synthetic oligonucleotide
ctgttctcagtcccatctagtaatcacttcagtgag

SEQ ID NO: 303712 - DNA, 36 bp, Artificial Sequence
  Description of Artificial Sequence: Synthetic oligonucleotide
tgttctcagtcccatctagtaatcacttcagtgagg

SEQ ID NO: 303713 - DNA, 35 bp, Artificial Sequence
  Description of Artificial Sequence: Synthetic oligonucleotide
gttctcagtcccatctagtaatcacttcagtgagg

SEQ ID NO: 303714 - DNA, 37 bp, Artificial Sequence
  Description of Artificial Sequence: Synthetic oligonucleotide
ttctcagtcccatctagtaatcacttcagtgaggatc

SEQ ID NO: 303715 - DNA, 36 bp, Artificial Sequence
  Description of Artificial Sequence: Synthetic oligonucleotide
tctcagtcccatctagtaatcacttcagtgaggatc

SEQ ID NO: 303716 - DNA, 35 bp, Artificial Sequence
  Description of Artificial Sequence: Synthetic oligonucleotide
ctcagtcccatctagtaatcacttcagtgaggatc

SEQ ID NO: 303717 - DNA, 35 bp, Artificial Sequence
  Description of Artificial Sequence: Synthetic oligonucleotide
tcagtcccatctagtaatcacttcagtgaggatcc

SEQ ID NO: 303718 - DNA, 34 bp, Artificial Sequence
  Description of Artificial Sequence: Synthetic oligonucleotide
cagtcccatctagtaatcacttcagtgaggatcc

SEQ ID NO: 303719 - DNA, 35 bp, Artificial Sequence
  Description of Artificial Sequence: Synthetic oligonucleotide
agtcccatctagtaatcacttcagtgaggatccag

SEQ ID NO: 303720 - DNA, 34 bp, Artificial Sequence
  Description of Artificial Sequence: Synthetic oligonucleotide
gtcccatctagtaatcacttcagtgaggatccag

SEQ ID NO: 303721 - DNA, 34 bp, Artificial Sequence
  Description of Artificial Sequence: Synthetic oligonucleotide
tcccatctagtaatcacttcagtgaggatccagg

SEQ ID NO: 303722 - DNA, 33 bp, Artificial Sequence
  Description of Artificial Sequence: Synthetic oligonucleotide
cccatctagtaatcacttcagtgaggatccagg

SEQ ID NO: 303723 - DNA, 33 bp, Artificial Sequence
  Description of Artificial Sequence: Synthetic oligonucleotide
ccatctagtaatcacttcagtgaggatccaggg

SEQ ID NO: 303724 - DNA, 33 bp, Artificial Sequence
  Description of Artificial Sequence: Synthetic oligonucleotide
catctagtaatcacttcagtgaggatccagggg

SEQ ID NO: 303725 - DNA, 33 bp, Artificial Sequence
  Description of Artificial Sequence: Synthetic oligonucleotide
atctagtaatcacttcagtgaggatccaggggc

SEQ ID NO: 303726 - DNA, 32 bp, Artificial Sequence
  Description of Artificial Sequence: Synthetic oligonucleotide
tctagtaatcacttcagtgaggatccaggggc

SEQ ID NO: 303727 - DNA, 31 bp, Artificial Sequence
  Description of Artificial Sequence: Synthetic oligonucleotide
ctagtaatcacttcagtgaggatccaggggc

SEQ ID NO: 303728 - DNA, 34 bp, Artificial Sequence
  Description of Artificial Sequence: Synthetic oligonucleotide
tagtaatcacttcagtgaggatccaggggctttc

SEQ ID NO: 303729 - DNA, 33 bp, Artificial Sequence
  Description of Artificial Sequence: Synthetic oligonucleotide
agtaatcacttcagtgaggatccaggggctttc

SEQ ID NO: 303730 - DNA, 32 bp, Artificial Sequence
  Description of Artificial Sequence: Synthetic oligonucleotide
gtaatcacttcagtgaggatccaggggctttc

SEQ ID NO: 303731 - DNA, 32 bp, Artificial Sequence
  Description of Artificial Sequence: Synthetic oligonucleotide
taatcacttcagtgaggatccaggggctttcg

SEQ ID NO: 303732 - DNA, 31 bp, Artificial Sequence
  Description of Artificial Sequence: Synthetic oligonucleotide
aatcacttcagtgaggatccaggggctttcg

SEQ ID NO: 303733 - DNA, 30 bp, Artificial Sequence
  Description of Artificial Sequence: Synthetic oligonucleotide
atcacttcagtgaggatccaggggctttcg

SEQ ID NO: 303734 - DNA, 29 bp, Artificial Sequence
  Description of Artificial Sequence: Synthetic oligonucleotide
tcacttcagtgaggatccaggggctttcg

SEQ ID NO: 303735 - DNA, 28 bp, Artificial Sequence
  Description of Artificial Sequence: Synthetic oligonucleotide
cacttcagtgaggatccaggggctttcg

SEQ ID NO: 303736 - DNA, 28 bp, Artificial Sequence
  Description of Artificial Sequence: Synthetic oligonucleotide
acttcagtgaggatccaggggctttcgc

SEQ ID NO: 303737 - DNA, 27 bp, Artificial Sequence
  Description of Artificial Sequence: Synthetic oligonucleotide
cttcagtgaggatccaggggctttcgc

SEQ ID NO: 303738 - DNA, 28 bp, Artificial Sequence
  Description of Artificial Sequence: Synthetic oligonucleotide
ttcagtgaggatccaggggctttcgcag

SEQ ID NO: 303739 - DNA, 27 bp, Artificial Sequence
  Description of Artificial Sequence: Synthetic oligonucleotide
tcagtgaggatccaggggctttcgcag

SEQ ID NO: 303740 - DNA, 27 bp, Artificial Sequence
  Description of Artificial Sequence: Synthetic oligonucleotide
cagtgaggatccaggggctttcgcagt

SEQ ID NO: 303741 - DNA, 28 bp, Artificial Sequence
  Description of Artificial Sequence: Synthetic oligonucleotide
agtgaggatccaggggctttcgcagtag

SEQ ID NO: 303742 - DNA, 27 bp, Artificial Sequence
  Description of Artificial Sequence: Synthetic oligonucleotide
gtgaggatccaggggctttcgcagtag

SEQ ID NO: 303743 - DNA, 27 bp, Artificial Sequence
  Description of Artificial Sequence: Synthetic oligonucleotide
tgaggatccaggggctttcgcagtagc

SEQ ID NO: 303744 - DNA, 26 bp, Artificial Sequence
  Description of Artificial Sequence: Synthetic oligonucleotide
gaggatccaggggctttcgcagtagc

SEQ ID NO: 303745 - DNA, 27 bp, Artificial Sequence
  Description of Artificial Sequence: Synthetic oligonucleotide
aggatccaggggctttcgcagtagcca

SEQ ID NO: 303746 - DNA, 26 bp, Artificial Sequence
  Description of Artificial Sequence: Synthetic oligonucleotide
ggatccaggggctttcgcagtagcca

SEQ ID NO: 303747 - DNA, 27 bp, Artificial Sequence
  Description of Artificial Sequence: Synthetic oligonucleotide
gatccaggggctttcgcagtagccagt

SEQ ID NO: 303748 - DNA, 30 bp, Artificial Sequence
  Description of Artificial Sequence: Synthetic oligonucleotide
atccaggggctttcgcagtagccagtaatg

SEQ ID NO: 303749 - DNA, 29 bp, Artificial Sequence
  Description of Artificial Sequence: Synthetic oligonucleotide
tccaggggctttcgcagtagccagtaatg

SEQ ID NO: 303750 - DNA, 28 bp, Artificial Sequence
  Description of Artificial Sequence: Synthetic oligonucleotide
ccaggggctttcgcagtagccagtaatg

SEQ ID NO: 303751 - DNA, 28 bp, Artificial Sequence
  Description of Artificial Sequence: Synthetic oligonucleotide
caggggctttcgcagtagccagtaatgg

SEQ ID NO: 303752 - DNA, 28 bp, Artificial Sequence
  Description of Artificial Sequence: Synthetic oligonucleotide
aggggctttcgcagtagccagtaatggg

SEQ ID NO: 303753 - DNA, 27 bp, Artificial Sequence
  Description of Artificial Sequence: Synthetic oligonucleotide
ggggctttcgcagtagccagtaatggg

SEQ ID NO: 303754 - DNA, 27 bp, Artificial Sequence
  Description of Artificial Sequence: Synthetic oligonucleotide
gggctttcgcagtagccagtaatgggg

SEQ ID NO: 303755 - DNA, 29 bp, Artificial Sequence
  Description of Artificial Sequence: Synthetic oligonucleotide
ggctttcgcagtagccagtaatggggatc

SEQ ID NO: 303756 - DNA, 29 bp, Artificial Sequence
  Description of Artificial Sequence: Synthetic oligonucleotide
gctttcgcagtagccagtaatggggatcg

SEQ ID NO: 303757 - DNA, 33 bp, Artificial Sequence
  Description of Artificial Sequence: Synthetic oligonucleotide
ctttcgcagtagccagtaatggggatcgatttc

SEQ ID NO: 303758 - DNA, 33 bp, Artificial Sequence
  Description of Artificial Sequence: Synthetic oligonucleotide
tttcgcagtagccagtaatggggatcgatttcc

SEQ ID NO: 303759 - DNA, 32 bp, Artificial Sequence
  Description of Artificial Sequence: Synthetic oligonucleotide
ttcgcagtagccagtaatggggatcgatttcc

SEQ ID NO: 303760 - DNA, 31 bp, Artificial Sequence
  Description of Artificial Sequence: Synthetic oligonucleotide
tcgcagtagccagtaatggggatcgatttcc

SEQ ID NO: 303761 - DNA, 30 bp, Artificial Sequence
  Description of Artificial Sequence: Synthetic oligonucleotide
cgcagtagccagtaatggggatcgatttcc

SEQ ID NO: 303762 - DNA, 32 bp, Artificial Sequence
  Description of Artificial Sequence: Synthetic oligonucleotide
gcagtagccagtaatggggatcgatttcctag

SEQ ID NO: 303763 - DNA, 32 bp, Artificial Sequence
  Description of Artificial Sequence: Synthetic oligonucleotide
cagtagccagtaatggggatcgatttcctagg

SEQ ID NO: 303764 - DNA, 32 bp, Artificial Sequence
  Description of Artificial Sequence: Synthetic oligonucleotide
agtagccagtaatggggatcgatttcctaggc

SEQ ID NO: 303765 - DNA, 31 bp, Artificial Sequence
  Description of Artificial Sequence: Synthetic oligonucleotide
gtagccagtaatggggatcgatttcctaggc

SEQ ID NO: 303766 - DNA, 32 bp, Artificial Sequence
  Description of Artificial Sequence: Synthetic oligonucleotide
tagccagtaatggggatcgatttcctaggcag

SEQ ID NO: 303767 - DNA, 31 bp, Artificial Sequence
  Description of Artificial Sequence: Synthetic oligonucleotide
agccagtaatggggatcgatttcctaggcag

SEQ ID NO: 303768 - DNA, 30 bp, Artificial Sequence
  Description of Artificial Sequence: Synthetic oligonucleotide
gccagtaatggggatcgatttcctaggcag

SEQ ID NO: 303769 - DNA, 30 bp, Artificial Sequence
  Description of Artificial Sequence: Synthetic oligonucleotide
ccagtaatggggatcgatttcctaggcagg

SEQ ID NO: 303770 - DNA, 31 bp, Artificial Sequence
  Description of Artificial Sequence: Synthetic oligonucleotide
cagtaatggggatcgatttcctaggcaggag

SEQ ID NO: 303771 - DNA, 31 bp, Artificial Sequence
  Description of Artificial Sequence: Synthetic oligonucleotide
agtaatggggatcgatttcctaggcaggagc

SEQ ID NO: 303772 - DNA, 30 bp, Artificial Sequence
  Description of Artificial Sequence: Synthetic oligonucleotide
gtaatggggatcgatttcctaggcaggagc

SEQ ID NO: 303773 - DNA, 33 bp, Artificial Sequence
  Description of Artificial Sequence: Synthetic oligonucleotide
taatggggatcgatttcctaggcaggagcaaag

SEQ ID NO: 303774 - DNA, 32 bp, Artificial Sequence
  Description of Artificial Sequence: Synthetic oligonucleotide
aatggggatcgatttcctaggcaggagcaaag

SEQ ID NO: 303775 - DNA, 31 bp, Artificial Sequence
  Description of Artificial Sequence: Synthetic oligonucleotide
atggggatcgatttcctaggcaggagcaaag

SEQ ID NO: 303776 - DNA, 30 bp, Artificial Sequence
  Description of Artificial Sequence: Synthetic oligonucleotide
tggggatcgatttcctaggcaggagcaaag

SEQ ID NO: 303777 - DNA, 29 bp, Artificial Sequence
  Description of Artificial Sequence: Synthetic oligonucleotide
ggggatcgatttcctaggcaggagcaaag

SEQ ID NO: 303778 - DNA, 29 bp, Artificial Sequence
  Description of Artificial Sequence: Synthetic oligonucleotide
gggatcgatttcctaggcaggagcaaagg

SEQ ID NO: 303779 - DNA, 29 bp, Artificial Sequence
  Description of Artificial Sequence: Synthetic oligonucleotide
ggatcgatttcctaggcaggagcaaaggc

SEQ ID NO: 303780 - DNA, 30 bp, Artificial Sequence
  Description of Artificial Sequence: Synthetic oligonucleotide
gatcgatttcctaggcaggagcaaaggctc

SEQ ID NO: 303781 - DNA, 30 bp, Artificial Sequence
  Description of Artificial Sequence: Synthetic oligonucleotide
atcgatttcctaggcaggagcaaaggctcc

SEQ ID NO: 303782 - DNA, 29 bp, Artificial Sequence
  Description of Artificial Sequence: Synthetic oligonucleotide
tcgatttcctaggcaggagcaaaggctcc

SEQ ID NO: 303783 - DNA, 28 bp, Artificial Sequence
  Description of Artificial Sequence: Synthetic oligonucleotide
cgatttcctaggcaggagcaaaggctcc

SEQ ID NO: 303784 - DNA, 28 bp, Artificial Sequence
  Description of Artificial Sequence: Synthetic oligonucleotide
gatttcctaggcaggagcaaaggctccc

SEQ ID NO: 303785 - DNA, 28 bp, Artificial Sequence
  Description of Artificial Sequence: Synthetic oligonucleotide
atttcctaggcaggagcaaaggctcccg

SEQ ID NO: 303786 - DNA, 27 bp, Artificial Sequence
  Description of Artificial Sequence: Synthetic oligonucleotide
tttcctaggcaggagcaaaggctcccg

SEQ ID NO: 303787 - DNA, 27 bp, Artificial Sequence
  Description of Artificial Sequence: Synthetic oligonucleotide
ttcctaggcaggagcaaaggctcccga

SEQ ID NO: 303788 - DNA, 26 bp, Artificial Sequence
  Description of Artificial Sequence: Synthetic oligonucleotide
tcctaggcaggagcaaaggctcccga

SEQ ID NO: 303789 - DNA, 25 bp, Artificial Sequence
  Description of Artificial Sequence: Synthetic oligonucleotide
cctaggcaggagcaaaggctcccga

SEQ ID NO: 303790 - DNA, 26 bp, Artificial Sequence
  Description of Artificial Sequence: Synthetic oligonucleotide
ctaggcaggagcaaaggctcccgagt

SEQ ID NO: 303791 - DNA, 27 bp, Artificial Sequence
  Description of Artificial Sequence: Synthetic oligonucleotide
taggcaggagcaaaggctcccgagtgt

SEQ ID NO: 303792 - DNA, 26 bp, Artificial Sequence
  Description of Artificial Sequence: Synthetic oligonucleotide
aggcaggagcaaaggctcccgagtgt

SEQ ID NO: 303793 - DNA, 25 bp, Artificial Sequence
  Description of Artificial Sequence: Synthetic oligonucleotide
ggcaggagcaaaggctcccgagtgt

SEQ ID NO: 303794 - DNA, 25 bp, Artificial Sequence
  Description of Artificial Sequence: Synthetic oligonucleotide
gcaggagcaaaggctcccgagtgtg

SEQ ID NO: 303795 - DNA, 26 bp, Artificial Sequence
  Description of Artificial Sequence: Synthetic oligonucleotide
caggagcaaaggctcccgagtgtggt

SEQ ID NO: 303796 - DNA, 27 bp, Artificial Sequence
  Description of Artificial Sequence: Synthetic oligonucleotide
aggagcaaaggctcccgagtgtggtct

SEQ ID NO: 303797 - DNA, 27 bp, Artificial Sequence
  Description of Artificial Sequence: Synthetic oligonucleotide
ggagcaaaggctcccgagtgtggtctt

SEQ ID NO: 303798 - DNA, 28 bp, Artificial Sequence
  Description of Artificial Sequence: Synthetic oligonucleotide
gagcaaaggctcccgagtgtggtctttc

SEQ ID NO: 303799 - DNA, 28 bp, Artificial Sequence
  Description of Artificial Sequence: Synthetic oligonucleotide
agcaaaggctcccgagtgtggtctttcc

SEQ ID NO: 303800 - DNA, 27 bp, Artificial Sequence
  Description of Artificial Sequence: Synthetic oligonucleotide
gcaaaggctcccgagtgtggtctttcc

SEQ ID NO: 303801 - DNA, 28 bp, Artificial Sequence
  Description of Artificial Sequence: Synthetic oligonucleotide
caaaggctcccgagtgtggtctttcctc

SEQ ID NO: 303802 - DNA, 29 bp, Artificial Sequence
  Description of Artificial Sequence: Synthetic oligonucleotide
aaaggctcccgagtgtggtctttcctctc

SEQ ID NO: 303803 - DNA, 28 bp, Artificial Sequence
  Description of Artificial Sequence: Synthetic oligonucleotide
aaggctcccgagtgtggtctttcctctc

SEQ ID NO: 303804 - DNA, 27 bp, Artificial Sequence
  Description of Artificial Sequence: Synthetic oligonucleotide
aggctcccgagtgtggtctttcctctc

SEQ ID NO: 303805 - DNA, 26 bp, Artificial Sequence
  Description of Artificial Sequence: Synthetic oligonucleotide
ggctcccgagtgtggtctttcctctc

SEQ ID NO: 303806 - DNA, 27 bp, Artificial Sequence
  Description of Artificial Sequence: Synthetic oligonucleotide
gctcccgagtgtggtctttcctctcct

SEQ ID NO: 303807 - DNA, 31 bp, Artificial Sequence
  Description of Artificial Sequence: Synthetic oligonucleotide
ctcccgagtgtggtctttcctctcctttatg

SEQ ID NO: 303808 - DNA, 32 bp, Artificial Sequence
  Description of Artificial Sequence: Synthetic oligonucleotide
tcccgagtgtggtctttcctctcctttatgac

SEQ ID NO: 303809 - DNA, 31 bp, Artificial Sequence
  Description of Artificial Sequence: Synthetic oligonucleotide
cccgagtgtggtctttcctctcctttatgac

SEQ ID NO: 303810 - DNA, 31 bp, Artificial Sequence
  Description of Artificial Sequence: Synthetic oligonucleotide
ccgagtgtggtctttcctctcctttatgacc

SEQ ID NO: 303811 - DNA, 32 bp, Artificial Sequence
  Description of Artificial Sequence: Synthetic oligonucleotide
cgagtgtggtctttcctctcctttatgacctg

SEQ ID NO: 303812 - DNA, 35 bp, Artificial Sequence
  Description of Artificial Sequence: Synthetic oligonucleotide
gagtgtggtctttcctctcctttatgacctgtttg

SEQ ID NO: 303813 - DNA, 36 bp, Artificial Sequence
  Description of Artificial Sequence: Synthetic oligonucleotide
agtgtggtctttcctctcctttatgacctgtttgtc

SEQ ID NO: 303814 - DNA, 35 bp, Artificial Sequence
  Description of Artificial Sequence: Synthetic oligonucleotide
gtgtggtctttcctctcctttatgacctgtttgtc

SEQ ID NO: 303815 - DNA, 35 bp, Artificial Sequence
  Description of Artificial Sequence: Synthetic oligonucleotide
tgtggtctttcctctcctttatgacctgtttgtcc

SEQ ID NO: 303816 - DNA, 34 bp, Artificial Sequence
  Description of Artificial Sequence: Synthetic oligonucleotide
gtggtctttcctctcctttatgacctgtttgtcc

SEQ ID NO: 303817 - DNA, 35 bp, Artificial Sequence
  Description of Artificial Sequence: Synthetic oligonucleotide
tggtctttcctctcctttatgacctgtttgtccac

SEQ ID NO: 303818 - DNA, 34 bp, Artificial Sequence
  Description of Artificial Sequence: Synthetic oligonucleotide
ggtctttcctctcctttatgacctgtttgtccac

SEQ ID NO: 303819 - DNA, 34 bp, Artificial Sequence
  Description of Artificial Sequence: Synthetic oligonucleotide
gtctttcctctcctttatgacctgtttgtccacg

SEQ ID NO: 303820 - DNA, 34 bp, Artificial Sequence
  Description of Artificial Sequence: Synthetic oligonucleotide
tctttcctctcctttatgacctgtttgtccacgc

SEQ ID NO: 303821 - DNA, 33 bp, Artificial Sequence
  Description of Artificial Sequence: Synthetic oligonucleotide
ctttcctctcctttatgacctgtttgtccacgc

SEQ ID NO: 303822 - DNA, 33 bp, Artificial Sequence
  Description of Artificial Sequence: Synthetic oligonucleotide
tttcctctcctttatgacctgtttgtccacgcc

SEQ ID NO: 303823 - DNA, 32 bp, Artificial Sequence
  Description of Artificial Sequence: Synthetic oligonucleotide
ttcctctcctttatgacctgtttgtccacgcc

SEQ ID NO: 303824 - DNA, 31 bp, Artificial Sequence
  Description of Artificial Sequence: Synthetic oligonucleotide
tcctctcctttatgacctgtttgtccacgcc

SEQ ID NO: 303825 - DNA, 30 bp, Artificial Sequence
  Description of Artificial Sequence: Synthetic oligonucleotide
cctctcctttatgacctgtttgtccacgcc

SEQ ID NO: 303826 - DNA, 33 bp, Artificial Sequence
  Description of Artificial Sequence: Synthetic oligonucleotide
ctctcctttatgacctgtttgtccacgccaatc

SEQ ID NO: 303827 - DNA, 34 bp, Artificial Sequence
  Description of Artificial Sequence: Synthetic oligonucleotide
tctcctttatgacctgtttgtccacgccaatctc

SEQ ID NO: 303828 - DNA, 33 bp, Artificial Sequence
  Description of Artificial Sequence: Synthetic oligonucleotide
ctcctttatgacctgtttgtccacgccaatctc

SEQ ID NO: 303829 - DNA, 34 bp, Artificial Sequence
  Description of Artificial Sequence: Synthetic oligonucleotide
tcctttatgacctgtttgtccacgccaatctcag

SEQ ID NO: 303830 - DNA, 33 bp, Artificial Sequence
  Description of Artificial Sequence: Synthetic oligonucleotide
cctttatgacctgtttgtccacgccaatctcag

SEQ ID NO: 303831 - DNA, 33 bp, Artificial Sequence
  Description of Artificial Sequence: Synthetic oligonucleotide
ctttatgacctgtttgtccacgccaatctcagc

SEQ ID NO: 303832 - DNA, 34 bp, Artificial Sequence
  Description of Artificial Sequence: Synthetic oligonucleotide
tttatgacctgtttgtccacgccaatctcagctc

SEQ ID NO: 303833 - DNA, 33 bp, Artificial Sequence
  Description of Artificial Sequence: Synthetic oligonucleotide
ttatgacctgtttgtccacgccaatctcagctc

SEQ ID NO: 303834 - DNA, 32 bp, Artificial Sequence
  Description of Artificial Sequence: Synthetic oligonucleotide
tatgacctgtttgtccacgccaatctcagctc

SEQ ID NO: 303835 - DNA, 31 bp, Artificial Sequence
  Description of Artificial Sequence: Synthetic oligonucleotide
atgacctgtttgtccacgccaatctcagctc

SEQ ID NO: 303836 - DNA, 30 bp, Artificial Sequence
  Description of Artificial Sequence: Synthetic oligonucleotide
tgacctgtttgtccacgccaatctcagctc

SEQ ID NO: 303837 - DNA, 29 bp, Artificial Sequence
  Description of Artificial Sequence: Synthetic oligonucleotide
gacctgtttgtccacgccaatctcagctc

SEQ ID NO: 303838 - DNA, 30 bp, Artificial Sequence
  Description of Artificial Sequence: Synthetic oligonucleotide
acctgtttgtccacgccaatctcagctctc

SEQ ID NO: 303839 - DNA, 29 bp, Artificial Sequence
  Description of Artificial Sequence: Synthetic oligonucleotide
cctgtttgtccacgccaatctcagctctc

SEQ ID NO: 303840 - DNA, 30 bp, Artificial Sequence
  Description of Artificial Sequence: Synthetic oligonucleotide
ctgtttgtccacgccaatctcagctctctg

SEQ ID NO: 303841 - DNA, 30 bp, Artificial Sequence
  Description of Artificial Sequence: Synthetic oligonucleotide
tgtttgtccacgccaatctcagctctctgg

SEQ ID NO: 303842 - DNA, 29 bp, Artificial Sequence
  Description of Artificial Sequence: Synthetic oligonucleotide
gtttgtccacgccaatctcagctctctgg

SEQ ID NO: 303843 - DNA, 30 bp, Artificial Sequence
  Description of Artificial Sequence: Synthetic oligonucleotide
tttgtccacgccaatctcagctctctggag

SEQ ID NO: 303844 - DNA, 29 bp, Artificial Sequence
  Description of Artificial Sequence: Synthetic oligonucleotide
ttgtccacgccaatctcagctctctggag

SEQ ID NO: 303845 - DNA, 28 bp, Artificial Sequence
  Description of Artificial Sequence: Synthetic oligonucleotide
tgtccacgccaatctcagctctctggag

SEQ ID NO: 303846 - DNA, 27 bp, Artificial Sequence
  Description of Artificial Sequence: Synthetic oligonucleotide
gtccacgccaatctcagctctctggag

SEQ ID NO: 303847 - DNA, 30 bp, Artificial Sequence
  Description of Artificial Sequence: Synthetic oligonucleotide
tccacgccaatctcagctctctggagtttg

SEQ ID NO: 303848 - DNA, 29 bp, Artificial Sequence
  Description of Artificial Sequence: Synthetic oligonucleotide
ccacgccaatctcagctctctggagtttg

SEQ ID NO: 303849 - DNA, 31 bp, Artificial Sequence
  Description of Artificial Sequence: Synthetic oligonucleotide
cacgccaatctcagctctctggagtttgttg

SEQ ID NO: 303850 - DNA, 31 bp, Artificial Sequence
  Description of Artificial Sequence: Synthetic oligonucleotide
acgccaatctcagctctctggagtttgttgc

SEQ ID NO: 303851 - DNA, 30 bp, Artificial Sequence
  Description of Artificial Sequence: Synthetic oligonucleotide
cgccaatctcagctctctggagtttgttgc

SEQ ID NO: 303852 - DNA, 32 bp, Artificial Sequence
  Description of Artificial Sequence: Synthetic oligonucleotide
gccaatctcagctctctggagtttgttgcaac

SEQ ID NO: 303853 - DNA, 33 bp, Artificial Sequence
  Description of Artificial Sequence: Synthetic oligonucleotide
ccaatctcagctctctggagtttgttgcaactg

SEQ ID NO: 303854 - DNA, 34 bp, Artificial Sequence
  Description of Artificial Sequence: Synthetic oligonucleotide
caatctcagctctctggagtttgttgcaactgag

SEQ ID NO: 303855 - DNA, 36 bp, Artificial Sequence
  Description of Artificial Sequence: Synthetic oligonucleotide
aatctcagctctctggagtttgttgcaactgagaag

SEQ ID NO: 303856 - DNA, 35 bp, Artificial Sequence
  Description of Artificial Sequence: Synthetic oligonucleotide
atctcagctctctggagtttgttgcaactgagaag

SEQ ID NO: 303857 - DNA, 34 bp, Artificial Sequence
  Description of Artificial Sequence: Synthetic oligonucleotide
tctcagctctctggagtttgttgcaactgagaag

SEQ ID NO: 303858 - DNA, 33 bp, Artificial Sequence
  Description of Artificial Sequence: Synthetic oligonucleotide
ctcagctctctggagtttgttgcaactgagaag

SEQ ID NO: 303859 - DNA, 35 bp, Artificial Sequence
  Description of Artificial Sequence: Synthetic oligonucleotide
tcagctctctggagtttgttgcaactgagaagaac

SEQ ID NO: 303860 - DNA, 34 bp, Artificial Sequence
  Description of Artificial Sequence: Synthetic oligonucleotide
cagctctctggagtttgttgcaactgagaagaac

SEQ ID NO: 303861 - DNA, 34 bp, Artificial Sequence
  Description of Artificial Sequence: Synthetic oligonucleotide
agctctctggagtttgttgcaactgagaagaacg

SEQ ID NO: 303862 - DNA, 33 bp, Artificial Sequence
  Description of Artificial Sequence: Synthetic oligonucleotide
gctctctggagtttgttgcaactgagaagaacg

SEQ ID NO: 303863 - DNA, 35 bp, Artificial Sequence
  Description of Artificial Sequence: Synthetic oligonucleotide
ctctctggagtttgttgcaactgagaagaacgaag

SEQ ID NO: 303864 - DNA, 36 bp, Artificial Sequence
  Description of Artificial Sequence: Synthetic oligonucleotide
tctctggagtttgttgcaactgagaagaacgaagtc

SEQ ID NO: 303865 - DNA, 35 bp, Artificial Sequence
  Description of Artificial Sequence: Synthetic oligonucleotide
ctctggagtttgttgcaactgagaagaacgaagtc

SEQ ID NO: 303866 - DNA, 37 bp, Artificial Sequence
  Description of Artificial Sequence: Synthetic oligonucleotide
tctggagtttgttgcaactgagaagaacgaagtcttc

SEQ ID NO: 303867 - DNA, 36 bp, Artificial Sequence
  Description of Artificial Sequence: Synthetic oligonucleotide
ctggagtttgttgcaactgagaagaacgaagtcttc

SEQ ID NO: 303868 - DNA, 36 bp, Artificial Sequence
  Description of Artificial Sequence: Synthetic oligonucleotide
tggagtttgttgcaactgagaagaacgaagtcttcg

SEQ ID NO: 303869 - DNA, 35 bp, Artificial Sequence
  Description of Artificial Sequence: Synthetic oligonucleotide
ggagtttgttgcaactgagaagaacgaagtcttcg

SEQ ID NO: 303870 - DNA, 36 bp, Artificial Sequence
  Description of Artificial Sequence: Synthetic oligonucleotide
gagtttgttgcaactgagaagaacgaagtcttcgtc

SEQ ID NO: 303871 - DNA, 37 bp, Artificial Sequence
  Description of Artificial Sequence: Synthetic oligonucleotide
agtttgttgcaactgagaagaacgaagtcttcgtcag

SEQ ID NO: 303872 - DNA, 36 bp, Artificial Sequence
  Description of Artificial Sequence: Synthetic oligonucleotide
gtttgttgcaactgagaagaacgaagtcttcgtcag

SEQ ID NO: 303873 - DNA, 36 bp, Artificial Sequence
  Description of Artificial Sequence: Synthetic oligonucleotide
tttgttgcaactgagaagaacgaagtcttcgtcagc

SEQ ID NO: 303874 - DNA, 35 bp, Artificial Sequence
  Description of Artificial Sequence: Synthetic oligonucleotide
ttgttgcaactgagaagaacgaagtcttcgtcagc

SEQ ID NO: 303875 - DNA, 34 bp, Artificial Sequence
  Description of Artificial Sequence: Synthetic oligonucleotide
tgttgcaactgagaagaacgaagtcttcgtcagc

SEQ ID NO: 303876 - DNA, 33 bp, Artificial Sequence
  Description of Artificial Sequence: Synthetic oligonucleotide
gttgcaactgagaagaacgaagtcttcgtcagc

SEQ ID NO: 303877 - DNA, 36 bp, Artificial Sequence
  Description of Artificial Sequence: Synthetic oligonucleotide
ttgcaactgagaagaacgaagtcttcgtcagcaatc

SEQ ID NO: 303878 - DNA, 35 bp, Artificial Sequence
  Description of Artificial Sequence: Synthetic oligonucleotide
tgcaactgagaagaacgaagtcttcgtcagcaatc

SEQ ID NO: 303879 - DNA, 34 bp, Artificial Sequence
  Description of Artificial Sequence: Synthetic oligonucleotide
gcaactgagaagaacgaagtcttcgtcagcaatc

SEQ ID NO: 303880 - DNA, 34 bp, Artificial Sequence
  Description of Artificial Sequence: Synthetic oligonucleotide
caactgagaagaacgaagtcttcgtcagcaatcc

SEQ ID NO: 303881 - DNA, 36 bp, Artificial Sequence
  Description of Artificial Sequence: Synthetic oligonucleotide
aactgagaagaacgaagtcttcgtcagcaatcctac

SEQ ID NO: 303882 - DNA, 35 bp, Artificial Sequence
  Description of Artificial Sequence: Synthetic oligonucleotide
actgagaagaacgaagtcttcgtcagcaatcctac

SEQ ID NO: 303883 - DNA, 34 bp, Artificial Sequence
  Description of Artificial Sequence: Synthetic oligonucleotide
ctgagaagaacgaagtcttcgtcagcaatcctac

SEQ ID NO: 303884 - DNA, 34 bp, Artificial Sequence
  Description of Artificial Sequence: Synthetic oligonucleotide
tgagaagaacgaagtcttcgtcagcaatcctacc

SEQ ID NO: 303885 - DNA, 33 bp, Artificial Sequence
  Description of Artificial Sequence: Synthetic oligonucleotide
gagaagaacgaagtcttcgtcagcaatcctacc

SEQ ID NO: 303886 - DNA, 33 bp, Artificial Sequence
  Description of Artificial Sequence: Synthetic oligonucleotide
agaagaacgaagtcttcgtcagcaatcctaccc

SEQ ID NO: 303887 - DNA, 32 bp, Artificial Sequence
  Description of Artificial Sequence: Synthetic oligonucleotide
gaagaacgaagtcttcgtcagcaatcctaccc

SEQ ID NO: 303888 - DNA, 33 bp, Artificial Sequence
  Description of Artificial Sequence: Synthetic oligonucleotide
aagaacgaagtcttcgtcagcaatcctacccag

SEQ ID NO: 303889 - DNA, 32 bp, Artificial Sequence
  Description of Artificial Sequence: Synthetic oligonucleotide
agaacgaagtcttcgtcagcaatcctacccag

SEQ ID NO: 303890 - DNA, 31 bp, Artificial Sequence
  Description of Artificial Sequence: Synthetic oligonucleotide
gaacgaagtcttcgtcagcaatcctacccag

SEQ ID NO: 303891 - DNA, 36 bp, Artificial Sequence
  Description of Artificial Sequence: Synthetic oligonucleotide
aacgaagtcttcgtcagcaatcctacccagtatatc

SEQ ID NO: 303892 - DNA, 35 bp, Artificial Sequence
  Description of Artificial Sequence: Synthetic oligonucleotide
acgaagtcttcgtcagcaatcctacccagtatatc

SEQ ID NO: 303893 - DNA, 34 bp, Artificial Sequence
  Description of Artificial Sequence: Synthetic oligonucleotide
cgaagtcttcgtcagcaatcctacccagtatatc

SEQ ID NO: 303894 - DNA, 36 bp, Artificial Sequence
  Description of Artificial Sequence: Synthetic oligonucleotide
gaagtcttcgtcagcaatcctacccagtatatcatc

SEQ ID NO: 303895 - DNA, 38 bp, Artificial Sequence
  Description of Artificial Sequence: Synthetic oligonucleotide
aagtcttcgtcagcaatcctacccagtatatcatcttc

SEQ ID NO: 303896 - DNA, 37 bp, Artificial Sequence
  Description of Artificial Sequence: Synthetic oligonucleotide
agtcttcgtcagcaatcctacccagtatatcatcttc

SEQ ID NO: 303897 - DNA, 36 bp, Artificial Sequence
  Description of Artificial Sequence: Synthetic oligonucleotide
gtcttcgtcagcaatcctacccagtatatcatcttc

SEQ ID NO: 303898 - DNA, 36 bp, Artificial Sequence
  Description of Artificial Sequence: Synthetic oligonucleotide
tcttcgtcagcaatcctacccagtatatcatcttcc

SEQ ID NO: 303899 - DNA, 35 bp, Artificial Sequence
  Description of Artificial Sequence: Synthetic oligonucleotide
cttcgtcagcaatcctacccagtatatcatcttcc

SEQ ID NO: 303900 - DNA, 36 bp, Artificial Sequence
  Description of Artificial Sequence: Synthetic oligonucleotide
ttcgtcagcaatcctacccagtatatcatcttccac

SEQ ID NO: 303901 - DNA, 35 bp, Artificial Sequence
  Description of Artificial Sequence: Synthetic oligonucleotide
tcgtcagcaatcctacccagtatatcatcttccac

SEQ ID NO: 303902 - DNA, 34 bp, Artificial Sequence
  Description of Artificial Sequence: Synthetic oligonucleotide
cgtcagcaatcctacccagtatatcatcttccac

SEQ ID NO: 303903 - DNA, 35 bp, Artificial Sequence
  Description of Artificial Sequence: Synthetic oligonucleotide
gtcagcaatcctacccagtatatcatcttccacag

SEQ ID NO: 303904 - DNA, 35 bp, Artificial Sequence
  Description of Artificial Sequence: Synthetic oligonucleotide
tcagcaatcctacccagtatatcatcttccacagc

SEQ ID NO: 303905 - DNA, 34 bp, Artificial Sequence
  Description of Artificial Sequence: Synthetic oligonucleotide
cagcaatcctacccagtatatcatcttccacagc

SEQ ID NO: 303906 - DNA, 37 bp, Artificial Sequence
  Description of Artificial Sequence: Synthetic oligonucleotide
agcaatcctacccagtatatcatcttccacagcaaac

SEQ ID NO: 303907 - DNA, 36 bp, Artificial Sequence
  Description of Artificial Sequence: Synthetic oligonucleotide
gcaatcctacccagtatatcatcttccacagcaaac

SEQ ID NO: 303908 - DNA, 38 bp, Artificial Sequence
  Description of Artificial Sequence: Synthetic oligonucleotide
caatcctacccagtatatcatcttccacagcaaacatc

SEQ ID NO: 303909 - DNA, 40 bp, Artificial Sequence
  Description of Artificial Sequence: Synthetic oligonucleotide
aatcctacccagtatatcatcttccacagcaaacatcttg

SEQ ID NO: 303910 - DNA, 39 bp, Artificial Sequence
  Description of Artificial Sequence: Synthetic oligonucleotide
atcctacccagtatatcatcttccacagcaaacatcttg

SEQ ID NO: 303911 - DNA, 38 bp, Artificial Sequence
  Description of Artificial Sequence: Synthetic oligonucleotide
tcctacccagtatatcatcttccacagcaaacatcttg

SEQ ID NO: 303912 - DNA, 37 bp, Artificial Sequence
  Description of Artificial Sequence: Synthetic oligonucleotide
cctacccagtatatcatcttccacagcaaacatcttg

SEQ ID NO: 303913 - DNA, 41 bp, Artificial Sequence
  Description of Artificial Sequence: Synthetic oligonucleotide
ctacccagtatatcatcttccacagcaaacatcttgaaaac

SEQ ID NO: 303914 - DNA, 42 bp, Artificial Sequence
  Description of Artificial Sequence: Synthetic oligonucleotide
tacccagtatatcatcttccacagcaaacatcttgaaaacac

SEQ ID NO: 303915 - DNA, 41 bp, Artificial Sequence
  Description of Artificial Sequence: Synthetic oligonucleotide
acccagtatatcatcttccacagcaaacatcttgaaaacac

SEQ ID NO: 303916 - DNA, 40 bp, Artificial Sequence
  Description of Artificial Sequence: Synthetic oligonucleotide
cccagtatatcatcttccacagcaaacatcttgaaaacac

SEQ ID NO: 303917 - DNA, 40 bp, Artificial Sequence
  Description of Artificial Sequence: Synthetic oligonucleotide
ccagtatatcatcttccacagcaaacatcttgaaaacacg

SEQ ID NO: 303918 - DNA, 43 bp, Artificial Sequence
  Description of Artificial Sequence: Synthetic oligonucleotide
cagtatatcatcttccacagcaaacatcttgaaaacacgaatg

SEQ ID NO: 303919 - DNA, 43 bp, Artificial Sequence
  Description of Artificial Sequence: Synthetic oligonucleotide
agtatatcatcttccacagcaaacatcttgaaaacacgaatgc

SEQ ID NO: 303920 - DNA, 42 bp, Artificial Sequence
  Description of Artificial Sequence: Synthetic oligonucleotide
gtatatcatcttccacagcaaacatcttgaaaacacgaatgc

SEQ ID NO: 303921 - DNA, 42 bp, Artificial Sequence
  Description of Artificial Sequence: Synthetic oligonucleotide
tatatcatcttccacagcaaacatcttgaaaacacgaatgcg

SEQ ID NO: 303922 - DNA, 41 bp, Artificial Sequence
  Description of Artificial Sequence: Synthetic oligonucleotide
atatcatcttccacagcaaacatcttgaaaacacgaatgcg

SEQ ID NO: 303923 - DNA, 40 bp, Artificial Sequence
  Description of Artificial Sequence: Synthetic oligonucleotide
tatcatcttccacagcaaacatcttgaaaacacgaatgcg

SEQ ID NO: 303924 - DNA, 39 bp, Artificial Sequence
  Description of Artificial Sequence: Synthetic oligonucleotide
atcatcttccacagcaaacatcttgaaaacacgaatgcg

SEQ ID NO: 303925 - DNA, 38 bp, Artificial Sequence
  Description of Artificial Sequence: Synthetic oligonucleotide
tcatcttccacagcaaacatcttgaaaacacgaatgcg

SEQ ID NO: 303926 - DNA, 37 bp, Artificial Sequence
  Description of Artificial Sequence: Synthetic oligonucleotide
catcttccacagcaaacatcttgaaaacacgaatgcg

SEQ ID NO: 303927 - DNA, 38 bp, Artificial Sequence
  Description of Artificial Sequence: Synthetic oligonucleotide
atcttccacagcaaacatcttgaaaacacgaatgcgac

SEQ ID NO: 303928 - DNA, 37 bp, Artificial Sequence
  Description of Artificial Sequence: Synthetic oligonucleotide
tcttccacagcaaacatcttgaaaacacgaatgcgac

SEQ ID NO: 303929 - DNA, 36 bp, Artificial Sequence
  Description of Artificial Sequence: Synthetic oligonucleotide
cttccacagcaaacatcttgaaaacacgaatgcgac

SEQ ID NO: 303930 - DNA, 36 bp, Artificial Sequence
  Description of Artificial Sequence: Synthetic oligonucleotide
ttccacagcaaacatcttgaaaacacgaatgcgacc

SEQ ID NO: 303931 - DNA, 35 bp, Artificial Sequence
  Description of Artificial Sequence: Synthetic oligonucleotide
tccacagcaaacatcttgaaaacacgaatgcgacc

SEQ ID NO: 303932 - DNA, 34 bp, Artificial Sequence
  Description of Artificial Sequence: Synthetic oligonucleotide
ccacagcaaacatcttgaaaacacgaatgcgacc

SEQ ID NO: 303933 - DNA, 34 bp, Artificial Sequence
  Description of Artificial Sequence: Synthetic oligonucleotide
cacagcaaacatcttgaaaacacgaatgcgaccc

SEQ ID NO: 303934 - DNA, 36 bp, Artificial Sequence
  Description of Artificial Sequence: Synthetic oligonucleotide
acagcaaacatcttgaaaacacgaatgcgacccttc

SEQ ID NO: 303935 - DNA, 35 bp, Artificial Sequence
  Description of Artificial Sequence: Synthetic oligonucleotide
cagcaaacatcttgaaaacacgaatgcgacccttc

SEQ ID NO: 303936 - DNA, 36 bp, Artificial Sequence
  Description of Artificial Sequence: Synthetic oligonucleotide
agcaaacatcttgaaaacacgaatgcgacccttcag

SEQ ID NO: 303937 - DNA, 35 bp, Artificial Sequence
  Description of Artificial Sequence: Synthetic oligonucleotide
gcaaacatcttgaaaacacgaatgcgacccttcag

SEQ ID NO: 303938 - DNA, 36 bp, Artificial Sequence
  Description of Artificial Sequence: Synthetic oligonucleotide
caaacatcttgaaaacacgaatgcgacccttcagac

SEQ ID NO: 303939 - DNA, 37 bp, Artificial Sequence
  Description of Artificial Sequence: Synthetic oligonucleotide
aaacatcttgaaaacacgaatgcgacccttcagacag

SEQ ID NO: 303940 - DNA, 36 bp, Artificial Sequence
  Description of Artificial Sequence: Synthetic oligonucleotide
aacatcttgaaaacacgaatgcgacccttcagacag

SEQ ID NO: 303941 - DNA, 35 bp, Artificial Sequence
  Description of Artificial Sequence: Synthetic oligonucleotide
acatcttgaaaacacgaatgcgacccttcagacag

SEQ ID NO: 303942 - DNA, 34 bp, Artificial Sequence
  Description of Artificial Sequence: Synthetic oligonucleotide
catcttgaaaacacgaatgcgacccttcagacag

SEQ ID NO: 303943 - DNA, 35 bp, Artificial Sequence
  Description of Artificial Sequence: Synthetic oligonucleotide
atcttgaaaacacgaatgcgacccttcagacagag

SEQ ID NO: 303944 - DNA, 34 bp, Artificial Sequence
  Description of Artificial Sequence: Synthetic oligonucleotide
tcttgaaaacacgaatgcgacccttcagacagag

SEQ ID NO: 303945 - DNA, 33 bp, Artificial Sequence
  Description of Artificial Sequence: Synthetic oligonucleotide
cttgaaaacacgaatgcgacccttcagacagag

SEQ ID NO: 303946 - DNA, 33 bp, Artificial Sequence
  Description of Artificial Sequence: Synthetic oligonucleotide
ttgaaaacacgaatgcgacccttcagacagagg

SEQ ID NO: 303947 - DNA, 32 bp, Artificial Sequence
  Description of Artificial Sequence: Synthetic oligonucleotide
tgaaaacacgaatgcgacccttcagacagagg

SEQ ID NO: 303948 - DNA, 31 bp, Artificial Sequence
  Description of Artificial Sequence: Synthetic oligonucleotide
gaaaacacgaatgcgacccttcagacagagg

SEQ ID NO: 303949 - DNA, 33 bp, Artificial Sequence
  Description of Artificial Sequence: Synthetic oligonucleotide
aaaacacgaatgcgacccttcagacagaggaag

SEQ ID NO: 303950 - DNA, 32 bp, Artificial Sequence
  Description of Artificial Sequence: Synthetic oligonucleotide
aaacacgaatgcgacccttcagacagaggaag

SEQ ID NO: 303951 - DNA, 31 bp, Artificial Sequence
  Description of Artificial Sequence: Synthetic oligonucleotide
aacacgaatgcgacccttcagacagaggaag

SEQ ID NO: 303952 - DNA, 30 bp, Artificial Sequence
  Description of Artificial Sequence: Synthetic oligonucleotide
acacgaatgcgacccttcagacagaggaag

SEQ ID NO: 303953 - DNA, 29 bp, Artificial Sequence
  Description of Artificial Sequence: Synthetic oligonucleotide
cacgaatgcgacccttcagacagaggaag

SEQ ID NO: 303954 - DNA, 32 bp, Artificial Sequence
  Description of Artificial Sequence: Synthetic oligonucleotide
acgaatgcgacccttcagacagaggaagtttc

SEQ ID NO: 303955 - DNA, 31 bp, Artificial Sequence
  Description of Artificial Sequence: Synthetic oligonucleotide
cgaatgcgacccttcagacagaggaagtttc

SEQ ID NO: 303956 - DNA, 33 bp, Artificial Sequence
  Description of Artificial Sequence: Synthetic oligonucleotide
gaatgcgacccttcagacagaggaagtttcaag

SEQ ID NO: 303957 - DNA, 36 bp, Artificial Sequence
  Description of Artificial Sequence: Synthetic oligonucleotide
aatgcgacccttcagacagaggaagtttcaagatag

SEQ ID NO: 303958 - DNA, 35 bp, Artificial Sequence
  Description of Artificial Sequence: Synthetic oligonucleotide
atgcgacccttcagacagaggaagtttcaagatag

SEQ ID NO: 303959 - DNA, 34 bp, Artificial Sequence
  Description of Artificial Sequence: Synthetic oligonucleotide
tgcgacccttcagacagaggaagtttcaagatag

SEQ ID NO: 303960 - DNA, 33 bp, Artificial Sequence
  Description of Artificial Sequence: Synthetic oligonucleotide
gcgacccttcagacagaggaagtttcaagatag

SEQ ID NO: 303961 - DNA, 35 bp, Artificial Sequence
  Description of Artificial Sequence: Synthetic oligonucleotide
cgacccttcagacagaggaagtttcaagatagatg

SEQ ID NO: 303962 - DNA, 38 bp, Artificial Sequence
  Description of Artificial Sequence: Synthetic oligonucleotide
gacccttcagacagaggaagtttcaagatagatgaaac

SEQ ID NO: 303963 - DNA, 38 bp, Artificial Sequence
  Description of Artificial Sequence: Synthetic oligonucleotide
acccttcagacagaggaagtttcaagatagatgaaacc

SEQ ID NO: 303964 - DNA, 37 bp, Artificial Sequence
  Description of Artificial Sequence: Synthetic oligonucleotide
cccttcagacagaggaagtttcaagatagatgaaacc

SEQ ID NO: 303965 - DNA, 38 bp, Artificial Sequence
  Description of Artificial Sequence: Synthetic oligonucleotide
ccttcagacagaggaagtttcaagatagatgaaaccac

SEQ ID NO: 303966 - DNA, 38 bp, Artificial Sequence
  Description of Artificial Sequence: Synthetic oligonucleotide
cttcagacagaggaagtttcaagatagatgaaaccacg

SEQ ID NO: 303967 - DNA, 42 bp, Artificial Sequence
  Description of Artificial Sequence: Synthetic oligonucleotide
ttcagacagaggaagtttcaagatagatgaaaccacgaaaag

SEQ ID NO: 303968 - DNA, 41 bp, Artificial Sequence
  Description of Artificial Sequence: Synthetic oligonucleotide
tcagacagaggaagtttcaagatagatgaaaccacgaaaag

SEQ ID NO: 303969 - DNA, 40 bp, Artificial Sequence
  Description of Artificial Sequence: Synthetic oligonucleotide
cagacagaggaagtttcaagatagatgaaaccacgaaaag

SEQ ID NO: 303970 - DNA, 42 bp, Artificial Sequence
  Description of Artificial Sequence: Synthetic oligonucleotide
agacagaggaagtttcaagatagatgaaaccacgaaaagaac

SEQ ID NO: 303971 - DNA, 41 bp, Artificial Sequence
  Description of Artificial Sequence: Synthetic oligonucleotide
gacagaggaagtttcaagatagatgaaaccacgaaaagaac

SEQ ID NO: 303972 - DNA, 42 bp, Artificial Sequence
  Description of Artificial Sequence: Synthetic oligonucleotide
acagaggaagtttcaagatagatgaaaccacgaaaagaacag

SEQ ID NO: 303973 - DNA, 41 bp, Artificial Sequence
  Description of Artificial Sequence: Synthetic oligonucleotide
cagaggaagtttcaagatagatgaaaccacgaaaagaacag

SEQ ID NO: 303974 - DNA, 44 bp, Artificial Sequence
  Description of Artificial Sequence: Synthetic oligonucleotide
agaggaagtttcaagatagatgaaaccacgaaaagaacagaaag

SEQ ID NO: 303975 - DNA, 43 bp, Artificial Sequence
  Description of Artificial Sequence: Synthetic oligonucleotide
gaggaagtttcaagatagatgaaaccacgaaaagaacagaaag

SEQ ID NO: 303976 - DNA, 47 bp, Artificial Sequence
  Description of Artificial Sequence: Synthetic oligonucleotide
aggaagtttcaagatagatgaaaccacgaaaagaacagaaagttttc

SEQ ID NO: 303977 - DNA, 46 bp, Artificial Sequence
  Description of Artificial Sequence: Synthetic oligonucleotide
ggaagtttcaagatagatgaaaccacgaaaagaacagaaagttttc

SEQ ID NO: 303978 - DNA, 47 bp, Artificial Sequence
  Description of Artificial Sequence: Synthetic oligonucleotide
gaagtttcaagatagatgaaaccacgaaaagaacagaaagttttcag

SEQ ID NO: 303979 - DNA, 50 bp, Artificial Sequence
  Description of Artificial Sequence: Synthetic oligonucleotide
aagtttcaagatagatgaaaccacgaaaagaacagaaagttttcagttac

SEQ ID NO: 303980 - DNA, 49 bp, Artificial Sequence
  Description of Artificial Sequence: Synthetic oligonucleotide
agtttcaagatagatgaaaccacgaaaagaacagaaagttttcagttac

SEQ ID NO: 303981 - DNA, 48 bp, Artificial Sequence
  Description of Artificial Sequence: Synthetic oligonucleotide
gtttcaagatagatgaaaccacgaaaagaacagaaagttttcagttac

SEQ ID NO: 303982 - DNA, 48 bp, Artificial Sequence
  Description of Artificial Sequence: Synthetic oligonucleotide
tttcaagatagatgaaaccacgaaaagaacagaaagttttcagttacc

SEQ ID NO: 303983 - DNA, 47 bp, Artificial Sequence
  Description of Artificial Sequence: Synthetic oligonucleotide
ttcaagatagatgaaaccacgaaaagaacagaaagttttcagttacc

SEQ ID NO: 303984 - DNA, 46 bp, Artificial Sequence
  Description of Artificial Sequence: Synthetic oligonucleotide
tcaagatagatgaaaccacgaaaagaacagaaagttttcagttacc

SEQ ID NO: 303985 - DNA, 45 bp, Artificial Sequence
  Description of Artificial Sequence: Synthetic oligonucleotide
caagatagatgaaaccacgaaaagaacagaaagttttcagttacc

SEQ ID NO: 303986 - DNA, 45 bp, Artificial Sequence
  Description of Artificial Sequence: Synthetic oligonucleotide
aagatagatgaaaccacgaaaagaacagaaagttttcagttaccc

SEQ ID NO: 303987 - DNA, 44 bp, Artificial Sequence
  Description of Artificial Sequence: Synthetic oligonucleotide
agatagatgaaaccacgaaaagaacagaaagttttcagttaccc

SEQ ID NO: 303988 - DNA, 43 bp, Artificial Sequence
  Description of Artificial Sequence: Synthetic oligonucleotide
gatagatgaaaccacgaaaagaacagaaagttttcagttaccc

SEQ ID NO: 303989 - DNA, 44 bp, Artificial Sequence
  Description of Artificial Sequence: Synthetic oligonucleotide
atagatgaaaccacgaaaagaacagaaagttttcagttaccctc

SEQ ID NO: 303990 - DNA, 43 bp, Artificial Sequence
  Description of Artificial Sequence: Synthetic oligonucleotide
tagatgaaaccacgaaaagaacagaaagttttcagttaccctc

SEQ ID NO: 303991 - DNA, 42 bp, Artificial Sequence
  Description of Artificial Sequence: Synthetic oligonucleotide
agatgaaaccacgaaaagaacagaaagttttcagttaccctc

SEQ ID NO: 303992 - DNA, 41 bp, Artificial Sequence
  Description of Artificial Sequence: Synthetic oligonucleotide
gatgaaaccacgaaaagaacagaaagttttcagttaccctc

SEQ ID NO: 303993 - DNA, 41 bp, Artificial Sequence
  Description of Artificial Sequence: Synthetic oligonucleotide
atgaaaccacgaaaagaacagaaagttttcagttaccctcc

SEQ ID NO: 303994 - DNA, 40 bp, Artificial Sequence
  Description of Artificial Sequence: Synthetic oligonucleotide
tgaaaccacgaaaagaacagaaagttttcagttaccctcc

SEQ ID NO: 303995 - DNA, 39 bp, Artificial Sequence
  Description of Artificial Sequence: Synthetic oligonucleotide
gaaaccacgaaaagaacagaaagttttcagttaccctcc

SEQ ID NO: 303996 - DNA, 40 bp, Artificial Sequence
  Description of Artificial Sequence: Synthetic oligonucleotide
aaaccacgaaaagaacagaaagttttcagttaccctcctc

SEQ ID NO: 303997 - DNA, 39 bp, Artificial Sequence
  Description of Artificial Sequence: Synthetic oligonucleotide
aaccacgaaaagaacagaaagttttcagttaccctcctc

SEQ ID NO: 303998 - DNA, 38 bp, Artificial Sequence
  Description of Artificial Sequence: Synthetic oligonucleotide
accacgaaaagaacagaaagttttcagttaccctcctc

SEQ ID NO: 303999 - DNA, 37 bp, Artificial Sequence
  Description of Artificial Sequence: Synthetic oligonucleotide
ccacgaaaagaacagaaagttttcagttaccctcctc

SEQ ID NO: 304000 - DNA, 39 bp, Artificial Sequence
  Description of Artificial Sequence: Synthetic oligonucleotide
cacgaaaagaacagaaagttttcagttaccctcctcatg

SEQ ID NO: 304001 - DNA, 41 bp, Artificial Sequence
  Description of Artificial Sequence: Synthetic oligonucleotide
acgaaaagaacagaaagttttcagttaccctcctcatgaac

SEQ ID NO: 304002 - DNA, 40 bp, Artificial Sequence
  Description of Artificial Sequence: Synthetic oligonucleotide
cgaaaagaacagaaagttttcagttaccctcctcatgaac

SEQ ID NO: 304003 - DNA, 45 bp, Artificial Sequence
  Description of Artificial Sequence: Synthetic oligonucleotide
gaaaagaacagaaagttttcagttaccctcctcatgaactaattg

SEQ ID NO: 304004 - DNA, 45 bp, Artificial Sequence
  Description of Artificial Sequence: Synthetic oligonucleotide
aaaagaacagaaagttttcagttaccctcctcatgaactaattgc

SEQ ID NO: 304005 - DNA, 44 bp, Artificial Sequence
  Description of Artificial Sequence: Synthetic oligonucleotide
aaagaacagaaagttttcagttaccctcctcatgaactaattgc

SEQ ID NO: 304006 - DNA, 43 bp, Artificial Sequence
  Description of Artificial Sequence: Synthetic oligonucleotide
aagaacagaaagttttcagttaccctcctcatgaactaattgc

SEQ ID NO: 304007 - DNA, 42 bp, Artificial Sequence
  Description of Artificial Sequence: Synthetic oligonucleotide
agaacagaaagttttcagttaccctcctcatgaactaattgc

SEQ ID NO: 304008 - DNA, 41 bp, Artificial Sequence
  Description of Artificial Sequence: Synthetic oligonucleotide
gaacagaaagttttcagttaccctcctcatgaactaattgc

SEQ ID NO: 304009 - DNA, 42 bp, Artificial Sequence
  Description of Artificial Sequence: Synthetic oligonucleotide
aacagaaagttttcagttaccctcctcatgaactaattgcac

SEQ ID NO: 304010 - DNA, 41 bp, Artificial Sequence
  Description of Artificial Sequence: Synthetic oligonucleotide
acagaaagttttcagttaccctcctcatgaactaattgcac

SEQ ID NO: 304011 - DNA, 40 bp, Artificial Sequence
  Description of Artificial Sequence: Synthetic oligonucleotide
cagaaagttttcagttaccctcctcatgaactaattgcac

SEQ ID NO: 304012 - DNA, 41 bp, Artificial Sequence
  Description of Artificial Sequence: Synthetic oligonucleotide
agaaagttttcagttaccctcctcatgaactaattgcactc

SEQ ID NO: 304013 - DNA, 40 bp, Artificial Sequence
  Description of Artificial Sequence: Synthetic oligonucleotide
gaaagttttcagttaccctcctcatgaactaattgcactc

SEQ ID NO: 304014 - DNA, 40 bp, Artificial Sequence
  Description of Artificial Sequence: Synthetic oligonucleotide
aaagttttcagttaccctcctcatgaactaattgcactcc

SEQ ID NO: 304015 - DNA, 39 bp, Artificial Sequence
  Description of Artificial Sequence: Synthetic oligonucleotide
aagttttcagttaccctcctcatgaactaattgcactcc

SEQ ID NO: 304016 - DNA, 38 bp, Artificial Sequence
  Description of Artificial Sequence: Synthetic oligonucleotide
agttttcagttaccctcctcatgaactaattgcactcc

SEQ ID NO: 304017 - DNA, 37 bp, Artificial Sequence
  Description of Artificial Sequence: Synthetic oligonucleotide
gttttcagttaccctcctcatgaactaattgcactcc

SEQ ID NO: 304018 - DNA, 38 bp, Artificial Sequence
  Description of Artificial Sequence: Synthetic oligonucleotide
ttttcagttaccctcctcatgaactaattgcactcctg

SEQ ID NO: 304019 - DNA, 37 bp, Artificial Sequence
  Description of Artificial Sequence: Synthetic oligonucleotide
tttcagttaccctcctcatgaactaattgcactcctg

SEQ ID NO: 304020 - DNA, 36 bp, Artificial Sequence
  Description of Artificial Sequence: Synthetic oligonucleotide
ttcagttaccctcctcatgaactaattgcactcctg

SEQ ID NO: 304021 - DNA, 35 bp, Artificial Sequence
  Description of Artificial Sequence: Synthetic oligonucleotide
tcagttaccctcctcatgaactaattgcactcctg

SEQ ID NO: 304022 - DNA, 34 bp, Artificial Sequence
  Description of Artificial Sequence: Synthetic oligonucleotide
cagttaccctcctcatgaactaattgcactcctg

SEQ ID NO: 304023 - DNA, 34 bp, Artificial Sequence
  Description of Artificial Sequence: Synthetic oligonucleotide
agttaccctcctcatgaactaattgcactcctgg

SEQ ID NO: 304024 - DNA, 33 bp, Artificial Sequence
  Description of Artificial Sequence: Synthetic oligonucleotide
gttaccctcctcatgaactaattgcactcctgg

SEQ ID NO: 304025 - DNA, 35 bp, Artificial Sequence
  Description of Artificial Sequence: Synthetic oligonucleotide
ttaccctcctcatgaactaattgcactcctggttc

SEQ ID NO: 304026 - DNA, 34 bp, Artificial Sequence
  Description of Artificial Sequence: Synthetic oligonucleotide
taccctcctcatgaactaattgcactcctggttc

SEQ ID NO: 304027 - DNA, 33 bp, Artificial Sequence
  Description of Artificial Sequence: Synthetic oligonucleotide
accctcctcatgaactaattgcactcctggttc

SEQ ID NO: 304028 - DNA, 32 bp, Artificial Sequence
  Description of Artificial Sequence: Synthetic oligonucleotide
ccctcctcatgaactaattgcactcctggttc

SEQ ID NO: 304029 - DNA, 32 bp, Artificial Sequence
  Description of Artificial Sequence: Synthetic oligonucleotide
cctcctcatgaactaattgcactcctggttcc

SEQ ID NO: 304030 - DNA, 33 bp, Artificial Sequence
  Description of Artificial Sequence: Synthetic oligonucleotide
ctcctcatgaactaattgcactcctggttccac

SEQ ID NO: 304031 - DNA, 34 bp, Artificial Sequence
  Description of Artificial Sequence: Synthetic oligonucleotide
tcctcatgaactaattgcactcctggttccacag

SEQ ID NO: 304032 - DNA, 33 bp, Artificial Sequence
  Description of Artificial Sequence: Synthetic oligonucleotide
cctcatgaactaattgcactcctggttccacag

SEQ ID NO: 304033 - DNA, 36 bp, Artificial Sequence
  Description of Artificial Sequence: Synthetic oligonucleotide
ctcatgaactaattgcactcctggttccacagaaac

SEQ ID NO: 304034 - DNA, 39 bp, Artificial Sequence
  Description of Artificial Sequence: Synthetic oligonucleotide
tcatgaactaattgcactcctggttccacagaaacttag

SEQ ID NO: 304035 - DNA, 38 bp, Artificial Sequence
  Description of Artificial Sequence: Synthetic oligonucleotide
catgaactaattgcactcctggttccacagaaacttag

SEQ ID NO: 304036 - DNA, 38 bp, Artificial Sequence
  Description of Artificial Sequence: Synthetic oligonucleotide
atgaactaattgcactcctggttccacagaaacttagg

SEQ ID NO: 304037 - DNA, 37 bp, Artificial Sequence
  Description of Artificial Sequence: Synthetic oligonucleotide
tgaactaattgcactcctggttccacagaaacttagg

SEQ ID NO: 304038 - DNA, 36 bp, Artificial Sequence
  Description of Artificial Sequence: Synthetic oligonucleotide
gaactaattgcactcctggttccacagaaacttagg

SEQ ID NO: 304039 - DNA, 36 bp, Artificial Sequence
  Description of Artificial Sequence: Synthetic oligonucleotide
aactaattgcactcctggttccacagaaacttaggc

SEQ ID NO: 304040 - DNA, 35 bp, Artificial Sequence
  Description of Artificial Sequence: Synthetic oligonucleotide
actaattgcactcctggttccacagaaacttaggc

SEQ ID NO: 304041 - DNA, 34 bp, Artificial Sequence
  Description of Artificial Sequence: Synthetic oligonucleotide
ctaattgcactcctggttccacagaaacttaggc

SEQ ID NO: 304042 - DNA, 34 bp, Artificial Sequence
  Description of Artificial Sequence: Synthetic oligonucleotide
taattgcactcctggttccacagaaacttaggcc

SEQ ID NO: 304043 - DNA, 33 bp, Artificial Sequence
  Description of Artificial Sequence: Synthetic oligonucleotide
aattgcactcctggttccacagaaacttaggcc

SEQ ID NO: 304044 - DNA, 32 bp, Artificial Sequence
  Description of Artificial Sequence: Synthetic oligonucleotide
attgcactcctggttccacagaaacttaggcc

SEQ ID NO: 304045 - DNA, 31 bp, Artificial Sequence
  Description of Artificial Sequence: Synthetic oligonucleotide
ttgcactcctggttccacagaaacttaggcc

SEQ ID NO: 304046 - DNA, 30 bp, Artificial Sequence
  Description of Artificial Sequence: Synthetic oligonucleotide
tgcactcctggttccacagaaacttaggcc

SEQ ID NO: 304047 - DNA, 29 bp, Artificial Sequence
  Description of Artificial Sequence: Synthetic oligonucleotide
gcactcctggttccacagaaacttaggcc

SEQ ID NO: 304048 - DNA, 30 bp, Artificial Sequence
  Description of Artificial Sequence: Synthetic oligonucleotide
cactcctggttccacagaaacttaggcctc

SEQ ID NO: 304049 - DNA, 31 bp, Artificial Sequence
  Description of Artificial Sequence: Synthetic oligonucleotide
actcctggttccacagaaacttaggcctcac

SEQ ID NO: 304050 - DNA, 30 bp, Artificial Sequence
  Description of Artificial Sequence: Synthetic oligonucleotide
ctcctggttccacagaaacttaggcctcac

SEQ ID NO: 304051 - DNA, 30 bp, Artificial Sequence
  Description of Artificial Sequence: Synthetic oligonucleotide
tcctggttccacagaaacttaggcctcacc

SEQ ID NO: 304052 - DNA, 29 bp, Artificial Sequence
  Description of Artificial Sequence: Synthetic oligonucleotide
cctggttccacagaaacttaggcctcacc

SEQ ID NO: 304053 - DNA, 30 bp, Artificial Sequence
  Description of Artificial Sequence: Synthetic oligonucleotide
ctggttccacagaaacttaggcctcacctc

SEQ ID NO: 304054 - DNA, 35 bp, Artificial Sequence
  Description of Artificial Sequence: Synthetic oligonucleotide
tggttccacagaaacttaggcctcacctcaaatac

SEQ ID NO: 304055 - DNA, 34 bp, Artificial Sequence
  Description of Artificial Sequence: Synthetic oligonucleotide
ggttccacagaaacttaggcctcacctcaaatac

SEQ ID NO: 304056 - DNA, 37 bp, Artificial Sequence
  Description of Artificial Sequence: Synthetic oligonucleotide
gttccacagaaacttaggcctcacctcaaatactatc

SEQ ID NO: 304057 - DNA, 38 bp, Artificial Sequence
  Description of Artificial Sequence: Synthetic oligonucleotide
ttccacagaaacttaggcctcacctcaaatactatctg

SEQ ID NO: 304058 - DNA, 37 bp, Artificial Sequence
  Description of Artificial Sequence: Synthetic oligonucleotide
tccacagaaacttaggcctcacctcaaatactatctg

SEQ ID NO: 304059 - DNA, 36 bp, Artificial Sequence
  Description of Artificial Sequence: Synthetic oligonucleotide
ccacagaaacttaggcctcacctcaaatactatctg

SEQ ID NO: 304060 - DNA, 36 bp, Artificial Sequence
  Description of Artificial Sequence: Synthetic oligonucleotide
cacagaaacttaggcctcacctcaaatactatctgg

SEQ ID NO: 304061 - DNA, 36 bp, Artificial Sequence
  Description of Artificial Sequence: Synthetic oligonucleotide
acagaaacttaggcctcacctcaaatactatctggc

SEQ ID NO: 304062 - DNA, 35 bp, Artificial Sequence
  Description of Artificial Sequence: Synthetic oligonucleotide
cagaaacttaggcctcacctcaaatactatctggc

SEQ ID NO: 304063 - DNA, 38 bp, Artificial Sequence
  Description of Artificial Sequence: Synthetic oligonucleotide
agaaacttaggcctcacctcaaatactatctggctatg

SEQ ID NO: 304064 - DNA, 37 bp, Artificial Sequence
  Description of Artificial Sequence: Synthetic oligonucleotide
gaaacttaggcctcacctcaaatactatctggctatg

SEQ ID NO: 304065 - DNA, 37 bp, Artificial Sequence
  Description of Artificial Sequence: Synthetic oligonucleotide
aaacttaggcctcacctcaaatactatctggctatgg

SEQ ID NO: 304066 - DNA, 36 bp, Artificial Sequence
  Description of Artificial Sequence: Synthetic oligonucleotide
aacttaggcctcacctcaaatactatctggctatgg

SEQ ID NO: 304067 - DNA, 35 bp, Artificial Sequence
  Description of Artificial Sequence: Synthetic oligonucleotide
acttaggcctcacctcaaatactatctggctatgg

SEQ ID NO: 304068 - DNA, 34 bp, Artificial Sequence
  Description of Artificial Sequence: Synthetic oligonucleotide
cttaggcctcacctcaaatactatctggctatgg

SEQ ID NO: 304069 - DNA, 35 bp, Artificial Sequence
  Description of Artificial Sequence: Synthetic oligonucleotide
ttaggcctcacctcaaatactatctggctatggtc

SEQ ID NO: 304070 - DNA, 34 bp, Artificial Sequence
  Description of Artificial Sequence: Synthetic oligonucleotide
taggcctcacctcaaatactatctggctatggtc

SEQ ID NO: 304071 - DNA, 33 bp, Artificial Sequence
  Description of Artificial Sequence: Synthetic oligonucleotide
aggcctcacctcaaatactatctggctatggtc

SEQ ID NO: 304072 - DNA, 32 bp, Artificial Sequence
  Description of Artificial Sequence: Synthetic oligonucleotide
ggcctcacctcaaatactatctggctatggtc

SEQ ID NO: 304073 - DNA, 34 bp, Artificial Sequence
  Description of Artificial Sequence: Synthetic oligonucleotide
gcctcacctcaaatactatctggctatggtcttc

SEQ ID NO: 304074 - DNA, 34 bp, Artificial Sequence
  Description of Artificial Sequence: Synthetic oligonucleotide
cctcacctcaaatactatctggctatggtcttcc

SEQ ID NO: 304075 - DNA, 36 bp, Artificial Sequence
  Description of Artificial Sequence: Synthetic oligonucleotide
ctcacctcaaatactatctggctatggtcttccaag

SEQ ID NO: 304076 - DNA, 36 bp, Artificial Sequence
  Description of Artificial Sequence: Synthetic oligonucleotide
tcacctcaaatactatctggctatggtcttccaagc

SEQ ID NO: 304077 - DNA, 35 bp, Artificial Sequence
  Description of Artificial Sequence: Synthetic oligonucleotide
cacctcaaatactatctggctatggtcttccaagc

SEQ ID NO: 304078 - DNA, 35 bp, Artificial Sequence
  Description of Artificial Sequence: Synthetic oligonucleotide
acctcaaatactatctggctatggtcttccaagcg

SEQ ID NO: 304079 - DNA, 34 bp, Artificial Sequence
  Description of Artificial Sequence: Synthetic oligonucleotide
cctcaaatactatctggctatggtcttccaagcg

SEQ ID NO: 304080 - DNA, 36 bp, Artificial Sequence
  Description of Artificial Sequence: Synthetic oligonucleotide
ctcaaatactatctggctatggtcttccaagcgaag

SEQ ID NO: 304081 - DNA, 39 bp, Artificial Sequence
  Description of Artificial Sequence: Synthetic oligonucleotide
tcaaatactatctggctatggtcttccaagcgaagttag

SEQ ID NO: 304082 - DNA, 38 bp, Artificial Sequence
  Description of Artificial Sequence: Synthetic oligonucleotide
caaatactatctggctatggtcttccaagcgaagttag

SEQ ID NO: 304083 - DNA, 38 bp, Artificial Sequence
  Description of Artificial Sequence: Synthetic oligonucleotide
aaatactatctggctatggtcttccaagcgaagttagg

SEQ ID NO: 304084 - DNA, 37 bp, Artificial Sequence
  Description of Artificial Sequence: Synthetic oligonucleotide
aatactatctggctatggtcttccaagcgaagttagg

SEQ ID NO: 304085 - DNA, 36 bp, Artificial Sequence
  Description of Artificial Sequence: Synthetic oligonucleotide
atactatctggctatggtcttccaagcgaagttagg

SEQ ID NO: 304086 - DNA, 35 bp, Artificial Sequence
  Description of Artificial Sequence: Synthetic oligonucleotide
tactatctggctatggtcttccaagcgaagttagg

SEQ ID NO: 304087 - DNA, 34 bp, Artificial Sequence
  Description of Artificial Sequence: Synthetic oligonucleotide
actatctggctatggtcttccaagcgaagttagg

SEQ ID NO: 304088 - DNA, 33 bp, Artificial Sequence
  Description of Artificial Sequence: Synthetic oligonucleotide
ctatctggctatggtcttccaagcgaagttagg

SEQ ID NO: 304089 - DNA, 34 bp, Artificial Sequence
  Description of Artificial Sequence: Synthetic oligonucleotide
tatctggctatggtcttccaagcgaagttaggtc

SEQ ID NO: 304090 - DNA, 33 bp, Artificial Sequence
  Description of Artificial Sequence: Synthetic oligonucleotide
atctggctatggtcttccaagcgaagttaggtc

SEQ ID NO: 304091 - DNA, 32 bp, Artificial Sequence
  Description of Artificial Sequence: Synthetic oligonucleotide
tctggctatggtcttccaagcgaagttaggtc

SEQ ID NO: 304092 - DNA, 31 bp, Artificial Sequence
  Description of Artificial Sequence: Synthetic oligonucleotide
ctggctatggtcttccaagcgaagttaggtc

SEQ ID NO: 304093 - DNA, 33 bp, Artificial Sequence
  Description of Artificial Sequence: Synthetic oligonucleotide
tggctatggtcttccaagcgaagttaggtcatg

SEQ ID NO: 304094 - DNA, 32 bp, Artificial Sequence
  Description of Artificial Sequence: Synthetic oligonucleotide
ggctatggtcttccaagcgaagttaggtcatg

SEQ ID NO: 304095 - DNA, 32 bp, Artificial Sequence
  Description of Artificial Sequence: Synthetic oligonucleotide
gctatggtcttccaagcgaagttaggtcatgg

SEQ ID NO: 304096 - DNA, 32 bp, Artificial Sequence
  Description of Artificial Sequence: Synthetic oligonucleotide
ctatggtcttccaagcgaagttaggtcatggc

SEQ ID NO: 304097 - DNA, 35 bp, Artificial Sequence
  Description of Artificial Sequence: Synthetic oligonucleotide
tatggtcttccaagcgaagttaggtcatggctttg

SEQ ID NO: 304098 - DNA, 34 bp, Artificial Sequence
  Description of Artificial Sequence: Synthetic oligonucleotide
atggtcttccaagcgaagttaggtcatggctttg

SEQ ID NO: 304099 - DNA, 33 bp, Artificial Sequence
  Description of Artificial Sequence: Synthetic oligonucleotide
tggtcttccaagcgaagttaggtcatggctttg

SEQ ID NO: 304100 - DNA, 32 bp, Artificial Sequence
  Description of Artificial Sequence: Synthetic oligonucleotide
ggtcttccaagcgaagttaggtcatggctttg

SEQ ID NO: 304101 - DNA, 34 bp, Artificial Sequence
  Description of Artificial Sequence: Synthetic oligonucleotide
gtcttccaagcgaagttaggtcatggctttgtag

SEQ ID NO: 304102 - DNA, 34 bp, Artificial Sequence
  Description of Artificial Sequence: Synthetic oligonucleotide
tcttccaagcgaagttaggtcatggctttgtagg

SEQ ID NO: 304103 - DNA, 33 bp, Artificial Sequence
  Description of Artificial Sequence: Synthetic oligonucleotide
cttccaagcgaagttaggtcatggctttgtagg

SEQ ID NO: 304104 - DNA, 33 bp, Artificial Sequence
  Description of Artificial Sequence: Synthetic oligonucleotide
ttccaagcgaagttaggtcatggctttgtaggg

SEQ ID NO: 304105 - DNA, 32 bp, Artificial Sequence
  Description of Artificial Sequence: Synthetic oligonucleotide
tccaagcgaagttaggtcatggctttgtaggg

SEQ ID NO: 304106 - DNA, 31 bp, Artificial Sequence
  Description of Artificial Sequence: Synthetic oligonucleotide
ccaagcgaagttaggtcatggctttgtaggg

SEQ ID NO: 304107 - DNA, 41 bp, Artificial Sequence
  Description of Artificial Sequence: Synthetic oligonucleotide
caagcgaagttaggtcatggctttgtagggttttaaaaaag

SEQ ID NO: 304108 - DNA, 41 bp, Artificial Sequence
  Description of Artificial Sequence: Synthetic oligonucleotide
aagcgaagttaggtcatggctttgtagggttttaaaaaagc

SEQ ID NO: 304109 - DNA, 40 bp, Artificial Sequence
  Description of Artificial Sequence: Synthetic oligonucleotide
agcgaagttaggtcatggctttgtagggttttaaaaaagc

SEQ ID NO: 304110 - DNA, 39 bp, Artificial Sequence
  Description of Artificial Sequence: Synthetic oligonucleotide
gcgaagttaggtcatggctttgtagggttttaaaaaagc

SEQ ID NO: 304111 - DNA, 40 bp, Artificial Sequence
  Description of Artificial Sequence: Synthetic oligonucleotide
cgaagttaggtcatggctttgtagggttttaaaaaagcac

SEQ ID NO: 304112 - DNA, 43 bp, Artificial Sequence
  Description of Artificial Sequence: Synthetic oligonucleotide
gaagttaggtcatggctttgtagggttttaaaaaagcacaaac

SEQ ID NO: 304113 - DNA, 44 bp, Artificial Sequence
  Description of Artificial Sequence: Synthetic oligonucleotide
aagttaggtcatggctttgtagggttttaaaaaagcacaaacag

SEQ ID NO: 304114 - DNA, 43 bp, Artificial Sequence
  Description of Artificial Sequence: Synthetic oligonucleotide
agttaggtcatggctttgtagggttttaaaaaagcacaaacag

SEQ ID NO: 304115 - DNA, 42 bp, Artificial Sequence
  Description of Artificial Sequence: Synthetic oligonucleotide
gttaggtcatggctttgtagggttttaaaaaagcacaaacag

SEQ ID NO: 304116 - DNA, 44 bp, Artificial Sequence
  Description of Artificial Sequence: Synthetic oligonucleotide
ttaggtcatggctttgtagggttttaaaaaagcacaaacagaac

SEQ ID NO: 304117 - DNA, 43 bp, Artificial Sequence
  Description of Artificial Sequence: Synthetic oligonucleotide
taggtcatggctttgtagggttttaaaaaagcacaaacagaac

SEQ ID NO: 304118 - DNA, 42 bp, Artificial Sequence
  Description of Artificial Sequence: Synthetic oligonucleotide
aggtcatggctttgtagggttttaaaaaagcacaaacagaac

SEQ ID NO: 304119 - DNA, 41 bp, Artificial Sequence
  Description of Artificial Sequence: Synthetic oligonucleotide
ggtcatggctttgtagggttttaaaaaagcacaaacagaac

SEQ ID NO: 304120 - DNA, 42 bp, Artificial Sequence
  Description of Artificial Sequence: Synthetic oligonucleotide
gtcatggctttgtagggttttaaaaaagcacaaacagaactc

SEQ ID NO: 304121 - DNA, 44 bp, Artificial Sequence
  Description of Artificial Sequence: Synthetic oligonucleotide
tcatggctttgtagggttttaaaaaagcacaaacagaactcatg

SEQ ID NO: 304122 - DNA, 43 bp, Artificial Sequence
  Description of Artificial Sequence: Synthetic oligonucleotide
catggctttgtagggttttaaaaaagcacaaacagaactcatg

SEQ ID NO: 304123 - DNA, 43 bp, Artificial Sequence
  Description of Artificial Sequence: Synthetic oligonucleotide
atggctttgtagggttttaaaaaagcacaaacagaactcatgg

SEQ ID NO: 304124 - DNA, 42 bp, Artificial Sequence
  Description of Artificial Sequence: Synthetic oligonucleotide
tggctttgtagggttttaaaaaagcacaaacagaactcatgg

SEQ ID NO: 304125 - DNA, 41 bp, Artificial Sequence
  Description of Artificial Sequence: Synthetic oligonucleotide
ggctttgtagggttttaaaaaagcacaaacagaactcatgg

SEQ ID NO: 304126 - DNA, 42 bp, Artificial Sequence
  Description of Artificial Sequence: Synthetic oligonucleotide
gctttgtagggttttaaaaaagcacaaacagaactcatggtg

SEQ ID NO: 304127 - DNA, 42 bp, Artificial Sequence
  Description of Artificial Sequence: Synthetic oligonucleotide
ctttgtagggttttaaaaaagcacaaacagaactcatggtgg

SEQ ID NO: 304128 - DNA, 43 bp, Artificial Sequence
  Description of Artificial Sequence: Synthetic oligonucleotide
tttgtagggttttaaaaaagcacaaacagaactcatggtggtg

SEQ ID NO: 304129 - DNA, 42 bp, Artificial Sequence
  Description of Artificial Sequence: Synthetic oligonucleotide
ttgtagggttttaaaaaagcacaaacagaactcatggtggtg

SEQ ID NO: 304130 - DNA, 41 bp, Artificial Sequence
  Description of Artificial Sequence: Synthetic oligonucleotide
tgtagggttttaaaaaagcacaaacagaactcatggtggtg

SEQ ID NO: 304131 - DNA, 40 bp, Artificial Sequence
  Description of Artificial Sequence: Synthetic oligonucleotide
gtagggttttaaaaaagcacaaacagaactcatggtggtg

SEQ ID NO: 304132 - DNA, 43 bp, Artificial Sequence
  Description of Artificial Sequence: Synthetic oligonucleotide
tagggttttaaaaaagcacaaacagaactcatggtggtgatac

SEQ ID NO: 304133 - DNA, 42 bp, Artificial Sequence
  Description of Artificial Sequence: Synthetic oligonucleotide
agggttttaaaaaagcacaaacagaactcatggtggtgatac

SEQ ID NO: 304134 - DNA, 41 bp, Artificial Sequence
  Description of Artificial Sequence: Synthetic oligonucleotide
gggttttaaaaaagcacaaacagaactcatggtggtgatac

SEQ ID NO: 304135 - DNA, 43 bp, Artificial Sequence
  Description of Artificial Sequence: Synthetic oligonucleotide
ggttttaaaaaagcacaaacagaactcatggtggtgatacaag

SEQ ID NO: 304136 - DNA, 47 bp, Artificial Sequence
  Description of Artificial Sequence: Synthetic oligonucleotide
gttttaaaaaagcacaaacagaactcatggtggtgatacaagaattg

SEQ ID NO: 304137 - DNA, 49 bp, Artificial Sequence
  Description of Artificial Sequence: Synthetic oligonucleotide
ttttaaaaaagcacaaacagaactcatggtggtgatacaagaattgttg

SEQ ID NO: 304138 - DNA, 48 bp, Artificial Sequence
  Description of Artificial Sequence: Synthetic oligonucleotide
tttaaaaaagcacaaacagaactcatggtggtgatacaagaattgttg

SEQ ID NO: 304139 - DNA, 47 bp, Artificial Sequence
  Description of Artificial Sequence: Synthetic oligonucleotide
ttaaaaaagcacaaacagaactcatggtggtgatacaagaattgttg

SEQ ID NO: 304140 - DNA, 46 bp, Artificial Sequence
  Description of Artificial Sequence: Synthetic oligonucleotide
taaaaaagcacaaacagaactcatggtggtgatacaagaattgttg

SEQ ID NO: 304141 - DNA, 45 bp, Artificial Sequence
  Description of Artificial Sequence: Synthetic oligonucleotide
aaaaaagcacaaacagaactcatggtggtgatacaagaattgttg

SEQ ID NO: 304142 - DNA, 44 bp, Artificial Sequence
  Description of Artificial Sequence: Synthetic oligonucleotide
aaaaagcacaaacagaactcatggtggtgatacaagaattgttg

SEQ ID NO: 304143 - DNA, 43 bp, Artificial Sequence
  Description of Artificial Sequence: Synthetic oligonucleotide
aaaagcacaaacagaactcatggtggtgatacaagaattgttg

SEQ ID NO: 304144 - DNA, 42 bp, Artificial Sequence
  Description of Artificial Sequence: Synthetic oligonucleotide
aaagcacaaacagaactcatggtggtgatacaagaattgttg

SEQ ID NO: 304145 - DNA, 41 bp, Artificial Sequence
  Description of Artificial Sequence: Synthetic oligonucleotide
aagcacaaacagaactcatggtggtgatacaagaattgttg

SEQ ID NO: 304146 - DNA, 40 bp, Artificial Sequence
  Description of Artificial Sequence: Synthetic oligonucleotide
agcacaaacagaactcatggtggtgatacaagaattgttg

SEQ ID NO: 304147 - DNA, 39 bp, Artificial Sequence
  Description of Artificial Sequence: Synthetic oligonucleotide
gcacaaacagaactcatggtggtgatacaagaattgttg

SEQ ID NO: 304148 - DNA, 39 bp, Artificial Sequence
  Description of Artificial Sequence: Synthetic oligonucleotide
cacaaacagaactcatggtggtgatacaagaattgttgc

SEQ ID NO: 304149 - DNA, 40 bp, Artificial Sequence
  Description of Artificial Sequence: Synthetic oligonucleotide
acaaacagaactcatggtggtgatacaagaattgttgcag

SEQ ID NO: 304150 - DNA, 39 bp, Artificial Sequence
  Description of Artificial Sequence: Synthetic oligonucleotide
caaacagaactcatggtggtgatacaagaattgttgcag

SEQ ID NO: 304151 - DNA, 42 bp, Artificial Sequence
  Description of Artificial Sequence: Synthetic oligonucleotide
aaacagaactcatggtggtgatacaagaattgttgcagtaag

SEQ ID NO: 304152 - DNA, 41 bp, Artificial Sequence
  Description of Artificial Sequence: Synthetic oligonucleotide
aacagaactcatggtggtgatacaagaattgttgcagtaag

SEQ ID NO: 304153 - DNA, 40 bp, Artificial Sequence
  Description of Artificial Sequence: Synthetic oligonucleotide
acagaactcatggtggtgatacaagaattgttgcagtaag

SEQ ID NO: 304154 - DNA, 39 bp, Artificial Sequence
  Description of Artificial Sequence: Synthetic oligonucleotide
cagaactcatggtggtgatacaagaattgttgcagtaag

SEQ ID NO: 304155 - DNA, 40 bp, Artificial Sequence
  Description of Artificial Sequence: Synthetic oligonucleotide
agaactcatggtggtgatacaagaattgttgcagtaagag

SEQ ID NO: 304156 - DNA, 39 bp, Artificial Sequence
  Description of Artificial Sequence: Synthetic oligonucleotide
gaactcatggtggtgatacaagaattgttgcagtaagag

SEQ ID NO: 304157 - DNA, 44 bp, Artificial Sequence
  Description of Artificial Sequence: Synthetic oligonucleotide
aactcatggtggtgatacaagaattgttgcagtaagagattttg

SEQ ID NO: 304158 - DNA, 43 bp, Artificial Sequence
  Description of Artificial Sequence: Synthetic oligonucleotide
actcatggtggtgatacaagaattgttgcagtaagagattttg

SEQ ID NO: 304159 - DNA, 42 bp, Artificial Sequence
  Description of Artificial Sequence: Synthetic oligonucleotide
ctcatggtggtgatacaagaattgttgcagtaagagattttg

SEQ ID NO: 304160 - DNA, 43 bp, Artificial Sequence
  Description of Artificial Sequence: Synthetic oligonucleotide
tcatggtggtgatacaagaattgttgcagtaagagattttgac

SEQ ID NO: 304161 - DNA, 42 bp, Artificial Sequence
  Description of Artificial Sequence: Synthetic oligonucleotide
catggtggtgatacaagaattgttgcagtaagagattttgac

SEQ ID NO: 304162 - DNA, 42 bp, Artificial Sequence
  Description of Artificial Sequence: Synthetic oligonucleotide
atggtggtgatacaagaattgttgcagtaagagattttgacc

SEQ ID NO: 304163 - DNA, 41 bp, Artificial Sequence
  Description of Artificial Sequence: Synthetic oligonucleotide
tggtggtgatacaagaattgttgcagtaagagattttgacc

SEQ ID NO: 304164 - DNA, 40 bp, Artificial Sequence
  Description of Artificial Sequence: Synthetic oligonucleotide
ggtggtgatacaagaattgttgcagtaagagattttgacc

SEQ ID NO: 304165 - DNA, 40 bp, Artificial Sequence
  Description of Artificial Sequence: Synthetic oligonucleotide
gtggtgatacaagaattgttgcagtaagagattttgaccc

SEQ ID NO: 304166 - DNA, 42 bp, Artificial Sequence
  Description of Artificial Sequence: Synthetic oligonucleotide
tggtgatacaagaattgttgcagtaagagattttgacccaac

SEQ ID NO: 304167 - DNA, 41 bp, Artificial Sequence
  Description of Artificial Sequence: Synthetic oligonucleotide
ggtgatacaagaattgttgcagtaagagattttgacccaac

SEQ ID NO: 304168 - DNA, 41 bp, Artificial Sequence
  Description of Artificial Sequence: Synthetic oligonucleotide
gtgatacaagaattgttgcagtaagagattttgacccaacc

SEQ ID NO: 304169 - DNA, 41 bp, Artificial Sequence
  Description of Artificial Sequence: Synthetic oligonucleotide
tgatacaagaattgttgcagtaagagattttgacccaaccc

SEQ ID NO: 304170 - DNA, 40 bp, Artificial Sequence
  Description of Artificial Sequence: Synthetic oligonucleotide
gatacaagaattgttgcagtaagagattttgacccaaccc

SEQ ID NO: 304171 - DNA, 41 bp, Artificial Sequence
  Description of Artificial Sequence: Synthetic oligonucleotide
atacaagaattgttgcagtaagagattttgacccaacccag

SEQ ID NO: 304172 - DNA, 40 bp, Artificial Sequence
  Description of Artificial Sequence: Synthetic oligonucleotide
tacaagaattgttgcagtaagagattttgacccaacccag

SEQ ID NO: 304173 - DNA, 39 bp, Artificial Sequence
  Description of Artificial Sequence: Synthetic oligonucleotide
acaagaattgttgcagtaagagattttgacccaacccag

SEQ ID NO: 304174 - DNA, 38 bp, Artificial Sequence
  Description of Artificial Sequence: Synthetic oligonucleotide
caagaattgttgcagtaagagattttgacccaacccag

SEQ ID NO: 304175 - DNA, 38 bp, Artificial Sequence
  Description of Artificial Sequence: Synthetic oligonucleotide
aagaattgttgcagtaagagattttgacccaacccagc

SEQ ID NO: 304176 - DNA, 37 bp, Artificial Sequence
  Description of Artificial Sequence: Synthetic oligonucleotide
agaattgttgcagtaagagattttgacccaacccagc

SEQ ID NO: 304177 - DNA, 36 bp, Artificial Sequence
  Description of Artificial Sequence: Synthetic oligonucleotide
gaattgttgcagtaagagattttgacccaacccagc

SEQ ID NO: 304178 - DNA, 36 bp, Artificial Sequence
  Description of Artificial Sequence: Synthetic oligonucleotide
aattgttgcagtaagagattttgacccaacccagcc

SEQ ID NO: 304179 - DNA, 35 bp, Artificial Sequence
  Description of Artificial Sequence: Synthetic oligonucleotide
attgttgcagtaagagattttgacccaacccagcc

SEQ ID NO: 304180 - DNA, 34 bp, Artificial Sequence
  Description of Artificial Sequence: Synthetic oligonucleotide
ttgttgcagtaagagattttgacccaacccagcc

SEQ ID NO: 304181 - DNA, 33 bp, Artificial Sequence
  Description of Artificial Sequence: Synthetic oligonucleotide
tgttgcagtaagagattttgacccaacccagcc

SEQ ID NO: 304182 - DNA, 32 bp, Artificial Sequence
  Description of Artificial Sequence: Synthetic oligonucleotide
gttgcagtaagagattttgacccaacccagcc

SEQ ID NO: 304183 - DNA, 33 bp, Artificial Sequence
  Description of Artificial Sequence: Synthetic oligonucleotide
ttgcagtaagagattttgacccaacccagccac

SEQ ID NO: 304184 - DNA, 32 bp, Artificial Sequence
  Description of Artificial Sequence: Synthetic oligonucleotide
tgcagtaagagattttgacccaacccagccac

SEQ ID NO: 304185 - DNA, 31 bp, Artificial Sequence
  Description of Artificial Sequence: Synthetic oligonucleotide
gcagtaagagattttgacccaacccagccac

SEQ ID NO: 304186 - DNA, 31 bp, Artificial Sequence
  Description of Artificial Sequence: Synthetic oligonucleotide
cagtaagagattttgacccaacccagccacg

SEQ ID NO: 304187 - DNA, 31 bp, Artificial Sequence
  Description of Artificial Sequence: Synthetic oligonucleotide
agtaagagattttgacccaacccagccacgc

SEQ ID NO: 304188 - DNA, 30 bp, Artificial Sequence
  Description of Artificial Sequence: Synthetic oligonucleotide
gtaagagattttgacccaacccagccacgc

SEQ ID NO: 304189 - DNA, 32 bp, Artificial Sequence
  Description of Artificial Sequence: Synthetic oligonucleotide
taagagattttgacccaacccagccacgcatg

SEQ ID NO: 304190 - DNA, 31 bp, Artificial Sequence
  Description of Artificial Sequence: Synthetic oligonucleotide
aagagattttgacccaacccagccacgcatg

SEQ ID NO: 304191 - DNA, 30 bp, Artificial Sequence
  Description of Artificial Sequence: Synthetic oligonucleotide
agagattttgacccaacccagccacgcatg

SEQ ID NO: 304192 - DNA, 29 bp, Artificial Sequence
  Description of Artificial Sequence: Synthetic oligonucleotide
gagattttgacccaacccagccacgcatg

SEQ ID NO: 304193 - DNA, 29 bp, Artificial Sequence
  Description of Artificial Sequence: Synthetic oligonucleotide
agattttgacccaacccagccacgcatgg

SEQ ID NO: 304194 - DNA, 28 bp, Artificial Sequence
  Description of Artificial Sequence: Synthetic oligonucleotide
gattttgacccaacccagccacgcatgg

SEQ ID NO: 304195 - DNA, 28 bp, Artificial Sequence
  Description of Artificial Sequence: Synthetic oligonucleotide
attttgacccaacccagccacgcatggg

SEQ ID NO: 304196 - DNA, 27 bp, Artificial Sequence
  Description of Artificial Sequence: Synthetic oligonucleotide
ttttgacccaacccagccacgcatggg

SEQ ID NO: 304197 - DNA, 27 bp, Artificial Sequence
  Description of Artificial Sequence: Synthetic oligonucleotide
tttgacccaacccagccacgcatgggt

SEQ ID NO: 304198 - DNA, 27 bp, Artificial Sequence
  Description of Artificial Sequence: Synthetic oligonucleotide
ttgacccaacccagccacgcatgggtt

SEQ ID NO: 304199 - DNA, 27 bp, Artificial Sequence
  Description of Artificial Sequence: Synthetic oligonucleotide
tgacccaacccagccacgcatgggttt

SEQ ID NO: 304200 - DNA, 26 bp, Artificial Sequence
  Description of Artificial Sequence: Synthetic oligonucleotide
gacccaacccagccacgcatgggttt

SEQ ID NO: 304201 - DNA, 26 bp, Artificial Sequence
  Description of Artificial Sequence: Synthetic oligonucleotide
acccaacccagccacgcatgggtttc

SEQ ID NO: 304202 - DNA, 25 bp, Artificial Sequence
  Description of Artificial Sequence: Synthetic oligonucleotide
cccaacccagccacgcatgggtttc

SEQ ID NO: 304203 - DNA, 25 bp, Artificial Sequence
  Description of Artificial Sequence: Synthetic oligonucleotide
ccaacccagccacgcatgggtttcc

SEQ ID NO: 304204 - DNA, 27 bp, Artificial Sequence
  Description of Artificial Sequence: Synthetic oligonucleotide
caacccagccacgcatgggtttccctt

SEQ ID NO: 304205 - DNA, 27 bp, Artificial Sequence
  Description of Artificial Sequence: Synthetic oligonucleotide
aacccagccacgcatgggtttcccttg

SEQ ID NO: 304206 - DNA, 26 bp, Artificial Sequence
  Description of Artificial Sequence: Synthetic oligonucleotide
acccagccacgcatgggtttcccttg

SEQ ID NO: 304207 - DNA, 25 bp, Artificial Sequence
  Description of Artificial Sequence: Synthetic oligonucleotide
cccagccacgcatgggtttcccttg

SEQ ID NO: 304208 - DNA, 27 bp, Artificial Sequence
  Description of Artificial Sequence: Synthetic oligonucleotide
ccagccacgcatgggtttcccttggtt

SEQ ID NO: 304209 - DNA, 28 bp, Artificial Sequence
  Description of Artificial Sequence: Synthetic oligonucleotide
cagccacgcatgggtttcccttggtttg

SEQ ID NO: 304210 - DNA, 30 bp, Artificial Sequence
  Description of Artificial Sequence: Synthetic oligonucleotide
agccacgcatgggtttcccttggtttgatg

SEQ ID NO: 304211 - DNA, 29 bp, Artificial Sequence
  Description of Artificial Sequence: Synthetic oligonucleotide
gccacgcatgggtttcccttggtttgatg

SEQ ID NO: 304212 - DNA, 31 bp, Artificial Sequence
  Description of Artificial Sequence: Synthetic oligonucleotide
ccacgcatgggtttcccttggtttgatgaag

SEQ ID NO: 304213 - DNA, 31 bp, Artificial Sequence
  Description of Artificial Sequence: Synthetic oligonucleotide
cacgcatgggtttcccttggtttgatgaagc

SEQ ID NO: 304214 - DNA, 31 bp, Artificial Sequence
  Description of Artificial Sequence: Synthetic oligonucleotide
acgcatgggtttcccttggtttgatgaagcg

SEQ ID NO: 304215 - DNA, 30 bp, Artificial Sequence
  Description of Artificial Sequence: Synthetic oligonucleotide
cgcatgggtttcccttggtttgatgaagcg

SEQ ID NO: 304216 - DNA, 32 bp, Artificial Sequence
  Description of Artificial Sequence: Synthetic oligonucleotide
gcatgggtttcccttggtttgatgaagcgttg

SEQ ID NO: 304217 - DNA, 34 bp, Artificial Sequence
  Description of Artificial Sequence: Synthetic oligonucleotide
catgggtttcccttggtttgatgaagcgttgttc

SEQ ID NO: 304218 - DNA, 37 bp, Artificial Sequence
  Description of Artificial Sequence: Synthetic oligonucleotide
atgggtttcccttggtttgatgaagcgttgttcatag

SEQ ID NO: 304219 - DNA, 36 bp, Artificial Sequence
  Description of Artificial Sequence: Synthetic oligonucleotide
tgggtttcccttggtttgatgaagcgttgttcatag

SEQ ID NO: 304220 - DNA, 35 bp, Artificial Sequence
  Description of Artificial Sequence: Synthetic oligonucleotide
gggtttcccttggtttgatgaagcgttgttcatag

SEQ ID NO: 304221 - DNA, 35 bp, Artificial Sequence
  Description of Artificial Sequence: Synthetic oligonucleotide
ggtttcccttggtttgatgaagcgttgttcatagc

SEQ ID NO: 304222 - DNA, 35 bp, Artificial Sequence
  Description of Artificial Sequence: Synthetic oligonucleotide
gtttcccttggtttgatgaagcgttgttcatagcc

SEQ ID NO: 304223 - DNA, 37 bp, Artificial Sequence
  Description of Artificial Sequence: Synthetic oligonucleotide
tttcccttggtttgatgaagcgttgttcatagccaac

SEQ ID NO: 304224 - DNA, 36 bp, Artificial Sequence
  Description of Artificial Sequence: Synthetic oligonucleotide
ttcccttggtttgatgaagcgttgttcatagccaac

SEQ ID NO: 304225 - DNA, 35 bp, Artificial Sequence
  Description of Artificial Sequence: Synthetic oligonucleotide
tcccttggtttgatgaagcgttgttcatagccaac

SEQ ID NO: 304226 - DNA, 34 bp, Artificial Sequence
  Description of Artificial Sequence: Synthetic oligonucleotide
cccttggtttgatgaagcgttgttcatagccaac

SEQ ID NO: 304227 - DNA, 38 bp, Artificial Sequence
  Description of Artificial Sequence: Synthetic oligonucleotide
ccttggtttgatgaagcgttgttcatagccaacttatc

SEQ ID NO: 304228 - DNA, 41 bp, Artificial Sequence
  Description of Artificial Sequence: Synthetic oligonucleotide
cttggtttgatgaagcgttgttcatagccaacttatcaatc

SEQ ID NO: 304229 - DNA, 43 bp, Artificial Sequence
  Description of Artificial Sequence: Synthetic oligonucleotide
ttggtttgatgaagcgttgttcatagccaacttatcaatcaag

SEQ ID NO: 304230 - DNA, 42 bp, Artificial Sequence
  Description of Artificial Sequence: Synthetic oligonucleotide
tggtttgatgaagcgttgttcatagccaacttatcaatcaag

SEQ ID NO: 304231 - DNA, 41 bp, Artificial Sequence
  Description of Artificial Sequence: Synthetic oligonucleotide
ggtttgatgaagcgttgttcatagccaacttatcaatcaag

SEQ ID NO: 304232 - DNA, 44 bp, Artificial Sequence
  Description of Artificial Sequence: Synthetic oligonucleotide
gtttgatgaagcgttgttcatagccaacttatcaatcaagttac

SEQ ID NO: 304233 - DNA, 44 bp, Artificial Sequence
  Description of Artificial Sequence: Synthetic oligonucleotide
tttgatgaagcgttgttcatagccaacttatcaatcaagttacg

SEQ ID NO: 304234 - DNA, 43 bp, Artificial Sequence
  Description of Artificial Sequence: Synthetic oligonucleotide
ttgatgaagcgttgttcatagccaacttatcaatcaagttacg

SEQ ID NO: 304235 - DNA, 42 bp, Artificial Sequence
  Description of Artificial Sequence: Synthetic oligonucleotide
tgatgaagcgttgttcatagccaacttatcaatcaagttacg

SEQ ID NO: 304236 - DNA, 41 bp, Artificial Sequence
  Description of Artificial Sequence: Synthetic oligonucleotide
gatgaagcgttgttcatagccaacttatcaatcaagttacg

SEQ ID NO: 304237 - DNA, 43 bp, Artificial Sequence
  Description of Artificial Sequence: Synthetic oligonucleotide
atgaagcgttgttcatagccaacttatcaatcaagttacgaag

SEQ ID NO: 304238 - DNA, 42 bp, Artificial Sequence
  Description of Artificial Sequence: Synthetic oligonucleotide
tgaagcgttgttcatagccaacttatcaatcaagttacgaag

SEQ ID NO: 304239 - DNA, 41 bp, Artificial Sequence
  Description of Artificial Sequence: Synthetic oligonucleotide
gaagcgttgttcatagccaacttatcaatcaagttacgaag

SEQ ID NO: 304240 - DNA, 42 bp, Artificial Sequence
  Description of Artificial Sequence: Synthetic oligonucleotide
aagcgttgttcatagccaacttatcaatcaagttacgaagag

SEQ ID NO: 304241 - DNA, 41 bp, Artificial Sequence
  Description of Artificial Sequence: Synthetic oligonucleotide
agcgttgttcatagccaacttatcaatcaagttacgaagag

SEQ ID NO: 304242 - DNA, 40 bp, Artificial Sequence
  Description of Artificial Sequence: Synthetic oligonucleotide
gcgttgttcatagccaacttatcaatcaagttacgaagag

SEQ ID NO: 304243 - DNA, 41 bp, Artificial Sequence
  Description of Artificial Sequence: Synthetic oligonucleotide
cgttgttcatagccaacttatcaatcaagttacgaagagtg

SEQ ID NO: 304244 - DNA, 42 bp, Artificial Sequence
  Description of Artificial Sequence: Synthetic oligonucleotide
gttgttcatagccaacttatcaatcaagttacgaagagtgag

SEQ ID NO: 304245 - DNA, 42 bp, Artificial Sequence
  Description of Artificial Sequence: Synthetic oligonucleotide
ttgttcatagccaacttatcaatcaagttacgaagagtgagc

SEQ ID NO: 304246 - DNA, 41 bp, Artificial Sequence
  Description of Artificial Sequence: Synthetic oligonucleotide
tgttcatagccaacttatcaatcaagttacgaagagtgagc

SEQ ID NO: 304247 - DNA, 40 bp, Artificial Sequence
  Description of Artificial Sequence: Synthetic oligonucleotide
gttcatagccaacttatcaatcaagttacgaagagtgagc

SEQ ID NO: 304248 - DNA, 41 bp, Artificial Sequence
  Description of Artificial Sequence: Synthetic oligonucleotide
ttcatagccaacttatcaatcaagttacgaagagtgagcag

SEQ ID NO: 304249 - DNA, 40 bp, Artificial Sequence
  Description of Artificial Sequence: Synthetic oligonucleotide
tcatagccaacttatcaatcaagttacgaagagtgagcag

SEQ ID NO: 304250 - DNA, 39 bp, Artificial Sequence
  Description of Artificial Sequence: Synthetic oligonucleotide
catagccaacttatcaatcaagttacgaagagtgagcag

SEQ ID NO: 304251 - DNA, 39 bp, Artificial Sequence
  Description of Artificial Sequence: Synthetic oligonucleotide
atagccaacttatcaatcaagttacgaagagtgagcagg

SEQ ID NO: 304252 - DNA, 38 bp, Artificial Sequence
  Description of Artificial Sequence: Synthetic oligonucleotide
tagccaacttatcaatcaagttacgaagagtgagcagg

SEQ ID NO: 304253 - DNA, 37 bp, Artificial Sequence
  Description of Artificial Sequence: Synthetic oligonucleotide
agccaacttatcaatcaagttacgaagagtgagcagg

SEQ ID NO: 304254 - DNA, 36 bp, Artificial Sequence
  Description of Artificial Sequence: Synthetic oligonucleotide
gccaacttatcaatcaagttacgaagagtgagcagg

SEQ ID NO: 304255 - DNA, 36 bp, Artificial Sequence
  Description of Artificial Sequence: Synthetic oligonucleotide
ccaacttatcaatcaagttacgaagagtgagcaggc

SEQ ID NO: 304256 - DNA, 41 bp, Artificial Sequence
  Description of Artificial Sequence: Synthetic oligonucleotide
caacttatcaatcaagttacgaagagtgagcaggcaaattg

SEQ ID NO: 304257 - DNA, 41 bp, Artificial Sequence
  Description of Artificial Sequence: Synthetic oligonucleotide
aacttatcaatcaagttacgaagagtgagcaggcaaattgc

SEQ ID NO: 304258 - DNA, 40 bp, Artificial Sequence
  Description of Artificial Sequence: Synthetic oligonucleotide
acttatcaatcaagttacgaagagtgagcaggcaaattgc

SEQ ID NO: 304259 - DNA, 39 bp, Artificial Sequence
  Description of Artificial Sequence: Synthetic oligonucleotide
cttatcaatcaagttacgaagagtgagcaggcaaattgc

SEQ ID NO: 304260 - DNA, 40 bp, Artificial Sequence
  Description of Artificial Sequence: Synthetic oligonucleotide
ttatcaatcaagttacgaagagtgagcaggcaaattgcac

SEQ ID NO: 304261 - DNA, 39 bp, Artificial Sequence
  Description of Artificial Sequence: Synthetic oligonucleotide
tatcaatcaagttacgaagagtgagcaggcaaattgcac

SEQ ID NO: 304262 - DNA, 38 bp, Artificial Sequence
  Description of Artificial Sequence: Synthetic oligonucleotide
atcaatcaagttacgaagagtgagcaggcaaattgcac

SEQ ID NO: 304263 - DNA, 37 bp, Artificial Sequence
  Description of Artificial Sequence: Synthetic oligonucleotide
tcaatcaagttacgaagagtgagcaggcaaattgcac

SEQ ID NO: 304264 - DNA, 36 bp, Artificial Sequence
  Description of Artificial Sequence: Synthetic oligonucleotide
caatcaagttacgaagagtgagcaggcaaattgcac

SEQ ID NO: 304265 - DNA, 39 bp, Artificial Sequence
  Description of Artificial Sequence: Synthetic oligonucleotide
aatcaagttacgaagagtgagcaggcaaattgcactaac

SEQ ID NO: 304266 - DNA, 38 bp, Artificial Sequence
  Description of Artificial Sequence: Synthetic oligonucleotide
atcaagttacgaagagtgagcaggcaaattgcactaac

SEQ ID NO: 304267 - DNA, 37 bp, Artificial Sequence
  Description of Artificial Sequence: Synthetic oligonucleotide
tcaagttacgaagagtgagcaggcaaattgcactaac

SEQ ID NO: 304268 - DNA, 36 bp, Artificial Sequence
  Description of Artificial Sequence: Synthetic oligonucleotide
caagttacgaagagtgagcaggcaaattgcactaac

SEQ ID NO: 304269 - DNA, 36 bp, Artificial Sequence
  Description of Artificial Sequence: Synthetic oligonucleotide
aagttacgaagagtgagcaggcaaattgcactaacc

SEQ ID NO: 304270 - DNA, 35 bp, Artificial Sequence
  Description of Artificial Sequence: Synthetic oligonucleotide
agttacgaagagtgagcaggcaaattgcactaacc

SEQ ID NO: 304271 - DNA, 34 bp, Artificial Sequence
  Description of Artificial Sequence: Synthetic oligonucleotide
gttacgaagagtgagcaggcaaattgcactaacc

SEQ ID NO: 304272 - DNA, 36 bp, Artificial Sequence
  Description of Artificial Sequence: Synthetic oligonucleotide
ttacgaagagtgagcaggcaaattgcactaaccaac

SEQ ID NO: 304273 - DNA, 35 bp, Artificial Sequence
  Description of Artificial Sequence: Synthetic oligonucleotide
tacgaagagtgagcaggcaaattgcactaaccaac

SEQ ID NO: 304274 - DNA, 34 bp, Artificial Sequence
  Description of Artificial Sequence: Synthetic oligonucleotide
acgaagagtgagcaggcaaattgcactaaccaac

SEQ ID NO: 304275 - DNA, 33 bp, Artificial Sequence
  Description of Artificial Sequence: Synthetic oligonucleotide
cgaagagtgagcaggcaaattgcactaaccaac

SEQ ID NO: 304276 - DNA, 35 bp, Artificial Sequence
  Description of Artificial Sequence: Synthetic oligonucleotide
gaagagtgagcaggcaaattgcactaaccaacatg

SEQ ID NO: 304277 - DNA, 35 bp, Artificial Sequence
  Description of Artificial Sequence: Synthetic oligonucleotide
aagagtgagcaggcaaattgcactaaccaacatgc

SEQ ID NO: 304278 - DNA, 34 bp, Artificial Sequence
  Description of Artificial Sequence: Synthetic oligonucleotide
agagtgagcaggcaaattgcactaaccaacatgc

SEQ ID NO: 304279 - DNA, 33 bp, Artificial Sequence
  Description of Artificial Sequence: Synthetic oligonucleotide
gagtgagcaggcaaattgcactaaccaacatgc

SEQ ID NO: 304280 - DNA, 33 bp, Artificial Sequence
  Description of Artificial Sequence: Synthetic oligonucleotide
agtgagcaggcaaattgcactaaccaacatgcg

SEQ ID NO: 304281 - DNA, 32 bp, Artificial Sequence
  Description of Artificial Sequence: Synthetic oligonucleotide
gtgagcaggcaaattgcactaaccaacatgcg

SEQ ID NO: 304282 - DNA, 35 bp, Artificial Sequence
  Description of Artificial Sequence: Synthetic oligonucleotide
tgagcaggcaaattgcactaaccaacatgcgaaag

SEQ ID NO: 304283 - DNA, 34 bp, Artificial Sequence
  Description of Artificial Sequence: Synthetic oligonucleotide
gagcaggcaaattgcactaaccaacatgcgaaag

SEQ ID NO: 304284 - DNA, 34 bp, Artificial Sequence
  Description of Artificial Sequence: Synthetic oligonucleotide
agcaggcaaattgcactaaccaacatgcgaaagg

SEQ ID NO: 304285 - DNA, 33 bp, Artificial Sequence
  Description of Artificial Sequence: Synthetic oligonucleotide
gcaggcaaattgcactaaccaacatgcgaaagg

SEQ ID NO: 304286 - DNA, 37 bp, Artificial Sequence
  Description of Artificial Sequence: Synthetic oligonucleotide
caggcaaattgcactaaccaacatgcgaaaggttaac

SEQ ID NO: 304287 - DNA, 38 bp, Artificial Sequence
  Description of Artificial Sequence: Synthetic oligonucleotide
aggcaaattgcactaaccaacatgcgaaaggttaacac

SEQ ID NO: 304288 - DNA, 37 bp, Artificial Sequence
  Description of Artificial Sequence: Synthetic oligonucleotide
ggcaaattgcactaaccaacatgcgaaaggttaacac

SEQ ID NO: 304289 - DNA, 41 bp, Artificial Sequence
  Description of Artificial Sequence: Synthetic oligonucleotide
gcaaattgcactaaccaacatgcgaaaggttaacacaattg

SEQ ID NO: 304290 - DNA, 43 bp, Artificial Sequence
  Description of Artificial Sequence: Synthetic oligonucleotide
caaattgcactaaccaacatgcgaaaggttaacacaattgaag

SEQ ID NO: 304291 - DNA, 45 bp, Artificial Sequence
  Description of Artificial Sequence: Synthetic oligonucleotide
aaattgcactaaccaacatgcgaaaggttaacacaattgaagttg

SEQ ID NO: 304292 - DNA, 44 bp, Artificial Sequence
  Description of Artificial Sequence: Synthetic oligonucleotide
aattgcactaaccaacatgcgaaaggttaacacaattgaagttg

SEQ ID NO: 304293 - DNA, 43 bp, Artificial Sequence
  Description of Artificial Sequence: Synthetic oligonucleotide
attgcactaaccaacatgcgaaaggttaacacaattgaagttg

SEQ ID NO: 304294 - DNA, 42 bp, Artificial Sequence
  Description of Artificial Sequence: Synthetic oligonucleotide
ttgcactaaccaacatgcgaaaggttaacacaattgaagttg

SEQ ID NO: 304295 - DNA, 41 bp, Artificial Sequence
  Description of Artificial Sequence: Synthetic oligonucleotide
tgcactaaccaacatgcgaaaggttaacacaattgaagttg

SEQ ID NO: 304296 - DNA, 40 bp, Artificial Sequence
  Description of Artificial Sequence: Synthetic oligonucleotide
gcactaaccaacatgcgaaaggttaacacaattgaagttg

SEQ ID NO: 304297 - DNA, 42 bp, Artificial Sequence
  Description of Artificial Sequence: Synthetic oligonucleotide
cactaaccaacatgcgaaaggttaacacaattgaagttgaag

SEQ ID NO: 304298 - DNA, 42 bp, Artificial Sequence
  Description of Artificial Sequence: Synthetic oligonucleotide
actaaccaacatgcgaaaggttaacacaattgaagttgaagg

SEQ ID NO: 304299 - DNA, 41 bp, Artificial Sequence
  Description of Artificial Sequence: Synthetic oligonucleotide
ctaaccaacatgcgaaaggttaacacaattgaagttgaagg

SEQ ID NO: 304300 - DNA, 42 bp, Artificial Sequence
  Description of Artificial Sequence: Synthetic oligonucleotide
taaccaacatgcgaaaggttaacacaattgaagttgaaggag

SEQ ID NO: 304301 - DNA, 41 bp, Artificial Sequence
  Description of Artificial Sequence: Synthetic oligonucleotide
aaccaacatgcgaaaggttaacacaattgaagttgaaggag

SEQ ID NO: 304302 - DNA, 40 bp, Artificial Sequence
  Description of Artificial Sequence: Synthetic oligonucleotide
accaacatgcgaaaggttaacacaattgaagttgaaggag

SEQ ID NO: 304303 - DNA, 39 bp, Artificial Sequence
  Description of Artificial Sequence: Synthetic oligonucleotide
ccaacatgcgaaaggttaacacaattgaagttgaaggag

SEQ ID NO: 304304 - DNA, 39 bp, Artificial Sequence
  Description of Artificial Sequence: Synthetic oligonucleotide
caacatgcgaaaggttaacacaattgaagttgaaggagc

SEQ ID NO: 304305 - DNA, 40 bp, Artificial Sequence
  Description of Artificial Sequence: Synthetic oligonucleotide
aacatgcgaaaggttaacacaattgaagttgaaggagctc

SEQ ID NO: 304306 - DNA, 39 bp, Artificial Sequence
  Description of Artificial Sequence: Synthetic oligonucleotide
acatgcgaaaggttaacacaattgaagttgaaggagctc

SEQ ID NO: 304307 - DNA, 38 bp, Artificial Sequence
  Description of Artificial Sequence: Synthetic oligonucleotide
catgcgaaaggttaacacaattgaagttgaaggagctc

SEQ ID NO: 304308 - DNA, 42 bp, Artificial Sequence
  Description of Artificial Sequence: Synthetic oligonucleotide
atgcgaaaggttaacacaattgaagttgaaggagctcttttg

SEQ ID NO: 304309 - DNA, 41 bp, Artificial Sequence
  Description of Artificial Sequence: Synthetic oligonucleotide
tgcgaaaggttaacacaattgaagttgaaggagctcttttg

SEQ ID NO: 304310 - DNA, 40 bp, Artificial Sequence
  Description of Artificial Sequence: Synthetic oligonucleotide
gcgaaaggttaacacaattgaagttgaaggagctcttttg

SEQ ID NO: 304311 - DNA, 40 bp, Artificial Sequence
  Description of Artificial Sequence: Synthetic oligonucleotide
cgaaaggttaacacaattgaagttgaaggagctcttttgg

SEQ ID NO: 304312 - DNA, 42 bp, Artificial Sequence
  Description of Artificial Sequence: Synthetic oligonucleotide
gaaaggttaacacaattgaagttgaaggagctcttttggatg

SEQ ID NO: 304313 - DNA, 44 bp, Artificial Sequence
  Description of Artificial Sequence: Synthetic oligonucleotide
aaaggttaacacaattgaagttgaaggagctcttttggatgatc

SEQ ID NO: 304314 - DNA, 43 bp, Artificial Sequence
  Description of Artificial Sequence: Synthetic oligonucleotide
aaggttaacacaattgaagttgaaggagctcttttggatgatc

SEQ ID NO: 304315 - DNA, 42 bp, Artificial Sequence
  Description of Artificial Sequence: Synthetic oligonucleotide
aggttaacacaattgaagttgaaggagctcttttggatgatc

SEQ ID NO: 304316 - DNA, 41 bp, Artificial Sequence
  Description of Artificial Sequence: Synthetic oligonucleotide
ggttaacacaattgaagttgaaggagctcttttggatgatc

SEQ ID NO: 304317 - DNA, 42 bp, Artificial Sequence
  Description of Artificial Sequence: Synthetic oligonucleotide
gttaacacaattgaagttgaaggagctcttttggatgatcac

SEQ ID NO: 304318 - DNA, 45 bp, Artificial Sequence
  Description of Artificial Sequence: Synthetic oligonucleotide
ttaacacaattgaagttgaaggagctcttttggatgatcactttc

SEQ ID NO: 304319 - DNA, 44 bp, Artificial Sequence
  Description of Artificial Sequence: Synthetic oligonucleotide
taacacaattgaagttgaaggagctcttttggatgatcactttc

SEQ ID NO: 304320 - DNA, 43 bp, Artificial Sequence
  Description of Artificial Sequence: Synthetic oligonucleotide
aacacaattgaagttgaaggagctcttttggatgatcactttc

SEQ ID NO: 304321 - DNA, 42 bp, Artificial Sequence
  Description of Artificial Sequence: Synthetic oligonucleotide
acacaattgaagttgaaggagctcttttggatgatcactttc

SEQ ID NO: 304322 - DNA, 41 bp, Artificial Sequence
  Description of Artificial Sequence: Synthetic oligonucleotide
cacaattgaagttgaaggagctcttttggatgatcactttc

SEQ ID NO: 304323 - DNA, 44 bp, Artificial Sequence
  Description of Artificial Sequence: Synthetic oligonucleotide
acaattgaagttgaaggagctcttttggatgatcactttcaaac

SEQ ID NO: 304324 - DNA, 43 bp, Artificial Sequence
  Description of Artificial Sequence: Synthetic oligonucleotide
caattgaagttgaaggagctcttttggatgatcactttcaaac

SEQ ID NO: 304325 - DNA, 45 bp, Artificial Sequence
  Description of Artificial Sequence: Synthetic oligonucleotide
aattgaagttgaaggagctcttttggatgatcactttcaaactac

SEQ ID NO: 304326 - DNA, 44 bp, Artificial Sequence
  Description of Artificial Sequence: Synthetic oligonucleotide
attgaagttgaaggagctcttttggatgatcactttcaaactac

SEQ ID NO: 304327 - DNA, 43 bp, Artificial Sequence
  Description of Artificial Sequence: Synthetic oligonucleotide
ttgaagttgaaggagctcttttggatgatcactttcaaactac

SEQ ID NO: 304328 - DNA, 42 bp, Artificial Sequence
  Description of Artificial Sequence: Synthetic oligonucleotide
tgaagttgaaggagctcttttggatgatcactttcaaactac

SEQ ID NO: 304329 - DNA, 41 bp, Artificial Sequence
  Description of Artificial Sequence: Synthetic oligonucleotide
gaagttgaaggagctcttttggatgatcactttcaaactac

SEQ ID NO: 304330 - DNA, 42 bp, Artificial Sequence
  Description of Artificial Sequence: Synthetic oligonucleotide
aagttgaaggagctcttttggatgatcactttcaaactactg

SEQ ID NO: 304331 - DNA, 41 bp, Artificial Sequence
  Description of Artificial Sequence: Synthetic oligonucleotide
agttgaaggagctcttttggatgatcactttcaaactactg

SEQ ID NO: 304332 - DNA, 40 bp, Artificial Sequence
  Description of Artificial Sequence: Synthetic oligonucleotide
gttgaaggagctcttttggatgatcactttcaaactactg

SEQ ID NO: 304333 - DNA, 47 bp, Artificial Sequence
  Description of Artificial Sequence: Synthetic oligonucleotide
ttgaaggagctcttttggatgatcactttcaaactactgaaaaaatg

SEQ ID NO: 304334 - DNA, 46 bp, Artificial Sequence
  Description of Artificial Sequence: Synthetic oligonucleotide
tgaaggagctcttttggatgatcactttcaaactactgaaaaaatg

SEQ ID NO: 304335 - DNA, 45 bp, Artificial Sequence
  Description of Artificial Sequence: Synthetic oligonucleotide
gaaggagctcttttggatgatcactttcaaactactgaaaaaatg

SEQ ID NO: 304336 - DNA, 46 bp, Artificial Sequence
  Description of Artificial Sequence: Synthetic oligonucleotide
aaggagctcttttggatgatcactttcaaactactgaaaaaatgag

SEQ ID NO: 304337 - DNA, 45 bp, Artificial Sequence
  Description of Artificial Sequence: Synthetic oligonucleotide
aggagctcttttggatgatcactttcaaactactgaaaaaatgag

SEQ ID NO: 304338 - DNA, 44 bp, Artificial Sequence
  Description of Artificial Sequence: Synthetic oligonucleotide
ggagctcttttggatgatcactttcaaactactgaaaaaatgag

SEQ ID NO: 304339 - DNA, 46 bp, Artificial Sequence
  Description of Artificial Sequence: Synthetic oligonucleotide
gagctcttttggatgatcactttcaaactactgaaaaaatgagaac

SEQ ID NO: 304340 - DNA, 49 bp, Artificial Sequence
  Description of Artificial Sequence: Synthetic oligonucleotide
agctcttttggatgatcactttcaaactactgaaaaaatgagaacatac

SEQ ID NO: 304341 - DNA, 48 bp, Artificial Sequence
  Description of Artificial Sequence: Synthetic oligonucleotide
gctcttttggatgatcactttcaaactactgaaaaaatgagaacatac

SEQ ID NO: 304342 - DNA, 48 bp, Artificial Sequence
  Description of Artificial Sequence: Synthetic oligonucleotide
ctcttttggatgatcactttcaaactactgaaaaaatgagaacatacc

SEQ ID NO: 304343 - DNA, 50 bp, Artificial Sequence
  Description of Artificial Sequence: Synthetic oligonucleotide
tcttttggatgatcactttcaaactactgaaaaaatgagaacataccttc

SEQ ID NO: 304344 - DNA, 49 bp, Artificial Sequence
  Description of Artificial Sequence: Synthetic oligonucleotide
cttttggatgatcactttcaaactactgaaaaaatgagaacataccttc

SEQ ID NO: 304345 - DNA, 51 bp, Artificial Sequence
  Description of Artificial Sequence: Synthetic oligonucleotide
ttttggatgatcactttcaaactactgaaaaaatgagaacataccttctag

SEQ ID NO: 304346 - DNA, 50 bp, Artificial Sequence
  Description of Artificial Sequence: Synthetic oligonucleotide
tttggatgatcactttcaaactactgaaaaaatgagaacataccttctag

SEQ ID NO: 304347 - DNA, 49 bp, Artificial Sequence
  Description of Artificial Sequence: Synthetic oligonucleotide
ttggatgatcactttcaaactactgaaaaaatgagaacataccttctag

SEQ ID NO: 304348 - DNA, 48 bp, Artificial Sequence
  Description of Artificial Sequence: Synthetic oligonucleotide
tggatgatcactttcaaactactgaaaaaatgagaacataccttctag

SEQ ID NO: 304349 - DNA, 47 bp, Artificial Sequence
  Description of Artificial Sequence: Synthetic oligonucleotide
ggatgatcactttcaaactactgaaaaaatgagaacataccttctag

SEQ ID NO: 304350 - DNA, 47 bp, Artificial Sequence
  Description of Artificial Sequence: Synthetic oligonucleotide
gatgatcactttcaaactactgaaaaaatgagaacataccttctagc

SEQ ID NO: 304351 - DNA, 47 bp, Artificial Sequence
  Description of Artificial Sequence: Synthetic oligonucleotide
atgatcactttcaaactactgaaaaaatgagaacataccttctagcc

SEQ ID NO: 304352 - DNA, 46 bp, Artificial Sequence
  Description of Artificial Sequence: Synthetic oligonucleotide
tgatcactttcaaactactgaaaaaatgagaacataccttctagcc

SEQ ID NO: 304353 - DNA, 45 bp, Artificial Sequence
  Description of Artificial Sequence: Synthetic oligonucleotide
gatcactttcaaactactgaaaaaatgagaacataccttctagcc

SEQ ID NO: 304354 - DNA, 47 bp, Artificial Sequence
  Description of Artificial Sequence: Synthetic oligonucleotide
atcactttcaaactactgaaaaaatgagaacataccttctagcctac

SEQ ID NO: 304355 - DNA, 46 bp, Artificial Sequence
  Description of Artificial Sequence: Synthetic oligonucleotide
tcactttcaaactactgaaaaaatgagaacataccttctagcctac

SEQ ID NO: 304356 - DNA, 45 bp, Artificial Sequence
  Description of Artificial Sequence: Synthetic oligonucleotide
cactttcaaactactgaaaaaatgagaacataccttctagcctac

SEQ ID NO: 304357 - DNA, 48 bp, Artificial Sequence
  Description of Artificial Sequence: Synthetic oligonucleotide
actttcaaactactgaaaaaatgagaacataccttctagcctacaaag

SEQ ID NO: 304358 - DNA, 47 bp, Artificial Sequence
  Description of Artificial Sequence: Synthetic oligonucleotide
ctttcaaactactgaaaaaatgagaacataccttctagcctacaaag

SEQ ID NO: 304359 - DNA, 50 bp, Artificial Sequence
  Description of Artificial Sequence: Synthetic oligonucleotide
tttcaaactactgaaaaaatgagaacataccttctagcctacaaagtttg

SEQ ID NO: 304360 - DNA, 49 bp, Artificial Sequence
  Description of Artificial Sequence: Synthetic oligonucleotide
ttcaaactactgaaaaaatgagaacataccttctagcctacaaagtttg

SEQ ID NO: 304361 - DNA, 48 bp, Artificial Sequence
  Description of Artificial Sequence: Synthetic oligonucleotide
tcaaactactgaaaaaatgagaacataccttctagcctacaaagtttg

SEQ ID NO: 304362 - DNA, 47 bp, Artificial Sequence
  Description of Artificial Sequence: Synthetic oligonucleotide
caaactactgaaaaaatgagaacataccttctagcctacaaagtttg

SEQ ID NO: 304363 - DNA, 48 bp, Artificial Sequence
  Description of Artificial Sequence: Synthetic oligonucleotide
aaactactgaaaaaatgagaacataccttctagcctacaaagtttgtg

SEQ ID NO: 304364 - DNA, 47 bp, Artificial Sequence
  Description of Artificial Sequence: Synthetic oligonucleotide
aactactgaaaaaatgagaacataccttctagcctacaaagtttgtg

SEQ ID NO: 304365 - DNA, 46 bp, Artificial Sequence
  Description of Artificial Sequence: Synthetic oligonucleotide
actactgaaaaaatgagaacataccttctagcctacaaagtttgtg

SEQ ID NO: 304366 - DNA, 45 bp, Artificial Sequence
  Description of Artificial Sequence: Synthetic oligonucleotide
ctactgaaaaaatgagaacataccttctagcctacaaagtttgtg

SEQ ID NO: 304367 - DNA, 49 bp, Artificial Sequence
  Description of Artificial Sequence: Synthetic oligonucleotide
tactgaaaaaatgagaacataccttctagcctacaaagtttgtgaattc

SEQ ID NO: 304368 - DNA, 48 bp, Artificial Sequence
  Description of Artificial Sequence: Synthetic oligonucleotide
actgaaaaaatgagaacataccttctagcctacaaagtttgtgaattc

SEQ ID NO: 304369 - DNA, 47 bp, Artificial Sequence
  Description of Artificial Sequence: Synthetic oligonucleotide
ctgaaaaaatgagaacataccttctagcctacaaagtttgtgaattc

SEQ ID NO: 304370 - DNA, 47 bp, Artificial Sequence
  Description of Artificial Sequence: Synthetic oligonucleotide
tgaaaaaatgagaacataccttctagcctacaaagtttgtgaattcc

SEQ ID NO: 304371 - DNA, 46 bp, Artificial Sequence
  Description of Artificial Sequence: Synthetic oligonucleotide
gaaaaaatgagaacataccttctagcctacaaagtttgtgaattcc

SEQ ID NO: 304372 - DNA, 47 bp, Artificial Sequence
  Description of Artificial Sequence: Synthetic oligonucleotide
aaaaaatgagaacataccttctagcctacaaagtttgtgaattccac

SEQ ID NO: 304373 - DNA, 46 bp, Artificial Sequence
  Description of Artificial Sequence: Synthetic oligonucleotide
aaaaatgagaacataccttctagcctacaaagtttgtgaattccac

SEQ ID NO: 304374 - DNA, 45 bp, Artificial Sequence
  Description of Artificial Sequence: Synthetic oligonucleotide
aaaatgagaacataccttctagcctacaaagtttgtgaattccac

SEQ ID NO: 304375 - DNA, 44 bp, Artificial Sequence
  Description of Artificial Sequence: Synthetic oligonucleotide
aaatgagaacataccttctagcctacaaagtttgtgaattccac

SEQ ID NO: 304376 - DNA, 43 bp, Artificial Sequence
  Description of Artificial Sequence: Synthetic oligonucleotide
aatgagaacataccttctagcctacaaagtttgtgaattccac

SEQ ID NO: 304377 - DNA, 42 bp, Artificial Sequence
  Description of Artificial Sequence: Synthetic oligonucleotide
atgagaacataccttctagcctacaaagtttgtgaattccac

SEQ ID NO: 304378 - DNA, 41 bp, Artificial Sequence
  Description of Artificial Sequence: Synthetic oligonucleotide
tgagaacataccttctagcctacaaagtttgtgaattccac

SEQ ID NO: 304379 - DNA, 40 bp, Artificial Sequence
  Description of Artificial Sequence: Synthetic oligonucleotide
gagaacataccttctagcctacaaagtttgtgaattccac

SEQ ID NO: 304380 - DNA, 41 bp, Artificial Sequence
  Description of Artificial Sequence: Synthetic oligonucleotide
agaacataccttctagcctacaaagtttgtgaattccactc

SEQ ID NO: 304381 - DNA, 40 bp, Artificial Sequence
  Description of Artificial Sequence: Synthetic oligonucleotide
gaacataccttctagcctacaaagtttgtgaattccactc

SEQ ID NO: 304382 - DNA, 41 bp, Artificial Sequence
  Description of Artificial Sequence: Synthetic oligonucleotide
aacataccttctagcctacaaagtttgtgaattccactctg

SEQ ID NO: 304383 - DNA, 40 bp, Artificial Sequence
  Description of Artificial Sequence: Synthetic oligonucleotide
acataccttctagcctacaaagtttgtgaattccactctg

SEQ ID NO: 304384 - DNA, 39 bp, Artificial Sequence
  Description of Artificial Sequence: Synthetic oligonucleotide
cataccttctagcctacaaagtttgtgaattccactctg

SEQ ID NO: 304385 - DNA, 40 bp, Artificial Sequence
  Description of Artificial Sequence: Synthetic oligonucleotide
ataccttctagcctacaaagtttgtgaattccactctgtg

SEQ ID NO: 304386 - DNA, 39 bp, Artificial Sequence
  Description of Artificial Sequence: Synthetic oligonucleotide
taccttctagcctacaaagtttgtgaattccactctgtg

SEQ ID NO: 304387 - DNA, 38 bp, Artificial Sequence
  Description of Artificial Sequence: Synthetic oligonucleotide
accttctagcctacaaagtttgtgaattccactctgtg

SEQ ID NO: 304388 - DNA, 37 bp, Artificial Sequence
  Description of Artificial Sequence: Synthetic oligonucleotide
ccttctagcctacaaagtttgtgaattccactctgtg

SEQ ID NO: 304389 - DNA, 38 bp, Artificial Sequence
  Description of Artificial Sequence: Synthetic oligonucleotide
cttctagcctacaaagtttgtgaattccactctgtgag

SEQ ID NO: 304390 - DNA, 39 bp, Artificial Sequence
  Description of Artificial Sequence: Synthetic oligonucleotide
ttctagcctacaaagtttgtgaattccactctgtgagtg

SEQ ID NO: 304391 - DNA, 38 bp, Artificial Sequence
  Description of Artificial Sequence: Synthetic oligonucleotide
tctagcctacaaagtttgtgaattccactctgtgagtg

SEQ ID NO: 304392 - DNA, 37 bp, Artificial Sequence
  Description of Artificial Sequence: Synthetic oligonucleotide
ctagcctacaaagtttgtgaattccactctgtgagtg

SEQ ID NO: 304393 - DNA, 37 bp, Artificial Sequence
  Description of Artificial Sequence: Synthetic oligonucleotide
tagcctacaaagtttgtgaattccactctgtgagtgg

SEQ ID NO: 304394 - DNA, 36 bp, Artificial Sequence
  Description of Artificial Sequence: Synthetic oligonucleotide
agcctacaaagtttgtgaattccactctgtgagtgg

SEQ ID NO: 304395 - DNA, 35 bp, Artificial Sequence
  Description of Artificial Sequence: Synthetic oligonucleotide
gcctacaaagtttgtgaattccactctgtgagtgg

SEQ ID NO: 304396 - DNA, 35 bp, Artificial Sequence
  Description of Artificial Sequence: Synthetic oligonucleotide
cctacaaagtttgtgaattccactctgtgagtggc

SEQ ID NO: 304397 - DNA, 37 bp, Artificial Sequence
  Description of Artificial Sequence: Synthetic oligonucleotide
ctacaaagtttgtgaattccactctgtgagtggctac

SEQ ID NO: 304398 - DNA, 38 bp, Artificial Sequence
  Description of Artificial Sequence: Synthetic oligonucleotide
tacaaagtttgtgaattccactctgtgagtggctacac

SEQ ID NO: 304399 - DNA, 37 bp, Artificial Sequence
  Description of Artificial Sequence: Synthetic oligonucleotide
acaaagtttgtgaattccactctgtgagtggctacac

SEQ ID NO: 304400 - DNA, 36 bp, Artificial Sequence
  Description of Artificial Sequence: Synthetic oligonucleotide
caaagtttgtgaattccactctgtgagtggctacac

SEQ ID NO: 304401 - DNA, 38 bp, Artificial Sequence
  Description of Artificial Sequence: Synthetic oligonucleotide
aaagtttgtgaattccactctgtgagtggctacacttc

SEQ ID NO: 304402 - DNA, 37 bp, Artificial Sequence
  Description of Artificial Sequence: Synthetic oligonucleotide
aagtttgtgaattccactctgtgagtggctacacttc

SEQ ID NO: 304403 - DNA, 36 bp, Artificial Sequence
  Description of Artificial Sequence: Synthetic oligonucleotide
agtttgtgaattccactctgtgagtggctacacttc

SEQ ID NO: 304404 - DNA, 35 bp, Artificial Sequence
  Description of Artificial Sequence: Synthetic oligonucleotide
gtttgtgaattccactctgtgagtggctacacttc

SEQ ID NO: 304405 - DNA, 37 bp, Artificial Sequence
  Description of Artificial Sequence: Synthetic oligonucleotide
tttgtgaattccactctgtgagtggctacacttcatc

SEQ ID NO: 304406 - DNA, 36 bp, Artificial Sequence
  Description of Artificial Sequence: Synthetic oligonucleotide
ttgtgaattccactctgtgagtggctacacttcatc

SEQ ID NO: 304407 - DNA, 35 bp, Artificial Sequence
  Description of Artificial Sequence: Synthetic oligonucleotide
tgtgaattccactctgtgagtggctacacttcatc

SEQ ID NO: 304408 - DNA, 34 bp, Artificial Sequence
  Description of Artificial Sequence: Synthetic oligonucleotide
gtgaattccactctgtgagtggctacacttcatc

SEQ ID NO: 304409 - DNA, 35 bp, Artificial Sequence
  Description of Artificial Sequence: Synthetic oligonucleotide
tgaattccactctgtgagtggctacacttcatctg

SEQ ID NO: 304410 - DNA, 34 bp, Artificial Sequence
  Description of Artificial Sequence: Synthetic oligonucleotide
gaattccactctgtgagtggctacacttcatctg

SEQ ID NO: 304411 - DNA, 34 bp, Artificial Sequence
  Description of Artificial Sequence: Synthetic oligonucleotide
aattccactctgtgagtggctacacttcatctgg

SEQ ID NO: 304412 - DNA, 33 bp, Artificial Sequence
  Description of Artificial Sequence: Synthetic oligonucleotide
attccactctgtgagtggctacacttcatctgg

SEQ ID NO: 304413 - DNA, 32 bp, Artificial Sequence
  Description of Artificial Sequence: Synthetic oligonucleotide
ttccactctgtgagtggctacacttcatctgg

SEQ ID NO: 304414 - DNA, 31 bp, Artificial Sequence
  Description of Artificial Sequence: Synthetic oligonucleotide
tccactctgtgagtggctacacttcatctgg

SEQ ID NO: 304415 - DNA, 30 bp, Artificial Sequence
  Description of Artificial Sequence: Synthetic oligonucleotide
ccactctgtgagtggctacacttcatctgg

SEQ ID NO: 304416 - DNA, 30 bp, Artificial Sequence
  Description of Artificial Sequence: Synthetic oligonucleotide
cactctgtgagtggctacacttcatctggg

SEQ ID NO: 304417 - DNA, 30 bp, Artificial Sequence
  Description of Artificial Sequence: Synthetic oligonucleotide
actctgtgagtggctacacttcatctgggg

SEQ ID NO: 304418 - DNA, 29 bp, Artificial Sequence
  Description of Artificial Sequence: Synthetic oligonucleotide
ctctgtgagtggctacacttcatctgggg

SEQ ID NO: 304419 - DNA, 30 bp, Artificial Sequence
  Description of Artificial Sequence: Synthetic oligonucleotide
tctgtgagtggctacacttcatctggggtc

SEQ ID NO: 304420 - DNA, 29 bp, Artificial Sequence
  Description of Artificial Sequence: Synthetic oligonucleotide
ctgtgagtggctacacttcatctggggtc

SEQ ID NO: 304421 - DNA, 31 bp, Artificial Sequence
  Description of Artificial Sequence: Synthetic oligonucleotide
tgtgagtggctacacttcatctggggtcaag

SEQ ID NO: 304422 - DNA, 30 bp, Artificial Sequence
  Description of Artificial Sequence: Synthetic oligonucleotide
gtgagtggctacacttcatctggggtcaag

SEQ ID NO: 304423 - DNA, 30 bp, Artificial Sequence
  Description of Artificial Sequence: Synthetic oligonucleotide
tgagtggctacacttcatctggggtcaagc

SEQ ID NO: 304424 - DNA, 29 bp, Artificial Sequence
  Description of Artificial Sequence: Synthetic oligonucleotide
gagtggctacacttcatctggggtcaagc

SEQ ID NO: 304425 - DNA, 30 bp, Artificial Sequence
  Description of Artificial Sequence: Synthetic oligonucleotide
agtggctacacttcatctggggtcaagctg

SEQ ID NO: 304426 - DNA, 29 bp, Artificial Sequence
  Description of Artificial Sequence: Synthetic oligonucleotide
gtggctacacttcatctggggtcaagctg

SEQ ID NO: 304427 - DNA, 30 bp, Artificial Sequence
  Description of Artificial Sequence: Synthetic oligonucleotide
tggctacacttcatctggggtcaagctgtc

SEQ ID NO: 304428 - DNA, 29 bp, Artificial Sequence
  Description of Artificial Sequence: Synthetic oligonucleotide
ggctacacttcatctggggtcaagctgtc

SEQ ID NO: 304429 - DNA, 29 bp, Artificial Sequence
  Description of Artificial Sequence: Synthetic oligonucleotide
gctacacttcatctggggtcaagctgtcc

SEQ ID NO: 304430 - DNA, 31 bp, Artificial Sequence
  Description of Artificial Sequence: Synthetic oligonucleotide
ctacacttcatctggggtcaagctgtccatc

SEQ ID NO: 304431 - DNA, 34 bp, Artificial Sequence
  Description of Artificial Sequence: Synthetic oligonucleotide
tacacttcatctggggtcaagctgtccatctttg

SEQ ID NO: 304432 - DNA, 33 bp, Artificial Sequence
  Description of Artificial Sequence: Synthetic oligonucleotide
acacttcatctggggtcaagctgtccatctttg

SEQ ID NO: 304433 - DNA, 32 bp, Artificial Sequence
  Description of Artificial Sequence: Synthetic oligonucleotide
cacttcatctggggtcaagctgtccatctttg

SEQ ID NO: 304434 - DNA, 32 bp, Artificial Sequence
  Description of Artificial Sequence: Synthetic oligonucleotide
acttcatctggggtcaagctgtccatctttgc

SEQ ID NO: 304435 - DNA, 31 bp, Artificial Sequence
  Description of Artificial Sequence: Synthetic oligonucleotide
cttcatctggggtcaagctgtccatctttgc

SEQ ID NO: 304436 - DNA, 33 bp, Artificial Sequence
  Description of Artificial Sequence: Synthetic oligonucleotide
ttcatctggggtcaagctgtccatctttgcatc

SEQ ID NO: 304437 - DNA, 32 bp, Artificial Sequence
  Description of Artificial Sequence: Synthetic oligonucleotide
tcatctggggtcaagctgtccatctttgcatc

SEQ ID NO: 304438 - DNA, 31 bp, Artificial Sequence
  Description of Artificial Sequence: Synthetic oligonucleotide
catctggggtcaagctgtccatctttgcatc

SEQ ID NO: 304439 - DNA, 31 bp, Artificial Sequence
  Description of Artificial Sequence: Synthetic oligonucleotide
atctggggtcaagctgtccatctttgcatcc

SEQ ID NO: 304440 - DNA, 30 bp, Artificial Sequence
  Description of Artificial Sequence: Synthetic oligonucleotide
tctggggtcaagctgtccatctttgcatcc

SEQ ID NO: 304441 - DNA, 29 bp, Artificial Sequence
  Description of Artificial Sequence: Synthetic oligonucleotide
ctggggtcaagctgtccatctttgcatcc

SEQ ID NO: 304442 - DNA, 29 bp, Artificial Sequence
  Description of Artificial Sequence: Synthetic oligonucleotide
tggggtcaagctgtccatctttgcatccc

SEQ ID NO: 304443 - DNA, 28 bp, Artificial Sequence
  Description of Artificial Sequence: Synthetic oligonucleotide
ggggtcaagctgtccatctttgcatccc

SEQ ID NO: 304444 - DNA, 28 bp, Artificial Sequence
  Description of Artificial Sequence: Synthetic oligonucleotide
gggtcaagctgtccatctttgcatcccc

SEQ ID NO: 304445 - DNA, 29 bp, Artificial Sequence
  Description of Artificial Sequence: Synthetic oligonucleotide
ggtcaagctgtccatctttgcatcccctg

SEQ ID NO: 304446 - DNA, 30 bp, Artificial Sequence
  Description of Artificial Sequence: Synthetic oligonucleotide
gtcaagctgtccatctttgcatcccctgac

SEQ ID NO: 304447 - DNA, 33 bp, Artificial Sequence
  Description of Artificial Sequence: Synthetic oligonucleotide
tcaagctgtccatctttgcatcccctgacaaac

SEQ ID NO: 304448 - DNA, 32 bp, Artificial Sequence
  Description of Artificial Sequence: Synthetic oligonucleotide
caagctgtccatctttgcatcccctgacaaac

SEQ ID NO: 304449 - DNA, 32 bp, Artificial Sequence
  Description of Artificial Sequence: Synthetic oligonucleotide
aagctgtccatctttgcatcccctgacaaacg

SEQ ID NO: 304450 - DNA, 31 bp, Artificial Sequence
  Description of Artificial Sequence: Synthetic oligonucleotide
agctgtccatctttgcatcccctgacaaacg

SEQ ID NO: 304451 - DNA, 30 bp, Artificial Sequence
  Description of Artificial Sequence: Synthetic oligonucleotide
gctgtccatctttgcatcccctgacaaacg

SEQ ID NO: 304452 - DNA, 30 bp, Artificial Sequence
  Description of Artificial Sequence: Synthetic oligonucleotide
ctgtccatctttgcatcccctgacaaacgg

SEQ ID NO: 304453 - DNA, 33 bp, Artificial Sequence
  Description of Artificial Sequence: Synthetic oligonucleotide
tgtccatctttgcatcccctgacaaacggtatc

SEQ ID NO: 304454 - DNA, 32 bp, Artificial Sequence
  Description of Artificial Sequence: Synthetic oligonucleotide
gtccatctttgcatcccctgacaaacggtatc

SEQ ID NO: 304455 - DNA, 35 bp, Artificial Sequence
  Description of Artificial Sequence: Synthetic oligonucleotide
tccatctttgcatcccctgacaaacggtatcaaac

SEQ ID NO: 304456 - DNA, 34 bp, Artificial Sequence
  Description of Artificial Sequence: Synthetic oligonucleotide
ccatctttgcatcccctgacaaacggtatcaaac

SEQ ID NO: 304457 - DNA, 35 bp, Artificial Sequence
  Description of Artificial Sequence: Synthetic oligonucleotide
catctttgcatcccctgacaaacggtatcaaacac

SEQ ID NO: 304458 - DNA, 40 bp, Artificial Sequence
  Description of Artificial Sequence: Synthetic oligonucleotide
atctttgcatcccctgacaaacggtatcaaacactttatg

SEQ ID NO: 304459 - DNA, 39 bp, Artificial Sequence
  Description of Artificial Sequence: Synthetic oligonucleotide
tctttgcatcccctgacaaacggtatcaaacactttatg

SEQ ID NO: 304460 - DNA, 38 bp, Artificial Sequence
  Description of Artificial Sequence: Synthetic oligonucleotide
ctttgcatcccctgacaaacggtatcaaacactttatg

SEQ ID NO: 304461 - DNA, 38 bp, Artificial Sequence
  Description of Artificial Sequence: Synthetic oligonucleotide
tttgcatcccctgacaaacggtatcaaacactttatgc

SEQ ID NO: 304462 - DNA, 37 bp, Artificial Sequence
  Description of Artificial Sequence: Synthetic oligonucleotide
ttgcatcccctgacaaacggtatcaaacactttatgc

SEQ ID NO: 304463 - DNA, 36 bp, Artificial Sequence
  Description of Artificial Sequence: Synthetic oligonucleotide
tgcatcccctgacaaacggtatcaaacactttatgc

SEQ ID NO: 304464 - DNA, 35 bp, Artificial Sequence
  Description of Artificial Sequence: Synthetic oligonucleotide
gcatcccctgacaaacggtatcaaacactttatgc

SEQ ID NO: 304465 - DNA, 38 bp, Artificial Sequence
  Description of Artificial Sequence: Synthetic oligonucleotide
catcccctgacaaacggtatcaaacactttatgctttc

SEQ ID NO: 304466 - DNA, 38 bp, Artificial Sequence
  Description of Artificial Sequence: Synthetic oligonucleotide
atcccctgacaaacggtatcaaacactttatgctttcc

SEQ ID NO: 304467 - DNA, 37 bp, Artificial Sequence
  Description of Artificial Sequence: Synthetic oligonucleotide
tcccctgacaaacggtatcaaacactttatgctttcc

SEQ ID NO: 304468 - DNA, 36 bp, Artificial Sequence
  Description of Artificial Sequence: Synthetic oligonucleotide
cccctgacaaacggtatcaaacactttatgctttcc

SEQ ID NO: 304469 - DNA, 37 bp, Artificial Sequence
  Description of Artificial Sequence: Synthetic oligonucleotide
ccctgacaaacggtatcaaacactttatgctttccag

SEQ ID NO: 304470 - DNA, 37 bp, Artificial Sequence
  Description of Artificial Sequence: Synthetic oligonucleotide
cctgacaaacggtatcaaacactttatgctttccagg

SEQ ID NO: 304471 - DNA, 37 bp, Artificial Sequence
  Description of Artificial Sequence: Synthetic oligonucleotide
ctgacaaacggtatcaaacactttatgctttccaggc

SEQ ID NO: 304472 - DNA, 39 bp, Artificial Sequence
  Description of Artificial Sequence: Synthetic oligonucleotide
tgacaaacggtatcaaacactttatgctttccaggcatc

SEQ ID NO: 304473 - DNA, 38 bp, Artificial Sequence
  Description of Artificial Sequence: Synthetic oligonucleotide
gacaaacggtatcaaacactttatgctttccaggcatc

SEQ ID NO: 304474 - DNA, 39 bp, Artificial Sequence
  Description of Artificial Sequence: Synthetic oligonucleotide
acaaacggtatcaaacactttatgctttccaggcatcag

SEQ ID NO: 304475 - DNA, 38 bp, Artificial Sequence
  Description of Artificial Sequence: Synthetic oligonucleotide
caaacggtatcaaacactttatgctttccaggcatcag

SEQ ID NO: 304476 - DNA, 39 bp, Artificial Sequence
  Description of Artificial Sequence: Synthetic oligonucleotide
aaacggtatcaaacactttatgctttccaggcatcagtg

SEQ ID NO: 304477 - DNA, 38 bp, Artificial Sequence
  Description of Artificial Sequence: Synthetic oligonucleotide
aacggtatcaaacactttatgctttccaggcatcagtg

SEQ ID NO: 304478 - DNA, 37 bp, Artificial Sequence
  Description of Artificial Sequence: Synthetic oligonucleotide
acggtatcaaacactttatgctttccaggcatcagtg

SEQ ID NO: 304479 - DNA, 36 bp, Artificial Sequence
  Description of Artificial Sequence: Synthetic oligonucleotide
cggtatcaaacactttatgctttccaggcatcagtg

SEQ ID NO: 304480 - DNA, 38 bp, Artificial Sequence
  Description of Artificial Sequence: Synthetic oligonucleotide
ggtatcaaacactttatgctttccaggcatcagtgaag

SEQ ID NO: 304481 - DNA, 38 bp, Artificial Sequence
  Description of Artificial Sequence: Synthetic oligonucleotide
gtatcaaacactttatgctttccaggcatcagtgaagc

SEQ ID NO: 304482 - DNA, 40 bp, Artificial Sequence
  Description of Artificial Sequence: Synthetic oligonucleotide
tatcaaacactttatgctttccaggcatcagtgaagctac

SEQ ID NO: 304483 - DNA, 39 bp, Artificial Sequence
  Description of Artificial Sequence: Synthetic oligonucleotide
atcaaacactttatgctttccaggcatcagtgaagctac

SEQ ID NO: 304484 - DNA, 38 bp, Artificial Sequence
  Description of Artificial Sequence: Synthetic oligonucleotide
tcaaacactttatgctttccaggcatcagtgaagctac

SEQ ID NO: 304485 - DNA, 37 bp, Artificial Sequence
  Description of Artificial Sequence: Synthetic oligonucleotide
caaacactttatgctttccaggcatcagtgaagctac

SEQ ID NO: 304486 - DNA, 39 bp, Artificial Sequence
  Description of Artificial Sequence: Synthetic oligonucleotide
aaacactttatgctttccaggcatcagtgaagctacatg

SEQ ID NO: 304487 - DNA, 38 bp, Artificial Sequence
  Description of Artificial Sequence: Synthetic oligonucleotide
aacactttatgctttccaggcatcagtgaagctacatg

SEQ ID NO: 304488 - DNA, 37 bp, Artificial Sequence
  Description of Artificial Sequence: Synthetic oligonucleotide
acactttatgctttccaggcatcagtgaagctacatg

SEQ ID NO: 304489 - DNA, 36 bp, Artificial Sequence
  Description of Artificial Sequence: Synthetic oligonucleotide
cactttatgctttccaggcatcagtgaagctacatg

SEQ ID NO: 304490 - DNA, 44 bp, Artificial Sequence
  Description of Artificial Sequence: Synthetic oligonucleotide
actttatgctttccaggcatcagtgaagctacatgatttttaag

SEQ ID NO: 304491 - DNA, 43 bp, Artificial Sequence
  Description of Artificial Sequence: Synthetic oligonucleotide
ctttatgctttccaggcatcagtgaagctacatgatttttaag

SEQ ID NO: 304492 - DNA, 47 bp, Artificial Sequence
  Description of Artificial Sequence: Synthetic oligonucleotide
tttatgctttccaggcatcagtgaagctacatgatttttaagaaaag

SEQ ID NO: 304493 - DNA, 46 bp, Artificial Sequence
  Description of Artificial Sequence: Synthetic oligonucleotide
ttatgctttccaggcatcagtgaagctacatgatttttaagaaaag

SEQ ID NO: 304494 - DNA, 45 bp, Artificial Sequence
  Description of Artificial Sequence: Synthetic oligonucleotide
tatgctttccaggcatcagtgaagctacatgatttttaagaaaag

SEQ ID NO: 304495 - DNA, 44 bp, Artificial Sequence
  Description of Artificial Sequence: Synthetic oligonucleotide
atgctttccaggcatcagtgaagctacatgatttttaagaaaag

SEQ ID NO: 304496 - DNA, 43 bp, Artificial Sequence
  Description of Artificial Sequence: Synthetic oligonucleotide
tgctttccaggcatcagtgaagctacatgatttttaagaaaag

SEQ ID NO: 304497 - DNA, 42 bp, Artificial Sequence
  Description of Artificial Sequence: Synthetic oligonucleotide
gctttccaggcatcagtgaagctacatgatttttaagaaaag

SEQ ID NO: 304498 - DNA, 44 bp, Artificial Sequence
  Description of Artificial Sequence: Synthetic oligonucleotide
ctttccaggcatcagtgaagctacatgatttttaagaaaagtac

SEQ ID NO: 304499 - DNA, 47 bp, Artificial Sequence
  Description of Artificial Sequence: Synthetic oligonucleotide
tttccaggcatcagtgaagctacatgatttttaagaaaagtacattg

SEQ ID NO: 304500 - DNA, 46 bp, Artificial Sequence
  Description of Artificial Sequence: Synthetic oligonucleotide
ttccaggcatcagtgaagctacatgatttttaagaaaagtacattg

SEQ ID NO: 304501 - DNA, 45 bp, Artificial Sequence
  Description of Artificial Sequence: Synthetic oligonucleotide
tccaggcatcagtgaagctacatgatttttaagaaaagtacattg

SEQ ID NO: 304502 - DNA, 44 bp, Artificial Sequence
  Description of Artificial Sequence: Synthetic oligonucleotide
ccaggcatcagtgaagctacatgatttttaagaaaagtacattg

SEQ ID NO: 304503 - DNA, 48 bp, Artificial Sequence
  Description of Artificial Sequence: Synthetic oligonucleotide
caggcatcagtgaagctacatgatttttaagaaaagtacattgatatc

SEQ ID NO: 304504 - DNA, 50 bp, Artificial Sequence
  Description of Artificial Sequence: Synthetic oligonucleotide
aggcatcagtgaagctacatgatttttaagaaaagtacattgatatcttc

SEQ ID NO: 304505 - DNA, 49 bp, Artificial Sequence
  Description of Artificial Sequence: Synthetic oligonucleotide
ggcatcagtgaagctacatgatttttaagaaaagtacattgatatcttc

SEQ ID NO: 304506 - DNA, 52 bp, Artificial Sequence
  Description of Artificial Sequence: Synthetic oligonucleotide
gcatcagtgaagctacatgatttttaagaaaagtacattgatatcttctatc

SEQ ID NO: 304507 - DNA, 52 bp, Artificial Sequence
  Description of Artificial Sequence: Synthetic oligonucleotide
catcagtgaagctacatgatttttaagaaaagtacattgatatcttctatcc

SEQ ID NO: 304508 - DNA, 53 bp, Artificial Sequence
  Description of Artificial Sequence: Synthetic oligonucleotide
atcagtgaagctacatgatttttaagaaaagtacattgatatcttctatccac

SEQ ID NO: 304509 - DNA, 52 bp, Artificial Sequence
  Description of Artificial Sequence: Synthetic oligonucleotide
tcagtgaagctacatgatttttaagaaaagtacattgatatcttctatccac

SEQ ID NO: 304510 - DNA, 51 bp, Artificial Sequence
  Description of Artificial Sequence: Synthetic oligonucleotide
cagtgaagctacatgatttttaagaaaagtacattgatatcttctatccac

SEQ ID NO: 304511 - DNA, 52 bp, Artificial Sequence
  Description of Artificial Sequence: Synthetic oligonucleotide
agtgaagctacatgatttttaagaaaagtacattgatatcttctatccactg

SEQ ID NO: 304512 - DNA, 51 bp, Artificial Sequence
  Description of Artificial Sequence: Synthetic oligonucleotide
gtgaagctacatgatttttaagaaaagtacattgatatcttctatccactg

SEQ ID NO: 304513 - DNA, 52 bp, Artificial Sequence
  Description of Artificial Sequence: Synthetic oligonucleotide
tgaagctacatgatttttaagaaaagtacattgatatcttctatccactgtc

SEQ ID NO: 304514 - DNA, 51 bp, Artificial Sequence
  Description of Artificial Sequence: Synthetic oligonucleotide
gaagctacatgatttttaagaaaagtacattgatatcttctatccactgtc

SEQ ID NO: 304515 - DNA, 51 bp, Artificial Sequence
  Description of Artificial Sequence: Synthetic oligonucleotide
aagctacatgatttttaagaaaagtacattgatatcttctatccactgtcc

SEQ ID NO: 304516 - DNA, 50 bp, Artificial Sequence
  Description of Artificial Sequence: Synthetic oligonucleotide
agctacatgatttttaagaaaagtacattgatatcttctatccactgtcc

SEQ ID NO: 304517 - DNA, 49 bp, Artificial Sequence
  Description of Artificial Sequence: Synthetic oligonucleotide
gctacatgatttttaagaaaagtacattgatatcttctatccactgtcc

SEQ ID NO: 304518 - DNA, 52 bp, Artificial Sequence
  Description of Artificial Sequence: Synthetic oligonucleotide
ctacatgatttttaagaaaagtacattgatatcttctatccactgtccaaac

SEQ ID NO: 304519 - DNA, 53 bp, Artificial Sequence
  Description of Artificial Sequence: Synthetic oligonucleotide
tacatgatttttaagaaaagtacattgatatcttctatccactgtccaaactg

SEQ ID NO: 304520 - DNA, 52 bp, Artificial Sequence
  Description of Artificial Sequence: Synthetic oligonucleotide
acatgatttttaagaaaagtacattgatatcttctatccactgtccaaactg

SEQ ID NO: 304521 - DNA, 51 bp, Artificial Sequence
  Description of Artificial Sequence: Synthetic oligonucleotide
catgatttttaagaaaagtacattgatatcttctatccactgtccaaactg

SEQ ID NO: 304522 - DNA, 51 bp, Artificial Sequence
  Description of Artificial Sequence: Synthetic oligonucleotide
atgatttttaagaaaagtacattgatatcttctatccactgtccaaactgc

SEQ ID NO: 304523 - DNA, 50 bp, Artificial Sequence
  Description of Artificial Sequence: Synthetic oligonucleotide
tgatttttaagaaaagtacattgatatcttctatccactgtccaaactgc

SEQ ID NO: 304524 - DNA, 49 bp, Artificial Sequence
  Description of Artificial Sequence: Synthetic oligonucleotide
gatttttaagaaaagtacattgatatcttctatccactgtccaaactgc

SEQ ID NO: 304525 - DNA, 57 bp, Artificial Sequence
  Description of Artificial Sequence: Synthetic oligonucleotide
atttttaagaaaagtacattgatatcttctatccactgtccaaactgcatttaattg

SEQ ID NO: 304526 - DNA, 56 bp, Artificial Sequence
  Description of Artificial Sequence: Synthetic oligonucleotide
tttttaagaaaagtacattgatatcttctatccactgtccaaactgcatttaattg

SEQ ID NO: 304527 - DNA, 55 bp, Artificial Sequence
  Description of Artificial Sequence: Synthetic oligonucleotide
ttttaagaaaagtacattgatatcttctatccactgtccaaactgcatttaattg

SEQ ID NO: 304528 - DNA, 54 bp, Artificial Sequence
  Description of Artificial Sequence: Synthetic oligonucleotide
tttaagaaaagtacattgatatcttctatccactgtccaaactgcatttaattg

SEQ ID NO: 304529 - DNA, 53 bp, Artificial Sequence
  Description of Artificial Sequence: Synthetic oligonucleotide
ttaagaaaagtacattgatatcttctatccactgtccaaactgcatttaattg

SEQ ID NO: 304530 - DNA, 52 bp, Artificial Sequence
  Description of Artificial Sequence: Synthetic oligonucleotide
taagaaaagtacattgatatcttctatccactgtccaaactgcatttaattg

SEQ ID NO: 304531 - DNA, 51 bp, Artificial Sequence
  Description of Artificial Sequence: Synthetic oligonucleotide
aagaaaagtacattgatatcttctatccactgtccaaactgcatttaattg

SEQ ID NO: 304532 - DNA, 50 bp, Artificial Sequence
  Description of Artificial Sequence: Synthetic oligonucleotide
agaaaagtacattgatatcttctatccactgtccaaactgcatttaattg

SEQ ID NO: 304533 - DNA, 49 bp, Artificial Sequence
  Description of Artificial Sequence: Synthetic oligonucleotide
gaaaagtacattgatatcttctatccactgtccaaactgcatttaattg

SEQ ID NO: 304534 - DNA, 49 bp, Artificial Sequence
  Description of Artificial Sequence: Synthetic oligonucleotide
aaaagtacattgatatcttctatccactgtccaaactgcatttaattgg

SEQ ID NO: 304535 - DNA, 48 bp, Artificial Sequence
  Description of Artificial Sequence: Synthetic oligonucleotide
aaagtacattgatatcttctatccactgtccaaactgcatttaattgg

SEQ ID NO: 304536 - DNA, 47 bp, Artificial Sequence
  Description of Artificial Sequence: Synthetic oligonucleotide
aagtacattgatatcttctatccactgtccaaactgcatttaattgg

SEQ ID NO: 304537 - DNA, 46 bp, Artificial Sequence
  Description of Artificial Sequence: Synthetic oligonucleotide
agtacattgatatcttctatccactgtccaaactgcatttaattgg

SEQ ID NO: 304538 - DNA, 45 bp, Artificial Sequence
  Description of Artificial Sequence: Synthetic oligonucleotide
gtacattgatatcttctatccactgtccaaactgcatttaattgg

SEQ ID NO: 304539 - DNA, 49 bp, Artificial Sequence
  Description of Artificial Sequence: Synthetic oligonucleotide
tacattgatatcttctatccactgtccaaactgcatttaattggtattc

SEQ ID NO: 304540 - DNA, 48 bp, Artificial Sequence
  Description of Artificial Sequence: Synthetic oligonucleotide
acattgatatcttctatccactgtccaaactgcatttaattggtattc

SEQ ID NO: 304541 - DNA, 47 bp, Artificial Sequence
  Description of Artificial Sequence: Synthetic oligonucleotide
cattgatatcttctatccactgtccaaactgcatttaattggtattc

SEQ ID NO: 304542 - DNA, 47 bp, Artificial Sequence
  Description of Artificial Sequence: Synthetic oligonucleotide
attgatatcttctatccactgtccaaactgcatttaattggtattcc

SEQ ID NO: 304543 - DNA, 46 bp, Artificial Sequence
  Description of Artificial Sequence: Synthetic oligonucleotide
ttgatatcttctatccactgtccaaactgcatttaattggtattcc

SEQ ID NO: 304544 - DNA, 45 bp, Artificial Sequence
  Description of Artificial Sequence: Synthetic oligonucleotide
tgatatcttctatccactgtccaaactgcatttaattggtattcc

SEQ ID NO: 304545 - DNA, 44 bp, Artificial Sequence
  Description of Artificial Sequence: Synthetic oligonucleotide
gatatcttctatccactgtccaaactgcatttaattggtattcc

SEQ ID NO: 304546 - DNA, 45 bp, Artificial Sequence
  Description of Artificial Sequence: Synthetic oligonucleotide
atatcttctatccactgtccaaactgcatttaattggtattcctg

SEQ ID NO: 304547 - DNA, 44 bp, Artificial Sequence
  Description of Artificial Sequence: Synthetic oligonucleotide
tatcttctatccactgtccaaactgcatttaattggtattcctg

SEQ ID NO: 304548 - DNA, 43 bp, Artificial Sequence
  Description of Artificial Sequence: Synthetic oligonucleotide
atcttctatccactgtccaaactgcatttaattggtattcctg

SEQ ID NO: 304549 - DNA, 42 bp, Artificial Sequence
  Description of Artificial Sequence: Synthetic oligonucleotide
tcttctatccactgtccaaactgcatttaattggtattcctg

SEQ ID NO: 304550 - DNA, 41 bp, Artificial Sequence
  Description of Artificial Sequence: Synthetic oligonucleotide
cttctatccactgtccaaactgcatttaattggtattcctg

SEQ ID NO: 304551 - DNA, 42 bp, Artificial Sequence
  Description of Artificial Sequence: Synthetic oligonucleotide
ttctatccactgtccaaactgcatttaattggtattcctgag

SEQ ID NO: 304552 - DNA, 41 bp, Artificial Sequence
  Description of Artificial Sequence: Synthetic oligonucleotide
tctatccactgtccaaactgcatttaattggtattcctgag

SEQ ID NO: 304553 - DNA, 40 bp, Artificial Sequence
  Description of Artificial Sequence: Synthetic oligonucleotide
ctatccactgtccaaactgcatttaattggtattcctgag

SEQ ID NO: 304554 - DNA, 43 bp, Artificial Sequence
  Description of Artificial Sequence: Synthetic oligonucleotide
tatccactgtccaaactgcatttaattggtattcctgagtttg

SEQ ID NO: 304555 - DNA, 42 bp, Artificial Sequence
  Description of Artificial Sequence: Synthetic oligonucleotide
atccactgtccaaactgcatttaattggtattcctgagtttg

SEQ ID NO: 304556 - DNA, 41 bp, Artificial Sequence
  Description of Artificial Sequence: Synthetic oligonucleotide
tccactgtccaaactgcatttaattggtattcctgagtttg

SEQ ID NO: 304557 - DNA, 40 bp, Artificial Sequence
  Description of Artificial Sequence: Synthetic oligonucleotide
ccactgtccaaactgcatttaattggtattcctgagtttg

SEQ ID NO: 304558 - DNA, 40 bp, Artificial Sequence
  Description of Artificial Sequence: Synthetic oligonucleotide
cactgtccaaactgcatttaattggtattcctgagtttgc

SEQ ID NO: 304559 - DNA, 41 bp, Artificial Sequence
  Description of Artificial Sequence: Synthetic oligonucleotide
actgtccaaactgcatttaattggtattcctgagtttgcac

SEQ ID NO: 304560 - DNA, 40 bp, Artificial Sequence
  Description of Artificial Sequence: Synthetic oligonucleotide
ctgtccaaactgcatttaattggtattcctgagtttgcac

SEQ ID NO: 304561 - DNA, 40 bp, Artificial Sequence
  Description of Artificial Sequence: Synthetic oligonucleotide
tgtccaaactgcatttaattggtattcctgagtttgcacc

SEQ ID NO: 304562 - DNA, 39 bp, Artificial Sequence
  Description of Artificial Sequence: Synthetic oligonucleotide
gtccaaactgcatttaattggtattcctgagtttgcacc

SEQ ID NO: 304563 - DNA, 40 bp, Artificial Sequence
  Description of Artificial Sequence: Synthetic oligonucleotide
tccaaactgcatttaattggtattcctgagtttgcacctc

SEQ ID NO: 304564 - DNA, 39 bp, Artificial Sequence
  Description of Artificial Sequence: Synthetic oligonucleotide
ccaaactgcatttaattggtattcctgagtttgcacctc

SEQ ID NO: 304565 - DNA, 39 bp, Artificial Sequence
  Description of Artificial Sequence: Synthetic oligonucleotide
caaactgcatttaattggtattcctgagtttgcacctcg

SEQ ID NO: 304566 - DNA, 40 bp, Artificial Sequence
  Description of Artificial Sequence: Synthetic oligonucleotide
aaactgcatttaattggtattcctgagtttgcacctcgag

SEQ ID NO: 304567 - DNA, 39 bp, Artificial Sequence
  Description of Artificial Sequence: Synthetic oligonucleotide
aactgcatttaattggtattcctgagtttgcacctcgag

SEQ ID NO: 304568 - DNA, 38 bp, Artificial Sequence
  Description of Artificial Sequence: Synthetic oligonucleotide
actgcatttaattggtattcctgagtttgcacctcgag

SEQ ID NO: 304569 - DNA, 37 bp, Artificial Sequence
  Description of Artificial Sequence: Synthetic oligonucleotide
ctgcatttaattggtattcctgagtttgcacctcgag

SEQ ID NO: 304570 - DNA, 37 bp, Artificial Sequence
  Description of Artificial Sequence: Synthetic oligonucleotide
tgcatttaattggtattcctgagtttgcacctcgagc

SEQ ID NO: 304571 - DNA, 36 bp, Artificial Sequence
  Description of Artificial Sequence: Synthetic oligonucleotide
gcatttaattggtattcctgagtttgcacctcgagc

SEQ ID NO: 304572 - DNA, 36 bp, Artificial Sequence
  Description of Artificial Sequence: Synthetic oligonucleotide
catttaattggtattcctgagtttgcacctcgagcc

SEQ ID NO: 304573 - DNA, 38 bp, Artificial Sequence
  Description of Artificial Sequence: Synthetic oligonucleotide
atttaattggtattcctgagtttgcacctcgagccatg

SEQ ID NO: 304574 - DNA, 37 bp, Artificial Sequence
  Description of Artificial Sequence: Synthetic oligonucleotide
tttaattggtattcctgagtttgcacctcgagccatg

SEQ ID NO: 304575 - DNA, 36 bp, Artificial Sequence
  Description of Artificial Sequence: Synthetic oligonucleotide
ttaattggtattcctgagtttgcacctcgagccatg

SEQ ID NO: 304576 - DNA, 35 bp, Artificial Sequence
  Description of Artificial Sequence: Synthetic oligonucleotide
taattggtattcctgagtttgcacctcgagccatg

SEQ ID NO: 304577 - DNA, 34 bp, Artificial Sequence
  Description of Artificial Sequence: Synthetic oligonucleotide
aattggtattcctgagtttgcacctcgagccatg

SEQ ID NO: 304578 - DNA, 33 bp, Artificial Sequence
  Description of Artificial Sequence: Synthetic oligonucleotide
attggtattcctgagtttgcacctcgagccatg

SEQ ID NO: 304579 - DNA, 32 bp, Artificial Sequence
  Description of Artificial Sequence: Synthetic oligonucleotide
ttggtattcctgagtttgcacctcgagccatg

SEQ ID NO: 304580 - DNA, 31 bp, Artificial Sequence
  Description of Artificial Sequence: Synthetic oligonucleotide
tggtattcctgagtttgcacctcgagccatg

SEQ ID NO: 304581 - DNA, 30 bp, Artificial Sequence
  Description of Artificial Sequence: Synthetic oligonucleotide
ggtattcctgagtttgcacctcgagccatg

SEQ ID NO: 304582 - DNA, 30 bp, Artificial Sequence
  Description of Artificial Sequence: Synthetic oligonucleotide
gtattcctgagtttgcacctcgagccatgg

SEQ ID NO: 304583 - DNA, 36 bp, Artificial Sequence
  Description of Artificial Sequence: Synthetic oligonucleotide
tattcctgagtttgcacctcgagccatggtaaattg

SEQ ID NO: 304584 - DNA, 35 bp, Artificial Sequence
  Description of Artificial Sequence: Synthetic oligonucleotide
attcctgagtttgcacctcgagccatggtaaattg

SEQ ID NO: 304585 - DNA, 34 bp, Artificial Sequence
  Description of Artificial Sequence: Synthetic oligonucleotide
ttcctgagtttgcacctcgagccatggtaaattg

SEQ ID NO: 304586 - DNA, 33 bp, Artificial Sequence
  Description of Artificial Sequence: Synthetic oligonucleotide
tcctgagtttgcacctcgagccatggtaaattg

SEQ ID NO: 304587 - DNA, 32 bp, Artificial Sequence
  Description of Artificial Sequence: Synthetic oligonucleotide
cctgagtttgcacctcgagccatggtaaattg

SEQ ID NO: 304588 - DNA, 32 bp, Artificial Sequence
  Description of Artificial Sequence: Synthetic oligonucleotide
ctgagtttgcacctcgagccatggtaaattgg

SEQ ID NO: 304589 - DNA, 32 bp, Artificial Sequence
  Description of Artificial Sequence: Synthetic oligonucleotide
tgagtttgcacctcgagccatggtaaattggg

SEQ ID NO: 304590 - DNA, 31 bp, Artificial Sequence
  Description of Artificial Sequence: Synthetic oligonucleotide
gagtttgcacctcgagccatggtaaattggg

SEQ ID NO: 304591 - DNA, 31 bp, Artificial Sequence
  Description of Artificial Sequence: Synthetic oligonucleotide
agtttgcacctcgagccatggtaaattgggg

SEQ ID NO: 304592 - DNA, 30 bp, Artificial Sequence
  Description of Artificial Sequence: Synthetic oligonucleotide
gtttgcacctcgagccatggtaaattgggg

SEQ ID NO: 304593 - DNA, 30 bp, Artificial Sequence
  Description of Artificial Sequence: Synthetic oligonucleotide
tttgcacctcgagccatggtaaattggggg

SEQ ID NO: 304594 - DNA, 29 bp, Artificial Sequence
  Description of Artificial Sequence: Synthetic oligonucleotide
ttgcacctcgagccatggtaaattggggg

SEQ ID NO: 304595 - DNA, 28 bp, Artificial Sequence
  Description of Artificial Sequence: Synthetic oligonucleotide
tgcacctcgagccatggtaaattggggg

SEQ ID NO: 304596 - DNA, 27 bp, Artificial Sequence
  Description of Artificial Sequence: Synthetic oligonucleotide
gcacctcgagccatggtaaattggggg

SEQ ID NO: 304597 - DNA, 27 bp, Artificial Sequence
  Description of Artificial Sequence: Synthetic oligonucleotide
cacctcgagccatggtaaattgggggc

SEQ ID NO: 304598 - DNA, 28 bp, Artificial Sequence
  Description of Artificial Sequence: Synthetic oligonucleotide
acctcgagccatggtaaattgggggctc

SEQ ID NO: 304599 - DNA, 27 bp, Artificial Sequence
  Description of Artificial Sequence: Synthetic oligonucleotide
cctcgagccatggtaaattgggggctc

SEQ ID NO: 304600 - DNA, 31 bp, Artificial Sequence
  Description of Artificial Sequence: Synthetic oligonucleotide
ctcgagccatggtaaattgggggctcattac

SEQ ID NO: 304601 - DNA, 36 bp, Artificial Sequence
  Description of Artificial Sequence: Synthetic oligonucleotide
tcgagccatggtaaattgggggctcattacaaatag

SEQ ID NO: 304602 - DNA, 35 bp, Artificial Sequence
  Description of Artificial Sequence: Synthetic oligonucleotide
cgagccatggtaaattgggggctcattacaaatag

SEQ ID NO: 304603 - DNA, 35 bp, Artificial Sequence
  Description of Artificial Sequence: Synthetic oligonucleotide
gagccatggtaaattgggggctcattacaaatagg

SEQ ID NO: 304604 - DNA, 35 bp, Artificial Sequence
  Description of Artificial Sequence: Synthetic oligonucleotide
agccatggtaaattgggggctcattacaaataggg

SEQ ID NO: 304605 - DNA, 34 bp, Artificial Sequence
  Description of Artificial Sequence: Synthetic oligonucleotide
gccatggtaaattgggggctcattacaaataggg

SEQ ID NO: 304606 - DNA, 35 bp, Artificial Sequence
  Description of Artificial Sequence: Synthetic oligonucleotide
ccatggtaaattgggggctcattacaaatagggag

SEQ ID NO: 304607 - DNA, 36 bp, Artificial Sequence
  Description of Artificial Sequence: Synthetic oligonucleotide
catggtaaattgggggctcattacaaatagggagtc

SEQ ID NO: 304608 - DNA, 36 bp, Artificial Sequence
  Description of Artificial Sequence: Synthetic oligonucleotide
atggtaaattgggggctcattacaaatagggagtcg

SEQ ID NO: 304609 - DNA, 35 bp, Artificial Sequence
  Description of Artificial Sequence: Synthetic oligonucleotide
tggtaaattgggggctcattacaaatagggagtcg

SEQ ID NO: 304610 - DNA, 34 bp, Artificial Sequence
  Description of Artificial Sequence: Synthetic oligonucleotide
ggtaaattgggggctcattacaaatagggagtcg

SEQ ID NO: 304611 - DNA, 35 bp, Artificial Sequence
  Description of Artificial Sequence: Synthetic oligonucleotide
gtaaattgggggctcattacaaatagggagtcgtc

SEQ ID NO: 304612 - DNA, 36 bp, Artificial Sequence
  Description of Artificial Sequence: Synthetic oligonucleotide
taaattgggggctcattacaaatagggagtcgtcac

SEQ ID NO: 304613 - DNA, 35 bp, Artificial Sequence
  Description of Artificial Sequence: Synthetic oligonucleotide
aaattgggggctcattacaaatagggagtcgtcac

SEQ ID NO: 304614 - DNA, 34 bp, Artificial Sequence
  Description of Artificial Sequence: Synthetic oligonucleotide
aattgggggctcattacaaatagggagtcgtcac

SEQ ID NO: 304615 - DNA, 33 bp, Artificial Sequence
  Description of Artificial Sequence: Synthetic oligonucleotide
attgggggctcattacaaatagggagtcgtcac

SEQ ID NO: 304616 - DNA, 32 bp, Artificial Sequence
  Description of Artificial Sequence: Synthetic oligonucleotide
ttgggggctcattacaaatagggagtcgtcac

SEQ ID NO: 304617 - DNA, 31 bp, Artificial Sequence
  Description of Artificial Sequence: Synthetic oligonucleotide
tgggggctcattacaaatagggagtcgtcac

SEQ ID NO: 304618 - DNA, 30 bp, Artificial Sequence
  Description of Artificial Sequence: Synthetic oligonucleotide
gggggctcattacaaatagggagtcgtcac

SEQ ID NO: 304619 - DNA, 31 bp, Artificial Sequence
  Description of Artificial Sequence: Synthetic oligonucleotide
ggggctcattacaaatagggagtcgtcactg

SEQ ID NO: 304620 - DNA, 31 bp, Artificial Sequence
  Description of Artificial Sequence: Synthetic oligonucleotide
gggctcattacaaatagggagtcgtcactgc

SEQ ID NO: 304621 - DNA, 36 bp, Artificial Sequence
  Description of Artificial Sequence: Synthetic oligonucleotide
ggctcattacaaatagggagtcgtcactgctatttg

SEQ ID NO: 304622 - DNA, 37 bp, Artificial Sequence
  Description of Artificial Sequence: Synthetic oligonucleotide
gctcattacaaatagggagtcgtcactgctatttgac

SEQ ID NO: 304623 - DNA, 37 bp, Artificial Sequence
  Description of Artificial Sequence: Synthetic oligonucleotide
ctcattacaaatagggagtcgtcactgctatttgacc

SEQ ID NO: 304624 - DNA, 37 bp, Artificial Sequence
  Description of Artificial Sequence: Synthetic oligonucleotide
tcattacaaatagggagtcgtcactgctatttgaccc

SEQ ID NO: 304625 - DNA, 36 bp, Artificial Sequence
  Description of Artificial Sequence: Synthetic oligonucleotide
cattacaaatagggagtcgtcactgctatttgaccc

SEQ ID NO: 304626 - DNA, 36 bp, Artificial Sequence
  Description of Artificial Sequence: Synthetic oligonucleotide
attacaaatagggagtcgtcactgctatttgacccc

SEQ ID NO: 304627 - DNA, 35 bp, Artificial Sequence
  Description of Artificial Sequence: Synthetic oligonucleotide
ttacaaatagggagtcgtcactgctatttgacccc

SEQ ID NO: 304628 - DNA, 34 bp, Artificial Sequence
  Description of Artificial Sequence: Synthetic oligonucleotide
tacaaatagggagtcgtcactgctatttgacccc

SEQ ID NO: 304629 - DNA, 33 bp, Artificial Sequence
  Description of Artificial Sequence: Synthetic oligonucleotide
acaaatagggagtcgtcactgctatttgacccc

SEQ ID NO: 304630 - DNA, 32 bp, Artificial Sequence
  Description of Artificial Sequence: Synthetic oligonucleotide
caaatagggagtcgtcactgctatttgacccc

SEQ ID NO: 304631 - DNA, 34 bp, Artificial Sequence
  Description of Artificial Sequence: Synthetic oligonucleotide
aaatagggagtcgtcactgctatttgacccctag

SEQ ID NO: 304632 - DNA, 33 bp, Artificial Sequence
  Description of Artificial Sequence: Synthetic oligonucleotide
aatagggagtcgtcactgctatttgacccctag

SEQ ID NO: 304633 - DNA, 32 bp, Artificial Sequence
  Description of Artificial Sequence: Synthetic oligonucleotide
atagggagtcgtcactgctatttgacccctag

SEQ ID NO: 304634 - DNA, 31 bp, Artificial Sequence
  Description of Artificial Sequence: Synthetic oligonucleotide
tagggagtcgtcactgctatttgacccctag

SEQ ID NO: 304635 - DNA, 30 bp, Artificial Sequence
  Description of Artificial Sequence: Synthetic oligonucleotide
agggagtcgtcactgctatttgacccctag

SEQ ID NO: 304636 - DNA, 29 bp, Artificial Sequence
  Description of Artificial Sequence: Synthetic oligonucleotide
gggagtcgtcactgctatttgacccctag

SEQ ID NO: 304637 - DNA, 30 bp, Artificial Sequence
  Description of Artificial Sequence: Synthetic oligonucleotide
ggagtcgtcactgctatttgacccctagac

SEQ ID NO: 304638 - DNA, 30 bp, Artificial Sequence
  Description of Artificial Sequence: Synthetic oligonucleotide
gagtcgtcactgctatttgacccctagacc

SEQ ID NO: 304639 - DNA, 31 bp, Artificial Sequence
  Description of Artificial Sequence: Synthetic oligonucleotide
agtcgtcactgctatttgacccctagacctc

SEQ ID NO: 304640 - DNA, 30 bp, Artificial Sequence
  Description of Artificial Sequence: Synthetic oligonucleotide
gtcgtcactgctatttgacccctagacctc

SEQ ID NO: 304641 - DNA, 32 bp, Artificial Sequence
  Description of Artificial Sequence: Synthetic oligonucleotide
tcgtcactgctatttgacccctagacctcttg

SEQ ID NO: 304642 - DNA, 31 bp, Artificial Sequence
  Description of Artificial Sequence: Synthetic oligonucleotide
cgtcactgctatttgacccctagacctcttg

SEQ ID NO: 304643 - DNA, 32 bp, Artificial Sequence
  Description of Artificial Sequence: Synthetic oligonucleotide
gtcactgctatttgacccctagacctcttgtg

SEQ ID NO: 304644 - DNA, 32 bp, Artificial Sequence
  Description of Artificial Sequence: Synthetic oligonucleotide
tcactgctatttgacccctagacctcttgtgc

SEQ ID NO: 304645 - DNA, 31 bp, Artificial Sequence
  Description of Artificial Sequence: Synthetic oligonucleotide
cactgctatttgacccctagacctcttgtgc

SEQ ID NO: 304646 - DNA, 33 bp, Artificial Sequence
  Description of Artificial Sequence: Synthetic oligonucleotide
actgctatttgacccctagacctcttgtgcttc

SEQ ID NO: 304647 - DNA, 32 bp, Artificial Sequence
  Description of Artificial Sequence: Synthetic oligonucleotide
ctgctatttgacccctagacctcttgtgcttc

SEQ ID NO: 304648 - DNA, 32 bp, Artificial Sequence
  Description of Artificial Sequence: Synthetic oligonucleotide
tgctatttgacccctagacctcttgtgcttcc

SEQ ID NO: 304649 - DNA, 31 bp, Artificial Sequence
  Description of Artificial Sequence: Synthetic oligonucleotide
gctatttgacccctagacctcttgtgcttcc

SEQ ID NO: 304650 - DNA, 31 bp, Artificial Sequence
  Description of Artificial Sequence: Synthetic oligonucleotide
ctatttgacccctagacctcttgtgcttccg

SEQ ID NO: 304651 - DNA, 36 bp, Artificial Sequence
  Description of Artificial Sequence: Synthetic oligonucleotide
tatttgacccctagacctcttgtgcttccgaaaaac

SEQ ID NO: 304652 - DNA, 35 bp, Artificial Sequence
  Description of Artificial Sequence: Synthetic oligonucleotide
atttgacccctagacctcttgtgcttccgaaaaac

SEQ ID NO: 304653 - DNA, 34 bp, Artificial Sequence
  Description of Artificial Sequence: Synthetic oligonucleotide
tttgacccctagacctcttgtgcttccgaaaaac

SEQ ID NO: 304654 - DNA, 33 bp, Artificial Sequence
  Description of Artificial Sequence: Synthetic oligonucleotide
ttgacccctagacctcttgtgcttccgaaaaac

SEQ ID NO: 304655 - DNA, 32 bp, Artificial Sequence
  Description of Artificial Sequence: Synthetic oligonucleotide
tgacccctagacctcttgtgcttccgaaaaac

SEQ ID NO: 304656 - DNA, 31 bp, Artificial Sequence
  Description of Artificial Sequence: Synthetic oligonucleotide
gacccctagacctcttgtgcttccgaaaaac

SEQ ID NO: 304657 - DNA, 32 bp, Artificial Sequence
  Description of Artificial Sequence: Synthetic oligonucleotide
acccctagacctcttgtgcttccgaaaaactg

SEQ ID NO: 304658 - DNA, 31 bp, Artificial Sequence
  Description of Artificial Sequence: Synthetic oligonucleotide
cccctagacctcttgtgcttccgaaaaactg

SEQ ID NO: 304659 - DNA, 32 bp, Artificial Sequence
  Description of Artificial Sequence: Synthetic oligonucleotide
ccctagacctcttgtgcttccgaaaaactgtg

SEQ ID NO: 304660 - DNA, 32 bp, Artificial Sequence
  Description of Artificial Sequence: Synthetic oligonucleotide
cctagacctcttgtgcttccgaaaaactgtgg

SEQ ID NO: 304661 - DNA, 32 bp, Artificial Sequence
  Description of Artificial Sequence: Synthetic oligonucleotide
ctagacctcttgtgcttccgaaaaactgtggc

SEQ ID NO: 304662 - DNA, 33 bp, Artificial Sequence
  Description of Artificial Sequence: Synthetic oligonucleotide
tagacctcttgtgcttccgaaaaactgtggctc

SEQ ID NO: 304663 - DNA, 32 bp, Artificial Sequence
  Description of Artificial Sequence: Synthetic oligonucleotide
agacctcttgtgcttccgaaaaactgtggctc

SEQ ID NO: 304664 - DNA, 31 bp, Artificial Sequence
  Description of Artificial Sequence: Synthetic oligonucleotide
gacctcttgtgcttccgaaaaactgtggctc

SEQ ID NO: 304665 - DNA, 32 bp, Artificial Sequence
  Description of Artificial Sequence: Synthetic oligonucleotide
acctcttgtgcttccgaaaaactgtggctcac

SEQ ID NO: 304666 - DNA, 31 bp, Artificial Sequence
  Description of Artificial Sequence: Synthetic oligonucleotide
cctcttgtgcttccgaaaaactgtggctcac

SEQ ID NO: 304667 - DNA, 31 bp, Artificial Sequence
  Description of Artificial Sequence: Synthetic oligonucleotide
ctcttgtgcttccgaaaaactgtggctcacc

SEQ ID NO: 304668 - DNA, 32 bp, Artificial Sequence
  Description of Artificial Sequence: Synthetic oligonucleotide
tcttgtgcttccgaaaaactgtggctcaccag

SEQ ID NO: 304669 - DNA, 31 bp, Artificial Sequence
  Description of Artificial Sequence: Synthetic oligonucleotide
cttgtgcttccgaaaaactgtggctcaccag

SEQ ID NO: 304670 - DNA, 32 bp, Artificial Sequence
  Description of Artificial Sequence: Synthetic oligonucleotide
ttgtgcttccgaaaaactgtggctcaccagag

SEQ ID NO: 304671 - DNA, 31 bp, Artificial Sequence
  Description of Artificial Sequence: Synthetic oligonucleotide
tgtgcttccgaaaaactgtggctcaccagag

SEQ ID NO: 304672 - DNA, 30 bp, Artificial Sequence
  Description of Artificial Sequence: Synthetic oligonucleotide
gtgcttccgaaaaactgtggctcaccagag

SEQ ID NO: 304673 - DNA, 31 bp, Artificial Sequence
  Description of Artificial Sequence: Synthetic oligonucleotide
tgcttccgaaaaactgtggctcaccagagac

SEQ ID NO: 304674 - DNA, 30 bp, Artificial Sequence
  Description of Artificial Sequence: Synthetic oligonucleotide
gcttccgaaaaactgtggctcaccagagac

SEQ ID NO: 304675 - DNA, 33 bp, Artificial Sequence
  Description of Artificial Sequence: Synthetic oligonucleotide
cttccgaaaaactgtggctcaccagagacatag

SEQ ID NO: 304676 - DNA, 33 bp, Artificial Sequence
  Description of Artificial Sequence: Synthetic oligonucleotide
ttccgaaaaactgtggctcaccagagacatagc

SEQ ID NO: 304677 - DNA, 32 bp, Artificial Sequence
  Description of Artificial Sequence: Synthetic oligonucleotide
tccgaaaaactgtggctcaccagagacatagc

SEQ ID NO: 304678 - DNA, 31 bp, Artificial Sequence
  Description of Artificial Sequence: Synthetic oligonucleotide
ccgaaaaactgtggctcaccagagacatagc

SEQ ID NO: 304679 - DNA, 31 bp, Artificial Sequence
  Description of Artificial Sequence: Synthetic oligonucleotide
cgaaaaactgtggctcaccagagacatagcc

SEQ ID NO: 304680 - DNA, 31 bp, Artificial Sequence
  Description of Artificial Sequence: Synthetic oligonucleotide
gaaaaactgtggctcaccagagacatagccc

SEQ ID NO: 304681 - DNA, 33 bp, Artificial Sequence
  Description of Artificial Sequence: Synthetic oligonucleotide
aaaaactgtggctcaccagagacatagcccaag

SEQ ID NO: 304682 - DNA, 32 bp, Artificial Sequence
  Description of Artificial Sequence: Synthetic oligonucleotide
aaaactgtggctcaccagagacatagcccaag

SEQ ID NO: 304683 - DNA, 31 bp, Artificial Sequence
  Description of Artificial Sequence: Synthetic oligonucleotide
aaactgtggctcaccagagacatagcccaag

SEQ ID NO: 304684 - DNA, 30 bp, Artificial Sequence
  Description of Artificial Sequence: Synthetic oligonucleotide
aactgtggctcaccagagacatagcccaag

SEQ ID NO: 304685 - DNA, 29 bp, Artificial Sequence
  Description of Artificial Sequence: Synthetic oligonucleotide
actgtggctcaccagagacatagcccaag

SEQ ID NO: 304686 - DNA, 28 bp, Artificial Sequence
  Description of Artificial Sequence: Synthetic oligonucleotide
ctgtggctcaccagagacatagcccaag

SEQ ID NO: 304687 - DNA, 30 bp, Artificial Sequence
  Description of Artificial Sequence: Synthetic oligonucleotide
tgtggctcaccagagacatagcccaagaac

SEQ ID NO: 304688 - DNA, 29 bp, Artificial Sequence
  Description of Artificial Sequence: Synthetic oligonucleotide
gtggctcaccagagacatagcccaagaac

SEQ ID NO: 304689 - DNA, 30 bp, Artificial Sequence
  Description of Artificial Sequence: Synthetic oligonucleotide
tggctcaccagagacatagcccaagaactg

SEQ ID NO: 304690 - DNA, 29 bp, Artificial Sequence
  Description of Artificial Sequence: Synthetic oligonucleotide
ggctcaccagagacatagcccaagaactg

SEQ ID NO: 304691 - DNA, 29 bp, Artificial Sequence
  Description of Artificial Sequence: Synthetic oligonucleotide
gctcaccagagacatagcccaagaactgg

SEQ ID NO: 304692 - DNA, 29 bp, Artificial Sequence
  Description of Artificial Sequence: Synthetic oligonucleotide
ctcaccagagacatagcccaagaactggc

SEQ ID NO: 304693 - DNA, 29 bp, Artificial Sequence
  Description of Artificial Sequence: Synthetic oligonucleotide
tcaccagagacatagcccaagaactggcg

SEQ ID NO: 304694 - DNA, 28 bp, Artificial Sequence
  Description of Artificial Sequence: Synthetic oligonucleotide
caccagagacatagcccaagaactggcg

SEQ ID NO: 304695 - DNA, 28 bp, Artificial Sequence
  Description of Artificial Sequence: Synthetic oligonucleotide
accagagacatagcccaagaactggcgg

SEQ ID NO: 304696 - DNA, 27 bp, Artificial Sequence
  Description of Artificial Sequence: Synthetic oligonucleotide
ccagagacatagcccaagaactggcgg

SEQ ID NO: 304697 - DNA, 28 bp, Artificial Sequence
  Description of Artificial Sequence: Synthetic oligonucleotide
cagagacatagcccaagaactggcggac

SEQ ID NO: 304698 - DNA, 28 bp, Artificial Sequence
  Description of Artificial Sequence: Synthetic oligonucleotide
agagacatagcccaagaactggcggacc

SEQ ID NO: 304699 - DNA, 27 bp, Artificial Sequence
  Description of Artificial Sequence: Synthetic oligonucleotide
gagacatagcccaagaactggcggacc

SEQ ID NO: 304700 - DNA, 28 bp, Artificial Sequence
  Description of Artificial Sequence: Synthetic oligonucleotide
agacatagcccaagaactggcggaccag

SEQ ID NO: 304701 - DNA, 27 bp, Artificial Sequence
  Description of Artificial Sequence: Synthetic oligonucleotide
gacatagcccaagaactggcggaccag

SEQ ID NO: 304702 - DNA, 28 bp, Artificial Sequence
  Description of Artificial Sequence: Synthetic oligonucleotide
acatagcccaagaactggcggaccagtg

SEQ ID NO: 304703 - DNA, 27 bp, Artificial Sequence
  Description of Artificial Sequence: Synthetic oligonucleotide
catagcccaagaactggcggaccagtg

SEQ ID NO: 304704 - DNA, 27 bp, Artificial Sequence
  Description of Artificial Sequence: Synthetic oligonucleotide
atagcccaagaactggcggaccagtgg

SEQ ID NO: 304705 - DNA, 27 bp, Artificial Sequence
  Description of Artificial Sequence: Synthetic oligonucleotide
tagcccaagaactggcggaccagtggt

SEQ ID NO: 304706 - DNA, 27 bp, Artificial Sequence
  Description of Artificial Sequence: Synthetic oligonucleotide
agcccaagaactggcggaccagtggta

SEQ ID NO: 304707 - DNA, 27 bp, Artificial Sequence
  Description of Artificial Sequence: Synthetic oligonucleotide
gcccaagaactggcggaccagtggtat

SEQ ID NO: 304708 - DNA, 27 bp, Artificial Sequence
  Description of Artificial Sequence: Synthetic oligonucleotide
cccaagaactggcggaccagtggtatg

SEQ ID NO: 304709 - DNA, 27 bp, Artificial Sequence
  Description of Artificial Sequence: Synthetic oligonucleotide
ccaagaactggcggaccagtggtatgg

SEQ ID NO: 304710 - DNA, 27 bp, Artificial Sequence
  Description of Artificial Sequence: Synthetic oligonucleotide
caagaactggcggaccagtggtatggc

SEQ ID NO: 304711 - DNA, 29 bp, Artificial Sequence
  Description of Artificial Sequence: Synthetic oligonucleotide
aagaactggcggaccagtggtatggcaac

SEQ ID NO: 304712 - DNA, 28 bp, Artificial Sequence
  Description of Artificial Sequence: Synthetic oligonucleotide
agaactggcggaccagtggtatggcaac

SEQ ID NO: 304713 - DNA, 27 bp, Artificial Sequence
  Description of Artificial Sequence: Synthetic oligonucleotide
gaactggcggaccagtggtatggcaac

SEQ ID NO: 304714 - DNA, 27 bp, Artificial Sequence
  Description of Artificial Sequence: Synthetic oligonucleotide
aactggcggaccagtggtatggcaacc

SEQ ID NO: 304715 - DNA, 27 bp, Artificial Sequence
  Description of Artificial Sequence: Synthetic oligonucleotide
actggcggaccagtggtatggcaacct

SEQ ID NO: 304716 - DNA, 26 bp, Artificial Sequence
  Description of Artificial Sequence: Synthetic oligonucleotide
ctggcggaccagtggtatggcaacct

SEQ ID NO: 304717 - DNA, 26 bp, Artificial Sequence
  Description of Artificial Sequence: Synthetic oligonucleotide
tggcggaccagtggtatggcaacctc

SEQ ID NO: 304718 - DNA, 25 bp, Artificial Sequence
  Description of Artificial Sequence: Synthetic oligonucleotide
ggcggaccagtggtatggcaacctc

SEQ ID NO: 304719 - DNA, 26 bp, Artificial Sequence
  Description of Artificial Sequence: Synthetic oligonucleotide
gcggaccagtggtatggcaacctcgt

SEQ ID NO: 304720 - DNA, 27 bp, Artificial Sequence
  Description of Artificial Sequence: Synthetic oligonucleotide
cggaccagtggtatggcaacctcgtca

SEQ ID NO: 304721 - DNA, 27 bp, Artificial Sequence
  Description of Artificial Sequence: Synthetic oligonucleotide
ggaccagtggtatggcaacctcgtcac

SEQ ID NO: 304722 - DNA, 30 bp, Artificial Sequence
  Description of Artificial Sequence: Synthetic oligonucleotide
gaccagtggtatggcaacctcgtcacaatg

SEQ ID NO: 304723 - DNA, 30 bp, Artificial Sequence
  Description of Artificial Sequence: Synthetic oligonucleotide
accagtggtatggcaacctcgtcacaatgc

SEQ ID NO: 304724 - DNA, 29 bp, Artificial Sequence
  Description of Artificial Sequence: Synthetic oligonucleotide
ccagtggtatggcaacctcgtcacaatgc

SEQ ID NO: 304725 - DNA, 32 bp, Artificial Sequence
  Description of Artificial Sequence: Synthetic oligonucleotide
cagtggtatggcaacctcgtcacaatgcaatg

SEQ ID NO: 304726 - DNA, 32 bp, Artificial Sequence
  Description of Artificial Sequence: Synthetic oligonucleotide
agtggtatggcaacctcgtcacaatgcaatgg

SEQ ID NO: 304727 - DNA, 31 bp, Artificial Sequence
  Description of Artificial Sequence: Synthetic oligonucleotide
gtggtatggcaacctcgtcacaatgcaatgg

SEQ ID NO: 304728 - DNA, 32 bp, Artificial Sequence
  Description of Artificial Sequence: Synthetic oligonucleotide
tggtatggcaacctcgtcacaatgcaatggtg

SEQ ID NO: 304729 - DNA, 31 bp, Artificial Sequence
  Description of Artificial Sequence: Synthetic oligonucleotide
ggtatggcaacctcgtcacaatgcaatggtg

SEQ ID NO: 304730 - DNA, 31 bp, Artificial Sequence
  Description of Artificial Sequence: Synthetic oligonucleotide
gtatggcaacctcgtcacaatgcaatggtgg

SEQ ID NO: 304731 - DNA, 34 bp, Artificial Sequence
  Description of Artificial Sequence: Synthetic oligonucleotide
tatggcaacctcgtcacaatgcaatggtggattg

SEQ ID NO: 304732 - DNA, 33 bp, Artificial Sequence
  Description of Artificial Sequence: Synthetic oligonucleotide
atggcaacctcgtcacaatgcaatggtggattg

SEQ ID NO: 304733 - DNA, 32 bp, Artificial Sequence
  Description of Artificial Sequence: Synthetic oligonucleotide
tggcaacctcgtcacaatgcaatggtggattg

SEQ ID NO: 304734 - DNA, 31 bp, Artificial Sequence
  Description of Artificial Sequence: Synthetic oligonucleotide
ggcaacctcgtcacaatgcaatggtggattg

SEQ ID NO: 304735 - DNA, 37 bp, Artificial Sequence
  Description of Artificial Sequence: Synthetic oligonucleotide
gcaacctcgtcacaatgcaatggtggattgatatttg

SEQ ID NO: 304736 - DNA, 37 bp, Artificial Sequence
  Description of Artificial Sequence: Synthetic oligonucleotide
caacctcgtcacaatgcaatggtggattgatatttgc

SEQ ID NO: 304737 - DNA, 37 bp, Artificial Sequence
  Description of Artificial Sequence: Synthetic oligonucleotide
aacctcgtcacaatgcaatggtggattgatatttgcc

SEQ ID NO: 304738 - DNA, 36 bp, Artificial Sequence
  Description of Artificial Sequence: Synthetic oligonucleotide
acctcgtcacaatgcaatggtggattgatatttgcc

SEQ ID NO: 304739 - DNA, 35 bp, Artificial Sequence
  Description of Artificial Sequence: Synthetic oligonucleotide
cctcgtcacaatgcaatggtggattgatatttgcc

SEQ ID NO: 304740 - DNA, 39 bp, Artificial Sequence
  Description of Artificial Sequence: Synthetic oligonucleotide
ctcgtcacaatgcaatggtggattgatatttgccttaag

SEQ ID NO: 304741 - DNA, 39 bp, Artificial Sequence
  Description of Artificial Sequence: Synthetic oligonucleotide
tcgtcacaatgcaatggtggattgatatttgccttaagg

SEQ ID NO: 304742 - DNA, 38 bp, Artificial Sequence
  Description of Artificial Sequence: Synthetic oligonucleotide
cgtcacaatgcaatggtggattgatatttgccttaagg

SEQ ID NO: 304743 - DNA, 39 bp, Artificial Sequence
  Description of Artificial Sequence: Synthetic oligonucleotide
gtcacaatgcaatggtggattgatatttgccttaaggag

SEQ ID NO: 304744 - DNA, 39 bp, Artificial Sequence
  Description of Artificial Sequence: Synthetic oligonucleotide
tcacaatgcaatggtggattgatatttgccttaaggagc

SEQ ID NO: 304745 - DNA, 38 bp, Artificial Sequence
  Description of Artificial Sequence: Synthetic oligonucleotide
cacaatgcaatggtggattgatatttgccttaaggagc

SEQ ID NO: 304746 - DNA, 38 bp, Artificial Sequence
  Description of Artificial Sequence: Synthetic oligonucleotide
acaatgcaatggtggattgatatttgccttaaggagcg

SEQ ID NO: 304747 - DNA, 37 bp, Artificial Sequence
  Description of Artificial Sequence: Synthetic oligonucleotide
caatgcaatggtggattgatatttgccttaaggagcg

SEQ ID NO: 304748 - DNA, 41 bp, Artificial Sequence
  Description of Artificial Sequence: Synthetic oligonucleotide
aatgcaatggtggattgatatttgccttaaggagcgttttg

SEQ ID NO: 304749 - DNA, 40 bp, Artificial Sequence
  Description of Artificial Sequence: Synthetic oligonucleotide
atgcaatggtggattgatatttgccttaaggagcgttttg

SEQ ID NO: 304750 - DNA, 39 bp, Artificial Sequence
  Description of Artificial Sequence: Synthetic oligonucleotide
tgcaatggtggattgatatttgccttaaggagcgttttg

SEQ ID NO: 304751 - DNA, 38 bp, Artificial Sequence
  Description of Artificial Sequence: Synthetic oligonucleotide
gcaatggtggattgatatttgccttaaggagcgttttg

SEQ ID NO: 304752 - DNA, 38 bp, Artificial Sequence
  Description of Artificial Sequence: Synthetic oligonucleotide
caatggtggattgatatttgccttaaggagcgttttgc

SEQ ID NO: 304753 - DNA, 44 bp, Artificial Sequence
  Description of Artificial Sequence: Synthetic oligonucleotide
aatggtggattgatatttgccttaaggagcgttttgcaatatac

SEQ ID NO: 304754 - DNA, 43 bp, Artificial Sequence
  Description of Artificial Sequence: Synthetic oligonucleotide
atggtggattgatatttgccttaaggagcgttttgcaatatac

SEQ ID NO: 304755 - DNA, 42 bp, Artificial Sequence
  Description of Artificial Sequence: Synthetic oligonucleotide
tggtggattgatatttgccttaaggagcgttttgcaatatac

SEQ ID NO: 304756 - DNA, 41 bp, Artificial Sequence
  Description of Artificial Sequence: Synthetic oligonucleotide
ggtggattgatatttgccttaaggagcgttttgcaatatac

SEQ ID NO: 304757 - DNA, 43 bp, Artificial Sequence
  Description of Artificial Sequence: Synthetic oligonucleotide
gtggattgatatttgccttaaggagcgttttgcaatatacatg

SEQ ID NO: 304758 - DNA, 43 bp, Artificial Sequence
  Description of Artificial Sequence: Synthetic oligonucleotide
tggattgatatttgccttaaggagcgttttgcaatatacatgg

SEQ ID NO: 304759 - DNA, 42 bp, Artificial Sequence
  Description of Artificial Sequence: Synthetic oligonucleotide
ggattgatatttgccttaaggagcgttttgcaatatacatgg

SEQ ID NO: 304760 - DNA, 44 bp, Artificial Sequence
  Description of Artificial Sequence: Synthetic oligonucleotide
gattgatatttgccttaaggagcgttttgcaatatacatggatc

SEQ ID NO: 304761 - DNA, 48 bp, Artificial Sequence
  Description of Artificial Sequence: Synthetic oligonucleotide
attgatatttgccttaaggagcgttttgcaatatacatggatcttatc

SEQ ID NO: 304762 - DNA, 47 bp, Artificial Sequence
  Description of Artificial Sequence: Synthetic oligonucleotide
ttgatatttgccttaaggagcgttttgcaatatacatggatcttatc

SEQ ID NO: 304763 - DNA, 46 bp, Artificial Sequence
  Description of Artificial Sequence: Synthetic oligonucleotide
tgatatttgccttaaggagcgttttgcaatatacatggatcttatc

SEQ ID NO: 304764 - DNA, 45 bp, Artificial Sequence
  Description of Artificial Sequence: Synthetic oligonucleotide
gatatttgccttaaggagcgttttgcaatatacatggatcttatc

SEQ ID NO: 304765 - DNA, 45 bp, Artificial Sequence
  Description of Artificial Sequence: Synthetic oligonucleotide
atatttgccttaaggagcgttttgcaatatacatggatcttatcg

SEQ ID NO: 304766 - DNA, 44 bp, Artificial Sequence
  Description of Artificial Sequence: Synthetic oligonucleotide
tatttgccttaaggagcgttttgcaatatacatggatcttatcg

SEQ ID NO: 304767 - DNA, 43 bp, Artificial Sequence
  Description of Artificial Sequence: Synthetic oligonucleotide
atttgccttaaggagcgttttgcaatatacatggatcttatcg

SEQ ID NO: 304768 - DNA, 42 bp, Artificial Sequence
  Description of Artificial Sequence: Synthetic oligonucleotide
tttgccttaaggagcgttttgcaatatacatggatcttatcg

SEQ ID NO: 304769 - DNA, 41 bp, Artificial Sequence
  Description of Artificial Sequence: Synthetic oligonucleotide
ttgccttaaggagcgttttgcaatatacatggatcttatcg

SEQ ID NO: 304770 - DNA, 40 bp, Artificial Sequence
  Description of Artificial Sequence: Synthetic oligonucleotide
tgccttaaggagcgttttgcaatatacatggatcttatcg

SEQ ID NO: 304771 - DNA, 39 bp, Artificial Sequence
  Description of Artificial Sequence: Synthetic oligonucleotide
gccttaaggagcgttttgcaatatacatggatcttatcg

SEQ ID NO: 304772 - DNA, 39 bp, Artificial Sequence
  Description of Artificial Sequence: Synthetic oligonucleotide
ccttaaggagcgttttgcaatatacatggatcttatcgc

SEQ ID NO: 304773 - DNA, 40 bp, Artificial Sequence
  Description of Artificial Sequence: Synthetic oligonucleotide
cttaaggagcgttttgcaatatacatggatcttatcgctc

SEQ ID NO: 304774 - DNA, 45 bp, Artificial Sequence
  Description of Artificial Sequence: Synthetic oligonucleotide
ttaaggagcgttttgcaatatacatggatcttatcgctcttaatg

SEQ ID NO: 304775 - DNA, 44 bp, Artificial Sequence
  Description of Artificial Sequence: Synthetic oligonucleotide
taaggagcgttttgcaatatacatggatcttatcgctcttaatg

SEQ ID NO: 304776 - DNA, 43 bp, Artificial Sequence
  Description of Artificial Sequence: Synthetic oligonucleotide
aaggagcgttttgcaatatacatggatcttatcgctcttaatg

SEQ ID NO: 304777 - DNA, 42 bp, Artificial Sequence
  Description of Artificial Sequence: Synthetic oligonucleotide
aggagcgttttgcaatatacatggatcttatcgctcttaatg

SEQ ID NO: 304778 - DNA, 41 bp, Artificial Sequence
  Description of Artificial Sequence: Synthetic oligonucleotide
ggagcgttttgcaatatacatggatcttatcgctcttaatg

SEQ ID NO: 304779 - DNA, 41 bp, Artificial Sequence
  Description of Artificial Sequence: Synthetic oligonucleotide
gagcgttttgcaatatacatggatcttatcgctcttaatgc

SEQ ID NO: 304780 - DNA, 43 bp, Artificial Sequence
  Description of Artificial Sequence: Synthetic oligonucleotide
agcgttttgcaatatacatggatcttatcgctcttaatgctag

SEQ ID NO: 304781 - DNA, 42 bp, Artificial Sequence
  Description of Artificial Sequence: Synthetic oligonucleotide
gcgttttgcaatatacatggatcttatcgctcttaatgctag

SEQ ID NO: 304782 - DNA, 46 bp, Artificial Sequence
  Description of Artificial Sequence: Synthetic oligonucleotide
cgttttgcaatatacatggatcttatcgctcttaatgctagatatc

SEQ ID NO: 304783 - DNA, 46 bp, Artificial Sequence
  Description of Artificial Sequence: Synthetic oligonucleotide
gttttgcaatatacatggatcttatcgctcttaatgctagatatcc

SEQ ID NO: 304784 - DNA, 47 bp, Artificial Sequence
  Description of Artificial Sequence: Synthetic oligonucleotide
ttttgcaatatacatggatcttatcgctcttaatgctagatatccag

SEQ ID NO: 304785 - DNA, 46 bp, Artificial Sequence
  Description of Artificial Sequence: Synthetic oligonucleotide
tttgcaatatacatggatcttatcgctcttaatgctagatatccag

SEQ ID NO: 304786 - DNA, 45 bp, Artificial Sequence
  Description of Artificial Sequence: Synthetic oligonucleotide
ttgcaatatacatggatcttatcgctcttaatgctagatatccag

SEQ ID NO: 304787 - DNA, 44 bp, Artificial Sequence
  Description of Artificial Sequence: Synthetic oligonucleotide
tgcaatatacatggatcttatcgctcttaatgctagatatccag

SEQ ID NO: 304788 - DNA, 43 bp, Artificial Sequence
  Description of Artificial Sequence: Synthetic oligonucleotide
gcaatatacatggatcttatcgctcttaatgctagatatccag

SEQ ID NO: 304789 - DNA, 44 bp, Artificial Sequence
  Description of Artificial Sequence: Synthetic oligonucleotide
caatatacatggatcttatcgctcttaatgctagatatccagac

SEQ ID NO: 304790 - DNA, 44 bp, Artificial Sequence
  Description of Artificial Sequence: Synthetic oligonucleotide
aatatacatggatcttatcgctcttaatgctagatatccagacc

SEQ ID NO: 304791 - DNA, 43 bp, Artificial Sequence
  Description of Artificial Sequence: Synthetic oligonucleotide
atatacatggatcttatcgctcttaatgctagatatccagacc

SEQ ID NO: 304792 - DNA, 42 bp, Artificial Sequence
  Description of Artificial Sequence: Synthetic oligonucleotide
tatacatggatcttatcgctcttaatgctagatatccagacc

SEQ ID NO: 304793 - DNA, 41 bp, Artificial Sequence
  Description of Artificial Sequence: Synthetic oligonucleotide
atacatggatcttatcgctcttaatgctagatatccagacc

SEQ ID NO: 304794 - DNA, 40 bp, Artificial Sequence
  Description of Artificial Sequence: Synthetic oligonucleotide
tacatggatcttatcgctcttaatgctagatatccagacc

SEQ ID NO: 304795 - DNA, 39 bp, Artificial Sequence
  Description of Artificial Sequence: Synthetic oligonucleotide
acatggatcttatcgctcttaatgctagatatccagacc

SEQ ID NO: 304796 - DNA, 38 bp, Artificial Sequence
  Description of Artificial Sequence: Synthetic oligonucleotide
catggatcttatcgctcttaatgctagatatccagacc

SEQ ID NO: 304797 - DNA, 39 bp, Artificial Sequence
  Description of Artificial Sequence: Synthetic oligonucleotide
atggatcttatcgctcttaatgctagatatccagacctg

SEQ ID NO: 304798 - DNA, 38 bp, Artificial Sequence
  Description of Artificial Sequence: Synthetic oligonucleotide
tggatcttatcgctcttaatgctagatatccagacctg

SEQ ID NO: 304799 - DNA, 37 bp, Artificial Sequence
  Description of Artificial Sequence: Synthetic oligonucleotide
ggatcttatcgctcttaatgctagatatccagacctg

SEQ ID NO: 304800 - DNA, 37 bp, Artificial Sequence
  Description of Artificial Sequence: Synthetic oligonucleotide
gatcttatcgctcttaatgctagatatccagacctgc

SEQ ID NO: 304801 - DNA, 42 bp, Artificial Sequence
  Description of Artificial Sequence: Synthetic oligonucleotide
atcttatcgctcttaatgctagatatccagacctgcaatttc

SEQ ID NO: 304802 - DNA, 41 bp, Artificial Sequence
  Description of Artificial Sequence: Synthetic oligonucleotide
tcttatcgctcttaatgctagatatccagacctgcaatttc

SEQ ID NO: 304803 - DNA, 40 bp, Artificial Sequence
  Description of Artificial Sequence: Synthetic oligonucleotide
cttatcgctcttaatgctagatatccagacctgcaatttc

SEQ ID NO: 304804 - DNA, 42 bp, Artificial Sequence
  Description of Artificial Sequence: Synthetic oligonucleotide
ttatcgctcttaatgctagatatccagacctgcaatttcatg

SEQ ID NO: 304805 - DNA, 41 bp, Artificial Sequence
  Description of Artificial Sequence: Synthetic oligonucleotide
tatcgctcttaatgctagatatccagacctgcaatttcatg

SEQ ID NO: 304806 - DNA, 40 bp, Artificial Sequence
  Description of Artificial Sequence: Synthetic oligonucleotide
atcgctcttaatgctagatatccagacctgcaatttcatg

SEQ ID NO: 304807 - DNA, 39 bp, Artificial Sequence
  Description of Artificial Sequence: Synthetic oligonucleotide
tcgctcttaatgctagatatccagacctgcaatttcatg

SEQ ID NO: 304808 - DNA, 38 bp, Artificial Sequence
  Description of Artificial Sequence: Synthetic oligonucleotide
cgctcttaatgctagatatccagacctgcaatttcatg

SEQ ID NO: 304809 - DNA, 39 bp, Artificial Sequence
  Description of Artificial Sequence: Synthetic oligonucleotide
gctcttaatgctagatatccagacctgcaatttcatgac

SEQ ID NO: 304810 - DNA, 47 bp, Artificial Sequence
  Description of Artificial Sequence: Synthetic oligonucleotide
ctcttaatgctagatatccagacctgcaatttcatgactattatttg

SEQ ID NO: 304811 - DNA, 50 bp, Artificial Sequence
  Description of Artificial Sequence: Synthetic oligonucleotide
tcttaatgctagatatccagacctgcaatttcatgactattatttgaatg

SEQ ID NO: 304812 - DNA, 49 bp, Artificial Sequence
  Description of Artificial Sequence: Synthetic oligonucleotide
cttaatgctagatatccagacctgcaatttcatgactattatttgaatg

SEQ ID NO: 304813 - DNA, 50 bp, Artificial Sequence
  Description of Artificial Sequence: Synthetic oligonucleotide
ttaatgctagatatccagacctgcaatttcatgactattatttgaatgtc

SEQ ID NO: 304814 - DNA, 49 bp, Artificial Sequence
  Description of Artificial Sequence: Synthetic oligonucleotide
taatgctagatatccagacctgcaatttcatgactattatttgaatgtc

SEQ ID NO: 304815 - DNA, 48 bp, Artificial Sequence
  Description of Artificial Sequence: Synthetic oligonucleotide
aatgctagatatccagacctgcaatttcatgactattatttgaatgtc

SEQ ID NO: 304816 - DNA, 47 bp, Artificial Sequence
  Description of Artificial Sequence: Synthetic oligonucleotide
atgctagatatccagacctgcaatttcatgactattatttgaatgtc

SEQ ID NO: 304817 - DNA, 46 bp, Artificial Sequence
  Description of Artificial Sequence: Synthetic oligonucleotide
tgctagatatccagacctgcaatttcatgactattatttgaatgtc

SEQ ID NO: 304818 - DNA, 45 bp, Artificial Sequence
  Description of Artificial Sequence: Synthetic oligonucleotide
gctagatatccagacctgcaatttcatgactattatttgaatgtc

SEQ ID NO: 304819 - DNA, 46 bp, Artificial Sequence
  Description of Artificial Sequence: Synthetic oligonucleotide
ctagatatccagacctgcaatttcatgactattatttgaatgtctg

SEQ ID NO: 304820 - DNA, 50 bp, Artificial Sequence
  Description of Artificial Sequence: Synthetic oligonucleotide
tagatatccagacctgcaatttcatgactattatttgaatgtctgttttg

SEQ ID NO: 304821 - DNA, 49 bp, Artificial Sequence
  Description of Artificial Sequence: Synthetic oligonucleotide
agatatccagacctgcaatttcatgactattatttgaatgtctgttttg

SEQ ID NO: 304822 - DNA, 48 bp, Artificial Sequence
  Description of Artificial Sequence: Synthetic oligonucleotide
gatatccagacctgcaatttcatgactattatttgaatgtctgttttg

SEQ ID NO: 304823 - DNA, 50 bp, Artificial Sequence
  Description of Artificial Sequence: Synthetic oligonucleotide
atatccagacctgcaatttcatgactattatttgaatgtctgttttgaac

SEQ ID NO: 304824 - DNA, 49 bp, Artificial Sequence
  Description of Artificial Sequence: Synthetic oligonucleotide
tatccagacctgcaatttcatgactattatttgaatgtctgttttgaac

SEQ ID NO: 304825 - DNA, 48 bp, Artificial Sequence
  Description of Artificial Sequence: Synthetic oligonucleotide
atccagacctgcaatttcatgactattatttgaatgtctgttttgaac

SEQ ID NO: 304826 - DNA, 47 bp, Artificial Sequence
  Description of Artificial Sequence: Synthetic oligonucleotide
tccagacctgcaatttcatgactattatttgaatgtctgttttgaac

SEQ ID NO: 304827 - DNA, 46 bp, Artificial Sequence
  Description of Artificial Sequence: Synthetic oligonucleotide
ccagacctgcaatttcatgactattatttgaatgtctgttttgaac

SEQ ID NO: 304828 - DNA, 52 bp, Artificial Sequence
  Description of Artificial Sequence: Synthetic oligonucleotide
cagacctgcaatttcatgactattatttgaatgtctgttttgaactaattac

SEQ ID NO: 304829 - DNA, 56 bp, Artificial Sequence
  Description of Artificial Sequence: Synthetic oligonucleotide
agacctgcaatttcatgactattatttgaatgtctgttttgaactaattacaatag

SEQ ID NO: 304830 - DNA, 55 bp, Artificial Sequence
  Description of Artificial Sequence: Synthetic oligonucleotide
gacctgcaatttcatgactattatttgaatgtctgttttgaactaattacaatag

SEQ ID NO: 304831 - DNA, 58 bp, Artificial Sequence
  Description of Artificial Sequence: Synthetic oligonucleotide
acctgcaatttcatgactattatttgaatgtctgttttgaactaattacaatagattc

SEQ ID NO: 304832 - DNA, 57 bp, Artificial Sequence
  Description of Artificial Sequence: Synthetic oligonucleotide
cctgcaatttcatgactattatttgaatgtctgttttgaactaattacaatagattc

SEQ ID NO: 304833 - DNA, 60 bp, Artificial Sequence
  Description of Artificial Sequence: Synthetic oligonucleotide
ctgcaatttcatgactattatttgaatgtctgttttgaactaattacaatagattcattc

SEQ ID NO: 304834 - DNA, 60 bp, Artificial Sequence
  Description of Artificial Sequence: Synthetic oligonucleotide
tgcaatttcatgactattatttgaatgtctgttttgaactaattacaatagattcattca

SEQ ID NO: 304835 - DNA, 60 bp, Artificial Sequence
  Description of Artificial Sequence: Synthetic oligonucleotide
gcaatttcatgactattatttgaatgtctgttttgaactaattacaatagattcattcaa

SEQ ID NO: 304836 - DNA, 60 bp, Artificial Sequence
  Description of Artificial Sequence: Synthetic oligonucleotide
caatttcatgactattatttgaatgtctgttttgaactaattacaatagattcattcaat

SEQ ID NO: 304837 - DNA, 60 bp, Artificial Sequence
  Description of Artificial Sequence: Synthetic oligonucleotide
aatttcatgactattatttgaatgtctgttttgaactaattacaatagattcattcaatt

SEQ ID NO: 304838 - DNA, 60 bp, Artificial Sequence
  Description of Artificial Sequence: Synthetic oligonucleotide
atttcatgactattatttgaatgtctgttttgaactaattacaatagattcattcaattc

SEQ ID NO: 304839 - DNA, 60 bp, Artificial Sequence
  Description of Artificial Sequence: Synthetic oligonucleotide
tttcatgactattatttgaatgtctgttttgaactaattacaatagattcattcaattca

SEQ ID NO: 304840 - DNA, 60 bp, Artificial Sequence
  Description of Artificial Sequence: Synthetic oligonucleotide
ttcatgactattatttgaatgtctgttttgaactaattacaatagattcattcaattcat

SEQ ID NO: 304841 - DNA, 60 bp, Artificial Sequence
  Description of Artificial Sequence: Synthetic oligonucleotide
tcatgactattatttgaatgtctgttttgaactaattacaatagattcattcaattcatc

SEQ ID NO: 304842 - DNA, 60 bp, Artificial Sequence
  Description of Artificial Sequence: Synthetic oligonucleotide
catgactattatttgaatgtctgttttgaactaattacaatagattcattcaattcatcc

SEQ ID NO: 304843 - DNA, 60 bp, Artificial Sequence
  Description of Artificial Sequence: Synthetic oligonucleotide
atgactattatttgaatgtctgttttgaactaattacaatagattcattcaattcatccg

SEQ ID NO: 304844 - DNA, 59 bp, Artificial Sequence
  Description of Artificial Sequence: Synthetic oligonucleotide
tgactattatttgaatgtctgttttgaactaattacaatagattcattcaattcatccg

SEQ ID NO: 304845 - DNA, 58 bp, Artificial Sequence
  Description of Artificial Sequence: Synthetic oligonucleotide
gactattatttgaatgtctgttttgaactaattacaatagattcattcaattcatccg

SEQ ID NO: 304846 - DNA, 58 bp, Artificial Sequence
  Description of Artificial Sequence: Synthetic oligonucleotide
actattatttgaatgtctgttttgaactaattacaatagattcattcaattcatccgg

SEQ ID NO: 304847 - DNA, 57 bp, Artificial Sequence
  Description of Artificial Sequence: Synthetic oligonucleotide
ctattatttgaatgtctgttttgaactaattacaatagattcattcaattcatccgg

SEQ ID NO: 304848 - DNA, 57 bp, Artificial Sequence
  Description of Artificial Sequence: Synthetic oligonucleotide
tattatttgaatgtctgttttgaactaattacaatagattcattcaattcatccggc

SEQ ID NO: 304849 - DNA, 56 bp, Artificial Sequence
  Description of Artificial Sequence: Synthetic oligonucleotide
attatttgaatgtctgttttgaactaattacaatagattcattcaattcatccggc

SEQ ID NO: 304850 - DNA, 55 bp, Artificial Sequence
  Description of Artificial Sequence: Synthetic oligonucleotide
ttatttgaatgtctgttttgaactaattacaatagattcattcaattcatccggc

SEQ ID NO: 304851 - DNA, 54 bp, Artificial Sequence
  Description of Artificial Sequence: Synthetic oligonucleotide
tatttgaatgtctgttttgaactaattacaatagattcattcaattcatccggc

SEQ ID NO: 304852 - DNA, 53 bp, Artificial Sequence
  Description of Artificial Sequence: Synthetic oligonucleotide
atttgaatgtctgttttgaactaattacaatagattcattcaattcatccggc

SEQ ID NO: 304853 - DNA, 52 bp, Artificial Sequence
  Description of Artificial Sequence: Synthetic oligonucleotide
tttgaatgtctgttttgaactaattacaatagattcattcaattcatccggc

SEQ ID NO: 304854 - DNA, 51 bp, Artificial Sequence
  Description of Artificial Sequence: Synthetic oligonucleotide
ttgaatgtctgttttgaactaattacaatagattcattcaattcatccggc

SEQ ID NO: 304855 - DNA, 50 bp, Artificial Sequence
  Description of Artificial Sequence: Synthetic oligonucleotide
tgaatgtctgttttgaactaattacaatagattcattcaattcatccggc

SEQ ID NO: 304856 - DNA, 49 bp, Artificial Sequence
  Description of Artificial Sequence: Synthetic oligonucleotide
gaatgtctgttttgaactaattacaatagattcattcaattcatccggc

SEQ ID NO: 304857 - DNA, 49 bp, Artificial Sequence
  Description of Artificial Sequence: Synthetic oligonucleotide
aatgtctgttttgaactaattacaatagattcattcaattcatccggcc

SEQ ID NO: 304858 - DNA, 48 bp, Artificial Sequence
  Description of Artificial Sequence: Synthetic oligonucleotide
atgtctgttttgaactaattacaatagattcattcaattcatccggcc

SEQ ID NO: 304859 - DNA, 47 bp, Artificial Sequence
  Description of Artificial Sequence: Synthetic oligonucleotide
tgtctgttttgaactaattacaatagattcattcaattcatccggcc

SEQ ID NO: 304860 - DNA, 46 bp, Artificial Sequence
  Description of Artificial Sequence: Synthetic oligonucleotide
gtctgttttgaactaattacaatagattcattcaattcatccggcc

SEQ ID NO: 304861 - DNA, 46 bp, Artificial Sequence
  Description of Artificial Sequence: Synthetic oligonucleotide
tctgttttgaactaattacaatagattcattcaattcatccggccc

SEQ ID NO: 304862 - DNA, 45 bp, Artificial Sequence
  Description of Artificial Sequence: Synthetic oligonucleotide
ctgttttgaactaattacaatagattcattcaattcatccggccc

SEQ ID NO: 304863 - DNA, 48 bp, Artificial Sequence
  Description of Artificial Sequence: Synthetic oligonucleotide
tgttttgaactaattacaatagattcattcaattcatccggccctatc

SEQ ID NO: 304864 - DNA, 47 bp, Artificial Sequence
  Description of Artificial Sequence: Synthetic oligonucleotide
gttttgaactaattacaatagattcattcaattcatccggccctatc

SEQ ID NO: 304865 - DNA, 48 bp, Artificial Sequence
  Description of Artificial Sequence: Synthetic oligonucleotide
ttttgaactaattacaatagattcattcaattcatccggccctatctg

SEQ ID NO: 304866 - DNA, 47 bp, Artificial Sequence
  Description of Artificial Sequence: Synthetic oligonucleotide
tttgaactaattacaatagattcattcaattcatccggccctatctg

SEQ ID NO: 304867 - DNA, 46 bp, Artificial Sequence
  Description of Artificial Sequence: Synthetic oligonucleotide
ttgaactaattacaatagattcattcaattcatccggccctatctg

SEQ ID NO: 304868 - DNA, 45 bp, Artificial Sequence
  Description of Artificial Sequence: Synthetic oligonucleotide
tgaactaattacaatagattcattcaattcatccggccctatctg

SEQ ID NO: 304869 - DNA, 44 bp, Artificial Sequence
  Description of Artificial Sequence: Synthetic oligonucleotide
gaactaattacaatagattcattcaattcatccggccctatctg

SEQ ID NO: 304870 - DNA, 44 bp, Artificial Sequence
  Description of Artificial Sequence: Synthetic oligonucleotide
aactaattacaatagattcattcaattcatccggccctatctgc

SEQ ID NO: 304871 - DNA, 43 bp, Artificial Sequence
  Description of Artificial Sequence: Synthetic oligonucleotide
actaattacaatagattcattcaattcatccggccctatctgc

SEQ ID NO: 304872 - DNA, 42 bp, Artificial Sequence
  Description of Artificial Sequence: Synthetic oligonucleotide
ctaattacaatagattcattcaattcatccggccctatctgc

SEQ ID NO: 304873 - DNA, 45 bp, Artificial Sequence
  Description of Artificial Sequence: Synthetic oligonucleotide
taattacaatagattcattcaattcatccggccctatctgcaaac

SEQ ID NO: 304874 - DNA, 44 bp, Artificial Sequence
  Description of Artificial Sequence: Synthetic oligonucleotide
aattacaatagattcattcaattcatccggccctatctgcaaac

SEQ ID NO: 304875 - DNA, 43 bp, Artificial Sequence
  Description of Artificial Sequence: Synthetic oligonucleotide
attacaatagattcattcaattcatccggccctatctgcaaac

SEQ ID NO: 304876 - DNA, 42 bp, Artificial Sequence
  Description of Artificial Sequence: Synthetic oligonucleotide
ttacaatagattcattcaattcatccggccctatctgcaaac

SEQ ID NO: 304877 - DNA, 41 bp, Artificial Sequence
  Description of Artificial Sequence: Synthetic oligonucleotide
tacaatagattcattcaattcatccggccctatctgcaaac

SEQ ID NO: 304878 - DNA, 40 bp, Artificial Sequence
  Description of Artificial Sequence: Synthetic oligonucleotide
acaatagattcattcaattcatccggccctatctgcaaac

SEQ ID NO: 304879 - DNA, 39 bp, Artificial Sequence
  Description of Artificial Sequence: Synthetic oligonucleotide
caatagattcattcaattcatccggccctatctgcaaac

SEQ ID NO: 304880 - DNA, 39 bp, Artificial Sequence
  Description of Artificial Sequence: Synthetic oligonucleotide
aatagattcattcaattcatccggccctatctgcaaacc

SEQ ID NO: 304881 - DNA, 38 bp, Artificial Sequence
  Description of Artificial Sequence: Synthetic oligonucleotide
atagattcattcaattcatccggccctatctgcaaacc

SEQ ID NO: 304882 - DNA, 37 bp, Artificial Sequence
  Description of Artificial Sequence: Synthetic oligonucleotide
tagattcattcaattcatccggccctatctgcaaacc

SEQ ID NO: 304883 - DNA, 36 bp, Artificial Sequence
  Description of Artificial Sequence: Synthetic oligonucleotide
agattcattcaattcatccggccctatctgcaaacc

SEQ ID NO: 304884 - DNA, 35 bp, Artificial Sequence
  Description of Artificial Sequence: Synthetic oligonucleotide
gattcattcaattcatccggccctatctgcaaacc

SEQ ID NO: 304885 - DNA, 36 bp, Artificial Sequence
  Description of Artificial Sequence: Synthetic oligonucleotide
attcattcaattcatccggccctatctgcaaaccag

SEQ ID NO: 304886 - DNA, 35 bp, Artificial Sequence
  Description of Artificial Sequence: Synthetic oligonucleotide
ttcattcaattcatccggccctatctgcaaaccag

SEQ ID NO: 304887 - DNA, 34 bp, Artificial Sequence
  Description of Artificial Sequence: Synthetic oligonucleotide
tcattcaattcatccggccctatctgcaaaccag

SEQ ID NO: 304888 - DNA, 33 bp, Artificial Sequence
  Description of Artificial Sequence: Synthetic oligonucleotide
cattcaattcatccggccctatctgcaaaccag

SEQ ID NO: 304889 - DNA, 33 bp, Artificial Sequence
  Description of Artificial Sequence: Synthetic oligonucleotide
attcaattcatccggccctatctgcaaaccagc

SEQ ID NO: 304890 - DNA, 32 bp, Artificial Sequence
  Description of Artificial Sequence: Synthetic oligonucleotide
ttcaattcatccggccctatctgcaaaccagc

SEQ ID NO: 304891 - DNA, 31 bp, Artificial Sequence
  Description of Artificial Sequence: Synthetic oligonucleotide
tcaattcatccggccctatctgcaaaccagc

SEQ ID NO: 304892 - DNA, 30 bp, Artificial Sequence
  Description of Artificial Sequence: Synthetic oligonucleotide
caattcatccggccctatctgcaaaccagc

SEQ ID NO: 304893 - DNA, 30 bp, Artificial Sequence
  Description of Artificial Sequence: Synthetic oligonucleotide
aattcatccggccctatctgcaaaccagcc

SEQ ID NO: 304894 - DNA, 29 bp, Artificial Sequence
  Description of Artificial Sequence: Synthetic oligonucleotide
attcatccggccctatctgcaaaccagcc

SEQ ID NO: 304895 - DNA, 28 bp, Artificial Sequence
  Description of Artificial Sequence: Synthetic oligonucleotide
ttcatccggccctatctgcaaaccagcc

SEQ ID NO: 304896 - DNA, 27 bp, Artificial Sequence
  Description of Artificial Sequence: Synthetic oligonucleotide
tcatccggccctatctgcaaaccagcc

SEQ ID NO: 304897 - DNA, 26 bp, Artificial Sequence
  Description of Artificial Sequence: Synthetic oligonucleotide
catccggccctatctgcaaaccagcc

SEQ ID NO: 304898 - DNA, 27 bp, Artificial Sequence
  Description of Artificial Sequence: Synthetic oligonucleotide
atccggccctatctgcaaaccagccga

SEQ ID NO: 304899 - DNA, 27 bp, Artificial Sequence
  Description of Artificial Sequence: Synthetic oligonucleotide
tccggccctatctgcaaaccagccgaa

SEQ ID NO: 304900 - DNA, 27 bp, Artificial Sequence
  Description of Artificial Sequence: Synthetic oligonucleotide
ccggccctatctgcaaaccagccgaaa

SEQ ID NO: 304901 - DNA, 27 bp, Artificial Sequence
  Description of Artificial Sequence: Synthetic oligonucleotide
cggccctatctgcaaaccagccgaaac

SEQ ID NO: 304902 - DNA, 27 bp, Artificial Sequence
  Description of Artificial Sequence: Synthetic oligonucleotide
ggccctatctgcaaaccagccgaaacc

SEQ ID NO: 304903 - DNA, 27 bp, Artificial Sequence
  Description of Artificial Sequence: Synthetic oligonucleotide
gccctatctgcaaaccagccgaaaccc

SEQ ID NO: 304904 - DNA, 27 bp, Artificial Sequence
  Description of Artificial Sequence: Synthetic oligonucleotide
ccctatctgcaaaccagccgaaacccc

SEQ ID NO: 304905 - DNA, 27 bp, Artificial Sequence
  Description of Artificial Sequence: Synthetic oligonucleotide
cctatctgcaaaccagccgaaaccccg

SEQ ID NO: 304906 - DNA, 28 bp, Artificial Sequence
  Description of Artificial Sequence: Synthetic oligonucleotide
ctatctgcaaaccagccgaaaccccgtc

SEQ ID NO: 304907 - DNA, 29 bp, Artificial Sequence
  Description of Artificial Sequence: Synthetic oligonucleotide
tatctgcaaaccagccgaaaccccgtctc

SEQ ID NO: 304908 - DNA, 28 bp, Artificial Sequence
  Description of Artificial Sequence: Synthetic oligonucleotide
atctgcaaaccagccgaaaccccgtctc

SEQ ID NO: 304909 - DNA, 27 bp, Artificial Sequence
  Description of Artificial Sequence: Synthetic oligonucleotide
tctgcaaaccagccgaaaccccgtctc

SEQ ID NO: 304910 - DNA, 27 bp, Artificial Sequence
  Description of Artificial Sequence: Synthetic oligonucleotide
ctgcaaaccagccgaaaccccgtctca

SEQ ID NO: 304911 - DNA, 31 bp, Artificial Sequence
  Description of Artificial Sequence: Synthetic oligonucleotide
tgcaaaccagccgaaaccccgtctcaaatac

SEQ ID NO: 304912 - DNA, 30 bp, Artificial Sequence
  Description of Artificial Sequence: Synthetic oligonucleotide
gcaaaccagccgaaaccccgtctcaaatac

SEQ ID NO: 304913 - DNA, 31 bp, Artificial Sequence
  Description of Artificial Sequence: Synthetic oligonucleotide
caaaccagccgaaaccccgtctcaaatactg

SEQ ID NO: 304914 - DNA, 31 bp, Artificial Sequence
  Description of Artificial Sequence: Synthetic oligonucleotide
aaaccagccgaaaccccgtctcaaatactgg

SEQ ID NO: 304915 - DNA, 30 bp, Artificial Sequence
  Description of Artificial Sequence: Synthetic oligonucleotide
aaccagccgaaaccccgtctcaaatactgg

SEQ ID NO: 304916 - DNA, 29 bp, Artificial Sequence
  Description of Artificial Sequence: Synthetic oligonucleotide
accagccgaaaccccgtctcaaatactgg

SEQ ID NO: 304917 - DNA, 28 bp, Artificial Sequence
  Description of Artificial Sequence: Synthetic oligonucleotide
ccagccgaaaccccgtctcaaatactgg

SEQ ID NO: 304918 - DNA, 32 bp, Artificial Sequence
  Description of Artificial Sequence: Synthetic oligonucleotide
cagccgaaaccccgtctcaaatactggaaatg

SEQ ID NO: 304919 - DNA, 35 bp, Artificial Sequence
  Description of Artificial Sequence: Synthetic oligonucleotide
agccgaaaccccgtctcaaatactggaaatgttag

SEQ ID NO: 304920 - DNA, 34 bp, Artificial Sequence
  Description of Artificial Sequence: Synthetic oligonucleotide
gccgaaaccccgtctcaaatactggaaatgttag

SEQ ID NO: 304921 - DNA, 36 bp, Artificial Sequence
  Description of Artificial Sequence: Synthetic oligonucleotide
ccgaaaccccgtctcaaatactggaaatgttagatg

SEQ ID NO: 304922 - DNA, 38 bp, Artificial Sequence
  Description of Artificial Sequence: Synthetic oligonucleotide
cgaaaccccgtctcaaatactggaaatgttagatgaag

SEQ ID NO: 304923 - DNA, 41 bp, Artificial Sequence
  Description of Artificial Sequence: Synthetic oligonucleotide
gaaaccccgtctcaaatactggaaatgttagatgaagttac

SEQ ID NO: 304924 - DNA, 41 bp, Artificial Sequence
  Description of Artificial Sequence: Synthetic oligonucleotide
aaaccccgtctcaaatactggaaatgttagatgaagttacc

SEQ ID NO: 304925 - DNA, 40 bp, Artificial Sequence
  Description of Artificial Sequence: Synthetic oligonucleotide
aaccccgtctcaaatactggaaatgttagatgaagttacc

SEQ ID NO: 304926 - DNA, 39 bp, Artificial Sequence
  Description of Artificial Sequence: Synthetic oligonucleotide
accccgtctcaaatactggaaatgttagatgaagttacc

SEQ ID NO: 304927 - DNA, 38 bp, Artificial Sequence
  Description of Artificial Sequence: Synthetic oligonucleotide
ccccgtctcaaatactggaaatgttagatgaagttacc

SEQ ID NO: 304928 - DNA, 43 bp, Artificial Sequence
  Description of Artificial Sequence: Synthetic oligonucleotide
cccgtctcaaatactggaaatgttagatgaagttacctataac

SEQ ID NO: 304929 - DNA, 45 bp, Artificial Sequence
  Description of Artificial Sequence: Synthetic oligonucleotide
ccgtctcaaatactggaaatgttagatgaagttacctataacatg

SEQ ID NO: 304930 - DNA, 45 bp, Artificial Sequence
  Description of Artificial Sequence: Synthetic oligonucleotide
cgtctcaaatactggaaatgttagatgaagttacctataacatgg

SEQ ID NO: 304931 - DNA, 45 bp, Artificial Sequence
  Description of Artificial Sequence: Synthetic oligonucleotide
gtctcaaatactggaaatgttagatgaagttacctataacatggg

SEQ ID NO: 304932 - DNA, 46 bp, Artificial Sequence
  Description of Artificial Sequence: Synthetic oligonucleotide
tctcaaatactggaaatgttagatgaagttacctataacatgggag

SEQ ID NO: 304933 - DNA, 45 bp, Artificial Sequence
  Description of Artificial Sequence: Synthetic oligonucleotide
ctcaaatactggaaatgttagatgaagttacctataacatgggag

SEQ ID NO: 304934 - DNA, 45 bp, Artificial Sequence
  Description of Artificial Sequence: Synthetic oligonucleotide
tcaaatactggaaatgttagatgaagttacctataacatgggagc

SEQ ID NO: 304935 - DNA, 44 bp, Artificial Sequence
  Description of Artificial Sequence: Synthetic oligonucleotide
caaatactggaaatgttagatgaagttacctataacatgggagc

SEQ ID NO: 304936 - DNA, 46 bp, Artificial Sequence
  Description of Artificial Sequence: Synthetic oligonucleotide
aaatactggaaatgttagatgaagttacctataacatgggagcttg

SEQ ID NO: 304937 - DNA, 45 bp, Artificial Sequence
  Description of Artificial Sequence: Synthetic oligonucleotide
aatactggaaatgttagatgaagttacctataacatgggagcttg

SEQ ID NO: 304938 - DNA, 44 bp, Artificial Sequence
  Description of Artificial Sequence: Synthetic oligonucleotide
atactggaaatgttagatgaagttacctataacatgggagcttg

SEQ ID NO: 304939 - DNA, 43 bp, Artificial Sequence
  Description of Artificial Sequence: Synthetic oligonucleotide
tactggaaatgttagatgaagttacctataacatgggagcttg

SEQ ID NO: 304940 - DNA, 42 bp, Artificial Sequence
  Description of Artificial Sequence: Synthetic oligonucleotide
actggaaatgttagatgaagttacctataacatgggagcttg

SEQ ID NO: 304941 - DNA, 41 bp, Artificial Sequence
  Description of Artificial Sequence: Synthetic oligonucleotide
ctggaaatgttagatgaagttacctataacatgggagcttg

SEQ ID NO: 304942 - DNA, 47 bp, Artificial Sequence
  Description of Artificial Sequence: Synthetic oligonucleotide
tggaaatgttagatgaagttacctataacatgggagcttgaattttg

SEQ ID NO: 304943 - DNA, 46 bp, Artificial Sequence
  Description of Artificial Sequence: Synthetic oligonucleotide
ggaaatgttagatgaagttacctataacatgggagcttgaattttg

SEQ ID NO: 304944 - DNA, 51 bp, Artificial Sequence
  Description of Artificial Sequence: Synthetic oligonucleotide
gaaatgttagatgaagttacctataacatgggagcttgaattttgaatttg

SEQ ID NO: 304945 - DNA, 51 bp, Artificial Sequence
  Description of Artificial Sequence: Synthetic oligonucleotide
aaatgttagatgaagttacctataacatgggagcttgaattttgaatttgc

SEQ ID NO: 304946 - DNA, 50 bp, Artificial Sequence
  Description of Artificial Sequence: Synthetic oligonucleotide
aatgttagatgaagttacctataacatgggagcttgaattttgaatttgc

SEQ ID NO: 304947 - DNA, 49 bp, Artificial Sequence
  Description of Artificial Sequence: Synthetic oligonucleotide
atgttagatgaagttacctataacatgggagcttgaattttgaatttgc

SEQ ID NO: 304948 - DNA, 48 bp, Artificial Sequence
  Description of Artificial Sequence: Synthetic oligonucleotide
tgttagatgaagttacctataacatgggagcttgaattttgaatttgc

SEQ ID NO: 304949 - DNA, 47 bp, Artificial Sequence
  Description of Artificial Sequence: Synthetic oligonucleotide
gttagatgaagttacctataacatgggagcttgaattttgaatttgc

SEQ ID NO: 304950 - DNA, 48 bp, Artificial Sequence
  Description of Artificial Sequence: Synthetic oligonucleotide
ttagatgaagttacctataacatgggagcttgaattttgaatttgctc

SEQ ID NO: 304951 - DNA, 47 bp, Artificial Sequence
  Description of Artificial Sequence: Synthetic oligonucleotide
tagatgaagttacctataacatgggagcttgaattttgaatttgctc

SEQ ID NO: 304952 - DNA, 46 bp, Artificial Sequence
  Description of Artificial Sequence: Synthetic oligonucleotide
agatgaagttacctataacatgggagcttgaattttgaatttgctc

SEQ ID NO: 304953 - DNA, 45 bp, Artificial Sequence
  Description of Artificial Sequence: Synthetic oligonucleotide
gatgaagttacctataacatgggagcttgaattttgaatttgctc

SEQ ID NO: 304954 - DNA, 47 bp, Artificial Sequence
  Description of Artificial Sequence: Synthetic oligonucleotide
atgaagttacctataacatgggagcttgaattttgaatttgctcaag

SEQ ID NO: 304955 - DNA, 46 bp, Artificial Sequence
  Description of Artificial Sequence: Synthetic oligonucleotide
tgaagttacctataacatgggagcttgaattttgaatttgctcaag

SEQ ID NO: 304956 - DNA, 45 bp, Artificial Sequence
  Description of Artificial Sequence: Synthetic oligonucleotide
gaagttacctataacatgggagcttgaattttgaatttgctcaag

SEQ ID NO: 304957 - DNA, 45 bp, Artificial Sequence
  Description of Artificial Sequence: Synthetic oligonucleotide
aagttacctataacatgggagcttgaattttgaatttgctcaagg

SEQ ID NO: 304958 - DNA, 44 bp, Artificial Sequence
  Description of Artificial Sequence: Synthetic oligonucleotide
agttacctataacatgggagcttgaattttgaatttgctcaagg

SEQ ID NO: 304959 - DNA, 43 bp, Artificial Sequence
  Description of Artificial Sequence: Synthetic oligonucleotide
gttacctataacatgggagcttgaattttgaatttgctcaagg

SEQ ID NO: 304960 - DNA, 48 bp, Artificial Sequence
  Description of Artificial Sequence: Synthetic oligonucleotide
ttacctataacatgggagcttgaattttgaatttgctcaaggtttttc

SEQ ID NO: 304961 - DNA, 47 bp, Artificial Sequence
  Description of Artificial Sequence: Synthetic oligonucleotide
tacctataacatgggagcttgaattttgaatttgctcaaggtttttc

SEQ ID NO: 304962 - DNA, 46 bp, Artificial Sequence
  Description of Artificial Sequence: Synthetic oligonucleotide
acctataacatgggagcttgaattttgaatttgctcaaggtttttc

SEQ ID NO: 304963 - DNA, 45 bp, Artificial Sequence
  Description of Artificial Sequence: Synthetic oligonucleotide
cctataacatgggagcttgaattttgaatttgctcaaggtttttc

SEQ ID NO: 304964 - DNA, 46 bp, Artificial Sequence
  Description of Artificial Sequence: Synthetic oligonucleotide
ctataacatgggagcttgaattttgaatttgctcaaggtttttctg

SEQ ID NO: 304965 - DNA, 46 bp, Artificial Sequence
  Description of Artificial Sequence: Synthetic oligonucleotide
tataacatgggagcttgaattttgaatttgctcaaggtttttctgg

SEQ ID NO: 304966 - DNA, 45 bp, Artificial Sequence
  Description of Artificial Sequence: Synthetic oligonucleotide
ataacatgggagcttgaattttgaatttgctcaaggtttttctgg

SEQ ID NO: 304967 - DNA, 44 bp, Artificial Sequence
  Description of Artificial Sequence: Synthetic oligonucleotide
taacatgggagcttgaattttgaatttgctcaaggtttttctgg

SEQ ID NO: 304968 - DNA, 43 bp, Artificial Sequence
  Description of Artificial Sequence: Synthetic oligonucleotide
aacatgggagcttgaattttgaatttgctcaaggtttttctgg

SEQ ID NO: 304969 - DNA, 42 bp, Artificial Sequence
  Description of Artificial Sequence: Synthetic oligonucleotide
acatgggagcttgaattttgaatttgctcaaggtttttctgg

SEQ ID NO: 304970 - DNA, 41 bp, Artificial Sequence
  Description of Artificial Sequence: Synthetic oligonucleotide
catgggagcttgaattttgaatttgctcaaggtttttctgg

SEQ ID NO: 304971 - DNA, 41 bp, Artificial Sequence
  Description of Artificial Sequence: Synthetic oligonucleotide
atgggagcttgaattttgaatttgctcaaggtttttctggg

SEQ ID NO: 304972 - DNA, 40 bp, Artificial Sequence
  Description of Artificial Sequence: Synthetic oligonucleotide
tgggagcttgaattttgaatttgctcaaggtttttctggg

SEQ ID NO: 304973 - DNA, 39 bp, Artificial Sequence
  Description of Artificial Sequence: Synthetic oligonucleotide
gggagcttgaattttgaatttgctcaaggtttttctggg

SEQ ID NO: 304974 - DNA, 40 bp, Artificial Sequence
  Description of Artificial Sequence: Synthetic oligonucleotide
ggagcttgaattttgaatttgctcaaggtttttctgggag

SEQ ID NO: 304975 - DNA, 41 bp, Artificial Sequence
  Description of Artificial Sequence: Synthetic oligonucleotide
gagcttgaattttgaatttgctcaaggtttttctgggagag

SEQ ID NO: 304976 - DNA, 41 bp, Artificial Sequence
  Description of Artificial Sequence: Synthetic oligonucleotide
agcttgaattttgaatttgctcaaggtttttctgggagagg

SEQ ID NO: 304977 - DNA, 40 bp, Artificial Sequence
  Description of Artificial Sequence: Synthetic oligonucleotide
gcttgaattttgaatttgctcaaggtttttctgggagagg

SEQ ID NO: 304978 - DNA, 41 bp, Artificial Sequence
  Description of Artificial Sequence: Synthetic oligonucleotide
cttgaattttgaatttgctcaaggtttttctgggagaggag

SEQ ID NO: 304979 - DNA, 46 bp, Artificial Sequence
  Description of Artificial Sequence: Synthetic oligonucleotide
ttgaattttgaatttgctcaaggtttttctgggagaggagaaaatc

SEQ ID NO: 304980 - DNA, 45 bp, Artificial Sequence
  Description of Artificial Sequence: Synthetic oligonucleotide
tgaattttgaatttgctcaaggtttttctgggagaggagaaaatc

SEQ ID NO: 304981 - DNA, 44 bp, Artificial Sequence
  Description of Artificial Sequence: Synthetic oligonucleotide
gaattttgaatttgctcaaggtttttctgggagaggagaaaatc

SEQ ID NO: 304982 - DNA, 44 bp, Artificial Sequence
  Description of Artificial Sequence: Synthetic oligonucleotide
aattttgaatttgctcaaggtttttctgggagaggagaaaatcc

SEQ ID NO: 304983 - DNA, 43 bp, Artificial Sequence
  Description of Artificial Sequence: Synthetic oligonucleotide
attttgaatttgctcaaggtttttctgggagaggagaaaatcc

SEQ ID NO: 304984 - DNA, 42 bp, Artificial Sequence
  Description of Artificial Sequence: Synthetic oligonucleotide
ttttgaatttgctcaaggtttttctgggagaggagaaaatcc

SEQ ID NO: 304985 - DNA, 41 bp, Artificial Sequence
  Description of Artificial Sequence: Synthetic oligonucleotide
tttgaatttgctcaaggtttttctgggagaggagaaaatcc

SEQ ID NO: 304986 - DNA, 40 bp, Artificial Sequence
  Description of Artificial Sequence: Synthetic oligonucleotide
ttgaatttgctcaaggtttttctgggagaggagaaaatcc

SEQ ID NO: 304987 - DNA, 39 bp, Artificial Sequence
  Description of Artificial Sequence: Synthetic oligonucleotide
tgaatttgctcaaggtttttctgggagaggagaaaatcc

SEQ ID NO: 304988 - DNA, 38 bp, Artificial Sequence
  Description of Artificial Sequence: Synthetic oligonucleotide
gaatttgctcaaggtttttctgggagaggagaaaatcc

SEQ ID NO: 304989 - DNA, 39 bp, Artificial Sequence
  Description of Artificial Sequence: Synthetic oligonucleotide
aatttgctcaaggtttttctgggagaggagaaaatccag

SEQ ID NO: 304990 - DNA, 38 bp, Artificial Sequence
  Description of Artificial Sequence: Synthetic oligonucleotide
atttgctcaaggtttttctgggagaggagaaaatccag

SEQ ID NO: 304991 - DNA, 37 bp, Artificial Sequence
  Description of Artificial Sequence: Synthetic oligonucleotide
tttgctcaaggtttttctgggagaggagaaaatccag

SEQ ID NO: 304992 - DNA, 36 bp, Artificial Sequence
  Description of Artificial Sequence: Synthetic oligonucleotide
ttgctcaaggtttttctgggagaggagaaaatccag

SEQ ID NO: 304993 - DNA, 35 bp, Artificial Sequence
  Description of Artificial Sequence: Synthetic oligonucleotide
tgctcaaggtttttctgggagaggagaaaatccag

SEQ ID NO: 304994 - DNA, 34 bp, Artificial Sequence
  Description of Artificial Sequence: Synthetic oligonucleotide
gctcaaggtttttctgggagaggagaaaatccag

SEQ ID NO: 304995 - DNA, 37 bp, Artificial Sequence
  Description of Artificial Sequence: Synthetic oligonucleotide
ctcaaggtttttctgggagaggagaaaatccagaaag

SEQ ID NO: 304996 - DNA, 37 bp, Artificial Sequence
  Description of Artificial Sequence: Synthetic oligonucleotide
tcaaggtttttctgggagaggagaaaatccagaaagc

SEQ ID NO: 304997 - DNA, 36 bp, Artificial Sequence
  Description of Artificial Sequence: Synthetic oligonucleotide
caaggtttttctgggagaggagaaaatccagaaagc

SEQ ID NO: 304998 - DNA, 43 bp, Artificial Sequence
  Description of Artificial Sequence: Synthetic oligonucleotide
aaggtttttctgggagaggagaaaatccagaaagcaataattc

SEQ ID NO: 304999 - DNA, 42 bp, Artificial Sequence
  Description of Artificial Sequence: Synthetic oligonucleotide
aggtttttctgggagaggagaaaatccagaaagcaataattc

SEQ ID NO: 305000 - DNA, 41 bp, Artificial Sequence
  Description of Artificial Sequence: Synthetic oligonucleotide
ggtttttctgggagaggagaaaatccagaaagcaataattc

SEQ ID NO: 305001 - DNA, 42 bp, Artificial Sequence
  Description of Artificial Sequence: Synthetic oligonucleotide
gtttttctgggagaggagaaaatccagaaagcaataattcac

SEQ ID NO: 305002 - DNA, 44 bp, Artificial Sequence
  Description of Artificial Sequence: Synthetic oligonucleotide
tttttctgggagaggagaaaatccagaaagcaataattcactac

SEQ ID NO: 305003 - DNA, 43 bp, Artificial Sequence
  Description of Artificial Sequence: Synthetic oligonucleotide
ttttctgggagaggagaaaatccagaaagcaataattcactac

SEQ ID NO: 305004 - DNA, 42 bp, Artificial Sequence
  Description of Artificial Sequence: Synthetic oligonucleotide
tttctgggagaggagaaaatccagaaagcaataattcactac

SEQ ID NO: 305005 - DNA, 41 bp, Artificial Sequence
  Description of Artificial Sequence: Synthetic oligonucleotide
ttctgggagaggagaaaatccagaaagcaataattcactac

SEQ ID NO: 305006 - DNA, 40 bp, Artificial Sequence
  Description of Artificial Sequence: Synthetic oligonucleotide
tctgggagaggagaaaatccagaaagcaataattcactac

SEQ ID NO: 305007 - DNA, 39 bp, Artificial Sequence
  Description of Artificial Sequence: Synthetic oligonucleotide
ctgggagaggagaaaatccagaaagcaataattcactac

SEQ ID NO: 305008 - DNA, 44 bp, Artificial Sequence
  Description of Artificial Sequence: Synthetic oligonucleotide
tgggagaggagaaaatccagaaagcaataattcactacttaaag

SEQ ID NO: 305009 - DNA, 43 bp, Artificial Sequence
  Description of Artificial Sequence: Synthetic oligonucleotide
gggagaggagaaaatccagaaagcaataattcactacttaaag

SEQ ID NO: 305010 - DNA, 45 bp, Artificial Sequence
  Description of Artificial Sequence: Synthetic oligonucleotide
ggagaggagaaaatccagaaagcaataattcactacttaaagtag

SEQ ID NO: 305011 - DNA, 47 bp, Artificial Sequence
  Description of Artificial Sequence: Synthetic oligonucleotide
gagaggagaaaatccagaaagcaataattcactacttaaagtagttc

SEQ ID NO: 305012 - DNA, 48 bp, Artificial Sequence
  Description of Artificial Sequence: Synthetic oligonucleotide
agaggagaaaatccagaaagcaataattcactacttaaagtagttcag

SEQ ID NO: 305013 - DNA, 47 bp, Artificial Sequence
  Description of Artificial Sequence: Synthetic oligonucleotide
gaggagaaaatccagaaagcaataattcactacttaaagtagttcag

SEQ ID NO: 305014 - DNA, 47 bp, Artificial Sequence
  Description of Artificial Sequence: Synthetic oligonucleotide
aggagaaaatccagaaagcaataattcactacttaaagtagttcagc

SEQ ID NO: 305015 - DNA, 46 bp, Artificial Sequence
  Description of Artificial Sequence: Synthetic oligonucleotide
ggagaaaatccagaaagcaataattcactacttaaagtagttcagc

SEQ ID NO: 305016 - DNA, 50 bp, Artificial Sequence
  Description of Artificial Sequence: Synthetic oligonucleotide
gagaaaatccagaaagcaataattcactacttaaagtagttcagctttag

SEQ ID NO: 305017 - DNA, 54 bp, Artificial Sequence
  Description of Artificial Sequence: Synthetic oligonucleotide
agaaaatccagaaagcaataattcactacttaaagtagttcagctttagaaatg

SEQ ID NO: 305018 - DNA, 53 bp, Artificial Sequence
  Description of Artificial Sequence: Synthetic oligonucleotide
gaaaatccagaaagcaataattcactacttaaagtagttcagctttagaaatg

SEQ ID NO: 305019 - DNA, 53 bp, Artificial Sequence
  Description of Artificial Sequence: Synthetic oligonucleotide
aaaatccagaaagcaataattcactacttaaagtagttcagctttagaaatgc

SEQ ID NO: 305020 - DNA, 52 bp, Artificial Sequence
  Description of Artificial Sequence: Synthetic oligonucleotide
aaatccagaaagcaataattcactacttaaagtagttcagctttagaaatgc

SEQ ID NO: 305021 - DNA, 51 bp, Artificial Sequence
  Description of Artificial Sequence: Synthetic oligonucleotide
aatccagaaagcaataattcactacttaaagtagttcagctttagaaatgc

SEQ ID NO: 305022 - DNA, 50 bp, Artificial Sequence
  Description of Artificial Sequence: Synthetic oligonucleotide
atccagaaagcaataattcactacttaaagtagttcagctttagaaatgc

SEQ ID NO: 305023 - DNA, 49 bp, Artificial Sequence
  Description of Artificial Sequence: Synthetic oligonucleotide
tccagaaagcaataattcactacttaaagtagttcagctttagaaatgc

SEQ ID NO: 305024 - DNA, 48 bp, Artificial Sequence
  Description of Artificial Sequence: Synthetic oligonucleotide
ccagaaagcaataattcactacttaaagtagttcagctttagaaatgc

SEQ ID NO: 305025 - DNA, 51 bp, Artificial Sequence
  Description of Artificial Sequence: Synthetic oligonucleotide
cagaaagcaataattcactacttaaagtagttcagctttagaaatgcaaag

SEQ ID NO: 305026 - DNA, 54 bp, Artificial Sequence
  Description of Artificial Sequence: Synthetic oligonucleotide
agaaagcaataattcactacttaaagtagttcagctttagaaatgcaaagaatg

SEQ ID NO: 305027 - DNA, 53 bp, Artificial Sequence
  Description of Artificial Sequence: Synthetic oligonucleotide
gaaagcaataattcactacttaaagtagttcagctttagaaatgcaaagaatg

SEQ ID NO: 305028 - DNA, 55 bp, Artificial Sequence
  Description of Artificial Sequence: Synthetic oligonucleotide
aaagcaataattcactacttaaagtagttcagctttagaaatgcaaagaatgatc

SEQ ID NO: 305029 - DNA, 54 bp, Artificial Sequence
  Description of Artificial Sequence: Synthetic oligonucleotide
aagcaataattcactacttaaagtagttcagctttagaaatgcaaagaatgatc

SEQ ID NO: 305030 - DNA, 53 bp, Artificial Sequence
  Description of Artificial Sequence: Synthetic oligonucleotide
agcaataattcactacttaaagtagttcagctttagaaatgcaaagaatgatc

SEQ ID NO: 305031 - DNA, 52 bp, Artificial Sequence
  Description of Artificial Sequence: Synthetic oligonucleotide
gcaataattcactacttaaagtagttcagctttagaaatgcaaagaatgatc

SEQ ID NO: 305032 - DNA, 53 bp, Artificial Sequence
  Description of Artificial Sequence: Synthetic oligonucleotide
caataattcactacttaaagtagttcagctttagaaatgcaaagaatgatcac

SEQ ID NO: 305033 - DNA, 55 bp, Artificial Sequence
  Description of Artificial Sequence: Synthetic oligonucleotide
aataattcactacttaaagtagttcagctttagaaatgcaaagaatgatcacttg

SEQ ID NO: 305034 - DNA, 54 bp, Artificial Sequence
  Description of Artificial Sequence: Synthetic oligonucleotide
ataattcactacttaaagtagttcagctttagaaatgcaaagaatgatcacttg

SEQ ID NO: 305035 - DNA, 53 bp, Artificial Sequence
  Description of Artificial Sequence: Synthetic oligonucleotide
taattcactacttaaagtagttcagctttagaaatgcaaagaatgatcacttg

SEQ ID NO: 305036 - DNA, 52 bp, Artificial Sequence
  Description of Artificial Sequence: Synthetic oligonucleotide
aattcactacttaaagtagttcagctttagaaatgcaaagaatgatcacttg

SEQ ID NO: 305037 - DNA, 51 bp, Artificial Sequence
  Description of Artificial Sequence: Synthetic oligonucleotide
attcactacttaaagtagttcagctttagaaatgcaaagaatgatcacttg

SEQ ID NO: 305038 - DNA, 50 bp, Artificial Sequence
  Description of Artificial Sequence: Synthetic oligonucleotide
ttcactacttaaagtagttcagctttagaaatgcaaagaatgatcacttg

SEQ ID NO: 305039 - DNA, 49 bp, Artificial Sequence
  Description of Artificial Sequence: Synthetic oligonucleotide
tcactacttaaagtagttcagctttagaaatgcaaagaatgatcacttg

SEQ ID NO: 305040 - DNA, 48 bp, Artificial Sequence
  Description of Artificial Sequence: Synthetic oligonucleotide
cactacttaaagtagttcagctttagaaatgcaaagaatgatcacttg

SEQ ID NO: 305041 - DNA, 49 bp, Artificial Sequence
  Description of Artificial Sequence: Synthetic oligonucleotide
actacttaaagtagttcagctttagaaatgcaaagaatgatcacttgtg

SEQ ID NO: 305042 - DNA, 48 bp, Artificial Sequence
  Description of Artificial Sequence: Synthetic oligonucleotide
ctacttaaagtagttcagctttagaaatgcaaagaatgatcacttgtg

SEQ ID NO: 305043 - DNA, 48 bp, Artificial Sequence
  Description of Artificial Sequence: Synthetic oligonucleotide
tacttaaagtagttcagctttagaaatgcaaagaatgatcacttgtgg

SEQ ID NO: 305044 - DNA, 47 bp, Artificial Sequence
  Description of Artificial Sequence: Synthetic oligonucleotide
acttaaagtagttcagctttagaaatgcaaagaatgatcacttgtgg

SEQ ID NO: 305045 - DNA, 46 bp, Artificial Sequence
  Description of Artificial Sequence: Synthetic oligonucleotide
cttaaagtagttcagctttagaaatgcaaagaatgatcacttgtgg

SEQ ID NO: 305046 - DNA, 47 bp, Artificial Sequence
  Description of Artificial Sequence: Synthetic oligonucleotide
ttaaagtagttcagctttagaaatgcaaagaatgatcacttgtggac

SEQ ID NO: 305047 - DNA, 46 bp, Artificial Sequence
  Description of Artificial Sequence: Synthetic oligonucleotide
taaagtagttcagctttagaaatgcaaagaatgatcacttgtggac

SEQ ID NO: 305048 - DNA, 45 bp, Artificial Sequence
  Description of Artificial Sequence: Synthetic oligonucleotide
aaagtagttcagctttagaaatgcaaagaatgatcacttgtggac

SEQ ID NO: 305049 - DNA, 44 bp, Artificial Sequence
  Description of Artificial Sequence: Synthetic oligonucleotide
aagtagttcagctttagaaatgcaaagaatgatcacttgtggac

SEQ ID NO: 305050 - DNA, 43 bp, Artificial Sequence
  Description of Artificial Sequence: Synthetic oligonucleotide
agtagttcagctttagaaatgcaaagaatgatcacttgtggac

SEQ ID NO: 305051 - DNA, 42 bp, Artificial Sequence
  Description of Artificial Sequence: Synthetic oligonucleotide
gtagttcagctttagaaatgcaaagaatgatcacttgtggac

SEQ ID NO: 305052 - DNA, 42 bp, Artificial Sequence
  Description of Artificial Sequence: Synthetic oligonucleotide
tagttcagctttagaaatgcaaagaatgatcacttgtggacc

SEQ ID NO: 305053 - DNA, 41 bp, Artificial Sequence
  Description of Artificial Sequence: Synthetic oligonucleotide
agttcagctttagaaatgcaaagaatgatcacttgtggacc

SEQ ID NO: 305054 - DNA, 40 bp, Artificial Sequence
  Description of Artificial Sequence: Synthetic oligonucleotide
gttcagctttagaaatgcaaagaatgatcacttgtggacc

SEQ ID NO: 305055 - DNA, 41 bp, Artificial Sequence
  Description of Artificial Sequence: Synthetic oligonucleotide
ttcagctttagaaatgcaaagaatgatcacttgtggaccag

SEQ ID NO: 305056 - DNA, 40 bp, Artificial Sequence
  Description of Artificial Sequence: Synthetic oligonucleotide
tcagctttagaaatgcaaagaatgatcacttgtggaccag

SEQ ID NO: 305057 - DNA, 39 bp, Artificial Sequence
  Description of Artificial Sequence: Synthetic oligonucleotide
cagctttagaaatgcaaagaatgatcacttgtggaccag

SEQ ID NO: 305058 - DNA, 40 bp, Artificial Sequence
  Description of Artificial Sequence: Synthetic oligonucleotide
agctttagaaatgcaaagaatgatcacttgtggaccagtc

SEQ ID NO: 305059 - DNA, 39 bp, Artificial Sequence
  Description of Artificial Sequence: Synthetic oligonucleotide
gctttagaaatgcaaagaatgatcacttgtggaccagtc

SEQ ID NO: 305060 - DNA, 40 bp, Artificial Sequence
  Description of Artificial Sequence: Synthetic oligonucleotide
ctttagaaatgcaaagaatgatcacttgtggaccagtctg

SEQ ID NO: 305061 - DNA, 41 bp, Artificial Sequence
  Description of Artificial Sequence: Synthetic oligonucleotide
tttagaaatgcaaagaatgatcacttgtggaccagtctgtc

SEQ ID NO: 305062 - DNA, 40 bp, Artificial Sequence
  Description of Artificial Sequence: Synthetic oligonucleotide
ttagaaatgcaaagaatgatcacttgtggaccagtctgtc

SEQ ID NO: 305063 - DNA, 39 bp, Artificial Sequence
  Description of Artificial Sequence: Synthetic oligonucleotide
tagaaatgcaaagaatgatcacttgtggaccagtctgtc

SEQ ID NO: 305064 - DNA, 38 bp, Artificial Sequence
  Description of Artificial Sequence: Synthetic oligonucleotide
agaaatgcaaagaatgatcacttgtggaccagtctgtc

SEQ ID NO: 305065 - DNA, 37 bp, Artificial Sequence
  Description of Artificial Sequence: Synthetic oligonucleotide
gaaatgcaaagaatgatcacttgtggaccagtctgtc

SEQ ID NO: 305066 - DNA, 42 bp, Artificial Sequence
  Description of Artificial Sequence: Synthetic oligonucleotide
aaatgcaaagaatgatcacttgtggaccagtctgtctaatag

SEQ ID NO: 305067 - DNA, 41 bp, Artificial Sequence
  Description of Artificial Sequence: Synthetic oligonucleotide
aatgcaaagaatgatcacttgtggaccagtctgtctaatag

SEQ ID NO: 305068 - DNA, 40 bp, Artificial Sequence
  Description of Artificial Sequence: Synthetic oligonucleotide
atgcaaagaatgatcacttgtggaccagtctgtctaatag

SEQ ID NO: 305069 - DNA, 39 bp, Artificial Sequence
  Description of Artificial Sequence: Synthetic oligonucleotide
tgcaaagaatgatcacttgtggaccagtctgtctaatag

SEQ ID NO: 305070 - DNA, 38 bp, Artificial Sequence
  Description of Artificial Sequence: Synthetic oligonucleotide
gcaaagaatgatcacttgtggaccagtctgtctaatag

SEQ ID NO: 305071 - DNA, 40 bp, Artificial Sequence
  Description of Artificial Sequence: Synthetic oligonucleotide
caaagaatgatcacttgtggaccagtctgtctaatagttg

SEQ ID NO: 305072 - DNA, 44 bp, Artificial Sequence
  Description of Artificial Sequence: Synthetic oligonucleotide
aaagaatgatcacttgtggaccagtctgtctaatagttgtatag

SEQ ID NO: 305073 - DNA, 43 bp, Artificial Sequence
  Description of Artificial Sequence: Synthetic oligonucleotide
aagaatgatcacttgtggaccagtctgtctaatagttgtatag

SEQ ID NO: 305074 - DNA, 42 bp, Artificial Sequence
  Description of Artificial Sequence: Synthetic oligonucleotide
agaatgatcacttgtggaccagtctgtctaatagttgtatag

SEQ ID NO: 305075 - DNA, 41 bp, Artificial Sequence
  Description of Artificial Sequence: Synthetic oligonucleotide
gaatgatcacttgtggaccagtctgtctaatagttgtatag

SEQ ID NO: 305076 - DNA, 44 bp, Artificial Sequence
  Description of Artificial Sequence: Synthetic oligonucleotide
aatgatcacttgtggaccagtctgtctaatagttgtatagaaag

SEQ ID NO: 305077 - DNA, 43 bp, Artificial Sequence
  Description of Artificial Sequence: Synthetic oligonucleotide
atgatcacttgtggaccagtctgtctaatagttgtatagaaag

SEQ ID NO: 305078 - DNA, 42 bp, Artificial Sequence
  Description of Artificial Sequence: Synthetic oligonucleotide
tgatcacttgtggaccagtctgtctaatagttgtatagaaag

SEQ ID NO: 305079 - DNA, 41 bp, Artificial Sequence
  Description of Artificial Sequence: Synthetic oligonucleotide
gatcacttgtggaccagtctgtctaatagttgtatagaaag

SEQ ID NO: 305080 - DNA, 42 bp, Artificial Sequence
  Description of Artificial Sequence: Synthetic oligonucleotide
atcacttgtggaccagtctgtctaatagttgtatagaaagtg

SEQ ID NO: 305081 - DNA, 41 bp, Artificial Sequence
  Description of Artificial Sequence: Synthetic oligonucleotide
tcacttgtggaccagtctgtctaatagttgtatagaaagtg

SEQ ID NO: 305082 - DNA, 40 bp, Artificial Sequence
  Description of Artificial Sequence: Synthetic oligonucleotide
cacttgtggaccagtctgtctaatagttgtatagaaagtg

SEQ ID NO: 305083 - DNA, 46 bp, Artificial Sequence
  Description of Artificial Sequence: Synthetic oligonucleotide
acttgtggaccagtctgtctaatagttgtatagaaagtgtttttac

SEQ ID NO: 305084 - DNA, 45 bp, Artificial Sequence
  Description of Artificial Sequence: Synthetic oligonucleotide
cttgtggaccagtctgtctaatagttgtatagaaagtgtttttac

SEQ ID NO: 305085 - DNA, 47 bp, Artificial Sequence
  Description of Artificial Sequence: Synthetic oligonucleotide
ttgtggaccagtctgtctaatagttgtatagaaagtgtttttacatc

SEQ ID NO: 305086 - DNA, 46 bp, Artificial Sequence
  Description of Artificial Sequence: Synthetic oligonucleotide
tgtggaccagtctgtctaatagttgtatagaaagtgtttttacatc

SEQ ID NO: 305087 - DNA, 45 bp, Artificial Sequence
  Description of Artificial Sequence: Synthetic oligonucleotide
gtggaccagtctgtctaatagttgtatagaaagtgtttttacatc

SEQ ID NO: 305088 - DNA, 46 bp, Artificial Sequence
  Description of Artificial Sequence: Synthetic oligonucleotide
tggaccagtctgtctaatagttgtatagaaagtgtttttacatcag

SEQ ID NO: 305089 - DNA, 45 bp, Artificial Sequence
  Description of Artificial Sequence: Synthetic oligonucleotide
ggaccagtctgtctaatagttgtatagaaagtgtttttacatcag

SEQ ID NO: 305090 - DNA, 45 bp, Artificial Sequence
  Description of Artificial Sequence: Synthetic oligonucleotide
gaccagtctgtctaatagttgtatagaaagtgtttttacatcagg

SEQ ID NO: 305091 - DNA, 46 bp, Artificial Sequence
  Description of Artificial Sequence: Synthetic oligonucleotide
accagtctgtctaatagttgtatagaaagtgtttttacatcaggtg

SEQ ID NO: 305092 - DNA, 45 bp, Artificial Sequence
  Description of Artificial Sequence: Synthetic oligonucleotide
ccagtctgtctaatagttgtatagaaagtgtttttacatcaggtg

SEQ ID NO: 305093 - DNA, 45 bp, Artificial Sequence
  Description of Artificial Sequence: Synthetic oligonucleotide
cagtctgtctaatagttgtatagaaagtgtttttacatcaggtgg

SEQ ID NO: 305094 - DNA, 46 bp, Artificial Sequence
  Description of Artificial Sequence: Synthetic oligonucleotide
agtctgtctaatagttgtatagaaagtgtttttacatcaggtggag

SEQ ID NO: 305095 - DNA, 45 bp, Artificial Sequence
  Description of Artificial Sequence: Synthetic oligonucleotide
gtctgtctaatagttgtatagaaagtgtttttacatcaggtggag

SEQ ID NO: 305096 - DNA, 48 bp, Artificial Sequence
  Description of Artificial Sequence: Synthetic oligonucleotide
tctgtctaatagttgtatagaaagtgtttttacatcaggtggagttag

SEQ ID NO: 305097 - DNA, 47 bp, Artificial Sequence
  Description of Artificial Sequence: Synthetic oligonucleotide
ctgtctaatagttgtatagaaagtgtttttacatcaggtggagttag

SEQ ID NO: 305098 - DNA, 48 bp, Artificial Sequence
  Description of Artificial Sequence: Synthetic oligonucleotide
tgtctaatagttgtatagaaagtgtttttacatcaggtggagttagtc

SEQ ID NO: 305099 - DNA, 47 bp, Artificial Sequence
  Description of Artificial Sequence: Synthetic oligonucleotide
gtctaatagttgtatagaaagtgtttttacatcaggtggagttagtc

SEQ ID NO: 305100 - DNA, 50 bp, Artificial Sequence
  Description of Artificial Sequence: Synthetic oligonucleotide
tctaatagttgtatagaaagtgtttttacatcaggtggagttagtcattc

SEQ ID NO: 305101 - DNA, 49 bp, Artificial Sequence
  Description of Artificial Sequence: Synthetic oligonucleotide
ctaatagttgtatagaaagtgtttttacatcaggtggagttagtcattc

SEQ ID NO: 305102 - DNA, 49 bp, Artificial Sequence
  Description of Artificial Sequence: Synthetic oligonucleotide
taatagttgtatagaaagtgtttttacatcaggtggagttagtcattcg

SEQ ID NO: 305103 - DNA, 48 bp, Artificial Sequence
  Description of Artificial Sequence: Synthetic oligonucleotide
aatagttgtatagaaagtgtttttacatcaggtggagttagtcattcg

SEQ ID NO: 305104 - DNA, 47 bp, Artificial Sequence
  Description of Artificial Sequence: Synthetic oligonucleotide
atagttgtatagaaagtgtttttacatcaggtggagttagtcattcg

SEQ ID NO: 305105 - DNA, 46 bp, Artificial Sequence
  Description of Artificial Sequence: Synthetic oligonucleotide
tagttgtatagaaagtgtttttacatcaggtggagttagtcattcg

SEQ ID NO: 305106 - DNA, 45 bp, Artificial Sequence
  Description of Artificial Sequence: Synthetic oligonucleotide
agttgtatagaaagtgtttttacatcaggtggagttagtcattcg

SEQ ID NO: 305107 - DNA, 44 bp, Artificial Sequence
  Description of Artificial Sequence: Synthetic oligonucleotide
gttgtatagaaagtgtttttacatcaggtggagttagtcattcg

SEQ ID NO: 305108 - DNA, 44 bp, Artificial Sequence
  Description of Artificial Sequence: Synthetic oligonucleotide
ttgtatagaaagtgtttttacatcaggtggagttagtcattcgg

SEQ ID NO: 305109 - DNA, 43 bp, Artificial Sequence
  Description of Artificial Sequence: Synthetic oligonucleotide
tgtatagaaagtgtttttacatcaggtggagttagtcattcgg

SEQ ID NO: 305110 - DNA, 42 bp, Artificial Sequence
  Description of Artificial Sequence: Synthetic oligonucleotide
gtatagaaagtgtttttacatcaggtggagttagtcattcgg

SEQ ID NO: 305111 - DNA, 44 bp, Artificial Sequence
  Description of Artificial Sequence: Synthetic oligonucleotide
tatagaaagtgtttttacatcaggtggagttagtcattcggttc

SEQ ID NO: 305112 - DNA, 43 bp, Artificial Sequence
  Description of Artificial Sequence: Synthetic oligonucleotide
atagaaagtgtttttacatcaggtggagttagtcattcggttc

SEQ ID NO: 305113 - DNA, 42 bp, Artificial Sequence
  Description of Artificial Sequence: Synthetic oligonucleotide
tagaaagtgtttttacatcaggtggagttagtcattcggttc

SEQ ID NO: 305114 - DNA, 41 bp, Artificial Sequence
  Description of Artificial Sequence: Synthetic oligonucleotide
agaaagtgtttttacatcaggtggagttagtcattcggttc

SEQ ID NO: 305115 - DNA, 40 bp, Artificial Sequence
  Description of Artificial Sequence: Synthetic oligonucleotide
gaaagtgtttttacatcaggtggagttagtcattcggttc

SEQ ID NO: 305116 - DNA, 40 bp, Artificial Sequence
  Description of Artificial Sequence: Synthetic oligonucleotide
aaagtgtttttacatcaggtggagttagtcattcggttcc

SEQ ID NO: 305117 - DNA, 39 bp, Artificial Sequence
  Description of Artificial Sequence: Synthetic oligonucleotide
aagtgtttttacatcaggtggagttagtcattcggttcc

SEQ ID NO: 305118 - DNA, 38 bp, Artificial Sequence
  Description of Artificial Sequence: Synthetic oligonucleotide
agtgtttttacatcaggtggagttagtcattcggttcc

SEQ ID NO: 305119 - DNA, 37 bp, Artificial Sequence
  Description of Artificial Sequence: Synthetic oligonucleotide
gtgtttttacatcaggtggagttagtcattcggttcc

SEQ ID NO: 305120 - DNA, 37 bp, Artificial Sequence
  Description of Artificial Sequence: Synthetic oligonucleotide
tgtttttacatcaggtggagttagtcattcggttccc

SEQ ID NO: 305121 - DNA, 36 bp, Artificial Sequence
  Description of Artificial Sequence: Synthetic oligonucleotide
gtttttacatcaggtggagttagtcattcggttccc

SEQ ID NO: 305122 - DNA, 38 bp, Artificial Sequence
  Description of Artificial Sequence: Synthetic oligonucleotide
tttttacatcaggtggagttagtcattcggttcccaag

SEQ ID NO: 305123 - DNA, 37 bp, Artificial Sequence
  Description of Artificial Sequence: Synthetic oligonucleotide
ttttacatcaggtggagttagtcattcggttcccaag

SEQ ID NO: 305124 - DNA, 36 bp, Artificial Sequence
  Description of Artificial Sequence: Synthetic oligonucleotide
tttacatcaggtggagttagtcattcggttcccaag

SEQ ID NO: 305125 - DNA, 35 bp, Artificial Sequence
  Description of Artificial Sequence: Synthetic oligonucleotide
ttacatcaggtggagttagtcattcggttcccaag

SEQ ID NO: 305126 - DNA, 34 bp, Artificial Sequence
  Description of Artificial Sequence: Synthetic oligonucleotide
tacatcaggtggagttagtcattcggttcccaag

SEQ ID NO: 305127 - DNA, 33 bp, Artificial Sequence
  Description of Artificial Sequence: Synthetic oligonucleotide
acatcaggtggagttagtcattcggttcccaag

SEQ ID NO: 305128 - DNA, 32 bp, Artificial Sequence
  Description of Artificial Sequence: Synthetic oligonucleotide
catcaggtggagttagtcattcggttcccaag

SEQ ID NO: 305129 - DNA, 34 bp, Artificial Sequence
  Description of Artificial Sequence: Synthetic oligonucleotide
atcaggtggagttagtcattcggttcccaagatc

SEQ ID NO: 305130 - DNA, 33 bp, Artificial Sequence
  Description of Artificial Sequence: Synthetic oligonucleotide
tcaggtggagttagtcattcggttcccaagatc

SEQ ID NO: 305131 - DNA, 32 bp, Artificial Sequence
  Description of Artificial Sequence: Synthetic oligonucleotide
caggtggagttagtcattcggttcccaagatc

SEQ ID NO: 305132 - DNA, 33 bp, Artificial Sequence
  Description of Artificial Sequence: Synthetic oligonucleotide
aggtggagttagtcattcggttcccaagatcac

SEQ ID NO: 305133 - DNA, 32 bp, Artificial Sequence
  Description of Artificial Sequence: Synthetic oligonucleotide
ggtggagttagtcattcggttcccaagatcac

SEQ ID NO: 305134 - DNA, 34 bp, Artificial Sequence
  Description of Artificial Sequence: Synthetic oligonucleotide
gtggagttagtcattcggttcccaagatcacaag

SEQ ID NO: 305135 - DNA, 37 bp, Artificial Sequence
  Description of Artificial Sequence: Synthetic oligonucleotide
tggagttagtcattcggttcccaagatcacaagtaac

SEQ ID NO: 305136 - DNA, 36 bp, Artificial Sequence
  Description of Artificial Sequence: Synthetic oligonucleotide
ggagttagtcattcggttcccaagatcacaagtaac

SEQ ID NO: 305137 - DNA, 38 bp, Artificial Sequence
  Description of Artificial Sequence: Synthetic oligonucleotide
gagttagtcattcggttcccaagatcacaagtaacttg

SEQ ID NO: 305138 - DNA, 38 bp, Artificial Sequence
  Description of Artificial Sequence: Synthetic oligonucleotide
agttagtcattcggttcccaagatcacaagtaacttgc

SEQ ID NO: 305139 - DNA, 37 bp, Artificial Sequence
  Description of Artificial Sequence: Synthetic oligonucleotide
gttagtcattcggttcccaagatcacaagtaacttgc

SEQ ID NO: 305140 - DNA, 38 bp, Artificial Sequence
  Description of Artificial Sequence: Synthetic oligonucleotide
ttagtcattcggttcccaagatcacaagtaacttgctc

SEQ ID NO: 305141 - DNA, 37 bp, Artificial Sequence
  Description of Artificial Sequence: Synthetic oligonucleotide
tagtcattcggttcccaagatcacaagtaacttgctc

SEQ ID NO: 305142 - DNA, 36 bp, Artificial Sequence
  Description of Artificial Sequence: Synthetic oligonucleotide
agtcattcggttcccaagatcacaagtaacttgctc

SEQ ID NO: 305143 - DNA, 35 bp, Artificial Sequence
  Description of Artificial Sequence: Synthetic oligonucleotide
gtcattcggttcccaagatcacaagtaacttgctc

SEQ ID NO: 305144 - DNA, 35 bp, Artificial Sequence
  Description of Artificial Sequence: Synthetic oligonucleotide
tcattcggttcccaagatcacaagtaacttgctcg

SEQ ID NO: 305145 - DNA, 34 bp, Artificial Sequence
  Description of Artificial Sequence: Synthetic oligonucleotide
cattcggttcccaagatcacaagtaacttgctcg

SEQ ID NO: 305146 - DNA, 34 bp, Artificial Sequence
  Description of Artificial Sequence: Synthetic oligonucleotide
attcggttcccaagatcacaagtaacttgctcgc

SEQ ID NO: 305147 - DNA, 33 bp, Artificial Sequence
  Description of Artificial Sequence: Synthetic oligonucleotide
ttcggttcccaagatcacaagtaacttgctcgc

SEQ ID NO: 305148 - DNA, 32 bp, Artificial Sequence
  Description of Artificial Sequence: Synthetic oligonucleotide
tcggttcccaagatcacaagtaacttgctcgc

SEQ ID NO: 305149 - DNA, 31 bp, Artificial Sequence
  Description of Artificial Sequence: Synthetic oligonucleotide
cggttcccaagatcacaagtaacttgctcgc

SEQ ID NO: 305150 - DNA, 31 bp, Artificial Sequence
  Description of Artificial Sequence: Synthetic oligonucleotide
ggttcccaagatcacaagtaacttgctcgcc

SEQ ID NO: 305151 - DNA, 34 bp, Artificial Sequence
  Description of Artificial Sequence: Synthetic oligonucleotide
gttcccaagatcacaagtaacttgctcgcctatc

SEQ ID NO: 305152 - DNA, 35 bp, Artificial Sequence
  Description of Artificial Sequence: Synthetic oligonucleotide
ttcccaagatcacaagtaacttgctcgcctatctg

SEQ ID NO: 305153 - DNA, 34 bp, Artificial Sequence
  Description of Artificial Sequence: Synthetic oligonucleotide
tcccaagatcacaagtaacttgctcgcctatctg

SEQ ID NO: 305154 - DNA, 33 bp, Artificial Sequence
  Description of Artificial Sequence: Synthetic oligonucleotide
cccaagatcacaagtaacttgctcgcctatctg

SEQ ID NO: 305155 - DNA, 33 bp, Artificial Sequence
  Description of Artificial Sequence: Synthetic oligonucleotide
ccaagatcacaagtaacttgctcgcctatctgg

SEQ ID NO: 305156 - DNA, 33 bp, Artificial Sequence
  Description of Artificial Sequence: Synthetic oligonucleotide
caagatcacaagtaacttgctcgcctatctggg

SEQ ID NO: 305157 - DNA, 33 bp, Artificial Sequence
  Description of Artificial Sequence: Synthetic oligonucleotide
aagatcacaagtaacttgctcgcctatctgggg

SEQ ID NO: 305158 - DNA, 32 bp, Artificial Sequence
  Description of Artificial Sequence: Synthetic oligonucleotide
agatcacaagtaacttgctcgcctatctgggg

SEQ ID NO: 305159 - DNA, 31 bp, Artificial Sequence
  Description of Artificial Sequence: Synthetic oligonucleotide
gatcacaagtaacttgctcgcctatctgggg

SEQ ID NO: 305160 - DNA, 31 bp, Artificial Sequence
  Description of Artificial Sequence: Synthetic oligonucleotide
atcacaagtaacttgctcgcctatctggggg

SEQ ID NO: 305161 - DNA, 30 bp, Artificial Sequence
  Description of Artificial Sequence: Synthetic oligonucleotide
tcacaagtaacttgctcgcctatctggggg

SEQ ID NO: 305162 - DNA, 29 bp, Artificial Sequence
  Description of Artificial Sequence: Synthetic oligonucleotide
cacaagtaacttgctcgcctatctggggg

SEQ ID NO: 305163 - DNA, 34 bp, Artificial Sequence
  Description of Artificial Sequence: Synthetic oligonucleotide
acaagtaacttgctcgcctatctgggggataatg

SEQ ID NO: 305164 - DNA, 33 bp, Artificial Sequence
  Description of Artificial Sequence: Synthetic oligonucleotide
caagtaacttgctcgcctatctgggggataatg

SEQ ID NO: 305165 - DNA, 33 bp, Artificial Sequence
  Description of Artificial Sequence: Synthetic oligonucleotide
aagtaacttgctcgcctatctgggggataatgc

SEQ ID NO: 305166 - DNA, 32 bp, Artificial Sequence
  Description of Artificial Sequence: Synthetic oligonucleotide
agtaacttgctcgcctatctgggggataatgc

SEQ ID NO: 305167 - DNA, 31 bp, Artificial Sequence
  Description of Artificial Sequence: Synthetic oligonucleotide
gtaacttgctcgcctatctgggggataatgc

SEQ ID NO: 305168 - DNA, 32 bp, Artificial Sequence
  Description of Artificial Sequence: Synthetic oligonucleotide
taacttgctcgcctatctgggggataatgcag

SEQ ID NO: 305169 - DNA, 31 bp, Artificial Sequence
  Description of Artificial Sequence: Synthetic oligonucleotide
aacttgctcgcctatctgggggataatgcag

SEQ ID NO: 305170 - DNA, 30 bp, Artificial Sequence
  Description of Artificial Sequence: Synthetic oligonucleotide
acttgctcgcctatctgggggataatgcag

SEQ ID NO: 305171 - DNA, 29 bp, Artificial Sequence
  Description of Artificial Sequence: Synthetic oligonucleotide
cttgctcgcctatctgggggataatgcag

SEQ ID NO: 305172 - DNA, 30 bp, Artificial Sequence
  Description of Artificial Sequence: Synthetic oligonucleotide
ttgctcgcctatctgggggataatgcagag

SEQ ID NO: 305173 - DNA, 29 bp, Artificial Sequence
  Description of Artificial Sequence: Synthetic oligonucleotide
tgctcgcctatctgggggataatgcagag

SEQ ID NO: 305174 - DNA, 28 bp, Artificial Sequence
  Description of Artificial Sequence: Synthetic oligonucleotide
gctcgcctatctgggggataatgcagag

SEQ ID NO: 305175 - DNA, 28 bp, Artificial Sequence
  Description of Artificial Sequence: Synthetic oligonucleotide
ctcgcctatctgggggataatgcagagc

SEQ ID NO: 305176 - DNA, 29 bp, Artificial Sequence
  Description of Artificial Sequence: Synthetic oligonucleotide
tcgcctatctgggggataatgcagagctc

SEQ ID NO: 305177 - DNA, 28 bp, Artificial Sequence
  Description of Artificial Sequence: Synthetic oligonucleotide
cgcctatctgggggataatgcagagctc

SEQ ID NO: 305178 - DNA, 31 bp, Artificial Sequence
  Description of Artificial Sequence: Synthetic oligonucleotide
gcctatctgggggataatgcagagctcaaag

SEQ ID NO: 305179 - DNA, 32 bp, Artificial Sequence
  Description of Artificial Sequence: Synthetic oligonucleotide
cctatctgggggataatgcagagctcaaagag

SEQ ID NO: 305180 - DNA, 34 bp, Artificial Sequence
  Description of Artificial Sequence: Synthetic oligonucleotide
ctatctgggggataatgcagagctcaaagagaag

SEQ ID NO: 305181 - DNA, 36 bp, Artificial Sequence
  Description of Artificial Sequence: Synthetic oligonucleotide
tatctgggggataatgcagagctcaaagagaagatg

SEQ ID NO: 305182 - DNA, 35 bp, Artificial Sequence
  Description of Artificial Sequence: Synthetic oligonucleotide
atctgggggataatgcagagctcaaagagaagatg

SEQ ID NO: 305183 - DNA, 34 bp, Artificial Sequence
  Description of Artificial Sequence: Synthetic oligonucleotide
tctgggggataatgcagagctcaaagagaagatg

SEQ ID NO: 305184 - DNA, 33 bp, Artificial Sequence
  Description of Artificial Sequence: Synthetic oligonucleotide
ctgggggataatgcagagctcaaagagaagatg

SEQ ID NO: 305185 - DNA, 34 bp, Artificial Sequence
  Description of Artificial Sequence: Synthetic oligonucleotide
tgggggataatgcagagctcaaagagaagatgac

SEQ ID NO: 305186 - DNA, 33 bp, Artificial Sequence
  Description of Artificial Sequence: Synthetic oligonucleotide
gggggataatgcagagctcaaagagaagatgac

SEQ ID NO: 305187 - DNA, 35 bp, Artificial Sequence
  Description of Artificial Sequence: Synthetic oligonucleotide
ggggataatgcagagctcaaagagaagatgactac

SEQ ID NO: 305188 - DNA, 37 bp, Artificial Sequence
  Description of Artificial Sequence: Synthetic oligonucleotide
gggataatgcagagctcaaagagaagatgactacttg

SEQ ID NO: 305189 - DNA, 37 bp, Artificial Sequence
  Description of Artificial Sequence: Synthetic oligonucleotide
ggataatgcagagctcaaagagaagatgactacttgg

SEQ ID NO: 305190 - DNA, 38 bp, Artificial Sequence
  Description of Artificial Sequence: Synthetic oligonucleotide
gataatgcagagctcaaagagaagatgactacttggac

SEQ ID NO: 305191 - DNA, 39 bp, Artificial Sequence
  Description of Artificial Sequence: Synthetic oligonucleotide
ataatgcagagctcaaagagaagatgactacttggactc

SEQ ID NO: 305192 - DNA, 38 bp, Artificial Sequence
  Description of Artificial Sequence: Synthetic oligonucleotide
taatgcagagctcaaagagaagatgactacttggactc

SEQ ID NO: 305193 - DNA, 37 bp, Artificial Sequence
  Description of Artificial Sequence: Synthetic oligonucleotide
aatgcagagctcaaagagaagatgactacttggactc

SEQ ID NO: 305194 - DNA, 36 bp, Artificial Sequence
  Description of Artificial Sequence: Synthetic oligonucleotide
atgcagagctcaaagagaagatgactacttggactc

SEQ ID NO: 305195 - DNA, 35 bp, Artificial Sequence
  Description of Artificial Sequence: Synthetic oligonucleotide
tgcagagctcaaagagaagatgactacttggactc

SEQ ID NO: 305196 - DNA, 34 bp, Artificial Sequence
  Description of Artificial Sequence: Synthetic oligonucleotide
gcagagctcaaagagaagatgactacttggactc

SEQ ID NO: 305197 - DNA, 35 bp, Artificial Sequence
  Description of Artificial Sequence: Synthetic oligonucleotide
cagagctcaaagagaagatgactacttggactctc

SEQ ID NO: 305198 - DNA, 35 bp, Artificial Sequence
  Description of Artificial Sequence: Synthetic oligonucleotide
agagctcaaagagaagatgactacttggactctcg

SEQ ID NO: 305199 - DNA, 34 bp, Artificial Sequence
  Description of Artificial Sequence: Synthetic oligonucleotide
gagctcaaagagaagatgactacttggactctcg

SEQ ID NO: 305200 - DNA, 35 bp, Artificial Sequence
  Description of Artificial Sequence: Synthetic oligonucleotide
agctcaaagagaagatgactacttggactctcgag

SEQ ID NO: 305201 - DNA, 34 bp, Artificial Sequence
  Description of Artificial Sequence: Synthetic oligonucleotide
gctcaaagagaagatgactacttggactctcgag

SEQ ID NO: 305202 - DNA, 37 bp, Artificial Sequence
  Description of Artificial Sequence: Synthetic oligonucleotide
ctcaaagagaagatgactacttggactctcgagaaag

SEQ ID NO: 305203 - DNA, 37 bp, Artificial Sequence
  Description of Artificial Sequence: Synthetic oligonucleotide
tcaaagagaagatgactacttggactctcgagaaagg

SEQ ID NO: 305204 - DNA, 36 bp, Artificial Sequence
  Description of Artificial Sequence: Synthetic oligonucleotide
caaagagaagatgactacttggactctcgagaaagg

SEQ ID NO: 305205 - DNA, 39 bp, Artificial Sequence
  Description of Artificial Sequence: Synthetic oligonucleotide
aaagagaagatgactacttggactctcgagaaaggaaac

SEQ ID NO: 305206 - DNA, 38 bp, Artificial Sequence
  Description of Artificial Sequence: Synthetic oligonucleotide
aagagaagatgactacttggactctcgagaaaggaaac

SEQ ID NO: 305207 - DNA, 37 bp, Artificial Sequence
  Description of Artificial Sequence: Synthetic oligonucleotide
agagaagatgactacttggactctcgagaaaggaaac

SEQ ID NO: 305208 - DNA, 36 bp, Artificial Sequence
  Description of Artificial Sequence: Synthetic oligonucleotide
gagaagatgactacttggactctcgagaaaggaaac

SEQ ID NO: 305209 - DNA, 36 bp, Artificial Sequence
  Description of Artificial Sequence: Synthetic oligonucleotide
agaagatgactacttggactctcgagaaaggaaacc

SEQ ID NO: 305210 - DNA, 35 bp, Artificial Sequence
  Description of Artificial Sequence: Synthetic oligonucleotide
gaagatgactacttggactctcgagaaaggaaacc

SEQ ID NO: 305211 - DNA, 35 bp, Artificial Sequence
  Description of Artificial Sequence: Synthetic oligonucleotide
aagatgactacttggactctcgagaaaggaaaccc

SEQ ID NO: 305212 - DNA, 34 bp, Artificial Sequence
  Description of Artificial Sequence: Synthetic oligonucleotide
agatgactacttggactctcgagaaaggaaaccc

SEQ ID NO: 305213 - DNA, 33 bp, Artificial Sequence
  Description of Artificial Sequence: Synthetic oligonucleotide
gatgactacttggactctcgagaaaggaaaccc

SEQ ID NO: 305214 - DNA, 33 bp, Artificial Sequence
  Description of Artificial Sequence: Synthetic oligonucleotide
atgactacttggactctcgagaaaggaaacccc

SEQ ID NO: 305215 - DNA, 32 bp, Artificial Sequence
  Description of Artificial Sequence: Synthetic oligonucleotide
tgactacttggactctcgagaaaggaaacccc

SEQ ID NO: 305216 - DNA, 31 bp, Artificial Sequence
  Description of Artificial Sequence: Synthetic oligonucleotide
gactacttggactctcgagaaaggaaacccc

SEQ ID NO: 305217 - DNA, 31 bp, Artificial Sequence
  Description of Artificial Sequence: Synthetic oligonucleotide
actacttggactctcgagaaaggaaaccccc

SEQ ID NO: 305218 - DNA, 30 bp, Artificial Sequence
  Description of Artificial Sequence: Synthetic oligonucleotide
ctacttggactctcgagaaaggaaaccccc

SEQ ID NO: 305219 - DNA, 31 bp, Artificial Sequence
  Description of Artificial Sequence: Synthetic oligonucleotide
tacttggactctcgagaaaggaaaccccctg

SEQ ID NO: 305220 - DNA, 30 bp, Artificial Sequence
  Description of Artificial Sequence: Synthetic oligonucleotide
acttggactctcgagaaaggaaaccccctg

SEQ ID NO: 305221 - DNA, 29 bp, Artificial Sequence
  Description of Artificial Sequence: Synthetic oligonucleotide
cttggactctcgagaaaggaaaccccctg

SEQ ID NO: 305222 - DNA, 29 bp, Artificial Sequence
  Description of Artificial Sequence: Synthetic oligonucleotide
ttggactctcgagaaaggaaaccccctgc

SEQ ID NO: 305223 - DNA, 28 bp, Artificial Sequence
  Description of Artificial Sequence: Synthetic oligonucleotide
tggactctcgagaaaggaaaccccctgc

SEQ ID NO: 305224 - DNA, 27 bp, Artificial Sequence
  Description of Artificial Sequence: Synthetic oligonucleotide
ggactctcgagaaaggaaaccccctgc

SEQ ID NO: 305225 - DNA, 28 bp, Artificial Sequence
  Description of Artificial Sequence: Synthetic oligonucleotide
gactctcgagaaaggaaaccccctgctc

SEQ ID NO: 305226 - DNA, 28 bp, Artificial Sequence
  Description of Artificial Sequence: Synthetic oligonucleotide
actctcgagaaaggaaaccccctgctcg

SEQ ID NO: 305227 - DNA, 27 bp, Artificial Sequence
  Description of Artificial Sequence: Synthetic oligonucleotide
ctctcgagaaaggaaaccccctgctcg

SEQ ID NO: 305228 - DNA, 28 bp, Artificial Sequence
  Description of Artificial Sequence: Synthetic oligonucleotide
tctcgagaaaggaaaccccctgctcgtg

SEQ ID NO: 305229 - DNA, 27 bp, Artificial Sequence
  Description of Artificial Sequence: Synthetic oligonucleotide
ctcgagaaaggaaaccccctgctcgtg

SEQ ID NO: 305230 - DNA, 27 bp, Artificial Sequence
  Description of Artificial Sequence: Synthetic oligonucleotide
tcgagaaaggaaaccccctgctcgtgg

SEQ ID NO: 305231 - DNA, 27 bp, Artificial Sequence
  Description of Artificial Sequence: Synthetic oligonucleotide
cgagaaaggaaaccccctgctcgtggt

SEQ ID NO: 305232 - DNA, 31 bp, Artificial Sequence
  Description of Artificial Sequence: Synthetic oligonucleotide
gagaaaggaaaccccctgctcgtggttaaag

SEQ ID NO: 305233 - DNA, 33 bp, Artificial Sequence
  Description of Artificial Sequence: Synthetic oligonucleotide
agaaaggaaaccccctgctcgtggttaaagaag

SEQ ID NO: 305234 - DNA, 32 bp, Artificial Sequence
  Description of Artificial Sequence: Synthetic oligonucleotide
gaaaggaaaccccctgctcgtggttaaagaag

SEQ ID NO: 305235 - DNA, 33 bp, Artificial Sequence
  Description of Artificial Sequence: Synthetic oligonucleotide
aaaggaaaccccctgctcgtggttaaagaagac

SEQ ID NO: 305236 - DNA, 32 bp, Artificial Sequence
  Description of Artificial Sequence: Synthetic oligonucleotide
aaggaaaccccctgctcgtggttaaagaagac

SEQ ID NO: 305237 - DNA, 31 bp, Artificial Sequence
  Description of Artificial Sequence: Synthetic oligonucleotide
aggaaaccccctgctcgtggttaaagaagac

SEQ ID NO: 305238 - DNA, 30 bp, Artificial Sequence
  Description of Artificial Sequence: Synthetic oligonucleotide
ggaaaccccctgctcgtggttaaagaagac

SEQ ID NO: 305239 - DNA, 30 bp, Artificial Sequence
  Description of Artificial Sequence: Synthetic oligonucleotide
gaaaccccctgctcgtggttaaagaagacg

SEQ ID NO: 305240 - DNA, 30 bp, Artificial Sequence
  Description of Artificial Sequence: Synthetic oligonucleotide
aaaccccctgctcgtggttaaagaagacgg

SEQ ID NO: 305241 - DNA, 29 bp, Artificial Sequence
  Description of Artificial Sequence: Synthetic oligonucleotide
aaccccctgctcgtggttaaagaagacgg

SEQ ID NO: 305242 - DNA, 28 bp, Artificial Sequence
  Description of Artificial Sequence: Synthetic oligonucleotide
accccctgctcgtggttaaagaagacgg

SEQ ID NO: 305243 - DNA, 27 bp, Artificial Sequence
  Description of Artificial Sequence: Synthetic oligonucleotide
ccccctgctcgtggttaaagaagacgg

SEQ ID NO: 305244 - DNA, 27 bp, Artificial Sequence
  Description of Artificial Sequence: Synthetic oligonucleotide
cccctgctcgtggttaaagaagacggg

SEQ ID NO: 305245 - DNA, 28 bp, Artificial Sequence
  Description of Artificial Sequence: Synthetic oligonucleotide
ccctgctcgtggttaaagaagacgggtc

SEQ ID NO: 305246 - DNA, 30 bp, Artificial Sequence
  Description of Artificial Sequence: Synthetic oligonucleotide
cctgctcgtggttaaagaagacgggtcttc

SEQ ID NO: 305247 - DNA, 31 bp, Artificial Sequence
  Description of Artificial Sequence: Synthetic oligonucleotide
ctgctcgtggttaaagaagacgggtcttcac

SEQ ID NO: 305248 - DNA, 32 bp, Artificial Sequence
  Description of Artificial Sequence: Synthetic oligonucleotide
tgctcgtggttaaagaagacgggtcttcactc

SEQ ID NO: 305249 - DNA, 31 bp, Artificial Sequence
  Description of Artificial Sequence: Synthetic oligonucleotide
gctcgtggttaaagaagacgggtcttcactc

SEQ ID NO: 305250 - DNA, 31 bp, Artificial Sequence
  Description of Artificial Sequence: Synthetic oligonucleotide
ctcgtggttaaagaagacgggtcttcactcc

SEQ ID NO: 305251 - DNA, 31 bp, Artificial Sequence
  Description of Artificial Sequence: Synthetic oligonucleotide
tcgtggttaaagaagacgggtcttcactccg

SEQ ID NO: 305252 - DNA, 30 bp, Artificial Sequence
  Description of Artificial Sequence: Synthetic oligonucleotide
cgtggttaaagaagacgggtcttcactccg

SEQ ID NO: 305253 - DNA, 31 bp, Artificial Sequence
  Description of Artificial Sequence: Synthetic oligonucleotide
gtggttaaagaagacgggtcttcactccgtc

SEQ ID NO: 305254 - DNA, 32 bp, Artificial Sequence
  Description of Artificial Sequence: Synthetic oligonucleotide
tggttaaagaagacgggtcttcactccgtctg

SEQ ID NO: 305255 - DNA, 31 bp, Artificial Sequence
  Description of Artificial Sequence: Synthetic oligonucleotide
ggttaaagaagacgggtcttcactccgtctg

SEQ ID NO: 305256 - DNA, 31 bp, Artificial Sequence
  Description of Artificial Sequence: Synthetic oligonucleotide
gttaaagaagacgggtcttcactccgtctgc

SEQ ID NO: 305257 - DNA, 33 bp, Artificial Sequence
  Description of Artificial Sequence: Synthetic oligonucleotide
ttaaagaagacgggtcttcactccgtctgcaac

SEQ ID NO: 305258 - DNA, 32 bp, Artificial Sequence
  Description of Artificial Sequence: Synthetic oligonucleotide
taaagaagacgggtcttcactccgtctgcaac

SEQ ID NO: 305259 - DNA, 31 bp, Artificial Sequence
  Description of Artificial Sequence: Synthetic oligonucleotide
aaagaagacgggtcttcactccgtctgcaac

SEQ ID NO: 305260 - DNA, 30 bp, Artificial Sequence
  Description of Artificial Sequence: Synthetic oligonucleotide
aagaagacgggtcttcactccgtctgcaac

SEQ ID NO: 305261 - DNA, 29 bp, Artificial Sequence
  Description of Artificial Sequence: Synthetic oligonucleotide
agaagacgggtcttcactccgtctgcaac

SEQ ID NO: 305262 - DNA, 28 bp, Artificial Sequence
  Description of Artificial Sequence: Synthetic oligonucleotide
gaagacgggtcttcactccgtctgcaac

SEQ ID NO: 305263 - DNA, 29 bp, Artificial Sequence
  Description of Artificial Sequence: Synthetic oligonucleotide
aagacgggtcttcactccgtctgcaacag

SEQ ID NO: 305264 - DNA, 28 bp, Artificial Sequence
  Description of Artificial Sequence: Synthetic oligonucleotide
agacgggtcttcactccgtctgcaacag

SEQ ID NO: 305265 - DNA, 27 bp, Artificial Sequence
  Description of Artificial Sequence: Synthetic oligonucleotide
gacgggtcttcactccgtctgcaacag

SEQ ID NO: 305266 - DNA, 27 bp, Artificial Sequence
  Description of Artificial Sequence: Synthetic oligonucleotide
acgggtcttcactccgtctgcaacagc

SEQ ID NO: 305267 - DNA, 27 bp, Artificial Sequence
  Description of Artificial Sequence: Synthetic oligonucleotide
cgggtcttcactccgtctgcaacagca

SEQ ID NO: 305268 - DNA, 27 bp, Artificial Sequence
  Description of Artificial Sequence: Synthetic oligonucleotide
gggtcttcactccgtctgcaacagcag

SEQ ID NO: 305269 - DNA, 27 bp, Artificial Sequence
  Description of Artificial Sequence: Synthetic oligonucleotide
ggtcttcactccgtctgcaacagcagc

SEQ ID NO: 305270 - DNA, 27 bp, Artificial Sequence
  Description of Artificial Sequence: Synthetic oligonucleotide
gtcttcactccgtctgcaacagcagcg

SEQ ID NO: 305271 - DNA, 27 bp, Artificial Sequence
  Description of Artificial Sequence: Synthetic oligonucleotide
tcttcactccgtctgcaacagcagcgc

SEQ ID NO: 305272 - DNA, 27 bp, Artificial Sequence
  Description of Artificial Sequence: Synthetic oligonucleotide
cttcactccgtctgcaacagcagcgct

SEQ ID NO: 305273 - DNA, 28 bp, Artificial Sequence
  Description of Artificial Sequence: Synthetic oligonucleotide
ttcactccgtctgcaacagcagcgcttc

SEQ ID NO: 305274 - DNA, 27 bp, Artificial Sequence
  Description of Artificial Sequence: Synthetic oligonucleotide
tcactccgtctgcaacagcagcgcttc

SEQ ID NO: 305275 - DNA, 26 bp, Artificial Sequence
  Description of Artificial Sequence: Synthetic oligonucleotide
cactccgtctgcaacagcagcgcttc

SEQ ID NO: 305276 - DNA, 27 bp, Artificial Sequence
  Description of Artificial Sequence: Synthetic oligonucleotide
actccgtctgcaacagcagcgcttcca

SEQ ID NO: 305277 - DNA, 26 bp, Artificial Sequence
  Description of Artificial Sequence: Synthetic oligonucleotide
ctccgtctgcaacagcagcgcttcca

SEQ ID NO: 305278 - DNA, 26 bp, Artificial Sequence
  Description of Artificial Sequence: Synthetic oligonucleotide
tccgtctgcaacagcagcgcttccac

SEQ ID NO: 305279 - DNA, 25 bp, Artificial Sequence
  Description of Artificial Sequence: Synthetic oligonucleotide
ccgtctgcaacagcagcgcttccac

SEQ ID NO: 305280 - DNA, 26 bp, Artificial Sequence
  Description of Artificial Sequence: Synthetic oligonucleotide
cgtctgcaacagcagcgcttccacca

SEQ ID NO: 305281 - DNA, 26 bp, Artificial Sequence
  Description of Artificial Sequence: Synthetic oligonucleotide
gtctgcaacagcagcgcttccaccag

SEQ ID NO: 305282 - DNA, 26 bp, Artificial Sequence
  Description of Artificial Sequence: Synthetic oligonucleotide
tctgcaacagcagcgcttccaccagg

SEQ ID NO: 305283 - DNA, 25 bp, Artificial Sequence
  Description of Artificial Sequence: Synthetic oligonucleotide
ctgcaacagcagcgcttccaccagg

SEQ ID NO: 305284 - DNA, 25 bp, Artificial Sequence
  Description of Artificial Sequence: Synthetic oligonucleotide
tgcaacagcagcgcttccaccaggg

SEQ ID NO: 305285 - DNA, 24 bp, Artificial Sequence
  Description of Artificial Sequence: Synthetic oligonucleotide
gcaacagcagcgcttccaccaggg

SEQ ID NO: 305286 - DNA, 24 bp, Artificial Sequence
  Description of Artificial Sequence: Synthetic oligonucleotide
caacagcagcgcttccaccagggg

SEQ ID NO: 305287 - DNA, 27 bp, Artificial Sequence
  Description of Artificial Sequence: Synthetic oligonucleotide
aacagcagcgcttccaccagggggtat

SEQ ID NO: 305288 - DNA, 27 bp, Artificial Sequence
  Description of Artificial Sequence: Synthetic oligonucleotide
acagcagcgcttccaccagggggtatt

SEQ ID NO: 305289 - DNA, 26 bp, Artificial Sequence
  Description of Artificial Sequence: Synthetic oligonucleotide
cagcagcgcttccaccagggggtatt

SEQ ID NO: 305290 - DNA, 26 bp, Artificial Sequence
  Description of Artificial Sequence: Synthetic oligonucleotide
agcagcgcttccaccagggggtattc

SEQ ID NO: 305291 - DNA, 25 bp, Artificial Sequence
  Description of Artificial Sequence: Synthetic oligonucleotide
gcagcgcttccaccagggggtattc

SEQ ID NO: 305292 - DNA, 26 bp, Artificial Sequence
  Description of Artificial Sequence: Synthetic oligonucleotide
cagcgcttccaccagggggtattcca

SEQ ID NO: 305293 - DNA, 26 bp, Artificial Sequence
  Description of Artificial Sequence: Synthetic oligonucleotide
agcgcttccaccagggggtattccag

SEQ ID NO: 305294 - DNA, 25 bp, Artificial Sequence
  Description of Artificial Sequence: Synthetic oligonucleotide
gcgcttccaccagggggtattccag

SEQ ID NO: 305295 - DNA, 27 bp, Artificial Sequence
  Description of Artificial Sequence: Synthetic oligonucleotide
cgcttccaccagggggtattccaggaa

SEQ ID NO: 305296 - DNA, 27 bp, Artificial Sequence
  Description of Artificial Sequence: Synthetic oligonucleotide
gcttccaccagggggtattccaggaac

SEQ ID NO: 305297 - DNA, 28 bp, Artificial Sequence
  Description of Artificial Sequence: Synthetic oligonucleotide
cttccaccagggggtattccaggaacac

SEQ ID NO: 305298 - DNA, 28 bp, Artificial Sequence
  Description of Artificial Sequence: Synthetic oligonucleotide
ttccaccagggggtattccaggaacacc

SEQ ID NO: 305299 - DNA, 27 bp, Artificial Sequence
  Description of Artificial Sequence: Synthetic oligonucleotide
tccaccagggggtattccaggaacacc

SEQ ID NO: 305300 - DNA, 26 bp, Artificial Sequence
  Description of Artificial Sequence: Synthetic oligonucleotide
ccaccagggggtattccaggaacacc

SEQ ID NO: 305301 - DNA, 27 bp, Artificial Sequence
  Description of Artificial Sequence: Synthetic oligonucleotide
caccagggggtattccaggaacaccct

SEQ ID NO: 305302 - DNA, 27 bp, Artificial Sequence
  Description of Artificial Sequence: Synthetic oligonucleotide
accagggggtattccaggaacaccctg

SEQ ID NO: 305303 - DNA, 27 bp, Artificial Sequence
  Description of Artificial Sequence: Synthetic oligonucleotide
ccagggggtattccaggaacaccctga

SEQ ID NO: 305304 - DNA, 29 bp, Artificial Sequence
  Description of Artificial Sequence: Synthetic oligonucleotide
cagggggtattccaggaacaccctgaatc

SEQ ID NO: 305305 - DNA, 29 bp, Artificial Sequence
  Description of Artificial Sequence: Synthetic oligonucleotide
agggggtattccaggaacaccctgaatcg

SEQ ID NO: 305306 - DNA, 28 bp, Artificial Sequence
  Description of Artificial Sequence: Synthetic oligonucleotide
gggggtattccaggaacaccctgaatcg

SEQ ID NO: 305307 - DNA, 29 bp, Artificial Sequence
  Description of Artificial Sequence: Synthetic oligonucleotide
ggggtattccaggaacaccctgaatcgag

SEQ ID NO: 305308 - DNA, 29 bp, Artificial Sequence
  Description of Artificial Sequence: Synthetic oligonucleotide
gggtattccaggaacaccctgaatcgagg

SEQ ID NO: 305309 - DNA, 29 bp, Artificial Sequence
  Description of Artificial Sequence: Synthetic oligonucleotide
ggtattccaggaacaccctgaatcgaggg

SEQ ID NO: 305310 - DNA, 29 bp, Artificial Sequence
  Description of Artificial Sequence: Synthetic oligonucleotide
gtattccaggaacaccctgaatcgagggc

SEQ ID NO: 305311 - DNA, 29 bp, Artificial Sequence
  Description of Artificial Sequence: Synthetic oligonucleotide
tattccaggaacaccctgaatcgagggcc

SEQ ID NO: 305312 - DNA, 28 bp, Artificial Sequence
  Description of Artificial Sequence: Synthetic oligonucleotide
attccaggaacaccctgaatcgagggcc

SEQ ID NO: 305313 - DNA, 27 bp, Artificial Sequence
  Description of Artificial Sequence: Synthetic oligonucleotide
ttccaggaacaccctgaatcgagggcc

SEQ ID NO: 305314 - DNA, 26 bp, Artificial Sequence
  Description of Artificial Sequence: Synthetic oligonucleotide
tccaggaacaccctgaatcgagggcc

SEQ ID NO: 305315 - DNA, 25 bp, Artificial Sequence
  Description of Artificial Sequence: Synthetic oligonucleotide
ccaggaacaccctgaatcgagggcc

SEQ ID NO: 305316 - DNA, 26 bp, Artificial Sequence
  Description of Artificial Sequence: Synthetic oligonucleotide
caggaacaccctgaatcgagggccct

SEQ ID NO: 305317 - DNA, 26 bp, Artificial Sequence
  Description of Artificial Sequence: Synthetic oligonucleotide
aggaacaccctgaatcgagggccctc

SEQ ID NO: 305318 - DNA, 25 bp, Artificial Sequence
  Description of Artificial Sequence: Synthetic oligonucleotide
ggaacaccctgaatcgagggccctc

SEQ ID NO: 305319 - DNA, 26 bp, Artificial Sequence
  Description of Artificial Sequence: Synthetic oligonucleotide
gaacaccctgaatcgagggccctcca

SEQ ID NO: 305320 - DNA, 26 bp, Artificial Sequence
  Description of Artificial Sequence: Synthetic oligonucleotide
aacaccctgaatcgagggccctccag

SEQ ID NO: 305321 - DNA, 25 bp, Artificial Sequence
  Description of Artificial Sequence: Synthetic oligonucleotide
acaccctgaatcgagggccctccag

SEQ ID NO: 305322 - DNA, 24 bp, Artificial Sequence
  Description of Artificial Sequence: Synthetic oligonucleotide
caccctgaatcgagggccctccag

SEQ ID NO: 305323 - DNA, 25 bp, Artificial Sequence
  Description of Artificial Sequence: Synthetic oligonucleotide
accctgaatcgagggccctccagga

SEQ ID NO: 305324 - DNA, 24 bp, Artificial Sequence
  Description of Artificial Sequence: Synthetic oligonucleotide
ccctgaatcgagggccctccagga

SEQ ID NO: 305325 - DNA, 25 bp, Artificial Sequence
  Description of Artificial Sequence: Synthetic oligonucleotide
cctgaatcgagggccctccaggaga

SEQ ID NO: 305326 - DNA, 25 bp, Artificial Sequence
  Description of Artificial Sequence: Synthetic oligonucleotide
ctgaatcgagggccctccaggagag

SEQ ID NO: 305327 - DNA, 27 bp, Artificial Sequence
  Description of Artificial Sequence: Synthetic oligonucleotide
tgaatcgagggccctccaggagaggaa

SEQ ID NO: 305328 - DNA, 26 bp, Artificial Sequence
  Description of Artificial Sequence: Synthetic oligonucleotide
gaatcgagggccctccaggagaggaa

SEQ ID NO: 305329 - DNA, 26 bp, Artificial Sequence
  Description of Artificial Sequence: Synthetic oligonucleotide
aatcgagggccctccaggagaggaac

SEQ ID NO: 305330 - DNA, 25 bp, Artificial Sequence
  Description of Artificial Sequence: Synthetic oligonucleotide
atcgagggccctccaggagaggaac

SEQ ID NO: 305331 - DNA, 24 bp, Artificial Sequence
  Description of Artificial Sequence: Synthetic oligonucleotide
tcgagggccctccaggagaggaac

SEQ ID NO: 305332 - DNA, 23 bp, Artificial Sequence
  Description of Artificial Sequence: Synthetic oligonucleotide
cgagggccctccaggagaggaac

SEQ ID NO: 305333 - DNA, 24 bp, Artificial Sequence
  Description of Artificial Sequence: Synthetic oligonucleotide
gagggccctccaggagaggaacct

SEQ ID NO: 305334 - DNA, 25 bp, Artificial Sequence
  Description of Artificial Sequence: Synthetic oligonucleotide
agggccctccaggagaggaacctgt

SEQ ID NO: 305335 - DNA, 24 bp, Artificial Sequence
  Description of Artificial Sequence: Synthetic oligonucleotide
gggccctccaggagaggaacctgt

SEQ ID NO: 305336 - DNA, 24 bp, Artificial Sequence
  Description of Artificial Sequence: Synthetic oligonucleotide
ggccctccaggagaggaacctgtg

SEQ ID NO: 305337 - DNA, 24 bp, Artificial Sequence
  Description of Artificial Sequence: Synthetic oligonucleotide
gccctccaggagaggaacctgtgg

SEQ ID NO: 305338 - DNA, 27 bp, Artificial Sequence
  Description of Artificial Sequence: Synthetic oligonucleotide
ccctccaggagaggaacctgtggctta

SEQ ID NO: 305339 - DNA, 28 bp, Artificial Sequence
  Description of Artificial Sequence: Synthetic oligonucleotide
cctccaggagaggaacctgtggcttatc

SEQ ID NO: 305340 - DNA, 28 bp, Artificial Sequence
  Description of Artificial Sequence: Synthetic oligonucleotide
ctccaggagaggaacctgtggcttatcc

SEQ ID NO: 305341 - DNA, 28 bp, Artificial Sequence
  Description of Artificial Sequence: Synthetic oligonucleotide
tccaggagaggaacctgtggcttatccc

SEQ ID NO: 305342 - DNA, 27 bp, Artificial Sequence
  Description of Artificial Sequence: Synthetic oligonucleotide
ccaggagaggaacctgtggcttatccc

SEQ ID NO: 305343 - DNA, 30 bp, Artificial Sequence
  Description of Artificial Sequence: Synthetic oligonucleotide
caggagaggaacctgtggcttatcccattc

SEQ ID NO: 305344 - DNA, 31 bp, Artificial Sequence
  Description of Artificial Sequence: Synthetic oligonucleotide
aggagaggaacctgtggcttatcccattcac

SEQ ID NO: 305345 - DNA, 30 bp, Artificial Sequence
  Description of Artificial Sequence: Synthetic oligonucleotide
ggagaggaacctgtggcttatcccattcac

SEQ ID NO: 305346 - DNA, 30 bp, Artificial Sequence
  Description of Artificial Sequence: Synthetic oligonucleotide
gagaggaacctgtggcttatcccattcacc

SEQ ID NO: 305347 - DNA, 32 bp, Artificial Sequence
  Description of Artificial Sequence: Synthetic oligonucleotide
agaggaacctgtggcttatcccattcacctac

SEQ ID NO: 305348 - DNA, 31 bp, Artificial Sequence
  Description of Artificial Sequence: Synthetic oligonucleotide
gaggaacctgtggcttatcccattcacctac

SEQ ID NO: 305349 - DNA, 32 bp, Artificial Sequence
  Description of Artificial Sequence: Synthetic oligonucleotide
aggaacctgtggcttatcccattcacctactc

SEQ ID NO: 305350 - DNA, 31 bp, Artificial Sequence
  Description of Artificial Sequence: Synthetic oligonucleotide
ggaacctgtggcttatcccattcacctactc

SEQ ID NO: 305351 - DNA, 31 bp, Artificial Sequence
  Description of Artificial Sequence: Synthetic oligonucleotide
gaacctgtggcttatcccattcacctactcc

SEQ ID NO: 305352 - DNA, 32 bp, Artificial Sequence
  Description of Artificial Sequence: Synthetic oligonucleotide
aacctgtggcttatcccattcacctactcctc

SEQ ID NO: 305353 - DNA, 31 bp, Artificial Sequence
  Description of Artificial Sequence: Synthetic oligonucleotide
acctgtggcttatcccattcacctactcctc

SEQ ID NO: 305354 - DNA, 30 bp, Artificial Sequence
  Description of Artificial Sequence: Synthetic oligonucleotide
cctgtggcttatcccattcacctactcctc

SEQ ID NO: 305355 - DNA, 30 bp, Artificial Sequence
  Description of Artificial Sequence: Synthetic oligonucleotide
ctgtggcttatcccattcacctactcctcg

SEQ ID NO: 305356 - DNA, 31 bp, Artificial Sequence
  Description of Artificial Sequence: Synthetic oligonucleotide
tgtggcttatcccattcacctactcctcgag

SEQ ID NO: 305357 - DNA, 30 bp, Artificial Sequence
  Description of Artificial Sequence: Synthetic oligonucleotide
gtggcttatcccattcacctactcctcgag

SEQ ID NO: 305358 - DNA, 32 bp, Artificial Sequence
  Description of Artificial Sequence: Synthetic oligonucleotide
tggcttatcccattcacctactcctcgagttc

SEQ ID NO: 305359 - DNA, 31 bp, Artificial Sequence
  Description of Artificial Sequence: Synthetic oligonucleotide
ggcttatcccattcacctactcctcgagttc

SEQ ID NO: 305360 - DNA, 33 bp, Artificial Sequence
  Description of Artificial Sequence: Synthetic oligonucleotide
gcttatcccattcacctactcctcgagttcttg

SEQ ID NO: 305361 - DNA, 37 bp, Artificial Sequence
  Description of Artificial Sequence: Synthetic oligonucleotide
cttatcccattcacctactcctcgagttcttgtaatg

SEQ ID NO: 305362 - DNA, 38 bp, Artificial Sequence
  Description of Artificial Sequence: Synthetic oligonucleotide
ttatcccattcacctactcctcgagttcttgtaatgtg

SEQ ID NO: 305363 - DNA, 37 bp, Artificial Sequence
  Description of Artificial Sequence: Synthetic oligonucleotide
tatcccattcacctactcctcgagttcttgtaatgtg

SEQ ID NO: 305364 - DNA, 36 bp, Artificial Sequence
  Description of Artificial Sequence: Synthetic oligonucleotide
atcccattcacctactcctcgagttcttgtaatgtg

SEQ ID NO: 305365 - DNA, 35 bp, Artificial Sequence
  Description of Artificial Sequence: Synthetic oligonucleotide
tcccattcacctactcctcgagttcttgtaatgtg

SEQ ID NO: 305366 - DNA, 34 bp, Artificial Sequence
  Description of Artificial Sequence: Synthetic oligonucleotide
cccattcacctactcctcgagttcttgtaatgtg

SEQ ID NO: 305367 - DNA, 36 bp, Artificial Sequence
  Description of Artificial Sequence: Synthetic oligonucleotide
ccattcacctactcctcgagttcttgtaatgtgatg

SEQ ID NO: 305368 - DNA, 36 bp, Artificial Sequence
  Description of Artificial Sequence: Synthetic oligonucleotide
cattcacctactcctcgagttcttgtaatgtgatgc

SEQ ID NO: 305369 - DNA, 37 bp, Artificial Sequence
  Description of Artificial Sequence: Synthetic oligonucleotide
attcacctactcctcgagttcttgtaatgtgatgcac

SEQ ID NO: 305370 - DNA, 36 bp, Artificial Sequence
  Description of Artificial Sequence: Synthetic oligonucleotide
ttcacctactcctcgagttcttgtaatgtgatgcac

SEQ ID NO: 305371 - DNA, 35 bp, Artificial Sequence
  Description of Artificial Sequence: Synthetic oligonucleotide
tcacctactcctcgagttcttgtaatgtgatgcac

SEQ ID NO: 305372 - DNA, 34 bp, Artificial Sequence
  Description of Artificial Sequence: Synthetic oligonucleotide
cacctactcctcgagttcttgtaatgtgatgcac

SEQ ID NO: 305373 - DNA, 35 bp, Artificial Sequence
  Description of Artificial Sequence: Synthetic oligonucleotide
acctactcctcgagttcttgtaatgtgatgcacag

SEQ ID NO: 305374 - DNA, 34 bp, Artificial Sequence
  Description of Artificial Sequence: Synthetic oligonucleotide
cctactcctcgagttcttgtaatgtgatgcacag

SEQ ID NO: 305375 - DNA, 35 bp, Artificial Sequence
  Description of Artificial Sequence: Synthetic oligonucleotide
ctactcctcgagttcttgtaatgtgatgcacagac

SEQ ID NO: 305376 - DNA, 36 bp, Artificial Sequence
  Description of Artificial Sequence: Synthetic oligonucleotide
tactcctcgagttcttgtaatgtgatgcacagacac

SEQ ID NO: 305377 - DNA, 35 bp, Artificial Sequence
  Description of Artificial Sequence: Synthetic oligonucleotide
actcctcgagttcttgtaatgtgatgcacagacac

SEQ ID NO: 305378 - DNA, 34 bp, Artificial Sequence
  Description of Artificial Sequence: Synthetic oligonucleotide
ctcctcgagttcttgtaatgtgatgcacagacac

SEQ ID NO: 305379 - DNA, 37 bp, Artificial Sequence
  Description of Artificial Sequence: Synthetic oligonucleotide
tcctcgagttcttgtaatgtgatgcacagacactttc

SEQ ID NO: 305380 - DNA, 36 bp, Artificial Sequence
  Description of Artificial Sequence: Synthetic oligonucleotide
cctcgagttcttgtaatgtgatgcacagacactttc

SEQ ID NO: 305381 - DNA, 42 bp, Artificial Sequence
  Description of Artificial Sequence: Synthetic oligonucleotide
ctcgagttcttgtaatgtgatgcacagacactttctaaaatg

SEQ ID NO: 305382 - DNA, 45 bp, Artificial Sequence
  Description of Artificial Sequence: Synthetic oligonucleotide
tcgagttcttgtaatgtgatgcacagacactttctaaaatgaaag

SEQ ID NO: 305383 - DNA, 44 bp, Artificial Sequence
  Description of Artificial Sequence: Synthetic oligonucleotide
cgagttcttgtaatgtgatgcacagacactttctaaaatgaaag

SEQ ID NO: 305384 - DNA, 45 bp, Artificial Sequence
  Description of Artificial Sequence: Synthetic oligonucleotide
gagttcttgtaatgtgatgcacagacactttctaaaatgaaagac

SEQ ID NO: 305385 - DNA, 46 bp, Artificial Sequence
  Description of Artificial Sequence: Synthetic oligonucleotide
agttcttgtaatgtgatgcacagacactttctaaaatgaaagacag

SEQ ID NO: 305386 - DNA, 45 bp, Artificial Sequence
  Description of Artificial Sequence: Synthetic oligonucleotide
gttcttgtaatgtgatgcacagacactttctaaaatgaaagacag

SEQ ID NO: 305387 - DNA, 48 bp, Artificial Sequence
  Description of Artificial Sequence: Synthetic oligonucleotide
ttcttgtaatgtgatgcacagacactttctaaaatgaaagacagaaac

SEQ ID NO: 305388 - DNA, 47 bp, Artificial Sequence
  Description of Artificial Sequence: Synthetic oligonucleotide
tcttgtaatgtgatgcacagacactttctaaaatgaaagacagaaac

SEQ ID NO: 305389 - DNA, 46 bp, Artificial Sequence
  Description of Artificial Sequence: Synthetic oligonucleotide
cttgtaatgtgatgcacagacactttctaaaatgaaagacagaaac

SEQ ID NO: 305390 - DNA, 47 bp, Artificial Sequence
  Description of Artificial Sequence: Synthetic oligonucleotide
ttgtaatgtgatgcacagacactttctaaaatgaaagacagaaactc

SEQ ID NO: 305391 - DNA, 46 bp, Artificial Sequence
  Description of Artificial Sequence: Synthetic oligonucleotide
tgtaatgtgatgcacagacactttctaaaatgaaagacagaaactc

SEQ ID NO: 305392 - DNA, 45 bp, Artificial Sequence
  Description of Artificial Sequence: Synthetic oligonucleotide
gtaatgtgatgcacagacactttctaaaatgaaagacagaaactc

SEQ ID NO: 305393 - DNA, 46 bp, Artificial Sequence
  Description of Artificial Sequence: Synthetic oligonucleotide
taatgtgatgcacagacactttctaaaatgaaagacagaaactctg

SEQ ID NO: 305394 - DNA, 45 bp, Artificial Sequence
  Description of Artificial Sequence: Synthetic oligonucleotide
aatgtgatgcacagacactttctaaaatgaaagacagaaactctg

SEQ ID NO: 305395 - DNA, 44 bp, Artificial Sequence
  Description of Artificial Sequence: Synthetic oligonucleotide
atgtgatgcacagacactttctaaaatgaaagacagaaactctg

SEQ ID NO: 305396 - DNA, 43 bp, Artificial Sequence
  Description of Artificial Sequence: Synthetic oligonucleotide
tgtgatgcacagacactttctaaaatgaaagacagaaactctg

SEQ ID NO: 305397 - DNA, 42 bp, Artificial Sequence
  Description of Artificial Sequence: Synthetic oligonucleotide
gtgatgcacagacactttctaaaatgaaagacagaaactctg

SEQ ID NO: 305398 - DNA, 42 bp, Artificial Sequence
  Description of Artificial Sequence: Synthetic oligonucleotide
tgatgcacagacactttctaaaatgaaagacagaaactctgg

SEQ ID NO: 305399 - DNA, 41 bp, Artificial Sequence
  Description of Artificial Sequence: Synthetic oligonucleotide
gatgcacagacactttctaaaatgaaagacagaaactctgg

SEQ ID NO: 305400 - DNA, 43 bp, Artificial Sequence
  Description of Artificial Sequence: Synthetic oligonucleotide
atgcacagacactttctaaaatgaaagacagaaactctggatg

SEQ ID NO: 305401 - DNA, 42 bp, Artificial Sequence
  Description of Artificial Sequence: Synthetic oligonucleotide
tgcacagacactttctaaaatgaaagacagaaactctggatg

SEQ ID NO: 305402 - DNA, 41 bp, Artificial Sequence
  Description of Artificial Sequence: Synthetic oligonucleotide
gcacagacactttctaaaatgaaagacagaaactctggatg

SEQ ID NO: 305403 - DNA, 43 bp, Artificial Sequence
  Description of Artificial Sequence: Synthetic oligonucleotide
cacagacactttctaaaatgaaagacagaaactctggatgtac

SEQ ID NO: 305404 - DNA, 43 bp, Artificial Sequence
  Description of Artificial Sequence: Synthetic oligonucleotide
acagacactttctaaaatgaaagacagaaactctggatgtacc

SEQ ID NO: 305405 - DNA, 42 bp, Artificial Sequence
  Description of Artificial Sequence: Synthetic oligonucleotide
cagacactttctaaaatgaaagacagaaactctggatgtacc

SEQ ID NO: 305406 - DNA, 43 bp, Artificial Sequence
  Description of Artificial Sequence: Synthetic oligonucleotide
agacactttctaaaatgaaagacagaaactctggatgtacctg

SEQ ID NO: 305407 - DNA, 42 bp, Artificial Sequence
  Description of Artificial Sequence: Synthetic oligonucleotide
gacactttctaaaatgaaagacagaaactctggatgtacctg

SEQ ID NO: 305408 - DNA, 46 bp, Artificial Sequence
  Description of Artificial Sequence: Synthetic oligonucleotide
acactttctaaaatgaaagacagaaactctggatgtacctgaaatg

SEQ ID NO: 305409 - DNA, 45 bp, Artificial Sequence
  Description of Artificial Sequence: Synthetic oligonucleotide
cactttctaaaatgaaagacagaaactctggatgtacctgaaatg

SEQ ID NO: 305410 - DNA, 46 bp, Artificial Sequence
  Description of Artificial Sequence: Synthetic oligonucleotide
actttctaaaatgaaagacagaaactctggatgtacctgaaatgac

SEQ ID NO: 305411 - DNA, 45 bp, Artificial Sequence
  Description of Artificial Sequence: Synthetic oligonucleotide
ctttctaaaatgaaagacagaaactctggatgtacctgaaatgac

SEQ ID NO: 305412 - DNA, 45 bp, Artificial Sequence
  Description of Artificial Sequence: Synthetic oligonucleotide
tttctaaaatgaaagacagaaactctggatgtacctgaaatgacc

SEQ ID NO: 305413 - DNA, 44 bp, Artificial Sequence
  Description of Artificial Sequence: Synthetic oligonucleotide
ttctaaaatgaaagacagaaactctggatgtacctgaaatgacc

SEQ ID NO: 305414 - DNA, 43 bp, Artificial Sequence
  Description of Artificial Sequence: Synthetic oligonucleotide
tctaaaatgaaagacagaaactctggatgtacctgaaatgacc

SEQ ID NO: 305415 - DNA, 42 bp, Artificial Sequence
  Description of Artificial Sequence: Synthetic oligonucleotide
ctaaaatgaaagacagaaactctggatgtacctgaaatgacc

SEQ ID NO: 305416 - DNA, 43 bp, Artificial Sequence
  Description of Artificial Sequence: Synthetic oligonucleotide
taaaatgaaagacagaaactctggatgtacctgaaatgaccag

SEQ ID NO: 305417 - DNA, 42 bp, Artificial Sequence
  Description of Artificial Sequence: Synthetic oligonucleotide
aaaatgaaagacagaaactctggatgtacctgaaatgaccag

SEQ ID NO: 305418 - DNA, 41 bp, Artificial Sequence
  Description of Artificial Sequence: Synthetic oligonucleotide
aaatgaaagacagaaactctggatgtacctgaaatgaccag

SEQ ID NO: 305419 - DNA, 40 bp, Artificial Sequence
  Description of Artificial Sequence: Synthetic oligonucleotide
aatgaaagacagaaactctggatgtacctgaaatgaccag

SEQ ID NO: 305420 - DNA, 39 bp, Artificial Sequence
  Description of Artificial Sequence: Synthetic oligonucleotide
atgaaagacagaaactctggatgtacctgaaatgaccag

SEQ ID NO: 305421 - DNA, 38 bp, Artificial Sequence
  Description of Artificial Sequence: Synthetic oligonucleotide
tgaaagacagaaactctggatgtacctgaaatgaccag

SEQ ID NO: 305422 - DNA, 37 bp, Artificial Sequence
  Description of Artificial Sequence: Synthetic oligonucleotide
gaaagacagaaactctggatgtacctgaaatgaccag

SEQ ID NO: 305423 - DNA, 39 bp, Artificial Sequence
  Description of Artificial Sequence: Synthetic oligonucleotide
aaagacagaaactctggatgtacctgaaatgaccagttg

SEQ ID NO: 305424 - DNA, 38 bp, Artificial Sequence
  Description of Artificial Sequence: Synthetic oligonucleotide
aagacagaaactctggatgtacctgaaatgaccagttg

SEQ ID NO: 305425 - DNA, 37 bp, Artificial Sequence
  Description of Artificial Sequence: Synthetic oligonucleotide
agacagaaactctggatgtacctgaaatgaccagttg

SEQ ID NO: 305426 - DNA, 36 bp, Artificial Sequence
  Description of Artificial Sequence: Synthetic oligonucleotide
gacagaaactctggatgtacctgaaatgaccagttg

SEQ ID NO: 305427 - DNA, 36 bp, Artificial Sequence
  Description of Artificial Sequence: Synthetic oligonucleotide
acagaaactctggatgtacctgaaatgaccagttgc

SEQ ID NO: 305428 - DNA, 35 bp, Artificial Sequence
  Description of Artificial Sequence: Synthetic oligonucleotide
cagaaactctggatgtacctgaaatgaccagttgc

SEQ ID NO: 305429 - DNA, 35 bp, Artificial Sequence
  Description of Artificial Sequence: Synthetic oligonucleotide
agaaactctggatgtacctgaaatgaccagttgcg

SEQ ID NO: 305430 - DNA, 34 bp, Artificial Sequence
  Description of Artificial Sequence: Synthetic oligonucleotide
gaaactctggatgtacctgaaatgaccagttgcg

SEQ ID NO: 305431 - DNA, 35 bp, Artificial Sequence
  Description of Artificial Sequence: Synthetic oligonucleotide
aaactctggatgtacctgaaatgaccagttgcgtg

SEQ ID NO: 305432 - DNA, 34 bp, Artificial Sequence
  Description of Artificial Sequence: Synthetic oligonucleotide
aactctggatgtacctgaaatgaccagttgcgtg

SEQ ID NO: 305433 - DNA, 33 bp, Artificial Sequence
  Description of Artificial Sequence: Synthetic oligonucleotide
actctggatgtacctgaaatgaccagttgcgtg

SEQ ID NO: 305434 - DNA, 32 bp, Artificial Sequence
  Description of Artificial Sequence: Synthetic oligonucleotide
ctctggatgtacctgaaatgaccagttgcgtg

SEQ ID NO: 305435 - DNA, 41 bp, Artificial Sequence
  Description of Artificial Sequence: Synthetic oligonucleotide
tctggatgtacctgaaatgaccagttgcgtgaaattttatg

SEQ ID NO: 305436 - DNA, 40 bp, Artificial Sequence
  Description of Artificial Sequence: Synthetic oligonucleotide
ctggatgtacctgaaatgaccagttgcgtgaaattttatg

SEQ ID NO: 305437 - DNA, 41 bp, Artificial Sequence
  Description of Artificial Sequence: Synthetic oligonucleotide
tggatgtacctgaaatgaccagttgcgtgaaattttatgtg

SEQ ID NO: 305438 - DNA, 40 bp, Artificial Sequence
  Description of Artificial Sequence: Synthetic oligonucleotide
ggatgtacctgaaatgaccagttgcgtgaaattttatgtg

SEQ ID NO: 305439 - DNA, 40 bp, Artificial Sequence
  Description of Artificial Sequence: Synthetic oligonucleotide
gatgtacctgaaatgaccagttgcgtgaaattttatgtgg

SEQ ID NO: 305440 - DNA, 41 bp, Artificial Sequence
  Description of Artificial Sequence: Synthetic oligonucleotide
atgtacctgaaatgaccagttgcgtgaaattttatgtggac

SEQ ID NO: 305441 - DNA, 40 bp, Artificial Sequence
  Description of Artificial Sequence: Synthetic oligonucleotide
tgtacctgaaatgaccagttgcgtgaaattttatgtggac

SEQ ID NO: 305442 - DNA, 39 bp, Artificial Sequence
  Description of Artificial Sequence: Synthetic oligonucleotide
gtacctgaaatgaccagttgcgtgaaattttatgtggac

SEQ ID NO: 305443 - DNA, 40 bp, Artificial Sequence
  Description of Artificial Sequence: Synthetic oligonucleotide
tacctgaaatgaccagttgcgtgaaattttatgtggactg

SEQ ID NO: 305444 - DNA, 39 bp, Artificial Sequence
  Description of Artificial Sequence: Synthetic oligonucleotide
acctgaaatgaccagttgcgtgaaattttatgtggactg

SEQ ID NO: 305445 - DNA, 38 bp, Artificial Sequence
  Description of Artificial Sequence: Synthetic oligonucleotide
cctgaaatgaccagttgcgtgaaattttatgtggactg

SEQ ID NO: 305446 - DNA, 42 bp, Artificial Sequence
  Description of Artificial Sequence: Synthetic oligonucleotide
ctgaaatgaccagttgcgtgaaattttatgtggactgaaatg

SEQ ID NO: 305447 - DNA, 42 bp, Artificial Sequence
  Description of Artificial Sequence: Synthetic oligonucleotide
tgaaatgaccagttgcgtgaaattttatgtggactgaaatgg

SEQ ID NO: 305448 - DNA, 41 bp, Artificial Sequence
  Description of Artificial Sequence: Synthetic oligonucleotide
gaaatgaccagttgcgtgaaattttatgtggactgaaatgg

SEQ ID NO: 305449 - DNA, 44 bp, Artificial Sequence
  Description of Artificial Sequence: Synthetic oligonucleotide
aaatgaccagttgcgtgaaattttatgtggactgaaatggttag

SEQ ID NO: 305450 - DNA, 43 bp, Artificial Sequence
  Description of Artificial Sequence: Synthetic oligonucleotide
aatgaccagttgcgtgaaattttatgtggactgaaatggttag

SEQ ID NO: 305451 - DNA, 42 bp, Artificial Sequence
  Description of Artificial Sequence: Synthetic oligonucleotide
atgaccagttgcgtgaaattttatgtggactgaaatggttag

SEQ ID NO: 305452 - DNA, 41 bp, Artificial Sequence
  Description of Artificial Sequence: Synthetic oligonucleotide
tgaccagttgcgtgaaattttatgtggactgaaatggttag

SEQ ID NO: 305453 - DNA, 40 bp, Artificial Sequence
  Description of Artificial Sequence: Synthetic oligonucleotide
gaccagttgcgtgaaattttatgtggactgaaatggttag

SEQ ID NO: 305454 - DNA, 42 bp, Artificial Sequence
  Description of Artificial Sequence: Synthetic oligonucleotide
accagttgcgtgaaattttatgtggactgaaatggttagtac

SEQ ID NO: 305455 - DNA, 41 bp, Artificial Sequence
  Description of Artificial Sequence: Synthetic oligonucleotide
ccagttgcgtgaaattttatgtggactgaaatggttagtac

SEQ ID NO: 305456 - DNA, 43 bp, Artificial Sequence
  Description of Artificial Sequence: Synthetic oligonucleotide
cagttgcgtgaaattttatgtggactgaaatggttagtacatc

SEQ ID NO: 305457 - DNA, 43 bp, Artificial Sequence
  Description of Artificial Sequence: Synthetic oligonucleotide
agttgcgtgaaattttatgtggactgaaatggttagtacatcg

SEQ ID NO: 305458 - DNA, 42 bp, Artificial Sequence
  Description of Artificial Sequence: Synthetic oligonucleotide
gttgcgtgaaattttatgtggactgaaatggttagtacatcg

SEQ ID NO: 305459 - DNA, 44 bp, Artificial Sequence
  Description of Artificial Sequence: Synthetic oligonucleotide
ttgcgtgaaattttatgtggactgaaatggttagtacatcgttg

SEQ ID NO: 305460 - DNA, 43 bp, Artificial Sequence
  Description of Artificial Sequence: Synthetic oligonucleotide
tgcgtgaaattttatgtggactgaaatggttagtacatcgttg

SEQ ID NO: 305461 - DNA, 42 bp, Artificial Sequence
  Description of Artificial Sequence: Synthetic oligonucleotide
gcgtgaaattttatgtggactgaaatggttagtacatcgttg

SEQ ID NO: 305462 - DNA, 43 bp, Artificial Sequence
  Description of Artificial Sequence: Synthetic oligonucleotide
cgtgaaattttatgtggactgaaatggttagtacatcgttgac

SEQ ID NO: 305463 - DNA, 46 bp, Artificial Sequence
  Description of Artificial Sequence: Synthetic oligonucleotide
gtgaaattttatgtggactgaaatggttagtacatcgttgactatg

SEQ ID NO: 305464 - DNA, 47 bp, Artificial Sequence
  Description of Artificial Sequence: Synthetic oligonucleotide
tgaaattttatgtggactgaaatggttagtacatcgttgactatgag

SEQ ID NO: 305465 - DNA, 46 bp, Artificial Sequence
  Description of Artificial Sequence: Synthetic oligonucleotide
gaaattttatgtggactgaaatggttagtacatcgttgactatgag

SEQ ID NO: 305466 - DNA, 46 bp, Artificial Sequence
  Description of Artificial Sequence: Synthetic oligonucleotide
aaattttatgtggactgaaatggttagtacatcgttgactatgagg

SEQ ID NO: 305467 - DNA, 45 bp, Artificial Sequence
  Description of Artificial Sequence: Synthetic oligonucleotide
aattttatgtggactgaaatggttagtacatcgttgactatgagg

SEQ ID NO: 305468 - DNA, 44 bp, Artificial Sequence
  Description of Artificial Sequence: Synthetic oligonucleotide
attttatgtggactgaaatggttagtacatcgttgactatgagg

SEQ ID NO: 305469 - DNA, 43 bp, Artificial Sequence
  Description of Artificial Sequence: Synthetic oligonucleotide
ttttatgtggactgaaatggttagtacatcgttgactatgagg

SEQ ID NO: 305470 - DNA, 42 bp, Artificial Sequence
  Description of Artificial Sequence: Synthetic oligonucleotide
tttatgtggactgaaatggttagtacatcgttgactatgagg

SEQ ID NO: 305471 - DNA, 41 bp, Artificial Sequence
  Description of Artificial Sequence: Synthetic oligonucleotide
ttatgtggactgaaatggttagtacatcgttgactatgagg

SEQ ID NO: 305472 - DNA, 40 bp, Artificial Sequence
  Description of Artificial Sequence: Synthetic oligonucleotide
tatgtggactgaaatggttagtacatcgttgactatgagg

SEQ ID NO: 305473 - DNA, 39 bp, Artificial Sequence
  Description of Artificial Sequence: Synthetic oligonucleotide
atgtggactgaaatggttagtacatcgttgactatgagg

SEQ ID NO: 305474 - DNA, 38 bp, Artificial Sequence
  Description of Artificial Sequence: Synthetic oligonucleotide
tgtggactgaaatggttagtacatcgttgactatgagg

SEQ ID NO: 305475 - DNA, 37 bp, Artificial Sequence
  Description of Artificial Sequence: Synthetic oligonucleotide
gtggactgaaatggttagtacatcgttgactatgagg

SEQ ID NO: 305476 - DNA, 37 bp, Artificial Sequence
  Description of Artificial Sequence: Synthetic oligonucleotide
tggactgaaatggttagtacatcgttgactatgaggc

SEQ ID NO: 305477 - DNA, 36 bp, Artificial Sequence
  Description of Artificial Sequence: Synthetic oligonucleotide
ggactgaaatggttagtacatcgttgactatgaggc

SEQ ID NO: 305478 - DNA, 37 bp, Artificial Sequence
  Description of Artificial Sequence: Synthetic oligonucleotide
gactgaaatggttagtacatcgttgactatgaggctc

SEQ ID NO: 305479 - DNA, 39 bp, Artificial Sequence
  Description of Artificial Sequence: Synthetic oligonucleotide
actgaaatggttagtacatcgttgactatgaggctcatg

SEQ ID NO: 305480 - DNA, 38 bp, Artificial Sequence
  Description of Artificial Sequence: Synthetic oligonucleotide
ctgaaatggttagtacatcgttgactatgaggctcatg

SEQ ID NO: 305481 - DNA, 38 bp, Artificial Sequence
  Description of Artificial Sequence: Synthetic oligonucleotide
tgaaatggttagtacatcgttgactatgaggctcatgg

SEQ ID NO: 305482 - DNA, 37 bp, Artificial Sequence
  Description of Artificial Sequence: Synthetic oligonucleotide
gaaatggttagtacatcgttgactatgaggctcatgg

SEQ ID NO: 305483 - DNA, 39 bp, Artificial Sequence
  Description of Artificial Sequence: Synthetic oligonucleotide
aaatggttagtacatcgttgactatgaggctcatggatg

SEQ ID NO: 305484 - DNA, 38 bp, Artificial Sequence
  Description of Artificial Sequence: Synthetic oligonucleotide
aatggttagtacatcgttgactatgaggctcatggatg

SEQ ID NO: 305485 - DNA, 37 bp, Artificial Sequence
  Description of Artificial Sequence: Synthetic oligonucleotide
atggttagtacatcgttgactatgaggctcatggatg

SEQ ID NO: 305486 - DNA, 36 bp, Artificial Sequence
  Description of Artificial Sequence: Synthetic oligonucleotide
tggttagtacatcgttgactatgaggctcatggatg

SEQ ID NO: 305487 - DNA, 35 bp, Artificial Sequence
  Description of Artificial Sequence: Synthetic oligonucleotide
ggttagtacatcgttgactatgaggctcatggatg

SEQ ID NO: 305488 - DNA, 35 bp, Artificial Sequence
  Description of Artificial Sequence: Synthetic oligonucleotide
gttagtacatcgttgactatgaggctcatggatgc

SEQ ID NO: 305489 - DNA, 35 bp, Artificial Sequence
  Description of Artificial Sequence: Synthetic oligonucleotide
ttagtacatcgttgactatgaggctcatggatgcg

SEQ ID NO: 305490 - DNA, 34 bp, Artificial Sequence
  Description of Artificial Sequence: Synthetic oligonucleotide
tagtacatcgttgactatgaggctcatggatgcg

SEQ ID NO: 305491 - DNA, 33 bp, Artificial Sequence
  Description of Artificial Sequence: Synthetic oligonucleotide
agtacatcgttgactatgaggctcatggatgcg

SEQ ID NO: 305492 - DNA, 32 bp, Artificial Sequence
  Description of Artificial Sequence: Synthetic oligonucleotide
gtacatcgttgactatgaggctcatggatgcg

SEQ ID NO: 305493 - DNA, 33 bp, Artificial Sequence
  Description of Artificial Sequence: Synthetic oligonucleotide
tacatcgttgactatgaggctcatggatgcgac

SEQ ID NO: 305494 - DNA, 32 bp, Artificial Sequence
  Description of Artificial Sequence: Synthetic oligonucleotide
acatcgttgactatgaggctcatggatgcgac

SEQ ID NO: 305495 - DNA, 31 bp, Artificial Sequence
  Description of Artificial Sequence: Synthetic oligonucleotide
catcgttgactatgaggctcatggatgcgac

SEQ ID NO: 305496 - DNA, 31 bp, Artificial Sequence
  Description of Artificial Sequence: Synthetic oligonucleotide
atcgttgactatgaggctcatggatgcgacc

SEQ ID NO: 305497 - DNA, 30 bp, Artificial Sequence
  Description of Artificial Sequence: Synthetic oligonucleotide
tcgttgactatgaggctcatggatgcgacc

SEQ ID NO: 305498 - DNA, 29 bp, Artificial Sequence
  Description of Artificial Sequence: Synthetic oligonucleotide
cgttgactatgaggctcatggatgcgacc

SEQ ID NO: 305499 - DNA, 31 bp, Artificial Sequence
  Description of Artificial Sequence: Synthetic oligonucleotide
gttgactatgaggctcatggatgcgaccaac

SEQ ID NO: 305500 - DNA, 32 bp, Artificial Sequence
  Description of Artificial Sequence: Synthetic oligonucleotide
ttgactatgaggctcatggatgcgaccaactc

SEQ ID NO: 305501 - DNA, 31 bp, Artificial Sequence
  Description of Artificial Sequence: Synthetic oligonucleotide
tgactatgaggctcatggatgcgaccaactc

SEQ ID NO: 305502 - DNA, 30 bp, Artificial Sequence
  Description of Artificial Sequence: Synthetic oligonucleotide
gactatgaggctcatggatgcgaccaactc

SEQ ID NO: 305503 - DNA, 34 bp, Artificial Sequence
  Description of Artificial Sequence: Synthetic oligonucleotide
actatgaggctcatggatgcgaccaactctttac

SEQ ID NO: 305504 - DNA, 33 bp, Artificial Sequence
  Description of Artificial Sequence: Synthetic oligonucleotide
ctatgaggctcatggatgcgaccaactctttac

SEQ ID NO: 305505 - DNA, 34 bp, Artificial Sequence
  Description of Artificial Sequence: Synthetic oligonucleotide
tatgaggctcatggatgcgaccaactctttacac

SEQ ID NO: 305506 - DNA, 33 bp, Artificial Sequence
  Description of Artificial Sequence: Synthetic oligonucleotide
atgaggctcatggatgcgaccaactctttacac

SEQ ID NO: 305507 - DNA, 32 bp, Artificial Sequence
  Description of Artificial Sequence: Synthetic oligonucleotide
tgaggctcatggatgcgaccaactctttacac

SEQ ID NO: 305508 - DNA, 31 bp, Artificial Sequence
  Description of Artificial Sequence: Synthetic oligonucleotide
gaggctcatggatgcgaccaactctttacac

SEQ ID NO: 305509 - DNA, 32 bp, Artificial Sequence
  Description of Artificial Sequence: Synthetic oligonucleotide
aggctcatggatgcgaccaactctttacacag

SEQ ID NO: 305510 - DNA, 31 bp, Artificial Sequence
  Description of Artificial Sequence: Synthetic oligonucleotide
ggctcatggatgcgaccaactctttacacag

SEQ ID NO: 305511 - DNA, 31 bp, Artificial Sequence
  Description of Artificial Sequence: Synthetic oligonucleotide
gctcatggatgcgaccaactctttacacagc

SEQ ID NO: 305512 - DNA, 32 bp, Artificial Sequence
  Description of Artificial Sequence: Synthetic oligonucleotide
ctcatggatgcgaccaactctttacacagcag

SEQ ID NO: 305513 - DNA, 35 bp, Artificial Sequence
  Description of Artificial Sequence: Synthetic oligonucleotide
tcatggatgcgaccaactctttacacagcagaatc

SEQ ID NO: 305514 - DNA, 34 bp, Artificial Sequence
  Description of Artificial Sequence: Synthetic oligonucleotide
catggatgcgaccaactctttacacagcagaatc

SEQ ID NO: 305515 - DNA, 35 bp, Artificial Sequence
  Description of Artificial Sequence: Synthetic oligonucleotide
atggatgcgaccaactctttacacagcagaatcag

SEQ ID NO: 305516 - DNA, 34 bp, Artificial Sequence
  Description of Artificial Sequence: Synthetic oligonucleotide
tggatgcgaccaactctttacacagcagaatcag

SEQ ID NO: 305517 - DNA, 33 bp, Artificial Sequence
  Description of Artificial Sequence: Synthetic oligonucleotide
ggatgcgaccaactctttacacagcagaatcag

SEQ ID NO: 305518 - DNA, 35 bp, Artificial Sequence
  Description of Artificial Sequence: Synthetic oligonucleotide
gatgcgaccaactctttacacagcagaatcagaag

SEQ ID NO: 305519 - DNA, 35 bp, Artificial Sequence
  Description of Artificial Sequence: Synthetic oligonucleotide
atgcgaccaactctttacacagcagaatcagaagc

SEQ ID NO: 305520 - DNA, 34 bp, Artificial Sequence
  Description of Artificial Sequence: Synthetic oligonucleotide
tgcgaccaactctttacacagcagaatcagaagc

SEQ ID NO: 305521 - DNA, 33 bp, Artificial Sequence
  Description of Artificial Sequence: Synthetic oligonucleotide
gcgaccaactctttacacagcagaatcagaagc

SEQ ID NO: 305522 - DNA, 34 bp, Artificial Sequence
  Description of Artificial Sequence: Synthetic oligonucleotide
cgaccaactctttacacagcagaatcagaagcac

SEQ ID NO: 305523 - DNA, 35 bp, Artificial Sequence
  Description of Artificial Sequence: Synthetic oligonucleotide
gaccaactctttacacagcagaatcagaagcacac

SEQ ID NO: 305524 - DNA, 36 bp, Artificial Sequence
  Description of Artificial Sequence: Synthetic oligonucleotide
accaactctttacacagcagaatcagaagcacacac

SEQ ID NO: 305525 - DNA, 35 bp, Artificial Sequence
  Description of Artificial Sequence: Synthetic oligonucleotide
ccaactctttacacagcagaatcagaagcacacac

SEQ ID NO: 305526 - DNA, 37 bp, Artificial Sequence
  Description of Artificial Sequence: Synthetic oligonucleotide
caactctttacacagcagaatcagaagcacacacttg

SEQ ID NO: 305527 - DNA, 38 bp, Artificial Sequence
  Description of Artificial Sequence: Synthetic oligonucleotide
aactctttacacagcagaatcagaagcacacacttgtc

SEQ ID NO: 305528 - DNA, 37 bp, Artificial Sequence
  Description of Artificial Sequence: Synthetic oligonucleotide
actctttacacagcagaatcagaagcacacacttgtc

SEQ ID NO: 305529 - DNA, 36 bp, Artificial Sequence
  Description of Artificial Sequence: Synthetic oligonucleotide
ctctttacacagcagaatcagaagcacacacttgtc

SEQ ID NO: 305530 - DNA, 37 bp, Artificial Sequence
  Description of Artificial Sequence: Synthetic oligonucleotide
tctttacacagcagaatcagaagcacacacttgtcag

SEQ ID NO: 305531 - DNA, 36 bp, Artificial Sequence
  Description of Artificial Sequence: Synthetic oligonucleotide
ctttacacagcagaatcagaagcacacacttgtcag

SEQ ID NO: 305532 - DNA, 37 bp, Artificial Sequence
  Description of Artificial Sequence: Synthetic oligonucleotide
tttacacagcagaatcagaagcacacacttgtcagac

SEQ ID NO: 305533 - DNA, 36 bp, Artificial Sequence
  Description of Artificial Sequence: Synthetic oligonucleotide
ttacacagcagaatcagaagcacacacttgtcagac

SEQ ID NO: 305534 - DNA, 35 bp, Artificial Sequence
  Description of Artificial Sequence: Synthetic oligonucleotide
tacacagcagaatcagaagcacacacttgtcagac

SEQ ID NO: 305535 - DNA, 34 bp, Artificial Sequence
  Description of Artificial Sequence: Synthetic oligonucleotide
acacagcagaatcagaagcacacacttgtcagac

SEQ ID NO: 305536 - DNA, 33 bp, Artificial Sequence
  Description of Artificial Sequence: Synthetic oligonucleotide
cacagcagaatcagaagcacacacttgtcagac

SEQ ID NO: 305537 - DNA, 33 bp, Artificial Sequence
  Description of Artificial Sequence: Synthetic oligonucleotide
acagcagaatcagaagcacacacttgtcagacc

SEQ ID NO: 305538 - DNA, 32 bp, Artificial Sequence
  Description of Artificial Sequence: Synthetic oligonucleotide
cagcagaatcagaagcacacacttgtcagacc

SEQ ID NO: 305539 - DNA, 35 bp, Artificial Sequence
  Description of Artificial Sequence: Synthetic oligonucleotide
agcagaatcagaagcacacacttgtcagacctatg

SEQ ID NO: 305540 - DNA, 34 bp, Artificial Sequence
  Description of Artificial Sequence: Synthetic oligonucleotide
gcagaatcagaagcacacacttgtcagacctatg

SEQ ID NO: 305541 - DNA, 34 bp, Artificial Sequence
  Description of Artificial Sequence: Synthetic oligonucleotide
cagaatcagaagcacacacttgtcagacctatgg

SEQ ID NO: 305542 - DNA, 35 bp, Artificial Sequence
  Description of Artificial Sequence: Synthetic oligonucleotide
agaatcagaagcacacacttgtcagacctatggac

SEQ ID NO: 305543 - DNA, 34 bp, Artificial Sequence
  Description of Artificial Sequence: Synthetic oligonucleotide
gaatcagaagcacacacttgtcagacctatggac

SEQ ID NO: 305544 - DNA, 35 bp, Artificial Sequence
  Description of Artificial Sequence: Synthetic oligonucleotide
aatcagaagcacacacttgtcagacctatggacag

SEQ ID NO: 305545 - DNA, 34 bp, Artificial Sequence
  Description of Artificial Sequence: Synthetic oligonucleotide
atcagaagcacacacttgtcagacctatggacag

SEQ ID NO: 305546 - DNA, 33 bp, Artificial Sequence
  Description of Artificial Sequence: Synthetic oligonucleotide
tcagaagcacacacttgtcagacctatggacag

SEQ ID NO: 305547 - DNA, 32 bp, Artificial Sequence
  Description of Artificial Sequence: Synthetic oligonucleotide
cagaagcacacacttgtcagacctatggacag

SEQ ID NO: 305548 - DNA, 33 bp, Artificial Sequence
  Description of Artificial Sequence: Synthetic oligonucleotide
agaagcacacacttgtcagacctatggacagag

SEQ ID NO: 305549 - DNA, 32 bp, Artificial Sequence
  Description of Artificial Sequence: Synthetic oligonucleotide
gaagcacacacttgtcagacctatggacagag

SEQ ID NO: 305550 - DNA, 34 bp, Artificial Sequence
  Description of Artificial Sequence: Synthetic oligonucleotide
aagcacacacttgtcagacctatggacagagttg

SEQ ID NO: 305551 - DNA, 33 bp, Artificial Sequence
  Description of Artificial Sequence: Synthetic oligonucleotide
agcacacacttgtcagacctatggacagagttg

SEQ ID NO: 305552 - DNA, 32 bp, Artificial Sequence
  Description of Artificial Sequence: Synthetic oligonucleotide
gcacacacttgtcagacctatggacagagttg

SEQ ID NO: 305553 - DNA, 32 bp, Artificial Sequence
  Description of Artificial Sequence: Synthetic oligonucleotide
cacacacttgtcagacctatggacagagttgg

SEQ ID NO: 305554 - DNA, 33 bp, Artificial Sequence
  Description of Artificial Sequence: Synthetic oligonucleotide
acacacttgtcagacctatggacagagttggtc

SEQ ID NO: 305555 - DNA, 32 bp, Artificial Sequence
  Description of Artificial Sequence: Synthetic oligonucleotide
cacacttgtcagacctatggacagagttggtc

SEQ ID NO: 305556 - DNA, 33 bp, Artificial Sequence
  Description of Artificial Sequence: Synthetic oligonucleotide
acacttgtcagacctatggacagagttggtctg

SEQ ID NO: 305557 - DNA, 32 bp, Artificial Sequence
  Description of Artificial Sequence: Synthetic oligonucleotide
cacttgtcagacctatggacagagttggtctg

SEQ ID NO: 305558 - DNA, 35 bp, Artificial Sequence
  Description of Artificial Sequence: Synthetic oligonucleotide
acttgtcagacctatggacagagttggtctgattg

SEQ ID NO: 305559 - DNA, 34 bp, Artificial Sequence
  Description of Artificial Sequence: Synthetic oligonucleotide
cttgtcagacctatggacagagttggtctgattg

SEQ ID NO: 305560 - DNA, 36 bp, Artificial Sequence
  Description of Artificial Sequence: Synthetic oligonucleotide
ttgtcagacctatggacagagttggtctgattgatg

SEQ ID NO: 305561 - DNA, 35 bp, Artificial Sequence
  Description of Artificial Sequence: Synthetic oligonucleotide
tgtcagacctatggacagagttggtctgattgatg

SEQ ID NO: 305562 - DNA, 34 bp, Artificial Sequence
  Description of Artificial Sequence: Synthetic oligonucleotide
gtcagacctatggacagagttggtctgattgatg

SEQ ID NO: 305563 - DNA, 36 bp, Artificial Sequence
  Description of Artificial Sequence: Synthetic oligonucleotide
tcagacctatggacagagttggtctgattgatgatg

SEQ ID NO: 305564 - DNA, 35 bp, Artificial Sequence
  Description of Artificial Sequence: Synthetic oligonucleotide
cagacctatggacagagttggtctgattgatgatg

SEQ ID NO: 305565 - DNA, 36 bp, Artificial Sequence
  Description of Artificial Sequence: Synthetic oligonucleotide
agacctatggacagagttggtctgattgatgatgtg

SEQ ID NO: 305566 - DNA, 35 bp, Artificial Sequence
  Description of Artificial Sequence: Synthetic oligonucleotide
gacctatggacagagttggtctgattgatgatgtg

SEQ ID NO: 305567 - DNA, 38 bp, Artificial Sequence
  Description of Artificial Sequence: Synthetic oligonucleotide
acctatggacagagttggtctgattgatgatgtgtatc

SEQ ID NO: 305568 - DNA, 37 bp, Artificial Sequence
  Description of Artificial Sequence: Synthetic oligonucleotide
cctatggacagagttggtctgattgatgatgtgtatc

SEQ ID NO: 305569 - DNA, 38 bp, Artificial Sequence
  Description of Artificial Sequence: Synthetic oligonucleotide
ctatggacagagttggtctgattgatgatgtgtatcag

SEQ ID NO: 305570 - DNA, 38 bp, Artificial Sequence
  Description of Artificial Sequence: Synthetic oligonucleotide
tatggacagagttggtctgattgatgatgtgtatcagc

SEQ ID NO: 305571 - DNA, 37 bp, Artificial Sequence
  Description of Artificial Sequence: Synthetic oligonucleotide
atggacagagttggtctgattgatgatgtgtatcagc

SEQ ID NO: 305572 - DNA, 36 bp, Artificial Sequence
  Description of Artificial Sequence: Synthetic oligonucleotide
tggacagagttggtctgattgatgatgtgtatcagc

SEQ ID NO: 305573 - DNA, 35 bp, Artificial Sequence
  Description of Artificial Sequence: Synthetic oligonucleotide
ggacagagttggtctgattgatgatgtgtatcagc

SEQ ID NO: 305574 - DNA, 37 bp, Artificial Sequence
  Description of Artificial Sequence: Synthetic oligonucleotide
gacagagttggtctgattgatgatgtgtatcagctag

SEQ ID NO: 305575 - DNA, 39 bp, Artificial Sequence
  Description of Artificial Sequence: Synthetic oligonucleotide
acagagttggtctgattgatgatgtgtatcagctagtag

SEQ ID NO: 305576 - DNA, 38 bp, Artificial Sequence
  Description of Artificial Sequence: Synthetic oligonucleotide
cagagttggtctgattgatgatgtgtatcagctagtag

SEQ ID NO: 305577 - DNA, 38 bp, Artificial Sequence
  Description of Artificial Sequence: Synthetic oligonucleotide
agagttggtctgattgatgatgtgtatcagctagtagg

SEQ ID NO: 305578 - DNA, 37 bp, Artificial Sequence
  Description of Artificial Sequence: Synthetic oligonucleotide
gagttggtctgattgatgatgtgtatcagctagtagg

SEQ ID NO: 305579 - DNA, 38 bp, Artificial Sequence
  Description of Artificial Sequence: Synthetic oligonucleotide
agttggtctgattgatgatgtgtatcagctagtaggtg

SEQ ID NO: 305580 - DNA, 37 bp, Artificial Sequence
  Description of Artificial Sequence: Synthetic oligonucleotide
gttggtctgattgatgatgtgtatcagctagtaggtg

SEQ ID NO: 305581 - DNA, 37 bp, Artificial Sequence
  Description of Artificial Sequence: Synthetic oligonucleotide
ttggtctgattgatgatgtgtatcagctagtaggtgc

SEQ ID NO: 305582 - DNA, 36 bp, Artificial Sequence
  Description of Artificial Sequence: Synthetic oligonucleotide
tggtctgattgatgatgtgtatcagctagtaggtgc

SEQ ID NO: 305583 - DNA, 35 bp, Artificial Sequence
  Description of Artificial Sequence: Synthetic oligonucleotide
ggtctgattgatgatgtgtatcagctagtaggtgc

SEQ ID NO: 305584 - DNA, 36 bp, Artificial Sequence
  Description of Artificial Sequence: Synthetic oligonucleotide
gtctgattgatgatgtgtatcagctagtaggtgcag

SEQ ID NO: 305585 - DNA, 36 bp, Artificial Sequence
  Description of Artificial Sequence: Synthetic oligonucleotide
tctgattgatgatgtgtatcagctagtaggtgcagg

SEQ ID NO: 305586 - DNA, 35 bp, Artificial Sequence
  Description of Artificial Sequence: Synthetic oligonucleotide
ctgattgatgatgtgtatcagctagtaggtgcagg

SEQ ID NO: 305587 - DNA, 35 bp, Artificial Sequence
  Description of Artificial Sequence: Synthetic oligonucleotide
tgattgatgatgtgtatcagctagtaggtgcaggg

SEQ ID NO: 305588 - DNA, 34 bp, Artificial Sequence
  Description of Artificial Sequence: Synthetic oligonucleotide
gattgatgatgtgtatcagctagtaggtgcaggg

SEQ ID NO: 305589 - DNA, 35 bp, Artificial Sequence
  Description of Artificial Sequence: Synthetic oligonucleotide
attgatgatgtgtatcagctagtaggtgcagggtg

SEQ ID NO: 305590 - DNA, 34 bp, Artificial Sequence
  Description of Artificial Sequence: Synthetic oligonucleotide
ttgatgatgtgtatcagctagtaggtgcagggtg

SEQ ID NO: 305591 - DNA, 33 bp, Artificial Sequence
  Description of Artificial Sequence: Synthetic oligonucleotide
tgatgatgtgtatcagctagtaggtgcagggtg

SEQ ID NO: 305592 - DNA, 32 bp, Artificial Sequence
  Description of Artificial Sequence: Synthetic oligonucleotide
gatgatgtgtatcagctagtaggtgcagggtg

SEQ ID NO: 305593 - DNA, 33 bp, Artificial Sequence
  Description of Artificial Sequence: Synthetic oligonucleotide
atgatgtgtatcagctagtaggtgcagggtgac

SEQ ID NO: 305594 - DNA, 32 bp, Artificial Sequence
  Description of Artificial Sequence: Synthetic oligonucleotide
tgatgtgtatcagctagtaggtgcagggtgac

SEQ ID NO: 305595 - DNA, 31 bp, Artificial Sequence
  Description of Artificial Sequence: Synthetic oligonucleotide
gatgtgtatcagctagtaggtgcagggtgac

SEQ ID NO: 305596 - DNA, 32 bp, Artificial Sequence
  Description of Artificial Sequence: Synthetic oligonucleotide
atgtgtatcagctagtaggtgcagggtgactg

SEQ ID NO: 305597 - DNA, 31 bp, Artificial Sequence
  Description of Artificial Sequence: Synthetic oligonucleotide
tgtgtatcagctagtaggtgcagggtgactg

SEQ ID NO: 305598 - DNA, 30 bp, Artificial Sequence
  Description of Artificial Sequence: Synthetic oligonucleotide
gtgtatcagctagtaggtgcagggtgactg

SEQ ID NO: 305599 - DNA, 31 bp, Artificial Sequence
  Description of Artificial Sequence: Synthetic oligonucleotide
tgtatcagctagtaggtgcagggtgactgac

SEQ ID NO: 305600 - DNA, 30 bp, Artificial Sequence
  Description of Artificial Sequence: Synthetic oligonucleotide
gtatcagctagtaggtgcagggtgactgac

SEQ ID NO: 305601 - DNA, 30 bp, Artificial Sequence
  Description of Artificial Sequence: Synthetic oligonucleotide
tatcagctagtaggtgcagggtgactgacc

SEQ ID NO: 305602 - DNA, 29 bp, Artificial Sequence
  Description of Artificial Sequence: Synthetic oligonucleotide
atcagctagtaggtgcagggtgactgacc

SEQ ID NO: 305603 - DNA, 28 bp, Artificial Sequence
  Description of Artificial Sequence: Synthetic oligonucleotide
tcagctagtaggtgcagggtgactgacc

SEQ ID NO: 305604 - DNA, 27 bp, Artificial Sequence
  Description of Artificial Sequence: Synthetic oligonucleotide
cagctagtaggtgcagggtgactgacc

SEQ ID NO: 305605 - DNA, 27 bp, Artificial Sequence
  Description of Artificial Sequence: Synthetic oligonucleotide
agctagtaggtgcagggtgactgaccc

SEQ ID NO: 305606 - DNA, 27 bp, Artificial Sequence
  Description of Artificial Sequence: Synthetic oligonucleotide
gctagtaggtgcagggtgactgaccca

SEQ ID NO: 305607 - DNA, 28 bp, Artificial Sequence
  Description of Artificial Sequence: Synthetic oligonucleotide
ctagtaggtgcagggtgactgacccaag

SEQ ID NO: 305608 - DNA, 29 bp, Artificial Sequence
  Description of Artificial Sequence: Synthetic oligonucleotide
tagtaggtgcagggtgactgacccaagac

SEQ ID NO: 305609 - DNA, 28 bp, Artificial Sequence
  Description of Artificial Sequence: Synthetic oligonucleotide
agtaggtgcagggtgactgacccaagac

SEQ ID NO: 305610 - DNA, 27 bp, Artificial Sequence
  Description of Artificial Sequence: Synthetic oligonucleotide
gtaggtgcagggtgactgacccaagac

SEQ ID NO: 305611 - DNA, 30 bp, Artificial Sequence
  Description of Artificial Sequence: Synthetic oligonucleotide
taggtgcagggtgactgacccaagacaaag

SEQ ID NO: 305612 - DNA, 29 bp, Artificial Sequence
  Description of Artificial Sequence: Synthetic oligonucleotide
aggtgcagggtgactgacccaagacaaag

SEQ ID NO: 305613 - DNA, 28 bp, Artificial Sequence
  Description of Artificial Sequence: Synthetic oligonucleotide
ggtgcagggtgactgacccaagacaaag

SEQ ID NO: 305614 - DNA, 28 bp, Artificial Sequence
  Description of Artificial Sequence: Synthetic oligonucleotide
gtgcagggtgactgacccaagacaaagc

SEQ ID NO: 305615 - DNA, 29 bp, Artificial Sequence
  Description of Artificial Sequence: Synthetic oligonucleotide
tgcagggtgactgacccaagacaaagcac

SEQ ID NO: 305616 - DNA, 28 bp, Artificial Sequence
  Description of Artificial Sequence: Synthetic oligonucleotide
gcagggtgactgacccaagacaaagcac

SEQ ID NO: 305617 - DNA, 30 bp, Artificial Sequence
  Description of Artificial Sequence: Synthetic oligonucleotide
cagggtgactgacccaagacaaagcacttg

SEQ ID NO: 305618 - DNA, 31 bp, Artificial Sequence
  Description of Artificial Sequence: Synthetic oligonucleotide
agggtgactgacccaagacaaagcacttgac

SEQ ID NO: 305619 - DNA, 30 bp, Artificial Sequence
  Description of Artificial Sequence: Synthetic oligonucleotide
gggtgactgacccaagacaaagcacttgac

SEQ ID NO: 305620 - DNA, 32 bp, Artificial Sequence
  Description of Artificial Sequence: Synthetic oligonucleotide
ggtgactgacccaagacaaagcacttgacatg

SEQ ID NO: 305621 - DNA, 33 bp, Artificial Sequence
  Description of Artificial Sequence: Synthetic oligonucleotide
gtgactgacccaagacaaagcacttgacatgtc

SEQ ID NO: 305622 - DNA, 36 bp, Artificial Sequence
  Description of Artificial Sequence: Synthetic oligonucleotide
tgactgacccaagacaaagcacttgacatgtcttac

SEQ ID NO: 305623 - DNA, 35 bp, Artificial Sequence
  Description of Artificial Sequence: Synthetic oligonucleotide
gactgacccaagacaaagcacttgacatgtcttac

SEQ ID NO: 305624 - DNA, 37 bp, Artificial Sequence
  Description of Artificial Sequence: Synthetic oligonucleotide
actgacccaagacaaagcacttgacatgtcttactac

SEQ ID NO: 305625 - DNA, 36 bp, Artificial Sequence
  Description of Artificial Sequence: Synthetic oligonucleotide
ctgacccaagacaaagcacttgacatgtcttactac

SEQ ID NO: 305626 - DNA, 36 bp, Artificial Sequence
  Description of Artificial Sequence: Synthetic oligonucleotide
tgacccaagacaaagcacttgacatgtcttactacc

SEQ ID NO: 305627 - DNA, 35 bp, Artificial Sequence
  Description of Artificial Sequence: Synthetic oligonucleotide
gacccaagacaaagcacttgacatgtcttactacc

SEQ ID NO: 305628 - DNA, 36 bp, Artificial Sequence
  Description of Artificial Sequence: Synthetic oligonucleotide
acccaagacaaagcacttgacatgtcttactaccac

SEQ ID NO: 305629 - DNA, 35 bp, Artificial Sequence
  Description of Artificial Sequence: Synthetic oligonucleotide
cccaagacaaagcacttgacatgtcttactaccac

SEQ ID NO: 305630 - DNA, 35 bp, Artificial Sequence
  Description of Artificial Sequence: Synthetic oligonucleotide
ccaagacaaagcacttgacatgtcttactaccacc

SEQ ID NO: 305631 - DNA, 37 bp, Artificial Sequence
  Description of Artificial Sequence: Synthetic oligonucleotide
caagacaaagcacttgacatgtcttactaccaccaac

SEQ ID NO: 305632 - DNA, 39 bp, Artificial Sequence
  Description of Artificial Sequence: Synthetic oligonucleotide
aagacaaagcacttgacatgtcttactaccaccaacatg

SEQ ID NO: 305633 - DNA, 38 bp, Artificial Sequence
  Description of Artificial Sequence: Synthetic oligonucleotide
agacaaagcacttgacatgtcttactaccaccaacatg

SEQ ID NO: 305634 - DNA, 37 bp, Artificial Sequence
  Description of Artificial Sequence: Synthetic oligonucleotide
gacaaagcacttgacatgtcttactaccaccaacatg

SEQ ID NO: 305635 - DNA, 40 bp, Artificial Sequence
  Description of Artificial Sequence: Synthetic oligonucleotide
acaaagcacttgacatgtcttactaccaccaacatgatac

SEQ ID NO: 305636 - DNA, 39 bp, Artificial Sequence
  Description of Artificial Sequence: Synthetic oligonucleotide
caaagcacttgacatgtcttactaccaccaacatgatac

SEQ ID NO: 305637 - DNA, 41 bp, Artificial Sequence
  Description of Artificial Sequence: Synthetic oligonucleotide
aaagcacttgacatgtcttactaccaccaacatgatacaag

SEQ ID NO: 305638 - DNA, 40 bp, Artificial Sequence
  Description of Artificial Sequence: Synthetic oligonucleotide
aagcacttgacatgtcttactaccaccaacatgatacaag

SEQ ID NO: 305639 - DNA, 39 bp, Artificial Sequence
  Description of Artificial Sequence: Synthetic oligonucleotide
agcacttgacatgtcttactaccaccaacatgatacaag

SEQ ID NO: 305640 - DNA, 38 bp, Artificial Sequence
  Description of Artificial Sequence: Synthetic oligonucleotide
gcacttgacatgtcttactaccaccaacatgatacaag

SEQ ID NO: 305641 - DNA, 38 bp, Artificial Sequence
  Description of Artificial Sequence: Synthetic oligonucleotide
cacttgacatgtcttactaccaccaacatgatacaagc

SEQ ID NO: 305642 - DNA, 39 bp, Artificial Sequence
  Description of Artificial Sequence: Synthetic oligonucleotide
acttgacatgtcttactaccaccaacatgatacaagcag

SEQ ID NO: 305643 - DNA, 38 bp, Artificial Sequence
  Description of Artificial Sequence: Synthetic oligonucleotide
cttgacatgtcttactaccaccaacatgatacaagcag

SEQ ID NO: 305644 - DNA, 38 bp, Artificial Sequence
  Description of Artificial Sequence: Synthetic oligonucleotide
ttgacatgtcttactaccaccaacatgatacaagcagc

SEQ ID NO: 305645 - DNA, 37 bp, Artificial Sequence
  Description of Artificial Sequence: Synthetic oligonucleotide
tgacatgtcttactaccaccaacatgatacaagcagc

SEQ ID NO: 305646 - DNA, 36 bp, Artificial Sequence
  Description of Artificial Sequence: Synthetic oligonucleotide
gacatgtcttactaccaccaacatgatacaagcagc

SEQ ID NO: 305647 - DNA, 36 bp, Artificial Sequence
  Description of Artificial Sequence: Synthetic oligonucleotide
acatgtcttactaccaccaacatgatacaagcagcg

SEQ ID NO: 305648 - DNA, 35 bp, Artificial Sequence
  Description of Artificial Sequence: Synthetic oligonucleotide
catgtcttactaccaccaacatgatacaagcagcg

SEQ ID NO: 305649 - DNA, 35 bp, Artificial Sequence
  Description of Artificial Sequence: Synthetic oligonucleotide
atgtcttactaccaccaacatgatacaagcagcgc

SEQ ID NO: 305650 - DNA, 34 bp, Artificial Sequence
  Description of Artificial Sequence: Synthetic oligonucleotide
tgtcttactaccaccaacatgatacaagcagcgc

SEQ ID NO: 305651 - DNA, 33 bp, Artificial Sequence
  Description of Artificial Sequence: Synthetic oligonucleotide
gtcttactaccaccaacatgatacaagcagcgc

SEQ ID NO: 305652 - DNA, 33 bp, Artificial Sequence
  Description of Artificial Sequence: Synthetic oligonucleotide
tcttactaccaccaacatgatacaagcagcgcc

SEQ ID NO: 305653 - DNA, 32 bp, Artificial Sequence
  Description of Artificial Sequence: Synthetic oligonucleotide
cttactaccaccaacatgatacaagcagcgcc

SEQ ID NO: 305654 - DNA, 32 bp, Artificial Sequence
  Description of Artificial Sequence: Synthetic oligonucleotide
ttactaccaccaacatgatacaagcagcgccg

SEQ ID NO: 305655 - DNA, 31 bp, Artificial Sequence
  Description of Artificial Sequence: Synthetic oligonucleotide
tactaccaccaacatgatacaagcagcgccg

SEQ ID NO: 305656 - DNA, 30 bp, Artificial Sequence
  Description of Artificial Sequence: Synthetic oligonucleotide
actaccaccaacatgatacaagcagcgccg

SEQ ID NO: 305657 - DNA, 29 bp, Artificial Sequence
  Description of Artificial Sequence: Synthetic oligonucleotide
ctaccaccaacatgatacaagcagcgccg

SEQ ID NO: 305658 - DNA, 29 bp, Artificial Sequence
  Description of Artificial Sequence: Synthetic oligonucleotide
taccaccaacatgatacaagcagcgccgc

SEQ ID NO: 305659 - DNA, 28 bp, Artificial Sequence
  Description of Artificial Sequence: Synthetic oligonucleotide
accaccaacatgatacaagcagcgccgc

SEQ ID NO: 305660 - DNA, 27 bp, Artificial Sequence
  Description of Artificial Sequence: Synthetic oligonucleotide
ccaccaacatgatacaagcagcgccgc

SEQ ID NO: 305661 - DNA, 28 bp, Artificial Sequence
  Description of Artificial Sequence: Synthetic oligonucleotide
caccaacatgatacaagcagcgccgcac

SEQ ID NO: 305662 - DNA, 30 bp, Artificial Sequence
  Description of Artificial Sequence: Synthetic oligonucleotide
accaacatgatacaagcagcgccgcacttc

SEQ ID NO: 305663 - DNA, 29 bp, Artificial Sequence
  Description of Artificial Sequence: Synthetic oligonucleotide
ccaacatgatacaagcagcgccgcacttc

SEQ ID NO: 305664 - DNA, 30 bp, Artificial Sequence
  Description of Artificial Sequence: Synthetic oligonucleotide
caacatgatacaagcagcgccgcacttcac

SEQ ID NO: 305665 - DNA, 30 bp, Artificial Sequence
  Description of Artificial Sequence: Synthetic oligonucleotide
aacatgatacaagcagcgccgcacttcacg

SEQ ID NO: 305666 - DNA, 29 bp, Artificial Sequence
  Description of Artificial Sequence: Synthetic oligonucleotide
acatgatacaagcagcgccgcacttcacg

SEQ ID NO: 305667 - DNA, 28 bp, Artificial Sequence
  Description of Artificial Sequence: Synthetic oligonucleotide
catgatacaagcagcgccgcacttcacg

SEQ ID NO: 305668 - DNA, 30 bp, Artificial Sequence
  Description of Artificial Sequence: Synthetic oligonucleotide
atgatacaagcagcgccgcacttcacgaag

SEQ ID NO: 305669 - DNA, 29 bp, Artificial Sequence
  Description of Artificial Sequence: Synthetic oligonucleotide
tgatacaagcagcgccgcacttcacgaag

SEQ ID NO: 305670 - DNA, 28 bp, Artificial Sequence
  Description of Artificial Sequence: Synthetic oligonucleotide
gatacaagcagcgccgcacttcacgaag

SEQ ID NO: 305671 - DNA, 28 bp, Artificial Sequence
  Description of Artificial Sequence: Synthetic oligonucleotide
atacaagcagcgccgcacttcacgaagg

SEQ ID NO: 305672 - DNA, 27 bp, Artificial Sequence
  Description of Artificial Sequence: Synthetic oligonucleotide
tacaagcagcgccgcacttcacgaagg

SEQ ID NO: 305673 - DNA, 27 bp, Artificial Sequence
  Description of Artificial Sequence: Synthetic oligonucleotide
acaagcagcgccgcacttcacgaaggt

SEQ ID NO: 305674 - DNA, 26 bp, Artificial Sequence
  Description of Artificial Sequence: Synthetic oligonucleotide
caagcagcgccgcacttcacgaaggt

SEQ ID NO: 305675 - DNA, 27 bp, Artificial Sequence
  Description of Artificial Sequence: Synthetic oligonucleotide
aagcagcgccgcacttcacgaaggtct

SEQ ID NO: 305676 - DNA, 26 bp, Artificial Sequence
  Description of Artificial Sequence: Synthetic oligonucleotide
agcagcgccgcacttcacgaaggtct

SEQ ID NO: 305677 - DNA, 25 bp, Artificial Sequence
  Description of Artificial Sequence: Synthetic oligonucleotide
gcagcgccgcacttcacgaaggtct

SEQ ID NO: 305678 - DNA, 26 bp, Artificial Sequence
  Description of Artificial Sequence: Synthetic oligonucleotide
cagcgccgcacttcacgaaggtctca

SEQ ID NO: 305679 - DNA, 27 bp, Artificial Sequence
  Description of Artificial Sequence: Synthetic oligonucleotide
agcgccgcacttcacgaaggtctcagt

SEQ ID NO: 305680 - DNA, 27 bp, Artificial Sequence
  Description of Artificial Sequence: Synthetic oligonucleotide
gcgccgcacttcacgaaggtctcagtt

SEQ ID NO: 305681 - DNA, 28 bp, Artificial Sequence
  Description of Artificial Sequence: Synthetic oligonucleotide
cgccgcacttcacgaaggtctcagttac

SEQ ID NO: 305682 - DNA, 30 bp, Artificial Sequence
  Description of Artificial Sequence: Synthetic oligonucleotide
gccgcacttcacgaaggtctcagttacttg

SEQ ID NO: 305683 - DNA, 30 bp, Artificial Sequence
  Description of Artificial Sequence: Synthetic oligonucleotide
ccgcacttcacgaaggtctcagttacttgc

SEQ ID NO: 305684 - DNA, 33 bp, Artificial Sequence
  Description of Artificial Sequence: Synthetic oligonucleotide
cgcacttcacgaaggtctcagttacttgcaatc

SEQ ID NO: 305685 - DNA, 33 bp, Artificial Sequence
  Description of Artificial Sequence: Synthetic oligonucleotide
gcacttcacgaaggtctcagttacttgcaatcg

SEQ ID NO: 305686 - DNA, 38 bp, Artificial Sequence
  Description of Artificial Sequence: Synthetic oligonucleotide
cacttcacgaaggtctcagttacttgcaatcgtttttc

SEQ ID NO: 305687 - DNA, 38 bp, Artificial Sequence
  Description of Artificial Sequence: Synthetic oligonucleotide
acttcacgaaggtctcagttacttgcaatcgtttttcc

SEQ ID NO: 305688 - DNA, 37 bp, Artificial Sequence
  Description of Artificial Sequence: Synthetic oligonucleotide
cttcacgaaggtctcagttacttgcaatcgtttttcc

SEQ ID NO: 305689 - DNA, 38 bp, Artificial Sequence
  Description of Artificial Sequence: Synthetic oligonucleotide
ttcacgaaggtctcagttacttgcaatcgtttttccac

SEQ ID NO: 305690 - DNA, 37 bp, Artificial Sequence
  Description of Artificial Sequence: Synthetic oligonucleotide
tcacgaaggtctcagttacttgcaatcgtttttccac

SEQ ID NO: 305691 - DNA, 36 bp, Artificial Sequence
  Description of Artificial Sequence: Synthetic oligonucleotide
cacgaaggtctcagttacttgcaatcgtttttccac

SEQ ID NO: 305692 - DNA, 38 bp, Artificial Sequence
  Description of Artificial Sequence: Synthetic oligonucleotide
acgaaggtctcagttacttgcaatcgtttttccacatg

SEQ ID NO: 305693 - DNA, 37 bp, Artificial Sequence
  Description of Artificial Sequence: Synthetic oligonucleotide
cgaaggtctcagttacttgcaatcgtttttccacatg

SEQ ID NO: 305694 - DNA, 39 bp, Artificial Sequence
  Description of Artificial Sequence: Synthetic oligonucleotide
gaaggtctcagttacttgcaatcgtttttccacatgatc

SEQ ID NO: 305695 - DNA, 39 bp, Artificial Sequence
  Description of Artificial Sequence: Synthetic oligonucleotide
aaggtctcagttacttgcaatcgtttttccacatgatcg

SEQ ID NO: 305696 - DNA, 38 bp, Artificial Sequence
  Description of Artificial Sequence: Synthetic oligonucleotide
aggtctcagttacttgcaatcgtttttccacatgatcg

SEQ ID NO: 305697 - DNA, 37 bp, Artificial Sequence
  Description of Artificial Sequence: Synthetic oligonucleotide
ggtctcagttacttgcaatcgtttttccacatgatcg

SEQ ID NO: 305698 - DNA, 38 bp, Artificial Sequence
  Description of Artificial Sequence: Synthetic oligonucleotide
gtctcagttacttgcaatcgtttttccacatgatcgac

SEQ ID NO: 305699 - DNA, 39 bp, Artificial Sequence
  Description of Artificial Sequence: Synthetic oligonucleotide
tctcagttacttgcaatcgtttttccacatgatcgacag

SEQ ID NO: 305700 - DNA, 38 bp, Artificial Sequence
  Description of Artificial Sequence: Synthetic oligonucleotide
ctcagttacttgcaatcgtttttccacatgatcgacag

SEQ ID NO: 305701 - DNA, 40 bp, Artificial Sequence
  Description of Artificial Sequence: Synthetic oligonucleotide
tcagttacttgcaatcgtttttccacatgatcgacagaag

SEQ ID NO: 305702 - DNA, 39 bp, Artificial Sequence
  Description of Artificial Sequence: Synthetic oligonucleotide
cagttacttgcaatcgtttttccacatgatcgacagaag

SEQ ID NO: 305703 - DNA, 39 bp, Artificial Sequence
  Description of Artificial Sequence: Synthetic oligonucleotide
agttacttgcaatcgtttttccacatgatcgacagaagg

SEQ ID NO: 305704 - DNA, 38 bp, Artificial Sequence
  Description of Artificial Sequence: Synthetic oligonucleotide
gttacttgcaatcgtttttccacatgatcgacagaagg

SEQ ID NO: 305705 - DNA, 45 bp, Artificial Sequence
  Description of Artificial Sequence: Synthetic oligonucleotide
ttacttgcaatcgtttttccacatgatcgacagaaggtatatttc

SEQ ID NO: 305706 - DNA, 44 bp, Artificial Sequence
  Description of Artificial Sequence: Synthetic oligonucleotide
tacttgcaatcgtttttccacatgatcgacagaaggtatatttc

SEQ ID NO: 305707 - DNA, 43 bp, Artificial Sequence
  Description of Artificial Sequence: Synthetic oligonucleotide
acttgcaatcgtttttccacatgatcgacagaaggtatatttc

SEQ ID NO: 305708 - DNA, 42 bp, Artificial Sequence
  Description of Artificial Sequence: Synthetic oligonucleotide
cttgcaatcgtttttccacatgatcgacagaaggtatatttc

SEQ ID NO: 305709 - DNA, 43 bp, Artificial Sequence
  Description of Artificial Sequence: Synthetic oligonucleotide
ttgcaatcgtttttccacatgatcgacagaaggtatatttcag

SEQ ID NO: 305710 - DNA, 42 bp, Artificial Sequence
  Description of Artificial Sequence: Synthetic oligonucleotide
tgcaatcgtttttccacatgatcgacagaaggtatatttcag

SEQ ID NO: 305711 - DNA, 41 bp, Artificial Sequence
  Description of Artificial Sequence: Synthetic oligonucleotide
gcaatcgtttttccacatgatcgacagaaggtatatttcag

SEQ ID NO: 305712 - DNA, 45 bp, Artificial Sequence
  Description of Artificial Sequence: Synthetic oligonucleotide
caatcgtttttccacatgatcgacagaaggtatatttcagttatc

SEQ ID NO: 305713 - DNA, 46 bp, Artificial Sequence
  Description of Artificial Sequence: Synthetic oligonucleotide
aatcgtttttccacatgatcgacagaaggtatatttcagttatctc

SEQ ID NO: 305714 - DNA, 45 bp, Artificial Sequence
  Description of Artificial Sequence: Synthetic oligonucleotide
atcgtttttccacatgatcgacagaaggtatatttcagttatctc

SEQ ID NO: 305715 - DNA, 44 bp, Artificial Sequence
  Description of Artificial Sequence: Synthetic oligonucleotide
tcgtttttccacatgatcgacagaaggtatatttcagttatctc

SEQ ID NO: 305716 - DNA, 43 bp, Artificial Sequence
  Description of Artificial Sequence: Synthetic oligonucleotide
cgtttttccacatgatcgacagaaggtatatttcagttatctc

SEQ ID NO: 305717 - DNA, 44 bp, Artificial Sequence
  Description of Artificial Sequence: Synthetic oligonucleotide
gtttttccacatgatcgacagaaggtatatttcagttatctctg

SEQ ID NO: 305718 - DNA, 48 bp, Artificial Sequence
  Description of Artificial Sequence: Synthetic oligonucleotide
tttttccacatgatcgacagaaggtatatttcagttatctctgataac

SEQ ID NO: 305719 - DNA, 47 bp, Artificial Sequence
  Description of Artificial Sequence: Synthetic oligonucleotide
ttttccacatgatcgacagaaggtatatttcagttatctctgataac

SEQ ID NO: 305720 - DNA, 46 bp, Artificial Sequence
  Description of Artificial Sequence: Synthetic oligonucleotide
tttccacatgatcgacagaaggtatatttcagttatctctgataac

SEQ ID NO: 305721 - DNA, 45 bp, Artificial Sequence
  Description of Artificial Sequence: Synthetic oligonucleotide
ttccacatgatcgacagaaggtatatttcagttatctctgataac

SEQ ID NO: 305722 - DNA, 44 bp, Artificial Sequence
  Description of Artificial Sequence: Synthetic oligonucleotide
tccacatgatcgacagaaggtatatttcagttatctctgataac

SEQ ID NO: 305723 - DNA, 43 bp, Artificial Sequence
  Description of Artificial Sequence: Synthetic oligonucleotide
ccacatgatcgacagaaggtatatttcagttatctctgataac

SEQ ID NO: 305724 - DNA, 43 bp, Artificial Sequence
  Description of Artificial Sequence: Synthetic oligonucleotide
cacatgatcgacagaaggtatatttcagttatctctgataacc

SEQ ID NO: 305725 - DNA, 44 bp, Artificial Sequence
  Description of Artificial Sequence: Synthetic oligonucleotide
acatgatcgacagaaggtatatttcagttatctctgataacctc

SEQ ID NO: 305726 - DNA, 43 bp, Artificial Sequence
  Description of Artificial Sequence: Synthetic oligonucleotide
catgatcgacagaaggtatatttcagttatctctgataacctc

SEQ ID NO: 305727 - DNA, 45 bp, Artificial Sequence
  Description of Artificial Sequence: Synthetic oligonucleotide
atgatcgacagaaggtatatttcagttatctctgataacctcaag

SEQ ID NO: 305728 - DNA, 44 bp, Artificial Sequence
  Description of Artificial Sequence: Synthetic oligonucleotide
tgatcgacagaaggtatatttcagttatctctgataacctcaag

SEQ ID NO: 305729 - DNA, 43 bp, Artificial Sequence
  Description of Artificial Sequence: Synthetic oligonucleotide
gatcgacagaaggtatatttcagttatctctgataacctcaag

SEQ ID NO: 305730 - DNA, 43 bp, Artificial Sequence
  Description of Artificial Sequence: Synthetic oligonucleotide
atcgacagaaggtatatttcagttatctctgataacctcaagg

SEQ ID NO: 305731 - DNA, 42 bp, Artificial Sequence
  Description of Artificial Sequence: Synthetic oligonucleotide
tcgacagaaggtatatttcagttatctctgataacctcaagg

SEQ ID NO: 305732 - DNA, 41 bp, Artificial Sequence
  Description of Artificial Sequence: Synthetic oligonucleotide
cgacagaaggtatatttcagttatctctgataacctcaagg

SEQ ID NO: 305733 - DNA, 41 bp, Artificial Sequence
  Description of Artificial Sequence: Synthetic oligonucleotide
gacagaaggtatatttcagttatctctgataacctcaaggg

SEQ ID NO: 305734 - DNA, 44 bp, Artificial Sequence
  Description of Artificial Sequence: Synthetic oligonucleotide
acagaaggtatatttcagttatctctgataacctcaagggttac

SEQ ID NO: 305735 - DNA, 43 bp, Artificial Sequence
  Description of Artificial Sequence: Synthetic oligonucleotide
cagaaggtatatttcagttatctctgataacctcaagggttac

SEQ ID NO: 305736 - DNA, 43 bp, Artificial Sequence
  Description of Artificial Sequence: Synthetic oligonucleotide
agaaggtatatttcagttatctctgataacctcaagggttacc

SEQ ID NO: 305737 - DNA, 42 bp, Artificial Sequence
  Description of Artificial Sequence: Synthetic oligonucleotide
gaaggtatatttcagttatctctgataacctcaagggttacc

SEQ ID NO: 305738 - DNA, 44 bp, Artificial Sequence
  Description of Artificial Sequence: Synthetic oligonucleotide
aaggtatatttcagttatctctgataacctcaagggttaccttc

SEQ ID NO: 305739 - DNA, 43 bp, Artificial Sequence
  Description of Artificial Sequence: Synthetic oligonucleotide
aggtatatttcagttatctctgataacctcaagggttaccttc

SEQ ID NO: 305740 - DNA, 42 bp, Artificial Sequence
  Description of Artificial Sequence: Synthetic oligonucleotide
ggtatatttcagttatctctgataacctcaagggttaccttc

SEQ ID NO: 305741 - DNA, 44 bp, Artificial Sequence
  Description of Artificial Sequence: Synthetic oligonucleotide
gtatatttcagttatctctgataacctcaagggttaccttcatc

SEQ ID NO: 305742 - DNA, 45 bp, Artificial Sequence
  Description of Artificial Sequence: Synthetic oligonucleotide
tatatttcagttatctctgataacctcaagggttaccttcatcag

SEQ ID NO: 305743 - DNA, 44 bp, Artificial Sequence
  Description of Artificial Sequence: Synthetic oligonucleotide
atatttcagttatctctgataacctcaagggttaccttcatcag

SEQ ID NO: 305744 - DNA, 43 bp, Artificial Sequence
  Description of Artificial Sequence: Synthetic oligonucleotide
tatttcagttatctctgataacctcaagggttaccttcatcag

SEQ ID NO: 305745 - DNA, 42 bp, Artificial Sequence
  Description of Artificial Sequence: Synthetic oligonucleotide
atttcagttatctctgataacctcaagggttaccttcatcag

SEQ ID NO: 305746 - DNA, 41 bp, Artificial Sequence
  Description of Artificial Sequence: Synthetic oligonucleotide
tttcagttatctctgataacctcaagggttaccttcatcag

SEQ ID NO: 305747 - DNA, 40 bp, Artificial Sequence
  Description of Artificial Sequence: Synthetic oligonucleotide
ttcagttatctctgataacctcaagggttaccttcatcag

SEQ ID NO: 305748 - DNA, 39 bp, Artificial Sequence
  Description of Artificial Sequence: Synthetic oligonucleotide
tcagttatctctgataacctcaagggttaccttcatcag

SEQ ID NO: 305749 - DNA, 38 bp, Artificial Sequence
  Description of Artificial Sequence: Synthetic oligonucleotide
cagttatctctgataacctcaagggttaccttcatcag

SEQ ID NO: 305750 - DNA, 46 bp, Artificial Sequence
  Description of Artificial Sequence: Synthetic oligonucleotide
agttatctctgataacctcaagggttaccttcatcagtatttaaag

SEQ ID NO: 305751 - DNA, 45 bp, Artificial Sequence
  Description of Artificial Sequence: Synthetic oligonucleotide
gttatctctgataacctcaagggttaccttcatcagtatttaaag

SEQ ID NO: 305752 - DNA, 45 bp, Artificial Sequence
  Description of Artificial Sequence: Synthetic oligonucleotide
ttatctctgataacctcaagggttaccttcatcagtatttaaagc

SEQ ID NO: 305753 - DNA, 44 bp, Artificial Sequence
  Description of Artificial Sequence: Synthetic oligonucleotide
tatctctgataacctcaagggttaccttcatcagtatttaaagc

SEQ ID NO: 305754 - DNA, 43 bp, Artificial Sequence
  Description of Artificial Sequence: Synthetic oligonucleotide
atctctgataacctcaagggttaccttcatcagtatttaaagc

SEQ ID NO: 305755 - DNA, 42 bp, Artificial Sequence
  Description of Artificial Sequence: Synthetic oligonucleotide
tctctgataacctcaagggttaccttcatcagtatttaaagc

SEQ ID NO: 305756 - DNA, 41 bp, Artificial Sequence
  Description of Artificial Sequence: Synthetic oligonucleotide
ctctgataacctcaagggttaccttcatcagtatttaaagc

SEQ ID NO: 305757 - DNA, 41 bp, Artificial Sequence
  Description of Artificial Sequence: Synthetic oligonucleotide
tctgataacctcaagggttaccttcatcagtatttaaagcc

SEQ ID NO: 305758 - DNA, 40 bp, Artificial Sequence
  Description of Artificial Sequence: Synthetic oligonucleotide
ctgataacctcaagggttaccttcatcagtatttaaagcc

SEQ ID NO: 305759 - DNA, 41 bp, Artificial Sequence
  Description of Artificial Sequence: Synthetic oligonucleotide
tgataacctcaagggttaccttcatcagtatttaaagccag

SEQ ID NO: 305760 - DNA, 40 bp, Artificial Sequence
  Description of Artificial Sequence: Synthetic oligonucleotide
gataacctcaagggttaccttcatcagtatttaaagccag

SEQ ID NO: 305761 - DNA, 41 bp, Artificial Sequence
  Description of Artificial Sequence: Synthetic oligonucleotide
ataacctcaagggttaccttcatcagtatttaaagccagtg

SEQ ID NO: 305762 - DNA, 40 bp, Artificial Sequence
  Description of Artificial Sequence: Synthetic oligonucleotide
taacctcaagggttaccttcatcagtatttaaagccagtg

SEQ ID NO: 305763 - DNA, 39 bp, Artificial Sequence
  Description of Artificial Sequence: Synthetic oligonucleotide
aacctcaagggttaccttcatcagtatttaaagccagtg

SEQ ID NO: 305764 - DNA, 38 bp, Artificial Sequence
  Description of Artificial Sequence: Synthetic oligonucleotide
acctcaagggttaccttcatcagtatttaaagccagtg

SEQ ID NO: 305765 - DNA, 37 bp, Artificial Sequence
  Description of Artificial Sequence: Synthetic oligonucleotide
cctcaagggttaccttcatcagtatttaaagccagtg

SEQ ID NO: 305766 - DNA, 40 bp, Artificial Sequence
  Description of Artificial Sequence: Synthetic oligonucleotide
ctcaagggttaccttcatcagtatttaaagccagtgtttg

SEQ ID NO: 305767 - DNA, 41 bp, Artificial Sequence
  Description of Artificial Sequence: Synthetic oligonucleotide
tcaagggttaccttcatcagtatttaaagccagtgtttgac

SEQ ID NO: 305768 - DNA, 40 bp, Artificial Sequence
  Description of Artificial Sequence: Synthetic oligonucleotide
caagggttaccttcatcagtatttaaagccagtgtttgac

SEQ ID NO: 305769 - DNA, 41 bp, Artificial Sequence
  Description of Artificial Sequence: Synthetic oligonucleotide
aagggttaccttcatcagtatttaaagccagtgtttgacag

SEQ ID NO: 305770 - DNA, 40 bp, Artificial Sequence
  Description of Artificial Sequence: Synthetic oligonucleotide
agggttaccttcatcagtatttaaagccagtgtttgacag

SEQ ID NO: 305771 - DNA, 39 bp, Artificial Sequence
  Description of Artificial Sequence: Synthetic oligonucleotide
gggttaccttcatcagtatttaaagccagtgtttgacag

SEQ ID NO: 305772 - DNA, 39 bp, Artificial Sequence
  Description of Artificial Sequence: Synthetic oligonucleotide
ggttaccttcatcagtatttaaagccagtgtttgacagg

SEQ ID NO: 305773 - DNA, 39 bp, Artificial Sequence
  Description of Artificial Sequence: Synthetic oligonucleotide
gttaccttcatcagtatttaaagccagtgtttgacaggc

SEQ ID NO: 305774 - DNA, 42 bp, Artificial Sequence
  Description of Artificial Sequence: Synthetic oligonucleotide
ttaccttcatcagtatttaaagccagtgtttgacaggctaag

SEQ ID NO: 305775 - DNA, 41 bp, Artificial Sequence
  Description of Artificial Sequence: Synthetic oligonucleotide
taccttcatcagtatttaaagccagtgtttgacaggctaag

SEQ ID NO: 305776 - DNA, 40 bp, Artificial Sequence
  Description of Artificial Sequence: Synthetic oligonucleotide
accttcatcagtatttaaagccagtgtttgacaggctaag

SEQ ID NO: 305777 - DNA, 39 bp, Artificial Sequence
  Description of Artificial Sequence: Synthetic oligonucleotide
ccttcatcagtatttaaagccagtgtttgacaggctaag

SEQ ID NO: 305778 - DNA, 39 bp, Artificial Sequence
  Description of Artificial Sequence: Synthetic oligonucleotide
cttcatcagtatttaaagccagtgtttgacaggctaagc

SEQ ID NO: 305779 - DNA, 40 bp, Artificial Sequence
  Description of Artificial Sequence: Synthetic oligonucleotide
ttcatcagtatttaaagccagtgtttgacaggctaagctg

SEQ ID NO: 305780 - DNA, 39 bp, Artificial Sequence
  Description of Artificial Sequence: Synthetic oligonucleotide
tcatcagtatttaaagccagtgtttgacaggctaagctg

SEQ ID NO: 305781 - DNA, 38 bp, Artificial Sequence
  Description of Artificial Sequence: Synthetic oligonucleotide
catcagtatttaaagccagtgtttgacaggctaagctg

SEQ ID NO: 305782 - DNA, 38 bp, Artificial Sequence
  Description of Artificial Sequence: Synthetic oligonucleotide
atcagtatttaaagccagtgtttgacaggctaagctgg

SEQ ID NO: 305783 - DNA, 37 bp, Artificial Sequence
  Description of Artificial Sequence: Synthetic oligonucleotide
tcagtatttaaagccagtgtttgacaggctaagctgg

SEQ ID NO: 305784 - DNA, 36 bp, Artificial Sequence
  Description of Artificial Sequence: Synthetic oligonucleotide
cagtatttaaagccagtgtttgacaggctaagctgg

SEQ ID NO: 305785 - DNA, 37 bp, Artificial Sequence
  Description of Artificial Sequence: Synthetic oligonucleotide
agtatttaaagccagtgtttgacaggctaagctggag

SEQ ID NO: 305786 - DNA, 36 bp, Artificial Sequence
  Description of Artificial Sequence: Synthetic oligonucleotide
gtatttaaagccagtgtttgacaggctaagctggag

SEQ ID NO: 305787 - DNA, 37 bp, Artificial Sequence
  Description of Artificial Sequence: Synthetic oligonucleotide
tatttaaagccagtgtttgacaggctaagctggagag

SEQ ID NO: 305788 - DNA, 36 bp, Artificial Sequence
  Description of Artificial Sequence: Synthetic oligonucleotide
atttaaagccagtgtttgacaggctaagctggagag

SEQ ID NO: 305789 - DNA, 35 bp, Artificial Sequence
  Description of Artificial Sequence: Synthetic oligonucleotide
tttaaagccagtgtttgacaggctaagctggagag

SEQ ID NO: 305790 - DNA, 34 bp, Artificial Sequence
  Description of Artificial Sequence: Synthetic oligonucleotide
ttaaagccagtgtttgacaggctaagctggagag

SEQ ID NO: 305791 - DNA, 33 bp, Artificial Sequence
  Description of Artificial Sequence: Synthetic oligonucleotide
taaagccagtgtttgacaggctaagctggagag

SEQ ID NO: 305792 - DNA, 32 bp, Artificial Sequence
  Description of Artificial Sequence: Synthetic oligonucleotide
aaagccagtgtttgacaggctaagctggagag

SEQ ID NO: 305793 - DNA, 31 bp, Artificial Sequence
  Description of Artificial Sequence: Synthetic oligonucleotide
aagccagtgtttgacaggctaagctggagag

SEQ ID NO: 305794 - DNA, 30 bp, Artificial Sequence
  Description of Artificial Sequence: Synthetic oligonucleotide
agccagtgtttgacaggctaagctggagag

SEQ ID NO: 305795 - DNA, 29 bp, Artificial Sequence
  Description of Artificial Sequence: Synthetic oligonucleotide
gccagtgtttgacaggctaagctggagag

SEQ ID NO: 305796 - DNA, 30 bp, Artificial Sequence
  Description of Artificial Sequence: Synthetic oligonucleotide
ccagtgtttgacaggctaagctggagagac

SEQ ID NO: 305797 - DNA, 32 bp, Artificial Sequence
  Description of Artificial Sequence: Synthetic oligonucleotide
cagtgtttgacaggctaagctggagagacaag

SEQ ID NO: 305798 - DNA, 32 bp, Artificial Sequence
  Description of Artificial Sequence: Synthetic oligonucleotide
agtgtttgacaggctaagctggagagacaagg

SEQ ID NO: 305799 - DNA, 31 bp, Artificial Sequence
  Description of Artificial Sequence: Synthetic oligonucleotide
gtgtttgacaggctaagctggagagacaagg

SEQ ID NO: 305800 - DNA, 31 bp, Artificial Sequence
  Description of Artificial Sequence: Synthetic oligonucleotide
tgtttgacaggctaagctggagagacaaggg

SEQ ID NO: 305801 - DNA, 30 bp, Artificial Sequence
  Description of Artificial Sequence: Synthetic oligonucleotide
gtttgacaggctaagctggagagacaaggg

SEQ ID NO: 305802 - DNA, 30 bp, Artificial Sequence
  Description of Artificial Sequence: Synthetic oligonucleotide
tttgacaggctaagctggagagacaagggc

SEQ ID NO: 305803 - DNA, 29 bp, Artificial Sequence
  Description of Artificial Sequence: Synthetic oligonucleotide
ttgacaggctaagctggagagacaagggc

SEQ ID NO: 305804 - DNA, 28 bp, Artificial Sequence
  Description of Artificial Sequence: Synthetic oligonucleotide
tgacaggctaagctggagagacaagggc

SEQ ID NO: 305805 - DNA, 27 bp, Artificial Sequence
  Description of Artificial Sequence: Synthetic oligonucleotide
gacaggctaagctggagagacaagggc

SEQ ID NO: 305806 - DNA, 28 bp, Artificial Sequence
  Description of Artificial Sequence: Synthetic oligonucleotide
acaggctaagctggagagacaagggcac

SEQ ID NO: 305807 - DNA, 27 bp, Artificial Sequence
  Description of Artificial Sequence: Synthetic oligonucleotide
caggctaagctggagagacaagggcac

SEQ ID NO: 305808 - DNA, 28 bp, Artificial Sequence
  Description of Artificial Sequence: Synthetic oligonucleotide
aggctaagctggagagacaagggcacag

SEQ ID NO: 305809 - DNA, 27 bp, Artificial Sequence
  Description of Artificial Sequence: Synthetic oligonucleotide
ggctaagctggagagacaagggcacag

SEQ ID NO: 305810 - DNA, 28 bp, Artificial Sequence
  Description of Artificial Sequence: Synthetic oligonucleotide
gctaagctggagagacaagggcacagtc

SEQ ID NO: 305811 - DNA, 29 bp, Artificial Sequence
  Description of Artificial Sequence: Synthetic oligonucleotide
ctaagctggagagacaagggcacagtctg

SEQ ID NO: 305812 - DNA, 29 bp, Artificial Sequence
  Description of Artificial Sequence: Synthetic oligonucleotide
taagctggagagacaagggcacagtctgg

SEQ ID NO: 305813 - DNA, 28 bp, Artificial Sequence
  Description of Artificial Sequence: Synthetic oligonucleotide
aagctggagagacaagggcacagtctgg

SEQ ID NO: 305814 - DNA, 27 bp, Artificial Sequence
  Description of Artificial Sequence: Synthetic oligonucleotide
agctggagagacaagggcacagtctgg

SEQ ID NO: 305815 - DNA, 26 bp, Artificial Sequence
  Description of Artificial Sequence: Synthetic oligonucleotide
gctggagagacaagggcacagtctgg

SEQ ID NO: 305816 - DNA, 27 bp, Artificial Sequence
  Description of Artificial Sequence: Synthetic oligonucleotide
ctggagagacaagggcacagtctgggt

SEQ ID NO: 305817 - DNA, 27 bp, Artificial Sequence
  Description of Artificial Sequence: Synthetic oligonucleotide
tggagagacaagggcacagtctgggtc

SEQ ID NO: 305818 - DNA, 27 bp, Artificial Sequence
  Description of Artificial Sequence: Synthetic oligonucleotide
ggagagacaagggcacagtctgggtca

SEQ ID NO: 305819 - DNA, 27 bp, Artificial Sequence
  Description of Artificial Sequence: Synthetic oligonucleotide
gagagacaagggcacagtctgggtcag

SEQ ID NO: 305820 - DNA, 27 bp, Artificial Sequence
  Description of Artificial Sequence: Synthetic oligonucleotide
agagacaagggcacagtctgggtcagg

SEQ ID NO: 305821 - DNA, 27 bp, Artificial Sequence
  Description of Artificial Sequence: Synthetic oligonucleotide
gagacaagggcacagtctgggtcagga

SEQ ID NO: 305822 - DNA, 28 bp, Artificial Sequence
  Description of Artificial Sequence: Synthetic oligonucleotide
agacaagggcacagtctgggtcaggatg

SEQ ID NO: 305823 - DNA, 27 bp, Artificial Sequence
  Description of Artificial Sequence: Synthetic oligonucleotide
gacaagggcacagtctgggtcaggatg

SEQ ID NO: 305824 - DNA, 27 bp, Artificial Sequence
  Description of Artificial Sequence: Synthetic oligonucleotide
acaagggcacagtctgggtcaggatgc

SEQ ID NO: 305825 - DNA, 27 bp, Artificial Sequence
  Description of Artificial Sequence: Synthetic oligonucleotide
caagggcacagtctgggtcaggatgct

SEQ ID NO: 305826 - DNA, 27 bp, Artificial Sequence
  Description of Artificial Sequence: Synthetic oligonucleotide
aagggcacagtctgggtcaggatgctg

SEQ ID NO: 305827 - DNA, 26 bp, Artificial Sequence
  Description of Artificial Sequence: Synthetic oligonucleotide
agggcacagtctgggtcaggatgctg

SEQ ID NO: 305828 - DNA, 25 bp, Artificial Sequence
  Description of Artificial Sequence: Synthetic oligonucleotide
gggcacagtctgggtcaggatgctg

SEQ ID NO: 305829 - DNA, 25 bp, Artificial Sequence
  Description of Artificial Sequence: Synthetic oligonucleotide
ggcacagtctgggtcaggatgctgc

SEQ ID NO: 305830 - DNA, 25 bp, Artificial Sequence
  Description of Artificial Sequence: Synthetic oligonucleotide
gcacagtctgggtcaggatgctgcg

SEQ ID NO: 305831 - DNA, 26 bp, Artificial Sequence
  Description of Artificial Sequence: Synthetic oligonucleotide
cacagtctgggtcaggatgctgcgct

SEQ ID NO: 305832 - DNA, 26 bp, Artificial Sequence
  Description of Artificial Sequence: Synthetic oligonucleotide
acagtctgggtcaggatgctgcgctc

SEQ ID NO: 305833 - DNA, 25 bp, Artificial Sequence
  Description of Artificial Sequence: Synthetic oligonucleotide
cagtctgggtcaggatgctgcgctc

SEQ ID NO: 305834 - DNA, 25 bp, Artificial Sequence
  Description of Artificial Sequence: Synthetic oligonucleotide
agtctgggtcaggatgctgcgctcg

SEQ ID NO: 305835 - DNA, 24 bp, Artificial Sequence
  Description of Artificial Sequence: Synthetic oligonucleotide
gtctgggtcaggatgctgcgctcg

SEQ ID NO: 305836 - DNA, 24 bp, Artificial Sequence
  Description of Artificial Sequence: Synthetic oligonucleotide
tctgggtcaggatgctgcgctcgg

SEQ ID NO: 305837 - DNA, 23 bp, Artificial Sequence
  Description of Artificial Sequence: Synthetic oligonucleotide
ctgggtcaggatgctgcgctcgg

SEQ ID NO: 305838 - DNA, 24 bp, Artificial Sequence
  Description of Artificial Sequence: Synthetic oligonucleotide
tgggtcaggatgctgcgctcggct

SEQ ID NO: 305839 - DNA, 23 bp, Artificial Sequence
  Description of Artificial Sequence: Synthetic oligonucleotide
gggtcaggatgctgcgctcggct

SEQ ID NO: 305840 - DNA, 24 bp, Artificial Sequence
  Description of Artificial Sequence: Synthetic oligonucleotide
ggtcaggatgctgcgctcggctgt

SEQ ID NO: 305841 - DNA, 26 bp, Artificial Sequence
  Description of Artificial Sequence: Synthetic oligonucleotide
gtcaggatgctgcgctcggctgtctt

SEQ ID NO: 305842 - DNA, 27 bp, Artificial Sequence
  Description of Artificial Sequence: Synthetic oligonucleotide
tcaggatgctgcgctcggctgtcttga

SEQ ID NO: 305843 - DNA, 27 bp, Artificial Sequence
  Description of Artificial Sequence: Synthetic oligonucleotide
caggatgctgcgctcggctgtcttgaa

SEQ ID NO: 305844 - DNA, 27 bp, Artificial Sequence
  Description of Artificial Sequence: Synthetic oligonucleotide
aggatgctgcgctcggctgtcttgaag

SEQ ID NO: 305845 - DNA, 26 bp, Artificial Sequence
  Description of Artificial Sequence: Synthetic oligonucleotide
ggatgctgcgctcggctgtcttgaag

SEQ ID NO: 305846 - DNA, 27 bp, Artificial Sequence
  Description of Artificial Sequence: Synthetic oligonucleotide
gatgctgcgctcggctgtcttgaagca

SEQ ID NO: 305847 - DNA, 27 bp, Artificial Sequence
  Description of Artificial Sequence: Synthetic oligonucleotide
atgctgcgctcggctgtcttgaagcag

SEQ ID NO: 305848 - DNA, 26 bp, Artificial Sequence
  Description of Artificial Sequence: Synthetic oligonucleotide
tgctgcgctcggctgtcttgaagcag

SEQ ID NO: 305849 - DNA, 25 bp, Artificial Sequence
  Description of Artificial Sequence: Synthetic oligonucleotide
gctgcgctcggctgtcttgaagcag

SEQ ID NO: 305850 - DNA, 25 bp, Artificial Sequence
  Description of Artificial Sequence: Synthetic oligonucleotide
ctgcgctcggctgtcttgaagcagg

SEQ ID NO: 305851 - DNA, 25 bp, Artificial Sequence
  Description of Artificial Sequence: Synthetic oligonucleotide
tgcgctcggctgtcttgaagcaggc

SEQ ID NO: 305852 - DNA, 24 bp, Artificial Sequence
  Description of Artificial Sequence: Synthetic oligonucleotide
gcgctcggctgtcttgaagcaggc

SEQ ID NO: 305853 - DNA, 25 bp, Artificial Sequence
  Description of Artificial Sequence: Synthetic oligonucleotide
cgctcggctgtcttgaagcaggcct

SEQ ID NO: 305854 - DNA, 26 bp, Artificial Sequence
  Description of Artificial Sequence: Synthetic oligonucleotide
gctcggctgtcttgaagcaggcctgt

SEQ ID NO: 305855 - DNA, 27 bp, Artificial Sequence
  Description of Artificial Sequence: Synthetic oligonucleotide
ctcggctgtcttgaagcaggcctgtga

SEQ ID NO: 305856 - DNA, 27 bp, Artificial Sequence
  Description of Artificial Sequence: Synthetic oligonucleotide
tcggctgtcttgaagcaggcctgtgag

SEQ ID NO: 305857 - DNA, 26 bp, Artificial Sequence
  Description of Artificial Sequence: Synthetic oligonucleotide
cggctgtcttgaagcaggcctgtgag

SEQ ID NO: 305858 - DNA, 27 bp, Artificial Sequence
  Description of Artificial Sequence: Synthetic oligonucleotide
ggctgtcttgaagcaggcctgtgagct

SEQ ID NO: 305859 - DNA, 27 bp, Artificial Sequence
  Description of Artificial Sequence: Synthetic oligonucleotide
gctgtcttgaagcaggcctgtgagctg

SEQ ID NO: 305860 - DNA, 29 bp, Artificial Sequence
  Description of Artificial Sequence: Synthetic oligonucleotide
ctgtcttgaagcaggcctgtgagctgaac

SEQ ID NO: 305861 - DNA, 29 bp, Artificial Sequence
  Description of Artificial Sequence: Synthetic oligonucleotide
tgtcttgaagcaggcctgtgagctgaacc

SEQ ID NO: 305862 - DNA, 28 bp, Artificial Sequence
  Description of Artificial Sequence: Synthetic oligonucleotide
gtcttgaagcaggcctgtgagctgaacc

SEQ ID NO: 305863 - DNA, 30 bp, Artificial Sequence
  Description of Artificial Sequence: Synthetic oligonucleotide
tcttgaagcaggcctgtgagctgaaccatc

SEQ ID NO: 305864 - DNA, 29 bp, Artificial Sequence
  Description of Artificial Sequence: Synthetic oligonucleotide
cttgaagcaggcctgtgagctgaaccatc

SEQ ID NO: 305865 - DNA, 29 bp, Artificial Sequence
  Description of Artificial Sequence: Synthetic oligonucleotide
ttgaagcaggcctgtgagctgaaccatcc

SEQ ID NO: 305866 - DNA, 28 bp, Artificial Sequence
  Description of Artificial Sequence: Synthetic oligonucleotide
tgaagcaggcctgtgagctgaaccatcc

SEQ ID NO: 305867 - DNA, 27 bp, Artificial Sequence
  Description of Artificial Sequence: Synthetic oligonucleotide
gaagcaggcctgtgagctgaaccatcc

SEQ ID NO: 305868 - DNA, 28 bp, Artificial Sequence
  Description of Artificial Sequence: Synthetic oligonucleotide
aagcaggcctgtgagctgaaccatcctc

SEQ ID NO: 305869 - DNA, 27 bp, Artificial Sequence
  Description of Artificial Sequence: Synthetic oligonucleotide
agcaggcctgtgagctgaaccatcctc

SEQ ID NO: 305870 - DNA, 26 bp, Artificial Sequence
  Description of Artificial Sequence: Synthetic oligonucleotide
gcaggcctgtgagctgaaccatcctc

SEQ ID NO: 305871 - DNA, 27 bp, Artificial Sequence
  Description of Artificial Sequence: Synthetic oligonucleotide
caggcctgtgagctgaaccatcctcct

SEQ ID NO: 305872 - DNA, 28 bp, Artificial Sequence
  Description of Artificial Sequence: Synthetic oligonucleotide
aggcctgtgagctgaaccatcctccttg

SEQ ID NO: 305873 - DNA, 27 bp, Artificial Sequence
  Description of Artificial Sequence: Synthetic oligonucleotide
ggcctgtgagctgaaccatcctccttg

SEQ ID NO: 305874 - DNA, 27 bp, Artificial Sequence
  Description of Artificial Sequence: Synthetic oligonucleotide
gcctgtgagctgaaccatcctccttgc

SEQ ID NO: 305875 - DNA, 29 bp, Artificial Sequence
  Description of Artificial Sequence: Synthetic oligonucleotide
cctgtgagctgaaccatcctccttgcaac

SEQ ID NO: 305876 - DNA, 29 bp, Artificial Sequence
  Description of Artificial Sequence: Synthetic oligonucleotide
ctgtgagctgaaccatcctccttgcaacc

SEQ ID NO: 305877 - DNA, 30 bp, Artificial Sequence
  Description of Artificial Sequence: Synthetic oligonucleotide
tgtgagctgaaccatcctccttgcaaccag

SEQ ID NO: 305878 - DNA, 29 bp, Artificial Sequence
  Description of Artificial Sequence: Synthetic oligonucleotide
gtgagctgaaccatcctccttgcaaccag

SEQ ID NO: 305879 - DNA, 32 bp, Artificial Sequence
  Description of Artificial Sequence: Synthetic oligonucleotide
tgagctgaaccatcctccttgcaaccagaaag

SEQ ID NO: 305880 - DNA, 31 bp, Artificial Sequence
  Description of Artificial Sequence: Synthetic oligonucleotide
gagctgaaccatcctccttgcaaccagaaag

SEQ ID NO: 305881 - DNA, 31 bp, Artificial Sequence
  Description of Artificial Sequence: Synthetic oligonucleotide
agctgaaccatcctccttgcaaccagaaagc

SEQ ID NO: 305882 - DNA, 30 bp, Artificial Sequence
  Description of Artificial Sequence: Synthetic oligonucleotide
gctgaaccatcctccttgcaaccagaaagc

SEQ ID NO: 305883 - DNA, 31 bp, Artificial Sequence
  Description of Artificial Sequence: Synthetic oligonucleotide
ctgaaccatcctccttgcaaccagaaagcag

SEQ ID NO: 305884 - DNA, 31 bp, Artificial Sequence
  Description of Artificial Sequence: Synthetic oligonucleotide
tgaaccatcctccttgcaaccagaaagcagc

SEQ ID NO: 305885 - DNA, 30 bp, Artificial Sequence
  Description of Artificial Sequence: Synthetic oligonucleotide
gaaccatcctccttgcaaccagaaagcagc

SEQ ID NO: 305886 - DNA, 31 bp, Artificial Sequence
  Description of Artificial Sequence: Synthetic oligonucleotide
aaccatcctccttgcaaccagaaagcagctg

SEQ ID NO: 305887 - DNA, 30 bp, Artificial Sequence
  Description of Artificial Sequence: Synthetic oligonucleotide
accatcctccttgcaaccagaaagcagctg

SEQ ID NO: 305888 - DNA, 29 bp, Artificial Sequence
  Description of Artificial Sequence: Synthetic oligonucleotide
ccatcctccttgcaaccagaaagcagctg

SEQ ID NO: 305889 - DNA, 31 bp, Artificial Sequence
  Description of Artificial Sequence: Synthetic oligonucleotide
catcctccttgcaaccagaaagcagctgaac

SEQ ID NO: 305890 - DNA, 32 bp, Artificial Sequence
  Description of Artificial Sequence: Synthetic oligonucleotide
atcctccttgcaaccagaaagcagctgaactc

SEQ ID NO: 305891 - DNA, 31 bp, Artificial Sequence
  Description of Artificial Sequence: Synthetic oligonucleotide
tcctccttgcaaccagaaagcagctgaactc

SEQ ID NO: 305892 - DNA, 30 bp, Artificial Sequence
  Description of Artificial Sequence: Synthetic oligonucleotide
cctccttgcaaccagaaagcagctgaactc

SEQ ID NO: 305893 - DNA, 32 bp, Artificial Sequence
  Description of Artificial Sequence: Synthetic oligonucleotide
ctccttgcaaccagaaagcagctgaactcatc

SEQ ID NO: 305894 - DNA, 33 bp, Artificial Sequence
  Description of Artificial Sequence: Synthetic oligonucleotide
tccttgcaaccagaaagcagctgaactcatctc

SEQ ID NO: 305895 - DNA, 32 bp, Artificial Sequence
  Description of Artificial Sequence: Synthetic oligonucleotide
ccttgcaaccagaaagcagctgaactcatctc

SEQ ID NO: 305896 - DNA, 32 bp, Artificial Sequence
  Description of Artificial Sequence: Synthetic oligonucleotide
cttgcaaccagaaagcagctgaactcatctcc

SEQ ID NO: 305897 - DNA, 32 bp, Artificial Sequence
  Description of Artificial Sequence: Synthetic oligonucleotide
ttgcaaccagaaagcagctgaactcatctccc

SEQ ID NO: 305898 - DNA, 31 bp, Artificial Sequence
  Description of Artificial Sequence: Synthetic oligonucleotide
tgcaaccagaaagcagctgaactcatctccc

SEQ ID NO: 305899 - DNA, 30 bp, Artificial Sequence
  Description of Artificial Sequence: Synthetic oligonucleotide
gcaaccagaaagcagctgaactcatctccc

SEQ ID NO: 305900 - DNA, 31 bp, Artificial Sequence
  Description of Artificial Sequence: Synthetic oligonucleotide
caaccagaaagcagctgaactcatctcccag

SEQ ID NO: 305901 - DNA, 32 bp, Artificial Sequence
  Description of Artificial Sequence: Synthetic oligonucleotide
aaccagaaagcagctgaactcatctcccagtc

SEQ ID NO: 305902 - DNA, 31 bp, Artificial Sequence
  Description of Artificial Sequence: Synthetic oligonucleotide
accagaaagcagctgaactcatctcccagtc

SEQ ID NO: 305903 - DNA, 30 bp, Artificial Sequence
  Description of Artificial Sequence: Synthetic oligonucleotide
ccagaaagcagctgaactcatctcccagtc

SEQ ID NO: 305904 - DNA, 30 bp, Artificial Sequence
  Description of Artificial Sequence: Synthetic oligonucleotide
cagaaagcagctgaactcatctcccagtcg

SEQ ID NO: 305905 - DNA, 32 bp, Artificial Sequence
  Description of Artificial Sequence: Synthetic oligonucleotide
agaaagcagctgaactcatctcccagtcgatg

SEQ ID NO: 305906 - DNA, 31 bp, Artificial Sequence
  Description of Artificial Sequence: Synthetic oligonucleotide
gaaagcagctgaactcatctcccagtcgatg

SEQ ID NO: 305907 - DNA, 31 bp, Artificial Sequence
  Description of Artificial Sequence: Synthetic oligonucleotide
aaagcagctgaactcatctcccagtcgatgg

SEQ ID NO: 305908 - DNA, 30 bp, Artificial Sequence
  Description of Artificial Sequence: Synthetic oligonucleotide
aagcagctgaactcatctcccagtcgatgg

SEQ ID NO: 305909 - DNA, 29 bp, Artificial Sequence
  Description of Artificial Sequence: Synthetic oligonucleotide
agcagctgaactcatctcccagtcgatgg

SEQ ID NO: 305910 - DNA, 28 bp, Artificial Sequence
  Description of Artificial Sequence: Synthetic oligonucleotide
gcagctgaactcatctcccagtcgatgg

SEQ ID NO: 305911 - DNA, 31 bp, Artificial Sequence
  Description of Artificial Sequence: Synthetic oligonucleotide
cagctgaactcatctcccagtcgatggaatc

SEQ ID NO: 305912 - DNA, 31 bp, Artificial Sequence
  Description of Artificial Sequence: Synthetic oligonucleotide
agctgaactcatctcccagtcgatggaatcg

SEQ ID NO: 305913 - DNA, 30 bp, Artificial Sequence
  Description of Artificial Sequence: Synthetic oligonucleotide
gctgaactcatctcccagtcgatggaatcg

SEQ ID NO: 305914 - DNA, 31 bp, Artificial Sequence
  Description of Artificial Sequence: Synthetic oligonucleotide
ctgaactcatctcccagtcgatggaatcgag

SEQ ID NO: 305915 - DNA, 32 bp, Artificial Sequence
  Description of Artificial Sequence: Synthetic oligonucleotide
tgaactcatctcccagtcgatggaatcgagtg

SEQ ID NO: 305916 - DNA, 31 bp, Artificial Sequence
  Description of Artificial Sequence: Synthetic oligonucleotide
gaactcatctcccagtcgatggaatcgagtg

SEQ ID NO: 305917 - DNA, 31 bp, Artificial Sequence
  Description of Artificial Sequence: Synthetic oligonucleotide
aactcatctcccagtcgatggaatcgagtgg

SEQ ID NO: 305918 - DNA, 30 bp, Artificial Sequence
  Description of Artificial Sequence: Synthetic oligonucleotide
actcatctcccagtcgatggaatcgagtgg

SEQ ID NO: 305919 - DNA, 29 bp, Artificial Sequence
  Description of Artificial Sequence: Synthetic oligonucleotide
ctcatctcccagtcgatggaatcgagtgg

SEQ ID NO: 305920 - DNA, 42 bp, Artificial Sequence
  Description of Artificial Sequence: Synthetic oligonucleotide
tcatctcccagtcgatggaatcgagtggaaaaataaatatac

SEQ ID NO: 305921 - DNA, 41 bp, Artificial Sequence
  Description of Artificial Sequence: Synthetic oligonucleotide
catctcccagtcgatggaatcgagtggaaaaataaatatac

SEQ ID NO: 305922 - DNA, 41 bp, Artificial Sequence
  Description of Artificial Sequence: Synthetic oligonucleotide
atctcccagtcgatggaatcgagtggaaaaataaatatacg

SEQ ID NO: 305923 - DNA, 40 bp, Artificial Sequence
  Description of Artificial Sequence: Synthetic oligonucleotide
tctcccagtcgatggaatcgagtggaaaaataaatatacg

SEQ ID NO: 305924 - DNA, 39 bp, Artificial Sequence
  Description of Artificial Sequence: Synthetic oligonucleotide
ctcccagtcgatggaatcgagtggaaaaataaatatacg

SEQ ID NO: 305925 - DNA, 41 bp, Artificial Sequence
  Description of Artificial Sequence: Synthetic oligonucleotide
tcccagtcgatggaatcgagtggaaaaataaatatacgaac

SEQ ID NO: 305926 - DNA, 40 bp, Artificial Sequence
  Description of Artificial Sequence: Synthetic oligonucleotide
cccagtcgatggaatcgagtggaaaaataaatatacgaac

SEQ ID NO: 305927 - DNA, 41 bp, Artificial Sequence
  Description of Artificial Sequence: Synthetic oligonucleotide
ccagtcgatggaatcgagtggaaaaataaatatacgaacag

SEQ ID NO: 305928 - DNA, 43 bp, Artificial Sequence
  Description of Artificial Sequence: Synthetic oligonucleotide
cagtcgatggaatcgagtggaaaaataaatatacgaacagatg

SEQ ID NO: 305929 - DNA, 50 bp, Artificial Sequence
  Description of Artificial Sequence: Synthetic oligonucleotide
agtcgatggaatcgagtggaaaaataaatatacgaacagatgtattaaag

SEQ ID NO: 305930 - DNA, 49 bp, Artificial Sequence
  Description of Artificial Sequence: Synthetic oligonucleotide
gtcgatggaatcgagtggaaaaataaatatacgaacagatgtattaaag

SEQ ID NO: 305931 - DNA, 52 bp, Artificial Sequence
  Description of Artificial Sequence: Synthetic oligonucleotide
tcgatggaatcgagtggaaaaataaatatacgaacagatgtattaaagattc

SEQ ID NO: 305932 - DNA, 51 bp, Artificial Sequence
  Description of Artificial Sequence: Synthetic oligonucleotide
cgatggaatcgagtggaaaaataaatatacgaacagatgtattaaagattc

SEQ ID NO: 305933 - DNA, 52 bp, Artificial Sequence
  Description of Artificial Sequence: Synthetic oligonucleotide
gatggaatcgagtggaaaaataaatatacgaacagatgtattaaagattctg

SEQ ID NO: 305934 - DNA, 56 bp, Artificial Sequence
  Description of Artificial Sequence: Synthetic oligonucleotide
atggaatcgagtggaaaaataaatatacgaacagatgtattaaagattctgtattc

SEQ ID NO: 305935 - DNA, 55 bp, Artificial Sequence
  Description of Artificial Sequence: Synthetic oligonucleotide
tggaatcgagtggaaaaataaatatacgaacagatgtattaaagattctgtattc

SEQ ID NO: 305936 - DNA, 54 bp, Artificial Sequence
  Description of Artificial Sequence: Synthetic oligonucleotide
ggaatcgagtggaaaaataaatatacgaacagatgtattaaagattctgtattc

SEQ ID NO: 305937 - DNA, 55 bp, Artificial Sequence
  Description of Artificial Sequence: Synthetic oligonucleotide
gaatcgagtggaaaaataaatatacgaacagatgtattaaagattctgtattctg

SEQ ID NO: 305938 - DNA, 56 bp, Artificial Sequence
  Description of Artificial Sequence: Synthetic oligonucleotide
aatcgagtggaaaaataaatatacgaacagatgtattaaagattctgtattctgag

SEQ ID NO: 305939 - DNA, 55 bp, Artificial Sequence
  Description of Artificial Sequence: Synthetic oligonucleotide
atcgagtggaaaaataaatatacgaacagatgtattaaagattctgtattctgag

SEQ ID NO: 305940 - DNA, 54 bp, Artificial Sequence
  Description of Artificial Sequence: Synthetic oligonucleotide
tcgagtggaaaaataaatatacgaacagatgtattaaagattctgtattctgag

SEQ ID NO: 305941 - DNA, 53 bp, Artificial Sequence
  Description of Artificial Sequence: Synthetic oligonucleotide
cgagtggaaaaataaatatacgaacagatgtattaaagattctgtattctgag

SEQ ID NO: 305942 - DNA, 53 bp, Artificial Sequence
  Description of Artificial Sequence: Synthetic oligonucleotide
gagtggaaaaataaatatacgaacagatgtattaaagattctgtattctgagg

SEQ ID NO: 305943 - DNA, 53 bp, Artificial Sequence
  Description of Artificial Sequence: Synthetic oligonucleotide
agtggaaaaataaatatacgaacagatgtattaaagattctgtattctgaggg

SEQ ID NO: 305944 - DNA, 52 bp, Artificial Sequence
  Description of Artificial Sequence: Synthetic oligonucleotide
gtggaaaaataaatatacgaacagatgtattaaagattctgtattctgaggg

SEQ ID NO: 305945 - DNA, 53 bp, Artificial Sequence
  Description of Artificial Sequence: Synthetic oligonucleotide
tggaaaaataaatatacgaacagatgtattaaagattctgtattctgagggtg

SEQ ID NO: 305946 - DNA, 52 bp, Artificial Sequence
  Description of Artificial Sequence: Synthetic oligonucleotide
ggaaaaataaatatacgaacagatgtattaaagattctgtattctgagggtg

SEQ ID NO: 305947 - DNA, 52 bp, Artificial Sequence
  Description of Artificial Sequence: Synthetic oligonucleotide
gaaaaataaatatacgaacagatgtattaaagattctgtattctgagggtgc

SEQ ID NO: 305948 - DNA, 53 bp, Artificial Sequence
  Description of Artificial Sequence: Synthetic oligonucleotide
aaaaataaatatacgaacagatgtattaaagattctgtattctgagggtgctc

SEQ ID NO: 305949 - DNA, 52 bp, Artificial Sequence
  Description of Artificial Sequence: Synthetic oligonucleotide
aaaataaatatacgaacagatgtattaaagattctgtattctgagggtgctc

SEQ ID NO: 305950 - DNA, 51 bp, Artificial Sequence
  Description of Artificial Sequence: Synthetic oligonucleotide
aaataaatatacgaacagatgtattaaagattctgtattctgagggtgctc

SEQ ID NO: 305951 - DNA, 50 bp, Artificial Sequence
  Description of Artificial Sequence: Synthetic oligonucleotide
aataaatatacgaacagatgtattaaagattctgtattctgagggtgctc

SEQ ID NO: 305952 - DNA, 49 bp, Artificial Sequence
  Description of Artificial Sequence: Synthetic oligonucleotide
ataaatatacgaacagatgtattaaagattctgtattctgagggtgctc

SEQ ID NO: 305953 - DNA, 48 bp, Artificial Sequence
  Description of Artificial Sequence: Synthetic oligonucleotide
taaatatacgaacagatgtattaaagattctgtattctgagggtgctc

SEQ ID NO: 305954 - DNA, 47 bp, Artificial Sequence
  Description of Artificial Sequence: Synthetic oligonucleotide
aaatatacgaacagatgtattaaagattctgtattctgagggtgctc

SEQ ID NO: 305955 - DNA, 46 bp, Artificial Sequence
  Description of Artificial Sequence: Synthetic oligonucleotide
aatatacgaacagatgtattaaagattctgtattctgagggtgctc

SEQ ID NO: 305956 - DNA, 45 bp, Artificial Sequence
  Description of Artificial Sequence: Synthetic oligonucleotide
atatacgaacagatgtattaaagattctgtattctgagggtgctc

SEQ ID NO: 305957 - DNA, 44 bp, Artificial Sequence
  Description of Artificial Sequence: Synthetic oligonucleotide
tatacgaacagatgtattaaagattctgtattctgagggtgctc

SEQ ID NO: 305958 - DNA, 43 bp, Artificial Sequence
  Description of Artificial Sequence: Synthetic oligonucleotide
atacgaacagatgtattaaagattctgtattctgagggtgctc

SEQ ID NO: 305959 - DNA, 42 bp, Artificial Sequence
  Description of Artificial Sequence: Synthetic oligonucleotide
tacgaacagatgtattaaagattctgtattctgagggtgctc

SEQ ID NO: 305960 - DNA, 41 bp, Artificial Sequence
  Description of Artificial Sequence: Synthetic oligonucleotide
acgaacagatgtattaaagattctgtattctgagggtgctc

SEQ ID NO: 305961 - DNA, 40 bp, Artificial Sequence
  Description of Artificial Sequence: Synthetic oligonucleotide
cgaacagatgtattaaagattctgtattctgagggtgctc

SEQ ID NO: 305962 - DNA, 41 bp, Artificial Sequence
  Description of Artificial Sequence: Synthetic oligonucleotide
gaacagatgtattaaagattctgtattctgagggtgctcac

SEQ ID NO: 305963 - DNA, 42 bp, Artificial Sequence
  Description of Artificial Sequence: Synthetic oligonucleotide
aacagatgtattaaagattctgtattctgagggtgctcacac

SEQ ID NO: 305964 - DNA, 41 bp, Artificial Sequence
  Description of Artificial Sequence: Synthetic oligonucleotide
acagatgtattaaagattctgtattctgagggtgctcacac

SEQ ID NO: 305965 - DNA, 40 bp, Artificial Sequence
  Description of Artificial Sequence: Synthetic oligonucleotide
cagatgtattaaagattctgtattctgagggtgctcacac

SEQ ID NO: 305966 - DNA, 42 bp, Artificial Sequence
  Description of Artificial Sequence: Synthetic oligonucleotide
agatgtattaaagattctgtattctgagggtgctcacacaac

SEQ ID NO: 305967 - DNA, 41 bp, Artificial Sequence
  Description of Artificial Sequence: Synthetic oligonucleotide
gatgtattaaagattctgtattctgagggtgctcacacaac

SEQ ID NO: 305968 - DNA, 42 bp, Artificial Sequence
  Description of Artificial Sequence: Synthetic oligonucleotide
atgtattaaagattctgtattctgagggtgctcacacaacag

SEQ ID NO: 305969 - DNA, 41 bp, Artificial Sequence
  Description of Artificial Sequence: Synthetic oligonucleotide
tgtattaaagattctgtattctgagggtgctcacacaacag

SEQ ID NO: 305970 - DNA, 40 bp, Artificial Sequence
  Description of Artificial Sequence: Synthetic oligonucleotide
gtattaaagattctgtattctgagggtgctcacacaacag

SEQ ID NO: 305971 - DNA, 40 bp, Artificial Sequence
  Description of Artificial Sequence: Synthetic oligonucleotide
tattaaagattctgtattctgagggtgctcacacaacagc

SEQ ID NO: 305972 - DNA, 39 bp, Artificial Sequence
  Description of Artificial Sequence: Synthetic oligonucleotide
attaaagattctgtattctgagggtgctcacacaacagc

SEQ ID NO: 305973 - DNA, 38 bp, Artificial Sequence
  Description of Artificial Sequence: Synthetic oligonucleotide
ttaaagattctgtattctgagggtgctcacacaacagc

SEQ ID NO: 305974 - DNA, 37 bp, Artificial Sequence
  Description of Artificial Sequence: Synthetic oligonucleotide
taaagattctgtattctgagggtgctcacacaacagc

SEQ ID NO: 305975 - DNA, 36 bp, Artificial Sequence
  Description of Artificial Sequence: Synthetic oligonucleotide
aaagattctgtattctgagggtgctcacacaacagc

SEQ ID NO: 305976 - DNA, 35 bp, Artificial Sequence
  Description of Artificial Sequence: Synthetic oligonucleotide
aagattctgtattctgagggtgctcacacaacagc

SEQ ID NO: 305977 - DNA, 34 bp, Artificial Sequence
  Description of Artificial Sequence: Synthetic oligonucleotide
agattctgtattctgagggtgctcacacaacagc

SEQ ID NO: 305978 - DNA, 33 bp, Artificial Sequence
  Description of Artificial Sequence: Synthetic oligonucleotide
gattctgtattctgagggtgctcacacaacagc

SEQ ID NO: 305979 - DNA, 34 bp, Artificial Sequence
  Description of Artificial Sequence: Synthetic oligonucleotide
attctgtattctgagggtgctcacacaacagcac

SEQ ID NO: 305980 - DNA, 33 bp, Artificial Sequence
  Description of Artificial Sequence: Synthetic oligonucleotide
ttctgtattctgagggtgctcacacaacagcac

SEQ ID NO: 305981 - DNA, 32 bp, Artificial Sequence
  Description of Artificial Sequence: Synthetic oligonucleotide
tctgtattctgagggtgctcacacaacagcac

SEQ ID NO: 305982 - DNA, 31 bp, Artificial Sequence
  Description of Artificial Sequence: Synthetic oligonucleotide
ctgtattctgagggtgctcacacaacagcac

SEQ ID NO: 305983 - DNA, 31 bp, Artificial Sequence
  Description of Artificial Sequence: Synthetic oligonucleotide
tgtattctgagggtgctcacacaacagcacg

SEQ ID NO: 305984 - DNA, 30 bp, Artificial Sequence
  Description of Artificial Sequence: Synthetic oligonucleotide
gtattctgagggtgctcacacaacagcacg

SEQ ID NO: 305985 - DNA, 32 bp, Artificial Sequence
  Description of Artificial Sequence: Synthetic oligonucleotide
tattctgagggtgctcacacaacagcacgatg

SEQ ID NO: 305986 - DNA, 31 bp, Artificial Sequence
  Description of Artificial Sequence: Synthetic oligonucleotide
attctgagggtgctcacacaacagcacgatg

SEQ ID NO: 305987 - DNA, 30 bp, Artificial Sequence
  Description of Artificial Sequence: Synthetic oligonucleotide
ttctgagggtgctcacacaacagcacgatg

SEQ ID NO: 305988 - DNA, 29 bp, Artificial Sequence
  Description of Artificial Sequence: Synthetic oligonucleotide
tctgagggtgctcacacaacagcacgatg

SEQ ID NO: 305989 - DNA, 28 bp, Artificial Sequence
  Description of Artificial Sequence: Synthetic oligonucleotide
ctgagggtgctcacacaacagcacgatg

SEQ ID NO: 305990 - DNA, 28 bp, Artificial Sequence
  Description of Artificial Sequence: Synthetic oligonucleotide
tgagggtgctcacacaacagcacgatgg

SEQ ID NO: 305991 - DNA, 27 bp, Artificial Sequence
  Description of Artificial Sequence: Synthetic oligonucleotide
gagggtgctcacacaacagcacgatgg

SEQ ID NO: 305992 - DNA, 32 bp, Artificial Sequence
  Description of Artificial Sequence: Synthetic oligonucleotide
agggtgctcacacaacagcacgatggaatttc

SEQ ID NO: 305993 - DNA, 31 bp, Artificial Sequence
  Description of Artificial Sequence: Synthetic oligonucleotide
gggtgctcacacaacagcacgatggaatttc

SEQ ID NO: 305994 - DNA, 31 bp, Artificial Sequence
  Description of Artificial Sequence: Synthetic oligonucleotide
ggtgctcacacaacagcacgatggaatttcc

SEQ ID NO: 305995 - DNA, 36 bp, Artificial Sequence
  Description of Artificial Sequence: Synthetic oligonucleotide
gtgctcacacaacagcacgatggaatttccttttag

SEQ ID NO: 305996 - DNA, 37 bp, Artificial Sequence
  Description of Artificial Sequence: Synthetic oligonucleotide
tgctcacacaacagcacgatggaatttccttttagac

SEQ ID NO: 305997 - DNA, 36 bp, Artificial Sequence
  Description of Artificial Sequence: Synthetic oligonucleotide
gctcacacaacagcacgatggaatttccttttagac

SEQ ID NO: 305998 - DNA, 36 bp, Artificial Sequence
  Description of Artificial Sequence: Synthetic oligonucleotide
ctcacacaacagcacgatggaatttccttttagacc

SEQ ID NO: 305999 - DNA, 41 bp, Artificial Sequence
  Description of Artificial Sequence: Synthetic oligonucleotide
tcacacaacagcacgatggaatttccttttagaccaatatg

SEQ ID NO: 306000 - DNA, 40 bp, Artificial Sequence
  Description of Artificial Sequence: Synthetic oligonucleotide
cacacaacagcacgatggaatttccttttagaccaatatg

SEQ ID NO: 306001 - DNA, 42 bp, Artificial Sequence
  Description of Artificial Sequence: Synthetic oligonucleotide
acacaacagcacgatggaatttccttttagaccaatatgaag

SEQ ID NO: 306002 - DNA, 41 bp, Artificial Sequence
  Description of Artificial Sequence: Synthetic oligonucleotide
cacaacagcacgatggaatttccttttagaccaatatgaag

SEQ ID NO: 306003 - DNA, 42 bp, Artificial Sequence
  Description of Artificial Sequence: Synthetic oligonucleotide
acaacagcacgatggaatttccttttagaccaatatgaagtg

SEQ ID NO: 306004 - DNA, 41 bp, Artificial Sequence
  Description of Artificial Sequence: Synthetic oligonucleotide
caacagcacgatggaatttccttttagaccaatatgaagtg

SEQ ID NO: 306005 - DNA, 42 bp, Artificial Sequence
  Description of Artificial Sequence: Synthetic oligonucleotide
aacagcacgatggaatttccttttagaccaatatgaagtgtc

SEQ ID NO: 306006 - DNA, 41 bp, Artificial Sequence
  Description of Artificial Sequence: Synthetic oligonucleotide
acagcacgatggaatttccttttagaccaatatgaagtgtc

SEQ ID NO: 306007 - DNA, 40 bp, Artificial Sequence
  Description of Artificial Sequence: Synthetic oligonucleotide
cagcacgatggaatttccttttagaccaatatgaagtgtc

SEQ ID NO: 306008 - DNA, 43 bp, Artificial Sequence
  Description of Artificial Sequence: Synthetic oligonucleotide
agcacgatggaatttccttttagaccaatatgaagtgtcaatg

SEQ ID NO: 306009 - DNA, 42 bp, Artificial Sequence
  Description of Artificial Sequence: Synthetic oligonucleotide
gcacgatggaatttccttttagaccaatatgaagtgtcaatg

SEQ ID NO: 306010 - DNA, 43 bp, Artificial Sequence
  Description of Artificial Sequence: Synthetic oligonucleotide
cacgatggaatttccttttagaccaatatgaagtgtcaatgtg

SEQ ID NO: 306011 - DNA, 45 bp, Artificial Sequence
  Description of Artificial Sequence: Synthetic oligonucleotide
acgatggaatttccttttagaccaatatgaagtgtcaatgtgaag

SEQ ID NO: 306012 - DNA, 44 bp, Artificial Sequence
  Description of Artificial Sequence: Synthetic oligonucleotide
cgatggaatttccttttagaccaatatgaagtgtcaatgtgaag

SEQ ID NO: 306013 - DNA, 45 bp, Artificial Sequence
  Description of Artificial Sequence: Synthetic oligonucleotide
gatggaatttccttttagaccaatatgaagtgtcaatgtgaagtg

SEQ ID NO: 306014 - DNA, 45 bp, Artificial Sequence
  Description of Artificial Sequence: Synthetic oligonucleotide
atggaatttccttttagaccaatatgaagtgtcaatgtgaagtgc

SEQ ID NO: 306015 - DNA, 44 bp, Artificial Sequence
  Description of Artificial Sequence: Synthetic oligonucleotide
tggaatttccttttagaccaatatgaagtgtcaatgtgaagtgc

SEQ ID NO: 306016 - DNA, 43 bp, Artificial Sequence
  Description of Artificial Sequence: Synthetic oligonucleotide
ggaatttccttttagaccaatatgaagtgtcaatgtgaagtgc

SEQ ID NO: 306017 - DNA, 44 bp, Artificial Sequence
  Description of Artificial Sequence: Synthetic oligonucleotide
gaatttccttttagaccaatatgaagtgtcaatgtgaagtgctg

SEQ ID NO: 306018 - DNA, 46 bp, Artificial Sequence
  Description of Artificial Sequence: Synthetic oligonucleotide
aatttccttttagaccaatatgaagtgtcaatgtgaagtgctgatc

SEQ ID NO: 306019 - DNA, 45 bp, Artificial Sequence
  Description of Artificial Sequence: Synthetic oligonucleotide
atttccttttagaccaatatgaagtgtcaatgtgaagtgctgatc

SEQ ID NO: 306020 - DNA, 44 bp, Artificial Sequence
  Description of Artificial Sequence: Synthetic oligonucleotide
tttccttttagaccaatatgaagtgtcaatgtgaagtgctgatc

SEQ ID NO: 306021 - DNA, 43 bp, Artificial Sequence
  Description of Artificial Sequence: Synthetic oligonucleotide
ttccttttagaccaatatgaagtgtcaatgtgaagtgctgatc

SEQ ID NO: 306022 - DNA, 42 bp, Artificial Sequence
  Description of Artificial Sequence: Synthetic oligonucleotide
tccttttagaccaatatgaagtgtcaatgtgaagtgctgatc

SEQ ID NO: 306023 - DNA, 41 bp, Artificial Sequence
  Description of Artificial Sequence: Synthetic oligonucleotide
ccttttagaccaatatgaagtgtcaatgtgaagtgctgatc

SEQ ID NO: 306024 - DNA, 45 bp, Artificial Sequence
  Description of Artificial Sequence: Synthetic oligonucleotide
cttttagaccaatatgaagtgtcaatgtgaagtgctgatcaaaac

SEQ ID NO: 306025 - DNA, 51 bp, Artificial Sequence
  Description of Artificial Sequence: Synthetic oligonucleotide
ttttagaccaatatgaagtgtcaatgtgaagtgctgatcaaaacaaatttc

SEQ ID NO: 306026 - DNA, 50 bp, Artificial Sequence
  Description of Artificial Sequence: Synthetic oligonucleotide
tttagaccaatatgaagtgtcaatgtgaagtgctgatcaaaacaaatttc

SEQ ID NO: 306027 - DNA, 49 bp, Artificial Sequence
  Description of Artificial Sequence: Synthetic oligonucleotide
ttagaccaatatgaagtgtcaatgtgaagtgctgatcaaaacaaatttc

SEQ ID NO: 306028 - DNA, 48 bp, Artificial Sequence
  Description of Artificial Sequence: Synthetic oligonucleotide
tagaccaatatgaagtgtcaatgtgaagtgctgatcaaaacaaatttc

SEQ ID NO: 306029 - DNA, 47 bp, Artificial Sequence
  Description of Artificial Sequence: Synthetic oligonucleotide
agaccaatatgaagtgtcaatgtgaagtgctgatcaaaacaaatttc

SEQ ID NO: 306030 - DNA, 46 bp, Artificial Sequence
  Description of Artificial Sequence: Synthetic oligonucleotide
gaccaatatgaagtgtcaatgtgaagtgctgatcaaaacaaatttc

SEQ ID NO: 306031 - DNA, 47 bp, Artificial Sequence
  Description of Artificial Sequence: Synthetic oligonucleotide
accaatatgaagtgtcaatgtgaagtgctgatcaaaacaaatttctg

SEQ ID NO: 306032 - DNA, 46 bp, Artificial Sequence
  Description of Artificial Sequence: Synthetic oligonucleotide
ccaatatgaagtgtcaatgtgaagtgctgatcaaaacaaatttctg

SEQ ID NO: 306033 - DNA, 49 bp, Artificial Sequence
  Description of Artificial Sequence: Synthetic oligonucleotide
caatatgaagtgtcaatgtgaagtgctgatcaaaacaaatttctgtatg

SEQ ID NO: 306034 - DNA, 49 bp, Artificial Sequence
  Description of Artificial Sequence: Synthetic oligonucleotide
aatatgaagtgtcaatgtgaagtgctgatcaaaacaaatttctgtatgg

SEQ ID NO: 306035 - DNA, 48 bp, Artificial Sequence
  Description of Artificial Sequence: Synthetic oligonucleotide
atatgaagtgtcaatgtgaagtgctgatcaaaacaaatttctgtatgg

SEQ ID NO: 306036 - DNA, 47 bp, Artificial Sequence
  Description of Artificial Sequence: Synthetic oligonucleotide
tatgaagtgtcaatgtgaagtgctgatcaaaacaaatttctgtatgg

SEQ ID NO: 306037 - DNA, 46 bp, Artificial Sequence
  Description of Artificial Sequence: Synthetic oligonucleotide
atgaagtgtcaatgtgaagtgctgatcaaaacaaatttctgtatgg

SEQ ID NO: 306038 - DNA, 45 bp, Artificial Sequence
  Description of Artificial Sequence: Synthetic oligonucleotide
tgaagtgtcaatgtgaagtgctgatcaaaacaaatttctgtatgg

SEQ ID NO: 306039 - DNA, 44 bp, Artificial Sequence
  Description of Artificial Sequence: Synthetic oligonucleotide
gaagtgtcaatgtgaagtgctgatcaaaacaaatttctgtatgg

SEQ ID NO: 306040 - DNA, 47 bp, Artificial Sequence
  Description of Artificial Sequence: Synthetic oligonucleotide
aagtgtcaatgtgaagtgctgatcaaaacaaatttctgtatggtttg

SEQ ID NO: 306041 - DNA, 46 bp, Artificial Sequence
  Description of Artificial Sequence: Synthetic oligonucleotide
agtgtcaatgtgaagtgctgatcaaaacaaatttctgtatggtttg

SEQ ID NO: 306042 - DNA, 45 bp, Artificial Sequence
  Description of Artificial Sequence: Synthetic oligonucleotide
gtgtcaatgtgaagtgctgatcaaaacaaatttctgtatggtttg

SEQ ID NO: 306043 - DNA, 46 bp, Artificial Sequence
  Description of Artificial Sequence: Synthetic oligonucleotide
tgtcaatgtgaagtgctgatcaaaacaaatttctgtatggtttgtc

SEQ ID NO: 306044 - DNA, 45 bp, Artificial Sequence
  Description of Artificial Sequence: Synthetic oligonucleotide
gtcaatgtgaagtgctgatcaaaacaaatttctgtatggtttgtc

SEQ ID NO: 306045 - DNA, 47 bp, Artificial Sequence
  Description of Artificial Sequence: Synthetic oligonucleotide
tcaatgtgaagtgctgatcaaaacaaatttctgtatggtttgtcaac

SEQ ID NO: 306046 - DNA, 46 bp, Artificial Sequence
  Description of Artificial Sequence: Synthetic oligonucleotide
caatgtgaagtgctgatcaaaacaaatttctgtatggtttgtcaac

SEQ ID NO: 306047 - DNA, 46 bp, Artificial Sequence
  Description of Artificial Sequence: Synthetic oligonucleotide
aatgtgaagtgctgatcaaaacaaatttctgtatggtttgtcaacc

SEQ ID NO: 306048 - DNA, 45 bp, Artificial Sequence
  Description of Artificial Sequence: Synthetic oligonucleotide
atgtgaagtgctgatcaaaacaaatttctgtatggtttgtcaacc

SEQ ID NO: 306049 - DNA, 44 bp, Artificial Sequence
  Description of Artificial Sequence: Synthetic oligonucleotide
tgtgaagtgctgatcaaaacaaatttctgtatggtttgtcaacc

SEQ ID NO: 306050 - DNA, 43 bp, Artificial Sequence
  Description of Artificial Sequence: Synthetic oligonucleotide
gtgaagtgctgatcaaaacaaatttctgtatggtttgtcaacc

SEQ ID NO: 306051 - DNA, 44 bp, Artificial Sequence
  Description of Artificial Sequence: Synthetic oligonucleotide
tgaagtgctgatcaaaacaaatttctgtatggtttgtcaaccag

SEQ ID NO: 306052 - DNA, 43 bp, Artificial Sequence
  Description of Artificial Sequence: Synthetic oligonucleotide
gaagtgctgatcaaaacaaatttctgtatggtttgtcaaccag

SEQ ID NO: 306053 - DNA, 43 bp, Artificial Sequence
  Description of Artificial Sequence: Synthetic oligonucleotide
aagtgctgatcaaaacaaatttctgtatggtttgtcaaccagc

SEQ ID NO: 306054 - DNA, 42 bp, Artificial Sequence
  Description of Artificial Sequence: Synthetic oligonucleotide
agtgctgatcaaaacaaatttctgtatggtttgtcaaccagc

SEQ ID NO: 306055 - DNA, 41 bp, Artificial Sequence
  Description of Artificial Sequence: Synthetic oligonucleotide
gtgctgatcaaaacaaatttctgtatggtttgtcaaccagc

SEQ ID NO: 306056 - DNA, 43 bp, Artificial Sequence
  Description of Artificial Sequence: Synthetic oligonucleotide
tgctgatcaaaacaaatttctgtatggtttgtcaaccagcaag

SEQ ID NO: 306057 - DNA, 42 bp, Artificial Sequence
  Description of Artificial Sequence: Synthetic oligonucleotide
gctgatcaaaacaaatttctgtatggtttgtcaaccagcaag

SEQ ID NO: 306058 - DNA, 42 bp, Artificial Sequence
  Description of Artificial Sequence: Synthetic oligonucleotide
ctgatcaaaacaaatttctgtatggtttgtcaaccagcaagc

SEQ ID NO: 306059 - DNA, 44 bp, Artificial Sequence
  Description of Artificial Sequence: Synthetic oligonucleotide
tgatcaaaacaaatttctgtatggtttgtcaaccagcaagcatg

SEQ ID NO: 306060 - DNA, 43 bp, Artificial Sequence
  Description of Artificial Sequence: Synthetic oligonucleotide
gatcaaaacaaatttctgtatggtttgtcaaccagcaagcatg

SEQ ID NO: 306061 - DNA, 44 bp, Artificial Sequence
  Description of Artificial Sequence: Synthetic oligonucleotide
atcaaaacaaatttctgtatggtttgtcaaccagcaagcatgag

SEQ ID NO: 306062 - DNA, 43 bp, Artificial Sequence
  Description of Artificial Sequence: Synthetic oligonucleotide
tcaaaacaaatttctgtatggtttgtcaaccagcaagcatgag

SEQ ID NO: 306063 - DNA, 42 bp, Artificial Sequence
  Description of Artificial Sequence: Synthetic oligonucleotide
caaaacaaatttctgtatggtttgtcaaccagcaagcatgag

SEQ ID NO: 306064 - DNA, 42 bp, Artificial Sequence
  Description of Artificial Sequence: Synthetic oligonucleotide
aaaacaaatttctgtatggtttgtcaaccagcaagcatgagg

SEQ ID NO: 306065 - DNA, 41 bp, Artificial Sequence
  Description of Artificial Sequence: Synthetic oligonucleotide
aaacaaatttctgtatggtttgtcaaccagcaagcatgagg

SEQ ID NO: 306066 - DNA, 40 bp, Artificial Sequence
  Description of Artificial Sequence: Synthetic oligonucleotide
aacaaatttctgtatggtttgtcaaccagcaagcatgagg

SEQ ID NO: 306067 - DNA, 39 bp, Artificial Sequence
  Description of Artificial Sequence: Synthetic oligonucleotide
acaaatttctgtatggtttgtcaaccagcaagcatgagg

SEQ ID NO: 306068 - DNA, 38 bp, Artificial Sequence
  Description of Artificial Sequence: Synthetic oligonucleotide
caaatttctgtatggtttgtcaaccagcaagcatgagg

SEQ ID NO: 306069 - DNA, 42 bp, Artificial Sequence
  Description of Artificial Sequence: Synthetic oligonucleotide
aaatttctgtatggtttgtcaaccagcaagcatgaggaaaag

SEQ ID NO: 306070 - DNA, 41 bp, Artificial Sequence
  Description of Artificial Sequence: Synthetic oligonucleotide
aatttctgtatggtttgtcaaccagcaagcatgaggaaaag

SEQ ID NO: 306071 - DNA, 40 bp, Artificial Sequence
  Description of Artificial Sequence: Synthetic oligonucleotide
atttctgtatggtttgtcaaccagcaagcatgaggaaaag

SEQ ID NO: 306072 - DNA, 39 bp, Artificial Sequence
  Description of Artificial Sequence: Synthetic oligonucleotide
tttctgtatggtttgtcaaccagcaagcatgaggaaaag

SEQ ID NO: 306073 - DNA, 38 bp, Artificial Sequence
  Description of Artificial Sequence: Synthetic oligonucleotide
ttctgtatggtttgtcaaccagcaagcatgaggaaaag

SEQ ID NO: 306074 - DNA, 37 bp, Artificial Sequence
  Description of Artificial Sequence: Synthetic oligonucleotide
tctgtatggtttgtcaaccagcaagcatgaggaaaag

SEQ ID NO: 306075 - DNA, 36 bp, Artificial Sequence
  Description of Artificial Sequence: Synthetic oligonucleotide
ctgtatggtttgtcaaccagcaagcatgaggaaaag

SEQ ID NO: 306076 - DNA, 39 bp, Artificial Sequence
  Description of Artificial Sequence: Synthetic oligonucleotide
tgtatggtttgtcaaccagcaagcatgaggaaaagtaac

SEQ ID NO: 306077 - DNA, 38 bp, Artificial Sequence
  Description of Artificial Sequence: Synthetic oligonucleotide
gtatggtttgtcaaccagcaagcatgaggaaaagtaac

SEQ ID NO: 306078 - DNA, 39 bp, Artificial Sequence
  Description of Artificial Sequence: Synthetic oligonucleotide
tatggtttgtcaaccagcaagcatgaggaaaagtaactg

SEQ ID NO: 306079 - DNA, 38 bp, Artificial Sequence
  Description of Artificial Sequence: Synthetic oligonucleotide
atggtttgtcaaccagcaagcatgaggaaaagtaactg

SEQ ID NO: 306080 - DNA, 37 bp, Artificial Sequence
  Description of Artificial Sequence: Synthetic oligonucleotide
tggtttgtcaaccagcaagcatgaggaaaagtaactg

SEQ ID NO: 306081 - DNA, 36 bp, Artificial Sequence
  Description of Artificial Sequence: Synthetic oligonucleotide
ggtttgtcaaccagcaagcatgaggaaaagtaactg

SEQ ID NO: 306082 - DNA, 38 bp, Artificial Sequence
  Description of Artificial Sequence: Synthetic oligonucleotide
gtttgtcaaccagcaagcatgaggaaaagtaactgaag

SEQ ID NO: 306083 - DNA, 44 bp, Artificial Sequence
  Description of Artificial Sequence: Synthetic oligonucleotide
tttgtcaaccagcaagcatgaggaaaagtaactgaagtttattg

SEQ ID NO: 306084 - DNA, 43 bp, Artificial Sequence
  Description of Artificial Sequence: Synthetic oligonucleotide
ttgtcaaccagcaagcatgaggaaaagtaactgaagtttattg

SEQ ID NO: 306085 - DNA, 42 bp, Artificial Sequence
  Description of Artificial Sequence: Synthetic oligonucleotide
tgtcaaccagcaagcatgaggaaaagtaactgaagtttattg

SEQ ID NO: 306086 - DNA, 41 bp, Artificial Sequence
  Description of Artificial Sequence: Synthetic oligonucleotide
gtcaaccagcaagcatgaggaaaagtaactgaagtttattg

SEQ ID NO: 306087 - DNA, 43 bp, Artificial Sequence
  Description of Artificial Sequence: Synthetic oligonucleotide
tcaaccagcaagcatgaggaaaagtaactgaagtttattgaac

SEQ ID NO: 306088 - DNA, 42 bp, Artificial Sequence
  Description of Artificial Sequence: Synthetic oligonucleotide
caaccagcaagcatgaggaaaagtaactgaagtttattgaac

SEQ ID NO: 306089 - DNA, 44 bp, Artificial Sequence
  Description of Artificial Sequence: Synthetic oligonucleotide
aaccagcaagcatgaggaaaagtaactgaagtttattgaactac

SEQ ID NO: 306090 - DNA, 43 bp, Artificial Sequence
  Description of Artificial Sequence: Synthetic oligonucleotide
accagcaagcatgaggaaaagtaactgaagtttattgaactac

SEQ ID NO: 306091 - DNA, 42 bp, Artificial Sequence
  Description of Artificial Sequence: Synthetic oligonucleotide
ccagcaagcatgaggaaaagtaactgaagtttattgaactac

SEQ ID NO: 306092 - DNA, 42 bp, Artificial Sequence
  Description of Artificial Sequence: Synthetic oligonucleotide
cagcaagcatgaggaaaagtaactgaagtttattgaactacg

SEQ ID NO: 306093 - DNA, 45 bp, Artificial Sequence
  Description of Artificial Sequence: Synthetic oligonucleotide
agcaagcatgaggaaaagtaactgaagtttattgaactacgaatg

SEQ ID NO: 306094 - DNA, 44 bp, Artificial Sequence
  Description of Artificial Sequence: Synthetic oligonucleotide
gcaagcatgaggaaaagtaactgaagtttattgaactacgaatg

SEQ ID NO: 306095 - DNA, 44 bp, Artificial Sequence
  Description of Artificial Sequence: Synthetic oligonucleotide
caagcatgaggaaaagtaactgaagtttattgaactacgaatgg

SEQ ID NO: 306096 - DNA, 46 bp, Artificial Sequence
  Description of Artificial Sequence: Synthetic oligonucleotide
aagcatgaggaaaagtaactgaagtttattgaactacgaatggaag

SEQ ID NO: 306097 - DNA, 45 bp, Artificial Sequence
  Description of Artificial Sequence: Synthetic oligonucleotide
agcatgaggaaaagtaactgaagtttattgaactacgaatggaag

SEQ ID NO: 306098 - DNA, 44 bp, Artificial Sequence
  Description of Artificial Sequence: Synthetic oligonucleotide
gcatgaggaaaagtaactgaagtttattgaactacgaatggaag

SEQ ID NO: 306099 - DNA, 44 bp, Artificial Sequence
  Description of Artificial Sequence: Synthetic oligonucleotide
catgaggaaaagtaactgaagtttattgaactacgaatggaagc

SEQ ID NO: 306100 - DNA, 47 bp, Artificial Sequence
  Description of Artificial Sequence: Synthetic oligonucleotide
atgaggaaaagtaactgaagtttattgaactacgaatggaagcaaag

SEQ ID NO: 306101 - DNA, 46 bp, Artificial Sequence
  Description of Artificial Sequence: Synthetic oligonucleotide
tgaggaaaagtaactgaagtttattgaactacgaatggaagcaaag

SEQ ID NO: 306102 - DNA, 45 bp, Artificial Sequence
  Description of Artificial Sequence: Synthetic oligonucleotide
gaggaaaagtaactgaagtttattgaactacgaatggaagcaaag

SEQ ID NO: 306103 - DNA, 45 bp, Artificial Sequence
  Description of Artificial Sequence: Synthetic oligonucleotide
aggaaaagtaactgaagtttattgaactacgaatggaagcaaagg

SEQ ID NO: 306104 - DNA, 44 bp, Artificial Sequence
  Description of Artificial Sequence: Synthetic oligonucleotide
ggaaaagtaactgaagtttattgaactacgaatggaagcaaagg

SEQ ID NO: 306105 - DNA, 48 bp, Artificial Sequence
  Description of Artificial Sequence: Synthetic oligonucleotide
gaaaagtaactgaagtttattgaactacgaatggaagcaaaggttatg

SEQ ID NO: 306106 - DNA, 50 bp, Artificial Sequence
  Description of Artificial Sequence: Synthetic oligonucleotide
aaaagtaactgaagtttattgaactacgaatggaagcaaaggttatgaag

SEQ ID NO: 306107 - DNA, 49 bp, Artificial Sequence
  Description of Artificial Sequence: Synthetic oligonucleotide
aaagtaactgaagtttattgaactacgaatggaagcaaaggttatgaag

SEQ ID NO: 306108 - DNA, 48 bp, Artificial Sequence
  Description of Artificial Sequence: Synthetic oligonucleotide
aagtaactgaagtttattgaactacgaatggaagcaaaggttatgaag

SEQ ID NO: 306109 - DNA, 47 bp, Artificial Sequence
  Description of Artificial Sequence: Synthetic oligonucleotide
agtaactgaagtttattgaactacgaatggaagcaaaggttatgaag

SEQ ID NO: 306110 - DNA, 46 bp, Artificial Sequence
  Description of Artificial Sequence: Synthetic oligonucleotide
gtaactgaagtttattgaactacgaatggaagcaaaggttatgaag

SEQ ID NO: 306111 - DNA, 47 bp, Artificial Sequence
  Description of Artificial Sequence: Synthetic oligonucleotide
taactgaagtttattgaactacgaatggaagcaaaggttatgaagac

SEQ ID NO: 306112 - DNA, 46 bp, Artificial Sequence
  Description of Artificial Sequence: Synthetic oligonucleotide
aactgaagtttattgaactacgaatggaagcaaaggttatgaagac

SEQ ID NO: 306113 - DNA, 45 bp, Artificial Sequence
  Description of Artificial Sequence: Synthetic oligonucleotide
actgaagtttattgaactacgaatggaagcaaaggttatgaagac

SEQ ID NO: 306114 - DNA, 44 bp, Artificial Sequence
  Description of Artificial Sequence: Synthetic oligonucleotide
ctgaagtttattgaactacgaatggaagcaaaggttatgaagac

SEQ ID NO: 306115 - DNA, 45 bp, Artificial Sequence
  Description of Artificial Sequence: Synthetic oligonucleotide
tgaagtttattgaactacgaatggaagcaaaggttatgaagacac

SEQ ID NO: 306116 - DNA, 44 bp, Artificial Sequence
  Description of Artificial Sequence: Synthetic oligonucleotide
gaagtttattgaactacgaatggaagcaaaggttatgaagacac

SEQ ID NO: 306117 - DNA, 45 bp, Artificial Sequence
  Description of Artificial Sequence: Synthetic oligonucleotide
aagtttattgaactacgaatggaagcaaaggttatgaagacacag

SEQ ID NO: 306118 - DNA, 44 bp, Artificial Sequence
  Description of Artificial Sequence: Synthetic oligonucleotide
agtttattgaactacgaatggaagcaaaggttatgaagacacag

SEQ ID NO: 306119 - DNA, 43 bp, Artificial Sequence
  Description of Artificial Sequence: Synthetic oligonucleotide
gtttattgaactacgaatggaagcaaaggttatgaagacacag

SEQ ID NO: 306120 - DNA, 45 bp, Artificial Sequence
  Description of Artificial Sequence: Synthetic oligonucleotide
tttattgaactacgaatggaagcaaaggttatgaagacacagtac

SEQ ID NO: 306121 - DNA, 44 bp, Artificial Sequence
  Description of Artificial Sequence: Synthetic oligonucleotide
ttattgaactacgaatggaagcaaaggttatgaagacacagtac

SEQ ID NO: 306122 - DNA, 43 bp, Artificial Sequence
  Description of Artificial Sequence: Synthetic oligonucleotide
tattgaactacgaatggaagcaaaggttatgaagacacagtac

SEQ ID NO: 306123 - DNA, 42 bp, Artificial Sequence
  Description of Artificial Sequence: Synthetic oligonucleotide
attgaactacgaatggaagcaaaggttatgaagacacagtac

SEQ ID NO: 306124 - DNA, 41 bp, Artificial Sequence
  Description of Artificial Sequence: Synthetic oligonucleotide
ttgaactacgaatggaagcaaaggttatgaagacacagtac

SEQ ID NO: 306125 - DNA, 40 bp, Artificial Sequence
  Description of Artificial Sequence: Synthetic oligonucleotide
tgaactacgaatggaagcaaaggttatgaagacacagtac

SEQ ID NO: 306126 - DNA, 39 bp, Artificial Sequence
  Description of Artificial Sequence: Synthetic oligonucleotide
gaactacgaatggaagcaaaggttatgaagacacagtac

SEQ ID NO: 306127 - DNA, 41 bp, Artificial Sequence
  Description of Artificial Sequence: Synthetic oligonucleotide
aactacgaatggaagcaaaggttatgaagacacagtacttg

SEQ ID NO: 306128 - DNA, 40 bp, Artificial Sequence
  Description of Artificial Sequence: Synthetic oligonucleotide
actacgaatggaagcaaaggttatgaagacacagtacttg

SEQ ID NO: 306129 - DNA, 39 bp, Artificial Sequence
  Description of Artificial Sequence: Synthetic oligonucleotide
ctacgaatggaagcaaaggttatgaagacacagtacttg

SEQ ID NO: 306130 - DNA, 39 bp, Artificial Sequence
  Description of Artificial Sequence: Synthetic oligonucleotide
tacgaatggaagcaaaggttatgaagacacagtacttgg

SEQ ID NO: 306131 - DNA, 38 bp, Artificial Sequence
  Description of Artificial Sequence: Synthetic oligonucleotide
acgaatggaagcaaaggttatgaagacacagtacttgg

SEQ ID NO: 306132 - DNA, 37 bp, Artificial Sequence
  Description of Artificial Sequence: Synthetic oligonucleotide
cgaatggaagcaaaggttatgaagacacagtacttgg

SEQ ID NO: 306133 - DNA, 37 bp, Artificial Sequence
  Description of Artificial Sequence: Synthetic oligonucleotide
gaatggaagcaaaggttatgaagacacagtacttggc

SEQ ID NO: 306134 - DNA, 38 bp, Artificial Sequence
  Description of Artificial Sequence: Synthetic oligonucleotide
aatggaagcaaaggttatgaagacacagtacttggcag

SEQ ID NO: 306135 - DNA, 37 bp, Artificial Sequence
  Description of Artificial Sequence: Synthetic oligonucleotide
atggaagcaaaggttatgaagacacagtacttggcag

SEQ ID NO: 306136 - DNA, 36 bp, Artificial Sequence
  Description of Artificial Sequence: Synthetic oligonucleotide
tggaagcaaaggttatgaagacacagtacttggcag

SEQ ID NO: 306137 - DNA, 35 bp, Artificial Sequence
  Description of Artificial Sequence: Synthetic oligonucleotide
ggaagcaaaggttatgaagacacagtacttggcag

SEQ ID NO: 306138 - DNA, 35 bp, Artificial Sequence
  Description of Artificial Sequence: Synthetic oligonucleotide
gaagcaaaggttatgaagacacagtacttggcagg

SEQ ID NO: 306139 - DNA, 36 bp, Artificial Sequence
  Description of Artificial Sequence: Synthetic oligonucleotide
aagcaaaggttatgaagacacagtacttggcaggtc

SEQ ID NO: 306140 - DNA, 35 bp, Artificial Sequence
  Description of Artificial Sequence: Synthetic oligonucleotide
agcaaaggttatgaagacacagtacttggcaggtc

SEQ ID NO: 306141 - DNA, 34 bp, Artificial Sequence
  Description of Artificial Sequence: Synthetic oligonucleotide
gcaaaggttatgaagacacagtacttggcaggtc

SEQ ID NO: 306142 - DNA, 35 bp, Artificial Sequence
  Description of Artificial Sequence: Synthetic oligonucleotide
caaaggttatgaagacacagtacttggcaggtctc

SEQ ID NO: 306143 - DNA, 35 bp, Artificial Sequence
  Description of Artificial Sequence: Synthetic oligonucleotide
aaaggttatgaagacacagtacttggcaggtctcc

SEQ ID NO: 306144 - DNA, 34 bp, Artificial Sequence
  Description of Artificial Sequence: Synthetic oligonucleotide
aaggttatgaagacacagtacttggcaggtctcc

SEQ ID NO: 306145 - DNA, 33 bp, Artificial Sequence
  Description of Artificial Sequence: Synthetic oligonucleotide
aggttatgaagacacagtacttggcaggtctcc

SEQ ID NO: 306146 - DNA, 32 bp, Artificial Sequence
  Description of Artificial Sequence: Synthetic oligonucleotide
ggttatgaagacacagtacttggcaggtctcc

SEQ ID NO: 306147 - DNA, 34 bp, Artificial Sequence
  Description of Artificial Sequence: Synthetic oligonucleotide
gttatgaagacacagtacttggcaggtctccttc

SEQ ID NO: 306148 - DNA, 36 bp, Artificial Sequence
  Description of Artificial Sequence: Synthetic oligonucleotide
ttatgaagacacagtacttggcaggtctccttcaag

SEQ ID NO: 306149 - DNA, 35 bp, Artificial Sequence
  Description of Artificial Sequence: Synthetic oligonucleotide
tatgaagacacagtacttggcaggtctccttcaag

SEQ ID NO: 306150 - DNA, 34 bp, Artificial Sequence
  Description of Artificial Sequence: Synthetic oligonucleotide
atgaagacacagtacttggcaggtctccttcaag

SEQ ID NO: 306151 - DNA, 33 bp, Artificial Sequence
  Description of Artificial Sequence: Synthetic oligonucleotide
tgaagacacagtacttggcaggtctccttcaag

SEQ ID NO: 306152 - DNA, 32 bp, Artificial Sequence
  Description of Artificial Sequence: Synthetic oligonucleotide
gaagacacagtacttggcaggtctccttcaag

SEQ ID NO: 306153 - DNA, 32 bp, Artificial Sequence
  Description of Artificial Sequence: Synthetic oligonucleotide
aagacacagtacttggcaggtctccttcaagc

SEQ ID NO: 306154 - DNA, 31 bp, Artificial Sequence
  Description of Artificial Sequence: Synthetic oligonucleotide
agacacagtacttggcaggtctccttcaagc

SEQ ID NO: 306155 - DNA, 30 bp, Artificial Sequence
  Description of Artificial Sequence: Synthetic oligonucleotide
gacacagtacttggcaggtctccttcaagc

SEQ ID NO: 306156 - DNA, 30 bp, Artificial Sequence
  Description of Artificial Sequence: Synthetic oligonucleotide
acacagtacttggcaggtctccttcaagcg

SEQ ID NO: 306157 - DNA, 29 bp, Artificial Sequence
  Description of Artificial Sequence: Synthetic oligonucleotide
cacagtacttggcaggtctccttcaagcg

SEQ ID NO: 306158 - DNA, 32 bp, Artificial Sequence
  Description of Artificial Sequence: Synthetic oligonucleotide
acagtacttggcaggtctccttcaagcgattg

SEQ ID NO: 306159 - DNA, 31 bp, Artificial Sequence
  Description of Artificial Sequence: Synthetic oligonucleotide
cagtacttggcaggtctccttcaagcgattg

SEQ ID NO: 306160 - DNA, 31 bp, Artificial Sequence
  Description of Artificial Sequence: Synthetic oligonucleotide
agtacttggcaggtctccttcaagcgattgc

SEQ ID NO: 306161 - DNA, 30 bp, Artificial Sequence
  Description of Artificial Sequence: Synthetic oligonucleotide
gtacttggcaggtctccttcaagcgattgc

SEQ ID NO: 306162 - DNA, 30 bp, Artificial Sequence
  Description of Artificial Sequence: Synthetic oligonucleotide
tacttggcaggtctccttcaagcgattgcc

SEQ ID NO: 306163 - DNA, 29 bp, Artificial Sequence
  Description of Artificial Sequence: Synthetic oligonucleotide
acttggcaggtctccttcaagcgattgcc

SEQ ID NO: 306164 - DNA, 28 bp, Artificial Sequence
  Description of Artificial Sequence: Synthetic oligonucleotide
cttggcaggtctccttcaagcgattgcc

SEQ ID NO: 306165 - DNA, 29 bp, Artificial Sequence
  Description of Artificial Sequence: Synthetic oligonucleotide
ttggcaggtctccttcaagcgattgcctg

SEQ ID NO: 306166 - DNA, 28 bp, Artificial Sequence
  Description of Artificial Sequence: Synthetic oligonucleotide
tggcaggtctccttcaagcgattgcctg

SEQ ID NO: 306167 - DNA, 27 bp, Artificial Sequence
  Description of Artificial Sequence: Synthetic oligonucleotide
ggcaggtctccttcaagcgattgcctg

SEQ ID NO: 306168 - DNA, 28 bp, Artificial Sequence
  Description of Artificial Sequence: Synthetic oligonucleotide
gcaggtctccttcaagcgattgcctgac

SEQ ID NO: 306169 - DNA, 28 bp, Artificial Sequence
  Description of Artificial Sequence: Synthetic oligonucleotide
caggtctccttcaagcgattgcctgacg

SEQ ID NO: 306170 - DNA, 29 bp, Artificial Sequence
  Description of Artificial Sequence: Synthetic oligonucleotide
aggtctccttcaagcgattgcctgacgtc

SEQ ID NO: 306171 - DNA, 28 bp, Artificial Sequence
  Description of Artificial Sequence: Synthetic oligonucleotide
ggtctccttcaagcgattgcctgacgtc

SEQ ID NO: 306172 - DNA, 28 bp, Artificial Sequence
  Description of Artificial Sequence: Synthetic oligonucleotide
gtctccttcaagcgattgcctgacgtcc

SEQ ID NO: 306173 - DNA, 31 bp, Artificial Sequence
  Description of Artificial Sequence: Synthetic oligonucleotide
tctccttcaagcgattgcctgacgtccaatg

SEQ ID NO: 306174 - DNA, 30 bp, Artificial Sequence
  Description of Artificial Sequence: Synthetic oligonucleotide
ctccttcaagcgattgcctgacgtccaatg

SEQ ID NO: 306175 - DNA, 30 bp, Artificial Sequence
  Description of Artificial Sequence: Synthetic oligonucleotide
tccttcaagcgattgcctgacgtccaatgg

SEQ ID NO: 306176 - DNA, 29 bp, Artificial Sequence
  Description of Artificial Sequence: Synthetic oligonucleotide
ccttcaagcgattgcctgacgtccaatgg

SEQ ID NO: 306177 - DNA, 29 bp, Artificial Sequence
  Description of Artificial Sequence: Synthetic oligonucleotide
cttcaagcgattgcctgacgtccaatggg

SEQ ID NO: 306178 - DNA, 29 bp, Artificial Sequence
  Description of Artificial Sequence: Synthetic oligonucleotide
ttcaagcgattgcctgacgtccaatgggg

SEQ ID NO: 306179 - DNA, 28 bp, Artificial Sequence
  Description of Artificial Sequence: Synthetic oligonucleotide
tcaagcgattgcctgacgtccaatgggg

SEQ ID NO: 306180 - DNA, 27 bp, Artificial Sequence
  Description of Artificial Sequence: Synthetic oligonucleotide
caagcgattgcctgacgtccaatgggg

SEQ ID NO: 306181 - DNA, 27 bp, Artificial Sequence
  Description of Artificial Sequence: Synthetic oligonucleotide
aagcgattgcctgacgtccaatggggc

SEQ ID NO: 306182 - DNA, 27 bp, Artificial Sequence
  Description of Artificial Sequence: Synthetic oligonucleotide
agcgattgcctgacgtccaatggggca

SEQ ID NO: 306183 - DNA, 26 bp, Artificial Sequence
  Description of Artificial Sequence: Synthetic oligonucleotide
gcgattgcctgacgtccaatggggca

SEQ ID NO: 306184 - DNA, 26 bp, Artificial Sequence
  Description of Artificial Sequence: Synthetic oligonucleotide
cgattgcctgacgtccaatggggcag

SEQ ID NO: 306185 - DNA, 27 bp, Artificial Sequence
  Description of Artificial Sequence: Synthetic oligonucleotide
gattgcctgacgtccaatggggcagca

SEQ ID NO: 306186 - DNA, 28 bp, Artificial Sequence
  Description of Artificial Sequence: Synthetic oligonucleotide
attgcctgacgtccaatggggcagcatc

SEQ ID NO: 306187 - DNA, 27 bp, Artificial Sequence
  Description of Artificial Sequence: Synthetic oligonucleotide
ttgcctgacgtccaatggggcagcatc

SEQ ID NO: 306188 - DNA, 27 bp, Artificial Sequence
  Description of Artificial Sequence: Synthetic oligonucleotide
tgcctgacgtccaatggggcagcatct

SEQ ID NO: 306189 - DNA, 27 bp, Artificial Sequence
  Description of Artificial Sequence: Synthetic oligonucleotide
gcctgacgtccaatggggcagcatcta

SEQ ID NO: 306190 - DNA, 27 bp, Artificial Sequence
  Description of Artificial Sequence: Synthetic oligonucleotide
cctgacgtccaatggggcagcatctag

SEQ ID NO: 306191 - DNA, 27 bp, Artificial Sequence
  Description of Artificial Sequence: Synthetic oligonucleotide
ctgacgtccaatggggcagcatctagc

SEQ ID NO: 306192 - DNA, 29 bp, Artificial Sequence
  Description of Artificial Sequence: Synthetic oligonucleotide
tgacgtccaatggggcagcatctagcatg

SEQ ID NO: 306193 - DNA, 28 bp, Artificial Sequence
  Description of Artificial Sequence: Synthetic oligonucleotide
gacgtccaatggggcagcatctagcatg

SEQ ID NO: 306194 - DNA, 28 bp, Artificial Sequence
  Description of Artificial Sequence: Synthetic oligonucleotide
acgtccaatggggcagcatctagcatgg

SEQ ID NO: 306195 - DNA, 27 bp, Artificial Sequence
  Description of Artificial Sequence: Synthetic oligonucleotide
cgtccaatggggcagcatctagcatgg

SEQ ID NO: 306196 - DNA, 27 bp, Artificial Sequence
  Description of Artificial Sequence: Synthetic oligonucleotide
gtccaatggggcagcatctagcatggc

SEQ ID NO: 306197 - DNA, 32 bp, Artificial Sequence
  Description of Artificial Sequence: Synthetic oligonucleotide
tccaatggggcagcatctagcatggcattttg

SEQ ID NO: 306198 - DNA, 31 bp, Artificial Sequence
  Description of Artificial Sequence: Synthetic oligonucleotide
ccaatggggcagcatctagcatggcattttg

SEQ ID NO: 306199 - DNA, 34 bp, Artificial Sequence
  Description of Artificial Sequence: Synthetic oligonucleotide
caatggggcagcatctagcatggcattttgtaac

SEQ ID NO: 306200 - DNA, 35 bp, Artificial Sequence
  Description of Artificial Sequence: Synthetic oligonucleotide
aatggggcagcatctagcatggcattttgtaacag

SEQ ID NO: 306201 - DNA, 34 bp, Artificial Sequence
  Description of Artificial Sequence: Synthetic oligonucleotide
atggggcagcatctagcatggcattttgtaacag

SEQ ID NO: 306202 - DNA, 33 bp, Artificial Sequence
  Description of Artificial Sequence: Synthetic oligonucleotide
tggggcagcatctagcatggcattttgtaacag

SEQ ID NO: 306203 - DNA, 32 bp, Artificial Sequence
  Description of Artificial Sequence: Synthetic oligonucleotide
ggggcagcatctagcatggcattttgtaacag

SEQ ID NO: 306204 - DNA, 38 bp, Artificial Sequence
  Description of Artificial Sequence: Synthetic oligonucleotide
gggcagcatctagcatggcattttgtaacagaaaattg

SEQ ID NO: 306205 - DNA, 38 bp, Artificial Sequence
  Description of Artificial Sequence: Synthetic oligonucleotide
ggcagcatctagcatggcattttgtaacagaaaattgc

SEQ ID NO: 306206 - DNA, 39 bp, Artificial Sequence
  Description of Artificial Sequence: Synthetic oligonucleotide
gcagcatctagcatggcattttgtaacagaaaattgcac

SEQ ID NO: 306207 - DNA, 39 bp, Artificial Sequence
  Description of Artificial Sequence: Synthetic oligonucleotide
cagcatctagcatggcattttgtaacagaaaattgcacc

SEQ ID NO: 306208 - DNA, 39 bp, Artificial Sequence
  Description of Artificial Sequence: Synthetic oligonucleotide
agcatctagcatggcattttgtaacagaaaattgcaccc

SEQ ID NO: 306209 - DNA, 38 bp, Artificial Sequence
  Description of Artificial Sequence: Synthetic oligonucleotide
gcatctagcatggcattttgtaacagaaaattgcaccc

SEQ ID NO: 306210 - DNA, 40 bp, Artificial Sequence
  Description of Artificial Sequence: Synthetic oligonucleotide
catctagcatggcattttgtaacagaaaattgcacccatc

SEQ ID NO: 306211 - DNA, 42 bp, Artificial Sequence
  Description of Artificial Sequence: Synthetic oligonucleotide
atctagcatggcattttgtaacagaaaattgcacccatcttg

SEQ ID NO: 306212 - DNA, 41 bp, Artificial Sequence
  Description of Artificial Sequence: Synthetic oligonucleotide
tctagcatggcattttgtaacagaaaattgcacccatcttg

SEQ ID NO: 306213 - DNA, 40 bp, Artificial Sequence
  Description of Artificial Sequence: Synthetic oligonucleotide
ctagcatggcattttgtaacagaaaattgcacccatcttg

SEQ ID NO: 306214 - DNA, 41 bp, Artificial Sequence
  Description of Artificial Sequence: Synthetic oligonucleotide
tagcatggcattttgtaacagaaaattgcacccatcttgtg

SEQ ID NO: 306215 - DNA, 40 bp, Artificial Sequence
  Description of Artificial Sequence: Synthetic oligonucleotide
agcatggcattttgtaacagaaaattgcacccatcttgtg

SEQ ID NO: 306216 - DNA, 39 bp, Artificial Sequence
  Description of Artificial Sequence: Synthetic oligonucleotide
gcatggcattttgtaacagaaaattgcacccatcttgtg

SEQ ID NO: 306217 - DNA, 48 bp, Artificial Sequence
  Description of Artificial Sequence: Synthetic oligonucleotide
catggcattttgtaacagaaaattgcacccatcttgtgaaaaaatatg

SEQ ID NO: 306218 - DNA, 49 bp, Artificial Sequence
  Description of Artificial Sequence: Synthetic oligonucleotide
atggcattttgtaacagaaaattgcacccatcttgtgaaaaaatatgac

SEQ ID NO: 306219 - DNA, 48 bp, Artificial Sequence
  Description of Artificial Sequence: Synthetic oligonucleotide
tggcattttgtaacagaaaattgcacccatcttgtgaaaaaatatgac

SEQ ID NO: 306220 - DNA, 47 bp, Artificial Sequence
  Description of Artificial Sequence: Synthetic oligonucleotide
ggcattttgtaacagaaaattgcacccatcttgtgaaaaaatatgac

SEQ ID NO: 306221 - DNA, 49 bp, Artificial Sequence
  Description of Artificial Sequence: Synthetic oligonucleotide
gcattttgtaacagaaaattgcacccatcttgtgaaaaaatatgacttg

SEQ ID NO: 306222 - DNA, 49 bp, Artificial Sequence
  Description of Artificial Sequence: Synthetic oligonucleotide
cattttgtaacagaaaattgcacccatcttgtgaaaaaatatgacttgg

SEQ ID NO: 306223 - DNA, 49 bp, Artificial Sequence
  Description of Artificial Sequence: Synthetic oligonucleotide
attttgtaacagaaaattgcacccatcttgtgaaaaaatatgacttggg

SEQ ID NO: 306224 - DNA, 48 bp, Artificial Sequence
  Description of Artificial Sequence: Synthetic oligonucleotide
ttttgtaacagaaaattgcacccatcttgtgaaaaaatatgacttggg

SEQ ID NO: 306225 - DNA, 47 bp, Artificial Sequence
  Description of Artificial Sequence: Synthetic oligonucleotide
tttgtaacagaaaattgcacccatcttgtgaaaaaatatgacttggg

SEQ ID NO: 306226 - DNA, 46 bp, Artificial Sequence
  Description of Artificial Sequence: Synthetic oligonucleotide
ttgtaacagaaaattgcacccatcttgtgaaaaaatatgacttggg

SEQ ID NO: 306227 - DNA, 45 bp, Artificial Sequence
  Description of Artificial Sequence: Synthetic oligonucleotide
tgtaacagaaaattgcacccatcttgtgaaaaaatatgacttggg

SEQ ID NO: 306228 - DNA, 44 bp, Artificial Sequence
  Description of Artificial Sequence: Synthetic oligonucleotide
gtaacagaaaattgcacccatcttgtgaaaaaatatgacttggg

SEQ ID NO: 306229 - DNA, 44 bp, Artificial Sequence
  Description of Artificial Sequence: Synthetic oligonucleotide
taacagaaaattgcacccatcttgtgaaaaaatatgacttgggg

SEQ ID NO: 306230 - DNA, 43 bp, Artificial Sequence
  Description of Artificial Sequence: Synthetic oligonucleotide
aacagaaaattgcacccatcttgtgaaaaaatatgacttgggg

SEQ ID NO: 306231 - DNA, 42 bp, Artificial Sequence
  Description of Artificial Sequence: Synthetic oligonucleotide
acagaaaattgcacccatcttgtgaaaaaatatgacttgggg

SEQ ID NO: 306232 - DNA, 41 bp, Artificial Sequence
  Description of Artificial Sequence: Synthetic oligonucleotide
cagaaaattgcacccatcttgtgaaaaaatatgacttgggg

SEQ ID NO: 306233 - DNA, 42 bp, Artificial Sequence
  Description of Artificial Sequence: Synthetic oligonucleotide
agaaaattgcacccatcttgtgaaaaaatatgacttggggtc

SEQ ID NO: 306234 - DNA, 41 bp, Artificial Sequence
  Description of Artificial Sequence: Synthetic oligonucleotide
gaaaattgcacccatcttgtgaaaaaatatgacttggggtc

SEQ ID NO: 306235 - DNA, 45 bp, Artificial Sequence
  Description of Artificial Sequence: Synthetic oligonucleotide
aaaattgcacccatcttgtgaaaaaatatgacttggggtcatatg

SEQ ID NO: 306236 - DNA, 44 bp, Artificial Sequence
  Description of Artificial Sequence: Synthetic oligonucleotide
aaattgcacccatcttgtgaaaaaatatgacttggggtcatatg

SEQ ID NO: 306237 - DNA, 43 bp, Artificial Sequence
  Description of Artificial Sequence: Synthetic oligonucleotide
aattgcacccatcttgtgaaaaaatatgacttggggtcatatg

SEQ ID NO: 306238 - DNA, 42 bp, Artificial Sequence
  Description of Artificial Sequence: Synthetic oligonucleotide
attgcacccatcttgtgaaaaaatatgacttggggtcatatg

SEQ ID NO: 306239 - DNA, 41 bp, Artificial Sequence
  Description of Artificial Sequence: Synthetic oligonucleotide
ttgcacccatcttgtgaaaaaatatgacttggggtcatatg

SEQ ID NO: 306240 - DNA, 40 bp, Artificial Sequence
  Description of Artificial Sequence: Synthetic oligonucleotide
tgcacccatcttgtgaaaaaatatgacttggggtcatatg

SEQ ID NO: 306241 - DNA, 39 bp, Artificial Sequence
  Description of Artificial Sequence: Synthetic oligonucleotide
gcacccatcttgtgaaaaaatatgacttggggtcatatg

SEQ ID NO: 306242 - DNA, 40 bp, Artificial Sequence
  Description of Artificial Sequence: Synthetic oligonucleotide
cacccatcttgtgaaaaaatatgacttggggtcatatgac

SEQ ID NO: 306243 - DNA, 44 bp, Artificial Sequence
  Description of Artificial Sequence: Synthetic oligonucleotide
acccatcttgtgaaaaaatatgacttggggtcatatgacttaag

SEQ ID NO: 306244 - DNA, 43 bp, Artificial Sequence
  Description of Artificial Sequence: Synthetic oligonucleotide
cccatcttgtgaaaaaatatgacttggggtcatatgacttaag

SEQ ID NO: 306245 - DNA, 43 bp, Artificial Sequence
  Description of Artificial Sequence: Synthetic oligonucleotide
ccatcttgtgaaaaaatatgacttggggtcatatgacttaagg

SEQ ID NO: 306246 - DNA, 45 bp, Artificial Sequence
  Description of Artificial Sequence: Synthetic oligonucleotide
catcttgtgaaaaaatatgacttggggtcatatgacttaaggatg

SEQ ID NO: 306247 - DNA, 47 bp, Artificial Sequence
  Description of Artificial Sequence: Synthetic oligonucleotide
atcttgtgaaaaaatatgacttggggtcatatgacttaaggatgaac

SEQ ID NO: 306248 - DNA, 46 bp, Artificial Sequence
  Description of Artificial Sequence: Synthetic oligonucleotide
tcttgtgaaaaaatatgacttggggtcatatgacttaaggatgaac

SEQ ID NO: 306249 - DNA, 45 bp, Artificial Sequence
  Description of Artificial Sequence: Synthetic oligonucleotide
cttgtgaaaaaatatgacttggggtcatatgacttaaggatgaac

SEQ ID NO: 306250 - DNA, 47 bp, Artificial Sequence
  Description of Artificial Sequence: Synthetic oligonucleotide
ttgtgaaaaaatatgacttggggtcatatgacttaaggatgaacatc

SEQ ID NO: 306251 - DNA, 46 bp, Artificial Sequence
  Description of Artificial Sequence: Synthetic oligonucleotide
tgtgaaaaaatatgacttggggtcatatgacttaaggatgaacatc

SEQ ID NO: 306252 - DNA, 45 bp, Artificial Sequence
  Description of Artificial Sequence: Synthetic oligonucleotide
gtgaaaaaatatgacttggggtcatatgacttaaggatgaacatc

SEQ ID NO: 306253 - DNA, 46 bp, Artificial Sequence
  Description of Artificial Sequence: Synthetic oligonucleotide
tgaaaaaatatgacttggggtcatatgacttaaggatgaacatctc

SEQ ID NO: 306254 - DNA, 45 bp, Artificial Sequence
  Description of Artificial Sequence: Synthetic oligonucleotide
gaaaaaatatgacttggggtcatatgacttaaggatgaacatctc

SEQ ID NO: 306255 - DNA, 46 bp, Artificial Sequence
  Description of Artificial Sequence: Synthetic oligonucleotide
aaaaaatatgacttggggtcatatgacttaaggatgaacatctctg

SEQ ID NO: 306256 - DNA, 45 bp, Artificial Sequence
  Description of Artificial Sequence: Synthetic oligonucleotide
aaaaatatgacttggggtcatatgacttaaggatgaacatctctg

SEQ ID NO: 306257 - DNA, 44 bp, Artificial Sequence
  Description of Artificial Sequence: Synthetic oligonucleotide
aaaatatgacttggggtcatatgacttaaggatgaacatctctg

SEQ ID NO: 306258 - DNA, 43 bp, Artificial Sequence
  Description of Artificial Sequence: Synthetic oligonucleotide
aaatatgacttggggtcatatgacttaaggatgaacatctctg

SEQ ID NO: 306259 - DNA, 42 bp, Artificial Sequence
  Description of Artificial Sequence: Synthetic oligonucleotide
aatatgacttggggtcatatgacttaaggatgaacatctctg

SEQ ID NO: 306260 - DNA, 41 bp, Artificial Sequence
  Description of Artificial Sequence: Synthetic oligonucleotide
atatgacttggggtcatatgacttaaggatgaacatctctg

SEQ ID NO: 306261 - DNA, 40 bp, Artificial Sequence
  Description of Artificial Sequence: Synthetic oligonucleotide
tatgacttggggtcatatgacttaaggatgaacatctctg

SEQ ID NO: 306262 - DNA, 39 bp, Artificial Sequence
  Description of Artificial Sequence: Synthetic oligonucleotide
atgacttggggtcatatgacttaaggatgaacatctctg

SEQ ID NO: 306263 - DNA, 38 bp, Artificial Sequence
  Description of Artificial Sequence: Synthetic oligonucleotide
tgacttggggtcatatgacttaaggatgaacatctctg

SEQ ID NO: 306264 - DNA, 37 bp, Artificial Sequence
  Description of Artificial Sequence: Synthetic oligonucleotide
gacttggggtcatatgacttaaggatgaacatctctg

SEQ ID NO: 306265 - DNA, 37 bp, Artificial Sequence
  Description of Artificial Sequence: Synthetic oligonucleotide
acttggggtcatatgacttaaggatgaacatctctgg

SEQ ID NO: 306266 - DNA, 36 bp, Artificial Sequence
  Description of Artificial Sequence: Synthetic oligonucleotide
cttggggtcatatgacttaaggatgaacatctctgg

SEQ ID NO: 306267 - DNA, 36 bp, Artificial Sequence
  Description of Artificial Sequence: Synthetic oligonucleotide
ttggggtcatatgacttaaggatgaacatctctggg

SEQ ID NO: 306268 - DNA, 35 bp, Artificial Sequence
  Description of Artificial Sequence: Synthetic oligonucleotide
tggggtcatatgacttaaggatgaacatctctggg

SEQ ID NO: 306269 - DNA, 34 bp, Artificial Sequence
  Description of Artificial Sequence: Synthetic oligonucleotide
ggggtcatatgacttaaggatgaacatctctggg

SEQ ID NO: 306270 - DNA, 35 bp, Artificial Sequence
  Description of Artificial Sequence: Synthetic oligonucleotide
gggtcatatgacttaaggatgaacatctctgggac

SEQ ID NO: 306271 - DNA, 37 bp, Artificial Sequence
  Description of Artificial Sequence: Synthetic oligonucleotide
ggtcatatgacttaaggatgaacatctctgggacaac

SEQ ID NO: 306272 - DNA, 38 bp, Artificial Sequence
  Description of Artificial Sequence: Synthetic oligonucleotide
gtcatatgacttaaggatgaacatctctgggacaacag

SEQ ID NO: 306273 - DNA, 38 bp, Artificial Sequence
  Description of Artificial Sequence: Synthetic oligonucleotide
tcatatgacttaaggatgaacatctctgggacaacagc

SEQ ID NO: 306274 - DNA, 37 bp, Artificial Sequence
  Description of Artificial Sequence: Synthetic oligonucleotide
catatgacttaaggatgaacatctctgggacaacagc

SEQ ID NO: 306275 - DNA, 38 bp, Artificial Sequence
  Description of Artificial Sequence: Synthetic oligonucleotide
atatgacttaaggatgaacatctctgggacaacagctg

SEQ ID NO: 306276 - DNA, 37 bp, Artificial Sequence
  Description of Artificial Sequence: Synthetic oligonucleotide
tatgacttaaggatgaacatctctgggacaacagctg

SEQ ID NO: 306277 - DNA, 36 bp, Artificial Sequence
  Description of Artificial Sequence: Synthetic oligonucleotide
atgacttaaggatgaacatctctgggacaacagctg

SEQ ID NO: 306278 - DNA, 35 bp, Artificial Sequence
  Description of Artificial Sequence: Synthetic oligonucleotide
tgacttaaggatgaacatctctgggacaacagctg

SEQ ID NO: 306279 - DNA, 34 bp, Artificial Sequence
  Description of Artificial Sequence: Synthetic oligonucleotide
gacttaaggatgaacatctctgggacaacagctg

SEQ ID NO: 306280 - DNA, 35 bp, Artificial Sequence
  Description of Artificial Sequence: Synthetic oligonucleotide
acttaaggatgaacatctctgggacaacagctgac

SEQ ID NO: 306281 - DNA, 34 bp, Artificial Sequence
  Description of Artificial Sequence: Synthetic oligonucleotide
cttaaggatgaacatctctgggacaacagctgac

SEQ ID NO: 306282 - DNA, 38 bp, Artificial Sequence
  Description of Artificial Sequence: Synthetic oligonucleotide
ttaaggatgaacatctctgggacaacagctgacttttc

SEQ ID NO: 306283 - DNA, 37 bp, Artificial Sequence
  Description of Artificial Sequence: Synthetic oligonucleotide
taaggatgaacatctctgggacaacagctgacttttc

SEQ ID NO: 306284 - DNA, 36 bp, Artificial Sequence
  Description of Artificial Sequence: Synthetic oligonucleotide
aaggatgaacatctctgggacaacagctgacttttc

SEQ ID NO: 306285 - DNA, 35 bp, Artificial Sequence
  Description of Artificial Sequence: Synthetic oligonucleotide
aggatgaacatctctgggacaacagctgacttttc

SEQ ID NO: 306286 - DNA, 34 bp, Artificial Sequence
  Description of Artificial Sequence: Synthetic oligonucleotide
ggatgaacatctctgggacaacagctgacttttc

SEQ ID NO: 306287 - DNA, 36 bp, Artificial Sequence
  Description of Artificial Sequence: Synthetic oligonucleotide
gatgaacatctctgggacaacagctgacttttcttg

SEQ ID NO: 306288 - DNA, 36 bp, Artificial Sequence
  Description of Artificial Sequence: Synthetic oligonucleotide
atgaacatctctgggacaacagctgacttttcttgc

SEQ ID NO: 306289 - DNA, 35 bp, Artificial Sequence
  Description of Artificial Sequence: Synthetic oligonucleotide
tgaacatctctgggacaacagctgacttttcttgc

SEQ ID NO: 306290 - DNA, 34 bp, Artificial Sequence
  Description of Artificial Sequence: Synthetic oligonucleotide
gaacatctctgggacaacagctgacttttcttgc

SEQ ID NO: 306291 - DNA, 36 bp, Artificial Sequence
  Description of Artificial Sequence: Synthetic oligonucleotide
aacatctctgggacaacagctgacttttcttgcaag

SEQ ID NO: 306292 - DNA, 35 bp, Artificial Sequence
  Description of Artificial Sequence: Synthetic oligonucleotide
acatctctgggacaacagctgacttttcttgcaag

SEQ ID NO: 306293 - DNA, 34 bp, Artificial Sequence
  Description of Artificial Sequence: Synthetic oligonucleotide
catctctgggacaacagctgacttttcttgcaag

SEQ ID NO: 306294 - DNA, 34 bp, Artificial Sequence
  Description of Artificial Sequence: Synthetic oligonucleotide
atctctgggacaacagctgacttttcttgcaagg

SEQ ID NO: 306295 - DNA, 33 bp, Artificial Sequence
  Description of Artificial Sequence: Synthetic oligonucleotide
tctctgggacaacagctgacttttcttgcaagg

SEQ ID NO: 306296 - DNA, 32 bp, Artificial Sequence
  Description of Artificial Sequence: Synthetic oligonucleotide
ctctgggacaacagctgacttttcttgcaagg

SEQ ID NO: 306297 - DNA, 36 bp, Artificial Sequence
  Description of Artificial Sequence: Synthetic oligonucleotide
tctgggacaacagctgacttttcttgcaaggataac

SEQ ID NO: 306298 - DNA, 35 bp, Artificial Sequence
  Description of Artificial Sequence: Synthetic oligonucleotide
ctgggacaacagctgacttttcttgcaaggataac

SEQ ID NO: 306299 - DNA, 37 bp, Artificial Sequence
  Description of Artificial Sequence: Synthetic oligonucleotide
tgggacaacagctgacttttcttgcaaggataacttg

SEQ ID NO: 306300 - DNA, 36 bp, Artificial Sequence
  Description of Artificial Sequence: Synthetic oligonucleotide
gggacaacagctgacttttcttgcaaggataacttg

SEQ ID NO: 306301 - DNA, 36 bp, Artificial Sequence
  Description of Artificial Sequence: Synthetic oligonucleotide
ggacaacagctgacttttcttgcaaggataacttgc

SEQ ID NO: 306302 - DNA, 38 bp, Artificial Sequence
  Description of Artificial Sequence: Synthetic oligonucleotide
gacaacagctgacttttcttgcaaggataacttgcaag

SEQ ID NO: 306303 - DNA, 39 bp, Artificial Sequence
  Description of Artificial Sequence: Synthetic oligonucleotide
acaacagctgacttttcttgcaaggataacttgcaagag

SEQ ID NO: 306304 - DNA, 38 bp, Artificial Sequence
  Description of Artificial Sequence: Synthetic oligonucleotide
caacagctgacttttcttgcaaggataacttgcaagag

SEQ ID NO: 306305 - DNA, 38 bp, Artificial Sequence
  Description of Artificial Sequence: Synthetic oligonucleotide
aacagctgacttttcttgcaaggataacttgcaagagc

SEQ ID NO: 306306 - DNA, 37 bp, Artificial Sequence
  Description of Artificial Sequence: Synthetic oligonucleotide
acagctgacttttcttgcaaggataacttgcaagagc

SEQ ID NO: 306307 - DNA, 36 bp, Artificial Sequence
  Description of Artificial Sequence: Synthetic oligonucleotide
cagctgacttttcttgcaaggataacttgcaagagc

SEQ ID NO: 306308 - DNA, 37 bp, Artificial Sequence
  Description of Artificial Sequence: Synthetic oligonucleotide
agctgacttttcttgcaaggataacttgcaagagctg

SEQ ID NO: 306309 - DNA, 36 bp, Artificial Sequence
  Description of Artificial Sequence: Synthetic oligonucleotide
gctgacttttcttgcaaggataacttgcaagagctg

SEQ ID NO: 306310 - DNA, 39 bp, Artificial Sequence
  Description of Artificial Sequence: Synthetic oligonucleotide
ctgacttttcttgcaaggataacttgcaagagctgaaac

SEQ ID NO: 306311 - DNA, 47 bp, Artificial Sequence
  Description of Artificial Sequence: Synthetic oligonucleotide
tgacttttcttgcaaggataacttgcaagagctgaaactatattttg

SEQ ID NO: 306312 - DNA, 46 bp, Artificial Sequence
  Description of Artificial Sequence: Synthetic oligonucleotide
gacttttcttgcaaggataacttgcaagagctgaaactatattttg

SEQ ID NO: 306313 - DNA, 49 bp, Artificial Sequence
  Description of Artificial Sequence: Synthetic oligonucleotide
acttttcttgcaaggataacttgcaagagctgaaactatattttgaatc

SEQ ID NO: 306314 - DNA, 48 bp, Artificial Sequence
  Description of Artificial Sequence: Synthetic oligonucleotide
cttttcttgcaaggataacttgcaagagctgaaactatattttgaatc

SEQ ID NO: 306315 - DNA, 49 bp, Artificial Sequence
  Description of Artificial Sequence: Synthetic oligonucleotide
ttttcttgcaaggataacttgcaagagctgaaactatattttgaatcac

SEQ ID NO: 306316 - DNA, 48 bp, Artificial Sequence
  Description of Artificial Sequence: Synthetic oligonucleotide
tttcttgcaaggataacttgcaagagctgaaactatattttgaatcac

SEQ ID NO: 306317 - DNA, 47 bp, Artificial Sequence
  Description of Artificial Sequence: Synthetic oligonucleotide
ttcttgcaaggataacttgcaagagctgaaactatattttgaatcac

SEQ ID NO: 306318 - DNA, 46 bp, Artificial Sequence
  Description of Artificial Sequence: Synthetic oligonucleotide
tcttgcaaggataacttgcaagagctgaaactatattttgaatcac

SEQ ID NO: 306319 - DNA, 45 bp, Artificial Sequence
  Description of Artificial Sequence: Synthetic oligonucleotide
cttgcaaggataacttgcaagagctgaaactatattttgaatcac

SEQ ID NO: 306320 - DNA, 47 bp, Artificial Sequence
  Description of Artificial Sequence: Synthetic oligonucleotide
ttgcaaggataacttgcaagagctgaaactatattttgaatcacttg

SEQ ID NO: 306321 - DNA, 46 bp, Artificial Sequence
  Description of Artificial Sequence: Synthetic oligonucleotide
tgcaaggataacttgcaagagctgaaactatattttgaatcacttg

SEQ ID NO: 306322 - DNA, 45 bp, Artificial Sequence
  Description of Artificial Sequence: Synthetic oligonucleotide
gcaaggataacttgcaagagctgaaactatattttgaatcacttg

SEQ ID NO: 306323 - DNA, 46 bp, Artificial Sequence
  Description of Artificial Sequence: Synthetic oligonucleotide
caaggataacttgcaagagctgaaactatattttgaatcacttgag

SEQ ID NO: 306324 - DNA, 46 bp, Artificial Sequence
  Description of Artificial Sequence: Synthetic oligonucleotide
aaggataacttgcaagagctgaaactatattttgaatcacttgagg

SEQ ID NO: 306325 - DNA, 45 bp, Artificial Sequence
  Description of Artificial Sequence: Synthetic oligonucleotide
aggataacttgcaagagctgaaactatattttgaatcacttgagg

SEQ ID NO: 306326 - DNA, 44 bp, Artificial Sequence
  Description of Artificial Sequence: Synthetic oligonucleotide
ggataacttgcaagagctgaaactatattttgaatcacttgagg

SEQ ID NO: 306327 - DNA, 44 bp, Artificial Sequence
  Description of Artificial Sequence: Synthetic oligonucleotide
gataacttgcaagagctgaaactatattttgaatcacttgaggc

SEQ ID NO: 306328 - DNA, 45 bp, Artificial Sequence
  Description of Artificial Sequence: Synthetic oligonucleotide
ataacttgcaagagctgaaactatattttgaatcacttgaggctg

SEQ ID NO: 306329 - DNA, 44 bp, Artificial Sequence
  Description of Artificial Sequence: Synthetic oligonucleotide
taacttgcaagagctgaaactatattttgaatcacttgaggctg

SEQ ID NO: 306330 - DNA, 43 bp, Artificial Sequence
  Description of Artificial Sequence: Synthetic oligonucleotide
aacttgcaagagctgaaactatattttgaatcacttgaggctg

SEQ ID NO: 306331 - DNA, 42 bp, Artificial Sequence
  Description of Artificial Sequence: Synthetic oligonucleotide
acttgcaagagctgaaactatattttgaatcacttgaggctg

SEQ ID NO: 306332 - DNA, 41 bp, Artificial Sequence
  Description of Artificial Sequence: Synthetic oligonucleotide
cttgcaagagctgaaactatattttgaatcacttgaggctg

SEQ ID NO: 306333 - DNA, 43 bp, Artificial Sequence
  Description of Artificial Sequence: Synthetic oligonucleotide
ttgcaagagctgaaactatattttgaatcacttgaggctgaag

SEQ ID NO: 306334 - DNA, 42 bp, Artificial Sequence
  Description of Artificial Sequence: Synthetic oligonucleotide
tgcaagagctgaaactatattttgaatcacttgaggctgaag

SEQ ID NO: 306335 - DNA, 41 bp, Artificial Sequence
  Description of Artificial Sequence: Synthetic oligonucleotide
gcaagagctgaaactatattttgaatcacttgaggctgaag

SEQ ID NO: 306336 - DNA, 41 bp, Artificial Sequence
  Description of Artificial Sequence: Synthetic oligonucleotide
caagagctgaaactatattttgaatcacttgaggctgaagg

SEQ ID NO: 306337 - DNA, 43 bp, Artificial Sequence
  Description of Artificial Sequence: Synthetic oligonucleotide
aagagctgaaactatattttgaatcacttgaggctgaaggatc

SEQ ID NO: 306338 - DNA, 42 bp, Artificial Sequence
  Description of Artificial Sequence: Synthetic oligonucleotide
agagctgaaactatattttgaatcacttgaggctgaaggatc

SEQ ID NO: 306339 - DNA, 41 bp, Artificial Sequence
  Description of Artificial Sequence: Synthetic oligonucleotide
gagctgaaactatattttgaatcacttgaggctgaaggatc

SEQ ID NO: 306340 - DNA, 42 bp, Artificial Sequence
  Description of Artificial Sequence: Synthetic oligonucleotide
agctgaaactatattttgaatcacttgaggctgaaggatcac

SEQ ID NO: 306341 - DNA, 41 bp, Artificial Sequence
  Description of Artificial Sequence: Synthetic oligonucleotide
gctgaaactatattttgaatcacttgaggctgaaggatcac

SEQ ID NO: 306342 - DNA, 43 bp, Artificial Sequence
  Description of Artificial Sequence: Synthetic oligonucleotide
ctgaaactatattttgaatcacttgaggctgaaggatcacttc

SEQ ID NO: 306343 - DNA, 44 bp, Artificial Sequence
  Description of Artificial Sequence: Synthetic oligonucleotide
tgaaactatattttgaatcacttgaggctgaaggatcacttctg

SEQ ID NO: 306344 - DNA, 43 bp, Artificial Sequence
  Description of Artificial Sequence: Synthetic oligonucleotide
gaaactatattttgaatcacttgaggctgaaggatcacttctg

SEQ ID NO: 306345 - DNA, 43 bp, Artificial Sequence
  Description of Artificial Sequence: Synthetic oligonucleotide
aaactatattttgaatcacttgaggctgaaggatcacttctgg

SEQ ID NO: 306346 - DNA, 42 bp, Artificial Sequence
  Description of Artificial Sequence: Synthetic oligonucleotide
aactatattttgaatcacttgaggctgaaggatcacttctgg

SEQ ID NO: 306347 - DNA, 41 bp, Artificial Sequence
  Description of Artificial Sequence: Synthetic oligonucleotide
actatattttgaatcacttgaggctgaaggatcacttctgg

SEQ ID NO: 306348 - DNA, 40 bp, Artificial Sequence
  Description of Artificial Sequence: Synthetic oligonucleotide
ctatattttgaatcacttgaggctgaaggatcacttctgg

SEQ ID NO: 306349 - DNA, 48 bp, Artificial Sequence
  Description of Artificial Sequence: Synthetic oligonucleotide
tatattttgaatcacttgaggctgaaggatcacttctggatatatttc

SEQ ID NO: 306350 - DNA, 47 bp, Artificial Sequence
  Description of Artificial Sequence: Synthetic oligonucleotide
atattttgaatcacttgaggctgaaggatcacttctggatatatttc

SEQ ID NO: 306351 - DNA, 46 bp, Artificial Sequence
  Description of Artificial Sequence: Synthetic oligonucleotide
tattttgaatcacttgaggctgaaggatcacttctggatatatttc

SEQ ID NO: 306352 - DNA, 45 bp, Artificial Sequence
  Description of Artificial Sequence: Synthetic oligonucleotide
attttgaatcacttgaggctgaaggatcacttctggatatatttc

SEQ ID NO: 306353 - DNA, 44 bp, Artificial Sequence
  Description of Artificial Sequence: Synthetic oligonucleotide
ttttgaatcacttgaggctgaaggatcacttctggatatatttc

SEQ ID NO: 306354 - DNA, 43 bp, Artificial Sequence
  Description of Artificial Sequence: Synthetic oligonucleotide
tttgaatcacttgaggctgaaggatcacttctggatatatttc

SEQ ID NO: 306355 - DNA, 42 bp, Artificial Sequence
  Description of Artificial Sequence: Synthetic oligonucleotide
ttgaatcacttgaggctgaaggatcacttctggatatatttc

SEQ ID NO: 306356 - DNA, 41 bp, Artificial Sequence
  Description of Artificial Sequence: Synthetic oligonucleotide
tgaatcacttgaggctgaaggatcacttctggatatatttc

SEQ ID NO: 306357 - DNA, 40 bp, Artificial Sequence
  Description of Artificial Sequence: Synthetic oligonucleotide
gaatcacttgaggctgaaggatcacttctggatatatttc

SEQ ID NO: 306358 - DNA, 43 bp, Artificial Sequence
  Description of Artificial Sequence: Synthetic oligonucleotide
aatcacttgaggctgaaggatcacttctggatatatttcaaac

SEQ ID NO: 306359 - DNA, 42 bp, Artificial Sequence
  Description of Artificial Sequence: Synthetic oligonucleotide
atcacttgaggctgaaggatcacttctggatatatttcaaac

SEQ ID NO: 306360 - DNA, 41 bp, Artificial Sequence
  Description of Artificial Sequence: Synthetic oligonucleotide
tcacttgaggctgaaggatcacttctggatatatttcaaac

SEQ ID NO: 306361 - DNA, 40 bp, Artificial Sequence
  Description of Artificial Sequence: Synthetic oligonucleotide
cacttgaggctgaaggatcacttctggatatatttcaaac

SEQ ID NO: 306362 - DNA, 41 bp, Artificial Sequence
  Description of Artificial Sequence: Synthetic oligonucleotide
acttgaggctgaaggatcacttctggatatatttcaaactc

SEQ ID NO: 306363 - DNA, 40 bp, Artificial Sequence
  Description of Artificial Sequence: Synthetic oligonucleotide
cttgaggctgaaggatcacttctggatatatttcaaactc

SEQ ID NO: 306364 - DNA, 42 bp, Artificial Sequence
  Description of Artificial Sequence: Synthetic oligonucleotide
ttgaggctgaaggatcacttctggatatatttcaaactcttc

SEQ ID NO: 306365 - DNA, 41 bp, Artificial Sequence
  Description of Artificial Sequence: Synthetic oligonucleotide
tgaggctgaaggatcacttctggatatatttcaaactcttc

SEQ ID NO: 306366 - DNA, 40 bp, Artificial Sequence
  Description of Artificial Sequence: Synthetic oligonucleotide
gaggctgaaggatcacttctggatatatttcaaactcttc

SEQ ID NO: 306367 - DNA, 41 bp, Artificial Sequence
  Description of Artificial Sequence: Synthetic oligonucleotide
aggctgaaggatcacttctggatatatttcaaactcttctg

SEQ ID NO: 306368 - DNA, 40 bp, Artificial Sequence
  Description of Artificial Sequence: Synthetic oligonucleotide
ggctgaaggatcacttctggatatatttcaaactcttctg

SEQ ID NO: 306369 - DNA, 40 bp, Artificial Sequence
  Description of Artificial Sequence: Synthetic oligonucleotide
gctgaaggatcacttctggatatatttcaaactcttctgg

SEQ ID NO: 306370 - DNA, 43 bp, Artificial Sequence
  Description of Artificial Sequence: Synthetic oligonucleotide
ctgaaggatcacttctggatatatttcaaactcttctggaaag

SEQ ID NO: 306371 - DNA, 43 bp, Artificial Sequence
  Description of Artificial Sequence: Synthetic oligonucleotide
tgaaggatcacttctggatatatttcaaactcttctggaaagg

SEQ ID NO: 306372 - DNA, 42 bp, Artificial Sequence
  Description of Artificial Sequence: Synthetic oligonucleotide
gaaggatcacttctggatatatttcaaactcttctggaaagg

SEQ ID NO: 306373 - DNA, 46 bp, Artificial Sequence
  Description of Artificial Sequence: Synthetic oligonucleotide
aaggatcacttctggatatatttcaaactcttctggaaaggataac

SEQ ID NO: 306374 - DNA, 45 bp, Artificial Sequence
  Description of Artificial Sequence: Synthetic oligonucleotide
aggatcacttctggatatatttcaaactcttctggaaaggataac

SEQ ID NO: 306375 - DNA, 44 bp, Artificial Sequence
  Description of Artificial Sequence: Synthetic oligonucleotide
ggatcacttctggatatatttcaaactcttctggaaaggataac

SEQ ID NO: 306376 - DNA, 44 bp, Artificial Sequence
  Description of Artificial Sequence: Synthetic oligonucleotide
gatcacttctggatatatttcaaactcttctggaaaggataacc

SEQ ID NO: 306377 - DNA, 57 bp, Artificial Sequence
  Description of Artificial Sequence: Synthetic oligonucleotide
atcacttctggatatatttcaaactcttctggaaaggataaccaataatataaaaag

SEQ ID NO: 306378 - DNA, 56 bp, Artificial Sequence
  Description of Artificial Sequence: Synthetic oligonucleotide
tcacttctggatatatttcaaactcttctggaaaggataaccaataatataaaaag

SEQ ID NO: 306379 - DNA, 55 bp, Artificial Sequence
  Description of Artificial Sequence: Synthetic oligonucleotide
cacttctggatatatttcaaactcttctggaaaggataaccaataatataaaaag

SEQ ID NO: 306380 - DNA, 55 bp, Artificial Sequence
  Description of Artificial Sequence: Synthetic oligonucleotide
acttctggatatatttcaaactcttctggaaaggataaccaataatataaaaagg

SEQ ID NO: 306381 - DNA, 54 bp, Artificial Sequence
  Description of Artificial Sequence: Synthetic oligonucleotide
cttctggatatatttcaaactcttctggaaaggataaccaataatataaaaagg

SEQ ID NO: 306382 - DNA, 54 bp, Artificial Sequence
  Description of Artificial Sequence: Synthetic oligonucleotide
ttctggatatatttcaaactcttctggaaaggataaccaataatataaaaaggc

SEQ ID NO: 306383 - DNA, 53 bp, Artificial Sequence
  Description of Artificial Sequence: Synthetic oligonucleotide
tctggatatatttcaaactcttctggaaaggataaccaataatataaaaaggc

SEQ ID NO: 306384 - DNA, 52 bp, Artificial Sequence
  Description of Artificial Sequence: Synthetic oligonucleotide
ctggatatatttcaaactcttctggaaaggataaccaataatataaaaaggc

SEQ ID NO: 306385 - DNA, 53 bp, Artificial Sequence
  Description of Artificial Sequence: Synthetic oligonucleotide
tggatatatttcaaactcttctggaaaggataaccaataatataaaaaggctg

SEQ ID NO: 306386 - DNA, 52 bp, Artificial Sequence
  Description of Artificial Sequence: Synthetic oligonucleotide
ggatatatttcaaactcttctggaaaggataaccaataatataaaaaggctg

SEQ ID NO: 306387 - DNA, 52 bp, Artificial Sequence
  Description of Artificial Sequence: Synthetic oligonucleotide
gatatatttcaaactcttctggaaaggataaccaataatataaaaaggctgg

SEQ ID NO: 306388 - DNA, 53 bp, Artificial Sequence
  Description of Artificial Sequence: Synthetic oligonucleotide
atatatttcaaactcttctggaaaggataaccaataatataaaaaggctggag

SEQ ID NO: 306389 - DNA, 52 bp, Artificial Sequence
  Description of Artificial Sequence: Synthetic oligonucleotide
tatatttcaaactcttctggaaaggataaccaataatataaaaaggctggag

SEQ ID NO: 306390 - DNA, 51 bp, Artificial Sequence
  Description of Artificial Sequence: Synthetic oligonucleotide
atatttcaaactcttctggaaaggataaccaataatataaaaaggctggag

SEQ ID NO: 306391 - DNA, 50 bp, Artificial Sequence
  Description of Artificial Sequence: Synthetic oligonucleotide
tatttcaaactcttctggaaaggataaccaataatataaaaaggctggag

SEQ ID NO: 306392 - DNA, 49 bp, Artificial Sequence
  Description of Artificial Sequence: Synthetic oligonucleotide
atttcaaactcttctggaaaggataaccaataatataaaaaggctggag

SEQ ID NO: 306393 - DNA, 48 bp, Artificial Sequence
  Description of Artificial Sequence: Synthetic oligonucleotide
tttcaaactcttctggaaaggataaccaataatataaaaaggctggag

SEQ ID NO: 306394 - DNA, 47 bp, Artificial Sequence
  Description of Artificial Sequence: Synthetic oligonucleotide
ttcaaactcttctggaaaggataaccaataatataaaaaggctggag

SEQ ID NO: 306395 - DNA, 46 bp, Artificial Sequence
  Description of Artificial Sequence: Synthetic oligonucleotide
tcaaactcttctggaaaggataaccaataatataaaaaggctggag

SEQ ID NO: 306396 - DNA, 45 bp, Artificial Sequence
  Description of Artificial Sequence: Synthetic oligonucleotide
caaactcttctggaaaggataaccaataatataaaaaggctggag

SEQ ID NO: 306397 - DNA, 47 bp, Artificial Sequence
  Description of Artificial Sequence: Synthetic oligonucleotide
aaactcttctggaaaggataaccaataatataaaaaggctggagatg

SEQ ID NO: 306398 - DNA, 46 bp, Artificial Sequence
  Description of Artificial Sequence: Synthetic oligonucleotide
aactcttctggaaaggataaccaataatataaaaaggctggagatg

SEQ ID NO: 306399 - DNA, 45 bp, Artificial Sequence
  Description of Artificial Sequence: Synthetic oligonucleotide
actcttctggaaaggataaccaataatataaaaaggctggagatg

SEQ ID NO: 306400 - DNA, 44 bp, Artificial Sequence
  Description of Artificial Sequence: Synthetic oligonucleotide
ctcttctggaaaggataaccaataatataaaaaggctggagatg

SEQ ID NO: 306401 - DNA, 47 bp, Artificial Sequence
  Description of Artificial Sequence: Synthetic oligonucleotide
tcttctggaaaggataaccaataatataaaaaggctggagatgaatc

SEQ ID NO: 306402 - DNA, 46 bp, Artificial Sequence
  Description of Artificial Sequence: Synthetic oligonucleotide
cttctggaaaggataaccaataatataaaaaggctggagatgaatc

SEQ ID NO: 306403 - DNA, 48 bp, Artificial Sequence
  Description of Artificial Sequence: Synthetic oligonucleotide
ttctggaaaggataaccaataatataaaaaggctggagatgaatcttc

SEQ ID NO: 306404 - DNA, 47 bp, Artificial Sequence
  Description of Artificial Sequence: Synthetic oligonucleotide
tctggaaaggataaccaataatataaaaaggctggagatgaatcttc

SEQ ID NO: 306405 - DNA, 46 bp, Artificial Sequence
  Description of Artificial Sequence: Synthetic oligonucleotide
ctggaaaggataaccaataatataaaaaggctggagatgaatcttc

SEQ ID NO: 306406 - DNA, 46 bp, Artificial Sequence
  Description of Artificial Sequence: Synthetic oligonucleotide
tggaaaggataaccaataatataaaaaggctggagatgaatcttcc

SEQ ID NO: 306407 - DNA, 45 bp, Artificial Sequence
  Description of Artificial Sequence: Synthetic oligonucleotide
ggaaaggataaccaataatataaaaaggctggagatgaatcttcc

SEQ ID NO: 306408 - DNA, 45 bp, Artificial Sequence
  Description of Artificial Sequence: Synthetic oligonucleotide
gaaaggataaccaataatataaaaaggctggagatgaatcttccc

SEQ ID NO: 306409 - DNA, 46 bp, Artificial Sequence
  Description of Artificial Sequence: Synthetic oligonucleotide
aaaggataaccaataatataaaaaggctggagatgaatcttcccac

SEQ ID NO: 306410 - DNA, 45 bp, Artificial Sequence
  Description of Artificial Sequence: Synthetic oligonucleotide
aaggataaccaataatataaaaaggctggagatgaatcttcccac

SEQ ID NO: 306411 - DNA, 44 bp, Artificial Sequence
  Description of Artificial Sequence: Synthetic oligonucleotide
aggataaccaataatataaaaaggctggagatgaatcttcccac

SEQ ID NO: 306412 - DNA, 43 bp, Artificial Sequence
  Description of Artificial Sequence: Synthetic oligonucleotide
ggataaccaataatataaaaaggctggagatgaatcttcccac

SEQ ID NO: 306413 - DNA, 44 bp, Artificial Sequence
  Description of Artificial Sequence: Synthetic oligonucleotide
gataaccaataatataaaaaggctggagatgaatcttcccactc

SEQ ID NO: 306414 - DNA, 45 bp, Artificial Sequence
  Description of Artificial Sequence: Synthetic oligonucleotide
ataaccaataatataaaaaggctggagatgaatcttcccactctg

SEQ ID NO: 306415 - DNA, 44 bp, Artificial Sequence
  Description of Artificial Sequence: Synthetic oligonucleotide
taaccaataatataaaaaggctggagatgaatcttcccactctg

SEQ ID NO: 306416 - DNA, 43 bp, Artificial Sequence
  Description of Artificial Sequence: Synthetic oligonucleotide
aaccaataatataaaaaggctggagatgaatcttcccactctg

SEQ ID NO: 306417 - DNA, 42 bp, Artificial Sequence
  Description of Artificial Sequence: Synthetic oligonucleotide
accaataatataaaaaggctggagatgaatcttcccactctg

SEQ ID NO: 306418 - DNA, 41 bp, Artificial Sequence
  Description of Artificial Sequence: Synthetic oligonucleotide
ccaataatataaaaaggctggagatgaatcttcccactctg

SEQ ID NO: 306419 - DNA, 42 bp, Artificial Sequence
  Description of Artificial Sequence: Synthetic oligonucleotide
caataatataaaaaggctggagatgaatcttcccactctgag

SEQ ID NO: 306420 - DNA, 42 bp, Artificial Sequence
  Description of Artificial Sequence: Synthetic oligonucleotide
aataatataaaaaggctggagatgaatcttcccactctgagg

SEQ ID NO: 306421 - DNA, 41 bp, Artificial Sequence
  Description of Artificial Sequence: Synthetic oligonucleotide
ataatataaaaaggctggagatgaatcttcccactctgagg

SEQ ID NO: 306422 - DNA, 40 bp, Artificial Sequence
  Description of Artificial Sequence: Synthetic oligonucleotide
taatataaaaaggctggagatgaatcttcccactctgagg

SEQ ID NO: 306423 - DNA, 39 bp, Artificial Sequence
  Description of Artificial Sequence: Synthetic oligonucleotide
aatataaaaaggctggagatgaatcttcccactctgagg

SEQ ID NO: 306424 - DNA, 38 bp, Artificial Sequence
  Description of Artificial Sequence: Synthetic oligonucleotide
atataaaaaggctggagatgaatcttcccactctgagg

SEQ ID NO: 306425 - DNA, 37 bp, Artificial Sequence
  Description of Artificial Sequence: Synthetic oligonucleotide
tataaaaaggctggagatgaatcttcccactctgagg

SEQ ID NO: 306426 - DNA, 36 bp, Artificial Sequence
  Description of Artificial Sequence: Synthetic oligonucleotide
ataaaaaggctggagatgaatcttcccactctgagg

SEQ ID NO: 306427 - DNA, 35 bp, Artificial Sequence
  Description of Artificial Sequence: Synthetic oligonucleotide
taaaaaggctggagatgaatcttcccactctgagg

SEQ ID NO: 306428 - DNA, 34 bp, Artificial Sequence
  Description of Artificial Sequence: Synthetic oligonucleotide
aaaaaggctggagatgaatcttcccactctgagg

SEQ ID NO: 306429 - DNA, 33 bp, Artificial Sequence
  Description of Artificial Sequence: Synthetic oligonucleotide
aaaaggctggagatgaatcttcccactctgagg

SEQ ID NO: 306430 - DNA, 32 bp, Artificial Sequence
  Description of Artificial Sequence: Synthetic oligonucleotide
aaaggctggagatgaatcttcccactctgagg

SEQ ID NO: 306431 - DNA, 31 bp, Artificial Sequence
  Description of Artificial Sequence: Synthetic oligonucleotide
aaggctggagatgaatcttcccactctgagg

SEQ ID NO: 306432 - DNA, 30 bp, Artificial Sequence
  Description of Artificial Sequence: Synthetic oligonucleotide
aggctggagatgaatcttcccactctgagg

SEQ ID NO: 306433 - DNA, 29 bp, Artificial Sequence
  Description of Artificial Sequence: Synthetic oligonucleotide
ggctggagatgaatcttcccactctgagg

SEQ ID NO: 306434 - DNA, 30 bp, Artificial Sequence
  Description of Artificial Sequence: Synthetic oligonucleotide
gctggagatgaatcttcccactctgaggtc

SEQ ID NO: 306435 - DNA, 32 bp, Artificial Sequence
  Description of Artificial Sequence: Synthetic oligonucleotide
ctggagatgaatcttcccactctgaggtcttg

SEQ ID NO: 306436 - DNA, 32 bp, Artificial Sequence
  Description of Artificial Sequence: Synthetic oligonucleotide
tggagatgaatcttcccactctgaggtcttgg

SEQ ID NO: 306437 - DNA, 31 bp, Artificial Sequence
  Description of Artificial Sequence: Synthetic oligonucleotide
ggagatgaatcttcccactctgaggtcttgg

SEQ ID NO: 306438 - DNA, 31 bp, Artificial Sequence
  Description of Artificial Sequence: Synthetic oligonucleotide
gagatgaatcttcccactctgaggtcttggc

SEQ ID NO: 306439 - DNA, 35 bp, Artificial Sequence
  Description of Artificial Sequence: Synthetic oligonucleotide
agatgaatcttcccactctgaggtcttggctaaag

SEQ ID NO: 306440 - DNA, 34 bp, Artificial Sequence
  Description of Artificial Sequence: Synthetic oligonucleotide
gatgaatcttcccactctgaggtcttggctaaag

SEQ ID NO: 306441 - DNA, 34 bp, Artificial Sequence
  Description of Artificial Sequence: Synthetic oligonucleotide
atgaatcttcccactctgaggtcttggctaaagg

SEQ ID NO: 306442 - DNA, 33 bp, Artificial Sequence
  Description of Artificial Sequence: Synthetic oligonucleotide
tgaatcttcccactctgaggtcttggctaaagg

SEQ ID NO: 306443 - DNA, 32 bp, Artificial Sequence
  Description of Artificial Sequence: Synthetic oligonucleotide
gaatcttcccactctgaggtcttggctaaagg

SEQ ID NO: 306444 - DNA, 38 bp, Artificial Sequence
  Description of Artificial Sequence: Synthetic oligonucleotide
aatcttcccactctgaggtcttggctaaaggttaatac

SEQ ID NO: 306445 - DNA, 37 bp, Artificial Sequence
  Description of Artificial Sequence: Synthetic oligonucleotide
atcttcccactctgaggtcttggctaaaggttaatac

SEQ ID NO: 306446 - DNA, 36 bp, Artificial Sequence
  Description of Artificial Sequence: Synthetic oligonucleotide
tcttcccactctgaggtcttggctaaaggttaatac

SEQ ID NO: 306447 - DNA, 35 bp, Artificial Sequence
  Description of Artificial Sequence: Synthetic oligonucleotide
cttcccactctgaggtcttggctaaaggttaatac

SEQ ID NO: 306448 - DNA, 27 bp, Artificial Sequence
  Description of Artificial Sequence: Synthetic oligonucleotide
atgtccatgacgctcatgggcgtcagc

SEQ ID NO: 306449 - DNA, 27 bp, Artificial Sequence
  Description of Artificial Sequence: Synthetic oligonucleotide
tgtccatgacgctcatgggcgtcagca

SEQ ID NO: 306450 - DNA, 27 bp, Artificial Sequence
  Description of Artificial Sequence: Synthetic oligonucleotide
gtccatgacgctcatgggcgtcagcat

SEQ ID NO: 306451 - DNA, 27 bp, Artificial Sequence
  Description of Artificial Sequence: Synthetic oligonucleotide
tccatgacgctcatgggcgtcagcatc

SEQ ID NO: 306452 - DNA, 26 bp, Artificial Sequence
  Description of Artificial Sequence: Synthetic oligonucleotide
ccatgacgctcatgggcgtcagcatc

SEQ ID NO: 306453 - DNA, 26 bp, Artificial Sequence
  Description of Artificial Sequence: Synthetic oligonucleotide
catgacgctcatgggcgtcagcatcg

SEQ ID NO: 306454 - DNA, 26 bp, Artificial Sequence
  Description of Artificial Sequence: Synthetic oligonucleotide
atgacgctcatgggcgtcagcatcgc

SEQ ID NO: 306455 - DNA, 25 bp, Artificial Sequence
  Description of Artificial Sequence: Synthetic oligonucleotide
tgacgctcatgggcgtcagcatcgc

SEQ ID NO: 306456 - DNA, 24 bp, Artificial Sequence
  Description of Artificial Sequence: Synthetic oligonucleotide
gacgctcatgggcgtcagcatcgc

SEQ ID NO: 306457 - DNA, 25 bp, Artificial Sequence
  Description of Artificial Sequence: Synthetic oligonucleotide
acgctcatgggcgtcagcatcgcgt

SEQ ID NO: 306458 - DNA, 24 bp, Artificial Sequence
  Description of Artificial Sequence: Synthetic oligonucleotide
cgctcatgggcgtcagcatcgcgt

SEQ ID NO: 306459 - DNA, 25 bp, Artificial Sequence
  Description of Artificial Sequence: Synthetic oligonucleotide
gctcatgggcgtcagcatcgcgtgt

SEQ ID NO: 306460 - DNA, 27 bp, Artificial Sequence
  Description of Artificial Sequence: Synthetic oligonucleotide
ctcatgggcgtcagcatcgcgtgtgtt

SEQ ID NO: 306461 - DNA, 27 bp, Artificial Sequence
  Description of Artificial Sequence: Synthetic oligonucleotide
tcatgggcgtcagcatcgcgtgtgttc

SEQ ID NO: 306462 - DNA, 26 bp, Artificial Sequence
  Description of Artificial Sequence: Synthetic oligonucleotide
catgggcgtcagcatcgcgtgtgttc

SEQ ID NO: 306463 - DNA, 26 bp, Artificial Sequence
  Description of Artificial Sequence: Synthetic oligonucleotide
atgggcgtcagcatcgcgtgtgttcg

SEQ ID NO: 306464 - DNA, 25 bp, Artificial Sequence
  Description of Artificial Sequence: Synthetic oligonucleotide
tgggcgtcagcatcgcgtgtgttcg

SEQ ID NO: 306465 - DNA, 24 bp, Artificial Sequence
  Description of Artificial Sequence: Synthetic oligonucleotide
gggcgtcagcatcgcgtgtgttcg

SEQ ID NO: 306466 - DNA, 26 bp, Artificial Sequence
  Description of Artificial Sequence: Synthetic oligonucleotide
ggcgtcagcatcgcgtgtgttcggtt

SEQ ID NO: 306467 - DNA, 27 bp, Artificial Sequence
  Description of Artificial Sequence: Synthetic oligonucleotide
gcgtcagcatcgcgtgtgttcggttct

SEQ ID NO: 306468 - DNA, 28 bp, Artificial Sequence
  Description of Artificial Sequence: Synthetic oligonucleotide
cgtcagcatcgcgtgtgttcggttcttc

SEQ ID NO: 306469 - DNA, 30 bp, Artificial Sequence
  Description of Artificial Sequence: Synthetic oligonucleotide
gtcagcatcgcgtgtgttcggttcttctag

SEQ ID NO: 306470 - DNA, 30 bp, Artificial Sequence
  Description of Artificial Sequence: Synthetic oligonucleotide
tcagcatcgcgtgtgttcggttcttctagc

SEQ ID NO: 306471 - DNA, 29 bp, Artificial Sequence
  Description of Artificial Sequence: Synthetic oligonucleotide
cagcatcgcgtgtgttcggttcttctagc

SEQ ID NO: 306472 - DNA, 30 bp, Artificial Sequence
  Description of Artificial Sequence: Synthetic oligonucleotide
agcatcgcgtgtgttcggttcttctagctg

SEQ ID NO: 306473 - DNA, 29 bp, Artificial Sequence
  Description of Artificial Sequence: Synthetic oligonucleotide
gcatcgcgtgtgttcggttcttctagctg

SEQ ID NO: 306474 - DNA, 29 bp, Artificial Sequence
  Description of Artificial Sequence: Synthetic oligonucleotide
catcgcgtgtgttcggttcttctagctgc

SEQ ID NO: 306475 - DNA, 30 bp, Artificial Sequence
  Description of Artificial Sequence: Synthetic oligonucleotide
atcgcgtgtgttcggttcttctagctgcag

SEQ ID NO: 306476 - DNA, 29 bp, Artificial Sequence
  Description of Artificial Sequence: Synthetic oligonucleotide
tcgcgtgtgttcggttcttctagctgcag

SEQ ID NO: 306477 - DNA, 28 bp, Artificial Sequence
  Description of Artificial Sequence: Synthetic oligonucleotide
cgcgtgtgttcggttcttctagctgcag

SEQ ID NO: 306478 - DNA, 28 bp, Artificial Sequence
  Description of Artificial Sequence: Synthetic oligonucleotide
gcgtgtgttcggttcttctagctgcagg

SEQ ID NO: 306479 - DNA, 28 bp, Artificial Sequence
  Description of Artificial Sequence: Synthetic oligonucleotide
cgtgtgttcggttcttctagctgcaggg

SEQ ID NO: 306480 - DNA, 28 bp, Artificial Sequence
  Description of Artificial Sequence: Synthetic oligonucleotide
gtgtgttcggttcttctagctgcagggc

SEQ ID NO: 306481 - DNA, 28 bp, Artificial Sequence
  Description of Artificial Sequence: Synthetic oligonucleotide
tgtgttcggttcttctagctgcagggcg

SEQ ID NO: 306482 - DNA, 27 bp, Artificial Sequence
  Description of Artificial Sequence: Synthetic oligonucleotide
gtgttcggttcttctagctgcagggcg

SEQ ID NO: 306483 - DNA, 27 bp, Artificial Sequence
  Description of Artificial Sequence: Synthetic oligonucleotide
tgttcggttcttctagctgcagggcgc

SEQ ID NO: 306484 - DNA, 26 bp, Artificial Sequence
  Description of Artificial Sequence: Synthetic oligonucleotide
gttcggttcttctagctgcagggcgc

SEQ ID NO: 306485 - DNA, 27 bp, Artificial Sequence
  Description of Artificial Sequence: Synthetic oligonucleotide
ttcggttcttctagctgcagggcgcct

SEQ ID NO: 306486 - DNA, 26 bp, Artificial Sequence
  Description of Artificial Sequence: Synthetic oligonucleotide
tcggttcttctagctgcagggcgcct

SEQ ID NO: 306487 - DNA, 25 bp, Artificial Sequence
  Description of Artificial Sequence: Synthetic oligonucleotide
cggttcttctagctgcagggcgcct

SEQ ID NO: 306488 - DNA, 25 bp, Artificial Sequence
  Description of Artificial Sequence: Synthetic oligonucleotide
ggttcttctagctgcagggcgcctg

SEQ ID NO: 306489 - DNA, 25 bp, Artificial Sequence
  Description of Artificial Sequence: Synthetic oligonucleotide
gttcttctagctgcagggcgcctgg

SEQ ID NO: 306490 - DNA, 25 bp, Artificial Sequence
  Description of Artificial Sequence: Synthetic oligonucleotide
ttcttctagctgcagggcgcctggc

SEQ ID NO: 306491 - DNA, 24 bp, Artificial Sequence
  Description of Artificial Sequence: Synthetic oligonucleotide
tcttctagctgcagggcgcctggc

SEQ ID NO: 306492 - DNA, 23 bp, Artificial Sequence
  Description of Artificial Sequence: Synthetic oligonucleotide
cttctagctgcagggcgcctggc

SEQ ID NO: 306493 - DNA, 24 bp, Artificial Sequence
  Description of Artificial Sequence: Synthetic oligonucleotide
ttctagctgcagggcgcctggcca

SEQ ID NO: 306494 - DNA, 23 bp, Artificial Sequence
  Description of Artificial Sequence: Synthetic oligonucleotide
tctagctgcagggcgcctggcca

SEQ ID NO: 306495 - DNA, 22 bp, Artificial Sequence
  Description of Artificial Sequence: Synthetic oligonucleotide
ctagctgcagggcgcctggcca

SEQ ID NO: 306496 - DNA, 24 bp, Artificial Sequence
  Description of Artificial Sequence: Synthetic oligonucleotide
tagctgcagggcgcctggccagat

SEQ ID NO: 306497 - DNA, 23 bp, Artificial Sequence
  Description of Artificial Sequence: Synthetic oligonucleotide
agctgcagggcgcctggccagat

SEQ ID NO: 306498 - DNA, 22 bp, Artificial Sequence
  Description of Artificial Sequence: Synthetic oligonucleotide
gctgcagggcgcctggccagat

SEQ ID NO: 306499 - DNA, 23 bp, Artificial Sequence
  Description of Artificial Sequence: Synthetic oligonucleotide
ctgcagggcgcctggccagatga

SEQ ID NO: 306500 - DNA, 23 bp, Artificial Sequence
  Description of Artificial Sequence: Synthetic oligonucleotide
tgcagggcgcctggccagatgag

SEQ ID NO: 306501 - DNA, 22 bp, Artificial Sequence
  Description of Artificial Sequence: Synthetic oligonucleotide
gcagggcgcctggccagatgag

SEQ ID NO: 306502 - DNA, 22 bp, Artificial Sequence
  Description of Artificial Sequence: Synthetic oligonucleotide
cagggcgcctggccagatgagg

SEQ ID NO: 306503 - DNA, 23 bp, Artificial Sequence
  Description of Artificial Sequence: Synthetic oligonucleotide
agggcgcctggccagatgagggt

SEQ ID NO: 306504 - DNA, 22 bp, Artificial Sequence
  Description of Artificial Sequence: Synthetic oligonucleotide
gggcgcctggccagatgagggt

SEQ ID NO: 306505 - DNA, 22 bp, Artificial Sequence
  Description of Artificial Sequence: Synthetic oligonucleotide
ggcgcctggccagatgagggtc

SEQ ID NO: 306506 - DNA, 23 bp, Artificial Sequence
  Description of Artificial Sequence: Synthetic oligonucleotide
gcgcctggccagatgagggtcgt

SEQ ID NO: 306507 - DNA, 24 bp, Artificial Sequence
  Description of Artificial Sequence: Synthetic oligonucleotide
cgcctggccagatgagggtcgtca

SEQ ID NO: 306508 - DNA, 24 bp, Artificial Sequence
  Description of Artificial Sequence: Synthetic oligonucleotide
gcctggccagatgagggtcgtcag

SEQ ID NO: 306509 - DNA, 25 bp, Artificial Sequence
  Description of Artificial Sequence: Synthetic oligonucleotide
cctggccagatgagggtcgtcagga

SEQ ID NO: 306510 - DNA, 27 bp, Artificial Sequence
  Description of Artificial Sequence: Synthetic oligonucleotide
ctggccagatgagggtcgtcaggacat

SEQ ID NO: 306511 - DNA, 27 bp, Artificial Sequence
  Description of Artificial Sequence: Synthetic oligonucleotide
tggccagatgagggtcgtcaggacatg

SEQ ID NO: 306512 - DNA, 26 bp, Artificial Sequence
  Description of Artificial Sequence: Synthetic oligonucleotide
ggccagatgagggtcgtcaggacatg

SEQ ID NO: 306513 - DNA, 26 bp, Artificial Sequence
  Description of Artificial Sequence: Synthetic oligonucleotide
gccagatgagggtcgtcaggacatgc

SEQ ID NO: 306514 - DNA, 26 bp, Artificial Sequence
  Description of Artificial Sequence: Synthetic oligonucleotide
ccagatgagggtcgtcaggacatgcc

SEQ ID NO: 306515 - DNA, 27 bp, Artificial Sequence
  Description of Artificial Sequence: Synthetic oligonucleotide
cagatgagggtcgtcaggacatgccct

SEQ ID NO: 306516 - DNA, 28 bp, Artificial Sequence
  Description of Artificial Sequence: Synthetic oligonucleotide
agatgagggtcgtcaggacatgcccttc

SEQ ID NO: 306517 - DNA, 27 bp, Artificial Sequence
  Description of Artificial Sequence: Synthetic oligonucleotide
gatgagggtcgtcaggacatgcccttc

SEQ ID NO: 306518 - DNA, 27 bp, Artificial Sequence
  Description of Artificial Sequence: Synthetic oligonucleotide
atgagggtcgtcaggacatgcccttcc

SEQ ID NO: 306519 - DNA, 27 bp, Artificial Sequence
  Description of Artificial Sequence: Synthetic oligonucleotide
tgagggtcgtcaggacatgcccttcct

SEQ ID NO: 306520 - DNA, 26 bp, Artificial Sequence
  Description of Artificial Sequence: Synthetic oligonucleotide
gagggtcgtcaggacatgcccttcct

SEQ ID NO: 306521 - DNA, 27 bp, Artificial Sequence
  Description of Artificial Sequence: Synthetic oligonucleotide
agggtcgtcaggacatgcccttcctga

SEQ ID NO: 306522 - DNA, 26 bp, Artificial Sequence
  Description of Artificial Sequence: Synthetic oligonucleotide
gggtcgtcaggacatgcccttcctga

SEQ ID NO: 306523 - DNA, 27 bp, Artificial Sequence
  Description of Artificial Sequence: Synthetic oligonucleotide
ggtcgtcaggacatgcccttcctgact

SEQ ID NO: 306524 - DNA, 27 bp, Artificial Sequence
  Description of Artificial Sequence: Synthetic oligonucleotide
gtcgtcaggacatgcccttcctgactg

SEQ ID NO: 306525 - DNA, 27 bp, Artificial Sequence
  Description of Artificial Sequence: Synthetic oligonucleotide
tcgtcaggacatgcccttcctgactgc

SEQ ID NO: 306526 - DNA, 26 bp, Artificial Sequence
  Description of Artificial Sequence: Synthetic oligonucleotide
cgtcaggacatgcccttcctgactgc

SEQ ID NO: 306527 - DNA, 27 bp, Artificial Sequence
  Description of Artificial Sequence: Synthetic oligonucleotide
gtcaggacatgcccttcctgactgcct

SEQ ID NO: 306528 - DNA, 27 bp, Artificial Sequence
  Description of Artificial Sequence: Synthetic oligonucleotide
tcaggacatgcccttcctgactgcctg

SEQ ID NO: 306529 - DNA, 26 bp, Artificial Sequence
  Description of Artificial Sequence: Synthetic oligonucleotide
caggacatgcccttcctgactgcctg

SEQ ID NO: 306530 - DNA, 26 bp, Artificial Sequence
  Description of Artificial Sequence: Synthetic oligonucleotide
aggacatgcccttcctgactgcctgg

SEQ ID NO: 306531 - DNA, 25 bp, Artificial Sequence
  Description of Artificial Sequence: Synthetic oligonucleotide
ggacatgcccttcctgactgcctgg

SEQ ID NO: 306532 - DNA, 25 bp, Artificial Sequence
  Description of Artificial Sequence: Synthetic oligonucleotide
gacatgcccttcctgactgcctggc

SEQ ID NO: 306533 - DNA, 25 bp, Artificial Sequence
  Description of Artificial Sequence: Synthetic oligonucleotide
acatgcccttcctgactgcctggcg

SEQ ID NO: 306534 - DNA, 24 bp, Artificial Sequence
  Description of Artificial Sequence: Synthetic oligonucleotide
catgcccttcctgactgcctggcg

SEQ ID NO: 306535 - DNA, 25 bp, Artificial Sequence
  Description of Artificial Sequence: Synthetic oligonucleotide
atgcccttcctgactgcctggcgca

SEQ ID NO: 306536 - DNA, 24 bp, Artificial Sequence
  Description of Artificial Sequence: Synthetic oligonucleotide
tgcccttcctgactgcctggcgca

SEQ ID NO: 306537 - DNA, 23 bp, Artificial Sequence
  Description of Artificial Sequence: Synthetic oligonucleotide
gcccttcctgactgcctggcgca

SEQ ID NO: 306538 - DNA, 23 bp, Artificial Sequence
  Description of Artificial Sequence: Synthetic oligonucleotide
cccttcctgactgcctggcgcag

SEQ ID NO: 306539 - DNA, 23 bp, Artificial Sequence
  Description of Artificial Sequence: Synthetic oligonucleotide
ccttcctgactgcctggcgcagc

SEQ ID NO: 306540 - DNA, 23 bp, Artificial Sequence
  Description of Artificial Sequence: Synthetic oligonucleotide
cttcctgactgcctggcgcagcg

SEQ ID NO: 306541 - DNA, 24 bp, Artificial Sequence
  Description of Artificial Sequence: Synthetic oligonucleotide
ttcctgactgcctggcgcagcgct

SEQ ID NO: 306542 - DNA, 23 bp, Artificial Sequence
  Description of Artificial Sequence: Synthetic oligonucleotide
tcctgactgcctggcgcagcgct

SEQ ID NO: 306543 - DNA, 22 bp, Artificial Sequence
  Description of Artificial Sequence: Synthetic oligonucleotide
cctgactgcctggcgcagcgct

SEQ ID NO: 306544 - DNA, 23 bp, Artificial Sequence
  Description of Artificial Sequence: Synthetic oligonucleotide
ctgactgcctggcgcagcgctgt

SEQ ID NO: 306545 - DNA, 23 bp, Artificial Sequence
  Description of Artificial Sequence: Synthetic oligonucleotide
tgactgcctggcgcagcgctgtc

SEQ ID NO: 306546 - DNA, 22 bp, Artificial Sequence
  Description of Artificial Sequence: Synthetic oligonucleotide
gactgcctggcgcagcgctgtc

SEQ ID NO: 306547 - DNA, 23 bp, Artificial Sequence
  Description of Artificial Sequence: Synthetic oligonucleotide
actgcctggcgcagcgctgtcgt

SEQ ID NO: 306548 - DNA, 22 bp, Artificial Sequence
  Description of Artificial Sequence: Synthetic oligonucleotide
ctgcctggcgcagcgctgtcgt

SEQ ID NO: 306549 - DNA, 22 bp, Artificial Sequence
  Description of Artificial Sequence: Synthetic oligonucleotide
tgcctggcgcagcgctgtcgtg

SEQ ID NO: 306550 - DNA, 21 bp, Artificial Sequence
  Description of Artificial Sequence: Synthetic oligonucleotide
gcctggcgcagcgctgtcgtg

SEQ ID NO: 306551 - DNA, 21 bp, Artificial Sequence
  Description of Artificial Sequence: Synthetic oligonucleotide
cctggcgcagcgctgtcgtgc

SEQ ID NO: 306552 - DNA, 22 bp, Artificial Sequence
  Description of Artificial Sequence: Synthetic oligonucleotide
ctggcgcagcgctgtcgtgcct

SEQ ID NO: 306553 - DNA, 22 bp, Artificial Sequence
  Description of Artificial Sequence: Synthetic oligonucleotide
tggcgcagcgctgtcgtgcctc

SEQ ID NO: 306554 - DNA, 21 bp, Artificial Sequence
  Description of Artificial Sequence: Synthetic oligonucleotide
ggcgcagcgctgtcgtgcctc

SEQ ID NO: 306555 - DNA, 22 bp, Artificial Sequence
  Description of Artificial Sequence: Synthetic oligonucleotide
gcgcagcgctgtcgtgcctcga

SEQ ID NO: 306556 - DNA, 22 bp, Artificial Sequence
  Description of Artificial Sequence: Synthetic oligonucleotide
cgcagcgctgtcgtgcctcgac

SEQ ID NO: 306557 - DNA, 23 bp, Artificial Sequence
  Description of Artificial Sequence: Synthetic oligonucleotide
gcagcgctgtcgtgcctcgacga

SEQ ID NO: 306558 - DNA, 23 bp, Artificial Sequence
  Description of Artificial Sequence: Synthetic oligonucleotide
cagcgctgtcgtgcctcgacgag

SEQ ID NO: 306559 - DNA, 24 bp, Artificial Sequence
  Description of Artificial Sequence: Synthetic oligonucleotide
agcgctgtcgtgcctcgacgagga

SEQ ID NO: 306560 - DNA, 23 bp, Artificial Sequence
  Description of Artificial Sequence: Synthetic oligonucleotide
gcgctgtcgtgcctcgacgagga

SEQ ID NO: 306561 - DNA, 24 bp, Artificial Sequence
  Description of Artificial Sequence: Synthetic oligonucleotide
cgctgtcgtgcctcgacgaggaca

SEQ ID NO: 306562 - DNA, 24 bp, Artificial Sequence
  Description of Artificial Sequence: Synthetic oligonucleotide
gctgtcgtgcctcgacgaggacac

SEQ ID NO: 306563 - DNA, 25 bp, Artificial Sequence
  Description of Artificial Sequence: Synthetic oligonucleotide
ctgtcgtgcctcgacgaggacacga

SEQ ID NO: 306564 - DNA, 26 bp, Artificial Sequence
  Description of Artificial Sequence: Synthetic oligonucleotide
tgtcgtgcctcgacgaggacacgaga

SEQ ID NO: 306565 - DNA, 25 bp, Artificial Sequence
  Description of Artificial Sequence: Synthetic oligonucleotide
gtcgtgcctcgacgaggacacgaga

SEQ ID NO: 306566 - DNA, 26 bp, Artificial Sequence
  Description of Artificial Sequence: Synthetic oligonucleotide
tcgtgcctcgacgaggacacgagact

SEQ ID NO: 306567 - DNA, 25 bp, Artificial Sequence
  Description of Artificial Sequence: Synthetic oligonucleotide
cgtgcctcgacgaggacacgagact

SEQ ID NO: 306568 - DNA, 27 bp, Artificial Sequence
  Description of Artificial Sequence: Synthetic oligonucleotide
gtgcctcgacgaggacacgagactctt

SEQ ID NO: 306569 - DNA, 27 bp, Artificial Sequence
  Description of Artificial Sequence: Synthetic oligonucleotide
tgcctcgacgaggacacgagactcttc

SEQ ID NO: 306570 - DNA, 26 bp, Artificial Sequence
  Description of Artificial Sequence: Synthetic oligonucleotide
gcctcgacgaggacacgagactcttc

SEQ ID NO: 306571 - DNA, 26 bp, Artificial Sequence
  Description of Artificial Sequence: Synthetic oligonucleotide
cctcgacgaggacacgagactcttcg

SEQ ID NO: 306572 - DNA, 27 bp, Artificial Sequence
  Description of Artificial Sequence: Synthetic oligonucleotide
ctcgacgaggacacgagactcttcgct

SEQ ID NO: 306573 - DNA, 27 bp, Artificial Sequence
  Description of Artificial Sequence: Synthetic oligonucleotide
tcgacgaggacacgagactcttcgctg

SEQ ID NO: 306574 - DNA, 27 bp, Artificial Sequence
  Description of Artificial Sequence: Synthetic oligonucleotide
cgacgaggacacgagactcttcgctgt

SEQ ID NO: 306575 - DNA, 27 bp, Artificial Sequence
  Description of Artificial Sequence: Synthetic oligonucleotide
gacgaggacacgagactcttcgctgtc

SEQ ID NO: 306576 - DNA, 28 bp, Artificial Sequence
  Description of Artificial Sequence: Synthetic oligonucleotide
acgaggacacgagactcttcgctgtcac

SEQ ID NO: 306577 - DNA, 27 bp, Artificial Sequence
  Description of Artificial Sequence: Synthetic oligonucleotide
cgaggacacgagactcttcgctgtcac

SEQ ID NO: 306578 - DNA, 28 bp, Artificial Sequence
  Description of Artificial Sequence: Synthetic oligonucleotide
gaggacacgagactcttcgctgtcactc

SEQ ID NO: 306579 - DNA, 29 bp, Artificial Sequence
  Description of Artificial Sequence: Synthetic oligonucleotide
aggacacgagactcttcgctgtcactcac

SEQ ID NO: 306580 - DNA, 28 bp, Artificial Sequence
  Description of Artificial Sequence: Synthetic oligonucleotide
ggacacgagactcttcgctgtcactcac

SEQ ID NO: 306581 - DNA, 28 bp, Artificial Sequence
  Description of Artificial Sequence: Synthetic oligonucleotide
gacacgagactcttcgctgtcactcacg

SEQ ID NO: 306582 - DNA, 29 bp, Artificial Sequence
  Description of Artificial Sequence: Synthetic oligonucleotide
acacgagactcttcgctgtcactcacgtc

SEQ ID NO: 306583 - DNA, 28 bp, Artificial Sequence
  Description of Artificial Sequence: Synthetic oligonucleotide
cacgagactcttcgctgtcactcacgtc

SEQ ID NO: 306584 - DNA, 30 bp, Artificial Sequence
  Description of Artificial Sequence: Synthetic oligonucleotide
acgagactcttcgctgtcactcacgtcttg

SEQ ID NO: 306585 - DNA, 29 bp, Artificial Sequence
  Description of Artificial Sequence: Synthetic oligonucleotide
cgagactcttcgctgtcactcacgtcttg

SEQ ID NO: 306586 - DNA, 29 bp, Artificial Sequence
  Description of Artificial Sequence: Synthetic oligonucleotide
gagactcttcgctgtcactcacgtcttgg

SEQ ID NO: 306587 - DNA, 29 bp, Artificial Sequence
  Description of Artificial Sequence: Synthetic oligonucleotide
agactcttcgctgtcactcacgtcttggg

SEQ ID NO: 306588 - DNA, 28 bp, Artificial Sequence
  Description of Artificial Sequence: Synthetic oligonucleotide
gactcttcgctgtcactcacgtcttggg

SEQ ID NO: 306589 - DNA, 33 bp, Artificial Sequence
  Description of Artificial Sequence: Synthetic oligonucleotide
actcttcgctgtcactcacgtcttgggtataac

SEQ ID NO: 306590 - DNA, 32 bp, Artificial Sequence
  Description of Artificial Sequence: Synthetic oligonucleotide
ctcttcgctgtcactcacgtcttgggtataac

SEQ ID NO: 306591 - DNA, 37 bp, Artificial Sequence
  Description of Artificial Sequence: Synthetic oligonucleotide
tcttcgctgtcactcacgtcttgggtataacaatttg

SEQ ID NO: 306592 - DNA, 36 bp, Artificial Sequence
  Description of Artificial Sequence: Synthetic oligonucleotide
cttcgctgtcactcacgtcttgggtataacaatttg

SEQ ID NO: 306593 - DNA, 37 bp, Artificial Sequence
  Description of Artificial Sequence: Synthetic oligonucleotide
ttcgctgtcactcacgtcttgggtataacaatttgag

SEQ ID NO: 306594 - DNA, 36 bp, Artificial Sequence
  Description of Artificial Sequence: Synthetic oligonucleotide
tcgctgtcactcacgtcttgggtataacaatttgag

SEQ ID NO: 306595 - DNA, 35 bp, Artificial Sequence
  Description of Artificial Sequence: Synthetic oligonucleotide
cgctgtcactcacgtcttgggtataacaatttgag

SEQ ID NO: 306596 - DNA, 35 bp, Artificial Sequence
  Description of Artificial Sequence: Synthetic oligonucleotide
gctgtcactcacgtcttgggtataacaatttgagg

SEQ ID NO: 306597 - DNA, 35 bp, Artificial Sequence
  Description of Artificial Sequence: Synthetic oligonucleotide
ctgtcactcacgtcttgggtataacaatttgaggc

SEQ ID NO: 306598 - DNA, 36 bp, Artificial Sequence
  Description of Artificial Sequence: Synthetic oligonucleotide
tgtcactcacgtcttgggtataacaatttgaggctg

SEQ ID NO: 306599 - DNA, 35 bp, Artificial Sequence
  Description of Artificial Sequence: Synthetic oligonucleotide
gtcactcacgtcttgggtataacaatttgaggctg

SEQ ID NO: 306600 - DNA, 37 bp, Artificial Sequence
  Description of Artificial Sequence: Synthetic oligonucleotide
tcactcacgtcttgggtataacaatttgaggctgtac

SEQ ID NO: 306601 - DNA, 36 bp, Artificial Sequence
  Description of Artificial Sequence: Synthetic oligonucleotide
cactcacgtcttgggtataacaatttgaggctgtac

SEQ ID NO: 306602 - DNA, 39 bp, Artificial Sequence
  Description of Artificial Sequence: Synthetic oligonucleotide
actcacgtcttgggtataacaatttgaggctgtactaag

SEQ ID NO: 306603 - DNA, 38 bp, Artificial Sequence
  Description of Artificial Sequence: Synthetic oligonucleotide
ctcacgtcttgggtataacaatttgaggctgtactaag

SEQ ID NO: 306604 - DNA, 40 bp, Artificial Sequence
  Description of Artificial Sequence: Synthetic oligonucleotide
tcacgtcttgggtataacaatttgaggctgtactaagaag

SEQ ID NO: 306605 - DNA, 39 bp, Artificial Sequence
  Description of Artificial Sequence: Synthetic oligonucleotide
cacgtcttgggtataacaatttgaggctgtactaagaag

SEQ ID NO: 306606 - DNA, 40 bp, Artificial Sequence
  Description of Artificial Sequence: Synthetic oligonucleotide
acgtcttgggtataacaatttgaggctgtactaagaagac

SEQ ID NO: 306607 - DNA, 39 bp, Artificial Sequence
  Description of Artificial Sequence: Synthetic oligonucleotide
cgtcttgggtataacaatttgaggctgtactaagaagac

SEQ ID NO: 306608 - DNA, 39 bp, Artificial Sequence
  Description of Artificial Sequence: Synthetic oligonucleotide
gtcttgggtataacaatttgaggctgtactaagaagacg

SEQ ID NO: 306609 - DNA, 39 bp, Artificial Sequence
  Description of Artificial Sequence: Synthetic oligonucleotide
tcttgggtataacaatttgaggctgtactaagaagacgc

SEQ ID NO: 306610 - DNA, 38 bp, Artificial Sequence
  Description of Artificial Sequence: Synthetic oligonucleotide
cttgggtataacaatttgaggctgtactaagaagacgc

SEQ ID NO: 306611 - DNA, 38 bp, Artificial Sequence
  Description of Artificial Sequence: Synthetic oligonucleotide
ttgggtataacaatttgaggctgtactaagaagacgcg

SEQ ID NO: 306612 - DNA, 37 bp, Artificial Sequence
  Description of Artificial Sequence: Synthetic oligonucleotide
tgggtataacaatttgaggctgtactaagaagacgcg

SEQ ID NO: 306613 - DNA, 36 bp, Artificial Sequence
  Description of Artificial Sequence: Synthetic oligonucleotide
gggtataacaatttgaggctgtactaagaagacgcg

SEQ ID NO: 306614 - DNA, 38 bp, Artificial Sequence
  Description of Artificial Sequence: Synthetic oligonucleotide
ggtataacaatttgaggctgtactaagaagacgcgatc

SEQ ID NO: 306615 - DNA, 38 bp, Artificial Sequence
  Description of Artificial Sequence: Synthetic oligonucleotide
gtataacaatttgaggctgtactaagaagacgcgatcc

SEQ ID NO: 306616 - DNA, 38 bp, Artificial Sequence
  Description of Artificial Sequence: Synthetic oligonucleotide
tataacaatttgaggctgtactaagaagacgcgatccc

SEQ ID NO: 306617 - DNA, 37 bp, Artificial Sequence
  Description of Artificial Sequence: Synthetic oligonucleotide
ataacaatttgaggctgtactaagaagacgcgatccc

SEQ ID NO: 306618 - DNA, 36 bp, Artificial Sequence
  Description of Artificial Sequence: Synthetic oligonucleotide
taacaatttgaggctgtactaagaagacgcgatccc

SEQ ID NO: 306619 - DNA, 35 bp, Artificial Sequence
  Description of Artificial Sequence: Synthetic oligonucleotide
aacaatttgaggctgtactaagaagacgcgatccc

SEQ ID NO: 306620 - DNA, 34 bp, Artificial Sequence
  Description of Artificial Sequence: Synthetic oligonucleotide
acaatttgaggctgtactaagaagacgcgatccc

SEQ ID NO: 306621 - DNA, 33 bp, Artificial Sequence
  Description of Artificial Sequence: Synthetic oligonucleotide
caatttgaggctgtactaagaagacgcgatccc

SEQ ID NO: 306622 - DNA, 34 bp, Artificial Sequence
  Description of Artificial Sequence: Synthetic oligonucleotide
aatttgaggctgtactaagaagacgcgatccctg

SEQ ID NO: 306623 - DNA, 33 bp, Artificial Sequence
  Description of Artificial Sequence: Synthetic oligonucleotide
atttgaggctgtactaagaagacgcgatccctg

SEQ ID NO: 306624 - DNA, 32 bp, Artificial Sequence
  Description of Artificial Sequence: Synthetic oligonucleotide
tttgaggctgtactaagaagacgcgatccctg

SEQ ID NO: 306625 - DNA, 31 bp, Artificial Sequence
  Description of Artificial Sequence: Synthetic oligonucleotide
ttgaggctgtactaagaagacgcgatccctg

SEQ ID NO: 306626 - DNA, 30 bp, Artificial Sequence
  Description of Artificial Sequence: Synthetic oligonucleotide
tgaggctgtactaagaagacgcgatccctg

SEQ ID NO: 306627 - DNA, 29 bp, Artificial Sequence
  Description of Artificial Sequence: Synthetic oligonucleotide
gaggctgtactaagaagacgcgatccctg

SEQ ID NO: 306628 - DNA, 30 bp, Artificial Sequence
  Description of Artificial Sequence: Synthetic oligonucleotide
aggctgtactaagaagacgcgatccctgtc

SEQ ID NO: 306629 - DNA, 29 bp, Artificial Sequence
  Description of Artificial Sequence: Synthetic oligonucleotide
ggctgtactaagaagacgcgatccctgtc

SEQ ID NO: 306630 - DNA, 29 bp, Artificial Sequence
  Description of Artificial Sequence: Synthetic oligonucleotide
gctgtactaagaagacgcgatccctgtcc

SEQ ID NO: 306631 - DNA, 29 bp, Artificial Sequence
  Description of Artificial Sequence: Synthetic oligonucleotide
ctgtactaagaagacgcgatccctgtccg

SEQ ID NO: 306632 - DNA, 30 bp, Artificial Sequence
  Description of Artificial Sequence: Synthetic oligonucleotide
tgtactaagaagacgcgatccctgtccgtg

SEQ ID NO: 306633 - DNA, 29 bp, Artificial Sequence
  Description of Artificial Sequence: Synthetic oligonucleotide
gtactaagaagacgcgatccctgtccgtg

SEQ ID NO: 306634 - DNA, 30 bp, Artificial Sequence
  Description of Artificial Sequence: Synthetic oligonucleotide
tactaagaagacgcgatccctgtccgtgag

SEQ ID NO: 306635 - DNA, 29 bp, Artificial Sequence
  Description of Artificial Sequence: Synthetic oligonucleotide
actaagaagacgcgatccctgtccgtgag

SEQ ID NO: 306636 - DNA, 28 bp, Artificial Sequence
  Description of Artificial Sequence: Synthetic oligonucleotide
ctaagaagacgcgatccctgtccgtgag

SEQ ID NO: 306637 - DNA, 28 bp, Artificial Sequence
  Description of Artificial Sequence: Synthetic oligonucleotide
taagaagacgcgatccctgtccgtgagc

SEQ ID NO: 306638 - DNA, 27 bp, Artificial Sequence
  Description of Artificial Sequence: Synthetic oligonucleotide
aagaagacgcgatccctgtccgtgagc

SEQ ID NO: 306639 - DNA, 27 bp, Artificial Sequence
  Description of Artificial Sequence: Synthetic oligonucleotide
agaagacgcgatccctgtccgtgagct

SEQ ID NO: 306640 - DNA, 26 bp, Artificial Sequence
  Description of Artificial Sequence: Synthetic oligonucleotide
gaagacgcgatccctgtccgtgagct

SEQ ID NO: 306641 - DNA, 27 bp, Artificial Sequence
  Description of Artificial Sequence: Synthetic oligonucleotide
aagacgcgatccctgtccgtgagctct

SEQ ID NO: 306642 - DNA, 27 bp, Artificial Sequence
  Description of Artificial Sequence: Synthetic oligonucleotide
agacgcgatccctgtccgtgagctctt

SEQ ID NO: 306643 - DNA, 26 bp, Artificial Sequence
  Description of Artificial Sequence: Synthetic oligonucleotide
gacgcgatccctgtccgtgagctctt

SEQ ID NO: 306644 - DNA, 27 bp, Artificial Sequence
  Description of Artificial Sequence: Synthetic oligonucleotide
acgcgatccctgtccgtgagctcttca

SEQ ID NO: 306645 - DNA, 27 bp, Artificial Sequence
  Description of Artificial Sequence: Synthetic oligonucleotide
cgcgatccctgtccgtgagctcttcaa

SEQ ID NO: 306646 - DNA, 27 bp, Artificial Sequence
  Description of Artificial Sequence: Synthetic oligonucleotide
gcgatccctgtccgtgagctcttcaac

SEQ ID NO: 306647 - DNA, 28 bp, Artificial Sequence
  Description of Artificial Sequence: Synthetic oligonucleotide
cgatccctgtccgtgagctcttcaacag

SEQ ID NO: 306648 - DNA, 34 bp, Artificial Sequence
  Description of Artificial Sequence: Synthetic oligonucleotide
gatccctgtccgtgagctcttcaacagaaaattc

SEQ ID NO: 306649 - DNA, 34 bp, Artificial Sequence
  Description of Artificial Sequence: Synthetic oligonucleotide
atccctgtccgtgagctcttcaacagaaaattcc

SEQ ID NO: 306650 - DNA, 33 bp, Artificial Sequence
  Description of Artificial Sequence: Synthetic oligonucleotide
tccctgtccgtgagctcttcaacagaaaattcc

SEQ ID NO: 306651 - DNA, 32 bp, Artificial Sequence
  Description of Artificial Sequence: Synthetic oligonucleotide
ccctgtccgtgagctcttcaacagaaaattcc

SEQ ID NO: 306652 - DNA, 32 bp, Artificial Sequence
  Description of Artificial Sequence: Synthetic oligonucleotide
cctgtccgtgagctcttcaacagaaaattccg

SEQ ID NO: 306653 - DNA, 32 bp, Artificial Sequence
  Description of Artificial Sequence: Synthetic oligonucleotide
ctgtccgtgagctcttcaacagaaaattccgg

SEQ ID NO: 306654 - DNA, 34 bp, Artificial Sequence
  Description of Artificial Sequence: Synthetic oligonucleotide
tgtccgtgagctcttcaacagaaaattccggatg

SEQ ID NO: 306655 - DNA, 33 bp, Artificial Sequence
  Description of Artificial Sequence: Synthetic oligonucleotide
gtccgtgagctcttcaacagaaaattccggatg

SEQ ID NO: 306656 - DNA, 34 bp, Artificial Sequence
  Description of Artificial Sequence: Synthetic oligonucleotide
tccgtgagctcttcaacagaaaattccggatgag

SEQ ID NO: 306657 - DNA, 33 bp, Artificial Sequence
  Description of Artificial Sequence: Synthetic oligonucleotide
ccgtgagctcttcaacagaaaattccggatgag

SEQ ID NO: 306658 - DNA, 33 bp, Artificial Sequence
  Description of Artificial Sequence: Synthetic oligonucleotide
cgtgagctcttcaacagaaaattccggatgagc

SEQ ID NO: 306659 - DNA, 35 bp, Artificial Sequence
  Description of Artificial Sequence: Synthetic oligonucleotide
gtgagctcttcaacagaaaattccggatgagcttc

SEQ ID NO: 306660 - DNA, 35 bp, Artificial Sequence
  Description of Artificial Sequence: Synthetic oligonucleotide
tgagctcttcaacagaaaattccggatgagcttcc

SEQ ID NO: 306661 - DNA, 34 bp, Artificial Sequence
  Description of Artificial Sequence: Synthetic oligonucleotide
gagctcttcaacagaaaattccggatgagcttcc

SEQ ID NO: 306662 - DNA, 35 bp, Artificial Sequence
  Description of Artificial Sequence: Synthetic oligonucleotide
agctcttcaacagaaaattccggatgagcttcctc

SEQ ID NO: 306663 - DNA, 34 bp, Artificial Sequence
  Description of Artificial Sequence: Synthetic oligonucleotide
gctcttcaacagaaaattccggatgagcttcctc

SEQ ID NO: 306664 - DNA, 36 bp, Artificial Sequence
  Description of Artificial Sequence: Synthetic oligonucleotide
ctcttcaacagaaaattccggatgagcttcctcttg

SEQ ID NO: 306665 - DNA, 36 bp, Artificial Sequence
  Description of Artificial Sequence: Synthetic oligonucleotide
tcttcaacagaaaattccggatgagcttcctcttgg

SEQ ID NO: 306666 - DNA, 35 bp, Artificial Sequence
  Description of Artificial Sequence: Synthetic oligonucleotide
cttcaacagaaaattccggatgagcttcctcttgg

SEQ ID NO: 306667 - DNA, 35 bp, Artificial Sequence
  Description of Artificial Sequence: Synthetic oligonucleotide
ttcaacagaaaattccggatgagcttcctcttggg

SEQ ID NO: 306668 - DNA, 34 bp, Artificial Sequence
  Description of Artificial Sequence: Synthetic oligonucleotide
tcaacagaaaattccggatgagcttcctcttggg

SEQ ID NO: 306669 - DNA, 33 bp, Artificial Sequence
  Description of Artificial Sequence: Synthetic oligonucleotide
caacagaaaattccggatgagcttcctcttggg

SEQ ID NO: 306670 - DNA, 33 bp, Artificial Sequence
  Description of Artificial Sequence: Synthetic oligonucleotide
aacagaaaattccggatgagcttcctcttgggc

SEQ ID NO: 306671 - DNA, 32 bp, Artificial Sequence
  Description of Artificial Sequence: Synthetic oligonucleotide
acagaaaattccggatgagcttcctcttgggc

SEQ ID NO: 306672 - DNA, 31 bp, Artificial Sequence
  Description of Artificial Sequence: Synthetic oligonucleotide
cagaaaattccggatgagcttcctcttgggc

SEQ ID NO: 306673 - DNA, 31 bp, Artificial Sequence
  Description of Artificial Sequence: Synthetic oligonucleotide
agaaaattccggatgagcttcctcttgggcc

SEQ ID NO: 306674 - DNA, 30 bp, Artificial Sequence
  Description of Artificial Sequence: Synthetic oligonucleotide
gaaaattccggatgagcttcctcttgggcc

SEQ ID NO: 306675 - DNA, 30 bp, Artificial Sequence
  Description of Artificial Sequence: Synthetic oligonucleotide
aaaattccggatgagcttcctcttgggccc

SEQ ID NO: 306676 - DNA, 29 bp, Artificial Sequence
  Description of Artificial Sequence: Synthetic oligonucleotide
aaattccggatgagcttcctcttgggccc

SEQ ID NO: 306677 - DNA, 28 bp, Artificial Sequence
  Description of Artificial Sequence: Synthetic oligonucleotide
aattccggatgagcttcctcttgggccc

SEQ ID NO: 306678 - DNA, 27 bp, Artificial Sequence
  Description of Artificial Sequence: Synthetic oligonucleotide
attccggatgagcttcctcttgggccc

SEQ ID NO: 306679 - DNA, 27 bp, Artificial Sequence
  Description of Artificial Sequence: Synthetic oligonucleotide
ttccggatgagcttcctcttgggccct

SEQ ID NO: 306680 - DNA, 26 bp, Artificial Sequence
  Description of Artificial Sequence: Synthetic oligonucleotide
tccggatgagcttcctcttgggccct

SEQ ID NO: 306681 - DNA, 25 bp, Artificial Sequence
  Description of Artificial Sequence: Synthetic oligonucleotide
ccggatgagcttcctcttgggccct

SEQ ID NO: 306682 - DNA, 26 bp, Artificial Sequence
  Description of Artificial Sequence: Synthetic oligonucleotide
cggatgagcttcctcttgggccctga

SEQ ID NO: 306683 - DNA, 27 bp, Artificial Sequence
  Description of Artificial Sequence: Synthetic oligonucleotide
ggatgagcttcctcttgggccctgaga

SEQ ID NO: 306684 - DNA, 27 bp, Artificial Sequence
  Description of Artificial Sequence: Synthetic oligonucleotide
gatgagcttcctcttgggccctgagac

SEQ ID NO: 306685 - DNA, 27 bp, Artificial Sequence
  Description of Artificial Sequence: Synthetic oligonucleotide
atgagcttcctcttgggccctgagacc

SEQ ID NO: 306686 - DNA, 26 bp, Artificial Sequence
  Description of Artificial Sequence: Synthetic oligonucleotide
tgagcttcctcttgggccctgagacc

SEQ ID NO: 306687 - DNA, 25 bp, Artificial Sequence
  Description of Artificial Sequence: Synthetic oligonucleotide
gagcttcctcttgggccctgagacc

SEQ ID NO: 306688 - DNA, 25 bp, Artificial Sequence
  Description of Artificial Sequence: Synthetic oligonucleotide
agcttcctcttgggccctgagaccc

SEQ ID NO: 306689 - DNA, 24 bp, Artificial Sequence
  Description of Artificial Sequence: Synthetic oligonucleotide
gcttcctcttgggccctgagaccc

SEQ ID NO: 306690 - DNA, 25 bp, Artificial Sequence
  Description of Artificial Sequence: Synthetic oligonucleotide
cttcctcttgggccctgagacccca

SEQ ID NO: 306691 - DNA, 25 bp, Artificial Sequence
  Description of Artificial Sequence: Synthetic oligonucleotide
ttcctcttgggccctgagaccccag

SEQ ID NO: 306692 - DNA, 24 bp, Artificial Sequence
  Description of Artificial Sequence: Synthetic oligonucleotide
tcctcttgggccctgagaccccag

SEQ ID NO: 306693 - DNA, 23 bp, Artificial Sequence
  Description of Artificial Sequence: Synthetic oligonucleotide
cctcttgggccctgagaccccag

SEQ ID NO: 306694 - DNA, 24 bp, Artificial Sequence
  Description of Artificial Sequence: Synthetic oligonucleotide
ctcttgggccctgagaccccagct

SEQ ID NO: 306695 - DNA, 26 bp, Artificial Sequence
  Description of Artificial Sequence: Synthetic oligonucleotide
tcttgggccctgagaccccagctcat

SEQ ID NO: 306696 - DNA, 25 bp, Artificial Sequence
  Description of Artificial Sequence: Synthetic oligonucleotide
cttgggccctgagaccccagctcat

SEQ ID NO: 306697 - DNA, 25 bp, Artificial Sequence
  Description of Artificial Sequence: Synthetic oligonucleotide
ttgggccctgagaccccagctcatg

SEQ ID NO: 306698 - DNA, 24 bp, Artificial Sequence
  Description of Artificial Sequence: Synthetic oligonucleotide
tgggccctgagaccccagctcatg

SEQ ID NO: 306699 - DNA, 23 bp, Artificial Sequence
  Description of Artificial Sequence: Synthetic oligonucleotide
gggccctgagaccccagctcatg

SEQ ID NO: 306700 - DNA, 24 bp, Artificial Sequence
  Description of Artificial Sequence: Synthetic oligonucleotide
ggccctgagaccccagctcatgca

SEQ ID NO: 306701 - DNA, 24 bp, Artificial Sequence
  Description of Artificial Sequence: Synthetic oligonucleotide
gccctgagaccccagctcatgcag

SEQ ID NO: 306702 - DNA, 24 bp, Artificial Sequence
  Description of Artificial Sequence: Synthetic oligonucleotide
ccctgagaccccagctcatgcagg

SEQ ID NO: 306703 - DNA, 25 bp, Artificial Sequence
  Description of Artificial Sequence: Synthetic oligonucleotide
cctgagaccccagctcatgcagggt

SEQ ID NO: 306704 - DNA, 25 bp, Artificial Sequence
  Description of Artificial Sequence: Synthetic oligonucleotide
ctgagaccccagctcatgcagggtc

SEQ ID NO: 306705 - DNA, 27 bp, Artificial Sequence
  Description of Artificial Sequence: Synthetic oligonucleotide
tgagaccccagctcatgcagggtccta

SEQ ID NO: 306706 - DNA, 26 bp, Artificial Sequence
  Description of Artificial Sequence: Synthetic oligonucleotide
gagaccccagctcatgcagggtccta

SEQ ID NO: 306707 - DNA, 27 bp, Artificial Sequence
  Description of Artificial Sequence: Synthetic oligonucleotide
agaccccagctcatgcagggtcctaca

SEQ ID NO: 306708 - DNA, 26 bp, Artificial Sequence
  Description of Artificial Sequence: Synthetic oligonucleotide
gaccccagctcatgcagggtcctaca

SEQ ID NO: 306709 - DNA, 27 bp, Artificial Sequence
  Description of Artificial Sequence: Synthetic oligonucleotide
accccagctcatgcagggtcctacaga

SEQ ID NO: 306710 - DNA, 27 bp, Artificial Sequence
  Description of Artificial Sequence: Synthetic oligonucleotide
ccccagctcatgcagggtcctacagat

SEQ ID NO: 306711 - DNA, 27 bp, Artificial Sequence
  Description of Artificial Sequence: Synthetic oligonucleotide
cccagctcatgcagggtcctacagatc

SEQ ID NO: 306712 - DNA, 28 bp, Artificial Sequence
  Description of Artificial Sequence: Synthetic oligonucleotide
ccagctcatgcagggtcctacagatctc

SEQ ID NO: 306713 - DNA, 28 bp, Artificial Sequence
  Description of Artificial Sequence: Synthetic oligonucleotide
cagctcatgcagggtcctacagatctcg

SEQ ID NO: 306714 - DNA, 28 bp, Artificial Sequence
  Description of Artificial Sequence: Synthetic oligonucleotide
agctcatgcagggtcctacagatctcgg

SEQ ID NO: 306715 - DNA, 27 bp, Artificial Sequence
  Description of Artificial Sequence: Synthetic oligonucleotide
gctcatgcagggtcctacagatctcgg

SEQ ID NO: 306716 - DNA, 27 bp, Artificial Sequence
  Description of Artificial Sequence: Synthetic oligonucleotide
ctcatgcagggtcctacagatctcggg

SEQ ID NO: 306717 - DNA, 27 bp, Artificial Sequence
  Description of Artificial Sequence: Synthetic oligonucleotide
tcatgcagggtcctacagatctcgggg

SEQ ID NO: 306718 - DNA, 27 bp, Artificial Sequence
  Description of Artificial Sequence: Synthetic oligonucleotide
catgcagggtcctacagatctcggggt

SEQ ID NO: 306719 - DNA, 28 bp, Artificial Sequence
  Description of Artificial Sequence: Synthetic oligonucleotide
atgcagggtcctacagatctcggggtac

SEQ ID NO: 306720 - DNA, 27 bp, Artificial Sequence
  Description of Artificial Sequence: Synthetic oligonucleotide
tgcagggtcctacagatctcggggtac

SEQ ID NO: 306721 - DNA, 27 bp, Artificial Sequence
  Description of Artificial Sequence: Synthetic oligonucleotide
gcagggtcctacagatctcggggtaca

SEQ ID NO: 306722 - DNA, 27 bp, Artificial Sequence
  Description of Artificial Sequence: Synthetic oligonucleotide
cagggtcctacagatctcggggtacac

SEQ ID NO: 306723 - DNA, 28 bp, Artificial Sequence
  Description of Artificial Sequence: Synthetic oligonucleotide
agggtcctacagatctcggggtacacac

SEQ ID NO: 306724 - DNA, 27 bp, Artificial Sequence
  Description of Artificial Sequence: Synthetic oligonucleotide
gggtcctacagatctcggggtacacac

SEQ ID NO: 306725 - DNA, 27 bp, Artificial Sequence
  Description of Artificial Sequence: Synthetic oligonucleotide
ggtcctacagatctcggggtacacacc

SEQ ID NO: 306726 - DNA, 27 bp, Artificial Sequence
  Description of Artificial Sequence: Synthetic oligonucleotide
gtcctacagatctcggggtacacaccc

SEQ ID NO: 306727 - DNA, 28 bp, Artificial Sequence
  Description of Artificial Sequence: Synthetic oligonucleotide
tcctacagatctcggggtacacacccac

SEQ ID NO: 306728 - DNA, 27 bp, Artificial Sequence
  Description of Artificial Sequence: Synthetic oligonucleotide
cctacagatctcggggtacacacccac

SEQ ID NO: 306729 - DNA, 28 bp, Artificial Sequence
  Description of Artificial Sequence: Synthetic oligonucleotide
ctacagatctcggggtacacacccacac

SEQ ID NO: 306730 - DNA, 29 bp, Artificial Sequence
  Description of Artificial Sequence: Synthetic oligonucleotide
tacagatctcggggtacacacccacacac

SEQ ID NO: 306731 - DNA, 28 bp, Artificial Sequence
  Description of Artificial Sequence: Synthetic oligonucleotide
acagatctcggggtacacacccacacac

SEQ ID NO: 306732 - DNA, 27 bp, Artificial Sequence
  Description of Artificial Sequence: Synthetic oligonucleotide
cagatctcggggtacacacccacacac

SEQ ID NO: 306733 - DNA, 27 bp, Artificial Sequence
  Description of Artificial Sequence: Synthetic oligonucleotide
agatctcggggtacacacccacacacc

SEQ ID NO: 306734 - DNA, 26 bp, Artificial Sequence
  Description of Artificial Sequence: Synthetic oligonucleotide
gatctcggggtacacacccacacacc

SEQ ID NO: 306735 - DNA, 26 bp, Artificial Sequence
  Description of Artificial Sequence: Synthetic oligonucleotide
atctcggggtacacacccacacaccc

SEQ ID NO: 306736 - DNA, 25 bp, Artificial Sequence
  Description of Artificial Sequence: Synthetic oligonucleotide
tctcggggtacacacccacacaccc

SEQ ID NO: 306737 - DNA, 24 bp, Artificial Sequence
  Description of Artificial Sequence: Synthetic oligonucleotide
ctcggggtacacacccacacaccc

SEQ ID NO: 306738 - DNA, 24 bp, Artificial Sequence
  Description of Artificial Sequence: Synthetic oligonucleotide
tcggggtacacacccacacacccc

SEQ ID NO: 306739 - DNA, 23 bp, Artificial Sequence
  Description of Artificial Sequence: Synthetic oligonucleotide
cggggtacacacccacacacccc

SEQ ID NO: 306740 - DNA, 24 bp, Artificial Sequence
  Description of Artificial Sequence: Synthetic oligonucleotide
ggggtacacacccacacaccccca

SEQ ID NO: 306741 - DNA, 25 bp, Artificial Sequence
  Description of Artificial Sequence: Synthetic oligonucleotide
gggtacacacccacacacccccact

SEQ ID NO: 306742 - DNA, 25 bp, Artificial Sequence
  Description of Artificial Sequence: Synthetic oligonucleotide
ggtacacacccacacacccccactc

SEQ ID NO: 306743 - DNA, 25 bp, Artificial Sequence
  Description of Artificial Sequence: Synthetic oligonucleotide
gtacacacccacacacccccactcg

SEQ ID NO: 306744 - DNA, 26 bp, Artificial Sequence
  Description of Artificial Sequence: Synthetic oligonucleotide
tacacacccacacacccccactcggt

SEQ ID NO: 306745 - DNA, 25 bp, Artificial Sequence
  Description of Artificial Sequence: Synthetic oligonucleotide
acacacccacacacccccactcggt

SEQ ID NO: 306746 - DNA, 24 bp, Artificial Sequence
  Description of Artificial Sequence: Synthetic oligonucleotide
cacacccacacacccccactcggt

SEQ ID NO: 306747 - DNA, 24 bp, Artificial Sequence
  Description of Artificial Sequence: Synthetic oligonucleotide
acacccacacacccccactcggtg

SEQ ID NO: 306748 - DNA, 23 bp, Artificial Sequence
  Description of Artificial Sequence: Synthetic oligonucleotide
cacccacacacccccactcggtg

SEQ ID NO: 306749 - DNA, 24 bp, Artificial Sequence
  Description of Artificial Sequence: Synthetic oligonucleotide
acccacacacccccactcggtggt

SEQ ID NO: 306750 - DNA, 23 bp, Artificial Sequence
  Description of Artificial Sequence: Synthetic oligonucleotide
cccacacacccccactcggtggt

SEQ ID NO: 306751 - DNA, 23 bp, Artificial Sequence
  Description of Artificial Sequence: Synthetic oligonucleotide
ccacacacccccactcggtggtc

SEQ ID NO: 306752 - DNA, 23 bp, Artificial Sequence
  Description of Artificial Sequence: Synthetic oligonucleotide
cacacacccccactcggtggtcg

SEQ ID NO: 306753 - DNA, 23 bp, Artificial Sequence
  Description of Artificial Sequence: Synthetic oligonucleotide
acacacccccactcggtggtcgg

SEQ ID NO: 306754 - DNA, 22 bp, Artificial Sequence
  Description of Artificial Sequence: Synthetic oligonucleotide
cacacccccactcggtggtcgg

SEQ ID NO: 306755 - DNA, 23 bp, Artificial Sequence
  Description of Artificial Sequence: Synthetic oligonucleotide
acacccccactcggtggtcggct

SEQ ID NO: 306756 - DNA, 22 bp, Artificial Sequence
  Description of Artificial Sequence: Synthetic oligonucleotide
cacccccactcggtggtcggct

SEQ ID NO: 306757 - DNA, 22 bp, Artificial Sequence
  Description of Artificial Sequence: Synthetic oligonucleotide
acccccactcggtggtcggctc

SEQ ID NO: 306758 - DNA, 21 bp, Artificial Sequence
  Description of Artificial Sequence: Synthetic oligonucleotide
cccccactcggtggtcggctc

SEQ ID NO: 306759 - DNA, 21 bp, Artificial Sequence
  Description of Artificial Sequence: Synthetic oligonucleotide
ccccactcggtggtcggctcc

SEQ ID NO: 306760 - DNA, 22 bp, Artificial Sequence
  Description of Artificial Sequence: Synthetic oligonucleotide
cccactcggtggtcggctccca

SEQ ID NO: 306761 - DNA, 22 bp, Artificial Sequence
  Description of Artificial Sequence: Synthetic oligonucleotide
ccactcggtggtcggctcccag

SEQ ID NO: 306762 - DNA, 24 bp, Artificial Sequence
  Description of Artificial Sequence: Synthetic oligonucleotide
cactcggtggtcggctcccagcaa

SEQ ID NO: 306763 - DNA, 24 bp, Artificial Sequence
  Description of Artificial Sequence: Synthetic oligonucleotide
actcggtggtcggctcccagcaag

SEQ ID NO: 306764 - DNA, 23 bp, Artificial Sequence
  Description of Artificial Sequence: Synthetic oligonucleotide
ctcggtggtcggctcccagcaag

SEQ ID NO: 306765 - DNA, 23 bp, Artificial Sequence
  Description of Artificial Sequence: Synthetic oligonucleotide
tcggtggtcggctcccagcaagc

SEQ ID NO: 306766 - DNA, 22 bp, Artificial Sequence
  Description of Artificial Sequence: Synthetic oligonucleotide
cggtggtcggctcccagcaagc

SEQ ID NO: 306767 - DNA, 22 bp, Artificial Sequence
  Description of Artificial Sequence: Synthetic oligonucleotide
ggtggtcggctcccagcaagcc

SEQ ID NO: 306768 - DNA, 22 bp, Artificial Sequence
  Description of Artificial Sequence: Synthetic oligonucleotide
gtggtcggctcccagcaagccc

SEQ ID NO: 306769 - DNA, 23 bp, Artificial Sequence
  Description of Artificial Sequence: Synthetic oligonucleotide
tggtcggctcccagcaagcccct

SEQ ID NO: 306770 - DNA, 22 bp, Artificial Sequence
  Description of Artificial Sequence: Synthetic oligonucleotide
ggtcggctcccagcaagcccct

SEQ ID NO: 306771 - DNA, 22 bp, Artificial Sequence
  Description of Artificial Sequence: Synthetic oligonucleotide
gtcggctcccagcaagcccctg

SEQ ID NO: 306772 - DNA, 23 bp, Artificial Sequence
  Description of Artificial Sequence: Synthetic oligonucleotide
tcggctcccagcaagcccctggt

SEQ ID NO: 306773 - DNA, 22 bp, Artificial Sequence
  Description of Artificial Sequence: Synthetic oligonucleotide
cggctcccagcaagcccctggt

SEQ ID NO: 306774 - DNA, 24 bp, Artificial Sequence
  Description of Artificial Sequence: Synthetic oligonucleotide
ggctcccagcaagcccctggtgaa

SEQ ID NO: 306775 - DNA, 26 bp, Artificial Sequence
  Description of Artificial Sequence: Synthetic oligonucleotide
gctcccagcaagcccctggtgaacat

SEQ ID NO: 306776 - DNA, 26 bp, Artificial Sequence
  Description of Artificial Sequence: Synthetic oligonucleotide
ctcccagcaagcccctggtgaacatg

SEQ ID NO: 306777 - DNA, 27 bp, Artificial Sequence
  Description of Artificial Sequence: Synthetic oligonucleotide
tcccagcaagcccctggtgaacatggt

SEQ ID NO: 306778 - DNA, 26 bp, Artificial Sequence
  Description of Artificial Sequence: Synthetic oligonucleotide
cccagcaagcccctggtgaacatggt

SEQ ID NO: 306779 - DNA, 27 bp, Artificial Sequence
  Description of Artificial Sequence: Synthetic oligonucleotide
ccagcaagcccctggtgaacatggtca

SEQ ID NO: 306780 - DNA, 27 bp, Artificial Sequence
  Description of Artificial Sequence: Synthetic oligonucleotide
cagcaagcccctggtgaacatggtcag

SEQ ID NO: 306781 - DNA, 28 bp, Artificial Sequence
  Description of Artificial Sequence: Synthetic oligonucleotide
agcaagcccctggtgaacatggtcagag

SEQ ID NO: 306782 - DNA, 27 bp, Artificial Sequence
  Description of Artificial Sequence: Synthetic oligonucleotide
gcaagcccctggtgaacatggtcagag

SEQ ID NO: 306783 - DNA, 27 bp, Artificial Sequence
  Description of Artificial Sequence: Synthetic oligonucleotide
caagcccctggtgaacatggtcagagg

SEQ ID NO: 306784 - DNA, 28 bp, Artificial Sequence
  Description of Artificial Sequence: Synthetic oligonucleotide
aagcccctggtgaacatggtcagaggag

SEQ ID NO: 306785 - DNA, 27 bp, Artificial Sequence
  Description of Artificial Sequence: Synthetic oligonucleotide
agcccctggtgaacatggtcagaggag

SEQ ID NO: 306786 - DNA, 27 bp, Artificial Sequence
  Description of Artificial Sequence: Synthetic oligonucleotide
gcccctggtgaacatggtcagaggagt

SEQ ID NO: 306787 - DNA, 27 bp, Artificial Sequence
  Description of Artificial Sequence: Synthetic oligonucleotide
cccctggtgaacatggtcagaggagtc

SEQ ID NO: 306788 - DNA, 27 bp, Artificial Sequence
  Description of Artificial Sequence: Synthetic oligonucleotide
ccctggtgaacatggtcagaggagtcc

SEQ ID NO: 306789 - DNA, 28 bp, Artificial Sequence
  Description of Artificial Sequence: Synthetic oligonucleotide
cctggtgaacatggtcagaggagtccac

SEQ ID NO: 306790 - DNA, 29 bp, Artificial Sequence
  Description of Artificial Sequence: Synthetic oligonucleotide
ctggtgaacatggtcagaggagtccactg

SEQ ID NO: 306791 - DNA, 33 bp, Artificial Sequence
  Description of Artificial Sequence: Synthetic oligonucleotide
tggtgaacatggtcagaggagtccactgaaaac

SEQ ID NO: 306792 - DNA, 32 bp, Artificial Sequence
  Description of Artificial Sequence: Synthetic oligonucleotide
ggtgaacatggtcagaggagtccactgaaaac

SEQ ID NO: 306793 - DNA, 32 bp, Artificial Sequence
  Description of Artificial Sequence: Synthetic oligonucleotide
gtgaacatggtcagaggagtccactgaaaacc

SEQ ID NO: 306794 - DNA, 34 bp, Artificial Sequence
  Description of Artificial Sequence: Synthetic oligonucleotide
tgaacatggtcagaggagtccactgaaaaccttg

SEQ ID NO: 306795 - DNA, 33 bp, Artificial Sequence
  Description of Artificial Sequence: Synthetic oligonucleotide
gaacatggtcagaggagtccactgaaaaccttg

SEQ ID NO: 306796 - DNA, 33 bp, Artificial Sequence
  Description of Artificial Sequence: Synthetic oligonucleotide
aacatggtcagaggagtccactgaaaaccttgc

SEQ ID NO: 306797 - DNA, 32 bp, Artificial Sequence
  Description of Artificial Sequence: Synthetic oligonucleotide
acatggtcagaggagtccactgaaaaccttgc

SEQ ID NO: 306798 - DNA, 31 bp, Artificial Sequence
  Description of Artificial Sequence: Synthetic oligonucleotide
catggtcagaggagtccactgaaaaccttgc

SEQ ID NO: 306799 - DNA, 31 bp, Artificial Sequence
  Description of Artificial Sequence: Synthetic oligonucleotide
atggtcagaggagtccactgaaaaccttgcc

SEQ ID NO: 306800 - DNA, 30 bp, Artificial Sequence
  Description of Artificial Sequence: Synthetic oligonucleotide
tggtcagaggagtccactgaaaaccttgcc

SEQ ID NO: 306801 - DNA, 29 bp, Artificial Sequence
  Description of Artificial Sequence: Synthetic oligonucleotide
ggtcagaggagtccactgaaaaccttgcc

SEQ ID NO: 306802 - DNA, 30 bp, Artificial Sequence
  Description of Artificial Sequence: Synthetic oligonucleotide
gtcagaggagtccactgaaaaccttgcctc

SEQ ID NO: 306803 - DNA, 30 bp, Artificial Sequence
  Description of Artificial Sequence: Synthetic oligonucleotide
tcagaggagtccactgaaaaccttgcctcc

SEQ ID NO: 306804 - DNA, 29 bp, Artificial Sequence
  Description of Artificial Sequence: Synthetic oligonucleotide
cagaggagtccactgaaaaccttgcctcc

SEQ ID NO: 306805 - DNA, 30 bp, Artificial Sequence
  Description of Artificial Sequence: Synthetic oligonucleotide
agaggagtccactgaaaaccttgcctcctg

SEQ ID NO: 306806 - DNA, 29 bp, Artificial Sequence
  Description of Artificial Sequence: Synthetic oligonucleotide
gaggagtccactgaaaaccttgcctcctg

SEQ ID NO: 306807 - DNA, 29 bp, Artificial Sequence
  Description of Artificial Sequence: Synthetic oligonucleotide
aggagtccactgaaaaccttgcctcctgg

SEQ ID NO: 306808 - DNA, 28 bp, Artificial Sequence
  Description of Artificial Sequence: Synthetic oligonucleotide
ggagtccactgaaaaccttgcctcctgg

SEQ ID NO: 306809 - DNA, 28 bp, Artificial Sequence
  Description of Artificial Sequence: Synthetic oligonucleotide
gagtccactgaaaaccttgcctcctggc

SEQ ID NO: 306810 - DNA, 28 bp, Artificial Sequence
  Description of Artificial Sequence: Synthetic oligonucleotide
agtccactgaaaaccttgcctcctggcg

SEQ ID NO: 306811 - DNA, 27 bp, Artificial Sequence
  Description of Artificial Sequence: Synthetic oligonucleotide
gtccactgaaaaccttgcctcctggcg

SEQ ID NO: 306812 - DNA, 27 bp, Artificial Sequence
  Description of Artificial Sequence: Synthetic oligonucleotide
tccactgaaaaccttgcctcctggcgc

SEQ ID NO: 306813 - DNA, 27 bp, Artificial Sequence
  Description of Artificial Sequence: Synthetic oligonucleotide
ccactgaaaaccttgcctcctggcgca

SEQ ID NO: 306814 - DNA, 27 bp, Artificial Sequence
  Description of Artificial Sequence: Synthetic oligonucleotide
cactgaaaaccttgcctcctggcgcac

SEQ ID NO: 306815 - DNA, 27 bp, Artificial Sequence
  Description of Artificial Sequence: Synthetic oligonucleotide
actgaaaaccttgcctcctggcgcacc

SEQ ID NO: 306816 - DNA, 26 bp, Artificial Sequence
  Description of Artificial Sequence: Synthetic oligonucleotide
ctgaaaaccttgcctcctggcgcacc

SEQ ID NO: 306817 - DNA, 27 bp, Artificial Sequence
  Description of Artificial Sequence: Synthetic oligonucleotide
tgaaaaccttgcctcctggcgcaccca

SEQ ID NO: 306818 - DNA, 26 bp, Artificial Sequence
  Description of Artificial Sequence: Synthetic oligonucleotide
gaaaaccttgcctcctggcgcaccca

SEQ ID NO: 306819 - DNA, 26 bp, Artificial Sequence
  Description of Artificial Sequence: Synthetic oligonucleotide
aaaaccttgcctcctggcgcacccag

SEQ ID NO: 306820 - DNA, 25 bp, Artificial Sequence
  Description of Artificial Sequence: Synthetic oligonucleotide
aaaccttgcctcctggcgcacccag

SEQ ID NO: 306821 - DNA, 24 bp, Artificial Sequence
  Description of Artificial Sequence: Synthetic oligonucleotide
aaccttgcctcctggcgcacccag

SEQ ID NO: 306822 - DNA, 23 bp, Artificial Sequence
  Description of Artificial Sequence: Synthetic oligonucleotide
accttgcctcctggcgcacccag

SEQ ID NO: 306823 - DNA, 22 bp, Artificial Sequence
  Description of Artificial Sequence: Synthetic oligonucleotide
ccttgcctcctggcgcacccag

SEQ ID NO: 306824 - DNA, 23 bp, Artificial Sequence
  Description of Artificial Sequence: Synthetic oligonucleotide
cttgcctcctggcgcacccaggt

SEQ ID NO: 306825 - DNA, 23 bp, Artificial Sequence
  Description of Artificial Sequence: Synthetic oligonucleotide
ttgcctcctggcgcacccaggtc

SEQ ID NO: 306826 - DNA, 22 bp, Artificial Sequence
  Description of Artificial Sequence: Synthetic oligonucleotide
tgcctcctggcgcacccaggtc

SEQ ID NO: 306827 - DNA, 21 bp, Artificial Sequence
  Description of Artificial Sequence: Synthetic oligonucleotide
gcctcctggcgcacccaggtc

SEQ ID NO: 306828 - DNA, 21 bp, Artificial Sequence
  Description of Artificial Sequence: Synthetic oligonucleotide
cctcctggcgcacccaggtcc

SEQ ID NO: 306829 - DNA, 21 bp, Artificial Sequence
  Description of Artificial Sequence: Synthetic oligonucleotide
ctcctggcgcacccaggtccg

SEQ ID NO: 306830 - DNA, 22 bp, Artificial Sequence
  Description of Artificial Sequence: Synthetic oligonucleotide
tcctggcgcacccaggtccgct

SEQ ID NO: 306831 - DNA, 21 bp, Artificial Sequence
  Description of Artificial Sequence: Synthetic oligonucleotide
cctggcgcacccaggtccgct

SEQ ID NO: 306832 - DNA, 21 bp, Artificial Sequence
  Description of Artificial Sequence: Synthetic oligonucleotide
ctggcgcacccaggtccgctg

SEQ ID NO: 306833 - DNA, 22 bp, Artificial Sequence
  Description of Artificial Sequence: Synthetic oligonucleotide
tggcgcacccaggtccgctggt

SEQ ID NO: 306834 - DNA, 21 bp, Artificial Sequence
  Description of Artificial Sequence: Synthetic oligonucleotide
ggcgcacccaggtccgctggt

SEQ ID NO: 306835 - DNA, 25 bp, Artificial Sequence
  Description of Artificial Sequence: Synthetic oligonucleotide
gcgcacccaggtccgctggtgatat

SEQ ID NO: 306836 - DNA, 26 bp, Artificial Sequence
  Description of Artificial Sequence: Synthetic oligonucleotide
cgcacccaggtccgctggtgatatca

SEQ ID NO: 306837 - DNA, 27 bp, Artificial Sequence
  Description of Artificial Sequence: Synthetic oligonucleotide
gcacccaggtccgctggtgatatcaga

SEQ ID NO: 306838 - DNA, 28 bp, Artificial Sequence
  Description of Artificial Sequence: Synthetic oligonucleotide
cacccaggtccgctggtgatatcagaag

SEQ ID NO: 306839 - DNA, 29 bp, Artificial Sequence
  Description of Artificial Sequence: Synthetic oligonucleotide
acccaggtccgctggtgatatcagaagtg

SEQ ID NO: 306840 - DNA, 28 bp, Artificial Sequence
  Description of Artificial Sequence: Synthetic oligonucleotide
cccaggtccgctggtgatatcagaagtg

SEQ ID NO: 306841 - DNA, 29 bp, Artificial Sequence
  Description of Artificial Sequence: Synthetic oligonucleotide
ccaggtccgctggtgatatcagaagtgac

SEQ ID NO: 306842 - DNA, 30 bp, Artificial Sequence
  Description of Artificial Sequence: Synthetic oligonucleotide
caggtccgctggtgatatcagaagtgacag

SEQ ID NO: 306843 - DNA, 31 bp, Artificial Sequence
  Description of Artificial Sequence: Synthetic oligonucleotide
aggtccgctggtgatatcagaagtgacagtc

SEQ ID NO: 306844 - DNA, 30 bp, Artificial Sequence
  Description of Artificial Sequence: Synthetic oligonucleotide
ggtccgctggtgatatcagaagtgacagtc

SEQ ID NO: 306845 - DNA, 32 bp, Artificial Sequence
  Description of Artificial Sequence: Synthetic oligonucleotide
gtccgctggtgatatcagaagtgacagtcatc

SEQ ID NO: 306846 - DNA, 32 bp, Artificial Sequence
  Description of Artificial Sequence: Synthetic oligonucleotide
tccgctggtgatatcagaagtgacagtcatcg

SEQ ID NO: 306847 - DNA, 31 bp, Artificial Sequence
  Description of Artificial Sequence: Synthetic oligonucleotide
ccgctggtgatatcagaagtgacagtcatcg

SEQ ID NO: 306848 - DNA, 32 bp, Artificial Sequence
  Description of Artificial Sequence: Synthetic oligonucleotide
cgctggtgatatcagaagtgacagtcatcgtg

SEQ ID NO: 306849 - DNA, 32 bp, Artificial Sequence
  Description of Artificial Sequence: Synthetic oligonucleotide
gctggtgatatcagaagtgacagtcatcgtgc

SEQ ID NO: 306850 - DNA, 35 bp, Artificial Sequence
  Description of Artificial Sequence: Synthetic oligonucleotide
ctggtgatatcagaagtgacagtcatcgtgcaatg

SEQ ID NO: 306851 - DNA, 37 bp, Artificial Sequence
  Description of Artificial Sequence: Synthetic oligonucleotide
tggtgatatcagaagtgacagtcatcgtgcaatgttc

SEQ ID NO: 306852 - DNA, 36 bp, Artificial Sequence
  Description of Artificial Sequence: Synthetic oligonucleotide
ggtgatatcagaagtgacagtcatcgtgcaatgttc

SEQ ID NO: 306853 - DNA, 36 bp, Artificial Sequence
  Description of Artificial Sequence: Synthetic oligonucleotide
gtgatatcagaagtgacagtcatcgtgcaatgttcg

SEQ ID NO: 306854 - DNA, 37 bp, Artificial Sequence
  Description of Artificial Sequence: Synthetic oligonucleotide
tgatatcagaagtgacagtcatcgtgcaatgttcgtc

SEQ ID NO: 306855 - DNA, 36 bp, Artificial Sequence
  Description of Artificial Sequence: Synthetic oligonucleotide
gatatcagaagtgacagtcatcgtgcaatgttcgtc

SEQ ID NO: 306856 - DNA, 37 bp, Artificial Sequence
  Description of Artificial Sequence: Synthetic oligonucleotide
atatcagaagtgacagtcatcgtgcaatgttcgtcag

SEQ ID NO: 306857 - DNA, 36 bp, Artificial Sequence
  Description of Artificial Sequence: Synthetic oligonucleotide
tatcagaagtgacagtcatcgtgcaatgttcgtcag

SEQ ID NO: 306858 - DNA, 35 bp, Artificial Sequence
  Description of Artificial Sequence: Synthetic oligonucleotide
atcagaagtgacagtcatcgtgcaatgttcgtcag

SEQ ID NO: 306859 - DNA, 34 bp, Artificial Sequence
  Description of Artificial Sequence: Synthetic oligonucleotide
tcagaagtgacagtcatcgtgcaatgttcgtcag

SEQ ID NO: 306860 - DNA, 33 bp, Artificial Sequence
  Description of Artificial Sequence: Synthetic oligonucleotide
cagaagtgacagtcatcgtgcaatgttcgtcag

SEQ ID NO: 306861 - DNA, 35 bp, Artificial Sequence
  Description of Artificial Sequence: Synthetic oligonucleotide
agaagtgacagtcatcgtgcaatgttcgtcagatg

SEQ ID NO: 306862 - DNA, 34 bp, Artificial Sequence
  Description of Artificial Sequence: Synthetic oligonucleotide
gaagtgacagtcatcgtgcaatgttcgtcagatg

SEQ ID NO: 306863 - DNA, 35 bp, Artificial Sequence
  Description of Artificial Sequence: Synthetic oligonucleotide
aagtgacagtcatcgtgcaatgttcgtcagatgtg

SEQ ID NO: 306864 - DNA, 34 bp, Artificial Sequence
  Description of Artificial Sequence: Synthetic oligonucleotide
agtgacagtcatcgtgcaatgttcgtcagatgtg

SEQ ID NO: 306865 - DNA, 33 bp, Artificial Sequence
  Description of Artificial Sequence: Synthetic oligonucleotide
gtgacagtcatcgtgcaatgttcgtcagatgtg

SEQ ID NO: 306866 - DNA, 35 bp, Artificial Sequence
  Description of Artificial Sequence: Synthetic oligonucleotide
tgacagtcatcgtgcaatgttcgtcagatgtgatg

SEQ ID NO: 306867 - DNA, 34 bp, Artificial Sequence
  Description of Artificial Sequence: Synthetic oligonucleotide
gacagtcatcgtgcaatgttcgtcagatgtgatg

SEQ ID NO: 306868 - DNA, 37 bp, Artificial Sequence
  Description of Artificial Sequence: Synthetic oligonucleotide
acagtcatcgtgcaatgttcgtcagatgtgatgtttg

SEQ ID NO: 306869 - DNA, 36 bp, Artificial Sequence
  Description of Artificial Sequence: Synthetic oligonucleotide
cagtcatcgtgcaatgttcgtcagatgtgatgtttg

SEQ ID NO: 306870 - DNA, 37 bp, Artificial Sequence
  Description of Artificial Sequence: Synthetic oligonucleotide
agtcatcgtgcaatgttcgtcagatgtgatgtttgag

SEQ ID NO: 306871 - DNA, 36 bp, Artificial Sequence
  Description of Artificial Sequence: Synthetic oligonucleotide
gtcatcgtgcaatgttcgtcagatgtgatgtttgag

SEQ ID NO: 306872 - DNA, 36 bp, Artificial Sequence
  Description of Artificial Sequence: Synthetic oligonucleotide
tcatcgtgcaatgttcgtcagatgtgatgtttgagg

SEQ ID NO: 306873 - DNA, 35 bp, Artificial Sequence
  Description of Artificial Sequence: Synthetic oligonucleotide
catcgtgcaatgttcgtcagatgtgatgtttgagg

SEQ ID NO: 306874 - DNA, 36 bp, Artificial Sequence
  Description of Artificial Sequence: Synthetic oligonucleotide
atcgtgcaatgttcgtcagatgtgatgtttgaggac

SEQ ID NO: 306875 - DNA, 35 bp, Artificial Sequence
  Description of Artificial Sequence: Synthetic oligonucleotide
tcgtgcaatgttcgtcagatgtgatgtttgaggac

SEQ ID NO: 306876 - DNA, 34 bp, Artificial Sequence
  Description of Artificial Sequence: Synthetic oligonucleotide
cgtgcaatgttcgtcagatgtgatgtttgaggac

SEQ ID NO: 306877 - DNA, 36 bp, Artificial Sequence
  Description of Artificial Sequence: Synthetic oligonucleotide
gtgcaatgttcgtcagatgtgatgtttgaggacttc

SEQ ID NO: 306878 - DNA, 36 bp, Artificial Sequence
  Description of Artificial Sequence: Synthetic oligonucleotide
tgcaatgttcgtcagatgtgatgtttgaggacttcc

SEQ ID NO: 306879 - DNA, 35 bp, Artificial Sequence
  Description of Artificial Sequence: Synthetic oligonucleotide
gcaatgttcgtcagatgtgatgtttgaggacttcc

SEQ ID NO: 306880 - DNA, 37 bp, Artificial Sequence
  Description of Artificial Sequence: Synthetic oligonucleotide
caatgttcgtcagatgtgatgtttgaggacttccttc

SEQ ID NO: 306881 - DNA, 38 bp, Artificial Sequence
  Description of Artificial Sequence: Synthetic oligonucleotide
aatgttcgtcagatgtgatgtttgaggacttccttcag

SEQ ID NO: 306882 - DNA, 37 bp, Artificial Sequence
  Description of Artificial Sequence: Synthetic oligonucleotide
atgttcgtcagatgtgatgtttgaggacttccttcag

SEQ ID NO: 306883 - DNA, 36 bp, Artificial Sequence
  Description of Artificial Sequence: Synthetic oligonucleotide
tgttcgtcagatgtgatgtttgaggacttccttcag

SEQ ID NO: 306884 - DNA, 35 bp, Artificial Sequence
  Description of Artificial Sequence: Synthetic oligonucleotide
gttcgtcagatgtgatgtttgaggacttccttcag

SEQ ID NO: 306885 - DNA, 35 bp, Artificial Sequence
  Description of Artificial Sequence: Synthetic oligonucleotide
ttcgtcagatgtgatgtttgaggacttccttcagc

SEQ ID NO: 306886 - DNA, 34 bp, Artificial Sequence
  Description of Artificial Sequence: Synthetic oligonucleotide
tcgtcagatgtgatgtttgaggacttccttcagc

SEQ ID NO: 306887 - DNA, 33 bp, Artificial Sequence
  Description of Artificial Sequence: Synthetic oligonucleotide
cgtcagatgtgatgtttgaggacttccttcagc

SEQ ID NO: 306888 - DNA, 34 bp, Artificial Sequence
  Description of Artificial Sequence: Synthetic oligonucleotide
gtcagatgtgatgtttgaggacttccttcagcac

SEQ ID NO: 306889 - DNA, 35 bp, Artificial Sequence
  Description of Artificial Sequence: Synthetic oligonucleotide
tcagatgtgatgtttgaggacttccttcagcacag

SEQ ID NO: 306890 - DNA, 34 bp, Artificial Sequence
  Description of Artificial Sequence: Synthetic oligonucleotide
cagatgtgatgtttgaggacttccttcagcacag

SEQ ID NO: 306891 - DNA, 35 bp, Artificial Sequence
  Description of Artificial Sequence: Synthetic oligonucleotide
agatgtgatgtttgaggacttccttcagcacagag

SEQ ID NO: 306892 - DNA, 34 bp, Artificial Sequence
  Description of Artificial Sequence: Synthetic oligonucleotide
gatgtgatgtttgaggacttccttcagcacagag

SEQ ID NO: 306893 - DNA, 35 bp, Artificial Sequence
  Description of Artificial Sequence: Synthetic oligonucleotide
atgtgatgtttgaggacttccttcagcacagagtg

SEQ ID NO: 306894 - DNA, 34 bp, Artificial Sequence
  Description of Artificial Sequence: Synthetic oligonucleotide
tgtgatgtttgaggacttccttcagcacagagtg

SEQ ID NO: 306895 - DNA, 33 bp, Artificial Sequence
  Description of Artificial Sequence: Synthetic oligonucleotide
gtgatgtttgaggacttccttcagcacagagtg

SEQ ID NO: 306896 - DNA, 33 bp, Artificial Sequence
  Description of Artificial Sequence: Synthetic oligonucleotide
tgatgtttgaggacttccttcagcacagagtgg

SEQ ID NO: 306897 - DNA, 32 bp, Artificial Sequence
  Description of Artificial Sequence: Synthetic oligonucleotide
gatgtttgaggacttccttcagcacagagtgg

SEQ ID NO: 306898 - DNA, 32 bp, Artificial Sequence
  Description of Artificial Sequence: Synthetic oligonucleotide
atgtttgaggacttccttcagcacagagtggg

SEQ ID NO: 306899 - DNA, 31 bp, Artificial Sequence
  Description of Artificial Sequence: Synthetic oligonucleotide
tgtttgaggacttccttcagcacagagtggg

SEQ ID NO: 306900 - DNA, 30 bp, Artificial Sequence
  Description of Artificial Sequence: Synthetic oligonucleotide
gtttgaggacttccttcagcacagagtggg

SEQ ID NO: 306901 - DNA, 30 bp, Artificial Sequence
  Description of Artificial Sequence: Synthetic oligonucleotide
tttgaggacttccttcagcacagagtgggg

SEQ ID NO: 306902 - DNA, 29 bp, Artificial Sequence
  Description of Artificial Sequence: Synthetic oligonucleotide
ttgaggacttccttcagcacagagtgggg

SEQ ID NO: 306903 - DNA, 28 bp, Artificial Sequence
  Description of Artificial Sequence: Synthetic oligonucleotide
tgaggacttccttcagcacagagtgggg

SEQ ID NO: 306904 - DNA, 27 bp, Artificial Sequence
  Description of Artificial Sequence: Synthetic oligonucleotide
gaggacttccttcagcacagagtgggg

SEQ ID NO: 306905 - DNA, 29 bp, Artificial Sequence
  Description of Artificial Sequence: Synthetic oligonucleotide
aggacttccttcagcacagagtggggatg

SEQ ID NO: 306906 - DNA, 28 bp, Artificial Sequence
  Description of Artificial Sequence: Synthetic oligonucleotide
ggacttccttcagcacagagtggggatg

SEQ ID NO: 306907 - DNA, 33 bp, Artificial Sequence
  Description of Artificial Sequence: Synthetic oligonucleotide
gacttccttcagcacagagtggggatgttaaag

SEQ ID NO: 306908 - DNA, 33 bp, Artificial Sequence
  Description of Artificial Sequence: Synthetic oligonucleotide
acttccttcagcacagagtggggatgttaaagg

SEQ ID NO: 306909 - DNA, 32 bp, Artificial Sequence
  Description of Artificial Sequence: Synthetic oligonucleotide
cttccttcagcacagagtggggatgttaaagg

SEQ ID NO: 306910 - DNA, 33 bp, Artificial Sequence
  Description of Artificial Sequence: Synthetic oligonucleotide
ttccttcagcacagagtggggatgttaaaggac

SEQ ID NO: 306911 - DNA, 32 bp, Artificial Sequence
  Description of Artificial Sequence: Synthetic oligonucleotide
tccttcagcacagagtggggatgttaaaggac

SEQ ID NO: 306912 - DNA, 31 bp, Artificial Sequence
  Description of Artificial Sequence: Synthetic oligonucleotide
ccttcagcacagagtggggatgttaaaggac

SEQ ID NO: 306913 - DNA, 32 bp, Artificial Sequence
  Description of Artificial Sequence: Synthetic oligonucleotide
cttcagcacagagtggggatgttaaaggacac

SEQ ID NO: 306914 - DNA, 35 bp, Artificial Sequence
  Description of Artificial Sequence: Synthetic oligonucleotide
ttcagcacagagtggggatgttaaaggacactatg

SEQ ID NO: 306915 - DNA, 34 bp, Artificial Sequence
  Description of Artificial Sequence: Synthetic oligonucleotide
tcagcacagagtggggatgttaaaggacactatg

SEQ ID NO: 306916 - DNA, 33 bp, Artificial Sequence
  Description of Artificial Sequence: Synthetic oligonucleotide
cagcacagagtggggatgttaaaggacactatg

SEQ ID NO: 306917 - DNA, 33 bp, Artificial Sequence
  Description of Artificial Sequence: Synthetic oligonucleotide
agcacagagtggggatgttaaaggacactatgc

SEQ ID NO: 306918 - DNA, 32 bp, Artificial Sequence
  Description of Artificial Sequence: Synthetic oligonucleotide
gcacagagtggggatgttaaaggacactatgc

SEQ ID NO: 306919 - DNA, 32 bp, Artificial Sequence
  Description of Artificial Sequence: Synthetic oligonucleotide
cacagagtggggatgttaaaggacactatgcg

SEQ ID NO: 306920 - DNA, 32 bp, Artificial Sequence
  Description of Artificial Sequence: Synthetic oligonucleotide
acagagtggggatgttaaaggacactatgcgc

SEQ ID NO: 306921 - DNA, 31 bp, Artificial Sequence
  Description of Artificial Sequence: Synthetic oligonucleotide
cagagtggggatgttaaaggacactatgcgc

SEQ ID NO: 306922 - DNA, 31 bp, Artificial Sequence
  Description of Artificial Sequence: Synthetic oligonucleotide
agagtggggatgttaaaggacactatgcgcc

SEQ ID NO: 306923 - DNA, 30 bp, Artificial Sequence
  Description of Artificial Sequence: Synthetic oligonucleotide
gagtggggatgttaaaggacactatgcgcc

SEQ ID NO: 306924 - DNA, 31 bp, Artificial Sequence
  Description of Artificial Sequence: Synthetic oligonucleotide
agtggggatgttaaaggacactatgcgcctc

SEQ ID NO: 306925 - DNA, 30 bp, Artificial Sequence
  Description of Artificial Sequence: Synthetic oligonucleotide
gtggggatgttaaaggacactatgcgcctc

SEQ ID NO: 306926 - DNA, 33 bp, Artificial Sequence
  Description of Artificial Sequence: Synthetic oligonucleotide
tggggatgttaaaggacactatgcgcctcatag

SEQ ID NO: 306927 - DNA, 32 bp, Artificial Sequence
  Description of Artificial Sequence: Synthetic oligonucleotide
ggggatgttaaaggacactatgcgcctcatag

SEQ ID NO: 306928 - DNA, 32 bp, Artificial Sequence
  Description of Artificial Sequence: Synthetic oligonucleotide
gggatgttaaaggacactatgcgcctcatagg

SEQ ID NO: 306929 - DNA, 33 bp, Artificial Sequence
  Description of Artificial Sequence: Synthetic oligonucleotide
ggatgttaaaggacactatgcgcctcataggag

SEQ ID NO: 306930 - DNA, 34 bp, Artificial Sequence
  Description of Artificial Sequence: Synthetic oligonucleotide
gatgttaaaggacactatgcgcctcataggagag

SEQ ID NO: 306931 - DNA, 34 bp, Artificial Sequence
  Description of Artificial Sequence: Synthetic oligonucleotide
atgttaaaggacactatgcgcctcataggagagc

SEQ ID NO: 306932 - DNA, 33 bp, Artificial Sequence
  Description of Artificial Sequence: Synthetic oligonucleotide
tgttaaaggacactatgcgcctcataggagagc

SEQ ID NO: 306933 - DNA, 32 bp, Artificial Sequence
  Description of Artificial Sequence: Synthetic oligonucleotide
gttaaaggacactatgcgcctcataggagagc

SEQ ID NO: 306934 - DNA, 33 bp, Artificial Sequence
  Description of Artificial Sequence: Synthetic oligonucleotide
ttaaaggacactatgcgcctcataggagagctg

SEQ ID NO: 306935 - DNA, 32 bp, Artificial Sequence
  Description of Artificial Sequence: Synthetic oligonucleotide
taaaggacactatgcgcctcataggagagctg

SEQ ID NO: 306936 - DNA, 31 bp, Artificial Sequence
  Description of Artificial Sequence: Synthetic oligonucleotide
aaaggacactatgcgcctcataggagagctg

SEQ ID NO: 306937 - DNA, 30 bp, Artificial Sequence
  Description of Artificial Sequence: Synthetic oligonucleotide
aaggacactatgcgcctcataggagagctg

SEQ ID NO: 306938 - DNA, 29 bp, Artificial Sequence
  Description of Artificial Sequence: Synthetic oligonucleotide
aggacactatgcgcctcataggagagctg

SEQ ID NO: 306939 - DNA, 28 bp, Artificial Sequence
  Description of Artificial Sequence: Synthetic oligonucleotide
ggacactatgcgcctcataggagagctg

SEQ ID NO: 306940 - DNA, 28 bp, Artificial Sequence
  Description of Artificial Sequence: Synthetic oligonucleotide
gacactatgcgcctcataggagagctgc

SEQ ID NO: 306941 - DNA, 30 bp, Artificial Sequence
  Description of Artificial Sequence: Synthetic oligonucleotide
acactatgcgcctcataggagagctgcatg

SEQ ID NO: 306942 - DNA, 29 bp, Artificial Sequence
  Description of Artificial Sequence: Synthetic oligonucleotide
cactatgcgcctcataggagagctgcatg

SEQ ID NO: 306943 - DNA, 31 bp, Artificial Sequence
  Description of Artificial Sequence: Synthetic oligonucleotide
actatgcgcctcataggagagctgcatgatg

SEQ ID NO: 306944 - DNA, 30 bp, Artificial Sequence
  Description of Artificial Sequence: Synthetic oligonucleotide
ctatgcgcctcataggagagctgcatgatg

SEQ ID NO: 306945 - DNA, 30 bp, Artificial Sequence
  Description of Artificial Sequence: Synthetic oligonucleotide
tatgcgcctcataggagagctgcatgatgg

SEQ ID NO: 306946 - DNA, 29 bp, Artificial Sequence
  Description of Artificial Sequence: Synthetic oligonucleotide
atgcgcctcataggagagctgcatgatgg

SEQ ID NO: 306947 - DNA, 28 bp, Artificial Sequence
  Description of Artificial Sequence: Synthetic oligonucleotide
tgcgcctcataggagagctgcatgatgg

SEQ ID NO: 306948 - DNA, 27 bp, Artificial Sequence
  Description of Artificial Sequence: Synthetic oligonucleotide
gcgcctcataggagagctgcatgatgg

SEQ ID NO: 306949 - DNA, 27 bp, Artificial Sequence
  Description of Artificial Sequence: Synthetic oligonucleotide
cgcctcataggagagctgcatgatggg

SEQ ID NO: 306950 - DNA, 27 bp, Artificial Sequence
  Description of Artificial Sequence: Synthetic oligonucleotide
gcctcataggagagctgcatgatgggg

SEQ ID NO: 306951 - DNA, 28 bp, Artificial Sequence
  Description of Artificial Sequence: Synthetic oligonucleotide
cctcataggagagctgcatgatggggtc

SEQ ID NO: 306952 - DNA, 29 bp, Artificial Sequence
  Description of Artificial Sequence: Synthetic oligonucleotide
ctcataggagagctgcatgatggggtcac

SEQ ID NO: 306953 - DNA, 29 bp, Artificial Sequence
  Description of Artificial Sequence: Synthetic oligonucleotide
tcataggagagctgcatgatggggtcacc

SEQ ID NO: 306954 - DNA, 28 bp, Artificial Sequence
  Description of Artificial Sequence: Synthetic oligonucleotide
cataggagagctgcatgatggggtcacc

SEQ ID NO: 306955 - DNA, 30 bp, Artificial Sequence
  Description of Artificial Sequence: Synthetic oligonucleotide
ataggagagctgcatgatggggtcaccaag

SEQ ID NO: 306956 - DNA, 29 bp, Artificial Sequence
  Description of Artificial Sequence: Synthetic oligonucleotide
taggagagctgcatgatggggtcaccaag

SEQ ID NO: 306957 - DNA, 28 bp, Artificial Sequence
  Description of Artificial Sequence: Synthetic oligonucleotide
aggagagctgcatgatggggtcaccaag

SEQ ID NO: 306958 - DNA, 27 bp, Artificial Sequence
  Description of Artificial Sequence: Synthetic oligonucleotide
ggagagctgcatgatggggtcaccaag

SEQ ID NO: 306959 - DNA, 27 bp, Artificial Sequence
  Description of Artificial Sequence: Synthetic oligonucleotide
gagagctgcatgatggggtcaccaagg

SEQ ID NO: 306960 - DNA, 27 bp, Artificial Sequence
  Description of Artificial Sequence: Synthetic oligonucleotide
agagctgcatgatggggtcaccaaggc

SEQ ID NO: 306961 - DNA, 26 bp, Artificial Sequence
  Description of Artificial Sequence: Synthetic oligonucleotide
gagctgcatgatggggtcaccaaggc

SEQ ID NO: 306962 - DNA, 27 bp, Artificial Sequence
  Description of Artificial Sequence: Synthetic oligonucleotide
agctgcatgatggggtcaccaaggcga

SEQ ID NO: 306963 - DNA, 27 bp, Artificial Sequence
  Description of Artificial Sequence: Synthetic oligonucleotide
gctgcatgatggggtcaccaaggcgaa

SEQ ID NO: 306964 - DNA, 27 bp, Artificial Sequence
  Description of Artificial Sequence: Synthetic oligonucleotide
ctgcatgatggggtcaccaaggcgaac

SEQ ID NO: 306965 - DNA, 29 bp, Artificial Sequence
  Description of Artificial Sequence: Synthetic oligonucleotide
tgcatgatggggtcaccaaggcgaacttc

SEQ ID NO: 306966 - DNA, 28 bp, Artificial Sequence
  Description of Artificial Sequence: Synthetic oligonucleotide
gcatgatggggtcaccaaggcgaacttc

SEQ ID NO: 306967 - DNA, 29 bp, Artificial Sequence
  Description of Artificial Sequence: Synthetic oligonucleotide
catgatggggtcaccaaggcgaacttctc

SEQ ID NO: 306968 - DNA, 29 bp, Artificial Sequence
  Description of Artificial Sequence: Synthetic oligonucleotide
atgatggggtcaccaaggcgaacttctcc

SEQ ID NO: 306969 - DNA, 28 bp, Artificial Sequence
  Description of Artificial Sequence: Synthetic oligonucleotide
tgatggggtcaccaaggcgaacttctcc

SEQ ID NO: 306970 - DNA, 27 bp, Artificial Sequence
  Description of Artificial Sequence: Synthetic oligonucleotide
gatggggtcaccaaggcgaacttctcc

SEQ ID NO: 306971 - DNA, 29 bp, Artificial Sequence
  Description of Artificial Sequence: Synthetic oligonucleotide
atggggtcaccaaggcgaacttctccttc

SEQ ID NO: 306972 - DNA, 28 bp, Artificial Sequence
  Description of Artificial Sequence: Synthetic oligonucleotide
tggggtcaccaaggcgaacttctccttc

SEQ ID NO: 306973 - DNA, 27 bp, Artificial Sequence
  Description of Artificial Sequence: Synthetic oligonucleotide
ggggtcaccaaggcgaacttctccttc

SEQ ID NO: 306974 - DNA, 27 bp, Artificial Sequence
  Description of Artificial Sequence: Synthetic oligonucleotide
gggtcaccaaggcgaacttctccttcg

SEQ ID NO: 306975 - DNA, 27 bp, Artificial Sequence
  Description of Artificial Sequence: Synthetic oligonucleotide
ggtcaccaaggcgaacttctccttcgg

SEQ ID NO: 306976 - DNA, 28 bp, Artificial Sequence
  Description of Artificial Sequence: Synthetic oligonucleotide
gtcaccaaggcgaacttctccttcggtc

SEQ ID NO: 306977 - DNA, 28 bp, Artificial Sequence
  Description of Artificial Sequence: Synthetic oligonucleotide
tcaccaaggcgaacttctccttcggtcc

SEQ ID NO: 306978 - DNA, 27 bp, Artificial Sequence
  Description of Artificial Sequence: Synthetic oligonucleotide
caccaaggcgaacttctccttcggtcc

SEQ ID NO: 306979 - DNA, 27 bp, Artificial Sequence
  Description of Artificial Sequence: Synthetic oligonucleotide
accaaggcgaacttctccttcggtccc

SEQ ID NO: 306980 - DNA, 27 bp, Artificial Sequence
  Description of Artificial Sequence: Synthetic oligonucleotide
ccaaggcgaacttctccttcggtccca

SEQ ID NO: 306981 - DNA, 28 bp, Artificial Sequence
  Description of Artificial Sequence: Synthetic oligonucleotide
caaggcgaacttctccttcggtcccaag

SEQ ID NO: 306982 - DNA, 30 bp, Artificial Sequence
  Description of Artificial Sequence: Synthetic oligonucleotide
aaggcgaacttctccttcggtcccaagatg

SEQ ID NO: 306983 - DNA, 29 bp, Artificial Sequence
  Description of Artificial Sequence: Synthetic oligonucleotide
aggcgaacttctccttcggtcccaagatg

SEQ ID NO: 306984 - DNA, 28 bp, Artificial Sequence
  Description of Artificial Sequence: Synthetic oligonucleotide
ggcgaacttctccttcggtcccaagatg

SEQ ID NO: 306985 - DNA, 28 bp, Artificial Sequence
  Description of Artificial Sequence: Synthetic oligonucleotide
gcgaacttctccttcggtcccaagatgc

SEQ ID NO: 306986 - DNA, 30 bp, Artificial Sequence
  Description of Artificial Sequence: Synthetic oligonucleotide
cgaacttctccttcggtcccaagatgcatg

SEQ ID NO: 306987 - DNA, 31 bp, Artificial Sequence
  Description of Artificial Sequence: Synthetic oligonucleotide
gaacttctccttcggtcccaagatgcatgag

SEQ ID NO: 306988 - DNA, 31 bp, Artificial Sequence
  Description of Artificial Sequence: Synthetic oligonucleotide
aacttctccttcggtcccaagatgcatgagc

SEQ ID NO: 306989 - DNA, 30 bp, Artificial Sequence
  Description of Artificial Sequence: Synthetic oligonucleotide
acttctccttcggtcccaagatgcatgagc

SEQ ID NO: 306990 - DNA, 29 bp, Artificial Sequence
  Description of Artificial Sequence: Synthetic oligonucleotide
cttctccttcggtcccaagatgcatgagc

SEQ ID NO: 306991 - DNA, 31 bp, Artificial Sequence
  Description of Artificial Sequence: Synthetic oligonucleotide
ttctccttcggtcccaagatgcatgagcttg

SEQ ID NO: 306992 - DNA, 30 bp, Artificial Sequence
  Description of Artificial Sequence: Synthetic oligonucleotide
tctccttcggtcccaagatgcatgagcttg

SEQ ID NO: 306993 - DNA, 29 bp, Artificial Sequence
  Description of Artificial Sequence: Synthetic oligonucleotide
ctccttcggtcccaagatgcatgagcttg

SEQ ID NO: 306994 - DNA, 29 bp, Artificial Sequence
  Description of Artificial Sequence: Synthetic oligonucleotide
tccttcggtcccaagatgcatgagcttgc

SEQ ID NO: 306995 - DNA, 28 bp, Artificial Sequence
  Description of Artificial Sequence: Synthetic oligonucleotide
ccttcggtcccaagatgcatgagcttgc

SEQ ID NO: 306996 - DNA, 29 bp, Artificial Sequence
  Description of Artificial Sequence: Synthetic oligonucleotide
cttcggtcccaagatgcatgagcttgcag

SEQ ID NO: 306997 - DNA, 29 bp, Artificial Sequence
  Description of Artificial Sequence: Synthetic oligonucleotide
ttcggtcccaagatgcatgagcttgcagg

SEQ ID NO: 306998 - DNA, 28 bp, Artificial Sequence
  Description of Artificial Sequence: Synthetic oligonucleotide
tcggtcccaagatgcatgagcttgcagg

SEQ ID NO: 306999 - DNA, 27 bp, Artificial Sequence
  Description of Artificial Sequence: Synthetic oligonucleotide
cggtcccaagatgcatgagcttgcagg

SEQ ID NO: 307000 - DNA, 27 bp, Artificial Sequence
  Description of Artificial Sequence: Synthetic oligonucleotide
ggtcccaagatgcatgagcttgcaggg

SEQ ID NO: 307001 - DNA, 28 bp, Artificial Sequence
  Description of Artificial Sequence: Synthetic oligonucleotide
gtcccaagatgcatgagcttgcagggtc

SEQ ID NO: 307002 - DNA, 28 bp, Artificial Sequence
  Description of Artificial Sequence: Synthetic oligonucleotide
tcccaagatgcatgagcttgcagggtcc

SEQ ID NO: 307003 - DNA, 27 bp, Artificial Sequence
  Description of Artificial Sequence: Synthetic oligonucleotide
cccaagatgcatgagcttgcagggtcc

SEQ ID NO: 307004 - DNA, 29 bp, Artificial Sequence
  Description of Artificial Sequence: Synthetic oligonucleotide
ccaagatgcatgagcttgcagggtcctac

SEQ ID NO: 307005 - DNA, 30 bp, Artificial Sequence
  Description of Artificial Sequence: Synthetic oligonucleotide
caagatgcatgagcttgcagggtcctacag

SEQ ID NO: 307006 - DNA, 32 bp, Artificial Sequence
  Description of Artificial Sequence: Synthetic oligonucleotide
aagatgcatgagcttgcagggtcctacagatc

SEQ ID NO: 307007 - DNA, 31 bp, Artificial Sequence
  Description of Artificial Sequence: Synthetic oligonucleotide
agatgcatgagcttgcagggtcctacagatc

SEQ ID NO: 307008 - DNA, 30 bp, Artificial Sequence
  Description of Artificial Sequence: Synthetic oligonucleotide
gatgcatgagcttgcagggtcctacagatc

SEQ ID NO: 307009 - DNA, 30 bp, Artificial Sequence
  Description of Artificial Sequence: Synthetic oligonucleotide
atgcatgagcttgcagggtcctacagatcc

SEQ ID NO: 307010 - DNA, 29 bp, Artificial Sequence
  Description of Artificial Sequence: Synthetic oligonucleotide
tgcatgagcttgcagggtcctacagatcc

SEQ ID NO: 307011 - DNA, 28 bp, Artificial Sequence
  Description of Artificial Sequence: Synthetic oligonucleotide
gcatgagcttgcagggtcctacagatcc

SEQ ID NO: 307012 - DNA, 30 bp, Artificial Sequence
  Description of Artificial Sequence: Synthetic oligonucleotide
catgagcttgcagggtcctacagatcctac

SEQ ID NO: 307013 - DNA, 30 bp, Artificial Sequence
  Description of Artificial Sequence: Synthetic oligonucleotide
atgagcttgcagggtcctacagatcctacg

SEQ ID NO: 307014 - DNA, 29 bp, Artificial Sequence
  Description of Artificial Sequence: Synthetic oligonucleotide
tgagcttgcagggtcctacagatcctacg

SEQ ID NO: 307015 - DNA, 28 bp, Artificial Sequence
  Description of Artificial Sequence: Synthetic oligonucleotide
gagcttgcagggtcctacagatcctacg

SEQ ID NO: 307016 - DNA, 28 bp, Artificial Sequence
  Description of Artificial Sequence: Synthetic oligonucleotide
agcttgcagggtcctacagatcctacgg

SEQ ID NO: 307017 - DNA, 27 bp, Artificial Sequence
  Description of Artificial Sequence: Synthetic oligonucleotide
gcttgcagggtcctacagatcctacgg

SEQ ID NO: 307018 - DNA, 29 bp, Artificial Sequence
  Description of Artificial Sequence: Synthetic oligonucleotide
cttgcagggtcctacagatcctacggttc

SEQ ID NO: 307019 - DNA, 30 bp, Artificial Sequence
  Description of Artificial Sequence: Synthetic oligonucleotide
ttgcagggtcctacagatcctacggttcag

SEQ ID NO: 307020 - DNA, 29 bp, Artificial Sequence
  Description of Artificial Sequence: Synthetic oligonucleotide
tgcagggtcctacagatcctacggttcag

SEQ ID NO: 307021 - DNA, 28 bp, Artificial Sequence
  Description of Artificial Sequence: Synthetic oligonucleotide
gcagggtcctacagatcctacggttcag

SEQ ID NO: 307022 - DNA, 31 bp, Artificial Sequence
  Description of Artificial Sequence: Synthetic oligonucleotide
cagggtcctacagatcctacggttcagttac

SEQ ID NO: 307023 - DNA, 32 bp, Artificial Sequence
  Description of Artificial Sequence: Synthetic oligonucleotide
agggtcctacagatcctacggttcagttactc

SEQ ID NO: 307024 - DNA, 31 bp, Artificial Sequence
  Description of Artificial Sequence: Synthetic oligonucleotide
gggtcctacagatcctacggttcagttactc

SEQ ID NO: 307025 - DNA, 32 bp, Artificial Sequence
  Description of Artificial Sequence: Synthetic oligonucleotide
ggtcctacagatcctacggttcagttactctc

SEQ ID NO: 307026 - DNA, 33 bp, Artificial Sequence
  Description of Artificial Sequence: Synthetic oligonucleotide
gtcctacagatcctacggttcagttactctctc

SEQ ID NO: 307027 - DNA, 33 bp, Artificial Sequence
  Description of Artificial Sequence: Synthetic oligonucleotide
tcctacagatcctacggttcagttactctctcc

SEQ ID NO: 307028 - DNA, 32 bp, Artificial Sequence
  Description of Artificial Sequence: Synthetic oligonucleotide
cctacagatcctacggttcagttactctctcc

SEQ ID NO: 307029 - DNA, 32 bp, Artificial Sequence
  Description of Artificial Sequence: Synthetic oligonucleotide
ctacagatcctacggttcagttactctctccc

SEQ ID NO: 307030 - DNA, 32 bp, Artificial Sequence
  Description of Artificial Sequence: Synthetic oligonucleotide
tacagatcctacggttcagttactctctcccc

SEQ ID NO: 307031 - DNA, 31 bp, Artificial Sequence
  Description of Artificial Sequence: Synthetic oligonucleotide
acagatcctacggttcagttactctctcccc

SEQ ID NO: 307032 - DNA, 30 bp, Artificial Sequence
  Description of Artificial Sequence: Synthetic oligonucleotide
cagatcctacggttcagttactctctcccc

SEQ ID NO: 307033 - DNA, 30 bp, Artificial Sequence
  Description of Artificial Sequence: Synthetic oligonucleotide
agatcctacggttcagttactctctccccc

SEQ ID NO: 307034 - DNA, 29 bp, Artificial Sequence
  Description of Artificial Sequence: Synthetic oligonucleotide
gatcctacggttcagttactctctccccc

SEQ ID NO: 307035 - DNA, 32 bp, Artificial Sequence
  Description of Artificial Sequence: Synthetic oligonucleotide
atcctacggttcagttactctctccccctatc

SEQ ID NO: 307036 - DNA, 31 bp, Artificial Sequence
  Description of Artificial Sequence: Synthetic oligonucleotide
tcctacggttcagttactctctccccctatc

SEQ ID NO: 307037 - DNA, 30 bp, Artificial Sequence
  Description of Artificial Sequence: Synthetic oligonucleotide
cctacggttcagttactctctccccctatc

SEQ ID NO: 307038 - DNA, 31 bp, Artificial Sequence
  Description of Artificial Sequence: Synthetic oligonucleotide
ctacggttcagttactctctccccctatctg

SEQ ID NO: 307039 - DNA, 33 bp, Artificial Sequence
  Description of Artificial Sequence: Synthetic oligonucleotide
tacggttcagttactctctccccctatctgttg

SEQ ID NO: 307040 - DNA, 32 bp, Artificial Sequence
  Description of Artificial Sequence: Synthetic oligonucleotide
acggttcagttactctctccccctatctgttg

SEQ ID NO: 307041 - DNA, 31 bp, Artificial Sequence
  Description of Artificial Sequence: Synthetic oligonucleotide
cggttcagttactctctccccctatctgttg

SEQ ID NO: 307042 - DNA, 32 bp, Artificial Sequence
  Description of Artificial Sequence: Synthetic oligonucleotide
ggttcagttactctctccccctatctgttgtc

SEQ ID NO: 307043 - DNA, 33 bp, Artificial Sequence
  Description of Artificial Sequence: Synthetic oligonucleotide
gttcagttactctctccccctatctgttgtcag

SEQ ID NO: 307044 - DNA, 33 bp, Artificial Sequence
  Description of Artificial Sequence: Synthetic oligonucleotide
ttcagttactctctccccctatctgttgtcagg

SEQ ID NO: 307045 - DNA, 32 bp, Artificial Sequence
  Description of Artificial Sequence: Synthetic oligonucleotide
tcagttactctctccccctatctgttgtcagg

SEQ ID NO: 307046 - DNA, 31 bp, Artificial Sequence
  Description of Artificial Sequence: Synthetic oligonucleotide
cagttactctctccccctatctgttgtcagg

SEQ ID NO: 307047 - DNA, 32 bp, Artificial Sequence
  Description of Artificial Sequence: Synthetic oligonucleotide
agttactctctccccctatctgttgtcaggtc

SEQ ID NO: 307048 - DNA, 31 bp, Artificial Sequence
  Description of Artificial Sequence: Synthetic oligonucleotide
gttactctctccccctatctgttgtcaggtc

SEQ ID NO: 307049 - DNA, 31 bp, Artificial Sequence
  Description of Artificial Sequence: Synthetic oligonucleotide
ttactctctccccctatctgttgtcaggtcc

SEQ ID NO: 307050 - DNA, 30 bp, Artificial Sequence
  Description of Artificial Sequence: Synthetic oligonucleotide
tactctctccccctatctgttgtcaggtcc

SEQ ID NO: 307051 - DNA, 29 bp, Artificial Sequence
  Description of Artificial Sequence: Synthetic oligonucleotide
actctctccccctatctgttgtcaggtcc

SEQ ID NO: 307052 - DNA, 28 bp, Artificial Sequence
  Description of Artificial Sequence: Synthetic oligonucleotide
ctctctccccctatctgttgtcaggtcc

SEQ ID NO: 307053 - DNA, 28 bp, Artificial Sequence
  Description of Artificial Sequence: Synthetic oligonucleotide
tctctccccctatctgttgtcaggtccc

SEQ ID NO: 307054 - DNA, 27 bp, Artificial Sequence
  Description of Artificial Sequence: Synthetic oligonucleotide
ctctccccctatctgttgtcaggtccc

SEQ ID NO: 307055 - DNA, 28 bp, Artificial Sequence
  Description of Artificial Sequence: Synthetic oligonucleotide
tctccccctatctgttgtcaggtcccag

SEQ ID NO: 307056 - DNA, 27 bp, Artificial Sequence
  Description of Artificial Sequence: Synthetic oligonucleotide
ctccccctatctgttgtcaggtcccag

SEQ ID NO: 307057 - DNA, 28 bp, Artificial Sequence
  Description of Artificial Sequence: Synthetic oligonucleotide
tccccctatctgttgtcaggtcccagtg

SEQ ID NO: 307058 - DNA, 27 bp, Artificial Sequence
  Description of Artificial Sequence: Synthetic oligonucleotide
ccccctatctgttgtcaggtcccagtg

SEQ ID NO: 307059 - DNA, 28 bp, Artificial Sequence
  Description of Artificial Sequence: Synthetic oligonucleotide
cccctatctgttgtcaggtcccagtgac

SEQ ID NO: 307060 - DNA, 28 bp, Artificial Sequence
  Description of Artificial Sequence: Synthetic oligonucleotide
ccctatctgttgtcaggtcccagtgacg

SEQ ID NO: 307061 - DNA, 28 bp, Artificial Sequence
  Description of Artificial Sequence: Synthetic oligonucleotide
cctatctgttgtcaggtcccagtgacgc

SEQ ID NO: 307062 - DNA, 29 bp, Artificial Sequence
  Description of Artificial Sequence: Synthetic oligonucleotide
ctatctgttgtcaggtcccagtgacgctc

SEQ ID NO: 307063 - DNA, 30 bp, Artificial Sequence
  Description of Artificial Sequence: Synthetic oligonucleotide
tatctgttgtcaggtcccagtgacgctctg

SEQ ID NO: 307064 - DNA, 29 bp, Artificial Sequence
  Description of Artificial Sequence: Synthetic oligonucleotide
atctgttgtcaggtcccagtgacgctctg

SEQ ID NO: 307065 - DNA, 28 bp, Artificial Sequence
  Description of Artificial Sequence: Synthetic oligonucleotide
tctgttgtcaggtcccagtgacgctctg

SEQ ID NO: 307066 - DNA, 27 bp, Artificial Sequence
  Description of Artificial Sequence: Synthetic oligonucleotide
ctgttgtcaggtcccagtgacgctctg

SEQ ID NO: 307067 - DNA, 27 bp, Artificial Sequence
  Description of Artificial Sequence: Synthetic oligonucleotide
tgttgtcaggtcccagtgacgctctgg

SEQ ID NO: 307068 - DNA, 27 bp, Artificial Sequence
  Description of Artificial Sequence: Synthetic oligonucleotide
gttgtcaggtcccagtgacgctctgga

SEQ ID NO: 307069 - DNA, 27 bp, Artificial Sequence
  Description of Artificial Sequence: Synthetic oligonucleotide
ttgtcaggtcccagtgacgctctggac

SEQ ID NO: 307070 - DNA, 27 bp, Artificial Sequence
  Description of Artificial Sequence: Synthetic oligonucleotide
tgtcaggtcccagtgacgctctggaca

SEQ ID NO: 307071 - DNA, 27 bp, Artificial Sequence
  Description of Artificial Sequence: Synthetic oligonucleotide
gtcaggtcccagtgacgctctggacaa

SEQ ID NO: 307072 - DNA, 27 bp, Artificial Sequence
  Description of Artificial Sequence: Synthetic oligonucleotide
tcaggtcccagtgacgctctggacaac

SEQ ID NO: 307073 - DNA, 26 bp, Artificial Sequence
  Description of Artificial Sequence: Synthetic oligonucleotide
caggtcccagtgacgctctggacaac

SEQ ID NO: 307074 - DNA, 27 bp, Artificial Sequence
  Description of Artificial Sequence: Synthetic oligonucleotide
aggtcccagtgacgctctggacaacgt

SEQ ID NO: 307075 - DNA, 26 bp, Artificial Sequence
  Description of Artificial Sequence: Synthetic oligonucleotide
ggtcccagtgacgctctggacaacgt

SEQ ID NO: 307076 - DNA, 27 bp, Artificial Sequence
  Description of Artificial Sequence: Synthetic oligonucleotide
gtcccagtgacgctctggacaacgtga

SEQ ID NO: 307077 - DNA, 28 bp, Artificial Sequence
  Description of Artificial Sequence: Synthetic oligonucleotide
tcccagtgacgctctggacaacgtgatc

SEQ ID NO: 307078 - DNA, 27 bp, Artificial Sequence
  Description of Artificial Sequence: Synthetic oligonucleotide
cccagtgacgctctggacaacgtgatc

SEQ ID NO: 307079 - DNA, 28 bp, Artificial Sequence
  Description of Artificial Sequence: Synthetic oligonucleotide
ccagtgacgctctggacaacgtgatcac

SEQ ID NO: 307080 - DNA, 29 bp, Artificial Sequence
  Description of Artificial Sequence: Synthetic oligonucleotide
cagtgacgctctggacaacgtgatcacac

SEQ ID NO: 307081 - DNA, 29 bp, Artificial Sequence
  Description of Artificial Sequence: Synthetic oligonucleotide
agtgacgctctggacaacgtgatcacacg

SEQ ID NO: 307082 - DNA, 28 bp, Artificial Sequence
  Description of Artificial Sequence: Synthetic oligonucleotide
gtgacgctctggacaacgtgatcacacg

SEQ ID NO: 307083 - DNA, 29 bp, Artificial Sequence
  Description of Artificial Sequence: Synthetic oligonucleotide
tgacgctctggacaacgtgatcacacgtc

SEQ ID NO: 307084 - DNA, 28 bp, Artificial Sequence
  Description of Artificial Sequence: Synthetic oligonucleotide
gacgctctggacaacgtgatcacacgtc

SEQ ID NO: 307085 - DNA, 33 bp, Artificial Sequence
  Description of Artificial Sequence: Synthetic oligonucleotide
acgctctggacaacgtgatcacacgtctatatc

SEQ ID NO: 307086 - DNA, 32 bp, Artificial Sequence
  Description of Artificial Sequence: Synthetic oligonucleotide
cgctctggacaacgtgatcacacgtctatatc

SEQ ID NO: 307087 - DNA, 33 bp, Artificial Sequence
  Description of Artificial Sequence: Synthetic oligonucleotide
gctctggacaacgtgatcacacgtctatatcag

SEQ ID NO: 307088 - DNA, 36 bp, Artificial Sequence
  Description of Artificial Sequence: Synthetic oligonucleotide
ctctggacaacgtgatcacacgtctatatcagaaac

SEQ ID NO: 307089 - DNA, 36 bp, Artificial Sequence
  Description of Artificial Sequence: Synthetic oligonucleotide
tctggacaacgtgatcacacgtctatatcagaaacc

SEQ ID NO: 307090 - DNA, 35 bp, Artificial Sequence
  Description of Artificial Sequence: Synthetic oligonucleotide
ctggacaacgtgatcacacgtctatatcagaaacc

SEQ ID NO: 307091 - DNA, 37 bp, Artificial Sequence
  Description of Artificial Sequence: Synthetic oligonucleotide
tggacaacgtgatcacacgtctatatcagaaaccttg

SEQ ID NO: 307092 - DNA, 36 bp, Artificial Sequence
  Description of Artificial Sequence: Synthetic oligonucleotide
ggacaacgtgatcacacgtctatatcagaaaccttg

SEQ ID NO: 307093 - DNA, 37 bp, Artificial Sequence
  Description of Artificial Sequence: Synthetic oligonucleotide
gacaacgtgatcacacgtctatatcagaaaccttgtc

SEQ ID NO: 307094 - DNA, 38 bp, Artificial Sequence
  Description of Artificial Sequence: Synthetic oligonucleotide
acaacgtgatcacacgtctatatcagaaaccttgtctc

SEQ ID NO: 307095 - DNA, 37 bp, Artificial Sequence
  Description of Artificial Sequence: Synthetic oligonucleotide
caacgtgatcacacgtctatatcagaaaccttgtctc

SEQ ID NO: 307096 - DNA, 38 bp, Artificial Sequence
  Description of Artificial Sequence: Synthetic oligonucleotide
aacgtgatcacacgtctatatcagaaaccttgtctctc

SEQ ID NO: 307097 - DNA, 37 bp, Artificial Sequence
  Description of Artificial Sequence: Synthetic oligonucleotide
acgtgatcacacgtctatatcagaaaccttgtctctc

SEQ ID NO: 307098 - DNA, 36 bp, Artificial Sequence
  Description of Artificial Sequence: Synthetic oligonucleotide
cgtgatcacacgtctatatcagaaaccttgtctctc

SEQ ID NO: 307099 - DNA, 37 bp, Artificial Sequence
  Description of Artificial Sequence: Synthetic oligonucleotide
gtgatcacacgtctatatcagaaaccttgtctctcag

SEQ ID NO: 307100 - DNA, 37 bp, Artificial Sequence
  Description of Artificial Sequence: Synthetic oligonucleotide
tgatcacacgtctatatcagaaaccttgtctctcagg

SEQ ID NO: 307101 - DNA, 36 bp, Artificial Sequence
  Description of Artificial Sequence: Synthetic oligonucleotide
gatcacacgtctatatcagaaaccttgtctctcagg

SEQ ID NO: 307102 - DNA, 36 bp, Artificial Sequence
  Description of Artificial Sequence: Synthetic oligonucleotide
atcacacgtctatatcagaaaccttgtctctcaggc

SEQ ID NO: 307103 - DNA, 35 bp, Artificial Sequence
  Description of Artificial Sequence: Synthetic oligonucleotide
tcacacgtctatatcagaaaccttgtctctcaggc

SEQ ID NO: 307104 - DNA, 34 bp, Artificial Sequence
  Description of Artificial Sequence: Synthetic oligonucleotide
cacacgtctatatcagaaaccttgtctctcaggc

SEQ ID NO: 307105 - DNA, 34 bp, Artificial Sequence
  Description of Artificial Sequence: Synthetic oligonucleotide
acacgtctatatcagaaaccttgtctctcaggcc

SEQ ID NO: 307106 - DNA, 33 bp, Artificial Sequence
  Description of Artificial Sequence: Synthetic oligonucleotide
cacgtctatatcagaaaccttgtctctcaggcc

SEQ ID NO: 307107 - DNA, 34 bp, Artificial Sequence
  Description of Artificial Sequence: Synthetic oligonucleotide
acgtctatatcagaaaccttgtctctcaggccag

SEQ ID NO: 307108 - DNA, 33 bp, Artificial Sequence
  Description of Artificial Sequence: Synthetic oligonucleotide
cgtctatatcagaaaccttgtctctcaggccag

SEQ ID NO: 307109 - DNA, 33 bp, Artificial Sequence
  Description of Artificial Sequence: Synthetic oligonucleotide
gtctatatcagaaaccttgtctctcaggccagc

SEQ ID NO: 307110 - DNA, 33 bp, Artificial Sequence
  Description of Artificial Sequence: Synthetic oligonucleotide
tctatatcagaaaccttgtctctcaggccagcc

SEQ ID NO: 307111 - DNA, 32 bp, Artificial Sequence
  Description of Artificial Sequence: Synthetic oligonucleotide
ctatatcagaaaccttgtctctcaggccagcc

SEQ ID NO: 307112 - DNA, 32 bp, Artificial Sequence
  Description of Artificial Sequence: Synthetic oligonucleotide
tatatcagaaaccttgtctctcaggccagccg

SEQ ID NO: 307113 - DNA, 31 bp, Artificial Sequence
  Description of Artificial Sequence: Synthetic oligonucleotide
atatcagaaaccttgtctctcaggccagccg

SEQ ID NO: 307114 - DNA, 30 bp, Artificial Sequence
  Description of Artificial Sequence: Synthetic oligonucleotide
tatcagaaaccttgtctctcaggccagccg

SEQ ID NO: 307115 - DNA, 29 bp, Artificial Sequence
  Description of Artificial Sequence: Synthetic oligonucleotide
atcagaaaccttgtctctcaggccagccg

SEQ ID NO: 307116 - DNA, 28 bp, Artificial Sequence
  Description of Artificial Sequence: Synthetic oligonucleotide
tcagaaaccttgtctctcaggccagccg

SEQ ID NO: 307117 - DNA, 27 bp, Artificial Sequence
  Description of Artificial Sequence: Synthetic oligonucleotide
cagaaaccttgtctctcaggccagccg

SEQ ID NO: 307118 - DNA, 27 bp, Artificial Sequence
  Description of Artificial Sequence: Synthetic oligonucleotide
agaaaccttgtctctcaggccagccgg

SEQ ID NO: 307119 - DNA, 26 bp, Artificial Sequence
  Description of Artificial Sequence: Synthetic oligonucleotide
gaaaccttgtctctcaggccagccgg

SEQ ID NO: 307120 - DNA, 26 bp, Artificial Sequence
  Description of Artificial Sequence: Synthetic oligonucleotide
aaaccttgtctctcaggccagccggg

SEQ ID NO: 307121 - DNA, 25 bp, Artificial Sequence
  Description of Artificial Sequence: Synthetic oligonucleotide
aaccttgtctctcaggccagccggg

SEQ ID NO: 307122 - DNA, 24 bp, Artificial Sequence
  Description of Artificial Sequence: Synthetic oligonucleotide
accttgtctctcaggccagccggg

SEQ ID NO: 307123 - DNA, 23 bp, Artificial Sequence
  Description of Artificial Sequence: Synthetic oligonucleotide
ccttgtctctcaggccagccggg

SEQ ID NO: 307124 - DNA, 23 bp, Artificial Sequence
  Description of Artificial Sequence: Synthetic oligonucleotide
cttgtctctcaggccagccgggc

SEQ ID NO: 307125 - DNA, 23 bp, Artificial Sequence
  Description of Artificial Sequence: Synthetic oligonucleotide
ttgtctctcaggccagccgggcg

SEQ ID NO: 307126 - DNA, 22 bp, Artificial Sequence
  Description of Artificial Sequence: Synthetic oligonucleotide
tgtctctcaggccagccgggcg

SEQ ID NO: 307127 - DNA, 21 bp, Artificial Sequence
  Description of Artificial Sequence: Synthetic oligonucleotide
gtctctcaggccagccgggcg

SEQ ID NO: 307128 - DNA, 21 bp, Artificial Sequence
  Description of Artificial Sequence: Synthetic oligonucleotide
tctctcaggccagccgggcgc

SEQ ID NO: 307129 - DNA, 20 bp, Artificial Sequence
  Description of Artificial Sequence: Synthetic oligonucleotide
ctctcaggccagccgggcgc

SEQ ID NO: 307130 - DNA, 21 bp, Artificial Sequence
  Description of Artificial Sequence: Synthetic oligonucleotide
tctcaggccagccgggcgcca

SEQ ID NO: 307131 - DNA, 20 bp, Artificial Sequence
  Description of Artificial Sequence: Synthetic oligonucleotide
ctcaggccagccgggcgcca

SEQ ID NO: 307132 - DNA, 20 bp, Artificial Sequence
  Description of Artificial Sequence: Synthetic oligonucleotide
tcaggccagccgggcgccac

SEQ ID NO: 307133 - DNA, 20 bp, Artificial Sequence
  Description of Artificial Sequence: Synthetic oligonucleotide
caggccagccgggcgccact

SEQ ID NO: 307134 - DNA, 20 bp, Artificial Sequence
  Description of Artificial Sequence: Synthetic oligonucleotide
aggccagccgggcgccacgt

SEQ ID NO: 307135 - DNA, 20 bp, Artificial Sequence
  Description of Artificial Sequence: Synthetic oligonucleotide
ggccagccgggcgccacgtt

SEQ ID NO: 307136 - DNA, 20 bp, Artificial Sequence
  Description of Artificial Sequence: Synthetic oligonucleotide
gccagccgggcgccacggta

SEQ ID NO: 307137 - DNA, 21 bp, Artificial Sequence
  Description of Artificial Sequence: Synthetic oligonucleotide
ccagccgggcgccacggtaca

SEQ ID NO: 307138 - DNA, 21 bp, Artificial Sequence
  Description of Artificial Sequence: Synthetic oligonucleotide
cagccgggcgccacggtacag

SEQ ID NO: 307139 - DNA, 21 bp, Artificial Sequence
  Description of Artificial Sequence: Synthetic oligonucleotide
agccgggcgccacggtacagg

SEQ ID NO: 307140 - DNA, 20 bp, Artificial Sequence
  Description of Artificial Sequence: Synthetic oligonucleotide
gccgggcgccacggtacagg

SEQ ID NO: 307141 - DNA, 21 bp, Artificial Sequence
  Description of Artificial Sequence: Synthetic oligonucleotide
ccgggcgccacggtacaggca

SEQ ID NO: 307142 - DNA, 21 bp, Artificial Sequence
  Description of Artificial Sequence: Synthetic oligonucleotide
cgggcgccacggtacaggcag

SEQ ID NO: 307143 - DNA, 22 bp, Artificial Sequence
  Description of Artificial Sequence: Synthetic oligonucleotide
gggcgccacggtacaggcagga

SEQ ID NO: 307144 - DNA, 23 bp, Artificial Sequence
  Description of Artificial Sequence: Synthetic oligonucleotide
ggcgccacggtacaggcaggaga

SEQ ID NO: 307145 - DNA, 25 bp, Artificial Sequence
  Description of Artificial Sequence: Synthetic oligonucleotide
gcgccacggtacaggcaggagacaa

SEQ ID NO: 307146 - DNA, 25 bp, Artificial Sequence
  Description of Artificial Sequence: Synthetic oligonucleotide
cgccacggtacaggcaggagacaac

SEQ ID NO: 307147 - DNA, 26 bp, Artificial Sequence
  Description of Artificial Sequence: Synthetic oligonucleotide
gccacggtacaggcaggagacaacgt

SEQ ID NO: 307148 - DNA, 27 bp, Artificial Sequence
  Description of Artificial Sequence: Synthetic oligonucleotide
ccacggtacaggcaggagacaacgtga

SEQ ID NO: 307149 - DNA, 27 bp, Artificial Sequence
  Description of Artificial Sequence: Synthetic oligonucleotide
cacggtacaggcaggagacaacgtgac

SEQ ID NO: 307150 - DNA, 27 bp, Artificial Sequence
  Description of Artificial Sequence: Synthetic oligonucleotide
acggtacaggcaggagacaacgtgacc

SEQ ID NO: 307151 - DNA, 27 bp, Artificial Sequence
  Description of Artificial Sequence: Synthetic oligonucleotide
cggtacaggcaggagacaacgtgacca

SEQ ID NO: 307152 - DNA, 28 bp, Artificial Sequence
  Description of Artificial Sequence: Synthetic oligonucleotide
ggtacaggcaggagacaacgtgaccatg

SEQ ID NO: 307153 - DNA, 29 bp, Artificial Sequence
  Description of Artificial Sequence: Synthetic oligonucleotide
gtacaggcaggagacaacgtgaccatgtc

SEQ ID NO: 307154 - DNA, 29 bp, Artificial Sequence
  Description of Artificial Sequence: Synthetic oligonucleotide
tacaggcaggagacaacgtgaccatgtcc

SEQ ID NO: 307155 - DNA, 28 bp, Artificial Sequence
  Description of Artificial Sequence: Synthetic oligonucleotide
acaggcaggagacaacgtgaccatgtcc

SEQ ID NO: 307156 - DNA, 27 bp, Artificial Sequence
  Description of Artificial Sequence: Synthetic oligonucleotide
caggcaggagacaacgtgaccatgtcc

SEQ ID NO: 307157 - DNA, 28 bp, Artificial Sequence
  Description of Artificial Sequence: Synthetic oligonucleotide
aggcaggagacaacgtgaccatgtcctg

SEQ ID NO: 307158 - DNA, 27 bp, Artificial Sequence
  Description of Artificial Sequence: Synthetic oligonucleotide
ggcaggagacaacgtgaccatgtcctg

SEQ ID NO: 307159 - DNA, 27 bp, Artificial Sequence
  Description of Artificial Sequence: Synthetic oligonucleotide
gcaggagacaacgtgaccatgtcctgc

SEQ ID NO: 307160 - DNA, 28 bp, Artificial Sequence
  Description of Artificial Sequence: Synthetic oligonucleotide
caggagacaacgtgaccatgtcctgcac

SEQ ID NO: 307161 - DNA, 28 bp, Artificial Sequence
  Description of Artificial Sequence: Synthetic oligonucleotide
aggagacaacgtgaccatgtcctgcacc

SEQ ID NO: 307162 - DNA, 27 bp, Artificial Sequence
  Description of Artificial Sequence: Synthetic oligonucleotide
ggagacaacgtgaccatgtcctgcacc

SEQ ID NO: 307163 - DNA, 28 bp, Artificial Sequence
  Description of Artificial Sequence: Synthetic oligonucleotide
gagacaacgtgaccatgtcctgcacctc

SEQ ID NO: 307164 - DNA, 28 bp, Artificial Sequence
  Description of Artificial Sequence: Synthetic oligonucleotide
agacaacgtgaccatgtcctgcacctcc

SEQ ID NO: 307165 - DNA, 27 bp, Artificial Sequence
  Description of Artificial Sequence: Synthetic oligonucleotide
gacaacgtgaccatgtcctgcacctcc

SEQ ID NO: 307166 - DNA, 27 bp, Artificial Sequence
  Description of Artificial Sequence: Synthetic oligonucleotide
acaacgtgaccatgtcctgcacctccc

SEQ ID NO: 307167 - DNA, 26 bp, Artificial Sequence
  Description of Artificial Sequence: Synthetic oligonucleotide
caacgtgaccatgtcctgcacctccc

SEQ ID NO: 307168 - DNA, 26 bp, Artificial Sequence
  Description of Artificial Sequence: Synthetic oligonucleotide
aacgtgaccatgtcctgcacctcccg

SEQ ID NO: 307169 - DNA, 25 bp, Artificial Sequence
  Description of Artificial Sequence: Synthetic oligonucleotide
acgtgaccatgtcctgcacctcccg

SEQ ID NO: 307170 - DNA, 24 bp, Artificial Sequence
  Description of Artificial Sequence: Synthetic oligonucleotide
cgtgaccatgtcctgcacctcccg

SEQ ID NO: 307171 - DNA, 25 bp, Artificial Sequence
  Description of Artificial Sequence: Synthetic oligonucleotide
gtgaccatgtcctgcacctcccgga

SEQ ID NO: 307172 - DNA, 25 bp, Artificial Sequence
  Description of Artificial Sequence: Synthetic oligonucleotide
tgaccatgtcctgcacctcccggag

SEQ ID NO: 307173 - DNA, 24 bp, Artificial Sequence
  Description of Artificial Sequence: Synthetic oligonucleotide
gaccatgtcctgcacctcccggag

SEQ ID NO: 307174 - DNA, 25 bp, Artificial Sequence
  Description of Artificial Sequence: Synthetic oligonucleotide
accatgtcctgcacctcccggaggt

SEQ ID NO: 307175 - DNA, 24 bp, Artificial Sequence
  Description of Artificial Sequence: Synthetic oligonucleotide
ccatgtcctgcacctcccggaggt

SEQ ID NO: 307176 - DNA, 24 bp, Artificial Sequence
  Description of Artificial Sequence: Synthetic oligonucleotide
catgtcctgcacctcccggaggtc

SEQ ID NO: 307177 - DNA, 27 bp, Artificial Sequence
  Description of Artificial Sequence: Synthetic oligonucleotide
atgtcctgcacctcccggaggtcctat

SEQ ID NO: 307178 - DNA, 26 bp, Artificial Sequence
  Description of Artificial Sequence: Synthetic oligonucleotide
tgtcctgcacctcccggaggtcctat

SEQ ID NO: 307179 - DNA, 25 bp, Artificial Sequence
  Description of Artificial Sequence: Synthetic oligonucleotide
gtcctgcacctcccggaggtcctat

SEQ ID NO: 307180 - DNA, 26 bp, Artificial Sequence
  Description of Artificial Sequence: Synthetic oligonucleotide
tcctgcacctcccggaggtcctatga

SEQ ID NO: 307181 - DNA, 25 bp, Artificial Sequence
  Description of Artificial Sequence: Synthetic oligonucleotide
cctgcacctcccggaggtcctatga

SEQ ID NO: 307182 - DNA, 27 bp, Artificial Sequence
  Description of Artificial Sequence: Synthetic oligonucleotide
ctgcacctcccggaggtcctatgactt

SEQ ID NO: 307183 - DNA, 27 bp, Artificial Sequence
  Description of Artificial Sequence: Synthetic oligonucleotide
tgcacctcccggaggtcctatgacttg

SEQ ID NO: 307184 - DNA, 27 bp, Artificial Sequence
  Description of Artificial Sequence: Synthetic oligonucleotide
gcacctcccggaggtcctatgacttgt

SEQ ID NO: 307185 - DNA, 28 bp, Artificial Sequence
  Description of Artificial Sequence: Synthetic oligonucleotide
cacctcccggaggtcctatgacttgtac

SEQ ID NO: 307186 - DNA, 28 bp, Artificial Sequence
  Description of Artificial Sequence: Synthetic oligonucleotide
acctcccggaggtcctatgacttgtacc

SEQ ID NO: 307187 - DNA, 27 bp, Artificial Sequence
  Description of Artificial Sequence: Synthetic oligonucleotide
cctcccggaggtcctatgacttgtacc

SEQ ID NO: 307188 - DNA, 29 bp, Artificial Sequence
  Description of Artificial Sequence: Synthetic oligonucleotide
ctcccggaggtcctatgacttgtaccatc

SEQ ID NO: 307189 - DNA, 32 bp, Artificial Sequence
  Description of Artificial Sequence: Synthetic oligonucleotide
tcccggaggtcctatgacttgtaccatcaatc

SEQ ID NO: 307190 - DNA, 31 bp, Artificial Sequence
  Description of Artificial Sequence: Synthetic oligonucleotide
cccggaggtcctatgacttgtaccatcaatc

SEQ ID NO: 307191 - DNA, 31 bp, Artificial Sequence
  Description of Artificial Sequence: Synthetic oligonucleotide
ccggaggtcctatgacttgtaccatcaatcc

SEQ ID NO: 307192 - DNA, 32 bp, Artificial Sequence
  Description of Artificial Sequence: Synthetic oligonucleotide
cggaggtcctatgacttgtaccatcaatccag

SEQ ID NO: 307193 - DNA, 32 bp, Artificial Sequence
  Description of Artificial Sequence: Synthetic oligonucleotide
ggaggtcctatgacttgtaccatcaatccagg

SEQ ID NO: 307194 - DNA, 32 bp, Artificial Sequence
  Description of Artificial Sequence: Synthetic oligonucleotide
gaggtcctatgacttgtaccatcaatccaggg

SEQ ID NO: 307195 - DNA, 33 bp, Artificial Sequence
  Description of Artificial Sequence: Synthetic oligonucleotide
aggtcctatgacttgtaccatcaatccagggtg

SEQ ID NO: 307196 - DNA, 32 bp, Artificial Sequence
  Description of Artificial Sequence: Synthetic oligonucleotide
ggtcctatgacttgtaccatcaatccagggtg

SEQ ID NO: 307197 - DNA, 32 bp, Artificial Sequence
  Description of Artificial Sequence: Synthetic oligonucleotide
gtcctatgacttgtaccatcaatccagggtgg

SEQ ID NO: 307198 - DNA, 32 bp, Artificial Sequence
  Description of Artificial Sequence: Synthetic oligonucleotide
tcctatgacttgtaccatcaatccagggtggg

SEQ ID NO: 307199 - DNA, 31 bp, Artificial Sequence
  Description of Artificial Sequence: Synthetic oligonucleotide
cctatgacttgtaccatcaatccagggtggg

SEQ ID NO: 307200 - DNA, 31 bp, Artificial Sequence
  Description of Artificial Sequence: Synthetic oligonucleotide
ctatgacttgtaccatcaatccagggtgggg

SEQ ID NO: 307201 - DNA, 31 bp, Artificial Sequence
  Description of Artificial Sequence: Synthetic oligonucleotide
tatgacttgtaccatcaatccagggtggggg

SEQ ID NO: 307202 - DNA, 30 bp, Artificial Sequence
  Description of Artificial Sequence: Synthetic oligonucleotide
atgacttgtaccatcaatccagggtggggg

SEQ ID NO: 307203 - DNA, 29 bp, Artificial Sequence
  Description of Artificial Sequence: Synthetic oligonucleotide
tgacttgtaccatcaatccagggtggggg

SEQ ID NO: 307204 - DNA, 28 bp, Artificial Sequence
  Description of Artificial Sequence: Synthetic oligonucleotide
gacttgtaccatcaatccagggtggggg

SEQ ID NO: 307205 - DNA, 29 bp, Artificial Sequence
  Description of Artificial Sequence: Synthetic oligonucleotide
acttgtaccatcaatccagggtgggggag

SEQ ID NO: 307206 - DNA, 28 bp, Artificial Sequence
  Description of Artificial Sequence: Synthetic oligonucleotide
cttgtaccatcaatccagggtgggggag

SEQ ID NO: 307207 - DNA, 28 bp, Artificial Sequence
  Description of Artificial Sequence: Synthetic oligonucleotide
ttgtaccatcaatccagggtgggggagg

SEQ ID NO: 307208 - DNA, 27 bp, Artificial Sequence
  Description of Artificial Sequence: Synthetic oligonucleotide
tgtaccatcaatccagggtgggggagg

SEQ ID NO: 307209 - DNA, 26 bp, Artificial Sequence
  Description of Artificial Sequence: Synthetic oligonucleotide
gtaccatcaatccagggtgggggagg

SEQ ID NO: 307210 - DNA, 26 bp, Artificial Sequence
  Description of Artificial Sequence: Synthetic oligonucleotide
taccatcaatccagggtgggggaggg

SEQ ID NO: 307211 - DNA, 25 bp, Artificial Sequence
  Description of Artificial Sequence: Synthetic oligonucleotide
accatcaatccagggtgggggaggg

SEQ ID NO: 307212 - DNA, 24 bp, Artificial Sequence
  Description of Artificial Sequence: Synthetic oligonucleotide
ccatcaatccagggtgggggaggg

SEQ ID NO: 307213 - DNA, 24 bp, Artificial Sequence
  Description of Artificial Sequence: Synthetic oligonucleotide
catcaatccagggtgggggagggc

SEQ ID NO: 307214 - DNA, 26 bp, Artificial Sequence
  Description of Artificial Sequence: Synthetic oligonucleotide
atcaatccagggtgggggagggccat

SEQ ID NO: 307215 - DNA, 25 bp, Artificial Sequence
  Description of Artificial Sequence: Synthetic oligonucleotide
tcaatccagggtgggggagggccat

SEQ ID NO: 307216 - DNA, 24 bp, Artificial Sequence
  Description of Artificial Sequence: Synthetic oligonucleotide
caatccagggtgggggagggccat

SEQ ID NO: 307217 - DNA, 26 bp, Artificial Sequence
  Description of Artificial Sequence: Synthetic oligonucleotide
aatccagggtgggggagggccatgaa

SEQ ID NO: 307218 - DNA, 25 bp, Artificial Sequence
  Description of Artificial Sequence: Synthetic oligonucleotide
atccagggtgggggagggccatgaa

SEQ ID NO: 307219 - DNA, 24 bp, Artificial Sequence
  Description of Artificial Sequence: Synthetic oligonucleotide
tccagggtgggggagggccatgaa

SEQ ID NO: 307220 - DNA, 23 bp, Artificial Sequence
  Description of Artificial Sequence: Synthetic oligonucleotide
ccagggtgggggagggccatgaa

SEQ ID NO: 307221 - DNA, 23 bp, Artificial Sequence
  Description of Artificial Sequence: Synthetic oligonucleotide
cagggtgggggagggccatgaac

SEQ ID NO: 307222 - DNA, 25 bp, Artificial Sequence
  Description of Artificial Sequence: Synthetic oligonucleotide
agggtgggggagggccatgaacgta

SEQ ID NO: 307223 - DNA, 24 bp, Artificial Sequence
  Description of Artificial Sequence: Synthetic oligonucleotide
gggtgggggagggccatgaacgta

SEQ ID NO: 307224 - DNA, 24 bp, Artificial Sequence
  Description of Artificial Sequence: Synthetic oligonucleotide
ggtgggggagggccatgaacgtac

SEQ ID NO: 307225 - DNA, 24 bp, Artificial Sequence
  Description of Artificial Sequence: Synthetic oligonucleotide
gtgggggagggccatgaacgtacg

SEQ ID NO: 307226 - DNA, 25 bp, Artificial Sequence
  Description of Artificial Sequence: Synthetic oligonucleotide
tgggggagggccatgaacgtacgct

SEQ ID NO: 307227 - DNA, 24 bp, Artificial Sequence
  Description of Artificial Sequence: Synthetic oligonucleotide
gggggagggccatgaacgtacgct

SEQ ID NO: 307228 - DNA, 24 bp, Artificial Sequence
  Description of Artificial Sequence: Synthetic oligonucleotide
ggggagggccatgaacgtacgctc

SEQ ID NO: 307229 - DNA, 24 bp, Artificial Sequence
  Description of Artificial Sequence: Synthetic oligonucleotide
gggagggccatgaacgtacgctcc

SEQ ID NO: 307230 - DNA, 25 bp, Artificial Sequence
  Description of Artificial Sequence: Synthetic oligonucleotide
ggagggccatgaacgtacgctccct

SEQ ID NO: 307231 - DNA, 25 bp, Artificial Sequence
  Description of Artificial Sequence: Synthetic oligonucleotide
gagggccatgaacgtacgctccctg

SEQ ID NO: 307232 - DNA, 26 bp, Artificial Sequence
  Description of Artificial Sequence: Synthetic oligonucleotide
agggccatgaacgtacgctccctgga

SEQ ID NO: 307233 - DNA, 25 bp, Artificial Sequence
  Description of Artificial Sequence: Synthetic oligonucleotide
gggccatgaacgtacgctccctgga

SEQ ID NO: 307234 - DNA, 26 bp, Artificial Sequence
  Description of Artificial Sequence: Synthetic oligonucleotide
ggccatgaacgtacgctccctggagt

SEQ ID NO: 307235 - DNA, 26 bp, Artificial Sequence
  Description of Artificial Sequence: Synthetic oligonucleotide
gccatgaacgtacgctccctggagtg

SEQ ID NO: 307236 - DNA, 26 bp, Artificial Sequence
  Description of Artificial Sequence: Synthetic oligonucleotide
ccatgaacgtacgctccctggagtgc

SEQ ID NO: 307237 - DNA, 26 bp, Artificial Sequence
  Description of Artificial Sequence: Synthetic oligonucleotide
catgaacgtacgctccctggagtgcc

SEQ ID NO: 307238 - DNA, 27 bp, Artificial Sequence
  Description of Artificial Sequence: Synthetic oligonucleotide
atgaacgtacgctccctggagtgccca

SEQ ID NO: 307239 - DNA, 27 bp, Artificial Sequence
  Description of Artificial Sequence: Synthetic oligonucleotide
tgaacgtacgctccctggagtgcccaa

SEQ ID NO: 307240 - DNA, 26 bp, Artificial Sequence
  Description of Artificial Sequence: Synthetic oligonucleotide
gaacgtacgctccctggagtgcccaa

SEQ ID NO: 307241 - DNA, 26 bp, Artificial Sequence
  Description of Artificial Sequence: Synthetic oligonucleotide
aacgtacgctccctggagtgcccaag

SEQ ID NO: 307242 - DNA, 25 bp, Artificial Sequence
  Description of Artificial Sequence: Synthetic oligonucleotide
acgtacgctccctggagtgcccaag

SEQ ID NO: 307243 - DNA, 24 bp, Artificial Sequence
  Description of Artificial Sequence: Synthetic oligonucleotide
cgtacgctccctggagtgcccaag

SEQ ID NO: 307244 - DNA, 25 bp, Artificial Sequence
  Description of Artificial Sequence: Synthetic oligonucleotide
gtacgctccctggagtgcccaagga

SEQ ID NO: 307245 - DNA, 27 bp, Artificial Sequence
  Description of Artificial Sequence: Synthetic oligonucleotide
tacgctccctggagtgcccaaggacaa

SEQ ID NO: 307246 - DNA, 26 bp, Artificial Sequence
  Description of Artificial Sequence: Synthetic oligonucleotide
acgctccctggagtgcccaaggacaa

SEQ ID NO: 307247 - DNA, 25 bp, Artificial Sequence
  Description of Artificial Sequence: Synthetic oligonucleotide
cgctccctggagtgcccaaggacaa

SEQ ID NO: 307248 - DNA, 25 bp, Artificial Sequence
  Description of Artificial Sequence: Synthetic oligonucleotide
gctccctggagtgcccaaggacaac

SEQ ID NO: 307249 - DNA, 25 bp, Artificial Sequence
  Description of Artificial Sequence: Synthetic oligonucleotide
ctccctggagtgcccaaggacaacg

SEQ ID NO: 307250 - DNA, 27 bp, Artificial Sequence
  Description of Artificial Sequence: Synthetic oligonucleotide
tccctggagtgcccaaggacaacggaa

SEQ ID NO: 307251 - DNA, 26 bp, Artificial Sequence
  Description of Artificial Sequence: Synthetic oligonucleotide
ccctggagtgcccaaggacaacggaa

SEQ ID NO: 307252 - DNA, 27 bp, Artificial Sequence
  Description of Artificial Sequence: Synthetic oligonucleotide
cctggagtgcccaaggacaacggaaga

SEQ ID NO: 307253 - DNA, 29 bp, Artificial Sequence
  Description of Artificial Sequence: Synthetic oligonucleotide
ctggagtgcccaaggacaacggaagattc

SEQ ID NO: 307254 - DNA, 29 bp, Artificial Sequence
  Description of Artificial Sequence: Synthetic oligonucleotide
tggagtgcccaaggacaacggaagattcc

SEQ ID NO: 307255 - DNA, 28 bp, Artificial Sequence
  Description of Artificial Sequence: Synthetic oligonucleotide
ggagtgcccaaggacaacggaagattcc

SEQ ID NO: 307256 - DNA, 29 bp, Artificial Sequence
  Description of Artificial Sequence: Synthetic oligonucleotide
gagtgcccaaggacaacggaagattccag

SEQ ID NO: 307257 - DNA, 29 bp, Artificial Sequence
  Description of Artificial Sequence: Synthetic oligonucleotide
agtgcccaaggacaacggaagattccagg

SEQ ID NO: 307258 - DNA, 28 bp, Artificial Sequence
  Description of Artificial Sequence: Synthetic oligonucleotide
gtgcccaaggacaacggaagattccagg

SEQ ID NO: 307259 - DNA, 28 bp, Artificial Sequence
  Description of Artificial Sequence: Synthetic oligonucleotide
tgcccaaggacaacggaagattccaggg

SEQ ID NO: 307260 - DNA, 27 bp, Artificial Sequence
  Description of Artificial Sequence: Synthetic oligonucleotide
gcccaaggacaacggaagattccaggg

SEQ ID NO: 307261 - DNA, 27 bp, Artificial Sequence
  Description of Artificial Sequence: Synthetic oligonucleotide
cccaaggacaacggaagattccagggc

SEQ ID NO: 307262 - DNA, 27 bp, Artificial Sequence
  Description of Artificial Sequence: Synthetic oligonucleotide
ccaaggacaacggaagattccagggcg

SEQ ID NO: 307263 - DNA, 28 bp, Artificial Sequence
  Description of Artificial Sequence: Synthetic oligonucleotide
caaggacaacggaagattccagggcgac

SEQ ID NO: 307264 - DNA, 31 bp, Artificial Sequence
  Description of Artificial Sequence: Synthetic oligonucleotide
aaggacaacggaagattccagggcgactttc

SEQ ID NO: 307265 - DNA, 30 bp, Artificial Sequence
  Description of Artificial Sequence: Synthetic oligonucleotide
aggacaacggaagattccagggcgactttc

SEQ ID NO: 307266 - DNA, 29 bp, Artificial Sequence
  Description of Artificial Sequence: Synthetic oligonucleotide
ggacaacggaagattccagggcgactttc

SEQ ID NO: 307267 - DNA, 29 bp, Artificial Sequence
  Description of Artificial Sequence: Synthetic oligonucleotide
gacaacggaagattccagggcgactttcc

SEQ ID NO: 307268 - DNA, 30 bp, Artificial Sequence
  Description of Artificial Sequence: Synthetic oligonucleotide
acaacggaagattccagggcgactttccac

SEQ ID NO: 307269 - DNA, 29 bp, Artificial Sequence
  Description of Artificial Sequence: Synthetic oligonucleotide
caacggaagattccagggcgactttccac

SEQ ID NO: 307270 - DNA, 30 bp, Artificial Sequence
  Description of Artificial Sequence: Synthetic oligonucleotide
aacggaagattccagggcgactttccactg

SEQ ID NO: 307271 - DNA, 29 bp, Artificial Sequence
  Description of Artificial Sequence: Synthetic oligonucleotide
acggaagattccagggcgactttccactg

SEQ ID NO: 307272 - DNA, 28 bp, Artificial Sequence
  Description of Artificial Sequence: Synthetic oligonucleotide
cggaagattccagggcgactttccactg

SEQ ID NO: 307273 - DNA, 28 bp, Artificial Sequence
  Description of Artificial Sequence: Synthetic oligonucleotide
ggaagattccagggcgactttccactgg

SEQ ID NO: 307274 - DNA, 28 bp, Artificial Sequence
  Description of Artificial Sequence: Synthetic oligonucleotide
gaagattccagggcgactttccactggg

SEQ ID NO: 307275 - DNA, 28 bp, Artificial Sequence
  Description of Artificial Sequence: Synthetic oligonucleotide
aagattccagggcgactttccactgggc

SEQ ID NO: 307276 - DNA, 27 bp, Artificial Sequence
  Description of Artificial Sequence: Synthetic oligonucleotide
agattccagggcgactttccactgggc

SEQ ID NO: 307277 - DNA, 26 bp, Artificial Sequence
  Description of Artificial Sequence: Synthetic oligonucleotide
gattccagggcgactttccactgggc

SEQ ID NO: 307278 - DNA, 26 bp, Artificial Sequence
  Description of Artificial Sequence: Synthetic oligonucleotide
attccagggcgactttccactgggcc

SEQ ID NO: 307279 - DNA, 25 bp, Artificial Sequence
  Description of Artificial Sequence: Synthetic oligonucleotide
ttccagggcgactttccactgggcc

SEQ ID NO: 307280 - DNA, 24 bp, Artificial Sequence
  Description of Artificial Sequence: Synthetic oligonucleotide
tccagggcgactttccactgggcc

SEQ ID NO: 307281 - DNA, 23 bp, Artificial Sequence
  Description of Artificial Sequence: Synthetic oligonucleotide
ccagggcgactttccactgggcc

SEQ ID NO: 307282 - DNA, 24 bp, Artificial Sequence
  Description of Artificial Sequence: Synthetic oligonucleotide
cagggcgactttccactgggccct

SEQ ID NO: 307283 - DNA, 24 bp, Artificial Sequence
  Description of Artificial Sequence: Synthetic oligonucleotide
agggcgactttccactgggccctc

SEQ ID NO: 307284 - DNA, 23 bp, Artificial Sequence
  Description of Artificial Sequence: Synthetic oligonucleotide
gggcgactttccactgggccctc

SEQ ID NO: 307285 - DNA, 23 bp, Artificial Sequence
  Description of Artificial Sequence: Synthetic oligonucleotide
ggcgactttccactgggccctcc

SEQ ID NO: 307286 - DNA, 24 bp, Artificial Sequence
  Description of Artificial Sequence: Synthetic oligonucleotide
gcgactttccactgggccctccca

SEQ ID NO: 307287 - DNA, 24 bp, Artificial Sequence
  Description of Artificial Sequence: Synthetic oligonucleotide
cgactttccactgggccctcccac

SEQ ID NO: 307288 - DNA, 24 bp, Artificial Sequence
  Description of Artificial Sequence: Synthetic oligonucleotide
gactttccactgggccctcccacc

SEQ ID NO: 307289 - DNA, 25 bp, Artificial Sequence
  Description of Artificial Sequence: Synthetic oligonucleotide
actttccactgggccctcccaccca

SEQ ID NO: 307290 - DNA, 24 bp, Artificial Sequence
  Description of Artificial Sequence: Synthetic oligonucleotide
ctttccactgggccctcccaccca

SEQ ID NO: 307291 - DNA, 24 bp, Artificial Sequence
  Description of Artificial Sequence: Synthetic oligonucleotide
tttccactgggccctcccacccac

SEQ ID NO: 307292 - DNA, 23 bp, Artificial Sequence
  Description of Artificial Sequence: Synthetic oligonucleotide
ttccactgggccctcccacccac

SEQ ID NO: 307293 - DNA, 22 bp, Artificial Sequence
  Description of Artificial Sequence: Synthetic oligonucleotide
tccactgggccctcccacccac

SEQ ID NO: 307294 - DNA, 21 bp, Artificial Sequence
  Description of Artificial Sequence: Synthetic oligonucleotide
ccactgggccctcccacccac

SEQ ID NO: 307295 - DNA, 21 bp, Artificial Sequence
  Description of Artificial Sequence: Synthetic oligonucleotide
cactgggccctcccacccacg

SEQ ID NO: 307296 - DNA, 22 bp, Artificial Sequence
  Description of Artificial Sequence: Synthetic oligonucleotide
actgggccctcccacccacggt

SEQ ID NO: 307297 - DNA, 21 bp, Artificial Sequence
  Description of Artificial Sequence: Synthetic oligonucleotide
ctgggccctcccacccacggt

SEQ ID NO: 307298 - DNA, 21 bp, Artificial Sequence
  Description of Artificial Sequence: Synthetic oligonucleotide
tgggccctcccacccacggtg

SEQ ID NO: 307299 - DNA, 20 bp, Artificial Sequence
  Description of Artificial Sequence: Synthetic oligonucleotide
gggccctcccacccacggtg

SEQ ID NO: 307300 - DNA, 20 bp, Artificial Sequence
  Description of Artificial Sequence: Synthetic oligonucleotide
ggccctcccacccacggtgg

SEQ ID NO: 307301 - DNA, 21 bp, Artificial Sequence
  Description of Artificial Sequence: Synthetic oligonucleotide
gccctcccacccacggtggga

SEQ ID NO: 307302 - DNA, 21 bp, Artificial Sequence
  Description of Artificial Sequence: Synthetic oligonucleotide
ccctcccacccacggtgggac

SEQ ID NO: 307303 - DNA, 23 bp, Artificial Sequence
  Description of Artificial Sequence: Synthetic oligonucleotide
cctcccacccacggtgggaccta

SEQ ID NO: 307304 - DNA, 24 bp, Artificial Sequence
  Description of Artificial Sequence: Synthetic oligonucleotide
ctcccacccacggtgggacctact

SEQ ID NO: 307305 - DNA, 26 bp, Artificial Sequence
  Description of Artificial Sequence: Synthetic oligonucleotide
tcccacccacggtgggacctactgat

SEQ ID NO: 307306 - DNA, 25 bp, Artificial Sequence
  Description of Artificial Sequence: Synthetic oligonucleotide
cccacccacggtgggacctactgat

SEQ ID NO: 307307 - DNA, 25 bp, Artificial Sequence
  Description of Artificial Sequence: Synthetic oligonucleotide
ccacccacggtgggacctactgatg

SEQ ID NO: 307308 - DNA, 27 bp, Artificial Sequence
  Description of Artificial Sequence: Synthetic oligonucleotide
cacccacggtgggacctactgatgctt

SEQ ID NO: 307309 - DNA, 27 bp, Artificial Sequence
  Description of Artificial Sequence: Synthetic oligonucleotide
acccacggtgggacctactgatgcttc

SEQ ID NO: 307310 - DNA, 26 bp, Artificial Sequence
  Description of Artificial Sequence: Synthetic oligonucleotide
cccacggtgggacctactgatgcttc

SEQ ID NO: 307311 - DNA, 26 bp, Artificial Sequence
  Description of Artificial Sequence: Synthetic oligonucleotide
ccacggtgggacctactgatgcttcg

SEQ ID NO: 307312 - DNA, 26 bp, Artificial Sequence
  Description of Artificial Sequence: Synthetic oligonucleotide
cacggtgggacctactgatgcttcgc

SEQ ID NO: 307313 - DNA, 27 bp, Artificial Sequence
  Description of Artificial Sequence: Synthetic oligonucleotide
acggtgggacctactgatgcttcgcct

SEQ ID NO: 307314 - DNA, 26 bp, Artificial Sequence
  Description of Artificial Sequence: Synthetic oligonucleotide
cggtgggacctactgatgcttcgcct

SEQ ID NO: 307315 - DNA, 27 bp, Artificial Sequence
  Description of Artificial Sequence: Synthetic oligonucleotide
ggtgggacctactgatgcttcgcctct

SEQ ID NO: 307316 - DNA, 29 bp, Artificial Sequence
  Description of Artificial Sequence: Synthetic oligonucleotide
gtgggacctactgatgcttcgcctctttc

SEQ ID NO: 307317 - DNA, 29 bp, Artificial Sequence
  Description of Artificial Sequence: Synthetic oligonucleotide
tgggacctactgatgcttcgcctctttcc

SEQ ID NO: 307318 - DNA, 28 bp, Artificial Sequence
  Description of Artificial Sequence: Synthetic oligonucleotide
gggacctactgatgcttcgcctctttcc

SEQ ID NO: 307319 - DNA, 28 bp, Artificial Sequence
  Description of Artificial Sequence: Synthetic oligonucleotide
ggacctactgatgcttcgcctctttccg

SEQ ID NO: 307320 - DNA, 29 bp, Artificial Sequence
  Description of Artificial Sequence: Synthetic oligonucleotide
gacctactgatgcttcgcctctttccgag

SEQ ID NO: 307321 - DNA, 30 bp, Artificial Sequence
  Description of Artificial Sequence: Synthetic oligonucleotide
acctactgatgcttcgcctctttccgagac

SEQ ID NO: 307322 - DNA, 29 bp, Artificial Sequence
  Description of Artificial Sequence: Synthetic oligonucleotide
cctactgatgcttcgcctctttccgagac

SEQ ID NO: 307323 - DNA, 30 bp, Artificial Sequence
  Description of Artificial Sequence: Synthetic oligonucleotide
ctactgatgcttcgcctctttccgagactc

SEQ ID NO: 307324 - DNA, 31 bp, Artificial Sequence
  Description of Artificial Sequence: Synthetic oligonucleotide
tactgatgcttcgcctctttccgagactctc

SEQ ID NO: 307325 - DNA, 30 bp, Artificial Sequence
  Description of Artificial Sequence: Synthetic oligonucleotide
actgatgcttcgcctctttccgagactctc

SEQ ID NO: 307326 - DNA, 29 bp, Artificial Sequence
  Description of Artificial Sequence: Synthetic oligonucleotide
ctgatgcttcgcctctttccgagactctc

SEQ ID NO: 307327 - DNA, 29 bp, Artificial Sequence
  Description of Artificial Sequence: Synthetic oligonucleotide
tgatgcttcgcctctttccgagactctcc

SEQ ID NO: 307328 - DNA, 28 bp, Artificial Sequence
  Description of Artificial Sequence: Synthetic oligonucleotide
gatgcttcgcctctttccgagactctcc

SEQ ID NO: 307329 - DNA, 28 bp, Artificial Sequence
  Description of Artificial Sequence: Synthetic oligonucleotide
atgcttcgcctctttccgagactctccc

SEQ ID NO: 307330 - DNA, 27 bp, Artificial Sequence
  Description of Artificial Sequence: Synthetic oligonucleotide
tgcttcgcctctttccgagactctccc

SEQ ID NO: 307331 - DNA, 27 bp, Artificial Sequence
  Description of Artificial Sequence: Synthetic oligonucleotide
gcttcgcctctttccgagactctccct

SEQ ID NO: 307332 - DNA, 28 bp, Artificial Sequence
  Description of Artificial Sequence: Synthetic oligonucleotide
cttcgcctctttccgagactctccctac

SEQ ID NO: 307333 - DNA, 28 bp, Artificial Sequence
  Description of Artificial Sequence: Synthetic oligonucleotide
ttcgcctctttccgagactctccctacg

SEQ ID NO: 307334 - DNA, 27 bp, Artificial Sequence
  Description of Artificial Sequence: Synthetic oligonucleotide
tcgcctctttccgagactctccctacg

SEQ ID NO: 307335 - DNA, 27 bp, Artificial Sequence
  Description of Artificial Sequence: Synthetic oligonucleotide
cgcctctttccgagactctccctacga

SEQ ID NO: 307336 - DNA, 27 bp, Artificial Sequence
  Description of Artificial Sequence: Synthetic oligonucleotide
gcctctttccgagactctccctacgag

SEQ ID NO: 307337 - DNA, 28 bp, Artificial Sequence
  Description of Artificial Sequence: Synthetic oligonucleotide
cctctttccgagactctccctacgagtg

SEQ ID NO: 307338 - DNA, 28 bp, Artificial Sequence
  Description of Artificial Sequence: Synthetic oligonucleotide
ctctttccgagactctccctacgagtgg

SEQ ID NO: 307339 - DNA, 29 bp, Artificial Sequence
  Description of Artificial Sequence: Synthetic oligonucleotide
tctttccgagactctccctacgagtggtg

SEQ ID NO: 307340 - DNA, 28 bp, Artificial Sequence
  Description of Artificial Sequence: Synthetic oligonucleotide
ctttccgagactctccctacgagtggtg

SEQ ID NO: 307341 - DNA, 29 bp, Artificial Sequence
  Description of Artificial Sequence: Synthetic oligonucleotide
tttccgagactctccctacgagtggtgag

SEQ ID NO: 307342 - DNA, 28 bp, Artificial Sequence
  Description of Artificial Sequence: Synthetic oligonucleotide
ttccgagactctccctacgagtggtgag

SEQ ID NO: 307343 - DNA, 27 bp, Artificial Sequence
  Description of Artificial Sequence: Synthetic oligonucleotide
tccgagactctccctacgagtggtgag

SEQ ID NO: 307344 - DNA, 27 bp, Artificial Sequence
  Description of Artificial Sequence: Synthetic oligonucleotide
ccgagactctccctacgagtggtgaga

SEQ ID NO: 307345 - DNA, 27 bp, Artificial Sequence
  Description of Artificial Sequence: Synthetic oligonucleotide
cgagactctccctacgagtggtgagac

SEQ ID NO: 307346 - DNA, 28 bp, Artificial Sequence
  Description of Artificial Sequence: Synthetic oligonucleotide
gagactctccctacgagtggtgagactc

SEQ ID NO: 307347 - DNA, 28 bp, Artificial Sequence
  Description of Artificial Sequence: Synthetic oligonucleotide
agactctccctacgagtggtgagactcg

SEQ ID NO: 307348 - DNA, 27 bp, Artificial Sequence
  Description of Artificial Sequence: Synthetic oligonucleotide
gactctccctacgagtggtgagactcg

SEQ ID NO: 307349 - DNA, 28 bp, Artificial Sequence
  Description of Artificial Sequence: Synthetic oligonucleotide
actctccctacgagtggtgagactcgag

SEQ ID NO: 307350 - DNA, 27 bp, Artificial Sequence
  Description of Artificial Sequence: Synthetic oligonucleotide
ctctccctacgagtggtgagactcgag

SEQ ID NO: 307351 - DNA, 28 bp, Artificial Sequence
  Description of Artificial Sequence: Synthetic oligonucleotide
tctccctacgagtggtgagactcgagag

SEQ ID NO: 307352 - DNA, 27 bp, Artificial Sequence
  Description of Artificial Sequence: Synthetic oligonucleotide
ctccctacgagtggtgagactcgagag

SEQ ID NO: 307353 - DNA, 28 bp, Artificial Sequence
  Description of Artificial Sequence: Synthetic oligonucleotide
tccctacgagtggtgagactcgagagac

SEQ ID NO: 307354 - DNA, 27 bp, Artificial Sequence
  Description of Artificial Sequence: Synthetic oligonucleotide
ccctacgagtggtgagactcgagagac

SEQ ID NO: 307355 - DNA, 27 bp, Artificial Sequence
  Description of Artificial Sequence: Synthetic oligonucleotide
cctacgagtggtgagactcgagagacc

SEQ ID NO: 307356 - DNA, 27 bp, Artificial Sequence
  Description of Artificial Sequence: Synthetic oligonucleotide
ctacgagtggtgagactcgagagaccc

SEQ ID NO: 307357 - DNA, 28 bp, Artificial Sequence
  Description of Artificial Sequence: Synthetic oligonucleotide
tacgagtggtgagactcgagagacccac

SEQ ID NO: 307358 - DNA, 27 bp, Artificial Sequence
  Description of Artificial Sequence: Synthetic oligonucleotide
acgagtggtgagactcgagagacccac

SEQ ID NO: 307359 - DNA, 27 bp, Artificial Sequence
  Description of Artificial Sequence: Synthetic oligonucleotide
cgagtggtgagactcgagagacccact

SEQ ID NO: 307360 - DNA, 27 bp, Artificial Sequence
  Description of Artificial Sequence: Synthetic oligonucleotide
gagtggtgagactcgagagacccactg

SEQ ID NO: 307361 - DNA, 27 bp, Artificial Sequence
  Description of Artificial Sequence: Synthetic oligonucleotide
agtggtgagactcgagagacccactgg

SEQ ID NO: 307362 - DNA, 27 bp, Artificial Sequence
  Description of Artificial Sequence: Synthetic oligonucleotide
gtggtgagactcgagagacccactggt

SEQ ID NO: 307363 - DNA, 28 bp, Artificial Sequence
  Description of Artificial Sequence: Synthetic oligonucleotide
tggtgagactcgagagacccactggttg

SEQ ID NO: 307364 - DNA, 27 bp, Artificial Sequence
  Description of Artificial Sequence: Synthetic oligonucleotide
ggtgagactcgagagacccactggttg

SEQ ID NO: 307365 - DNA, 30 bp, Artificial Sequence
  Description of Artificial Sequence: Synthetic oligonucleotide
gtgagactcgagagacccactggttgtttc

SEQ ID NO: 307366 - DNA, 31 bp, Artificial Sequence
  Description of Artificial Sequence: Synthetic oligonucleotide
tgagactcgagagacccactggttgtttctg

SEQ ID NO: 307367 - DNA, 30 bp, Artificial Sequence
  Description of Artificial Sequence: Synthetic oligonucleotide
gagactcgagagacccactggttgtttctg

SEQ ID NO: 307368 - DNA, 31 bp, Artificial Sequence
  Description of Artificial Sequence: Synthetic oligonucleotide
agactcgagagacccactggttgtttctgac

SEQ ID NO: 307369 - DNA, 30 bp, Artificial Sequence
  Description of Artificial Sequence: Synthetic oligonucleotide
gactcgagagacccactggttgtttctgac

SEQ ID NO: 307370 - DNA, 31 bp, Artificial Sequence
  Description of Artificial Sequence: Synthetic oligonucleotide
actcgagagacccactggttgtttctgacac

SEQ ID NO: 307371 - DNA, 30 bp, Artificial Sequence
  Description of Artificial Sequence: Synthetic oligonucleotide
ctcgagagacccactggttgtttctgacac

SEQ ID NO: 307372 - DNA, 31 bp, Artificial Sequence
  Description of Artificial Sequence: Synthetic oligonucleotide
tcgagagacccactggttgtttctgacacag

SEQ ID NO: 307373 - DNA, 30 bp, Artificial Sequence
  Description of Artificial Sequence: Synthetic oligonucleotide
cgagagacccactggttgtttctgacacag

SEQ ID NO: 307374 - DNA, 30 bp, Artificial Sequence
  Description of Artificial Sequence: Synthetic oligonucleotide
gagagacccactggttgtttctgacacagg

SEQ ID NO: 307375 - DNA, 33 bp, Artificial Sequence
  Description of Artificial Sequence: Synthetic oligonucleotide
agagacccactggttgtttctgacacaggaaag

SEQ ID NO: 307376 - DNA, 32 bp, Artificial Sequence
  Description of Artificial Sequence: Synthetic oligonucleotide
gagacccactggttgtttctgacacaggaaag

SEQ ID NO: 307377 - DNA, 32 bp, Artificial Sequence
  Description of Artificial Sequence: Synthetic oligonucleotide
agacccactggttgtttctgacacaggaaagc

SEQ ID NO: 307378 - DNA, 31 bp, Artificial Sequence
  Description of Artificial Sequence: Synthetic oligonucleotide
gacccactggttgtttctgacacaggaaagc

SEQ ID NO: 307379 - DNA, 31 bp, Artificial Sequence
  Description of Artificial Sequence: Synthetic oligonucleotide
acccactggttgtttctgacacaggaaagcc

SEQ ID NO: 307380 - DNA, 30 bp, Artificial Sequence
  Description of Artificial Sequence: Synthetic oligonucleotide
cccactggttgtttctgacacaggaaagcc

SEQ ID NO: 307381 - DNA, 32 bp, Artificial Sequence
  Description of Artificial Sequence: Synthetic oligonucleotide
ccactggttgtttctgacacaggaaagccttc

SEQ ID NO: 307382 - DNA, 36 bp, Artificial Sequence
  Description of Artificial Sequence: Synthetic oligonucleotide
cactggttgtttctgacacaggaaagccttcaaatc

SEQ ID NO: 307383 - DNA, 36 bp, Artificial Sequence
  Description of Artificial Sequence: Synthetic oligonucleotide
actggttgtttctgacacaggaaagccttcaaatcg

SEQ ID NO: 307384 - DNA, 35 bp, Artificial Sequence
  Description of Artificial Sequence: Synthetic oligonucleotide
ctggttgtttctgacacaggaaagccttcaaatcg

SEQ ID NO: 307385 - DNA, 37 bp, Artificial Sequence
  Description of Artificial Sequence: Synthetic oligonucleotide
tggttgtttctgacacaggaaagccttcaaatcgttg

SEQ ID NO: 307386 - DNA, 36 bp, Artificial Sequence
  Description of Artificial Sequence: Synthetic oligonucleotide
ggttgtttctgacacaggaaagccttcaaatcgttg

SEQ ID NO: 307387 - DNA, 36 bp, Artificial Sequence
  Description of Artificial Sequence: Synthetic oligonucleotide
gttgtttctgacacaggaaagccttcaaatcgttgg

SEQ ID NO: 307388 - DNA, 36 bp, Artificial Sequence
  Description of Artificial Sequence: Synthetic oligonucleotide
ttgtttctgacacaggaaagccttcaaatcgttggc

SEQ ID NO: 307389 - DNA, 35 bp, Artificial Sequence
  Description of Artificial Sequence: Synthetic oligonucleotide
tgtttctgacacaggaaagccttcaaatcgttggc

SEQ ID NO: 307390 - DNA, 34 bp, Artificial Sequence
  Description of Artificial Sequence: Synthetic oligonucleotide
gtttctgacacaggaaagccttcaaatcgttggc

SEQ ID NO: 307391 - DNA, 34 bp, Artificial Sequence
  Description of Artificial Sequence: Synthetic oligonucleotide
tttctgacacaggaaagccttcaaatcgttggcc

SEQ ID NO: 307392 - DNA, 33 bp, Artificial Sequence
  Description of Artificial Sequence: Synthetic oligonucleotide
ttctgacacaggaaagccttcaaatcgttggcc

SEQ ID NO: 307393 - DNA, 32 bp, Artificial Sequence
  Description of Artificial Sequence: Synthetic oligonucleotide
tctgacacaggaaagccttcaaatcgttggcc

SEQ ID NO: 307394 - DNA, 31 bp, Artificial Sequence
  Description of Artificial Sequence: Synthetic oligonucleotide
ctgacacaggaaagccttcaaatcgttggcc

SEQ ID NO: 307395 - DNA, 33 bp, Artificial Sequence
  Description of Artificial Sequence: Synthetic oligonucleotide
tgacacaggaaagccttcaaatcgttggccttg

SEQ ID NO: 307396 - DNA, 32 bp, Artificial Sequence
  Description of Artificial Sequence: Synthetic oligonucleotide
gacacaggaaagccttcaaatcgttggccttg

SEQ ID NO: 307397 - DNA, 33 bp, Artificial Sequence
  Description of Artificial Sequence: Synthetic oligonucleotide
acacaggaaagccttcaaatcgttggccttgac

SEQ ID NO: 307398 - DNA, 32 bp, Artificial Sequence
  Description of Artificial Sequence: Synthetic oligonucleotide
cacaggaaagccttcaaatcgttggccttgac

SEQ ID NO: 307399 - DNA, 32 bp, Artificial Sequence
  Description of Artificial Sequence: Synthetic oligonucleotide
acaggaaagccttcaaatcgttggccttgacc

SEQ ID NO: 307400 - DNA, 31 bp, Artificial Sequence
  Description of Artificial Sequence: Synthetic oligonucleotide
caggaaagccttcaaatcgttggccttgacc

SEQ ID NO: 307401 - DNA, 31 bp, Artificial Sequence
  Description of Artificial Sequence: Synthetic oligonucleotide
aggaaagccttcaaatcgttggccttgaccc

SEQ ID NO: 307402 - DNA, 30 bp, Artificial Sequence
  Description of Artificial Sequence: Synthetic oligonucleotide
ggaaagccttcaaatcgttggccttgaccc

SEQ ID NO: 307403 - DNA, 31 bp, Artificial Sequence
  Description of Artificial Sequence: Synthetic oligonucleotide
gaaagccttcaaatcgttggccttgacccac

SEQ ID NO: 307404 - DNA, 32 bp, Artificial Sequence
  Description of Artificial Sequence: Synthetic oligonucleotide
aaagccttcaaatcgttggccttgacccactg

SEQ ID NO: 307405 - DNA, 31 bp, Artificial Sequence
  Description of Artificial Sequence: Synthetic oligonucleotide
aagccttcaaatcgttggccttgacccactg

SEQ ID NO: 307406 - DNA, 30 bp, Artificial Sequence
  Description of Artificial Sequence: Synthetic oligonucleotide
agccttcaaatcgttggccttgacccactg

SEQ ID NO: 307407 - DNA, 29 bp, Artificial Sequence
  Description of Artificial Sequence: Synthetic oligonucleotide
gccttcaaatcgttggccttgacccactg

SEQ ID NO: 307408 - DNA, 31 bp, Artificial Sequence
  Description of Artificial Sequence: Synthetic oligonucleotide
ccttcaaatcgttggccttgacccactgatc

SEQ ID NO: 307409 - DNA, 31 bp, Artificial Sequence
  Description of Artificial Sequence: Synthetic oligonucleotide
cttcaaatcgttggccttgacccactgatcc

SEQ ID NO: 307410 - DNA, 33 bp, Artificial Sequence
  Description of Artificial Sequence: Synthetic oligonucleotide
ttcaaatcgttggccttgacccactgatccaag

SEQ ID NO: 307411 - DNA, 32 bp, Artificial Sequence
  Description of Artificial Sequence: Synthetic oligonucleotide
tcaaatcgttggccttgacccactgatccaag

SEQ ID NO: 307412 - DNA, 31 bp, Artificial Sequence
  Description of Artificial Sequence: Synthetic oligonucleotide
caaatcgttggccttgacccactgatccaag

SEQ ID NO: 307413 - DNA, 31 bp, Artificial Sequence
  Description of Artificial Sequence: Synthetic oligonucleotide
aaatcgttggccttgacccactgatccaagc

SEQ ID NO: 307414 - DNA, 30 bp, Artificial Sequence
  Description of Artificial Sequence: Synthetic oligonucleotide
aatcgttggccttgacccactgatccaagc

SEQ ID NO: 307415 - DNA, 29 bp, Artificial Sequence
  Description of Artificial Sequence: Synthetic oligonucleotide
atcgttggccttgacccactgatccaagc

SEQ ID NO: 307416 - DNA, 28 bp, Artificial Sequence
  Description of Artificial Sequence: Synthetic oligonucleotide
tcgttggccttgacccactgatccaagc

SEQ ID NO: 307417 - DNA, 27 bp, Artificial Sequence
  Description of Artificial Sequence: Synthetic oligonucleotide
cgttggccttgacccactgatccaagc

SEQ ID NO: 307418 - DNA, 28 bp, Artificial Sequence
  Description of Artificial Sequence: Synthetic oligonucleotide
gttggccttgacccactgatccaagctc

SEQ ID NO: 307419 - DNA, 28 bp, Artificial Sequence
  Description of Artificial Sequence: Synthetic oligonucleotide
ttggccttgacccactgatccaagctcc

SEQ ID NO: 307420 - DNA, 27 bp, Artificial Sequence
  Description of Artificial Sequence: Synthetic oligonucleotide
tggccttgacccactgatccaagctcc

SEQ ID NO: 307421 - DNA, 27 bp, Artificial Sequence
  Description of Artificial Sequence: Synthetic oligonucleotide
ggccttgacccactgatccaagctcca

SEQ ID NO: 307422 - DNA, 30 bp, Artificial Sequence
  Description of Artificial Sequence: Synthetic oligonucleotide
gccttgacccactgatccaagctccataac

SEQ ID NO: 307423 - DNA, 30 bp, Artificial Sequence
  Description of Artificial Sequence: Synthetic oligonucleotide
ccttgacccactgatccaagctccataacc

SEQ ID NO: 307424 - DNA, 30 bp, Artificial Sequence
  Description of Artificial Sequence: Synthetic oligonucleotide
cttgacccactgatccaagctccataaccg

SEQ ID NO: 307425 - DNA, 30 bp, Artificial Sequence
  Description of Artificial Sequence: Synthetic oligonucleotide
ttgacccactgatccaagctccataaccgg

SEQ ID NO: 307426 - DNA, 29 bp, Artificial Sequence
  Description of Artificial Sequence: Synthetic oligonucleotide
tgacccactgatccaagctccataaccgg

SEQ ID NO: 307427 - DNA, 28 bp, Artificial Sequence
  Description of Artificial Sequence: Synthetic oligonucleotide
gacccactgatccaagctccataaccgg

SEQ ID NO: 307428 - DNA, 31 bp, Artificial Sequence
  Description of Artificial Sequence: Synthetic oligonucleotide
acccactgatccaagctccataaccggttac

SEQ ID NO: 307429 - DNA, 30 bp, Artificial Sequence
  Description of Artificial Sequence: Synthetic oligonucleotide
cccactgatccaagctccataaccggttac

SEQ ID NO: 307430 - DNA, 30 bp, Artificial Sequence
  Description of Artificial Sequence: Synthetic oligonucleotide
ccactgatccaagctccataaccggttacc

SEQ ID NO: 307431 - DNA, 30 bp, Artificial Sequence
  Description of Artificial Sequence: Synthetic oligonucleotide
cactgatccaagctccataaccggttaccc

SEQ ID NO: 307432 - DNA, 30 bp, Artificial Sequence
  Description of Artificial Sequence: Synthetic oligonucleotide
actgatccaagctccataaccggttacccc

SEQ ID NO: 307433 - DNA, 29 bp, Artificial Sequence
  Description of Artificial Sequence: Synthetic oligonucleotide
ctgatccaagctccataaccggttacccc

SEQ ID NO: 307434 - DNA, 30 bp, Artificial Sequence
  Description of Artificial Sequence: Synthetic oligonucleotide
tgatccaagctccataaccggttaccccag

SEQ ID NO: 307435 - DNA, 29 bp, Artificial Sequence
  Description of Artificial Sequence: Synthetic oligonucleotide
gatccaagctccataaccggttaccccag

SEQ ID NO: 307436 - DNA, 30 bp, Artificial Sequence
  Description of Artificial Sequence: Synthetic oligonucleotide
atccaagctccataaccggttaccccagac

SEQ ID NO: 307437 - DNA, 29 bp, Artificial Sequence
  Description of Artificial Sequence: Synthetic oligonucleotide
tccaagctccataaccggttaccccagac

SEQ ID NO: 307438 - DNA, 28 bp, Artificial Sequence
  Description of Artificial Sequence: Synthetic oligonucleotide
ccaagctccataaccggttaccccagac

SEQ ID NO: 307439 - DNA, 29 bp, Artificial Sequence
  Description of Artificial Sequence: Synthetic oligonucleotide
caagctccataaccggttaccccagacag

SEQ ID NO: 307440 - DNA, 29 bp, Artificial Sequence
  Description of Artificial Sequence: Synthetic oligonucleotide
aagctccataaccggttaccccagacagc

SEQ ID NO: 307441 - DNA, 28 bp, Artificial Sequence
  Description of Artificial Sequence: Synthetic oligonucleotide
agctccataaccggttaccccagacagc

SEQ ID NO: 307442 - DNA, 27 bp, Artificial Sequence
  Description of Artificial Sequence: Synthetic oligonucleotide
gctccataaccggttaccccagacagc

SEQ ID NO: 307443 - DNA, 28 bp, Artificial Sequence
  Description of Artificial Sequence: Synthetic oligonucleotide
ctccataaccggttaccccagacagctg

SEQ ID NO: 307444 - DNA, 28 bp, Artificial Sequence
  Description of Artificial Sequence: Synthetic oligonucleotide
tccataaccggttaccccagacagctgc

SEQ ID NO: 307445 - DNA, 27 bp, Artificial Sequence
  Description of Artificial Sequence: Synthetic oligonucleotide
ccataaccggttaccccagacagctgc

SEQ ID NO: 307446 - DNA, 28 bp, Artificial Sequence
  Description of Artificial Sequence: Synthetic oligonucleotide
cataaccggttaccccagacagctgcac

SEQ ID NO: 307447 - DNA, 28 bp, Artificial Sequence
  Description of Artificial Sequence: Synthetic oligonucleotide
ataaccggttaccccagacagctgcacg

SEQ ID NO: 307448 - DNA, 27 bp, Artificial Sequence
  Description of Artificial Sequence: Synthetic oligonucleotide
taaccggttaccccagacagctgcacg

SEQ ID NO: 307449 - DNA, 27 bp, Artificial Sequence
  Description of Artificial Sequence: Synthetic oligonucleotide
aaccggttaccccagacagctgcacgt

SEQ ID NO: 307450 - DNA, 27 bp, Artificial Sequence
  Description of Artificial Sequence: Synthetic oligonucleotide
accggttaccccagacagctgcacgta

SEQ ID NO: 307451 - DNA, 26 bp, Artificial Sequence
  Description of Artificial Sequence: Synthetic oligonucleotide
ccggttaccccagacagctgcacgta

SEQ ID NO: 307452 - DNA, 27 bp, Artificial Sequence
  Description of Artificial Sequence: Synthetic oligonucleotide
cggttaccccagacagctgcacgtact

SEQ ID NO: 307453 - DNA, 27 bp, Artificial Sequence
  Description of Artificial Sequence: Synthetic oligonucleotide
ggttaccccagacagctgcacgtactg

SEQ ID NO: 307454 - DNA, 30 bp, Artificial Sequence
  Description of Artificial Sequence: Synthetic oligonucleotide
gttaccccagacagctgcacgtactgattg

SEQ ID NO: 307455 - DNA, 30 bp, Artificial Sequence
  Description of Artificial Sequence: Synthetic oligonucleotide
ttaccccagacagctgcacgtactgattgg

SEQ ID NO: 307456 - DNA, 29 bp, Artificial Sequence
  Description of Artificial Sequence: Synthetic oligonucleotide
taccccagacagctgcacgtactgattgg

SEQ ID NO: 307457 - DNA, 28 bp, Artificial Sequence
  Description of Artificial Sequence: Synthetic oligonucleotide
accccagacagctgcacgtactgattgg

SEQ ID NO: 307458 - DNA, 27 bp, Artificial Sequence
  Description of Artificial Sequence: Synthetic oligonucleotide
ccccagacagctgcacgtactgattgg

SEQ ID NO: 307459 - DNA, 27 bp, Artificial Sequence
  Description of Artificial Sequence: Synthetic oligonucleotide
cccagacagctgcacgtactgattggg

SEQ ID NO: 307460 - DNA, 28 bp, Artificial Sequence
  Description of Artificial Sequence: Synthetic oligonucleotide
ccagacagctgcacgtactgattgggac

SEQ ID NO: 307461 - DNA, 28 bp, Artificial Sequence
  Description of Artificial Sequence: Synthetic oligonucleotide
cagacagctgcacgtactgattgggacg

SEQ ID NO: 307462 - DNA, 29 bp, Artificial Sequence
  Description of Artificial Sequence: Synthetic oligonucleotide
agacagctgcacgtactgattgggacgtc

SEQ ID NO: 307463 - DNA, 28 bp, Artificial Sequence
  Description of Artificial Sequence: Synthetic oligonucleotide
gacagctgcacgtactgattgggacgtc

SEQ ID NO: 307464 - DNA, 29 bp, Artificial Sequence
  Description of Artificial Sequence: Synthetic oligonucleotide
acagctgcacgtactgattgggacgtcag

SEQ ID NO: 307465 - DNA, 28 bp, Artificial Sequence
  Description of Artificial Sequence: Synthetic oligonucleotide
cagctgcacgtactgattgggacgtcag

SEQ ID NO: 307466 - DNA, 29 bp, Artificial Sequence
  Description of Artificial Sequence: Synthetic oligonucleotide
agctgcacgtactgattgggacgtcagtg

SEQ ID NO: 307467 - DNA, 28 bp, Artificial Sequence
  Description of Artificial Sequence: Synthetic oligonucleotide
gctgcacgtactgattgggacgtcagtg

SEQ ID NO: 307468 - DNA, 28 bp, Artificial Sequence
  Description of Artificial Sequence: Synthetic oligonucleotide
ctgcacgtactgattgggacgtcagtgg

SEQ ID NO: 307469 - DNA, 29 bp, Artificial Sequence
  Description of Artificial Sequence: Synthetic oligonucleotide
tgcacgtactgattgggacgtcagtggtc

SEQ ID NO: 307470 - DNA, 28 bp, Artificial Sequence
  Description of Artificial Sequence: Synthetic oligonucleotide
gcacgtactgattgggacgtcagtggtc

SEQ ID NO: 307471 - DNA, 30 bp, Artificial Sequence
  Description of Artificial Sequence: Synthetic oligonucleotide
cacgtactgattgggacgtcagtggtcttc

SEQ ID NO: 307472 - DNA, 32 bp, Artificial Sequence
  Description of Artificial Sequence: Synthetic oligonucleotide
acgtactgattgggacgtcagtggtcttcatc

SEQ ID NO: 307473 - DNA, 31 bp, Artificial Sequence
  Description of Artificial Sequence: Synthetic oligonucleotide
cgtactgattgggacgtcagtggtcttcatc

SEQ ID NO: 307474 - DNA, 31 bp, Artificial Sequence
  Description of Artificial Sequence: Synthetic oligonucleotide
gtactgattgggacgtcagtggtcttcatcc

SEQ ID NO: 307475 - DNA, 32 bp, Artificial Sequence
  Description of Artificial Sequence: Synthetic oligonucleotide
tactgattgggacgtcagtggtcttcatcctc

SEQ ID NO: 307476 - DNA, 31 bp, Artificial Sequence
  Description of Artificial Sequence: Synthetic oligonucleotide
actgattgggacgtcagtggtcttcatcctc

SEQ ID NO: 307477 - DNA, 30 bp, Artificial Sequence
  Description of Artificial Sequence: Synthetic oligonucleotide
ctgattgggacgtcagtggtcttcatcctc

SEQ ID NO: 307478 - DNA, 32 bp, Artificial Sequence
  Description of Artificial Sequence: Synthetic oligonucleotide
tgattgggacgtcagtggtcttcatcctcatc

SEQ ID NO: 307479 - DNA, 31 bp, Artificial Sequence
  Description of Artificial Sequence: Synthetic oligonucleotide
gattgggacgtcagtggtcttcatcctcatc

SEQ ID NO: 307480 - DNA, 33 bp, Artificial Sequence
  Description of Artificial Sequence: Synthetic oligonucleotide
attgggacgtcagtggtcttcatcctcatcatc

SEQ ID NO: 307481 - DNA, 32 bp, Artificial Sequence
  Description of Artificial Sequence: Synthetic oligonucleotide
ttgggacgtcagtggtcttcatcctcatcatc

SEQ ID NO: 307482 - DNA, 31 bp, Artificial Sequence
  Description of Artificial Sequence: Synthetic oligonucleotide
tgggacgtcagtggtcttcatcctcatcatc

SEQ ID NO: 307483 - DNA, 30 bp, Artificial Sequence
  Description of Artificial Sequence: Synthetic oligonucleotide
gggacgtcagtggtcttcatcctcatcatc

SEQ ID NO: 307484 - DNA, 32 bp, Artificial Sequence
  Description of Artificial Sequence: Synthetic oligonucleotide
ggacgtcagtggtcttcatcctcatcatcatc

SEQ ID NO: 307485 - DNA, 32 bp, Artificial Sequence
  Description of Artificial Sequence: Synthetic oligonucleotide
gacgtcagtggtcttcatcctcatcatcatcc

SEQ ID NO: 307486 - DNA, 33 bp, Artificial Sequence
  Description of Artificial Sequence: Synthetic oligonucleotide
acgtcagtggtcttcatcctcatcatcatccac

SEQ ID NO: 307487 - DNA, 32 bp, Artificial Sequence
  Description of Artificial Sequence: Synthetic oligonucleotide
cgtcagtggtcttcatcctcatcatcatccac

SEQ ID NO: 307488 - DNA, 32 bp, Artificial Sequence
  Description of Artificial Sequence: Synthetic oligonucleotide
gtcagtggtcttcatcctcatcatcatccacc

SEQ ID NO: 307489 - DNA, 33 bp, Artificial Sequence
  Description of Artificial Sequence: Synthetic oligonucleotide
tcagtggtcttcatcctcatcatcatccacctc

SEQ ID NO: 307490 - DNA, 32 bp, Artificial Sequence
  Description of Artificial Sequence: Synthetic oligonucleotide
cagtggtcttcatcctcatcatcatccacctc

SEQ ID NO: 307491 - DNA, 34 bp, Artificial Sequence
  Description of Artificial Sequence: Synthetic oligonucleotide
agtggtcttcatcctcatcatcatccacctcttc

SEQ ID NO: 307492 - DNA, 33 bp, Artificial Sequence
  Description of Artificial Sequence: Synthetic oligonucleotide
gtggtcttcatcctcatcatcatccacctcttc

SEQ ID NO: 307493 - DNA, 36 bp, Artificial Sequence
  Description of Artificial Sequence: Synthetic oligonucleotide
tggtcttcatcctcatcatcatccacctcttcttac

SEQ ID NO: 307494 - DNA, 35 bp, Artificial Sequence
  Description of Artificial Sequence: Synthetic oligonucleotide
ggtcttcatcctcatcatcatccacctcttcttac

SEQ ID NO: 307495 - DNA, 36 bp, Artificial Sequence
  Description of Artificial Sequence: Synthetic oligonucleotide
gtcttcatcctcatcatcatccacctcttcttactc

SEQ ID NO: 307496 - DNA, 36 bp, Artificial Sequence
  Description of Artificial Sequence: Synthetic oligonucleotide
tcttcatcctcatcatcatccacctcttcttactcc

SEQ ID NO: 307497 - DNA, 35 bp, Artificial Sequence
  Description of Artificial Sequence: Synthetic oligonucleotide
cttcatcctcatcatcatccacctcttcttactcc

SEQ ID NO: 307498 - DNA, 37 bp, Artificial Sequence
  Description of Artificial Sequence: Synthetic oligonucleotide
ttcatcctcatcatcatccacctcttcttactccttc

SEQ ID NO: 307499 - DNA, 36 bp, Artificial Sequence
  Description of Artificial Sequence: Synthetic oligonucleotide
tcatcctcatcatcatccacctcttcttactccttc

SEQ ID NO: 307500 - DNA, 35 bp, Artificial Sequence
  Description of Artificial Sequence: Synthetic oligonucleotide
catcctcatcatcatccacctcttcttactccttc

SEQ ID NO: 307501 - DNA, 37 bp, Artificial Sequence
  Description of Artificial Sequence: Synthetic oligonucleotide
atcctcatcatcatccacctcttcttactccttcaac

SEQ ID NO: 307502 - DNA, 36 bp, Artificial Sequence
  Description of Artificial Sequence: Synthetic oligonucleotide
tcctcatcatcatccacctcttcttactccttcaac

SEQ ID NO: 307503 - DNA, 35 bp, Artificial Sequence
  Description of Artificial Sequence: Synthetic oligonucleotide
cctcatcatcatccacctcttcttactccttcaac

SEQ ID NO: 307504 - DNA, 35 bp, Artificial Sequence
  Description of Artificial Sequence: Synthetic oligonucleotide
ctcatcatcatccacctcttcttactccttcaacg

SEQ ID NO: 307505 - DNA, 35 bp, Artificial Sequence
  Description of Artificial Sequence: Synthetic oligonucleotide
tcatcatcatccacctcttcttactccttcaacgc

SEQ ID NO: 307506 - DNA, 34 bp, Artificial Sequence
  Description of Artificial Sequence: Synthetic oligonucleotide
catcatcatccacctcttcttactccttcaacgc

SEQ ID NO: 307507 - DNA, 35 bp, Artificial Sequence
  Description of Artificial Sequence: Synthetic oligonucleotide
atcatcatccacctcttcttactccttcaacgctg

SEQ ID NO: 307508 - DNA, 34 bp, Artificial Sequence
  Description of Artificial Sequence: Synthetic oligonucleotide
tcatcatccacctcttcttactccttcaacgctg

SEQ ID NO: 307509 - DNA, 33 bp, Artificial Sequence
  Description of Artificial Sequence: Synthetic oligonucleotide
catcatccacctcttcttactccttcaacgctg

SEQ ID NO: 307510 - DNA, 33 bp, Artificial Sequence
  Description of Artificial Sequence: Synthetic oligonucleotide
atcatccacctcttcttactccttcaacgctgg

SEQ ID NO: 307511 - DNA, 32 bp, Artificial Sequence
  Description of Artificial Sequence: Synthetic oligonucleotide
tcatccacctcttcttactccttcaacgctgg

SEQ ID NO: 307512 - DNA, 31 bp, Artificial Sequence
  Description of Artificial Sequence: Synthetic oligonucleotide
catccacctcttcttactccttcaacgctgg

SEQ ID NO: 307513 - DNA, 32 bp, Artificial Sequence
  Description of Artificial Sequence: Synthetic oligonucleotide
atccacctcttcttactccttcaacgctggtg

SEQ ID NO: 307514 - DNA, 31 bp, Artificial Sequence
  Description of Artificial Sequence: Synthetic oligonucleotide
tccacctcttcttactccttcaacgctggtg

SEQ ID NO: 307515 - DNA, 30 bp, Artificial Sequence
  Description of Artificial Sequence: Synthetic oligonucleotide
ccacctcttcttactccttcaacgctggtg

SEQ ID NO: 307516 - DNA, 30 bp, Artificial Sequence
  Description of Artificial Sequence: Synthetic oligonucleotide
cacctcttcttactccttcaacgctggtgc

SEQ ID NO: 307517 - DNA, 31 bp, Artificial Sequence
  Description of Artificial Sequence: Synthetic oligonucleotide
acctcttcttactccttcaacgctggtgctc

SEQ ID NO: 307518 - DNA, 30 bp, Artificial Sequence
  Description of Artificial Sequence: Synthetic oligonucleotide
cctcttcttactccttcaacgctggtgctc

SEQ ID NO: 307519 - DNA, 30 bp, Artificial Sequence
  Description of Artificial Sequence: Synthetic oligonucleotide
ctcttcttactccttcaacgctggtgctcg

SEQ ID NO: 307520 - DNA, 32 bp, Artificial Sequence
  Description of Artificial Sequence: Synthetic oligonucleotide
tcttcttactccttcaacgctggtgctcgaac

SEQ ID NO: 307521 - DNA, 31 bp, Artificial Sequence
  Description of Artificial Sequence: Synthetic oligonucleotide
cttcttactccttcaacgctggtgctcgaac

SEQ ID NO: 307522 - DNA, 41 bp, Artificial Sequence
  Description of Artificial Sequence: Synthetic oligonucleotide
ttcttactccttcaacgctggtgctcgaacaaaataaaatg

SEQ ID NO: 307523 - DNA, 40 bp, Artificial Sequence
  Description of Artificial Sequence: Synthetic oligonucleotide
tcttactccttcaacgctggtgctcgaacaaaataaaatg

SEQ ID NO: 307524 - DNA, 39 bp, Artificial Sequence
  Description of Artificial Sequence: Synthetic oligonucleotide
cttactccttcaacgctggtgctcgaacaaaataaaatg

SEQ ID NO: 307525 - DNA, 39 bp, Artificial Sequence
  Description of Artificial Sequence: Synthetic oligonucleotide
ttactccttcaacgctggtgctcgaacaaaataaaatgc

SEQ ID NO: 307526 - DNA, 38 bp, Artificial Sequence
  Description of Artificial Sequence: Synthetic oligonucleotide
tactccttcaacgctggtgctcgaacaaaataaaatgc

SEQ ID NO: 307527 - DNA, 37 bp, Artificial Sequence
  Description of Artificial Sequence: Synthetic oligonucleotide
actccttcaacgctggtgctcgaacaaaataaaatgc

SEQ ID NO: 307528 - DNA, 36 bp, Artificial Sequence
  Description of Artificial Sequence: Synthetic oligonucleotide
ctccttcaacgctggtgctcgaacaaaataaaatgc

SEQ ID NO: 307529 - DNA, 37 bp, Artificial Sequence
  Description of Artificial Sequence: Synthetic oligonucleotide
tccttcaacgctggtgctcgaacaaaataaaatgctg

SEQ ID NO: 307530 - DNA, 36 bp, Artificial Sequence
  Description of Artificial Sequence: Synthetic oligonucleotide
ccttcaacgctggtgctcgaacaaaataaaatgctg

SEQ ID NO: 307531 - DNA, 36 bp, Artificial Sequence
  Description of Artificial Sequence: Synthetic oligonucleotide
cttcaacgctggtgctcgaacaaaataaaatgctgc

SEQ ID NO: 307532 - DNA, 37 bp, Artificial Sequence
  Description of Artificial Sequence: Synthetic oligonucleotide
ttcaacgctggtgctcgaacaaaataaaatgctgctc

SEQ ID NO: 307533 - DNA, 36 bp, Artificial Sequence
  Description of Artificial Sequence: Synthetic oligonucleotide
tcaacgctggtgctcgaacaaaataaaatgctgctc

SEQ ID NO: 307534 - DNA, 35 bp, Artificial Sequence
  Description of Artificial Sequence: Synthetic oligonucleotide
caacgctggtgctcgaacaaaataaaatgctgctc

SEQ ID NO: 307535 - DNA, 39 bp, Artificial Sequence
  Description of Artificial Sequence: Synthetic oligonucleotide
aacgctggtgctcgaacaaaataaaatgctgctctaatg

SEQ ID NO: 307536 - DNA, 38 bp, Artificial Sequence
  Description of Artificial Sequence: Synthetic oligonucleotide
acgctggtgctcgaacaaaataaaatgctgctctaatg

SEQ ID NO: 307537 - DNA, 37 bp, Artificial Sequence
  Description of Artificial Sequence: Synthetic oligonucleotide
cgctggtgctcgaacaaaataaaatgctgctctaatg

SEQ ID NO: 307538 - DNA, 37 bp, Artificial Sequence
  Description of Artificial Sequence: Synthetic oligonucleotide
gctggtgctcgaacaaaataaaatgctgctctaatgg

SEQ ID NO: 307539 - DNA, 38 bp, Artificial Sequence
  Description of Artificial Sequence: Synthetic oligonucleotide
ctggtgctcgaacaaaataaaatgctgctctaatggac

SEQ ID NO: 307540 - DNA, 38 bp, Artificial Sequence
  Description of Artificial Sequence: Synthetic oligonucleotide
tggtgctcgaacaaaataaaatgctgctctaatggacg

SEQ ID NO: 307541 - DNA, 37 bp, Artificial Sequence
  Description of Artificial Sequence: Synthetic oligonucleotide
ggtgctcgaacaaaataaaatgctgctctaatggacg

SEQ ID NO: 307542 - DNA, 39 bp, Artificial Sequence
  Description of Artificial Sequence: Synthetic oligonucleotide
gtgctcgaacaaaataaaatgctgctctaatggacgaag

SEQ ID NO: 307543 - DNA, 40 bp, Artificial Sequence
  Description of Artificial Sequence: Synthetic oligonucleotide
tgctcgaacaaaataaaatgctgctctaatggacgaagag

SEQ ID NO: 307544 - DNA, 39 bp, Artificial Sequence
  Description of Artificial Sequence: Synthetic oligonucleotide
gctcgaacaaaataaaatgctgctctaatggacgaagag

SEQ ID NO: 307545 - DNA, 39 bp, Artificial Sequence
  Description of Artificial Sequence: Synthetic oligonucleotide
ctcgaacaaaataaaatgctgctctaatggacgaagagc

SEQ ID NO: 307546 - DNA, 39 bp, Artificial Sequence
  Description of Artificial Sequence: Synthetic oligonucleotide
tcgaacaaaataaaatgctgctctaatggacgaagagcc

SEQ ID NO: 307547 - DNA, 38 bp, Artificial Sequence
  Description of Artificial Sequence: Synthetic oligonucleotide
cgaacaaaataaaatgctgctctaatggacgaagagcc

SEQ ID NO: 307548 - DNA, 39 bp, Artificial Sequence
  Description of Artificial Sequence: Synthetic oligonucleotide
gaacaaaataaaatgctgctctaatggacgaagagcctg

SEQ ID NO: 307549 - DNA, 39 bp, Artificial Sequence
  Description of Artificial Sequence: Synthetic oligonucleotide
aacaaaataaaatgctgctctaatggacgaagagcctgg

SEQ ID NO: 307550 - DNA, 38 bp, Artificial Sequence
  Description of Artificial Sequence: Synthetic oligonucleotide
acaaaataaaatgctgctctaatggacgaagagcctgg

SEQ ID NO: 307551 - DNA, 37 bp, Artificial Sequence
  Description of Artificial Sequence: Synthetic oligonucleotide
caaaataaaatgctgctctaatggacgaagagcctgg

SEQ ID NO: 307552 - DNA, 38 bp, Artificial Sequence
  Description of Artificial Sequence: Synthetic oligonucleotide
aaaataaaatgctgctctaatggacgaagagcctggag

SEQ ID NO: 307553 - DNA, 37 bp, Artificial Sequence
  Description of Artificial Sequence: Synthetic oligonucleotide
aaataaaatgctgctctaatggacgaagagcctggag

SEQ ID NO: 307554 - DNA, 36 bp, Artificial Sequence
  Description of Artificial Sequence: Synthetic oligonucleotide
aataaaatgctgctctaatggacgaagagcctggag

SEQ ID NO: 307555 - DNA, 35 bp, Artificial Sequence
  Description of Artificial Sequence: Synthetic oligonucleotide
ataaaatgctgctctaatggacgaagagcctggag

SEQ ID NO: 307556 - DNA, 34 bp, Artificial Sequence
  Description of Artificial Sequence: Synthetic oligonucleotide
taaaatgctgctctaatggacgaagagcctggag

SEQ ID NO: 307557 - DNA, 33 bp, Artificial Sequence
  Description of Artificial Sequence: Synthetic oligonucleotide
aaaatgctgctctaatggacgaagagcctggag

SEQ ID NO: 307558 - DNA, 32 bp, Artificial Sequence
  Description of Artificial Sequence: Synthetic oligonucleotide
aaatgctgctctaatggacgaagagcctggag

SEQ ID NO: 307559 - DNA, 31 bp, Artificial Sequence
  Description of Artificial Sequence: Synthetic oligonucleotide
aatgctgctctaatggacgaagagcctggag

SEQ ID NO: 307560 - DNA, 30 bp, Artificial Sequence
  Description of Artificial Sequence: Synthetic oligonucleotide
atgctgctctaatggacgaagagcctggag

SEQ ID NO: 307561 - DNA, 29 bp, Artificial Sequence
  Description of Artificial Sequence: Synthetic oligonucleotide
tgctgctctaatggacgaagagcctggag

SEQ ID NO: 307562 - DNA, 28 bp, Artificial Sequence
  Description of Artificial Sequence: Synthetic oligonucleotide
gctgctctaatggacgaagagcctggag

SEQ ID NO: 307563 - DNA, 28 bp, Artificial Sequence
  Description of Artificial Sequence: Synthetic oligonucleotide
ctgctctaatggacgaagagcctggagg

SEQ ID NO: 307564 - DNA, 28 bp, Artificial Sequence
  Description of Artificial Sequence: Synthetic oligonucleotide
tgctctaatggacgaagagcctggaggg

SEQ ID NO: 307565 - DNA, 27 bp, Artificial Sequence
  Description of Artificial Sequence: Synthetic oligonucleotide
gctctaatggacgaagagcctggaggg

SEQ ID NO: 307566 - DNA, 29 bp, Artificial Sequence
  Description of Artificial Sequence: Synthetic oligonucleotide
ctctaatggacgaagagcctggagggaac

SEQ ID NO: 307567 - DNA, 30 bp, Artificial Sequence
  Description of Artificial Sequence: Synthetic oligonucleotide
tctaatggacgaagagcctggagggaacag

SEQ ID NO: 307568 - DNA, 29 bp, Artificial Sequence
  Description of Artificial Sequence: Synthetic oligonucleotide
ctaatggacgaagagcctggagggaacag

SEQ ID NO: 307569 - DNA, 31 bp, Artificial Sequence
  Description of Artificial Sequence: Synthetic oligonucleotide
taatggacgaagagcctggagggaacagtac

SEQ ID NO: 307570 - DNA, 30 bp, Artificial Sequence
  Description of Artificial Sequence: Synthetic oligonucleotide
aatggacgaagagcctggagggaacagtac

SEQ ID NO: 307571 - DNA, 29 bp, Artificial Sequence
  Description of Artificial Sequence: Synthetic oligonucleotide
atggacgaagagcctggagggaacagtac

SEQ ID NO: 307572 - DNA, 28 bp, Artificial Sequence
  Description of Artificial Sequence: Synthetic oligonucleotide
tggacgaagagcctggagggaacagtac

SEQ ID NO: 307573 - DNA, 27 bp, Artificial Sequence
  Description of Artificial Sequence: Synthetic oligonucleotide
ggacgaagagcctggagggaacagtac

SEQ ID NO: 307574 - DNA, 28 bp, Artificial Sequence
  Description of Artificial Sequence: Synthetic oligonucleotide
gacgaagagcctggagggaacagtacag

SEQ ID NO: 307575 - DNA, 29 bp, Artificial Sequence
  Description of Artificial Sequence: Synthetic oligonucleotide
acgaagagcctggagggaacagtacagtg

SEQ ID NO: 307576 - DNA, 28 bp, Artificial Sequence
  Description of Artificial Sequence: Synthetic oligonucleotide
cgaagagcctggagggaacagtacagtg

SEQ ID NO: 307577 - DNA, 30 bp, Artificial Sequence
  Description of Artificial Sequence: Synthetic oligonucleotide
gaagagcctggagggaacagtacagtgaac

SEQ ID NO: 307578 - DNA, 31 bp, Artificial Sequence
  Description of Artificial Sequence: Synthetic oligonucleotide
aagagcctggagggaacagtacagtgaactg

SEQ ID NO: 307579 - DNA, 30 bp, Artificial Sequence
  Description of Artificial Sequence: Synthetic oligonucleotide
agagcctggagggaacagtacagtgaactg

SEQ ID NO: 307580 - DNA, 29 bp, Artificial Sequence
  Description of Artificial Sequence: Synthetic oligonucleotide
gagcctggagggaacagtacagtgaactg

SEQ ID NO: 307581 - DNA, 29 bp, Artificial Sequence
  Description of Artificial Sequence: Synthetic oligonucleotide
agcctggagggaacagtacagtgaactgg

SEQ ID NO: 307582 - DNA, 28 bp, Artificial Sequence
  Description of Artificial Sequence: Synthetic oligonucleotide
gcctggagggaacagtacagtgaactgg

SEQ ID NO: 307583 - DNA, 28 bp, Artificial Sequence
  Description of Artificial Sequence: Synthetic oligonucleotide
cctggagggaacagtacagtgaactggg

SEQ ID NO: 307584 - DNA, 29 bp, Artificial Sequence
  Description of Artificial Sequence: Synthetic oligonucleotide
ctggagggaacagtacagtgaactgggag

SEQ ID NO: 307585 - DNA, 29 bp, Artificial Sequence
  Description of Artificial Sequence: Synthetic oligonucleotide
tggagggaacagtacagtgaactgggagg

SEQ ID NO: 307586 - DNA, 28 bp, Artificial Sequence
  Description of Artificial Sequence: Synthetic oligonucleotide
ggagggaacagtacagtgaactgggagg

SEQ ID NO: 307587 - DNA, 29 bp, Artificial Sequence
  Description of Artificial Sequence: Synthetic oligonucleotide
gagggaacagtacagtgaactgggaggac

SEQ ID NO: 307588 - DNA, 30 bp, Artificial Sequence
  Description of Artificial Sequence: Synthetic oligonucleotide
agggaacagtacagtgaactgggaggactg

SEQ ID NO: 307589 - DNA, 29 bp, Artificial Sequence
  Description of Artificial Sequence: Synthetic oligonucleotide
gggaacagtacagtgaactgggaggactg

SEQ ID NO: 307590 - DNA, 30 bp, Artificial Sequence
  Description of Artificial Sequence: Synthetic oligonucleotide
ggaacagtacagtgaactgggaggactgtg

SEQ ID NO: 307591 - DNA, 32 bp, Artificial Sequence
  Description of Artificial Sequence: Synthetic oligonucleotide
gaacagtacagtgaactgggaggactgtgatg

SEQ ID NO: 307592 - DNA, 34 bp, Artificial Sequence
  Description of Artificial Sequence: Synthetic oligonucleotide
aacagtacagtgaactgggaggactgtgatgaac

SEQ ID NO: 307593 - DNA, 33 bp, Artificial Sequence
  Description of Artificial Sequence: Synthetic oligonucleotide
acagtacagtgaactgggaggactgtgatgaac

SEQ ID NO: 307594 - DNA, 32 bp, Artificial Sequence
  Description of Artificial Sequence: Synthetic oligonucleotide
cagtacagtgaactgggaggactgtgatgaac

SEQ ID NO: 307595 - DNA, 34 bp, Artificial Sequence
  Description of Artificial Sequence: Synthetic oligonucleotide
agtacagtgaactgggaggactgtgatgaactag

SEQ ID NO: 307596 - DNA, 33 bp, Artificial Sequence
  Description of Artificial Sequence: Synthetic oligonucleotide
gtacagtgaactgggaggactgtgatgaactag

SEQ ID NO: 307597 - DNA, 34 bp, Artificial Sequence
  Description of Artificial Sequence: Synthetic oligonucleotide
tacagtgaactgggaggactgtgatgaactagac

SEQ ID NO: 307598 - DNA, 33 bp, Artificial Sequence
  Description of Artificial Sequence: Synthetic oligonucleotide
acagtgaactgggaggactgtgatgaactagac

SEQ ID NO: 307599 - DNA, 32 bp, Artificial Sequence
  Description of Artificial Sequence: Synthetic oligonucleotide
cagtgaactgggaggactgtgatgaactagac

SEQ ID NO: 307600 - DNA, 32 bp, Artificial Sequence
  Description of Artificial Sequence: Synthetic oligonucleotide
agtgaactgggaggactgtgatgaactagacc

SEQ ID NO: 307601 - DNA, 31 bp, Artificial Sequence
  Description of Artificial Sequence: Synthetic oligonucleotide
gtgaactgggaggactgtgatgaactagacc

SEQ ID NO: 307602 - DNA, 31 bp, Artificial Sequence
  Description of Artificial Sequence: Synthetic oligonucleotide
tgaactgggaggactgtgatgaactagaccc

SEQ ID NO: 307603 - DNA, 30 bp, Artificial Sequence
  Description of Artificial Sequence: Synthetic oligonucleotide
gaactgggaggactgtgatgaactagaccc

SEQ ID NO: 307604 - DNA, 31 bp, Artificial Sequence
  Description of Artificial Sequence: Synthetic oligonucleotide
aactgggaggactgtgatgaactagaccctc

SEQ ID NO: 307605 - DNA, 30 bp, Artificial Sequence
  Description of Artificial Sequence: Synthetic oligonucleotide
actgggaggactgtgatgaactagaccctc

SEQ ID NO: 307606 - DNA, 29 bp, Artificial Sequence
  Description of Artificial Sequence: Synthetic oligonucleotide
ctgggaggactgtgatgaactagaccctc

SEQ ID NO: 307607 - DNA, 30 bp, Artificial Sequence
  Description of Artificial Sequence: Synthetic oligonucleotide
tgggaggactgtgatgaactagaccctcag

SEQ ID NO: 307608 - DNA, 29 bp, Artificial Sequence
  Description of Artificial Sequence: Synthetic oligonucleotide
gggaggactgtgatgaactagaccctcag

SEQ ID NO: 307609 - DNA, 29 bp, Artificial Sequence
  Description of Artificial Sequence: Synthetic oligonucleotide
ggaggactgtgatgaactagaccctcagc

SEQ ID NO: 307610 - DNA, 30 bp, Artificial Sequence
  Description of Artificial Sequence: Synthetic oligonucleotide
gaggactgtgatgaactagaccctcagcag

SEQ ID NO: 307611 - DNA, 30 bp, Artificial Sequence
  Description of Artificial Sequence: Synthetic oligonucleotide
aggactgtgatgaactagaccctcagcagg

SEQ ID NO: 307612 - DNA, 29 bp, Artificial Sequence
  Description of Artificial Sequence: Synthetic oligonucleotide
ggactgtgatgaactagaccctcagcagg

SEQ ID NO: 307613 - DNA, 30 bp, Artificial Sequence
  Description of Artificial Sequence: Synthetic oligonucleotide
gactgtgatgaactagaccctcagcaggtg

SEQ ID NO: 307614 - DNA, 31 bp, Artificial Sequence
  Description of Artificial Sequence: Synthetic oligonucleotide
actgtgatgaactagaccctcagcaggtgac

SEQ ID NO: 307615 - DNA, 30 bp, Artificial Sequence
  Description of Artificial Sequence: Synthetic oligonucleotide
ctgtgatgaactagaccctcagcaggtgac

SEQ ID NO: 307616 - DNA, 32 bp, Artificial Sequence
  Description of Artificial Sequence: Synthetic oligonucleotide
tgtgatgaactagaccctcagcaggtgacatc

SEQ ID NO: 307617 - DNA, 31 bp, Artificial Sequence
  Description of Artificial Sequence: Synthetic oligonucleotide
gtgatgaactagaccctcagcaggtgacatc

SEQ ID NO: 307618 - DNA, 31 bp, Artificial Sequence
  Description of Artificial Sequence: Synthetic oligonucleotide
tgatgaactagaccctcagcaggtgacatcc

SEQ ID NO: 307619 - DNA, 30 bp, Artificial Sequence
  Description of Artificial Sequence: Synthetic oligonucleotide
gatgaactagaccctcagcaggtgacatcc

SEQ ID NO: 307620 - DNA, 30 bp, Artificial Sequence
  Description of Artificial Sequence: Synthetic oligonucleotide
atgaactagaccctcagcaggtgacatccg

SEQ ID NO: 307621 - DNA, 29 bp, Artificial Sequence
  Description of Artificial Sequence: Synthetic oligonucleotide
tgaactagaccctcagcaggtgacatccg

SEQ ID NO: 307622 - DNA, 28 bp, Artificial Sequence
  Description of Artificial Sequence: Synthetic oligonucleotide
gaactagaccctcagcaggtgacatccg

SEQ ID NO: 307623 - DNA, 28 bp, Artificial Sequence
  Description of Artificial Sequence: Synthetic oligonucleotide
aactagaccctcagcaggtgacatccgc

SEQ ID NO: 307624 - DNA, 27 bp, Artificial Sequence
  Description of Artificial Sequence: Synthetic oligonucleotide
actagaccctcagcaggtgacatccgc

SEQ ID NO: 307625 - DNA, 27 bp, Artificial Sequence
  Description of Artificial Sequence: Synthetic oligonucleotide
ctagaccctcagcaggtgacatccgca

SEQ ID NO: 307626 - DNA, 27 bp, Artificial Sequence
  Description of Artificial Sequence: Synthetic oligonucleotide
tagaccctcagcaggtgacatccgcac

SEQ ID NO: 307627 - DNA, 27 bp, Artificial Sequence
  Description of Artificial Sequence: Synthetic oligonucleotide
agaccctcagcaggtgacatccgcaca

SEQ ID NO: 307628 - DNA, 26 bp, Artificial Sequence
  Description of Artificial Sequence: Synthetic oligonucleotide
gaccctcagcaggtgacatccgcaca

SEQ ID NO: 307629 - DNA, 27 bp, Artificial Sequence
  Description of Artificial Sequence: Synthetic oligonucleotide
accctcagcaggtgacatccgcacagt

SEQ ID NO: 307630 - DNA, 27 bp, Artificial Sequence
  Description of Artificial Sequence: Synthetic oligonucleotide
ccctcagcaggtgacatccgcacagtt

SEQ ID NO: 307631 - DNA, 27 bp, Artificial Sequence
  Description of Artificial Sequence: Synthetic oligonucleotide
cctcagcaggtgacatccgcacagttc

SEQ ID NO: 307632 - DNA, 27 bp, Artificial Sequence
  Description of Artificial Sequence: Synthetic oligonucleotide
ctcagcaggtgacatccgcacagttcg

SEQ ID NO: 307633 - DNA, 29 bp, Artificial Sequence
  Description of Artificial Sequence: Synthetic oligonucleotide
tcagcaggtgacatccgcacagttcgatc

SEQ ID NO: 307634 - DNA, 28 bp, Artificial Sequence
  Description of Artificial Sequence: Synthetic oligonucleotide
cagcaggtgacatccgcacagttcgatc

SEQ ID NO: 307635 - DNA, 29 bp, Artificial Sequence
  Description of Artificial Sequence: Synthetic oligonucleotide
agcaggtgacatccgcacagttcgatcac

SEQ ID NO: 307636 - DNA, 28 bp, Artificial Sequence
  Description of Artificial Sequence: Synthetic oligonucleotide
gcaggtgacatccgcacagttcgatcac

SEQ ID NO: 307637 - DNA, 29 bp, Artificial Sequence
  Description of Artificial Sequence: Synthetic oligonucleotide
caggtgacatccgcacagttcgatcactg

SEQ ID NO: 307638 - DNA, 29 bp, Artificial Sequence
  Description of Artificial Sequence: Synthetic oligonucleotide
aggtgacatccgcacagttcgatcactgg

SEQ ID NO: 307639 - DNA, 28 bp, Artificial Sequence
  Description of Artificial Sequence: Synthetic oligonucleotide
ggtgacatccgcacagttcgatcactgg

SEQ ID NO: 307640 - DNA, 28 bp, Artificial Sequence
  Description of Artificial Sequence: Synthetic oligonucleotide
gtgacatccgcacagttcgatcactggg

SEQ ID NO: 307641 - DNA, 32 bp, Artificial Sequence
  Description of Artificial Sequence: Synthetic oligonucleotide
tgacatccgcacagttcgatcactgggttttc

SEQ ID NO: 307642 - DNA, 31 bp, Artificial Sequence
  Description of Artificial Sequence: Synthetic oligonucleotide
gacatccgcacagttcgatcactgggttttc

SEQ ID NO: 307643 - DNA, 32 bp, Artificial Sequence
  Description of Artificial Sequence: Synthetic oligonucleotide
acatccgcacagttcgatcactgggttttcac

SEQ ID NO: 307644 - DNA, 31 bp, Artificial Sequence
  Description of Artificial Sequence: Synthetic oligonucleotide
catccgcacagttcgatcactgggttttcac

SEQ ID NO: 307645 - DNA, 32 bp, Artificial Sequence
  Description of Artificial Sequence: Synthetic oligonucleotide
atccgcacagttcgatcactgggttttcacac

SEQ ID NO: 307646 - DNA, 31 bp, Artificial Sequence
  Description of Artificial Sequence: Synthetic oligonucleotide
tccgcacagttcgatcactgggttttcacac

SEQ ID NO: 307647 - DNA, 30 bp, Artificial Sequence
  Description of Artificial Sequence: Synthetic oligonucleotide
ccgcacagttcgatcactgggttttcacac

SEQ ID NO: 307648 - DNA, 31 bp, Artificial Sequence
  Description of Artificial Sequence: Synthetic oligonucleotide
cgcacagttcgatcactgggttttcacactg

SEQ ID NO: 307649 - DNA, 32 bp, Artificial Sequence
  Description of Artificial Sequence: Synthetic oligonucleotide
gcacagttcgatcactgggttttcacactgag

SEQ ID NO: 307650 - DNA, 38 bp, Artificial Sequence
  Description of Artificial Sequence: Synthetic oligonucleotide
cacagttcgatcactgggttttcacactgagaaaaatg

SEQ ID NO: 307651 - DNA, 39 bp, Artificial Sequence
  Description of Artificial Sequence: Synthetic oligonucleotide
acagttcgatcactgggttttcacactgagaaaaatgac

SEQ ID NO: 307652 - DNA, 38 bp, Artificial Sequence
  Description of Artificial Sequence: Synthetic oligonucleotide
cagttcgatcactgggttttcacactgagaaaaatgac

SEQ ID NO: 307653 - DNA, 39 bp, Artificial Sequence
  Description of Artificial Sequence: Synthetic oligonucleotide
agttcgatcactgggttttcacactgagaaaaatgactc

SEQ ID NO: 307654 - DNA, 38 bp, Artificial Sequence
  Description of Artificial Sequence: Synthetic oligonucleotide
gttcgatcactgggttttcacactgagaaaaatgactc

SEQ ID NO: 307655 - DNA, 38 bp, Artificial Sequence
  Description of Artificial Sequence: Synthetic oligonucleotide
ttcgatcactgggttttcacactgagaaaaatgactcg

SEQ ID NO: 307656 - DNA, 37 bp, Artificial Sequence
  Description of Artificial Sequence: Synthetic oligonucleotide
tcgatcactgggttttcacactgagaaaaatgactcg

SEQ ID NO: 307657 - DNA, 36 bp, Artificial Sequence
  Description of Artificial Sequence: Synthetic oligonucleotide
cgatcactgggttttcacactgagaaaaatgactcg

SEQ ID NO: 307658 - DNA, 36 bp, Artificial Sequence
  Description of Artificial Sequence: Synthetic oligonucleotide
gatcactgggttttcacactgagaaaaatgactcgc

SEQ ID NO: 307659 - DNA, 36 bp, Artificial Sequence
  Description of Artificial Sequence: Synthetic oligonucleotide
atcactgggttttcacactgagaaaaatgactcgcc

SEQ ID NO: 307660 - DNA, 35 bp, Artificial Sequence
  Description of Artificial Sequence: Synthetic oligonucleotide
tcactgggttttcacactgagaaaaatgactcgcc

SEQ ID NO: 307661 - DNA, 34 bp, Artificial Sequence
  Description of Artificial Sequence: Synthetic oligonucleotide
cactgggttttcacactgagaaaaatgactcgcc

SEQ ID NO: 307662 - DNA, 34 bp, Artificial Sequence
  Description of Artificial Sequence: Synthetic oligonucleotide
actgggttttcacactgagaaaaatgactcgccc

SEQ ID NO: 307663 - DNA, 33 bp, Artificial Sequence
  Description of Artificial Sequence: Synthetic oligonucleotide
ctgggttttcacactgagaaaaatgactcgccc

SEQ ID NO: 307664 - DNA, 35 bp, Artificial Sequence
  Description of Artificial Sequence: Synthetic oligonucleotide
tgggttttcacactgagaaaaatgactcgccctac

SEQ ID NO: 307665 - DNA, 34 bp, Artificial Sequence
  Description of Artificial Sequence: Synthetic oligonucleotide
gggttttcacactgagaaaaatgactcgccctac

SEQ ID NO: 307666 - DNA, 35 bp, Artificial Sequence
  Description of Artificial Sequence: Synthetic oligonucleotide
ggttttcacactgagaaaaatgactcgccctactc

SEQ ID NO: 307667 - DNA, 36 bp, Artificial Sequence
  Description of Artificial Sequence: Synthetic oligonucleotide
gttttcacactgagaaaaatgactcgccctactcag

SEQ ID NO: 307668 - DNA, 37 bp, Artificial Sequence
  Description of Artificial Sequence: Synthetic oligonucleotide
ttttcacactgagaaaaatgactcgccctactcagag

SEQ ID NO: 307669 - DNA, 36 bp, Artificial Sequence
  Description of Artificial Sequence: Synthetic oligonucleotide
tttcacactgagaaaaatgactcgccctactcagag

SEQ ID NO: 307670 - DNA, 35 bp, Artificial Sequence
  Description of Artificial Sequence: Synthetic oligonucleotide
ttcacactgagaaaaatgactcgccctactcagag

SEQ ID NO: 307671 - DNA, 34 bp, Artificial Sequence
  Description of Artificial Sequence: Synthetic oligonucleotide
tcacactgagaaaaatgactcgccctactcagag

SEQ ID NO: 307672 - DNA, 33 bp, Artificial Sequence
  Description of Artificial Sequence: Synthetic oligonucleotide
cacactgagaaaaatgactcgccctactcagag

SEQ ID NO: 307673 - DNA, 33 bp, Artificial Sequence
  Description of Artificial Sequence: Synthetic oligonucleotide
acactgagaaaaatgactcgccctactcagagg

SEQ ID NO: 307674 - DNA, 32 bp, Artificial Sequence
  Description of Artificial Sequence: Synthetic oligonucleotide
cactgagaaaaatgactcgccctactcagagg

SEQ ID NO: 307675 - DNA, 32 bp, Artificial Sequence
  Description of Artificial Sequence: Synthetic oligonucleotide
actgagaaaaatgactcgccctactcagaggc

SEQ ID NO: 307676 - DNA, 31 bp, Artificial Sequence
  Description of Artificial Sequence: Synthetic oligonucleotide
ctgagaaaaatgactcgccctactcagaggc

SEQ ID NO: 307677 - DNA, 31 bp, Artificial Sequence
  Description of Artificial Sequence: Synthetic oligonucleotide
tgagaaaaatgactcgccctactcagaggcc

SEQ ID NO: 307678 - DNA, 30 bp, Artificial Sequence
  Description of Artificial Sequence: Synthetic oligonucleotide
gagaaaaatgactcgccctactcagaggcc

SEQ ID NO: 307679 - DNA, 30 bp, Artificial Sequence
  Description of Artificial Sequence: Synthetic oligonucleotide
agaaaaatgactcgccctactcagaggccg

SEQ ID NO: 307680 - DNA, 29 bp, Artificial Sequence
  Description of Artificial Sequence: Synthetic oligonucleotide
gaaaaatgactcgccctactcagaggccg

SEQ ID NO: 307681 - DNA, 31 bp, Artificial Sequence
  Description of Artificial Sequence: Synthetic oligonucleotide
aaaaatgactcgccctactcagaggccgaag

SEQ ID NO: 307682 - DNA, 30 bp, Artificial Sequence
  Description of Artificial Sequence: Synthetic oligonucleotide
aaaatgactcgccctactcagaggccgaag

SEQ ID NO: 307683 - DNA, 29 bp, Artificial Sequence
  Description of Artificial Sequence: Synthetic oligonucleotide
aaatgactcgccctactcagaggccgaag

SEQ ID NO: 307684 - DNA, 28 bp, Artificial Sequence
  Description of Artificial Sequence: Synthetic oligonucleotide
aatgactcgccctactcagaggccgaag

SEQ ID NO: 307685 - DNA, 27 bp, Artificial Sequence
  Description of Artificial Sequence: Synthetic oligonucleotide
atgactcgccctactcagaggccgaag

SEQ ID NO: 307686 - DNA, 27 bp, Artificial Sequence
  Description of Artificial Sequence: Synthetic oligonucleotide
tgactcgccctactcagaggccgaaga

SEQ ID NO: 307687 - DNA, 26 bp, Artificial Sequence
  Description of Artificial Sequence: Synthetic oligonucleotide
gactcgccctactcagaggccgaaga

SEQ ID NO: 307688 - DNA, 27 bp, Artificial Sequence
  Description of Artificial Sequence: Synthetic oligonucleotide
actcgccctactcagaggccgaagaca

SEQ ID NO: 307689 - DNA, 26 bp, Artificial Sequence
  Description of Artificial Sequence: Synthetic oligonucleotide
ctcgccctactcagaggccgaagaca

SEQ ID NO: 307690 - DNA, 26 bp, Artificial Sequence
  Description of Artificial Sequence: Synthetic oligonucleotide
tcgccctactcagaggccgaagacac

SEQ ID NO: 307691 - DNA, 25 bp, Artificial Sequence
  Description of Artificial Sequence: Synthetic oligonucleotide
cgccctactcagaggccgaagacac

SEQ ID NO: 307692 - DNA, 25 bp, Artificial Sequence
  Description of Artificial Sequence: Synthetic oligonucleotide
gccctactcagaggccgaagacacg

SEQ ID NO: 307693 - DNA, 25 bp, Artificial Sequence
  Description of Artificial Sequence: Synthetic oligonucleotide
ccctactcagaggccgaagacacgc

SEQ ID NO: 307694 - DNA, 25 bp, Artificial Sequence
  Description of Artificial Sequence: Synthetic oligonucleotide
cctactcagaggccgaagacacgcc

SEQ ID NO: 307695 - DNA, 27 bp, Artificial Sequence
  Description of Artificial Sequence: Synthetic oligonucleotide
ctactcagaggccgaagacacgcccaa

SEQ ID NO: 307696 - DNA, 27 bp, Artificial Sequence
  Description of Artificial Sequence: Synthetic oligonucleotide
tactcagaggccgaagacacgcccaac

SEQ ID NO: 307697 - DNA, 27 bp, Artificial Sequence
  Description of Artificial Sequence: Synthetic oligonucleotide
actcagaggccgaagacacgcccaaca

SEQ ID NO: 307698 - DNA, 26 bp, Artificial Sequence
  Description of Artificial Sequence: Synthetic oligonucleotide
ctcagaggccgaagacacgcccaaca

SEQ ID NO: 307699 - DNA, 27 bp, Artificial Sequence
  Description of Artificial Sequence: Synthetic oligonucleotide
tcagaggccgaagacacgcccaacaga

SEQ ID NO: 307700 - DNA, 27 bp, Artificial Sequence
  Description of Artificial Sequence: Synthetic oligonucleotide
cagaggccgaagacacgcccaacagat

SEQ ID NO: 307701 - DNA, 28 bp, Artificial Sequence
  Description of Artificial Sequence: Synthetic oligonucleotide
agaggccgaagacacgcccaacagattc

SEQ ID NO: 307702 - DNA, 27 bp, Artificial Sequence
  Description of Artificial Sequence: Synthetic oligonucleotide
gaggccgaagacacgcccaacagattc

SEQ ID NO: 307703 - DNA, 27 bp, Artificial Sequence
  Description of Artificial Sequence: Synthetic oligonucleotide
aggccgaagacacgcccaacagattcc

SEQ ID NO: 307704 - DNA, 27 bp, Artificial Sequence
  Description of Artificial Sequence: Synthetic oligonucleotide
ggccgaagacacgcccaacagattcca

SEQ ID NO: 307705 - DNA, 27 bp, Artificial Sequence
  Description of Artificial Sequence: Synthetic oligonucleotide
gccgaagacacgcccaacagattccag

SEQ ID NO: 307706 - DNA, 27 bp, Artificial Sequence
  Description of Artificial Sequence: Synthetic oligonucleotide
ccgaagacacgcccaacagattccagc

SEQ ID NO: 307707 - DNA, 27 bp, Artificial Sequence
  Description of Artificial Sequence: Synthetic oligonucleotide
cgaagacacgcccaacagattccagcg

SEQ ID NO: 307708 - DNA, 28 bp, Artificial Sequence
  Description of Artificial Sequence: Synthetic oligonucleotide
gaagacacgcccaacagattccagcgtg

SEQ ID NO: 307709 - DNA, 30 bp, Artificial Sequence
  Description of Artificial Sequence: Synthetic oligonucleotide
aagacacgcccaacagattccagcgtgaac

SEQ ID NO: 307710 - DNA, 29 bp, Artificial Sequence
  Description of Artificial Sequence: Synthetic oligonucleotide
agacacgcccaacagattccagcgtgaac

SEQ ID NO: 307711 - DNA, 28 bp, Artificial Sequence
  Description of Artificial Sequence: Synthetic oligonucleotide
gacacgcccaacagattccagcgtgaac

SEQ ID NO: 307712 - DNA, 29 bp, Artificial Sequence
  Description of Artificial Sequence: Synthetic oligonucleotide
acacgcccaacagattccagcgtgaacac

SEQ ID NO: 307713 - DNA, 28 bp, Artificial Sequence
  Description of Artificial Sequence: Synthetic oligonucleotide
cacgcccaacagattccagcgtgaacac

SEQ ID NO: 307714 - DNA, 28 bp, Artificial Sequence
  Description of Artificial Sequence: Synthetic oligonucleotide
acgcccaacagattccagcgtgaacacg

SEQ ID NO: 307715 - DNA, 27 bp, Artificial Sequence
  Description of Artificial Sequence: Synthetic oligonucleotide
cgcccaacagattccagcgtgaacacg

SEQ ID NO: 307716 - DNA, 27 bp, Artificial Sequence
  Description of Artificial Sequence: Synthetic oligonucleotide
gcccaacagattccagcgtgaacacgg

SEQ ID NO: 307717 - DNA, 29 bp, Artificial Sequence
  Description of Artificial Sequence: Synthetic oligonucleotide
cccaacagattccagcgtgaacacggaac

SEQ ID NO: 307718 - DNA, 31 bp, Artificial Sequence
  Description of Artificial Sequence: Synthetic oligonucleotide
ccaacagattccagcgtgaacacggaactac

SEQ ID NO: 307719 - DNA, 31 bp, Artificial Sequence
  Description of Artificial Sequence: Synthetic oligonucleotide
caacagattccagcgtgaacacggaactacc

SEQ ID NO: 307720 - DNA, 35 bp, Artificial Sequence
  Description of Artificial Sequence: Synthetic oligonucleotide
aacagattccagcgtgaacacggaactaccaaatg

SEQ ID NO: 307721 - DNA, 34 bp, Artificial Sequence
  Description of Artificial Sequence: Synthetic oligonucleotide
acagattccagcgtgaacacggaactaccaaatg

SEQ ID NO: 307722 - DNA, 33 bp, Artificial Sequence
  Description of Artificial Sequence: Synthetic oligonucleotide
cagattccagcgtgaacacggaactaccaaatg

SEQ ID NO: 307723 - DNA, 33 bp, Artificial Sequence
  Description of Artificial Sequence: Synthetic oligonucleotide
agattccagcgtgaacacggaactaccaaatgc

SEQ ID NO: 307724 - DNA, 32 bp, Artificial Sequence
  Description of Artificial Sequence: Synthetic oligonucleotide
gattccagcgtgaacacggaactaccaaatgc

SEQ ID NO: 307725 - DNA, 33 bp, Artificial Sequence
  Description of Artificial Sequence: Synthetic oligonucleotide
attccagcgtgaacacggaactaccaaatgcag

SEQ ID NO: 307726 - DNA, 32 bp, Artificial Sequence
  Description of Artificial Sequence: Synthetic oligonucleotide
ttccagcgtgaacacggaactaccaaatgcag

SEQ ID NO: 307727 - DNA, 31 bp, Artificial Sequence
  Description of Artificial Sequence: Synthetic oligonucleotide
tccagcgtgaacacggaactaccaaatgcag

SEQ ID NO: 307728 - DNA, 30 bp, Artificial Sequence
  Description of Artificial Sequence: Synthetic oligonucleotide
ccagcgtgaacacggaactaccaaatgcag

SEQ ID NO: 307729 - DNA, 31 bp, Artificial Sequence
  Description of Artificial Sequence: Synthetic oligonucleotide
cagcgtgaacacggaactaccaaatgcagag

SEQ ID NO: 307730 - DNA, 31 bp, Artificial Sequence
  Description of Artificial Sequence: Synthetic oligonucleotide
agcgtgaacacggaactaccaaatgcagagc

SEQ ID NO: 307731 - DNA, 30 bp, Artificial Sequence
  Description of Artificial Sequence: Synthetic oligonucleotide
gcgtgaacacggaactaccaaatgcagagc

SEQ ID NO: 307732 - DNA, 30 bp, Artificial Sequence
  Description of Artificial Sequence: Synthetic oligonucleotide
cgtgaacacggaactaccaaatgcagagcc

SEQ ID NO: 307733 - DNA, 30 bp, Artificial Sequence
  Description of Artificial Sequence: Synthetic oligonucleotide
gtgaacacggaactaccaaatgcagagccc

SEQ ID NO: 307734 - DNA, 31 bp, Artificial Sequence
  Description of Artificial Sequence: Synthetic oligonucleotide
tgaacacggaactaccaaatgcagagcccag

SEQ ID NO: 307735 - DNA, 30 bp, Artificial Sequence
  Description of Artificial Sequence: Synthetic oligonucleotide
gaacacggaactaccaaatgcagagcccag

SEQ ID NO: 307736 - DNA, 32 bp, Artificial Sequence
  Description of Artificial Sequence: Synthetic oligonucleotide
aacacggaactaccaaatgcagagcccagatg

SEQ ID NO: 307737 - DNA, 31 bp, Artificial Sequence
  Description of Artificial Sequence: Synthetic oligonucleotide
acacggaactaccaaatgcagagcccagatg

SEQ ID NO: 307738 - DNA, 30 bp, Artificial Sequence
  Description of Artificial Sequence: Synthetic oligonucleotide
cacggaactaccaaatgcagagcccagatg

SEQ ID NO: 307739 - DNA, 30 bp, Artificial Sequence
  Description of Artificial Sequence: Synthetic oligonucleotide
acggaactaccaaatgcagagcccagatgc

SEQ ID NO: 307740 - DNA, 29 bp, Artificial Sequence
  Description of Artificial Sequence: Synthetic oligonucleotide
cggaactaccaaatgcagagcccagatgc

SEQ ID NO: 307741 - DNA, 32 bp, Artificial Sequence
  Description of Artificial Sequence: Synthetic oligonucleotide
ggaactaccaaatgcagagcccagatgcaaag

SEQ ID NO: 307742 - DNA, 34 bp, Artificial Sequence
  Description of Artificial Sequence: Synthetic oligonucleotide
gaactaccaaatgcagagcccagatgcaaagttg

SEQ ID NO: 307743 - DNA, 35 bp, Artificial Sequence
  Description of Artificial Sequence: Synthetic oligonucleotide
aactaccaaatgcagagcccagatgcaaagttgtg

SEQ ID NO: 307744 - DNA, 34 bp, Artificial Sequence
  Description of Artificial Sequence: Synthetic oligonucleotide
actaccaaatgcagagcccagatgcaaagttgtg

SEQ ID NO: 307745 - DNA, 33 bp, Artificial Sequence
  Description of Artificial Sequence: Synthetic oligonucleotide
ctaccaaatgcagagcccagatgcaaagttgtg

SEQ ID NO: 307746 - DNA, 34 bp, Artificial Sequence
  Description of Artificial Sequence: Synthetic oligonucleotide
taccaaatgcagagcccagatgcaaagttgtgtc

SEQ ID NO: 307747 - DNA, 33 bp, Artificial Sequence
  Description of Artificial Sequence: Synthetic oligonucleotide
accaaatgcagagcccagatgcaaagttgtgtc

SEQ ID NO: 307748 - DNA, 32 bp, Artificial Sequence
  Description of Artificial Sequence: Synthetic oligonucleotide
ccaaatgcagagcccagatgcaaagttgtgtc

SEQ ID NO: 307749 - DNA, 32 bp, Artificial Sequence
  Description of Artificial Sequence: Synthetic oligonucleotide
caaatgcagagcccagatgcaaagttgtgtcc

SEQ ID NO: 307750 - DNA, 33 bp, Artificial Sequence
  Description of Artificial Sequence: Synthetic oligonucleotide
aaatgcagagcccagatgcaaagttgtgtcctg

SEQ ID NO: 307751 - DNA, 32 bp, Artificial Sequence
  Description of Artificial Sequence: Synthetic oligonucleotide
aatgcagagcccagatgcaaagttgtgtcctg

SEQ ID NO: 307752 - DNA, 31 bp, Artificial Sequence
  Description of Artificial Sequence: Synthetic oligonucleotide
atgcagagcccagatgcaaagttgtgtcctg

SEQ ID NO: 307753 - DNA, 30 bp, Artificial Sequence
  Description of Artificial Sequence: Synthetic oligonucleotide
tgcagagcccagatgcaaagttgtgtcctg

SEQ ID NO: 307754 - DNA, 29 bp, Artificial Sequence
  Description of Artificial Sequence: Synthetic oligonucleotide
gcagagcccagatgcaaagttgtgtcctg

SEQ ID NO: 307755 - DNA, 29 bp, Artificial Sequence
  Description of Artificial Sequence: Synthetic oligonucleotide
cagagcccagatgcaaagttgtgtcctgc

SEQ ID NO: 307756 - DNA, 29 bp, Artificial Sequence
  Description of Artificial Sequence: Synthetic oligonucleotide
agagcccagatgcaaagttgtgtcctgcc

SEQ ID NO: 307757 - DNA, 28 bp, Artificial Sequence
  Description of Artificial Sequence: Synthetic oligonucleotide
gagcccagatgcaaagttgtgtcctgcc

SEQ ID NO: 307758 - DNA, 28 bp, Artificial Sequence
  Description of Artificial Sequence: Synthetic oligonucleotide
agcccagatgcaaagttgtgtcctgccc

SEQ ID NO: 307759 - DNA, 27 bp, Artificial Sequence
  Description of Artificial Sequence: Synthetic oligonucleotide
gcccagatgcaaagttgtgtcctgccc

SEQ ID NO: 307760 - DNA, 29 bp, Artificial Sequence
  Description of Artificial Sequence: Synthetic oligonucleotide
cccagatgcaaagttgtgtcctgcccttg

SEQ ID NO: 307761 - DNA, 30 bp, Artificial Sequence
  Description of Artificial Sequence: Synthetic oligonucleotide
ccagatgcaaagttgtgtcctgcccttgag

SEQ ID NO: 307762 - DNA, 30 bp, Artificial Sequence
  Description of Artificial Sequence: Synthetic oligonucleotide
cagatgcaaagttgtgtcctgcccttgagc

SEQ ID NO: 307763 - DNA, 31 bp, Artificial Sequence
  Description of Artificial Sequence: Synthetic oligonucleotide
agatgcaaagttgtgtcctgcccttgagcac

SEQ ID NO: 307764 - DNA, 30 bp, Artificial Sequence
  Description of Artificial Sequence: Synthetic oligonucleotide
gatgcaaagttgtgtcctgcccttgagcac

SEQ ID NO: 307765 - DNA, 30 bp, Artificial Sequence
  Description of Artificial Sequence: Synthetic oligonucleotide
atgcaaagttgtgtcctgcccttgagcacc

SEQ ID NO: 307766 - DNA, 29 bp, Artificial Sequence
  Description of Artificial Sequence: Synthetic oligonucleotide
tgcaaagttgtgtcctgcccttgagcacc

SEQ ID NO: 307767 - DNA, 28 bp, Artificial Sequence
  Description of Artificial Sequence: Synthetic oligonucleotide
gcaaagttgtgtcctgcccttgagcacc

SEQ ID NO: 307768 - DNA, 29 bp, Artificial Sequence
  Description of Artificial Sequence: Synthetic oligonucleotide
caaagttgtgtcctgcccttgagcaccac

SEQ ID NO: 307769 - DNA, 30 bp, Artificial Sequence
  Description of Artificial Sequence: Synthetic oligonucleotide
aaagttgtgtcctgcccttgagcaccactg

SEQ ID NO: 307770 - DNA, 29 bp, Artificial Sequence
  Description of Artificial Sequence: Synthetic oligonucleotide
aagttgtgtcctgcccttgagcaccactg

SEQ ID NO: 307771 - DNA, 28 bp, Artificial Sequence
  Description of Artificial Sequence: Synthetic oligonucleotide
agttgtgtcctgcccttgagcaccactg

SEQ ID NO: 307772 - DNA, 27 bp, Artificial Sequence
  Description of Artificial Sequence: Synthetic oligonucleotide
gttgtgtcctgcccttgagcaccactg

SEQ ID NO: 307773 - DNA, 28 bp, Artificial Sequence
  Description of Artificial Sequence: Synthetic oligonucleotide
ttgtgtcctgcccttgagcaccactgtc

SEQ ID NO: 307774 - DNA, 27 bp, Artificial Sequence
  Description of Artificial Sequence: Synthetic oligonucleotide
tgtgtcctgcccttgagcaccactgtc

SEQ ID NO: 307775 - DNA, 27 bp, Artificial Sequence
  Description of Artificial Sequence: Synthetic oligonucleotide
gtgtcctgcccttgagcaccactgtca

SEQ ID NO: 307776 - DNA, 27 bp, Artificial Sequence
  Description of Artificial Sequence: Synthetic oligonucleotide
tgtcctgcccttgagcaccactgtcag

SEQ ID NO: 307777 - DNA, 26 bp, Artificial Sequence
  Description of Artificial Sequence: Synthetic oligonucleotide
gtcctgcccttgagcaccactgtcag

SEQ ID NO: 307778 - DNA, 26 bp, Artificial Sequence
  Description of Artificial Sequence: Synthetic oligonucleotide
tcctgcccttgagcaccactgtcagg

SEQ ID NO: 307779 - DNA, 25 bp, Artificial Sequence
  Description of Artificial Sequence: Synthetic oligonucleotide
cctgcccttgagcaccactgtcagg

SEQ ID NO: 307780 - DNA, 25 bp, Artificial Sequence
  Description of Artificial Sequence: Synthetic oligonucleotide
ctgcccttgagcaccactgtcaggc

SEQ ID NO: 307781 - DNA, 27 bp, Artificial Sequence
  Description of Artificial Sequence: Synthetic oligonucleotide
tgcccttgagcaccactgtcaggccta

SEQ ID NO: 307782 - DNA, 26 bp, Artificial Sequence
  Description of Artificial Sequence: Synthetic oligonucleotide
gcccttgagcaccactgtcaggccta

SEQ ID NO: 307783 - DNA, 27 bp, Artificial Sequence
  Description of Artificial Sequence: Synthetic oligonucleotide
cccttgagcaccactgtcaggcctaga

SEQ ID NO: 307784 - DNA, 27 bp, Artificial Sequence
  Description of Artificial Sequence: Synthetic oligonucleotide
ccttgagcaccactgtcaggcctagag

SEQ ID NO: 307785 - DNA, 27 bp, Artificial Sequence
  Description of Artificial Sequence: Synthetic oligonucleotide
cttgagcaccactgtcaggcctagagg

SEQ ID NO: 307786 - DNA, 27 bp, Artificial Sequence
  Description of Artificial Sequence: Synthetic oligonucleotide
ttgagcaccactgtcaggcctagaggg

SEQ ID NO: 307787 - DNA, 26 bp, Artificial Sequence
  Description of Artificial Sequence: Synthetic oligonucleotide
tgagcaccactgtcaggcctagaggg

SEQ ID NO: 307788 - DNA, 25 bp, Artificial Sequence
  Description of Artificial Sequence: Synthetic oligonucleotide
gagcaccactgtcaggcctagaggg

SEQ ID NO: 307789 - DNA, 27 bp, Artificial Sequence
  Description of Artificial Sequence: Synthetic oligonucleotide
agcaccactgtcaggcctagaggggat

SEQ ID NO: 307790 - DNA, 26 bp, Artificial Sequence
  Description of Artificial Sequence: Synthetic oligonucleotide
gcaccactgtcaggcctagaggggat

SEQ ID NO: 307791 - DNA, 27 bp, Artificial Sequence
  Description of Artificial Sequence: Synthetic oligonucleotide
caccactgtcaggcctagaggggatca

SEQ ID NO: 307792 - DNA, 28 bp, Artificial Sequence
  Description of Artificial Sequence: Synthetic oligonucleotide
accactgtcaggcctagaggggatcatc

SEQ ID NO: 307793 - DNA, 27 bp, Artificial Sequence
  Description of Artificial Sequence: Synthetic oligonucleotide
ccactgtcaggcctagaggggatcatc

SEQ ID NO: 307794 - DNA, 29 bp, Artificial Sequence
  Description of Artificial Sequence: Synthetic oligonucleotide
cactgtcaggcctagaggggatcatctag

SEQ ID NO: 307795 - DNA, 29 bp, Artificial Sequence
  Description of Artificial Sequence: Synthetic oligonucleotide
actgtcaggcctagaggggatcatctagg

SEQ ID NO: 307796 - DNA, 28 bp, Artificial Sequence
  Description of Artificial Sequence: Synthetic oligonucleotide
ctgtcaggcctagaggggatcatctagg

SEQ ID NO: 307797 - DNA, 28 bp, Artificial Sequence
  Description of Artificial Sequence: Synthetic oligonucleotide
tgtcaggcctagaggggatcatctaggg

SEQ ID NO: 307798 - DNA, 27 bp, Artificial Sequence
  Description of Artificial Sequence: Synthetic oligonucleotide
gtcaggcctagaggggatcatctaggg

SEQ ID NO: 307799 - DNA, 28 bp, Artificial Sequence
  Description of Artificial Sequence: Synthetic oligonucleotide
tcaggcctagaggggatcatctagggag

SEQ ID NO: 307800 - DNA, 27 bp, Artificial Sequence
  Description of Artificial Sequence: Synthetic oligonucleotide
caggcctagaggggatcatctagggag

SEQ ID NO: 307801 - DNA, 28 bp, Artificial Sequence
  Description of Artificial Sequence: Synthetic oligonucleotide
aggcctagaggggatcatctagggagtc

SEQ ID NO: 307802 - DNA, 27 bp, Artificial Sequence
  Description of Artificial Sequence: Synthetic oligonucleotide
ggcctagaggggatcatctagggagtc

SEQ ID NO: 307803 - DNA, 29 bp, Artificial Sequence
  Description of Artificial Sequence: Synthetic oligonucleotide
gcctagaggggatcatctagggagtcaac

SEQ ID NO: 307804 - DNA, 30 bp, Artificial Sequence
  Description of Artificial Sequence: Synthetic oligonucleotide
cctagaggggatcatctagggagtcaacag

SEQ ID NO: 307805 - DNA, 30 bp, Artificial Sequence
  Description of Artificial Sequence: Synthetic oligonucleotide
ctagaggggatcatctagggagtcaacagc

SEQ ID NO: 307806 - DNA, 30 bp, Artificial Sequence
  Description of Artificial Sequence: Synthetic oligonucleotide
tagaggggatcatctagggagtcaacagcc

SEQ ID NO: 307807 - DNA, 29 bp, Artificial Sequence
  Description of Artificial Sequence: Synthetic oligonucleotide
agaggggatcatctagggagtcaacagcc

SEQ ID NO: 307808 - DNA, 28 bp, Artificial Sequence
  Description of Artificial Sequence: Synthetic oligonucleotide
gaggggatcatctagggagtcaacagcc

SEQ ID NO: 307809 - DNA, 28 bp, Artificial Sequence
  Description of Artificial Sequence: Synthetic oligonucleotide
aggggatcatctagggagtcaacagccc

SEQ ID NO: 307810 - DNA, 27 bp, Artificial Sequence
  Description of Artificial Sequence: Synthetic oligonucleotide
ggggatcatctagggagtcaacagccc

SEQ ID NO: 307811 - DNA, 28 bp, Artificial Sequence
  Description of Artificial Sequence: Synthetic oligonucleotide
gggatcatctagggagtcaacagcccag

SEQ ID NO: 307812 - DNA, 29 bp, Artificial Sequence
  Description of Artificial Sequence: Synthetic oligonucleotide
ggatcatctagggagtcaacagcccagtc

SEQ ID NO: 307813 - DNA, 30 bp, Artificial Sequence
  Description of Artificial Sequence: Synthetic oligonucleotide
gatcatctagggagtcaacagcccagtctc

SEQ ID NO: 307814 - DNA, 33 bp, Artificial Sequence
  Description of Artificial Sequence: Synthetic oligonucleotide
atcatctagggagtcaacagcccagtctcaaac

SEQ ID NO: 307815 - DNA, 32 bp, Artificial Sequence
  Description of Artificial Sequence: Synthetic oligonucleotide
tcatctagggagtcaacagcccagtctcaaac

SEQ ID NO: 307816 - DNA, 31 bp, Artificial Sequence
  Description of Artificial Sequence: Synthetic oligonucleotide
catctagggagtcaacagcccagtctcaaac

SEQ ID NO: 307817 - DNA, 31 bp, Artificial Sequence
  Description of Artificial Sequence: Synthetic oligonucleotide
atctagggagtcaacagcccagtctcaaacg

SEQ ID NO: 307818 - DNA, 30 bp, Artificial Sequence
  Description of Artificial Sequence: Synthetic oligonucleotide
tctagggagtcaacagcccagtctcaaacg

SEQ ID NO: 307819 - DNA, 29 bp, Artificial Sequence
  Description of Artificial Sequence: Synthetic oligonucleotide
ctagggagtcaacagcccagtctcaaacg

SEQ ID NO: 307820 - DNA, 29 bp, Artificial Sequence
  Description of Artificial Sequence: Synthetic oligonucleotide
tagggagtcaacagcccagtctcaaacgc

SEQ ID NO: 307821 - DNA, 28 bp, Artificial Sequence
  Description of Artificial Sequence: Synthetic oligonucleotide
agggagtcaacagcccagtctcaaacgc

SEQ ID NO: 307822 - DNA, 27 bp, Artificial Sequence
  Description of Artificial Sequence: Synthetic oligonucleotide
gggagtcaacagcccagtctcaaacgc

SEQ ID NO: 307823 - DNA, 28 bp, Artificial Sequence
  Description of Artificial Sequence: Synthetic oligonucleotide
ggagtcaacagcccagtctcaaacgcag

SEQ ID NO: 307824 - DNA, 28 bp, Artificial Sequence
  Description of Artificial Sequence: Synthetic oligonucleotide
gagtcaacagcccagtctcaaacgcagg

SEQ ID NO: 307825 - DNA, 30 bp, Artificial Sequence
  Description of Artificial Sequence: Synthetic oligonucleotide
agtcaacagcccagtctcaaacgcaggttg

SEQ ID NO: 307826 - DNA, 29 bp, Artificial Sequence
  Description of Artificial Sequence: Synthetic oligonucleotide
gtcaacagcccagtctcaaacgcaggttg

SEQ ID NO: 307827 - DNA, 29 bp, Artificial Sequence
  Description of Artificial Sequence: Synthetic oligonucleotide
tcaacagcccagtctcaaacgcaggttgc

SEQ ID NO: 307828 - DNA, 28 bp, Artificial Sequence
  Description of Artificial Sequence: Synthetic oligonucleotide
caacagcccagtctcaaacgcaggttgc

SEQ ID NO: 307829 - DNA, 28 bp, Artificial Sequence
  Description of Artificial Sequence: Synthetic oligonucleotide
aacagcccagtctcaaacgcaggttgcc

SEQ ID NO: 307830 - DNA, 27 bp, Artificial Sequence
  Description of Artificial Sequence: Synthetic oligonucleotide
acagcccagtctcaaacgcaggttgcc

SEQ ID NO: 307831 - DNA, 27 bp, Artificial Sequence
  Description of Artificial Sequence: Synthetic oligonucleotide
cagcccagtctcaaacgcaggttgcct

SEQ ID NO: 307832 - DNA, 27 bp, Artificial Sequence
  Description of Artificial Sequence: Synthetic oligonucleotide
agcccagtctcaaacgcaggttgcctg

SEQ ID NO: 307833 - DNA, 26 bp, Artificial Sequence
  Description of Artificial Sequence: Synthetic oligonucleotide
gcccagtctcaaacgcaggttgcctg

SEQ ID NO: 307834 - DNA, 27 bp, Artificial Sequence
  Description of Artificial Sequence: Synthetic oligonucleotide
cccagtctcaaacgcaggttgcctgct

SEQ ID NO: 307835 - DNA, 27 bp, Artificial Sequence
  Description of Artificial Sequence: Synthetic oligonucleotide
ccagtctcaaacgcaggttgcctgctc

SEQ ID NO: 307836 - DNA, 27 bp, Artificial Sequence
  Description of Artificial Sequence: Synthetic oligonucleotide
cagtctcaaacgcaggttgcctgctcc

SEQ ID NO: 307837 - DNA, 27 bp, Artificial Sequence
  Description of Artificial Sequence: Synthetic oligonucleotide
agtctcaaacgcaggttgcctgctccc

SEQ ID NO: 307838 - DNA, 27 bp, Artificial Sequence
  Description of Artificial Sequence: Synthetic oligonucleotide
gtctcaaacgcaggttgcctgctccca

SEQ ID NO: 307839 - DNA, 28 bp, Artificial Sequence
  Description of Artificial Sequence: Synthetic oligonucleotide
tctcaaacgcaggttgcctgctcccatg

SEQ ID NO: 307840 - DNA, 27 bp, Artificial Sequence
  Description of Artificial Sequence: Synthetic oligonucleotide
ctcaaacgcaggttgcctgctcccatg

SEQ ID NO: 307841 - DNA, 29 bp, Artificial Sequence
  Description of Artificial Sequence: Synthetic oligonucleotide
tcaaacgcaggttgcctgctcccatgaac

SEQ ID NO: 307842 - DNA, 28 bp, Artificial Sequence
  Description of Artificial Sequence: Synthetic oligonucleotide
caaacgcaggttgcctgctcccatgaac

SEQ ID NO: 307843 - DNA, 28 bp, Artificial Sequence
  Description of Artificial Sequence: Synthetic oligonucleotide
aaacgcaggttgcctgctcccatgaacc

SEQ ID NO: 307844 - DNA, 27 bp, Artificial Sequence
  Description of Artificial Sequence: Synthetic oligonucleotide
aacgcaggttgcctgctcccatgaacc

SEQ ID NO: 307845 - DNA, 27 bp, Artificial Sequence
  Description of Artificial Sequence: Synthetic oligonucleotide
acgcaggttgcctgctcccatgaacca

SEQ ID NO: 307846 - DNA, 26 bp, Artificial Sequence
  Description of Artificial Sequence: Synthetic oligonucleotide
cgcaggttgcctgctcccatgaacca

SEQ ID NO: 307847 - DNA, 26 bp, Artificial Sequence
  Description of Artificial Sequence: Synthetic oligonucleotide
gcaggttgcctgctcccatgaaccag

SEQ ID NO: 307848 - DNA, 27 bp, Artificial Sequence
  Description of Artificial Sequence: Synthetic oligonucleotide
caggttgcctgctcccatgaaccagca

SEQ ID NO: 307849 - DNA, 27 bp, Artificial Sequence
  Description of Artificial Sequence: Synthetic oligonucleotide
aggttgcctgctcccatgaaccagcag

SEQ ID NO: 307850 - DNA, 26 bp, Artificial Sequence
  Description of Artificial Sequence: Synthetic oligonucleotide
ggttgcctgctcccatgaaccagcag

SEQ ID NO: 307851 - DNA, 27 bp, Artificial Sequence
  Description of Artificial Sequence: Synthetic oligonucleotide
gttgcctgctcccatgaaccagcagca

SEQ ID NO: 307852 - DNA, 27 bp, Artificial Sequence
  Description of Artificial Sequence: Synthetic oligonucleotide
ttgcctgctcccatgaaccagcagcag

SEQ ID NO: 307853 - DNA, 26 bp, Artificial Sequence
  Description of Artificial Sequence: Synthetic oligonucleotide
tgcctgctcccatgaaccagcagcag

SEQ ID NO: 307854 - DNA, 25 bp, Artificial Sequence
  Description of Artificial Sequence: Synthetic oligonucleotide
gcctgctcccatgaaccagcagcag

SEQ ID NO: 307855 - DNA, 27 bp, Artificial Sequence
  Description of Artificial Sequence: Synthetic oligonucleotide
cctgctcccatgaaccagcagcaggaa

SEQ ID NO: 307856 - DNA, 28 bp, Artificial Sequence
  Description of Artificial Sequence: Synthetic oligonucleotide
ctgctcccatgaaccagcagcaggaatc

SEQ ID NO: 307857 - DNA, 29 bp, Artificial Sequence
  Description of Artificial Sequence: Synthetic oligonucleotide
tgctcccatgaaccagcagcaggaatctg

SEQ ID NO: 307858 - DNA, 28 bp, Artificial Sequence
  Description of Artificial Sequence: Synthetic oligonucleotide
gctcccatgaaccagcagcaggaatctg

SEQ ID NO: 307859 - DNA, 24 bp, Artificial Sequence
  Description of Artificial Sequence: Synthetic oligonucleotide
atggccgagctgttgcggaggctg

SEQ ID NO: 307860 - DNA, 23 bp, Artificial Sequence
  Description of Artificial Sequence: Synthetic oligonucleotide
tggccgagctgttgcggaggctg

SEQ ID NO: 307861 - DNA, 22 bp, Artificial Sequence
  Description of Artificial Sequence: Synthetic oligonucleotide
ggccgagctgttgcggaggctg

SEQ ID NO: 307862 - DNA, 22 bp, Artificial Sequence
  Description of Artificial Sequence: Synthetic oligonucleotide
gccgagctgttgcggaggctgg

SEQ ID NO: 307863 - DNA, 22 bp, Artificial Sequence
  Description of Artificial Sequence: Synthetic oligonucleotide
ccgagctgttgcggaggctggc

SEQ ID NO: 307864 - DNA, 22 bp, Artificial Sequence
  Description of Artificial Sequence: Synthetic oligonucleotide
cgagctgttgcggaggctggcc

SEQ ID NO: 307865 - DNA, 22 bp, Artificial Sequence
  Description of Artificial Sequence: Synthetic oligonucleotide
gagctgttgcggaggctggccg

SEQ ID NO: 307866 - DNA, 26 bp, Artificial Sequence
  Description of Artificial Sequence: Synthetic oligonucleotide
agctgttgcggaggctggccggtaaa

SEQ ID NO: 307867 - DNA, 25 bp, Artificial Sequence
  Description of Artificial Sequence: Synthetic oligonucleotide
gctgttgcggaggctggccggtaaa

SEQ ID NO: 307868 - DNA, 25 bp, Artificial Sequence
  Description of Artificial Sequence: Synthetic oligonucleotide
ctgttgcggaggctggccggtaaac

SEQ ID NO: 307869 - DNA, 27 bp, Artificial Sequence
  Description of Artificial Sequence: Synthetic oligonucleotide
tgttgcggaggctggccggtaaaccaa

SEQ ID NO: 307870 - DNA, 27 bp, Artificial Sequence
  Description of Artificial Sequence: Synthetic oligonucleotide
gttgcggaggctggccggtaaaccaaa

SEQ ID NO: 307871 - DNA, 29 bp, Artificial Sequence
  Description of Artificial Sequence: Synthetic oligonucleotide
ttgcggaggctggccggtaaaccaaaaag

SEQ ID NO: 307872 - DNA, 28 bp, Artificial Sequence
  Description of Artificial Sequence: Synthetic oligonucleotide
tgcggaggctggccggtaaaccaaaaag

SEQ ID NO: 307873 - DNA, 27 bp, Artificial Sequence
  Description of Artificial Sequence: Synthetic oligonucleotide
gcggaggctggccggtaaaccaaaaag

SEQ ID NO: 307874 - DNA, 27 bp, Artificial Sequence
  Description of Artificial Sequence: Synthetic oligonucleotide
cggaggctggccggtaaaccaaaaagc

SEQ ID NO: 307875 - DNA, 27 bp, Artificial Sequence
  Description of Artificial Sequence: Synthetic oligonucleotide
ggaggctggccggtaaaccaaaaagcc

SEQ ID NO: 307876 - DNA, 28 bp, Artificial Sequence
  Description of Artificial Sequence: Synthetic oligonucleotide
gaggctggccggtaaaccaaaaagccac

SEQ ID NO: 307877 - DNA, 28 bp, Artificial Sequence
  Description of Artificial Sequence: Synthetic oligonucleotide
aggctggccggtaaaccaaaaagccacg

SEQ ID NO: 307878 - DNA, 27 bp, Artificial Sequence
  Description of Artificial Sequence: Synthetic oligonucleotide
ggctggccggtaaaccaaaaagccacg

SEQ ID NO: 307879 - DNA, 27 bp, Artificial Sequence
  Description of Artificial Sequence: Synthetic oligonucleotide
gctggccggtaaaccaaaaagccacgc

SEQ ID NO: 307880 - DNA, 28 bp, Artificial Sequence
  Description of Artificial Sequence: Synthetic oligonucleotide
ctggccggtaaaccaaaaagccacgcac

SEQ ID NO: 307881 - DNA, 30 bp, Artificial Sequence
  Description of Artificial Sequence: Synthetic oligonucleotide
tggccggtaaaccaaaaagccacgcacatc

SEQ ID NO: 307882 - DNA, 29 bp, Artificial Sequence
  Description of Artificial Sequence: Synthetic oligonucleotide
ggccggtaaaccaaaaagccacgcacatc

SEQ ID NO: 307883 - DNA, 29 bp, Artificial Sequence
  Description of Artificial Sequence: Synthetic oligonucleotide
gccggtaaaccaaaaagccacgcacatcg

SEQ ID NO: 307884 - DNA, 30 bp, Artificial Sequence
  Description of Artificial Sequence: Synthetic oligonucleotide
ccggtaaaccaaaaagccacgcacatcgac

SEQ ID NO: 307885 - DNA, 30 bp, Artificial Sequence
  Description of Artificial Sequence: Synthetic oligonucleotide
cggtaaaccaaaaagccacgcacatcgacc

SEQ ID NO: 307886 - DNA, 33 bp, Artificial Sequence
  Description of Artificial Sequence: Synthetic oligonucleotide
ggtaaaccaaaaagccacgcacatcgacctatc

SEQ ID NO: 307887 - DNA, 35 bp, Artificial Sequence
  Description of Artificial Sequence: Synthetic oligonucleotide
gtaaaccaaaaagccacgcacatcgacctatcatc

SEQ ID NO: 307888 - DNA, 35 bp, Artificial Sequence
  Description of Artificial Sequence: Synthetic oligonucleotide
taaaccaaaaagccacgcacatcgacctatcatcc

SEQ ID NO: 307889 - DNA, 34 bp, Artificial Sequence
  Description of Artificial Sequence: Synthetic oligonucleotide
aaaccaaaaagccacgcacatcgacctatcatcc

SEQ ID NO: 307890 - DNA, 33 bp, Artificial Sequence
  Description of Artificial Sequence: Synthetic oligonucleotide
aaccaaaaagccacgcacatcgacctatcatcc

SEQ ID NO: 307891 - DNA, 32 bp, Artificial Sequence
  Description of Artificial Sequence: Synthetic oligonucleotide
accaaaaagccacgcacatcgacctatcatcc

SEQ ID NO: 307892 - DNA, 31 bp, Artificial Sequence
  Description of Artificial Sequence: Synthetic oligonucleotide
ccaaaaagccacgcacatcgacctatcatcc

SEQ ID NO: 307893 - DNA, 35 bp, Artificial Sequence
  Description of Artificial Sequence: Synthetic oligonucleotide
caaaaagccacgcacatcgacctatcatccttttc

SEQ ID NO: 307894 - DNA, 35 bp, Artificial Sequence
  Description of Artificial Sequence: Synthetic oligonucleotide
aaaaagccacgcacatcgacctatcatccttttcg

SEQ ID NO: 307895 - DNA, 34 bp, Artificial Sequence
  Description of Artificial Sequence: Synthetic oligonucleotide
aaaagccacgcacatcgacctatcatccttttcg

SEQ ID NO: 307896 - DNA, 33 bp, Artificial Sequence
  Description of Artificial Sequence: Synthetic oligonucleotide
aaagccacgcacatcgacctatcatccttttcg

SEQ ID NO: 307897 - DNA, 32 bp, Artificial Sequence
  Description of Artificial Sequence: Synthetic oligonucleotide
aagccacgcacatcgacctatcatccttttcg

SEQ ID NO: 307898 - DNA, 31 bp, Artificial Sequence
  Description of Artificial Sequence: Synthetic oligonucleotide
agccacgcacatcgacctatcatccttttcg

SEQ ID NO: 307899 - DNA, 30 bp, Artificial Sequence
  Description of Artificial Sequence: Synthetic oligonucleotide
gccacgcacatcgacctatcatccttttcg

SEQ ID NO: 307900 - DNA, 37 bp, Artificial Sequence
  Description of Artificial Sequence: Synthetic oligonucleotide
ccacgcacatcgacctatcatccttttcgtaataatg

SEQ ID NO: 307901 - DNA, 37 bp, Artificial Sequence
  Description of Artificial Sequence: Synthetic oligonucleotide
cacgcacatcgacctatcatccttttcgtaataatgc

SEQ ID NO: 307902 - DNA, 39 bp, Artificial Sequence
  Description of Artificial Sequence: Synthetic oligonucleotide
acgcacatcgacctatcatccttttcgtaataatgcatg

SEQ ID NO: 307903 - DNA, 38 bp, Artificial Sequence
  Description of Artificial Sequence: Synthetic oligonucleotide
cgcacatcgacctatcatccttttcgtaataatgcatg

SEQ ID NO: 307904 - DNA, 39 bp, Artificial Sequence
  Description of Artificial Sequence: Synthetic oligonucleotide
gcacatcgacctatcatccttttcgtaataatgcatgtc

SEQ ID NO: 307905 - DNA, 41 bp, Artificial Sequence
  Description of Artificial Sequence: Synthetic oligonucleotide
cacatcgacctatcatccttttcgtaataatgcatgtcttg

SEQ ID NO: 307906 - DNA, 41 bp, Artificial Sequence
  Description of Artificial Sequence: Synthetic oligonucleotide
acatcgacctatcatccttttcgtaataatgcatgtcttgg

SEQ ID NO: 307907 - DNA, 40 bp, Artificial Sequence
  Description of Artificial Sequence: Synthetic oligonucleotide
catcgacctatcatccttttcgtaataatgcatgtcttgg

SEQ ID NO: 307908 - DNA, 41 bp, Artificial Sequence
  Description of Artificial Sequence: Synthetic oligonucleotide
atcgacctatcatccttttcgtaataatgcatgtcttggtg

SEQ ID NO: 307909 - DNA, 40 bp, Artificial Sequence
  Description of Artificial Sequence: Synthetic oligonucleotide
tcgacctatcatccttttcgtaataatgcatgtcttggtg

SEQ ID NO: 307910 - DNA, 39 bp, Artificial Sequence
  Description of Artificial Sequence: Synthetic oligonucleotide
cgacctatcatccttttcgtaataatgcatgtcttggtg

SEQ ID NO: 307911 - DNA, 41 bp, Artificial Sequence
  Description of Artificial Sequence: Synthetic oligonucleotide
gacctatcatccttttcgtaataatgcatgtcttggtgttg

SEQ ID NO: 307912 - DNA, 44 bp, Artificial Sequence
  Description of Artificial Sequence: Synthetic oligonucleotide
acctatcatccttttcgtaataatgcatgtcttggtgttgtttg

SEQ ID NO: 307913 - DNA, 43 bp, Artificial Sequence
  Description of Artificial Sequence: Synthetic oligonucleotide
cctatcatccttttcgtaataatgcatgtcttggtgttgtttg

SEQ ID NO: 307914 - DNA, 43 bp, Artificial Sequence
  Description of Artificial Sequence: Synthetic oligonucleotide
ctatcatccttttcgtaataatgcatgtcttggtgttgtttgg

SEQ ID NO: 307915 - DNA, 46 bp, Artificial Sequence
  Description of Artificial Sequence: Synthetic oligonucleotide
tatcatccttttcgtaataatgcatgtcttggtgttgtttggtaac

SEQ ID NO: 307916 - DNA, 45 bp, Artificial Sequence
  Description of Artificial Sequence: Synthetic oligonucleotide
atcatccttttcgtaataatgcatgtcttggtgttgtttggtaac

SEQ ID NO: 307917 - DNA, 44 bp, Artificial Sequence
  Description of Artificial Sequence: Synthetic oligonucleotide
tcatccttttcgtaataatgcatgtcttggtgttgtttggtaac

SEQ ID NO: 307918 - DNA, 43 bp, Artificial Sequence
  Description of Artificial Sequence: Synthetic oligonucleotide
catccttttcgtaataatgcatgtcttggtgttgtttggtaac

SEQ ID NO: 307919 - DNA, 43 bp, Artificial Sequence
  Description of Artificial Sequence: Synthetic oligonucleotide
atccttttcgtaataatgcatgtcttggtgttgtttggtaacg

SEQ ID NO: 307920 - DNA, 42 bp, Artificial Sequence
  Description of Artificial Sequence: Synthetic oligonucleotide
tccttttcgtaataatgcatgtcttggtgttgtttggtaacg

SEQ ID NO: 307921 - DNA, 41 bp, Artificial Sequence
  Description of Artificial Sequence: Synthetic oligonucleotide
ccttttcgtaataatgcatgtcttggtgttgtttggtaacg

SEQ ID NO: 307922 - DNA, 41 bp, Artificial Sequence
  Description of Artificial Sequence: Synthetic oligonucleotide
cttttcgtaataatgcatgtcttggtgttgtttggtaacgg

SEQ ID NO: 307923 - DNA, 41 bp, Artificial Sequence
  Description of Artificial Sequence: Synthetic oligonucleotide
ttttcgtaataatgcatgtcttggtgttgtttggtaacggg

SEQ ID NO: 307924 - DNA, 40 bp, Artificial Sequence
  Description of Artificial Sequence: Synthetic oligonucleotide
tttcgtaataatgcatgtcttggtgttgtttggtaacggg

SEQ ID NO: 307925 - DNA, 39 bp, Artificial Sequence
  Description of Artificial Sequence: Synthetic oligonucleotide
ttcgtaataatgcatgtcttggtgttgtttggtaacggg

SEQ ID NO: 307926 - DNA, 38 bp, Artificial Sequence
  Description of Artificial Sequence: Synthetic oligonucleotide
tcgtaataatgcatgtcttggtgttgtttggtaacggg

SEQ ID NO: 307927 - DNA, 37 bp, Artificial Sequence
  Description of Artificial Sequence: Synthetic oligonucleotide
cgtaataatgcatgtcttggtgttgtttggtaacggg

SEQ ID NO: 307928 - DNA, 37 bp, Artificial Sequence
  Description of Artificial Sequence: Synthetic oligonucleotide
gtaataatgcatgtcttggtgttgtttggtaacgggg

SEQ ID NO: 307929 - DNA, 38 bp, Artificial Sequence
  Description of Artificial Sequence: Synthetic oligonucleotide
taataatgcatgtcttggtgttgtttggtaacggggtc

SEQ ID NO: 307930 - DNA, 37 bp, Artificial Sequence
  Description of Artificial Sequence: Synthetic oligonucleotide
aataatgcatgtcttggtgttgtttggtaacggggtc

SEQ ID NO: 307931 - DNA, 36 bp, Artificial Sequence
  Description of Artificial Sequence: Synthetic oligonucleotide
ataatgcatgtcttggtgttgtttggtaacggggtc

SEQ ID NO: 307932 - DNA, 35 bp, Artificial Sequence
  Description of Artificial Sequence: Synthetic oligonucleotide
taatgcatgtcttggtgttgtttggtaacggggtc

SEQ ID NO: 307933 - DNA, 34 bp, Artificial Sequence
  Description of Artificial Sequence: Synthetic oligonucleotide
aatgcatgtcttggtgttgtttggtaacggggtc

SEQ ID NO: 307934 - DNA, 33 bp, Artificial Sequence
  Description of Artificial Sequence: Synthetic oligonucleotide
atgcatgtcttggtgttgtttggtaacggggtc

SEQ ID NO: 307935 - DNA, 32 bp, Artificial Sequence
  Description of Artificial Sequence: Synthetic oligonucleotide
tgcatgtcttggtgttgtttggtaacggggtc

SEQ ID NO: 307936 - DNA, 31 bp, Artificial Sequence
  Description of Artificial Sequence: Synthetic oligonucleotide
gcatgtcttggtgttgtttggtaacggggtc

SEQ ID NO: 307937 - DNA, 31 bp, Artificial Sequence
  Description of Artificial Sequence: Synthetic oligonucleotide
catgtcttggtgttgtttggtaacggggtcc

SEQ ID NO: 307938 - DNA, 34 bp, Artificial Sequence
  Description of Artificial Sequence: Synthetic oligonucleotide
atgtcttggtgttgtttggtaacggggtccaaag

SEQ ID NO: 307939 - DNA, 33 bp, Artificial Sequence
  Description of Artificial Sequence: Synthetic oligonucleotide
tgtcttggtgttgtttggtaacggggtccaaag

SEQ ID NO: 307940 - DNA, 32 bp, Artificial Sequence
  Description of Artificial Sequence: Synthetic oligonucleotide
gtcttggtgttgtttggtaacggggtccaaag

SEQ ID NO: 307941 - DNA, 32 bp, Artificial Sequence
  Description of Artificial Sequence: Synthetic oligonucleotide
tcttggtgttgtttggtaacggggtccaaagc

SEQ ID NO: 307942 - DNA, 31 bp, Artificial Sequence
  Description of Artificial Sequence: Synthetic oligonucleotide
cttggtgttgtttggtaacggggtccaaagc

SEQ ID NO: 307943 - DNA, 31 bp, Artificial Sequence
  Description of Artificial Sequence: Synthetic oligonucleotide
ttggtgttgtttggtaacggggtccaaagcc

SEQ ID NO: 307944 - DNA, 30 bp, Artificial Sequence
  Description of Artificial Sequence: Synthetic oligonucleotide
tggtgttgtttggtaacggggtccaaagcc

SEQ ID NO: 307945 - DNA, 29 bp, Artificial Sequence
  Description of Artificial Sequence: Synthetic oligonucleotide
ggtgttgtttggtaacggggtccaaagcc

SEQ ID NO: 307946 - DNA, 29 bp, Artificial Sequence
  Description of Artificial Sequence: Synthetic oligonucleotide
gtgttgtttggtaacggggtccaaagccc

SEQ ID NO: 307947 - DNA, 29 bp, Artificial Sequence
  Description of Artificial Sequence: Synthetic oligonucleotide
tgttgtttggtaacggggtccaaagcccc

SEQ ID NO: 307948 - DNA, 28 bp, Artificial Sequence
  Description of Artificial Sequence: Synthetic oligonucleotide
gttgtttggtaacggggtccaaagcccc

SEQ ID NO: 307949 - DNA, 29 bp, Artificial Sequence
  Description of Artificial Sequence: Synthetic oligonucleotide
ttgtttggtaacggggtccaaagccccag

SEQ ID NO: 307950 - DNA, 28 bp, Artificial Sequence
  Description of Artificial Sequence: Synthetic oligonucleotide
tgtttggtaacggggtccaaagccccag

SEQ ID NO: 307951 - DNA, 27 bp, Artificial Sequence
  Description of Artificial Sequence: Synthetic oligonucleotide
gtttggtaacggggtccaaagccccag

SEQ ID NO: 307952 - DNA, 29 bp, Artificial Sequence
  Description of Artificial Sequence: Synthetic oligonucleotide
tttggtaacggggtccaaagccccagtag

SEQ ID NO: 307953 - DNA, 28 bp, Artificial Sequence
  Description of Artificial Sequence: Synthetic oligonucleotide
ttggtaacggggtccaaagccccagtag

SEQ ID NO: 307954 - DNA, 27 bp, Artificial Sequence
  Description of Artificial Sequence: Synthetic oligonucleotide
tggtaacggggtccaaagccccagtag

SEQ ID NO: 307955 - DNA, 27 bp, Artificial Sequence
  Description of Artificial Sequence: Synthetic oligonucleotide
ggtaacggggtccaaagccccagtagt

SEQ ID NO: 307956 - DNA, 27 bp, Artificial Sequence
  Description of Artificial Sequence: Synthetic oligonucleotide
gtaacggggtccaaagccccagtagtc

SEQ ID NO: 307957 - DNA, 31 bp, Artificial Sequence
  Description of Artificial Sequence: Synthetic oligonucleotide
taacggggtccaaagccccagtagtctaatg

SEQ ID NO: 307958 - DNA, 30 bp, Artificial Sequence
  Description of Artificial Sequence: Synthetic oligonucleotide
aacggggtccaaagccccagtagtctaatg

SEQ ID NO: 307959 - DNA, 29 bp, Artificial Sequence
  Description of Artificial Sequence: Synthetic oligonucleotide
acggggtccaaagccccagtagtctaatg

SEQ ID NO: 307960 - DNA, 28 bp, Artificial Sequence
  Description of Artificial Sequence: Synthetic oligonucleotide
cggggtccaaagccccagtagtctaatg

SEQ ID NO: 307961 - DNA, 28 bp, Artificial Sequence
  Description of Artificial Sequence: Synthetic oligonucleotide
ggggtccaaagccccagtagtctaatgg

SEQ ID NO: 307962 - DNA, 28 bp, Artificial Sequence
  Description of Artificial Sequence: Synthetic oligonucleotide
gggtccaaagccccagtagtctaatggc

SEQ ID NO: 307963 - DNA, 29 bp, Artificial Sequence
  Description of Artificial Sequence: Synthetic oligonucleotide
ggtccaaagccccagtagtctaatggcag

SEQ ID NO: 307964 - DNA, 29 bp, Artificial Sequence
  Description of Artificial Sequence: Synthetic oligonucleotide
gtccaaagccccagtagtctaatggcagg

SEQ ID NO: 307965 - DNA, 31 bp, Artificial Sequence
  Description of Artificial Sequence: Synthetic oligonucleotide
tccaaagccccagtagtctaatggcaggaag

SEQ ID NO: 307966 - DNA, 30 bp, Artificial Sequence
  Description of Artificial Sequence: Synthetic oligonucleotide
ccaaagccccagtagtctaatggcaggaag

SEQ ID NO: 307967 - DNA, 30 bp, Artificial Sequence
  Description of Artificial Sequence: Synthetic oligonucleotide
caaagccccagtagtctaatggcaggaagc

SEQ ID NO: 307968 - DNA, 30 bp, Artificial Sequence
  Description of Artificial Sequence: Synthetic oligonucleotide
aaagccccagtagtctaatggcaggaagcc

SEQ ID NO: 307969 - DNA, 29 bp, Artificial Sequence
  Description of Artificial Sequence: Synthetic oligonucleotide
aagccccagtagtctaatggcaggaagcc

SEQ ID NO: 307970 - DNA, 28 bp, Artificial Sequence
  Description of Artificial Sequence: Synthetic oligonucleotide
agccccagtagtctaatggcaggaagcc

SEQ ID NO: 307971 - DNA, 27 bp, Artificial Sequence
  Description of Artificial Sequence: Synthetic oligonucleotide
gccccagtagtctaatggcaggaagcc

SEQ ID NO: 307972 - DNA, 28 bp, Artificial Sequence
  Description of Artificial Sequence: Synthetic oligonucleotide
ccccagtagtctaatggcaggaagccag

SEQ ID NO: 307973 - DNA, 28 bp, Artificial Sequence
  Description of Artificial Sequence: Synthetic oligonucleotide
cccagtagtctaatggcaggaagccagg

SEQ ID NO: 307974 - DNA, 30 bp, Artificial Sequence
  Description of Artificial Sequence: Synthetic oligonucleotide
ccagtagtctaatggcaggaagccaggaac

SEQ ID NO: 307975 - DNA, 30 bp, Artificial Sequence
  Description of Artificial Sequence: Synthetic oligonucleotide
cagtagtctaatggcaggaagccaggaacg

SEQ ID NO: 307976 - DNA, 30 bp, Artificial Sequence
  Description of Artificial Sequence: Synthetic oligonucleotide
agtagtctaatggcaggaagccaggaacgg

SEQ ID NO: 307977 - DNA, 29 bp, Artificial Sequence
  Description of Artificial Sequence: Synthetic oligonucleotide
gtagtctaatggcaggaagccaggaacgg

SEQ ID NO: 307978 - DNA, 29 bp, Artificial Sequence
  Description of Artificial Sequence: Synthetic oligonucleotide
tagtctaatggcaggaagccaggaacggg

SEQ ID NO: 307979 - DNA, 28 bp, Artificial Sequence
  Description of Artificial Sequence: Synthetic oligonucleotide
agtctaatggcaggaagccaggaacggg

SEQ ID NO: 307980 - DNA, 27 bp, Artificial Sequence
  Description of Artificial Sequence: Synthetic oligonucleotide
gtctaatggcaggaagccaggaacggg

SEQ ID NO: 307981 - DNA, 27 bp, Artificial Sequence
  Description of Artificial Sequence: Synthetic oligonucleotide
tctaatggcaggaagccaggaacgggg

SEQ ID NO: 307982 - DNA, 26 bp, Artificial Sequence
  Description of Artificial Sequence: Synthetic oligonucleotide
ctaatggcaggaagccaggaacgggg

SEQ ID NO: 307983 - DNA, 27 bp, Artificial Sequence
  Description of Artificial Sequence: Synthetic oligonucleotide
taatggcaggaagccaggaacggggct

SEQ ID NO: 307984 - DNA, 27 bp, Artificial Sequence
  Description of Artificial Sequence: Synthetic oligonucleotide
aatggcaggaagccaggaacggggctt

SEQ ID NO: 307985 - DNA, 26 bp, Artificial Sequence
  Description of Artificial Sequence: Synthetic oligonucleotide
atggcaggaagccaggaacggggctt

SEQ ID NO: 307986 - DNA, 25 bp, Artificial Sequence
  Description of Artificial Sequence: Synthetic oligonucleotide
tggcaggaagccaggaacggggctt

SEQ ID NO: 307987 - DNA, 24 bp, Artificial Sequence
  Description of Artificial Sequence: Synthetic oligonucleotide
ggcaggaagccaggaacggggctt

SEQ ID NO: 307988 - DNA, 25 bp, Artificial Sequence
  Description of Artificial Sequence: Synthetic oligonucleotide
gcaggaagccaggaacggggcttct

SEQ ID NO: 307989 - DNA, 25 bp, Artificial Sequence
  Description of Artificial Sequence: Synthetic oligonucleotide
caggaagccaggaacggggcttctg

SEQ ID NO: 307990 - DNA, 27 bp, Artificial Sequence
  Description of Artificial Sequence: Synthetic oligonucleotide
aggaagccaggaacggggcttctgcat

SEQ ID NO: 307991 - DNA, 26 bp, Artificial Sequence
  Description of Artificial Sequence: Synthetic oligonucleotide
ggaagccaggaacggggcttctgcat

SEQ ID NO: 307992 - DNA, 26 bp, Artificial Sequence
  Description of Artificial Sequence: Synthetic oligonucleotide
gaagccaggaacggggcttctgcatg

SEQ ID NO: 307993 - DNA, 26 bp, Artificial Sequence
  Description of Artificial Sequence: Synthetic oligonucleotide
aagccaggaacggggcttctgcatgc

SEQ ID NO: 307994 - DNA, 25 bp, Artificial Sequence
  Description of Artificial Sequence: Synthetic oligonucleotide
agccaggaacggggcttctgcatgc

SEQ ID NO: 307995 - DNA, 24 bp, Artificial Sequence
  Description of Artificial Sequence: Synthetic oligonucleotide
gccaggaacggggcttctgcatgc

SEQ ID NO: 307996 - DNA, 25 bp, Artificial Sequence
  Description of Artificial Sequence: Synthetic oligonucleotide
ccaggaacggggcttctgcatgcct

SEQ ID NO: 307997 - DNA, 27 bp, Artificial Sequence
  Description of Artificial Sequence: Synthetic oligonucleotide
caggaacggggcttctgcatgcctgtt

SEQ ID NO: 307998 - DNA, 28 bp, Artificial Sequence
  Description of Artificial Sequence: Synthetic oligonucleotide
aggaacggggcttctgcatgcctgttag

SEQ ID NO: 307999 - DNA, 27 bp, Artificial Sequence
  Description of Artificial Sequence: Synthetic oligonucleotide
ggaacggggcttctgcatgcctgttag

SEQ ID NO: 308000 - DNA, 27 bp, Artificial Sequence
  Description of Artificial Sequence: Synthetic oligonucleotide
gaacggggcttctgcatgcctgttagg

SEQ ID NO: 308001 - DNA, 27 bp, Artificial Sequence
  Description of Artificial Sequence: Synthetic oligonucleotide
aacggggcttctgcatgcctgttaggg

SEQ ID NO: 308002 - DNA, 27 bp, Artificial Sequence
  Description of Artificial Sequence: Synthetic oligonucleotide
acggggcttctgcatgcctgttagggt

SEQ ID NO: 308003 - DNA, 27 bp, Artificial Sequence
  Description of Artificial Sequence: Synthetic oligonucleotide
cggggcttctgcatgcctgttagggta

SEQ ID NO: 308004 - DNA, 27 bp, Artificial Sequence
  Description of Artificial Sequence: Synthetic oligonucleotide
ggggcttctgcatgcctgttagggtac

SEQ ID NO: 308005 - DNA, 27 bp, Artificial Sequence
  Description of Artificial Sequence: Synthetic oligonucleotide
gggcttctgcatgcctgttagggtacc

SEQ ID NO: 308006 - DNA, 28 bp, Artificial Sequence
  Description of Artificial Sequence: Synthetic oligonucleotide
ggcttctgcatgcctgttagggtacctg

SEQ ID NO: 308007 - DNA, 29 bp, Artificial Sequence
  Description of Artificial Sequence: Synthetic oligonucleotide
gcttctgcatgcctgttagggtacctgac

SEQ ID NO: 308008 - DNA, 29 bp, Artificial Sequence
  Description of Artificial Sequence: Synthetic oligonucleotide
cttctgcatgcctgttagggtacctgacc

SEQ ID NO: 308009 - DNA, 31 bp, Artificial Sequence
  Description of Artificial Sequence: Synthetic oligonucleotide
ttctgcatgcctgttagggtacctgaccaac

SEQ ID NO: 308010 - DNA, 30 bp, Artificial Sequence
  Description of Artificial Sequence: Synthetic oligonucleotide
tctgcatgcctgttagggtacctgaccaac

SEQ ID NO: 308011 - DNA, 29 bp, Artificial Sequence
  Description of Artificial Sequence: Synthetic oligonucleotide
ctgcatgcctgttagggtacctgaccaac

SEQ ID NO: 308012 - DNA, 30 bp, Artificial Sequence
  Description of Artificial Sequence: Synthetic oligonucleotide
tgcatgcctgttagggtacctgaccaactg

SEQ ID NO: 308013 - DNA, 29 bp, Artificial Sequence
  Description of Artificial Sequence: Synthetic oligonucleotide
gcatgcctgttagggtacctgaccaactg

SEQ ID NO: 308014 - DNA, 29 bp, Artificial Sequence
  Description of Artificial Sequence: Synthetic oligonucleotide
catgcctgttagggtacctgaccaactgc

SEQ ID NO: 308015 - DNA, 30 bp, Artificial Sequence
  Description of Artificial Sequence: Synthetic oligonucleotide
atgcctgttagggtacctgaccaactgcag

SEQ ID NO: 308016 - DNA, 29 bp, Artificial Sequence
  Description of Artificial Sequence: Synthetic oligonucleotide
tgcctgttagggtacctgaccaactgcag

SEQ ID NO: 308017 - DNA, 28 bp, Artificial Sequence
  Description of Artificial Sequence: Synthetic oligonucleotide
gcctgttagggtacctgaccaactgcag

SEQ ID NO: 308018 - DNA, 28 bp, Artificial Sequence
  Description of Artificial Sequence: Synthetic oligonucleotide
cctgttagggtacctgaccaactgcagc

SEQ ID NO: 308019 - DNA, 28 bp, Artificial Sequence
  Description of Artificial Sequence: Synthetic oligonucleotide
ctgttagggtacctgaccaactgcagcg

SEQ ID NO: 308020 - DNA, 28 bp, Artificial Sequence
  Description of Artificial Sequence: Synthetic oligonucleotide
tgttagggtacctgaccaactgcagcgc

SEQ ID NO: 308021 - DNA, 27 bp, Artificial Sequence
  Description of Artificial Sequence: Synthetic oligonucleotide
gttagggtacctgaccaactgcagcgc

SEQ ID NO: 308022 - DNA, 27 bp, Artificial Sequence
  Description of Artificial Sequence: Synthetic oligonucleotide
ttagggtacctgaccaactgcagcgcc

SEQ ID NO: 308023 - DNA, 27 bp, Artificial Sequence
  Description of Artificial Sequence: Synthetic oligonucleotide
tagggtacctgaccaactgcagcgcct

SEQ ID NO: 308024 - DNA, 26 bp, Artificial Sequence
  Description of Artificial Sequence: Synthetic oligonucleotide
agggtacctgaccaactgcagcgcct

SEQ ID NO: 308025 - DNA, 25 bp, Artificial Sequence
  Description of Artificial Sequence: Synthetic oligonucleotide
gggtacctgaccaactgcagcgcct

SEQ ID NO: 308026 - DNA, 26 bp, Artificial Sequence
  Description of Artificial Sequence: Synthetic oligonucleotide
ggtacctgaccaactgcagcgcctct

SEQ ID NO: 308027 - DNA, 26 bp, Artificial Sequence
  Description of Artificial Sequence: Synthetic oligonucleotide
gtacctgaccaactgcagcgcctctc

SEQ ID NO: 308028 - DNA, 27 bp, Artificial Sequence
  Description of Artificial Sequence: Synthetic oligonucleotide
tacctgaccaactgcagcgcctctcgt

SEQ ID NO: 308029 - DNA, 27 bp, Artificial Sequence
  Description of Artificial Sequence: Synthetic oligonucleotide
acctgaccaactgcagcgcctctcgtt

SEQ ID NO: 308030 - DNA, 26 bp, Artificial Sequence
  Description of Artificial Sequence: Synthetic oligonucleotide
cctgaccaactgcagcgcctctcgtt

SEQ ID NO: 308031 - DNA, 26 bp, Artificial Sequence
  Description of Artificial Sequence: Synthetic oligonucleotide
ctgaccaactgcagcgcctctcgttg

SEQ ID NO: 308032 - DNA, 26 bp, Artificial Sequence
  Description of Artificial Sequence: Synthetic oligonucleotide
tgaccaactgcagcgcctctcgttgc

SEQ ID NO: 308033 - DNA, 25 bp, Artificial Sequence
  Description of Artificial Sequence: Synthetic oligonucleotide
gaccaactgcagcgcctctcgttgc

SEQ ID NO: 308034 - DNA, 27 bp, Artificial Sequence
  Description of Artificial Sequence: Synthetic oligonucleotide
accaactgcagcgcctctcgttgcgaa

SEQ ID NO: 308035 - DNA, 26 bp, Artificial Sequence
  Description of Artificial Sequence: Synthetic oligonucleotide
ccaactgcagcgcctctcgttgcgaa

SEQ ID NO: 308036 - DNA, 26 bp, Artificial Sequence
  Description of Artificial Sequence: Synthetic oligonucleotide
caactgcagcgcctctcgttgcgaag

SEQ ID NO: 308037 - DNA, 27 bp, Artificial Sequence
  Description of Artificial Sequence: Synthetic oligonucleotide
aactgcagcgcctctcgttgcgaagga

SEQ ID NO: 308038 - DNA, 27 bp, Artificial Sequence
  Description of Artificial Sequence: Synthetic oligonucleotide
actgcagcgcctctcgttgcgaaggat

SEQ ID NO: 308039 - DNA, 26 bp, Artificial Sequence
  Description of Artificial Sequence: Synthetic oligonucleotide
ctgcagcgcctctcgttgcgaaggat

SEQ ID NO: 308040 - DNA, 26 bp, Artificial Sequence
  Description of Artificial Sequence: Synthetic oligonucleotide
tgcagcgcctctcgttgcgaaggatg

SEQ ID NO: 308041 - DNA, 25 bp, Artificial Sequence
  Description of Artificial Sequence: Synthetic oligonucleotide
gcagcgcctctcgttgcgaaggatg

SEQ ID NO: 308042 - DNA, 26 bp, Artificial Sequence
  Description of Artificial Sequence: Synthetic oligonucleotide
cagcgcctctcgttgcgaaggatggt

SEQ ID NO: 308043 - DNA, 27 bp, Artificial Sequence
  Description of Artificial Sequence: Synthetic oligonucleotide
agcgcctctcgttgcgaaggatggtgt

SEQ ID NO: 308044 - DNA, 27 bp, Artificial Sequence
  Description of Artificial Sequence: Synthetic oligonucleotide
gcgcctctcgttgcgaaggatggtgta

SEQ ID NO: 308045 - DNA, 27 bp, Artificial Sequence
  Description of Artificial Sequence: Synthetic oligonucleotide
cgcctctcgttgcgaaggatggtgtac

SEQ ID NO: 308046 - DNA, 27 bp, Artificial Sequence
  Description of Artificial Sequence: Synthetic oligonucleotide
gcctctcgttgcgaaggatggtgtacc

SEQ ID NO: 308047 - DNA, 27 bp, Artificial Sequence
  Description of Artificial Sequence: Synthetic oligonucleotide
cctctcgttgcgaaggatggtgtaccc

SEQ ID NO: 308048 - DNA, 27 bp, Artificial Sequence
  Description of Artificial Sequence: Synthetic oligonucleotide
ctctcgttgcgaaggatggtgtacccc

SEQ ID NO: 308049 - DNA, 27 bp, Artificial Sequence
  Description of Artificial Sequence: Synthetic oligonucleotide
tctcgttgcgaaggatggtgtaccccc

SEQ ID NO: 308050 - DNA, 27 bp, Artificial Sequence
  Description of Artificial Sequence: Synthetic oligonucleotide
ctcgttgcgaaggatggtgtaccccca

SEQ ID NO: 308051 - DNA, 27 bp, Artificial Sequence
  Description of Artificial Sequence: Synthetic oligonucleotide
tcgttgcgaaggatggtgtacccccag

SEQ ID NO: 308052 - DNA, 26 bp, Artificial Sequence
  Description of Artificial Sequence: Synthetic oligonucleotide
cgttgcgaaggatggtgtacccccag

SEQ ID NO: 308053 - DNA, 26 bp, Artificial Sequence
  Description of Artificial Sequence: Synthetic oligonucleotide
gttgcgaaggatggtgtacccccagg

SEQ ID NO: 308054 - DNA, 27 bp, Artificial Sequence
  Description of Artificial Sequence: Synthetic oligonucleotide
ttgcgaaggatggtgtacccccaggca

SEQ ID NO: 308055 - DNA, 27 bp, Artificial Sequence
  Description of Artificial Sequence: Synthetic oligonucleotide
tgcgaaggatggtgtacccccaggcaa

SEQ ID NO: 308056 - DNA, 27 bp, Artificial Sequence
  Description of Artificial Sequence: Synthetic oligonucleotide
gcgaaggatggtgtacccccaggcaaa

SEQ ID NO: 308057 - DNA, 27 bp, Artificial Sequence
  Description of Artificial Sequence: Synthetic oligonucleotide
cgaaggatggtgtacccccaggcaaag

SEQ ID NO: 308058 - DNA, 27 bp, Artificial Sequence
  Description of Artificial Sequence: Synthetic oligonucleotide
gaaggatggtgtacccccaggcaaagg

SEQ ID NO: 308059 - DNA, 28 bp, Artificial Sequence
  Description of Artificial Sequence: Synthetic oligonucleotide
aaggatggtgtacccccaggcaaaggtg

SEQ ID NO: 308060 - DNA, 27 bp, Artificial Sequence
  Description of Artificial Sequence: Synthetic oligonucleotide
aggatggtgtacccccaggcaaaggtg

SEQ ID NO: 308061 - DNA, 26 bp, Artificial Sequence
  Description of Artificial Sequence: Synthetic oligonucleotide
ggatggtgtacccccaggcaaaggtg

SEQ ID NO: 308062 - DNA, 27 bp, Artificial Sequence
  Description of Artificial Sequence: Synthetic oligonucleotide
gatggtgtacccccaggcaaaggtgca

SEQ ID NO: 308063 - DNA, 27 bp, Artificial Sequence
  Description of Artificial Sequence: Synthetic oligonucleotide
atggtgtacccccaggcaaaggtgcag

SEQ ID NO: 308064 - DNA, 27 bp, Artificial Sequence
  Description of Artificial Sequence: Synthetic oligonucleotide
tggtgtacccccaggcaaaggtgcaga

SEQ ID NO: 308065 - DNA, 26 bp, Artificial Sequence
  Description of Artificial Sequence: Synthetic oligonucleotide
ggtgtacccccaggcaaaggtgcaga

SEQ ID NO: 308066 - DNA, 27 bp, Artificial Sequence
  Description of Artificial Sequence: Synthetic oligonucleotide
gtgtacccccaggcaaaggtgcagaca

SEQ ID NO: 308067 - DNA, 27 bp, Artificial Sequence
  Description of Artificial Sequence: Synthetic oligonucleotide
tgtacccccaggcaaaggtgcagacac

SEQ ID NO: 308068 - DNA, 26 bp, Artificial Sequence
  Description of Artificial Sequence: Synthetic oligonucleotide
gtacccccaggcaaaggtgcagacac

SEQ ID NO: 308069 - DNA, 26 bp, Artificial Sequence
  Description of Artificial Sequence: Synthetic oligonucleotide
tacccccaggcaaaggtgcagacacc

SEQ ID NO: 308070 - DNA, 25 bp, Artificial Sequence
  Description of Artificial Sequence: Synthetic oligonucleotide
acccccaggcaaaggtgcagacacc

SEQ ID NO: 308071 - DNA, 24 bp, Artificial Sequence
  Description of Artificial Sequence: Synthetic oligonucleotide
cccccaggcaaaggtgcagacacc

SEQ ID NO: 308072 - DNA, 25 bp, Artificial Sequence
  Description of Artificial Sequence: Synthetic oligonucleotide
ccccaggcaaaggtgcagacaccgt

SEQ ID NO: 308073 - DNA, 27 bp, Artificial Sequence
  Description of Artificial Sequence: Synthetic oligonucleotide
cccaggcaaaggtgcagacaccgtgaa

SEQ ID NO: 308074 - DNA, 27 bp, Artificial Sequence
  Description of Artificial Sequence: Synthetic oligonucleotide
ccaggcaaaggtgcagacaccgtgaag

SEQ ID NO: 308075 - DNA, 27 bp, Artificial Sequence
  Description of Artificial Sequence: Synthetic oligonucleotide
caggcaaaggtgcagacaccgtgaagg

SEQ ID NO: 308076 - DNA, 29 bp, Artificial Sequence
  Description of Artificial Sequence: Synthetic oligonucleotide
aggcaaaggtgcagacaccgtgaaggaag

SEQ ID NO: 308077 - DNA, 28 bp, Artificial Sequence
  Description of Artificial Sequence: Synthetic oligonucleotide
ggcaaaggtgcagacaccgtgaaggaag

SEQ ID NO: 308078 - DNA, 28 bp, Artificial Sequence
  Description of Artificial Sequence: Synthetic oligonucleotide
gcaaaggtgcagacaccgtgaaggaagg

SEQ ID NO: 308079 - DNA, 30 bp, Artificial Sequence
  Description of Artificial Sequence: Synthetic oligonucleotide
caaaggtgcagacaccgtgaaggaaggatc

SEQ ID NO: 308080 - DNA, 31 bp, Artificial Sequence
  Description of Artificial Sequence: Synthetic oligonucleotide
aaaggtgcagacaccgtgaaggaaggatctc

SEQ ID NO: 308081 - DNA, 30 bp, Artificial Sequence
  Description of Artificial Sequence: Synthetic oligonucleotide
aaggtgcagacaccgtgaaggaaggatctc

SEQ ID NO: 308082 - DNA, 29 bp, Artificial Sequence
  Description of Artificial Sequence: Synthetic oligonucleotide
aggtgcagacaccgtgaaggaaggatctc

SEQ ID NO: 308083 - DNA, 28 bp, Artificial Sequence
  Description of Artificial Sequence: Synthetic oligonucleotide
ggtgcagacaccgtgaaggaaggatctc

SEQ ID NO: 308084 - DNA, 28 bp, Artificial Sequence
  Description of Artificial Sequence: Synthetic oligonucleotide
gtgcagacaccgtgaaggaaggatctcc

SEQ ID NO: 308085 - DNA, 29 bp, Artificial Sequence
  Description of Artificial Sequence: Synthetic oligonucleotide
tgcagacaccgtgaaggaaggatctcctc

SEQ ID NO: 308086 - DNA, 28 bp, Artificial Sequence
  Description of Artificial Sequence: Synthetic oligonucleotide
gcagacaccgtgaaggaaggatctcctc

SEQ ID NO: 308087 - DNA, 28 bp, Artificial Sequence
  Description of Artificial Sequence: Synthetic oligonucleotide
cagacaccgtgaaggaaggatctcctcg

SEQ ID NO: 308088 - DNA, 29 bp, Artificial Sequence
  Description of Artificial Sequence: Synthetic oligonucleotide
agacaccgtgaaggaaggatctcctcgtg

SEQ ID NO: 308089 - DNA, 28 bp, Artificial Sequence
  Description of Artificial Sequence: Synthetic oligonucleotide
gacaccgtgaaggaaggatctcctcgtg

SEQ ID NO: 308090 - DNA, 28 bp, Artificial Sequence
  Description of Artificial Sequence: Synthetic oligonucleotide
acaccgtgaaggaaggatctcctcgtgg

SEQ ID NO: 308091 - DNA, 27 bp, Artificial Sequence
  Description of Artificial Sequence: Synthetic oligonucleotide
caccgtgaaggaaggatctcctcgtgg

SEQ ID NO: 308092 - DNA, 28 bp, Artificial Sequence
  Description of Artificial Sequence: Synthetic oligonucleotide
accgtgaaggaaggatctcctcgtggag

SEQ ID NO: 308093 - DNA, 27 bp, Artificial Sequence
  Description of Artificial Sequence: Synthetic oligonucleotide
ccgtgaaggaaggatctcctcgtggag

SEQ ID NO: 308094 - DNA, 28 bp, Artificial Sequence
  Description of Artificial Sequence: Synthetic oligonucleotide
cgtgaaggaaggatctcctcgtggagac

SEQ ID NO: 308095 - DNA, 28 bp, Artificial Sequence
  Description of Artificial Sequence: Synthetic oligonucleotide
gtgaaggaaggatctcctcgtggagacc

SEQ ID NO: 308096 - DNA, 28 bp, Artificial Sequence
  Description of Artificial Sequence: Synthetic oligonucleotide
tgaaggaaggatctcctcgtggagaccc

SEQ ID NO: 308097 - DNA, 27 bp, Artificial Sequence
  Description of Artificial Sequence: Synthetic oligonucleotide
gaaggaaggatctcctcgtggagaccc

SEQ ID NO: 308098 - DNA, 27 bp, Artificial Sequence
  Description of Artificial Sequence: Synthetic oligonucleotide
aaggaaggatctcctcgtggagacccc

SEQ ID NO: 308099 - DNA, 27 bp, Artificial Sequence
  Description of Artificial Sequence: Synthetic oligonucleotide
aggaaggatctcctcgtggagacccct

SEQ ID NO: 308100 - DNA, 27 bp, Artificial Sequence
  Description of Artificial Sequence: Synthetic oligonucleotide
ggaaggatctcctcgtggagacccctt

SEQ ID NO: 308101 - DNA, 27 bp, Artificial Sequence
  Description of Artificial Sequence: Synthetic oligonucleotide
gaaggatctcctcgtggagaccccttg

SEQ ID NO: 308102 - DNA, 27 bp, Artificial Sequence
  Description of Artificial Sequence: Synthetic oligonucleotide
aaggatctcctcgtggagaccccttgc

SEQ ID NO: 308103 - DNA, 26 bp, Artificial Sequence
  Description of Artificial Sequence: Synthetic oligonucleotide
aggatctcctcgtggagaccccttgc

SEQ ID NO: 308104 - DNA, 25 bp, Artificial Sequence
  Description of Artificial Sequence: Synthetic oligonucleotide
ggatctcctcgtggagaccccttgc

SEQ ID NO: 308105 - DNA, 26 bp, Artificial Sequence
  Description of Artificial Sequence: Synthetic oligonucleotide
gatctcctcgtggagaccccttgcct

SEQ ID NO: 308106 - DNA, 26 bp, Artificial Sequence
  Description of Artificial Sequence: Synthetic oligonucleotide
atctcctcgtggagaccccttgcctg

SEQ ID NO: 308107 - DNA, 25 bp, Artificial Sequence
  Description of Artificial Sequence: Synthetic oligonucleotide
tctcctcgtggagaccccttgcctg

SEQ ID NO: 308108 - DNA, 24 bp, Artificial Sequence
  Description of Artificial Sequence: Synthetic oligonucleotide
ctcctcgtggagaccccttgcctg

SEQ ID NO: 308109 - DNA, 24 bp, Artificial Sequence
  Description of Artificial Sequence: Synthetic oligonucleotide
tcctcgtggagaccccttgcctgg

SEQ ID NO: 308110 - DNA, 23 bp, Artificial Sequence
  Description of Artificial Sequence: Synthetic oligonucleotide
cctcgtggagaccccttgcctgg

SEQ ID NO: 308111 - DNA, 24 bp, Artificial Sequence
  Description of Artificial Sequence: Synthetic oligonucleotide
ctcgtggagaccccttgcctggct

SEQ ID NO: 308112 - DNA, 24 bp, Artificial Sequence
  Description of Artificial Sequence: Synthetic oligonucleotide
tcgtggagaccccttgcctggctc

SEQ ID NO: 308113 - DNA, 23 bp, Artificial Sequence
  Description of Artificial Sequence: Synthetic oligonucleotide
cgtggagaccccttgcctggctc

SEQ ID NO: 308114 - DNA, 23 bp, Artificial Sequence
  Description of Artificial Sequence: Synthetic oligonucleotide
gtggagaccccttgcctggctcc

SEQ ID NO: 308115 - DNA, 26 bp, Artificial Sequence
  Description of Artificial Sequence: Synthetic oligonucleotide
tggagaccccttgcctggctcccttt

SEQ ID NO: 308116 - DNA, 25 bp, Artificial Sequence
  Description of Artificial Sequence: Synthetic oligonucleotide
ggagaccccttgcctggctcccttt

SEQ ID NO: 308117 - DNA, 26 bp, Artificial Sequence
  Description of Artificial Sequence: Synthetic oligonucleotide
gagaccccttgcctggctccctttgt

SEQ ID NO: 308118 - DNA, 27 bp, Artificial Sequence
  Description of Artificial Sequence: Synthetic oligonucleotide
agaccccttgcctggctccctttgtct

SEQ ID NO: 308119 - DNA, 26 bp, Artificial Sequence
  Description of Artificial Sequence: Synthetic oligonucleotide
gaccccttgcctggctccctttgtct

SEQ ID NO: 308120 - DNA, 26 bp, Artificial Sequence
  Description of Artificial Sequence: Synthetic oligonucleotide
accccttgcctggctccctttgtctg

SEQ ID NO: 308121 - DNA, 25 bp, Artificial Sequence
  Description of Artificial Sequence: Synthetic oligonucleotide
ccccttgcctggctccctttgtctg

SEQ ID NO: 308122 - DNA, 25 bp, Artificial Sequence
  Description of Artificial Sequence: Synthetic oligonucleotide
cccttgcctggctccctttgtctgg

SEQ ID NO: 308123 - DNA, 26 bp, Artificial Sequence
  Description of Artificial Sequence: Synthetic oligonucleotide
ccttgcctggctccctttgtctgggt

SEQ ID NO: 308124 - DNA, 26 bp, Artificial Sequence
  Description of Artificial Sequence: Synthetic oligonucleotide
cttgcctggctccctttgtctgggtg

SEQ ID NO: 308125 - DNA, 26 bp, Artificial Sequence
  Description of Artificial Sequence: Synthetic oligonucleotide
ttgcctggctccctttgtctgggtgg

SEQ ID NO: 308126 - DNA, 25 bp, Artificial Sequence
  Description of Artificial Sequence: Synthetic oligonucleotide
tgcctggctccctttgtctgggtgg

SEQ ID NO: 308127 - DNA, 24 bp, Artificial Sequence
  Description of Artificial Sequence: Synthetic oligonucleotide
gcctggctccctttgtctgggtgg

SEQ ID NO: 308128 - DNA, 24 bp, Artificial Sequence
  Description of Artificial Sequence: Synthetic oligonucleotide
cctggctccctttgtctgggtggg

SEQ ID NO: 308129 - DNA, 25 bp, Artificial Sequence
  Description of Artificial Sequence: Synthetic oligonucleotide
ctggctccctttgtctgggtgggca

SEQ ID NO: 308130 - DNA, 27 bp, Artificial Sequence
  Description of Artificial Sequence: Synthetic oligonucleotide
tggctccctttgtctgggtgggcacat

SEQ ID NO: 308131 - DNA, 27 bp, Artificial Sequence
  Description of Artificial Sequence: Synthetic oligonucleotide
ggctccctttgtctgggtgggcacatt

SEQ ID NO: 308132 - DNA, 27 bp, Artificial Sequence
  Description of Artificial Sequence: Synthetic oligonucleotide
gctccctttgtctgggtgggcacattg

SEQ ID NO: 308133 - DNA, 29 bp, Artificial Sequence
  Description of Artificial Sequence: Synthetic oligonucleotide
ctccctttgtctgggtgggcacattgaac

SEQ ID NO: 308134 - DNA, 31 bp, Artificial Sequence
  Description of Artificial Sequence: Synthetic oligonucleotide
tccctttgtctgggtgggcacattgaacatc

SEQ ID NO: 308135 - DNA, 30 bp, Artificial Sequence
  Description of Artificial Sequence: Synthetic oligonucleotide
ccctttgtctgggtgggcacattgaacatc

SEQ ID NO: 308136 - DNA, 30 bp, Artificial Sequence
  Description of Artificial Sequence: Synthetic oligonucleotide
cctttgtctgggtgggcacattgaacatcg

SEQ ID NO: 308137 - DNA, 31 bp, Artificial Sequence
  Description of Artificial Sequence: Synthetic oligonucleotide
ctttgtctgggtgggcacattgaacatcgac

SEQ ID NO: 308138 - DNA, 33 bp, Artificial Sequence
  Description of Artificial Sequence: Synthetic oligonucleotide
tttgtctgggtgggcacattgaacatcgacttc

SEQ ID NO: 308139 - DNA, 32 bp, Artificial Sequence
  Description of Artificial Sequence: Synthetic oligonucleotide
ttgtctgggtgggcacattgaacatcgacttc

SEQ ID NO: 308140 - DNA, 31 bp, Artificial Sequence
  Description of Artificial Sequence: Synthetic oligonucleotide
tgtctgggtgggcacattgaacatcgacttc

SEQ ID NO: 308141 - DNA, 30 bp, Artificial Sequence
  Description of Artificial Sequence: Synthetic oligonucleotide
gtctgggtgggcacattgaacatcgacttc

SEQ ID NO: 308142 - DNA, 30 bp, Artificial Sequence
  Description of Artificial Sequence: Synthetic oligonucleotide
tctgggtgggcacattgaacatcgacttcc

SEQ ID NO: 308143 - DNA, 29 bp, Artificial Sequence
  Description of Artificial Sequence: Synthetic oligonucleotide
ctgggtgggcacattgaacatcgacttcc

SEQ ID NO: 308144 - DNA, 30 bp, Artificial Sequence
  Description of Artificial Sequence: Synthetic oligonucleotide
tgggtgggcacattgaacatcgacttcctc

SEQ ID NO: 308145 - DNA, 29 bp, Artificial Sequence
  Description of Artificial Sequence: Synthetic oligonucleotide
gggtgggcacattgaacatcgacttcctc

SEQ ID NO: 308146 - DNA, 31 bp, Artificial Sequence
  Description of Artificial Sequence: Synthetic oligonucleotide
ggtgggcacattgaacatcgacttcctcaac

SEQ ID NO: 308147 - DNA, 31 bp, Artificial Sequence
  Description of Artificial Sequence: Synthetic oligonucleotide
gtgggcacattgaacatcgacttcctcaacg

SEQ ID NO: 308148 - DNA, 32 bp, Artificial Sequence
  Description of Artificial Sequence: Synthetic oligonucleotide
tgggcacattgaacatcgacttcctcaacgtg

SEQ ID NO: 308149 - DNA, 31 bp, Artificial Sequence
  Description of Artificial Sequence: Synthetic oligonucleotide
gggcacattgaacatcgacttcctcaacgtg

SEQ ID NO: 308150 - DNA, 31 bp, Artificial Sequence
  Description of Artificial Sequence: Synthetic oligonucleotide
ggcacattgaacatcgacttcctcaacgtgc

SEQ ID NO: 308151 - DNA, 32 bp, Artificial Sequence
  Description of Artificial Sequence: Synthetic oligonucleotide
gcacattgaacatcgacttcctcaacgtgcag

SEQ ID NO: 308152 - DNA, 34 bp, Artificial Sequence
  Description of Artificial Sequence: Synthetic oligonucleotide
cacattgaacatcgacttcctcaacgtgcagttc

SEQ ID NO: 308153 - DNA, 35 bp, Artificial Sequence
  Description of Artificial Sequence: Synthetic oligonucleotide
acattgaacatcgacttcctcaacgtgcagttcag

SEQ ID NO: 308154 - DNA, 34 bp, Artificial Sequence
  Description of Artificial Sequence: Synthetic oligonucleotide
cattgaacatcgacttcctcaacgtgcagttcag

SEQ ID NO: 308155 - DNA, 34 bp, Artificial Sequence
  Description of Artificial Sequence: Synthetic oligonucleotide
attgaacatcgacttcctcaacgtgcagttcagc

SEQ ID NO: 308156 - DNA, 33 bp, Artificial Sequence
  Description of Artificial Sequence: Synthetic oligonucleotide
ttgaacatcgacttcctcaacgtgcagttcagc

SEQ ID NO: 308157 - DNA, 32 bp, Artificial Sequence
  Description of Artificial Sequence: Synthetic oligonucleotide
tgaacatcgacttcctcaacgtgcagttcagc

SEQ ID NO: 308158 - DNA, 31 bp, Artificial Sequence
  Description of Artificial Sequence: Synthetic oligonucleotide
gaacatcgacttcctcaacgtgcagttcagc

SEQ ID NO: 308159 - DNA, 31 bp, Artificial Sequence
  Description of Artificial Sequence: Synthetic oligonucleotide
aacatcgacttcctcaacgtgcagttcagcc

SEQ ID NO: 308160 - DNA, 30 bp, Artificial Sequence
  Description of Artificial Sequence: Synthetic oligonucleotide
acatcgacttcctcaacgtgcagttcagcc

SEQ ID NO: 308161 - DNA, 29 bp, Artificial Sequence
  Description of Artificial Sequence: Synthetic oligonucleotide
catcgacttcctcaacgtgcagttcagcc

SEQ ID NO: 308162 - DNA, 30 bp, Artificial Sequence
  Description of Artificial Sequence: Synthetic oligonucleotide
atcgacttcctcaacgtgcagttcagcctc

SEQ ID NO: 308163 - DNA, 29 bp, Artificial Sequence
  Description of Artificial Sequence: Synthetic oligonucleotide
tcgacttcctcaacgtgcagttcagcctc

SEQ ID NO: 308164 - DNA, 28 bp, Artificial Sequence
  Description of Artificial Sequence: Synthetic oligonucleotide
cgacttcctcaacgtgcagttcagcctc

SEQ ID NO: 308165 - DNA, 28 bp, Artificial Sequence
  Description of Artificial Sequence: Synthetic oligonucleotide
gacttcctcaacgtgcagttcagcctcc

SEQ ID NO: 308166 - DNA, 29 bp, Artificial Sequence
  Description of Artificial Sequence: Synthetic oligonucleotide
acttcctcaacgtgcagttcagcctccag

SEQ ID NO: 308167 - DNA, 28 bp, Artificial Sequence
  Description of Artificial Sequence: Synthetic oligonucleotide
cttcctcaacgtgcagttcagcctccag

SEQ ID NO: 308168 - DNA, 30 bp, Artificial Sequence
  Description of Artificial Sequence: Synthetic oligonucleotide
ttcctcaacgtgcagttcagcctccagaac

SEQ ID NO: 308169 - DNA, 29 bp, Artificial Sequence
  Description of Artificial Sequence: Synthetic oligonucleotide
tcctcaacgtgcagttcagcctccagaac

SEQ ID NO: 308170 - DNA, 28 bp, Artificial Sequence
  Description of Artificial Sequence: Synthetic oligonucleotide
cctcaacgtgcagttcagcctccagaac

SEQ ID NO: 308171 - DNA, 29 bp, Artificial Sequence
  Description of Artificial Sequence: Synthetic oligonucleotide
ctcaacgtgcagttcagcctccagaactc

SEQ ID NO: 308172 - DNA, 29 bp, Artificial Sequence
  Description of Artificial Sequence: Synthetic oligonucleotide
tcaacgtgcagttcagcctccagaactcc

SEQ ID NO: 308173 - DNA, 28 bp, Artificial Sequence
  Description of Artificial Sequence: Synthetic oligonucleotide
caacgtgcagttcagcctccagaactcc

SEQ ID NO: 308174 - DNA, 29 bp, Artificial Sequence
  Description of Artificial Sequence: Synthetic oligonucleotide
aacgtgcagttcagcctccagaactccac

SEQ ID NO: 308175 - DNA, 28 bp, Artificial Sequence
  Description of Artificial Sequence: Synthetic oligonucleotide
acgtgcagttcagcctccagaactccac

SEQ ID NO: 308176 - DNA, 27 bp, Artificial Sequence
  Description of Artificial Sequence: Synthetic oligonucleotide
cgtgcagttcagcctccagaactccac

SEQ ID NO: 308177 - DNA, 27 bp, Artificial Sequence
  Description of Artificial Sequence: Synthetic oligonucleotide
gtgcagttcagcctccagaactccacc

SEQ ID NO: 308178 - DNA, 30 bp, Artificial Sequence
  Description of Artificial Sequence: Synthetic oligonucleotide
tgcagttcagcctccagaactccaccattg

SEQ ID NO: 308179 - DNA, 29 bp, Artificial Sequence
  Description of Artificial Sequence: Synthetic oligonucleotide
gcagttcagcctccagaactccaccattg

SEQ ID NO: 308180 - DNA, 29 bp, Artificial Sequence
  Description of Artificial Sequence: Synthetic oligonucleotide
cagttcagcctccagaactccaccattgc

SEQ ID NO: 308181 - DNA, 29 bp, Artificial Sequence
  Description of Artificial Sequence: Synthetic oligonucleotide
agttcagcctccagaactccaccattgcg

SEQ ID NO: 308182 - DNA, 28 bp, Artificial Sequence
  Description of Artificial Sequence: Synthetic oligonucleotide
gttcagcctccagaactccaccattgcg

SEQ ID NO: 308183 - DNA, 32 bp, Artificial Sequence
  Description of Artificial Sequence: Synthetic oligonucleotide
ttcagcctccagaactccaccattgcgttaac

SEQ ID NO: 308184 - DNA, 31 bp, Artificial Sequence
  Description of Artificial Sequence: Synthetic oligonucleotide
tcagcctccagaactccaccattgcgttaac

SEQ ID NO: 308185 - DNA, 30 bp, Artificial Sequence
  Description of Artificial Sequence: Synthetic oligonucleotide
cagcctccagaactccaccattgcgttaac

SEQ ID NO: 308186 - DNA, 31 bp, Artificial Sequence
  Description of Artificial Sequence: Synthetic oligonucleotide
agcctccagaactccaccattgcgttaactg

SEQ ID NO: 308187 - DNA, 30 bp, Artificial Sequence
  Description of Artificial Sequence: Synthetic oligonucleotide
gcctccagaactccaccattgcgttaactg

SEQ ID NO: 308188 - DNA, 31 bp, Artificial Sequence
  Description of Artificial Sequence: Synthetic oligonucleotide
cctccagaactccaccattgcgttaactgtc

SEQ ID NO: 308189 - DNA, 34 bp, Artificial Sequence
  Description of Artificial Sequence: Synthetic oligonucleotide
ctccagaactccaccattgcgttaactgtctttg

SEQ ID NO: 308190 - DNA, 34 bp, Artificial Sequence
  Description of Artificial Sequence: Synthetic oligonucleotide
tccagaactccaccattgcgttaactgtctttgc

SEQ ID NO: 308191 - DNA, 33 bp, Artificial Sequence
  Description of Artificial Sequence: Synthetic oligonucleotide
ccagaactccaccattgcgttaactgtctttgc

SEQ ID NO: 308192 - DNA, 33 bp, Artificial Sequence
  Description of Artificial Sequence: Synthetic oligonucleotide
cagaactccaccattgcgttaactgtctttgcc

SEQ ID NO: 308193 - DNA, 35 bp, Artificial Sequence
  Description of Artificial Sequence: Synthetic oligonucleotide
agaactccaccattgcgttaactgtctttgccatc

SEQ ID NO: 308194 - DNA, 34 bp, Artificial Sequence
  Description of Artificial Sequence: Synthetic oligonucleotide
gaactccaccattgcgttaactgtctttgccatc

SEQ ID NO: 308195 - DNA, 36 bp, Artificial Sequence
  Description of Artificial Sequence: Synthetic oligonucleotide
aactccaccattgcgttaactgtctttgccatctag

SEQ ID NO: 308196 - DNA, 35 bp, Artificial Sequence
  Description of Artificial Sequence: Synthetic oligonucleotide
actccaccattgcgttaactgtctttgccatctag

SEQ ID NO: 308197 - DNA, 34 bp, Artificial Sequence
  Description of Artificial Sequence: Synthetic oligonucleotide
ctccaccattgcgttaactgtctttgccatctag

SEQ ID NO: 308198 - DNA, 39 bp, Artificial Sequence
  Description of Artificial Sequence: Synthetic oligonucleotide
tccaccattgcgttaactgtctttgccatctagaaatac

SEQ ID NO: 308199 - DNA, 38 bp, Artificial Sequence
  Description of Artificial Sequence: Synthetic oligonucleotide
ccaccattgcgttaactgtctttgccatctagaaatac

SEQ ID NO: 308200 - DNA, 38 bp, Artificial Sequence
  Description of Artificial Sequence: Synthetic oligonucleotide
caccattgcgttaactgtctttgccatctagaaatacg

SEQ ID NO: 308201 - DNA, 39 bp, Artificial Sequence
  Description of Artificial Sequence: Synthetic oligonucleotide
accattgcgttaactgtctttgccatctagaaatacgag

SEQ ID NO: 308202 - DNA, 38 bp, Artificial Sequence
  Description of Artificial Sequence: Synthetic oligonucleotide
ccattgcgttaactgtctttgccatctagaaatacgag

SEQ ID NO: 308203 - DNA, 38 bp, Artificial Sequence
  Description of Artificial Sequence: Synthetic oligonucleotide
cattgcgttaactgtctttgccatctagaaatacgagg

SEQ ID NO: 308204 - DNA, 38 bp, Artificial Sequence
  Description of Artificial Sequence: Synthetic oligonucleotide
attgcgttaactgtctttgccatctagaaatacgaggc

SEQ ID NO: 308205 - DNA, 37 bp, Artificial Sequence
  Description of Artificial Sequence: Synthetic oligonucleotide
ttgcgttaactgtctttgccatctagaaatacgaggc

SEQ ID NO: 308206 - DNA, 36 bp, Artificial Sequence
  Description of Artificial Sequence: Synthetic oligonucleotide
tgcgttaactgtctttgccatctagaaatacgaggc

SEQ ID NO: 308207 - DNA, 35 bp, Artificial Sequence
  Description of Artificial Sequence: Synthetic oligonucleotide
gcgttaactgtctttgccatctagaaatacgaggc

SEQ ID NO: 308208 - DNA, 38 bp, Artificial Sequence
  Description of Artificial Sequence: Synthetic oligonucleotide
cgttaactgtctttgccatctagaaatacgaggctttc

SEQ ID NO: 308209 - DNA, 38 bp, Artificial Sequence
  Description of Artificial Sequence: Synthetic oligonucleotide
gttaactgtctttgccatctagaaatacgaggctttcc

SEQ ID NO: 308210 - DNA, 39 bp, Artificial Sequence
  Description of Artificial Sequence: Synthetic oligonucleotide
ttaactgtctttgccatctagaaatacgaggctttcctc

SEQ ID NO: 308211 - DNA, 38 bp, Artificial Sequence
  Description of Artificial Sequence: Synthetic oligonucleotide
taactgtctttgccatctagaaatacgaggctttcctc

SEQ ID NO: 308212 - DNA, 37 bp, Artificial Sequence
  Description of Artificial Sequence: Synthetic oligonucleotide
aactgtctttgccatctagaaatacgaggctttcctc

SEQ ID NO: 308213 - DNA, 36 bp, Artificial Sequence
  Description of Artificial Sequence: Synthetic oligonucleotide
actgtctttgccatctagaaatacgaggctttcctc

SEQ ID NO: 308214 - DNA, 35 bp, Artificial Sequence
  Description of Artificial Sequence: Synthetic oligonucleotide
ctgtctttgccatctagaaatacgaggctttcctc

SEQ ID NO: 308215 - DNA, 37 bp, Artificial Sequence
  Description of Artificial Sequence: Synthetic oligonucleotide
tgtctttgccatctagaaatacgaggctttcctcaag

SEQ ID NO: 308216 - DNA, 36 bp, Artificial Sequence
  Description of Artificial Sequence: Synthetic oligonucleotide
gtctttgccatctagaaatacgaggctttcctcaag

SEQ ID NO: 308217 - DNA, 36 bp, Artificial Sequence
  Description of Artificial Sequence: Synthetic oligonucleotide
tctttgccatctagaaatacgaggctttcctcaagc

SEQ ID NO: 308218 - DNA, 35 bp, Artificial Sequence
  Description of Artificial Sequence: Synthetic oligonucleotide
ctttgccatctagaaatacgaggctttcctcaagc

SEQ ID NO: 308219 - DNA, 36 bp, Artificial Sequence
  Description of Artificial Sequence: Synthetic oligonucleotide
tttgccatctagaaatacgaggctttcctcaagctg

SEQ ID NO: 308220 - DNA, 35 bp, Artificial Sequence
  Description of Artificial Sequence: Synthetic oligonucleotide
ttgccatctagaaatacgaggctttcctcaagctg

SEQ ID NO: 308221 - DNA, 34 bp, Artificial Sequence
  Description of Artificial Sequence: Synthetic oligonucleotide
tgccatctagaaatacgaggctttcctcaagctg

SEQ ID NO: 308222 - DNA, 33 bp, Artificial Sequence
  Description of Artificial Sequence: Synthetic oligonucleotide
gccatctagaaatacgaggctttcctcaagctg

SEQ ID NO: 308223 - DNA, 35 bp, Artificial Sequence
  Description of Artificial Sequence: Synthetic oligonucleotide
ccatctagaaatacgaggctttcctcaagctgttc

SEQ ID NO: 308224 - DNA, 35 bp, Artificial Sequence
  Description of Artificial Sequence: Synthetic oligonucleotide
catctagaaatacgaggctttcctcaagctgttcg

SEQ ID NO: 308225 - DNA, 36 bp, Artificial Sequence
  Description of Artificial Sequence: Synthetic oligonucleotide
atctagaaatacgaggctttcctcaagctgttcgtg

SEQ ID NO: 308226 - DNA, 35 bp, Artificial Sequence
  Description of Artificial Sequence: Synthetic oligonucleotide
tctagaaatacgaggctttcctcaagctgttcgtg

SEQ ID NO: 308227 - DNA, 34 bp, Artificial Sequence
  Description of Artificial Sequence: Synthetic oligonucleotide
ctagaaatacgaggctttcctcaagctgttcgtg

SEQ ID NO: 308228 - DNA, 34 bp, Artificial Sequence
  Description of Artificial Sequence: Synthetic oligonucleotide
tagaaatacgaggctttcctcaagctgttcgtgg

SEQ ID NO: 308229 - DNA, 33 bp, Artificial Sequence
  Description of Artificial Sequence: Synthetic oligonucleotide
agaaatacgaggctttcctcaagctgttcgtgg

SEQ ID NO: 308230 - DNA, 32 bp, Artificial Sequence
  Description of Artificial Sequence: Synthetic oligonucleotide
gaaatacgaggctttcctcaagctgttcgtgg

SEQ ID NO: 308231 - DNA, 33 bp, Artificial Sequence
  Description of Artificial Sequence: Synthetic oligonucleotide
aaatacgaggctttcctcaagctgttcgtggag

SEQ ID NO: 308232 - DNA, 32 bp, Artificial Sequence
  Description of Artificial Sequence: Synthetic oligonucleotide
aatacgaggctttcctcaagctgttcgtggag

SEQ ID NO: 308233 - DNA, 31 bp, Artificial Sequence
  Description of Artificial Sequence: Synthetic oligonucleotide
atacgaggctttcctcaagctgttcgtggag

SEQ ID NO: 308234 - DNA, 30 bp, Artificial Sequence
  Description of Artificial Sequence: Synthetic oligonucleotide
tacgaggctttcctcaagctgttcgtggag

SEQ ID NO: 308235 - DNA, 29 bp, Artificial Sequence
  Description of Artificial Sequence: Synthetic oligonucleotide
acgaggctttcctcaagctgttcgtggag

SEQ ID NO: 308236 - DNA, 28 bp, Artificial Sequence
  Description of Artificial Sequence: Synthetic oligonucleotide
cgaggctttcctcaagctgttcgtggag

SEQ ID NO: 308237 - DNA, 29 bp, Artificial Sequence
  Description of Artificial Sequence: Synthetic oligonucleotide
gaggctttcctcaagctgttcgtggagac

SEQ ID NO: 308238 - DNA, 29 bp, Artificial Sequence
  Description of Artificial Sequence: Synthetic oligonucleotide
aggctttcctcaagctgttcgtggagacg

SEQ ID NO: 308239 - DNA, 28 bp, Artificial Sequence
  Description of Artificial Sequence: Synthetic oligonucleotide
ggctttcctcaagctgttcgtggagacg

SEQ ID NO: 308240 - DNA, 28 bp, Artificial Sequence
  Description of Artificial Sequence: Synthetic oligonucleotide
gctttcctcaagctgttcgtggagacgg

SEQ ID NO: 308241 - DNA, 28 bp, Artificial Sequence
  Description of Artificial Sequence: Synthetic oligonucleotide
ctttcctcaagctgttcgtggagacggg

SEQ ID NO: 308242 - DNA, 28 bp, Artificial Sequence
  Description of Artificial Sequence: Synthetic oligonucleotide
tttcctcaagctgttcgtggagacgggg

SEQ ID NO: 308243 - DNA, 27 bp, Artificial Sequence
  Description of Artificial Sequence: Synthetic oligonucleotide
ttcctcaagctgttcgtggagacgggg

SEQ ID NO: 308244 - DNA, 26 bp, Artificial Sequence
  Description of Artificial Sequence: Synthetic oligonucleotide
tcctcaagctgttcgtggagacgggg

SEQ ID NO: 308245 - DNA, 25 bp, Artificial Sequence
  Description of Artificial Sequence: Synthetic oligonucleotide
cctcaagctgttcgtggagacgggg

SEQ ID NO: 308246 - DNA, 26 bp, Artificial Sequence
  Description of Artificial Sequence: Synthetic oligonucleotide
ctcaagctgttcgtggagacggggga

SEQ ID NO: 308247 - DNA, 27 bp, Artificial Sequence
  Description of Artificial Sequence: Synthetic oligonucleotide
tcaagctgttcgtggagacgggggaga

SEQ ID NO: 308248 - DNA, 27 bp, Artificial Sequence
  Description of Artificial Sequence: Synthetic oligonucleotide
caagctgttcgtggagacgggggagaa

SEQ ID NO: 308249 - DNA, 27 bp, Artificial Sequence
  Description of Artificial Sequence: Synthetic oligonucleotide
aagctgttcgtggagacgggggagaag

SEQ ID NO: 308250 - DNA, 26 bp, Artificial Sequence
  Description of Artificial Sequence: Synthetic oligonucleotide
agctgttcgtggagacgggggagaag

SEQ ID NO: 308251 - DNA, 25 bp, Artificial Sequence
  Description of Artificial Sequence: Synthetic oligonucleotide
gctgttcgtggagacgggggagaag

SEQ ID NO: 308252 - DNA, 26 bp, Artificial Sequence
  Description of Artificial Sequence: Synthetic oligonucleotide
ctgttcgtggagacgggggagaagca

SEQ ID NO: 308253 - DNA, 27 bp, Artificial Sequence
  Description of Artificial Sequence: Synthetic oligonucleotide
tgttcgtggagacgggggagaagcagt

SEQ ID NO: 308254 - DNA, 27 bp, Artificial Sequence
  Description of Artificial Sequence: Synthetic oligonucleotide
gttcgtggagacgggggagaagcagtt

SEQ ID NO: 308255 - DNA, 27 bp, Artificial Sequence
  Description of Artificial Sequence: Synthetic oligonucleotide
ttcgtggagacgggggagaagcagttc

SEQ ID NO: 308256 - DNA, 27 bp, Artificial Sequence
  Description of Artificial Sequence: Synthetic oligonucleotide
tcgtggagacgggggagaagcagttca

SEQ ID NO: 308257 - DNA, 27 bp, Artificial Sequence
  Description of Artificial Sequence: Synthetic oligonucleotide
cgtggagacgggggagaagcagttcat

SEQ ID NO: 308258 - DNA, 27 bp, Artificial Sequence
  Description of Artificial Sequence: Synthetic oligonucleotide
gtggagacgggggagaagcagttcatg

SEQ ID NO: 308259 - DNA, 27 bp, Artificial Sequence
  Description of Artificial Sequence: Synthetic oligonucleotide
tggagacgggggagaagcagttcatgg

SEQ ID NO: 308260 - DNA, 27 bp, Artificial Sequence
  Description of Artificial Sequence: Synthetic oligonucleotide
ggagacgggggagaagcagttcatggt

SEQ ID NO: 308261 - DNA, 27 bp, Artificial Sequence
  Description of Artificial Sequence: Synthetic oligonucleotide
gagacgggggagaagcagttcatggtg

SEQ ID NO: 308262 - DNA, 27 bp, Artificial Sequence
  Description of Artificial Sequence: Synthetic oligonucleotide
agacgggggagaagcagttcatggtgc

SEQ ID NO: 308263 - DNA, 26 bp, Artificial Sequence
  Description of Artificial Sequence: Synthetic oligonucleotide
gacgggggagaagcagttcatggtgc

SEQ ID NO: 308264 - DNA, 26 bp, Artificial Sequence
  Description of Artificial Sequence: Synthetic oligonucleotide
acgggggagaagcagttcatggtgcg

SEQ ID NO: 308265 - DNA, 25 bp, Artificial Sequence
  Description of Artificial Sequence: Synthetic oligonucleotide
cgggggagaagcagttcatggtgcg

SEQ ID NO: 308266 - DNA, 25 bp, Artificial Sequence
  Description of Artificial Sequence: Synthetic oligonucleotide
gggggagaagcagttcatggtgcgc

SEQ ID NO: 308267 - DNA, 26 bp, Artificial Sequence
  Description of Artificial Sequence: Synthetic oligonucleotide
ggggagaagcagttcatggtgcgcca

SEQ ID NO: 308268 - DNA, 26 bp, Artificial Sequence
  Description of Artificial Sequence: Synthetic oligonucleotide
gggagaagcagttcatggtgcgccac

SEQ ID NO: 308269 - DNA, 26 bp, Artificial Sequence
  Description of Artificial Sequence: Synthetic oligonucleotide
ggagaagcagttcatggtgcgccacc

SEQ ID NO: 308270 - DNA, 27 bp, Artificial Sequence
  Description of Artificial Sequence: Synthetic oligonucleotide
gagaagcagttcatggtgcgccaccgt

SEQ ID NO: 308271 - DNA, 27 bp, Artificial Sequence
  Description of Artificial Sequence: Synthetic oligonucleotide
agaagcagttcatggtgcgccaccgtg

SEQ ID NO: 308272 - DNA, 27 bp, Artificial Sequence
  Description of Artificial Sequence: Synthetic oligonucleotide
gaagcagttcatggtgcgccaccgtga

SEQ ID NO: 308273 - DNA, 27 bp, Artificial Sequence
  Description of Artificial Sequence: Synthetic oligonucleotide
aagcagttcatggtgcgccaccgtgac

SEQ ID NO: 308274 - DNA, 26 bp, Artificial Sequence
  Description of Artificial Sequence: Synthetic oligonucleotide
agcagttcatggtgcgccaccgtgac

SEQ ID NO: 308275 - DNA, 25 bp, Artificial Sequence
  Description of Artificial Sequence: Synthetic oligonucleotide
gcagttcatggtgcgccaccgtgac

SEQ ID NO: 308276 - DNA, 26 bp, Artificial Sequence
  Description of Artificial Sequence: Synthetic oligonucleotide
cagttcatggtgcgccaccgtgacca

SEQ ID NO: 308277 - DNA, 27 bp, Artificial Sequence
  Description of Artificial Sequence: Synthetic oligonucleotide
agttcatggtgcgccaccgtgaccact

SEQ ID NO: 308278 - DNA, 27 bp, Artificial Sequence
  Description of Artificial Sequence: Synthetic oligonucleotide
gttcatggtgcgccaccgtgaccacta

SEQ ID NO: 308279 - DNA, 27 bp, Artificial Sequence
  Description of Artificial Sequence: Synthetic oligonucleotide
ttcatggtgcgccaccgtgaccactac

SEQ ID NO: 308280 - DNA, 27 bp, Artificial Sequence
  Description of Artificial Sequence: Synthetic oligonucleotide
tcatggtgcgccaccgtgaccactact

SEQ ID NO: 308281 - DNA, 27 bp, Artificial Sequence
  Description of Artificial Sequence: Synthetic oligonucleotide
catggtgcgccaccgtgaccactacta

SEQ ID NO: 308282 - DNA, 28 bp, Artificial Sequence
  Description of Artificial Sequence: Synthetic oligonucleotide
atggtgcgccaccgtgaccactactaag

SEQ ID NO: 308283 - DNA, 27 bp, Artificial Sequence
  Description of Artificial Sequence: Synthetic oligonucleotide
tggtgcgccaccgtgaccactactaag

SEQ ID NO: 308284 - DNA, 27 bp, Artificial Sequence
  Description of Artificial Sequence: Synthetic oligonucleotide
ggtgcgccaccgtgaccactactaagt

SEQ ID NO: 308285 - DNA, 27 bp, Artificial Sequence
  Description of Artificial Sequence: Synthetic oligonucleotide
gtgcgccaccgtgaccactactaagtc

SEQ ID NO: 308286 - DNA, 29 bp, Artificial Sequence
  Description of Artificial Sequence: Synthetic oligonucleotide
tgcgccaccgtgaccactactaagtcttc

SEQ ID NO: 308287 - DNA, 28 bp, Artificial Sequence
  Description of Artificial Sequence: Synthetic oligonucleotide
gcgccaccgtgaccactactaagtcttc

SEQ ID NO: 308288 - DNA, 29 bp, Artificial Sequence
  Description of Artificial Sequence: Synthetic oligonucleotide
cgccaccgtgaccactactaagtcttcac

SEQ ID NO: 308289 - DNA, 29 bp, Artificial Sequence
  Description of Artificial Sequence: Synthetic oligonucleotide
gccaccgtgaccactactaagtcttcacc

SEQ ID NO: 308290 - DNA, 29 bp, Artificial Sequence
  Description of Artificial Sequence: Synthetic oligonucleotide
ccaccgtgaccactactaagtcttcaccc

SEQ ID NO: 308291 - DNA, 30 bp, Artificial Sequence
  Description of Artificial Sequence: Synthetic oligonucleotide
caccgtgaccactactaagtcttcacccac

SEQ ID NO: 308292 - DNA, 30 bp, Artificial Sequence
  Description of Artificial Sequence: Synthetic oligonucleotide
accgtgaccactactaagtcttcacccacc

SEQ ID NO: 308293 - DNA, 29 bp, Artificial Sequence
  Description of Artificial Sequence: Synthetic oligonucleotide
ccgtgaccactactaagtcttcacccacc

SEQ ID NO: 308294 - DNA, 30 bp, Artificial Sequence
  Description of Artificial Sequence: Synthetic oligonucleotide
cgtgaccactactaagtcttcacccaccag

SEQ ID NO: 308295 - DNA, 30 bp, Artificial Sequence
  Description of Artificial Sequence: Synthetic oligonucleotide
gtgaccactactaagtcttcacccaccagc

SEQ ID NO: 308296 - DNA, 30 bp, Artificial Sequence
  Description of Artificial Sequence: Synthetic oligonucleotide
tgaccactactaagtcttcacccaccagcc

SEQ ID NO: 308297 - DNA, 29 bp, Artificial Sequence
  Description of Artificial Sequence: Synthetic oligonucleotide
gaccactactaagtcttcacccaccagcc

SEQ ID NO: 308298 - DNA, 29 bp, Artificial Sequence
  Description of Artificial Sequence: Synthetic oligonucleotide
accactactaagtcttcacccaccagccg

SEQ ID NO: 308299 - DNA, 28 bp, Artificial Sequence
  Description of Artificial Sequence: Synthetic oligonucleotide
ccactactaagtcttcacccaccagccg

SEQ ID NO: 308300 - DNA, 28 bp, Artificial Sequence
  Description of Artificial Sequence: Synthetic oligonucleotide
cactactaagtcttcacccaccagccgg

SEQ ID NO: 308301 - DNA, 28 bp, Artificial Sequence
  Description of Artificial Sequence: Synthetic oligonucleotide
actactaagtcttcacccaccagccggg

SEQ ID NO: 308302 - DNA, 27 bp, Artificial Sequence
  Description of Artificial Sequence: Synthetic oligonucleotide
ctactaagtcttcacccaccagccggg

SEQ ID NO: 308303 - DNA, 27 bp, Artificial Sequence
  Description of Artificial Sequence: Synthetic oligonucleotide
tactaagtcttcacccaccagccgggc

SEQ ID NO: 308304 - DNA, 26 bp, Artificial Sequence
  Description of Artificial Sequence: Synthetic oligonucleotide
actaagtcttcacccaccagccgggc

SEQ ID NO: 308305 - DNA, 25 bp, Artificial Sequence
  Description of Artificial Sequence: Synthetic oligonucleotide
ctaagtcttcacccaccagccgggc

SEQ ID NO: 308306 - DNA, 25 bp, Artificial Sequence
  Description of Artificial Sequence: Synthetic oligonucleotide
taagtcttcacccaccagccgggcg

SEQ ID NO: 308307 - DNA, 24 bp, Artificial Sequence
  Description of Artificial Sequence: Synthetic oligonucleotide
aagtcttcacccaccagccgggcg

SEQ ID NO: 308308 - DNA, 23 bp, Artificial Sequence
  Description of Artificial Sequence: Synthetic oligonucleotide
agtcttcacccaccagccgggcg

SEQ ID NO: 308309 - DNA, 22 bp, Artificial Sequence
  Description of Artificial Sequence: Synthetic oligonucleotide
gtcttcacccaccagccgggcg

SEQ ID NO: 308310 - DNA, 22 bp, Artificial Sequence
  Description of Artificial Sequence: Synthetic oligonucleotide
tcttcacccaccagccgggcgc

SEQ ID NO: 308311 - DNA, 21 bp, Artificial Sequence
  Description of Artificial Sequence: Synthetic oligonucleotide
cttcacccaccagccgggcgc

SEQ ID NO: 308312 - DNA, 21 bp, Artificial Sequence
  Description of Artificial Sequence: Synthetic oligonucleotide
ttcacccaccagccgggcgcg

SEQ ID NO: 308313 - DNA, 20 bp, Artificial Sequence
  Description of Artificial Sequence: Synthetic oligonucleotide
tcacccaccagccgggcgcg

SEQ ID NO: 308314 - DNA, 20 bp, Artificial Sequence
  Description of Artificial Sequence: Synthetic oligonucleotide
cacccaccagccgggcgcgt

SEQ ID NO: 308315 - DNA, 20 bp, Artificial Sequence
  Description of Artificial Sequence: Synthetic oligonucleotide
acccaccagccgggcgcggt

SEQ ID NO: 308316 - DNA, 20 bp, Artificial Sequence
  Description of Artificial Sequence: Synthetic oligonucleotide
cccaccagccgggcgcggtt

SEQ ID NO: 308317 - DNA, 20 bp, Artificial Sequence
  Description of Artificial Sequence: Synthetic oligonucleotide
ccaccagccgggcgcggtgt

SEQ ID NO: 308318 - DNA, 20 bp, Artificial Sequence
  Description of Artificial Sequence: Synthetic oligonucleotide
caccagccgggcgcggtgct

SEQ ID NO: 308319 - DNA, 20 bp, Artificial Sequence
  Description of Artificial Sequence: Synthetic oligonucleotide
accagccgggcgcggtgcct

SEQ ID NO: 308320 - DNA, 20 bp, Artificial Sequence
  Description of Artificial Sequence: Synthetic oligonucleotide
ccagccgggcgcggtgcctt

SEQ ID NO: 308321 - DNA, 20 bp, Artificial Sequence
  Description of Artificial Sequence: Synthetic oligonucleotide
cagccgggcgcggtgccgtt

SEQ ID NO: 308322 - DNA, 20 bp, Artificial Sequence
  Description of Artificial Sequence: Synthetic oligonucleotide
agccgggcgcggtgccgctt

SEQ ID NO: 308323 - DNA, 20 bp, Artificial Sequence
  Description of Artificial Sequence: Synthetic oligonucleotide
gccgggcgcggtgccgcttt

SEQ ID NO: 308324 - DNA, 20 bp, Artificial Sequence
  Description of Artificial Sequence: Synthetic oligonucleotide
ccgggcgcggtgccgcgttt

SEQ ID NO: 308325 - DNA, 20 bp, Artificial Sequence
  Description of Artificial Sequence: Synthetic oligonucleotide
cgggcgcggtgccgcgcttt

SEQ ID NO: 308326 - DNA, 20 bp, Artificial Sequence
  Description of Artificial Sequence: Synthetic oligonucleotide
gggcgcggtgccgcgcgttt

SEQ ID NO: 308327 - DNA, 20 bp, Artificial Sequence
  Description of Artificial Sequence: Synthetic oligonucleotide
ggcgcggtgccgcgcgtgat

SEQ ID NO: 308328 - DNA, 20 bp, Artificial Sequence
  Description of Artificial Sequence: Synthetic oligonucleotide
gcgcggtgccgcgcgtgact

SEQ ID NO: 308329 - DNA, 20 bp, Artificial Sequence
  Description of Artificial Sequence: Synthetic oligonucleotide
cgcggtgccgcgcgtgacgt

SEQ ID NO: 308330 - DNA, 20 bp, Artificial Sequence
  Description of Artificial Sequence: Synthetic oligonucleotide
gcggtgccgcgcgtgacggt

SEQ ID NO: 308331 - DNA, 20 bp, Artificial Sequence
  Description of Artificial Sequence: Synthetic oligonucleotide
cggtgccgcgcgtgacggtg

SEQ ID NO: 308332 - DNA, 20 bp, Artificial Sequence
  Description of Artificial Sequence: Synthetic oligonucleotide
ggtgccgcgcgtgacggtgg

SEQ ID NO: 308333 - DNA, 20 bp, Artificial Sequence
  Description of Artificial Sequence: Synthetic oligonucleotide
gtgccgcgcgtgacggtggg

SEQ ID NO: 308334 - DNA, 21 bp, Artificial Sequence
  Description of Artificial Sequence: Synthetic oligonucleotide
tgccgcgcgtgacggtgggga

SEQ ID NO: 308335 - DNA, 20 bp, Artificial Sequence
  Description of Artificial Sequence: Synthetic oligonucleotide
gccgcgcgtgacggtgggga

SEQ ID NO: 308336 - DNA, 20 bp, Artificial Sequence
  Description of Artificial Sequence: Synthetic oligonucleotide
ccgcgcgtgacggtggggac

SEQ ID NO: 308337 - DNA, 20 bp, Artificial Sequence
  Description of Artificial Sequence: Synthetic oligonucleotide
cgcgcgtgacggtggggacc

SEQ ID NO: 308338 - DNA, 20 bp, Artificial Sequence
  Description of Artificial Sequence: Synthetic oligonucleotide
gcgcgtgacggtggggaccg

SEQ ID NO: 308339 - DNA, 21 bp, Artificial Sequence
  Description of Artificial Sequence: Synthetic oligonucleotide
cgcgtgacggtggggaccgct

SEQ ID NO: 308340 - DNA, 21 bp, Artificial Sequence
  Description of Artificial Sequence: Synthetic oligonucleotide
gcgtgacggtggggaccgctc

SEQ ID NO: 308341 - DNA, 21 bp, Artificial Sequence
  Description of Artificial Sequence: Synthetic oligonucleotide
cgtgacggtggggaccgctcg

SEQ ID NO: 308342 - DNA, 21 bp, Artificial Sequence
  Description of Artificial Sequence: Synthetic oligonucleotide
gtgacggtggggaccgctcgg

SEQ ID NO: 308343 - DNA, 22 bp, Artificial Sequence
  Description of Artificial Sequence: Synthetic oligonucleotide
tgacggtggggaccgctcggca

SEQ ID NO: 308344 - DNA, 21 bp, Artificial Sequence
  Description of Artificial Sequence: Synthetic oligonucleotide
gacggtggggaccgctcggca

SEQ ID NO: 308345 - DNA, 21 bp, Artificial Sequence
  Description of Artificial Sequence: Synthetic oligonucleotide
acggtggggaccgctcggcag

SEQ ID NO: 308346 - DNA, 20 bp, Artificial Sequence
  Description of Artificial Sequence: Synthetic oligonucleotide
cggtggggaccgctcggcag

SEQ ID NO: 308347 - DNA, 21 bp, Artificial Sequence
  Description of Artificial Sequence: Synthetic oligonucleotide
ggtggggaccgctcggcagct

SEQ ID NO: 308348 - DNA, 22 bp, Artificial Sequence
  Description of Artificial Sequence: Synthetic oligonucleotide
gtggggaccgctcggcagctct

SEQ ID NO: 308349 - DNA, 23 bp, Artificial Sequence
  Description of Artificial Sequence: Synthetic oligonucleotide
tggggaccgctcggcagctctca

SEQ ID NO: 308350 - DNA, 22 bp, Artificial Sequence
  Description of Artificial Sequence: Synthetic oligonucleotide
ggggaccgctcggcagctctca

SEQ ID NO: 308351 - DNA, 23 bp, Artificial Sequence
  Description of Artificial Sequence: Synthetic oligonucleotide
gggaccgctcggcagctctcagt

SEQ ID NO: 308352 - DNA, 23 bp, Artificial Sequence
  Description of Artificial Sequence: Synthetic oligonucleotide
ggaccgctcggcagctctcagtg

SEQ ID NO: 308353 - DNA, 24 bp, Artificial Sequence
  Description of Artificial Sequence: Synthetic oligonucleotide
gaccgctcggcagctctcagtgct

SEQ ID NO: 308354 - DNA, 24 bp, Artificial Sequence
  Description of Artificial Sequence: Synthetic oligonucleotide
accgctcggcagctctcagtgctg

SEQ ID NO: 308355 - DNA, 23 bp, Artificial Sequence
  Description of Artificial Sequence: Synthetic oligonucleotide
ccgctcggcagctctcagtgctg

SEQ ID NO: 308356 - DNA, 24 bp, Artificial Sequence
  Description of Artificial Sequence: Synthetic oligonucleotide
cgctcggcagctctcagtgctgca

SEQ ID NO: 308357 - DNA, 24 bp, Artificial Sequence
  Description of Artificial Sequence: Synthetic oligonucleotide
gctcggcagctctcagtgctgcag

SEQ ID NO: 308358 - DNA, 25 bp, Artificial Sequence
  Description of Artificial Sequence: Synthetic oligonucleotide
ctcggcagctctcagtgctgcaggt

SEQ ID NO: 308359 - DNA, 25 bp, Artificial Sequence
  Description of Artificial Sequence: Synthetic oligonucleotide
tcggcagctctcagtgctgcaggtg

SEQ ID NO: 308360 - DNA, 24 bp, Artificial Sequence
  Description of Artificial Sequence: Synthetic oligonucleotide
cggcagctctcagtgctgcaggtg

SEQ ID NO: 308361 - DNA, 24 bp, Artificial Sequence
  Description of Artificial Sequence: Synthetic oligonucleotide
ggcagctctcagtgctgcaggtgc

SEQ ID NO: 308362 - DNA, 24 bp, Artificial Sequence
  Description of Artificial Sequence: Synthetic oligonucleotide
gcagctctcagtgctgcaggtgcg

SEQ ID NO: 308363 - DNA, 24 bp, Artificial Sequence
  Description of Artificial Sequence: Synthetic oligonucleotide
cagctctcagtgctgcaggtgcgc

SEQ ID NO: 308364 - DNA, 24 bp, Artificial Sequence
  Description of Artificial Sequence: Synthetic oligonucleotide
agctctcagtgctgcaggtgcgcg

SEQ ID NO: 308365 - DNA, 23 bp, Artificial Sequence
  Description of Artificial Sequence: Synthetic oligonucleotide
gctctcagtgctgcaggtgcgcg

SEQ ID NO: 308366 - DNA, 23 bp, Artificial Sequence
  Description of Artificial Sequence: Synthetic oligonucleotide
ctctcagtgctgcaggtgcgcgg

SEQ ID NO: 308367 - DNA, 25 bp, Artificial Sequence
  Description of Artificial Sequence: Synthetic oligonucleotide
tctcagtgctgcaggtgcgcggcta

SEQ ID NO: 308368 - DNA, 24 bp, Artificial Sequence
  Description of Artificial Sequence: Synthetic oligonucleotide
ctcagtgctgcaggtgcgcggcta

SEQ ID NO: 308369 - DNA, 26 bp, Artificial Sequence
  Description of Artificial Sequence: Synthetic oligonucleotide
tcagtgctgcaggtgcgcggctacaa

SEQ ID NO: 308370 - DNA, 25 bp, Artificial Sequence
  Description of Artificial Sequence: Synthetic oligonucleotide
cagtgctgcaggtgcgcggctacaa

SEQ ID NO: 308371 - DNA, 25 bp, Artificial Sequence
  Description of Artificial Sequence: Synthetic oligonucleotide
agtgctgcaggtgcgcggctacaag

SEQ ID NO: 308372 - DNA, 24 bp, Artificial Sequence
  Description of Artificial Sequence: Synthetic oligonucleotide
gtgctgcaggtgcgcggctacaag

SEQ ID NO: 308373 - DNA, 24 bp, Artificial Sequence
  Description of Artificial Sequence: Synthetic oligonucleotide
tgctgcaggtgcgcggctacaagc

SEQ ID NO: 308374 - DNA, 23 bp, Artificial Sequence
  Description of Artificial Sequence: Synthetic oligonucleotide
gctgcaggtgcgcggctacaagc

SEQ ID NO: 308375 - DNA, 23 bp, Artificial Sequence
  Description of Artificial Sequence: Synthetic oligonucleotide
ctgcaggtgcgcggctacaagcg

SEQ ID NO: 308376 - DNA, 24 bp, Artificial Sequence
  Description of Artificial Sequence: Synthetic oligonucleotide
tgcaggtgcgcggctacaagcggt

SEQ ID NO: 308377 - DNA, 23 bp, Artificial Sequence
  Description of Artificial Sequence: Synthetic oligonucleotide
gcaggtgcgcggctacaagcggt

SEQ ID NO: 308378 - DNA, 23 bp, Artificial Sequence
  Description of Artificial Sequence: Synthetic oligonucleotide
caggtgcgcggctacaagcggtg

SEQ ID NO: 308379 - DNA, 23 bp, Artificial Sequence
  Description of Artificial Sequence: Synthetic oligonucleotide
aggtgcgcggctacaagcggtgg

SEQ ID NO: 308380 - DNA, 22 bp, Artificial Sequence
  Description of Artificial Sequence: Synthetic oligonucleotide
ggtgcgcggctacaagcggtgg

SEQ ID NO: 308381 - DNA, 23 bp, Artificial Sequence
  Description of Artificial Sequence: Synthetic oligonucleotide
gtgcgcggctacaagcggtggca

SEQ ID NO: 308382 - DNA, 23 bp, Artificial Sequence
  Description of Artificial Sequence: Synthetic oligonucleotide
tgcgcggctacaagcggtggcag

SEQ ID NO: 308383 - DNA, 22 bp, Artificial Sequence
  Description of Artificial Sequence: Synthetic oligonucleotide
gcgcggctacaagcggtggcag

SEQ ID NO: 308384 - DNA, 23 bp, Artificial Sequence
  Description of Artificial Sequence: Synthetic oligonucleotide
cgcggctacaagcggtggcagga

SEQ ID NO: 308385 - DNA, 23 bp, Artificial Sequence
  Description of Artificial Sequence: Synthetic oligonucleotide
gcggctacaagcggtggcaggac

SEQ ID NO: 308386 - DNA, 24 bp, Artificial Sequence
  Description of Artificial Sequence: Synthetic oligonucleotide
cggctacaagcggtggcaggacct

SEQ ID NO: 308387 - DNA, 25 bp, Artificial Sequence
  Description of Artificial Sequence: Synthetic oligonucleotide
ggctacaagcggtggcaggacctgt

SEQ ID NO: 308388 - DNA, 25 bp, Artificial Sequence
  Description of Artificial Sequence: Synthetic oligonucleotide
gctacaagcggtggcaggacctgtc

SEQ ID NO: 308389 - DNA, 27 bp, Artificial Sequence
  Description of Artificial Sequence: Synthetic oligonucleotide
ctacaagcggtggcaggacctgtccat

SEQ ID NO: 308390 - DNA, 27 bp, Artificial Sequence
  Description of Artificial Sequence: Synthetic oligonucleotide
tacaagcggtggcaggacctgtccatg

SEQ ID NO: 308391 - DNA, 26 bp, Artificial Sequence
  Description of Artificial Sequence: Synthetic oligonucleotide
acaagcggtggcaggacctgtccatg

SEQ ID NO: 308392 - DNA, 25 bp, Artificial Sequence
  Description of Artificial Sequence: Synthetic oligonucleotide
caagcggtggcaggacctgtccatg

SEQ ID NO: 308393 - DNA, 25 bp, Artificial Sequence
  Description of Artificial Sequence: Synthetic oligonucleotide
aagcggtggcaggacctgtccatgc

SEQ ID NO: 308394 - DNA, 24 bp, Artificial Sequence
  Description of Artificial Sequence: Synthetic oligonucleotide
agcggtggcaggacctgtccatgc

SEQ ID NO: 308395 - DNA, 23 bp, Artificial Sequence
  Description of Artificial Sequence: Synthetic oligonucleotide
gcggtggcaggacctgtccatgc

SEQ ID NO: 308396 - DNA, 23 bp, Artificial Sequence
  Description of Artificial Sequence: Synthetic oligonucleotide
cggtggcaggacctgtccatgcc

SEQ ID NO: 308397 - DNA, 23 bp, Artificial Sequence
  Description of Artificial Sequence: Synthetic oligonucleotide
ggtggcaggacctgtccatgccc

SEQ ID NO: 308398 - DNA, 23 bp, Artificial Sequence
  Description of Artificial Sequence: Synthetic oligonucleotide
gtggcaggacctgtccatgcccc

SEQ ID NO: 308399 - DNA, 23 bp, Artificial Sequence
  Description of Artificial Sequence: Synthetic oligonucleotide
tggcaggacctgtccatgccccg

SEQ ID NO: 308400 - DNA, 22 bp, Artificial Sequence
  Description of Artificial Sequence: Synthetic oligonucleotide
ggcaggacctgtccatgccccg

SEQ ID NO: 308401 - DNA, 24 bp, Artificial Sequence
  Description of Artificial Sequence: Synthetic oligonucleotide
gcaggacctgtccatgccccgcat

SEQ ID NO: 308402 - DNA, 24 bp, Artificial Sequence
  Description of Artificial Sequence: Synthetic oligonucleotide
caggacctgtccatgccccgcatg

SEQ ID NO: 308403 - DNA, 25 bp, Artificial Sequence
  Description of Artificial Sequence: Synthetic oligonucleotide
aggacctgtccatgccccgcatgga

SEQ ID NO: 308404 - DNA, 24 bp, Artificial Sequence
  Description of Artificial Sequence: Synthetic oligonucleotide
ggacctgtccatgccccgcatgga

SEQ ID NO: 308405 - DNA, 26 bp, Artificial Sequence
  Description of Artificial Sequence: Synthetic oligonucleotide
gacctgtccatgccccgcatggacat

SEQ ID NO: 308406 - DNA, 27 bp, Artificial Sequence
  Description of Artificial Sequence: Synthetic oligonucleotide
acctgtccatgccccgcatggacatga

SEQ ID NO: 308407 - DNA, 27 bp, Artificial Sequence
  Description of Artificial Sequence: Synthetic oligonucleotide
cctgtccatgccccgcatggacatgat

SEQ ID NO: 308408 - DNA, 27 bp, Artificial Sequence
  Description of Artificial Sequence: Synthetic oligonucleotide
ctgtccatgccccgcatggacatgatc

SEQ ID NO: 308409 - DNA, 28 bp, Artificial Sequence
  Description of Artificial Sequence: Synthetic oligonucleotide
tgtccatgccccgcatggacatgatcag

SEQ ID NO: 308410 - DNA, 27 bp, Artificial Sequence
  Description of Artificial Sequence: Synthetic oligonucleotide
gtccatgccccgcatggacatgatcag

SEQ ID NO: 308411 - DNA, 28 bp, Artificial Sequence
  Description of Artificial Sequence: Synthetic oligonucleotide
tccatgccccgcatggacatgatcagtc

SEQ ID NO: 308412 - DNA, 27 bp, Artificial Sequence
  Description of Artificial Sequence: Synthetic oligonucleotide
ccatgccccgcatggacatgatcagtc

SEQ ID NO: 308413 - DNA, 28 bp, Artificial Sequence
  Description of Artificial Sequence: Synthetic oligonucleotide
catgccccgcatggacatgatcagtcac

SEQ ID NO: 308414 - DNA, 30 bp, Artificial Sequence
  Description of Artificial Sequence: Synthetic oligonucleotide
atgccccgcatggacatgatcagtcacttc

SEQ ID NO: 308415 - DNA, 29 bp, Artificial Sequence
  Description of Artificial Sequence: Synthetic oligonucleotide
tgccccgcatggacatgatcagtcacttc

SEQ ID NO: 308416 - DNA, 28 bp, Artificial Sequence
  Description of Artificial Sequence: Synthetic oligonucleotide
gccccgcatggacatgatcagtcacttc

SEQ ID NO: 308417 - DNA, 29 bp, Artificial Sequence
  Description of Artificial Sequence: Synthetic oligonucleotide
ccccgcatggacatgatcagtcacttctg

SEQ ID NO: 308418 - DNA, 29 bp, Artificial Sequence
  Description of Artificial Sequence: Synthetic oligonucleotide
cccgcatggacatgatcagtcacttctgc

SEQ ID NO: 308419 - DNA, 29 bp, Artificial Sequence
  Description of Artificial Sequence: Synthetic oligonucleotide
ccgcatggacatgatcagtcacttctgcg

SEQ ID NO: 308420 - DNA, 30 bp, Artificial Sequence
  Description of Artificial Sequence: Synthetic oligonucleotide
cgcatggacatgatcagtcacttctgcgtg

SEQ ID NO: 308421 - DNA, 30 bp, Artificial Sequence
  Description of Artificial Sequence: Synthetic oligonucleotide
gcatggacatgatcagtcacttctgcgtgc

SEQ ID NO: 308422 - DNA, 30 bp, Artificial Sequence
  Description of Artificial Sequence: Synthetic oligonucleotide
catggacatgatcagtcacttctgcgtgcg

SEQ ID NO: 308423 - DNA, 30 bp, Artificial Sequence
  Description of Artificial Sequence: Synthetic oligonucleotide
atggacatgatcagtcacttctgcgtgcgg

SEQ ID NO: 308424 - DNA, 29 bp, Artificial Sequence
  Description of Artificial Sequence: Synthetic oligonucleotide
tggacatgatcagtcacttctgcgtgcgg

SEQ ID NO: 308425 - DNA, 28 bp, Artificial Sequence
  Description of Artificial Sequence: Synthetic oligonucleotide
ggacatgatcagtcacttctgcgtgcgg

SEQ ID NO: 308426 - DNA, 28 bp, Artificial Sequence
  Description of Artificial Sequence: Synthetic oligonucleotide
gacatgatcagtcacttctgcgtgcggc

SEQ ID NO: 308427 - DNA, 28 bp, Artificial Sequence
  Description of Artificial Sequence: Synthetic oligonucleotide
acatgatcagtcacttctgcgtgcggcg

SEQ ID NO: 308428 - DNA, 27 bp, Artificial Sequence
  Description of Artificial Sequence: Synthetic oligonucleotide
catgatcagtcacttctgcgtgcggcg

SEQ ID NO: 308429 - DNA, 27 bp, Artificial Sequence
  Description of Artificial Sequence: Synthetic oligonucleotide
atgatcagtcacttctgcgtgcggcgc

SEQ ID NO: 308430 - DNA, 27 bp, Artificial Sequence
  Description of Artificial Sequence: Synthetic oligonucleotide
tgatcagtcacttctgcgtgcggcgct

SEQ ID NO: 308431 - DNA, 27 bp, Artificial Sequence
  Description of Artificial Sequence: Synthetic oligonucleotide
gatcagtcacttctgcgtgcggcgctt

SEQ ID NO: 308432 - DNA, 27 bp, Artificial Sequence
  Description of Artificial Sequence: Synthetic oligonucleotide
atcagtcacttctgcgtgcggcgcttg

SEQ ID NO: 308433 - DNA, 26 bp, Artificial Sequence
  Description of Artificial Sequence: Synthetic oligonucleotide
tcagtcacttctgcgtgcggcgcttg

SEQ ID NO: 308434 - DNA, 25 bp, Artificial Sequence
  Description of Artificial Sequence: Synthetic oligonucleotide
cagtcacttctgcgtgcggcgcttg

SEQ ID NO: 308435 - DNA, 26 bp, Artificial Sequence
  Description of Artificial Sequence: Synthetic oligonucleotide
agtcacttctgcgtgcggcgcttgct

SEQ ID NO: 308436 - DNA, 25 bp, Artificial Sequence
  Description of Artificial Sequence: Synthetic oligonucleotide
gtcacttctgcgtgcggcgcttgct

SEQ ID NO: 308437 - DNA, 26 bp, Artificial Sequence
  Description of Artificial Sequence: Synthetic oligonucleotide
tcacttctgcgtgcggcgcttgctca

SEQ ID NO: 308438 - DNA, 25 bp, Artificial Sequence
  Description of Artificial Sequence: Synthetic oligonucleotide
cacttctgcgtgcggcgcttgctca

SEQ ID NO: 308439 - DNA, 25 bp, Artificial Sequence
  Description of Artificial Sequence: Synthetic oligonucleotide
acttctgcgtgcggcgcttgctcag

SEQ ID NO: 308440 - DNA, 24 bp, Artificial Sequence
  Description of Artificial Sequence: Synthetic oligonucleotide
cttctgcgtgcggcgcttgctcag

SEQ ID NO: 308441 - DNA, 24 bp, Artificial Sequence
  Description of Artificial Sequence: Synthetic oligonucleotide
ttctgcgtgcggcgcttgctcagc

SEQ ID NO: 308442 - DNA, 23 bp, Artificial Sequence
  Description of Artificial Sequence: Synthetic oligonucleotide
tctgcgtgcggcgcttgctcagc

SEQ ID NO: 308443 - DNA, 22 bp, Artificial Sequence
  Description of Artificial Sequence: Synthetic oligonucleotide
ctgcgtgcggcgcttgctcagc

SEQ ID NO: 308444 - DNA, 23 bp, Artificial Sequence
  Description of Artificial Sequence: Synthetic oligonucleotide
tgcgtgcggcgcttgctcagcga

SEQ ID NO: 308445 - DNA, 22 bp, Artificial Sequence
  Description of Artificial Sequence: Synthetic oligonucleotide
gcgtgcggcgcttgctcagcga

SEQ ID NO: 308446 - DNA, 22 bp, Artificial Sequence
  Description of Artificial Sequence: Synthetic oligonucleotide
cgtgcggcgcttgctcagcgag

SEQ ID NO: 308447 - DNA, 23 bp, Artificial Sequence
  Description of Artificial Sequence: Synthetic oligonucleotide
gtgcggcgcttgctcagcgagct

SEQ ID NO: 308448 - DNA, 23 bp, Artificial Sequence
  Description of Artificial Sequence: Synthetic oligonucleotide
tgcggcgcttgctcagcgagctg

SEQ ID NO: 308449 - DNA, 22 bp, Artificial Sequence
  Description of Artificial Sequence: Synthetic oligonucleotide
gcggcgcttgctcagcgagctg

SEQ ID NO: 308450 - DNA, 26 bp, Artificial Sequence
  Description of Artificial Sequence: Synthetic oligonucleotide
cggcgcttgctcagcgagctggatta

SEQ ID NO: 308451 - DNA, 26 bp, Artificial Sequence
  Description of Artificial Sequence: Synthetic oligonucleotide
ggcgcttgctcagcgagctggattac

SEQ ID NO: 308452 - DNA, 27 bp, Artificial Sequence
  Description of Artificial Sequence: Synthetic oligonucleotide
gcgcttgctcagcgagctggattacca

SEQ ID NO: 308453 - DNA, 27 bp, Artificial Sequence
  Description of Artificial Sequence: Synthetic oligonucleotide
cgcttgctcagcgagctggattaccag

SEQ ID NO: 308454 - DNA, 27 bp, Artificial Sequence
  Description of Artificial Sequence: Synthetic oligonucleotide
gcttgctcagcgagctggattaccagg

SEQ ID NO: 308455 - DNA, 28 bp, Artificial Sequence
  Description of Artificial Sequence: Synthetic oligonucleotide
cttgctcagcgagctggattaccaggtg

SEQ ID NO: 308456 - DNA, 29 bp, Artificial Sequence
  Description of Artificial Sequence: Synthetic oligonucleotide
ttgctcagcgagctggattaccaggtgtg

SEQ ID NO: 308457 - DNA, 28 bp, Artificial Sequence
  Description of Artificial Sequence: Synthetic oligonucleotide
tgctcagcgagctggattaccaggtgtg

SEQ ID NO: 308458 - DNA, 27 bp, Artificial Sequence
  Description of Artificial Sequence: Synthetic oligonucleotide
gctcagcgagctggattaccaggtgtg

SEQ ID NO: 308459 - DNA, 27 bp, Artificial Sequence
  Description of Artificial Sequence: Synthetic oligonucleotide
ctcagcgagctggattaccaggtgtgc

SEQ ID NO: 308460 - DNA, 27 bp, Artificial Sequence
  Description of Artificial Sequence: Synthetic oligonucleotide
tcagcgagctggattaccaggtgtgcg

SEQ ID NO: 308461 - DNA, 27 bp, Artificial Sequence
  Description of Artificial Sequence: Synthetic oligonucleotide
cagcgagctggattaccaggtgtgcgt

SEQ ID NO: 308462 - DNA, 27 bp, Artificial Sequence
  Description of Artificial Sequence: Synthetic oligonucleotide
agcgagctggattaccaggtgtgcgtc

SEQ ID NO: 308463 - DNA, 26 bp, Artificial Sequence
  Description of Artificial Sequence: Synthetic oligonucleotide
gcgagctggattaccaggtgtgcgtc

SEQ ID NO: 308464 - DNA, 27 bp, Artificial Sequence
  Description of Artificial Sequence: Synthetic oligonucleotide
cgagctggattaccaggtgtgcgtcga

SEQ ID NO: 308465 - DNA, 27 bp, Artificial Sequence
  Description of Artificial Sequence: Synthetic oligonucleotide
gagctggattaccaggtgtgcgtcgac

SEQ ID NO: 308466 - DNA, 27 bp, Artificial Sequence
  Description of Artificial Sequence: Synthetic oligonucleotide
agctggattaccaggtgtgcgtcgacg

SEQ ID NO: 308467 - DNA, 27 bp, Artificial Sequence
  Description of Artificial Sequence: Synthetic oligonucleotide
gctggattaccaggtgtgcgtcgacgt

SEQ ID NO: 308468 - DNA, 27 bp, Artificial Sequence
  Description of Artificial Sequence: Synthetic oligonucleotide
ctggattaccaggtgtgcgtcgacgtg

SEQ ID NO: 308469 - DNA, 27 bp, Artificial Sequence
  Description of Artificial Sequence: Synthetic oligonucleotide
tggattaccaggtgtgcgtcgacgtgg

SEQ ID NO: 308470 - DNA, 27 bp, Artificial Sequence
  Description of Artificial Sequence: Synthetic oligonucleotide
ggattaccaggtgtgcgtcgacgtgga

SEQ ID NO: 308471 - DNA, 27 bp, Artificial Sequence
  Description of Artificial Sequence: Synthetic oligonucleotide
gattaccaggtgtgcgtcgacgtggac

SEQ ID NO: 308472 - DNA, 29 bp, Artificial Sequence
  Description of Artificial Sequence: Synthetic oligonucleotide
attaccaggtgtgcgtcgacgtggacttg

SEQ ID NO: 308473 - DNA, 28 bp, Artificial Sequence
  Description of Artificial Sequence: Synthetic oligonucleotide
ttaccaggtgtgcgtcgacgtggacttg

SEQ ID NO: 308474 - DNA, 27 bp, Artificial Sequence
  Description of Artificial Sequence: Synthetic oligonucleotide
taccaggtgtgcgtcgacgtggacttg

SEQ ID NO: 308475 - DNA, 26 bp, Artificial Sequence
  Description of Artificial Sequence: Synthetic oligonucleotide
accaggtgtgcgtcgacgtggacttg

SEQ ID NO: 308476 - DNA, 25 bp, Artificial Sequence
  Description of Artificial Sequence: Synthetic oligonucleotide
ccaggtgtgcgtcgacgtggacttg

SEQ ID NO: 308477 - DNA, 26 bp, Artificial Sequence
  Description of Artificial Sequence: Synthetic oligonucleotide
caggtgtgcgtcgacgtggacttgga

SEQ ID NO: 308478 - DNA, 27 bp, Artificial Sequence
  Description of Artificial Sequence: Synthetic oligonucleotide
aggtgtgcgtcgacgtggacttggagt

SEQ ID NO: 308479 - DNA, 27 bp, Artificial Sequence
  Description of Artificial Sequence: Synthetic oligonucleotide
ggtgtgcgtcgacgtggacttggagtt

SEQ ID NO: 308480 - DNA, 27 bp, Artificial Sequence
  Description of Artificial Sequence: Synthetic oligonucleotide
gtgtgcgtcgacgtggacttggagttc

SEQ ID NO: 308481 - DNA, 27 bp, Artificial Sequence
  Description of Artificial Sequence: Synthetic oligonucleotide
tgtgcgtcgacgtggacttggagttcc

SEQ ID NO: 308482 - DNA, 26 bp, Artificial Sequence
  Description of Artificial Sequence: Synthetic oligonucleotide
gtgcgtcgacgtggacttggagttcc

SEQ ID NO: 308483 - DNA, 26 bp, Artificial Sequence
  Description of Artificial Sequence: Synthetic oligonucleotide
tgcgtcgacgtggacttggagttccc

SEQ ID NO: 308484 - DNA, 25 bp, Artificial Sequence
  Description of Artificial Sequence: Synthetic oligonucleotide
gcgtcgacgtggacttggagttccc

SEQ ID NO: 308485 - DNA, 25 bp, Artificial Sequence
  Description of Artificial Sequence: Synthetic oligonucleotide
cgtcgacgtggacttggagttcccc

SEQ ID NO: 308486 - DNA, 26 bp, Artificial Sequence
  Description of Artificial Sequence: Synthetic oligonucleotide
gtcgacgtggacttggagttccccga

SEQ ID NO: 308487 - DNA, 26 bp, Artificial Sequence
  Description of Artificial Sequence: Synthetic oligonucleotide
tcgacgtggacttggagttccccgac

SEQ ID NO: 308488 - DNA, 25 bp, Artificial Sequence
  Description of Artificial Sequence: Synthetic oligonucleotide
cgacgtggacttggagttccccgac

SEQ ID NO: 308489 - DNA, 26 bp, Artificial Sequence
  Description of Artificial Sequence: Synthetic oligonucleotide
gacgtggacttggagttccccgacca

SEQ ID NO: 308490 - DNA, 26 bp, Artificial Sequence
  Description of Artificial Sequence: Synthetic oligonucleotide
acgtggacttggagttccccgaccac

SEQ ID NO: 308491 - DNA, 25 bp, Artificial Sequence
  Description of Artificial Sequence: Synthetic oligonucleotide
cgtggacttggagttccccgaccac

SEQ ID NO: 308492 - DNA, 26 bp, Artificial Sequence
  Description of Artificial Sequence: Synthetic oligonucleotide
gtggacttggagttccccgaccacgt

SEQ ID NO: 308493 - DNA, 26 bp, Artificial Sequence
  Description of Artificial Sequence: Synthetic oligonucleotide
tggacttggagttccccgaccacgtc

SEQ ID NO: 308494 - DNA, 25 bp, Artificial Sequence
  Description of Artificial Sequence: Synthetic oligonucleotide
ggacttggagttccccgaccacgtc

SEQ ID NO: 308495 - DNA, 25 bp, Artificial Sequence
  Description of Artificial Sequence: Synthetic oligonucleotide
gacttggagttccccgaccacgtcg

SEQ ID NO: 308496 - DNA, 25 bp, Artificial Sequence
  Description of Artificial Sequence: Synthetic oligonucleotide
acttggagttccccgaccacgtcgg

SEQ ID NO: 308497 - DNA, 24 bp, Artificial Sequence
  Description of Artificial Sequence: Synthetic oligonucleotide
cttggagttccccgaccacgtcgg

SEQ ID NO: 308498 - DNA, 24 bp, Artificial Sequence
  Description of Artificial Sequence: Synthetic oligonucleotide
ttggagttccccgaccacgtcggc

SEQ ID NO: 308499 - DNA, 23 bp, Artificial Sequence
  Description of Artificial Sequence: Synthetic oligonucleotide
tggagttccccgaccacgtcggc

SEQ ID NO: 308500 - DNA, 22 bp, Artificial Sequence
  Description of Artificial Sequence: Synthetic oligonucleotide
ggagttccccgaccacgtcggc

SEQ ID NO: 308501 - DNA, 23 bp, Artificial Sequence
  Description of Artificial Sequence: Synthetic oligonucleotide
gagttccccgaccacgtcggcgt

SEQ ID NO: 308502 - DNA, 23 bp, Artificial Sequence
  Description of Artificial Sequence: Synthetic oligonucleotide
agttccccgaccacgtcggcgtg

SEQ ID NO: 308503 - DNA, 22 bp, Artificial Sequence
  Description of Artificial Sequence: Synthetic oligonucleotide
gttccccgaccacgtcggcgtg

SEQ ID NO: 308504 - DNA, 23 bp, Artificial Sequence
  Description of Artificial Sequence: Synthetic oligonucleotide
ttccccgaccacgtcggcgtgga

SEQ ID NO: 308505 - DNA, 22 bp, Artificial Sequence
  Description of Artificial Sequence: Synthetic oligonucleotide
tccccgaccacgtcggcgtgga

SEQ ID NO: 308506 - DNA, 21 bp, Artificial Sequence
  Description of Artificial Sequence: Synthetic oligonucleotide
ccccgaccacgtcggcgtgga

SEQ ID NO: 308507 - DNA, 23 bp, Artificial Sequence
  Description of Artificial Sequence: Synthetic oligonucleotide
cccgaccacgtcggcgtggagtt

SEQ ID NO: 308508 - DNA, 23 bp, Artificial Sequence
  Description of Artificial Sequence: Synthetic oligonucleotide
ccgaccacgtcggcgtggagttc

SEQ ID NO: 308509 - DNA, 24 bp, Artificial Sequence
  Description of Artificial Sequence: Synthetic oligonucleotide
cgaccacgtcggcgtggagttcct

SEQ ID NO: 308510 - DNA, 25 bp, Artificial Sequence
  Description of Artificial Sequence: Synthetic oligonucleotide
gaccacgtcggcgtggagttcctga

SEQ ID NO: 308511 - DNA, 26 bp, Artificial Sequence
  Description of Artificial Sequence: Synthetic oligonucleotide
accacgtcggcgtggagttcctgact

SEQ ID NO: 308512 - DNA, 25 bp, Artificial Sequence
  Description of Artificial Sequence: Synthetic oligonucleotide
ccacgtcggcgtggagttcctgact

SEQ ID NO: 308513 - DNA, 25 bp, Artificial Sequence
  Description of Artificial Sequence: Synthetic oligonucleotide
cacgtcggcgtggagttcctgactc

SEQ ID NO: 308514 - DNA, 25 bp, Artificial Sequence
  Description of Artificial Sequence: Synthetic oligonucleotide
acgtcggcgtggagttcctgactcg

SEQ ID NO: 308515 - DNA, 24 bp, Artificial Sequence
  Description of Artificial Sequence: Synthetic oligonucleotide
cgtcggcgtggagttcctgactcg

SEQ ID NO: 308516 - DNA, 24 bp, Artificial Sequence
  Description of Artificial Sequence: Synthetic oligonucleotide
gtcggcgtggagttcctgactcgg

SEQ ID NO: 308517 - DNA, 25 bp, Artificial Sequence
  Description of Artificial Sequence: Synthetic oligonucleotide
tcggcgtggagttcctgactcggct

SEQ ID NO: 308518 - DNA, 24 bp, Artificial Sequence
  Description of Artificial Sequence: Synthetic oligonucleotide
cggcgtggagttcctgactcggct

SEQ ID NO: 308519 - DNA, 26 bp, Artificial Sequence
  Description of Artificial Sequence: Synthetic oligonucleotide
ggcgtggagttcctgactcggctgtt

SEQ ID NO: 308520 - DNA, 26 bp, Artificial Sequence
  Description of Artificial Sequence: Synthetic oligonucleotide
gcgtggagttcctgactcggctgttc

SEQ ID NO: 308521 - DNA, 26 bp, Artificial Sequence
  Description of Artificial Sequence: Synthetic oligonucleotide
cgtggagttcctgactcggctgttcg

SEQ ID NO: 308522 - DNA, 26 bp, Artificial Sequence
  Description of Artificial Sequence: Synthetic oligonucleotide
gtggagttcctgactcggctgttcgg

SEQ ID NO: 308523 - DNA, 27 bp, Artificial Sequence
  Description of Artificial Sequence: Synthetic oligonucleotide
tggagttcctgactcggctgttcggga

SEQ ID NO: 308524 - DNA, 26 bp, Artificial Sequence
  Description of Artificial Sequence: Synthetic oligonucleotide
ggagttcctgactcggctgttcggga

SEQ ID NO: 308525 - DNA, 26 bp, Artificial Sequence
  Description of Artificial Sequence: Synthetic oligonucleotide
gagttcctgactcggctgttcgggac

SEQ ID NO: 308526 - DNA, 26 bp, Artificial Sequence
  Description of Artificial Sequence: Synthetic oligonucleotide
agttcctgactcggctgttcgggacc

SEQ ID NO: 308527 - DNA, 25 bp, Artificial Sequence
  Description of Artificial Sequence: Synthetic oligonucleotide
gttcctgactcggctgttcgggacc

SEQ ID NO: 308528 - DNA, 26 bp, Artificial Sequence
  Description of Artificial Sequence: Synthetic oligonucleotide
ttcctgactcggctgttcgggaccct

SEQ ID NO: 308529 - DNA, 25 bp, Artificial Sequence
  Description of Artificial Sequence: Synthetic oligonucleotide
tcctgactcggctgttcgggaccct

SEQ ID NO: 308530 - DNA, 24 bp, Artificial Sequence
  Description of Artificial Sequence: Synthetic oligonucleotide
cctgactcggctgttcgggaccct

SEQ ID NO: 308531 - DNA, 24 bp, Artificial Sequence
  Description of Artificial Sequence: Synthetic oligonucleotide
ctgactcggctgttcgggaccctg

SEQ ID NO: 308532 - DNA, 25 bp, Artificial Sequence
  Description of Artificial Sequence: Synthetic oligonucleotide
tgactcggctgttcgggaccctgca

SEQ ID NO: 308533 - DNA, 24 bp, Artificial Sequence
  Description of Artificial Sequence: Synthetic oligonucleotide
gactcggctgttcgggaccctgca

SEQ ID NO: 308534 - DNA, 24 bp, Artificial Sequence
  Description of Artificial Sequence: Synthetic oligonucleotide
actcggctgttcgggaccctgcac

SEQ ID NO: 308535 - DNA, 23 bp, Artificial Sequence
  Description of Artificial Sequence: Synthetic oligonucleotide
ctcggctgttcgggaccctgcac

SEQ ID NO: 308536 - DNA, 23 bp, Artificial Sequence
  Description of Artificial Sequence: Synthetic oligonucleotide
tcggctgttcgggaccctgcacg

SEQ ID NO: 308537 - DNA, 22 bp, Artificial Sequence
  Description of Artificial Sequence: Synthetic oligonucleotide
cggctgttcgggaccctgcacg

SEQ ID NO: 308538 - DNA, 22 bp, Artificial Sequence
  Description of Artificial Sequence: Synthetic oligonucleotide
ggctgttcgggaccctgcacgc

SEQ ID NO: 308539 - DNA, 22 bp, Artificial Sequence
  Description of Artificial Sequence: Synthetic oligonucleotide
gctgttcgggaccctgcacgcc

SEQ ID NO: 308540 - DNA, 22 bp, Artificial Sequence
  Description of Artificial Sequence: Synthetic oligonucleotide
ctgttcgggaccctgcacgccg

SEQ ID NO: 308541 - DNA, 22 bp, Artificial Sequence
  Description of Artificial Sequence: Synthetic oligonucleotide
tgttcgggaccctgcacgccgg

SEQ ID NO: 308542 - DNA, 21 bp, Artificial Sequence
  Description of Artificial Sequence: Synthetic oligonucleotide
gttcgggaccctgcacgccgg

SEQ ID NO: 308543 - DNA, 23 bp, Artificial Sequence
  Description of Artificial Sequence: Synthetic oligonucleotide
ttcgggaccctgcacgccggctt

SEQ ID NO: 308544 - DNA, 22 bp, Artificial Sequence
  Description of Artificial Sequence: Synthetic oligonucleotide
tcgggaccctgcacgccggctt

SEQ ID NO: 308545 - DNA, 21 bp, Artificial Sequence
  Description of Artificial Sequence: Synthetic oligonucleotide
cgggaccctgcacgccggctt

SEQ ID NO: 308546 - DNA, 23 bp, Artificial Sequence
  Description of Artificial Sequence: Synthetic oligonucleotide
gggaccctgcacgccggcttctt

SEQ ID NO: 308547 - DNA, 23 bp, Artificial Sequence
  Description of Artificial Sequence: Synthetic oligonucleotide
ggaccctgcacgccggcttcttc

SEQ ID NO: 308548 - DNA, 23 bp, Artificial Sequence
  Description of Artificial Sequence: Synthetic oligonucleotide
gaccctgcacgccggcttcttcg

SEQ ID NO: 308549 - DNA, 25 bp, Artificial Sequence
  Description of Artificial Sequence: Synthetic oligonucleotide
accctgcacgccggcttcttcggaa

SEQ ID NO: 308550 - DNA, 24 bp, Artificial Sequence
  Description of Artificial Sequence: Synthetic oligonucleotide
ccctgcacgccggcttcttcggaa

SEQ ID NO: 308551 - DNA, 24 bp, Artificial Sequence
  Description of Artificial Sequence: Synthetic oligonucleotide
cctgcacgccggcttcttcggaag

SEQ ID NO: 308552 - DNA, 25 bp, Artificial Sequence
  Description of Artificial Sequence: Synthetic oligonucleotide
ctgcacgccggcttcttcggaagca

SEQ ID NO: 308553 - DNA, 25 bp, Artificial Sequence
  Description of Artificial Sequence: Synthetic oligonucleotide
tgcacgccggcttcttcggaagcag

SEQ ID NO: 308554 - DNA, 24 bp, Artificial Sequence
  Description of Artificial Sequence: Synthetic oligonucleotide
gcacgccggcttcttcggaagcag

SEQ ID NO: 308555 - DNA, 24 bp, Artificial Sequence
  Description of Artificial Sequence: Synthetic oligonucleotide
cacgccggcttcttcggaagcagg

SEQ ID NO: 308556 - DNA, 24 bp, Artificial Sequence
  Description of Artificial Sequence: Synthetic oligonucleotide
acgccggcttcttcggaagcaggc

SEQ ID NO: 308557 - DNA, 23 bp, Artificial Sequence
  Description of Artificial Sequence: Synthetic oligonucleotide
cgccggcttcttcggaagcaggc

SEQ ID NO: 308558 - DNA, 23 bp, Artificial Sequence
  Description of Artificial Sequence: Synthetic oligonucleotide
gccggcttcttcggaagcaggcg

SEQ ID NO: 308559 - DNA, 23 bp, Artificial Sequence
  Description of Artificial Sequence: Synthetic oligonucleotide
ccggcttcttcggaagcaggcgg

SEQ ID NO: 308560 - DNA, 24 bp, Artificial Sequence
  Description of Artificial Sequence: Synthetic oligonucleotide
cggcttcttcggaagcaggcggga

SEQ ID NO: 308561 - DNA, 24 bp, Artificial Sequence
  Description of Artificial Sequence: Synthetic oligonucleotide
ggcttcttcggaagcaggcgggag

SEQ ID NO: 308562 - DNA, 24 bp, Artificial Sequence
  Description of Artificial Sequence: Synthetic oligonucleotide
gcttcttcggaagcaggcgggagg

SEQ ID NO: 308563 - DNA, 24 bp, Artificial Sequence
  Description of Artificial Sequence: Synthetic oligonucleotide
cttcttcggaagcaggcgggaggc

SEQ ID NO: 308564 - DNA, 26 bp, Artificial Sequence
  Description of Artificial Sequence: Synthetic oligonucleotide
ttcttcggaagcaggcgggaggccat

SEQ ID NO: 308565 - DNA, 25 bp, Artificial Sequence
  Description of Artificial Sequence: Synthetic oligonucleotide
tcttcggaagcaggcgggaggccat

SEQ ID NO: 308566 - DNA, 24 bp, Artificial Sequence
  Description of Artificial Sequence: Synthetic oligonucleotide
cttcggaagcaggcgggaggccat

SEQ ID NO: 308567 - DNA, 25 bp, Artificial Sequence
  Description of Artificial Sequence: Synthetic oligonucleotide
ttcggaagcaggcgggaggccatca

SEQ ID NO: 308568 - DNA, 24 bp, Artificial Sequence
  Description of Artificial Sequence: Synthetic oligonucleotide
tcggaagcaggcgggaggccatca

SEQ ID NO: 308569 - DNA, 23 bp, Artificial Sequence
  Description of Artificial Sequence: Synthetic oligonucleotide
cggaagcaggcgggaggccatca

SEQ ID NO: 308570 - DNA, 23 bp, Artificial Sequence
  Description of Artificial Sequence: Synthetic oligonucleotide
ggaagcaggcgggaggccatcac

SEQ ID NO: 308571 - DNA, 25 bp, Artificial Sequence
  Description of Artificial Sequence: Synthetic oligonucleotide
gaagcaggcgggaggccatcaccta

SEQ ID NO: 308572 - DNA, 25 bp, Artificial Sequence
  Description of Artificial Sequence: Synthetic oligonucleotide
aagcaggcgggaggccatcacctac

SEQ ID NO: 308573 - DNA, 24 bp, Artificial Sequence
  Description of Artificial Sequence: Synthetic oligonucleotide
agcaggcgggaggccatcacctac

SEQ ID NO: 308574 - DNA, 23 bp, Artificial Sequence
  Description of Artificial Sequence: Synthetic oligonucleotide
gcaggcgggaggccatcacctac

SEQ ID NO: 308575 - DNA, 24 bp, Artificial Sequence
  Description of Artificial Sequence: Synthetic oligonucleotide
caggcgggaggccatcacctacgt

SEQ ID NO: 308576 - DNA, 24 bp, Artificial Sequence
  Description of Artificial Sequence: Synthetic oligonucleotide
aggcgggaggccatcacctacgtg

SEQ ID NO: 308577 - DNA, 23 bp, Artificial Sequence
  Description of Artificial Sequence: Synthetic oligonucleotide
ggcgggaggccatcacctacgtg

SEQ ID NO: 308578 - DNA, 23 bp, Artificial Sequence
  Description of Artificial Sequence: Synthetic oligonucleotide
gcgggaggccatcacctacgtgc

SEQ ID NO: 308579 - DNA, 23 bp, Artificial Sequence
  Description of Artificial Sequence: Synthetic oligonucleotide
cgggaggccatcacctacgtgcg

SEQ ID NO: 308580 - DNA, 23 bp, Artificial Sequence
  Description of Artificial Sequence: Synthetic oligonucleotide
gggaggccatcacctacgtgcgc

SEQ ID NO: 308581 - DNA, 23 bp, Artificial Sequence
  Description of Artificial Sequence: Synthetic oligonucleotide
ggaggccatcacctacgtgcgcc

SEQ ID NO: 308582 - DNA, 23 bp, Artificial Sequence
  Description of Artificial Sequence: Synthetic oligonucleotide
gaggccatcacctacgtgcgccg

SEQ ID NO: 308583 - DNA, 23 bp, Artificial Sequence
  Description of Artificial Sequence: Synthetic oligonucleotide
aggccatcacctacgtgcgccgg

SEQ ID NO: 308584 - DNA, 22 bp, Artificial Sequence
  Description of Artificial Sequence: Synthetic oligonucleotide
ggccatcacctacgtgcgccgg

SEQ ID NO: 308585 - DNA, 22 bp, Artificial Sequence
  Description of Artificial Sequence: Synthetic oligonucleotide
gccatcacctacgtgcgccggc

SEQ ID NO: 308586 - DNA, 22 bp, Artificial Sequence
  Description of Artificial Sequence: Synthetic oligonucleotide
ccatcacctacgtgcgccggcc

SEQ ID NO: 308587 - DNA, 22 bp, Artificial Sequence
  Description of Artificial Sequence: Synthetic oligonucleotide
catcacctacgtgcgccggccg

SEQ ID NO: 308588 - DNA, 23 bp, Artificial Sequence
  Description of Artificial Sequence: Synthetic oligonucleotide
atcacctacgtgcgccggccgca

SEQ ID NO: 308589 - DNA, 22 bp, Artificial Sequence
  Description of Artificial Sequence: Synthetic oligonucleotide
tcacctacgtgcgccggccgca

SEQ ID NO: 308590 - DNA, 21 bp, Artificial Sequence
  Description of Artificial Sequence: Synthetic oligonucleotide
cacctacgtgcgccggccgca

SEQ ID NO: 308591 - DNA, 22 bp, Artificial Sequence
  Description of Artificial Sequence: Synthetic oligonucleotide
acctacgtgcgccggccgcagt

SEQ ID NO: 308592 - DNA, 21 bp, Artificial Sequence
  Description of Artificial Sequence: Synthetic oligonucleotide
cctacgtgcgccggccgcagt

SEQ ID NO: 308593 - DNA, 21 bp, Artificial Sequence
  Description of Artificial Sequence: Synthetic oligonucleotide
ctacgtgcgccggccgcagtc

SEQ ID NO: 308594 - DNA, 21 bp, Artificial Sequence
  Description of Artificial Sequence: Synthetic oligonucleotide
tacgtgcgccggccgcagtcc

SEQ ID NO: 308595 - DNA, 20 bp, Artificial Sequence
  Description of Artificial Sequence: Synthetic oligonucleotide
acgtgcgccggccgcagtcc

SEQ ID NO: 308596 - DNA, 20 bp, Artificial Sequence
  Description of Artificial Sequence: Synthetic oligonucleotide
cgtgcgccggccgcagtcct

SEQ ID NO: 308597 - DNA, 20 bp, Artificial Sequence
  Description of Artificial Sequence: Synthetic oligonucleotide
gtgcgccggccgcagtccca

SEQ ID NO: 308598 - DNA, 20 bp, Artificial Sequence
  Description of Artificial Sequence: Synthetic oligonucleotide
tgcgccggccgcagtcccag

SEQ ID NO: 308599 - DNA, 20 bp, Artificial Sequence
  Description of Artificial Sequence: Synthetic oligonucleotide
gcgccggccgcagtcccagt

SEQ ID NO: 308600 - DNA, 20 bp, Artificial Sequence
  Description of Artificial Sequence: Synthetic oligonucleotide
cgccggccgcagtcccagct

SEQ ID NO: 308601 - DNA, 20 bp, Artificial Sequence
  Description of Artificial Sequence: Synthetic oligonucleotide
gccggccgcagtcccagcct

SEQ ID NO: 308602 - DNA, 21 bp, Artificial Sequence
  Description of Artificial Sequence: Synthetic oligonucleotide
ccggccgcagtcccagcccta

SEQ ID NO: 308603 - DNA, 23 bp, Artificial Sequence
  Description of Artificial Sequence: Synthetic oligonucleotide
cggccgcagtcccagccctacat

SEQ ID NO: 308604 - DNA, 23 bp, Artificial Sequence
  Description of Artificial Sequence: Synthetic oligonucleotide
ggccgcagtcccagccctacatc

SEQ ID NO: 308605 - DNA, 23 bp, Artificial Sequence
  Description of Artificial Sequence: Synthetic oligonucleotide
gccgcagtcccagccctacatcc

SEQ ID NO: 308606 - DNA, 23 bp, Artificial Sequence
  Description of Artificial Sequence: Synthetic oligonucleotide
ccgcagtcccagccctacatccg

SEQ ID NO: 308607 - DNA, 25 bp, Artificial Sequence
  Description of Artificial Sequence: Synthetic oligonucleotide
cgcagtcccagccctacatccgcaa

SEQ ID NO: 308608 - DNA, 25 bp, Artificial Sequence
  Description of Artificial Sequence: Synthetic oligonucleotide
gcagtcccagccctacatccgcaag

SEQ ID NO: 308609 - DNA, 26 bp, Artificial Sequence
  Description of Artificial Sequence: Synthetic oligonucleotide
cagtcccagccctacatccgcaagga

SEQ ID NO: 308610 - DNA, 26 bp, Artificial Sequence
  Description of Artificial Sequence: Synthetic oligonucleotide
agtcccagccctacatccgcaaggac

SEQ ID NO: 308611 - DNA, 25 bp, Artificial Sequence
  Description of Artificial Sequence: Synthetic oligonucleotide
gtcccagccctacatccgcaaggac

SEQ ID NO: 308612 - DNA, 26 bp, Artificial Sequence
  Description of Artificial Sequence: Synthetic oligonucleotide
tcccagccctacatccgcaaggacga

SEQ ID NO: 308613 - DNA, 25 bp, Artificial Sequence
  Description of Artificial Sequence: Synthetic oligonucleotide
cccagccctacatccgcaaggacga

SEQ ID NO: 308614 - DNA, 25 bp, Artificial Sequence
  Description of Artificial Sequence: Synthetic oligonucleotide
ccagccctacatccgcaaggacgac

SEQ ID NO: 308615 - DNA, 25 bp, Artificial Sequence
  Description of Artificial Sequence: Synthetic oligonucleotide
cagccctacatccgcaaggacgacg

SEQ ID NO: 308616 - DNA, 25 bp, Artificial Sequence
  Description of Artificial Sequence: Synthetic oligonucleotide
agccctacatccgcaaggacgacgg

SEQ ID NO: 308617 - DNA, 24 bp, Artificial Sequence
  Description of Artificial Sequence: Synthetic oligonucleotide
gccctacatccgcaaggacgacgg

SEQ ID NO: 308618 - DNA, 24 bp, Artificial Sequence
  Description of Artificial Sequence: Synthetic oligonucleotide
ccctacatccgcaaggacgacggc

SEQ ID NO: 308619 - DNA, 27 bp, Artificial Sequence
  Description of Artificial Sequence: Synthetic oligonucleotide
cctacatccgcaaggacgacggcgatt

SEQ ID NO: 308620 - DNA, 28 bp, Artificial Sequence
  Description of Artificial Sequence: Synthetic oligonucleotide
ctacatccgcaaggacgacggcgatttc

SEQ ID NO: 308621 - DNA, 30 bp, Artificial Sequence
  Description of Artificial Sequence: Synthetic oligonucleotide
tacatccgcaaggacgacggcgatttcaac

SEQ ID NO: 308622 - DNA, 29 bp, Artificial Sequence
  Description of Artificial Sequence: Synthetic oligonucleotide
acatccgcaaggacgacggcgatttcaac

SEQ ID NO: 308623 - DNA, 28 bp, Artificial Sequence
  Description of Artificial Sequence: Synthetic oligonucleotide
catccgcaaggacgacggcgatttcaac

SEQ ID NO: 308624 - DNA, 30 bp, Artificial Sequence
  Description of Artificial Sequence: Synthetic oligonucleotide
atccgcaaggacgacggcgatttcaactac

SEQ ID NO: 308625 - DNA, 29 bp, Artificial Sequence
  Description of Artificial Sequence: Synthetic oligonucleotide
tccgcaaggacgacggcgatttcaactac

SEQ ID NO: 308626 - DNA, 28 bp, Artificial Sequence
  Description of Artificial Sequence: Synthetic oligonucleotide
ccgcaaggacgacggcgatttcaactac

SEQ ID NO: 308627 - DNA, 28 bp, Artificial Sequence
  Description of Artificial Sequence: Synthetic oligonucleotide
cgcaaggacgacggcgatttcaactacc

SEQ ID NO: 308628 - DNA, 29 bp, Artificial Sequence
  Description of Artificial Sequence: Synthetic oligonucleotide
gcaaggacgacggcgatttcaactacctg

SEQ ID NO: 308629 - DNA, 29 bp, Artificial Sequence
  Description of Artificial Sequence: Synthetic oligonucleotide
caaggacgacggcgatttcaactacctgg

SEQ ID NO: 308630 - DNA, 29 bp, Artificial Sequence
  Description of Artificial Sequence: Synthetic oligonucleotide
aaggacgacggcgatttcaactacctggc

SEQ ID NO: 308631 - DNA, 28 bp, Artificial Sequence
  Description of Artificial Sequence: Synthetic oligonucleotide
aggacgacggcgatttcaactacctggc

SEQ ID NO: 308632 - DNA, 27 bp, Artificial Sequence
  Description of Artificial Sequence: Synthetic oligonucleotide
ggacgacggcgatttcaactacctggc

SEQ ID NO: 308633 - DNA, 27 bp, Artificial Sequence
  Description of Artificial Sequence: Synthetic oligonucleotide
gacgacggcgatttcaactacctggcg

SEQ ID NO: 308634 - DNA, 27 bp, Artificial Sequence
  Description of Artificial Sequence: Synthetic oligonucleotide
acgacggcgatttcaactacctggcgg

SEQ ID NO: 308635 - DNA, 26 bp, Artificial Sequence
  Description of Artificial Sequence: Synthetic oligonucleotide
cgacggcgatttcaactacctggcgg

SEQ ID NO: 308636 - DNA, 26 bp, Artificial Sequence
  Description of Artificial Sequence: Synthetic oligonucleotide
gacggcgatttcaactacctggcggg

SEQ ID NO: 308637 - DNA, 27 bp, Artificial Sequence
  Description of Artificial Sequence: Synthetic oligonucleotide
acggcgatttcaactacctggcggggt

SEQ ID NO: 308638 - DNA, 27 bp, Artificial Sequence
  Description of Artificial Sequence: Synthetic oligonucleotide
cggcgatttcaactacctggcggggtt

SEQ ID NO: 308639 - DNA, 27 bp, Artificial Sequence
  Description of Artificial Sequence: Synthetic oligonucleotide
ggcgatttcaactacctggcggggttc

SEQ ID NO: 308640 - DNA, 29 bp, Artificial Sequence
  Description of Artificial Sequence: Synthetic oligonucleotide
gcgatttcaactacctggcggggttcttg

SEQ ID NO: 308641 - DNA, 29 bp, Artificial Sequence
  Description of Artificial Sequence: Synthetic oligonucleotide
cgatttcaactacctggcggggttcttgg

SEQ ID NO: 308642 - DNA, 29 bp, Artificial Sequence
  Description of Artificial Sequence: Synthetic oligonucleotide
gatttcaactacctggcggggttcttggg

SEQ ID NO: 308643 - DNA, 29 bp, Artificial Sequence
  Description of Artificial Sequence: Synthetic oligonucleotide
atttcaactacctggcggggttcttgggg

SEQ ID NO: 308644 - DNA, 28 bp, Artificial Sequence
  Description of Artificial Sequence: Synthetic oligonucleotide
tttcaactacctggcggggttcttgggg

SEQ ID NO: 308645 - DNA, 27 bp, Artificial Sequence
  Description of Artificial Sequence: Synthetic oligonucleotide
ttcaactacctggcggggttcttgggg

SEQ ID NO: 308646 - DNA, 26 bp, Artificial Sequence
  Description of Artificial Sequence: Synthetic oligonucleotide
tcaactacctggcggggttcttgggg

SEQ ID NO: 308647 - DNA, 25 bp, Artificial Sequence
  Description of Artificial Sequence: Synthetic oligonucleotide
caactacctggcggggttcttgggg

SEQ ID NO: 308648 - DNA, 25 bp, Artificial Sequence
  Description of Artificial Sequence: Synthetic oligonucleotide
aactacctggcggggttcttggggg

SEQ ID NO: 308649 - DNA, 24 bp, Artificial Sequence
  Description of Artificial Sequence: Synthetic oligonucleotide
actacctggcggggttcttggggg

SEQ ID NO: 308650 - DNA, 23 bp, Artificial Sequence
  Description of Artificial Sequence: Synthetic oligonucleotide
ctacctggcggggttcttggggg

SEQ ID NO: 308651 - DNA, 23 bp, Artificial Sequence
  Description of Artificial Sequence: Synthetic oligonucleotide
tacctggcggggttcttgggggg

SEQ ID NO: 308652 - DNA, 22 bp, Artificial Sequence
  Description of Artificial Sequence: Synthetic oligonucleotide
acctggcggggttcttgggggg

SEQ ID NO: 308653 - DNA, 21 bp, Artificial Sequence
  Description of Artificial Sequence: Synthetic oligonucleotide
cctggcggggttcttgggggg

SEQ ID NO: 308654 - DNA, 22 bp, Artificial Sequence
  Description of Artificial Sequence: Synthetic oligonucleotide
ctggcggggttcttgggggggt

SEQ ID NO: 308655 - DNA, 22 bp, Artificial Sequence
  Description of Artificial Sequence: Synthetic oligonucleotide
tggcggggttcttgggggggtc

SEQ ID NO: 308656 - DNA, 21 bp, Artificial Sequence
  Description of Artificial Sequence: Synthetic oligonucleotide
ggcggggttcttgggggggtc

SEQ ID NO: 308657 - DNA, 21 bp, Artificial Sequence
  Description of Artificial Sequence: Synthetic oligonucleotide
gcggggttcttgggggggtcg

SEQ ID NO: 308658 - DNA, 22 bp, Artificial Sequence
  Description of Artificial Sequence: Synthetic oligonucleotide
cggggttcttgggggggtcgct

SEQ ID NO: 308659 - DNA, 22 bp, Artificial Sequence
  Description of Artificial Sequence: Synthetic oligonucleotide
ggggttcttgggggggtcgctg

SEQ ID NO: 308660 - DNA, 24 bp, Artificial Sequence
  Description of Artificial Sequence: Synthetic oligonucleotide
gggttcttgggggggtcgctgcaa

SEQ ID NO: 308661 - DNA, 25 bp, Artificial Sequence
  Description of Artificial Sequence: Synthetic oligonucleotide
ggttcttgggggggtcgctgcaaga

SEQ ID NO: 308662 - DNA, 25 bp, Artificial Sequence
  Description of Artificial Sequence: Synthetic oligonucleotide
gttcttgggggggtcgctgcaagag

SEQ ID NO: 308663 - DNA, 26 bp, Artificial Sequence
  Description of Artificial Sequence: Synthetic oligonucleotide
ttcttgggggggtcgctgcaagagga

SEQ ID NO: 308664 - DNA, 25 bp, Artificial Sequence
  Description of Artificial Sequence: Synthetic oligonucleotide
tcttgggggggtcgctgcaagagga

SEQ ID NO: 308665 - DNA, 24 bp, Artificial Sequence
  Description of Artificial Sequence: Synthetic oligonucleotide
cttgggggggtcgctgcaagagga

SEQ ID NO: 308666 - DNA, 24 bp, Artificial Sequence
  Description of Artificial Sequence: Synthetic oligonucleotide
ttgggggggtcgctgcaagaggag

SEQ ID NO: 308667 - DNA, 23 bp, Artificial Sequence
  Description of Artificial Sequence: Synthetic oligonucleotide
tgggggggtcgctgcaagaggag

SEQ ID NO: 308668 - DNA, 22 bp, Artificial Sequence
  Description of Artificial Sequence: Synthetic oligonucleotide
gggggggtcgctgcaagaggag

SEQ ID NO: 308669 - DNA, 23 bp, Artificial Sequence
  Description of Artificial Sequence: Synthetic oligonucleotide
ggggggtcgctgcaagaggagca

SEQ ID NO: 308670 - DNA, 23 bp, Artificial Sequence
  Description of Artificial Sequence: Synthetic oligonucleotide
gggggtcgctgcaagaggagcag

SEQ ID NO: 308671 - DNA, 23 bp, Artificial Sequence
  Description of Artificial Sequence: Synthetic oligonucleotide
ggggtcgctgcaagaggagcagc

SEQ ID NO: 308672 - DNA, 23 bp, Artificial Sequence
  Description of Artificial Sequence: Synthetic oligonucleotide
gggtcgctgcaagaggagcagcg

SEQ ID NO: 308673 - DNA, 23 bp, Artificial Sequence
  Description of Artificial Sequence: Synthetic oligonucleotide
ggtcgctgcaagaggagcagcgg

SEQ ID NO: 308674 - DNA, 24 bp, Artificial Sequence
  Description of Artificial Sequence: Synthetic oligonucleotide
gtcgctgcaagaggagcagcggct

SEQ ID NO: 308675 - DNA, 25 bp, Artificial Sequence
  Description of Artificial Sequence: Synthetic oligonucleotide
tcgctgcaagaggagcagcggctga

SEQ ID NO: 308676 - DNA, 24 bp, Artificial Sequence
  Description of Artificial Sequence: Synthetic oligonucleotide
cgctgcaagaggagcagcggctga

SEQ ID NO: 308677 - DNA, 24 bp, Artificial Sequence
  Description of Artificial Sequence: Synthetic oligonucleotide
gctgcaagaggagcagcggctgac

SEQ ID NO: 308678 - DNA, 25 bp, Artificial Sequence
  Description of Artificial Sequence: Synthetic oligonucleotide
ctgcaagaggagcagcggctgacca

SEQ ID NO: 308679 - DNA, 25 bp, Artificial Sequence
  Description of Artificial Sequence: Synthetic oligonucleotide
tgcaagaggagcagcggctgaccag

SEQ ID NO: 308680 - DNA, 24 bp, Artificial Sequence
  Description of Artificial Sequence: Synthetic oligonucleotide
gcaagaggagcagcggctgaccag

SEQ ID NO: 308681 - DNA, 24 bp, Artificial Sequence
  Description of Artificial Sequence: Synthetic oligonucleotide
caagaggagcagcggctgaccagg

SEQ ID NO: 308682 - DNA, 24 bp, Artificial Sequence
  Description of Artificial Sequence: Synthetic oligonucleotide
aagaggagcagcggctgaccaggg

SEQ ID NO: 308683 - DNA, 23 bp, Artificial Sequence
  Description of Artificial Sequence: Synthetic oligonucleotide
agaggagcagcggctgaccaggg

SEQ ID NO: 308684 - DNA, 22 bp, Artificial Sequence
  Description of Artificial Sequence: Synthetic oligonucleotide
gaggagcagcggctgaccaggg

SEQ ID NO: 308685 - DNA, 22 bp, Artificial Sequence
  Description of Artificial Sequence: Synthetic oligonucleotide
aggagcagcggctgaccagggc

SEQ ID NO: 308686 - DNA, 21 bp, Artificial Sequence
  Description of Artificial Sequence: Synthetic oligonucleotide
ggagcagcggctgaccagggc

SEQ ID NO: 308687 - DNA, 22 bp, Artificial Sequence
  Description of Artificial Sequence: Synthetic oligonucleotide
gagcagcggctgaccagggcca

SEQ ID NO: 308688 - DNA, 22 bp, Artificial Sequence
  Description of Artificial Sequence: Synthetic oligonucleotide
agcagcggctgaccagggccag

SEQ ID NO: 308689 - DNA, 21 bp, Artificial Sequence
  Description of Artificial Sequence: Synthetic oligonucleotide
gcagcggctgaccagggccag

SEQ ID NO: 308690 - DNA, 21 bp, Artificial Sequence
  Description of Artificial Sequence: Synthetic oligonucleotide
cagcggctgaccagggccagc

SEQ ID NO: 308691 - DNA, 22 bp, Artificial Sequence
  Description of Artificial Sequence: Synthetic oligonucleotide
agcggctgaccagggccagcca

SEQ ID NO: 308692 - DNA, 21 bp, Artificial Sequence
  Description of Artificial Sequence: Synthetic oligonucleotide
gcggctgaccagggccagcca

SEQ ID NO: 308693 - DNA, 21 bp, Artificial Sequence
  Description of Artificial Sequence: Synthetic oligonucleotide
cggctgaccagggccagccac

SEQ ID NO: 308694 - DNA, 22 bp, Artificial Sequence
  Description of Artificial Sequence: Synthetic oligonucleotide
ggctgaccagggccagccacca

SEQ ID NO: 308695 - DNA, 22 bp, Artificial Sequence
  Description of Artificial Sequence: Synthetic oligonucleotide
gctgaccagggccagccaccag

SEQ ID NO: 308696 - DNA, 22 bp, Artificial Sequence
  Description of Artificial Sequence: Synthetic oligonucleotide
ctgaccagggccagccaccagg

SEQ ID NO: 308697 - DNA, 22 bp, Artificial Sequence
  Description of Artificial Sequence: Synthetic oligonucleotide
tgaccagggccagccaccaggg

SEQ ID NO: 308698 - DNA, 21 bp, Artificial Sequence
  Description of Artificial Sequence: Synthetic oligonucleotide
gaccagggccagccaccaggg

SEQ ID NO: 308699 - DNA, 23 bp, Artificial Sequence
  Description of Artificial Sequence: Synthetic oligonucleotide
accagggccagccaccagggcat

SEQ ID NO: 308700 - DNA, 22 bp, Artificial Sequence
  Description of Artificial Sequence: Synthetic oligonucleotide
ccagggccagccaccagggcat

SEQ ID NO: 308701 - DNA, 24 bp, Artificial Sequence
  Description of Artificial Sequence: Synthetic oligonucleotide
cagggccagccaccagggcatgat

SEQ ID NO: 308702 - DNA, 24 bp, Artificial Sequence
  Description of Artificial Sequence: Synthetic oligonucleotide
agggccagccaccagggcatgatg

SEQ ID NO: 308703 - DNA, 23 bp, Artificial Sequence
  Description of Artificial Sequence: Synthetic oligonucleotide
gggccagccaccagggcatgatg

SEQ ID NO: 308704 - DNA, 24 bp, Artificial Sequence
  Description of Artificial Sequence: Synthetic oligonucleotide
ggccagccaccagggcatgatggt

SEQ ID NO: 308705 - DNA, 24 bp, Artificial Sequence
  Description of Artificial Sequence: Synthetic oligonucleotide
gccagccaccagggcatgatggtg

SEQ ID NO: 308706 - DNA, 25 bp, Artificial Sequence
  Description of Artificial Sequence: Synthetic oligonucleotide
ccagccaccagggcatgatggtgga

SEQ ID NO: 308707 - DNA, 25 bp, Artificial Sequence
  Description of Artificial Sequence: Synthetic oligonucleotide
cagccaccagggcatgatggtggac

SEQ ID NO: 308708 - DNA, 26 bp, Artificial Sequence
  Description of Artificial Sequence: Synthetic oligonucleotide
agccaccagggcatgatggtggacca

SEQ ID NO: 308709 - DNA, 25 bp, Artificial Sequence
  Description of Artificial Sequence: Synthetic oligonucleotide
gccaccagggcatgatggtggacca

SEQ ID NO: 308710 - DNA, 25 bp, Artificial Sequence
  Description of Artificial Sequence: Synthetic oligonucleotide
ccaccagggcatgatggtggaccag

SEQ ID NO: 308711 - DNA, 25 bp, Artificial Sequence
  Description of Artificial Sequence: Synthetic oligonucleotide
caccagggcatgatggtggaccagg

SEQ ID NO: 308712 - DNA, 25 bp, Artificial Sequence
  Description of Artificial Sequence: Synthetic oligonucleotide
accagggcatgatggtggaccaggc

SEQ ID NO: 308713 - DNA, 24 bp, Artificial Sequence
  Description of Artificial Sequence: Synthetic oligonucleotide
ccagggcatgatggtggaccaggc

SEQ ID NO: 308714 - DNA, 26 bp, Artificial Sequence
  Description of Artificial Sequence: Synthetic oligonucleotide
cagggcatgatggtggaccaggccta

SEQ ID NO: 308715 - DNA, 26 bp, Artificial Sequence
  Description of Artificial Sequence: Synthetic oligonucleotide
agggcatgatggtggaccaggcctac

SEQ ID NO: 308716 - DNA, 25 bp, Artificial Sequence
  Description of Artificial Sequence: Synthetic oligonucleotide
gggcatgatggtggaccaggcctac

SEQ ID NO: 308717 - DNA, 25 bp, Artificial Sequence
  Description of Artificial Sequence: Synthetic oligonucleotide
ggcatgatggtggaccaggcctacg

SEQ ID NO: 308718 - DNA, 25 bp, Artificial Sequence
  Description of Artificial Sequence: Synthetic oligonucleotide
gcatgatggtggaccaggcctacgg

SEQ ID NO: 308719 - DNA, 27 bp, Artificial Sequence
  Description of Artificial Sequence: Synthetic oligonucleotide
catgatggtggaccaggcctacggcat

SEQ ID NO: 308720 - DNA, 27 bp, Artificial Sequence
  Description of Artificial Sequence: Synthetic oligonucleotide
atgatggtggaccaggcctacggcatc

SEQ ID NO: 308721 - DNA, 26 bp, Artificial Sequence
  Description of Artificial Sequence: Synthetic oligonucleotide
tgatggtggaccaggcctacggcatc

SEQ ID NO: 308722 - DNA, 25 bp, Artificial Sequence
  Description of Artificial Sequence: Synthetic oligonucleotide
gatggtggaccaggcctacggcatc

SEQ ID NO: 308723 - DNA, 26 bp, Artificial Sequence
  Description of Artificial Sequence: Synthetic oligonucleotide
atggtggaccaggcctacggcatcgt

SEQ ID NO: 308724 - DNA, 25 bp, Artificial Sequence
  Description of Artificial Sequence: Synthetic oligonucleotide
tggtggaccaggcctacggcatcgt

SEQ ID NO: 308725 - DNA, 24 bp, Artificial Sequence
  Description of Artificial Sequence: Synthetic oligonucleotide
ggtggaccaggcctacggcatcgt

SEQ ID NO: 308726 - DNA, 24 bp, Artificial Sequence
  Description of Artificial Sequence: Synthetic oligonucleotide
gtggaccaggcctacggcatcgtg

SEQ ID NO: 308727 - DNA, 24 bp, Artificial Sequence
  Description of Artificial Sequence: Synthetic oligonucleotide
tggaccaggcctacggcatcgtgg

SEQ ID NO: 308728 - DNA, 23 bp, Artificial Sequence
  Description of Artificial Sequence: Synthetic oligonucleotide
ggaccaggcctacggcatcgtgg

SEQ ID NO: 308729 - DNA, 23 bp, Artificial Sequence
  Description of Artificial Sequence: Synthetic oligonucleotide
gaccaggcctacggcatcgtggc

SEQ ID NO: 308730 - DNA, 23 bp, Artificial Sequence
  Description of Artificial Sequence: Synthetic oligonucleotide
accaggcctacggcatcgtggcc

SEQ ID NO: 308731 - DNA, 22 bp, Artificial Sequence
  Description of Artificial Sequence: Synthetic oligonucleotide
ccaggcctacggcatcgtggcc

SEQ ID NO: 308732 - DNA, 23 bp, Artificial Sequence
  Description of Artificial Sequence: Synthetic oligonucleotide
caggcctacggcatcgtggccgt

SEQ ID NO: 308733 - DNA, 24 bp, Artificial Sequence
  Description of Artificial Sequence: Synthetic oligonucleotide
aggcctacggcatcgtggccgtgt

SEQ ID NO: 308734 - DNA, 23 bp, Artificial Sequence
  Description of Artificial Sequence: Synthetic oligonucleotide
ggcctacggcatcgtggccgtgt

SEQ ID NO: 308735 - DNA, 23 bp, Artificial Sequence
  Description of Artificial Sequence: Synthetic oligonucleotide
gcctacggcatcgtggccgtgtg

SEQ ID NO: 308736 - DNA, 23 bp, Artificial Sequence
  Description of Artificial Sequence: Synthetic oligonucleotide
cctacggcatcgtggccgtgtgc

SEQ ID NO: 308737 - DNA, 24 bp, Artificial Sequence
  Description of Artificial Sequence: Synthetic oligonucleotide
ctacggcatcgtggccgtgtgcca

SEQ ID NO: 308738 - DNA, 24 bp, Artificial Sequence
  Description of Artificial Sequence: Synthetic oligonucleotide
tacggcatcgtggccgtgtgccac

SEQ ID NO: 308739 - DNA, 23 bp, Artificial Sequence
  Description of Artificial Sequence: Synthetic oligonucleotide
acggcatcgtggccgtgtgccac

SEQ ID NO: 308740 - DNA, 22 bp, Artificial Sequence
  Description of Artificial Sequence: Synthetic oligonucleotide
cggcatcgtggccgtgtgccac

SEQ ID NO: 308741 - DNA, 23 bp, Artificial Sequence
  Description of Artificial Sequence: Synthetic oligonucleotide
ggcatcgtggccgtgtgccacga

SEQ ID NO: 308742 - DNA, 23 bp, Artificial Sequence
  Description of Artificial Sequence: Synthetic oligonucleotide
gcatcgtggccgtgtgccacgac

SEQ ID NO: 308743 - DNA, 24 bp, Artificial Sequence
  Description of Artificial Sequence: Synthetic oligonucleotide
catcgtggccgtgtgccacgacga

SEQ ID NO: 308744 - DNA, 25 bp, Artificial Sequence
  Description of Artificial Sequence: Synthetic oligonucleotide
atcgtggccgtgtgccacgacgagt

SEQ ID NO: 308745 - DNA, 24 bp, Artificial Sequence
  Description of Artificial Sequence: Synthetic oligonucleotide
tcgtggccgtgtgccacgacgagt

SEQ ID NO: 308746 - DNA, 23 bp, Artificial Sequence
  Description of Artificial Sequence: Synthetic oligonucleotide
cgtggccgtgtgccacgacgagt

SEQ ID NO: 308747 - DNA, 23 bp, Artificial Sequence
  Description of Artificial Sequence: Synthetic oligonucleotide
gtggccgtgtgccacgacgagtg

SEQ ID NO: 308748 - DNA, 23 bp, Artificial Sequence
  Description of Artificial Sequence: Synthetic oligonucleotide
tggccgtgtgccacgacgagtgc

SEQ ID NO: 308749 - DNA, 22 bp, Artificial Sequence
  Description of Artificial Sequence: Synthetic oligonucleotide
ggccgtgtgccacgacgagtgc

SEQ ID NO: 308750 - DNA, 23 bp, Artificial Sequence
  Description of Artificial Sequence: Synthetic oligonucleotide
gccgtgtgccacgacgagtgcca

SEQ ID NO: 308751 - DNA, 23 bp, Artificial Sequence
  Description of Artificial Sequence: Synthetic oligonucleotide
ccgtgtgccacgacgagtgccac

SEQ ID NO: 308752 - DNA, 24 bp, Artificial Sequence
  Description of Artificial Sequence: Synthetic oligonucleotide
cgtgtgccacgacgagtgccacct

SEQ ID NO: 308753 - DNA, 26 bp, Artificial Sequence
  Description of Artificial Sequence: Synthetic oligonucleotide
gtgtgccacgacgagtgccacctgat

SEQ ID NO: 308754 - DNA, 27 bp, Artificial Sequence
  Description of Artificial Sequence: Synthetic oligonucleotide
tgtgccacgacgagtgccacctgatca

SEQ ID NO: 308755 - DNA, 27 bp, Artificial Sequence
  Description of Artificial Sequence: Synthetic oligonucleotide
gtgccacgacgagtgccacctgatcaa

SEQ ID NO: 308756 - DNA, 27 bp, Artificial Sequence
  Description of Artificial Sequence: Synthetic oligonucleotide
tgccacgacgagtgccacctgatcaag

SEQ ID NO: 308757 - DNA, 27 bp, Artificial Sequence
  Description of Artificial Sequence: Synthetic oligonucleotide
gccacgacgagtgccacctgatcaagt

SEQ ID NO: 308758 - DNA, 28 bp, Artificial Sequence
  Description of Artificial Sequence: Synthetic oligonucleotide
ccacgacgagtgccacctgatcaagtac

SEQ ID NO: 308759 - DNA, 28 bp, Artificial Sequence
  Description of Artificial Sequence: Synthetic oligonucleotide
cacgacgagtgccacctgatcaagtacc

SEQ ID NO: 308760 - DNA, 29 bp, Artificial Sequence
  Description of Artificial Sequence: Synthetic oligonucleotide
acgacgagtgccacctgatcaagtacctc

SEQ ID NO: 308761 - DNA, 28 bp, Artificial Sequence
  Description of Artificial Sequence: Synthetic oligonucleotide
cgacgagtgccacctgatcaagtacctc

SEQ ID NO: 308762 - DNA, 28 bp, Artificial Sequence
  Description of Artificial Sequence: Synthetic oligonucleotide
gacgagtgccacctgatcaagtacctcc

SEQ ID NO: 308763 - DNA, 29 bp, Artificial Sequence
  Description of Artificial Sequence: Synthetic oligonucleotide
acgagtgccacctgatcaagtacctcctg

SEQ ID NO: 308764 - DNA, 28 bp, Artificial Sequence
  Description of Artificial Sequence: Synthetic oligonucleotide
cgagtgccacctgatcaagtacctcctg

SEQ ID NO: 308765 - DNA, 28 bp, Artificial Sequence
  Description of Artificial Sequence: Synthetic oligonucleotide
gagtgccacctgatcaagtacctcctgc

SEQ ID NO: 308766 - DNA, 28 bp, Artificial Sequence
  Description of Artificial Sequence: Synthetic oligonucleotide
agtgccacctgatcaagtacctcctgcg

SEQ ID NO: 308767 - DNA, 27 bp, Artificial Sequence
  Description of Artificial Sequence: Synthetic oligonucleotide
gtgccacctgatcaagtacctcctgcg

SEQ ID NO: 308768 - DNA, 27 bp, Artificial Sequence
  Description of Artificial Sequence: Synthetic oligonucleotide
tgccacctgatcaagtacctcctgcgc

SEQ ID NO: 308769 - DNA, 26 bp, Artificial Sequence
  Description of Artificial Sequence: Synthetic oligonucleotide
gccacctgatcaagtacctcctgcgc

SEQ ID NO: 308770 - DNA, 27 bp, Artificial Sequence
  Description of Artificial Sequence: Synthetic oligonucleotide
ccacctgatcaagtacctcctgcgcca

SEQ ID NO: 308771 - DNA, 27 bp, Artificial Sequence
  Description of Artificial Sequence: Synthetic oligonucleotide
cacctgatcaagtacctcctgcgccac

SEQ ID NO: 308772 - DNA, 30 bp, Artificial Sequence
  Description of Artificial Sequence: Synthetic oligonucleotide
acctgatcaagtacctcctgcgccactaac

SEQ ID NO: 308773 - DNA, 29 bp, Artificial Sequence
  Description of Artificial Sequence: Synthetic oligonucleotide
cctgatcaagtacctcctgcgccactaac

SEQ ID NO: 308774 - DNA, 29 bp, Artificial Sequence
  Description of Artificial Sequence: Synthetic oligonucleotide
ctgatcaagtacctcctgcgccactaacc

SEQ ID NO: 308775 - DNA, 29 bp, Artificial Sequence
  Description of Artificial Sequence: Synthetic oligonucleotide
tgatcaagtacctcctgcgccactaaccc

SEQ ID NO: 308776 - DNA, 28 bp, Artificial Sequence
  Description of Artificial Sequence: Synthetic oligonucleotide
gatcaagtacctcctgcgccactaaccc

SEQ ID NO: 308777 - DNA, 29 bp, Artificial Sequence
  Description of Artificial Sequence: Synthetic oligonucleotide
atcaagtacctcctgcgccactaacccac

SEQ ID NO: 308778 - DNA, 28 bp, Artificial Sequence
  Description of Artificial Sequence: Synthetic oligonucleotide
tcaagtacctcctgcgccactaacccac

SEQ ID NO: 308779 - DNA, 27 bp, Artificial Sequence
  Description of Artificial Sequence: Synthetic oligonucleotide
caagtacctcctgcgccactaacccac

SEQ ID NO: 308780 - DNA, 27 bp, Artificial Sequence
  Description of Artificial Sequence: Synthetic oligonucleotide
aagtacctcctgcgccactaacccacc

SEQ ID NO: 308781 - DNA, 27 bp, Artificial Sequence
  Description of Artificial Sequence: Synthetic oligonucleotide
agtacctcctgcgccactaacccacca

SEQ ID NO: 308782 - DNA, 27 bp, Artificial Sequence
  Description of Artificial Sequence: Synthetic oligonucleotide
gtacctcctgcgccactaacccaccat

SEQ ID NO: 308783 - DNA, 27 bp, Artificial Sequence
  Description of Artificial Sequence: Synthetic oligonucleotide
tacctcctgcgccactaacccaccatg

SEQ ID NO: 308784 - DNA, 26 bp, Artificial Sequence
  Description of Artificial Sequence: Synthetic oligonucleotide
acctcctgcgccactaacccaccatg

SEQ ID NO: 308785 - DNA, 25 bp, Artificial Sequence
  Description of Artificial Sequence: Synthetic oligonucleotide
cctcctgcgccactaacccaccatg

SEQ ID NO: 308786 - DNA, 26 bp, Artificial Sequence
  Description of Artificial Sequence: Synthetic oligonucleotide
ctcctgcgccactaacccaccatggt

SEQ ID NO: 308787 - DNA, 26 bp, Artificial Sequence
  Description of Artificial Sequence: Synthetic oligonucleotide
tcctgcgccactaacccaccatggtg

SEQ ID NO: 308788 - DNA, 25 bp, Artificial Sequence
  Description of Artificial Sequence: Synthetic oligonucleotide
cctgcgccactaacccaccatggtg

SEQ ID NO: 308789 - DNA, 26 bp, Artificial Sequence
  Description of Artificial Sequence: Synthetic oligonucleotide
ctgcgccactaacccaccatggtgct

SEQ ID NO: 308790 - DNA, 27 bp, Artificial Sequence
  Description of Artificial Sequence: Synthetic oligonucleotide
tgcgccactaacccaccatggtgctct

SEQ ID NO: 308791 - DNA, 26 bp, Artificial Sequence
  Description of Artificial Sequence: Synthetic oligonucleotide
gcgccactaacccaccatggtgctct

SEQ ID NO: 308792 - DNA, 26 bp, Artificial Sequence
  Description of Artificial Sequence: Synthetic oligonucleotide
cgccactaacccaccatggtgctctc

SEQ ID NO: 308793 - DNA, 26 bp, Artificial Sequence
  Description of Artificial Sequence: Synthetic oligonucleotide
gccactaacccaccatggtgctctcg

SEQ ID NO: 308794 - DNA, 26 bp, Artificial Sequence
  Description of Artificial Sequence: Synthetic oligonucleotide
ccactaacccaccatggtgctctcgc

SEQ ID NO: 308795 - DNA, 26 bp, Artificial Sequence
  Description of Artificial Sequence: Synthetic oligonucleotide
cactaacccaccatggtgctctcgcc

SEQ ID NO: 308796 - DNA, 26 bp, Artificial Sequence
  Description of Artificial Sequence: Synthetic oligonucleotide
actaacccaccatggtgctctcgccc

SEQ ID NO: 308797 - DNA, 25 bp, Artificial Sequence
  Description of Artificial Sequence: Synthetic oligonucleotide
ctaacccaccatggtgctctcgccc

SEQ ID NO: 308798 - DNA, 26 bp, Artificial Sequence
  Description of Artificial Sequence: Synthetic oligonucleotide
taacccaccatggtgctctcgcccga

SEQ ID NO: 308799 - DNA, 25 bp, Artificial Sequence
  Description of Artificial Sequence: Synthetic oligonucleotide
aacccaccatggtgctctcgcccga

SEQ ID NO: 308800 - DNA, 24 bp, Artificial Sequence
  Description of Artificial Sequence: Synthetic oligonucleotide
acccaccatggtgctctcgcccga

SEQ ID NO: 308801 - DNA, 23 bp, Artificial Sequence
  Description of Artificial Sequence: Synthetic oligonucleotide
cccaccatggtgctctcgcccga

SEQ ID NO: 308802 - DNA, 25 bp, Artificial Sequence
  Description of Artificial Sequence: Synthetic oligonucleotide
ccaccatggtgctctcgcccgagta

SEQ ID NO: 308803 - DNA, 27 bp, Artificial Sequence
  Description of Artificial Sequence: Synthetic oligonucleotide
caccatggtgctctcgcccgagtacat

SEQ ID NO: 308804 - DNA, 27 bp, Artificial Sequence
  Description of Artificial Sequence: Synthetic oligonucleotide
accatggtgctctcgcccgagtacatg

SEQ ID NO: 308805 - DNA, 27 bp, Artificial Sequence
  Description of Artificial Sequence: Synthetic oligonucleotide
ccatggtgctctcgcccgagtacatgt

SEQ ID NO: 308806 - DNA, 27 bp, Artificial Sequence
  Description of Artificial Sequence: Synthetic oligonucleotide
catggtgctctcgcccgagtacatgtg

SEQ ID NO: 308807 - DNA, 27 bp, Artificial Sequence
  Description of Artificial Sequence: Synthetic oligonucleotide
atggtgctctcgcccgagtacatgtgg

SEQ ID NO: 308808 - DNA, 26 bp, Artificial Sequence
  Description of Artificial Sequence: Synthetic oligonucleotide
tggtgctctcgcccgagtacatgtgg

SEQ ID NO: 308809 - DNA, 25 bp, Artificial Sequence
  Description of Artificial Sequence: Synthetic oligonucleotide
ggtgctctcgcccgagtacatgtgg

SEQ ID NO: 308810 - DNA, 26 bp, Artificial Sequence
  Description of Artificial Sequence: Synthetic oligonucleotide
gtgctctcgcccgagtacatgtggga

SEQ ID NO: 308811 - DNA, 26 bp, Artificial Sequence
  Description of Artificial Sequence: Synthetic oligonucleotide
tgctctcgcccgagtacatgtgggac

SEQ ID NO: 308812 - DNA, 25 bp, Artificial Sequence
  Description of Artificial Sequence: Synthetic oligonucleotide
gctctcgcccgagtacatgtgggac

SEQ ID NO: 308813 - DNA, 26 bp, Artificial Sequence
  Description of Artificial Sequence: Synthetic oligonucleotide
ctctcgcccgagtacatgtgggacct

SEQ ID NO: 308814 - DNA, 26 bp, Artificial Sequence
  Description of Artificial Sequence: Synthetic oligonucleotide
tctcgcccgagtacatgtgggacctg

SEQ ID NO: 308815 - DNA, 25 bp, Artificial Sequence
  Description of Artificial Sequence: Synthetic oligonucleotide
ctcgcccgagtacatgtgggacctg

SEQ ID NO: 308816 - DNA, 26 bp, Artificial Sequence
  Description of Artificial Sequence: Synthetic oligonucleotide
tcgcccgagtacatgtgggacctgca

SEQ ID NO: 308817 - DNA, 25 bp, Artificial Sequence
  Description of Artificial Sequence: Synthetic oligonucleotide
cgcccgagtacatgtgggacctgca

SEQ ID NO: 308818 - DNA, 25 bp, Artificial Sequence
  Description of Artificial Sequence: Synthetic oligonucleotide
gcccgagtacatgtgggacctgcag

SEQ ID NO: 308819 - DNA, 26 bp, Artificial Sequence
  Description of Artificial Sequence: Synthetic oligonucleotide
cccgagtacatgtgggacctgcagct

SEQ ID NO: 308820 - DNA, 26 bp, Artificial Sequence
  Description of Artificial Sequence: Synthetic oligonucleotide
ccgagtacatgtgggacctgcagctg

SEQ ID NO: 308821 - DNA, 27 bp, Artificial Sequence
  Description of Artificial Sequence: Synthetic oligonucleotide
cgagtacatgtgggacctgcagctgct

SEQ ID NO: 308822 - DNA, 27 bp, Artificial Sequence
  Description of Artificial Sequence: Synthetic oligonucleotide
gagtacatgtgggacctgcagctgctc

SEQ ID NO: 308823 - DNA, 27 bp, Artificial Sequence
  Description of Artificial Sequence: Synthetic oligonucleotide
agtacatgtgggacctgcagctgctcg

SEQ ID NO: 308824 - DNA, 26 bp, Artificial Sequence
  Description of Artificial Sequence: Synthetic oligonucleotide
gtacatgtgggacctgcagctgctcg

SEQ ID NO: 308825 - DNA, 26 bp, Artificial Sequence
  Description of Artificial Sequence: Synthetic oligonucleotide
tacatgtgggacctgcagctgctcgg

SEQ ID NO: 308826 - DNA, 25 bp, Artificial Sequence
  Description of Artificial Sequence: Synthetic oligonucleotide
acatgtgggacctgcagctgctcgg

SEQ ID NO: 308827 - DNA, 24 bp, Artificial Sequence
  Description of Artificial Sequence: Synthetic oligonucleotide
catgtgggacctgcagctgctcgg

SEQ ID NO: 308828 - DNA, 25 bp, Artificial Sequence
  Description of Artificial Sequence: Synthetic oligonucleotide
atgtgggacctgcagctgctcggct

SEQ ID NO: 308829 - DNA, 24 bp, Artificial Sequence
  Description of Artificial Sequence: Synthetic oligonucleotide
tgtgggacctgcagctgctcggct

SEQ ID NO: 308830 - DNA, 23 bp, Artificial Sequence
  Description of Artificial Sequence: Synthetic oligonucleotide
gtgggacctgcagctgctcggct

SEQ ID NO: 308831 - DNA, 23 bp, Artificial Sequence
  Description of Artificial Sequence: Synthetic oligonucleotide
tgggacctgcagctgctcggctg

SEQ ID NO: 308832 - DNA, 22 bp, Artificial Sequence
  Description of Artificial Sequence: Synthetic oligonucleotide
gggacctgcagctgctcggctg

SEQ ID NO: 308833 - DNA, 22 bp, Artificial Sequence
  Description of Artificial Sequence: Synthetic oligonucleotide
ggacctgcagctgctcggctgg

SEQ ID NO: 308834 - DNA, 22 bp, Artificial Sequence
  Description of Artificial Sequence: Synthetic oligonucleotide
gacctgcagctgctcggctggc

SEQ ID NO: 308835 - DNA, 22 bp, Artificial Sequence
  Description of Artificial Sequence: Synthetic oligonucleotide
acctgcagctgctcggctggcc

SEQ ID NO: 308836 - DNA, 21 bp, Artificial Sequence
  Description of Artificial Sequence: Synthetic oligonucleotide
cctgcagctgctcggctggcc

SEQ ID NO: 308837 - DNA, 21 bp, Artificial Sequence
  Description of Artificial Sequence: Synthetic oligonucleotide
ctgcagctgctcggctggccc

SEQ ID NO: 308838 - DNA, 21 bp, Artificial Sequence
  Description of Artificial Sequence: Synthetic oligonucleotide
tgcagctgctcggctggcccc

SEQ ID NO: 308839 - DNA, 20 bp, Artificial Sequence
  Description of Artificial Sequence: Synthetic oligonucleotide
gcagctgctcggctggcccc

SEQ ID NO: 308840 - DNA, 20 bp, Artificial Sequence
  Description of Artificial Sequence: Synthetic oligonucleotide
cagctgctcggctggccccc

SEQ ID NO: 308841 - DNA, 20 bp, Artificial Sequence
  Description of Artificial Sequence: Synthetic oligonucleotide
agctgctcggctggcccccc

SEQ ID NO: 308842 - DNA, 20 bp, Artificial Sequence
  Description of Artificial Sequence: Synthetic oligonucleotide
gctgctcggctggcccccct

SEQ ID NO: 308843 - DNA, 20 bp, Artificial Sequence
  Description of Artificial Sequence: Synthetic oligonucleotide
ctgctcggctggccccccgt

SEQ ID NO: 308844 - DNA, 20 bp, Artificial Sequence
  Description of Artificial Sequence: Synthetic oligonucleotide
tgctcggctggccccccgtc

SEQ ID NO: 308845 - DNA, 20 bp, Artificial Sequence
  Description of Artificial Sequence: Synthetic oligonucleotide
gctcggctggccccccgtct

SEQ ID NO: 308846 - DNA, 20 bp, Artificial Sequence
  Description of Artificial Sequence: Synthetic oligonucleotide
ctcggctggccccccgtcct

SEQ ID NO: 308847 - DNA, 21 bp, Artificial Sequence
  Description of Artificial Sequence: Synthetic oligonucleotide
tcggctggccccccgtcctga

SEQ ID NO: 308848 - DNA, 20 bp, Artificial Sequence
  Description of Artificial Sequence: Synthetic oligonucleotide
cggctggccccccgtcctga

SEQ ID NO: 308849 - DNA, 20 bp, Artificial Sequence
  Description of Artificial Sequence: Synthetic oligonucleotide
ggctggccccccgtcctgac

SEQ ID NO: 308850 - DNA, 22 bp, Artificial Sequence
  Description of Artificial Sequence: Synthetic oligonucleotide
gctggccccccgtcctgacgaa

SEQ ID NO: 308851 - DNA, 22 bp, Artificial Sequence
  Description of Artificial Sequence: Synthetic oligonucleotide
ctggccccccgtcctgacgaag

SEQ ID NO: 308852 - DNA, 23 bp, Artificial Sequence
  Description of Artificial Sequence: Synthetic oligonucleotide
tggccccccgtcctgacgaagct

SEQ ID NO: 308853 - DNA, 22 bp, Artificial Sequence
  Description of Artificial Sequence: Synthetic oligonucleotide
ggccccccgtcctgacgaagct

SEQ ID NO: 308854 - DNA, 23 bp, Artificial Sequence
  Description of Artificial Sequence: Synthetic oligonucleotide
gccccccgtcctgacgaagctga

SEQ ID NO: 308855 - DNA, 23 bp, Artificial Sequence
  Description of Artificial Sequence: Synthetic oligonucleotide
ccccccgtcctgacgaagctgag

SEQ ID NO: 308856 - DNA, 25 bp, Artificial Sequence
  Description of Artificial Sequence: Synthetic oligonucleotide
cccccgtcctgacgaagctgagctt

SEQ ID NO: 308857 - DNA, 26 bp, Artificial Sequence
  Description of Artificial Sequence: Synthetic oligonucleotide
ccccgtcctgacgaagctgagcttca

SEQ ID NO: 308858 - DNA, 27 bp, Artificial Sequence
  Description of Artificial Sequence: Synthetic oligonucleotide
cccgtcctgacgaagctgagcttcact

SEQ ID NO: 308859 - DNA, 27 bp, Artificial Sequence
  Description of Artificial Sequence: Synthetic oligonucleotide
ccgtcctgacgaagctgagcttcactg

SEQ ID NO: 308860 - DNA, 27 bp, Artificial Sequence
  Description of Artificial Sequence: Synthetic oligonucleotide
cgtcctgacgaagctgagcttcactgc

SEQ ID NO: 308861 - DNA, 27 bp, Artificial Sequence
  Description of Artificial Sequence: Synthetic oligonucleotide
gtcctgacgaagctgagcttcactgcg

SEQ ID NO: 308862 - DNA, 27 bp, Artificial Sequence
  Description of Artificial Sequence: Synthetic oligonucleotide
tcctgacgaagctgagcttcactgcgc

SEQ ID NO: 308863 - DNA, 27 bp, Artificial Sequence
  Description of Artificial Sequence: Synthetic oligonucleotide
cctgacgaagctgagcttcactgcgct

SEQ ID NO: 308864 - DNA, 27 bp, Artificial Sequence
  Description of Artificial Sequence: Synthetic oligonucleotide
ctgacgaagctgagcttcactgcgctg

SEQ ID NO: 308865 - DNA, 27 bp, Artificial Sequence
  Description of Artificial Sequence: Synthetic oligonucleotide
tgacgaagctgagcttcactgcgctgc

SEQ ID NO: 308866 - DNA, 26 bp, Artificial Sequence
  Description of Artificial Sequence: Synthetic oligonucleotide
gacgaagctgagcttcactgcgctgc

SEQ ID NO: 308867 - DNA, 26 bp, Artificial Sequence
  Description of Artificial Sequence: Synthetic oligonucleotide
acgaagctgagcttcactgcgctgcc

SEQ ID NO: 308868 - DNA, 25 bp, Artificial Sequence
  Description of Artificial Sequence: Synthetic oligonucleotide
cgaagctgagcttcactgcgctgcc

SEQ ID NO: 308869 - DNA, 27 bp, Artificial Sequence
  Description of Artificial Sequence: Synthetic oligonucleotide
gaagctgagcttcactgcgctgcccaa

SEQ ID NO: 308870 - DNA, 27 bp, Artificial Sequence
  Description of Artificial Sequence: Synthetic oligonucleotide
aagctgagcttcactgcgctgcccaag

SEQ ID NO: 308871 - DNA, 27 bp, Artificial Sequence
  Description of Artificial Sequence: Synthetic oligonucleotide
agctgagcttcactgcgctgcccaaga

SEQ ID NO: 308872 - DNA, 27 bp, Artificial Sequence
  Description of Artificial Sequence: Synthetic oligonucleotide
gctgagcttcactgcgctgcccaagat

SEQ ID NO: 308873 - DNA, 27 bp, Artificial Sequence
  Description of Artificial Sequence: Synthetic oligonucleotide
ctgagcttcactgcgctgcccaagatc

SEQ ID NO: 308874 - DNA, 27 bp, Artificial Sequence
  Description of Artificial Sequence: Synthetic oligonucleotide
tgagcttcactgcgctgcccaagatcc

SEQ ID NO: 308875 - DNA, 27 bp, Artificial Sequence
  Description of Artificial Sequence: Synthetic oligonucleotide
gagcttcactgcgctgcccaagatcca

SEQ ID NO: 308876 - DNA, 27 bp, Artificial Sequence
  Description of Artificial Sequence: Synthetic oligonucleotide
agcttcactgcgctgcccaagatccac

SEQ ID NO: 308877 - DNA, 26 bp, Artificial Sequence
  Description of Artificial Sequence: Synthetic oligonucleotide
gcttcactgcgctgcccaagatccac

SEQ ID NO: 308878 - DNA, 27 bp, Artificial Sequence
  Description of Artificial Sequence: Synthetic oligonucleotide
cttcactgcgctgcccaagatccacca

SEQ ID NO: 308879 - DNA, 27 bp, Artificial Sequence
  Description of Artificial Sequence: Synthetic oligonucleotide
ttcactgcgctgcccaagatccaccag

SEQ ID NO: 308880 - DNA, 26 bp, Artificial Sequence
  Description of Artificial Sequence: Synthetic oligonucleotide
tcactgcgctgcccaagatccaccag

SEQ ID NO: 308881 - DNA, 25 bp, Artificial Sequence
  Description of Artificial Sequence: Synthetic oligonucleotide
cactgcgctgcccaagatccaccag

SEQ ID NO: 308882 - DNA, 25 bp, Artificial Sequence
  Description of Artificial Sequence: Synthetic oligonucleotide
actgcgctgcccaagatccaccagg

SEQ ID NO: 308883 - DNA, 24 bp, Artificial Sequence
  Description of Artificial Sequence: Synthetic oligonucleotide
ctgcgctgcccaagatccaccagg

SEQ ID NO: 308884 - DNA, 24 bp, Artificial Sequence
  Description of Artificial Sequence: Synthetic oligonucleotide
tgcgctgcccaagatccaccaggc

SEQ ID NO: 308885 - DNA, 23 bp, Artificial Sequence
  Description of Artificial Sequence: Synthetic oligonucleotide
gcgctgcccaagatccaccaggc

SEQ ID NO: 308886 - DNA, 23 bp, Artificial Sequence
  Description of Artificial Sequence: Synthetic oligonucleotide
cgctgcccaagatccaccaggcc

SEQ ID NO: 308887 - DNA, 24 bp, Artificial Sequence
  Description of Artificial Sequence: Synthetic oligonucleotide
gctgcccaagatccaccaggccgt

SEQ ID NO: 308888 - DNA, 24 bp, Artificial Sequence
  Description of Artificial Sequence: Synthetic oligonucleotide
ctgcccaagatccaccaggccgtc

SEQ ID NO: 308889 - DNA, 24 bp, Artificial Sequence
  Description of Artificial Sequence: Synthetic oligonucleotide
tgcccaagatccaccaggccgtcc

SEQ ID NO: 308890 - DNA, 23 bp, Artificial Sequence
  Description of Artificial Sequence: Synthetic oligonucleotide
gcccaagatccaccaggccgtcc

SEQ ID NO: 308891 - DNA, 23 bp, Artificial Sequence
  Description of Artificial Sequence: Synthetic oligonucleotide
cccaagatccaccaggccgtccg

SEQ ID NO: 308892 - DNA, 25 bp, Artificial Sequence
  Description of Artificial Sequence: Synthetic oligonucleotide
ccaagatccaccaggccgtccggaa

SEQ ID NO: 308893 - DNA, 25 bp, Artificial Sequence
  Description of Artificial Sequence: Synthetic oligonucleotide
caagatccaccaggccgtccggaac

SEQ ID NO: 308894 - DNA, 25 bp, Artificial Sequence
  Description of Artificial Sequence: Synthetic oligonucleotide
aagatccaccaggccgtccggaacg

SEQ ID NO: 308895 - DNA, 24 bp, Artificial Sequence
  Description of Artificial Sequence: Synthetic oligonucleotide
agatccaccaggccgtccggaacg

SEQ ID NO: 308896 - DNA, 23 bp, Artificial Sequence
  Description of Artificial Sequence: Synthetic oligonucleotide
gatccaccaggccgtccggaacg

SEQ ID NO: 308897 - DNA, 23 bp, Artificial Sequence
  Description of Artificial Sequence: Synthetic oligonucleotide
atccaccaggccgtccggaacgc

SEQ ID NO: 308898 - DNA, 22 bp, Artificial Sequence
  Description of Artificial Sequence: Synthetic oligonucleotide
tccaccaggccgtccggaacgc

SEQ ID NO: 308899 - DNA, 21 bp, Artificial Sequence
  Description of Artificial Sequence: Synthetic oligonucleotide
ccaccaggccgtccggaacgc

SEQ ID NO: 308900 - DNA, 22 bp, Artificial Sequence
  Description of Artificial Sequence: Synthetic oligonucleotide
caccaggccgtccggaacgcgt

SEQ ID NO: 308901 - DNA, 23 bp, Artificial Sequence
  Description of Artificial Sequence: Synthetic oligonucleotide
accaggccgtccggaacgcgtga

SEQ ID NO: 308902 - DNA, 27 bp, Artificial Sequence
  Description of Artificial Sequence: Synthetic oligonucleotide
tgggtcagtttgcttcccccacagcca

SEQ ID NO: 308903 - DNA, 27 bp, Artificial Sequence
  Description of Artificial Sequence: Synthetic oligonucleotide
gggtcagtttgcttcccccacagccaa

SEQ ID NO: 308904 - DNA, 27 bp, Artificial Sequence
  Description of Artificial Sequence: Synthetic oligonucleotide
ggtcagtttgcttcccccacagccaag

SEQ ID NO: 308905 - DNA, 27 bp, Artificial Sequence
  Description of Artificial Sequence: Synthetic oligonucleotide
gtcagtttgcttcccccacagccaagg

SEQ ID NO: 308906 - DNA, 27 bp, Artificial Sequence
  Description of Artificial Sequence: Synthetic oligonucleotide
tcagtttgcttcccccacagccaaggg

SEQ ID NO: 308907 - DNA, 26 bp, Artificial Sequence
  Description of Artificial Sequence: Synthetic oligonucleotide
cagtttgcttcccccacagccaaggg

SEQ ID NO: 308908 - DNA, 27 bp, Artificial Sequence
  Description of Artificial Sequence: Synthetic oligonucleotide
agtttgcttcccccacagccaagggct

SEQ ID NO: 308909 - DNA, 26 bp, Artificial Sequence
  Description of Artificial Sequence: Synthetic oligonucleotide
gtttgcttcccccacagccaagggct

SEQ ID NO: 308910 - DNA, 26 bp, Artificial Sequence
  Description of Artificial Sequence: Synthetic oligonucleotide
tttgcttcccccacagccaagggctg

SEQ ID NO: 308911 - DNA, 25 bp, Artificial Sequence
  Description of Artificial Sequence: Synthetic oligonucleotide
ttgcttcccccacagccaagggctg

SEQ ID NO: 308912 - DNA, 24 bp, Artificial Sequence
  Description of Artificial Sequence: Synthetic oligonucleotide
tgcttcccccacagccaagggctg

SEQ ID NO: 308913 - DNA, 23 bp, Artificial Sequence
  Description of Artificial Sequence: Synthetic oligonucleotide
gcttcccccacagccaagggctg

SEQ ID NO: 308914 - DNA, 24 bp, Artificial Sequence
  Description of Artificial Sequence: Synthetic oligonucleotide
cttcccccacagccaagggctgct

SEQ ID NO: 308915 - DNA, 24 bp, Artificial Sequence
  Description of Artificial Sequence: Synthetic oligonucleotide
ttcccccacagccaagggctgctg

SEQ ID NO: 308916 - DNA, 23 bp, Artificial Sequence
  Description of Artificial Sequence: Synthetic oligonucleotide
tcccccacagccaagggctgctg

SEQ ID NO: 308917 - DNA, 22 bp, Artificial Sequence
  Description of Artificial Sequence: Synthetic oligonucleotide
cccccacagccaagggctgctg

SEQ ID NO: 308918 - DNA, 22 bp, Artificial Sequence
  Description of Artificial Sequence: Synthetic oligonucleotide
ccccacagccaagggctgctgc

SEQ ID NO: 308919 - DNA, 23 bp, Artificial Sequence
  Description of Artificial Sequence: Synthetic oligonucleotide
cccacagccaagggctgctgcct

SEQ ID NO: 308920 - DNA, 23 bp, Artificial Sequence
  Description of Artificial Sequence: Synthetic oligonucleotide
ccacagccaagggctgctgcctg

SEQ ID NO: 308921 - DNA, 25 bp, Artificial Sequence
  Description of Artificial Sequence: Synthetic oligonucleotide
cacagccaagggctgctgcctggat

SEQ ID NO: 308922 - DNA, 25 bp, Artificial Sequence
  Description of Artificial Sequence: Synthetic oligonucleotide
acagccaagggctgctgcctggatg

SEQ ID NO: 308923 - DNA, 24 bp, Artificial Sequence
  Description of Artificial Sequence: Synthetic oligonucleotide
cagccaagggctgctgcctggatg

SEQ ID NO: 308924 - DNA, 24 bp, Artificial Sequence
  Description of Artificial Sequence: Synthetic oligonucleotide
agccaagggctgctgcctggatgg

SEQ ID NO: 308925 - DNA, 23 bp, Artificial Sequence
  Description of Artificial Sequence: Synthetic oligonucleotide
gccaagggctgctgcctggatgg

SEQ ID NO: 308926 - DNA, 23 bp, Artificial Sequence
  Description of Artificial Sequence: Synthetic oligonucleotide
ccaagggctgctgcctggatggg

SEQ ID NO: 308927 - DNA, 24 bp, Artificial Sequence
  Description of Artificial Sequence: Synthetic oligonucleotide
caagggctgctgcctggatggggt

SEQ ID NO: 308928 - DNA, 25 bp, Artificial Sequence
  Description of Artificial Sequence: Synthetic oligonucleotide
aagggctgctgcctggatggggtca

SEQ ID NO: 308929 - DNA, 24 bp, Artificial Sequence
  Description of Artificial Sequence: Synthetic oligonucleotide
agggctgctgcctggatggggtca

SEQ ID NO: 308930 - DNA, 23 bp, Artificial Sequence
  Description of Artificial Sequence: Synthetic oligonucleotide
gggctgctgcctggatggggtca

SEQ ID NO: 308931 - DNA, 24 bp, Artificial Sequence
  Description of Artificial Sequence: Synthetic oligonucleotide
ggctgctgcctggatggggtcaca

SEQ ID NO: 308932 - DNA, 24 bp, Artificial Sequence
  Description of Artificial Sequence: Synthetic oligonucleotide
gctgctgcctggatggggtcacac

SEQ ID NO: 308933 - DNA, 25 bp, Artificial Sequence
  Description of Artificial Sequence: Synthetic oligonucleotide
ctgctgcctggatggggtcacacgt

SEQ ID NO: 308934 - DNA, 26 bp, Artificial Sequence
  Description of Artificial Sequence: Synthetic oligonucleotide
tgctgcctggatggggtcacacgtct

SEQ ID NO: 308935 - DNA, 25 bp, Artificial Sequence
  Description of Artificial Sequence: Synthetic oligonucleotide
gctgcctggatggggtcacacgtct

SEQ ID NO: 308936 - DNA, 25 bp, Artificial Sequence
  Description of Artificial Sequence: Synthetic oligonucleotide
ctgcctggatggggtcacacgtctg

SEQ ID NO: 308937 - DNA, 25 bp, Artificial Sequence
  Description of Artificial Sequence: Synthetic oligonucleotide
tgcctggatggggtcacacgtctgg

SEQ ID NO: 308938 - DNA, 24 bp, Artificial Sequence
  Description of Artificial Sequence: Synthetic oligonucleotide
gcctggatggggtcacacgtctgg

SEQ ID NO: 308939 - DNA, 24 bp, Artificial Sequence
  Description of Artificial Sequence: Synthetic oligonucleotide
cctggatggggtcacacgtctggc

SEQ ID NO: 308940 - DNA, 26 bp, Artificial Sequence
  Description of Artificial Sequence: Synthetic oligonucleotide
ctggatggggtcacacgtctggccat

SEQ ID NO: 308941 - DNA, 27 bp, Artificial Sequence
  Description of Artificial Sequence: Synthetic oligonucleotide
tggatggggtcacacgtctggccatga

SEQ ID NO: 308942 - DNA, 27 bp, Artificial Sequence
  Description of Artificial Sequence: Synthetic oligonucleotide
ggatggggtcacacgtctggccatgat

SEQ ID NO: 308943 - DNA, 27 bp, Artificial Sequence
  Description of Artificial Sequence: Synthetic oligonucleotide
gatggggtcacacgtctggccatgatg

SEQ ID NO: 308944 - DNA, 27 bp, Artificial Sequence
  Description of Artificial Sequence: Synthetic oligonucleotide
atggggtcacacgtctggccatgatgc

SEQ ID NO: 308945 - DNA, 26 bp, Artificial Sequence
  Description of Artificial Sequence: Synthetic oligonucleotide
tggggtcacacgtctggccatgatgc

SEQ ID NO: 308946 - DNA, 25 bp, Artificial Sequence
  Description of Artificial Sequence: Synthetic oligonucleotide
ggggtcacacgtctggccatgatgc

SEQ ID NO: 308947 - DNA, 27 bp, Artificial Sequence
  Description of Artificial Sequence: Synthetic oligonucleotide
gggtcacacgtctggccatgatgcctt

SEQ ID NO: 308948 - DNA, 27 bp, Artificial Sequence
  Description of Artificial Sequence: Synthetic oligonucleotide
ggtcacacgtctggccatgatgccttc

SEQ ID NO: 308949 - DNA, 27 bp, Artificial Sequence
  Description of Artificial Sequence: Synthetic oligonucleotide
gtcacacgtctggccatgatgccttcc

SEQ ID NO: 308950 - DNA, 28 bp, Artificial Sequence
  Description of Artificial Sequence: Synthetic oligonucleotide
tcacacgtctggccatgatgccttcctg

SEQ ID NO: 308951 - DNA, 27 bp, Artificial Sequence
  Description of Artificial Sequence: Synthetic oligonucleotide
cacacgtctggccatgatgccttcctg

SEQ ID NO: 308952 - DNA, 27 bp, Artificial Sequence
  Description of Artificial Sequence: Synthetic oligonucleotide
acacgtctggccatgatgccttcctgc

SEQ ID NO: 308953 - DNA, 26 bp, Artificial Sequence
  Description of Artificial Sequence: Synthetic oligonucleotide
cacgtctggccatgatgccttcctgc

SEQ ID NO: 308954 - DNA, 27 bp, Artificial Sequence
  Description of Artificial Sequence: Synthetic oligonucleotide
acgtctggccatgatgccttcctgcga

SEQ ID NO: 308955 - DNA, 26 bp, Artificial Sequence
  Description of Artificial Sequence: Synthetic oligonucleotide
cgtctggccatgatgccttcctgcga

SEQ ID NO: 308956 - DNA, 26 bp, Artificial Sequence
  Description of Artificial Sequence: Synthetic oligonucleotide
gtctggccatgatgccttcctgcgac

SEQ ID NO: 308957 - DNA, 27 bp, Artificial Sequence
  Description of Artificial Sequence: Synthetic oligonucleotide
tctggccatgatgccttcctgcgacca

SEQ ID NO: 308958 - DNA, 26 bp, Artificial Sequence
  Description of Artificial Sequence: Synthetic oligonucleotide
ctggccatgatgccttcctgcgacca

SEQ ID NO: 308959 - DNA, 26 bp, Artificial Sequence
  Description of Artificial Sequence: Synthetic oligonucleotide
tggccatgatgccttcctgcgaccag

SEQ ID NO: 308960 - DNA, 25 bp, Artificial Sequence
  Description of Artificial Sequence: Synthetic oligonucleotide
ggccatgatgccttcctgcgaccag

SEQ ID NO: 308961 - DNA, 25 bp, Artificial Sequence
  Description of Artificial Sequence: Synthetic oligonucleotide
gccatgatgccttcctgcgaccagc

SEQ ID NO: 308962 - DNA, 25 bp, Artificial Sequence
  Description of Artificial Sequence: Synthetic oligonucleotide
ccatgatgccttcctgcgaccagcg

SEQ ID NO: 308963 - DNA, 25 bp, Artificial Sequence
  Description of Artificial Sequence: Synthetic oligonucleotide
catgatgccttcctgcgaccagcgg

SEQ ID NO: 308964 - DNA, 25 bp, Artificial Sequence
  Description of Artificial Sequence: Synthetic oligonucleotide
atgatgccttcctgcgaccagcggg

SEQ ID NO: 308965 - DNA, 24 bp, Artificial Sequence
  Description of Artificial Sequence: Synthetic oligonucleotide
tgatgccttcctgcgaccagcggg

SEQ ID NO: 308966 - DNA, 23 bp, Artificial Sequence
  Description of Artificial Sequence: Synthetic oligonucleotide
gatgccttcctgcgaccagcggg

SEQ ID NO: 308967 - DNA, 24 bp, Artificial Sequence
  Description of Artificial Sequence: Synthetic oligonucleotide
atgccttcctgcgaccagcgggca

SEQ ID NO: 308968 - DNA, 23 bp, Artificial Sequence
  Description of Artificial Sequence: Synthetic oligonucleotide
tgccttcctgcgaccagcgggca

SEQ ID NO: 308969 - DNA, 22 bp, Artificial Sequence
  Description of Artificial Sequence: Synthetic oligonucleotide
gccttcctgcgaccagcgggca

SEQ ID NO: 308970 - DNA, 22 bp, Artificial Sequence
  Description of Artificial Sequence: Synthetic oligonucleotide
ccttcctgcgaccagcgggcac

SEQ ID NO: 308971 - DNA, 22 bp, Artificial Sequence
  Description of Artificial Sequence: Synthetic oligonucleotide
cttcctgcgaccagcgggcacc

SEQ ID NO: 308972 - DNA, 22 bp, Artificial Sequence
  Description of Artificial Sequence: Synthetic oligonucleotide
ttcctgcgaccagcgggcaccc

SEQ ID NO: 308973 - DNA, 21 bp, Artificial Sequence
  Description of Artificial Sequence: Synthetic oligonucleotide
tcctgcgaccagcgggcaccc

SEQ ID NO: 308974 - DNA, 20 bp, Artificial Sequence
  Description of Artificial Sequence: Synthetic oligonucleotide
cctgcgaccagcgggcaccc

SEQ ID NO: 308975 - DNA, 20 bp, Artificial Sequence
  Description of Artificial Sequence: Synthetic oligonucleotide
ctgcgaccagcgggcacccc

SEQ ID NO: 308976 - DNA, 20 bp, Artificial Sequence
  Description of Artificial Sequence: Synthetic oligonucleotide
tgcgaccagcgggcaccccg

SEQ ID NO: 308977 - DNA, 20 bp, Artificial Sequence
  Description of Artificial Sequence: Synthetic oligonucleotide
gcgaccagcgggcaccccgt

SEQ ID NO: 308978 - DNA, 20 bp, Artificial Sequence
  Description of Artificial Sequence: Synthetic oligonucleotide
cgaccagcgggcaccccgct

SEQ ID NO: 308979 - DNA, 20 bp, Artificial Sequence
  Description of Artificial Sequence: Synthetic oligonucleotide
gaccagcgggcaccccgcgt

SEQ ID NO: 308980 - DNA, 20 bp, Artificial Sequence
  Description of Artificial Sequence: Synthetic oligonucleotide
accagcgggcaccccgcgtg

SEQ ID NO: 308981 - DNA, 20 bp, Artificial Sequence
  Description of Artificial Sequence: Synthetic oligonucleotide
ccagcgggcaccccgcgtgt

SEQ ID NO: 308982 - DNA, 20 bp, Artificial Sequence
  Description of Artificial Sequence: Synthetic oligonucleotide
cagcgggcaccccgcgtgct

SEQ ID NO: 308983 - DNA, 20 bp, Artificial Sequence
  Description of Artificial Sequence: Synthetic oligonucleotide
agcgggcaccccgcgtgctg

SEQ ID NO: 308984 - DNA, 20 bp, Artificial Sequence
  Description of Artificial Sequence: Synthetic oligonucleotide
gcgggcaccccgcgtgctgt

SEQ ID NO: 308985 - DNA, 20 bp, Artificial Sequence
  Description of Artificial Sequence: Synthetic oligonucleotide
cgggcaccccgcgtgctgca

SEQ ID NO: 308986 - DNA, 20 bp, Artificial Sequence
  Description of Artificial Sequence: Synthetic oligonucleotide
gggcaccccgcgtgctgcag

SEQ ID NO: 308987 - DNA, 20 bp, Artificial Sequence
  Description of Artificial Sequence: Synthetic oligonucleotide
ggcaccccgcgtgctgcagc

SEQ ID NO: 308988 - DNA, 20 bp, Artificial Sequence
  Description of Artificial Sequence: Synthetic oligonucleotide
gcaccccgcgtgctgcagcc

SEQ ID NO: 308989 - DNA, 20 bp, Artificial Sequence
  Description of Artificial Sequence: Synthetic oligonucleotide
caccccgcgtgctgcagccg

SEQ ID NO: 308990 - DNA, 21 bp, Artificial Sequence
  Description of Artificial Sequence: Synthetic oligonucleotide
accccgcgtgctgcagccgga

SEQ ID NO: 308991 - DNA, 20 bp, Artificial Sequence
  Description of Artificial Sequence: Synthetic oligonucleotide
ccccgcgtgctgcagccgga

SEQ ID NO: 308992 - DNA, 21 bp, Artificial Sequence
  Description of Artificial Sequence: Synthetic oligonucleotide
cccgcgtgctgcagccggagt

SEQ ID NO: 308993 - DNA, 21 bp, Artificial Sequence
  Description of Artificial Sequence: Synthetic oligonucleotide
ccgcgtgctgcagccggagtg

SEQ ID NO: 308994 - DNA, 21 bp, Artificial Sequence
  Description of Artificial Sequence: Synthetic oligonucleotide
cgcgtgctgcagccggagtgc

SEQ ID NO: 308995 - DNA, 21 bp, Artificial Sequence
  Description of Artificial Sequence: Synthetic oligonucleotide
gcgtgctgcagccggagtgcc

SEQ ID NO: 308996 - DNA, 21 bp, Artificial Sequence
  Description of Artificial Sequence: Synthetic oligonucleotide
cgtgctgcagccggagtgccg

SEQ ID NO: 308997 - DNA, 21 bp, Artificial Sequence
  Description of Artificial Sequence: Synthetic oligonucleotide
gtgctgcagccggagtgccgg

SEQ ID NO: 308998 - DNA, 22 bp, Artificial Sequence
  Description of Artificial Sequence: Synthetic oligonucleotide
tgctgcagccggagtgccggga

SEQ ID NO: 308999 - DNA, 21 bp, Artificial Sequence
  Description of Artificial Sequence: Synthetic oligonucleotide
gctgcagccggagtgccggga

SEQ ID NO: 309000 - DNA, 21 bp, Artificial Sequence
  Description of Artificial Sequence: Synthetic oligonucleotide
ctgcagccggagtgccgggag

SEQ ID NO: 309001 - DNA, 21 bp, Artificial Sequence
  Description of Artificial Sequence: Synthetic oligonucleotide
tgcagccggagtgccgggagg

SEQ ID NO: 309002 - DNA, 20 bp, Artificial Sequence
  Description of Artificial Sequence: Synthetic oligonucleotide
gcagccggagtgccgggagg

SEQ ID NO: 309003 - DNA, 20 bp, Artificial Sequence
  Description of Artificial Sequence: Synthetic oligonucleotide
cagccggagtgccgggaggc

SEQ ID NO: 309004 - DNA, 22 bp, Artificial Sequence
  Description of Artificial Sequence: Synthetic oligonucleotide
agccggagtgccgggaggcctt

SEQ ID NO: 309005 - DNA, 21 bp, Artificial Sequence
  Description of Artificial Sequence: Synthetic oligonucleotide
gccggagtgccgggaggcctt

SEQ ID NO: 309006 - DNA, 21 bp, Artificial Sequence
  Description of Artificial Sequence: Synthetic oligonucleotide
ccggagtgccgggaggccttc

SEQ ID NO: 309007 - DNA, 22 bp, Artificial Sequence
  Description of Artificial Sequence: Synthetic oligonucleotide
cggagtgccgggaggccttcct

SEQ ID NO: 309008 - DNA, 23 bp, Artificial Sequence
  Description of Artificial Sequence: Synthetic oligonucleotide
ggagtgccgggaggccttcctgt

SEQ ID NO: 309009 - DNA, 23 bp, Artificial Sequence
  Description of Artificial Sequence: Synthetic oligonucleotide
gagtgccgggaggccttcctgtg

SEQ ID NO: 309010 - DNA, 24 bp, Artificial Sequence
  Description of Artificial Sequence: Synthetic oligonucleotide
agtgccgggaggccttcctgtgct

SEQ ID NO: 309011 - DNA, 23 bp, Artificial Sequence
  Description of Artificial Sequence: Synthetic oligonucleotide
gtgccgggaggccttcctgtgct

SEQ ID NO: 309012 - DNA, 23 bp, Artificial Sequence
  Description of Artificial Sequence: Synthetic oligonucleotide
tgccgggaggccttcctgtgctg

SEQ ID NO: 309013 - DNA, 22 bp, Artificial Sequence
  Description of Artificial Sequence: Synthetic oligonucleotide
gccgggaggccttcctgtgctg

SEQ ID NO: 309014 - DNA, 23 bp, Artificial Sequence
  Description of Artificial Sequence: Synthetic oligonucleotide
ccgggaggccttcctgtgctgct

SEQ ID NO: 309015 - DNA, 23 bp, Artificial Sequence
  Description of Artificial Sequence: Synthetic oligonucleotide
cgggaggccttcctgtgctgctg

SEQ ID NO: 309016 - DNA, 23 bp, Artificial Sequence
  Description of Artificial Sequence: Synthetic oligonucleotide
gggaggccttcctgtgctgctgc

SEQ ID NO: 309017 - DNA, 27 bp, Artificial Sequence
  Description of Artificial Sequence: Synthetic oligonucleotide
ggaggccttcctgtgctgctgccattt

SEQ ID NO: 309018 - DNA, 28 bp, Artificial Sequence
  Description of Artificial Sequence: Synthetic oligonucleotide
gaggccttcctgtgctgctgccattttg

SEQ ID NO: 309019 - DNA, 28 bp, Artificial Sequence
  Description of Artificial Sequence: Synthetic oligonucleotide
aggccttcctgtgctgctgccattttgc

SEQ ID NO: 309020 - DNA, 27 bp, Artificial Sequence
  Description of Artificial Sequence: Synthetic oligonucleotide
ggccttcctgtgctgctgccattttgc

SEQ ID NO: 309021 - DNA, 28 bp, Artificial Sequence
  Description of Artificial Sequence: Synthetic oligonucleotide
gccttcctgtgctgctgccattttgctg

SEQ ID NO: 309022 - DNA, 29 bp, Artificial Sequence
  Description of Artificial Sequence: Synthetic oligonucleotide
ccttcctgtgctgctgccattttgctgag

SEQ ID NO: 309023 - DNA, 30 bp, Artificial Sequence
  Description of Artificial Sequence: Synthetic oligonucleotide
cttcctgtgctgctgccattttgctgagtg

SEQ ID NO: 309024 - DNA, 31 bp, Artificial Sequence
  Description of Artificial Sequence: Synthetic oligonucleotide
ttcctgtgctgctgccattttgctgagtgtc

SEQ ID NO: 309025 - DNA, 30 bp, Artificial Sequence
  Description of Artificial Sequence: Synthetic oligonucleotide
tcctgtgctgctgccattttgctgagtgtc

SEQ ID NO: 309026 - DNA, 29 bp, Artificial Sequence
  Description of Artificial Sequence: Synthetic oligonucleotide
cctgtgctgctgccattttgctgagtgtc

SEQ ID NO: 309027 - DNA, 30 bp, Artificial Sequence
  Description of Artificial Sequence: Synthetic oligonucleotide
ctgtgctgctgccattttgctgagtgtctg

SEQ ID NO: 309028 - DNA, 30 bp, Artificial Sequence
  Description of Artificial Sequence: Synthetic oligonucleotide
tgtgctgctgccattttgctgagtgtctgc

SEQ ID NO: 309029 - DNA, 29 bp, Artificial Sequence
  Description of Artificial Sequence: Synthetic oligonucleotide
gtgctgctgccattttgctgagtgtctgc

SEQ ID NO: 309030 - DNA, 29 bp, Artificial Sequence
  Description of Artificial Sequence: Synthetic oligonucleotide
tgctgctgccattttgctgagtgtctgcg

SEQ ID NO: 309031 - DNA, 28 bp, Artificial Sequence
  Description of Artificial Sequence: Synthetic oligonucleotide
gctgctgccattttgctgagtgtctgcg

SEQ ID NO: 309032 - DNA, 28 bp, Artificial Sequence
  Description of Artificial Sequence: Synthetic oligonucleotide
ctgctgccattttgctgagtgtctgcgc

SEQ ID NO: 309033 - DNA, 30 bp, Artificial Sequence
  Description of Artificial Sequence: Synthetic oligonucleotide
tgctgccattttgctgagtgtctgcgcatg

SEQ ID NO: 309034 - DNA, 29 bp, Artificial Sequence
  Description of Artificial Sequence: Synthetic oligonucleotide
gctgccattttgctgagtgtctgcgcatg

SEQ ID NO: 309035 - DNA, 31 bp, Artificial Sequence
  Description of Artificial Sequence: Synthetic oligonucleotide
ctgccattttgctgagtgtctgcgcatgaag

SEQ ID NO: 309036 - DNA, 32 bp, Artificial Sequence
  Description of Artificial Sequence: Synthetic oligonucleotide
tgccattttgctgagtgtctgcgcatgaagag

SEQ ID NO: 309037 - DNA, 31 bp, Artificial Sequence
  Description of Artificial Sequence: Synthetic oligonucleotide
gccattttgctgagtgtctgcgcatgaagag

SEQ ID NO: 309038 - DNA, 31 bp, Artificial Sequence
  Description of Artificial Sequence: Synthetic oligonucleotide
ccattttgctgagtgtctgcgcatgaagagc

SEQ ID NO: 309039 - DNA, 32 bp, Artificial Sequence
  Description of Artificial Sequence: Synthetic oligonucleotide
cattttgctgagtgtctgcgcatgaagagcag

SEQ ID NO: 309040 - DNA, 32 bp, Artificial Sequence
  Description of Artificial Sequence: Synthetic oligonucleotide
attttgctgagtgtctgcgcatgaagagcagc

SEQ ID NO: 309041 - DNA, 31 bp, Artificial Sequence
  Description of Artificial Sequence: Synthetic oligonucleotide
ttttgctgagtgtctgcgcatgaagagcagc

SEQ ID NO: 309042 - DNA, 30 bp, Artificial Sequence
  Description of Artificial Sequence: Synthetic oligonucleotide
tttgctgagtgtctgcgcatgaagagcagc

SEQ ID NO: 309043 - DNA, 29 bp, Artificial Sequence
  Description of Artificial Sequence: Synthetic oligonucleotide
ttgctgagtgtctgcgcatgaagagcagc

SEQ ID NO: 309044 - DNA, 28 bp, Artificial Sequence
  Description of Artificial Sequence: Synthetic oligonucleotide
tgctgagtgtctgcgcatgaagagcagc

SEQ ID NO: 309045 - DNA, 27 bp, Artificial Sequence
  Description of Artificial Sequence: Synthetic oligonucleotide
gctgagtgtctgcgcatgaagagcagc

SEQ ID NO: 309046 - DNA, 27 bp, Artificial Sequence
  Description of Artificial Sequence: Synthetic oligonucleotide
ctgagtgtctgcgcatgaagagcagcg

SEQ ID NO: 309047 - DNA, 28 bp, Artificial Sequence
  Description of Artificial Sequence: Synthetic oligonucleotide
tgagtgtctgcgcatgaagagcagcgac

SEQ ID NO: 309048 - DNA, 27 bp, Artificial Sequence
  Description of Artificial Sequence: Synthetic oligonucleotide
gagtgtctgcgcatgaagagcagcgac

SEQ ID NO: 309049 - DNA, 29 bp, Artificial Sequence
  Description of Artificial Sequence: Synthetic oligonucleotide
agtgtctgcgcatgaagagcagcgacaag

SEQ ID NO: 309050 - DNA, 28 bp, Artificial Sequence
  Description of Artificial Sequence: Synthetic oligonucleotide
gtgtctgcgcatgaagagcagcgacaag

SEQ ID NO: 309051 - DNA, 28 bp, Artificial Sequence
  Description of Artificial Sequence: Synthetic oligonucleotide
tgtctgcgcatgaagagcagcgacaagg

SEQ ID NO: 309052 - DNA, 27 bp, Artificial Sequence
  Description of Artificial Sequence: Synthetic oligonucleotide
gtctgcgcatgaagagcagcgacaagg

SEQ ID NO: 309053 - DNA, 27 bp, Artificial Sequence
  Description of Artificial Sequence: Synthetic oligonucleotide
tctgcgcatgaagagcagcgacaaggg

SEQ ID NO: 309054 - DNA, 26 bp, Artificial Sequence
  Description of Artificial Sequence: Synthetic oligonucleotide
ctgcgcatgaagagcagcgacaaggg

SEQ ID NO: 309055 - DNA, 26 bp, Artificial Sequence
  Description of Artificial Sequence: Synthetic oligonucleotide
tgcgcatgaagagcagcgacaagggc

SEQ ID NO: 309056 - DNA, 25 bp, Artificial Sequence
  Description of Artificial Sequence: Synthetic oligonucleotide
gcgcatgaagagcagcgacaagggc

SEQ ID NO: 309057 - DNA, 26 bp, Artificial Sequence
  Description of Artificial Sequence: Synthetic oligonucleotide
cgcatgaagagcagcgacaagggcga

SEQ ID NO: 309058 - DNA, 26 bp, Artificial Sequence
  Description of Artificial Sequence: Synthetic oligonucleotide
gcatgaagagcagcgacaagggcgag

SEQ ID NO: 309059 - DNA, 26 bp, Artificial Sequence
  Description of Artificial Sequence: Synthetic oligonucleotide
catgaagagcagcgacaagggcgagg

SEQ ID NO: 309060 - DNA, 26 bp, Artificial Sequence
  Description of Artificial Sequence: Synthetic oligonucleotide
atgaagagcagcgacaagggcgaggc

SEQ ID NO: 309061 - DNA, 25 bp, Artificial Sequence
  Description of Artificial Sequence: Synthetic oligonucleotide
tgaagagcagcgacaagggcgaggc

SEQ ID NO: 309062 - DNA, 24 bp, Artificial Sequence
  Description of Artificial Sequence: Synthetic oligonucleotide
gaagagcagcgacaagggcgaggc

SEQ ID NO: 309063 - DNA, 24 bp, Artificial Sequence
  Description of Artificial Sequence: Synthetic oligonucleotide
aagagcagcgacaagggcgaggcg

SEQ ID NO: 309064 - DNA, 23 bp, Artificial Sequence
  Description of Artificial Sequence: Synthetic oligonucleotide
agagcagcgacaagggcgaggcg

SEQ ID NO: 309065 - DNA, 22 bp, Artificial Sequence
  Description of Artificial Sequence: Synthetic oligonucleotide
gagcagcgacaagggcgaggcg

SEQ ID NO: 309066 - DNA, 22 bp, Artificial Sequence
  Description of Artificial Sequence: Synthetic oligonucleotide
agcagcgacaagggcgaggcgg

SEQ ID NO: 309067 - DNA, 21 bp, Artificial Sequence
  Description of Artificial Sequence: Synthetic oligonucleotide
gcagcgacaagggcgaggcgg

SEQ ID NO: 309068 - DNA, 21 bp, Artificial Sequence
  Description of Artificial Sequence: Synthetic oligonucleotide
cagcgacaagggcgaggcggg

SEQ ID NO: 309069 - DNA, 21 bp, Artificial Sequence
  Description of Artificial Sequence: Synthetic oligonucleotide
agcgacaagggcgaggcgggc

SEQ ID NO: 309070 - DNA, 20 bp, Artificial Sequence
  Description of Artificial Sequence: Synthetic oligonucleotide
gcgacaagggcgaggcgggc

SEQ ID NO: 309071 - DNA, 21 bp, Artificial Sequence
  Description of Artificial Sequence: Synthetic oligonucleotide
cgacaagggcgaggcgggcca

SEQ ID NO: 309072 - DNA, 21 bp, Artificial Sequence
  Description of Artificial Sequence: Synthetic oligonucleotide
gacaagggcgaggcgggccac

SEQ ID NO: 309073 - DNA, 23 bp, Artificial Sequence
  Description of Artificial Sequence: Synthetic oligonucleotide
acaagggcgaggcgggccaccaa

SEQ ID NO: 309074 - DNA, 22 bp, Artificial Sequence
  Description of Artificial Sequence: Synthetic oligonucleotide
caagggcgaggcgggccaccaa

SEQ ID NO: 309075 - DNA, 22 bp, Artificial Sequence
  Description of Artificial Sequence: Synthetic oligonucleotide
aagggcgaggcgggccaccaac

SEQ ID NO: 309076 - DNA, 21 bp, Artificial Sequence
  Description of Artificial Sequence: Synthetic oligonucleotide
agggcgaggcgggccaccaac

SEQ ID NO: 309077 - DNA, 20 bp, Artificial Sequence
  Description of Artificial Sequence: Synthetic oligonucleotide
gggcgaggcgggccaccaac

SEQ ID NO: 309078 - DNA, 21 bp, Artificial Sequence
  Description of Artificial Sequence: Synthetic oligonucleotide
ggcgaggcgggccaccaacga

SEQ ID NO: 309079 - DNA, 21 bp, Artificial Sequence
  Description of Artificial Sequence: Synthetic oligonucleotide
gcgaggcgggccaccaacgag

SEQ ID NO: 309080 - DNA, 21 bp, Artificial Sequence
  Description of Artificial Sequence: Synthetic oligonucleotide
cgaggcgggccaccaacgagc

SEQ ID NO: 309081 - DNA, 21 bp, Artificial Sequence
  Description of Artificial Sequence: Synthetic oligonucleotide
gaggcgggccaccaacgagcg

SEQ ID NO: 309082 - DNA, 22 bp, Artificial Sequence
  Description of Artificial Sequence: Synthetic oligonucleotide
aggcgggccaccaacgagcgct

SEQ ID NO: 309083 - DNA, 21 bp, Artificial Sequence
  Description of Artificial Sequence: Synthetic oligonucleotide
ggcgggccaccaacgagcgct

SEQ ID NO: 309084 - DNA, 21 bp, Artificial Sequence
  Description of Artificial Sequence: Synthetic oligonucleotide
gcgggccaccaacgagcgctg

SEQ ID NO: 309085 - DNA, 22 bp, Artificial Sequence
  Description of Artificial Sequence: Synthetic oligonucleotide
cgggccaccaacgagcgctgga

SEQ ID NO: 309086 - DNA, 24 bp, Artificial Sequence
  Description of Artificial Sequence: Synthetic oligonucleotide
gggccaccaacgagcgctggagat

SEQ ID NO: 309087 - DNA, 24 bp, Artificial Sequence
  Description of Artificial Sequence: Synthetic oligonucleotide
ggccaccaacgagcgctggagatc

SEQ ID NO: 309088 - DNA, 25 bp, Artificial Sequence
  Description of Artificial Sequence: Synthetic oligonucleotide
gccaccaacgagcgctggagatcgt

SEQ ID NO: 309089 - DNA, 25 bp, Artificial Sequence
  Description of Artificial Sequence: Synthetic oligonucleotide
ccaccaacgagcgctggagatcgtg

SEQ ID NO: 309090 - DNA, 26 bp, Artificial Sequence
  Description of Artificial Sequence: Synthetic oligonucleotide
caccaacgagcgctggagatcgtgca

SEQ ID NO: 309091 - DNA, 26 bp, Artificial Sequence
  Description of Artificial Sequence: Synthetic oligonucleotide
accaacgagcgctggagatcgtgcag

SEQ ID NO: 309092 - DNA, 25 bp, Artificial Sequence
  Description of Artificial Sequence: Synthetic oligonucleotide
ccaacgagcgctggagatcgtgcag

SEQ ID NO: 309093 - DNA, 26 bp, Artificial Sequence
  Description of Artificial Sequence: Synthetic oligonucleotide
caacgagcgctggagatcgtgcagga

SEQ ID NO: 309094 - DNA, 26 bp, Artificial Sequence
  Description of Artificial Sequence: Synthetic oligonucleotide
aacgagcgctggagatcgtgcaggag

SEQ ID NO: 309095 - DNA, 25 bp, Artificial Sequence
  Description of Artificial Sequence: Synthetic oligonucleotide
acgagcgctggagatcgtgcaggag

SEQ ID NO: 309096 - DNA, 24 bp, Artificial Sequence
  Description of Artificial Sequence: Synthetic oligonucleotide
cgagcgctggagatcgtgcaggag

SEQ ID NO: 309097 - DNA, 25 bp, Artificial Sequence
  Description of Artificial Sequence: Synthetic oligonucleotide
gagcgctggagatcgtgcaggaggt

SEQ ID NO: 309098 - DNA, 25 bp, Artificial Sequence
  Description of Artificial Sequence: Synthetic oligonucleotide
agcgctggagatcgtgcaggaggtg

SEQ ID NO: 309099 - DNA, 24 bp, Artificial Sequence
  Description of Artificial Sequence: Synthetic oligonucleotide
gcgctggagatcgtgcaggaggtg

SEQ ID NO: 309100 - DNA, 25 bp, Artificial Sequence
  Description of Artificial Sequence: Synthetic oligonucleotide
cgctggagatcgtgcaggaggtgga

SEQ ID NO: 309101 - DNA, 25 bp, Artificial Sequence
  Description of Artificial Sequence: Synthetic oligonucleotide
gctggagatcgtgcaggaggtggac

SEQ ID NO: 309102 - DNA, 26 bp, Artificial Sequence
  Description of Artificial Sequence: Synthetic oligonucleotide
ctggagatcgtgcaggaggtggacct

SEQ ID NO: 309103 - DNA, 27 bp, Artificial Sequence
  Description of Artificial Sequence: Synthetic oligonucleotide
tggagatcgtgcaggaggtggacctga

SEQ ID NO: 309104 - DNA, 27 bp, Artificial Sequence
  Description of Artificial Sequence: Synthetic oligonucleotide
ggagatcgtgcaggaggtggacctgat

SEQ ID NO: 309105 - DNA, 28 bp, Artificial Sequence
  Description of Artificial Sequence: Synthetic oligonucleotide
gagatcgtgcaggaggtggacctgatag

SEQ ID NO: 309106 - DNA, 30 bp, Artificial Sequence
  Description of Artificial Sequence: Synthetic oligonucleotide
agatcgtgcaggaggtggacctgatagatg

SEQ ID NO: 309107 - DNA, 29 bp, Artificial Sequence
  Description of Artificial Sequence: Synthetic oligonucleotide
gatcgtgcaggaggtggacctgatagatg

SEQ ID NO: 309108 - DNA, 30 bp, Artificial Sequence
  Description of Artificial Sequence: Synthetic oligonucleotide
atcgtgcaggaggtggacctgatagatgag

SEQ ID NO: 309109 - DNA, 29 bp, Artificial Sequence
  Description of Artificial Sequence: Synthetic oligonucleotide
tcgtgcaggaggtggacctgatagatgag

SEQ ID NO: 309110 - DNA, 28 bp, Artificial Sequence
  Description of Artificial Sequence: Synthetic oligonucleotide
cgtgcaggaggtggacctgatagatgag

SEQ ID NO: 309111 - DNA, 28 bp, Artificial Sequence
  Description of Artificial Sequence: Synthetic oligonucleotide
gtgcaggaggtggacctgatagatgagg

SEQ ID NO: 309112 - DNA, 30 bp, Artificial Sequence
  Description of Artificial Sequence: Synthetic oligonucleotide
tgcaggaggtggacctgatagatgaggatc

SEQ ID NO: 309113 - DNA, 29 bp, Artificial Sequence
  Description of Artificial Sequence: Synthetic oligonucleotide
gcaggaggtggacctgatagatgaggatc

SEQ ID NO: 309114 - DNA, 30 bp, Artificial Sequence
  Description of Artificial Sequence: Synthetic oligonucleotide
caggaggtggacctgatagatgaggatcac

SEQ ID NO: 309115 - DNA, 33 bp, Artificial Sequence
  Description of Artificial Sequence: Synthetic oligonucleotide
aggaggtggacctgatagatgaggatcacattc

SEQ ID NO: 309116 - DNA, 32 bp, Artificial Sequence
  Description of Artificial Sequence: Synthetic oligonucleotide
ggaggtggacctgatagatgaggatcacattc

SEQ ID NO: 309117 - DNA, 32 bp, Artificial Sequence
  Description of Artificial Sequence: Synthetic oligonucleotide
gaggtggacctgatagatgaggatcacattcc

SEQ ID NO: 309118 - DNA, 32 bp, Artificial Sequence
  Description of Artificial Sequence: Synthetic oligonucleotide
aggtggacctgatagatgaggatcacattccc

SEQ ID NO: 309119 - DNA, 31 bp, Artificial Sequence
  Description of Artificial Sequence: Synthetic oligonucleotide
ggtggacctgatagatgaggatcacattccc

SEQ ID NO: 309120 - DNA, 31 bp, Artificial Sequence
  Description of Artificial Sequence: Synthetic oligonucleotide
gtggacctgatagatgaggatcacattcccg

SEQ ID NO: 309121 - DNA, 32 bp, Artificial Sequence
  Description of Artificial Sequence: Synthetic oligonucleotide
tggacctgatagatgaggatcacattcccgag

SEQ ID NO: 309122 - DNA, 31 bp, Artificial Sequence
  Description of Artificial Sequence: Synthetic oligonucleotide
ggacctgatagatgaggatcacattcccgag

SEQ ID NO: 309123 - DNA, 31 bp, Artificial Sequence
  Description of Artificial Sequence: Synthetic oligonucleotide
gacctgatagatgaggatcacattcccgagc

SEQ ID NO: 309124 - DNA, 31 bp, Artificial Sequence
  Description of Artificial Sequence: Synthetic oligonucleotide
acctgatagatgaggatcacattcccgagcg

SEQ ID NO: 309125 - DNA, 30 bp, Artificial Sequence
  Description of Artificial Sequence: Synthetic oligonucleotide
cctgatagatgaggatcacattcccgagcg

SEQ ID NO: 309126 - DNA, 30 bp, Artificial Sequence
  Description of Artificial Sequence: Synthetic oligonucleotide
ctgatagatgaggatcacattcccgagcgc

SEQ ID NO: 309127 - DNA, 31 bp, Artificial Sequence
  Description of Artificial Sequence: Synthetic oligonucleotide
tgatagatgaggatcacattcccgagcgcag

SEQ ID NO: 309128 - DNA, 30 bp, Artificial Sequence
  Description of Artificial Sequence: Synthetic oligonucleotide
gatagatgaggatcacattcccgagcgcag

SEQ ID NO: 309129 - DNA, 30 bp, Artificial Sequence
  Description of Artificial Sequence: Synthetic oligonucleotide
atagatgaggatcacattcccgagcgcagc

SEQ ID NO: 309130 - DNA, 29 bp, Artificial Sequence
  Description of Artificial Sequence: Synthetic oligonucleotide
tagatgaggatcacattcccgagcgcagc

SEQ ID NO: 309131 - DNA, 28 bp, Artificial Sequence
  Description of Artificial Sequence: Synthetic oligonucleotide
agatgaggatcacattcccgagcgcagc

SEQ ID NO: 309132 - DNA, 27 bp, Artificial Sequence
  Description of Artificial Sequence: Synthetic oligonucleotide
gatgaggatcacattcccgagcgcagc

SEQ ID NO: 309133 - DNA, 29 bp, Artificial Sequence
  Description of Artificial Sequence: Synthetic oligonucleotide
atgaggatcacattcccgagcgcagcttg

SEQ ID NO: 309134 - DNA, 28 bp, Artificial Sequence
  Description of Artificial Sequence: Synthetic oligonucleotide
tgaggatcacattcccgagcgcagcttg

SEQ ID NO: 309135 - DNA, 27 bp, Artificial Sequence
  Description of Artificial Sequence: Synthetic oligonucleotide
gaggatcacattcccgagcgcagcttg

SEQ ID NO: 309136 - DNA, 29 bp, Artificial Sequence
  Description of Artificial Sequence: Synthetic oligonucleotide
aggatcacattcccgagcgcagcttgttc

SEQ ID NO: 309137 - DNA, 28 bp, Artificial Sequence
  Description of Artificial Sequence: Synthetic oligonucleotide
ggatcacattcccgagcgcagcttgttc

SEQ ID NO: 309138 - DNA, 28 bp, Artificial Sequence
  Description of Artificial Sequence: Synthetic oligonucleotide
gatcacattcccgagcgcagcttgttcc

SEQ ID NO: 309139 - DNA, 28 bp, Artificial Sequence
  Description of Artificial Sequence: Synthetic oligonucleotide
atcacattcccgagcgcagcttgttccc

SEQ ID NO: 309140 - DNA, 27 bp, Artificial Sequence
  Description of Artificial Sequence: Synthetic oligonucleotide
tcacattcccgagcgcagcttgttccc

SEQ ID NO: 309141 - DNA, 27 bp, Artificial Sequence
  Description of Artificial Sequence: Synthetic oligonucleotide
cacattcccgagcgcagcttgttccca

SEQ ID NO: 309142 - DNA, 27 bp, Artificial Sequence
  Description of Artificial Sequence: Synthetic oligonucleotide
acattcccgagcgcagcttgttcccag

SEQ ID NO: 309143 - DNA, 27 bp, Artificial Sequence
  Description of Artificial Sequence: Synthetic oligonucleotide
cattcccgagcgcagcttgttcccaga

SEQ ID NO: 309144 - DNA, 27 bp, Artificial Sequence
  Description of Artificial Sequence: Synthetic oligonucleotide
attcccgagcgcagcttgttcccagag

SEQ ID NO: 309145 - DNA, 27 bp, Artificial Sequence
  Description of Artificial Sequence: Synthetic oligonucleotide
ttcccgagcgcagcttgttcccagagt

SEQ ID NO: 309146 - DNA, 27 bp, Artificial Sequence
  Description of Artificial Sequence: Synthetic oligonucleotide
tcccgagcgcagcttgttcccagagta

SEQ ID NO: 309147 - DNA, 26 bp, Artificial Sequence
  Description of Artificial Sequence: Synthetic oligonucleotide
cccgagcgcagcttgttcccagagta

SEQ ID NO: 309148 - DNA, 27 bp, Artificial Sequence
  Description of Artificial Sequence: Synthetic oligonucleotide
ccgagcgcagcttgttcccagagtact

SEQ ID NO: 309149 - DNA, 27 bp, Artificial Sequence
  Description of Artificial Sequence: Synthetic oligonucleotide
cgagcgcagcttgttcccagagtactg

SEQ ID NO: 309150 - DNA, 27 bp, Artificial Sequence
  Description of Artificial Sequence: Synthetic oligonucleotide
gagcgcagcttgttcccagagtactgg

SEQ ID NO: 309151 - DNA, 27 bp, Artificial Sequence
  Description of Artificial Sequence: Synthetic oligonucleotide
agcgcagcttgttcccagagtactggc

SEQ ID NO: 309152 - DNA, 27 bp, Artificial Sequence
  Description of Artificial Sequence: Synthetic oligonucleotide
gcgcagcttgttcccagagtactggct

SEQ ID NO: 309153 - DNA, 27 bp, Artificial Sequence
  Description of Artificial Sequence: Synthetic oligonucleotide
cgcagcttgttcccagagtactggctc

SEQ ID NO: 309154 - DNA, 28 bp, Artificial Sequence
  Description of Artificial Sequence: Synthetic oligonucleotide
gcagcttgttcccagagtactggctctc

SEQ ID NO: 309155 - DNA, 28 bp, Artificial Sequence
  Description of Artificial Sequence: Synthetic oligonucleotide
cagcttgttcccagagtactggctctcg

SEQ ID NO: 309156 - DNA, 29 bp, Artificial Sequence
  Description of Artificial Sequence: Synthetic oligonucleotide
agcttgttcccagagtactggctctcgag

SEQ ID NO: 309157 - DNA, 28 bp, Artificial Sequence
  Description of Artificial Sequence: Synthetic oligonucleotide
gcttgttcccagagtactggctctcgag

SEQ ID NO: 309158 - DNA, 29 bp, Artificial Sequence
  Description of Artificial Sequence: Synthetic oligonucleotide
cttgttcccagagtactggctctcgagag

SEQ ID NO: 309159 - DNA, 30 bp, Artificial Sequence
  Description of Artificial Sequence: Synthetic oligonucleotide
ttgttcccagagtactggctctcgagagtg

SEQ ID NO: 309160 - DNA, 29 bp, Artificial Sequence
  Description of Artificial Sequence: Synthetic oligonucleotide
tgttcccagagtactggctctcgagagtg

SEQ ID NO: 309161 - DNA, 28 bp, Artificial Sequence
  Description of Artificial Sequence: Synthetic oligonucleotide
gttcccagagtactggctctcgagagtg

SEQ ID NO: 309162 - DNA, 28 bp, Artificial Sequence
  Description of Artificial Sequence: Synthetic oligonucleotide
ttcccagagtactggctctcgagagtgg

SEQ ID NO: 309163 - DNA, 27 bp, Artificial Sequence
  Description of Artificial Sequence: Synthetic oligonucleotide
tcccagagtactggctctcgagagtgg

SEQ ID NO: 309164 - DNA, 27 bp, Artificial Sequence
  Description of Artificial Sequence: Synthetic oligonucleotide
cccagagtactggctctcgagagtgga

SEQ ID NO: 309165 - DNA, 29 bp, Artificial Sequence
  Description of Artificial Sequence: Synthetic oligonucleotide
ccagagtactggctctcgagagtggatac

SEQ ID NO: 309166 - DNA, 30 bp, Artificial Sequence
  Description of Artificial Sequence: Synthetic oligonucleotide
cagagtactggctctcgagagtggatacag

SEQ ID NO: 309167 - DNA, 31 bp, Artificial Sequence
  Description of Artificial Sequence: Synthetic oligonucleotide
agagtactggctctcgagagtggatacagtg

SEQ ID NO: 309168 - DNA, 30 bp, Artificial Sequence
  Description of Artificial Sequence: Synthetic oligonucleotide
gagtactggctctcgagagtggatacagtg

SEQ ID NO: 309169 - DNA, 30 bp, Artificial Sequence
  Description of Artificial Sequence: Synthetic oligonucleotide
agtactggctctcgagagtggatacagtgg

SEQ ID NO: 309170 - DNA, 29 bp, Artificial Sequence
  Description of Artificial Sequence: Synthetic oligonucleotide
gtactggctctcgagagtggatacagtgg

SEQ ID NO: 309171 - DNA, 30 bp, Artificial Sequence
  Description of Artificial Sequence: Synthetic oligonucleotide
tactggctctcgagagtggatacagtggac

SEQ ID NO: 309172 - DNA, 29 bp, Artificial Sequence
  Description of Artificial Sequence: Synthetic oligonucleotide
actggctctcgagagtggatacagtggac

SEQ ID NO: 309173 - DNA, 28 bp, Artificial Sequence
  Description of Artificial Sequence: Synthetic oligonucleotide
ctggctctcgagagtggatacagtggac

SEQ ID NO: 309174 - DNA, 28 bp, Artificial Sequence
  Description of Artificial Sequence: Synthetic oligonucleotide
tggctctcgagagtggatacagtggacg

SEQ ID NO: 309175 - DNA, 27 bp, Artificial Sequence
  Description of Artificial Sequence: Synthetic oligonucleotide
ggctctcgagagtggatacagtggacg

SEQ ID NO: 309176 - DNA, 27 bp, Artificial Sequence
  Description of Artificial Sequence: Synthetic oligonucleotide
gctctcgagagtggatacagtggacgg

SEQ ID NO: 309177 - DNA, 27 bp, Artificial Sequence
  Description of Artificial Sequence: Synthetic oligonucleotide
ctctcgagagtggatacagtggacggc

SEQ ID NO: 309178 - DNA, 30 bp, Artificial Sequence
  Description of Artificial Sequence: Synthetic oligonucleotide
tctcgagagtggatacagtggacggctttc

SEQ ID NO: 309179 - DNA, 29 bp, Artificial Sequence
  Description of Artificial Sequence: Synthetic oligonucleotide
ctcgagagtggatacagtggacggctttc

SEQ ID NO: 309180 - DNA, 36 bp, Artificial Sequence
  Description of Artificial Sequence: Synthetic oligonucleotide
tcgagagtggatacagtggacggctttcaaaaattg

SEQ ID NO: 309181 - DNA, 35 bp, Artificial Sequence
  Description of Artificial Sequence: Synthetic oligonucleotide
cgagagtggatacagtggacggctttcaaaaattg

SEQ ID NO: 309182 - DNA, 36 bp, Artificial Sequence
  Description of Artificial Sequence: Synthetic oligonucleotide
gagagtggatacagtggacggctttcaaaaattgac

SEQ ID NO: 309183 - DNA, 37 bp, Artificial Sequence
  Description of Artificial Sequence: Synthetic oligonucleotide
agagtggatacagtggacggctttcaaaaattgacac

SEQ ID NO: 309184 - DNA, 36 bp, Artificial Sequence
  Description of Artificial Sequence: Synthetic oligonucleotide
gagtggatacagtggacggctttcaaaaattgacac

SEQ ID NO: 309185 - DNA, 37 bp, Artificial Sequence
  Description of Artificial Sequence: Synthetic oligonucleotide
agtggatacagtggacggctttcaaaaattgacactc

SEQ ID NO: 309186 - DNA, 36 bp, Artificial Sequence
  Description of Artificial Sequence: Synthetic oligonucleotide
gtggatacagtggacggctttcaaaaattgacactc

SEQ ID NO: 309187 - DNA, 37 bp, Artificial Sequence
  Description of Artificial Sequence: Synthetic oligonucleotide
tggatacagtggacggctttcaaaaattgacactctg

SEQ ID NO: 309188 - DNA, 36 bp, Artificial Sequence
  Description of Artificial Sequence: Synthetic oligonucleotide
ggatacagtggacggctttcaaaaattgacactctg

SEQ ID NO: 309189 - DNA, 36 bp, Artificial Sequence
  Description of Artificial Sequence: Synthetic oligonucleotide
gatacagtggacggctttcaaaaattgacactctgg

SEQ ID NO: 309190 - DNA, 36 bp, Artificial Sequence
  Description of Artificial Sequence: Synthetic oligonucleotide
atacagtggacggctttcaaaaattgacactctggc

SEQ ID NO: 309191 - DNA, 35 bp, Artificial Sequence
  Description of Artificial Sequence: Synthetic oligonucleotide
tacagtggacggctttcaaaaattgacactctggc

SEQ ID NO: 309192 - DNA, 34 bp, Artificial Sequence
  Description of Artificial Sequence: Synthetic oligonucleotide
acagtggacggctttcaaaaattgacactctggc

SEQ ID NO: 309193 - DNA, 33 bp, Artificial Sequence
  Description of Artificial Sequence: Synthetic oligonucleotide
cagtggacggctttcaaaaattgacactctggc

SEQ ID NO: 309194 - DNA, 34 bp, Artificial Sequence
  Description of Artificial Sequence: Synthetic oligonucleotide
agtggacggctttcaaaaattgacactctggctc

SEQ ID NO: 309195 - DNA, 33 bp, Artificial Sequence
  Description of Artificial Sequence: Synthetic oligonucleotide
gtggacggctttcaaaaattgacactctggctc

SEQ ID NO: 309196 - DNA, 33 bp, Artificial Sequence
  Description of Artificial Sequence: Synthetic oligonucleotide
tggacggctttcaaaaattgacactctggctcc

SEQ ID NO: 309197 - DNA, 32 bp, Artificial Sequence
  Description of Artificial Sequence: Synthetic oligonucleotide
ggacggctttcaaaaattgacactctggctcc

SEQ ID NO: 309198 - DNA, 32 bp, Artificial Sequence
  Description of Artificial Sequence: Synthetic oligonucleotide
gacggctttcaaaaattgacactctggctccc

SEQ ID NO: 309199 - DNA, 32 bp, Artificial Sequence
  Description of Artificial Sequence: Synthetic oligonucleotide
acggctttcaaaaattgacactctggctcccc

SEQ ID NO: 309200 - DNA, 31 bp, Artificial Sequence
  Description of Artificial Sequence: Synthetic oligonucleotide
cggctttcaaaaattgacactctggctcccc

SEQ ID NO: 309201 - DNA, 31 bp, Artificial Sequence
  Description of Artificial Sequence: Synthetic oligonucleotide
ggctttcaaaaattgacactctggctccccc

SEQ ID NO: 309202 - DNA, 32 bp, Artificial Sequence
  Description of Artificial Sequence: Synthetic oligonucleotide
gctttcaaaaattgacactctggctcccccac

SEQ ID NO: 309203 - DNA, 33 bp, Artificial Sequence
  Description of Artificial Sequence: Synthetic oligonucleotide
ctttcaaaaattgacactctggctcccccactc

SEQ ID NO: 309204 - DNA, 34 bp, Artificial Sequence
  Description of Artificial Sequence: Synthetic oligonucleotide
tttcaaaaattgacactctggctcccccactctc

SEQ ID NO: 309205 - DNA, 33 bp, Artificial Sequence
  Description of Artificial Sequence: Synthetic oligonucleotide
ttcaaaaattgacactctggctcccccactctc

SEQ ID NO: 309206 - DNA, 32 bp, Artificial Sequence
  Description of Artificial Sequence: Synthetic oligonucleotide
tcaaaaattgacactctggctcccccactctc

SEQ ID NO: 309207 - DNA, 31 bp, Artificial Sequence
  Description of Artificial Sequence: Synthetic oligonucleotide
caaaaattgacactctggctcccccactctc

SEQ ID NO: 309208 - DNA, 32 bp, Artificial Sequence
  Description of Artificial Sequence: Synthetic oligonucleotide
aaaaattgacactctggctcccccactctctg

SEQ ID NO: 309209 - DNA, 31 bp, Artificial Sequence
  Description of Artificial Sequence: Synthetic oligonucleotide
aaaattgacactctggctcccccactctctg

SEQ ID NO: 309210 - DNA, 30 bp, Artificial Sequence
  Description of Artificial Sequence: Synthetic oligonucleotide
aaattgacactctggctcccccactctctg

SEQ ID NO: 309211 - DNA, 29 bp, Artificial Sequence
  Description of Artificial Sequence: Synthetic oligonucleotide
aattgacactctggctcccccactctctg

SEQ ID NO: 309212 - DNA, 28 bp, Artificial Sequence
  Description of Artificial Sequence: Synthetic oligonucleotide
attgacactctggctcccccactctctg

SEQ ID NO: 309213 - DNA, 27 bp, Artificial Sequence
  Description of Artificial Sequence: Synthetic oligonucleotide
ttgacactctggctcccccactctctg

SEQ ID NO: 309214 - DNA, 27 bp, Artificial Sequence
  Description of Artificial Sequence: Synthetic oligonucleotide
tgacactctggctcccccactctctga

SEQ ID NO: 309215 - DNA, 26 bp, Artificial Sequence
  Description of Artificial Sequence: Synthetic oligonucleotide
gacactctggctcccccactctctga

SEQ ID NO: 309216 - DNA, 26 bp, Artificial Sequence
  Description of Artificial Sequence: Synthetic oligonucleotide
acactctggctcccccactctctgag

SEQ ID NO: 309217 - DNA, 25 bp, Artificial Sequence
  Description of Artificial Sequence: Synthetic oligonucleotide
cactctggctcccccactctctgag

SEQ ID NO: 309218 - DNA, 26 bp, Artificial Sequence
  Description of Artificial Sequence: Synthetic oligonucleotide
actctggctcccccactctctgagca

SEQ ID NO: 309219 - DNA, 25 bp, Artificial Sequence
  Description of Artificial Sequence: Synthetic oligonucleotide
ctctggctcccccactctctgagca

SEQ ID NO: 309220 - DNA, 25 bp, Artificial Sequence
  Description of Artificial Sequence: Synthetic oligonucleotide
tctggctcccccactctctgagcac

SEQ ID NO: 309221 - DNA, 24 bp, Artificial Sequence
  Description of Artificial Sequence: Synthetic oligonucleotide
ctggctcccccactctctgagcac

SEQ ID NO: 309222 - DNA, 25 bp, Artificial Sequence
  Description of Artificial Sequence: Synthetic oligonucleotide
tggctcccccactctctgagcacgt

SEQ ID NO: 309223 - DNA, 24 bp, Artificial Sequence
  Description of Artificial Sequence: Synthetic oligonucleotide
ggctcccccactctctgagcacgt

SEQ ID NO: 309224 - DNA, 24 bp, Artificial Sequence
  Description of Artificial Sequence: Synthetic oligonucleotide
gctcccccactctctgagcacgtg

SEQ ID NO: 309225 - DNA, 24 bp, Artificial Sequence
  Description of Artificial Sequence: Synthetic oligonucleotide
ctcccccactctctgagcacgtgg

SEQ ID NO: 309226 - DNA, 25 bp, Artificial Sequence
  Description of Artificial Sequence: Synthetic oligonucleotide
tcccccactctctgagcacgtggga

SEQ ID NO: 309227 - DNA, 24 bp, Artificial Sequence
  Description of Artificial Sequence: Synthetic oligonucleotide
cccccactctctgagcacgtggga

SEQ ID NO: 309228 - DNA, 26 bp, Artificial Sequence
  Description of Artificial Sequence: Synthetic oligonucleotide
ccccactctctgagcacgtgggacat

SEQ ID NO: 309229 - DNA, 26 bp, Artificial Sequence
  Description of Artificial Sequence: Synthetic oligonucleotide
cccactctctgagcacgtgggacatc

SEQ ID NO: 309230 - DNA, 27 bp, Artificial Sequence
  Description of Artificial Sequence: Synthetic oligonucleotide
ccactctctgagcacgtgggacatcca

SEQ ID NO: 309231 - DNA, 28 bp, Artificial Sequence
  Description of Artificial Sequence: Synthetic oligonucleotide
cactctctgagcacgtgggacatccatg

SEQ ID NO: 309232 - DNA, 28 bp, Artificial Sequence
  Description of Artificial Sequence: Synthetic oligonucleotide
actctctgagcacgtgggacatccatgg

SEQ ID NO: 309233 - DNA, 27 bp, Artificial Sequence
  Description of Artificial Sequence: Synthetic oligonucleotide
ctctctgagcacgtgggacatccatgg

SEQ ID NO: 309234 - DNA, 27 bp, Artificial Sequence
  Description of Artificial Sequence: Synthetic oligonucleotide
tctctgagcacgtgggacatccatggc

SEQ ID NO: 309235 - DNA, 26 bp, Artificial Sequence
  Description of Artificial Sequence: Synthetic oligonucleotide
ctctgagcacgtgggacatccatggc

SEQ ID NO: 309236 - DNA, 27 bp, Artificial Sequence
  Description of Artificial Sequence: Synthetic oligonucleotide
tctgagcacgtgggacatccatggcgt

SEQ ID NO: 309237 - DNA, 26 bp, Artificial Sequence
  Description of Artificial Sequence: Synthetic oligonucleotide
ctgagcacgtgggacatccatggcgt

SEQ ID NO: 309238 - DNA, 27 bp, Artificial Sequence
  Description of Artificial Sequence: Synthetic oligonucleotide
tgagcacgtgggacatccatggcgtga

SEQ ID NO: 309239 - DNA, 26 bp, Artificial Sequence
  Description of Artificial Sequence: Synthetic oligonucleotide
gagcacgtgggacatccatggcgtga

SEQ ID NO: 309240 - DNA, 26 bp, Artificial Sequence
  Description of Artificial Sequence: Synthetic oligonucleotide
agcacgtgggacatccatggcgtgag

SEQ ID NO: 309241 - DNA, 25 bp, Artificial Sequence
  Description of Artificial Sequence: Synthetic oligonucleotide
gcacgtgggacatccatggcgtgag

SEQ ID NO: 309242 - DNA, 25 bp, Artificial Sequence
  Description of Artificial Sequence: Synthetic oligonucleotide
cacgtgggacatccatggcgtgagc

SEQ ID NO: 309243 - DNA, 26 bp, Artificial Sequence
  Description of Artificial Sequence: Synthetic oligonucleotide
acgtgggacatccatggcgtgagcct

SEQ ID NO: 309244 - DNA, 25 bp, Artificial Sequence
  Description of Artificial Sequence: Synthetic oligonucleotide
cgtgggacatccatggcgtgagcct

SEQ ID NO: 309245 - DNA, 26 bp, Artificial Sequence
  Description of Artificial Sequence: Synthetic oligonucleotide
gtgggacatccatggcgtgagcctgt

SEQ ID NO: 309246 - DNA, 26 bp, Artificial Sequence
  Description of Artificial Sequence: Synthetic oligonucleotide
tgggacatccatggcgtgagcctgtg

SEQ ID NO: 309247 - DNA, 25 bp, Artificial Sequence
  Description of Artificial Sequence: Synthetic oligonucleotide
gggacatccatggcgtgagcctgtg

SEQ ID NO: 309248 - DNA, 27 bp, Artificial Sequence
  Description of Artificial Sequence: Synthetic oligonucleotide
ggacatccatggcgtgagcctgtgcaa

SEQ ID NO: 309249 - DNA, 29 bp, Artificial Sequence
  Description of Artificial Sequence: Synthetic oligonucleotide
gacatccatggcgtgagcctgtgcaaaac

SEQ ID NO: 309250 - DNA, 29 bp, Artificial Sequence
  Description of Artificial Sequence: Synthetic oligonucleotide
acatccatggcgtgagcctgtgcaaaacc

SEQ ID NO: 309251 - DNA, 28 bp, Artificial Sequence
  Description of Artificial Sequence: Synthetic oligonucleotide
catccatggcgtgagcctgtgcaaaacc

SEQ ID NO: 309252 - DNA, 31 bp, Artificial Sequence
  Description of Artificial Sequence: Synthetic oligonucleotide
atccatggcgtgagcctgtgcaaaaccaatg

SEQ ID NO: 309253 - DNA, 30 bp, Artificial Sequence
  Description of Artificial Sequence: Synthetic oligonucleotide
tccatggcgtgagcctgtgcaaaaccaatg

SEQ ID NO: 309254 - DNA, 29 bp, Artificial Sequence
  Description of Artificial Sequence: Synthetic oligonucleotide
ccatggcgtgagcctgtgcaaaaccaatg

SEQ ID NO: 309255 - DNA, 29 bp, Artificial Sequence
  Description of Artificial Sequence: Synthetic oligonucleotide
catggcgtgagcctgtgcaaaaccaatgg

SEQ ID NO: 309256 - DNA, 29 bp, Artificial Sequence
  Description of Artificial Sequence: Synthetic oligonucleotide
atggcgtgagcctgtgcaaaaccaatggc

SEQ ID NO: 309257 - DNA, 28 bp, Artificial Sequence
  Description of Artificial Sequence: Synthetic oligonucleotide
tggcgtgagcctgtgcaaaaccaatggc

SEQ ID NO: 309258 - DNA, 27 bp, Artificial Sequence
  Description of Artificial Sequence: Synthetic oligonucleotide
ggcgtgagcctgtgcaaaaccaatggc

SEQ ID NO: 309259 - DNA, 27 bp, Artificial Sequence
  Description of Artificial Sequence: Synthetic oligonucleotide
gcgtgagcctgtgcaaaaccaatggcc

SEQ ID NO: 309260 - DNA, 30 bp, Artificial Sequence
  Description of Artificial Sequence: Synthetic oligonucleotide
cgtgagcctgtgcaaaaccaatggcctatg

SEQ ID NO: 309261 - DNA, 31 bp, Artificial Sequence
  Description of Artificial Sequence: Synthetic oligonucleotide
gtgagcctgtgcaaaaccaatggcctatgtc

SEQ ID NO: 309262 - DNA, 32 bp, Artificial Sequence
  Description of Artificial Sequence: Synthetic oligonucleotide
tgagcctgtgcaaaaccaatggcctatgtctg

SEQ ID NO: 309263 - DNA, 31 bp, Artificial Sequence
  Description of Artificial Sequence: Synthetic oligonucleotide
gagcctgtgcaaaaccaatggcctatgtctg

SEQ ID NO: 309264 - DNA, 31 bp, Artificial Sequence
  Description of Artificial Sequence: Synthetic oligonucleotide
agcctgtgcaaaaccaatggcctatgtctgg

SEQ ID NO: 309265 - DNA, 30 bp, Artificial Sequence
  Description of Artificial Sequence: Synthetic oligonucleotide
gcctgtgcaaaaccaatggcctatgtctgg

SEQ ID NO: 309266 - DNA, 30 bp, Artificial Sequence
  Description of Artificial Sequence: Synthetic oligonucleotide
cctgtgcaaaaccaatggcctatgtctggc

SEQ ID NO: 309267 - DNA, 30 bp, Artificial Sequence
  Description of Artificial Sequence: Synthetic oligonucleotide
ctgtgcaaaaccaatggcctatgtctggcc

SEQ ID NO: 309268 - DNA, 31 bp, Artificial Sequence
  Description of Artificial Sequence: Synthetic oligonucleotide
tgtgcaaaaccaatggcctatgtctggccac

SEQ ID NO: 309269 - DNA, 30 bp, Artificial Sequence
  Description of Artificial Sequence: Synthetic oligonucleotide
gtgcaaaaccaatggcctatgtctggccac

SEQ ID NO: 309270 - DNA, 30 bp, Artificial Sequence
  Description of Artificial Sequence: Synthetic oligonucleotide
tgcaaaaccaatggcctatgtctggccacc

SEQ ID NO: 309271 - DNA, 29 bp, Artificial Sequence
  Description of Artificial Sequence: Synthetic oligonucleotide
gcaaaaccaatggcctatgtctggccacc

SEQ ID NO: 309272 - DNA, 29 bp, Artificial Sequence
  Description of Artificial Sequence: Synthetic oligonucleotide
caaaaccaatggcctatgtctggccaccc

SEQ ID NO: 309273 - DNA, 29 bp, Artificial Sequence
  Description of Artificial Sequence: Synthetic oligonucleotide
aaaaccaatggcctatgtctggccacccg

SEQ ID NO: 309274 - DNA, 28 bp, Artificial Sequence
  Description of Artificial Sequence: Synthetic oligonucleotide
aaaccaatggcctatgtctggccacccg

SEQ ID NO: 309275 - DNA, 27 bp, Artificial Sequence
  Description of Artificial Sequence: Synthetic oligonucleotide
aaccaatggcctatgtctggccacccg

SEQ ID NO: 309276 - DNA, 27 bp, Artificial Sequence
  Description of Artificial Sequence: Synthetic oligonucleotide
accaatggcctatgtctggccacccga

SEQ ID NO: 309277 - DNA, 26 bp, Artificial Sequence
  Description of Artificial Sequence: Synthetic oligonucleotide
ccaatggcctatgtctggccacccga

SEQ ID NO: 309278 - DNA, 27 bp, Artificial Sequence
  Description of Artificial Sequence: Synthetic oligonucleotide
caatggcctatgtctggccacccgagt

SEQ ID NO: 309279 - DNA, 28 bp, Artificial Sequence
  Description of Artificial Sequence: Synthetic oligonucleotide
aatggcctatgtctggccacccgagttc

SEQ ID NO: 309280 - DNA, 27 bp, Artificial Sequence
  Description of Artificial Sequence: Synthetic oligonucleotide
atggcctatgtctggccacccgagttc

SEQ ID NO: 309281 - DNA, 27 bp, Artificial Sequence
  Description of Artificial Sequence: Synthetic oligonucleotide
tggcctatgtctggccacccgagttca

SEQ ID NO: 309282 - DNA, 26 bp, Artificial Sequence
  Description of Artificial Sequence: Synthetic oligonucleotide
ggcctatgtctggccacccgagttca

SEQ ID NO: 309283 - DNA, 26 bp, Artificial Sequence
  Description of Artificial Sequence: Synthetic oligonucleotide
gcctatgtctggccacccgagttcag

SEQ ID NO: 309284 - DNA, 27 bp, Artificial Sequence
  Description of Artificial Sequence: Synthetic oligonucleotide
cctatgtctggccacccgagttcagct

SEQ ID NO: 309285 - DNA, 27 bp, Artificial Sequence
  Description of Artificial Sequence: Synthetic oligonucleotide
ctatgtctggccacccgagttcagctg

SEQ ID NO: 309286 - DNA, 27 bp, Artificial Sequence
  Description of Artificial Sequence: Synthetic oligonucleotide
tatgtctggccacccgagttcagctgc

SEQ ID NO: 309287 - DNA, 26 bp, Artificial Sequence
  Description of Artificial Sequence: Synthetic oligonucleotide
atgtctggccacccgagttcagctgc

SEQ ID NO: 309288 - DNA, 25 bp, Artificial Sequence
  Description of Artificial Sequence: Synthetic oligonucleotide
tgtctggccacccgagttcagctgc

SEQ ID NO: 309289 - DNA, 24 bp, Artificial Sequence
  Description of Artificial Sequence: Synthetic oligonucleotide
gtctggccacccgagttcagctgc

SEQ ID NO: 309290 - DNA, 24 bp, Artificial Sequence
  Description of Artificial Sequence: Synthetic oligonucleotide
tctggccacccgagttcagctgcg

SEQ ID NO: 309291 - DNA, 23 bp, Artificial Sequence
  Description of Artificial Sequence: Synthetic oligonucleotide
ctggccacccgagttcagctgcg

SEQ ID NO: 309292 - DNA, 23 bp, Artificial Sequence
  Description of Artificial Sequence: Synthetic oligonucleotide
tggccacccgagttcagctgcgg

SEQ ID NO: 309293 - DNA, 22 bp, Artificial Sequence
  Description of Artificial Sequence: Synthetic oligonucleotide
ggccacccgagttcagctgcgg

SEQ ID NO: 309294 - DNA, 23 bp, Artificial Sequence
  Description of Artificial Sequence: Synthetic oligonucleotide
gccacccgagttcagctgcgggt

SEQ ID NO: 309295 - DNA, 25 bp, Artificial Sequence
  Description of Artificial Sequence: Synthetic oligonucleotide
ccacccgagttcagctgcgggtgtt

SEQ ID NO: 309296 - DNA, 25 bp, Artificial Sequence
  Description of Artificial Sequence: Synthetic oligonucleotide
cacccgagttcagctgcgggtgttc

SEQ ID NO: 309297 - DNA, 25 bp, Artificial Sequence
  Description of Artificial Sequence: Synthetic oligonucleotide
acccgagttcagctgcgggtgttcg

SEQ ID NO: 309298 - DNA, 24 bp, Artificial Sequence
  Description of Artificial Sequence: Synthetic oligonucleotide
cccgagttcagctgcgggtgttcg

SEQ ID NO: 309299 - DNA, 24 bp, Artificial Sequence
  Description of Artificial Sequence: Synthetic oligonucleotide
ccgagttcagctgcgggtgttcgg

SEQ ID NO: 309300 - DNA, 24 bp, Artificial Sequence
  Description of Artificial Sequence: Synthetic oligonucleotide
cgagttcagctgcgggtgttcggc

SEQ ID NO: 309301 - DNA, 25 bp, Artificial Sequence
  Description of Artificial Sequence: Synthetic oligonucleotide
gagttcagctgcgggtgttcggcga

SEQ ID NO: 309302 - DNA, 27 bp, Artificial Sequence
  Description of Artificial Sequence: Synthetic oligonucleotide
agttcagctgcgggtgttcggcgagtt

SEQ ID NO: 309303 - DNA, 26 bp, Artificial Sequence
  Description of Artificial Sequence: Synthetic oligonucleotide
gttcagctgcgggtgttcggcgagtt

SEQ ID NO: 309304 - DNA, 26 bp, Artificial Sequence
  Description of Artificial Sequence: Synthetic oligonucleotide
ttcagctgcgggtgttcggcgagttc

SEQ ID NO: 309305 - DNA, 25 bp, Artificial Sequence
  Description of Artificial Sequence: Synthetic oligonucleotide
tcagctgcgggtgttcggcgagttc

SEQ ID NO: 309306 - DNA, 24 bp, Artificial Sequence
  Description of Artificial Sequence: Synthetic oligonucleotide
cagctgcgggtgttcggcgagttc

SEQ ID NO: 309307 - DNA, 25 bp, Artificial Sequence
  Description of Artificial Sequence: Synthetic oligonucleotide
agctgcgggtgttcggcgagttcct

SEQ ID NO: 309308 - DNA, 24 bp, Artificial Sequence
  Description of Artificial Sequence: Synthetic oligonucleotide
gctgcgggtgttcggcgagttcct

SEQ ID NO: 309309 - DNA, 24 bp, Artificial Sequence
  Description of Artificial Sequence: Synthetic oligonucleotide
ctgcgggtgttcggcgagttcctc

SEQ ID NO: 309310 - DNA, 25 bp, Artificial Sequence
  Description of Artificial Sequence: Synthetic oligonucleotide
tgcgggtgttcggcgagttcctcct

SEQ ID NO: 309311 - DNA, 24 bp, Artificial Sequence
  Description of Artificial Sequence: Synthetic oligonucleotide
gcgggtgttcggcgagttcctcct

SEQ ID NO: 309312 - DNA, 24 bp, Artificial Sequence
  Description of Artificial Sequence: Synthetic oligonucleotide
cgggtgttcggcgagttcctcctg

SEQ ID NO: 309313 - DNA, 25 bp, Artificial Sequence
  Description of Artificial Sequence: Synthetic oligonucleotide
gggtgttcggcgagttcctcctgca

SEQ ID NO: 309314 - DNA, 25 bp, Artificial Sequence
  Description of Artificial Sequence: Synthetic oligonucleotide
ggtgttcggcgagttcctcctgcac

SEQ ID NO: 309315 - DNA, 26 bp, Artificial Sequence
  Description of Artificial Sequence: Synthetic oligonucleotide
gtgttcggcgagttcctcctgcacct

SEQ ID NO: 309316 - DNA, 26 bp, Artificial Sequence
  Description of Artificial Sequence: Synthetic oligonucleotide
tgttcggcgagttcctcctgcacctg

SEQ ID NO: 309317 - DNA, 25 bp, Artificial Sequence
  Description of Artificial Sequence: Synthetic oligonucleotide
gttcggcgagttcctcctgcacctg

SEQ ID NO: 309318 - DNA, 25 bp, Artificial Sequence
  Description of Artificial Sequence: Synthetic oligonucleotide
ttcggcgagttcctcctgcacctgc

SEQ ID NO: 309319 - DNA, 24 bp, Artificial Sequence
  Description of Artificial Sequence: Synthetic oligonucleotide
tcggcgagttcctcctgcacctgc

SEQ ID NO: 309320 - DNA, 23 bp, Artificial Sequence
  Description of Artificial Sequence: Synthetic oligonucleotide
cggcgagttcctcctgcacctgc

SEQ ID NO: 309321 - DNA, 23 bp, Artificial Sequence
  Description of Artificial Sequence: Synthetic oligonucleotide
ggcgagttcctcctgcacctgcg

SEQ ID NO: 309322 - DNA, 23 bp, Artificial Sequence
  Description of Artificial Sequence: Synthetic oligonucleotide
gcgagttcctcctgcacctgcgc

SEQ ID NO: 309323 - DNA, 24 bp, Artificial Sequence
  Description of Artificial Sequence: Synthetic oligonucleotide
cgagttcctcctgcacctgcgcct

SEQ ID NO: 309324 - DNA, 24 bp, Artificial Sequence
  Description of Artificial Sequence: Synthetic oligonucleotide
gagttcctcctgcacctgcgcctg

SEQ ID NO: 309325 - DNA, 24 bp, Artificial Sequence
  Description of Artificial Sequence: Synthetic oligonucleotide
agttcctcctgcacctgcgcctgc

SEQ ID NO: 309326 - DNA, 23 bp, Artificial Sequence
  Description of Artificial Sequence: Synthetic oligonucleotide
gttcctcctgcacctgcgcctgc

SEQ ID NO: 309327 - DNA, 23 bp, Artificial Sequence
  Description of Artificial Sequence: Synthetic oligonucleotide
ttcctcctgcacctgcgcctgcc

SEQ ID NO: 309328 - DNA, 22 bp, Artificial Sequence
  Description of Artificial Sequence: Synthetic oligonucleotide
tcctcctgcacctgcgcctgcc

SEQ ID NO: 309329 - DNA, 21 bp, Artificial Sequence
  Description of Artificial Sequence: Synthetic oligonucleotide
cctcctgcacctgcgcctgcc

SEQ ID NO: 309330 - DNA, 23 bp, Artificial Sequence
  Description of Artificial Sequence: Synthetic oligonucleotide
ctcctgcacctgcgcctgccctt

SEQ ID NO: 309331 - DNA, 24 bp, Artificial Sequence
  Description of Artificial Sequence: Synthetic oligonucleotide
tcctgcacctgcgcctgcccttgt

SEQ ID NO: 309332 - DNA, 23 bp, Artificial Sequence
  Description of Artificial Sequence: Synthetic oligonucleotide
cctgcacctgcgcctgcccttgt

SEQ ID NO: 309333 - DNA, 24 bp, Artificial Sequence
  Description of Artificial Sequence: Synthetic oligonucleotide
ctgcacctgcgcctgcccttgtct

SEQ ID NO: 309334 - DNA, 25 bp, Artificial Sequence
  Description of Artificial Sequence: Synthetic oligonucleotide
tgcacctgcgcctgcccttgtctgt

SEQ ID NO: 309335 - DNA, 24 bp, Artificial Sequence
  Description of Artificial Sequence: Synthetic oligonucleotide
gcacctgcgcctgcccttgtctgt

SEQ ID NO: 309336 - DNA, 24 bp, Artificial Sequence
  Description of Artificial Sequence: Synthetic oligonucleotide
cacctgcgcctgcccttgtctgtc

SEQ ID NO: 309337 - DNA, 24 bp, Artificial Sequence
  Description of Artificial Sequence: Synthetic oligonucleotide
acctgcgcctgcccttgtctgtcc

SEQ ID NO: 309338 - DNA, 23 bp, Artificial Sequence
  Description of Artificial Sequence: Synthetic oligonucleotide
cctgcgcctgcccttgtctgtcc

SEQ ID NO: 309339 - DNA, 23 bp, Artificial Sequence
  Description of Artificial Sequence: Synthetic oligonucleotide
ctgcgcctgcccttgtctgtccc

SEQ ID NO: 309340 - DNA, 23 bp, Artificial Sequence
  Description of Artificial Sequence: Synthetic oligonucleotide
tgcgcctgcccttgtctgtcccc

SEQ ID NO: 309341 - DNA, 22 bp, Artificial Sequence
  Description of Artificial Sequence: Synthetic oligonucleotide
gcgcctgcccttgtctgtcccc

SEQ ID NO: 309342 - DNA, 22 bp, Artificial Sequence
  Description of Artificial Sequence: Synthetic oligonucleotide
cgcctgcccttgtctgtccccc

SEQ ID NO: 309343 - DNA, 22 bp, Artificial Sequence
  Description of Artificial Sequence: Synthetic oligonucleotide
gcctgcccttgtctgtcccccg

SEQ ID NO: 309344 - DNA, 25 bp, Artificial Sequence
  Description of Artificial Sequence: Synthetic oligonucleotide
cctgcccttgtctgtcccccgcttt

SEQ ID NO: 309345 - DNA, 26 bp, Artificial Sequence
  Description of Artificial Sequence: Synthetic oligonucleotide
ctgcccttgtctgtcccccgctttga

SEQ ID NO: 309346 - DNA, 26 bp, Artificial Sequence
  Description of Artificial Sequence: Synthetic oligonucleotide
tgcccttgtctgtcccccgctttgac

SEQ ID NO: 309347 - DNA, 25 bp, Artificial Sequence
  Description of Artificial Sequence: Synthetic oligonucleotide
gcccttgtctgtcccccgctttgac

SEQ ID NO: 309348 - DNA, 26 bp, Artificial Sequence
  Description of Artificial Sequence: Synthetic oligonucleotide
cccttgtctgtcccccgctttgacca

SEQ ID NO: 309349 - DNA, 26 bp, Artificial Sequence
  Description of Artificial Sequence: Synthetic oligonucleotide
ccttgtctgtcccccgctttgaccag

SEQ ID NO: 309350 - DNA, 27 bp, Artificial Sequence
  Description of Artificial Sequence: Synthetic oligonucleotide
cttgtctgtcccccgctttgaccagct

SEQ ID NO: 309351 - DNA, 27 bp, Artificial Sequence
  Description of Artificial Sequence: Synthetic oligonucleotide
ttgtctgtcccccgctttgaccagctg

SEQ ID NO: 309352 - DNA, 26 bp, Artificial Sequence
  Description of Artificial Sequence: Synthetic oligonucleotide
tgtctgtcccccgctttgaccagctg

SEQ ID NO: 309353 - DNA, 25 bp, Artificial Sequence
  Description of Artificial Sequence: Synthetic oligonucleotide
gtctgtcccccgctttgaccagctg

SEQ ID NO: 309354 - DNA, 26 bp, Artificial Sequence
  Description of Artificial Sequence: Synthetic oligonucleotide
tctgtcccccgctttgaccagctgga

SEQ ID NO: 309355 - DNA, 25 bp, Artificial Sequence
  Description of Artificial Sequence: Synthetic oligonucleotide
ctgtcccccgctttgaccagctgga

SEQ ID NO: 309356 - DNA, 25 bp, Artificial Sequence
  Description of Artificial Sequence: Synthetic oligonucleotide
tgtcccccgctttgaccagctggag

SEQ ID NO: 309357 - DNA, 24 bp, Artificial Sequence
  Description of Artificial Sequence: Synthetic oligonucleotide
gtcccccgctttgaccagctggag

SEQ ID NO: 309358 - DNA, 25 bp, Artificial Sequence
  Description of Artificial Sequence: Synthetic oligonucleotide
tcccccgctttgaccagctggaggt

SEQ ID NO: 309359 - DNA, 24 bp, Artificial Sequence
  Description of Artificial Sequence: Synthetic oligonucleotide
cccccgctttgaccagctggaggt

SEQ ID NO: 309360 - DNA, 24 bp, Artificial Sequence
  Description of Artificial Sequence: Synthetic oligonucleotide
ccccgctttgaccagctggaggtg

SEQ ID NO: 309361 - DNA, 24 bp, Artificial Sequence
  Description of Artificial Sequence: Synthetic oligonucleotide
cccgctttgaccagctggaggtgc

SEQ ID NO: 309362 - DNA, 24 bp, Artificial Sequence
  Description of Artificial Sequence: Synthetic oligonucleotide
ccgctttgaccagctggaggtgcg

SEQ ID NO: 309363 - DNA, 24 bp, Artificial Sequence
  Description of Artificial Sequence: Synthetic oligonucleotide
cgctttgaccagctggaggtgcgg

SEQ ID NO: 309364 - DNA, 24 bp, Artificial Sequence
  Description of Artificial Sequence: Synthetic oligonucleotide
gctttgaccagctggaggtgcggc

SEQ ID NO: 309365 - DNA, 25 bp, Artificial Sequence
  Description of Artificial Sequence: Synthetic oligonucleotide
ctttgaccagctggaggtgcggcct

SEQ ID NO: 309366 - DNA, 26 bp, Artificial Sequence
  Description of Artificial Sequence: Synthetic oligonucleotide
tttgaccagctggaggtgcggcctga

SEQ ID NO: 309367 - DNA, 25 bp, Artificial Sequence
  Description of Artificial Sequence: Synthetic oligonucleotide
ttgaccagctggaggtgcggcctga

SEQ ID NO: 309368 - DNA, 24 bp, Artificial Sequence
  Description of Artificial Sequence: Synthetic oligonucleotide
tgaccagctggaggtgcggcctga

SEQ ID NO: 309369 - DNA, 23 bp, Artificial Sequence
  Description of Artificial Sequence: Synthetic oligonucleotide
gaccagctggaggtgcggcctga

SEQ ID NO: 309370 - DNA, 23 bp, Artificial Sequence
  Description of Artificial Sequence: Synthetic oligonucleotide
accagctggaggtgcggcctgac

SEQ ID NO: 309371 - DNA, 22 bp, Artificial Sequence
  Description of Artificial Sequence: Synthetic oligonucleotide
ccagctggaggtgcggcctgac

SEQ ID NO: 309372 - DNA, 23 bp, Artificial Sequence
  Description of Artificial Sequence: Synthetic oligonucleotide
cagctggaggtgcggcctgacct

SEQ ID NO: 309373 - DNA, 27 bp, Artificial Sequence
  Description of Artificial Sequence: Synthetic oligonucleotide
agctggaggtgcggcctgacctctata

SEQ ID NO: 309374 - DNA, 27 bp, Artificial Sequence
  Description of Artificial Sequence: Synthetic oligonucleotide
gctggaggtgcggcctgacctctataa

SEQ ID NO: 309375 - DNA, 27 bp, Artificial Sequence
  Description of Artificial Sequence: Synthetic oligonucleotide
ctggaggtgcggcctgacctctataag

SEQ ID NO: 309376 - DNA, 29 bp, Artificial Sequence
  Description of Artificial Sequence: Synthetic oligonucleotide
tggaggtgcggcctgacctctataagtac

SEQ ID NO: 309377 - DNA, 28 bp, Artificial Sequence
  Description of Artificial Sequence: Synthetic oligonucleotide
ggaggtgcggcctgacctctataagtac

SEQ ID NO: 309378 - DNA, 28 bp, Artificial Sequence
  Description of Artificial Sequence: Synthetic oligonucleotide
gaggtgcggcctgacctctataagtacc

SEQ ID NO: 309379 - DNA, 29 bp, Artificial Sequence
  Description of Artificial Sequence: Synthetic oligonucleotide
aggtgcggcctgacctctataagtacctg

SEQ ID NO: 309380 - DNA, 28 bp, Artificial Sequence
  Description of Artificial Sequence: Synthetic oligonucleotide
ggtgcggcctgacctctataagtacctg

SEQ ID NO: 309381 - DNA, 28 bp, Artificial Sequence
  Description of Artificial Sequence: Synthetic oligonucleotide
gtgcggcctgacctctataagtacctgg

SEQ ID NO: 309382 - DNA, 35 bp, Artificial Sequence
  Description of Artificial Sequence: Synthetic oligonucleotide
tgcggcctgacctctataagtacctggattaaaac

SEQ ID NO: 309383 - DNA, 34 bp, Artificial Sequence
  Description of Artificial Sequence: Synthetic oligonucleotide
gcggcctgacctctataagtacctggattaaaac

SEQ ID NO: 309384 - DNA, 34 bp, Artificial Sequence
  Description of Artificial Sequence: Synthetic oligonucleotide
cggcctgacctctataagtacctggattaaaacc

SEQ ID NO: 309385 - DNA, 35 bp, Artificial Sequence
  Description of Artificial Sequence: Synthetic oligonucleotide
ggcctgacctctataagtacctggattaaaacctg

SEQ ID NO: 309386 - DNA, 36 bp, Artificial Sequence
  Description of Artificial Sequence: Synthetic oligonucleotide
gcctgacctctataagtacctggattaaaacctgag

SEQ ID NO: 309387 - DNA, 37 bp, Artificial Sequence
  Description of Artificial Sequence: Synthetic oligonucleotide
cctgacctctataagtacctggattaaaacctgagtg

SEQ ID NO: 309388 - DNA, 38 bp, Artificial Sequence
  Description of Artificial Sequence: Synthetic oligonucleotide
ctgacctctataagtacctggattaaaacctgagtgtg

SEQ ID NO: 309389 - DNA, 39 bp, Artificial Sequence
  Description of Artificial Sequence: Synthetic oligonucleotide
tgacctctataagtacctggattaaaacctgagtgtgag

SEQ ID NO: 309390 - DNA, 38 bp, Artificial Sequence
  Description of Artificial Sequence: Synthetic oligonucleotide
gacctctataagtacctggattaaaacctgagtgtgag

SEQ ID NO: 309391 - DNA, 38 bp, Artificial Sequence
  Description of Artificial Sequence: Synthetic oligonucleotide
acctctataagtacctggattaaaacctgagtgtgagc

SEQ ID NO: 309392 - DNA, 37 bp, Artificial Sequence
  Description of Artificial Sequence: Synthetic oligonucleotide
cctctataagtacctggattaaaacctgagtgtgagc

SEQ ID NO: 309393 - DNA, 37 bp, Artificial Sequence
  Description of Artificial Sequence: Synthetic oligonucleotide
ctctataagtacctggattaaaacctgagtgtgagcg

SEQ ID NO: 309394 - DNA, 38 bp, Artificial Sequence
  Description of Artificial Sequence: Synthetic oligonucleotide
tctataagtacctggattaaaacctgagtgtgagcgtg

SEQ ID NO: 309395 - DNA, 37 bp, Artificial Sequence
  Description of Artificial Sequence: Synthetic oligonucleotide
ctataagtacctggattaaaacctgagtgtgagcgtg

SEQ ID NO: 309396 - DNA, 37 bp, Artificial Sequence
  Description of Artificial Sequence: Synthetic oligonucleotide
tataagtacctggattaaaacctgagtgtgagcgtgc

SEQ ID NO: 309397 - DNA, 36 bp, Artificial Sequence
  Description of Artificial Sequence: Synthetic oligonucleotide
ataagtacctggattaaaacctgagtgtgagcgtgc

SEQ ID NO: 309398 - DNA, 35 bp, Artificial Sequence
  Description of Artificial Sequence: Synthetic oligonucleotide
taagtacctggattaaaacctgagtgtgagcgtgc

SEQ ID NO: 309399 - DNA, 34 bp, Artificial Sequence
  Description of Artificial Sequence: Synthetic oligonucleotide
aagtacctggattaaaacctgagtgtgagcgtgc

SEQ ID NO: 309400 - DNA, 33 bp, Artificial Sequence
  Description of Artificial Sequence: Synthetic oligonucleotide
agtacctggattaaaacctgagtgtgagcgtgc

SEQ ID NO: 309401 - DNA, 32 bp, Artificial Sequence
  Description of Artificial Sequence: Synthetic oligonucleotide
gtacctggattaaaacctgagtgtgagcgtgc

SEQ ID NO: 309402 - DNA, 33 bp, Artificial Sequence
  Description of Artificial Sequence: Synthetic oligonucleotide
tacctggattaaaacctgagtgtgagcgtgcac

SEQ ID NO: 309403 - DNA, 32 bp, Artificial Sequence
  Description of Artificial Sequence: Synthetic oligonucleotide
acctggattaaaacctgagtgtgagcgtgcac

SEQ ID NO: 309404 - DNA, 31 bp, Artificial Sequence
  Description of Artificial Sequence: Synthetic oligonucleotide
cctggattaaaacctgagtgtgagcgtgcac

SEQ ID NO: 309405 - DNA, 31 bp, Artificial Sequence
  Description of Artificial Sequence: Synthetic oligonucleotide
ctggattaaaacctgagtgtgagcgtgcacg

SEQ ID NO: 309406 - DNA, 32 bp, Artificial Sequence
  Description of Artificial Sequence: Synthetic oligonucleotide
tggattaaaacctgagtgtgagcgtgcacgtg

SEQ ID NO: 309407 - DNA, 31 bp, Artificial Sequence
  Description of Artificial Sequence: Synthetic oligonucleotide
ggattaaaacctgagtgtgagcgtgcacgtg

SEQ ID NO: 309408 - DNA, 32 bp, Artificial Sequence
  Description of Artificial Sequence: Synthetic oligonucleotide
gattaaaacctgagtgtgagcgtgcacgtgtc

SEQ ID NO: 309409 - DNA, 32 bp, Artificial Sequence
  Description of Artificial Sequence: Synthetic oligonucleotide
attaaaacctgagtgtgagcgtgcacgtgtcc

SEQ ID NO: 309410 - DNA, 31 bp, Artificial Sequence
  Description of Artificial Sequence: Synthetic oligonucleotide
ttaaaacctgagtgtgagcgtgcacgtgtcc

SEQ ID NO: 309411 - DNA, 30 bp, Artificial Sequence
  Description of Artificial Sequence: Synthetic oligonucleotide
taaaacctgagtgtgagcgtgcacgtgtcc

SEQ ID NO: 309412 - DNA, 29 bp, Artificial Sequence
  Description of Artificial Sequence: Synthetic oligonucleotide
aaaacctgagtgtgagcgtgcacgtgtcc

SEQ ID NO: 309413 - DNA, 28 bp, Artificial Sequence
  Description of Artificial Sequence: Synthetic oligonucleotide
aaacctgagtgtgagcgtgcacgtgtcc

SEQ ID NO: 309414 - DNA, 27 bp, Artificial Sequence
  Description of Artificial Sequence: Synthetic oligonucleotide
aacctgagtgtgagcgtgcacgtgtcc

SEQ ID NO: 309415 - DNA, 26 bp, Artificial Sequence
  Description of Artificial Sequence: Synthetic oligonucleotide
acctgagtgtgagcgtgcacgtgtcc

SEQ ID NO: 309416 - DNA, 25 bp, Artificial Sequence
  Description of Artificial Sequence: Synthetic oligonucleotide
cctgagtgtgagcgtgcacgtgtcc

SEQ ID NO: 309417 - DNA, 25 bp, Artificial Sequence
  Description of Artificial Sequence: Synthetic oligonucleotide
ctgagtgtgagcgtgcacgtgtccg

SEQ ID NO: 309418 - DNA, 26 bp, Artificial Sequence
  Description of Artificial Sequence: Synthetic oligonucleotide
tgagtgtgagcgtgcacgtgtccgca

SEQ ID NO: 309419 - DNA, 25 bp, Artificial Sequence
  Description of Artificial Sequence: Synthetic oligonucleotide
gagtgtgagcgtgcacgtgtccgca

SEQ ID NO: 309420 - DNA, 26 bp, Artificial Sequence
  Description of Artificial Sequence: Synthetic oligonucleotide
agtgtgagcgtgcacgtgtccgcagt

SEQ ID NO: 309421 - DNA, 25 bp, Artificial Sequence
  Description of Artificial Sequence: Synthetic oligonucleotide
gtgtgagcgtgcacgtgtccgcagt

SEQ ID NO: 309422 - DNA, 25 bp, Artificial Sequence
  Description of Artificial Sequence: Synthetic oligonucleotide
tgtgagcgtgcacgtgtccgcagtg

SEQ ID NO: 309423 - DNA, 24 bp, Artificial Sequence
  Description of Artificial Sequence: Synthetic oligonucleotide
gtgagcgtgcacgtgtccgcagtg

SEQ ID NO: 309424 - DNA, 25 bp, Artificial Sequence
  Description of Artificial Sequence: Synthetic oligonucleotide
tgagcgtgcacgtgtccgcagtgga

SEQ ID NO: 309425 - DNA, 24 bp, Artificial Sequence
  Description of Artificial Sequence: Synthetic oligonucleotide
gagcgtgcacgtgtccgcagtgga

SEQ ID NO: 309426 - DNA, 24 bp, Artificial Sequence
  Description of Artificial Sequence: Synthetic oligonucleotide
agcgtgcacgtgtccgcagtggag

SEQ ID NO: 309427 - DNA, 23 bp, Artificial Sequence
  Description of Artificial Sequence: Synthetic oligonucleotide
gcgtgcacgtgtccgcagtggag

SEQ ID NO: 309428 - DNA, 23 bp, Artificial Sequence
  Description of Artificial Sequence: Synthetic oligonucleotide
cgtgcacgtgtccgcagtggagg

SEQ ID NO: 309429 - DNA, 23 bp, Artificial Sequence
  Description of Artificial Sequence: Synthetic oligonucleotide
gtgcacgtgtccgcagtggaggc

SEQ ID NO: 309430 - DNA, 23 bp, Artificial Sequence
  Description of Artificial Sequence: Synthetic oligonucleotide
tgcacgtgtccgcagtggaggcg

SEQ ID NO: 309431 - DNA, 22 bp, Artificial Sequence
  Description of Artificial Sequence: Synthetic oligonucleotide
gcacgtgtccgcagtggaggcg

SEQ ID NO: 309432 - DNA, 23 bp, Artificial Sequence
  Description of Artificial Sequence: Synthetic oligonucleotide
cacgtgtccgcagtggaggcgct

SEQ ID NO: 309433 - DNA, 24 bp, Artificial Sequence
  Description of Artificial Sequence: Synthetic oligonucleotide
acgtgtccgcagtggaggcgctgt

SEQ ID NO: 309434 - DNA, 23 bp, Artificial Sequence
  Description of Artificial Sequence: Synthetic oligonucleotide
cgtgtccgcagtggaggcgctgt

SEQ ID NO: 309435 - DNA, 23 bp, Artificial Sequence
  Description of Artificial Sequence: Synthetic oligonucleotide
gtgtccgcagtggaggcgctgtg

SEQ ID NO: 309436 - DNA, 23 bp, Artificial Sequence
  Description of Artificial Sequence: Synthetic oligonucleotide
tgtccgcagtggaggcgctgtgc

SEQ ID NO: 309437 - DNA, 22 bp, Artificial Sequence
  Description of Artificial Sequence: Synthetic oligonucleotide
gtccgcagtggaggcgctgtgc

SEQ ID NO: 309438 - DNA, 23 bp, Artificial Sequence
  Description of Artificial Sequence: Synthetic oligonucleotide
tccgcagtggaggcgctgtgcct

SEQ ID NO: 309439 - DNA, 22 bp, Artificial Sequence
  Description of Artificial Sequence: Synthetic oligonucleotide
ccgcagtggaggcgctgtgcct

SEQ ID NO: 309440 - DNA, 22 bp, Artificial Sequence
  Description of Artificial Sequence: Synthetic oligonucleotide
cgcagtggaggcgctgtgcctc

SEQ ID NO: 309441 - DNA, 22 bp, Artificial Sequence
  Description of Artificial Sequence: Synthetic oligonucleotide
gcagtggaggcgctgtgcctcg

SEQ ID NO: 309442 - DNA, 23 bp, Artificial Sequence
  Description of Artificial Sequence: Synthetic oligonucleotide
cagtggaggcgctgtgcctcgct

SEQ ID NO: 309443 - DNA, 23 bp, Artificial Sequence
  Description of Artificial Sequence: Synthetic oligonucleotide
agtggaggcgctgtgcctcgctg

SEQ ID NO: 309444 - DNA, 22 bp, Artificial Sequence
  Description of Artificial Sequence: Synthetic oligonucleotide
gtggaggcgctgtgcctcgctg

SEQ ID NO: 309445 - DNA, 22 bp, Artificial Sequence
  Description of Artificial Sequence: Synthetic oligonucleotide
tggaggcgctgtgcctcgctgg

SEQ ID NO: 309446 - DNA, 21 bp, Artificial Sequence
  Description of Artificial Sequence: Synthetic oligonucleotide
ggaggcgctgtgcctcgctgg

SEQ ID NO: 309447 - DNA, 21 bp, Artificial Sequence
  Description of Artificial Sequence: Synthetic oligonucleotide
gaggcgctgtgcctcgctggg

SEQ ID NO: 309448 - DNA, 21 bp, Artificial Sequence
  Description of Artificial Sequence: Synthetic oligonucleotide
aggcgctgtgcctcgctgggg

SEQ ID NO: 309449 - DNA, 20 bp, Artificial Sequence
  Description of Artificial Sequence: Synthetic oligonucleotide
ggcgctgtgcctcgctgggg

SEQ ID NO: 309450 - DNA, 20 bp, Artificial Sequence
  Description of Artificial Sequence: Synthetic oligonucleotide
gcgctgtgcctcgctggggg

SEQ ID NO: 309451 - DNA, 20 bp, Artificial Sequence
  Description of Artificial Sequence: Synthetic oligonucleotide
cgctgtgcctcgctgggggc

SEQ ID NO: 309452 - DNA, 20 bp, Artificial Sequence
  Description of Artificial Sequence: Synthetic oligonucleotide
gctgtgcctcgctgggggcc

SEQ ID NO: 309453 - DNA, 21 bp, Artificial Sequence
  Description of Artificial Sequence: Synthetic oligonucleotide
ctgtgcctcgctgggggccga

SEQ ID NO: 309454 - DNA, 21 bp, Artificial Sequence
  Description of Artificial Sequence: Synthetic oligonucleotide
tgtgcctcgctgggggccgag

SEQ ID NO: 309455 - DNA, 20 bp, Artificial Sequence
  Description of Artificial Sequence: Synthetic oligonucleotide
gtgcctcgctgggggccgag

SEQ ID NO: 309456 - DNA, 20 bp, Artificial Sequence
  Description of Artificial Sequence: Synthetic oligonucleotide
tgcctcgctgggggccgagg

SEQ ID NO: 309457 - DNA, 20 bp, Artificial Sequence
  Description of Artificial Sequence: Synthetic oligonucleotide
gcctcgctgggggccgaggt

SEQ ID NO: 309458 - DNA, 20 bp, Artificial Sequence
  Description of Artificial Sequence: Synthetic oligonucleotide
cctcgctgggggccgagggt

SEQ ID NO: 309459 - DNA, 20 bp, Artificial Sequence
  Description of Artificial Sequence: Synthetic oligonucleotide
ctcgctgggggccgagggct

SEQ ID NO: 309460 - DNA, 20 bp, Artificial Sequence
  Description of Artificial Sequence: Synthetic oligonucleotide
tcgctgggggccgagggctg

SEQ ID NO: 309461 - DNA, 20 bp, Artificial Sequence
  Description of Artificial Sequence: Synthetic oligonucleotide
cgctgggggccgagggctgt

SEQ ID NO: 309462 - DNA, 20 bp, Artificial Sequence
  Description of Artificial Sequence: Synthetic oligonucleotide
gctgggggccgagggctggt

SEQ ID NO: 309463 - DNA, 20 bp, Artificial Sequence
  Description of Artificial Sequence: Synthetic oligonucleotide
ctgggggccgagggctgggt

SEQ ID NO: 309464 - DNA, 20 bp, Artificial Sequence
  Description of Artificial Sequence: Synthetic oligonucleotide
tgggggccgagggctgggct

SEQ ID NO: 309465 - DNA, 20 bp, Artificial Sequence
  Description of Artificial Sequence: Synthetic oligonucleotide
gggggccgagggctgggctt

SEQ ID NO: 309466 - DNA, 20 bp, Artificial Sequence
  Description of Artificial Sequence: Synthetic oligonucleotide
ggggccgagggctgggccat

SEQ ID NO: 309467 - DNA, 20 bp, Artificial Sequence
  Description of Artificial Sequence: Synthetic oligonucleotide
gggccgagggctgggccagt

SEQ ID NO: 309468 - DNA, 20 bp, Artificial Sequence
  Description of Artificial Sequence: Synthetic oligonucleotide
ggccgagggctgggccagca

SEQ ID NO: 309469 - DNA, 20 bp, Artificial Sequence
  Description of Artificial Sequence: Synthetic oligonucleotide
gccgagggctgggccagcag

SEQ ID NO: 309470 - DNA, 21 bp, Artificial Sequence
  Description of Artificial Sequence: Synthetic oligonucleotide
ccgagggctgggccagcaggt

SEQ ID NO: 309471 - DNA, 21 bp, Artificial Sequence
  Description of Artificial Sequence: Synthetic oligonucleotide
cgagggctgggccagcaggtc

SEQ ID NO: 309472 - DNA, 22 bp, Artificial Sequence
  Description of Artificial Sequence: Synthetic oligonucleotide
gagggctgggccagcaggtcct

SEQ ID NO: 309473 - DNA, 22 bp, Artificial Sequence
  Description of Artificial Sequence: Synthetic oligonucleotide
agggctgggccagcaggtcctg

SEQ ID NO: 309474 - DNA, 21 bp, Artificial Sequence
  Description of Artificial Sequence: Synthetic oligonucleotide
gggctgggccagcaggtcctg

SEQ ID NO: 309475 - DNA, 22 bp, Artificial Sequence
  Description of Artificial Sequence: Synthetic oligonucleotide
ggctgggccagcaggtcctggt

SEQ ID NO: 309476 - DNA, 22 bp, Artificial Sequence
  Description of Artificial Sequence: Synthetic oligonucleotide
gctgggccagcaggtcctggtg

SEQ ID NO: 309477 - DNA, 22 bp, Artificial Sequence
  Description of Artificial Sequence: Synthetic oligonucleotide
ctgggccagcaggtcctggtgc

SEQ ID NO: 309478 - DNA, 23 bp, Artificial Sequence
  Description of Artificial Sequence: Synthetic oligonucleotide
tgggccagcaggtcctggtgcct

SEQ ID NO: 309479 - DNA, 22 bp, Artificial Sequence
  Description of Artificial Sequence: Synthetic oligonucleotide
gggccagcaggtcctggtgcct

SEQ ID NO: 309480 - DNA, 22 bp, Artificial Sequence
  Description of Artificial Sequence: Synthetic oligonucleotide
ggccagcaggtcctggtgcctc

SEQ ID NO: 309481 - DNA, 22 bp, Artificial Sequence
  Description of Artificial Sequence: Synthetic oligonucleotide
gccagcaggtcctggtgcctcc

SEQ ID NO: 309482 - DNA, 22 bp, Artificial Sequence
  Description of Artificial Sequence: Synthetic oligonucleotide
ccagcaggtcctggtgcctccg

SEQ ID NO: 309483 - DNA, 22 bp, Artificial Sequence
  Description of Artificial Sequence: Synthetic oligonucleotide
cagcaggtcctggtgcctccgg

SEQ ID NO: 309484 - DNA, 22 bp, Artificial Sequence
  Description of Artificial Sequence: Synthetic oligonucleotide
agcaggtcctggtgcctccggg

SEQ ID NO: 309485 - DNA, 21 bp, Artificial Sequence
  Description of Artificial Sequence: Synthetic oligonucleotide
gcaggtcctggtgcctccggg

SEQ ID NO: 309486 - DNA, 22 bp, Artificial Sequence
  Description of Artificial Sequence: Synthetic oligonucleotide
caggtcctggtgcctccgggct

SEQ ID NO: 309487 - DNA, 23 bp, Artificial Sequence
  Description of Artificial Sequence: Synthetic oligonucleotide
aggtcctggtgcctccgggctct

SEQ ID NO: 309488 - DNA, 22 bp, Artificial Sequence
  Description of Artificial Sequence: Synthetic oligonucleotide
ggtcctggtgcctccgggctct

SEQ ID NO: 309489 - DNA, 22 bp, Artificial Sequence
  Description of Artificial Sequence: Synthetic oligonucleotide
gtcctggtgcctccgggctctg

SEQ ID NO: 309490 - DNA, 22 bp, Artificial Sequence
  Description of Artificial Sequence: Synthetic oligonucleotide
tcctggtgcctccgggctctgg

SEQ ID NO: 309491 - DNA, 21 bp, Artificial Sequence
  Description of Artificial Sequence: Synthetic oligonucleotide
cctggtgcctccgggctctgg

SEQ ID NO: 309492 - DNA, 21 bp, Artificial Sequence
  Description of Artificial Sequence: Synthetic oligonucleotide
ctggtgcctccgggctctggc

SEQ ID NO: 309493 - DNA, 21 bp, Artificial Sequence
  Description of Artificial Sequence: Synthetic oligonucleotide
tggtgcctccgggctctggcc

SEQ ID NO: 309494 - DNA, 20 bp, Artificial Sequence
  Description of Artificial Sequence: Synthetic oligonucleotide
ggtgcctccgggctctggcc

SEQ ID NO: 309495 - DNA, 20 bp, Artificial Sequence
  Description of Artificial Sequence: Synthetic oligonucleotide
gtgcctccgggctctggccg

SEQ ID NO: 309496 - DNA, 20 bp, Artificial Sequence
  Description of Artificial Sequence: Synthetic oligonucleotide
tgcctccgggctctggccgg

SEQ ID NO: 309497 - DNA, 20 bp, Artificial Sequence
  Description of Artificial Sequence: Synthetic oligonucleotide
gcctccgggctctggccggt

SEQ ID NO: 309498 - DNA, 20 bp, Artificial Sequence
  Description of Artificial Sequence: Synthetic oligonucleotide
cctccgggctctggccggct

SEQ ID NO: 309499 - DNA, 20 bp, Artificial Sequence
  Description of Artificial Sequence: Synthetic oligonucleotide
ctccgggctctggccggcct

SEQ ID NO: 309500 - DNA, 22 bp, Artificial Sequence
  Description of Artificial Sequence: Synthetic oligonucleotide
tccgggctctggccggcctgta

SEQ ID NO: 309501 - DNA, 21 bp, Artificial Sequence
  Description of Artificial Sequence: Synthetic oligonucleotide
ccgggctctggccggcctgta

SEQ ID NO: 309502 - DNA, 21 bp, Artificial Sequence
  Description of Artificial Sequence: Synthetic oligonucleotide
cgggctctggccggcctgtag

SEQ ID NO: 309503 - DNA, 21 bp, Artificial Sequence
  Description of Artificial Sequence: Synthetic oligonucleotide
gggctctggccggcctgtagc

SEQ ID NO: 309504 - DNA, 23 bp, Artificial Sequence
  Description of Artificial Sequence: Synthetic oligonucleotide
ggctctggccggcctgtagcctt

SEQ ID NO: 309505 - DNA, 24 bp, Artificial Sequence
  Description of Artificial Sequence: Synthetic oligonucleotide
gctctggccggcctgtagccttct

SEQ ID NO: 309506 - DNA, 25 bp, Artificial Sequence
  Description of Artificial Sequence: Synthetic oligonucleotide
ctctggccggcctgtagccttctct

SEQ ID NO: 309507 - DNA, 26 bp, Artificial Sequence
  Description of Artificial Sequence: Synthetic oligonucleotide
tctggccggcctgtagccttctctct

SEQ ID NO: 309508 - DNA, 25 bp, Artificial Sequence
  Description of Artificial Sequence: Synthetic oligonucleotide
ctggccggcctgtagccttctctct

SEQ ID NO: 309509 - DNA, 25 bp, Artificial Sequence
  Description of Artificial Sequence: Synthetic oligonucleotide
tggccggcctgtagccttctctctg

SEQ ID NO: 309510 - DNA, 24 bp, Artificial Sequence
  Description of Artificial Sequence: Synthetic oligonucleotide
ggccggcctgtagccttctctctg

SEQ ID NO: 309511 - DNA, 25 bp, Artificial Sequence
  Description of Artificial Sequence: Synthetic oligonucleotide
gccggcctgtagccttctctctggt

SEQ ID NO: 309512 - DNA, 25 bp, Artificial Sequence
  Description of Artificial Sequence: Synthetic oligonucleotide
ccggcctgtagccttctctctggtg

SEQ ID NO: 309513 - DNA, 25 bp, Artificial Sequence
  Description of Artificial Sequence: Synthetic oligonucleotide
cggcctgtagccttctctctggtgc

SEQ ID NO: 309514 - DNA, 25 bp, Artificial Sequence
  Description of Artificial Sequence: Synthetic oligonucleotide
ggcctgtagccttctctctggtgcc

SEQ ID NO: 309515 - DNA, 26 bp, Artificial Sequence
  Description of Artificial Sequence: Synthetic oligonucleotide
gcctgtagccttctctctggtgccca

SEQ ID NO: 309516 - DNA, 26 bp, Artificial Sequence
  Description of Artificial Sequence: Synthetic oligonucleotide
cctgtagccttctctctggtgcccag

SEQ ID NO: 309517 - DNA, 26 bp, Artificial Sequence
  Description of Artificial Sequence: Synthetic oligonucleotide
ctgtagccttctctctggtgcccagg

SEQ ID NO: 309518 - DNA, 26 bp, Artificial Sequence
  Description of Artificial Sequence: Synthetic oligonucleotide
tgtagccttctctctggtgcccaggg

SEQ ID NO: 309519 - DNA, 25 bp, Artificial Sequence
  Description of Artificial Sequence: Synthetic oligonucleotide
gtagccttctctctggtgcccaggg

SEQ ID NO: 309520 - DNA, 26 bp, Artificial Sequence
  Description of Artificial Sequence: Synthetic oligonucleotide
tagccttctctctggtgcccagggca

SEQ ID NO: 309521 - DNA, 25 bp, Artificial Sequence
  Description of Artificial Sequence: Synthetic oligonucleotide
agccttctctctggtgcccagggca

SEQ ID NO: 309522 - DNA, 24 bp, Artificial Sequence
  Description of Artificial Sequence: Synthetic oligonucleotide
gccttctctctggtgcccagggca

SEQ ID NO: 309523 - DNA, 24 bp, Artificial Sequence
  Description of Artificial Sequence: Synthetic oligonucleotide
ccttctctctggtgcccagggcag

SEQ ID NO: 309524 - DNA, 24 bp, Artificial Sequence
  Description of Artificial Sequence: Synthetic oligonucleotide
cttctctctggtgcccagggcagc

SEQ ID NO: 309525 - DNA, 25 bp, Artificial Sequence
  Description of Artificial Sequence: Synthetic oligonucleotide
ttctctctggtgcccagggcagcca

SEQ ID NO: 309526 - DNA, 24 bp, Artificial Sequence
  Description of Artificial Sequence: Synthetic oligonucleotide
tctctctggtgcccagggcagcca

SEQ ID NO: 309527 - DNA, 23 bp, Artificial Sequence
  Description of Artificial Sequence: Synthetic oligonucleotide
ctctctggtgcccagggcagcca

SEQ ID NO: 309528 - DNA, 23 bp, Artificial Sequence
  Description of Artificial Sequence: Synthetic oligonucleotide
tctctggtgcccagggcagccac

SEQ ID NO: 309529 - DNA, 22 bp, Artificial Sequence
  Description of Artificial Sequence: Synthetic oligonucleotide
ctctggtgcccagggcagccac

SEQ ID NO: 309530 - DNA, 22 bp, Artificial Sequence
  Description of Artificial Sequence: Synthetic oligonucleotide
tctggtgcccagggcagccacg

SEQ ID NO: 309531 - DNA, 21 bp, Artificial Sequence
  Description of Artificial Sequence: Synthetic oligonucleotide
ctggtgcccagggcagccacg

SEQ ID NO: 309532 - DNA, 21 bp, Artificial Sequence
  Description of Artificial Sequence: Synthetic oligonucleotide
tggtgcccagggcagccacgg

SEQ ID NO: 309533 - DNA, 20 bp, Artificial Sequence
  Description of Artificial Sequence: Synthetic oligonucleotide
ggtgcccagggcagccacgg

SEQ ID NO: 309534 - DNA, 21 bp, Artificial Sequence
  Description of Artificial Sequence: Synthetic oligonucleotide
gtgcccagggcagccacggct

SEQ ID NO: 309535 - DNA, 22 bp, Artificial Sequence
  Description of Artificial Sequence: Synthetic oligonucleotide
tgcccagggcagccacggctgt

SEQ ID NO: 309536 - DNA, 21 bp, Artificial Sequence
  Description of Artificial Sequence: Synthetic oligonucleotide
gcccagggcagccacggctgt

SEQ ID NO: 309537 - DNA, 22 bp, Artificial Sequence
  Description of Artificial Sequence: Synthetic oligonucleotide
cccagggcagccacggctgtgt

SEQ ID NO: 309538 - DNA, 23 bp, Artificial Sequence
  Description of Artificial Sequence: Synthetic oligonucleotide
ccagggcagccacggctgtgtct

SEQ ID NO: 309539 - DNA, 24 bp, Artificial Sequence
  Description of Artificial Sequence: Synthetic oligonucleotide
cagggcagccacggctgtgtctgt

SEQ ID NO: 309540 - DNA, 26 bp, Artificial Sequence
  Description of Artificial Sequence: Synthetic oligonucleotide
agggcagccacggctgtgtctgtgaa

SEQ ID NO: 309541 - DNA, 25 bp, Artificial Sequence
  Description of Artificial Sequence: Synthetic oligonucleotide
gggcagccacggctgtgtctgtgaa

SEQ ID NO: 309542 - DNA, 25 bp, Artificial Sequence
  Description of Artificial Sequence: Synthetic oligonucleotide
ggcagccacggctgtgtctgtgaag

SEQ ID NO: 309543 - DNA, 26 bp, Artificial Sequence
  Description of Artificial Sequence: Synthetic oligonucleotide
gcagccacggctgtgtctgtgaaggt

SEQ ID NO: 309544 - DNA, 26 bp, Artificial Sequence
  Description of Artificial Sequence: Synthetic oligonucleotide
cagccacggctgtgtctgtgaaggtg

SEQ ID NO: 309545 - DNA, 27 bp, Artificial Sequence
  Description of Artificial Sequence: Synthetic oligonucleotide
agccacggctgtgtctgtgaaggtgga

SEQ ID NO: 309546 - DNA, 26 bp, Artificial Sequence
  Description of Artificial Sequence: Synthetic oligonucleotide
gccacggctgtgtctgtgaaggtgga

SEQ ID NO: 309547 - DNA, 26 bp, Artificial Sequence
  Description of Artificial Sequence: Synthetic oligonucleotide
ccacggctgtgtctgtgaaggtggag

SEQ ID NO: 309548 - DNA, 26 bp, Artificial Sequence
  Description of Artificial Sequence: Synthetic oligonucleotide
cacggctgtgtctgtgaaggtggagg

SEQ ID NO: 309549 - DNA, 27 bp, Artificial Sequence
  Description of Artificial Sequence: Synthetic oligonucleotide
acggctgtgtctgtgaaggtggaggct

SEQ ID NO: 309550 - DNA, 26 bp, Artificial Sequence
  Description of Artificial Sequence: Synthetic oligonucleotide
cggctgtgtctgtgaaggtggaggct

SEQ ID NO: 309551 - DNA, 26 bp, Artificial Sequence
  Description of Artificial Sequence: Synthetic oligonucleotide
ggctgtgtctgtgaaggtggaggctc

SEQ ID NO: 309552 - DNA, 27 bp, Artificial Sequence
  Description of Artificial Sequence: Synthetic oligonucleotide
gctgtgtctgtgaaggtggaggctcga

SEQ ID NO: 309553 - DNA, 27 bp, Artificial Sequence
  Description of Artificial Sequence: Synthetic oligonucleotide
ctgtgtctgtgaaggtggaggctcgag

SEQ ID NO: 309554 - DNA, 27 bp, Artificial Sequence
  Description of Artificial Sequence: Synthetic oligonucleotide
tgtgtctgtgaaggtggaggctcgagg

SEQ ID NO: 309555 - DNA, 26 bp, Artificial Sequence
  Description of Artificial Sequence: Synthetic oligonucleotide
gtgtctgtgaaggtggaggctcgagg

SEQ ID NO: 309556 - DNA, 27 bp, Artificial Sequence
  Description of Artificial Sequence: Synthetic oligonucleotide
tgtctgtgaaggtggaggctcgaggct

SEQ ID NO: 309557 - DNA, 26 bp, Artificial Sequence
  Description of Artificial Sequence: Synthetic oligonucleotide
gtctgtgaaggtggaggctcgaggct

SEQ ID NO: 309558 - DNA, 26 bp, Artificial Sequence
  Description of Artificial Sequence: Synthetic oligonucleotide
tctgtgaaggtggaggctcgaggctc

SEQ ID NO: 309559 - DNA, 25 bp, Artificial Sequence
  Description of Artificial Sequence: Synthetic oligonucleotide
ctgtgaaggtggaggctcgaggctc

SEQ ID NO: 309560 - DNA, 27 bp, Artificial Sequence
  Description of Artificial Sequence: Synthetic oligonucleotide
tgtgaaggtggaggctcgaggctcctt

SEQ ID NO: 309561 - DNA, 26 bp, Artificial Sequence
  Description of Artificial Sequence: Synthetic oligonucleotide
gtgaaggtggaggctcgaggctcctt

SEQ ID NO: 309562 - DNA, 26 bp, Artificial Sequence
  Description of Artificial Sequence: Synthetic oligonucleotide
tgaaggtggaggctcgaggctccttc

SEQ ID NO: 309563 - DNA, 25 bp, Artificial Sequence
  Description of Artificial Sequence: Synthetic oligonucleotide
gaaggtggaggctcgaggctccttc

SEQ ID NO: 309564 - DNA, 27 bp, Artificial Sequence
  Description of Artificial Sequence: Synthetic oligonucleotide
aaggtggaggctcgaggctccttcgaa

SEQ ID NO: 309565 - DNA, 27 bp, Artificial Sequence
  Description of Artificial Sequence: Synthetic oligonucleotide
aggtggaggctcgaggctccttcgaaa

SEQ ID NO: 309566 - DNA, 27 bp, Artificial Sequence
  Description of Artificial Sequence: Synthetic oligonucleotide
ggtggaggctcgaggctccttcgaaat

SEQ ID NO: 309567 - DNA, 27 bp, Artificial Sequence
  Description of Artificial Sequence: Synthetic oligonucleotide
gtggaggctcgaggctccttcgaaatc

SEQ ID NO: 309568 - DNA, 27 bp, Artificial Sequence
  Description of Artificial Sequence: Synthetic oligonucleotide
tggaggctcgaggctccttcgaaatcc

SEQ ID NO: 309569 - DNA, 26 bp, Artificial Sequence
  Description of Artificial Sequence: Synthetic oligonucleotide
ggaggctcgaggctccttcgaaatcc

SEQ ID NO: 309570 - DNA, 27 bp, Artificial Sequence
  Description of Artificial Sequence: Synthetic oligonucleotide
gaggctcgaggctccttcgaaatccct

SEQ ID NO: 309571 - DNA, 27 bp, Artificial Sequence
  Description of Artificial Sequence: Synthetic oligonucleotide
aggctcgaggctccttcgaaatccctg

SEQ ID NO: 309572 - DNA, 27 bp, Artificial Sequence
  Description of Artificial Sequence: Synthetic oligonucleotide
ggctcgaggctccttcgaaatccctgt

SEQ ID NO: 309573 - DNA, 27 bp, Artificial Sequence
  Description of Artificial Sequence: Synthetic oligonucleotide
gctcgaggctccttcgaaatccctgtg

SEQ ID NO: 309574 - DNA, 27 bp, Artificial Sequence
  Description of Artificial Sequence: Synthetic oligonucleotide
ctcgaggctccttcgaaatccctgtgg

SEQ ID NO: 309575 - DNA, 27 bp, Artificial Sequence
  Description of Artificial Sequence: Synthetic oligonucleotide
tcgaggctccttcgaaatccctgtggc

SEQ ID NO: 309576 - DNA, 27 bp, Artificial Sequence
  Description of Artificial Sequence: Synthetic oligonucleotide
cgaggctccttcgaaatccctgtggca

SEQ ID NO: 309577 - DNA, 27 bp, Artificial Sequence
  Description of Artificial Sequence: Synthetic oligonucleotide
gaggctccttcgaaatccctgtggcag

SEQ ID NO: 309578 - DNA, 29 bp, Artificial Sequence
  Description of Artificial Sequence: Synthetic oligonucleotide
aggctccttcgaaatccctgtggcagatg

SEQ ID NO: 309579 - DNA, 28 bp, Artificial Sequence
  Description of Artificial Sequence: Synthetic oligonucleotide
ggctccttcgaaatccctgtggcagatg

SEQ ID NO: 309580 - DNA, 28 bp, Artificial Sequence
  Description of Artificial Sequence: Synthetic oligonucleotide
gctccttcgaaatccctgtggcagatgc

SEQ ID NO: 309581 - DNA, 28 bp, Artificial Sequence
  Description of Artificial Sequence: Synthetic oligonucleotide
ctccttcgaaatccctgtggcagatgcg

SEQ ID NO: 309582 - DNA, 28 bp, Artificial Sequence
  Description of Artificial Sequence: Synthetic oligonucleotide
tccttcgaaatccctgtggcagatgcgg

SEQ ID NO: 309583 - DNA, 27 bp, Artificial Sequence
  Description of Artificial Sequence: Synthetic oligonucleotide
ccttcgaaatccctgtggcagatgcgg

SEQ ID NO: 309584 - DNA, 28 bp, Artificial Sequence
  Description of Artificial Sequence: Synthetic oligonucleotide
cttcgaaatccctgtggcagatgcggtc

SEQ ID NO: 309585 - DNA, 29 bp, Artificial Sequence
  Description of Artificial Sequence: Synthetic oligonucleotide
ttcgaaatccctgtggcagatgcggtctc

SEQ ID NO: 309586 - DNA, 28 bp, Artificial Sequence
  Description of Artificial Sequence: Synthetic oligonucleotide
tcgaaatccctgtggcagatgcggtctc

SEQ ID NO: 309587 - DNA, 27 bp, Artificial Sequence
  Description of Artificial Sequence: Synthetic oligonucleotide
cgaaatccctgtggcagatgcggtctc

SEQ ID NO: 309588 - DNA, 27 bp, Artificial Sequence
  Description of Artificial Sequence: Synthetic oligonucleotide
gaaatccctgtggcagatgcggtctcc

SEQ ID NO: 309589 - DNA, 29 bp, Artificial Sequence
  Description of Artificial Sequence: Synthetic oligonucleotide
aaatccctgtggcagatgcggtctccaag

SEQ ID NO: 309590 - DNA, 28 bp, Artificial Sequence
  Description of Artificial Sequence: Synthetic oligonucleotide
aatccctgtggcagatgcggtctccaag

SEQ ID NO: 309591 - DNA, 27 bp, Artificial Sequence
  Description of Artificial Sequence: Synthetic oligonucleotide
atccctgtggcagatgcggtctccaag

SEQ ID NO: 309592 - DNA, 26 bp, Artificial Sequence
  Description of Artificial Sequence: Synthetic oligonucleotide
tccctgtggcagatgcggtctccaag

SEQ ID NO: 309593 - DNA, 25 bp, Artificial Sequence
  Description of Artificial Sequence: Synthetic oligonucleotide
ccctgtggcagatgcggtctccaag

SEQ ID NO: 309594 - DNA, 27 bp, Artificial Sequence
  Description of Artificial Sequence: Synthetic oligonucleotide
cctgtggcagatgcggtctccaaggtt

SEQ ID NO: 309595 - DNA, 27 bp, Artificial Sequence
  Description of Artificial Sequence: Synthetic oligonucleotide
ctgtggcagatgcggtctccaaggttg

SEQ ID NO: 309596 - DNA, 28 bp, Artificial Sequence
  Description of Artificial Sequence: Synthetic oligonucleotide
tgtggcagatgcggtctccaaggttgtg

SEQ ID NO: 309597 - DNA, 27 bp, Artificial Sequence
  Description of Artificial Sequence: Synthetic oligonucleotide
gtggcagatgcggtctccaaggttgtg

SEQ ID NO: 309598 - DNA, 27 bp, Artificial Sequence
  Description of Artificial Sequence: Synthetic oligonucleotide
tggcagatgcggtctccaaggttgtgc

SEQ ID NO: 309599 - DNA, 27 bp, Artificial Sequence
  Description of Artificial Sequence: Synthetic oligonucleotide
ggcagatgcggtctccaaggttgtgca

SEQ ID NO: 309600 - DNA, 27 bp, Artificial Sequence
  Description of Artificial Sequence: Synthetic oligonucleotide
gcagatgcggtctccaaggttgtgcag

SEQ ID NO: 309601 - DNA, 30 bp, Artificial Sequence
  Description of Artificial Sequence: Synthetic oligonucleotide
cagatgcggtctccaaggttgtgcagattg

SEQ ID NO: 309602 - DNA, 31 bp, Artificial Sequence
  Description of Artificial Sequence: Synthetic oligonucleotide
agatgcggtctccaaggttgtgcagattgtg

SEQ ID NO: 309603 - DNA, 30 bp, Artificial Sequence
  Description of Artificial Sequence: Synthetic oligonucleotide
gatgcggtctccaaggttgtgcagattgtg

SEQ ID NO: 309604 - DNA, 32 bp, Artificial Sequence
  Description of Artificial Sequence: Synthetic oligonucleotide
atgcggtctccaaggttgtgcagattgtgaag

SEQ ID NO: 309605 - DNA, 31 bp, Artificial Sequence
  Description of Artificial Sequence: Synthetic oligonucleotide
tgcggtctccaaggttgtgcagattgtgaag

SEQ ID NO: 309606 - DNA, 30 bp, Artificial Sequence
  Description of Artificial Sequence: Synthetic oligonucleotide
gcggtctccaaggttgtgcagattgtgaag

SEQ ID NO: 309607 - DNA, 30 bp, Artificial Sequence
  Description of Artificial Sequence: Synthetic oligonucleotide
cggtctccaaggttgtgcagattgtgaagg

SEQ ID NO: 309608 - DNA, 32 bp, Artificial Sequence
  Description of Artificial Sequence: Synthetic oligonucleotide
ggtctccaaggttgtgcagattgtgaaggaag

SEQ ID NO: 309609 - DNA, 32 bp, Artificial Sequence
  Description of Artificial Sequence: Synthetic oligonucleotide
gtctccaaggttgtgcagattgtgaaggaagg

SEQ ID NO: 309610 - DNA, 32 bp, Artificial Sequence
  Description of Artificial Sequence: Synthetic oligonucleotide
tctccaaggttgtgcagattgtgaaggaaggc

SEQ ID NO: 309611 - DNA, 31 bp, Artificial Sequence
  Description of Artificial Sequence: Synthetic oligonucleotide
ctccaaggttgtgcagattgtgaaggaaggc

SEQ ID NO: 309612 - DNA, 31 bp, Artificial Sequence
  Description of Artificial Sequence: Synthetic oligonucleotide
tccaaggttgtgcagattgtgaaggaaggcg

SEQ ID NO: 309613 - DNA, 30 bp, Artificial Sequence
  Description of Artificial Sequence: Synthetic oligonucleotide
ccaaggttgtgcagattgtgaaggaaggcg

SEQ ID NO: 309614 - DNA, 30 bp, Artificial Sequence
  Description of Artificial Sequence: Synthetic oligonucleotide
caaggttgtgcagattgtgaaggaaggcgc

SEQ ID NO: 309615 - DNA, 30 bp, Artificial Sequence
  Description of Artificial Sequence: Synthetic oligonucleotide
aaggttgtgcagattgtgaaggaaggcgcc

SEQ ID NO: 309616 - DNA, 29 bp, Artificial Sequence
  Description of Artificial Sequence: Synthetic oligonucleotide
aggttgtgcagattgtgaaggaaggcgcc

SEQ ID NO: 309617 - DNA, 28 bp, Artificial Sequence
  Description of Artificial Sequence: Synthetic oligonucleotide
ggttgtgcagattgtgaaggaaggcgcc

SEQ ID NO: 309618 - DNA, 30 bp, Artificial Sequence
  Description of Artificial Sequence: Synthetic oligonucleotide
gttgtgcagattgtgaaggaaggcgccatc

SEQ ID NO: 309619 - DNA, 30 bp, Artificial Sequence
  Description of Artificial Sequence: Synthetic oligonucleotide
ttgtgcagattgtgaaggaaggcgccatcc

SEQ ID NO: 309620 - DNA, 29 bp, Artificial Sequence
  Description of Artificial Sequence: Synthetic oligonucleotide
tgtgcagattgtgaaggaaggcgccatcc

SEQ ID NO: 309621 - DNA, 28 bp, Artificial Sequence
  Description of Artificial Sequence: Synthetic oligonucleotide
gtgcagattgtgaaggaaggcgccatcc

SEQ ID NO: 309622 - DNA, 31 bp, Artificial Sequence
  Description of Artificial Sequence: Synthetic oligonucleotide
tgcagattgtgaaggaaggcgccatccattg

SEQ ID NO: 309623 - DNA, 30 bp, Artificial Sequence
  Description of Artificial Sequence: Synthetic oligonucleotide
gcagattgtgaaggaaggcgccatccattg

SEQ ID NO: 309624 - DNA, 31 bp, Artificial Sequence
  Description of Artificial Sequence: Synthetic oligonucleotide
cagattgtgaaggaaggcgccatccattgag

SEQ ID NO: 309625 - DNA, 32 bp, Artificial Sequence
  Description of Artificial Sequence: Synthetic oligonucleotide
agattgtgaaggaaggcgccatccattgagag

SEQ ID NO: 309626 - DNA, 31 bp, Artificial Sequence
  Description of Artificial Sequence: Synthetic oligonucleotide
gattgtgaaggaaggcgccatccattgagag

SEQ ID NO: 309627 - DNA, 31 bp, Artificial Sequence
  Description of Artificial Sequence: Synthetic oligonucleotide
attgtgaaggaaggcgccatccattgagagg

SEQ ID NO: 309628 - DNA, 30 bp, Artificial Sequence
  Description of Artificial Sequence: Synthetic oligonucleotide
ttgtgaaggaaggcgccatccattgagagg

SEQ ID NO: 309629 - DNA, 29 bp, Artificial Sequence
  Description of Artificial Sequence: Synthetic oligonucleotide
tgtgaaggaaggcgccatccattgagagg

SEQ ID NO: 309630 - DNA, 28 bp, Artificial Sequence
  Description of Artificial Sequence: Synthetic oligonucleotide
gtgaaggaaggcgccatccattgagagg

SEQ ID NO: 309631 - DNA, 29 bp, Artificial Sequence
  Description of Artificial Sequence: Synthetic oligonucleotide
tgaaggaaggcgccatccattgagaggag

SEQ ID NO: 309632 - DNA, 28 bp, Artificial Sequence
  Description of Artificial Sequence: Synthetic oligonucleotide
gaaggaaggcgccatccattgagaggag

SEQ ID NO: 309633 - DNA, 28 bp, Artificial Sequence
  Description of Artificial Sequence: Synthetic oligonucleotide
aaggaaggcgccatccattgagaggagc

SEQ ID NO: 309634 - DNA, 27 bp, Artificial Sequence
  Description of Artificial Sequence: Synthetic oligonucleotide
aggaaggcgccatccattgagaggagc

SEQ ID NO: 309635 - DNA, 27 bp, Artificial Sequence
  Description of Artificial Sequence: Synthetic oligonucleotide
ggaaggcgccatccattgagaggagca

SEQ ID NO: 309636 - DNA, 27 bp, Artificial Sequence
  Description of Artificial Sequence: Synthetic oligonucleotide
gaaggcgccatccattgagaggagcag

SEQ ID NO: 309637 - DNA, 27 bp, Artificial Sequence
  Description of Artificial Sequence: Synthetic oligonucleotide
aaggcgccatccattgagaggagcagg

SEQ ID NO: 309638 - DNA, 27 bp, Artificial Sequence
  Description of Artificial Sequence: Synthetic oligonucleotide
aggcgccatccattgagaggagcaggt

SEQ ID NO: 309639 - DNA, 26 bp, Artificial Sequence
  Description of Artificial Sequence: Synthetic oligonucleotide
ggcgccatccattgagaggagcaggt

SEQ ID NO: 309640 - DNA, 27 bp, Artificial Sequence
  Description of Artificial Sequence: Synthetic oligonucleotide
gcgccatccattgagaggagcaggtct

SEQ ID NO: 309641 - DNA, 29 bp, Artificial Sequence
  Description of Artificial Sequence: Synthetic oligonucleotide
cgccatccattgagaggagcaggtctatg

SEQ ID NO: 309642 - DNA, 31 bp, Artificial Sequence
  Description of Artificial Sequence: Synthetic oligonucleotide
gccatccattgagaggagcaggtctatgatc

SEQ ID NO: 309643 - DNA, 32 bp, Artificial Sequence
  Description of Artificial Sequence: Synthetic oligonucleotide
ccatccattgagaggagcaggtctatgatctc

SEQ ID NO: 309644 - DNA, 34 bp, Artificial Sequence
  Description of Artificial Sequence: Synthetic oligonucleotide
catccattgagaggagcaggtctatgatctcaac

SEQ ID NO: 309645 - DNA, 34 bp, Artificial Sequence
  Description of Artificial Sequence: Synthetic oligonucleotide
atccattgagaggagcaggtctatgatctcaacc

SEQ ID NO: 309646 - DNA, 33 bp, Artificial Sequence
  Description of Artificial Sequence: Synthetic oligonucleotide
tccattgagaggagcaggtctatgatctcaacc

SEQ ID NO: 309647 - DNA, 32 bp, Artificial Sequence
  Description of Artificial Sequence: Synthetic oligonucleotide
ccattgagaggagcaggtctatgatctcaacc

SEQ ID NO: 309648 - DNA, 32 bp, Artificial Sequence
  Description of Artificial Sequence: Synthetic oligonucleotide
cattgagaggagcaggtctatgatctcaaccc

SEQ ID NO: 309649 - DNA, 32 bp, Artificial Sequence
  Description of Artificial Sequence: Synthetic oligonucleotide
attgagaggagcaggtctatgatctcaacccc

SEQ ID NO: 309650 - DNA, 31 bp, Artificial Sequence
  Description of Artificial Sequence: Synthetic oligonucleotide
ttgagaggagcaggtctatgatctcaacccc

SEQ ID NO: 309651 - DNA, 30 bp, Artificial Sequence
  Description of Artificial Sequence: Synthetic oligonucleotide
tgagaggagcaggtctatgatctcaacccc

SEQ ID NO: 309652 - DNA, 29 bp, Artificial Sequence
  Description of Artificial Sequence: Synthetic oligonucleotide
gagaggagcaggtctatgatctcaacccc

SEQ ID NO: 309653 - DNA, 31 bp, Artificial Sequence
  Description of Artificial Sequence: Synthetic oligonucleotide
agaggagcaggtctatgatctcaaccccatg

SEQ ID NO: 309654 - DNA, 30 bp, Artificial Sequence
  Description of Artificial Sequence: Synthetic oligonucleotide
gaggagcaggtctatgatctcaaccccatg

SEQ ID NO: 309655 - DNA, 30 bp, Artificial Sequence
  Description of Artificial Sequence: Synthetic oligonucleotide
aggagcaggtctatgatctcaaccccatgg

SEQ ID NO: 309656 - DNA, 29 bp, Artificial Sequence
  Description of Artificial Sequence: Synthetic oligonucleotide
ggagcaggtctatgatctcaaccccatgg

SEQ ID NO: 309657 - DNA, 30 bp, Artificial Sequence
  Description of Artificial Sequence: Synthetic oligonucleotide
gagcaggtctatgatctcaaccccatggac

SEQ ID NO: 309658 - DNA, 30 bp, Artificial Sequence
  Description of Artificial Sequence: Synthetic oligonucleotide
agcaggtctatgatctcaaccccatggacc

SEQ ID NO: 309659 - DNA, 29 bp, Artificial Sequence
  Description of Artificial Sequence: Synthetic oligonucleotide
gcaggtctatgatctcaaccccatggacc

SEQ ID NO: 309660 - DNA, 30 bp, Artificial Sequence
  Description of Artificial Sequence: Synthetic oligonucleotide
caggtctatgatctcaaccccatggaccac

SEQ ID NO: 309661 - DNA, 30 bp, Artificial Sequence
  Description of Artificial Sequence: Synthetic oligonucleotide
aggtctatgatctcaaccccatggaccacc

SEQ ID NO: 309662 - DNA, 29 bp, Artificial Sequence
  Description of Artificial Sequence: Synthetic oligonucleotide
ggtctatgatctcaaccccatggaccacc

SEQ ID NO: 309663 - DNA, 29 bp, Artificial Sequence
  Description of Artificial Sequence: Synthetic oligonucleotide
gtctatgatctcaaccccatggaccaccc

SEQ ID NO: 309664 - DNA, 30 bp, Artificial Sequence
  Description of Artificial Sequence: Synthetic oligonucleotide
tctatgatctcaaccccatggaccacccag

SEQ ID NO: 309665 - DNA, 29 bp, Artificial Sequence
  Description of Artificial Sequence: Synthetic oligonucleotide
ctatgatctcaaccccatggaccacccag

SEQ ID NO: 309666 - DNA, 29 bp, Artificial Sequence
  Description of Artificial Sequence: Synthetic oligonucleotide
tatgatctcaaccccatggaccacccagg

SEQ ID NO: 309667 - DNA, 28 bp, Artificial Sequence
  Description of Artificial Sequence: Synthetic oligonucleotide
atgatctcaaccccatggaccacccagg

SEQ ID NO: 309668 - DNA, 27 bp, Artificial Sequence
  Description of Artificial Sequence: Synthetic oligonucleotide
tgatctcaaccccatggaccacccagg

SEQ ID NO: 309669 - DNA, 26 bp, Artificial Sequence
  Description of Artificial Sequence: Synthetic oligonucleotide
gatctcaaccccatggaccacccagg

SEQ ID NO: 309670 - DNA, 26 bp, Artificial Sequence
  Description of Artificial Sequence: Synthetic oligonucleotide
atctcaaccccatggaccacccaggc

SEQ ID NO: 309671 - DNA, 25 bp, Artificial Sequence
  Description of Artificial Sequence: Synthetic oligonucleotide
tctcaaccccatggaccacccaggc

SEQ ID NO: 309672 - DNA, 24 bp, Artificial Sequence
  Description of Artificial Sequence: Synthetic oligonucleotide
ctcaaccccatggaccacccaggc

SEQ ID NO: 309673 - DNA, 24 bp, Artificial Sequence
  Description of Artificial Sequence: Synthetic oligonucleotide
tcaaccccatggaccacccaggcc

SEQ ID NO: 309674 - DNA, 23 bp, Artificial Sequence
  Description of Artificial Sequence: Synthetic oligonucleotide
caaccccatggaccacccaggcc

SEQ ID NO: 309675 - DNA, 23 bp, Artificial Sequence
  Description of Artificial Sequence: Synthetic oligonucleotide
aaccccatggaccacccaggccg

SEQ ID NO: 309676 - DNA, 22 bp, Artificial Sequence
  Description of Artificial Sequence: Synthetic oligonucleotide
accccatggaccacccaggccg

SEQ ID NO: 309677 - DNA, 21 bp, Artificial Sequence
  Description of Artificial Sequence: Synthetic oligonucleotide
ccccatggaccacccaggccg

SEQ ID NO: 309678 - DNA, 22 bp, Artificial Sequence
  Description of Artificial Sequence: Synthetic oligonucleotide
cccatggaccacccaggccgga

SEQ ID NO: 309679 - DNA, 22 bp, Artificial Sequence
  Description of Artificial Sequence: Synthetic oligonucleotide
ccatggaccacccaggccggac

SEQ ID NO: 309680 - DNA, 24 bp, Artificial Sequence
  Description of Artificial Sequence: Synthetic oligonucleotide
catggaccacccaggccggacgtt

SEQ ID NO: 309681 - DNA, 24 bp, Artificial Sequence
  Description of Artificial Sequence: Synthetic oligonucleotide
atggaccacccaggccggacgttg

SEQ ID NO: 309682 - DNA, 23 bp, Artificial Sequence
  Description of Artificial Sequence: Synthetic oligonucleotide
tggaccacccaggccggacgttg

SEQ ID NO: 309683 - DNA, 22 bp, Artificial Sequence
  Description of Artificial Sequence: Synthetic oligonucleotide
ggaccacccaggccggacgttg

SEQ ID NO: 309684 - DNA, 27 bp, Artificial Sequence
  Description of Artificial Sequence: Synthetic oligonucleotide
gaccacccaggccggacgttggaaata

SEQ ID NO: 309685 - DNA, 27 bp, Artificial Sequence
  Description of Artificial Sequence: Synthetic oligonucleotide
accacccaggccggacgttggaaatag

SEQ ID NO: 309686 - DNA, 26 bp, Artificial Sequence
  Description of Artificial Sequence: Synthetic oligonucleotide
ccacccaggccggacgttggaaatag

SEQ ID NO: 309687 - DNA, 27 bp, Artificial Sequence
  Description of Artificial Sequence: Synthetic oligonucleotide
cacccaggccggacgttggaaatagct

SEQ ID NO: 309688 - DNA, 27 bp, Artificial Sequence
  Description of Artificial Sequence: Synthetic oligonucleotide
acccaggccggacgttggaaatagctg

SEQ ID NO: 309689 - DNA, 26 bp, Artificial Sequence
  Description of Artificial Sequence: Synthetic oligonucleotide
cccaggccggacgttggaaatagctg

SEQ ID NO: 309690 - DNA, 26 bp, Artificial Sequence
  Description of Artificial Sequence: Synthetic oligonucleotide
ccaggccggacgttggaaatagctgg

SEQ ID NO: 309691 - DNA, 27 bp, Artificial Sequence
  Description of Artificial Sequence: Synthetic oligonucleotide
caggccggacgttggaaatagctggca

SEQ ID NO: 309692 - DNA, 28 bp, Artificial Sequence
  Description of Artificial Sequence: Synthetic oligonucleotide
aggccggacgttggaaatagctggcaac

SEQ ID NO: 309693 - DNA, 27 bp, Artificial Sequence
  Description of Artificial Sequence: Synthetic oligonucleotide
ggccggacgttggaaatagctggcaac

SEQ ID NO: 309694 - DNA, 28 bp, Artificial Sequence
  Description of Artificial Sequence: Synthetic oligonucleotide
gccggacgttggaaatagctggcaactg

SEQ ID NO: 309695 - DNA, 29 bp, Artificial Sequence
  Description of Artificial Sequence: Synthetic oligonucleotide
ccggacgttggaaatagctggcaactgtg

SEQ ID NO: 309696 - DNA, 31 bp, Artificial Sequence
  Description of Artificial Sequence: Synthetic oligonucleotide
cggacgttggaaatagctggcaactgtgatc

SEQ ID NO: 309697 - DNA, 31 bp, Artificial Sequence
  Description of Artificial Sequence: Synthetic oligonucleotide
ggacgttggaaatagctggcaactgtgatcc

SEQ ID NO: 309698 - DNA, 31 bp, Artificial Sequence
  Description of Artificial Sequence: Synthetic oligonucleotide
gacgttggaaatagctggcaactgtgatccc

SEQ ID NO: 309699 - DNA, 36 bp, Artificial Sequence
  Description of Artificial Sequence: Synthetic oligonucleotide
acgttggaaatagctggcaactgtgatcccaaaatg

SEQ ID NO: 309700 - DNA, 35 bp, Artificial Sequence
  Description of Artificial Sequence: Synthetic oligonucleotide
cgttggaaatagctggcaactgtgatcccaaaatg

SEQ ID NO: 309701 - DNA, 37 bp, Artificial Sequence
  Description of Artificial Sequence: Synthetic oligonucleotide
gttggaaatagctggcaactgtgatcccaaaatgatc

SEQ ID NO: 309702 - DNA, 37 bp, Artificial Sequence
  Description of Artificial Sequence: Synthetic oligonucleotide
ttggaaatagctggcaactgtgatcccaaaatgatcc

SEQ ID NO: 309703 - DNA, 36 bp, Artificial Sequence
  Description of Artificial Sequence: Synthetic oligonucleotide
tggaaatagctggcaactgtgatcccaaaatgatcc

SEQ ID NO: 309704 - DNA, 35 bp, Artificial Sequence
  Description of Artificial Sequence: Synthetic oligonucleotide
ggaaatagctggcaactgtgatcccaaaatgatcc

SEQ ID NO: 309705 - DNA, 35 bp, Artificial Sequence
  Description of Artificial Sequence: Synthetic oligonucleotide
gaaatagctggcaactgtgatcccaaaatgatccc

SEQ ID NO: 309706 - DNA, 36 bp, Artificial Sequence
  Description of Artificial Sequence: Synthetic oligonucleotide
aaatagctggcaactgtgatcccaaaatgatccctc

SEQ ID NO: 309707 - DNA, 35 bp, Artificial Sequence
  Description of Artificial Sequence: Synthetic oligonucleotide
aatagctggcaactgtgatcccaaaatgatccctc

SEQ ID NO: 309708 - DNA, 34 bp, Artificial Sequence
  Description of Artificial Sequence: Synthetic oligonucleotide
atagctggcaactgtgatcccaaaatgatccctc

SEQ ID NO: 309709 - DNA, 33 bp, Artificial Sequence
  Description of Artificial Sequence: Synthetic oligonucleotide
tagctggcaactgtgatcccaaaatgatccctc

SEQ ID NO: 309710 - DNA, 32 bp, Artificial Sequence
  Description of Artificial Sequence: Synthetic oligonucleotide
agctggcaactgtgatcccaaaatgatccctc

SEQ ID NO: 309711 - DNA, 31 bp, Artificial Sequence
  Description of Artificial Sequence: Synthetic oligonucleotide
gctggcaactgtgatcccaaaatgatccctc

SEQ ID NO: 309712 - DNA, 33 bp, Artificial Sequence
  Description of Artificial Sequence: Synthetic oligonucleotide
ctggcaactgtgatcccaaaatgatccctcatg

SEQ ID NO: 309713 - DNA, 33 bp, Artificial Sequence
  Description of Artificial Sequence: Synthetic oligonucleotide
tggcaactgtgatcccaaaatgatccctcatgg

SEQ ID NO: 309714 - DNA, 32 bp, Artificial Sequence
  Description of Artificial Sequence: Synthetic oligonucleotide
ggcaactgtgatcccaaaatgatccctcatgg

SEQ ID NO: 309715 - DNA, 32 bp, Artificial Sequence
  Description of Artificial Sequence: Synthetic oligonucleotide
gcaactgtgatcccaaaatgatccctcatggg

SEQ ID NO: 309716 - DNA, 32 bp, Artificial Sequence
  Description of Artificial Sequence: Synthetic oligonucleotide
caactgtgatcccaaaatgatccctcatgggg

SEQ ID NO: 309717 - DNA, 33 bp, Artificial Sequence
  Description of Artificial Sequence: Synthetic oligonucleotide
aactgtgatcccaaaatgatccctcatggggac

SEQ ID NO: 309718 - DNA, 32 bp, Artificial Sequence
  Description of Artificial Sequence: Synthetic oligonucleotide
actgtgatcccaaaatgatccctcatggggac

SEQ ID NO: 309719 - DNA, 31 bp, Artificial Sequence
  Description of Artificial Sequence: Synthetic oligonucleotide
ctgtgatcccaaaatgatccctcatggggac

SEQ ID NO: 309720 - DNA, 36 bp, Artificial Sequence
  Description of Artificial Sequence: Synthetic oligonucleotide
tgtgatcccaaaatgatccctcatggggactataac

SEQ ID NO: 309721 - DNA, 35 bp, Artificial Sequence
  Description of Artificial Sequence: Synthetic oligonucleotide
gtgatcccaaaatgatccctcatggggactataac

SEQ ID NO: 309722 - DNA, 36 bp, Artificial Sequence
  Description of Artificial Sequence: Synthetic oligonucleotide
tgatcccaaaatgatccctcatggggactataacag

SEQ ID NO: 309723 - DNA, 35 bp, Artificial Sequence
  Description of Artificial Sequence: Synthetic oligonucleotide
gatcccaaaatgatccctcatggggactataacag

SEQ ID NO: 309724 - DNA, 35 bp, Artificial Sequence
  Description of Artificial Sequence: Synthetic oligonucleotide
atcccaaaatgatccctcatggggactataacagc

SEQ ID NO: 309725 - DNA, 34 bp, Artificial Sequence
  Description of Artificial Sequence: Synthetic oligonucleotide
tcccaaaatgatccctcatggggactataacagc

SEQ ID NO: 309726 - DNA, 33 bp, Artificial Sequence
  Description of Artificial Sequence: Synthetic oligonucleotide
cccaaaatgatccctcatggggactataacagc

SEQ ID NO: 309727 - DNA, 35 bp, Artificial Sequence
  Description of Artificial Sequence: Synthetic oligonucleotide
ccaaaatgatccctcatggggactataacagctag

SEQ ID NO: 309728 - DNA, 35 bp, Artificial Sequence
  Description of Artificial Sequence: Synthetic oligonucleotide
caaaatgatccctcatggggactataacagctagg

SEQ ID NO: 309729 - DNA, 36 bp, Artificial Sequence
  Description of Artificial Sequence: Synthetic oligonucleotide
aaaatgatccctcatggggactataacagctaggtc

SEQ ID NO: 309730 - DNA, 35 bp, Artificial Sequence
  Description of Artificial Sequence: Synthetic oligonucleotide
aaatgatccctcatggggactataacagctaggtc

SEQ ID NO: 309731 - DNA, 34 bp, Artificial Sequence
  Description of Artificial Sequence: Synthetic oligonucleotide
aatgatccctcatggggactataacagctaggtc

SEQ ID NO: 309732 - DNA, 33 bp, Artificial Sequence
  Description of Artificial Sequence: Synthetic oligonucleotide
atgatccctcatggggactataacagctaggtc

SEQ ID NO: 309733 - DNA, 32 bp, Artificial Sequence
  Description of Artificial Sequence: Synthetic oligonucleotide
tgatccctcatggggactataacagctaggtc

SEQ ID NO: 309734 - DNA, 31 bp, Artificial Sequence
  Description of Artificial Sequence: Synthetic oligonucleotide
gatccctcatggggactataacagctaggtc

SEQ ID NO: 309735 - DNA, 32 bp, Artificial Sequence
  Description of Artificial Sequence: Synthetic oligonucleotide
atccctcatggggactataacagctaggtcag

SEQ ID NO: 309736 - DNA, 31 bp, Artificial Sequence
  Description of Artificial Sequence: Synthetic oligonucleotide
tccctcatggggactataacagctaggtcag

SEQ ID NO: 309737 - DNA, 30 bp, Artificial Sequence
  Description of Artificial Sequence: Synthetic oligonucleotide
ccctcatggggactataacagctaggtcag

SEQ ID NO: 309738 - DNA, 30 bp, Artificial Sequence
  Description of Artificial Sequence: Synthetic oligonucleotide
cctcatggggactataacagctaggtcagg

SEQ ID NO: 309739 - DNA, 30 bp, Artificial Sequence
  Description of Artificial Sequence: Synthetic oligonucleotide
ctcatggggactataacagctaggtcaggg

SEQ ID NO: 309740 - DNA, 33 bp, Artificial Sequence
  Description of Artificial Sequence: Synthetic oligonucleotide
tcatggggactataacagctaggtcagggtttc

SEQ ID NO: 309741 - DNA, 32 bp, Artificial Sequence
  Description of Artificial Sequence: Synthetic oligonucleotide
catggggactataacagctaggtcagggtttc

SEQ ID NO: 309742 - DNA, 33 bp, Artificial Sequence
  Description of Artificial Sequence: Synthetic oligonucleotide
atggggactataacagctaggtcagggtttcag

SEQ ID NO: 309743 - DNA, 32 bp, Artificial Sequence
  Description of Artificial Sequence: Synthetic oligonucleotide
tggggactataacagctaggtcagggtttcag

SEQ ID NO: 309744 - DNA, 31 bp, Artificial Sequence
  Description of Artificial Sequence: Synthetic oligonucleotide
ggggactataacagctaggtcagggtttcag

SEQ ID NO: 309745 - DNA, 31 bp, Artificial Sequence
  Description of Artificial Sequence: Synthetic oligonucleotide
gggactataacagctaggtcagggtttcagc

SEQ ID NO: 309746 - DNA, 31 bp, Artificial Sequence
  Description of Artificial Sequence: Synthetic oligonucleotide
ggactataacagctaggtcagggtttcagcc

SEQ ID NO: 309747 - DNA, 32 bp, Artificial Sequence
  Description of Artificial Sequence: Synthetic oligonucleotide
gactataacagctaggtcagggtttcagcctc

SEQ ID NO: 309748 - DNA, 33 bp, Artificial Sequence
  Description of Artificial Sequence: Synthetic oligonucleotide
actataacagctaggtcagggtttcagcctcag

SEQ ID NO: 309749 - DNA, 32 bp, Artificial Sequence
  Description of Artificial Sequence: Synthetic oligonucleotide
ctataacagctaggtcagggtttcagcctcag

SEQ ID NO: 309750 - DNA, 34 bp, Artificial Sequence
  Description of Artificial Sequence: Synthetic oligonucleotide
tataacagctaggtcagggtttcagcctcagttc

SEQ ID NO: 309751 - DNA, 33 bp, Artificial Sequence
  Description of Artificial Sequence: Synthetic oligonucleotide
ataacagctaggtcagggtttcagcctcagttc

SEQ ID NO: 309752 - DNA, 32 bp, Artificial Sequence
  Description of Artificial Sequence: Synthetic oligonucleotide
taacagctaggtcagggtttcagcctcagttc

SEQ ID NO: 309753 - DNA, 31 bp, Artificial Sequence
  Description of Artificial Sequence: Synthetic oligonucleotide
aacagctaggtcagggtttcagcctcagttc

SEQ ID NO: 309754 - DNA, 30 bp, Artificial Sequence
  Description of Artificial Sequence: Synthetic oligonucleotide
acagctaggtcagggtttcagcctcagttc

SEQ ID NO: 309755 - DNA, 29 bp, Artificial Sequence
  Description of Artificial Sequence: Synthetic oligonucleotide
cagctaggtcagggtttcagcctcagttc

SEQ ID NO: 309756 - DNA, 29 bp, Artificial Sequence
  Description of Artificial Sequence: Synthetic oligonucleotide
agctaggtcagggtttcagcctcagttcc

SEQ ID NO: 309757 - DNA, 28 bp, Artificial Sequence
  Description of Artificial Sequence: Synthetic oligonucleotide
gctaggtcagggtttcagcctcagttcc

SEQ ID NO: 309758 - DNA, 31 bp, Artificial Sequence
  Description of Artificial Sequence: Synthetic oligonucleotide
ctaggtcagggtttcagcctcagttccattg

SEQ ID NO: 309759 - DNA, 31 bp, Artificial Sequence
  Description of Artificial Sequence: Synthetic oligonucleotide
taggtcagggtttcagcctcagttccattgg

SEQ ID NO: 309760 - DNA, 30 bp, Artificial Sequence
  Description of Artificial Sequence: Synthetic oligonucleotide
aggtcagggtttcagcctcagttccattgg

SEQ ID NO: 309761 - DNA, 29 bp, Artificial Sequence
  Description of Artificial Sequence: Synthetic oligonucleotide
ggtcagggtttcagcctcagttccattgg

SEQ ID NO: 309762 - DNA, 30 bp, Artificial Sequence
  Description of Artificial Sequence: Synthetic oligonucleotide
gtcagggtttcagcctcagttccattggag

SEQ ID NO: 309763 - DNA, 31 bp, Artificial Sequence
  Description of Artificial Sequence: Synthetic oligonucleotide
tcagggtttcagcctcagttccattggagac

SEQ ID NO: 309764 - DNA, 30 bp, Artificial Sequence
  Description of Artificial Sequence: Synthetic oligonucleotide
cagggtttcagcctcagttccattggagac

SEQ ID NO: 309765 - DNA, 34 bp, Artificial Sequence
  Description of Artificial Sequence: Synthetic oligonucleotide
agggtttcagcctcagttccattggagactttag

SEQ ID NO: 309766 - DNA, 33 bp, Artificial Sequence
  Description of Artificial Sequence: Synthetic oligonucleotide
gggtttcagcctcagttccattggagactttag

SEQ ID NO: 309767 - DNA, 33 bp, Artificial Sequence
  Description of Artificial Sequence: Synthetic oligonucleotide
ggtttcagcctcagttccattggagactttagg

SEQ ID NO: 309768 - DNA, 33 bp, Artificial Sequence
  Description of Artificial Sequence: Synthetic oligonucleotide
gtttcagcctcagttccattggagactttaggc

SEQ ID NO: 309769 - DNA, 34 bp, Artificial Sequence
  Description of Artificial Sequence: Synthetic oligonucleotide
tttcagcctcagttccattggagactttaggcac

SEQ ID NO: 309770 - DNA, 33 bp, Artificial Sequence
  Description of Artificial Sequence: Synthetic oligonucleotide
ttcagcctcagttccattggagactttaggcac

SEQ ID NO: 309771 - DNA, 32 bp, Artificial Sequence
  Description of Artificial Sequence: Synthetic oligonucleotide
tcagcctcagttccattggagactttaggcac

SEQ ID NO: 309772 - DNA, 31 bp, Artificial Sequence
  Description of Artificial Sequence: Synthetic oligonucleotide
cagcctcagttccattggagactttaggcac

SEQ ID NO: 309773 - DNA, 32 bp, Artificial Sequence
  Description of Artificial Sequence: Synthetic oligonucleotide
agcctcagttccattggagactttaggcactg

SEQ ID NO: 309774 - DNA, 31 bp, Artificial Sequence
  Description of Artificial Sequence: Synthetic oligonucleotide
gcctcagttccattggagactttaggcactg

SEQ ID NO: 309775 - DNA, 32 bp, Artificial Sequence
  Description of Artificial Sequence: Synthetic oligonucleotide
cctcagttccattggagactttaggcactgag

SEQ ID NO: 309776 - DNA, 32 bp, Artificial Sequence
  Description of Artificial Sequence: Synthetic oligonucleotide
ctcagttccattggagactttaggcactgagg

SEQ ID NO: 309777 - DNA, 32 bp, Artificial Sequence
  Description of Artificial Sequence: Synthetic oligonucleotide
tcagttccattggagactttaggcactgaggg

SEQ ID NO: 309778 - DNA, 31 bp, Artificial Sequence
  Description of Artificial Sequence: Synthetic oligonucleotide
cagttccattggagactttaggcactgaggg

SEQ ID NO: 309779 - DNA, 31 bp, Artificial Sequence
  Description of Artificial Sequence: Synthetic oligonucleotide
agttccattggagactttaggcactgagggg

SEQ ID NO: 309780 - DNA, 30 bp, Artificial Sequence
  Description of Artificial Sequence: Synthetic oligonucleotide
gttccattggagactttaggcactgagggg

SEQ ID NO: 309781 - DNA, 30 bp, Artificial Sequence
  Description of Artificial Sequence: Synthetic oligonucleotide
ttccattggagactttaggcactgaggggg

SEQ ID NO: 309782 - DNA, 29 bp, Artificial Sequence
  Description of Artificial Sequence: Synthetic oligonucleotide
tccattggagactttaggcactgaggggg

SEQ ID NO: 309783 - DNA, 28 bp, Artificial Sequence
  Description of Artificial Sequence: Synthetic oligonucleotide
ccattggagactttaggcactgaggggg

SEQ ID NO: 309784 - DNA, 28 bp, Artificial Sequence
  Description of Artificial Sequence: Synthetic oligonucleotide
cattggagactttaggcactgagggggg

SEQ ID NO: 309785 - DNA, 28 bp, Artificial Sequence
  Description of Artificial Sequence: Synthetic oligonucleotide
attggagactttaggcactgaggggggc

SEQ ID NO: 309786 - DNA, 27 bp, Artificial Sequence
  Description of Artificial Sequence: Synthetic oligonucleotide
ttggagactttaggcactgaggggggc

SEQ ID NO: 309787 - DNA, 27 bp, Artificial Sequence
  Description of Artificial Sequence: Synthetic oligonucleotide
tggagactttaggcactgaggggggct

SEQ ID NO: 309788 - DNA, 27 bp, Artificial Sequence
  Description of Artificial Sequence: Synthetic oligonucleotide
ggagactttaggcactgaggggggctt

SEQ ID NO: 309789 - DNA, 27 bp, Artificial Sequence
  Description of Artificial Sequence: Synthetic oligonucleotide
gagactttaggcactgaggggggcttg

SEQ ID NO: 309790 - DNA, 28 bp, Artificial Sequence
  Description of Artificial Sequence: Synthetic oligonucleotide
agactttaggcactgaggggggcttgtc

SEQ ID NO: 309791 - DNA, 27 bp, Artificial Sequence
  Description of Artificial Sequence: Synthetic oligonucleotide
gactttaggcactgaggggggcttgtc

SEQ ID NO: 309792 - DNA, 28 bp, Artificial Sequence
  Description of Artificial Sequence: Synthetic oligonucleotide
actttaggcactgaggggggcttgtcac

SEQ ID NO: 309793 - DNA, 27 bp, Artificial Sequence
  Description of Artificial Sequence: Synthetic oligonucleotide
ctttaggcactgaggggggcttgtcac

SEQ ID NO: 309794 - DNA, 27 bp, Artificial Sequence
  Description of Artificial Sequence: Synthetic oligonucleotide
tttaggcactgaggggggcttgtcacc

SEQ ID NO: 309795 - DNA, 27 bp, Artificial Sequence
  Description of Artificial Sequence: Synthetic oligonucleotide
ttaggcactgaggggggcttgtcacct

SEQ ID NO: 309796 - DNA, 26 bp, Artificial Sequence
  Description of Artificial Sequence: Synthetic oligonucleotide
taggcactgaggggggcttgtcacct

SEQ ID NO: 309797 - DNA, 25 bp, Artificial Sequence
  Description of Artificial Sequence: Synthetic oligonucleotide
aggcactgaggggggcttgtcacct

SEQ ID NO: 309798 - DNA, 24 bp, Artificial Sequence
  Description of Artificial Sequence: Synthetic oligonucleotide
ggcactgaggggggcttgtcacct

SEQ ID NO: 309799 - DNA, 24 bp, Artificial Sequence
  Description of Artificial Sequence: Synthetic oligonucleotide
gcactgaggggggcttgtcacctg

SEQ ID NO: 309800 - DNA, 25 bp, Artificial Sequence
  Description of Artificial Sequence: Synthetic oligonucleotide
cactgaggggggcttgtcacctgga

SEQ ID NO: 309801 - DNA, 25 bp, Artificial Sequence
  Description of Artificial Sequence: Synthetic oligonucleotide
actgaggggggcttgtcacctggag

SEQ ID NO: 309802 - DNA, 24 bp, Artificial Sequence
  Description of Artificial Sequence: Synthetic oligonucleotide
ctgaggggggcttgtcacctggag

SEQ ID NO: 309803 - DNA, 24 bp, Artificial Sequence
  Description of Artificial Sequence: Synthetic oligonucleotide
tgaggggggcttgtcacctggagg

SEQ ID NO: 309804 - DNA, 23 bp, Artificial Sequence
  Description of Artificial Sequence: Synthetic oligonucleotide
gaggggggcttgtcacctggagg

SEQ ID NO: 309805 - DNA, 23 bp, Artificial Sequence
  Description of Artificial Sequence: Synthetic oligonucleotide
aggggggcttgtcacctggaggc

SEQ ID NO: 309806 - DNA, 22 bp, Artificial Sequence
  Description of Artificial Sequence: Synthetic oligonucleotide
ggggggcttgtcacctggaggc

SEQ ID NO: 309807 - DNA, 23 bp, Artificial Sequence
  Description of Artificial Sequence: Synthetic oligonucleotide
gggggcttgtcacctggaggcgt

SEQ ID NO: 309808 - DNA, 23 bp, Artificial Sequence
  Description of Artificial Sequence: Synthetic oligonucleotide
ggggcttgtcacctggaggcgtg

SEQ ID NO: 309809 - DNA, 23 bp, Artificial Sequence
  Description of Artificial Sequence: Synthetic oligonucleotide
gggcttgtcacctggaggcgtgc

SEQ ID NO: 309810 - DNA, 23 bp, Artificial Sequence
  Description of Artificial Sequence: Synthetic oligonucleotide
ggcttgtcacctggaggcgtgcc

SEQ ID NO: 309811 - DNA, 24 bp, Artificial Sequence
  Description of Artificial Sequence: Synthetic oligonucleotide
gcttgtcacctggaggcgtgccct

SEQ ID NO: 309812 - DNA, 24 bp, Artificial Sequence
  Description of Artificial Sequence: Synthetic oligonucleotide
cttgtcacctggaggcgtgccctc

SEQ ID NO: 309813 - DNA, 24 bp, Artificial Sequence
  Description of Artificial Sequence: Synthetic oligonucleotide
ttgtcacctggaggcgtgccctcc

SEQ ID NO: 309814 - DNA, 23 bp, Artificial Sequence
  Description of Artificial Sequence: Synthetic oligonucleotide
tgtcacctggaggcgtgccctcc

SEQ ID NO: 309815 - DNA, 22 bp, Artificial Sequence
  Description of Artificial Sequence: Synthetic oligonucleotide
gtcacctggaggcgtgccctcc

SEQ ID NO: 309816 - DNA, 23 bp, Artificial Sequence
  Description of Artificial Sequence: Synthetic oligonucleotide
tcacctggaggcgtgccctccct

SEQ ID NO: 309817 - DNA, 22 bp, Artificial Sequence
  Description of Artificial Sequence: Synthetic oligonucleotide
cacctggaggcgtgccctccct

SEQ ID NO: 309818 - DNA, 24 bp, Artificial Sequence
  Description of Artificial Sequence: Synthetic oligonucleotide
acctggaggcgtgccctccctcta

SEQ ID NO: 309819 - DNA, 23 bp, Artificial Sequence
  Description of Artificial Sequence: Synthetic oligonucleotide
cctggaggcgtgccctccctcta

SEQ ID NO: 309820 - DNA, 24 bp, Artificial Sequence
  Description of Artificial Sequence: Synthetic oligonucleotide
ctggaggcgtgccctccctctaga

SEQ ID NO: 309821 - DNA, 24 bp, Artificial Sequence
  Description of Artificial Sequence: Synthetic oligonucleotide
tggaggcgtgccctccctctagag

SEQ ID NO: 309822 - DNA, 23 bp, Artificial Sequence
  Description of Artificial Sequence: Synthetic oligonucleotide
ggaggcgtgccctccctctagag

SEQ ID NO: 309823 - DNA, 23 bp, Artificial Sequence
  Description of Artificial Sequence: Synthetic oligonucleotide
gaggcgtgccctccctctagagg

SEQ ID NO: 309824 - DNA, 25 bp, Artificial Sequence
  Description of Artificial Sequence: Synthetic oligonucleotide
aggcgtgccctccctctagaggctt

SEQ ID NO: 309825 - DNA, 24 bp, Artificial Sequence
  Description of Artificial Sequence: Synthetic oligonucleotide
ggcgtgccctccctctagaggctt

SEQ ID NO: 309826 - DNA, 24 bp, Artificial Sequence
  Description of Artificial Sequence: Synthetic oligonucleotide
gcgtgccctccctctagaggcttc

SEQ ID NO: 309827 - DNA, 25 bp, Artificial Sequence
  Description of Artificial Sequence: Synthetic oligonucleotide
cgtgccctccctctagaggcttcca

SEQ ID NO: 309828 - DNA, 25 bp, Artificial Sequence
  Description of Artificial Sequence: Synthetic oligonucleotide
gtgccctccctctagaggcttccac

SEQ ID NO: 309829 - DNA, 26 bp, Artificial Sequence
  Description of Artificial Sequence: Synthetic oligonucleotide
tgccctccctctagaggcttccacga

SEQ ID NO: 309830 - DNA, 25 bp, Artificial Sequence
  Description of Artificial Sequence: Synthetic oligonucleotide
gccctccctctagaggcttccacga

SEQ ID NO: 309831 - DNA, 25 bp, Artificial Sequence
  Description of Artificial Sequence: Synthetic oligonucleotide
ccctccctctagaggcttccacgag

SEQ ID NO: 309832 - DNA, 25 bp, Artificial Sequence
  Description of Artificial Sequence: Synthetic oligonucleotide
cctccctctagaggcttccacgagg

SEQ ID NO: 309833 - DNA, 26 bp, Artificial Sequence
  Description of Artificial Sequence: Synthetic oligonucleotide
ctccctctagaggcttccacgaggct

SEQ ID NO: 309834 - DNA, 27 bp, Artificial Sequence
  Description of Artificial Sequence: Synthetic oligonucleotide
tccctctagaggcttccacgaggctgt

SEQ ID NO: 309835 - DNA, 26 bp, Artificial Sequence
  Description of Artificial Sequence: Synthetic oligonucleotide
ccctctagaggcttccacgaggctgt

SEQ ID NO: 309836 - DNA, 26 bp, Artificial Sequence
  Description of Artificial Sequence: Synthetic oligonucleotide
cctctagaggcttccacgaggctgtc

SEQ ID NO: 309837 - DNA, 26 bp, Artificial Sequence
  Description of Artificial Sequence: Synthetic oligonucleotide
ctctagaggcttccacgaggctgtcg

SEQ ID NO: 309838 - DNA, 26 bp, Artificial Sequence
  Description of Artificial Sequence: Synthetic oligonucleotide
tctagaggcttccacgaggctgtcgg

SEQ ID NO: 309839 - DNA, 25 bp, Artificial Sequence
  Description of Artificial Sequence: Synthetic oligonucleotide
ctagaggcttccacgaggctgtcgg

SEQ ID NO: 309840 - DNA, 26 bp, Artificial Sequence
  Description of Artificial Sequence: Synthetic oligonucleotide
tagaggcttccacgaggctgtcggga

SEQ ID NO: 309841 - DNA, 25 bp, Artificial Sequence
  Description of Artificial Sequence: Synthetic oligonucleotide
agaggcttccacgaggctgtcggga

SEQ ID NO: 309842 - DNA, 24 bp, Artificial Sequence
  Description of Artificial Sequence: Synthetic oligonucleotide
gaggcttccacgaggctgtcggga

SEQ ID NO: 309843 - DNA, 24 bp, Artificial Sequence
  Description of Artificial Sequence: Synthetic oligonucleotide
aggcttccacgaggctgtcgggag

SEQ ID NO: 309844 - DNA, 23 bp, Artificial Sequence
  Description of Artificial Sequence: Synthetic oligonucleotide
ggcttccacgaggctgtcgggag

SEQ ID NO: 309845 - DNA, 26 bp, Artificial Sequence
  Description of Artificial Sequence: Synthetic oligonucleotide
gcttccacgaggctgtcgggagcaaa

SEQ ID NO: 309846 - DNA, 26 bp, Artificial Sequence
  Description of Artificial Sequence: Synthetic oligonucleotide
cttccacgaggctgtcgggagcaaag

SEQ ID NO: 309847 - DNA, 27 bp, Artificial Sequence
  Description of Artificial Sequence: Synthetic oligonucleotide
ttccacgaggctgtcgggagcaaagca

SEQ ID NO: 309848 - DNA, 27 bp, Artificial Sequence
  Description of Artificial Sequence: Synthetic oligonucleotide
tccacgaggctgtcgggagcaaagcat

SEQ ID NO: 309849 - DNA, 26 bp, Artificial Sequence
  Description of Artificial Sequence: Synthetic oligonucleotide
ccacgaggctgtcgggagcaaagcat

SEQ ID NO: 309850 - DNA, 27 bp, Artificial Sequence
  Description of Artificial Sequence: Synthetic oligonucleotide
cacgaggctgtcgggagcaaagcatga

SEQ ID NO: 309851 - DNA, 28 bp, Artificial Sequence
  Description of Artificial Sequence: Synthetic oligonucleotide
acgaggctgtcgggagcaaagcatgatc

SEQ ID NO: 309852 - DNA, 27 bp, Artificial Sequence
  Description of Artificial Sequence: Synthetic oligonucleotide
cgaggctgtcgggagcaaagcatgatc

SEQ ID NO: 309853 - DNA, 29 bp, Artificial Sequence
  Description of Artificial Sequence: Synthetic oligonucleotide
gaggctgtcgggagcaaagcatgatctag

SEQ ID NO: 309854 - DNA, 31 bp, Artificial Sequence
  Description of Artificial Sequence: Synthetic oligonucleotide
aggctgtcgggagcaaagcatgatctagttg

SEQ ID NO: 309855 - DNA, 30 bp, Artificial Sequence
  Description of Artificial Sequence: Synthetic oligonucleotide
ggctgtcgggagcaaagcatgatctagttg

SEQ ID NO: 309856 - DNA, 30 bp, Artificial Sequence
  Description of Artificial Sequence: Synthetic oligonucleotide
gctgtcgggagcaaagcatgatctagttgg

SEQ ID NO: 309857 - DNA, 30 bp, Artificial Sequence
  Description of Artificial Sequence: Synthetic oligonucleotide
ctgtcgggagcaaagcatgatctagttggc

SEQ ID NO: 309858 - DNA, 31 bp, Artificial Sequence
  Description of Artificial Sequence: Synthetic oligonucleotide
tgtcgggagcaaagcatgatctagttggctc

SEQ ID NO: 309859 - DNA, 30 bp, Artificial Sequence
  Description of Artificial Sequence: Synthetic oligonucleotide
gtcgggagcaaagcatgatctagttggctc

SEQ ID NO: 309860 - DNA, 30 bp, Artificial Sequence
  Description of Artificial Sequence: Synthetic oligonucleotide
tcgggagcaaagcatgatctagttggctcc

SEQ ID NO: 309861 - DNA, 29 bp, Artificial Sequence
  Description of Artificial Sequence: Synthetic oligonucleotide
cgggagcaaagcatgatctagttggctcc

SEQ ID NO: 309862 - DNA, 29 bp, Artificial Sequence
  Description of Artificial Sequence: Synthetic oligonucleotide
gggagcaaagcatgatctagttggctccg

SEQ ID NO: 309863 - DNA, 30 bp, Artificial Sequence
  Description of Artificial Sequence: Synthetic oligonucleotide
ggagcaaagcatgatctagttggctccgtc

SEQ ID NO: 309864 - DNA, 31 bp, Artificial Sequence
  Description of Artificial Sequence: Synthetic oligonucleotide
gagcaaagcatgatctagttggctccgtcac

SEQ ID NO: 309865 - DNA, 32 bp, Artificial Sequence
  Description of Artificial Sequence: Synthetic oligonucleotide
agcaaagcatgatctagttggctccgtcactg

SEQ ID NO: 309866 - DNA, 31 bp, Artificial Sequence
  Description of Artificial Sequence: Synthetic oligonucleotide
gcaaagcatgatctagttggctccgtcactg

SEQ ID NO: 309867 - DNA, 31 bp, Artificial Sequence
  Description of Artificial Sequence: Synthetic oligonucleotide
caaagcatgatctagttggctccgtcactgg

SEQ ID NO: 309868 - DNA, 31 bp, Artificial Sequence
  Description of Artificial Sequence: Synthetic oligonucleotide
aaagcatgatctagttggctccgtcactggc

SEQ ID NO: 309869 - DNA, 30 bp, Artificial Sequence
  Description of Artificial Sequence: Synthetic oligonucleotide
aagcatgatctagttggctccgtcactggc

SEQ ID NO: 309870 - DNA, 29 bp, Artificial Sequence
  Description of Artificial Sequence: Synthetic oligonucleotide
agcatgatctagttggctccgtcactggc

SEQ ID NO: 309871 - DNA, 28 bp, Artificial Sequence
  Description of Artificial Sequence: Synthetic oligonucleotide
gcatgatctagttggctccgtcactggc

SEQ ID NO: 309872 - DNA, 29 bp, Artificial Sequence
  Description of Artificial Sequence: Synthetic oligonucleotide
catgatctagttggctccgtcactggctg

SEQ ID NO: 309873 - DNA, 29 bp, Artificial Sequence
  Description of Artificial Sequence: Synthetic oligonucleotide
atgatctagttggctccgtcactggctgg

SEQ ID NO: 309874 - DNA, 28 bp, Artificial Sequence
  Description of Artificial Sequence: Synthetic oligonucleotide
tgatctagttggctccgtcactggctgg

SEQ ID NO: 309875 - DNA, 27 bp, Artificial Sequence
  Description of Artificial Sequence: Synthetic oligonucleotide
gatctagttggctccgtcactggctgg

SEQ ID NO: 309876 - DNA, 29 bp, Artificial Sequence
  Description of Artificial Sequence: Synthetic oligonucleotide
atctagttggctccgtcactggctggttc

SEQ ID NO: 309877 - DNA, 28 bp, Artificial Sequence
  Description of Artificial Sequence: Synthetic oligonucleotide
tctagttggctccgtcactggctggttc

SEQ ID NO: 309878 - DNA, 27 bp, Artificial Sequence
  Description of Artificial Sequence: Synthetic oligonucleotide
ctagttggctccgtcactggctggttc

SEQ ID NO: 309879 - DNA, 27 bp, Artificial Sequence
  Description of Artificial Sequence: Synthetic oligonucleotide
tagttggctccgtcactggctggttcc

SEQ ID NO: 309880 - DNA, 26 bp, Artificial Sequence
  Description of Artificial Sequence: Synthetic oligonucleotide
agttggctccgtcactggctggttcc

SEQ ID NO: 309881 - DNA, 25 bp, Artificial Sequence
  Description of Artificial Sequence: Synthetic oligonucleotide
gttggctccgtcactggctggttcc

SEQ ID NO: 309882 - DNA, 25 bp, Artificial Sequence
  Description of Artificial Sequence: Synthetic oligonucleotide
ttggctccgtcactggctggttccc

SEQ ID NO: 309883 - DNA, 24 bp, Artificial Sequence
  Description of Artificial Sequence: Synthetic oligonucleotide
tggctccgtcactggctggttccc

SEQ ID NO: 309884 - DNA, 23 bp, Artificial Sequence
  Description of Artificial Sequence: Synthetic oligonucleotide
ggctccgtcactggctggttccc

SEQ ID NO: 309885 - DNA, 23 bp, Artificial Sequence
  Description of Artificial Sequence: Synthetic oligonucleotide
gctccgtcactggctggttcccg

SEQ ID NO: 309886 - DNA, 25 bp, Artificial Sequence
  Description of Artificial Sequence: Synthetic oligonucleotide
ctccgtcactggctggttcccgcta

SEQ ID NO: 309887 - DNA, 25 bp, Artificial Sequence
  Description of Artificial Sequence: Synthetic oligonucleotide
tccgtcactggctggttcccgctag

SEQ ID NO: 309888 - DNA, 24 bp, Artificial Sequence
  Description of Artificial Sequence: Synthetic oligonucleotide
ccgtcactggctggttcccgctag

SEQ ID NO: 309889 - DNA, 25 bp, Artificial Sequence
  Description of Artificial Sequence: Synthetic oligonucleotide
cgtcactggctggttcccgctagct

SEQ ID NO: 309890 - DNA, 25 bp, Artificial Sequence
  Description of Artificial Sequence: Synthetic oligonucleotide
gtcactggctggttcccgctagctg

SEQ ID NO: 309891 - DNA, 26 bp, Artificial Sequence
  Description of Artificial Sequence: Synthetic oligonucleotide
tcactggctggttcccgctagctgga

SEQ ID NO: 309892 - DNA, 25 bp, Artificial Sequence
  Description of Artificial Sequence: Synthetic oligonucleotide
cactggctggttcccgctagctgga

SEQ ID NO: 309893 - DNA, 27 bp, Artificial Sequence
  Description of Artificial Sequence: Synthetic oligonucleotide
actggctggttcccgctagctggacaa

SEQ ID NO: 309894 - DNA, 26 bp, Artificial Sequence
  Description of Artificial Sequence: Synthetic oligonucleotide
ctggctggttcccgctagctggacaa

SEQ ID NO: 309895 - DNA, 27 bp, Artificial Sequence
  Description of Artificial Sequence: Synthetic oligonucleotide
tggctggttcccgctagctggacaagt

SEQ ID NO: 309896 - DNA, 26 bp, Artificial Sequence
  Description of Artificial Sequence: Synthetic oligonucleotide
ggctggttcccgctagctggacaagt

SEQ ID NO: 309897 - DNA, 27 bp, Artificial Sequence
  Description of Artificial Sequence: Synthetic oligonucleotide
gctggttcccgctagctggacaagtca

SEQ ID NO: 309898 - DNA, 27 bp, Artificial Sequence
  Description of Artificial Sequence: Synthetic oligonucleotide
ctggttcccgctagctggacaagtcag

SEQ ID NO: 309899 - DNA, 28 bp, Artificial Sequence
  Description of Artificial Sequence: Synthetic oligonucleotide
tggttcccgctagctggacaagtcagag

SEQ ID NO: 309900 - DNA, 27 bp, Artificial Sequence
  Description of Artificial Sequence: Synthetic oligonucleotide
ggttcccgctagctggacaagtcagag

SEQ ID NO: 309901 - DNA, 27 bp, Artificial Sequence
  Description of Artificial Sequence: Synthetic oligonucleotide
gttcccgctagctggacaagtcagagc

SEQ ID NO: 309902 - DNA, 28 bp, Artificial Sequence
  Description of Artificial Sequence: Synthetic oligonucleotide
ttcccgctagctggacaagtcagagcag

SEQ ID NO: 309903 - DNA, 27 bp, Artificial Sequence
  Description of Artificial Sequence: Synthetic oligonucleotide
tcccgctagctggacaagtcagagcag

SEQ ID NO: 309904 - DNA, 27 bp, Artificial Sequence
  Description of Artificial Sequence: Synthetic oligonucleotide
cccgctagctggacaagtcagagcagt

SEQ ID NO: 309905 - DNA, 27 bp, Artificial Sequence
  Description of Artificial Sequence: Synthetic oligonucleotide
ccgctagctggacaagtcagagcagtc

SEQ ID NO: 309906 - DNA, 27 bp, Artificial Sequence
  Description of Artificial Sequence: Synthetic oligonucleotide
cgctagctggacaagtcagagcagtcg

SEQ ID NO: 309907 - DNA, 28 bp, Artificial Sequence
  Description of Artificial Sequence: Synthetic oligonucleotide
gctagctggacaagtcagagcagtcgag

SEQ ID NO: 309908 - DNA, 28 bp, Artificial Sequence
  Description of Artificial Sequence: Synthetic oligonucleotide
ctagctggacaagtcagagcagtcgagc

SEQ ID NO: 309909 - DNA, 29 bp, Artificial Sequence
  Description of Artificial Sequence: Synthetic oligonucleotide
tagctggacaagtcagagcagtcgagcac

SEQ ID NO: 309910 - DNA, 28 bp, Artificial Sequence
  Description of Artificial Sequence: Synthetic oligonucleotide
agctggacaagtcagagcagtcgagcac

SEQ ID NO: 309911 - DNA, 27 bp, Artificial Sequence
  Description of Artificial Sequence: Synthetic oligonucleotide
gctggacaagtcagagcagtcgagcac

SEQ ID NO: 309912 - DNA, 28 bp, Artificial Sequence
  Description of Artificial Sequence: Synthetic oligonucleotide
ctggacaagtcagagcagtcgagcacac

SEQ ID NO: 309913 - DNA, 29 bp, Artificial Sequence
  Description of Artificial Sequence: Synthetic oligonucleotide
tggacaagtcagagcagtcgagcacactc

SEQ ID NO: 309914 - DNA, 28 bp, Artificial Sequence
  Description of Artificial Sequence: Synthetic oligonucleotide
ggacaagtcagagcagtcgagcacactc

SEQ ID NO: 309915 - DNA, 28 bp, Artificial Sequence
  Description of Artificial Sequence: Synthetic oligonucleotide
gacaagtcagagcagtcgagcacactcc

SEQ ID NO: 309916 - DNA, 28 bp, Artificial Sequence
  Description of Artificial Sequence: Synthetic oligonucleotide
acaagtcagagcagtcgagcacactccc

SEQ ID NO: 309917 - DNA, 27 bp, Artificial Sequence
  Description of Artificial Sequence: Synthetic oligonucleotide
caagtcagagcagtcgagcacactccc

SEQ ID NO: 309918 - DNA, 28 bp, Artificial Sequence
  Description of Artificial Sequence: Synthetic oligonucleotide
aagtcagagcagtcgagcacactccctc

SEQ ID NO: 309919 - DNA, 27 bp, Artificial Sequence
  Description of Artificial Sequence: Synthetic oligonucleotide
agtcagagcagtcgagcacactccctc

SEQ ID NO: 309920 - DNA, 26 bp, Artificial Sequence
  Description of Artificial Sequence: Synthetic oligonucleotide
gtcagagcagtcgagcacactccctc

SEQ ID NO: 309921 - DNA, 26 bp, Artificial Sequence
  Description of Artificial Sequence: Synthetic oligonucleotide
tcagagcagtcgagcacactccctcc

SEQ ID NO: 309922 - DNA, 25 bp, Artificial Sequence
  Description of Artificial Sequence: Synthetic oligonucleotide
cagagcagtcgagcacactccctcc

SEQ ID NO: 309923 - DNA, 25 bp, Artificial Sequence
  Description of Artificial Sequence: Synthetic oligonucleotide
agagcagtcgagcacactccctccc

SEQ ID NO: 309924 - DNA, 24 bp, Artificial Sequence
  Description of Artificial Sequence: Synthetic oligonucleotide
gagcagtcgagcacactccctccc

SEQ ID NO: 309925 - DNA, 25 bp, Artificial Sequence
  Description of Artificial Sequence: Synthetic oligonucleotide
agcagtcgagcacactccctcccga

SEQ ID NO: 309926 - DNA, 24 bp, Artificial Sequence
  Description of Artificial Sequence: Synthetic oligonucleotide
gcagtcgagcacactccctcccga

SEQ ID NO: 309927 - DNA, 25 bp, Artificial Sequence
  Description of Artificial Sequence: Synthetic oligonucleotide
cagtcgagcacactccctcccgagt

SEQ ID NO: 309928 - DNA, 25 bp, Artificial Sequence
  Description of Artificial Sequence: Synthetic oligonucleotide
agtcgagcacactccctcccgagtc

SEQ ID NO: 309929 - DNA, 24 bp, Artificial Sequence
  Description of Artificial Sequence: Synthetic oligonucleotide
gtcgagcacactccctcccgagtc

SEQ ID NO: 309930 - DNA, 26 bp, Artificial Sequence
  Description of Artificial Sequence: Synthetic oligonucleotide
tcgagcacactccctcccgagtccaa

SEQ ID NO: 309931 - DNA, 25 bp, Artificial Sequence
  Description of Artificial Sequence: Synthetic oligonucleotide
cgagcacactccctcccgagtccaa

SEQ ID NO: 309932 - DNA, 25 bp, Artificial Sequence
  Description of Artificial Sequence: Synthetic oligonucleotide
gagcacactccctcccgagtccaag

SEQ ID NO: 309933 - DNA, 26 bp, Artificial Sequence
  Description of Artificial Sequence: Synthetic oligonucleotide
agcacactccctcccgagtccaagga

SEQ ID NO: 309934 - DNA, 25 bp, Artificial Sequence
  Description of Artificial Sequence: Synthetic oligonucleotide
gcacactccctcccgagtccaagga

SEQ ID NO: 309935 - DNA, 25 bp, Artificial Sequence
  Description of Artificial Sequence: Synthetic oligonucleotide
cacactccctcccgagtccaaggac

SEQ ID NO: 309936 - DNA, 26 bp, Artificial Sequence
  Description of Artificial Sequence: Synthetic oligonucleotide
acactccctcccgagtccaaggacct

SEQ ID NO: 309937 - DNA, 25 bp, Artificial Sequence
  Description of Artificial Sequence: Synthetic oligonucleotide
cactccctcccgagtccaaggacct

SEQ ID NO: 309938 - DNA, 25 bp, Artificial Sequence
  Description of Artificial Sequence: Synthetic oligonucleotide
actccctcccgagtccaaggacctc

SEQ ID NO: 309939 - DNA, 24 bp, Artificial Sequence
  Description of Artificial Sequence: Synthetic oligonucleotide
ctccctcccgagtccaaggacctc

SEQ ID NO: 309940 - DNA, 24 bp, Artificial Sequence
  Description of Artificial Sequence: Synthetic oligonucleotide
tccctcccgagtccaaggacctcg

SEQ ID NO: 309941 - DNA, 23 bp, Artificial Sequence
  Description of Artificial Sequence: Synthetic oligonucleotide
ccctcccgagtccaaggacctcg

SEQ ID NO: 309942 - DNA, 23 bp, Artificial Sequence
  Description of Artificial Sequence: Synthetic oligonucleotide
cctcccgagtccaaggacctcgc

SEQ ID NO: 309943 - DNA, 23 bp, Artificial Sequence
  Description of Artificial Sequence: Synthetic oligonucleotide
ctcccgagtccaaggacctcgcc

SEQ ID NO: 309944 - DNA, 24 bp, Artificial Sequence
  Description of Artificial Sequence: Synthetic oligonucleotide
tcccgagtccaaggacctcgccgt

SEQ ID NO: 309945 - DNA, 23 bp, Artificial Sequence
  Description of Artificial Sequence: Synthetic oligonucleotide
cccgagtccaaggacctcgccgt

SEQ ID NO: 309946 - DNA, 23 bp, Artificial Sequence
  Description of Artificial Sequence: Synthetic oligonucleotide
ccgagtccaaggacctcgccgtg

SEQ ID NO: 309947 - DNA, 25 bp, Artificial Sequence
  Description of Artificial Sequence: Synthetic oligonucleotide
cgagtccaaggacctcgccgtggaa

SEQ ID NO: 309948 - DNA, 26 bp, Artificial Sequence
  Description of Artificial Sequence: Synthetic oligonucleotide
gagtccaaggacctcgccgtggaact

SEQ ID NO: 309949 - DNA, 27 bp, Artificial Sequence
  Description of Artificial Sequence: Synthetic oligonucleotide
agtccaaggacctcgccgtggaactga

SEQ ID NO: 309950 - DNA, 27 bp, Artificial Sequence
  Description of Artificial Sequence: Synthetic oligonucleotide
gtccaaggacctcgccgtggaactgat

SEQ ID NO: 309951 - DNA, 27 bp, Artificial Sequence
  Description of Artificial Sequence: Synthetic oligonucleotide
tccaaggacctcgccgtggaactgatc

SEQ ID NO: 309952 - DNA, 26 bp, Artificial Sequence
  Description of Artificial Sequence: Synthetic oligonucleotide
ccaaggacctcgccgtggaactgatc

SEQ ID NO: 309953 - DNA, 27 bp, Artificial Sequence
  Description of Artificial Sequence: Synthetic oligonucleotide
caaggacctcgccgtggaactgatcca

SEQ ID NO: 309954 - DNA, 27 bp, Artificial Sequence
  Description of Artificial Sequence: Synthetic oligonucleotide
aaggacctcgccgtggaactgatccag

SEQ ID NO: 309955 - DNA, 27 bp, Artificial Sequence
  Description of Artificial Sequence: Synthetic oligonucleotide
aggacctcgccgtggaactgatccagt

SEQ ID NO: 309956 - DNA, 27 bp, Artificial Sequence
  Description of Artificial Sequence: Synthetic oligonucleotide
ggacctcgccgtggaactgatccagta

SEQ ID NO: 309957 - DNA, 28 bp, Artificial Sequence
  Description of Artificial Sequence: Synthetic oligonucleotide
gacctcgccgtggaactgatccagtaag

SEQ ID NO: 309958 - DNA, 28 bp, Artificial Sequence
  Description of Artificial Sequence: Synthetic oligonucleotide
acctcgccgtggaactgatccagtaagg

SEQ ID NO: 309959 - DNA, 27 bp, Artificial Sequence
  Description of Artificial Sequence: Synthetic oligonucleotide
cctcgccgtggaactgatccagtaagg

SEQ ID NO: 309960 - DNA, 27 bp, Artificial Sequence
  Description of Artificial Sequence: Synthetic oligonucleotide
ctcgccgtggaactgatccagtaaggc

SEQ ID NO: 309961 - DNA, 29 bp, Artificial Sequence
  Description of Artificial Sequence: Synthetic oligonucleotide
tcgccgtggaactgatccagtaaggctac

SEQ ID NO: 309962 - DNA, 28 bp, Artificial Sequence
  Description of Artificial Sequence: Synthetic oligonucleotide
cgccgtggaactgatccagtaaggctac

SEQ ID NO: 309963 - DNA, 30 bp, Artificial Sequence
  Description of Artificial Sequence: Synthetic oligonucleotide
gccgtggaactgatccagtaaggctacaag

SEQ ID NO: 309964 - DNA, 30 bp, Artificial Sequence
  Description of Artificial Sequence: Synthetic oligonucleotide
ccgtggaactgatccagtaaggctacaagc

SEQ ID NO: 309965 - DNA, 30 bp, Artificial Sequence
  Description of Artificial Sequence: Synthetic oligonucleotide
cgtggaactgatccagtaaggctacaagcg

SEQ ID NO: 309966 - DNA, 30 bp, Artificial Sequence
  Description of Artificial Sequence: Synthetic oligonucleotide
gtggaactgatccagtaaggctacaagcgg

SEQ ID NO: 309967 - DNA, 32 bp, Artificial Sequence
  Description of Artificial Sequence: Synthetic oligonucleotide
tggaactgatccagtaaggctacaagcggatc

SEQ ID NO: 309968 - DNA, 31 bp, Artificial Sequence
  Description of Artificial Sequence: Synthetic oligonucleotide
ggaactgatccagtaaggctacaagcggatc

SEQ ID NO: 309969 - DNA, 31 bp, Artificial Sequence
  Description of Artificial Sequence: Synthetic oligonucleotide
gaactgatccagtaaggctacaagcggatcc

SEQ ID NO: 309970 - DNA, 32 bp, Artificial Sequence
  Description of Artificial Sequence: Synthetic oligonucleotide
aactgatccagtaaggctacaagcggatccac

SEQ ID NO: 309971 - DNA, 31 bp, Artificial Sequence
  Description of Artificial Sequence: Synthetic oligonucleotide
actgatccagtaaggctacaagcggatccac

SEQ ID NO: 309972 - DNA, 30 bp, Artificial Sequence
  Description of Artificial Sequence: Synthetic oligonucleotide
ctgatccagtaaggctacaagcggatccac

SEQ ID NO: 309973 - DNA, 30 bp, Artificial Sequence
  Description of Artificial Sequence: Synthetic oligonucleotide
tgatccagtaaggctacaagcggatccacc

SEQ ID NO: 309974 - DNA, 29 bp, Artificial Sequence
  Description of Artificial Sequence: Synthetic oligonucleotide
gatccagtaaggctacaagcggatccacc

SEQ ID NO: 309975 - DNA, 30 bp, Artificial Sequence
  Description of Artificial Sequence: Synthetic oligonucleotide
atccagtaaggctacaagcggatccaccag

SEQ ID NO: 309976 - DNA, 29 bp, Artificial Sequence
  Description of Artificial Sequence: Synthetic oligonucleotide
tccagtaaggctacaagcggatccaccag

SEQ ID NO: 309977 - DNA, 28 bp, Artificial Sequence
  Description of Artificial Sequence: Synthetic oligonucleotide
ccagtaaggctacaagcggatccaccag

SEQ ID NO: 309978 - DNA, 31 bp, Artificial Sequence
  Description of Artificial Sequence: Synthetic oligonucleotide
cagtaaggctacaagcggatccaccagtttc

SEQ ID NO: 309979 - DNA, 31 bp, Artificial Sequence
  Description of Artificial Sequence: Synthetic oligonucleotide
agtaaggctacaagcggatccaccagtttcg

SEQ ID NO: 309980 - DNA, 30 bp, Artificial Sequence
  Description of Artificial Sequence: Synthetic oligonucleotide
gtaaggctacaagcggatccaccagtttcg

SEQ ID NO: 309981 - DNA, 30 bp, Artificial Sequence
  Description of Artificial Sequence: Synthetic oligonucleotide
taaggctacaagcggatccaccagtttcgg

SEQ ID NO: 309982 - DNA, 29 bp, Artificial Sequence
  Description of Artificial Sequence: Synthetic oligonucleotide
aaggctacaagcggatccaccagtttcgg

SEQ ID NO: 309983 - DNA, 28 bp, Artificial Sequence
  Description of Artificial Sequence: Synthetic oligonucleotide
aggctacaagcggatccaccagtttcgg

SEQ ID NO: 309984 - DNA, 27 bp, Artificial Sequence
  Description of Artificial Sequence: Synthetic oligonucleotide
ggctacaagcggatccaccagtttcgg

SEQ ID NO: 309985 - DNA, 29 bp, Artificial Sequence
  Description of Artificial Sequence: Synthetic oligonucleotide
gctacaagcggatccaccagtttcggtag

SEQ ID NO: 309986 - DNA, 29 bp, Artificial Sequence
  Description of Artificial Sequence: Synthetic oligonucleotide
ctacaagcggatccaccagtttcggtagg

SEQ ID NO: 309987 - DNA, 29 bp, Artificial Sequence
  Description of Artificial Sequence: Synthetic oligonucleotide
tacaagcggatccaccagtttcggtaggc

SEQ ID NO: 309988 - DNA, 28 bp, Artificial Sequence
  Description of Artificial Sequence: Synthetic oligonucleotide
acaagcggatccaccagtttcggtaggc

SEQ ID NO: 309989 - DNA, 27 bp, Artificial Sequence
  Description of Artificial Sequence: Synthetic oligonucleotide
caagcggatccaccagtttcggtaggc

SEQ ID NO: 309990 - DNA, 27 bp, Artificial Sequence
  Description of Artificial Sequence: Synthetic oligonucleotide
aagcggatccaccagtttcggtaggcg

SEQ ID NO: 309991 - DNA, 26 bp, Artificial Sequence
  Description of Artificial Sequence: Synthetic oligonucleotide
agcggatccaccagtttcggtaggcg

SEQ ID NO: 309992 - DNA, 25 bp, Artificial Sequence
  Description of Artificial Sequence: Synthetic oligonucleotide
gcggatccaccagtttcggtaggcg

SEQ ID NO: 309993 - DNA, 27 bp, Artificial Sequence
  Description of Artificial Sequence: Synthetic oligonucleotide
cggatccaccagtttcggtaggcggat

SEQ ID NO: 309994 - DNA, 27 bp, Artificial Sequence
  Description of Artificial Sequence: Synthetic oligonucleotide
ggatccaccagtttcggtaggcggatg

SEQ ID NO: 309995 - DNA, 27 bp, Artificial Sequence
  Description of Artificial Sequence: Synthetic oligonucleotide
gatccaccagtttcggtaggcggatgc

SEQ ID NO: 309996 - DNA, 29 bp, Artificial Sequence
  Description of Artificial Sequence: Synthetic oligonucleotide
atccaccagtttcggtaggcggatgcttc

SEQ ID NO: 309997 - DNA, 28 bp, Artificial Sequence
  Description of Artificial Sequence: Synthetic oligonucleotide
tccaccagtttcggtaggcggatgcttc

SEQ ID NO: 309998 - DNA, 27 bp, Artificial Sequence
  Description of Artificial Sequence: Synthetic oligonucleotide
ccaccagtttcggtaggcggatgcttc

SEQ ID NO: 309999 - DNA, 27 bp, Artificial Sequence
  Description of Artificial Sequence: Synthetic oligonucleotide
caccagtttcggtaggcggatgcttcc

SEQ ID NO: 310000 - DNA, 30 bp, Artificial Sequence
  Description of Artificial Sequence: Synthetic oligonucleotide
accagtttcggtaggcggatgcttcctatg

SEQ ID NO: 310001 - DNA, 29 bp, Artificial Sequence
  Description of Artificial Sequence: Synthetic oligonucleotide
ccagtttcggtaggcggatgcttcctatg

SEQ ID NO: 310002 - DNA, 29 bp, Artificial Sequence
  Description of Artificial Sequence: Synthetic oligonucleotide
cagtttcggtaggcggatgcttcctatgc

SEQ ID NO: 310003 - DNA, 29 bp, Artificial Sequence
  Description of Artificial Sequence: Synthetic oligonucleotide
agtttcggtaggcggatgcttcctatgcc

SEQ ID NO: 310004 - DNA, 28 bp, Artificial Sequence
  Description of Artificial Sequence: Synthetic oligonucleotide
gtttcggtaggcggatgcttcctatgcc

SEQ ID NO: 310005 - DNA, 28 bp, Artificial Sequence
  Description of Artificial Sequence: Synthetic oligonucleotide
tttcggtaggcggatgcttcctatgccg

SEQ ID NO: 310006 - DNA, 27 bp, Artificial Sequence
  Description of Artificial Sequence: Synthetic oligonucleotide
ttcggtaggcggatgcttcctatgccg

SEQ ID NO: 310007 - DNA, 26 bp, Artificial Sequence
  Description of Artificial Sequence: Synthetic oligonucleotide
tcggtaggcggatgcttcctatgccg

SEQ ID NO: 310008 - DNA, 25 bp, Artificial Sequence
  Description of Artificial Sequence: Synthetic oligonucleotide
cggtaggcggatgcttcctatgccg

SEQ ID NO: 310009 - DNA, 27 bp, Artificial Sequence
  Description of Artificial Sequence: Synthetic oligonucleotide
ggtaggcggatgcttcctatgccgctt

SEQ ID NO: 310010 - DNA, 27 bp, Artificial Sequence
  Description of Artificial Sequence: Synthetic oligonucleotide
gtaggcggatgcttcctatgccgcttg

SEQ ID NO: 310011 - DNA, 27 bp, Artificial Sequence
  Description of Artificial Sequence: Synthetic oligonucleotide
taggcggatgcttcctatgccgcttgg

SEQ ID NO: 310012 - DNA, 27 bp, Artificial Sequence
  Description of Artificial Sequence: Synthetic oligonucleotide
aggcggatgcttcctatgccgcttggt

SEQ ID NO: 310013 - DNA, 27 bp, Artificial Sequence
  Description of Artificial Sequence: Synthetic oligonucleotide
ggcggatgcttcctatgccgcttggtt

SEQ ID NO: 310014 - DNA, 27 bp, Artificial Sequence
  Description of Artificial Sequence: Synthetic oligonucleotide
gcggatgcttcctatgccgcttggttg

SEQ ID NO: 310015 - DNA, 28 bp, Artificial Sequence
  Description of Artificial Sequence: Synthetic oligonucleotide
cggatgcttcctatgccgcttggttgac

SEQ ID NO: 310016 - DNA, 29 bp, Artificial Sequence
  Description of Artificial Sequence: Synthetic oligonucleotide
ggatgcttcctatgccgcttggttgacac

SEQ ID NO: 310017 - DNA, 29 bp, Artificial Sequence
  Description of Artificial Sequence: Synthetic oligonucleotide
gatgcttcctatgccgcttggttgacacg

SEQ ID NO: 310018 - DNA, 29 bp, Artificial Sequence
  Description of Artificial Sequence: Synthetic oligonucleotide
atgcttcctatgccgcttggttgacacgg

SEQ ID NO: 310019 - DNA, 28 bp, Artificial Sequence
  Description of Artificial Sequence: Synthetic oligonucleotide
tgcttcctatgccgcttggttgacacgg

SEQ ID NO: 310020 - DNA, 27 bp, Artificial Sequence
  Description of Artificial Sequence: Synthetic oligonucleotide
gcttcctatgccgcttggttgacacgg

SEQ ID NO: 310021 - DNA, 27 bp, Artificial Sequence
  Description of Artificial Sequence: Synthetic oligonucleotide
cttcctatgccgcttggttgacacggg

SEQ ID NO: 310022 - DNA, 27 bp, Artificial Sequence
  Description of Artificial Sequence: Synthetic oligonucleotide
ttcctatgccgcttggttgacacgggg

SEQ ID NO: 310023 - DNA, 26 bp, Artificial Sequence
  Description of Artificial Sequence: Synthetic oligonucleotide
tcctatgccgcttggttgacacgggg

SEQ ID NO: 310024 - DNA, 25 bp, Artificial Sequence
  Description of Artificial Sequence: Synthetic oligonucleotide
cctatgccgcttggttgacacgggg

SEQ ID NO: 310025 - DNA, 26 bp, Artificial Sequence
  Description of Artificial Sequence: Synthetic oligonucleotide
ctatgccgcttggttgacacggggca

SEQ ID NO: 310026 - DNA, 26 bp, Artificial Sequence
  Description of Artificial Sequence: Synthetic oligonucleotide
tatgccgcttggttgacacggggcac

SEQ ID NO: 310027 - DNA, 25 bp, Artificial Sequence
  Description of Artificial Sequence: Synthetic oligonucleotide
atgccgcttggttgacacggggcac

SEQ ID NO: 310028 - DNA, 24 bp, Artificial Sequence
  Description of Artificial Sequence: Synthetic oligonucleotide
tgccgcttggttgacacggggcac

SEQ ID NO: 310029 - DNA, 23 bp, Artificial Sequence
  Description of Artificial Sequence: Synthetic oligonucleotide
gccgcttggttgacacggggcac

SEQ ID NO: 310030 - DNA, 24 bp, Artificial Sequence
  Description of Artificial Sequence: Synthetic oligonucleotide
ccgcttggttgacacggggcacca

SEQ ID NO: 310031 - DNA, 24 bp, Artificial Sequence
  Description of Artificial Sequence: Synthetic oligonucleotide
cgcttggttgacacggggcaccag

SEQ ID NO: 310032 - DNA, 25 bp, Artificial Sequence
  Description of Artificial Sequence: Synthetic oligonucleotide
gcttggttgacacggggcaccagca

SEQ ID NO: 310033 - DNA, 25 bp, Artificial Sequence
  Description of Artificial Sequence: Synthetic oligonucleotide
cttggttgacacggggcaccagcac

SEQ ID NO: 310034 - DNA, 26 bp, Artificial Sequence
  Description of Artificial Sequence: Synthetic oligonucleotide
ttggttgacacggggcaccagcacct

SEQ ID NO: 310035 - DNA, 25 bp, Artificial Sequence
  Description of Artificial Sequence: Synthetic oligonucleotide
tggttgacacggggcaccagcacct

SEQ ID NO: 310036 - DNA, 24 bp, Artificial Sequence
  Description of Artificial Sequence: Synthetic oligonucleotide
ggttgacacggggcaccagcacct

SEQ ID NO: 310037 - DNA, 24 bp, Artificial Sequence
  Description of Artificial Sequence: Synthetic oligonucleotide
gttgacacggggcaccagcacctg

SEQ ID NO: 310038 - DNA, 24 bp, Artificial Sequence
  Description of Artificial Sequence: Synthetic oligonucleotide
ttgacacggggcaccagcacctgc

SEQ ID NO: 310039 - DNA, 23 bp, Artificial Sequence
  Description of Artificial Sequence: Synthetic oligonucleotide
tgacacggggcaccagcacctgc

SEQ ID NO: 310040 - DNA, 22 bp, Artificial Sequence
  Description of Artificial Sequence: Synthetic oligonucleotide
gacacggggcaccagcacctgc

SEQ ID NO: 310041 - DNA, 23 bp, Artificial Sequence
  Description of Artificial Sequence: Synthetic oligonucleotide
acacggggcaccagcacctgcct

SEQ ID NO: 310042 - DNA, 22 bp, Artificial Sequence
  Description of Artificial Sequence: Synthetic oligonucleotide
cacggggcaccagcacctgcct

SEQ ID NO: 310043 - DNA, 23 bp, Artificial Sequence
  Description of Artificial Sequence: Synthetic oligonucleotide
acggggcaccagcacctgcctca

SEQ ID NO: 310044 - DNA, 22 bp, Artificial Sequence
  Description of Artificial Sequence: Synthetic oligonucleotide
cggggcaccagcacctgcctca

SEQ ID NO: 310045 - DNA, 23 bp, Artificial Sequence
  Description of Artificial Sequence: Synthetic oligonucleotide
ggggcaccagcacctgcctcaca

SEQ ID NO: 310046 - DNA, 23 bp, Artificial Sequence
  Description of Artificial Sequence: Synthetic oligonucleotide
gggcaccagcacctgcctcacag

SEQ ID NO: 310047 - DNA, 23 bp, Artificial Sequence
  Description of Artificial Sequence: Synthetic oligonucleotide
ggcaccagcacctgcctcacagc

SEQ ID NO: 310048 - DNA, 26 bp, Artificial Sequence
  Description of Artificial Sequence: Synthetic oligonucleotide
gcaccagcacctgcctcacagccatt

SEQ ID NO: 310049 - DNA, 27 bp, Artificial Sequence
  Description of Artificial Sequence: Synthetic oligonucleotide
caccagcacctgcctcacagccattgt

SEQ ID NO: 310050 - DNA, 27 bp, Artificial Sequence
  Description of Artificial Sequence: Synthetic oligonucleotide
accagcacctgcctcacagccattgtg

SEQ ID NO: 310051 - DNA, 27 bp, Artificial Sequence
  Description of Artificial Sequence: Synthetic oligonucleotide
ccagcacctgcctcacagccattgtgt

SEQ ID NO: 310052 - DNA, 28 bp, Artificial Sequence
  Description of Artificial Sequence: Synthetic oligonucleotide
cagcacctgcctcacagccattgtgttg

SEQ ID NO: 310053 - DNA, 30 bp, Artificial Sequence
  Description of Artificial Sequence: Synthetic oligonucleotide
agcacctgcctcacagccattgtgttgatg

SEQ ID NO: 310054 - DNA, 29 bp, Artificial Sequence
  Description of Artificial Sequence: Synthetic oligonucleotide
gcacctgcctcacagccattgtgttgatg

SEQ ID NO: 310055 - DNA, 29 bp, Artificial Sequence
  Description of Artificial Sequence: Synthetic oligonucleotide
cacctgcctcacagccattgtgttgatgg

SEQ ID NO: 310056 - DNA, 30 bp, Artificial Sequence
  Description of Artificial Sequence: Synthetic oligonucleotide
acctgcctcacagccattgtgttgatggtc

SEQ ID NO: 310057 - DNA, 29 bp, Artificial Sequence
  Description of Artificial Sequence: Synthetic oligonucleotide
cctgcctcacagccattgtgttgatggtc

SEQ ID NO: 310058 - DNA, 29 bp, Artificial Sequence
  Description of Artificial Sequence: Synthetic oligonucleotide
ctgcctcacagccattgtgttgatggtcc

SEQ ID NO: 310059 - DNA, 30 bp, Artificial Sequence
  Description of Artificial Sequence: Synthetic oligonucleotide
tgcctcacagccattgtgttgatggtcctg

SEQ ID NO: 310060 - DNA, 29 bp, Artificial Sequence
  Description of Artificial Sequence: Synthetic oligonucleotide
gcctcacagccattgtgttgatggtcctg

SEQ ID NO: 310061 - DNA, 30 bp, Artificial Sequence
  Description of Artificial Sequence: Synthetic oligonucleotide
cctcacagccattgtgttgatggtcctgag

SEQ ID NO: 310062 - DNA, 33 bp, Artificial Sequence
  Description of Artificial Sequence: Synthetic oligonucleotide
ctcacagccattgtgttgatggtcctgagattg

SEQ ID NO: 310063 - DNA, 33 bp, Artificial Sequence
  Description of Artificial Sequence: Synthetic oligonucleotide
tcacagccattgtgttgatggtcctgagattgg

SEQ ID NO: 310064 - DNA, 32 bp, Artificial Sequence
  Description of Artificial Sequence: Synthetic oligonucleotide
cacagccattgtgttgatggtcctgagattgg

SEQ ID NO: 310065 - DNA, 32 bp, Artificial Sequence
  Description of Artificial Sequence: Synthetic oligonucleotide
acagccattgtgttgatggtcctgagattggc

SEQ ID NO: 310066 - DNA, 31 bp, Artificial Sequence
  Description of Artificial Sequence: Synthetic oligonucleotide
cagccattgtgttgatggtcctgagattggc

SEQ ID NO: 310067 - DNA, 31 bp, Artificial Sequence
  Description of Artificial Sequence: Synthetic oligonucleotide
agccattgtgttgatggtcctgagattggcc

SEQ ID NO: 310068 - DNA, 30 bp, Artificial Sequence
  Description of Artificial Sequence: Synthetic oligonucleotide
gccattgtgttgatggtcctgagattggcc

SEQ ID NO: 310069 - DNA, 30 bp, Artificial Sequence
  Description of Artificial Sequence: Synthetic oligonucleotide
ccattgtgttgatggtcctgagattggccc

SEQ ID NO: 310070 - DNA, 31 bp, Artificial Sequence
  Description of Artificial Sequence: Synthetic oligonucleotide
cattgtgttgatggtcctgagattggcccag

SEQ ID NO: 310071 - DNA, 31 bp, Artificial Sequence
  Description of Artificial Sequence: Synthetic oligonucleotide
attgtgttgatggtcctgagattggcccagc

SEQ ID NO: 310072 - DNA, 30 bp, Artificial Sequence
  Description of Artificial Sequence: Synthetic oligonucleotide
ttgtgttgatggtcctgagattggcccagc

SEQ ID NO: 310073 - DNA, 29 bp, Artificial Sequence
  Description of Artificial Sequence: Synthetic oligonucleotide
tgtgttgatggtcctgagattggcccagc

SEQ ID NO: 310074 - DNA, 28 bp, Artificial Sequence
  Description of Artificial Sequence: Synthetic oligonucleotide
gtgttgatggtcctgagattggcccagc

SEQ ID NO: 310075 - DNA, 29 bp, Artificial Sequence
  Description of Artificial Sequence: Synthetic oligonucleotide
tgttgatggtcctgagattggcccagcag

SEQ ID NO: 310076 - DNA, 28 bp, Artificial Sequence
  Description of Artificial Sequence: Synthetic oligonucleotide
gttgatggtcctgagattggcccagcag

SEQ ID NO: 310077 - DNA, 28 bp, Artificial Sequence
  Description of Artificial Sequence: Synthetic oligonucleotide
ttgatggtcctgagattggcccagcagc

SEQ ID NO: 310078 - DNA, 27 bp, Artificial Sequence
  Description of Artificial Sequence: Synthetic oligonucleotide
tgatggtcctgagattggcccagcagc

SEQ ID NO: 310079 - DNA, 27 bp, Artificial Sequence
  Description of Artificial Sequence: Synthetic oligonucleotide
gatggtcctgagattggcccagcagca

SEQ ID NO: 310080 - DNA, 27 bp, Artificial Sequence
  Description of Artificial Sequence: Synthetic oligonucleotide
atggtcctgagattggcccagcagcag

SEQ ID NO: 310081 - DNA, 26 bp, Artificial Sequence
  Description of Artificial Sequence: Synthetic oligonucleotide
tggtcctgagattggcccagcagcag

SEQ ID NO: 310082 - DNA, 25 bp, Artificial Sequence
  Description of Artificial Sequence: Synthetic oligonucleotide
ggtcctgagattggcccagcagcag

SEQ ID NO: 310083 - DNA, 27 bp, Artificial Sequence
  Description of Artificial Sequence: Synthetic oligonucleotide
gtcctgagattggcccagcagcaggta

SEQ ID NO: 310084 - DNA, 27 bp, Artificial Sequence
  Description of Artificial Sequence: Synthetic oligonucleotide
tcctgagattggcccagcagcaggtag

SEQ ID NO: 310085 - DNA, 26 bp, Artificial Sequence
  Description of Artificial Sequence: Synthetic oligonucleotide
cctgagattggcccagcagcaggtag

SEQ ID NO: 310086 - DNA, 26 bp, Artificial Sequence
  Description of Artificial Sequence: Synthetic oligonucleotide
ctgagattggcccagcagcaggtagc

SEQ ID NO: 310087 - DNA, 26 bp, Artificial Sequence
  Description of Artificial Sequence: Synthetic oligonucleotide
tgagattggcccagcagcaggtagcc

SEQ ID NO: 310088 - DNA, 25 bp, Artificial Sequence
  Description of Artificial Sequence: Synthetic oligonucleotide
gagattggcccagcagcaggtagcc

SEQ ID NO: 310089 - DNA, 25 bp, Artificial Sequence
  Description of Artificial Sequence: Synthetic oligonucleotide
agattggcccagcagcaggtagccg

SEQ ID NO: 310090 - DNA, 24 bp, Artificial Sequence
  Description of Artificial Sequence: Synthetic oligonucleotide
gattggcccagcagcaggtagccg

SEQ ID NO: 310091 - DNA, 24 bp, Artificial Sequence
  Description of Artificial Sequence: Synthetic oligonucleotide
attggcccagcagcaggtagccgg

SEQ ID NO: 310092 - DNA, 23 bp, Artificial Sequence
  Description of Artificial Sequence: Synthetic oligonucleotide
ttggcccagcagcaggtagccgg

SEQ ID NO: 310093 - DNA, 22 bp, Artificial Sequence
  Description of Artificial Sequence: Synthetic oligonucleotide
tggcccagcagcaggtagccgg

SEQ ID NO: 310094 - DNA, 21 bp, Artificial Sequence
  Description of Artificial Sequence: Synthetic oligonucleotide
ggcccagcagcaggtagccgg

SEQ ID NO: 310095 - DNA, 22 bp, Artificial Sequence
  Description of Artificial Sequence: Synthetic oligonucleotide
gcccagcagcaggtagccggct

SEQ ID NO: 310096 - DNA, 22 bp, Artificial Sequence
  Description of Artificial Sequence: Synthetic oligonucleotide
cccagcagcaggtagccggctc

SEQ ID NO: 310097 - DNA, 22 bp, Artificial Sequence
  Description of Artificial Sequence: Synthetic oligonucleotide
ccagcagcaggtagccggctcg

SEQ ID NO: 310098 - DNA, 22 bp, Artificial Sequence
  Description of Artificial Sequence: Synthetic oligonucleotide
cagcagcaggtagccggctcgc

SEQ ID NO: 310099 - DNA, 23 bp, Artificial Sequence
  Description of Artificial Sequence: Synthetic oligonucleotide
agcagcaggtagccggctcgcca

SEQ ID NO: 310100 - DNA, 22 bp, Artificial Sequence
  Description of Artificial Sequence: Synthetic oligonucleotide
gcagcaggtagccggctcgcca

SEQ ID NO: 310101 - DNA, 23 bp, Artificial Sequence
  Description of Artificial Sequence: Synthetic oligonucleotide
cagcaggtagccggctcgccaga

SEQ ID NO: 310102 - DNA, 26 bp, Artificial Sequence
  Description of Artificial Sequence: Synthetic oligonucleotide
agcaggtagccggctcgccagagaaa

SEQ ID NO: 310103 - DNA, 25 bp, Artificial Sequence
  Description of Artificial Sequence: Synthetic oligonucleotide
gcaggtagccggctcgccagagaaa

SEQ ID NO: 310104 - DNA, 26 bp, Artificial Sequence
  Description of Artificial Sequence: Synthetic oligonucleotide
caggtagccggctcgccagagaaact

SEQ ID NO: 310105 - DNA, 26 bp, Artificial Sequence
  Description of Artificial Sequence: Synthetic oligonucleotide
aggtagccggctcgccagagaaactg

SEQ ID NO: 310106 - DNA, 25 bp, Artificial Sequence
  Description of Artificial Sequence: Synthetic oligonucleotide
ggtagccggctcgccagagaaactg

SEQ ID NO: 310107 - DNA, 26 bp, Artificial Sequence
  Description of Artificial Sequence: Synthetic oligonucleotide
gtagccggctcgccagagaaactgga

SEQ ID NO: 310108 - DNA, 26 bp, Artificial Sequence
  Description of Artificial Sequence: Synthetic oligonucleotide
tagccggctcgccagagaaactggag

SEQ ID NO: 310109 - DNA, 25 bp, Artificial Sequence
  Description of Artificial Sequence: Synthetic oligonucleotide
agccggctcgccagagaaactggag

SEQ ID NO: 310110 - DNA, 24 bp, Artificial Sequence
  Description of Artificial Sequence: Synthetic oligonucleotide
gccggctcgccagagaaactggag

SEQ ID NO: 310111 - DNA, 25 bp, Artificial Sequence
  Description of Artificial Sequence: Synthetic oligonucleotide
ccggctcgccagagaaactggagga

SEQ ID NO: 310112 - DNA, 26 bp, Artificial Sequence
  Description of Artificial Sequence: Synthetic oligonucleotide
cggctcgccagagaaactggaggaga

SEQ ID NO: 310113 - DNA, 27 bp, Artificial Sequence
  Description of Artificial Sequence: Synthetic oligonucleotide
ggctcgccagagaaactggaggagaca

SEQ ID NO: 310114 - DNA, 28 bp, Artificial Sequence
  Description of Artificial Sequence: Synthetic oligonucleotide
gctcgccagagaaactggaggagacatg

SEQ ID NO: 310115 - DNA, 31 bp, Artificial Sequence
  Description of Artificial Sequence: Synthetic oligonucleotide
ctcgccagagaaactggaggagacatgtaac

SEQ ID NO: 310116 - DNA, 32 bp, Artificial Sequence
  Description of Artificial Sequence: Synthetic oligonucleotide
tcgccagagaaactggaggagacatgtaactg

SEQ ID NO: 310117 - DNA, 31 bp, Artificial Sequence
  Description of Artificial Sequence: Synthetic oligonucleotide
cgccagagaaactggaggagacatgtaactg

SEQ ID NO: 310118 - DNA, 31 bp, Artificial Sequence
  Description of Artificial Sequence: Synthetic oligonucleotide
gccagagaaactggaggagacatgtaactgg

SEQ ID NO: 310119 - DNA, 31 bp, Artificial Sequence
  Description of Artificial Sequence: Synthetic oligonucleotide
ccagagaaactggaggagacatgtaactggc

SEQ ID NO: 310120 - DNA, 33 bp, Artificial Sequence
  Description of Artificial Sequence: Synthetic oligonucleotide
cagagaaactggaggagacatgtaactggctac

SEQ ID NO: 310121 - DNA, 34 bp, Artificial Sequence
  Description of Artificial Sequence: Synthetic oligonucleotide
agagaaactggaggagacatgtaactggctactg

SEQ ID NO: 310122 - DNA, 33 bp, Artificial Sequence
  Description of Artificial Sequence: Synthetic oligonucleotide
gagaaactggaggagacatgtaactggctactg

SEQ ID NO: 310123 - DNA, 34 bp, Artificial Sequence
  Description of Artificial Sequence: Synthetic oligonucleotide
agaaactggaggagacatgtaactggctactgtc

SEQ ID NO: 310124 - DNA, 33 bp, Artificial Sequence
  Description of Artificial Sequence: Synthetic oligonucleotide
gaaactggaggagacatgtaactggctactgtc

SEQ ID NO: 310125 - DNA, 33 bp, Artificial Sequence
  Description of Artificial Sequence: Synthetic oligonucleotide
aaactggaggagacatgtaactggctactgtcc

SEQ ID NO: 310126 - DNA, 32 bp, Artificial Sequence
  Description of Artificial Sequence: Synthetic oligonucleotide
aactggaggagacatgtaactggctactgtcc

SEQ ID NO: 310127 - DNA, 31 bp, Artificial Sequence
  Description of Artificial Sequence: Synthetic oligonucleotide
actggaggagacatgtaactggctactgtcc

SEQ ID NO: 310128 - DNA, 30 bp, Artificial Sequence
  Description of Artificial Sequence: Synthetic oligonucleotide
ctggaggagacatgtaactggctactgtcc

SEQ ID NO: 310129 - DNA, 30 bp, Artificial Sequence
  Description of Artificial Sequence: Synthetic oligonucleotide
tggaggagacatgtaactggctactgtccc

SEQ ID NO: 310130 - DNA, 29 bp, Artificial Sequence
  Description of Artificial Sequence: Synthetic oligonucleotide
ggaggagacatgtaactggctactgtccc

SEQ ID NO: 310131 - DNA, 30 bp, Artificial Sequence
  Description of Artificial Sequence: Synthetic oligonucleotide
gaggagacatgtaactggctactgtcccag

SEQ ID NO: 310132 - DNA, 30 bp, Artificial Sequence
  Description of Artificial Sequence: Synthetic oligonucleotide
aggagacatgtaactggctactgtcccagg

SEQ ID NO: 310133 - DNA, 29 bp, Artificial Sequence
  Description of Artificial Sequence: Synthetic oligonucleotide
ggagacatgtaactggctactgtcccagg

SEQ ID NO: 310134 - DNA, 30 bp, Artificial Sequence
  Description of Artificial Sequence: Synthetic oligonucleotide
gagacatgtaactggctactgtcccaggag

SEQ ID NO: 310135 - DNA, 30 bp, Artificial Sequence
  Description of Artificial Sequence: Synthetic oligonucleotide
agacatgtaactggctactgtcccaggagc

SEQ ID NO: 310136 - DNA, 29 bp, Artificial Sequence
  Description of Artificial Sequence: Synthetic oligonucleotide
gacatgtaactggctactgtcccaggagc

SEQ ID NO: 310137 - DNA, 30 bp, Artificial Sequence
  Description of Artificial Sequence: Synthetic oligonucleotide
acatgtaactggctactgtcccaggagcag

SEQ ID NO: 310138 - DNA, 29 bp, Artificial Sequence
  Description of Artificial Sequence: Synthetic oligonucleotide
catgtaactggctactgtcccaggagcag

SEQ ID NO: 310139 - DNA, 29 bp, Artificial Sequence
  Description of Artificial Sequence: Synthetic oligonucleotide
atgtaactggctactgtcccaggagcagg

SEQ ID NO: 310140 - DNA, 28 bp, Artificial Sequence
  Description of Artificial Sequence: Synthetic oligonucleotide
tgtaactggctactgtcccaggagcagg

SEQ ID NO: 310141 - DNA, 27 bp, Artificial Sequence
  Description of Artificial Sequence: Synthetic oligonucleotide
gtaactggctactgtcccaggagcagg

SEQ ID NO: 310142 - DNA, 27 bp, Artificial Sequence
  Description of Artificial Sequence: Synthetic oligonucleotide
taactggctactgtcccaggagcaggc

SEQ ID NO: 310143 - DNA, 27 bp, Artificial Sequence
  Description of Artificial Sequence: Synthetic oligonucleotide
aactggctactgtcccaggagcaggct

SEQ ID NO: 310144 - DNA, 26 bp, Artificial Sequence
  Description of Artificial Sequence: Synthetic oligonucleotide
actggctactgtcccaggagcaggct

SEQ ID NO: 310145 - DNA, 25 bp, Artificial Sequence
  Description of Artificial Sequence: Synthetic oligonucleotide
ctggctactgtcccaggagcaggct

SEQ ID NO: 310146 - DNA, 26 bp, Artificial Sequence
  Description of Artificial Sequence: Synthetic oligonucleotide
tggctactgtcccaggagcaggctgt

SEQ ID NO: 310147 - DNA, 25 bp, Artificial Sequence
  Description of Artificial Sequence: Synthetic oligonucleotide
ggctactgtcccaggagcaggctgt

SEQ ID NO: 310148 - DNA, 25 bp, Artificial Sequence
  Description of Artificial Sequence: Synthetic oligonucleotide
gctactgtcccaggagcaggctgtc

SEQ ID NO: 310149 - DNA, 25 bp, Artificial Sequence
  Description of Artificial Sequence: Synthetic oligonucleotide
ctactgtcccaggagcaggctgtcg

SEQ ID NO: 310150 - DNA, 25 bp, Artificial Sequence
  Description of Artificial Sequence: Synthetic oligonucleotide
tactgtcccaggagcaggctgtcgg

SEQ ID NO: 310151 - DNA, 24 bp, Artificial Sequence
  Description of Artificial Sequence: Synthetic oligonucleotide
actgtcccaggagcaggctgtcgg

SEQ ID NO: 310152 - DNA, 23 bp, Artificial Sequence
  Description of Artificial Sequence: Synthetic oligonucleotide
ctgtcccaggagcaggctgtcgg

SEQ ID NO: 310153 - DNA, 24 bp, Artificial Sequence
  Description of Artificial Sequence: Synthetic oligonucleotide
tgtcccaggagcaggctgtcggct

SEQ ID NO: 310154 - DNA, 23 bp, Artificial Sequence
  Description of Artificial Sequence: Synthetic oligonucleotide
gtcccaggagcaggctgtcggct

SEQ ID NO: 310155 - DNA, 23 bp, Artificial Sequence
  Description of Artificial Sequence: Synthetic oligonucleotide
tcccaggagcaggctgtcggctc

SEQ ID NO: 310156 - DNA, 22 bp, Artificial Sequence
  Description of Artificial Sequence: Synthetic oligonucleotide
cccaggagcaggctgtcggctc

SEQ ID NO: 310157 - DNA, 24 bp, Artificial Sequence
  Description of Artificial Sequence: Synthetic oligonucleotide
ccaggagcaggctgtcggctcgtt

SEQ ID NO: 310158 - DNA, 24 bp, Artificial Sequence
  Description of Artificial Sequence: Synthetic oligonucleotide
caggagcaggctgtcggctcgttg

SEQ ID NO: 310159 - DNA, 25 bp, Artificial Sequence
  Description of Artificial Sequence: Synthetic oligonucleotide
aggagcaggctgtcggctcgttgca

SEQ ID NO: 310160 - DNA, 24 bp, Artificial Sequence
  Description of Artificial Sequence: Synthetic oligonucleotide
ggagcaggctgtcggctcgttgca

SEQ ID NO: 310161 - DNA, 24 bp, Artificial Sequence
  Description of Artificial Sequence: Synthetic oligonucleotide
gagcaggctgtcggctcgttgcag

SEQ ID NO: 310162 - DNA, 25 bp, Artificial Sequence
  Description of Artificial Sequence: Synthetic oligonucleotide
agcaggctgtcggctcgttgcagga

SEQ ID NO: 310163 - DNA, 24 bp, Artificial Sequence
  Description of Artificial Sequence: Synthetic oligonucleotide
gcaggctgtcggctcgttgcagga

SEQ ID NO: 310164 - DNA, 24 bp, Artificial Sequence
  Description of Artificial Sequence: Synthetic oligonucleotide
caggctgtcggctcgttgcaggac

SEQ ID NO: 310165 - DNA, 25 bp, Artificial Sequence
  Description of Artificial Sequence: Synthetic oligonucleotide
aggctgtcggctcgttgcaggacca

SEQ ID NO: 310166 - DNA, 24 bp, Artificial Sequence
  Description of Artificial Sequence: Synthetic oligonucleotide
ggctgtcggctcgttgcaggacca

SEQ ID NO: 310167 - DNA, 24 bp, Artificial Sequence
  Description of Artificial Sequence: Synthetic oligonucleotide
gctgtcggctcgttgcaggaccag

SEQ ID NO: 310168 - DNA, 25 bp, Artificial Sequence
  Description of Artificial Sequence: Synthetic oligonucleotide
ctgtcggctcgttgcaggaccagca

SEQ ID NO: 310169 - DNA, 25 bp, Artificial Sequence
  Description of Artificial Sequence: Synthetic oligonucleotide
tgtcggctcgttgcaggaccagcag

SEQ ID NO: 310170 - DNA, 24 bp, Artificial Sequence
  Description of Artificial Sequence: Synthetic oligonucleotide
gtcggctcgttgcaggaccagcag

SEQ ID NO: 310171 - DNA, 26 bp, Artificial Sequence
  Description of Artificial Sequence: Synthetic oligonucleotide
tcggctcgttgcaggaccagcagcat

SEQ ID NO: 310172 - DNA, 25 bp, Artificial Sequence
  Description of Artificial Sequence: Synthetic oligonucleotide
cggctcgttgcaggaccagcagcat

SEQ ID NO: 310173 - DNA, 25 bp, Artificial Sequence
  Description of Artificial Sequence: Synthetic oligonucleotide
ggctcgttgcaggaccagcagcatg

SEQ ID NO: 310174 - DNA, 26 bp, Artificial Sequence
  Description of Artificial Sequence: Synthetic oligonucleotide
gctcgttgcaggaccagcagcatgca

SEQ ID NO: 310175 - DNA, 26 bp, Artificial Sequence
  Description of Artificial Sequence: Synthetic oligonucleotide
ctcgttgcaggaccagcagcatgcag

SEQ ID NO: 310176 - DNA, 26 bp, Artificial Sequence
  Description of Artificial Sequence: Synthetic oligonucleotide
tcgttgcaggaccagcagcatgcagc

SEQ ID NO: 310177 - DNA, 25 bp, Artificial Sequence
  Description of Artificial Sequence: Synthetic oligonucleotide
cgttgcaggaccagcagcatgcagc

SEQ ID NO: 310178 - DNA, 25 bp, Artificial Sequence
  Description of Artificial Sequence: Synthetic oligonucleotide
gttgcaggaccagcagcatgcagcg

SEQ ID NO: 310179 - DNA, 25 bp, Artificial Sequence
  Description of Artificial Sequence: Synthetic oligonucleotide
ttgcaggaccagcagcatgcagcgg

SEQ ID NO: 310180 - DNA, 24 bp, Artificial Sequence
  Description of Artificial Sequence: Synthetic oligonucleotide
tgcaggaccagcagcatgcagcgg

SEQ ID NO: 310181 - DNA, 23 bp, Artificial Sequence
  Description of Artificial Sequence: Synthetic oligonucleotide
gcaggaccagcagcatgcagcgg

SEQ ID NO: 310182 - DNA, 23 bp, Artificial Sequence
  Description of Artificial Sequence: Synthetic oligonucleotide
caggaccagcagcatgcagcggg

SEQ ID NO: 310183 - DNA, 26 bp, Artificial Sequence
  Description of Artificial Sequence: Synthetic oligonucleotide
aggaccagcagcatgcagcggggttt

SEQ ID NO: 310184 - DNA, 25 bp, Artificial Sequence
  Description of Artificial Sequence: Synthetic oligonucleotide
ggaccagcagcatgcagcggggttt

SEQ ID NO: 310185 - DNA, 25 bp, Artificial Sequence
  Description of Artificial Sequence: Synthetic oligonucleotide
gaccagcagcatgcagcggggtttg

SEQ ID NO: 310186 - DNA, 26 bp, Artificial Sequence
  Description of Artificial Sequence: Synthetic oligonucleotide
accagcagcatgcagcggggtttgga

SEQ ID NO: 310187 - DNA, 25 bp, Artificial Sequence
  Description of Artificial Sequence: Synthetic oligonucleotide
ccagcagcatgcagcggggtttgga

SEQ ID NO: 310188 - DNA, 25 bp, Artificial Sequence
  Description of Artificial Sequence: Synthetic oligonucleotide
cagcagcatgcagcggggtttggag

SEQ ID NO: 310189 - DNA, 25 bp, Artificial Sequence
  Description of Artificial Sequence: Synthetic oligonucleotide
agcagcatgcagcggggtttggagg

SEQ ID NO: 310190 - DNA, 24 bp, Artificial Sequence
  Description of Artificial Sequence: Synthetic oligonucleotide
gcagcatgcagcggggtttggagg

SEQ ID NO: 310191 - DNA, 24 bp, Artificial Sequence
  Description of Artificial Sequence: Synthetic oligonucleotide
cagcatgcagcggggtttggaggg

SEQ ID NO: 310192 - DNA, 27 bp, Artificial Sequence
  Description of Artificial Sequence: Synthetic oligonucleotide
agcatgcagcggggtttggagggcaat

SEQ ID NO: 310193 - DNA, 26 bp, Artificial Sequence
  Description of Artificial Sequence: Synthetic oligonucleotide
gcatgcagcggggtttggagggcaat

SEQ ID NO: 310194 - DNA, 27 bp, Artificial Sequence
  Description of Artificial Sequence: Synthetic oligonucleotide
catgcagcggggtttggagggcaatga

SEQ ID NO: 310195 - DNA, 28 bp, Artificial Sequence
  Description of Artificial Sequence: Synthetic oligonucleotide
atgcagcggggtttggagggcaatgaag

SEQ ID NO: 310196 - DNA, 27 bp, Artificial Sequence
  Description of Artificial Sequence: Synthetic oligonucleotide
tgcagcggggtttggagggcaatgaag

SEQ ID NO: 310197 - DNA, 27 bp, Artificial Sequence
  Description of Artificial Sequence: Synthetic oligonucleotide
gcagcggggtttggagggcaatgaaga

SEQ ID NO: 310198 - DNA, 27 bp, Artificial Sequence
  Description of Artificial Sequence: Synthetic oligonucleotide
cagcggggtttggagggcaatgaagag

SEQ ID NO: 310199 - DNA, 28 bp, Artificial Sequence
  Description of Artificial Sequence: Synthetic oligonucleotide
agcggggtttggagggcaatgaagagac

SEQ ID NO: 310200 - DNA, 27 bp, Artificial Sequence
  Description of Artificial Sequence: Synthetic oligonucleotide
gcggggtttggagggcaatgaagagac

SEQ ID NO: 310201 - DNA, 28 bp, Artificial Sequence
  Description of Artificial Sequence: Synthetic oligonucleotide
cggggtttggagggcaatgaagagactg

SEQ ID NO: 310202 - DNA, 29 bp, Artificial Sequence
  Description of Artificial Sequence: Synthetic oligonucleotide
ggggtttggagggcaatgaagagactgtg

SEQ ID NO: 310203 - DNA, 29 bp, Artificial Sequence
  Description of Artificial Sequence: Synthetic oligonucleotide
gggtttggagggcaatgaagagactgtgc

SEQ ID NO: 310204 - DNA, 29 bp, Artificial Sequence
  Description of Artificial Sequence: Synthetic oligonucleotide
ggtttggagggcaatgaagagactgtgcc

SEQ ID NO: 310205 - DNA, 30 bp, Artificial Sequence
  Description of Artificial Sequence: Synthetic oligonucleotide
gtttggagggcaatgaagagactgtgccac

SEQ ID NO: 310206 - DNA, 31 bp, Artificial Sequence
  Description of Artificial Sequence: Synthetic oligonucleotide
tttggagggcaatgaagagactgtgccactc

SEQ ID NO: 310207 - DNA, 30 bp, Artificial Sequence
  Description of Artificial Sequence: Synthetic oligonucleotide
ttggagggcaatgaagagactgtgccactc

SEQ ID NO: 310208 - DNA, 29 bp, Artificial Sequence
  Description of Artificial Sequence: Synthetic oligonucleotide
tggagggcaatgaagagactgtgccactc

SEQ ID NO: 310209 - DNA, 28 bp, Artificial Sequence
  Description of Artificial Sequence: Synthetic oligonucleotide
ggagggcaatgaagagactgtgccactc

SEQ ID NO: 310210 - DNA, 29 bp, Artificial Sequence
  Description of Artificial Sequence: Synthetic oligonucleotide
gagggcaatgaagagactgtgccactcac

SEQ ID NO: 310211 - DNA, 30 bp, Artificial Sequence
  Description of Artificial Sequence: Synthetic oligonucleotide
agggcaatgaagagactgtgccactcacag

SEQ ID NO: 310212 - DNA, 29 bp, Artificial Sequence
  Description of Artificial Sequence: Synthetic oligonucleotide
gggcaatgaagagactgtgccactcacag

SEQ ID NO: 310213 - DNA, 29 bp, Artificial Sequence
  Description of Artificial Sequence: Synthetic oligonucleotide
ggcaatgaagagactgtgccactcacagg

SEQ ID NO: 310214 - DNA, 29 bp, Artificial Sequence
  Description of Artificial Sequence: Synthetic oligonucleotide
gcaatgaagagactgtgccactcacaggc

SEQ ID NO: 310215 - DNA, 32 bp, Artificial Sequence
  Description of Artificial Sequence: Synthetic oligonucleotide
caatgaagagactgtgccactcacaggctttg

SEQ ID NO: 310216 - DNA, 33 bp, Artificial Sequence
  Description of Artificial Sequence: Synthetic oligonucleotide
aatgaagagactgtgccactcacaggctttgtg

SEQ ID NO: 310217 - DNA, 32 bp, Artificial Sequence
  Description of Artificial Sequence: Synthetic oligonucleotide
atgaagagactgtgccactcacaggctttgtg

SEQ ID NO: 310218 - DNA, 31 bp, Artificial Sequence
  Description of Artificial Sequence: Synthetic oligonucleotide
tgaagagactgtgccactcacaggctttgtg

SEQ ID NO: 310219 - DNA, 30 bp, Artificial Sequence
  Description of Artificial Sequence: Synthetic oligonucleotide
gaagagactgtgccactcacaggctttgtg

SEQ ID NO: 310220 - DNA, 31 bp, Artificial Sequence
  Description of Artificial Sequence: Synthetic oligonucleotide
aagagactgtgccactcacaggctttgtgac

SEQ ID NO: 310221 - DNA, 30 bp, Artificial Sequence
  Description of Artificial Sequence: Synthetic oligonucleotide
agagactgtgccactcacaggctttgtgac

SEQ ID NO: 310222 - DNA, 29 bp, Artificial Sequence
  Description of Artificial Sequence: Synthetic oligonucleotide
gagactgtgccactcacaggctttgtgac

SEQ ID NO: 310223 - DNA, 29 bp, Artificial Sequence
  Description of Artificial Sequence: Synthetic oligonucleotide
agactgtgccactcacaggctttgtgacg

SEQ ID NO: 310224 - DNA, 28 bp, Artificial Sequence
  Description of Artificial Sequence: Synthetic oligonucleotide
gactgtgccactcacaggctttgtgacg

SEQ ID NO: 310225 - DNA, 30 bp, Artificial Sequence
  Description of Artificial Sequence: Synthetic oligonucleotide
actgtgccactcacaggctttgtgacgatc

SEQ ID NO: 310226 - DNA, 29 bp, Artificial Sequence
  Description of Artificial Sequence: Synthetic oligonucleotide
ctgtgccactcacaggctttgtgacgatc

SEQ ID NO: 310227 - DNA, 29 bp, Artificial Sequence
  Description of Artificial Sequence: Synthetic oligonucleotide
tgtgccactcacaggctttgtgacgatcg

SEQ ID NO: 310228 - DNA, 28 bp, Artificial Sequence
  Description of Artificial Sequence: Synthetic oligonucleotide
gtgccactcacaggctttgtgacgatcg

SEQ ID NO: 310229 - DNA, 28 bp, Artificial Sequence
  Description of Artificial Sequence: Synthetic oligonucleotide
tgccactcacaggctttgtgacgatcgc

SEQ ID NO: 310230 - DNA, 27 bp, Artificial Sequence
  Description of Artificial Sequence: Synthetic oligonucleotide
gccactcacaggctttgtgacgatcgc

SEQ ID NO: 310231 - DNA, 27 bp, Artificial Sequence
  Description of Artificial Sequence: Synthetic oligonucleotide
ccactcacaggctttgtgacgatcgcc

SEQ ID NO: 310232 - DNA, 27 bp, Artificial Sequence
  Description of Artificial Sequence: Synthetic oligonucleotide
cactcacaggctttgtgacgatcgccc

SEQ ID NO: 310233 - DNA, 29 bp, Artificial Sequence
  Description of Artificial Sequence: Synthetic oligonucleotide
actcacaggctttgtgacgatcgcccttg

SEQ ID NO: 310234 - DNA, 28 bp, Artificial Sequence
  Description of Artificial Sequence: Synthetic oligonucleotide
ctcacaggctttgtgacgatcgcccttg

SEQ ID NO: 310235 - DNA, 30 bp, Artificial Sequence
  Description of Artificial Sequence: Synthetic oligonucleotide
tcacaggctttgtgacgatcgcccttgatc

SEQ ID NO: 310236 - DNA, 29 bp, Artificial Sequence
  Description of Artificial Sequence: Synthetic oligonucleotide
cacaggctttgtgacgatcgcccttgatc

SEQ ID NO: 310237 - DNA, 31 bp, Artificial Sequence
  Description of Artificial Sequence: Synthetic oligonucleotide
acaggctttgtgacgatcgcccttgatcatg

SEQ ID NO: 310238 - DNA, 30 bp, Artificial Sequence
  Description of Artificial Sequence: Synthetic oligonucleotide
caggctttgtgacgatcgcccttgatcatg

SEQ ID NO: 310239 - DNA, 30 bp, Artificial Sequence
  Description of Artificial Sequence: Synthetic oligonucleotide
aggctttgtgacgatcgcccttgatcatgg

SEQ ID NO: 310240 - DNA, 29 bp, Artificial Sequence
  Description of Artificial Sequence: Synthetic oligonucleotide
ggctttgtgacgatcgcccttgatcatgg

SEQ ID NO: 310241 - DNA, 29 bp, Artificial Sequence
  Description of Artificial Sequence: Synthetic oligonucleotide
gctttgtgacgatcgcccttgatcatggg

SEQ ID NO: 310242 - DNA, 29 bp, Artificial Sequence
  Description of Artificial Sequence: Synthetic oligonucleotide
ctttgtgacgatcgcccttgatcatgggc

SEQ ID NO: 310243 - DNA, 30 bp, Artificial Sequence
  Description of Artificial Sequence: Synthetic oligonucleotide
tttgtgacgatcgcccttgatcatgggcag

SEQ ID NO: 310244 - DNA, 29 bp, Artificial Sequence
  Description of Artificial Sequence: Synthetic oligonucleotide
ttgtgacgatcgcccttgatcatgggcag

SEQ ID NO: 310245 - DNA, 28 bp, Artificial Sequence
  Description of Artificial Sequence: Synthetic oligonucleotide
tgtgacgatcgcccttgatcatgggcag

SEQ ID NO: 310246 - DNA, 27 bp, Artificial Sequence
  Description of Artificial Sequence: Synthetic oligonucleotide
gtgacgatcgcccttgatcatgggcag

SEQ ID NO: 310247 - DNA, 27 bp, Artificial Sequence
  Description of Artificial Sequence: Synthetic oligonucleotide
tgacgatcgcccttgatcatgggcagg

SEQ ID NO: 310248 - DNA, 26 bp, Artificial Sequence
  Description of Artificial Sequence: Synthetic oligonucleotide
gacgatcgcccttgatcatgggcagg

SEQ ID NO: 310249 - DNA, 26 bp, Artificial Sequence
  Description of Artificial Sequence: Synthetic oligonucleotide
acgatcgcccttgatcatgggcaggc

SEQ ID NO: 310250 - DNA, 25 bp, Artificial Sequence
  Description of Artificial Sequence: Synthetic oligonucleotide
cgatcgcccttgatcatgggcaggc

SEQ ID NO: 310251 - DNA, 25 bp, Artificial Sequence
  Description of Artificial Sequence: Synthetic oligonucleotide
gatcgcccttgatcatgggcaggcc

SEQ ID NO: 310252 - DNA, 26 bp, Artificial Sequence
  Description of Artificial Sequence: Synthetic oligonucleotide
atcgcccttgatcatgggcaggccgt

SEQ ID NO: 310253 - DNA, 25 bp, Artificial Sequence
  Description of Artificial Sequence: Synthetic oligonucleotide
tcgcccttgatcatgggcaggccgt

SEQ ID NO: 310254 - DNA, 24 bp, Artificial Sequence
  Description of Artificial Sequence: Synthetic oligonucleotide
cgcccttgatcatgggcaggccgt

SEQ ID NO: 310255 - DNA, 26 bp, Artificial Sequence
  Description of Artificial Sequence: Synthetic oligonucleotide
gcccttgatcatgggcaggccgtctt

SEQ ID NO: 310256 - DNA, 26 bp, Artificial Sequence
  Description of Artificial Sequence: Synthetic oligonucleotide
cccttgatcatgggcaggccgtcttg

SEQ ID NO: 310257 - DNA, 27 bp, Artificial Sequence
  Description of Artificial Sequence: Synthetic oligonucleotide
ccttgatcatgggcaggccgtcttgca

SEQ ID NO: 310258 - DNA, 27 bp, Artificial Sequence
  Description of Artificial Sequence: Synthetic oligonucleotide
cttgatcatgggcaggccgtcttgcag

SEQ ID NO: 310259 - DNA, 27 bp, Artificial Sequence
  Description of Artificial Sequence: Synthetic oligonucleotide
ttgatcatgggcaggccgtcttgcagg

SEQ ID NO: 310260 - DNA, 27 bp, Artificial Sequence
  Description of Artificial Sequence: Synthetic oligonucleotide
tgatcatgggcaggccgtcttgcagga

SEQ ID NO: 310261 - DNA, 27 bp, Artificial Sequence
  Description of Artificial Sequence: Synthetic oligonucleotide
gatcatgggcaggccgtcttgcaggat

SEQ ID NO: 310262 - DNA, 27 bp, Artificial Sequence
  Description of Artificial Sequence: Synthetic oligonucleotide
atcatgggcaggccgtcttgcaggatg

SEQ ID NO: 310263 - DNA, 27 bp, Artificial Sequence
  Description of Artificial Sequence: Synthetic oligonucleotide
tcatgggcaggccgtcttgcaggatga

SEQ ID NO: 310264 - DNA, 26 bp, Artificial Sequence
  Description of Artificial Sequence: Synthetic oligonucleotide
catgggcaggccgtcttgcaggatga

SEQ ID NO: 310265 - DNA, 26 bp, Artificial Sequence
  Description of Artificial Sequence: Synthetic oligonucleotide
atgggcaggccgtcttgcaggatgag

SEQ ID NO: 310266 - DNA, 25 bp, Artificial Sequence
  Description of Artificial Sequence: Synthetic oligonucleotide
tgggcaggccgtcttgcaggatgag

SEQ ID NO: 310267 - DNA, 24 bp, Artificial Sequence
  Description of Artificial Sequence: Synthetic oligonucleotide
gggcaggccgtcttgcaggatgag

SEQ ID NO: 310268 - DNA, 24 bp, Artificial Sequence
  Description of Artificial Sequence: Synthetic oligonucleotide
ggcaggccgtcttgcaggatgagc

SEQ ID NO: 310269 - DNA, 25 bp, Artificial Sequence
  Description of Artificial Sequence: Synthetic oligonucleotide
gcaggccgtcttgcaggatgagcgt

SEQ ID NO: 310270 - DNA, 25 bp, Artificial Sequence
  Description of Artificial Sequence: Synthetic oligonucleotide
caggccgtcttgcaggatgagcgtg

SEQ ID NO: 310271 - DNA, 26 bp, Artificial Sequence
  Description of Artificial Sequence: Synthetic oligonucleotide
aggccgtcttgcaggatgagcgtgca

SEQ ID NO: 310272 - DNA, 25 bp, Artificial Sequence
  Description of Artificial Sequence: Synthetic oligonucleotide
ggccgtcttgcaggatgagcgtgca

SEQ ID NO: 310273 - DNA, 26 bp, Artificial Sequence
  Description of Artificial Sequence: Synthetic oligonucleotide
gccgtcttgcaggatgagcgtgcaga

SEQ ID NO: 310274 - DNA, 26 bp, Artificial Sequence
  Description of Artificial Sequence: Synthetic oligonucleotide
ccgtcttgcaggatgagcgtgcagag

SEQ ID NO: 310275 - DNA, 26 bp, Artificial Sequence
  Description of Artificial Sequence: Synthetic oligonucleotide
cgtcttgcaggatgagcgtgcagagc

SEQ ID NO: 310276 - DNA, 27 bp, Artificial Sequence
  Description of Artificial Sequence: Synthetic oligonucleotide
gtcttgcaggatgagcgtgcagagcga

SEQ ID NO: 310277 - DNA, 29 bp, Artificial Sequence
  Description of Artificial Sequence: Synthetic oligonucleotide
tcttgcaggatgagcgtgcagagcgattg

SEQ ID NO: 310278 - DNA, 28 bp, Artificial Sequence
  Description of Artificial Sequence: Synthetic oligonucleotide
cttgcaggatgagcgtgcagagcgattg

SEQ ID NO: 310279 - DNA, 30 bp, Artificial Sequence
  Description of Artificial Sequence: Synthetic oligonucleotide
ttgcaggatgagcgtgcagagcgattgaag

SEQ ID NO: 310280 - DNA, 29 bp, Artificial Sequence
  Description of Artificial Sequence: Synthetic oligonucleotide
tgcaggatgagcgtgcagagcgattgaag

SEQ ID NO: 310281 - DNA, 28 bp, Artificial Sequence
  Description of Artificial Sequence: Synthetic oligonucleotide
gcaggatgagcgtgcagagcgattgaag

SEQ ID NO: 310282 - DNA, 28 bp, Artificial Sequence
  Description of Artificial Sequence: Synthetic oligonucleotide
caggatgagcgtgcagagcgattgaagc

SEQ ID NO: 310283 - DNA, 29 bp, Artificial Sequence
  Description of Artificial Sequence: Synthetic oligonucleotide
aggatgagcgtgcagagcgattgaagcac

SEQ ID NO: 310284 - DNA, 28 bp, Artificial Sequence
  Description of Artificial Sequence: Synthetic oligonucleotide
ggatgagcgtgcagagcgattgaagcac

SEQ ID NO: 310285 - DNA, 29 bp, Artificial Sequence
  Description of Artificial Sequence: Synthetic oligonucleotide
gatgagcgtgcagagcgattgaagcacag

SEQ ID NO: 310286 - DNA, 30 bp, Artificial Sequence
  Description of Artificial Sequence: Synthetic oligonucleotide
atgagcgtgcagagcgattgaagcacagag

SEQ ID NO: 310287 - DNA, 29 bp, Artificial Sequence
  Description of Artificial Sequence: Synthetic oligonucleotide
tgagcgtgcagagcgattgaagcacagag

SEQ ID NO: 310288 - DNA, 28 bp, Artificial Sequence
  Description of Artificial Sequence: Synthetic oligonucleotide
gagcgtgcagagcgattgaagcacagag

SEQ ID NO: 310289 - DNA, 29 bp, Artificial Sequence
  Description of Artificial Sequence: Synthetic oligonucleotide
agcgtgcagagcgattgaagcacagagtg

SEQ ID NO: 310290 - DNA, 28 bp, Artificial Sequence
  Description of Artificial Sequence: Synthetic oligonucleotide
gcgtgcagagcgattgaagcacagagtg

SEQ ID NO: 310291 - DNA, 28 bp, Artificial Sequence
  Description of Artificial Sequence: Synthetic oligonucleotide
cgtgcagagcgattgaagcacagagtgg

SEQ ID NO: 310292 - DNA, 30 bp, Artificial Sequence
  Description of Artificial Sequence: Synthetic oligonucleotide
gtgcagagcgattgaagcacagagtggaac

SEQ ID NO: 310293 - DNA, 30 bp, Artificial Sequence
  Description of Artificial Sequence: Synthetic oligonucleotide
tgcagagcgattgaagcacagagtggaacc

SEQ ID NO: 310294 - DNA, 29 bp, Artificial Sequence
  Description of Artificial Sequence: Synthetic oligonucleotide
gcagagcgattgaagcacagagtggaacc

SEQ ID NO: 310295 - DNA, 29 bp, Artificial Sequence
  Description of Artificial Sequence: Synthetic oligonucleotide
cagagcgattgaagcacagagtggaaccc

SEQ ID NO: 310296 - DNA, 30 bp, Artificial Sequence
  Description of Artificial Sequence: Synthetic oligonucleotide
agagcgattgaagcacagagtggaaccctc

SEQ ID NO: 310297 - DNA, 29 bp, Artificial Sequence
  Description of Artificial Sequence: Synthetic oligonucleotide
gagcgattgaagcacagagtggaaccctc

SEQ ID NO: 310298 - DNA, 29 bp, Artificial Sequence
  Description of Artificial Sequence: Synthetic oligonucleotide
agcgattgaagcacagagtggaaccctcc

SEQ ID NO: 310299 - DNA, 28 bp, Artificial Sequence
  Description of Artificial Sequence: Synthetic oligonucleotide
gcgattgaagcacagagtggaaccctcc

SEQ ID NO: 310300 - DNA, 30 bp, Artificial Sequence
  Description of Artificial Sequence: Synthetic oligonucleotide
cgattgaagcacagagtggaaccctccatc

SEQ ID NO: 310301 - DNA, 31 bp, Artificial Sequence
  Description of Artificial Sequence: Synthetic oligonucleotide
gattgaagcacagagtggaaccctccatctg

SEQ ID NO: 310302 - DNA, 34 bp, Artificial Sequence
  Description of Artificial Sequence: Synthetic oligonucleotide
attgaagcacagagtggaaccctccatctgaaag

SEQ ID NO: 310303 - DNA, 33 bp, Artificial Sequence
  Description of Artificial Sequence: Synthetic oligonucleotide
ttgaagcacagagtggaaccctccatctgaaag

SEQ ID NO: 310304 - DNA, 32 bp, Artificial Sequence
  Description of Artificial Sequence: Synthetic oligonucleotide
tgaagcacagagtggaaccctccatctgaaag

SEQ ID NO: 310305 - DNA, 31 bp, Artificial Sequence
  Description of Artificial Sequence: Synthetic oligonucleotide
gaagcacagagtggaaccctccatctgaaag

SEQ ID NO: 310306 - DNA, 31 bp, Artificial Sequence
  Description of Artificial Sequence: Synthetic oligonucleotide
aagcacagagtggaaccctccatctgaaagg

SEQ ID NO: 310307 - DNA, 30 bp, Artificial Sequence
  Description of Artificial Sequence: Synthetic oligonucleotide
agcacagagtggaaccctccatctgaaagg

SEQ ID NO: 310308 - DNA, 29 bp, Artificial Sequence
  Description of Artificial Sequence: Synthetic oligonucleotide
gcacagagtggaaccctccatctgaaagg

SEQ ID NO: 310309 - DNA, 29 bp, Artificial Sequence
  Description of Artificial Sequence: Synthetic oligonucleotide
cacagagtggaaccctccatctgaaaggc

SEQ ID NO: 310310 - DNA, 31 bp, Artificial Sequence
  Description of Artificial Sequence: Synthetic oligonucleotide
acagagtggaaccctccatctgaaaggcaag

SEQ ID NO: 310311 - DNA, 30 bp, Artificial Sequence
  Description of Artificial Sequence: Synthetic oligonucleotide
cagagtggaaccctccatctgaaaggcaag

SEQ ID NO: 310312 - DNA, 30 bp, Artificial Sequence
  Description of Artificial Sequence: Synthetic oligonucleotide
agagtggaaccctccatctgaaaggcaagg

SEQ ID NO: 310313 - DNA, 29 bp, Artificial Sequence
  Description of Artificial Sequence: Synthetic oligonucleotide
gagtggaaccctccatctgaaaggcaagg

SEQ ID NO: 310314 - DNA, 30 bp, Artificial Sequence
  Description of Artificial Sequence: Synthetic oligonucleotide
agtggaaccctccatctgaaaggcaaggtc

SEQ ID NO: 310315 - DNA, 29 bp, Artificial Sequence
  Description of Artificial Sequence: Synthetic oligonucleotide
gtggaaccctccatctgaaaggcaaggtc

SEQ ID NO: 310316 - DNA, 35 bp, Artificial Sequence
  Description of Artificial Sequence: Synthetic oligonucleotide
tggaaccctccatctgaaaggcaaggtcatttttg

SEQ ID NO: 310317 - DNA, 34 bp, Artificial Sequence
  Description of Artificial Sequence: Synthetic oligonucleotide
ggaaccctccatctgaaaggcaaggtcatttttg

SEQ ID NO: 310318 - DNA, 34 bp, Artificial Sequence
  Description of Artificial Sequence: Synthetic oligonucleotide
gaaccctccatctgaaaggcaaggtcatttttgc

SEQ ID NO: 310319 - DNA, 34 bp, Artificial Sequence
  Description of Artificial Sequence: Synthetic oligonucleotide
aaccctccatctgaaaggcaaggtcatttttgcg

SEQ ID NO: 310320 - DNA, 33 bp, Artificial Sequence
  Description of Artificial Sequence: Synthetic oligonucleotide
accctccatctgaaaggcaaggtcatttttgcg

SEQ ID NO: 310321 - DNA, 32 bp, Artificial Sequence
  Description of Artificial Sequence: Synthetic oligonucleotide
ccctccatctgaaaggcaaggtcatttttgcg

SEQ ID NO: 310322 - DNA, 32 bp, Artificial Sequence
  Description of Artificial Sequence: Synthetic oligonucleotide
cctccatctgaaaggcaaggtcatttttgcgg

SEQ ID NO: 310323 - DNA, 32 bp, Artificial Sequence
  Description of Artificial Sequence: Synthetic oligonucleotide
ctccatctgaaaggcaaggtcatttttgcggg

SEQ ID NO: 310324 - DNA, 33 bp, Artificial Sequence
  Description of Artificial Sequence: Synthetic oligonucleotide
tccatctgaaaggcaaggtcatttttgcgggag

SEQ ID NO: 310325 - DNA, 32 bp, Artificial Sequence
  Description of Artificial Sequence: Synthetic oligonucleotide
ccatctgaaaggcaaggtcatttttgcgggag

SEQ ID NO: 310326 - DNA, 35 bp, Artificial Sequence
  Description of Artificial Sequence: Synthetic oligonucleotide
catctgaaaggcaaggtcatttttgcgggagaaag

SEQ ID NO: 310327 - DNA, 35 bp, Artificial Sequence
  Description of Artificial Sequence: Synthetic oligonucleotide
atctgaaaggcaaggtcatttttgcgggagaaagg

SEQ ID NO: 310328 - DNA, 34 bp, Artificial Sequence
  Description of Artificial Sequence: Synthetic oligonucleotide
tctgaaaggcaaggtcatttttgcgggagaaagg

SEQ ID NO: 310329 - DNA, 33 bp, Artificial Sequence
  Description of Artificial Sequence: Synthetic oligonucleotide
ctgaaaggcaaggtcatttttgcgggagaaagg

SEQ ID NO: 310330 - DNA, 35 bp, Artificial Sequence
  Description of Artificial Sequence: Synthetic oligonucleotide
tgaaaggcaaggtcatttttgcgggagaaaggaag

SEQ ID NO: 310331 - DNA, 34 bp, Artificial Sequence
  Description of Artificial Sequence: Synthetic oligonucleotide
gaaaggcaaggtcatttttgcgggagaaaggaag

SEQ ID NO: 310332 - DNA, 35 bp, Artificial Sequence
  Description of Artificial Sequence: Synthetic oligonucleotide
aaaggcaaggtcatttttgcgggagaaaggaagtg

SEQ ID NO: 310333 - DNA, 34 bp, Artificial Sequence
  Description of Artificial Sequence: Synthetic oligonucleotide
aaggcaaggtcatttttgcgggagaaaggaagtg

SEQ ID NO: 310334 - DNA, 33 bp, Artificial Sequence
  Description of Artificial Sequence: Synthetic oligonucleotide
aggcaaggtcatttttgcgggagaaaggaagtg

SEQ ID NO: 310335 - DNA, 32 bp, Artificial Sequence
  Description of Artificial Sequence: Synthetic oligonucleotide
ggcaaggtcatttttgcgggagaaaggaagtg

SEQ ID NO: 310336 - DNA, 32 bp, Artificial Sequence
  Description of Artificial Sequence: Synthetic oligonucleotide
gcaaggtcatttttgcgggagaaaggaagtgc

SEQ ID NO: 310337 - DNA, 33 bp, Artificial Sequence
  Description of Artificial Sequence: Synthetic oligonucleotide
caaggtcatttttgcgggagaaaggaagtgctg

SEQ ID NO: 310338 - DNA, 33 bp, Artificial Sequence
  Description of Artificial Sequence: Synthetic oligonucleotide
aaggtcatttttgcgggagaaaggaagtgctgg

SEQ ID NO: 310339 - DNA, 32 bp, Artificial Sequence
  Description of Artificial Sequence: Synthetic oligonucleotide
aggtcatttttgcgggagaaaggaagtgctgg

SEQ ID NO: 310340 - DNA, 31 bp, Artificial Sequence
  Description of Artificial Sequence: Synthetic oligonucleotide
ggtcatttttgcgggagaaaggaagtgctgg

SEQ ID NO: 310341 - DNA, 31 bp, Artificial Sequence
  Description of Artificial Sequence: Synthetic oligonucleotide
gtcatttttgcgggagaaaggaagtgctggc

SEQ ID NO: 310342 - DNA, 31 bp, Artificial Sequence
  Description of Artificial Sequence: Synthetic oligonucleotide
tcatttttgcgggagaaaggaagtgctggcc

SEQ ID NO: 310343 - DNA, 30 bp, Artificial Sequence
  Description of Artificial Sequence: Synthetic oligonucleotide
catttttgcgggagaaaggaagtgctggcc

SEQ ID NO: 310344 - DNA, 31 bp, Artificial Sequence
  Description of Artificial Sequence: Synthetic oligonucleotide
atttttgcgggagaaaggaagtgctggcctc

SEQ ID NO: 310345 - DNA, 30 bp, Artificial Sequence
  Description of Artificial Sequence: Synthetic oligonucleotide
tttttgcgggagaaaggaagtgctggcctc

SEQ ID NO: 310346 - DNA, 29 bp, Artificial Sequence
  Description of Artificial Sequence: Synthetic oligonucleotide
ttttgcgggagaaaggaagtgctggcctc

SEQ ID NO: 310347 - DNA, 28 bp, Artificial Sequence
  Description of Artificial Sequence: Synthetic oligonucleotide
tttgcgggagaaaggaagtgctggcctc

SEQ ID NO: 310348 - DNA, 27 bp, Artificial Sequence
  Description of Artificial Sequence: Synthetic oligonucleotide
ttgcgggagaaaggaagtgctggcctc

SEQ ID NO: 310349 - DNA, 26 bp, Artificial Sequence
  Description of Artificial Sequence: Synthetic oligonucleotide
tgcgggagaaaggaagtgctggcctc

SEQ ID NO: 310350 - DNA, 25 bp, Artificial Sequence
  Description of Artificial Sequence: Synthetic oligonucleotide
gcgggagaaaggaagtgctggcctc

SEQ ID NO: 310351 - DNA, 26 bp, Artificial Sequence
  Description of Artificial Sequence: Synthetic oligonucleotide
cgggagaaaggaagtgctggcctcct

SEQ ID NO: 310352 - DNA, 26 bp, Artificial Sequence
  Description of Artificial Sequence: Synthetic oligonucleotide
gggagaaaggaagtgctggcctcctg

SEQ ID NO: 310353 - DNA, 26 bp, Artificial Sequence
  Description of Artificial Sequence: Synthetic oligonucleotide
ggagaaaggaagtgctggcctcctgg

SEQ ID NO: 310354 - DNA, 27 bp, Artificial Sequence
  Description of Artificial Sequence: Synthetic oligonucleotide
gagaaaggaagtgctggcctcctgggt

SEQ ID NO: 310355 - DNA, 27 bp, Artificial Sequence
  Description of Artificial Sequence: Synthetic oligonucleotide
agaaaggaagtgctggcctcctgggtc

SEQ ID NO: 310356 - DNA, 26 bp, Artificial Sequence
  Description of Artificial Sequence: Synthetic oligonucleotide
gaaaggaagtgctggcctcctgggtc

SEQ ID NO: 310357 - DNA, 26 bp, Artificial Sequence
  Description of Artificial Sequence: Synthetic oligonucleotide
aaaggaagtgctggcctcctgggtcc

SEQ ID NO: 310358 - DNA, 25 bp, Artificial Sequence
  Description of Artificial Sequence: Synthetic oligonucleotide
aaggaagtgctggcctcctgggtcc

SEQ ID NO: 310359 - DNA, 24 bp, Artificial Sequence
  Description of Artificial Sequence: Synthetic oligonucleotide
aggaagtgctggcctcctgggtcc

SEQ ID NO: 310360 - DNA, 23 bp, Artificial Sequence
  Description of Artificial Sequence: Synthetic oligonucleotide
ggaagtgctggcctcctgggtcc

SEQ ID NO: 310361 - DNA, 23 bp, Artificial Sequence
  Description of Artificial Sequence: Synthetic oligonucleotide
gaagtgctggcctcctgggtccc

SEQ ID NO: 310362 - DNA, 24 bp, Artificial Sequence
  Description of Artificial Sequence: Synthetic oligonucleotide
aagtgctggcctcctgggtcccca

SEQ ID NO: 310363 - DNA, 23 bp, Artificial Sequence
  Description of Artificial Sequence: Synthetic oligonucleotide
agtgctggcctcctgggtcccca

SEQ ID NO: 310364 - DNA, 22 bp, Artificial Sequence
  Description of Artificial Sequence: Synthetic oligonucleotide
gtgctggcctcctgggtcccca

SEQ ID NO: 310365 - DNA, 22 bp, Artificial Sequence
  Description of Artificial Sequence: Synthetic oligonucleotide
tgctggcctcctgggtccccac

SEQ ID NO: 310366 - DNA, 21 bp, Artificial Sequence
  Description of Artificial Sequence: Synthetic oligonucleotide
gctggcctcctgggtccccac

SEQ ID NO: 310367 - DNA, 21 bp, Artificial Sequence
  Description of Artificial Sequence: Synthetic oligonucleotide
ctggcctcctgggtccccacg

SEQ ID NO: 310368 - DNA, 22 bp, Artificial Sequence
  Description of Artificial Sequence: Synthetic oligonucleotide
tggcctcctgggtccccacgca

SEQ ID NO: 310369 - DNA, 21 bp, Artificial Sequence
  Description of Artificial Sequence: Synthetic oligonucleotide
ggcctcctgggtccccacgca

SEQ ID NO: 310370 - DNA, 21 bp, Artificial Sequence
  Description of Artificial Sequence: Synthetic oligonucleotide
gcctcctgggtccccacgcag

SEQ ID NO: 310371 - DNA, 22 bp, Artificial Sequence
  Description of Artificial Sequence: Synthetic oligonucleotide
cctcctgggtccccacgcaggt

SEQ ID NO: 310372 - DNA, 22 bp, Artificial Sequence
  Description of Artificial Sequence: Synthetic oligonucleotide
ctcctgggtccccacgcaggtg

SEQ ID NO: 310373 - DNA, 22 bp, Artificial Sequence
  Description of Artificial Sequence: Synthetic oligonucleotide
tcctgggtccccacgcaggtgc

SEQ ID NO: 310374 - DNA, 21 bp, Artificial Sequence
  Description of Artificial Sequence: Synthetic oligonucleotide
cctgggtccccacgcaggtgc

SEQ ID NO: 310375 - DNA, 23 bp, Artificial Sequence
  Description of Artificial Sequence: Synthetic oligonucleotide
ctgggtccccacgcaggtgccat

SEQ ID NO: 310376 - DNA, 24 bp, Artificial Sequence
  Description of Artificial Sequence: Synthetic oligonucleotide
tgggtccccacgcaggtgccatca

SEQ ID NO: 310377 - DNA, 23 bp, Artificial Sequence
  Description of Artificial Sequence: Synthetic oligonucleotide
gggtccccacgcaggtgccatca

SEQ ID NO: 310378 - DNA, 23 bp, Artificial Sequence
  Description of Artificial Sequence: Synthetic oligonucleotide
ggtccccacgcaggtgccatcac

SEQ ID NO: 310379 - DNA, 23 bp, Artificial Sequence
  Description of Artificial Sequence: Synthetic oligonucleotide
gtccccacgcaggtgccatcacc

SEQ ID NO: 310380 - DNA, 23 bp, Artificial Sequence
  Description of Artificial Sequence: Synthetic oligonucleotide
tccccacgcaggtgccatcaccg

SEQ ID NO: 310381 - DNA, 22 bp, Artificial Sequence
  Description of Artificial Sequence: Synthetic oligonucleotide
ccccacgcaggtgccatcaccg

SEQ ID NO: 310382 - DNA, 22 bp, Artificial Sequence
  Description of Artificial Sequence: Synthetic oligonucleotide
cccacgcaggtgccatcaccgc

SEQ ID NO: 310383 - DNA, 25 bp, Artificial Sequence
  Description of Artificial Sequence: Synthetic oligonucleotide
ccacgcaggtgccatcaccgcctat

SEQ ID NO: 310384 - DNA, 25 bp, Artificial Sequence
  Description of Artificial Sequence: Synthetic oligonucleotide
cacgcaggtgccatcaccgcctatg

SEQ ID NO: 310385 - DNA, 25 bp, Artificial Sequence
  Description of Artificial Sequence: Synthetic oligonucleotide
acgcaggtgccatcaccgcctatgc

SEQ ID NO: 310386 - DNA, 24 bp, Artificial Sequence
  Description of Artificial Sequence: Synthetic oligonucleotide
cgcaggtgccatcaccgcctatgc

SEQ ID NO: 310387 - DNA, 24 bp, Artificial Sequence
  Description of Artificial Sequence: Synthetic oligonucleotide
gcaggtgccatcaccgcctatgcc

SEQ ID NO: 310388 - DNA, 25 bp, Artificial Sequence
  Description of Artificial Sequence: Synthetic oligonucleotide
caggtgccatcaccgcctatgccgt

SEQ ID NO: 310389 - DNA, 26 bp, Artificial Sequence
  Description of Artificial Sequence: Synthetic oligonucleotide
aggtgccatcaccgcctatgccgtga

SEQ ID NO: 310390 - DNA, 25 bp, Artificial Sequence
  Description of Artificial Sequence: Synthetic oligonucleotide
ggtgccatcaccgcctatgccgtga

SEQ ID NO: 310391 - DNA, 26 bp, Artificial Sequence
  Description of Artificial Sequence: Synthetic oligonucleotide
gtgccatcaccgcctatgccgtgaca

SEQ ID NO: 310392 - DNA, 27 bp, Artificial Sequence
  Description of Artificial Sequence: Synthetic oligonucleotide
tgccatcaccgcctatgccgtgacact

SEQ ID NO: 310393 - DNA, 26 bp, Artificial Sequence
  Description of Artificial Sequence: Synthetic oligonucleotide
gccatcaccgcctatgccgtgacact

SEQ ID NO: 310394 - DNA, 27 bp, Artificial Sequence
  Description of Artificial Sequence: Synthetic oligonucleotide
ccatcaccgcctatgccgtgacactga

SEQ ID NO: 310395 - DNA, 27 bp, Artificial Sequence
  Description of Artificial Sequence: Synthetic oligonucleotide
catcaccgcctatgccgtgacactgag

SEQ ID NO: 310396 - DNA, 27 bp, Artificial Sequence
  Description of Artificial Sequence: Synthetic oligonucleotide
atcaccgcctatgccgtgacactgagc

SEQ ID NO: 310397 - DNA, 27 bp, Artificial Sequence
  Description of Artificial Sequence: Synthetic oligonucleotide
tcaccgcctatgccgtgacactgagca

SEQ ID NO: 310398 - DNA, 27 bp, Artificial Sequence
  Description of Artificial Sequence: Synthetic oligonucleotide
caccgcctatgccgtgacactgagcaa

SEQ ID NO: 310399 - DNA, 27 bp, Artificial Sequence
  Description of Artificial Sequence: Synthetic oligonucleotide
accgcctatgccgtgacactgagcaag

SEQ ID NO: 310400 - DNA, 26 bp, Artificial Sequence
  Description of Artificial Sequence: Synthetic oligonucleotide
ccgcctatgccgtgacactgagcaag

SEQ ID NO: 310401 - DNA, 26 bp, Artificial Sequence
  Description of Artificial Sequence: Synthetic oligonucleotide
cgcctatgccgtgacactgagcaagg

SEQ ID NO: 310402 - DNA, 26 bp, Artificial Sequence
  Description of Artificial Sequence: Synthetic oligonucleotide
gcctatgccgtgacactgagcaaggc

SEQ ID NO: 310403 - DNA, 26 bp, Artificial Sequence
  Description of Artificial Sequence: Synthetic oligonucleotide
cctatgccgtgacactgagcaaggcc

SEQ ID NO: 310404 - DNA, 26 bp, Artificial Sequence
  Description of Artificial Sequence: Synthetic oligonucleotide
ctatgccgtgacactgagcaaggccc

SEQ ID NO: 310405 - DNA, 27 bp, Artificial Sequence
  Description of Artificial Sequence: Synthetic oligonucleotide
tatgccgtgacactgagcaaggcccca

SEQ ID NO: 310406 - DNA, 26 bp, Artificial Sequence
  Description of Artificial Sequence: Synthetic oligonucleotide
atgccgtgacactgagcaaggcccca

SEQ ID NO: 310407 - DNA, 25 bp, Artificial Sequence
  Description of Artificial Sequence: Synthetic oligonucleotide
tgccgtgacactgagcaaggcccca

SEQ ID NO: 310408 - DNA, 24 bp, Artificial Sequence
  Description of Artificial Sequence: Synthetic oligonucleotide
gccgtgacactgagcaaggcccca

SEQ ID NO: 310409 - DNA, 24 bp, Artificial Sequence
  Description of Artificial Sequence: Synthetic oligonucleotide
ccgtgacactgagcaaggccccag

SEQ ID NO: 310410 - DNA, 24 bp, Artificial Sequence
  Description of Artificial Sequence: Synthetic oligonucleotide
cgtgacactgagcaaggccccagc

SEQ ID NO: 310411 - DNA, 24 bp, Artificial Sequence
  Description of Artificial Sequence: Synthetic oligonucleotide
gtgacactgagcaaggccccagcg

SEQ ID NO: 310412 - DNA, 25 bp, Artificial Sequence
  Description of Artificial Sequence: Synthetic oligonucleotide
tgacactgagcaaggccccagcgga

SEQ ID NO: 310413 - DNA, 24 bp, Artificial Sequence
  Description of Artificial Sequence: Synthetic oligonucleotide
gacactgagcaaggccccagcgga

SEQ ID NO: 310414 - DNA, 24 bp, Artificial Sequence
  Description of Artificial Sequence: Synthetic oligonucleotide
acactgagcaaggccccagcggac

SEQ ID NO: 310415 - DNA, 23 bp, Artificial Sequence
  Description of Artificial Sequence: Synthetic oligonucleotide
cactgagcaaggccccagcggac

SEQ ID NO: 310416 - DNA, 24 bp, Artificial Sequence
  Description of Artificial Sequence: Synthetic oligonucleotide
actgagcaaggccccagcggacct

SEQ ID NO: 310417 - DNA, 23 bp, Artificial Sequence
  Description of Artificial Sequence: Synthetic oligonucleotide
ctgagcaaggccccagcggacct

SEQ ID NO: 310418 - DNA, 23 bp, Artificial Sequence
  Description of Artificial Sequence: Synthetic oligonucleotide
tgagcaaggccccagcggacctg

SEQ ID NO: 310419 - DNA, 22 bp, Artificial Sequence
  Description of Artificial Sequence: Synthetic oligonucleotide
gagcaaggccccagcggacctg

SEQ ID NO: 310420 - DNA, 22 bp, Artificial Sequence
  Description of Artificial Sequence: Synthetic oligonucleotide
agcaaggccccagcggacctgg

SEQ ID NO: 310421 - DNA, 21 bp, Artificial Sequence
  Description of Artificial Sequence: Synthetic oligonucleotide
gcaaggccccagcggacctgg

SEQ ID NO: 310422 - DNA, 21 bp, Artificial Sequence
  Description of Artificial Sequence: Synthetic oligonucleotide
caaggccccagcggacctggg

SEQ ID NO: 310423 - DNA, 21 bp, Artificial Sequence
  Description of Artificial Sequence: Synthetic oligonucleotide
aaggccccagcggacctgggg

SEQ ID NO: 310424 - DNA, 20 bp, Artificial Sequence
  Description of Artificial Sequence: Synthetic oligonucleotide
aggccccagcggacctgggg

SEQ ID NO: 310425 - DNA, 20 bp, Artificial Sequence
  Description of Artificial Sequence: Synthetic oligonucleotide
ggccccagcggacctggggt

SEQ ID NO: 310426 - DNA, 20 bp, Artificial Sequence
  Description of Artificial Sequence: Synthetic oligonucleotide
gccccagcggacctgggggt

SEQ ID NO: 310427 - DNA, 20 bp, Artificial Sequence
  Description of Artificial Sequence: Synthetic oligonucleotide
ccccagcggacctggggggt

SEQ ID NO: 310428 - DNA, 22 bp, Artificial Sequence
  Description of Artificial Sequence: Synthetic oligonucleotide
cccagcggacctggggggtgtt

SEQ ID NO: 310429 - DNA, 22 bp, Artificial Sequence
  Description of Artificial Sequence: Synthetic oligonucleotide
ccagcggacctggggggtgttg

SEQ ID NO: 310430 - DNA, 22 bp, Artificial Sequence
  Description of Artificial Sequence: Synthetic oligonucleotide
cagcggacctggggggtgttgg

SEQ ID NO: 310431 - DNA, 22 bp, Artificial Sequence
  Description of Artificial Sequence: Synthetic oligonucleotide
agcggacctggggggtgttggc

SEQ ID NO: 310432 - DNA, 21 bp, Artificial Sequence
  Description of Artificial Sequence: Synthetic oligonucleotide
gcggacctggggggtgttggc

SEQ ID NO: 310433 - DNA, 22 bp, Artificial Sequence
  Description of Artificial Sequence: Synthetic oligonucleotide
cggacctggggggtgttggcca

SEQ ID NO: 310434 - DNA, 24 bp, Artificial Sequence
  Description of Artificial Sequence: Synthetic oligonucleotide
ggacctggggggtgttggccacaa

SEQ ID NO: 310435 - DNA, 26 bp, Artificial Sequence
  Description of Artificial Sequence: Synthetic oligonucleotide
gacctggggggtgttggccacaacaa

SEQ ID NO: 310436 - DNA, 26 bp, Artificial Sequence
  Description of Artificial Sequence: Synthetic oligonucleotide
acctggggggtgttggccacaacaag

SEQ ID NO: 310437 - DNA, 25 bp, Artificial Sequence
  Description of Artificial Sequence: Synthetic oligonucleotide
cctggggggtgttggccacaacaag

SEQ ID NO: 310438 - DNA, 26 bp, Artificial Sequence
  Description of Artificial Sequence: Synthetic oligonucleotide
ctggggggtgttggccacaacaagct

SEQ ID NO: 310439 - DNA, 27 bp, Artificial Sequence
  Description of Artificial Sequence: Synthetic oligonucleotide
tggggggtgttggccacaacaagctca

SEQ ID NO: 310440 - DNA, 27 bp, Artificial Sequence
  Description of Artificial Sequence: Synthetic oligonucleotide
ggggggtgttggccacaacaagctcat

SEQ ID NO: 310441 - DNA, 27 bp, Artificial Sequence
  Description of Artificial Sequence: Synthetic oligonucleotide
gggggtgttggccacaacaagctcatg

SEQ ID NO: 310442 - DNA, 27 bp, Artificial Sequence
  Description of Artificial Sequence: Synthetic oligonucleotide
ggggtgttggccacaacaagctcatgg

SEQ ID NO: 310443 - DNA, 27 bp, Artificial Sequence
  Description of Artificial Sequence: Synthetic oligonucleotide
gggtgttggccacaacaagctcatggc

SEQ ID NO: 310444 - DNA, 30 bp, Artificial Sequence
  Description of Artificial Sequence: Synthetic oligonucleotide
ggtgttggccacaacaagctcatggcattg

SEQ ID NO: 310445 - DNA, 30 bp, Artificial Sequence
  Description of Artificial Sequence: Synthetic oligonucleotide
gtgttggccacaacaagctcatggcattgg

SEQ ID NO: 310446 - DNA, 30 bp, Artificial Sequence
  Description of Artificial Sequence: Synthetic oligonucleotide
tgttggccacaacaagctcatggcattggc

SEQ ID NO: 310447 - DNA, 29 bp, Artificial Sequence
  Description of Artificial Sequence: Synthetic oligonucleotide
gttggccacaacaagctcatggcattggc

SEQ ID NO: 310448 - DNA, 29 bp, Artificial Sequence
  Description of Artificial Sequence: Synthetic oligonucleotide
ttggccacaacaagctcatggcattggcc

SEQ ID NO: 310449 - DNA, 28 bp, Artificial Sequence
  Description of Artificial Sequence: Synthetic oligonucleotide
tggccacaacaagctcatggcattggcc

SEQ ID NO: 310450 - DNA, 27 bp, Artificial Sequence
  Description of Artificial Sequence: Synthetic oligonucleotide
ggccacaacaagctcatggcattggcc

SEQ ID NO: 310451 - DNA, 27 bp, Artificial Sequence
  Description of Artificial Sequence: Synthetic oligonucleotide
gccacaacaagctcatggcattggccc

SEQ ID NO: 310452 - DNA, 28 bp, Artificial Sequence
  Description of Artificial Sequence: Synthetic oligonucleotide
ccacaacaagctcatggcattggcccag

SEQ ID NO: 310453 - DNA, 28 bp, Artificial Sequence
  Description of Artificial Sequence: Synthetic oligonucleotide
cacaacaagctcatggcattggcccagg

SEQ ID NO: 310454 - DNA, 29 bp, Artificial Sequence
  Description of Artificial Sequence: Synthetic oligonucleotide
acaacaagctcatggcattggcccaggtg

SEQ ID NO: 310455 - DNA, 28 bp, Artificial Sequence
  Description of Artificial Sequence: Synthetic oligonucleotide
caacaagctcatggcattggcccaggtg

SEQ ID NO: 310456 - DNA, 29 bp, Artificial Sequence
  Description of Artificial Sequence: Synthetic oligonucleotide
aacaagctcatggcattggcccaggtgac

SEQ ID NO: 310457 - DNA, 28 bp, Artificial Sequence
  Description of Artificial Sequence: Synthetic oligonucleotide
acaagctcatggcattggcccaggtgac

SEQ ID NO: 310458 - DNA, 27 bp, Artificial Sequence
  Description of Artificial Sequence: Synthetic oligonucleotide
caagctcatggcattggcccaggtgac

SEQ ID NO: 310459 - DNA, 28 bp, Artificial Sequence
  Description of Artificial Sequence: Synthetic oligonucleotide
aagctcatggcattggcccaggtgactg

SEQ ID NO: 310460 - DNA, 27 bp, Artificial Sequence
  Description of Artificial Sequence: Synthetic oligonucleotide
agctcatggcattggcccaggtgactg

SEQ ID NO: 310461 - DNA, 26 bp, Artificial Sequence
  Description of Artificial Sequence: Synthetic oligonucleotide
gctcatggcattggcccaggtgactg

SEQ ID NO: 310462 - DNA, 27 bp, Artificial Sequence
  Description of Artificial Sequence: Synthetic oligonucleotide
ctcatggcattggcccaggtgactgga

SEQ ID NO: 310463 - DNA, 27 bp, Artificial Sequence
  Description of Artificial Sequence: Synthetic oligonucleotide
tcatggcattggcccaggtgactggag

SEQ ID NO: 310464 - DNA, 32 bp, Artificial Sequence
  Description of Artificial Sequence: Synthetic oligonucleotide
atggccagccagttcaagatgaagctcttgtg

SEQ ID NO: 310465 - DNA, 31 bp, Artificial Sequence
  Description of Artificial Sequence: Synthetic oligonucleotide
tggccagccagttcaagatgaagctcttgtg

SEQ ID NO: 310466 - DNA, 30 bp, Artificial Sequence
  Description of Artificial Sequence: Synthetic oligonucleotide
ggccagccagttcaagatgaagctcttgtg

SEQ ID NO: 310467 - DNA, 30 bp, Artificial Sequence
  Description of Artificial Sequence: Synthetic oligonucleotide
gccagccagttcaagatgaagctcttgtgg

SEQ ID NO: 310468 - DNA, 31 bp, Artificial Sequence
  Description of Artificial Sequence: Synthetic oligonucleotide
ccagccagttcaagatgaagctcttgtggag

SEQ ID NO: 310469 - DNA, 31 bp, Artificial Sequence
  Description of Artificial Sequence: Synthetic oligonucleotide
cagccagttcaagatgaagctcttgtggagg

SEQ ID NO: 310470 - DNA, 31 bp, Artificial Sequence
  Description of Artificial Sequence: Synthetic oligonucleotide
agccagttcaagatgaagctcttgtggaggg

SEQ ID NO: 310471 - DNA, 30 bp, Artificial Sequence
  Description of Artificial Sequence: Synthetic oligonucleotide
gccagttcaagatgaagctcttgtggaggg

SEQ ID NO: 310472 - DNA, 30 bp, Artificial Sequence
  Description of Artificial Sequence: Synthetic oligonucleotide
ccagttcaagatgaagctcttgtggagggc

SEQ ID NO: 310473 - DNA, 31 bp, Artificial Sequence
  Description of Artificial Sequence: Synthetic oligonucleotide
cagttcaagatgaagctcttgtggagggcac

SEQ ID NO: 310474 - DNA, 32 bp, Artificial Sequence
  Description of Artificial Sequence: Synthetic oligonucleotide
agttcaagatgaagctcttgtggagggcactg

SEQ ID NO: 310475 - DNA, 31 bp, Artificial Sequence
  Description of Artificial Sequence: Synthetic oligonucleotide
gttcaagatgaagctcttgtggagggcactg

SEQ ID NO: 310476 - DNA, 31 bp, Artificial Sequence
  Description of Artificial Sequence: Synthetic oligonucleotide
ttcaagatgaagctcttgtggagggcactgg

SEQ ID NO: 310477 - DNA, 30 bp, Artificial Sequence
  Description of Artificial Sequence: Synthetic oligonucleotide
tcaagatgaagctcttgtggagggcactgg

SEQ ID NO: 310478 - DNA, 29 bp, Artificial Sequence
  Description of Artificial Sequence: Synthetic oligonucleotide
caagatgaagctcttgtggagggcactgg

SEQ ID NO: 310479 - DNA, 30 bp, Artificial Sequence
  Description of Artificial Sequence: Synthetic oligonucleotide
aagatgaagctcttgtggagggcactggtg

SEQ ID NO: 310480 - DNA, 29 bp, Artificial Sequence
  Description of Artificial Sequence: Synthetic oligonucleotide
agatgaagctcttgtggagggcactggtg

SEQ ID NO: 310481 - DNA, 28 bp, Artificial Sequence
  Description of Artificial Sequence: Synthetic oligonucleotide
gatgaagctcttgtggagggcactggtg

SEQ ID NO: 310482 - DNA, 28 bp, Artificial Sequence
  Description of Artificial Sequence: Synthetic oligonucleotide
atgaagctcttgtggagggcactggtgg

SEQ ID NO: 310483 - DNA, 27 bp, Artificial Sequence
  Description of Artificial Sequence: Synthetic oligonucleotide
tgaagctcttgtggagggcactggtgg

SEQ ID NO: 310484 - DNA, 26 bp, Artificial Sequence
  Description of Artificial Sequence: Synthetic oligonucleotide
gaagctcttgtggagggcactggtgg

SEQ ID NO: 310485 - DNA, 26 bp, Artificial Sequence
  Description of Artificial Sequence: Synthetic oligonucleotide
aagctcttgtggagggcactggtggc

SEQ ID NO: 310486 - DNA, 25 bp, Artificial Sequence
  Description of Artificial Sequence: Synthetic oligonucleotide
agctcttgtggagggcactggtggc

SEQ ID NO: 310487 - DNA, 24 bp, Artificial Sequence
  Description of Artificial Sequence: Synthetic oligonucleotide
gctcttgtggagggcactggtggc

SEQ ID NO: 310488 - DNA, 24 bp, Artificial Sequence
  Description of Artificial Sequence: Synthetic oligonucleotide
ctcttgtggagggcactggtggcc

SEQ ID NO: 310489 - DNA, 25 bp, Artificial Sequence
  Description of Artificial Sequence: Synthetic oligonucleotide
tcttgtggagggcactggtggccgt

SEQ ID NO: 310490 - DNA, 24 bp, Artificial Sequence
  Description of Artificial Sequence: Synthetic oligonucleotide
cttgtggagggcactggtggccgt

SEQ ID NO: 310491 - DNA, 26 bp, Artificial Sequence
  Description of Artificial Sequence: Synthetic oligonucleotide
ttgtggagggcactggtggccgtgtt

SEQ ID NO: 310492 - DNA, 25 bp, Artificial Sequence
  Description of Artificial Sequence: Synthetic oligonucleotide
tgtggagggcactggtggccgtgtt

SEQ ID NO: 310493 - DNA, 24 bp, Artificial Sequence
  Description of Artificial Sequence: Synthetic oligonucleotide
gtggagggcactggtggccgtgtt

SEQ ID NO: 310494 - DNA, 24 bp, Artificial Sequence
  Description of Artificial Sequence: Synthetic oligonucleotide
tggagggcactggtggccgtgttc

SEQ ID NO: 310495 - DNA, 23 bp, Artificial Sequence
  Description of Artificial Sequence: Synthetic oligonucleotide
ggagggcactggtggccgtgttc

SEQ ID NO: 310496 - DNA, 24 bp, Artificial Sequence
  Description of Artificial Sequence: Synthetic oligonucleotide
gagggcactggtggccgtgttcct

SEQ ID NO: 310497 - DNA, 24 bp, Artificial Sequence
  Description of Artificial Sequence: Synthetic oligonucleotide
agggcactggtggccgtgttcctg

SEQ ID NO: 310498 - DNA, 23 bp, Artificial Sequence
  Description of Artificial Sequence: Synthetic oligonucleotide
gggcactggtggccgtgttcctg

SEQ ID NO: 310499 - DNA, 23 bp, Artificial Sequence
  Description of Artificial Sequence: Synthetic oligonucleotide
ggcactggtggccgtgttcctgg

SEQ ID NO: 310500 - DNA, 23 bp, Artificial Sequence
  Description of Artificial Sequence: Synthetic oligonucleotide
gcactggtggccgtgttcctggc

SEQ ID NO: 310501 - DNA, 24 bp, Artificial Sequence
  Description of Artificial Sequence: Synthetic oligonucleotide
cactggtggccgtgttcctggcga

SEQ ID NO: 310502 - DNA, 24 bp, Artificial Sequence
  Description of Artificial Sequence: Synthetic oligonucleotide
actggtggccgtgttcctggcgac

SEQ ID NO: 310503 - DNA, 23 bp, Artificial Sequence
  Description of Artificial Sequence: Synthetic oligonucleotide
ctggtggccgtgttcctggcgac

SEQ ID NO: 310504 - DNA, 24 bp, Artificial Sequence
  Description of Artificial Sequence: Synthetic oligonucleotide
tggtggccgtgttcctggcgacga

SEQ ID NO: 310505 - DNA, 23 bp, Artificial Sequence
  Description of Artificial Sequence: Synthetic oligonucleotide
ggtggccgtgttcctggcgacga

SEQ ID NO: 310506 - DNA, 23 bp, Artificial Sequence
  Description of Artificial Sequence: Synthetic oligonucleotide
gtggccgtgttcctggcgacgac

SEQ ID NO: 310507 - DNA, 23 bp, Artificial Sequence
  Description of Artificial Sequence: Synthetic oligonucleotide
tggccgtgttcctggcgacgacc

SEQ ID NO: 310508 - DNA, 22 bp, Artificial Sequence
  Description of Artificial Sequence: Synthetic oligonucleotide
ggccgtgttcctggcgacgacc

SEQ ID NO: 310509 - DNA, 23 bp, Artificial Sequence
  Description of Artificial Sequence: Synthetic oligonucleotide
gccgtgttcctggcgacgaccct

SEQ ID NO: 310510 - DNA, 26 bp, Artificial Sequence
  Description of Artificial Sequence: Synthetic oligonucleotide
ccgtgttcctggcgacgaccctcatt

SEQ ID NO: 310511 - DNA, 27 bp, Artificial Sequence
  Description of Artificial Sequence: Synthetic oligonucleotide
cgtgttcctggcgacgaccctcattgt

SEQ ID NO: 310512 - DNA, 27 bp, Artificial Sequence
  Description of Artificial Sequence: Synthetic oligonucleotide
gtgttcctggcgacgaccctcattgtc

SEQ ID NO: 310513 - DNA, 29 bp, Artificial Sequence
  Description of Artificial Sequence: Synthetic oligonucleotide
tgttcctggcgacgaccctcattgtcttc

SEQ ID NO: 310514 - DNA, 28 bp, Artificial Sequence
  Description of Artificial Sequence: Synthetic oligonucleotide
gttcctggcgacgaccctcattgtcttc

SEQ ID NO: 310515 - DNA, 30 bp, Artificial Sequence
  Description of Artificial Sequence: Synthetic oligonucleotide
ttcctggcgacgaccctcattgtcttcaac

SEQ ID NO: 310516 - DNA, 29 bp, Artificial Sequence
  Description of Artificial Sequence: Synthetic oligonucleotide
tcctggcgacgaccctcattgtcttcaac

SEQ ID NO: 310517 - DNA, 28 bp, Artificial Sequence
  Description of Artificial Sequence: Synthetic oligonucleotide
cctggcgacgaccctcattgtcttcaac

SEQ ID NO: 310518 - DNA, 29 bp, Artificial Sequence
  Description of Artificial Sequence: Synthetic oligonucleotide
ctggcgacgaccctcattgtcttcaacag

SEQ ID NO: 310519 - DNA, 29 bp, Artificial Sequence
  Description of Artificial Sequence: Synthetic oligonucleotide
tggcgacgaccctcattgtcttcaacagc

SEQ ID NO: 310520 - DNA, 28 bp, Artificial Sequence
  Description of Artificial Sequence: Synthetic oligonucleotide
ggcgacgaccctcattgtcttcaacagc

SEQ ID NO: 310521 - DNA, 30 bp, Artificial Sequence
  Description of Artificial Sequence: Synthetic oligonucleotide
gcgacgaccctcattgtcttcaacagcatc

SEQ ID NO: 310522 - DNA, 30 bp, Artificial Sequence
  Description of Artificial Sequence: Synthetic oligonucleotide
cgacgaccctcattgtcttcaacagcatcg

SEQ ID NO: 310523 - DNA, 30 bp, Artificial Sequence
  Description of Artificial Sequence: Synthetic oligonucleotide
gacgaccctcattgtcttcaacagcatcgg

SEQ ID NO: 310524 - DNA, 32 bp, Artificial Sequence
  Description of Artificial Sequence: Synthetic oligonucleotide
acgaccctcattgtcttcaacagcatcggatc

SEQ ID NO: 310525 - DNA, 31 bp, Artificial Sequence
  Description of Artificial Sequence: Synthetic oligonucleotide
cgaccctcattgtcttcaacagcatcggatc

SEQ ID NO: 310526 - DNA, 32 bp, Artificial Sequence
  Description of Artificial Sequence: Synthetic oligonucleotide
gaccctcattgtcttcaacagcatcggatctg

SEQ ID NO: 310527 - DNA, 32 bp, Artificial Sequence
  Description of Artificial Sequence: Synthetic oligonucleotide
accctcattgtcttcaacagcatcggatctgc

SEQ ID NO: 310528 - DNA, 31 bp, Artificial Sequence
  Description of Artificial Sequence: Synthetic oligonucleotide
ccctcattgtcttcaacagcatcggatctgc

SEQ ID NO: 310529 - DNA, 31 bp, Artificial Sequence
  Description of Artificial Sequence: Synthetic oligonucleotide
cctcattgtcttcaacagcatcggatctgcc

SEQ ID NO: 310530 - DNA, 31 bp, Artificial Sequence
  Description of Artificial Sequence: Synthetic oligonucleotide
ctcattgtcttcaacagcatcggatctgccc

SEQ ID NO: 310531 - DNA, 32 bp, Artificial Sequence
  Description of Artificial Sequence: Synthetic oligonucleotide
tcattgtcttcaacagcatcggatctgccctg

SEQ ID NO: 310532 - DNA, 31 bp, Artificial Sequence
  Description of Artificial Sequence: Synthetic oligonucleotide
cattgtcttcaacagcatcggatctgccctg

SEQ ID NO: 310533 - DNA, 31 bp, Artificial Sequence
  Description of Artificial Sequence: Synthetic oligonucleotide
attgtcttcaacagcatcggatctgccctgc

SEQ ID NO: 310534 - DNA, 30 bp, Artificial Sequence
  Description of Artificial Sequence: Synthetic oligonucleotide
ttgtcttcaacagcatcggatctgccctgc

SEQ ID NO: 310535 - DNA, 29 bp, Artificial Sequence
  Description of Artificial Sequence: Synthetic oligonucleotide
tgtcttcaacagcatcggatctgccctgc

SEQ ID NO: 310536 - DNA, 28 bp, Artificial Sequence
  Description of Artificial Sequence: Synthetic oligonucleotide
gtcttcaacagcatcggatctgccctgc

SEQ ID NO: 310537 - DNA, 28 bp, Artificial Sequence
  Description of Artificial Sequence: Synthetic oligonucleotide
tcttcaacagcatcggatctgccctgcg

SEQ ID NO: 310538 - DNA, 27 bp, Artificial Sequence
  Description of Artificial Sequence: Synthetic oligonucleotide
cttcaacagcatcggatctgccctgcg

SEQ ID NO: 310539 - DNA, 27 bp, Artificial Sequence
  Description of Artificial Sequence: Synthetic oligonucleotide
ttcaacagcatcggatctgccctgcgc

SEQ ID NO: 310540 - DNA, 27 bp, Artificial Sequence
  Description of Artificial Sequence: Synthetic oligonucleotide
tcaacagcatcggatctgccctgcgct

SEQ ID NO: 310541 - DNA, 27 bp, Artificial Sequence
  Description of Artificial Sequence: Synthetic oligonucleotide
caacagcatcggatctgccctgcgctt

SEQ ID NO: 310542 - DNA, 27 bp, Artificial Sequence
  Description of Artificial Sequence: Synthetic oligonucleotide
aacagcatcggatctgccctgcgcttc

SEQ ID NO: 310543 - DNA, 27 bp, Artificial Sequence
  Description of Artificial Sequence: Synthetic oligonucleotide
acagcatcggatctgccctgcgcttca

SEQ ID NO: 310544 - DNA, 27 bp, Artificial Sequence
  Description of Artificial Sequence: Synthetic oligonucleotide
cagcatcggatctgccctgcgcttcaa

SEQ ID NO: 310545 - DNA, 30 bp, Artificial Sequence
  Description of Artificial Sequence: Synthetic oligonucleotide
agcatcggatctgccctgcgcttcaaattc

SEQ ID NO: 310546 - DNA, 29 bp, Artificial Sequence
  Description of Artificial Sequence: Synthetic oligonucleotide
gcatcggatctgccctgcgcttcaaattc

SEQ ID NO: 310547 - DNA, 29 bp, Artificial Sequence
  Description of Artificial Sequence: Synthetic oligonucleotide
catcggatctgccctgcgcttcaaattcc

SEQ ID NO: 310548 - DNA, 29 bp, Artificial Sequence
  Description of Artificial Sequence: Synthetic oligonucleotide
atcggatctgccctgcgcttcaaattccc

SEQ ID NO: 310549 - DNA, 28 bp, Artificial Sequence
  Description of Artificial Sequence: Synthetic oligonucleotide
tcggatctgccctgcgcttcaaattccc

SEQ ID NO: 310550 - DNA, 27 bp, Artificial Sequence
  Description of Artificial Sequence: Synthetic oligonucleotide
cggatctgccctgcgcttcaaattccc

SEQ ID NO: 310551 - DNA, 27 bp, Artificial Sequence
  Description of Artificial Sequence: Synthetic oligonucleotide
ggatctgccctgcgcttcaaattcccg

SEQ ID NO: 310552 - DNA, 27 bp, Artificial Sequence
  Description of Artificial Sequence: Synthetic oligonucleotide
gatctgccctgcgcttcaaattcccgg

SEQ ID NO: 310553 - DNA, 28 bp, Artificial Sequence
  Description of Artificial Sequence: Synthetic oligonucleotide
atctgccctgcgcttcaaattcccggtg

SEQ ID NO: 310554 - DNA, 27 bp, Artificial Sequence
  Description of Artificial Sequence: Synthetic oligonucleotide
tctgccctgcgcttcaaattcccggtg

SEQ ID NO: 310555 - DNA, 26 bp, Artificial Sequence
  Description of Artificial Sequence: Synthetic oligonucleotide
ctgccctgcgcttcaaattcccggtg

SEQ ID NO: 310556 - DNA, 26 bp, Artificial Sequence
  Description of Artificial Sequence: Synthetic oligonucleotide
tgccctgcgcttcaaattcccggtgg

SEQ ID NO: 310557 - DNA, 25 bp, Artificial Sequence
  Description of Artificial Sequence: Synthetic oligonucleotide
gccctgcgcttcaaattcccggtgg

SEQ ID NO: 310558 - DNA, 25 bp, Artificial Sequence
  Description of Artificial Sequence: Synthetic oligonucleotide
ccctgcgcttcaaattcccggtggg

SEQ ID NO: 310559 - DNA, 27 bp, Artificial Sequence
  Description of Artificial Sequence: Synthetic oligonucleotide
cctgcgcttcaaattcccggtgggcaa

SEQ ID NO: 310560 - DNA, 27 bp, Artificial Sequence
  Description of Artificial Sequence: Synthetic oligonucleotide
ctgcgcttcaaattcccggtgggcaac

SEQ ID NO: 310561 - DNA, 29 bp, Artificial Sequence
  Description of Artificial Sequence: Synthetic oligonucleotide
tgcgcttcaaattcccggtgggcaacaac

SEQ ID NO: 310562 - DNA, 28 bp, Artificial Sequence
  Description of Artificial Sequence: Synthetic oligonucleotide
gcgcttcaaattcccggtgggcaacaac

SEQ ID NO: 310563 - DNA, 28 bp, Artificial Sequence
  Description of Artificial Sequence: Synthetic oligonucleotide
cgcttcaaattcccggtgggcaacaacc

SEQ ID NO: 310564 - DNA, 29 bp, Artificial Sequence
  Description of Artificial Sequence: Synthetic oligonucleotide
gcttcaaattcccggtgggcaacaaccag

SEQ ID NO: 310565 - DNA, 30 bp, Artificial Sequence
  Description of Artificial Sequence: Synthetic oligonucleotide
cttcaaattcccggtgggcaacaaccagtc

SEQ ID NO: 310566 - DNA, 30 bp, Artificial Sequence
  Description of Artificial Sequence: Synthetic oligonucleotide
ttcaaattcccggtgggcaacaaccagtcg

SEQ ID NO: 310567 - DNA, 29 bp, Artificial Sequence
  Description of Artificial Sequence: Synthetic oligonucleotide
tcaaattcccggtgggcaacaaccagtcg

SEQ ID NO: 310568 - DNA, 28 bp, Artificial Sequence
  Description of Artificial Sequence: Synthetic oligonucleotide
caaattcccggtgggcaacaaccagtcg

SEQ ID NO: 310569 - DNA, 28 bp, Artificial Sequence
  Description of Artificial Sequence: Synthetic oligonucleotide
aaattcccggtgggcaacaaccagtcgg

SEQ ID NO: 310570 - DNA, 27 bp, Artificial Sequence
  Description of Artificial Sequence: Synthetic oligonucleotide
aattcccggtgggcaacaaccagtcgg

SEQ ID NO: 310571 - DNA, 26 bp, Artificial Sequence
  Description of Artificial Sequence: Synthetic oligonucleotide
attcccggtgggcaacaaccagtcgg

SEQ ID NO: 310572 - DNA, 25 bp, Artificial Sequence
  Description of Artificial Sequence: Synthetic oligonucleotide
ttcccggtgggcaacaaccagtcgg

SEQ ID NO: 310573 - DNA, 24 bp, Artificial Sequence
  Description of Artificial Sequence: Synthetic oligonucleotide
tcccggtgggcaacaaccagtcgg

SEQ ID NO: 310574 - DNA, 23 bp, Artificial Sequence
  Description of Artificial Sequence: Synthetic oligonucleotide
cccggtgggcaacaaccagtcgg

SEQ ID NO: 310575 - DNA, 23 bp, Artificial Sequence
  Description of Artificial Sequence: Synthetic oligonucleotide
ccggtgggcaacaaccagtcggc

SEQ ID NO: 310576 - DNA, 23 bp, Artificial Sequence
  Description of Artificial Sequence: Synthetic oligonucleotide
cggtgggcaacaaccagtcggcg

SEQ ID NO: 310577 - DNA, 24 bp, Artificial Sequence
  Description of Artificial Sequence: Synthetic oligonucleotide
ggtgggcaacaaccagtcggcggt

SEQ ID NO: 310578 - DNA, 24 bp, Artificial Sequence
  Description of Artificial Sequence: Synthetic oligonucleotide
gtgggcaacaaccagtcggcggtc

SEQ ID NO: 310579 - DNA, 25 bp, Artificial Sequence
  Description of Artificial Sequence: Synthetic oligonucleotide
tgggcaacaaccagtcggcggtcct

SEQ ID NO: 310580 - DNA, 24 bp, Artificial Sequence
  Description of Artificial Sequence: Synthetic oligonucleotide
gggcaacaaccagtcggcggtcct

SEQ ID NO: 310581 - DNA, 24 bp, Artificial Sequence
  Description of Artificial Sequence: Synthetic oligonucleotide
ggcaacaaccagtcggcggtcctg

SEQ ID NO: 310582 - DNA, 25 bp, Artificial Sequence
  Description of Artificial Sequence: Synthetic oligonucleotide
gcaacaaccagtcggcggtcctgga

SEQ ID NO: 310583 - DNA, 27 bp, Artificial Sequence
  Description of Artificial Sequence: Synthetic oligonucleotide
caacaaccagtcggcggtcctggacaa

SEQ ID NO: 310584 - DNA, 27 bp, Artificial Sequence
  Description of Artificial Sequence: Synthetic oligonucleotide
aacaaccagtcggcggtcctggacaac

SEQ ID NO: 310585 - DNA, 26 bp, Artificial Sequence
  Description of Artificial Sequence: Synthetic oligonucleotide
acaaccagtcggcggtcctggacaac

SEQ ID NO: 310586 - DNA, 25 bp, Artificial Sequence
  Description of Artificial Sequence: Synthetic oligonucleotide
caaccagtcggcggtcctggacaac

SEQ ID NO: 310587 - DNA, 26 bp, Artificial Sequence
  Description of Artificial Sequence: Synthetic oligonucleotide
aaccagtcggcggtcctggacaacgt

SEQ ID NO: 310588 - DNA, 25 bp, Artificial Sequence
  Description of Artificial Sequence: Synthetic oligonucleotide
accagtcggcggtcctggacaacgt

SEQ ID NO: 310589 - DNA, 24 bp, Artificial Sequence
  Description of Artificial Sequence: Synthetic oligonucleotide
ccagtcggcggtcctggacaacgt

SEQ ID NO: 310590 - DNA, 26 bp, Artificial Sequence
  Description of Artificial Sequence: Synthetic oligonucleotide
cagtcggcggtcctggacaacgtcaa

SEQ ID NO: 310591 - DNA, 26 bp, Artificial Sequence
  Description of Artificial Sequence: Synthetic oligonucleotide
agtcggcggtcctggacaacgtcaag

SEQ ID NO: 310592 - DNA, 25 bp, Artificial Sequence
  Description of Artificial Sequence: Synthetic oligonucleotide
gtcggcggtcctggacaacgtcaag

SEQ ID NO: 310593 - DNA, 26 bp, Artificial Sequence
  Description of Artificial Sequence: Synthetic oligonucleotide
tcggcggtcctggacaacgtcaaggt

SEQ ID NO: 310594 - DNA, 25 bp, Artificial Sequence
  Description of Artificial Sequence: Synthetic oligonucleotide
cggcggtcctggacaacgtcaaggt

SEQ ID NO: 310595 - DNA, 26 bp, Artificial Sequence
  Description of Artificial Sequence: Synthetic oligonucleotide
ggcggtcctggacaacgtcaaggtgt

SEQ ID NO: 310596 - DNA, 26 bp, Artificial Sequence
  Description of Artificial Sequence: Synthetic oligonucleotide
gcggtcctggacaacgtcaaggtgtc

SEQ ID NO: 310597 - DNA, 26 bp, Artificial Sequence
  Description of Artificial Sequence: Synthetic oligonucleotide
cggtcctggacaacgtcaaggtgtcg

SEQ ID NO: 310598 - DNA, 27 bp, Artificial Sequence
  Description of Artificial Sequence: Synthetic oligonucleotide
ggtcctggacaacgtcaaggtgtcggt

SEQ ID NO: 310599 - DNA, 27 bp, Artificial Sequence
  Description of Artificial Sequence: Synthetic oligonucleotide
gtcctggacaacgtcaaggtgtcggtg

SEQ ID NO: 310600 - DNA, 27 bp, Artificial Sequence
  Description of Artificial Sequence: Synthetic oligonucleotide
tcctggacaacgtcaaggtgtcggtgg

SEQ ID NO: 310601 - DNA, 26 bp, Artificial Sequence
  Description of Artificial Sequence: Synthetic oligonucleotide
cctggacaacgtcaaggtgtcggtgg

SEQ ID NO: 310602 - DNA, 26 bp, Artificial Sequence
  Description of Artificial Sequence: Synthetic oligonucleotide
ctggacaacgtcaaggtgtcggtggc

SEQ ID NO: 310603 - DNA, 27 bp, Artificial Sequence
  Description of Artificial Sequence: Synthetic oligonucleotide
tggacaacgtcaaggtgtcggtggcct

SEQ ID NO: 310604 - DNA, 27 bp, Artificial Sequence
  Description of Artificial Sequence: Synthetic oligonucleotide
ggacaacgtcaaggtgtcggtggcctt

SEQ ID NO: 310605 - DNA, 27 bp, Artificial Sequence
  Description of Artificial Sequence: Synthetic oligonucleotide
gacaacgtcaaggtgtcggtggccttc

SEQ ID NO: 310606 - DNA, 27 bp, Artificial Sequence
  Description of Artificial Sequence: Synthetic oligonucleotide
acaacgtcaaggtgtcggtggccttcg

SEQ ID NO: 310607 - DNA, 26 bp, Artificial Sequence
  Description of Artificial Sequence: Synthetic oligonucleotide
caacgtcaaggtgtcggtggccttcg

SEQ ID NO: 310608 - DNA, 26 bp, Artificial Sequence
  Description of Artificial Sequence: Synthetic oligonucleotide
aacgtcaaggtgtcggtggccttcgc

SEQ ID NO: 310609 - DNA, 25 bp, Artificial Sequence
  Description of Artificial Sequence: Synthetic oligonucleotide
acgtcaaggtgtcggtggccttcgc

SEQ ID NO: 310610 - DNA, 24 bp, Artificial Sequence
  Description of Artificial Sequence: Synthetic oligonucleotide
cgtcaaggtgtcggtggccttcgc

SEQ ID NO: 310611 - DNA, 24 bp, Artificial Sequence
  Description of Artificial Sequence: Synthetic oligonucleotide
gtcaaggtgtcggtggccttcgcg

SEQ ID NO: 310612 - DNA, 25 bp, Artificial Sequence
  Description of Artificial Sequence: Synthetic oligonucleotide
tcaaggtgtcggtggccttcgcgct

SEQ ID NO: 310613 - DNA, 24 bp, Artificial Sequence
  Description of Artificial Sequence: Synthetic oligonucleotide
caaggtgtcggtggccttcgcgct

SEQ ID NO: 310614 - DNA, 25 bp, Artificial Sequence
  Description of Artificial Sequence: Synthetic oligonucleotide
aaggtgtcggtggccttcgcgctga

SEQ ID NO: 310615 - DNA, 24 bp, Artificial Sequence
  Description of Artificial Sequence: Synthetic oligonucleotide
aggtgtcggtggccttcgcgctga

SEQ ID NO: 310616 - DNA, 23 bp, Artificial Sequence
  Description of Artificial Sequence: Synthetic oligonucleotide
ggtgtcggtggccttcgcgctga

SEQ ID NO: 310617 - DNA, 23 bp, Artificial Sequence
  Description of Artificial Sequence: Synthetic oligonucleotide
gtgtcggtggccttcgcgctgag

SEQ ID NO: 310618 - DNA, 25 bp, Artificial Sequence
  Description of Artificial Sequence: Synthetic oligonucleotide
tgtcggtggccttcgcgctgagcat

SEQ ID NO: 310619 - DNA, 24 bp, Artificial Sequence
  Description of Artificial Sequence: Synthetic oligonucleotide
gtcggtggccttcgcgctgagcat

SEQ ID NO: 310620 - DNA, 24 bp, Artificial Sequence
  Description of Artificial Sequence: Synthetic oligonucleotide
tcggtggccttcgcgctgagcatg

SEQ ID NO: 310621 - DNA, 23 bp, Artificial Sequence
  Description of Artificial Sequence: Synthetic oligonucleotide
cggtggccttcgcgctgagcatg

SEQ ID NO: 310622 - DNA, 23 bp, Artificial Sequence
  Description of Artificial Sequence: Synthetic oligonucleotide
ggtggccttcgcgctgagcatgg

SEQ ID NO: 310623 - DNA, 23 bp, Artificial Sequence
  Description of Artificial Sequence: Synthetic oligonucleotide
gtggccttcgcgctgagcatggc

SEQ ID NO: 310624 - DNA, 24 bp, Artificial Sequence
  Description of Artificial Sequence: Synthetic oligonucleotide
tggccttcgcgctgagcatggcca

SEQ ID NO: 310625 - DNA, 23 bp, Artificial Sequence
  Description of Artificial Sequence: Synthetic oligonucleotide
ggccttcgcgctgagcatggcca

SEQ ID NO: 310626 - DNA, 23 bp, Artificial Sequence
  Description of Artificial Sequence: Synthetic oligonucleotide
gccttcgcgctgagcatggccac

SEQ ID NO: 310627 - DNA, 23 bp, Artificial Sequence
  Description of Artificial Sequence: Synthetic oligonucleotide
ccttcgcgctgagcatggccacg

SEQ ID NO: 310628 - DNA, 24 bp, Artificial Sequence
  Description of Artificial Sequence: Synthetic oligonucleotide
cttcgcgctgagcatggccacgct

SEQ ID NO: 310629 - DNA, 24 bp, Artificial Sequence
  Description of Artificial Sequence: Synthetic oligonucleotide
ttcgcgctgagcatggccacgctg

SEQ ID NO: 310630 - DNA, 23 bp, Artificial Sequence
  Description of Artificial Sequence: Synthetic oligonucleotide
tcgcgctgagcatggccacgctg

SEQ ID NO: 310631 - DNA, 22 bp, Artificial Sequence
  Description of Artificial Sequence: Synthetic oligonucleotide
cgcgctgagcatggccacgctg

SEQ ID NO: 310632 - DNA, 22 bp, Artificial Sequence
  Description of Artificial Sequence: Synthetic oligonucleotide
gcgctgagcatggccacgctgc

SEQ ID NO: 310633 - DNA, 22 bp, Artificial Sequence
  Description of Artificial Sequence: Synthetic oligonucleotide
cgctgagcatggccacgctgcc

SEQ ID NO: 310634 - DNA, 22 bp, Artificial Sequence
  Description of Artificial Sequence: Synthetic oligonucleotide
gctgagcatggccacgctgccg

SEQ ID NO: 310635 - DNA, 23 bp, Artificial Sequence
  Description of Artificial Sequence: Synthetic oligonucleotide
ctgagcatggccacgctgccgca

SEQ ID NO: 310636 - DNA, 24 bp, Artificial Sequence
  Description of Artificial Sequence: Synthetic oligonucleotide
tgagcatggccacgctgccgcaga

SEQ ID NO: 310637 - DNA, 23 bp, Artificial Sequence
  Description of Artificial Sequence: Synthetic oligonucleotide
gagcatggccacgctgccgcaga

SEQ ID NO: 310638 - DNA, 24 bp, Artificial Sequence
  Description of Artificial Sequence: Synthetic oligonucleotide
agcatggccacgctgccgcagagt

SEQ ID NO: 310639 - DNA, 23 bp, Artificial Sequence
  Description of Artificial Sequence: Synthetic oligonucleotide
gcatggccacgctgccgcagagt

SEQ ID NO: 310640 - DNA, 24 bp, Artificial Sequence
  Description of Artificial Sequence: Synthetic oligonucleotide
catggccacgctgccgcagagtga

SEQ ID NO: 310641 - DNA, 24 bp, Artificial Sequence
  Description of Artificial Sequence: Synthetic oligonucleotide
atggccacgctgccgcagagtgag

SEQ ID NO: 310642 - DNA, 23 bp, Artificial Sequence
  Description of Artificial Sequence: Synthetic oligonucleotide
tggccacgctgccgcagagtgag

SEQ ID NO: 310643 - DNA, 22 bp, Artificial Sequence
  Description of Artificial Sequence: Synthetic oligonucleotide
ggccacgctgccgcagagtgag

SEQ ID NO: 310644 - DNA, 22 bp, Artificial Sequence
  Description of Artificial Sequence: Synthetic oligonucleotide
gccacgctgccgcagagtgagg

SEQ ID NO: 310645 - DNA, 22 bp, Artificial Sequence
  Description of Artificial Sequence: Synthetic oligonucleotide
ccacgctgccgcagagtgaggg

SEQ ID NO: 310646 - DNA, 22 bp, Artificial Sequence
  Description of Artificial Sequence: Synthetic oligonucleotide
cacgctgccgcagagtgagggc

SEQ ID NO: 310647 - DNA, 23 bp, Artificial Sequence
  Description of Artificial Sequence: Synthetic oligonucleotide
acgctgccgcagagtgagggcca

SEQ ID NO: 310648 - DNA, 22 bp, Artificial Sequence
  Description of Artificial Sequence: Synthetic oligonucleotide
cgctgccgcagagtgagggcca

SEQ ID NO: 310649 - DNA, 24 bp, Artificial Sequence
  Description of Artificial Sequence: Synthetic oligonucleotide
gctgccgcagagtgagggccacat

SEQ ID NO: 310650 - DNA, 25 bp, Artificial Sequence
  Description of Artificial Sequence: Synthetic oligonucleotide
ctgccgcagagtgagggccacatga

SEQ ID NO: 310651 - DNA, 25 bp, Artificial Sequence
  Description of Artificial Sequence: Synthetic oligonucleotide
tgccgcagagtgagggccacatgag

SEQ ID NO: 310652 - DNA, 24 bp, Artificial Sequence
  Description of Artificial Sequence: Synthetic oligonucleotide
gccgcagagtgagggccacatgag

SEQ ID NO: 310653 - DNA, 24 bp, Artificial Sequence
  Description of Artificial Sequence: Synthetic oligonucleotide
ccgcagagtgagggccacatgagc

SEQ ID NO: 310654 - DNA, 24 bp, Artificial Sequence
  Description of Artificial Sequence: Synthetic oligonucleotide
cgcagagtgagggccacatgagcg

SEQ ID NO: 310655 - DNA, 24 bp, Artificial Sequence
  Description of Artificial Sequence: Synthetic oligonucleotide
gcagagtgagggccacatgagcgg

SEQ ID NO: 310656 - DNA, 24 bp, Artificial Sequence
  Description of Artificial Sequence: Synthetic oligonucleotide
cagagtgagggccacatgagcggc

SEQ ID NO: 310657 - DNA, 24 bp, Artificial Sequence
  Description of Artificial Sequence: Synthetic oligonucleotide
agagtgagggccacatgagcggcg

SEQ ID NO: 310658 - DNA, 23 bp, Artificial Sequence
  Description of Artificial Sequence: Synthetic oligonucleotide
gagtgagggccacatgagcggcg

SEQ ID NO: 310659 - DNA, 23 bp, Artificial Sequence
  Description of Artificial Sequence: Synthetic oligonucleotide
agtgagggccacatgagcggcgc

SEQ ID NO: 310660 - DNA, 22 bp, Artificial Sequence
  Description of Artificial Sequence: Synthetic oligonucleotide
gtgagggccacatgagcggcgc

SEQ ID NO: 310661 - DNA, 22 bp, Artificial Sequence
  Description of Artificial Sequence: Synthetic oligonucleotide
tgagggccacatgagcggcgcc

SEQ ID NO: 310662 - DNA, 21 bp, Artificial Sequence
  Description of Artificial Sequence: Synthetic oligonucleotide
gagggccacatgagcggcgcc

SEQ ID NO: 310663 - DNA, 22 bp, Artificial Sequence
  Description of Artificial Sequence: Synthetic oligonucleotide
agggccacatgagcggcgccga

SEQ ID NO: 310664 - DNA, 21 bp, Artificial Sequence
  Description of Artificial Sequence: Synthetic oligonucleotide
gggccacatgagcggcgccga

SEQ ID NO: 310665 - DNA, 21 bp, Artificial Sequence
  Description of Artificial Sequence: Synthetic oligonucleotide
ggccacatgagcggcgccgac

SEQ ID NO: 310666 - DNA, 22 bp, Artificial Sequence
  Description of Artificial Sequence: Synthetic oligonucleotide
gccacatgagcggcgccgacct

SEQ ID NO: 310667 - DNA, 24 bp, Artificial Sequence
  Description of Artificial Sequence: Synthetic oligonucleotide
ccacatgagcggcgccgacctcaa

SEQ ID NO: 310668 - DNA, 24 bp, Artificial Sequence
  Description of Artificial Sequence: Synthetic oligonucleotide
cacatgagcggcgccgacctcaac

SEQ ID NO: 310669 - DNA, 24 bp, Artificial Sequence
  Description of Artificial Sequence: Synthetic oligonucleotide
acatgagcggcgccgacctcaacc

SEQ ID NO: 310670 - DNA, 23 bp, Artificial Sequence
  Description of Artificial Sequence: Synthetic oligonucleotide
catgagcggcgccgacctcaacc

SEQ ID NO: 310671 - DNA, 23 bp, Artificial Sequence
  Description of Artificial Sequence: Synthetic oligonucleotide
atgagcggcgccgacctcaaccg

SEQ ID NO: 310672 - DNA, 22 bp, Artificial Sequence
  Description of Artificial Sequence: Synthetic oligonucleotide
tgagcggcgccgacctcaaccg

SEQ ID NO: 310673 - DNA, 21 bp, Artificial Sequence
  Description of Artificial Sequence: Synthetic oligonucleotide
gagcggcgccgacctcaaccg

SEQ ID NO: 310674 - DNA, 21 bp, Artificial Sequence
  Description of Artificial Sequence: Synthetic oligonucleotide
agcggcgccgacctcaaccgg

SEQ ID NO: 310675 - DNA, 20 bp, Artificial Sequence
  Description of Artificial Sequence: Synthetic oligonucleotide
gcggcgccgacctcaaccgg

SEQ ID NO: 310676 - DNA, 20 bp, Artificial Sequence
  Description of Artificial Sequence: Synthetic oligonucleotide
cggcgccgacctcaaccggg

SEQ ID NO: 310677 - DNA, 21 bp, Artificial Sequence
  Description of Artificial Sequence: Synthetic oligonucleotide
ggcgccgacctcaaccgggct

SEQ ID NO: 310678 - DNA, 22 bp, Artificial Sequence
  Description of Artificial Sequence: Synthetic oligonucleotide
gcgccgacctcaaccgggctgt

SEQ ID NO: 310679 - DNA, 23 bp, Artificial Sequence
  Description of Artificial Sequence: Synthetic oligonucleotide
cgccgacctcaaccgggctgtca

SEQ ID NO: 310680 - DNA, 24 bp, Artificial Sequence
  Description of Artificial Sequence: Synthetic oligonucleotide
gccgacctcaaccgggctgtcact

SEQ ID NO: 310681 - DNA, 25 bp, Artificial Sequence
  Description of Artificial Sequence: Synthetic oligonucleotide
ccgacctcaaccgggctgtcactct

SEQ ID NO: 310682 - DNA, 25 bp, Artificial Sequence
  Description of Artificial Sequence: Synthetic oligonucleotide
cgacctcaaccgggctgtcactctg

SEQ ID NO: 310683 - DNA, 25 bp, Artificial Sequence
  Description of Artificial Sequence: Synthetic oligonucleotide
gacctcaaccgggctgtcactctgg

SEQ ID NO: 310684 - DNA, 25 bp, Artificial Sequence
  Description of Artificial Sequence: Synthetic oligonucleotide
acctcaaccgggctgtcactctggg

SEQ ID NO: 310685 - DNA, 24 bp, Artificial Sequence
  Description of Artificial Sequence: Synthetic oligonucleotide
cctcaaccgggctgtcactctggg

SEQ ID NO: 310686 - DNA, 24 bp, Artificial Sequence
  Description of Artificial Sequence: Synthetic oligonucleotide
ctcaaccgggctgtcactctgggg

SEQ ID NO: 310687 - DNA, 25 bp, Artificial Sequence
  Description of Artificial Sequence: Synthetic oligonucleotide
tcaaccgggctgtcactctggggct

SEQ ID NO: 310688 - DNA, 24 bp, Artificial Sequence
  Description of Artificial Sequence: Synthetic oligonucleotide
caaccgggctgtcactctggggct

SEQ ID NO: 310689 - DNA, 24 bp, Artificial Sequence
  Description of Artificial Sequence: Synthetic oligonucleotide
aaccgggctgtcactctggggctg

SEQ ID NO: 310690 - DNA, 23 bp, Artificial Sequence
  Description of Artificial Sequence: Synthetic oligonucleotide
accgggctgtcactctggggctg

SEQ ID NO: 310691 - DNA, 22 bp, Artificial Sequence
  Description of Artificial Sequence: Synthetic oligonucleotide
ccgggctgtcactctggggctg

SEQ ID NO: 310692 - DNA, 23 bp, Artificial Sequence
  Description of Artificial Sequence: Synthetic oligonucleotide
cgggctgtcactctggggctggt

SEQ ID NO: 310693 - DNA, 23 bp, Artificial Sequence
  Description of Artificial Sequence: Synthetic oligonucleotide
gggctgtcactctggggctggtg

SEQ ID NO: 310694 - DNA, 24 bp, Artificial Sequence
  Description of Artificial Sequence: Synthetic oligonucleotide
ggctgtcactctggggctggtgct

SEQ ID NO: 310695 - DNA, 25 bp, Artificial Sequence
  Description of Artificial Sequence: Synthetic oligonucleotide
gctgtcactctggggctggtgctca

SEQ ID NO: 310696 - DNA, 25 bp, Artificial Sequence
  Description of Artificial Sequence: Synthetic oligonucleotide
ctgtcactctggggctggtgctcag

SEQ ID NO: 310697 - DNA, 26 bp, Artificial Sequence
  Description of Artificial Sequence: Synthetic oligonucleotide
tgtcactctggggctggtgctcagct

SEQ ID NO: 310698 - DNA, 25 bp, Artificial Sequence
  Description of Artificial Sequence: Synthetic oligonucleotide
gtcactctggggctggtgctcagct

SEQ ID NO: 310699 - DNA, 25 bp, Artificial Sequence
  Description of Artificial Sequence: Synthetic oligonucleotide
tcactctggggctggtgctcagctc

SEQ ID NO: 310700 - DNA, 24 bp, Artificial Sequence
  Description of Artificial Sequence: Synthetic oligonucleotide
cactctggggctggtgctcagctc

SEQ ID NO: 310701 - DNA, 24 bp, Artificial Sequence
  Description of Artificial Sequence: Synthetic oligonucleotide
actctggggctggtgctcagctcc

SEQ ID NO: 310702 - DNA, 23 bp, Artificial Sequence
  Description of Artificial Sequence: Synthetic oligonucleotide
ctctggggctggtgctcagctcc

SEQ ID NO: 310703 - DNA, 24 bp, Artificial Sequence
  Description of Artificial Sequence: Synthetic oligonucleotide
tctggggctggtgctcagctccca

SEQ ID NO: 310704 - DNA, 23 bp, Artificial Sequence
  Description of Artificial Sequence: Synthetic oligonucleotide
ctggggctggtgctcagctccca

SEQ ID NO: 310705 - DNA, 25 bp, Artificial Sequence
  Description of Artificial Sequence: Synthetic oligonucleotide
tggggctggtgctcagctcccagat

SEQ ID NO: 310706 - DNA, 24 bp, Artificial Sequence
  Description of Artificial Sequence: Synthetic oligonucleotide
ggggctggtgctcagctcccagat

SEQ ID NO: 310707 - DNA, 25 bp, Artificial Sequence
  Description of Artificial Sequence: Synthetic oligonucleotide
gggctggtgctcagctcccagatca

SEQ ID NO: 310708 - DNA, 25 bp, Artificial Sequence
  Description of Artificial Sequence: Synthetic oligonucleotide
ggctggtgctcagctcccagatcag

SEQ ID NO: 310709 - DNA, 27 bp, Artificial Sequence
  Description of Artificial Sequence: Synthetic oligonucleotide
gctggtgctcagctcccagatcaggat

SEQ ID NO: 310710 - DNA, 27 bp, Artificial Sequence
  Description of Artificial Sequence: Synthetic oligonucleotide
ctggtgctcagctcccagatcaggatc

SEQ ID NO: 310711 - DNA, 29 bp, Artificial Sequence
  Description of Artificial Sequence: Synthetic oligonucleotide
tggtgctcagctcccagatcaggatcttc

SEQ ID NO: 310712 - DNA, 28 bp, Artificial Sequence
  Description of Artificial Sequence: Synthetic oligonucleotide
ggtgctcagctcccagatcaggatcttc

SEQ ID NO: 310713 - DNA, 28 bp, Artificial Sequence
  Description of Artificial Sequence: Synthetic oligonucleotide
gtgctcagctcccagatcaggatcttcc

SEQ ID NO: 310714 - DNA, 28 bp, Artificial Sequence
  Description of Artificial Sequence: Synthetic oligonucleotide
tgctcagctcccagatcaggatcttccg

SEQ ID NO: 310715 - DNA, 27 bp, Artificial Sequence
  Description of Artificial Sequence: Synthetic oligonucleotide
gctcagctcccagatcaggatcttccg

SEQ ID NO: 310716 - DNA, 28 bp, Artificial Sequence
  Description of Artificial Sequence: Synthetic oligonucleotide
ctcagctcccagatcaggatcttccgtc

SEQ ID NO: 310717 - DNA, 28 bp, Artificial Sequence
  Description of Artificial Sequence: Synthetic oligonucleotide
tcagctcccagatcaggatcttccgtcc

SEQ ID NO: 310718 - DNA, 27 bp, Artificial Sequence
  Description of Artificial Sequence: Synthetic oligonucleotide
cagctcccagatcaggatcttccgtcc

SEQ ID NO: 310719 - DNA, 27 bp, Artificial Sequence
  Description of Artificial Sequence: Synthetic oligonucleotide
agctcccagatcaggatcttccgtccc

SEQ ID NO: 310720 - DNA, 26 bp, Artificial Sequence
  Description of Artificial Sequence: Synthetic oligonucleotide
gctcccagatcaggatcttccgtccc

SEQ ID NO: 310721 - DNA, 27 bp, Artificial Sequence
  Description of Artificial Sequence: Synthetic oligonucleotide
ctcccagatcaggatcttccgtcccct

SEQ ID NO: 310722 - DNA, 27 bp, Artificial Sequence
  Description of Artificial Sequence: Synthetic oligonucleotide
tcccagatcaggatcttccgtcccctc

SEQ ID NO: 310723 - DNA, 27 bp, Artificial Sequence
  Description of Artificial Sequence: Synthetic oligonucleotide
cccagatcaggatcttccgtcccctca

SEQ ID NO: 310724 - DNA, 28 bp, Artificial Sequence
  Description of Artificial Sequence: Synthetic oligonucleotide
ccagatcaggatcttccgtcccctcatg

SEQ ID NO: 310725 - DNA, 30 bp, Artificial Sequence
  Description of Artificial Sequence: Synthetic oligonucleotide
cagatcaggatcttccgtcccctcatgttc

SEQ ID NO: 310726 - DNA, 32 bp, Artificial Sequence
  Description of Artificial Sequence: Synthetic oligonucleotide
agatcaggatcttccgtcccctcatgttcatc

SEQ ID NO: 310727 - DNA, 31 bp, Artificial Sequence
  Description of Artificial Sequence: Synthetic oligonucleotide
gatcaggatcttccgtcccctcatgttcatc

SEQ ID NO: 310728 - DNA, 33 bp, Artificial Sequence
  Description of Artificial Sequence: Synthetic oligonucleotide
atcaggatcttccgtcccctcatgttcatcatc

SEQ ID NO: 310729 - DNA, 32 bp, Artificial Sequence
  Description of Artificial Sequence: Synthetic oligonucleotide
tcaggatcttccgtcccctcatgttcatcatc

SEQ ID NO: 310730 - DNA, 31 bp, Artificial Sequence
  Description of Artificial Sequence: Synthetic oligonucleotide
caggatcttccgtcccctcatgttcatcatc

SEQ ID NO: 310731 - DNA, 31 bp, Artificial Sequence
  Description of Artificial Sequence: Synthetic oligonucleotide
aggatcttccgtcccctcatgttcatcatcg

SEQ ID NO: 310732 - DNA, 30 bp, Artificial Sequence
  Description of Artificial Sequence: Synthetic oligonucleotide
ggatcttccgtcccctcatgttcatcatcg

SEQ ID NO: 310733 - DNA, 30 bp, Artificial Sequence
  Description of Artificial Sequence: Synthetic oligonucleotide
gatcttccgtcccctcatgttcatcatcgc

SEQ ID NO: 310734 - DNA, 30 bp, Artificial Sequence
  Description of Artificial Sequence: Synthetic oligonucleotide
atcttccgtcccctcatgttcatcatcgcg

SEQ ID NO: 310735 - DNA, 29 bp, Artificial Sequence
  Description of Artificial Sequence: Synthetic oligonucleotide
tcttccgtcccctcatgttcatcatcgcg

SEQ ID NO: 310736 - DNA, 28 bp, Artificial Sequence
  Description of Artificial Sequence: Synthetic oligonucleotide
cttccgtcccctcatgttcatcatcgcg

SEQ ID NO: 310737 - DNA, 28 bp, Artificial Sequence
  Description of Artificial Sequence: Synthetic oligonucleotide
ttccgtcccctcatgttcatcatcgcgc

SEQ ID NO: 310738 - DNA, 27 bp, Artificial Sequence
  Description of Artificial Sequence: Synthetic oligonucleotide
tccgtcccctcatgttcatcatcgcgc

SEQ ID NO: 310739 - DNA, 27 bp, Artificial Sequence
  Description of Artificial Sequence: Synthetic oligonucleotide
ccgtcccctcatgttcatcatcgcgca

SEQ ID NO: 310740 - DNA, 27 bp, Artificial Sequence
  Description of Artificial Sequence: Synthetic oligonucleotide
cgtcccctcatgttcatcatcgcgcag

SEQ ID NO: 310741 - DNA, 28 bp, Artificial Sequence
  Description of Artificial Sequence: Synthetic oligonucleotide
gtcccctcatgttcatcatcgcgcagtg

SEQ ID NO: 310742 - DNA, 28 bp, Artificial Sequence
  Description of Artificial Sequence: Synthetic oligonucleotide
tcccctcatgttcatcatcgcgcagtgc

SEQ ID NO: 310743 - DNA, 27 bp, Artificial Sequence
  Description of Artificial Sequence: Synthetic oligonucleotide
cccctcatgttcatcatcgcgcagtgc

SEQ ID NO: 310744 - DNA, 27 bp, Artificial Sequence
  Description of Artificial Sequence: Synthetic oligonucleotide
ccctcatgttcatcatcgcgcagtgcg

SEQ ID NO: 310745 - DNA, 28 bp, Artificial Sequence
  Description of Artificial Sequence: Synthetic oligonucleotide
cctcatgttcatcatcgcgcagtgcgtg

SEQ ID NO: 310746 - DNA, 28 bp, Artificial Sequence
  Description of Artificial Sequence: Synthetic oligonucleotide
ctcatgttcatcatcgcgcagtgcgtgc

SEQ ID NO: 310747 - DNA, 28 bp, Artificial Sequence
  Description of Artificial Sequence: Synthetic oligonucleotide
tcatgttcatcatcgcgcagtgcgtgcg

SEQ ID NO: 310748 - DNA, 27 bp, Artificial Sequence
  Description of Artificial Sequence: Synthetic oligonucleotide
catgttcatcatcgcgcagtgcgtgcg

SEQ ID NO: 310749 - DNA, 27 bp, Artificial Sequence
  Description of Artificial Sequence: Synthetic oligonucleotide
atgttcatcatcgcgcagtgcgtgcgg

SEQ ID NO: 310750 - DNA, 26 bp, Artificial Sequence
  Description of Artificial Sequence: Synthetic oligonucleotide
tgttcatcatcgcgcagtgcgtgcgg

SEQ ID NO: 310751 - DNA, 25 bp, Artificial Sequence
  Description of Artificial Sequence: Synthetic oligonucleotide
gttcatcatcgcgcagtgcgtgcgg

SEQ ID NO: 310752 - DNA, 25 bp, Artificial Sequence
  Description of Artificial Sequence: Synthetic oligonucleotide
ttcatcatcgcgcagtgcgtgcggg

SEQ ID NO: 310753 - DNA, 24 bp, Artificial Sequence
  Description of Artificial Sequence: Synthetic oligonucleotide
tcatcatcgcgcagtgcgtgcggg

SEQ ID NO: 310754 - DNA, 23 bp, Artificial Sequence
  Description of Artificial Sequence: Synthetic oligonucleotide
catcatcgcgcagtgcgtgcggg

SEQ ID NO: 310755 - DNA, 23 bp, Artificial Sequence
  Description of Artificial Sequence: Synthetic oligonucleotide
atcatcgcgcagtgcgtgcgggc

SEQ ID NO: 310756 - DNA, 22 bp, Artificial Sequence
  Description of Artificial Sequence: Synthetic oligonucleotide
tcatcgcgcagtgcgtgcgggc

SEQ ID NO: 310757 - DNA, 21 bp, Artificial Sequence
  Description of Artificial Sequence: Synthetic oligonucleotide
catcgcgcagtgcgtgcgggc

SEQ ID NO: 310758 - DNA, 23 bp, Artificial Sequence
  Description of Artificial Sequence: Synthetic oligonucleotide
atcgcgcagtgcgtgcgggccat

SEQ ID NO: 310759 - DNA, 22 bp, Artificial Sequence
  Description of Artificial Sequence: Synthetic oligonucleotide
tcgcgcagtgcgtgcgggccat

SEQ ID NO: 310760 - DNA, 21 bp, Artificial Sequence
  Description of Artificial Sequence: Synthetic oligonucleotide
cgcgcagtgcgtgcgggccat

SEQ ID NO: 310761 - DNA, 21 bp, Artificial Sequence
  Description of Artificial Sequence: Synthetic oligonucleotide
gcgcagtgcgtgcgggccatc

SEQ ID NO: 310762 - DNA, 22 bp, Artificial Sequence
  Description of Artificial Sequence: Synthetic oligonucleotide
cgcagtgcgtgcgggccatcga

SEQ ID NO: 310763 - DNA, 22 bp, Artificial Sequence
  Description of Artificial Sequence: Synthetic oligonucleotide
gcagtgcgtgcgggccatcgac

SEQ ID NO: 310764 - DNA, 22 bp, Artificial Sequence
  Description of Artificial Sequence: Synthetic oligonucleotide
cagtgcgtgcgggccatcgacg

SEQ ID NO: 310765 - DNA, 22 bp, Artificial Sequence
  Description of Artificial Sequence: Synthetic oligonucleotide
agtgcgtgcgggccatcgacgc

SEQ ID NO: 310766 - DNA, 21 bp, Artificial Sequence
  Description of Artificial Sequence: Synthetic oligonucleotide
gtgcgtgcgggccatcgacgc

SEQ ID NO: 310767 - DNA, 22 bp, Artificial Sequence
  Description of Artificial Sequence: Synthetic oligonucleotide
tgcgtgcgggccatcgacgcca

SEQ ID NO: 310768 - DNA, 21 bp, Artificial Sequence
  Description of Artificial Sequence: Synthetic oligonucleotide
gcgtgcgggccatcgacgcca

SEQ ID NO: 310769 - DNA, 21 bp, Artificial Sequence
  Description of Artificial Sequence: Synthetic oligonucleotide
cgtgcgggccatcgacgccac

SEQ ID NO: 310770 - DNA, 21 bp, Artificial Sequence
  Description of Artificial Sequence: Synthetic oligonucleotide
gtgcgggccatcgacgccacc

SEQ ID NO: 310771 - DNA, 21 bp, Artificial Sequence
  Description of Artificial Sequence: Synthetic oligonucleotide
tgcgggccatcgacgccaccg

SEQ ID NO: 310772 - DNA, 20 bp, Artificial Sequence
  Description of Artificial Sequence: Synthetic oligonucleotide
gcgggccatcgacgccaccg

SEQ ID NO: 310773 - DNA, 20 bp, Artificial Sequence
  Description of Artificial Sequence: Synthetic oligonucleotide
cgggccatcgacgccaccgc

SEQ ID NO: 310774 - DNA, 22 bp, Artificial Sequence
  Description of Artificial Sequence: Synthetic oligonucleotide
gggccatcgacgccaccgcgat

SEQ ID NO: 310775 - DNA, 22 bp, Artificial Sequence
  Description of Artificial Sequence: Synthetic oligonucleotide
ggccatcgacgccaccgcgatc

SEQ ID NO: 310776 - DNA, 23 bp, Artificial Sequence
  Description of Artificial Sequence: Synthetic oligonucleotide
gccatcgacgccaccgcgatcct

SEQ ID NO: 310777 - DNA, 24 bp, Artificial Sequence
  Description of Artificial Sequence: Synthetic oligonucleotide
ccatcgacgccaccgcgatcctct

SEQ ID NO: 310778 - DNA, 25 bp, Artificial Sequence
  Description of Artificial Sequence: Synthetic oligonucleotide
catcgacgccaccgcgatcctctca

SEQ ID NO: 310779 - DNA, 25 bp, Artificial Sequence
  Description of Artificial Sequence: Synthetic oligonucleotide
atcgacgccaccgcgatcctctcac

SEQ ID NO: 310780 - DNA, 24 bp, Artificial Sequence
  Description of Artificial Sequence: Synthetic oligonucleotide
tcgacgccaccgcgatcctctcac

SEQ ID NO: 310781 - DNA, 23 bp, Artificial Sequence
  Description of Artificial Sequence: Synthetic oligonucleotide
cgacgccaccgcgatcctctcac

SEQ ID NO: 310782 - DNA, 23 bp, Artificial Sequence
  Description of Artificial Sequence: Synthetic oligonucleotide
gacgccaccgcgatcctctcacg

SEQ ID NO: 310783 - DNA, 25 bp, Artificial Sequence
  Description of Artificial Sequence: Synthetic oligonucleotide
acgccaccgcgatcctctcacgcat

SEQ ID NO: 310784 - DNA, 24 bp, Artificial Sequence
  Description of Artificial Sequence: Synthetic oligonucleotide
cgccaccgcgatcctctcacgcat

SEQ ID NO: 310785 - DNA, 25 bp, Artificial Sequence
  Description of Artificial Sequence: Synthetic oligonucleotide
gccaccgcgatcctctcacgcatca

SEQ ID NO: 310786 - DNA, 25 bp, Artificial Sequence
  Description of Artificial Sequence: Synthetic oligonucleotide
ccaccgcgatcctctcacgcatcac

SEQ ID NO: 310787 - DNA, 26 bp, Artificial Sequence
  Description of Artificial Sequence: Synthetic oligonucleotide
caccgcgatcctctcacgcatcacct

SEQ ID NO: 310788 - DNA, 26 bp, Artificial Sequence
  Description of Artificial Sequence: Synthetic oligonucleotide
accgcgatcctctcacgcatcacctg

SEQ ID NO: 310789 - DNA, 25 bp, Artificial Sequence
  Description of Artificial Sequence: Synthetic oligonucleotide
ccgcgatcctctcacgcatcacctg

SEQ ID NO: 310790 - DNA, 26 bp, Artificial Sequence
  Description of Artificial Sequence: Synthetic oligonucleotide
cgcgatcctctcacgcatcacctgct

SEQ ID NO: 310791 - DNA, 26 bp, Artificial Sequence
  Description of Artificial Sequence: Synthetic oligonucleotide
gcgatcctctcacgcatcacctgctc

SEQ ID NO: 310792 - DNA, 26 bp, Artificial Sequence
  Description of Artificial Sequence: Synthetic oligonucleotide
cgatcctctcacgcatcacctgctcc

SEQ ID NO: 310793 - DNA, 27 bp, Artificial Sequence
  Description of Artificial Sequence: Synthetic oligonucleotide
gatcctctcacgcatcacctgctccct

SEQ ID NO: 310794 - DNA, 27 bp, Artificial Sequence
  Description of Artificial Sequence: Synthetic oligonucleotide
atcctctcacgcatcacctgctccctg

SEQ ID NO: 310795 - DNA, 27 bp, Artificial Sequence
  Description of Artificial Sequence: Synthetic oligonucleotide
tcctctcacgcatcacctgctccctga

SEQ ID NO: 310796 - DNA, 26 bp, Artificial Sequence
  Description of Artificial Sequence: Synthetic oligonucleotide
cctctcacgcatcacctgctccctga

SEQ ID NO: 310797 - DNA, 27 bp, Artificial Sequence
  Description of Artificial Sequence: Synthetic oligonucleotide
ctctcacgcatcacctgctccctgaca

SEQ ID NO: 310798 - DNA, 27 bp, Artificial Sequence
  Description of Artificial Sequence: Synthetic oligonucleotide
tctcacgcatcacctgctccctgacag

SEQ ID NO: 310799 - DNA, 26 bp, Artificial Sequence
  Description of Artificial Sequence: Synthetic oligonucleotide
ctcacgcatcacctgctccctgacag

SEQ ID NO: 310800 - DNA, 26 bp, Artificial Sequence
  Description of Artificial Sequence: Synthetic oligonucleotide
tcacgcatcacctgctccctgacagg

SEQ ID NO: 310801 - DNA, 25 bp, Artificial Sequence
  Description of Artificial Sequence: Synthetic oligonucleotide
cacgcatcacctgctccctgacagg

SEQ ID NO: 310802 - DNA, 27 bp, Artificial Sequence
  Description of Artificial Sequence: Synthetic oligonucleotide
acgcatcacctgctccctgacagggaa

SEQ ID NO: 310803 - DNA, 26 bp, Artificial Sequence
  Description of Artificial Sequence: Synthetic oligonucleotide
cgcatcacctgctccctgacagggaa

SEQ ID NO: 310804 - DNA, 27 bp, Artificial Sequence
  Description of Artificial Sequence: Synthetic oligonucleotide
gcatcacctgctccctgacagggaact

SEQ ID NO: 310805 - DNA, 27 bp, Artificial Sequence
  Description of Artificial Sequence: Synthetic oligonucleotide
catcacctgctccctgacagggaactc

SEQ ID NO: 310806 - DNA, 27 bp, Artificial Sequence
  Description of Artificial Sequence: Synthetic oligonucleotide
atcacctgctccctgacagggaactcg

SEQ ID NO: 310807 - DNA, 26 bp, Artificial Sequence
  Description of Artificial Sequence: Synthetic oligonucleotide
tcacctgctccctgacagggaactcg

SEQ ID NO: 310808 - DNA, 25 bp, Artificial Sequence
  Description of Artificial Sequence: Synthetic oligonucleotide
cacctgctccctgacagggaactcg

SEQ ID NO: 310809 - DNA, 27 bp, Artificial Sequence
  Description of Artificial Sequence: Synthetic oligonucleotide
acctgctccctgacagggaactcggtt

SEQ ID NO: 310810 - DNA, 26 bp, Artificial Sequence
  Description of Artificial Sequence: Synthetic oligonucleotide
cctgctccctgacagggaactcggtt

SEQ ID NO: 310811 - DNA, 26 bp, Artificial Sequence
  Description of Artificial Sequence: Synthetic oligonucleotide
ctgctccctgacagggaactcggttg

SEQ ID NO: 310812 - DNA, 26 bp, Artificial Sequence
  Description of Artificial Sequence: Synthetic oligonucleotide
tgctccctgacagggaactcggttgg

SEQ ID NO: 310813 - DNA, 25 bp, Artificial Sequence
  Description of Artificial Sequence: Synthetic oligonucleotide
gctccctgacagggaactcggttgg

SEQ ID NO: 310814 - DNA, 25 bp, Artificial Sequence
  Description of Artificial Sequence: Synthetic oligonucleotide
ctccctgacagggaactcggttggc

SEQ ID NO: 310815 - DNA, 25 bp, Artificial Sequence
  Description of Artificial Sequence: Synthetic oligonucleotide
tccctgacagggaactcggttggcc

SEQ ID NO: 310816 - DNA, 24 bp, Artificial Sequence
  Description of Artificial Sequence: Synthetic oligonucleotide
ccctgacagggaactcggttggcc

SEQ ID NO: 310817 - DNA, 24 bp, Artificial Sequence
  Description of Artificial Sequence: Synthetic oligonucleotide
cctgacagggaactcggttggccg

SEQ ID NO: 310818 - DNA, 27 bp, Artificial Sequence
  Description of Artificial Sequence: Synthetic oligonucleotide
ctgacagggaactcggttggccgcatt

SEQ ID NO: 310819 - DNA, 27 bp, Artificial Sequence
  Description of Artificial Sequence: Synthetic oligonucleotide
tgacagggaactcggttggccgcattg

SEQ ID NO: 310820 - DNA, 27 bp, Artificial Sequence
  Description of Artificial Sequence: Synthetic oligonucleotide
gacagggaactcggttggccgcattga

SEQ ID NO: 310821 - DNA, 27 bp, Artificial Sequence
  Description of Artificial Sequence: Synthetic oligonucleotide
acagggaactcggttggccgcattgac

SEQ ID NO: 310822 - DNA, 26 bp, Artificial Sequence
  Description of Artificial Sequence: Synthetic oligonucleotide
cagggaactcggttggccgcattgac

SEQ ID NO: 310823 - DNA, 27 bp, Artificial Sequence
  Description of Artificial Sequence: Synthetic oligonucleotide
agggaactcggttggccgcattgacct

SEQ ID NO: 310824 - DNA, 26 bp, Artificial Sequence
  Description of Artificial Sequence: Synthetic oligonucleotide
gggaactcggttggccgcattgacct

SEQ ID NO: 310825 - DNA, 26 bp, Artificial Sequence
  Description of Artificial Sequence: Synthetic oligonucleotide
ggaactcggttggccgcattgacctg

SEQ ID NO: 310826 - DNA, 26 bp, Artificial Sequence
  Description of Artificial Sequence: Synthetic oligonucleotide
gaactcggttggccgcattgacctgg

SEQ ID NO: 310827 - DNA, 27 bp, Artificial Sequence
  Description of Artificial Sequence: Synthetic oligonucleotide
aactcggttggccgcattgacctggca

SEQ ID NO: 310828 - DNA, 26 bp, Artificial Sequence
  Description of Artificial Sequence: Synthetic oligonucleotide
actcggttggccgcattgacctggca

SEQ ID NO: 310829 - DNA, 25 bp, Artificial Sequence
  Description of Artificial Sequence: Synthetic oligonucleotide
ctcggttggccgcattgacctggca

SEQ ID NO: 310830 - DNA, 27 bp, Artificial Sequence
  Description of Artificial Sequence: Synthetic oligonucleotide
tcggttggccgcattgacctggcagat

SEQ ID NO: 310831 - DNA, 26 bp, Artificial Sequence
  Description of Artificial Sequence: Synthetic oligonucleotide
cggttggccgcattgacctggcagat

SEQ ID NO: 310832 - DNA, 26 bp, Artificial Sequence
  Description of Artificial Sequence: Synthetic oligonucleotide
ggttggccgcattgacctggcagatg

SEQ ID NO: 310833 - DNA, 27 bp, Artificial Sequence
  Description of Artificial Sequence: Synthetic oligonucleotide
gttggccgcattgacctggcagatggt

SEQ ID NO: 310834 - DNA, 27 bp, Artificial Sequence
  Description of Artificial Sequence: Synthetic oligonucleotide
ttggccgcattgacctggcagatggtg

SEQ ID NO: 310835 - DNA, 27 bp, Artificial Sequence
  Description of Artificial Sequence: Synthetic oligonucleotide
tggccgcattgacctggcagatggtgt

SEQ ID NO: 310836 - DNA, 26 bp, Artificial Sequence
  Description of Artificial Sequence: Synthetic oligonucleotide
ggccgcattgacctggcagatggtgt

SEQ ID NO: 310837 - DNA, 27 bp, Artificial Sequence
  Description of Artificial Sequence: Synthetic oligonucleotide
gccgcattgacctggcagatggtgtgt

SEQ ID NO: 310838 - DNA, 28 bp, Artificial Sequence
  Description of Artificial Sequence: Synthetic oligonucleotide
ccgcattgacctggcagatggtgtgtac

SEQ ID NO: 310839 - DNA, 29 bp, Artificial Sequence
  Description of Artificial Sequence: Synthetic oligonucleotide
cgcattgacctggcagatggtgtgtactc

SEQ ID NO: 310840 - DNA, 29 bp, Artificial Sequence
  Description of Artificial Sequence: Synthetic oligonucleotide
gcattgacctggcagatggtgtgtactcg

SEQ ID NO: 310841 - DNA, 29 bp, Artificial Sequence
  Description of Artificial Sequence: Synthetic oligonucleotide
cattgacctggcagatggtgtgtactcgg

SEQ ID NO: 310842 - DNA, 29 bp, Artificial Sequence
  Description of Artificial Sequence: Synthetic oligonucleotide
attgacctggcagatggtgtgtactcggg

SEQ ID NO: 310843 - DNA, 28 bp, Artificial Sequence
  Description of Artificial Sequence: Synthetic oligonucleotide
ttgacctggcagatggtgtgtactcggg

SEQ ID NO: 310844 - DNA, 27 bp, Artificial Sequence
  Description of Artificial Sequence: Synthetic oligonucleotide
tgacctggcagatggtgtgtactcggg

SEQ ID NO: 310845 - DNA, 26 bp, Artificial Sequence
  Description of Artificial Sequence: Synthetic oligonucleotide
gacctggcagatggtgtgtactcggg

SEQ ID NO: 310846 - DNA, 26 bp, Artificial Sequence
  Description of Artificial Sequence: Synthetic oligonucleotide
acctggcagatggtgtgtactcgggc

SEQ ID NO: 310847 - DNA, 25 bp, Artificial Sequence
  Description of Artificial Sequence: Synthetic oligonucleotide
cctggcagatggtgtgtactcgggc

SEQ ID NO: 310848 - DNA, 26 bp, Artificial Sequence
  Description of Artificial Sequence: Synthetic oligonucleotide
ctggcagatggtgtgtactcgggcct

SEQ ID NO: 310849 - DNA, 26 bp, Artificial Sequence
  Description of Artificial Sequence: Synthetic oligonucleotide
tggcagatggtgtgtactcgggcctg

SEQ ID NO: 310850 - DNA, 25 bp, Artificial Sequence
  Description of Artificial Sequence: Synthetic oligonucleotide
ggcagatggtgtgtactcgggcctg

SEQ ID NO: 310851 - DNA, 25 bp, Artificial Sequence
  Description of Artificial Sequence: Synthetic oligonucleotide
gcagatggtgtgtactcgggcctgg

SEQ ID NO: 310852 - DNA, 25 bp, Artificial Sequence
  Description of Artificial Sequence: Synthetic oligonucleotide
cagatggtgtgtactcgggcctggg

SEQ ID NO: 310853 - DNA, 25 bp, Artificial Sequence
  Description of Artificial Sequence: Synthetic oligonucleotide
agatggtgtgtactcgggcctgggc

SEQ ID NO: 310854 - DNA, 24 bp, Artificial Sequence
  Description of Artificial Sequence: Synthetic oligonucleotide
gatggtgtgtactcgggcctgggc

SEQ ID NO: 310855 - DNA, 25 bp, Artificial Sequence
  Description of Artificial Sequence: Synthetic oligonucleotide
atggtgtgtactcgggcctgggcct

SEQ ID NO: 310856 - DNA, 24 bp, Artificial Sequence
  Description of Artificial Sequence: Synthetic oligonucleotide
tggtgtgtactcgggcctgggcct

SEQ ID NO: 310857 - DNA, 23 bp, Artificial Sequence
  Description of Artificial Sequence: Synthetic oligonucleotide
ggtgtgtactcgggcctgggcct

SEQ ID NO: 310858 - DNA, 23 bp, Artificial Sequence
  Description of Artificial Sequence: Synthetic oligonucleotide
gtgtgtactcgggcctgggcctg

SEQ ID NO: 310859 - DNA, 23 bp, Artificial Sequence
  Description of Artificial Sequence: Synthetic oligonucleotide
tgtgtactcgggcctgggcctgg

SEQ ID NO: 310860 - DNA, 22 bp, Artificial Sequence
  Description of Artificial Sequence: Synthetic oligonucleotide
gtgtactcgggcctgggcctgg

SEQ ID NO: 310861 - DNA, 22 bp, Artificial Sequence
  Description of Artificial Sequence: Synthetic oligonucleotide
tgtactcgggcctgggcctggg

SEQ ID NO: 310862 - DNA, 21 bp, Artificial Sequence
  Description of Artificial Sequence: Synthetic oligonucleotide
gtactcgggcctgggcctggg

SEQ ID NO: 310863 - DNA, 23 bp, Artificial Sequence
  Description of Artificial Sequence: Synthetic oligonucleotide
tactcgggcctgggcctggggat

SEQ ID NO: 310864 - DNA, 22 bp, Artificial Sequence
  Description of Artificial Sequence: Synthetic oligonucleotide
actcgggcctgggcctggggat

SEQ ID NO: 310865 - DNA, 21 bp, Artificial Sequence
  Description of Artificial Sequence: Synthetic oligonucleotide
ctcgggcctgggcctggggat

SEQ ID NO: 310866 - DNA, 21 bp, Artificial Sequence
  Description of Artificial Sequence: Synthetic oligonucleotide
tcgggcctgggcctggggatc

SEQ ID NO: 310867 - DNA, 20 bp, Artificial Sequence
  Description of Artificial Sequence: Synthetic oligonucleotide
cgggcctgggcctggggatc

SEQ ID NO: 310868 - DNA, 21 bp, Artificial Sequence
  Description of Artificial Sequence: Synthetic oligonucleotide
gggcctgggcctggggatcga

SEQ ID NO: 310869 - DNA, 23 bp, Artificial Sequence
  Description of Artificial Sequence: Synthetic oligonucleotide
ggcctgggcctggggatcgagat

SEQ ID NO: 310870 - DNA, 25 bp, Artificial Sequence
  Description of Artificial Sequence: Synthetic oligonucleotide
gcctgggcctggggatcgagatctt

SEQ ID NO: 310871 - DNA, 25 bp, Artificial Sequence
  Description of Artificial Sequence: Synthetic oligonucleotide
cctgggcctggggatcgagatcttc

SEQ ID NO: 310872 - DNA, 25 bp, Artificial Sequence
  Description of Artificial Sequence: Synthetic oligonucleotide
ctgggcctggggatcgagatcttcg

SEQ ID NO: 310873 - DNA, 25 bp, Artificial Sequence
  Description of Artificial Sequence: Synthetic oligonucleotide
tgggcctggggatcgagatcttcgg

SEQ ID NO: 310874 - DNA, 24 bp, Artificial Sequence
  Description of Artificial Sequence: Synthetic oligonucleotide
gggcctggggatcgagatcttcgg

SEQ ID NO: 310875 - DNA, 25 bp, Artificial Sequence
  Description of Artificial Sequence: Synthetic oligonucleotide
ggcctggggatcgagatcttcggga

SEQ ID NO: 310876 - DNA, 25 bp, Artificial Sequence
  Description of Artificial Sequence: Synthetic oligonucleotide
gcctggggatcgagatcttcgggac

SEQ ID NO: 310877 - DNA, 25 bp, Artificial Sequence
  Description of Artificial Sequence: Synthetic oligonucleotide
cctggggatcgagatcttcgggacc

SEQ ID NO: 310878 - DNA, 26 bp, Artificial Sequence
  Description of Artificial Sequence: Synthetic oligonucleotide
ctggggatcgagatcttcgggaccca

SEQ ID NO: 310879 - DNA, 26 bp, Artificial Sequence
  Description of Artificial Sequence: Synthetic oligonucleotide
tggggatcgagatcttcgggacccac

SEQ ID NO: 310880 - DNA, 25 bp, Artificial Sequence
  Description of Artificial Sequence: Synthetic oligonucleotide
ggggatcgagatcttcgggacccac

SEQ ID NO: 310881 - DNA, 26 bp, Artificial Sequence
  Description of Artificial Sequence: Synthetic oligonucleotide
gggatcgagatcttcgggacccacca

SEQ ID NO: 310882 - DNA, 26 bp, Artificial Sequence
  Description of Artificial Sequence: Synthetic oligonucleotide
ggatcgagatcttcgggacccaccag

SEQ ID NO: 310883 - DNA, 27 bp, Artificial Sequence
  Description of Artificial Sequence: Synthetic oligonucleotide
gatcgagatcttcgggacccaccagct

SEQ ID NO: 310884 - DNA, 27 bp, Artificial Sequence
  Description of Artificial Sequence: Synthetic oligonucleotide
atcgagatcttcgggacccaccagctg

SEQ ID NO: 310885 - DNA, 26 bp, Artificial Sequence
  Description of Artificial Sequence: Synthetic oligonucleotide
tcgagatcttcgggacccaccagctg

SEQ ID NO: 310886 - DNA, 25 bp, Artificial Sequence
  Description of Artificial Sequence: Synthetic oligonucleotide
cgagatcttcgggacccaccagctg

SEQ ID NO: 310887 - DNA, 26 bp, Artificial Sequence
  Description of Artificial Sequence: Synthetic oligonucleotide
gagatcttcgggacccaccagctggt

SEQ ID NO: 310888 - DNA, 26 bp, Artificial Sequence
  Description of Artificial Sequence: Synthetic oligonucleotide
agatcttcgggacccaccagctggtc

SEQ ID NO: 310889 - DNA, 25 bp, Artificial Sequence
  Description of Artificial Sequence: Synthetic oligonucleotide
gatcttcgggacccaccagctggtc

SEQ ID NO: 310890 - DNA, 27 bp, Artificial Sequence
  Description of Artificial Sequence: Synthetic oligonucleotide
atcttcgggacccaccagctggtccta

SEQ ID NO: 310891 - DNA, 27 bp, Artificial Sequence
  Description of Artificial Sequence: Synthetic oligonucleotide
tcttcgggacccaccagctggtcctat

SEQ ID NO: 310892 - DNA, 26 bp, Artificial Sequence
  Description of Artificial Sequence: Synthetic oligonucleotide
cttcgggacccaccagctggtcctat

SEQ ID NO: 310893 - DNA, 26 bp, Artificial Sequence
  Description of Artificial Sequence: Synthetic oligonucleotide
ttcgggacccaccagctggtcctatg

SEQ ID NO: 310894 - DNA, 25 bp, Artificial Sequence
  Description of Artificial Sequence: Synthetic oligonucleotide
tcgggacccaccagctggtcctatg

SEQ ID NO: 310895 - DNA, 24 bp, Artificial Sequence
  Description of Artificial Sequence: Synthetic oligonucleotide
cgggacccaccagctggtcctatg

SEQ ID NO: 310896 - DNA, 24 bp, Artificial Sequence
  Description of Artificial Sequence: Synthetic oligonucleotide
gggacccaccagctggtcctatgc

SEQ ID NO: 310897 - DNA, 25 bp, Artificial Sequence
  Description of Artificial Sequence: Synthetic oligonucleotide
ggacccaccagctggtcctatgcgt

SEQ ID NO: 310898 - DNA, 25 bp, Artificial Sequence
  Description of Artificial Sequence: Synthetic oligonucleotide
gacccaccagctggtcctatgcgtg

SEQ ID NO: 310899 - DNA, 26 bp, Artificial Sequence
  Description of Artificial Sequence: Synthetic oligonucleotide
acccaccagctggtcctatgcgtggt

SEQ ID NO: 310900 - DNA, 25 bp, Artificial Sequence
  Description of Artificial Sequence: Synthetic oligonucleotide
cccaccagctggtcctatgcgtggt

SEQ ID NO: 310901 - DNA, 25 bp, Artificial Sequence
  Description of Artificial Sequence: Synthetic oligonucleotide
ccaccagctggtcctatgcgtggtg

SEQ ID NO: 310902 - DNA, 25 bp, Artificial Sequence
  Description of Artificial Sequence: Synthetic oligonucleotide
caccagctggtcctatgcgtggtgg

SEQ ID NO: 310903 - DNA, 27 bp, Artificial Sequence
  Description of Artificial Sequence: Synthetic oligonucleotide
accagctggtcctatgcgtggtggcta

SEQ ID NO: 310904 - DNA, 26 bp, Artificial Sequence
  Description of Artificial Sequence: Synthetic oligonucleotide
ccagctggtcctatgcgtggtggcta

SEQ ID NO: 310905 - DNA, 27 bp, Artificial Sequence
  Description of Artificial Sequence: Synthetic oligonucleotide
cagctggtcctatgcgtggtggctact

SEQ ID NO: 310906 - DNA, 28 bp, Artificial Sequence
  Description of Artificial Sequence: Synthetic oligonucleotide
agctggtcctatgcgtggtggctactag

SEQ ID NO: 310907 - DNA, 27 bp, Artificial Sequence
  Description of Artificial Sequence: Synthetic oligonucleotide
gctggtcctatgcgtggtggctactag

SEQ ID NO: 310908 - DNA, 27 bp, Artificial Sequence
  Description of Artificial Sequence: Synthetic oligonucleotide
ctggtcctatgcgtggtggctactagc

SEQ ID NO: 310909 - DNA, 27 bp, Artificial Sequence
  Description of Artificial Sequence: Synthetic oligonucleotide
tggtcctatgcgtggtggctactagcg

SEQ ID NO: 310910 - DNA, 27 bp, Artificial Sequence
  Description of Artificial Sequence: Synthetic oligonucleotide
ggtcctatgcgtggtggctactagcga

SEQ ID NO: 310911 - DNA, 27 bp, Artificial Sequence
  Description of Artificial Sequence: Synthetic oligonucleotide
gtcctatgcgtggtggctactagcgac

SEQ ID NO: 310912 - DNA, 27 bp, Artificial Sequence
  Description of Artificial Sequence: Synthetic oligonucleotide
tcctatgcgtggtggctactagcgacc

SEQ ID NO: 310913 - DNA, 26 bp, Artificial Sequence
  Description of Artificial Sequence: Synthetic oligonucleotide
cctatgcgtggtggctactagcgacc

SEQ ID NO: 310914 - DNA, 26 bp, Artificial Sequence
  Description of Artificial Sequence: Synthetic oligonucleotide
ctatgcgtggtggctactagcgaccg

SEQ ID NO: 310915 - DNA, 27 bp, Artificial Sequence
  Description of Artificial Sequence: Synthetic oligonucleotide
tatgcgtggtggctactagcgaccgga

SEQ ID NO: 310916 - DNA, 26 bp, Artificial Sequence
  Description of Artificial Sequence: Synthetic oligonucleotide
atgcgtggtggctactagcgaccgga

SEQ ID NO: 310917 - DNA, 25 bp, Artificial Sequence
  Description of Artificial Sequence: Synthetic oligonucleotide
tgcgtggtggctactagcgaccgga

SEQ ID NO: 310918 - DNA, 24 bp, Artificial Sequence
  Description of Artificial Sequence: Synthetic oligonucleotide
gcgtggtggctactagcgaccgga

SEQ ID NO: 310919 - DNA, 24 bp, Artificial Sequence
  Description of Artificial Sequence: Synthetic oligonucleotide
cgtggtggctactagcgaccggag

SEQ ID NO: 310920 - DNA, 24 bp, Artificial Sequence
  Description of Artificial Sequence: Synthetic oligonucleotide
gtggtggctactagcgaccggagc

SEQ ID NO: 310921 - DNA, 24 bp, Artificial Sequence
  Description of Artificial Sequence: Synthetic oligonucleotide
tggtggctactagcgaccggagcc

SEQ ID NO: 310922 - DNA, 23 bp, Artificial Sequence
  Description of Artificial Sequence: Synthetic oligonucleotide
ggtggctactagcgaccggagcc

SEQ ID NO: 310923 - DNA, 23 bp, Artificial Sequence
  Description of Artificial Sequence: Synthetic oligonucleotide
gtggctactagcgaccggagccg

SEQ ID NO: 310924 - DNA, 23 bp, Artificial Sequence
  Description of Artificial Sequence: Synthetic oligonucleotide
tggctactagcgaccggagccgc

SEQ ID NO: 310925 - DNA, 22 bp, Artificial Sequence
  Description of Artificial Sequence: Synthetic oligonucleotide
ggctactagcgaccggagccgc

SEQ ID NO: 310926 - DNA, 22 bp, Artificial Sequence
  Description of Artificial Sequence: Synthetic oligonucleotide
gctactagcgaccggagccgcc

SEQ ID NO: 310927 - DNA, 23 bp, Artificial Sequence
  Description of Artificial Sequence: Synthetic oligonucleotide
ctactagcgaccggagccgccgt

SEQ ID NO: 310928 - DNA, 24 bp, Artificial Sequence
  Description of Artificial Sequence: Synthetic oligonucleotide
tactagcgaccggagccgccgtga

SEQ ID NO: 310929 - DNA, 23 bp, Artificial Sequence
  Description of Artificial Sequence: Synthetic oligonucleotide
actagcgaccggagccgccgtga

SEQ ID NO: 310930 - DNA, 22 bp, Artificial Sequence
  Description of Artificial Sequence: Synthetic oligonucleotide
ctagcgaccggagccgccgtga

SEQ ID NO: 310931 - DNA, 22 bp, Artificial Sequence
  Description of Artificial Sequence: Synthetic oligonucleotide
tagcgaccggagccgccgtgac

SEQ ID NO: 310932 - DNA, 21 bp, Artificial Sequence
  Description of Artificial Sequence: Synthetic oligonucleotide
agcgaccggagccgccgtgac

SEQ ID NO: 310933 - DNA, 20 bp, Artificial Sequence
  Description of Artificial Sequence: Synthetic oligonucleotide
gcgaccggagccgccgtgac

SEQ ID NO: 310934 - DNA, 22 bp, Artificial Sequence
  Description of Artificial Sequence: Synthetic oligonucleotide
cgaccggagccgccgtgacgtt

SEQ ID NO: 310935 - DNA, 22 bp, Artificial Sequence
  Description of Artificial Sequence: Synthetic oligonucleotide
gaccggagccgccgtgacgttg

SEQ ID NO: 310936 - DNA, 23 bp, Artificial Sequence
  Description of Artificial Sequence: Synthetic oligonucleotide
accggagccgccgtgacgttggt

SEQ ID NO: 310937 - DNA, 22 bp, Artificial Sequence
  Description of Artificial Sequence: Synthetic oligonucleotide
ccggagccgccgtgacgttggt

SEQ ID NO: 310938 - DNA, 22 bp, Artificial Sequence
  Description of Artificial Sequence: Synthetic oligonucleotide
cggagccgccgtgacgttggtg

SEQ ID NO: 310939 - DNA, 22 bp, Artificial Sequence
  Description of Artificial Sequence: Synthetic oligonucleotide
ggagccgccgtgacgttggtgg

SEQ ID NO: 310940 - DNA, 23 bp, Artificial Sequence
  Description of Artificial Sequence: Synthetic oligonucleotide
gagccgccgtgacgttggtggct

SEQ ID NO: 310941 - DNA, 24 bp, Artificial Sequence
  Description of Artificial Sequence: Synthetic oligonucleotide
agccgccgtgacgttggtggctga

SEQ ID NO: 310942 - DNA, 23 bp, Artificial Sequence
  Description of Artificial Sequence: Synthetic oligonucleotide
gccgccgtgacgttggtggctga

SEQ ID NO: 310943 - DNA, 23 bp, Artificial Sequence
  Description of Artificial Sequence: Synthetic oligonucleotide
ccgccgtgacgttggtggctgag

SEQ ID NO: 310944 - DNA, 23 bp, Artificial Sequence
  Description of Artificial Sequence: Synthetic oligonucleotide
cgccgtgacgttggtggctgagc

SEQ ID NO: 310945 - DNA, 23 bp, Artificial Sequence
  Description of Artificial Sequence: Synthetic oligonucleotide
gccgtgacgttggtggctgagcc

SEQ ID NO: 310946 - DNA, 23 bp, Artificial Sequence
  Description of Artificial Sequence: Synthetic oligonucleotide
ccgtgacgttggtggctgagccc

SEQ ID NO: 310947 - DNA, 23 bp, Artificial Sequence
  Description of Artificial Sequence: Synthetic oligonucleotide
cgtgacgttggtggctgagcccc

SEQ ID NO: 310948 - DNA, 23 bp, Artificial Sequence
  Description of Artificial Sequence: Synthetic oligonucleotide
gtgacgttggtggctgagccccc

SEQ ID NO: 310949 - DNA, 25 bp, Artificial Sequence
  Description of Artificial Sequence: Synthetic oligonucleotide
tgacgttggtggctgagccccccta

SEQ ID NO: 310950 - DNA, 24 bp, Artificial Sequence
  Description of Artificial Sequence: Synthetic oligonucleotide
gacgttggtggctgagccccccta

SEQ ID NO: 310951 - DNA, 24 bp, Artificial Sequence
  Description of Artificial Sequence: Synthetic oligonucleotide
acgttggtggctgagcccccctag

SEQ ID NO: 310952 - DNA, 23 bp, Artificial Sequence
  Description of Artificial Sequence: Synthetic oligonucleotide
cgttggtggctgagcccccctag

SEQ ID NO: 310953 - DNA, 23 bp, Artificial Sequence
  Description of Artificial Sequence: Synthetic oligonucleotide
gttggtggctgagcccccctagc

SEQ ID NO: 310954 - DNA, 25 bp, Artificial Sequence
  Description of Artificial Sequence: Synthetic oligonucleotide
ttggtggctgagcccccctagccat

SEQ ID NO: 310955 - DNA, 24 bp, Artificial Sequence
  Description of Artificial Sequence: Synthetic oligonucleotide
tggtggctgagcccccctagccat

SEQ ID NO: 310956 - DNA, 23 bp, Artificial Sequence
  Description of Artificial Sequence: Synthetic oligonucleotide
ggtggctgagcccccctagccat

SEQ ID NO: 310957 - DNA, 23 bp, Artificial Sequence
  Description of Artificial Sequence: Synthetic oligonucleotide
gtggctgagcccccctagccatc

SEQ ID NO: 310958 - DNA, 23 bp, Artificial Sequence
  Description of Artificial Sequence: Synthetic oligonucleotide
tggctgagcccccctagccatcg

SEQ ID NO: 310959 - DNA, 22 bp, Artificial Sequence
  Description of Artificial Sequence: Synthetic oligonucleotide
ggctgagcccccctagccatcg

SEQ ID NO: 310960 - DNA, 22 bp, Artificial Sequence
  Description of Artificial Sequence: Synthetic oligonucleotide
gctgagcccccctagccatcgg

SEQ ID NO: 310961 - DNA, 22 bp, Artificial Sequence
  Description of Artificial Sequence: Synthetic oligonucleotide
ctgagcccccctagccatcggc

SEQ ID NO: 310962 - DNA, 23 bp, Artificial Sequence
  Description of Artificial Sequence: Synthetic oligonucleotide
tgagcccccctagccatcggcgt

SEQ ID NO: 310963 - DNA, 22 bp, Artificial Sequence
  Description of Artificial Sequence: Synthetic oligonucleotide
gagcccccctagccatcggcgt

SEQ ID NO: 310964 - DNA, 23 bp, Artificial Sequence
  Description of Artificial Sequence: Synthetic oligonucleotide
agcccccctagccatcggcgtct

SEQ ID NO: 310965 - DNA, 22 bp, Artificial Sequence
  Description of Artificial Sequence: Synthetic oligonucleotide
gcccccctagccatcggcgtct

SEQ ID NO: 310966 - DNA, 23 bp, Artificial Sequence
  Description of Artificial Sequence: Synthetic oligonucleotide
cccccctagccatcggcgtctct

SEQ ID NO: 310967 - DNA, 25 bp, Artificial Sequence
  Description of Artificial Sequence: Synthetic oligonucleotide
ccccctagccatcggcgtctctgta

SEQ ID NO: 310968 - DNA, 25 bp, Artificial Sequence
  Description of Artificial Sequence: Synthetic oligonucleotide
cccctagccatcggcgtctctgtag

SEQ ID NO: 310969 - DNA, 25 bp, Artificial Sequence
  Description of Artificial Sequence: Synthetic oligonucleotide
ccctagccatcggcgtctctgtagg

SEQ ID NO: 310970 - DNA, 25 bp, Artificial Sequence
  Description of Artificial Sequence: Synthetic oligonucleotide
cctagccatcggcgtctctgtaggc

SEQ ID NO: 310971 - DNA, 27 bp, Artificial Sequence
  Description of Artificial Sequence: Synthetic oligonucleotide
ctagccatcggcgtctctgtaggcctt

SEQ ID NO: 310972 - DNA, 27 bp, Artificial Sequence
  Description of Artificial Sequence: Synthetic oligonucleotide
tagccatcggcgtctctgtaggccttg

SEQ ID NO: 310973 - DNA, 26 bp, Artificial Sequence
  Description of Artificial Sequence: Synthetic oligonucleotide
agccatcggcgtctctgtaggccttg

SEQ ID NO: 310974 - DNA, 25 bp, Artificial Sequence
  Description of Artificial Sequence: Synthetic oligonucleotide
gccatcggcgtctctgtaggccttg

SEQ ID NO: 310975 - DNA, 26 bp, Artificial Sequence
  Description of Artificial Sequence: Synthetic oligonucleotide
ccatcggcgtctctgtaggccttgga

SEQ ID NO: 310976 - DNA, 27 bp, Artificial Sequence
  Description of Artificial Sequence: Synthetic oligonucleotide
catcggcgtctctgtaggccttggaca

SEQ ID NO: 310977 - DNA, 27 bp, Artificial Sequence
  Description of Artificial Sequence: Synthetic oligonucleotide
atcggcgtctctgtaggccttggacag

SEQ ID NO: 310978 - DNA, 26 bp, Artificial Sequence
  Description of Artificial Sequence: Synthetic oligonucleotide
tcggcgtctctgtaggccttggacag

SEQ ID NO: 310979 - DNA, 25 bp, Artificial Sequence
  Description of Artificial Sequence: Synthetic oligonucleotide
cggcgtctctgtaggccttggacag

SEQ ID NO: 310980 - DNA, 26 bp, Artificial Sequence
  Description of Artificial Sequence: Synthetic oligonucleotide
ggcgtctctgtaggccttggacagct

SEQ ID NO: 310981 - DNA, 26 bp, Artificial Sequence
  Description of Artificial Sequence: Synthetic oligonucleotide
gcgtctctgtaggccttggacagctc

SEQ ID NO: 310982 - DNA, 27 bp, Artificial Sequence
  Description of Artificial Sequence: Synthetic oligonucleotide
cgtctctgtaggccttggacagctcct

SEQ ID NO: 310983 - DNA, 27 bp, Artificial Sequence
  Description of Artificial Sequence: Synthetic oligonucleotide
gtctctgtaggccttggacagctcctg

SEQ ID NO: 310984 - DNA, 27 bp, Artificial Sequence
  Description of Artificial Sequence: Synthetic oligonucleotide
tctctgtaggccttggacagctcctgg

SEQ ID NO: 310985 - DNA, 26 bp, Artificial Sequence
  Description of Artificial Sequence: Synthetic oligonucleotide
ctctgtaggccttggacagctcctgg

SEQ ID NO: 310986 - DNA, 27 bp, Artificial Sequence
  Description of Artificial Sequence: Synthetic oligonucleotide
tctgtaggccttggacagctcctggct

SEQ ID NO: 310987 - DNA, 27 bp, Artificial Sequence
  Description of Artificial Sequence: Synthetic oligonucleotide
ctgtaggccttggacagctcctggctt

SEQ ID NO: 310988 - DNA, 29 bp, Artificial Sequence
  Description of Artificial Sequence: Synthetic oligonucleotide
tgtaggccttggacagctcctggcttttg

SEQ ID NO: 310989 - DNA, 28 bp, Artificial Sequence
  Description of Artificial Sequence: Synthetic oligonucleotide
gtaggccttggacagctcctggcttttg

SEQ ID NO: 310990 - DNA, 29 bp, Artificial Sequence
  Description of Artificial Sequence: Synthetic oligonucleotide
taggccttggacagctcctggcttttgac

SEQ ID NO: 310991 - DNA, 28 bp, Artificial Sequence
  Description of Artificial Sequence: Synthetic oligonucleotide
aggccttggacagctcctggcttttgac

SEQ ID NO: 310992 - DNA, 27 bp, Artificial Sequence
  Description of Artificial Sequence: Synthetic oligonucleotide
ggccttggacagctcctggcttttgac

SEQ ID NO: 310993 - DNA, 29 bp, Artificial Sequence
  Description of Artificial Sequence: Synthetic oligonucleotide
gccttggacagctcctggcttttgactac

SEQ ID NO: 310994 - DNA, 30 bp, Artificial Sequence
  Description of Artificial Sequence: Synthetic oligonucleotide
ccttggacagctcctggcttttgactacag

SEQ ID NO: 310995 - DNA, 31 bp, Artificial Sequence
  Description of Artificial Sequence: Synthetic oligonucleotide
cttggacagctcctggcttttgactacagtg

SEQ ID NO: 310996 - DNA, 31 bp, Artificial Sequence
  Description of Artificial Sequence: Synthetic oligonucleotide
ttggacagctcctggcttttgactacagtgg

SEQ ID NO: 310997 - DNA, 30 bp, Artificial Sequence
  Description of Artificial Sequence: Synthetic oligonucleotide
tggacagctcctggcttttgactacagtgg

SEQ ID NO: 310998 - DNA, 29 bp, Artificial Sequence
  Description of Artificial Sequence: Synthetic oligonucleotide
ggacagctcctggcttttgactacagtgg

SEQ ID NO: 310999 - DNA, 29 bp, Artificial Sequence
  Description of Artificial Sequence: Synthetic oligonucleotide
gacagctcctggcttttgactacagtggc

SEQ ID NO: 311000 - DNA, 30 bp, Artificial Sequence
  Description of Artificial Sequence: Synthetic oligonucleotide
acagctcctggcttttgactacagtggctg

SEQ ID NO: 311001 - DNA, 29 bp, Artificial Sequence
  Description of Artificial Sequence: Synthetic oligonucleotide
cagctcctggcttttgactacagtggctg

SEQ ID NO: 311002 - DNA, 30 bp, Artificial Sequence
  Description of Artificial Sequence: Synthetic oligonucleotide
agctcctggcttttgactacagtggctgtg

SEQ ID NO: 311003 - DNA, 29 bp, Artificial Sequence
  Description of Artificial Sequence: Synthetic oligonucleotide
gctcctggcttttgactacagtggctgtg

SEQ ID NO: 311004 - DNA, 29 bp, Artificial Sequence
  Description of Artificial Sequence: Synthetic oligonucleotide
ctcctggcttttgactacagtggctgtgg

SEQ ID NO: 311005 - DNA, 29 bp, Artificial Sequence
  Description of Artificial Sequence: Synthetic oligonucleotide
tcctggcttttgactacagtggctgtggc

SEQ ID NO: 311006 - DNA, 28 bp, Artificial Sequence
  Description of Artificial Sequence: Synthetic oligonucleotide
cctggcttttgactacagtggctgtggc

SEQ ID NO: 311007 - DNA, 33 bp, Artificial Sequence
  Description of Artificial Sequence: Synthetic oligonucleotide
ctggcttttgactacagtggctgtggcattaac

SEQ ID NO: 311008 - DNA, 33 bp, Artificial Sequence
  Description of Artificial Sequence: Synthetic oligonucleotide
tggcttttgactacagtggctgtggcattaacc

SEQ ID NO: 311009 - DNA, 32 bp, Artificial Sequence
  Description of Artificial Sequence: Synthetic oligonucleotide
ggcttttgactacagtggctgtggcattaacc

SEQ ID NO: 311010 - DNA, 32 bp, Artificial Sequence
  Description of Artificial Sequence: Synthetic oligonucleotide
gcttttgactacagtggctgtggcattaaccc

SEQ ID NO: 311011 - DNA, 33 bp, Artificial Sequence
  Description of Artificial Sequence: Synthetic oligonucleotide
cttttgactacagtggctgtggcattaaccctc

SEQ ID NO: 311012 - DNA, 33 bp, Artificial Sequence
  Description of Artificial Sequence: Synthetic oligonucleotide
ttttgactacagtggctgtggcattaaccctcc

SEQ ID NO: 311013 - DNA, 32 bp, Artificial Sequence
  Description of Artificial Sequence: Synthetic oligonucleotide
tttgactacagtggctgtggcattaaccctcc

SEQ ID NO: 311014 - DNA, 31 bp, Artificial Sequence
  Description of Artificial Sequence: Synthetic oligonucleotide
ttgactacagtggctgtggcattaaccctcc

SEQ ID NO: 311015 - DNA, 30 bp, Artificial Sequence
  Description of Artificial Sequence: Synthetic oligonucleotide
tgactacagtggctgtggcattaaccctcc

SEQ ID NO: 311016 - DNA, 29 bp, Artificial Sequence
  Description of Artificial Sequence: Synthetic oligonucleotide
gactacagtggctgtggcattaaccctcc

SEQ ID NO: 311017 - DNA, 30 bp, Artificial Sequence
  Description of Artificial Sequence: Synthetic oligonucleotide
actacagtggctgtggcattaaccctcctc

SEQ ID NO: 311018 - DNA, 29 bp, Artificial Sequence
  Description of Artificial Sequence: Synthetic oligonucleotide
ctacagtggctgtggcattaaccctcctc

SEQ ID NO: 311019 - DNA, 29 bp, Artificial Sequence
  Description of Artificial Sequence: Synthetic oligonucleotide
tacagtggctgtggcattaaccctcctcg

SEQ ID NO: 311020 - DNA, 28 bp, Artificial Sequence
  Description of Artificial Sequence: Synthetic oligonucleotide
acagtggctgtggcattaaccctcctcg

SEQ ID NO: 311021 - DNA, 27 bp, Artificial Sequence
  Description of Artificial Sequence: Synthetic oligonucleotide
cagtggctgtggcattaaccctcctcg

SEQ ID NO: 311022 - DNA, 27 bp, Artificial Sequence
  Description of Artificial Sequence: Synthetic oligonucleotide
agtggctgtggcattaaccctcctcgg

SEQ ID NO: 311023 - DNA, 27 bp, Artificial Sequence
  Description of Artificial Sequence: Synthetic oligonucleotide
gtggctgtggcattaaccctcctcggt

SEQ ID NO: 311024 - DNA, 27 bp, Artificial Sequence
  Description of Artificial Sequence: Synthetic oligonucleotide
tggctgtggcattaaccctcctcggtc

SEQ ID NO: 311025 - DNA, 26 bp, Artificial Sequence
  Description of Artificial Sequence: Synthetic oligonucleotide
ggctgtggcattaaccctcctcggtc

SEQ ID NO: 311026 - DNA, 27 bp, Artificial Sequence
  Description of Artificial Sequence: Synthetic oligonucleotide
gctgtggcattaaccctcctcggtcct

SEQ ID NO: 311027 - DNA, 29 bp, Artificial Sequence
  Description of Artificial Sequence: Synthetic oligonucleotide
ctgtggcattaaccctcctcggtcctatg

SEQ ID NO: 311028 - DNA, 29 bp, Artificial Sequence
  Description of Artificial Sequence: Synthetic oligonucleotide
tgtggcattaaccctcctcggtcctatgg

SEQ ID NO: 311029 - DNA, 28 bp, Artificial Sequence
  Description of Artificial Sequence: Synthetic oligonucleotide
gtggcattaaccctcctcggtcctatgg

SEQ ID NO: 311030 - DNA, 28 bp, Artificial Sequence
  Description of Artificial Sequence: Synthetic oligonucleotide
tggcattaaccctcctcggtcctatggc

SEQ ID NO: 311031 - DNA, 27 bp, Artificial Sequence
  Description of Artificial Sequence: Synthetic oligonucleotide
ggcattaaccctcctcggtcctatggc

SEQ ID NO: 311032 - DNA, 28 bp, Artificial Sequence
  Description of Artificial Sequence: Synthetic oligonucleotide
gcattaaccctcctcggtcctatggctc

SEQ ID NO: 311033 - DNA, 28 bp, Artificial Sequence
  Description of Artificial Sequence: Synthetic oligonucleotide
cattaaccctcctcggtcctatggctcc

SEQ ID NO: 311034 - DNA, 28 bp, Artificial Sequence
  Description of Artificial Sequence: Synthetic oligonucleotide
attaaccctcctcggtcctatggctccg

SEQ ID NO: 311035 - DNA, 27 bp, Artificial Sequence
  Description of Artificial Sequence: Synthetic oligonucleotide
ttaaccctcctcggtcctatggctccg

SEQ ID NO: 311036 - DNA, 26 bp, Artificial Sequence
  Description of Artificial Sequence: Synthetic oligonucleotide
taaccctcctcggtcctatggctccg

SEQ ID NO: 311037 - DNA, 25 bp, Artificial Sequence
  Description of Artificial Sequence: Synthetic oligonucleotide
aaccctcctcggtcctatggctccg

SEQ ID NO: 311038 - DNA, 24 bp, Artificial Sequence
  Description of Artificial Sequence: Synthetic oligonucleotide
accctcctcggtcctatggctccg

SEQ ID NO: 311039 - DNA, 23 bp, Artificial Sequence
  Description of Artificial Sequence: Synthetic oligonucleotide
ccctcctcggtcctatggctccg

SEQ ID NO: 311040 - DNA, 23 bp, Artificial Sequence
  Description of Artificial Sequence: Synthetic oligonucleotide
cctcctcggtcctatggctccgc

SEQ ID NO: 311041 - DNA, 23 bp, Artificial Sequence
  Description of Artificial Sequence: Synthetic oligonucleotide
ctcctcggtcctatggctccgcc

SEQ ID NO: 311042 - DNA, 24 bp, Artificial Sequence
  Description of Artificial Sequence: Synthetic oligonucleotide
tcctcggtcctatggctccgccgt

SEQ ID NO: 311043 - DNA, 23 bp, Artificial Sequence
  Description of Artificial Sequence: Synthetic oligonucleotide
cctcggtcctatggctccgccgt

SEQ ID NO: 311044 - DNA, 25 bp, Artificial Sequence
  Description of Artificial Sequence: Synthetic oligonucleotide
ctcggtcctatggctccgccgtgat

SEQ ID NO: 311045 - DNA, 26 bp, Artificial Sequence
  Description of Artificial Sequence: Synthetic oligonucleotide
tcggtcctatggctccgccgtgatca

SEQ ID NO: 311046 - DNA, 25 bp, Artificial Sequence
  Description of Artificial Sequence: Synthetic oligonucleotide
cggtcctatggctccgccgtgatca

SEQ ID NO: 311047 - DNA, 26 bp, Artificial Sequence
  Description of Artificial Sequence: Synthetic oligonucleotide
ggtcctatggctccgccgtgatcaca

SEQ ID NO: 311048 - DNA, 27 bp, Artificial Sequence
  Description of Artificial Sequence: Synthetic oligonucleotide
gtcctatggctccgccgtgatcacaga

SEQ ID NO: 311049 - DNA, 27 bp, Artificial Sequence
  Description of Artificial Sequence: Synthetic oligonucleotide
tcctatggctccgccgtgatcacagac

SEQ ID NO: 311050 - DNA, 27 bp, Artificial Sequence
  Description of Artificial Sequence: Synthetic oligonucleotide
cctatggctccgccgtgatcacagaca

SEQ ID NO: 311051 - DNA, 28 bp, Artificial Sequence
  Description of Artificial Sequence: Synthetic oligonucleotide
ctatggctccgccgtgatcacagacaac

SEQ ID NO: 311052 - DNA, 30 bp, Artificial Sequence
  Description of Artificial Sequence: Synthetic oligonucleotide
tatggctccgccgtgatcacagacaacttc

SEQ ID NO: 311053 - DNA, 29 bp, Artificial Sequence
  Description of Artificial Sequence: Synthetic oligonucleotide
atggctccgccgtgatcacagacaacttc

SEQ ID NO: 311054 - DNA, 28 bp, Artificial Sequence
  Description of Artificial Sequence: Synthetic oligonucleotide
tggctccgccgtgatcacagacaacttc

SEQ ID NO: 311055 - DNA, 27 bp, Artificial Sequence
  Description of Artificial Sequence: Synthetic oligonucleotide
ggctccgccgtgatcacagacaacttc

SEQ ID NO: 311056 - DNA, 28 bp, Artificial Sequence
  Description of Artificial Sequence: Synthetic oligonucleotide
gctccgccgtgatcacagacaacttcac

SEQ ID NO: 311057 - DNA, 28 bp, Artificial Sequence
  Description of Artificial Sequence: Synthetic oligonucleotide
ctccgccgtgatcacagacaacttcacc

SEQ ID NO: 311058 - DNA, 30 bp, Artificial Sequence
  Description of Artificial Sequence: Synthetic oligonucleotide
tccgccgtgatcacagacaacttcaccaac

SEQ ID NO: 311059 - DNA, 29 bp, Artificial Sequence
  Description of Artificial Sequence: Synthetic oligonucleotide
ccgccgtgatcacagacaacttcaccaac

SEQ ID NO: 311060 - DNA, 29 bp, Artificial Sequence
  Description of Artificial Sequence: Synthetic oligonucleotide
cgccgtgatcacagacaacttcaccaacc

SEQ ID NO: 311061 - DNA, 30 bp, Artificial Sequence
  Description of Artificial Sequence: Synthetic oligonucleotide
gccgtgatcacagacaacttcaccaaccac

SEQ ID NO: 311062 - DNA, 31 bp, Artificial Sequence
  Description of Artificial Sequence: Synthetic oligonucleotide
ccgtgatcacagacaacttcaccaaccactg

SEQ ID NO: 311063 - DNA, 31 bp, Artificial Sequence
  Description of Artificial Sequence: Synthetic oligonucleotide
cgtgatcacagacaacttcaccaaccactgc

SEQ ID NO: 311064 - DNA, 36 bp, Artificial Sequence
  Description of Artificial Sequence: Synthetic oligonucleotide
gtgatcacagacaacttcaccaaccactgcattttc

SEQ ID NO: 311065 - DNA, 37 bp, Artificial Sequence
  Description of Artificial Sequence: Synthetic oligonucleotide
tgatcacagacaacttcaccaaccactgcattttctg

SEQ ID NO: 311066 - DNA, 36 bp, Artificial Sequence
  Description of Artificial Sequence: Synthetic oligonucleotide
gatcacagacaacttcaccaaccactgcattttctg

SEQ ID NO: 311067 - DNA, 36 bp, Artificial Sequence
  Description of Artificial Sequence: Synthetic oligonucleotide
atcacagacaacttcaccaaccactgcattttctgg

SEQ ID NO: 311068 - DNA, 35 bp, Artificial Sequence
  Description of Artificial Sequence: Synthetic oligonucleotide
tcacagacaacttcaccaaccactgcattttctgg

SEQ ID NO: 311069 - DNA, 34 bp, Artificial Sequence
  Description of Artificial Sequence: Synthetic oligonucleotide
cacagacaacttcaccaaccactgcattttctgg

SEQ ID NO: 311070 - DNA, 34 bp, Artificial Sequence
  Description of Artificial Sequence: Synthetic oligonucleotide
acagacaacttcaccaaccactgcattttctggc

SEQ ID NO: 311071 - DNA, 33 bp, Artificial Sequence
  Description of Artificial Sequence: Synthetic oligonucleotide
cagacaacttcaccaaccactgcattttctggc

SEQ ID NO: 311072 - DNA, 34 bp, Artificial Sequence
  Description of Artificial Sequence: Synthetic oligonucleotide
agacaacttcaccaaccactgcattttctggctg

SEQ ID NO: 311073 - DNA, 33 bp, Artificial Sequence
  Description of Artificial Sequence: Synthetic oligonucleotide
gacaacttcaccaaccactgcattttctggctg

SEQ ID NO: 311074 - DNA, 33 bp, Artificial Sequence
  Description of Artificial Sequence: Synthetic oligonucleotide
acaacttcaccaaccactgcattttctggctgg

SEQ ID NO: 311075 - DNA, 32 bp, Artificial Sequence
  Description of Artificial Sequence: Synthetic oligonucleotide
caacttcaccaaccactgcattttctggctgg

SEQ ID NO: 311076 - DNA, 32 bp, Artificial Sequence
  Description of Artificial Sequence: Synthetic oligonucleotide
aacttcaccaaccactgcattttctggctggg

SEQ ID NO: 311077 - DNA, 31 bp, Artificial Sequence
  Description of Artificial Sequence: Synthetic oligonucleotide
acttcaccaaccactgcattttctggctggg

SEQ ID NO: 311078 - DNA, 30 bp, Artificial Sequence
  Description of Artificial Sequence: Synthetic oligonucleotide
cttcaccaaccactgcattttctggctggg

SEQ ID NO: 311079 - DNA, 30 bp, Artificial Sequence
  Description of Artificial Sequence: Synthetic oligonucleotide
ttcaccaaccactgcattttctggctgggg

SEQ ID NO: 311080 - DNA, 29 bp, Artificial Sequence
  Description of Artificial Sequence: Synthetic oligonucleotide
tcaccaaccactgcattttctggctgggg

SEQ ID NO: 311081 - DNA, 28 bp, Artificial Sequence
  Description of Artificial Sequence: Synthetic oligonucleotide
caccaaccactgcattttctggctgggg

SEQ ID NO: 311082 - DNA, 28 bp, Artificial Sequence
  Description of Artificial Sequence: Synthetic oligonucleotide
accaaccactgcattttctggctggggc

SEQ ID NO: 311083 - DNA, 27 bp, Artificial Sequence
  Description of Artificial Sequence: Synthetic oligonucleotide
ccaaccactgcattttctggctggggc

SEQ ID NO: 311084 - DNA, 27 bp, Artificial Sequence
  Description of Artificial Sequence: Synthetic oligonucleotide
caaccactgcattttctggctggggcc

SEQ ID NO: 311085 - DNA, 30 bp, Artificial Sequence
  Description of Artificial Sequence: Synthetic oligonucleotide
aaccactgcattttctggctggggccatac

SEQ ID NO: 311086 - DNA, 29 bp, Artificial Sequence
  Description of Artificial Sequence: Synthetic oligonucleotide
accactgcattttctggctggggccatac

SEQ ID NO: 311087 - DNA, 28 bp, Artificial Sequence
  Description of Artificial Sequence: Synthetic oligonucleotide
ccactgcattttctggctggggccatac

SEQ ID NO: 311088 - DNA, 30 bp, Artificial Sequence
  Description of Artificial Sequence: Synthetic oligonucleotide
cactgcattttctggctggggccatacatc

SEQ ID NO: 311089 - DNA, 30 bp, Artificial Sequence
  Description of Artificial Sequence: Synthetic oligonucleotide
actgcattttctggctggggccatacatcg

SEQ ID NO: 311090 - DNA, 29 bp, Artificial Sequence
  Description of Artificial Sequence: Synthetic oligonucleotide
ctgcattttctggctggggccatacatcg

SEQ ID NO: 311091 - DNA, 29 bp, Artificial Sequence
  Description of Artificial Sequence: Synthetic oligonucleotide
tgcattttctggctggggccatacatcgg

SEQ ID NO: 311092 - DNA, 28 bp, Artificial Sequence
  Description of Artificial Sequence: Synthetic oligonucleotide
gcattttctggctggggccatacatcgg

SEQ ID NO: 311093 - DNA, 28 bp, Artificial Sequence
  Description of Artificial Sequence: Synthetic oligonucleotide
cattttctggctggggccatacatcggg

SEQ ID NO: 311094 - DNA, 28 bp, Artificial Sequence
  Description of Artificial Sequence: Synthetic oligonucleotide
attttctggctggggccatacatcgggg

SEQ ID NO: 311095 - DNA, 27 bp, Artificial Sequence
  Description of Artificial Sequence: Synthetic oligonucleotide
ttttctggctggggccatacatcgggg

SEQ ID NO: 311096 - DNA, 26 bp, Artificial Sequence
  Description of Artificial Sequence: Synthetic oligonucleotide
tttctggctggggccatacatcgggg

SEQ ID NO: 311097 - DNA, 25 bp, Artificial Sequence
  Description of Artificial Sequence: Synthetic oligonucleotide
ttctggctggggccatacatcgggg

SEQ ID NO: 311098 - DNA, 24 bp, Artificial Sequence
  Description of Artificial Sequence: Synthetic oligonucleotide
tctggctggggccatacatcgggg

SEQ ID NO: 311099 - DNA, 23 bp, Artificial Sequence
  Description of Artificial Sequence: Synthetic oligonucleotide
ctggctggggccatacatcgggg

SEQ ID NO: 311100 - DNA, 24 bp, Artificial Sequence
  Description of Artificial Sequence: Synthetic oligonucleotide
tggctggggccatacatcgggggt

SEQ ID NO: 311101 - DNA, 23 bp, Artificial Sequence
  Description of Artificial Sequence: Synthetic oligonucleotide
ggctggggccatacatcgggggt

SEQ ID NO: 311102 - DNA, 23 bp, Artificial Sequence
  Description of Artificial Sequence: Synthetic oligonucleotide
gctggggccatacatcgggggtg

SEQ ID NO: 311103 - DNA, 23 bp, Artificial Sequence
  Description of Artificial Sequence: Synthetic oligonucleotide
ctggggccatacatcgggggtgc

SEQ ID NO: 311104 - DNA, 23 bp, Artificial Sequence
  Description of Artificial Sequence: Synthetic oligonucleotide
tggggccatacatcgggggtgcc

SEQ ID NO: 311105 - DNA, 22 bp, Artificial Sequence
  Description of Artificial Sequence: Synthetic oligonucleotide
ggggccatacatcgggggtgcc

SEQ ID NO: 311106 - DNA, 23 bp, Artificial Sequence
  Description of Artificial Sequence: Synthetic oligonucleotide
gggccatacatcgggggtgccct

SEQ ID NO: 311107 - DNA, 23 bp, Artificial Sequence
  Description of Artificial Sequence: Synthetic oligonucleotide
ggccatacatcgggggtgccctg

SEQ ID NO: 311108 - DNA, 23 bp, Artificial Sequence
  Description of Artificial Sequence: Synthetic oligonucleotide
gccatacatcgggggtgccctgg

SEQ ID NO: 311109 - DNA, 24 bp, Artificial Sequence
  Description of Artificial Sequence: Synthetic oligonucleotide
ccatacatcgggggtgccctggct

SEQ ID NO: 311110 - DNA, 26 bp, Artificial Sequence
  Description of Artificial Sequence: Synthetic oligonucleotide
catacatcgggggtgccctggctcta

SEQ ID NO: 311111 - DNA, 27 bp, Artificial Sequence
  Description of Artificial Sequence: Synthetic oligonucleotide
atacatcgggggtgccctggctctact

SEQ ID NO: 311112 - DNA, 26 bp, Artificial Sequence
  Description of Artificial Sequence: Synthetic oligonucleotide
tacatcgggggtgccctggctctact

SEQ ID NO: 311113 - DNA, 25 bp, Artificial Sequence
  Description of Artificial Sequence: Synthetic oligonucleotide
acatcgggggtgccctggctctact

SEQ ID NO: 311114 - DNA, 24 bp, Artificial Sequence
  Description of Artificial Sequence: Synthetic oligonucleotide
catcgggggtgccctggctctact

SEQ ID NO: 311115 - DNA, 26 bp, Artificial Sequence
  Description of Artificial Sequence: Synthetic oligonucleotide
atcgggggtgccctggctctactcat

SEQ ID NO: 311116 - DNA, 25 bp, Artificial Sequence
  Description of Artificial Sequence: Synthetic oligonucleotide
tcgggggtgccctggctctactcat

SEQ ID NO: 311117 - DNA, 24 bp, Artificial Sequence
  Description of Artificial Sequence: Synthetic oligonucleotide
cgggggtgccctggctctactcat

SEQ ID NO: 311118 - DNA, 26 bp, Artificial Sequence
  Description of Artificial Sequence: Synthetic oligonucleotide
gggggtgccctggctctactcatctt

SEQ ID NO: 311119 - DNA, 26 bp, Artificial Sequence
  Description of Artificial Sequence: Synthetic oligonucleotide
ggggtgccctggctctactcatcttc

SEQ ID NO: 311120 - DNA, 27 bp, Artificial Sequence
  Description of Artificial Sequence: Synthetic oligonucleotide
gggtgccctggctctactcatcttcga

SEQ ID NO: 311121 - DNA, 27 bp, Artificial Sequence
  Description of Artificial Sequence: Synthetic oligonucleotide
ggtgccctggctctactcatcttcgac

SEQ ID NO: 311122 - DNA, 29 bp, Artificial Sequence
  Description of Artificial Sequence: Synthetic oligonucleotide
gtgccctggctctactcatcttcgacttc

SEQ ID NO: 311123 - DNA, 31 bp, Artificial Sequence
  Description of Artificial Sequence: Synthetic oligonucleotide
tgccctggctctactcatcttcgacttcatg

SEQ ID NO: 311124 - DNA, 30 bp, Artificial Sequence
  Description of Artificial Sequence: Synthetic oligonucleotide
gccctggctctactcatcttcgacttcatg

SEQ ID NO: 311125 - DNA, 30 bp, Artificial Sequence
  Description of Artificial Sequence: Synthetic oligonucleotide
ccctggctctactcatcttcgacttcatgc

SEQ ID NO: 311126 - DNA, 31 bp, Artificial Sequence
  Description of Artificial Sequence: Synthetic oligonucleotide
cctggctctactcatcttcgacttcatgctg

SEQ ID NO: 311127 - DNA, 31 bp, Artificial Sequence
  Description of Artificial Sequence: Synthetic oligonucleotide
ctggctctactcatcttcgacttcatgctgg

SEQ ID NO: 311128 - DNA, 31 bp, Artificial Sequence
  Description of Artificial Sequence: Synthetic oligonucleotide
tggctctactcatcttcgacttcatgctggc

SEQ ID NO: 311129 - DNA, 30 bp, Artificial Sequence
  Description of Artificial Sequence: Synthetic oligonucleotide
ggctctactcatcttcgacttcatgctggc

SEQ ID NO: 311130 - DNA, 30 bp, Artificial Sequence
  Description of Artificial Sequence: Synthetic oligonucleotide
gctctactcatcttcgacttcatgctggcc

SEQ ID NO: 311131 - DNA, 30 bp, Artificial Sequence
  Description of Artificial Sequence: Synthetic oligonucleotide
ctctactcatcttcgacttcatgctggccc

SEQ ID NO: 311132 - DNA, 30 bp, Artificial Sequence
  Description of Artificial Sequence: Synthetic oligonucleotide
tctactcatcttcgacttcatgctggcccc

SEQ ID NO: 311133 - DNA, 29 bp, Artificial Sequence
  Description of Artificial Sequence: Synthetic oligonucleotide
ctactcatcttcgacttcatgctggcccc

SEQ ID NO: 311134 - DNA, 30 bp, Artificial Sequence
  Description of Artificial Sequence: Synthetic oligonucleotide
tactcatcttcgacttcatgctggccccag

SEQ ID NO: 311135 - DNA, 29 bp, Artificial Sequence
  Description of Artificial Sequence: Synthetic oligonucleotide
actcatcttcgacttcatgctggccccag

SEQ ID NO: 311136 - DNA, 28 bp, Artificial Sequence
  Description of Artificial Sequence: Synthetic oligonucleotide
ctcatcttcgacttcatgctggccccag

SEQ ID NO: 311137 - DNA, 28 bp, Artificial Sequence
  Description of Artificial Sequence: Synthetic oligonucleotide
tcatcttcgacttcatgctggccccagg

SEQ ID NO: 311138 - DNA, 27 bp, Artificial Sequence
  Description of Artificial Sequence: Synthetic oligonucleotide
catcttcgacttcatgctggccccagg

SEQ ID NO: 311139 - DNA, 27 bp, Artificial Sequence
  Description of Artificial Sequence: Synthetic oligonucleotide
atcttcgacttcatgctggccccaggc

SEQ ID NO: 311140 - DNA, 27 bp, Artificial Sequence
  Description of Artificial Sequence: Synthetic oligonucleotide
tcttcgacttcatgctggccccaggca

SEQ ID NO: 311141 - DNA, 26 bp, Artificial Sequence
  Description of Artificial Sequence: Synthetic oligonucleotide
cttcgacttcatgctggccccaggca

SEQ ID NO: 311142 - DNA, 26 bp, Artificial Sequence
  Description of Artificial Sequence: Synthetic oligonucleotide
ttcgacttcatgctggccccaggcag

SEQ ID NO: 311143 - DNA, 25 bp, Artificial Sequence
  Description of Artificial Sequence: Synthetic oligonucleotide
tcgacttcatgctggccccaggcag

SEQ ID NO: 311144 - DNA, 24 bp, Artificial Sequence
  Description of Artificial Sequence: Synthetic oligonucleotide
cgacttcatgctggccccaggcag

SEQ ID NO: 311145 - DNA, 25 bp, Artificial Sequence
  Description of Artificial Sequence: Synthetic oligonucleotide
gacttcatgctggccccaggcagca

SEQ ID NO: 311146 - DNA, 26 bp, Artificial Sequence
  Description of Artificial Sequence: Synthetic oligonucleotide
acttcatgctggccccaggcagcagt

SEQ ID NO: 311147 - DNA, 25 bp, Artificial Sequence
  Description of Artificial Sequence: Synthetic oligonucleotide
cttcatgctggccccaggcagcagt

SEQ ID NO: 311148 - DNA, 26 bp, Artificial Sequence
  Description of Artificial Sequence: Synthetic oligonucleotide
ttcatgctggccccaggcagcagtgt

SEQ ID NO: 311149 - DNA, 25 bp, Artificial Sequence
  Description of Artificial Sequence: Synthetic oligonucleotide
tcatgctggccccaggcagcagtgt

SEQ ID NO: 311150 - DNA, 24 bp, Artificial Sequence
  Description of Artificial Sequence: Synthetic oligonucleotide
catgctggccccaggcagcagtgt

SEQ ID NO: 311151 - DNA, 24 bp, Artificial Sequence
  Description of Artificial Sequence: Synthetic oligonucleotide
atgctggccccaggcagcagtgtc

SEQ ID NO: 311152 - DNA, 23 bp, Artificial Sequence
  Description of Artificial Sequence: Synthetic oligonucleotide
tgctggccccaggcagcagtgtc

SEQ ID NO: 311153 - DNA, 22 bp, Artificial Sequence
  Description of Artificial Sequence: Synthetic oligonucleotide
gctggccccaggcagcagtgtc

SEQ ID NO: 311154 - DNA, 23 bp, Artificial Sequence
  Description of Artificial Sequence: Synthetic oligonucleotide
ctggccccaggcagcagtgtcct

SEQ ID NO: 311155 - DNA, 24 bp, Artificial Sequence
  Description of Artificial Sequence: Synthetic oligonucleotide
tggccccaggcagcagtgtcctca

SEQ ID NO: 311156 - DNA, 23 bp, Artificial Sequence
  Description of Artificial Sequence: Synthetic oligonucleotide
ggccccaggcagcagtgtcctca

SEQ ID NO: 311157 - DNA, 24 bp, Artificial Sequence
  Description of Artificial Sequence: Synthetic oligonucleotide
gccccaggcagcagtgtcctcaca

SEQ ID NO: 311158 - DNA, 25 bp, Artificial Sequence
  Description of Artificial Sequence: Synthetic oligonucleotide
ccccaggcagcagtgtcctcacaga

SEQ ID NO: 311159 - DNA, 25 bp, Artificial Sequence
  Description of Artificial Sequence: Synthetic oligonucleotide
cccaggcagcagtgtcctcacagag

SEQ ID NO: 311160 - DNA, 25 bp, Artificial Sequence
  Description of Artificial Sequence: Synthetic oligonucleotide
ccaggcagcagtgtcctcacagagc

SEQ ID NO: 311161 - DNA, 25 bp, Artificial Sequence
  Description of Artificial Sequence: Synthetic oligonucleotide
caggcagcagtgtcctcacagagcg

SEQ ID NO: 311162 - DNA, 25 bp, Artificial Sequence
  Description of Artificial Sequence: Synthetic oligonucleotide
aggcagcagtgtcctcacagagcgc

SEQ ID NO: 311163 - DNA, 24 bp, Artificial Sequence
  Description of Artificial Sequence: Synthetic oligonucleotide
ggcagcagtgtcctcacagagcgc

SEQ ID NO: 311164 - DNA, 25 bp, Artificial Sequence
  Description of Artificial Sequence: Synthetic oligonucleotide
gcagcagtgtcctcacagagcgcgt

SEQ ID NO: 311165 - DNA, 27 bp, Artificial Sequence
  Description of Artificial Sequence: Synthetic oligonucleotide
cagcagtgtcctcacagagcgcgtgaa

SEQ ID NO: 311166 - DNA, 27 bp, Artificial Sequence
  Description of Artificial Sequence: Synthetic oligonucleotide
agcagtgtcctcacagagcgcgtgaag

SEQ ID NO: 311167 - DNA, 26 bp, Artificial Sequence
  Description of Artificial Sequence: Synthetic oligonucleotide
gcagtgtcctcacagagcgcgtgaag

SEQ ID NO: 311168 - DNA, 27 bp, Artificial Sequence
  Description of Artificial Sequence: Synthetic oligonucleotide
cagtgtcctcacagagcgcgtgaagct

SEQ ID NO: 311169 - DNA, 27 bp, Artificial Sequence
  Description of Artificial Sequence: Synthetic oligonucleotide
agtgtcctcacagagcgcgtgaagctg

SEQ ID NO: 311170 - DNA, 27 bp, Artificial Sequence
  Description of Artificial Sequence: Synthetic oligonucleotide
gtgtcctcacagagcgcgtgaagctgt

SEQ ID NO: 311171 - DNA, 27 bp, Artificial Sequence
  Description of Artificial Sequence: Synthetic oligonucleotide
tgtcctcacagagcgcgtgaagctgtg

SEQ ID NO: 311172 - DNA, 26 bp, Artificial Sequence
  Description of Artificial Sequence: Synthetic oligonucleotide
gtcctcacagagcgcgtgaagctgtg

SEQ ID NO: 311173 - DNA, 27 bp, Artificial Sequence
  Description of Artificial Sequence: Synthetic oligonucleotide
tcctcacagagcgcgtgaagctgtgga

SEQ ID NO: 311174 - DNA, 26 bp, Artificial Sequence
  Description of Artificial Sequence: Synthetic oligonucleotide
cctcacagagcgcgtgaagctgtgga

SEQ ID NO: 311175 - DNA, 26 bp, Artificial Sequence
  Description of Artificial Sequence: Synthetic oligonucleotide
ctcacagagcgcgtgaagctgtggac

SEQ ID NO: 311176 - DNA, 27 bp, Artificial Sequence
  Description of Artificial Sequence: Synthetic oligonucleotide
tcacagagcgcgtgaagctgtggacca

SEQ ID NO: 311177 - DNA, 26 bp, Artificial Sequence
  Description of Artificial Sequence: Synthetic oligonucleotide
cacagagcgcgtgaagctgtggacca

SEQ ID NO: 311178 - DNA, 26 bp, Artificial Sequence
  Description of Artificial Sequence: Synthetic oligonucleotide
acagagcgcgtgaagctgtggaccac

SEQ ID NO: 311179 - DNA, 25 bp, Artificial Sequence
  Description of Artificial Sequence: Synthetic oligonucleotide
cagagcgcgtgaagctgtggaccac

SEQ ID NO: 311180 - DNA, 25 bp, Artificial Sequence
  Description of Artificial Sequence: Synthetic oligonucleotide
agagcgcgtgaagctgtggaccacc

SEQ ID NO: 311181 - DNA, 24 bp, Artificial Sequence
  Description of Artificial Sequence: Synthetic oligonucleotide
gagcgcgtgaagctgtggaccacc

SEQ ID NO: 311182 - DNA, 24 bp, Artificial Sequence
  Description of Artificial Sequence: Synthetic oligonucleotide
agcgcgtgaagctgtggaccaccg

SEQ ID NO: 311183 - DNA, 23 bp, Artificial Sequence
  Description of Artificial Sequence: Synthetic oligonucleotide
gcgcgtgaagctgtggaccaccg

SEQ ID NO: 311184 - DNA, 23 bp, Artificial Sequence
  Description of Artificial Sequence: Synthetic oligonucleotide
cgcgtgaagctgtggaccaccgg

SEQ ID NO: 311185 - DNA, 23 bp, Artificial Sequence
  Description of Artificial Sequence: Synthetic oligonucleotide
gcgtgaagctgtggaccaccggc

SEQ ID NO: 311186 - DNA, 24 bp, Artificial Sequence
  Description of Artificial Sequence: Synthetic oligonucleotide
cgtgaagctgtggaccaccggcca

SEQ ID NO: 311187 - DNA, 24 bp, Artificial Sequence
  Description of Artificial Sequence: Synthetic oligonucleotide
gtgaagctgtggaccaccggccag

SEQ ID NO: 311188 - DNA, 25 bp, Artificial Sequence
  Description of Artificial Sequence: Synthetic oligonucleotide
tgaagctgtggaccaccggccaggt

SEQ ID NO: 311189 - DNA, 24 bp, Artificial Sequence
  Description of Artificial Sequence: Synthetic oligonucleotide
gaagctgtggaccaccggccaggt

SEQ ID NO: 311190 - DNA, 24 bp, Artificial Sequence
  Description of Artificial Sequence: Synthetic oligonucleotide
aagctgtggaccaccggccaggtc

SEQ ID NO: 311191 - DNA, 23 bp, Artificial Sequence
  Description of Artificial Sequence: Synthetic oligonucleotide
agctgtggaccaccggccaggtc

SEQ ID NO: 311192 - DNA, 22 bp, Artificial Sequence
  Description of Artificial Sequence: Synthetic oligonucleotide
gctgtggaccaccggccaggtc

SEQ ID NO: 311193 - DNA, 23 bp, Artificial Sequence
  Description of Artificial Sequence: Synthetic oligonucleotide
ctgtggaccaccggccaggtcga

SEQ ID NO: 311194 - DNA, 23 bp, Artificial Sequence
  Description of Artificial Sequence: Synthetic oligonucleotide
tgtggaccaccggccaggtcgag

SEQ ID NO: 311195 - DNA, 22 bp, Artificial Sequence
  Description of Artificial Sequence: Synthetic oligonucleotide
gtggaccaccggccaggtcgag

SEQ ID NO: 311196 - DNA, 23 bp, Artificial Sequence
  Description of Artificial Sequence: Synthetic oligonucleotide
tggaccaccggccaggtcgagga

SEQ ID NO: 311197 - DNA, 22 bp, Artificial Sequence
  Description of Artificial Sequence: Synthetic oligonucleotide
ggaccaccggccaggtcgagga

SEQ ID NO: 311198 - DNA, 25 bp, Artificial Sequence
  Description of Artificial Sequence: Synthetic oligonucleotide
gaccaccggccaggtcgaggagtat

SEQ ID NO: 311199 - DNA, 26 bp, Artificial Sequence
  Description of Artificial Sequence: Synthetic oligonucleotide
accaccggccaggtcgaggagtatca

SEQ ID NO: 311200 - DNA, 25 bp, Artificial Sequence
  Description of Artificial Sequence: Synthetic oligonucleotide
ccaccggccaggtcgaggagtatca

SEQ ID NO: 311201 - DNA, 25 bp, Artificial Sequence
  Description of Artificial Sequence: Synthetic oligonucleotide
caccggccaggtcgaggagtatcac

SEQ ID NO: 311202 - DNA, 26 bp, Artificial Sequence
  Description of Artificial Sequence: Synthetic oligonucleotide
accggccaggtcgaggagtatcacct

SEQ ID NO: 311203 - DNA, 25 bp, Artificial Sequence
  Description of Artificial Sequence: Synthetic oligonucleotide
ccggccaggtcgaggagtatcacct

SEQ ID NO: 311204 - DNA, 25 bp, Artificial Sequence
  Description of Artificial Sequence: Synthetic oligonucleotide
cggccaggtcgaggagtatcacctg

SEQ ID NO: 311205 - DNA, 27 bp, Artificial Sequence
  Description of Artificial Sequence: Synthetic oligonucleotide
ggccaggtcgaggagtatcacctggat

SEQ ID NO: 311206 - DNA, 27 bp, Artificial Sequence
  Description of Artificial Sequence: Synthetic oligonucleotide
gccaggtcgaggagtatcacctggatg

SEQ ID NO: 311207 - DNA, 27 bp, Artificial Sequence
  Description of Artificial Sequence: Synthetic oligonucleotide
ccaggtcgaggagtatcacctggatgg

SEQ ID NO: 311208 - DNA, 27 bp, Artificial Sequence
  Description of Artificial Sequence: Synthetic oligonucleotide
caggtcgaggagtatcacctggatggc

SEQ ID NO: 311209 - DNA, 27 bp, Artificial Sequence
  Description of Artificial Sequence: Synthetic oligonucleotide
aggtcgaggagtatcacctggatggcg

SEQ ID NO: 311210 - DNA, 27 bp, Artificial Sequence
  Description of Artificial Sequence: Synthetic oligonucleotide
ggtcgaggagtatcacctggatggcga

SEQ ID NO: 311211 - DNA, 27 bp, Artificial Sequence
  Description of Artificial Sequence: Synthetic oligonucleotide
gtcgaggagtatcacctggatggcgac

SEQ ID NO: 311212 - DNA, 27 bp, Artificial Sequence
  Description of Artificial Sequence: Synthetic oligonucleotide
tcgaggagtatcacctggatggcgacg

SEQ ID NO: 311213 - DNA, 27 bp, Artificial Sequence
  Description of Artificial Sequence: Synthetic oligonucleotide
cgaggagtatcacctggatggcgacga

SEQ ID NO: 311214 - DNA, 27 bp, Artificial Sequence
  Description of Artificial Sequence: Synthetic oligonucleotide
gaggagtatcacctggatggcgacgac

SEQ ID NO: 311215 - DNA, 29 bp, Artificial Sequence
  Description of Artificial Sequence: Synthetic oligonucleotide
aggagtatcacctggatggcgacgacatg

SEQ ID NO: 311216 - DNA, 28 bp, Artificial Sequence
  Description of Artificial Sequence: Synthetic oligonucleotide
ggagtatcacctggatggcgacgacatg

SEQ ID NO: 311217 - DNA, 30 bp, Artificial Sequence
  Description of Artificial Sequence: Synthetic oligonucleotide
gagtatcacctggatggcgacgacatgaac

SEQ ID NO: 311218 - DNA, 31 bp, Artificial Sequence
  Description of Artificial Sequence: Synthetic oligonucleotide
agtatcacctggatggcgacgacatgaactc

SEQ ID NO: 311219 - DNA, 30 bp, Artificial Sequence
  Description of Artificial Sequence: Synthetic oligonucleotide
gtatcacctggatggcgacgacatgaactc

SEQ ID NO: 311220 - DNA, 30 bp, Artificial Sequence
  Description of Artificial Sequence: Synthetic oligonucleotide
tatcacctggatggcgacgacatgaactcc

SEQ ID NO: 311221 - DNA, 29 bp, Artificial Sequence
  Description of Artificial Sequence: Synthetic oligonucleotide
atcacctggatggcgacgacatgaactcc

SEQ ID NO: 311222 - DNA, 28 bp, Artificial Sequence
  Description of Artificial Sequence: Synthetic oligonucleotide
tcacctggatggcgacgacatgaactcc

SEQ ID NO: 311223 - DNA, 27 bp, Artificial Sequence
  Description of Artificial Sequence: Synthetic oligonucleotide
cacctggatggcgacgacatgaactcc

SEQ ID NO: 311224 - DNA, 28 bp, Artificial Sequence
  Description of Artificial Sequence: Synthetic oligonucleotide
acctggatggcgacgacatgaactccag

SEQ ID NO: 311225 - DNA, 27 bp, Artificial Sequence
  Description of Artificial Sequence: Synthetic oligonucleotide
cctggatggcgacgacatgaactccag

SEQ ID NO: 311226 - DNA, 27 bp, Artificial Sequence
  Description of Artificial Sequence: Synthetic oligonucleotide
ctggatggcgacgacatgaactccagg

SEQ ID NO: 311227 - DNA, 27 bp, Artificial Sequence
  Description of Artificial Sequence: Synthetic oligonucleotide
tggatggcgacgacatgaactccaggc

SEQ ID NO: 311228 - DNA, 27 bp, Artificial Sequence
  Description of Artificial Sequence: Synthetic oligonucleotide
ggatggcgacgacatgaactccaggct

SEQ ID NO: 311229 - DNA, 27 bp, Artificial Sequence
  Description of Artificial Sequence: Synthetic oligonucleotide
gatggcgacgacatgaactccaggctg

SEQ ID NO: 311230 - DNA, 27 bp, Artificial Sequence
  Description of Artificial Sequence: Synthetic oligonucleotide
atggcgacgacatgaactccaggctgg

SEQ ID NO: 311231 - DNA, 27 bp, Artificial Sequence
  Description of Artificial Sequence: Synthetic oligonucleotide
tggcgacgacatgaactccaggctgga

SEQ ID NO: 311232 - DNA, 26 bp, Artificial Sequence
  Description of Artificial Sequence: Synthetic oligonucleotide
ggcgacgacatgaactccaggctgga

SEQ ID NO: 311233 - DNA, 27 bp, Artificial Sequence
  Description of Artificial Sequence: Synthetic oligonucleotide
gcgacgacatgaactccaggctggaga

SEQ ID NO: 311234 - DNA, 28 bp, Artificial Sequence
  Description of Artificial Sequence: Synthetic oligonucleotide
cgacgacatgaactccaggctggagatg

SEQ ID NO: 311235 - DNA, 30 bp, Artificial Sequence
  Description of Artificial Sequence: Synthetic oligonucleotide
gacgacatgaactccaggctggagatgatg

SEQ ID NO: 311236 - DNA, 30 bp, Artificial Sequence
  Description of Artificial Sequence: Synthetic oligonucleotide
acgacatgaactccaggctggagatgatgc

SEQ ID NO: 311237 - DNA, 29 bp, Artificial Sequence
  Description of Artificial Sequence: Synthetic oligonucleotide
cgacatgaactccaggctggagatgatgc

SEQ ID NO: 311238 - DNA, 29 bp, Artificial Sequence
  Description of Artificial Sequence: Synthetic oligonucleotide
gacatgaactccaggctggagatgatgcc

SEQ ID NO: 311239 - DNA, 29 bp, Artificial Sequence
  Description of Artificial Sequence: Synthetic oligonucleotide
acatgaactccaggctggagatgatgccc

SEQ ID NO: 311240 - DNA, 28 bp, Artificial Sequence
  Description of Artificial Sequence: Synthetic oligonucleotide
catgaactccaggctggagatgatgccc

SEQ ID NO: 311241 - DNA, 33 bp, Artificial Sequence
  Description of Artificial Sequence: Synthetic oligonucleotide
atgaactccaggctggagatgatgcccaaatac

SEQ ID NO: 311242 - DNA, 21 bp, Artificial Sequence
  Description of Artificial Sequence: Synthetic oligonucleotide
atgaccgtcccgcggccgacc

SEQ ID NO: 311243 - DNA, 20 bp, Artificial Sequence
  Description of Artificial Sequence: Synthetic oligonucleotide
tgaccgtcccgcggccgacc

SEQ ID NO: 311244 - DNA, 20 bp, Artificial Sequence
  Description of Artificial Sequence: Synthetic oligonucleotide
gaccgtcccgcggccgacct

SEQ ID NO: 311245 - DNA, 20 bp, Artificial Sequence
  Description of Artificial Sequence: Synthetic oligonucleotide
accgtcccgcggccgaccgt

SEQ ID NO: 311246 - DNA, 20 bp, Artificial Sequence
  Description of Artificial Sequence: Synthetic oligonucleotide
ccgtcccgcggccgaccgtt

SEQ ID NO: 311247 - DNA, 20 bp, Artificial Sequence
  Description of Artificial Sequence: Synthetic oligonucleotide
cgtcccgcggccgaccgtgt

SEQ ID NO: 311248 - DNA, 20 bp, Artificial Sequence
  Description of Artificial Sequence: Synthetic oligonucleotide
gtcccgcggccgaccgtgct

SEQ ID NO: 311249 - DNA, 20 bp, Artificial Sequence
  Description of Artificial Sequence: Synthetic oligonucleotide
tcccgcggccgaccgtgcct

SEQ ID NO: 311250 - DNA, 20 bp, Artificial Sequence
  Description of Artificial Sequence: Synthetic oligonucleotide
cccgcggccgaccgtgcctt

SEQ ID NO: 311251 - DNA, 20 bp, Artificial Sequence
  Description of Artificial Sequence: Synthetic oligonucleotide
ccgcggccgaccgtgccctt

SEQ ID NO: 311252 - DNA, 20 bp, Artificial Sequence
  Description of Artificial Sequence: Synthetic oligonucleotide
cgcggccgaccgtgcccgtt

SEQ ID NO: 311253 - DNA, 20 bp, Artificial Sequence
  Description of Artificial Sequence: Synthetic oligonucleotide
gcggccgaccgtgcccgctt

SEQ ID NO: 311254 - DNA, 20 bp, Artificial Sequence
  Description of Artificial Sequence: Synthetic oligonucleotide
cggccgaccgtgcccgcctt

SEQ ID NO: 311255 - DNA, 20 bp, Artificial Sequence
  Description of Artificial Sequence: Synthetic oligonucleotide
ggccgaccgtgcccgccgtt

SEQ ID NO: 311256 - DNA, 20 bp, Artificial Sequence
  Description of Artificial Sequence: Synthetic oligonucleotide
gccgaccgtgcccgccgctt

SEQ ID NO: 311257 - DNA, 20 bp, Artificial Sequence
  Description of Artificial Sequence: Synthetic oligonucleotide
ccgaccgtgcccgccgcgtt

SEQ ID NO: 311258 - DNA, 20 bp, Artificial Sequence
  Description of Artificial Sequence: Synthetic oligonucleotide
cgaccgtgcccgccgcgctt

SEQ ID NO: 311259 - DNA, 20 bp, Artificial Sequence
  Description of Artificial Sequence: Synthetic oligonucleotide
gaccgtgcccgccgcgctgt

SEQ ID NO: 311260 - DNA, 20 bp, Artificial Sequence
  Description of Artificial Sequence: Synthetic oligonucleotide
accgtgcccgccgcgctgct

SEQ ID NO: 311261 - DNA, 20 bp, Artificial Sequence
  Description of Artificial Sequence: Synthetic oligonucleotide
ccgtgcccgccgcgctgctt

SEQ ID NO: 311262 - DNA, 20 bp, Artificial Sequence
  Description of Artificial Sequence: Synthetic oligonucleotide
cgtgcccgccgcgctgcctt

SEQ ID NO: 311263 - DNA, 20 bp, Artificial Sequence
  Description of Artificial Sequence: Synthetic oligonucleotide
gtgcccgccgcgctgccctt

SEQ ID NO: 311264 - DNA, 20 bp, Artificial Sequence
  Description of Artificial Sequence: Synthetic oligonucleotide
tgcccgccgcgctgcccgtt

SEQ ID NO: 311265 - DNA, 20 bp, Artificial Sequence
  Description of Artificial Sequence: Synthetic oligonucleotide
gcccgccgcgctgcccgttt

SEQ ID NO: 311266 - DNA, 20 bp, Artificial Sequence
  Description of Artificial Sequence: Synthetic oligonucleotide
cccgccgcgctgcccgtctt

SEQ ID NO: 311267 - DNA, 20 bp, Artificial Sequence
  Description of Artificial Sequence: Synthetic oligonucleotide
ccgccgcgctgcccgtcctt

SEQ ID NO: 311268 - DNA, 20 bp, Artificial Sequence
  Description of Artificial Sequence: Synthetic oligonucleotide
cgccgcgctgcccgtcctct

SEQ ID NO: 311269 - DNA, 20 bp, Artificial Sequence
  Description of Artificial Sequence: Synthetic oligonucleotide
gccgcgctgcccgtcctcgt

SEQ ID NO: 311270 - DNA, 20 bp, Artificial Sequence
  Description of Artificial Sequence: Synthetic oligonucleotide
ccgcgctgcccgtcctcggt

SEQ ID NO: 311271 - DNA, 20 bp, Artificial Sequence
  Description of Artificial Sequence: Synthetic oligonucleotide
cgcgctgcccgtcctcgggt

SEQ ID NO: 311272 - DNA, 20 bp, Artificial Sequence
  Description of Artificial Sequence: Synthetic oligonucleotide
gcgctgcccgtcctcggggt

SEQ ID NO: 311273 - DNA, 20 bp, Artificial Sequence
  Description of Artificial Sequence: Synthetic oligonucleotide
cgctgcccgtcctcggggtg

SEQ ID NO: 311274 - DNA, 21 bp, Artificial Sequence
  Description of Artificial Sequence: Synthetic oligonucleotide
gctgcccgtcctcggggtgct

SEQ ID NO: 311275 - DNA, 21 bp, Artificial Sequence
  Description of Artificial Sequence: Synthetic oligonucleotide
ctgcccgtcctcggggtgctg

SEQ ID NO: 311276 - DNA, 21 bp, Artificial Sequence
  Description of Artificial Sequence: Synthetic oligonucleotide
tgcccgtcctcggggtgctgc

SEQ ID NO: 311277 - DNA, 20 bp, Artificial Sequence
  Description of Artificial Sequence: Synthetic oligonucleotide
gcccgtcctcggggtgctgc

SEQ ID NO: 311278 - DNA, 20 bp, Artificial Sequence
  Description of Artificial Sequence: Synthetic oligonucleotide
cccgtcctcggggtgctgcc

SEQ ID NO: 311279 - DNA, 20 bp, Artificial Sequence
  Description of Artificial Sequence: Synthetic oligonucleotide
ccgtcctcggggtgctgccc

SEQ ID NO: 311280 - DNA, 20 bp, Artificial Sequence
  Description of Artificial Sequence: Synthetic oligonucleotide
cgtcctcggggtgctgcccc

SEQ ID NO: 311281 - DNA, 20 bp, Artificial Sequence
  Description of Artificial Sequence: Synthetic oligonucleotide
gtcctcggggtgctgccccg

SEQ ID NO: 311282 - DNA, 20 bp, Artificial Sequence
  Description of Artificial Sequence: Synthetic oligonucleotide
tcctcggggtgctgccccgc

SEQ ID NO: 311283 - DNA, 20 bp, Artificial Sequence
  Description of Artificial Sequence: Synthetic oligonucleotide
cctcggggtgctgccccgct

SEQ ID NO: 311284 - DNA, 20 bp, Artificial Sequence
  Description of Artificial Sequence: Synthetic oligonucleotide
ctcggggtgctgccccgcct

SEQ ID NO: 311285 - DNA, 20 bp, Artificial Sequence
  Description of Artificial Sequence: Synthetic oligonucleotide
tcggggtgctgccccgcctg

SEQ ID NO: 311286 - DNA, 20 bp, Artificial Sequence
  Description of Artificial Sequence: Synthetic oligonucleotide
cggggtgctgccccgcctgt

SEQ ID NO: 311287 - DNA, 20 bp, Artificial Sequence
  Description of Artificial Sequence: Synthetic oligonucleotide
ggggtgctgccccgcctgct

SEQ ID NO: 311288 - DNA, 20 bp, Artificial Sequence
  Description of Artificial Sequence: Synthetic oligonucleotide
gggtgctgccccgcctgctg

SEQ ID NO: 311289 - DNA, 21 bp, Artificial Sequence
  Description of Artificial Sequence: Synthetic oligonucleotide
ggtgctgccccgcctgctgct

SEQ ID NO: 311290 - DNA, 21 bp, Artificial Sequence
  Description of Artificial Sequence: Synthetic oligonucleotide
gtgctgccccgcctgctgctg

SEQ ID NO: 311291 - DNA, 22 bp, Artificial Sequence
  Description of Artificial Sequence: Synthetic oligonucleotide
tgctgccccgcctgctgctggt

SEQ ID NO: 311292 - DNA, 21 bp, Artificial Sequence
  Description of Artificial Sequence: Synthetic oligonucleotide
gctgccccgcctgctgctggt

SEQ ID NO: 311293 - DNA, 21 bp, Artificial Sequence
  Description of Artificial Sequence: Synthetic oligonucleotide
ctgccccgcctgctgctggtg

SEQ ID NO: 311294 - DNA, 22 bp, Artificial Sequence
  Description of Artificial Sequence: Synthetic oligonucleotide
tgccccgcctgctgctggtggt

SEQ ID NO: 311295 - DNA, 21 bp, Artificial Sequence
  Description of Artificial Sequence: Synthetic oligonucleotide
gccccgcctgctgctggtggt

SEQ ID NO: 311296 - DNA, 21 bp, Artificial Sequence
  Description of Artificial Sequence: Synthetic oligonucleotide
ccccgcctgctgctggtggtg

SEQ ID NO: 311297 - DNA, 22 bp, Artificial Sequence
  Description of Artificial Sequence: Synthetic oligonucleotide
cccgcctgctgctggtggtgct

SEQ ID NO: 311298 - DNA, 24 bp, Artificial Sequence
  Description of Artificial Sequence: Synthetic oligonucleotide
ccgcctgctgctggtggtgctgta

SEQ ID NO: 311299 - DNA, 25 bp, Artificial Sequence
  Description of Artificial Sequence: Synthetic oligonucleotide
cgcctgctgctggtggtgctgtagt

SEQ ID NO: 311300 - DNA, 25 bp, Artificial Sequence
  Description of Artificial Sequence: Synthetic oligonucleotide
gcctgctgctggtggtgctgtagtg

SEQ ID NO: 311301 - DNA, 25 bp, Artificial Sequence
  Description of Artificial Sequence: Synthetic oligonucleotide
cctgctgctggtggtgctgtagtgc

SEQ ID NO: 311302 - DNA, 26 bp, Artificial Sequence
  Description of Artificial Sequence: Synthetic oligonucleotide
ctgctgctggtggtgctgtagtgcct

SEQ ID NO: 311303 - DNA, 26 bp, Artificial Sequence
  Description of Artificial Sequence: Synthetic oligonucleotide
tgctgctggtggtgctgtagtgcctg

SEQ ID NO: 311304 - DNA, 25 bp, Artificial Sequence
  Description of Artificial Sequence: Synthetic oligonucleotide
gctgctggtggtgctgtagtgcctg

SEQ ID NO: 311305 - DNA, 25 bp, Artificial Sequence
  Description of Artificial Sequence: Synthetic oligonucleotide
ctgctggtggtgctgtagtgcctgc

SEQ ID NO: 311306 - DNA, 25 bp, Artificial Sequence
  Description of Artificial Sequence: Synthetic oligonucleotide
tgctggtggtgctgtagtgcctgcc

SEQ ID NO: 311307 - DNA, 24 bp, Artificial Sequence
  Description of Artificial Sequence: Synthetic oligonucleotide
gctggtggtgctgtagtgcctgcc

SEQ ID NO: 311308 - DNA, 24 bp, Artificial Sequence
  Description of Artificial Sequence: Synthetic oligonucleotide
ctggtggtgctgtagtgcctgccc

SEQ ID NO: 311309 - DNA, 24 bp, Artificial Sequence
  Description of Artificial Sequence: Synthetic oligonucleotide
tggtggtgctgtagtgcctgcccg

SEQ ID NO: 311310 - DNA, 23 bp, Artificial Sequence
  Description of Artificial Sequence: Synthetic oligonucleotide
ggtggtgctgtagtgcctgcccg

SEQ ID NO: 311311 - DNA, 23 bp, Artificial Sequence
  Description of Artificial Sequence: Synthetic oligonucleotide
gtggtgctgtagtgcctgcccgc

SEQ ID NO: 311312 - DNA, 23 bp, Artificial Sequence
  Description of Artificial Sequence: Synthetic oligonucleotide
tggtgctgtagtgcctgcccgcc

SEQ ID NO: 311313 - DNA, 22 bp, Artificial Sequence
  Description of Artificial Sequence: Synthetic oligonucleotide
ggtgctgtagtgcctgcccgcc

SEQ ID NO: 311314 - DNA, 23 bp, Artificial Sequence
  Description of Artificial Sequence: Synthetic oligonucleotide
gtgctgtagtgcctgcccgccgt

SEQ ID NO: 311315 - DNA, 24 bp, Artificial Sequence
  Description of Artificial Sequence: Synthetic oligonucleotide
tgctgtagtgcctgcccgccgtgt

SEQ ID NO: 311316 - DNA, 23 bp, Artificial Sequence
  Description of Artificial Sequence: Synthetic oligonucleotide
gctgtagtgcctgcccgccgtgt

SEQ ID NO: 311317 - DNA, 23 bp, Artificial Sequence
  Description of Artificial Sequence: Synthetic oligonucleotide
ctgtagtgcctgcccgccgtgtg

SEQ ID NO: 311318 - DNA, 23 bp, Artificial Sequence
  Description of Artificial Sequence: Synthetic oligonucleotide
tgtagtgcctgcccgccgtgtgg

SEQ ID NO: 311319 - DNA, 22 bp, Artificial Sequence
  Description of Artificial Sequence: Synthetic oligonucleotide
gtagtgcctgcccgccgtgtgg

SEQ ID NO: 311320 - DNA, 22 bp, Artificial Sequence
  Description of Artificial Sequence: Synthetic oligonucleotide
tagtgcctgcccgccgtgtggc

SEQ ID NO: 311321 - DNA, 21 bp, Artificial Sequence
  Description of Artificial Sequence: Synthetic oligonucleotide
agtgcctgcccgccgtgtggc

SEQ ID NO: 311322 - DNA, 20 bp, Artificial Sequence
  Description of Artificial Sequence: Synthetic oligonucleotide
gtgcctgcccgccgtgtggc

SEQ ID NO: 311323 - DNA, 21 bp, Artificial Sequence
  Description of Artificial Sequence: Synthetic oligonucleotide
tgcctgcccgccgtgtggcgt

SEQ ID NO: 311324 - DNA, 20 bp, Artificial Sequence
  Description of Artificial Sequence: Synthetic oligonucleotide
gcctgcccgccgtgtggcgt

SEQ ID NO: 311325 - DNA, 21 bp, Artificial Sequence
  Description of Artificial Sequence: Synthetic oligonucleotide
cctgcccgccgtgtggcgtga

SEQ ID NO: 311326 - DNA, 22 bp, Artificial Sequence
  Description of Artificial Sequence: Synthetic oligonucleotide
ctgcccgccgtgtggcgtgact

SEQ ID NO: 311327 - DNA, 23 bp, Artificial Sequence
  Description of Artificial Sequence: Synthetic oligonucleotide
tgcccgccgtgtggcgtgactgt

SEQ ID NO: 311328 - DNA, 22 bp, Artificial Sequence
  Description of Artificial Sequence: Synthetic oligonucleotide
gcccgccgtgtggcgtgactgt

SEQ ID NO: 311329 - DNA, 22 bp, Artificial Sequence
  Description of Artificial Sequence: Synthetic oligonucleotide
cccgccgtgtggcgtgactgtg

SEQ ID NO: 311330 - DNA, 22 bp, Artificial Sequence
  Description of Artificial Sequence: Synthetic oligonucleotide
ccgccgtgtggcgtgactgtgc

SEQ ID NO: 311331 - DNA, 22 bp, Artificial Sequence
  Description of Artificial Sequence: Synthetic oligonucleotide
cgccgtgtggcgtgactgtgcc

SEQ ID NO: 311332 - DNA, 24 bp, Artificial Sequence
  Description of Artificial Sequence: Synthetic oligonucleotide
gccgtgtggcgtgactgtgccctt

SEQ ID NO: 311333 - DNA, 24 bp, Artificial Sequence
  Description of Artificial Sequence: Synthetic oligonucleotide
ccgtgtggcgtgactgtgcccttc

SEQ ID NO: 311334 - DNA, 24 bp, Artificial Sequence
  Description of Artificial Sequence: Synthetic oligonucleotide
cgtgtggcgtgactgtgcccttcc

SEQ ID NO: 311335 - DNA, 24 bp, Artificial Sequence
  Description of Artificial Sequence: Synthetic oligonucleotide
gtgtggcgtgactgtgcccttccc

SEQ ID NO: 311336 - DNA, 24 bp, Artificial Sequence
  Description of Artificial Sequence: Synthetic oligonucleotide
tgtggcgtgactgtgcccttcccc

SEQ ID NO: 311337 - DNA, 23 bp, Artificial Sequence
  Description of Artificial Sequence: Synthetic oligonucleotide
gtggcgtgactgtgcccttcccc

SEQ ID NO: 311338 - DNA, 24 bp, Artificial Sequence
  Description of Artificial Sequence: Synthetic oligonucleotide
tggcgtgactgtgcccttccccct

SEQ ID NO: 311339 - DNA, 23 bp, Artificial Sequence
  Description of Artificial Sequence: Synthetic oligonucleotide
ggcgtgactgtgcccttccccct

SEQ ID NO: 311340 - DNA, 25 bp, Artificial Sequence
  Description of Artificial Sequence: Synthetic oligonucleotide
gcgtgactgtgcccttccccctgat

SEQ ID NO: 311341 - DNA, 27 bp, Artificial Sequence
  Description of Artificial Sequence: Synthetic oligonucleotide
cgtgactgtgcccttccccctgatgta

SEQ ID NO: 311342 - DNA, 27 bp, Artificial Sequence
  Description of Artificial Sequence: Synthetic oligonucleotide
gtgactgtgcccttccccctgatgtac

SEQ ID NO: 311343 - DNA, 27 bp, Artificial Sequence
  Description of Artificial Sequence: Synthetic oligonucleotide
tgactgtgcccttccccctgatgtacc

SEQ ID NO: 311344 - DNA, 27 bp, Artificial Sequence
  Description of Artificial Sequence: Synthetic oligonucleotide
gactgtgcccttccccctgatgtacct

SEQ ID NO: 311345 - DNA, 30 bp, Artificial Sequence
  Description of Artificial Sequence: Synthetic oligonucleotide
actgtgcccttccccctgatgtaccttatg

SEQ ID NO: 311346 - DNA, 29 bp, Artificial Sequence
  Description of Artificial Sequence: Synthetic oligonucleotide
ctgtgcccttccccctgatgtaccttatg

SEQ ID NO: 311347 - DNA, 29 bp, Artificial Sequence
  Description of Artificial Sequence: Synthetic oligonucleotide
tgtgcccttccccctgatgtaccttatgc

SEQ ID NO: 311348 - DNA, 28 bp, Artificial Sequence
  Description of Artificial Sequence: Synthetic oligonucleotide
gtgcccttccccctgatgtaccttatgc

SEQ ID NO: 311349 - DNA, 28 bp, Artificial Sequence
  Description of Artificial Sequence: Synthetic oligonucleotide
tgcccttccccctgatgtaccttatgcc

SEQ ID NO: 311350 - DNA, 27 bp, Artificial Sequence
  Description of Artificial Sequence: Synthetic oligonucleotide
gcccttccccctgatgtaccttatgcc

SEQ ID NO: 311351 - DNA, 27 bp, Artificial Sequence
  Description of Artificial Sequence: Synthetic oligonucleotide
cccttccccctgatgtaccttatgccc

SEQ ID NO: 311352 - DNA, 28 bp, Artificial Sequence
  Description of Artificial Sequence: Synthetic oligonucleotide
ccttccccctgatgtaccttatgcccag

SEQ ID NO: 311353 - DNA, 28 bp, Artificial Sequence
  Description of Artificial Sequence: Synthetic oligonucleotide
cttccccctgatgtaccttatgcccagc

SEQ ID NO: 311354 - DNA, 28 bp, Artificial Sequence
  Description of Artificial Sequence: Synthetic oligonucleotide
ttccccctgatgtaccttatgcccagcg

SEQ ID NO: 311355 - DNA, 27 bp, Artificial Sequence
  Description of Artificial Sequence: Synthetic oligonucleotide
tccccctgatgtaccttatgcccagcg

SEQ ID NO: 311356 - DNA, 27 bp, Artificial Sequence
  Description of Artificial Sequence: Synthetic oligonucleotide
ccccctgatgtaccttatgcccagcga

SEQ ID NO: 311357 - DNA, 27 bp, Artificial Sequence
  Description of Artificial Sequence: Synthetic oligonucleotide
cccctgatgtaccttatgcccagcgag

SEQ ID NO: 311358 - DNA, 27 bp, Artificial Sequence
  Description of Artificial Sequence: Synthetic oligonucleotide
ccctgatgtaccttatgcccagcgagc

SEQ ID NO: 311359 - DNA, 30 bp, Artificial Sequence
  Description of Artificial Sequence: Synthetic oligonucleotide
cctgatgtaccttatgcccagcgagctttg

SEQ ID NO: 311360 - DNA, 30 bp, Artificial Sequence
  Description of Artificial Sequence: Synthetic oligonucleotide
ctgatgtaccttatgcccagcgagctttgg

SEQ ID NO: 311361 - DNA, 32 bp, Artificial Sequence
  Description of Artificial Sequence: Synthetic oligonucleotide
tgatgtaccttatgcccagcgagctttggatg

SEQ ID NO: 311362 - DNA, 31 bp, Artificial Sequence
  Description of Artificial Sequence: Synthetic oligonucleotide
gatgtaccttatgcccagcgagctttggatg

SEQ ID NO: 311363 - DNA, 31 bp, Artificial Sequence
  Description of Artificial Sequence: Synthetic oligonucleotide
atgtaccttatgcccagcgagctttggatgg

SEQ ID NO: 311364 - DNA, 30 bp, Artificial Sequence
  Description of Artificial Sequence: Synthetic oligonucleotide
tgtaccttatgcccagcgagctttggatgg

SEQ ID NO: 311365 - DNA, 29 bp, Artificial Sequence
  Description of Artificial Sequence: Synthetic oligonucleotide
gtaccttatgcccagcgagctttggatgg

SEQ ID NO: 311366 - DNA, 29 bp, Artificial Sequence
  Description of Artificial Sequence: Synthetic oligonucleotide
taccttatgcccagcgagctttggatggc

SEQ ID NO: 311367 - DNA, 28 bp, Artificial Sequence
  Description of Artificial Sequence: Synthetic oligonucleotide
accttatgcccagcgagctttggatggc

SEQ ID NO: 311368 - DNA, 27 bp, Artificial Sequence
  Description of Artificial Sequence: Synthetic oligonucleotide
ccttatgcccagcgagctttggatggc

SEQ ID NO: 311369 - DNA, 27 bp, Artificial Sequence
  Description of Artificial Sequence: Synthetic oligonucleotide
cttatgcccagcgagctttggatggcc

SEQ ID NO: 311370 - DNA, 27 bp, Artificial Sequence
  Description of Artificial Sequence: Synthetic oligonucleotide
ttatgcccagcgagctttggatggccg

SEQ ID NO: 311371 - DNA, 27 bp, Artificial Sequence
  Description of Artificial Sequence: Synthetic oligonucleotide
tatgcccagcgagctttggatggccgt

SEQ ID NO: 311372 - DNA, 27 bp, Artificial Sequence
  Description of Artificial Sequence: Synthetic oligonucleotide
atgcccagcgagctttggatggccgta

SEQ ID NO: 311373 - DNA, 26 bp, Artificial Sequence
  Description of Artificial Sequence: Synthetic oligonucleotide
tgcccagcgagctttggatggccgta

SEQ ID NO: 311374 - DNA, 25 bp, Artificial Sequence
  Description of Artificial Sequence: Synthetic oligonucleotide
gcccagcgagctttggatggccgta

SEQ ID NO: 311375 - DNA, 27 bp, Artificial Sequence
  Description of Artificial Sequence: Synthetic oligonucleotide
cccagcgagctttggatggccgtacat

SEQ ID NO: 311376 - DNA, 27 bp, Artificial Sequence
  Description of Artificial Sequence: Synthetic oligonucleotide
ccagcgagctttggatggccgtacatg

SEQ ID NO: 311377 - DNA, 31 bp, Artificial Sequence
  Description of Artificial Sequence: Synthetic oligonucleotide
cagcgagctttggatggccgtacatgttttc

SEQ ID NO: 311378 - DNA, 31 bp, Artificial Sequence
  Description of Artificial Sequence: Synthetic oligonucleotide
agcgagctttggatggccgtacatgttttcc

SEQ ID NO: 311379 - DNA, 30 bp, Artificial Sequence
  Description of Artificial Sequence: Synthetic oligonucleotide
gcgagctttggatggccgtacatgttttcc

SEQ ID NO: 311380 - DNA, 30 bp, Artificial Sequence
  Description of Artificial Sequence: Synthetic oligonucleotide
cgagctttggatggccgtacatgttttccc

SEQ ID NO: 311381 - DNA, 30 bp, Artificial Sequence
  Description of Artificial Sequence: Synthetic oligonucleotide
gagctttggatggccgtacatgttttcccg

SEQ ID NO: 311382 - DNA, 31 bp, Artificial Sequence
  Description of Artificial Sequence: Synthetic oligonucleotide
agctttggatggccgtacatgttttcccgtg

SEQ ID NO: 311383 - DNA, 30 bp, Artificial Sequence
  Description of Artificial Sequence: Synthetic oligonucleotide
gctttggatggccgtacatgttttcccgtg

SEQ ID NO: 311384 - DNA, 30 bp, Artificial Sequence
  Description of Artificial Sequence: Synthetic oligonucleotide
ctttggatggccgtacatgttttcccgtgg

SEQ ID NO: 311385 - DNA, 33 bp, Artificial Sequence
  Description of Artificial Sequence: Synthetic oligonucleotide
tttggatggccgtacatgttttcccgtggatac

SEQ ID NO: 311386 - DNA, 32 bp, Artificial Sequence
  Description of Artificial Sequence: Synthetic oligonucleotide
ttggatggccgtacatgttttcccgtggatac

SEQ ID NO: 311387 - DNA, 31 bp, Artificial Sequence
  Description of Artificial Sequence: Synthetic oligonucleotide
tggatggccgtacatgttttcccgtggatac

SEQ ID NO: 311388 - DNA, 30 bp, Artificial Sequence
  Description of Artificial Sequence: Synthetic oligonucleotide
ggatggccgtacatgttttcccgtggatac

SEQ ID NO: 311389 - DNA, 31 bp, Artificial Sequence
  Description of Artificial Sequence: Synthetic oligonucleotide
gatggccgtacatgttttcccgtggatactg

SEQ ID NO: 311390 - DNA, 37 bp, Artificial Sequence
  Description of Artificial Sequence: Synthetic oligonucleotide
atggccgtacatgttttcccgtggatactgttataac

SEQ ID NO: 311391 - DNA, 36 bp, Artificial Sequence
  Description of Artificial Sequence: Synthetic oligonucleotide
tggccgtacatgttttcccgtggatactgttataac

SEQ ID NO: 311392 - DNA, 35 bp, Artificial Sequence
  Description of Artificial Sequence: Synthetic oligonucleotide
ggccgtacatgttttcccgtggatactgttataac

SEQ ID NO: 311393 - DNA, 35 bp, Artificial Sequence
  Description of Artificial Sequence: Synthetic oligonucleotide
gccgtacatgttttcccgtggatactgttataacg

SEQ ID NO: 311394 - DNA, 37 bp, Artificial Sequence
  Description of Artificial Sequence: Synthetic oligonucleotide
ccgtacatgttttcccgtggatactgttataacgtac

SEQ ID NO: 311395 - DNA, 41 bp, Artificial Sequence
  Description of Artificial Sequence: Synthetic oligonucleotide
cgtacatgttttcccgtggatactgttataacgtactaatg

SEQ ID NO: 311396 - DNA, 42 bp, Artificial Sequence
  Description of Artificial Sequence: Synthetic oligonucleotide
gtacatgttttcccgtggatactgttataacgtactaatgtg

SEQ ID NO: 311397 - DNA, 44 bp, Artificial Sequence
  Description of Artificial Sequence: Synthetic oligonucleotide
tacatgttttcccgtggatactgttataacgtactaatgtgaag

SEQ ID NO: 311398 - DNA, 43 bp, Artificial Sequence
  Description of Artificial Sequence: Synthetic oligonucleotide
acatgttttcccgtggatactgttataacgtactaatgtgaag

SEQ ID NO: 311399 - DNA, 42 bp, Artificial Sequence
  Description of Artificial Sequence: Synthetic oligonucleotide
catgttttcccgtggatactgttataacgtactaatgtgaag

SEQ ID NO: 311400 - DNA, 45 bp, Artificial Sequence
  Description of Artificial Sequence: Synthetic oligonucleotide
atgttttcccgtggatactgttataacgtactaatgtgaagtaag

SEQ ID NO: 311401 - DNA, 44 bp, Artificial Sequence
  Description of Artificial Sequence: Synthetic oligonucleotide
tgttttcccgtggatactgttataacgtactaatgtgaagtaag

SEQ ID NO: 311402 - DNA, 43 bp, Artificial Sequence
  Description of Artificial Sequence: Synthetic oligonucleotide
gttttcccgtggatactgttataacgtactaatgtgaagtaag

SEQ ID NO: 311403 - DNA, 43 bp, Artificial Sequence
  Description of Artificial Sequence: Synthetic oligonucleotide
ttttcccgtggatactgttataacgtactaatgtgaagtaagc

SEQ ID NO: 311404 - DNA, 42 bp, Artificial Sequence
  Description of Artificial Sequence: Synthetic oligonucleotide
tttcccgtggatactgttataacgtactaatgtgaagtaagc

SEQ ID NO: 311405 - DNA, 41 bp, Artificial Sequence
  Description of Artificial Sequence: Synthetic oligonucleotide
ttcccgtggatactgttataacgtactaatgtgaagtaagc

SEQ ID NO: 311406 - DNA, 40 bp, Artificial Sequence
  Description of Artificial Sequence: Synthetic oligonucleotide
tcccgtggatactgttataacgtactaatgtgaagtaagc

SEQ ID NO: 311407 - DNA, 39 bp, Artificial Sequence
  Description of Artificial Sequence: Synthetic oligonucleotide
cccgtggatactgttataacgtactaatgtgaagtaagc

SEQ ID NO: 311408 - DNA, 42 bp, Artificial Sequence
  Description of Artificial Sequence: Synthetic oligonucleotide
ccgtggatactgttataacgtactaatgtgaagtaagctttg

SEQ ID NO: 311409 - DNA, 43 bp, Artificial Sequence
  Description of Artificial Sequence: Synthetic oligonucleotide
cgtggatactgttataacgtactaatgtgaagtaagctttgtc

SEQ ID NO: 311410 - DNA, 49 bp, Artificial Sequence
  Description of Artificial Sequence: Synthetic oligonucleotide
gtggatactgttataacgtactaatgtgaagtaagctttgtcaaaattc

SEQ ID NO: 311411 - DNA, 49 bp, Artificial Sequence
  Description of Artificial Sequence: Synthetic oligonucleotide
tggatactgttataacgtactaatgtgaagtaagctttgtcaaaattcc

SEQ ID NO: 311412 - DNA, 48 bp, Artificial Sequence
  Description of Artificial Sequence: Synthetic oligonucleotide
ggatactgttataacgtactaatgtgaagtaagctttgtcaaaattcc

SEQ ID NO: 311413 - DNA, 49 bp, Artificial Sequence
  Description of Artificial Sequence: Synthetic oligonucleotide
gatactgttataacgtactaatgtgaagtaagctttgtcaaaattcctc

SEQ ID NO: 311414 - DNA, 49 bp, Artificial Sequence
  Description of Artificial Sequence: Synthetic oligonucleotide
atactgttataacgtactaatgtgaagtaagctttgtcaaaattcctcg

SEQ ID NO: 311415 - DNA, 48 bp, Artificial Sequence
  Description of Artificial Sequence: Synthetic oligonucleotide
tactgttataacgtactaatgtgaagtaagctttgtcaaaattcctcg

SEQ ID NO: 311416 - DNA, 47 bp, Artificial Sequence
  Description of Artificial Sequence: Synthetic oligonucleotide
actgttataacgtactaatgtgaagtaagctttgtcaaaattcctcg

SEQ ID NO: 311417 - DNA, 46 bp, Artificial Sequence
  Description of Artificial Sequence: Synthetic oligonucleotide
ctgttataacgtactaatgtgaagtaagctttgtcaaaattcctcg

SEQ ID NO: 311418 - DNA, 46 bp, Artificial Sequence
  Description of Artificial Sequence: Synthetic oligonucleotide
tgttataacgtactaatgtgaagtaagctttgtcaaaattcctcgc

SEQ ID NO: 311419 - DNA, 45 bp, Artificial Sequence
  Description of Artificial Sequence: Synthetic oligonucleotide
gttataacgtactaatgtgaagtaagctttgtcaaaattcctcgc

SEQ ID NO: 311420 - DNA, 45 bp, Artificial Sequence
  Description of Artificial Sequence: Synthetic oligonucleotide
ttataacgtactaatgtgaagtaagctttgtcaaaattcctcgcg

SEQ ID NO: 311421 - DNA, 44 bp, Artificial Sequence
  Description of Artificial Sequence: Synthetic oligonucleotide
tataacgtactaatgtgaagtaagctttgtcaaaattcctcgcg

SEQ ID NO: 311422 - DNA, 43 bp, Artificial Sequence
  Description of Artificial Sequence: Synthetic oligonucleotide
ataacgtactaatgtgaagtaagctttgtcaaaattcctcgcg

SEQ ID NO: 311423 - DNA, 42 bp, Artificial Sequence
  Description of Artificial Sequence: Synthetic oligonucleotide
taacgtactaatgtgaagtaagctttgtcaaaattcctcgcg

SEQ ID NO: 311424 - DNA, 41 bp, Artificial Sequence
  Description of Artificial Sequence: Synthetic oligonucleotide
aacgtactaatgtgaagtaagctttgtcaaaattcctcgcg

SEQ ID NO: 311425 - DNA, 40 bp, Artificial Sequence
  Description of Artificial Sequence: Synthetic oligonucleotide
acgtactaatgtgaagtaagctttgtcaaaattcctcgcg

SEQ ID NO: 311426 - DNA, 39 bp, Artificial Sequence
  Description of Artificial Sequence: Synthetic oligonucleotide
cgtactaatgtgaagtaagctttgtcaaaattcctcgcg

SEQ ID NO: 311427 - DNA, 40 bp, Artificial Sequence
  Description of Artificial Sequence: Synthetic oligonucleotide
gtactaatgtgaagtaagctttgtcaaaattcctcgcgag

SEQ ID NO: 311428 - DNA, 42 bp, Artificial Sequence
  Description of Artificial Sequence: Synthetic oligonucleotide
tactaatgtgaagtaagctttgtcaaaattcctcgcgagaag

SEQ ID NO: 311429 - DNA, 41 bp, Artificial Sequence
  Description of Artificial Sequence: Synthetic oligonucleotide
actaatgtgaagtaagctttgtcaaaattcctcgcgagaag

SEQ ID NO: 311430 - DNA, 40 bp, Artificial Sequence
  Description of Artificial Sequence: Synthetic oligonucleotide
ctaatgtgaagtaagctttgtcaaaattcctcgcgagaag

SEQ ID NO: 311431 - DNA, 40 bp, Artificial Sequence
  Description of Artificial Sequence: Synthetic oligonucleotide
taatgtgaagtaagctttgtcaaaattcctcgcgagaagg

SEQ ID NO: 311432 - DNA, 39 bp, Artificial Sequence
  Description of Artificial Sequence: Synthetic oligonucleotide
aatgtgaagtaagctttgtcaaaattcctcgcgagaagg

SEQ ID NO: 311433 - DNA, 38 bp, Artificial Sequence
  Description of Artificial Sequence: Synthetic oligonucleotide
atgtgaagtaagctttgtcaaaattcctcgcgagaagg

SEQ ID NO: 311434 - DNA, 37 bp, Artificial Sequence
  Description of Artificial Sequence: Synthetic oligonucleotide
tgtgaagtaagctttgtcaaaattcctcgcgagaagg

SEQ ID NO: 311435 - DNA, 36 bp, Artificial Sequence
  Description of Artificial Sequence: Synthetic oligonucleotide
gtgaagtaagctttgtcaaaattcctcgcgagaagg

SEQ ID NO: 311436 - DNA, 37 bp, Artificial Sequence
  Description of Artificial Sequence: Synthetic oligonucleotide
tgaagtaagctttgtcaaaattcctcgcgagaaggtc

SEQ ID NO: 311437 - DNA, 36 bp, Artificial Sequence
  Description of Artificial Sequence: Synthetic oligonucleotide
gaagtaagctttgtcaaaattcctcgcgagaaggtc

SEQ ID NO: 311438 - DNA, 37 bp, Artificial Sequence
  Description of Artificial Sequence: Synthetic oligonucleotide
aagtaagctttgtcaaaattcctcgcgagaaggtctc

SEQ ID NO: 311439 - DNA, 36 bp, Artificial Sequence
  Description of Artificial Sequence: Synthetic oligonucleotide
agtaagctttgtcaaaattcctcgcgagaaggtctc

SEQ ID NO: 311440 - DNA, 35 bp, Artificial Sequence
  Description of Artificial Sequence: Synthetic oligonucleotide
gtaagctttgtcaaaattcctcgcgagaaggtctc

SEQ ID NO: 311441 - DNA, 36 bp, Artificial Sequence
  Description of Artificial Sequence: Synthetic oligonucleotide
taagctttgtcaaaattcctcgcgagaaggtctcag

SEQ ID NO: 311442 - DNA, 35 bp, Artificial Sequence
  Description of Artificial Sequence: Synthetic oligonucleotide
aagctttgtcaaaattcctcgcgagaaggtctcag

SEQ ID NO: 311443 - DNA, 34 bp, Artificial Sequence
  Description of Artificial Sequence: Synthetic oligonucleotide
agctttgtcaaaattcctcgcgagaaggtctcag

SEQ ID NO: 311444 - DNA, 33 bp, Artificial Sequence
  Description of Artificial Sequence: Synthetic oligonucleotide
gctttgtcaaaattcctcgcgagaaggtctcag

SEQ ID NO: 311445 - DNA, 34 bp, Artificial Sequence
  Description of Artificial Sequence: Synthetic oligonucleotide
ctttgtcaaaattcctcgcgagaaggtctcagtg

SEQ ID NO: 311446 - DNA, 36 bp, Artificial Sequence
  Description of Artificial Sequence: Synthetic oligonucleotide
tttgtcaaaattcctcgcgagaaggtctcagtgatg

SEQ ID NO: 311447 - DNA, 35 bp, Artificial Sequence
  Description of Artificial Sequence: Synthetic oligonucleotide
ttgtcaaaattcctcgcgagaaggtctcagtgatg

SEQ ID NO: 311448 - DNA, 34 bp, Artificial Sequence
  Description of Artificial Sequence: Synthetic oligonucleotide
tgtcaaaattcctcgcgagaaggtctcagtgatg

SEQ ID NO: 311449 - DNA, 33 bp, Artificial Sequence
  Description of Artificial Sequence: Synthetic oligonucleotide
gtcaaaattcctcgcgagaaggtctcagtgatg

SEQ ID NO: 311450 - DNA, 34 bp, Artificial Sequence
  Description of Artificial Sequence: Synthetic oligonucleotide
tcaaaattcctcgcgagaaggtctcagtgatgtg

SEQ ID NO: 311451 - DNA, 33 bp, Artificial Sequence
  Description of Artificial Sequence: Synthetic oligonucleotide
caaaattcctcgcgagaaggtctcagtgatgtg

SEQ ID NO: 311452 - DNA, 33 bp, Artificial Sequence
  Description of Artificial Sequence: Synthetic oligonucleotide
aaaattcctcgcgagaaggtctcagtgatgtgc

SEQ ID NO: 311453 - DNA, 32 bp, Artificial Sequence
  Description of Artificial Sequence: Synthetic oligonucleotide
aaattcctcgcgagaaggtctcagtgatgtgc

SEQ ID NO: 311454 - DNA, 31 bp, Artificial Sequence
  Description of Artificial Sequence: Synthetic oligonucleotide
aattcctcgcgagaaggtctcagtgatgtgc

SEQ ID NO: 311455 - DNA, 30 bp, Artificial Sequence
  Description of Artificial Sequence: Synthetic oligonucleotide
attcctcgcgagaaggtctcagtgatgtgc

SEQ ID NO: 311456 - DNA, 29 bp, Artificial Sequence
  Description of Artificial Sequence: Synthetic oligonucleotide
ttcctcgcgagaaggtctcagtgatgtgc

SEQ ID NO: 311457 - DNA, 28 bp, Artificial Sequence
  Description of Artificial Sequence: Synthetic oligonucleotide
tcctcgcgagaaggtctcagtgatgtgc

SEQ ID NO: 311458 - DNA, 27 bp, Artificial Sequence
  Description of Artificial Sequence: Synthetic oligonucleotide
cctcgcgagaaggtctcagtgatgtgc

SEQ ID NO: 311459 - DNA, 27 bp, Artificial Sequence
  Description of Artificial Sequence: Synthetic oligonucleotide
ctcgcgagaaggtctcagtgatgtgcc

SEQ ID NO: 311460 - DNA, 31 bp, Artificial Sequence
  Description of Artificial Sequence: Synthetic oligonucleotide
tcgcgagaaggtctcagtgatgtgccttaag

SEQ ID NO: 311461 - DNA, 30 bp, Artificial Sequence
  Description of Artificial Sequence: Synthetic oligonucleotide
cgcgagaaggtctcagtgatgtgccttaag

SEQ ID NO: 311462 - DNA, 30 bp, Artificial Sequence
  Description of Artificial Sequence: Synthetic oligonucleotide
gcgagaaggtctcagtgatgtgccttaagc

SEQ ID NO: 311463 - DNA, 30 bp, Artificial Sequence
  Description of Artificial Sequence: Synthetic oligonucleotide
cgagaaggtctcagtgatgtgccttaagcg

SEQ ID NO: 311464 - DNA, 30 bp, Artificial Sequence
  Description of Artificial Sequence: Synthetic oligonucleotide
gagaaggtctcagtgatgtgccttaagcgc

SEQ ID NO: 311465 - DNA, 31 bp, Artificial Sequence
  Description of Artificial Sequence: Synthetic oligonucleotide
agaaggtctcagtgatgtgccttaagcgcag

SEQ ID NO: 311466 - DNA, 30 bp, Artificial Sequence
  Description of Artificial Sequence: Synthetic oligonucleotide
gaaggtctcagtgatgtgccttaagcgcag

SEQ ID NO: 311467 - DNA, 31 bp, Artificial Sequence
  Description of Artificial Sequence: Synthetic oligonucleotide
aaggtctcagtgatgtgccttaagcgcagtc

SEQ ID NO: 311468 - DNA, 30 bp, Artificial Sequence
  Description of Artificial Sequence: Synthetic oligonucleotide
aggtctcagtgatgtgccttaagcgcagtc

SEQ ID NO: 311469 - DNA, 29 bp, Artificial Sequence
  Description of Artificial Sequence: Synthetic oligonucleotide
ggtctcagtgatgtgccttaagcgcagtc

SEQ ID NO: 311470 - DNA, 32 bp, Artificial Sequence
  Description of Artificial Sequence: Synthetic oligonucleotide
gtctcagtgatgtgccttaagcgcagtcaatc

SEQ ID NO: 311471 - DNA, 32 bp, Artificial Sequence
  Description of Artificial Sequence: Synthetic oligonucleotide
tctcagtgatgtgccttaagcgcagtcaatcg

SEQ ID NO: 311472 - DNA, 31 bp, Artificial Sequence
  Description of Artificial Sequence: Synthetic oligonucleotide
ctcagtgatgtgccttaagcgcagtcaatcg

SEQ ID NO: 311473 - DNA, 32 bp, Artificial Sequence
  Description of Artificial Sequence: Synthetic oligonucleotide
tcagtgatgtgccttaagcgcagtcaatcgtc

SEQ ID NO: 311474 - DNA, 31 bp, Artificial Sequence
  Description of Artificial Sequence: Synthetic oligonucleotide
cagtgatgtgccttaagcgcagtcaatcgtc

SEQ ID NO: 311475 - DNA, 32 bp, Artificial Sequence
  Description of Artificial Sequence: Synthetic oligonucleotide
agtgatgtgccttaagcgcagtcaatcgtcag

SEQ ID NO: 311476 - DNA, 31 bp, Artificial Sequence
  Description of Artificial Sequence: Synthetic oligonucleotide
gtgatgtgccttaagcgcagtcaatcgtcag

SEQ ID NO: 311477 - DNA, 36 bp, Artificial Sequence
  Description of Artificial Sequence: Synthetic oligonucleotide
tgatgtgccttaagcgcagtcaatcgtcagatatag

SEQ ID NO: 311478 - DNA, 35 bp, Artificial Sequence
  Description of Artificial Sequence: Synthetic oligonucleotide
gatgtgccttaagcgcagtcaatcgtcagatatag

SEQ ID NO: 311479 - DNA, 37 bp, Artificial Sequence
  Description of Artificial Sequence: Synthetic oligonucleotide
atgtgccttaagcgcagtcaatcgtcagatatagaag

SEQ ID NO: 311480 - DNA, 36 bp, Artificial Sequence
  Description of Artificial Sequence: Synthetic oligonucleotide
tgtgccttaagcgcagtcaatcgtcagatatagaag

SEQ ID NO: 311481 - DNA, 35 bp, Artificial Sequence
  Description of Artificial Sequence: Synthetic oligonucleotide
gtgccttaagcgcagtcaatcgtcagatatagaag

SEQ ID NO: 311482 - DNA, 36 bp, Artificial Sequence
  Description of Artificial Sequence: Synthetic oligonucleotide
tgccttaagcgcagtcaatcgtcagatatagaagag

SEQ ID NO: 311483 - DNA, 35 bp, Artificial Sequence
  Description of Artificial Sequence: Synthetic oligonucleotide
gccttaagcgcagtcaatcgtcagatatagaagag

SEQ ID NO: 311484 - DNA, 37 bp, Artificial Sequence
  Description of Artificial Sequence: Synthetic oligonucleotide
ccttaagcgcagtcaatcgtcagatatagaagagttc

SEQ ID NO: 311485 - DNA, 38 bp, Artificial Sequence
  Description of Artificial Sequence: Synthetic oligonucleotide
cttaagcgcagtcaatcgtcagatatagaagagttcag

SEQ ID NO: 311486 - DNA, 38 bp, Artificial Sequence
  Description of Artificial Sequence: Synthetic oligonucleotide
ttaagcgcagtcaatcgtcagatatagaagagttcagc

SEQ ID NO: 311487 - DNA, 37 bp, Artificial Sequence
  Description of Artificial Sequence: Synthetic oligonucleotide
taagcgcagtcaatcgtcagatatagaagagttcagc

SEQ ID NO: 311488 - DNA, 36 bp, Artificial Sequence
  Description of Artificial Sequence: Synthetic oligonucleotide
aagcgcagtcaatcgtcagatatagaagagttcagc

SEQ ID NO: 311489 - DNA, 35 bp, Artificial Sequence
  Description of Artificial Sequence: Synthetic oligonucleotide
agcgcagtcaatcgtcagatatagaagagttcagc

SEQ ID NO: 311490 - DNA, 34 bp, Artificial Sequence
  Description of Artificial Sequence: Synthetic oligonucleotide
gcgcagtcaatcgtcagatatagaagagttcagc

SEQ ID NO: 311491 - DNA, 37 bp, Artificial Sequence
  Description of Artificial Sequence: Synthetic oligonucleotide
cgcagtcaatcgtcagatatagaagagttcagcaatc

SEQ ID NO: 311492 - DNA, 37 bp, Artificial Sequence
  Description of Artificial Sequence: Synthetic oligonucleotide
gcagtcaatcgtcagatatagaagagttcagcaatcg

SEQ ID NO: 311493 - DNA, 39 bp, Artificial Sequence
  Description of Artificial Sequence: Synthetic oligonucleotide
cagtcaatcgtcagatatagaagagttcagcaatcgtac

SEQ ID NO: 311494 - DNA, 39 bp, Artificial Sequence
  Description of Artificial Sequence: Synthetic oligonucleotide
agtcaatcgtcagatatagaagagttcagcaatcgtacc

SEQ ID NO: 311495 - DNA, 38 bp, Artificial Sequence
  Description of Artificial Sequence: Synthetic oligonucleotide
gtcaatcgtcagatatagaagagttcagcaatcgtacc

SEQ ID NO: 311496 - DNA, 39 bp, Artificial Sequence
  Description of Artificial Sequence: Synthetic oligonucleotide
tcaatcgtcagatatagaagagttcagcaatcgtacctg

SEQ ID NO: 311497 - DNA, 38 bp, Artificial Sequence
  Description of Artificial Sequence: Synthetic oligonucleotide
caatcgtcagatatagaagagttcagcaatcgtacctg

SEQ ID NO: 311498 - DNA, 38 bp, Artificial Sequence
  Description of Artificial Sequence: Synthetic oligonucleotide
aatcgtcagatatagaagagttcagcaatcgtacctgc

SEQ ID NO: 311499 - DNA, 37 bp, Artificial Sequence
  Description of Artificial Sequence: Synthetic oligonucleotide
atcgtcagatatagaagagttcagcaatcgtacctgc

SEQ ID NO: 311500 - DNA, 36 bp, Artificial Sequence
  Description of Artificial Sequence: Synthetic oligonucleotide
tcgtcagatatagaagagttcagcaatcgtacctgc

SEQ ID NO: 311501 - DNA, 35 bp, Artificial Sequence
  Description of Artificial Sequence: Synthetic oligonucleotide
cgtcagatatagaagagttcagcaatcgtacctgc

SEQ ID NO: 311502 - DNA, 35 bp, Artificial Sequence
  Description of Artificial Sequence: Synthetic oligonucleotide
gtcagatatagaagagttcagcaatcgtacctgcg

SEQ ID NO: 311503 - DNA, 36 bp, Artificial Sequence
  Description of Artificial Sequence: Synthetic oligonucleotide
tcagatatagaagagttcagcaatcgtacctgcgag

SEQ ID NO: 311504 - DNA, 35 bp, Artificial Sequence
  Description of Artificial Sequence: Synthetic oligonucleotide
cagatatagaagagttcagcaatcgtacctgcgag

SEQ ID NO: 311505 - DNA, 35 bp, Artificial Sequence
  Description of Artificial Sequence: Synthetic oligonucleotide
agatatagaagagttcagcaatcgtacctgcgagg

SEQ ID NO: 311506 - DNA, 34 bp, Artificial Sequence
  Description of Artificial Sequence: Synthetic oligonucleotide
gatatagaagagttcagcaatcgtacctgcgagg

SEQ ID NO: 311507 - DNA, 35 bp, Artificial Sequence
  Description of Artificial Sequence: Synthetic oligonucleotide
atatagaagagttcagcaatcgtacctgcgaggtc

SEQ ID NO: 311508 - DNA, 34 bp, Artificial Sequence
  Description of Artificial Sequence: Synthetic oligonucleotide
tatagaagagttcagcaatcgtacctgcgaggtc

SEQ ID NO: 311509 - DNA, 33 bp, Artificial Sequence
  Description of Artificial Sequence: Synthetic oligonucleotide
atagaagagttcagcaatcgtacctgcgaggtc

SEQ ID NO: 311510 - DNA, 32 bp, Artificial Sequence
  Description of Artificial Sequence: Synthetic oligonucleotide
tagaagagttcagcaatcgtacctgcgaggtc

SEQ ID NO: 311511 - DNA, 31 bp, Artificial Sequence
  Description of Artificial Sequence: Synthetic oligonucleotide
agaagagttcagcaatcgtacctgcgaggtc

SEQ ID NO: 311512 - DNA, 30 bp, Artificial Sequence
  Description of Artificial Sequence: Synthetic oligonucleotide
gaagagttcagcaatcgtacctgcgaggtc

SEQ ID NO: 311513 - DNA, 30 bp, Artificial Sequence
  Description of Artificial Sequence: Synthetic oligonucleotide
aagagttcagcaatcgtacctgcgaggtcc

SEQ ID NO: 311514 - DNA, 29 bp, Artificial Sequence
  Description of Artificial Sequence: Synthetic oligonucleotide
agagttcagcaatcgtacctgcgaggtcc

SEQ ID NO: 311515 - DNA, 28 bp, Artificial Sequence
  Description of Artificial Sequence: Synthetic oligonucleotide
gagttcagcaatcgtacctgcgaggtcc

SEQ ID NO: 311516 - DNA, 28 bp, Artificial Sequence
  Description of Artificial Sequence: Synthetic oligonucleotide
agttcagcaatcgtacctgcgaggtccc

SEQ ID NO: 311517 - DNA, 27 bp, Artificial Sequence
  Description of Artificial Sequence: Synthetic oligonucleotide
gttcagcaatcgtacctgcgaggtccc

SEQ ID NO: 311518 - DNA, 29 bp, Artificial Sequence
  Description of Artificial Sequence: Synthetic oligonucleotide
ttcagcaatcgtacctgcgaggtcccaac

SEQ ID NO: 311519 - DNA, 28 bp, Artificial Sequence
  Description of Artificial Sequence: Synthetic oligonucleotide
tcagcaatcgtacctgcgaggtcccaac

SEQ ID NO: 311520 - DNA, 27 bp, Artificial Sequence
  Description of Artificial Sequence: Synthetic oligonucleotide
cagcaatcgtacctgcgaggtcccaac

SEQ ID NO: 311521 - DNA, 29 bp, Artificial Sequence
  Description of Artificial Sequence: Synthetic oligonucleotide
agcaatcgtacctgcgaggtcccaacaag

SEQ ID NO: 311522 - DNA, 28 bp, Artificial Sequence
  Description of Artificial Sequence: Synthetic oligonucleotide
gcaatcgtacctgcgaggtcccaacaag

SEQ ID NO: 311523 - DNA, 28 bp, Artificial Sequence
  Description of Artificial Sequence: Synthetic oligonucleotide
caatcgtacctgcgaggtcccaacaagg

SEQ ID NO: 311524 - DNA, 28 bp, Artificial Sequence
  Description of Artificial Sequence: Synthetic oligonucleotide
aatcgtacctgcgaggtcccaacaaggg

SEQ ID NO: 311525 - DNA, 27 bp, Artificial Sequence
  Description of Artificial Sequence: Synthetic oligonucleotide
atcgtacctgcgaggtcccaacaaggg

SEQ ID NO: 311526 - DNA, 27 bp, Artificial Sequence
  Description of Artificial Sequence: Synthetic oligonucleotide
tcgtacctgcgaggtcccaacaagggt

SEQ ID NO: 311527 - DNA, 27 bp, Artificial Sequence
  Description of Artificial Sequence: Synthetic oligonucleotide
cgtacctgcgaggtcccaacaagggta

SEQ ID NO: 311528 - DNA, 31 bp, Artificial Sequence
  Description of Artificial Sequence: Synthetic oligonucleotide
gtacctgcgaggtcccaacaagggtaaattc

SEQ ID NO: 311529 - DNA, 32 bp, Artificial Sequence
  Description of Artificial Sequence: Synthetic oligonucleotide
tacctgcgaggtcccaacaagggtaaattctg

SEQ ID NO: 311530 - DNA, 31 bp, Artificial Sequence
  Description of Artificial Sequence: Synthetic oligonucleotide
acctgcgaggtcccaacaagggtaaattctg

SEQ ID NO: 311531 - DNA, 30 bp, Artificial Sequence
  Description of Artificial Sequence: Synthetic oligonucleotide
cctgcgaggtcccaacaagggtaaattctg

SEQ ID NO: 311532 - DNA, 30 bp, Artificial Sequence
  Description of Artificial Sequence: Synthetic oligonucleotide
ctgcgaggtcccaacaagggtaaattctgg

SEQ ID NO: 311533 - DNA, 32 bp, Artificial Sequence
  Description of Artificial Sequence: Synthetic oligonucleotide
tgcgaggtcccaacaagggtaaattctggatc

SEQ ID NO: 311534 - DNA, 31 bp, Artificial Sequence
  Description of Artificial Sequence: Synthetic oligonucleotide
gcgaggtcccaacaagggtaaattctggatc

SEQ ID NO: 311535 - DNA, 31 bp, Artificial Sequence
  Description of Artificial Sequence: Synthetic oligonucleotide
cgaggtcccaacaagggtaaattctggatcc

SEQ ID NO: 311536 - DNA, 31 bp, Artificial Sequence
  Description of Artificial Sequence: Synthetic oligonucleotide
gaggtcccaacaagggtaaattctggatccc

SEQ ID NO: 311537 - DNA, 32 bp, Artificial Sequence
  Description of Artificial Sequence: Synthetic oligonucleotide
aggtcccaacaagggtaaattctggatccctc

SEQ ID NO: 311538 - DNA, 31 bp, Artificial Sequence
  Description of Artificial Sequence: Synthetic oligonucleotide
ggtcccaacaagggtaaattctggatccctc

SEQ ID NO: 311539 - DNA, 34 bp, Artificial Sequence
  Description of Artificial Sequence: Synthetic oligonucleotide
gtcccaacaagggtaaattctggatccctcaatc

SEQ ID NO: 311540 - DNA, 35 bp, Artificial Sequence
  Description of Artificial Sequence: Synthetic oligonucleotide
tcccaacaagggtaaattctggatccctcaatcag

SEQ ID NO: 311541 - DNA, 34 bp, Artificial Sequence
  Description of Artificial Sequence: Synthetic oligonucleotide
cccaacaagggtaaattctggatccctcaatcag

SEQ ID NO: 311542 - DNA, 34 bp, Artificial Sequence
  Description of Artificial Sequence: Synthetic oligonucleotide
ccaacaagggtaaattctggatccctcaatcagc

SEQ ID NO: 311543 - DNA, 34 bp, Artificial Sequence
  Description of Artificial Sequence: Synthetic oligonucleotide
caacaagggtaaattctggatccctcaatcagcc

SEQ ID NO: 311544 - DNA, 40 bp, Artificial Sequence
  Description of Artificial Sequence: Synthetic oligonucleotide
aacaagggtaaattctggatccctcaatcagccttatttc

SEQ ID NO: 311545 - DNA, 39 bp, Artificial Sequence
  Description of Artificial Sequence: Synthetic oligonucleotide
acaagggtaaattctggatccctcaatcagccttatttc

SEQ ID NO: 311546 - DNA, 38 bp, Artificial Sequence
  Description of Artificial Sequence: Synthetic oligonucleotide
caagggtaaattctggatccctcaatcagccttatttc

SEQ ID NO: 311547 - DNA, 39 bp, Artificial Sequence
  Description of Artificial Sequence: Synthetic oligonucleotide
aagggtaaattctggatccctcaatcagccttatttcac

SEQ ID NO: 311548 - DNA, 38 bp, Artificial Sequence
  Description of Artificial Sequence: Synthetic oligonucleotide
agggtaaattctggatccctcaatcagccttatttcac

SEQ ID NO: 311549 - DNA, 37 bp, Artificial Sequence
  Description of Artificial Sequence: Synthetic oligonucleotide
gggtaaattctggatccctcaatcagccttatttcac

SEQ ID NO: 311550 - DNA, 38 bp, Artificial Sequence
  Description of Artificial Sequence: Synthetic oligonucleotide
ggtaaattctggatccctcaatcagccttatttcactc

SEQ ID NO: 311551 - DNA, 39 bp, Artificial Sequence
  Description of Artificial Sequence: Synthetic oligonucleotide
gtaaattctggatccctcaatcagccttatttcactcag

SEQ ID NO: 311552 - DNA, 48 bp, Artificial Sequence
  Description of Artificial Sequence: Synthetic oligonucleotide
taaattctggatccctcaatcagccttatttcactcagatttattttc

SEQ ID NO: 311553 - DNA, 47 bp, Artificial Sequence
  Description of Artificial Sequence: Synthetic oligonucleotide
aaattctggatccctcaatcagccttatttcactcagatttattttc

SEQ ID NO: 311554 - DNA, 46 bp, Artificial Sequence
  Description of Artificial Sequence: Synthetic oligonucleotide
aattctggatccctcaatcagccttatttcactcagatttattttc

SEQ ID NO: 311555 - DNA, 45 bp, Artificial Sequence
  Description of Artificial Sequence: Synthetic oligonucleotide
attctggatccctcaatcagccttatttcactcagatttattttc

SEQ ID NO: 311556 - DNA, 44 bp, Artificial Sequence
  Description of Artificial Sequence: Synthetic oligonucleotide
ttctggatccctcaatcagccttatttcactcagatttattttc

SEQ ID NO: 311557 - DNA, 43 bp, Artificial Sequence
  Description of Artificial Sequence: Synthetic oligonucleotide
tctggatccctcaatcagccttatttcactcagatttattttc

SEQ ID NO: 311558 - DNA, 42 bp, Artificial Sequence
  Description of Artificial Sequence: Synthetic oligonucleotide
ctggatccctcaatcagccttatttcactcagatttattttc

SEQ ID NO: 311559 - DNA, 42 bp, Artificial Sequence
  Description of Artificial Sequence: Synthetic oligonucleotide
tggatccctcaatcagccttatttcactcagatttattttcc

SEQ ID NO: 311560 - DNA, 41 bp, Artificial Sequence
  Description of Artificial Sequence: Synthetic oligonucleotide
ggatccctcaatcagccttatttcactcagatttattttcc

SEQ ID NO: 311561 - DNA, 42 bp, Artificial Sequence
  Description of Artificial Sequence: Synthetic oligonucleotide
gatccctcaatcagccttatttcactcagatttattttcctg

SEQ ID NO: 311562 - DNA, 43 bp, Artificial Sequence
  Description of Artificial Sequence: Synthetic oligonucleotide
atccctcaatcagccttatttcactcagatttattttcctgtc

SEQ ID NO: 311563 - DNA, 42 bp, Artificial Sequence
  Description of Artificial Sequence: Synthetic oligonucleotide
tccctcaatcagccttatttcactcagatttattttcctgtc

SEQ ID NO: 311564 - DNA, 41 bp, Artificial Sequence
  Description of Artificial Sequence: Synthetic oligonucleotide
ccctcaatcagccttatttcactcagatttattttcctgtc

SEQ ID NO: 311565 - DNA, 41 bp, Artificial Sequence
  Description of Artificial Sequence: Synthetic oligonucleotide
cctcaatcagccttatttcactcagatttattttcctgtcg

SEQ ID NO: 311566 - DNA, 41 bp, Artificial Sequence
  Description of Artificial Sequence: Synthetic oligonucleotide
ctcaatcagccttatttcactcagatttattttcctgtcgg

SEQ ID NO: 311567 - DNA, 43 bp, Artificial Sequence
  Description of Artificial Sequence: Synthetic oligonucleotide
tcaatcagccttatttcactcagatttattttcctgtcggtac

SEQ ID NO: 311568 - DNA, 42 bp, Artificial Sequence
  Description of Artificial Sequence: Synthetic oligonucleotide
caatcagccttatttcactcagatttattttcctgtcggtac

SEQ ID NO: 311569 - DNA, 43 bp, Artificial Sequence
  Description of Artificial Sequence: Synthetic oligonucleotide
aatcagccttatttcactcagatttattttcctgtcggtactc

SEQ ID NO: 311570 - DNA, 42 bp, Artificial Sequence
  Description of Artificial Sequence: Synthetic oligonucleotide
atcagccttatttcactcagatttattttcctgtcggtactc

SEQ ID NO: 311571 - DNA, 41 bp, Artificial Sequence
  Description of Artificial Sequence: Synthetic oligonucleotide
tcagccttatttcactcagatttattttcctgtcggtactc

SEQ ID NO: 311572 - DNA, 40 bp, Artificial Sequence
  Description of Artificial Sequence: Synthetic oligonucleotide
cagccttatttcactcagatttattttcctgtcggtactc

SEQ ID NO: 311573 - DNA, 42 bp, Artificial Sequence
  Description of Artificial Sequence: Synthetic oligonucleotide
agccttatttcactcagatttattttcctgtcggtactcttg

SEQ ID NO: 311574 - DNA, 41 bp, Artificial Sequence
  Description of Artificial Sequence: Synthetic oligonucleotide
gccttatttcactcagatttattttcctgtcggtactcttg

SEQ ID NO: 311575 - DNA, 42 bp, Artificial Sequence
  Description of Artificial Sequence: Synthetic oligonucleotide
ccttatttcactcagatttattttcctgtcggtactcttgtg

SEQ ID NO: 311576 - DNA, 42 bp, Artificial Sequence
  Description of Artificial Sequence: Synthetic oligonucleotide
cttatttcactcagatttattttcctgtcggtactcttgtgg

SEQ ID NO: 311577 - DNA, 47 bp, Artificial Sequence
  Description of Artificial Sequence: Synthetic oligonucleotide
ttatttcactcagatttattttcctgtcggtactcttgtggaatttg

SEQ ID NO: 311578 - DNA, 46 bp, Artificial Sequence
  Description of Artificial Sequence: Synthetic oligonucleotide
tatttcactcagatttattttcctgtcggtactcttgtggaatttg

SEQ ID NO: 311579 - DNA, 45 bp, Artificial Sequence
  Description of Artificial Sequence: Synthetic oligonucleotide
atttcactcagatttattttcctgtcggtactcttgtggaatttg

SEQ ID NO: 311580 - DNA, 44 bp, Artificial Sequence
  Description of Artificial Sequence: Synthetic oligonucleotide
tttcactcagatttattttcctgtcggtactcttgtggaatttg

SEQ ID NO: 311581 - DNA, 43 bp, Artificial Sequence
  Description of Artificial Sequence: Synthetic oligonucleotide
ttcactcagatttattttcctgtcggtactcttgtggaatttg

SEQ ID NO: 311582 - DNA, 42 bp, Artificial Sequence
  Description of Artificial Sequence: Synthetic oligonucleotide
tcactcagatttattttcctgtcggtactcttgtggaatttg

SEQ ID NO: 311583 - DNA, 41 bp, Artificial Sequence
  Description of Artificial Sequence: Synthetic oligonucleotide
cactcagatttattttcctgtcggtactcttgtggaatttg

SEQ ID NO: 311584 - DNA, 42 bp, Artificial Sequence
  Description of Artificial Sequence: Synthetic oligonucleotide
actcagatttattttcctgtcggtactcttgtggaatttgag

SEQ ID NO: 311585 - DNA, 41 bp, Artificial Sequence
  Description of Artificial Sequence: Synthetic oligonucleotide
ctcagatttattttcctgtcggtactcttgtggaatttgag

SEQ ID NO: 311586 - DNA, 42 bp, Artificial Sequence
  Description of Artificial Sequence: Synthetic oligonucleotide
tcagatttattttcctgtcggtactcttgtggaatttgagtg

SEQ ID NO: 311587 - DNA, 41 bp, Artificial Sequence
  Description of Artificial Sequence: Synthetic oligonucleotide
cagatttattttcctgtcggtactcttgtggaatttgagtg

SEQ ID NO: 311588 - DNA, 41 bp, Artificial Sequence
  Description of Artificial Sequence: Synthetic oligonucleotide
agatttattttcctgtcggtactcttgtggaatttgagtgc

SEQ ID NO: 311589 - DNA, 40 bp, Artificial Sequence
  Description of Artificial Sequence: Synthetic oligonucleotide
gatttattttcctgtcggtactcttgtggaatttgagtgc

SEQ ID NO: 311590 - DNA, 40 bp, Artificial Sequence
  Description of Artificial Sequence: Synthetic oligonucleotide
atttattttcctgtcggtactcttgtggaatttgagtgcc

SEQ ID NO: 311591 - DNA, 39 bp, Artificial Sequence
  Description of Artificial Sequence: Synthetic oligonucleotide
tttattttcctgtcggtactcttgtggaatttgagtgcc

SEQ ID NO: 311592 - DNA, 38 bp, Artificial Sequence
  Description of Artificial Sequence: Synthetic oligonucleotide
ttattttcctgtcggtactcttgtggaatttgagtgcc

SEQ ID NO: 311593 - DNA, 37 bp, Artificial Sequence
  Description of Artificial Sequence: Synthetic oligonucleotide
tattttcctgtcggtactcttgtggaatttgagtgcc

SEQ ID NO: 311594 - DNA, 36 bp, Artificial Sequence
  Description of Artificial Sequence: Synthetic oligonucleotide
attttcctgtcggtactcttgtggaatttgagtgcc

SEQ ID NO: 311595 - DNA, 35 bp, Artificial Sequence
  Description of Artificial Sequence: Synthetic oligonucleotide
ttttcctgtcggtactcttgtggaatttgagtgcc

SEQ ID NO: 311596 - DNA, 34 bp, Artificial Sequence
  Description of Artificial Sequence: Synthetic oligonucleotide
tttcctgtcggtactcttgtggaatttgagtgcc

SEQ ID NO: 311597 - DNA, 33 bp, Artificial Sequence
  Description of Artificial Sequence: Synthetic oligonucleotide
ttcctgtcggtactcttgtggaatttgagtgcc

SEQ ID NO: 311598 - DNA, 32 bp, Artificial Sequence
  Description of Artificial Sequence: Synthetic oligonucleotide
tcctgtcggtactcttgtggaatttgagtgcc

SEQ ID NO: 311599 - DNA, 31 bp, Artificial Sequence
  Description of Artificial Sequence: Synthetic oligonucleotide
cctgtcggtactcttgtggaatttgagtgcc

SEQ ID NO: 311600 - DNA, 31 bp, Artificial Sequence
  Description of Artificial Sequence: Synthetic oligonucleotide
ctgtcggtactcttgtggaatttgagtgccg

SEQ ID NO: 311601 - DNA, 32 bp, Artificial Sequence
  Description of Artificial Sequence: Synthetic oligonucleotide
tgtcggtactcttgtggaatttgagtgccgac

SEQ ID NO: 311602 - DNA, 31 bp, Artificial Sequence
  Description of Artificial Sequence: Synthetic oligonucleotide
gtcggtactcttgtggaatttgagtgccgac

SEQ ID NO: 311603 - DNA, 31 bp, Artificial Sequence
  Description of Artificial Sequence: Synthetic oligonucleotide
tcggtactcttgtggaatttgagtgccgacc

SEQ ID NO: 311604 - DNA, 30 bp, Artificial Sequence
  Description of Artificial Sequence: Synthetic oligonucleotide
cggtactcttgtggaatttgagtgccgacc

SEQ ID NO: 311605 - DNA, 31 bp, Artificial Sequence
  Description of Artificial Sequence: Synthetic oligonucleotide
ggtactcttgtggaatttgagtgccgaccag

SEQ ID NO: 311606 - DNA, 31 bp, Artificial Sequence
  Description of Artificial Sequence: Synthetic oligonucleotide
gtactcttgtggaatttgagtgccgaccagg

SEQ ID NO: 311607 - DNA, 34 bp, Artificial Sequence
  Description of Artificial Sequence: Synthetic oligonucleotide
tactcttgtggaatttgagtgccgaccaggttac

SEQ ID NO: 311608 - DNA, 33 bp, Artificial Sequence
  Description of Artificial Sequence: Synthetic oligonucleotide
actcttgtggaatttgagtgccgaccaggttac

SEQ ID NO: 311609 - DNA, 32 bp, Artificial Sequence
  Description of Artificial Sequence: Synthetic oligonucleotide
ctcttgtggaatttgagtgccgaccaggttac

SEQ ID NO: 311610 - DNA, 33 bp, Artificial Sequence
  Description of Artificial Sequence: Synthetic oligonucleotide
tcttgtggaatttgagtgccgaccaggttactg

SEQ ID NO: 311611 - DNA, 32 bp, Artificial Sequence
  Description of Artificial Sequence: Synthetic oligonucleotide
cttgtggaatttgagtgccgaccaggttactg

SEQ ID NO: 311612 - DNA, 34 bp, Artificial Sequence
  Description of Artificial Sequence: Synthetic oligonucleotide
ttgtggaatttgagtgccgaccaggttactgaag

SEQ ID NO: 311613 - DNA, 33 bp, Artificial Sequence
  Description of Artificial Sequence: Synthetic oligonucleotide
tgtggaatttgagtgccgaccaggttactgaag

SEQ ID NO: 311614 - DNA, 32 bp, Artificial Sequence
  Description of Artificial Sequence: Synthetic oligonucleotide
gtggaatttgagtgccgaccaggttactgaag

SEQ ID NO: 311615 - DNA, 33 bp, Artificial Sequence
  Description of Artificial Sequence: Synthetic oligonucleotide
tggaatttgagtgccgaccaggttactgaagag

SEQ ID NO: 311616 - DNA, 32 bp, Artificial Sequence
  Description of Artificial Sequence: Synthetic oligonucleotide
ggaatttgagtgccgaccaggttactgaagag

SEQ ID NO: 311617 - DNA, 34 bp, Artificial Sequence
  Description of Artificial Sequence: Synthetic oligonucleotide
gaatttgagtgccgaccaggttactgaagagaac

SEQ ID NO: 311618 - DNA, 34 bp, Artificial Sequence
  Description of Artificial Sequence: Synthetic oligonucleotide
aatttgagtgccgaccaggttactgaagagaacg

SEQ ID NO: 311619 - DNA, 33 bp, Artificial Sequence
  Description of Artificial Sequence: Synthetic oligonucleotide
atttgagtgccgaccaggttactgaagagaacg

SEQ ID NO: 311620 - DNA, 32 bp, Artificial Sequence
  Description of Artificial Sequence: Synthetic oligonucleotide
tttgagtgccgaccaggttactgaagagaacg

SEQ ID NO: 311621 - DNA, 31 bp, Artificial Sequence
  Description of Artificial Sequence: Synthetic oligonucleotide
ttgagtgccgaccaggttactgaagagaacg

SEQ ID NO: 311622 - DNA, 30 bp, Artificial Sequence
  Description of Artificial Sequence: Synthetic oligonucleotide
tgagtgccgaccaggttactgaagagaacg

SEQ ID NO: 311623 - DNA, 29 bp, Artificial Sequence
  Description of Artificial Sequence: Synthetic oligonucleotide
gagtgccgaccaggttactgaagagaacg

SEQ ID NO: 311624 - DNA, 31 bp, Artificial Sequence
  Description of Artificial Sequence: Synthetic oligonucleotide
agtgccgaccaggttactgaagagaacgttc

SEQ ID NO: 311625 - DNA, 30 bp, Artificial Sequence
  Description of Artificial Sequence: Synthetic oligonucleotide
gtgccgaccaggttactgaagagaacgttc

SEQ ID NO: 311626 - DNA, 31 bp, Artificial Sequence
  Description of Artificial Sequence: Synthetic oligonucleotide
tgccgaccaggttactgaagagaacgttctc

SEQ ID NO: 311627 - DNA, 30 bp, Artificial Sequence
  Description of Artificial Sequence: Synthetic oligonucleotide
gccgaccaggttactgaagagaacgttctc

SEQ ID NO: 311628 - DNA, 33 bp, Artificial Sequence
  Description of Artificial Sequence: Synthetic oligonucleotide
ccgaccaggttactgaagagaacgttctctatc

SEQ ID NO: 311629 - DNA, 34 bp, Artificial Sequence
  Description of Artificial Sequence: Synthetic oligonucleotide
cgaccaggttactgaagagaacgttctctatctc

SEQ ID NO: 311630 - DNA, 34 bp, Artificial Sequence
  Description of Artificial Sequence: Synthetic oligonucleotide
gaccaggttactgaagagaacgttctctatctcc

SEQ ID NO: 311631 - DNA, 38 bp, Artificial Sequence
  Description of Artificial Sequence: Synthetic oligonucleotide
accaggttactgaagagaacgttctctatctccaaaac

SEQ ID NO: 311632 - DNA, 37 bp, Artificial Sequence
  Description of Artificial Sequence: Synthetic oligonucleotide
ccaggttactgaagagaacgttctctatctccaaaac

SEQ ID NO: 311633 - DNA, 40 bp, Artificial Sequence
  Description of Artificial Sequence: Synthetic oligonucleotide
caggttactgaagagaacgttctctatctccaaaactatc

SEQ ID NO: 311634 - DNA, 42 bp, Artificial Sequence
  Description of Artificial Sequence: Synthetic oligonucleotide
aggttactgaagagaacgttctctatctccaaaactatcttg

SEQ ID NO: 311635 - DNA, 41 bp, Artificial Sequence
  Description of Artificial Sequence: Synthetic oligonucleotide
ggttactgaagagaacgttctctatctccaaaactatcttg

SEQ ID NO: 311636 - DNA, 41 bp, Artificial Sequence
  Description of Artificial Sequence: Synthetic oligonucleotide
gttactgaagagaacgttctctatctccaaaactatcttgc

SEQ ID NO: 311637 - DNA, 41 bp, Artificial Sequence
  Description of Artificial Sequence: Synthetic oligonucleotide
ttactgaagagaacgttctctatctccaaaactatcttgcc

SEQ ID NO: 311638 - DNA, 40 bp, Artificial Sequence
  Description of Artificial Sequence: Synthetic oligonucleotide
tactgaagagaacgttctctatctccaaaactatcttgcc

SEQ ID NO: 311639 - DNA, 39 bp, Artificial Sequence
  Description of Artificial Sequence: Synthetic oligonucleotide
actgaagagaacgttctctatctccaaaactatcttgcc

SEQ ID NO: 311640 - DNA, 38 bp, Artificial Sequence
  Description of Artificial Sequence: Synthetic oligonucleotide
ctgaagagaacgttctctatctccaaaactatcttgcc

SEQ ID NO: 311641 - DNA, 40 bp, Artificial Sequence
  Description of Artificial Sequence: Synthetic oligonucleotide
tgaagagaacgttctctatctccaaaactatcttgccttc

SEQ ID NO: 311642 - DNA, 39 bp, Artificial Sequence
  Description of Artificial Sequence: Synthetic oligonucleotide
gaagagaacgttctctatctccaaaactatcttgccttc

SEQ ID NO: 311643 - DNA, 40 bp, Artificial Sequence
  Description of Artificial Sequence: Synthetic oligonucleotide
aagagaacgttctctatctccaaaactatcttgccttctg

SEQ ID NO: 311644 - DNA, 39 bp, Artificial Sequence
  Description of Artificial Sequence: Synthetic oligonucleotide
agagaacgttctctatctccaaaactatcttgccttctg

SEQ ID NO: 311645 - DNA, 38 bp, Artificial Sequence
  Description of Artificial Sequence: Synthetic oligonucleotide
gagaacgttctctatctccaaaactatcttgccttctg

SEQ ID NO: 311646 - DNA, 48 bp, Artificial Sequence
  Description of Artificial Sequence: Synthetic oligonucleotide
agaacgttctctatctccaaaactatcttgccttctgaatttaaattg

SEQ ID NO: 311647 - DNA, 47 bp, Artificial Sequence
  Description of Artificial Sequence: Synthetic oligonucleotide
gaacgttctctatctccaaaactatcttgccttctgaatttaaattg

SEQ ID NO: 311648 - DNA, 47 bp, Artificial Sequence
  Description of Artificial Sequence: Synthetic oligonucleotide
aacgttctctatctccaaaactatcttgccttctgaatttaaattgg

SEQ ID NO: 311649 - DNA, 46 bp, Artificial Sequence
  Description of Artificial Sequence: Synthetic oligonucleotide
acgttctctatctccaaaactatcttgccttctgaatttaaattgg

SEQ ID NO: 311650 - DNA, 45 bp, Artificial Sequence
  Description of Artificial Sequence: Synthetic oligonucleotide
cgttctctatctccaaaactatcttgccttctgaatttaaattgg

SEQ ID NO: 311651 - DNA, 46 bp, Artificial Sequence
  Description of Artificial Sequence: Synthetic oligonucleotide
gttctctatctccaaaactatcttgccttctgaatttaaattggtc

SEQ ID NO: 311652 - DNA, 46 bp, Artificial Sequence
  Description of Artificial Sequence: Synthetic oligonucleotide
ttctctatctccaaaactatcttgccttctgaatttaaattggtcc

SEQ ID NO: 311653 - DNA, 45 bp, Artificial Sequence
  Description of Artificial Sequence: Synthetic oligonucleotide
tctctatctccaaaactatcttgccttctgaatttaaattggtcc

SEQ ID NO: 311654 - DNA, 44 bp, Artificial Sequence
  Description of Artificial Sequence: Synthetic oligonucleotide
ctctatctccaaaactatcttgccttctgaatttaaattggtcc

SEQ ID NO: 311655 - DNA, 45 bp, Artificial Sequence
  Description of Artificial Sequence: Synthetic oligonucleotide
tctatctccaaaactatcttgccttctgaatttaaattggtccac

SEQ ID NO: 311656 - DNA, 44 bp, Artificial Sequence
  Description of Artificial Sequence: Synthetic oligonucleotide
ctatctccaaaactatcttgccttctgaatttaaattggtccac

SEQ ID NO: 311657 - DNA, 45 bp, Artificial Sequence
  Description of Artificial Sequence: Synthetic oligonucleotide
tatctccaaaactatcttgccttctgaatttaaattggtccacac

SEQ ID NO: 311658 - DNA, 44 bp, Artificial Sequence
  Description of Artificial Sequence: Synthetic oligonucleotide
atctccaaaactatcttgccttctgaatttaaattggtccacac

SEQ ID NO: 311659 - DNA, 43 bp, Artificial Sequence
  Description of Artificial Sequence: Synthetic oligonucleotide
tctccaaaactatcttgccttctgaatttaaattggtccacac

SEQ ID NO: 311660 - DNA, 42 bp, Artificial Sequence
  Description of Artificial Sequence: Synthetic oligonucleotide
ctccaaaactatcttgccttctgaatttaaattggtccacac

SEQ ID NO: 311661 - DNA, 42 bp, Artificial Sequence
  Description of Artificial Sequence: Synthetic oligonucleotide
tccaaaactatcttgccttctgaatttaaattggtccacacc

SEQ ID NO: 311662 - DNA, 41 bp, Artificial Sequence
  Description of Artificial Sequence: Synthetic oligonucleotide
ccaaaactatcttgccttctgaatttaaattggtccacacc

SEQ ID NO: 311663 - DNA, 42 bp, Artificial Sequence
  Description of Artificial Sequence: Synthetic oligonucleotide
caaaactatcttgccttctgaatttaaattggtccacaccag

SEQ ID NO: 311664 - DNA, 43 bp, Artificial Sequence
  Description of Artificial Sequence: Synthetic oligonucleotide
aaaactatcttgccttctgaatttaaattggtccacaccagtc

SEQ ID NO: 311665 - DNA, 42 bp, Artificial Sequence
  Description of Artificial Sequence: Synthetic oligonucleotide
aaactatcttgccttctgaatttaaattggtccacaccagtc

SEQ ID NO: 311666 - DNA, 41 bp, Artificial Sequence
  Description of Artificial Sequence: Synthetic oligonucleotide
aactatcttgccttctgaatttaaattggtccacaccagtc

SEQ ID NO: 311667 - DNA, 40 bp, Artificial Sequence
  Description of Artificial Sequence: Synthetic oligonucleotide
actatcttgccttctgaatttaaattggtccacaccagtc

SEQ ID NO: 311668 - DNA, 39 bp, Artificial Sequence
  Description of Artificial Sequence: Synthetic oligonucleotide
ctatcttgccttctgaatttaaattggtccacaccagtc

SEQ ID NO: 311669 - DNA, 39 bp, Artificial Sequence
  Description of Artificial Sequence: Synthetic oligonucleotide
tatcttgccttctgaatttaaattggtccacaccagtcg

SEQ ID NO: 311670 - DNA, 38 bp, Artificial Sequence
  Description of Artificial Sequence: Synthetic oligonucleotide
atcttgccttctgaatttaaattggtccacaccagtcg

SEQ ID NO: 311671 - DNA, 37 bp, Artificial Sequence
  Description of Artificial Sequence: Synthetic oligonucleotide
tcttgccttctgaatttaaattggtccacaccagtcg

SEQ ID NO: 311672 - DNA, 36 bp, Artificial Sequence
  Description of Artificial Sequence: Synthetic oligonucleotide
cttgccttctgaatttaaattggtccacaccagtcg

SEQ ID NO: 311673 - DNA, 42 bp, Artificial Sequence
  Description of Artificial Sequence: Synthetic oligonucleotide
ttgccttctgaatttaaattggtccacaccagtcgaatattg

SEQ ID NO: 311674 - DNA, 41 bp, Artificial Sequence
  Description of Artificial Sequence: Synthetic oligonucleotide
tgccttctgaatttaaattggtccacaccagtcgaatattg

SEQ ID NO: 311675 - DNA, 40 bp, Artificial Sequence
  Description of Artificial Sequence: Synthetic oligonucleotide
gccttctgaatttaaattggtccacaccagtcgaatattg

SEQ ID NO: 311676 - DNA, 46 bp, Artificial Sequence
  Description of Artificial Sequence: Synthetic oligonucleotide
ccttctgaatttaaattggtccacaccagtcgaatattgtaaaaac

SEQ ID NO: 311677 - DNA, 50 bp, Artificial Sequence
  Description of Artificial Sequence: Synthetic oligonucleotide
cttctgaatttaaattggtccacaccagtcgaatattgtaaaaacaaatc

SEQ ID NO: 311678 - DNA, 52 bp, Artificial Sequence
  Description of Artificial Sequence: Synthetic oligonucleotide
ttctgaatttaaattggtccacaccagtcgaatattgtaaaaacaaatcatg

SEQ ID NO: 311679 - DNA, 51 bp, Artificial Sequence
  Description of Artificial Sequence: Synthetic oligonucleotide
tctgaatttaaattggtccacaccagtcgaatattgtaaaaacaaatcatg

SEQ ID NO: 311680 - DNA, 50 bp, Artificial Sequence
  Description of Artificial Sequence: Synthetic oligonucleotide
ctgaatttaaattggtccacaccagtcgaatattgtaaaaacaaatcatg

SEQ ID NO: 311681 - DNA, 50 bp, Artificial Sequence
  Description of Artificial Sequence: Synthetic oligonucleotide
tgaatttaaattggtccacaccagtcgaatattgtaaaaacaaatcatgc

SEQ ID NO: 311682 - DNA, 49 bp, Artificial Sequence
  Description of Artificial Sequence: Synthetic oligonucleotide
gaatttaaattggtccacaccagtcgaatattgtaaaaacaaatcatgc

SEQ ID NO: 311683 - DNA, 49 bp, Artificial Sequence
  Description of Artificial Sequence: Synthetic oligonucleotide
aatttaaattggtccacaccagtcgaatattgtaaaaacaaatcatgcg

SEQ ID NO: 311684 - DNA, 48 bp, Artificial Sequence
  Description of Artificial Sequence: Synthetic oligonucleotide
atttaaattggtccacaccagtcgaatattgtaaaaacaaatcatgcg

SEQ ID NO: 311685 - DNA, 47 bp, Artificial Sequence
  Description of Artificial Sequence: Synthetic oligonucleotide
tttaaattggtccacaccagtcgaatattgtaaaaacaaatcatgcg

SEQ ID NO: 311686 - DNA, 46 bp, Artificial Sequence
  Description of Artificial Sequence: Synthetic oligonucleotide
ttaaattggtccacaccagtcgaatattgtaaaaacaaatcatgcg

SEQ ID NO: 311687 - DNA, 45 bp, Artificial Sequence
  Description of Artificial Sequence: Synthetic oligonucleotide
taaattggtccacaccagtcgaatattgtaaaaacaaatcatgcg

SEQ ID NO: 311688 - DNA, 44 bp, Artificial Sequence
  Description of Artificial Sequence: Synthetic oligonucleotide
aaattggtccacaccagtcgaatattgtaaaaacaaatcatgcg

SEQ ID NO: 311689 - DNA, 43 bp, Artificial Sequence
  Description of Artificial Sequence: Synthetic oligonucleotide
aattggtccacaccagtcgaatattgtaaaaacaaatcatgcg

SEQ ID NO: 311690 - DNA, 42 bp, Artificial Sequence
  Description of Artificial Sequence: Synthetic oligonucleotide
attggtccacaccagtcgaatattgtaaaaacaaatcatgcg

SEQ ID NO: 311691 - DNA, 41 bp, Artificial Sequence
  Description of Artificial Sequence: Synthetic oligonucleotide
ttggtccacaccagtcgaatattgtaaaaacaaatcatgcg

SEQ ID NO: 311692 - DNA, 40 bp, Artificial Sequence
  Description of Artificial Sequence: Synthetic oligonucleotide
tggtccacaccagtcgaatattgtaaaaacaaatcatgcg

SEQ ID NO: 311693 - DNA, 39 bp, Artificial Sequence
  Description of Artificial Sequence: Synthetic oligonucleotide
ggtccacaccagtcgaatattgtaaaaacaaatcatgcg

SEQ ID NO: 311694 - DNA, 39 bp, Artificial Sequence
  Description of Artificial Sequence: Synthetic oligonucleotide
gtccacaccagtcgaatattgtaaaaacaaatcatgcgc

SEQ ID NO: 311695 - DNA, 43 bp, Artificial Sequence
  Description of Artificial Sequence: Synthetic oligonucleotide
tccacaccagtcgaatattgtaaaaacaaatcatgcgctaatc

SEQ ID NO: 311696 - DNA, 42 bp, Artificial Sequence
  Description of Artificial Sequence: Synthetic oligonucleotide
ccacaccagtcgaatattgtaaaaacaaatcatgcgctaatc

SEQ ID NO: 311697 - DNA, 42 bp, Artificial Sequence
  Description of Artificial Sequence: Synthetic oligonucleotide
cacaccagtcgaatattgtaaaaacaaatcatgcgctaatcc

SEQ ID NO: 311698 - DNA, 42 bp, Artificial Sequence
  Description of Artificial Sequence: Synthetic oligonucleotide
acaccagtcgaatattgtaaaaacaaatcatgcgctaatccg

SEQ ID NO: 311699 - DNA, 41 bp, Artificial Sequence
  Description of Artificial Sequence: Synthetic oligonucleotide
caccagtcgaatattgtaaaaacaaatcatgcgctaatccg

SEQ ID NO: 311700 - DNA, 41 bp, Artificial Sequence
  Description of Artificial Sequence: Synthetic oligonucleotide
accagtcgaatattgtaaaaacaaatcatgcgctaatccgg

SEQ ID NO: 311701 - DNA, 40 bp, Artificial Sequence
  Description of Artificial Sequence: Synthetic oligonucleotide
ccagtcgaatattgtaaaaacaaatcatgcgctaatccgg

SEQ ID NO: 311702 - DNA, 40 bp, Artificial Sequence
  Description of Artificial Sequence: Synthetic oligonucleotide
cagtcgaatattgtaaaaacaaatcatgcgctaatccggc

SEQ ID NO: 311703 - DNA, 41 bp, Artificial Sequence
  Description of Artificial Sequence: Synthetic oligonucleotide
agtcgaatattgtaaaaacaaatcatgcgctaatccggcag

SEQ ID NO: 311704 - DNA, 40 bp, Artificial Sequence
  Description of Artificial Sequence: Synthetic oligonucleotide
gtcgaatattgtaaaaacaaatcatgcgctaatccggcag

SEQ ID NO: 311705 - DNA, 45 bp, Artificial Sequence
  Description of Artificial Sequence: Synthetic oligonucleotide
tcgaatattgtaaaaacaaatcatgcgctaatccggcagaaatac

SEQ ID NO: 311706 - DNA, 44 bp, Artificial Sequence
  Description of Artificial Sequence: Synthetic oligonucleotide
cgaatattgtaaaaacaaatcatgcgctaatccggcagaaatac

SEQ ID NO: 311707 - DNA, 44 bp, Artificial Sequence
  Description of Artificial Sequence: Synthetic oligonucleotide
gaatattgtaaaaacaaatcatgcgctaatccggcagaaatacg

SEQ ID NO: 311708 - DNA, 48 bp, Artificial Sequence
  Description of Artificial Sequence: Synthetic oligonucleotide
aatattgtaaaaacaaatcatgcgctaatccggcagaaatacgtaatg

SEQ ID NO: 311709 - DNA, 47 bp, Artificial Sequence
  Description of Artificial Sequence: Synthetic oligonucleotide
atattgtaaaaacaaatcatgcgctaatccggcagaaatacgtaatg

SEQ ID NO: 311710 - DNA, 46 bp, Artificial Sequence
  Description of Artificial Sequence: Synthetic oligonucleotide
tattgtaaaaacaaatcatgcgctaatccggcagaaatacgtaatg

SEQ ID NO: 311711 - DNA, 45 bp, Artificial Sequence
  Description of Artificial Sequence: Synthetic oligonucleotide
attgtaaaaacaaatcatgcgctaatccggcagaaatacgtaatg

SEQ ID NO: 311712 - DNA, 44 bp, Artificial Sequence
  Description of Artificial Sequence: Synthetic oligonucleotide
ttgtaaaaacaaatcatgcgctaatccggcagaaatacgtaatg

SEQ ID NO: 311713 - DNA, 43 bp, Artificial Sequence
  Description of Artificial Sequence: Synthetic oligonucleotide
tgtaaaaacaaatcatgcgctaatccggcagaaatacgtaatg

SEQ ID NO: 311714 - DNA, 42 bp, Artificial Sequence
  Description of Artificial Sequence: Synthetic oligonucleotide
gtaaaaacaaatcatgcgctaatccggcagaaatacgtaatg

SEQ ID NO: 311715 - DNA, 42 bp, Artificial Sequence
  Description of Artificial Sequence: Synthetic oligonucleotide
taaaaacaaatcatgcgctaatccggcagaaatacgtaatgg

SEQ ID NO: 311716 - DNA, 41 bp, Artificial Sequence
  Description of Artificial Sequence: Synthetic oligonucleotide
aaaaacaaatcatgcgctaatccggcagaaatacgtaatgg

SEQ ID NO: 311717 - DNA, 40 bp, Artificial Sequence
  Description of Artificial Sequence: Synthetic oligonucleotide
aaaacaaatcatgcgctaatccggcagaaatacgtaatgg

SEQ ID NO: 311718 - DNA, 39 bp, Artificial Sequence
  Description of Artificial Sequence: Synthetic oligonucleotide
aaacaaatcatgcgctaatccggcagaaatacgtaatgg

SEQ ID NO: 311719 - DNA, 38 bp, Artificial Sequence
  Description of Artificial Sequence: Synthetic oligonucleotide
aacaaatcatgcgctaatccggcagaaatacgtaatgg

SEQ ID NO: 311720 - DNA, 37 bp, Artificial Sequence
  Description of Artificial Sequence: Synthetic oligonucleotide
acaaatcatgcgctaatccggcagaaatacgtaatgg

SEQ ID NO: 311721 - DNA, 36 bp, Artificial Sequence
  Description of Artificial Sequence: Synthetic oligonucleotide
caaatcatgcgctaatccggcagaaatacgtaatgg

SEQ ID NO: 311722 - DNA, 37 bp, Artificial Sequence
  Description of Artificial Sequence: Synthetic oligonucleotide
aaatcatgcgctaatccggcagaaatacgtaatggtc

SEQ ID NO: 311723 - DNA, 36 bp, Artificial Sequence
  Description of Artificial Sequence: Synthetic oligonucleotide
aatcatgcgctaatccggcagaaatacgtaatggtc

SEQ ID NO: 311724 - DNA, 35 bp, Artificial Sequence
  Description of Artificial Sequence: Synthetic oligonucleotide
atcatgcgctaatccggcagaaatacgtaatggtc

SEQ ID NO: 311725 - DNA, 34 bp, Artificial Sequence
  Description of Artificial Sequence: Synthetic oligonucleotide
tcatgcgctaatccggcagaaatacgtaatggtc

SEQ ID NO: 311726 - DNA, 33 bp, Artificial Sequence
  Description of Artificial Sequence: Synthetic oligonucleotide
catgcgctaatccggcagaaatacgtaatggtc

SEQ ID NO: 311727 - DNA, 34 bp, Artificial Sequence
  Description of Artificial Sequence: Synthetic oligonucleotide
atgcgctaatccggcagaaatacgtaatggtcag

SEQ ID NO: 311728 - DNA, 33 bp, Artificial Sequence
  Description of Artificial Sequence: Synthetic oligonucleotide
tgcgctaatccggcagaaatacgtaatggtcag

SEQ ID NO: 311729 - DNA, 32 bp, Artificial Sequence
  Description of Artificial Sequence: Synthetic oligonucleotide
gcgctaatccggcagaaatacgtaatggtcag

SEQ ID NO: 311730 - DNA, 35 bp, Artificial Sequence
  Description of Artificial Sequence: Synthetic oligonucleotide
cgctaatccggcagaaatacgtaatggtcagtttg

SEQ ID NO: 311731 - DNA, 37 bp, Artificial Sequence
  Description of Artificial Sequence: Synthetic oligonucleotide
gctaatccggcagaaatacgtaatggtcagtttgatg

SEQ ID NO: 311732 - DNA, 39 bp, Artificial Sequence
  Description of Artificial Sequence: Synthetic oligonucleotide
ctaatccggcagaaatacgtaatggtcagtttgatgtac

SEQ ID NO: 311733 - DNA, 39 bp, Artificial Sequence
  Description of Artificial Sequence: Synthetic oligonucleotide
taatccggcagaaatacgtaatggtcagtttgatgtacg

SEQ ID NO: 311734 - DNA, 38 bp, Artificial Sequence
  Description of Artificial Sequence: Synthetic oligonucleotide
aatccggcagaaatacgtaatggtcagtttgatgtacg

SEQ ID NO: 311735 - DNA, 37 bp, Artificial Sequence
  Description of Artificial Sequence: Synthetic oligonucleotide
atccggcagaaatacgtaatggtcagtttgatgtacg

SEQ ID NO: 311736 - DNA, 36 bp, Artificial Sequence
  Description of Artificial Sequence: Synthetic oligonucleotide
tccggcagaaatacgtaatggtcagtttgatgtacg

SEQ ID NO: 311737 - DNA, 35 bp, Artificial Sequence
  Description of Artificial Sequence: Synthetic oligonucleotide
ccggcagaaatacgtaatggtcagtttgatgtacg

SEQ ID NO: 311738 - DNA, 36 bp, Artificial Sequence
  Description of Artificial Sequence: Synthetic oligonucleotide
cggcagaaatacgtaatggtcagtttgatgtacgag

SEQ ID NO: 311739 - DNA, 36 bp, Artificial Sequence
  Description of Artificial Sequence: Synthetic oligonucleotide
ggcagaaatacgtaatggtcagtttgatgtacgagg

SEQ ID NO: 311740 - DNA, 37 bp, Artificial Sequence
  Description of Artificial Sequence: Synthetic oligonucleotide
gcagaaatacgtaatggtcagtttgatgtacgaggtg

SEQ ID NO: 311741 - DNA, 37 bp, Artificial Sequence
  Description of Artificial Sequence: Synthetic oligonucleotide
cagaaatacgtaatggtcagtttgatgtacgaggtgg

SEQ ID NO: 311742 - DNA, 37 bp, Artificial Sequence
  Description of Artificial Sequence: Synthetic oligonucleotide
agaaatacgtaatggtcagtttgatgtacgaggtggc

SEQ ID NO: 311743 - DNA, 36 bp, Artificial Sequence
  Description of Artificial Sequence: Synthetic oligonucleotide
gaaatacgtaatggtcagtttgatgtacgaggtggc

SEQ ID NO: 311744 - DNA, 45 bp, Artificial Sequence
  Description of Artificial Sequence: Synthetic oligonucleotide
aaatacgtaatggtcagtttgatgtacgaggtggcattttatttg

SEQ ID NO: 311745 - DNA, 44 bp, Artificial Sequence
  Description of Artificial Sequence: Synthetic oligonucleotide
aatacgtaatggtcagtttgatgtacgaggtggcattttatttg

SEQ ID NO: 311746 - DNA, 43 bp, Artificial Sequence
  Description of Artificial Sequence: Synthetic oligonucleotide
atacgtaatggtcagtttgatgtacgaggtggcattttatttg

SEQ ID NO: 311747 - DNA, 42 bp, Artificial Sequence
  Description of Artificial Sequence: Synthetic oligonucleotide
tacgtaatggtcagtttgatgtacgaggtggcattttatttg

SEQ ID NO: 311748 - DNA, 41 bp, Artificial Sequence
  Description of Artificial Sequence: Synthetic oligonucleotide
acgtaatggtcagtttgatgtacgaggtggcattttatttg

SEQ ID NO: 311749 - DNA, 40 bp, Artificial Sequence
  Description of Artificial Sequence: Synthetic oligonucleotide
cgtaatggtcagtttgatgtacgaggtggcattttatttg

SEQ ID NO: 311750 - DNA, 40 bp, Artificial Sequence
  Description of Artificial Sequence: Synthetic oligonucleotide
gtaatggtcagtttgatgtacgaggtggcattttatttgg

SEQ ID NO: 311751 - DNA, 41 bp, Artificial Sequence
  Description of Artificial Sequence: Synthetic oligonucleotide
taatggtcagtttgatgtacgaggtggcattttatttggtc

SEQ ID NO: 311752 - DNA, 40 bp, Artificial Sequence
  Description of Artificial Sequence: Synthetic oligonucleotide
aatggtcagtttgatgtacgaggtggcattttatttggtc

SEQ ID NO: 311753 - DNA, 39 bp, Artificial Sequence
  Description of Artificial Sequence: Synthetic oligonucleotide
atggtcagtttgatgtacgaggtggcattttatttggtc

SEQ ID NO: 311754 - DNA, 38 bp, Artificial Sequence
  Description of Artificial Sequence: Synthetic oligonucleotide
tggtcagtttgatgtacgaggtggcattttatttggtc

SEQ ID NO: 311755 - DNA, 37 bp, Artificial Sequence
  Description of Artificial Sequence: Synthetic oligonucleotide
ggtcagtttgatgtacgaggtggcattttatttggtc

SEQ ID NO: 311756 - DNA, 37 bp, Artificial Sequence
  Description of Artificial Sequence: Synthetic oligonucleotide
gtcagtttgatgtacgaggtggcattttatttggtcc

SEQ ID NO: 311757 - DNA, 39 bp, Artificial Sequence
  Description of Artificial Sequence: Synthetic oligonucleotide
tcagtttgatgtacgaggtggcattttatttggtccaac

SEQ ID NO: 311758 - DNA, 38 bp, Artificial Sequence
  Description of Artificial Sequence: Synthetic oligonucleotide
cagtttgatgtacgaggtggcattttatttggtccaac

SEQ ID NO: 311759 - DNA, 38 bp, Artificial Sequence
  Description of Artificial Sequence: Synthetic oligonucleotide
agtttgatgtacgaggtggcattttatttggtccaacc

SEQ ID NO: 311760 - DNA, 37 bp, Artificial Sequence
  Description of Artificial Sequence: Synthetic oligonucleotide
gtttgatgtacgaggtggcattttatttggtccaacc

SEQ ID NO: 311761 - DNA, 39 bp, Artificial Sequence
  Description of Artificial Sequence: Synthetic oligonucleotide
tttgatgtacgaggtggcattttatttggtccaaccatc

SEQ ID NO: 311762 - DNA, 38 bp, Artificial Sequence
  Description of Artificial Sequence: Synthetic oligonucleotide
ttgatgtacgaggtggcattttatttggtccaaccatc

SEQ ID NO: 311763 - DNA, 37 bp, Artificial Sequence
  Description of Artificial Sequence: Synthetic oligonucleotide
tgatgtacgaggtggcattttatttggtccaaccatc

SEQ ID NO: 311764 - DNA, 36 bp, Artificial Sequence
  Description of Artificial Sequence: Synthetic oligonucleotide
gatgtacgaggtggcattttatttggtccaaccatc

SEQ ID NO: 311765 - DNA, 37 bp, Artificial Sequence
  Description of Artificial Sequence: Synthetic oligonucleotide
atgtacgaggtggcattttatttggtccaaccatctg

SEQ ID NO: 311766 - DNA, 36 bp, Artificial Sequence
  Description of Artificial Sequence: Synthetic oligonucleotide
tgtacgaggtggcattttatttggtccaaccatctg

SEQ ID NO: 311767 - DNA, 35 bp, Artificial Sequence
  Description of Artificial Sequence: Synthetic oligonucleotide
gtacgaggtggcattttatttggtccaaccatctg

SEQ ID NO: 311768 - DNA, 35 bp, Artificial Sequence
  Description of Artificial Sequence: Synthetic oligonucleotide
tacgaggtggcattttatttggtccaaccatctgc

SEQ ID NO: 311769 - DNA, 34 bp, Artificial Sequence
  Description of Artificial Sequence: Synthetic oligonucleotide
acgaggtggcattttatttggtccaaccatctgc

SEQ ID NO: 311770 - DNA, 33 bp, Artificial Sequence
  Description of Artificial Sequence: Synthetic oligonucleotide
cgaggtggcattttatttggtccaaccatctgc

SEQ ID NO: 311771 - DNA, 35 bp, Artificial Sequence
  Description of Artificial Sequence: Synthetic oligonucleotide
gaggtggcattttatttggtccaaccatctgcttc

SEQ ID NO: 311772 - DNA, 36 bp, Artificial Sequence
  Description of Artificial Sequence: Synthetic oligonucleotide
aggtggcattttatttggtccaaccatctgcttctc

SEQ ID NO: 311773 - DNA, 35 bp, Artificial Sequence
  Description of Artificial Sequence: Synthetic oligonucleotide
ggtggcattttatttggtccaaccatctgcttctc

SEQ ID NO: 311774 - DNA, 37 bp, Artificial Sequence
  Description of Artificial Sequence: Synthetic oligonucleotide
gtggcattttatttggtccaaccatctgcttctcatg

SEQ ID NO: 311775 - DNA, 40 bp, Artificial Sequence
  Description of Artificial Sequence: Synthetic oligonucleotide
tggcattttatttggtccaaccatctgcttctcatgaaac

SEQ ID NO: 311776 - DNA, 39 bp, Artificial Sequence
  Description of Artificial Sequence: Synthetic oligonucleotide
ggcattttatttggtccaaccatctgcttctcatgaaac

SEQ ID NO: 311777 - DNA, 40 bp, Artificial Sequence
  Description of Artificial Sequence: Synthetic oligonucleotide
gcattttatttggtccaaccatctgcttctcatgaaacac

SEQ ID NO: 311778 - DNA, 41 bp, Artificial Sequence
  Description of Artificial Sequence: Synthetic oligonucleotide
cattttatttggtccaaccatctgcttctcatgaaacacag

SEQ ID NO: 311779 - DNA, 41 bp, Artificial Sequence
  Description of Artificial Sequence: Synthetic oligonucleotide
attttatttggtccaaccatctgcttctcatgaaacacagg

SEQ ID NO: 311780 - DNA, 40 bp, Artificial Sequence
  Description of Artificial Sequence: Synthetic oligonucleotide
ttttatttggtccaaccatctgcttctcatgaaacacagg

SEQ ID NO: 311781 - DNA, 39 bp, Artificial Sequence
  Description of Artificial Sequence: Synthetic oligonucleotide
tttatttggtccaaccatctgcttctcatgaaacacagg

SEQ ID NO: 311782 - DNA, 38 bp, Artificial Sequence
  Description of Artificial Sequence: Synthetic oligonucleotide
ttatttggtccaaccatctgcttctcatgaaacacagg

SEQ ID NO: 311783 - DNA, 37 bp, Artificial Sequence
  Description of Artificial Sequence: Synthetic oligonucleotide
tatttggtccaaccatctgcttctcatgaaacacagg

SEQ ID NO: 311784 - DNA, 36 bp, Artificial Sequence
  Description of Artificial Sequence: Synthetic oligonucleotide
atttggtccaaccatctgcttctcatgaaacacagg

SEQ ID NO: 311785 - DNA, 35 bp, Artificial Sequence
  Description of Artificial Sequence: Synthetic oligonucleotide
tttggtccaaccatctgcttctcatgaaacacagg

SEQ ID NO: 311786 - DNA, 34 bp, Artificial Sequence
  Description of Artificial Sequence: Synthetic oligonucleotide
ttggtccaaccatctgcttctcatgaaacacagg

SEQ ID NO: 311787 - DNA, 33 bp, Artificial Sequence
  Description of Artificial Sequence: Synthetic oligonucleotide
tggtccaaccatctgcttctcatgaaacacagg

SEQ ID NO: 311788 - DNA, 32 bp, Artificial Sequence
  Description of Artificial Sequence: Synthetic oligonucleotide
ggtccaaccatctgcttctcatgaaacacagg

SEQ ID NO: 311789 - DNA, 32 bp, Artificial Sequence
  Description of Artificial Sequence: Synthetic oligonucleotide
gtccaaccatctgcttctcatgaaacacaggg

SEQ ID NO: 311790 - DNA, 34 bp, Artificial Sequence
  Description of Artificial Sequence: Synthetic oligonucleotide
tccaaccatctgcttctcatgaaacacagggaac

SEQ ID NO: 311791 - DNA, 33 bp, Artificial Sequence
  Description of Artificial Sequence: Synthetic oligonucleotide
ccaaccatctgcttctcatgaaacacagggaac

SEQ ID NO: 311792 - DNA, 42 bp, Artificial Sequence
  Description of Artificial Sequence: Synthetic oligonucleotide
caaccatctgcttctcatgaaacacagggaacaaattatatg

SEQ ID NO: 311793 - DNA, 42 bp, Artificial Sequence
  Description of Artificial Sequence: Synthetic oligonucleotide
aaccatctgcttctcatgaaacacagggaacaaattatatgg

SEQ ID NO: 311794 - DNA, 41 bp, Artificial Sequence
  Description of Artificial Sequence: Synthetic oligonucleotide
accatctgcttctcatgaaacacagggaacaaattatatgg

SEQ ID NO: 311795 - DNA, 40 bp, Artificial Sequence
  Description of Artificial Sequence: Synthetic oligonucleotide
ccatctgcttctcatgaaacacagggaacaaattatatgg

SEQ ID NO: 311796 - DNA, 40 bp, Artificial Sequence
  Description of Artificial Sequence: Synthetic oligonucleotide
catctgcttctcatgaaacacagggaacaaattatatggc

SEQ ID NO: 311797 - DNA, 41 bp, Artificial Sequence
  Description of Artificial Sequence: Synthetic oligonucleotide
atctgcttctcatgaaacacagggaacaaattatatggctc

SEQ ID NO: 311798 - DNA, 40 bp, Artificial Sequence
  Description of Artificial Sequence: Synthetic oligonucleotide
tctgcttctcatgaaacacagggaacaaattatatggctc

SEQ ID NO: 311799 - DNA, 39 bp, Artificial Sequence
  Description of Artificial Sequence: Synthetic oligonucleotide
ctgcttctcatgaaacacagggaacaaattatatggctc

SEQ ID NO: 311800 - DNA, 39 bp, Artificial Sequence
  Description of Artificial Sequence: Synthetic oligonucleotide
tgcttctcatgaaacacagggaacaaattatatggctcg

SEQ ID NO: 311801 - DNA, 38 bp, Artificial Sequence
  Description of Artificial Sequence: Synthetic oligonucleotide
gcttctcatgaaacacagggaacaaattatatggctcg

SEQ ID NO: 311802 - DNA, 39 bp, Artificial Sequence
  Description of Artificial Sequence: Synthetic oligonucleotide
cttctcatgaaacacagggaacaaattatatggctcgac

SEQ ID NO: 311803 - DNA, 41 bp, Artificial Sequence
  Description of Artificial Sequence: Synthetic oligonucleotide
ttctcatgaaacacagggaacaaattatatggctcgacatc

SEQ ID NO: 311804 - DNA, 40 bp, Artificial Sequence
  Description of Artificial Sequence: Synthetic oligonucleotide
tctcatgaaacacagggaacaaattatatggctcgacatc

SEQ ID NO: 311805 - DNA, 39 bp, Artificial Sequence
  Description of Artificial Sequence: Synthetic oligonucleotide
ctcatgaaacacagggaacaaattatatggctcgacatc

SEQ ID NO: 311806 - DNA, 41 bp, Artificial Sequence
  Description of Artificial Sequence: Synthetic oligonucleotide
tcatgaaacacagggaacaaattatatggctcgacatctag

SEQ ID NO: 311807 - DNA, 40 bp, Artificial Sequence
  Description of Artificial Sequence: Synthetic oligonucleotide
catgaaacacagggaacaaattatatggctcgacatctag

SEQ ID NO: 311808 - DNA, 45 bp, Artificial Sequence
  Description of Artificial Sequence: Synthetic oligonucleotide
atgaaacacagggaacaaattatatggctcgacatctagttttag

SEQ ID NO: 311809 - DNA, 44 bp, Artificial Sequence
  Description of Artificial Sequence: Synthetic oligonucleotide
tgaaacacagggaacaaattatatggctcgacatctagttttag

SEQ ID NO: 311810 - DNA, 43 bp, Artificial Sequence
  Description of Artificial Sequence: Synthetic oligonucleotide
gaaacacagggaacaaattatatggctcgacatctagttttag

SEQ ID NO: 311811 - DNA, 44 bp, Artificial Sequence
  Description of Artificial Sequence: Synthetic oligonucleotide
aaacacagggaacaaattatatggctcgacatctagttttagtc

SEQ ID NO: 311812 - DNA, 43 bp, Artificial Sequence
  Description of Artificial Sequence: Synthetic oligonucleotide
aacacagggaacaaattatatggctcgacatctagttttagtc

SEQ ID NO: 311813 - DNA, 42 bp, Artificial Sequence
  Description of Artificial Sequence: Synthetic oligonucleotide
acacagggaacaaattatatggctcgacatctagttttagtc

SEQ ID NO: 311814 - DNA, 41 bp, Artificial Sequence
  Description of Artificial Sequence: Synthetic oligonucleotide
cacagggaacaaattatatggctcgacatctagttttagtc

SEQ ID NO: 311815 - DNA, 47 bp, Artificial Sequence
  Description of Artificial Sequence: Synthetic oligonucleotide
acagggaacaaattatatggctcgacatctagttttagtcttatttg

SEQ ID NO: 311816 - DNA, 46 bp, Artificial Sequence
  Description of Artificial Sequence: Synthetic oligonucleotide
cagggaacaaattatatggctcgacatctagttttagtcttatttg

SEQ ID NO: 311817 - DNA, 47 bp, Artificial Sequence
  Description of Artificial Sequence: Synthetic oligonucleotide
agggaacaaattatatggctcgacatctagttttagtcttatttgag

SEQ ID NO: 311818 - DNA, 46 bp, Artificial Sequence
  Description of Artificial Sequence: Synthetic oligonucleotide
gggaacaaattatatggctcgacatctagttttagtcttatttgag

SEQ ID NO: 311819 - DNA, 46 bp, Artificial Sequence
  Description of Artificial Sequence: Synthetic oligonucleotide
ggaacaaattatatggctcgacatctagttttagtcttatttgagg

SEQ ID NO: 311820 - DNA, 46 bp, Artificial Sequence
  Description of Artificial Sequence: Synthetic oligonucleotide
gaacaaattatatggctcgacatctagttttagtcttatttgaggc

SEQ ID NO: 311821 - DNA, 47 bp, Artificial Sequence
  Description of Artificial Sequence: Synthetic oligonucleotide
aacaaattatatggctcgacatctagttttagtcttatttgaggcag

SEQ ID NO: 311822 - DNA, 46 bp, Artificial Sequence
  Description of Artificial Sequence: Synthetic oligonucleotide
acaaattatatggctcgacatctagttttagtcttatttgaggcag

SEQ ID NO: 311823 - DNA, 45 bp, Artificial Sequence
  Description of Artificial Sequence: Synthetic oligonucleotide
caaattatatggctcgacatctagttttagtcttatttgaggcag

SEQ ID NO: 311824 - DNA, 45 bp, Artificial Sequence
  Description of Artificial Sequence: Synthetic oligonucleotide
aaattatatggctcgacatctagttttagtcttatttgaggcagc

SEQ ID NO: 311825 - DNA, 44 bp, Artificial Sequence
  Description of Artificial Sequence: Synthetic oligonucleotide
aattatatggctcgacatctagttttagtcttatttgaggcagc

SEQ ID NO: 311826 - DNA, 43 bp, Artificial Sequence
  Description of Artificial Sequence: Synthetic oligonucleotide
attatatggctcgacatctagttttagtcttatttgaggcagc

SEQ ID NO: 311827 - DNA, 42 bp, Artificial Sequence
  Description of Artificial Sequence: Synthetic oligonucleotide
ttatatggctcgacatctagttttagtcttatttgaggcagc

SEQ ID NO: 311828 - DNA, 41 bp, Artificial Sequence
  Description of Artificial Sequence: Synthetic oligonucleotide
tatatggctcgacatctagttttagtcttatttgaggcagc

SEQ ID NO: 311829 - DNA, 40 bp, Artificial Sequence
  Description of Artificial Sequence: Synthetic oligonucleotide
atatggctcgacatctagttttagtcttatttgaggcagc

SEQ ID NO: 311830 - DNA, 39 bp, Artificial Sequence
  Description of Artificial Sequence: Synthetic oligonucleotide
tatggctcgacatctagttttagtcttatttgaggcagc

SEQ ID NO: 311831 - DNA, 38 bp, Artificial Sequence
  Description of Artificial Sequence: Synthetic oligonucleotide
atggctcgacatctagttttagtcttatttgaggcagc

SEQ ID NO: 311832 - DNA, 37 bp, Artificial Sequence
  Description of Artificial Sequence: Synthetic oligonucleotide
tggctcgacatctagttttagtcttatttgaggcagc

SEQ ID NO: 311833 - DNA, 36 bp, Artificial Sequence
  Description of Artificial Sequence: Synthetic oligonucleotide
ggctcgacatctagttttagtcttatttgaggcagc

SEQ ID NO: 311834 - DNA, 37 bp, Artificial Sequence
  Description of Artificial Sequence: Synthetic oligonucleotide
gctcgacatctagttttagtcttatttgaggcagctc

SEQ ID NO: 311835 - DNA, 38 bp, Artificial Sequence
  Description of Artificial Sequence: Synthetic oligonucleotide
ctcgacatctagttttagtcttatttgaggcagctcag

SEQ ID NO: 311836 - DNA, 39 bp, Artificial Sequence
  Description of Artificial Sequence: Synthetic oligonucleotide
tcgacatctagttttagtcttatttgaggcagctcagtc

SEQ ID NO: 311837 - DNA, 38 bp, Artificial Sequence
  Description of Artificial Sequence: Synthetic oligonucleotide
cgacatctagttttagtcttatttgaggcagctcagtc

SEQ ID NO: 311838 - DNA, 38 bp, Artificial Sequence
  Description of Artificial Sequence: Synthetic oligonucleotide
gacatctagttttagtcttatttgaggcagctcagtcc

SEQ ID NO: 311839 - DNA, 39 bp, Artificial Sequence
  Description of Artificial Sequence: Synthetic oligonucleotide
acatctagttttagtcttatttgaggcagctcagtccag

SEQ ID NO: 311840 - DNA, 38 bp, Artificial Sequence
  Description of Artificial Sequence: Synthetic oligonucleotide
catctagttttagtcttatttgaggcagctcagtccag

SEQ ID NO: 311841 - DNA, 39 bp, Artificial Sequence
  Description of Artificial Sequence: Synthetic oligonucleotide
atctagttttagtcttatttgaggcagctcagtccagtg

SEQ ID NO: 311842 - DNA, 38 bp, Artificial Sequence
  Description of Artificial Sequence: Synthetic oligonucleotide
tctagttttagtcttatttgaggcagctcagtccagtg

SEQ ID NO: 311843 - DNA, 37 bp, Artificial Sequence
  Description of Artificial Sequence: Synthetic oligonucleotide
ctagttttagtcttatttgaggcagctcagtccagtg

SEQ ID NO: 311844 - DNA, 37 bp, Artificial Sequence
  Description of Artificial Sequence: Synthetic oligonucleotide
tagttttagtcttatttgaggcagctcagtccagtgg

SEQ ID NO: 311845 - DNA, 36 bp, Artificial Sequence
  Description of Artificial Sequence: Synthetic oligonucleotide
agttttagtcttatttgaggcagctcagtccagtgg

SEQ ID NO: 311846 - DNA, 35 bp, Artificial Sequence
  Description of Artificial Sequence: Synthetic oligonucleotide
gttttagtcttatttgaggcagctcagtccagtgg

SEQ ID NO: 311847 - DNA, 36 bp, Artificial Sequence
  Description of Artificial Sequence: Synthetic oligonucleotide
ttttagtcttatttgaggcagctcagtccagtggtg

SEQ ID NO: 311848 - DNA, 35 bp, Artificial Sequence
  Description of Artificial Sequence: Synthetic oligonucleotide
tttagtcttatttgaggcagctcagtccagtggtg

SEQ ID NO: 311849 - DNA, 34 bp, Artificial Sequence
  Description of Artificial Sequence: Synthetic oligonucleotide
ttagtcttatttgaggcagctcagtccagtggtg

SEQ ID NO: 311850 - DNA, 33 bp, Artificial Sequence
  Description of Artificial Sequence: Synthetic oligonucleotide
tagtcttatttgaggcagctcagtccagtggtg

SEQ ID NO: 311851 - DNA, 32 bp, Artificial Sequence
  Description of Artificial Sequence: Synthetic oligonucleotide
agtcttatttgaggcagctcagtccagtggtg

SEQ ID NO: 311852 - DNA, 31 bp, Artificial Sequence
  Description of Artificial Sequence: Synthetic oligonucleotide
gtcttatttgaggcagctcagtccagtggtg

SEQ ID NO: 311853 - DNA, 32 bp, Artificial Sequence
  Description of Artificial Sequence: Synthetic oligonucleotide
tcttatttgaggcagctcagtccagtggtgtg

SEQ ID NO: 311854 - DNA, 31 bp, Artificial Sequence
  Description of Artificial Sequence: Synthetic oligonucleotide
cttatttgaggcagctcagtccagtggtgtg

SEQ ID NO: 311855 - DNA, 32 bp, Artificial Sequence
  Description of Artificial Sequence: Synthetic oligonucleotide
ttatttgaggcagctcagtccagtggtgtgac

SEQ ID NO: 311856 - DNA, 31 bp, Artificial Sequence
  Description of Artificial Sequence: Synthetic oligonucleotide
tatttgaggcagctcagtccagtggtgtgac

SEQ ID NO: 311857 - DNA, 30 bp, Artificial Sequence
  Description of Artificial Sequence: Synthetic oligonucleotide
atttgaggcagctcagtccagtggtgtgac

SEQ ID NO: 311858 - DNA, 29 bp, Artificial Sequence
  Description of Artificial Sequence: Synthetic oligonucleotide
tttgaggcagctcagtccagtggtgtgac

SEQ ID NO: 311859 - DNA, 28 bp, Artificial Sequence
  Description of Artificial Sequence: Synthetic oligonucleotide
ttgaggcagctcagtccagtggtgtgac

SEQ ID NO: 311860 - DNA, 27 bp, Artificial Sequence
  Description of Artificial Sequence: Synthetic oligonucleotide
tgaggcagctcagtccagtggtgtgac

SEQ ID NO: 311861 - DNA, 26 bp, Artificial Sequence
  Description of Artificial Sequence: Synthetic oligonucleotide
gaggcagctcagtccagtggtgtgac

SEQ ID NO: 311862 - DNA, 26 bp, Artificial Sequence
  Description of Artificial Sequence: Synthetic oligonucleotide
aggcagctcagtccagtggtgtgacc

SEQ ID NO: 311863 - DNA, 25 bp, Artificial Sequence
  Description of Artificial Sequence: Synthetic oligonucleotide
ggcagctcagtccagtggtgtgacc

SEQ ID NO: 311864 - DNA, 25 bp, Artificial Sequence
  Description of Artificial Sequence: Synthetic oligonucleotide
gcagctcagtccagtggtgtgaccc

SEQ ID NO: 311865 - DNA, 27 bp, Artificial Sequence
  Description of Artificial Sequence: Synthetic oligonucleotide
cagctcagtccagtggtgtgacccgta

SEQ ID NO: 311866 - DNA, 27 bp, Artificial Sequence
  Description of Artificial Sequence: Synthetic oligonucleotide
agctcagtccagtggtgtgacccgtag

SEQ ID NO: 311867 - DNA, 26 bp, Artificial Sequence
  Description of Artificial Sequence: Synthetic oligonucleotide
gctcagtccagtggtgtgacccgtag

SEQ ID NO: 311868 - DNA, 26 bp, Artificial Sequence
  Description of Artificial Sequence: Synthetic oligonucleotide
ctcagtccagtggtgtgacccgtagc

SEQ ID NO: 311869 - DNA, 27 bp, Artificial Sequence
  Description of Artificial Sequence: Synthetic oligonucleotide
tcagtccagtggtgtgacccgtagcca

SEQ ID NO: 311870 - DNA, 26 bp, Artificial Sequence
  Description of Artificial Sequence: Synthetic oligonucleotide
cagtccagtggtgtgacccgtagcca

SEQ ID NO: 311871 - DNA, 27 bp, Artificial Sequence
  Description of Artificial Sequence: Synthetic oligonucleotide
agtccagtggtgtgacccgtagccaga

SEQ ID NO: 311872 - DNA, 26 bp, Artificial Sequence
  Description of Artificial Sequence: Synthetic oligonucleotide
gtccagtggtgtgacccgtagccaga

SEQ ID NO: 311873 - DNA, 27 bp, Artificial Sequence
  Description of Artificial Sequence: Synthetic oligonucleotide
tccagtggtgtgacccgtagccagagt

SEQ ID NO: 311874 - DNA, 26 bp, Artificial Sequence
  Description of Artificial Sequence: Synthetic oligonucleotide
ccagtggtgtgacccgtagccagagt

SEQ ID NO: 311875 - DNA, 26 bp, Artificial Sequence
  Description of Artificial Sequence: Synthetic oligonucleotide
cagtggtgtgacccgtagccagagtg

SEQ ID NO: 311876 - DNA, 27 bp, Artificial Sequence
  Description of Artificial Sequence: Synthetic oligonucleotide
agtggtgtgacccgtagccagagtgga

SEQ ID NO: 311877 - DNA, 26 bp, Artificial Sequence
  Description of Artificial Sequence: Synthetic oligonucleotide
gtggtgtgacccgtagccagagtgga

SEQ ID NO: 311878 - DNA, 27 bp, Artificial Sequence
  Description of Artificial Sequence: Synthetic oligonucleotide
tggtgtgacccgtagccagagtggaga

SEQ ID NO: 311879 - DNA, 26 bp, Artificial Sequence
  Description of Artificial Sequence: Synthetic oligonucleotide
ggtgtgacccgtagccagagtggaga

SEQ ID NO: 311880 - DNA, 27 bp, Artificial Sequence
  Description of Artificial Sequence: Synthetic oligonucleotide
gtgtgacccgtagccagagtggagaga

SEQ ID NO: 311881 - DNA, 35 bp, Artificial Sequence
  Description of Artificial Sequence: Synthetic oligonucleotide
tgtgacccgtagccagagtggagagaaattaattg

SEQ ID NO: 311882 - DNA, 34 bp, Artificial Sequence
  Description of Artificial Sequence: Synthetic oligonucleotide
gtgacccgtagccagagtggagagaaattaattg

SEQ ID NO: 311883 - DNA, 35 bp, Artificial Sequence
  Description of Artificial Sequence: Synthetic oligonucleotide
tgacccgtagccagagtggagagaaattaattgtc

SEQ ID NO: 311884 - DNA, 34 bp, Artificial Sequence
  Description of Artificial Sequence: Synthetic oligonucleotide
gacccgtagccagagtggagagaaattaattgtc

SEQ ID NO: 311885 - DNA, 34 bp, Artificial Sequence
  Description of Artificial Sequence: Synthetic oligonucleotide
acccgtagccagagtggagagaaattaattgtcc

SEQ ID NO: 311886 - DNA, 33 bp, Artificial Sequence
  Description of Artificial Sequence: Synthetic oligonucleotide
cccgtagccagagtggagagaaattaattgtcc

SEQ ID NO: 311887 - DNA, 34 bp, Artificial Sequence
  Description of Artificial Sequence: Synthetic oligonucleotide
ccgtagccagagtggagagaaattaattgtccag

SEQ ID NO: 311888 - DNA, 34 bp, Artificial Sequence
  Description of Artificial Sequence: Synthetic oligonucleotide
cgtagccagagtggagagaaattaattgtccagg

SEQ ID NO: 311889 - DNA, 35 bp, Artificial Sequence
  Description of Artificial Sequence: Synthetic oligonucleotide
gtagccagagtggagagaaattaattgtccaggac

SEQ ID NO: 311890 - DNA, 35 bp, Artificial Sequence
  Description of Artificial Sequence: Synthetic oligonucleotide
tagccagagtggagagaaattaattgtccaggacc

SEQ ID NO: 311891 - DNA, 34 bp, Artificial Sequence
  Description of Artificial Sequence: Synthetic oligonucleotide
agccagagtggagagaaattaattgtccaggacc

SEQ ID NO: 311892 - DNA, 33 bp, Artificial Sequence
  Description of Artificial Sequence: Synthetic oligonucleotide
gccagagtggagagaaattaattgtccaggacc

SEQ ID NO: 311893 - DNA, 34 bp, Artificial Sequence
  Description of Artificial Sequence: Synthetic oligonucleotide
ccagagtggagagaaattaattgtccaggaccac

SEQ ID NO: 311894 - DNA, 34 bp, Artificial Sequence
  Description of Artificial Sequence: Synthetic oligonucleotide
cagagtggagagaaattaattgtccaggaccacc

SEQ ID NO: 311895 - DNA, 35 bp, Artificial Sequence
  Description of Artificial Sequence: Synthetic oligonucleotide
agagtggagagaaattaattgtccaggaccaccac

SEQ ID NO: 311896 - DNA, 34 bp, Artificial Sequence
  Description of Artificial Sequence: Synthetic oligonucleotide
gagtggagagaaattaattgtccaggaccaccac

SEQ ID NO: 311897 - DNA, 39 bp, Artificial Sequence
  Description of Artificial Sequence: Synthetic oligonucleotide
agtggagagaaattaattgtccaggaccaccacatattg

SEQ ID NO: 311898 - DNA, 38 bp, Artificial Sequence
  Description of Artificial Sequence: Synthetic oligonucleotide
gtggagagaaattaattgtccaggaccaccacatattg

SEQ ID NO: 311899 - DNA, 39 bp, Artificial Sequence
  Description of Artificial Sequence: Synthetic oligonucleotide
tggagagaaattaattgtccaggaccaccacatattgac

SEQ ID NO: 311900 - DNA, 38 bp, Artificial Sequence
  Description of Artificial Sequence: Synthetic oligonucleotide
ggagagaaattaattgtccaggaccaccacatattgac

SEQ ID NO: 311901 - DNA, 41 bp, Artificial Sequence
  Description of Artificial Sequence: Synthetic oligonucleotide
gagagaaattaattgtccaggaccaccacatattgacaatc

SEQ ID NO: 311902 - DNA, 41 bp, Artificial Sequence
  Description of Artificial Sequence: Synthetic oligonucleotide
agagaaattaattgtccaggaccaccacatattgacaatcg

SEQ ID NO: 311903 - DNA, 40 bp, Artificial Sequence
  Description of Artificial Sequence: Synthetic oligonucleotide
gagaaattaattgtccaggaccaccacatattgacaatcg

SEQ ID NO: 311904 - DNA, 47 bp, Artificial Sequence
  Description of Artificial Sequence: Synthetic oligonucleotide
agaaattaattgtccaggaccaccacatattgacaatcgaataattc

SEQ ID NO: 311905 - DNA, 46 bp, Artificial Sequence
  Description of Artificial Sequence: Synthetic oligonucleotide
gaaattaattgtccaggaccaccacatattgacaatcgaataattc

SEQ ID NO: 311906 - DNA, 48 bp, Artificial Sequence
  Description of Artificial Sequence: Synthetic oligonucleotide
aaattaattgtccaggaccaccacatattgacaatcgaataattctag

SEQ ID NO: 311907 - DNA, 47 bp, Artificial Sequence
  Description of Artificial Sequence: Synthetic oligonucleotide
aattaattgtccaggaccaccacatattgacaatcgaataattctag

SEQ ID NO: 311908 - DNA, 46 bp, Artificial Sequence
  Description of Artificial Sequence: Synthetic oligonucleotide
attaattgtccaggaccaccacatattgacaatcgaataattctag

SEQ ID NO: 311909 - DNA, 45 bp, Artificial Sequence
  Description of Artificial Sequence: Synthetic oligonucleotide
ttaattgtccaggaccaccacatattgacaatcgaataattctag

SEQ ID NO: 311910 - DNA, 44 bp, Artificial Sequence
  Description of Artificial Sequence: Synthetic oligonucleotide
taattgtccaggaccaccacatattgacaatcgaataattctag

SEQ ID NO: 311911 - DNA, 43 bp, Artificial Sequence
  Description of Artificial Sequence: Synthetic oligonucleotide
aattgtccaggaccaccacatattgacaatcgaataattctag

SEQ ID NO: 311912 - DNA, 42 bp, Artificial Sequence
  Description of Artificial Sequence: Synthetic oligonucleotide
attgtccaggaccaccacatattgacaatcgaataattctag

SEQ ID NO: 311913 - DNA, 41 bp, Artificial Sequence
  Description of Artificial Sequence: Synthetic oligonucleotide
ttgtccaggaccaccacatattgacaatcgaataattctag

SEQ ID NO: 311914 - DNA, 40 bp, Artificial Sequence
  Description of Artificial Sequence: Synthetic oligonucleotide
tgtccaggaccaccacatattgacaatcgaataattctag

SEQ ID NO: 311915 - DNA, 39 bp, Artificial Sequence
  Description of Artificial Sequence: Synthetic oligonucleotide
gtccaggaccaccacatattgacaatcgaataattctag

SEQ ID NO: 311916 - DNA, 39 bp, Artificial Sequence
  Description of Artificial Sequence: Synthetic oligonucleotide
tccaggaccaccacatattgacaatcgaataattctagg

SEQ ID NO: 311917 - DNA, 38 bp, Artificial Sequence
  Description of Artificial Sequence: Synthetic oligonucleotide
ccaggaccaccacatattgacaatcgaataattctagg

SEQ ID NO: 311918 - DNA, 38 bp, Artificial Sequence
  Description of Artificial Sequence: Synthetic oligonucleotide
caggaccaccacatattgacaatcgaataattctaggg

SEQ ID NO: 311919 - DNA, 38 bp, Artificial Sequence
  Description of Artificial Sequence: Synthetic oligonucleotide
aggaccaccacatattgacaatcgaataattctagggg

SEQ ID NO: 311920 - DNA, 37 bp, Artificial Sequence
  Description of Artificial Sequence: Synthetic oligonucleotide
ggaccaccacatattgacaatcgaataattctagggg

SEQ ID NO: 311921 - DNA, 39 bp, Artificial Sequence
  Description of Artificial Sequence: Synthetic oligonucleotide
gaccaccacatattgacaatcgaataattctaggggaac

SEQ ID NO: 311922 - DNA, 39 bp, Artificial Sequence
  Description of Artificial Sequence: Synthetic oligonucleotide
accaccacatattgacaatcgaataattctaggggaacg

SEQ ID NO: 311923 - DNA, 38 bp, Artificial Sequence
  Description of Artificial Sequence: Synthetic oligonucleotide
ccaccacatattgacaatcgaataattctaggggaacg

SEQ ID NO: 311924 - DNA, 39 bp, Artificial Sequence
  Description of Artificial Sequence: Synthetic oligonucleotide
caccacatattgacaatcgaataattctaggggaacgag

SEQ ID NO: 311925 - DNA, 40 bp, Artificial Sequence
  Description of Artificial Sequence: Synthetic oligonucleotide
accacatattgacaatcgaataattctaggggaacgagac

SEQ ID NO: 311926 - DNA, 39 bp, Artificial Sequence
  Description of Artificial Sequence: Synthetic oligonucleotide
ccacatattgacaatcgaataattctaggggaacgagac

SEQ ID NO: 311927 - DNA, 39 bp, Artificial Sequence
  Description of Artificial Sequence: Synthetic oligonucleotide
cacatattgacaatcgaataattctaggggaacgagacc

SEQ ID NO: 311928 - DNA, 44 bp, Artificial Sequence
  Description of Artificial Sequence: Synthetic oligonucleotide
acatattgacaatcgaataattctaggggaacgagaccattatc

SEQ ID NO: 311929 - DNA, 43 bp, Artificial Sequence
  Description of Artificial Sequence: Synthetic oligonucleotide
catattgacaatcgaataattctaggggaacgagaccattatc

SEQ ID NO: 311930 - DNA, 43 bp, Artificial Sequence
  Description of Artificial Sequence: Synthetic oligonucleotide
atattgacaatcgaataattctaggggaacgagaccattatcg

SEQ ID NO: 311931 - DNA, 42 bp, Artificial Sequence
  Description of Artificial Sequence: Synthetic oligonucleotide
tattgacaatcgaataattctaggggaacgagaccattatcg

SEQ ID NO: 311932 - DNA, 41 bp, Artificial Sequence
  Description of Artificial Sequence: Synthetic oligonucleotide
attgacaatcgaataattctaggggaacgagaccattatcg

SEQ ID NO: 311933 - DNA, 40 bp, Artificial Sequence
  Description of Artificial Sequence: Synthetic oligonucleotide
ttgacaatcgaataattctaggggaacgagaccattatcg

SEQ ID NO: 311934 - DNA, 39 bp, Artificial Sequence
  Description of Artificial Sequence: Synthetic oligonucleotide
tgacaatcgaataattctaggggaacgagaccattatcg

SEQ ID NO: 311935 - DNA, 38 bp, Artificial Sequence
  Description of Artificial Sequence: Synthetic oligonucleotide
gacaatcgaataattctaggggaacgagaccattatcg

SEQ ID NO: 311936 - DNA, 43 bp, Artificial Sequence
  Description of Artificial Sequence: Synthetic oligonucleotide
acaatcgaataattctaggggaacgagaccattatcgatatag

SEQ ID NO: 311937 - DNA, 42 bp, Artificial Sequence
  Description of Artificial Sequence: Synthetic oligonucleotide
caatcgaataattctaggggaacgagaccattatcgatatag

SEQ ID NO: 311938 - DNA, 43 bp, Artificial Sequence
  Description of Artificial Sequence: Synthetic oligonucleotide
aatcgaataattctaggggaacgagaccattatcgatatagac

SEQ ID NO: 311939 - DNA, 42 bp, Artificial Sequence
  Description of Artificial Sequence: Synthetic oligonucleotide
atcgaataattctaggggaacgagaccattatcgatatagac

SEQ ID NO: 311940 - DNA, 41 bp, Artificial Sequence
  Description of Artificial Sequence: Synthetic oligonucleotide
tcgaataattctaggggaacgagaccattatcgatatagac

SEQ ID NO: 311941 - DNA, 40 bp, Artificial Sequence
  Description of Artificial Sequence: Synthetic oligonucleotide
cgaataattctaggggaacgagaccattatcgatatagac

SEQ ID NO: 311942 - DNA, 41 bp, Artificial Sequence
  Description of Artificial Sequence: Synthetic oligonucleotide
gaataattctaggggaacgagaccattatcgatatagactg

SEQ ID NO: 311943 - DNA, 42 bp, Artificial Sequence
  Description of Artificial Sequence: Synthetic oligonucleotide
aataattctaggggaacgagaccattatcgatatagactgtc

SEQ ID NO: 311944 - DNA, 41 bp, Artificial Sequence
  Description of Artificial Sequence: Synthetic oligonucleotide
ataattctaggggaacgagaccattatcgatatagactgtc

SEQ ID NO: 311945 - DNA, 40 bp, Artificial Sequence
  Description of Artificial Sequence: Synthetic oligonucleotide
taattctaggggaacgagaccattatcgatatagactgtc

SEQ ID NO: 311946 - DNA, 39 bp, Artificial Sequence
  Description of Artificial Sequence: Synthetic oligonucleotide
aattctaggggaacgagaccattatcgatatagactgtc

SEQ ID NO: 311947 - DNA, 38 bp, Artificial Sequence
  Description of Artificial Sequence: Synthetic oligonucleotide
attctaggggaacgagaccattatcgatatagactgtc

SEQ ID NO: 311948 - DNA, 37 bp, Artificial Sequence
  Description of Artificial Sequence: Synthetic oligonucleotide
ttctaggggaacgagaccattatcgatatagactgtc

SEQ ID NO: 311949 - DNA, 36 bp, Artificial Sequence
  Description of Artificial Sequence: Synthetic oligonucleotide
tctaggggaacgagaccattatcgatatagactgtc

SEQ ID NO: 311950 - DNA, 35 bp, Artificial Sequence
  Description of Artificial Sequence: Synthetic oligonucleotide
ctaggggaacgagaccattatcgatatagactgtc

SEQ ID NO: 311951 - DNA, 36 bp, Artificial Sequence
  Description of Artificial Sequence: Synthetic oligonucleotide
taggggaacgagaccattatcgatatagactgtctg

SEQ ID NO: 311952 - DNA, 35 bp, Artificial Sequence
  Description of Artificial Sequence: Synthetic oligonucleotide
aggggaacgagaccattatcgatatagactgtctg

SEQ ID NO: 311953 - DNA, 34 bp, Artificial Sequence
  Description of Artificial Sequence: Synthetic oligonucleotide
ggggaacgagaccattatcgatatagactgtctg

SEQ ID NO: 311954 - DNA, 37 bp, Artificial Sequence
  Description of Artificial Sequence: Synthetic oligonucleotide
gggaacgagaccattatcgatatagactgtctgtaac

SEQ ID NO: 311955 - DNA, 37 bp, Artificial Sequence
  Description of Artificial Sequence: Synthetic oligonucleotide
ggaacgagaccattatcgatatagactgtctgtaacc

SEQ ID NO: 311956 - DNA, 40 bp, Artificial Sequence
  Description of Artificial Sequence: Synthetic oligonucleotide
gaacgagaccattatcgatatagactgtctgtaacctatg

SEQ ID NO: 311957 - DNA, 40 bp, Artificial Sequence
  Description of Artificial Sequence: Synthetic oligonucleotide
aacgagaccattatcgatatagactgtctgtaacctatgc

SEQ ID NO: 311958 - DNA, 39 bp, Artificial Sequence
  Description of Artificial Sequence: Synthetic oligonucleotide
acgagaccattatcgatatagactgtctgtaacctatgc

SEQ ID NO: 311959 - DNA, 38 bp, Artificial Sequence
  Description of Artificial Sequence: Synthetic oligonucleotide
cgagaccattatcgatatagactgtctgtaacctatgc

SEQ ID NO: 311960 - DNA, 40 bp, Artificial Sequence
  Description of Artificial Sequence: Synthetic oligonucleotide
gagaccattatcgatatagactgtctgtaacctatgcatg

SEQ ID NO: 311961 - DNA, 47 bp, Artificial Sequence
  Description of Artificial Sequence: Synthetic oligonucleotide
agaccattatcgatatagactgtctgtaacctatgcatgttataaag

SEQ ID NO: 311962 - DNA, 46 bp, Artificial Sequence
  Description of Artificial Sequence: Synthetic oligonucleotide
gaccattatcgatatagactgtctgtaacctatgcatgttataaag

SEQ ID NO: 311963 - DNA, 46 bp, Artificial Sequence
  Description of Artificial Sequence: Synthetic oligonucleotide
accattatcgatatagactgtctgtaacctatgcatgttataaagg

SEQ ID NO: 311964 - DNA, 45 bp, Artificial Sequence
  Description of Artificial Sequence: Synthetic oligonucleotide
ccattatcgatatagactgtctgtaacctatgcatgttataaagg

SEQ ID NO: 311965 - DNA, 48 bp, Artificial Sequence
  Description of Artificial Sequence: Synthetic oligonucleotide
cattatcgatatagactgtctgtaacctatgcatgttataaaggatac

SEQ ID NO: 311966 - DNA, 49 bp, Artificial Sequence
  Description of Artificial Sequence: Synthetic oligonucleotide
attatcgatatagactgtctgtaacctatgcatgttataaaggatacac

SEQ ID NO: 311967 - DNA, 48 bp, Artificial Sequence
  Description of Artificial Sequence: Synthetic oligonucleotide
ttatcgatatagactgtctgtaacctatgcatgttataaaggatacac

SEQ ID NO: 311968 - DNA, 47 bp, Artificial Sequence
  Description of Artificial Sequence: Synthetic oligonucleotide
tatcgatatagactgtctgtaacctatgcatgttataaaggatacac

SEQ ID NO: 311969 - DNA, 46 bp, Artificial Sequence
  Description of Artificial Sequence: Synthetic oligonucleotide
atcgatatagactgtctgtaacctatgcatgttataaaggatacac

SEQ ID NO: 311970 - DNA, 45 bp, Artificial Sequence
  Description of Artificial Sequence: Synthetic oligonucleotide
tcgatatagactgtctgtaacctatgcatgttataaaggatacac

SEQ ID NO: 311971 - DNA, 44 bp, Artificial Sequence
  Description of Artificial Sequence: Synthetic oligonucleotide
cgatatagactgtctgtaacctatgcatgttataaaggatacac

SEQ ID NO: 311972 - DNA, 44 bp, Artificial Sequence
  Description of Artificial Sequence: Synthetic oligonucleotide
gatatagactgtctgtaacctatgcatgttataaaggatacacc

SEQ ID NO: 311973 - DNA, 46 bp, Artificial Sequence
  Description of Artificial Sequence: Synthetic oligonucleotide
atatagactgtctgtaacctatgcatgttataaaggatacaccatg

SEQ ID NO: 311974 - DNA, 45 bp, Artificial Sequence
  Description of Artificial Sequence: Synthetic oligonucleotide
tatagactgtctgtaacctatgcatgttataaaggatacaccatg

SEQ ID NO: 311975 - DNA, 44 bp, Artificial Sequence
  Description of Artificial Sequence: Synthetic oligonucleotide
atagactgtctgtaacctatgcatgttataaaggatacaccatg

SEQ ID NO: 311976 - DNA, 43 bp, Artificial Sequence
  Description of Artificial Sequence: Synthetic oligonucleotide
tagactgtctgtaacctatgcatgttataaaggatacaccatg

SEQ ID NO: 311977 - DNA, 42 bp, Artificial Sequence
  Description of Artificial Sequence: Synthetic oligonucleotide
agactgtctgtaacctatgcatgttataaaggatacaccatg

SEQ ID NO: 311978 - DNA, 41 bp, Artificial Sequence
  Description of Artificial Sequence: Synthetic oligonucleotide
gactgtctgtaacctatgcatgttataaaggatacaccatg

SEQ ID NO: 311979 - DNA, 44 bp, Artificial Sequence
  Description of Artificial Sequence: Synthetic oligonucleotide
actgtctgtaacctatgcatgttataaaggatacaccatgatag

SEQ ID NO: 311980 - DNA, 43 bp, Artificial Sequence
  Description of Artificial Sequence: Synthetic oligonucleotide
ctgtctgtaacctatgcatgttataaaggatacaccatgatag

SEQ ID NO: 311981 - DNA, 43 bp, Artificial Sequence
  Description of Artificial Sequence: Synthetic oligonucleotide
tgtctgtaacctatgcatgttataaaggatacaccatgatagg

SEQ ID NO: 311982 - DNA, 42 bp, Artificial Sequence
  Description of Artificial Sequence: Synthetic oligonucleotide
gtctgtaacctatgcatgttataaaggatacaccatgatagg

SEQ ID NO: 311983 - DNA, 43 bp, Artificial Sequence
  Description of Artificial Sequence: Synthetic oligonucleotide
tctgtaacctatgcatgttataaaggatacaccatgataggag

SEQ ID NO: 311984 - DNA, 42 bp, Artificial Sequence
  Description of Artificial Sequence: Synthetic oligonucleotide
ctgtaacctatgcatgttataaaggatacaccatgataggag

SEQ ID NO: 311985 - DNA, 43 bp, Artificial Sequence
  Description of Artificial Sequence: Synthetic oligonucleotide
tgtaacctatgcatgttataaaggatacaccatgataggagag

SEQ ID NO: 311986 - DNA, 42 bp, Artificial Sequence
  Description of Artificial Sequence: Synthetic oligonucleotide
gtaacctatgcatgttataaaggatacaccatgataggagag

SEQ ID NO: 311987 - DNA, 42 bp, Artificial Sequence
  Description of Artificial Sequence: Synthetic oligonucleotide
taacctatgcatgttataaaggatacaccatgataggagagc

SEQ ID NO: 311988 - DNA, 41 bp, Artificial Sequence
  Description of Artificial Sequence: Synthetic oligonucleotide
aacctatgcatgttataaaggatacaccatgataggagagc

SEQ ID NO: 311989 - DNA, 40 bp, Artificial Sequence
  Description of Artificial Sequence: Synthetic oligonucleotide
acctatgcatgttataaaggatacaccatgataggagagc

SEQ ID NO: 311990 - DNA, 39 bp, Artificial Sequence
  Description of Artificial Sequence: Synthetic oligonucleotide
cctatgcatgttataaaggatacaccatgataggagagc

SEQ ID NO: 311991 - DNA, 40 bp, Artificial Sequence
  Description of Artificial Sequence: Synthetic oligonucleotide
ctatgcatgttataaaggatacaccatgataggagagcac

SEQ ID NO: 311992 - DNA, 41 bp, Artificial Sequence
  Description of Artificial Sequence: Synthetic oligonucleotide
tatgcatgttataaaggatacaccatgataggagagcacac

SEQ ID NO: 311993 - DNA, 40 bp, Artificial Sequence
  Description of Artificial Sequence: Synthetic oligonucleotide
atgcatgttataaaggatacaccatgataggagagcacac

SEQ ID NO: 311994 - DNA, 39 bp, Artificial Sequence
  Description of Artificial Sequence: Synthetic oligonucleotide
tgcatgttataaaggatacaccatgataggagagcacac

SEQ ID NO: 311995 - DNA, 38 bp, Artificial Sequence
  Description of Artificial Sequence: Synthetic oligonucleotide
gcatgttataaaggatacaccatgataggagagcacac

SEQ ID NO: 311996 - DNA, 46 bp, Artificial Sequence
  Description of Artificial Sequence: Synthetic oligonucleotide
catgttataaaggatacaccatgataggagagcacactatttattc

SEQ ID NO: 311997 - DNA, 48 bp, Artificial Sequence
  Description of Artificial Sequence: Synthetic oligonucleotide
atgttataaaggatacaccatgataggagagcacactatttattctac

SEQ ID NO: 311998 - DNA, 47 bp, Artificial Sequence
  Description of Artificial Sequence: Synthetic oligonucleotide
tgttataaaggatacaccatgataggagagcacactatttattctac

SEQ ID NO: 311999 - DNA, 46 bp, Artificial Sequence
  Description of Artificial Sequence: Synthetic oligonucleotide
gttataaaggatacaccatgataggagagcacactatttattctac

SEQ ID NO: 312000 - DNA, 47 bp, Artificial Sequence
  Description of Artificial Sequence: Synthetic oligonucleotide
ttataaaggatacaccatgataggagagcacactatttattctactg

SEQ ID NO: 312001 - DNA, 46 bp, Artificial Sequence
  Description of Artificial Sequence: Synthetic oligonucleotide
tataaaggatacaccatgataggagagcacactatttattctactg

SEQ ID NO: 312002 - DNA, 45 bp, Artificial Sequence
  Description of Artificial Sequence: Synthetic oligonucleotide
ataaaggatacaccatgataggagagcacactatttattctactg

SEQ ID NO: 312003 - DNA, 44 bp, Artificial Sequence
  Description of Artificial Sequence: Synthetic oligonucleotide
taaaggatacaccatgataggagagcacactatttattctactg

SEQ ID NO: 312004 - DNA, 43 bp, Artificial Sequence
  Description of Artificial Sequence: Synthetic oligonucleotide
aaaggatacaccatgataggagagcacactatttattctactg

SEQ ID NO: 312005 - DNA, 42 bp, Artificial Sequence
  Description of Artificial Sequence: Synthetic oligonucleotide
aaggatacaccatgataggagagcacactatttattctactg

SEQ ID NO: 312006 - DNA, 41 bp, Artificial Sequence
  Description of Artificial Sequence: Synthetic oligonucleotide
aggatacaccatgataggagagcacactatttattctactg

SEQ ID NO: 312007 - DNA, 40 bp, Artificial Sequence
  Description of Artificial Sequence: Synthetic oligonucleotide
ggatacaccatgataggagagcacactatttattctactg

SEQ ID NO: 312008 - DNA, 41 bp, Artificial Sequence
  Description of Artificial Sequence: Synthetic oligonucleotide
gatacaccatgataggagagcacactatttattctactgtg

SEQ ID NO: 312009 - DNA, 47 bp, Artificial Sequence
  Description of Artificial Sequence: Synthetic oligonucleotide
atacaccatgataggagagcacactatttattctactgtgaaaaatg

SEQ ID NO: 312010 - DNA, 46 bp, Artificial Sequence
  Description of Artificial Sequence: Synthetic oligonucleotide
tacaccatgataggagagcacactatttattctactgtgaaaaatg

SEQ ID NO: 312011 - DNA, 45 bp, Artificial Sequence
  Description of Artificial Sequence: Synthetic oligonucleotide
acaccatgataggagagcacactatttattctactgtgaaaaatg

SEQ ID NO: 312012 - DNA, 44 bp, Artificial Sequence
  Description of Artificial Sequence: Synthetic oligonucleotide
caccatgataggagagcacactatttattctactgtgaaaaatg

SEQ ID NO: 312013 - DNA, 46 bp, Artificial Sequence
  Description of Artificial Sequence: Synthetic oligonucleotide
accatgataggagagcacactatttattctactgtgaaaaatgatg

SEQ ID NO: 312014 - DNA, 45 bp, Artificial Sequence
  Description of Artificial Sequence: Synthetic oligonucleotide
ccatgataggagagcacactatttattctactgtgaaaaatgatg

SEQ ID NO: 312015 - DNA, 47 bp, Artificial Sequence
  Description of Artificial Sequence: Synthetic oligonucleotide
catgataggagagcacactatttattctactgtgaaaaatgatgaac

SEQ ID NO: 312016 - DNA, 47 bp, Artificial Sequence
  Description of Artificial Sequence: Synthetic oligonucleotide
atgataggagagcacactatttattctactgtgaaaaatgatgaacg

SEQ ID NO: 312017 - DNA, 46 bp, Artificial Sequence
  Description of Artificial Sequence: Synthetic oligonucleotide
tgataggagagcacactatttattctactgtgaaaaatgatgaacg

SEQ ID NO: 312018 - DNA, 45 bp, Artificial Sequence
  Description of Artificial Sequence: Synthetic oligonucleotide
gataggagagcacactatttattctactgtgaaaaatgatgaacg

SEQ ID NO: 312019 - DNA, 46 bp, Artificial Sequence
  Description of Artificial Sequence: Synthetic oligonucleotide
ataggagagcacactatttattctactgtgaaaaatgatgaacgag

SEQ ID NO: 312020 - DNA, 45 bp, Artificial Sequence
  Description of Artificial Sequence: Synthetic oligonucleotide
taggagagcacactatttattctactgtgaaaaatgatgaacgag

SEQ ID NO: 312021 - DNA, 44 bp, Artificial Sequence
  Description of Artificial Sequence: Synthetic oligonucleotide
aggagagcacactatttattctactgtgaaaaatgatgaacgag

SEQ ID NO: 312022 - DNA, 43 bp, Artificial Sequence
  Description of Artificial Sequence: Synthetic oligonucleotide
ggagagcacactatttattctactgtgaaaaatgatgaacgag

SEQ ID NO: 312023 - DNA, 44 bp, Artificial Sequence
  Description of Artificial Sequence: Synthetic oligonucleotide
gagagcacactatttattctactgtgaaaaatgatgaacgagag

SEQ ID NO: 312024 - DNA, 45 bp, Artificial Sequence
  Description of Artificial Sequence: Synthetic oligonucleotide
agagcacactatttattctactgtgaaaaatgatgaacgagagtg

SEQ ID NO: 312025 - DNA, 44 bp, Artificial Sequence
  Description of Artificial Sequence: Synthetic oligonucleotide
gagcacactatttattctactgtgaaaaatgatgaacgagagtg

SEQ ID NO: 312026 - DNA, 44 bp, Artificial Sequence
  Description of Artificial Sequence: Synthetic oligonucleotide
agcacactatttattctactgtgaaaaatgatgaacgagagtgg

SEQ ID NO: 312027 - DNA, 43 bp, Artificial Sequence
  Description of Artificial Sequence: Synthetic oligonucleotide
gcacactatttattctactgtgaaaaatgatgaacgagagtgg

SEQ ID NO: 312028 - DNA, 44 bp, Artificial Sequence
  Description of Artificial Sequence: Synthetic oligonucleotide
cacactatttattctactgtgaaaaatgatgaacgagagtggac

SEQ ID NO: 312029 - DNA, 45 bp, Artificial Sequence
  Description of Artificial Sequence: Synthetic oligonucleotide
acactatttattctactgtgaaaaatgatgaacgagagtggactg

SEQ ID NO: 312030 - DNA, 44 bp, Artificial Sequence
  Description of Artificial Sequence: Synthetic oligonucleotide
cactatttattctactgtgaaaaatgatgaacgagagtggactg

SEQ ID NO: 312031 - DNA, 44 bp, Artificial Sequence
  Description of Artificial Sequence: Synthetic oligonucleotide
actatttattctactgtgaaaaatgatgaacgagagtggactgg

SEQ ID NO: 312032 - DNA, 43 bp, Artificial Sequence
  Description of Artificial Sequence: Synthetic oligonucleotide
ctatttattctactgtgaaaaatgatgaacgagagtggactgg

SEQ ID NO: 312033 - DNA, 43 bp, Artificial Sequence
  Description of Artificial Sequence: Synthetic oligonucleotide
tatttattctactgtgaaaaatgatgaacgagagtggactggc

SEQ ID NO: 312034 - DNA, 42 bp, Artificial Sequence
  Description of Artificial Sequence: Synthetic oligonucleotide
atttattctactgtgaaaaatgatgaacgagagtggactggc

SEQ ID NO: 312035 - DNA, 41 bp, Artificial Sequence
  Description of Artificial Sequence: Synthetic oligonucleotide
tttattctactgtgaaaaatgatgaacgagagtggactggc

SEQ ID NO: 312036 - DNA, 40 bp, Artificial Sequence
  Description of Artificial Sequence: Synthetic oligonucleotide
ttattctactgtgaaaaatgatgaacgagagtggactggc

SEQ ID NO: 312037 - DNA, 39 bp, Artificial Sequence
  Description of Artificial Sequence: Synthetic oligonucleotide
tattctactgtgaaaaatgatgaacgagagtggactggc

SEQ ID NO: 312038 - DNA, 38 bp, Artificial Sequence
  Description of Artificial Sequence: Synthetic oligonucleotide
attctactgtgaaaaatgatgaacgagagtggactggc

SEQ ID NO: 312039 - DNA, 37 bp, Artificial Sequence
  Description of Artificial Sequence: Synthetic oligonucleotide
ttctactgtgaaaaatgatgaacgagagtggactggc

SEQ ID NO: 312040 - DNA, 36 bp, Artificial Sequence
  Description of Artificial Sequence: Synthetic oligonucleotide
tctactgtgaaaaatgatgaacgagagtggactggc

SEQ ID NO: 312041 - DNA, 35 bp, Artificial Sequence
  Description of Artificial Sequence: Synthetic oligonucleotide
ctactgtgaaaaatgatgaacgagagtggactggc

SEQ ID NO: 312042 - DNA, 35 bp, Artificial Sequence
  Description of Artificial Sequence: Synthetic oligonucleotide
tactgtgaaaaatgatgaacgagagtggactggcc

SEQ ID NO: 312043 - DNA, 34 bp, Artificial Sequence
  Description of Artificial Sequence: Synthetic oligonucleotide
actgtgaaaaatgatgaacgagagtggactggcc

SEQ ID NO: 312044 - DNA, 33 bp, Artificial Sequence
  Description of Artificial Sequence: Synthetic oligonucleotide
ctgtgaaaaatgatgaacgagagtggactggcc

SEQ ID NO: 312045 - DNA, 33 bp, Artificial Sequence
  Description of Artificial Sequence: Synthetic oligonucleotide
tgtgaaaaatgatgaacgagagtggactggccc

SEQ ID NO: 312046 - DNA, 32 bp, Artificial Sequence
  Description of Artificial Sequence: Synthetic oligonucleotide
gtgaaaaatgatgaacgagagtggactggccc

SEQ ID NO: 312047 - DNA, 33 bp, Artificial Sequence
  Description of Artificial Sequence: Synthetic oligonucleotide
tgaaaaatgatgaacgagagtggactggcccac

SEQ ID NO: 312048 - DNA, 32 bp, Artificial Sequence
  Description of Artificial Sequence: Synthetic oligonucleotide
gaaaaatgatgaacgagagtggactggcccac

SEQ ID NO: 312049 - DNA, 32 bp, Artificial Sequence
  Description of Artificial Sequence: Synthetic oligonucleotide
aaaaatgatgaacgagagtggactggcccacc

SEQ ID NO: 312050 - DNA, 31 bp, Artificial Sequence
  Description of Artificial Sequence: Synthetic oligonucleotide
aaaatgatgaacgagagtggactggcccacc

SEQ ID NO: 312051 - DNA, 30 bp, Artificial Sequence
  Description of Artificial Sequence: Synthetic oligonucleotide
aaatgatgaacgagagtggactggcccacc

SEQ ID NO: 312052 - DNA, 29 bp, Artificial Sequence
  Description of Artificial Sequence: Synthetic oligonucleotide
aatgatgaacgagagtggactggcccacc

SEQ ID NO: 312053 - DNA, 28 bp, Artificial Sequence
  Description of Artificial Sequence: Synthetic oligonucleotide
atgatgaacgagagtggactggcccacc

SEQ ID NO: 312054 - DNA, 27 bp, Artificial Sequence
  Description of Artificial Sequence: Synthetic oligonucleotide
tgatgaacgagagtggactggcccacc

SEQ ID NO: 312055 - DNA, 27 bp, Artificial Sequence
  Description of Artificial Sequence: Synthetic oligonucleotide
gatgaacgagagtggactggcccacct

SEQ ID NO: 312056 - DNA, 27 bp, Artificial Sequence
  Description of Artificial Sequence: Synthetic oligonucleotide
atgaacgagagtggactggcccacctc

SEQ ID NO: 312057 - DNA, 26 bp, Artificial Sequence
  Description of Artificial Sequence: Synthetic oligonucleotide
tgaacgagagtggactggcccacctc

SEQ ID NO: 312058 - DNA, 25 bp, Artificial Sequence
  Description of Artificial Sequence: Synthetic oligonucleotide
gaacgagagtggactggcccacctc

SEQ ID NO: 312059 - DNA, 26 bp, Artificial Sequence
  Description of Artificial Sequence: Synthetic oligonucleotide
aacgagagtggactggcccacctcct

SEQ ID NO: 312060 - DNA, 25 bp, Artificial Sequence
  Description of Artificial Sequence: Synthetic oligonucleotide
acgagagtggactggcccacctcct

SEQ ID NO: 312061 - DNA, 24 bp, Artificial Sequence
  Description of Artificial Sequence: Synthetic oligonucleotide
cgagagtggactggcccacctcct

SEQ ID NO: 312062 - DNA, 27 bp, Artificial Sequence
  Description of Artificial Sequence: Synthetic oligonucleotide
gagagtggactggcccacctcctgaat

SEQ ID NO: 312063 - DNA, 27 bp, Artificial Sequence
  Description of Artificial Sequence: Synthetic oligonucleotide
agagtggactggcccacctcctgaatg

SEQ ID NO: 312064 - DNA, 26 bp, Artificial Sequence
  Description of Artificial Sequence: Synthetic oligonucleotide
gagtggactggcccacctcctgaatg

SEQ ID NO: 312065 - DNA, 27 bp, Artificial Sequence
  Description of Artificial Sequence: Synthetic oligonucleotide
agtggactggcccacctcctgaatgct

SEQ ID NO: 312066 - DNA, 26 bp, Artificial Sequence
  Description of Artificial Sequence: Synthetic oligonucleotide
gtggactggcccacctcctgaatgct

SEQ ID NO: 312067 - DNA, 27 bp, Artificial Sequence
  Description of Artificial Sequence: Synthetic oligonucleotide
tggactggcccacctcctgaatgctga

SEQ ID NO: 312068 - DNA, 26 bp, Artificial Sequence
  Description of Artificial Sequence: Synthetic oligonucleotide
ggactggcccacctcctgaatgctga

SEQ ID NO: 312069 - DNA, 26 bp, Artificial Sequence
  Description of Artificial Sequence: Synthetic oligonucleotide
gactggcccacctcctgaatgctgag

SEQ ID NO: 312070 - DNA, 27 bp, Artificial Sequence
  Description of Artificial Sequence: Synthetic oligonucleotide
actggcccacctcctgaatgctgagga

SEQ ID NO: 312071 - DNA, 27 bp, Artificial Sequence
  Description of Artificial Sequence: Synthetic oligonucleotide
ctggcccacctcctgaatgctgaggaa

SEQ ID NO: 312072 - DNA, 30 bp, Artificial Sequence
  Description of Artificial Sequence: Synthetic oligonucleotide
tggcccacctcctgaatgctgaggaaaatg

SEQ ID NO: 312073 - DNA, 29 bp, Artificial Sequence
  Description of Artificial Sequence: Synthetic oligonucleotide
ggcccacctcctgaatgctgaggaaaatg

SEQ ID NO: 312074 - DNA, 30 bp, Artificial Sequence
  Description of Artificial Sequence: Synthetic oligonucleotide
gcccacctcctgaatgctgaggaaaatgtc

SEQ ID NO: 312075 - DNA, 33 bp, Artificial Sequence
  Description of Artificial Sequence: Synthetic oligonucleotide
cccacctcctgaatgctgaggaaaatgtctaac

SEQ ID NO: 312076 - DNA, 35 bp, Artificial Sequence
  Description of Artificial Sequence: Synthetic oligonucleotide
ccacctcctgaatgctgaggaaaatgtctaacttc

SEQ ID NO: 312077 - DNA, 35 bp, Artificial Sequence
  Description of Artificial Sequence: Synthetic oligonucleotide
cacctcctgaatgctgaggaaaatgtctaacttcg

SEQ ID NO: 312078 - DNA, 37 bp, Artificial Sequence
  Description of Artificial Sequence: Synthetic oligonucleotide
acctcctgaatgctgaggaaaatgtctaacttcgaag

SEQ ID NO: 312079 - DNA, 36 bp, Artificial Sequence
  Description of Artificial Sequence: Synthetic oligonucleotide
cctcctgaatgctgaggaaaatgtctaacttcgaag

SEQ ID NO: 312080 - DNA, 36 bp, Artificial Sequence
  Description of Artificial Sequence: Synthetic oligonucleotide
ctcctgaatgctgaggaaaatgtctaacttcgaagg

SEQ ID NO: 312081 - DNA, 37 bp, Artificial Sequence
  Description of Artificial Sequence: Synthetic oligonucleotide
tcctgaatgctgaggaaaatgtctaacttcgaaggtc

SEQ ID NO: 312082 - DNA, 36 bp, Artificial Sequence
  Description of Artificial Sequence: Synthetic oligonucleotide
cctgaatgctgaggaaaatgtctaacttcgaaggtc

SEQ ID NO: 312083 - DNA, 36 bp, Artificial Sequence
  Description of Artificial Sequence: Synthetic oligonucleotide
ctgaatgctgaggaaaatgtctaacttcgaaggtcc

SEQ ID NO: 312084 - DNA, 36 bp, Artificial Sequence
  Description of Artificial Sequence: Synthetic oligonucleotide
tgaatgctgaggaaaatgtctaacttcgaaggtccc

SEQ ID NO: 312085 - DNA, 35 bp, Artificial Sequence
  Description of Artificial Sequence: Synthetic oligonucleotide
gaatgctgaggaaaatgtctaacttcgaaggtccc

SEQ ID NO: 312086 - DNA, 36 bp, Artificial Sequence
  Description of Artificial Sequence: Synthetic oligonucleotide
aatgctgaggaaaatgtctaacttcgaaggtcccag

SEQ ID NO: 312087 - DNA, 35 bp, Artificial Sequence
  Description of Artificial Sequence: Synthetic oligonucleotide
atgctgaggaaaatgtctaacttcgaaggtcccag

SEQ ID NO: 312088 - DNA, 34 bp, Artificial Sequence
  Description of Artificial Sequence: Synthetic oligonucleotide
tgctgaggaaaatgtctaacttcgaaggtcccag

SEQ ID NO: 312089 - DNA, 33 bp, Artificial Sequence
  Description of Artificial Sequence: Synthetic oligonucleotide
gctgaggaaaatgtctaacttcgaaggtcccag

SEQ ID NO: 312090 - DNA, 33 bp, Artificial Sequence
  Description of Artificial Sequence: Synthetic oligonucleotide
ctgaggaaaatgtctaacttcgaaggtcccagc

SEQ ID NO: 312091 - DNA, 35 bp, Artificial Sequence
  Description of Artificial Sequence: Synthetic oligonucleotide
tgaggaaaatgtctaacttcgaaggtcccagcaac

SEQ ID NO: 312092 - DNA, 34 bp, Artificial Sequence
  Description of Artificial Sequence: Synthetic oligonucleotide
gaggaaaatgtctaacttcgaaggtcccagcaac

SEQ ID NO: 312093 - DNA, 35 bp, Artificial Sequence
  Description of Artificial Sequence: Synthetic oligonucleotide
aggaaaatgtctaacttcgaaggtcccagcaacag

SEQ ID NO: 312094 - DNA, 34 bp, Artificial Sequence
  Description of Artificial Sequence: Synthetic oligonucleotide
ggaaaatgtctaacttcgaaggtcccagcaacag

SEQ ID NO: 312095 - DNA, 36 bp, Artificial Sequence
  Description of Artificial Sequence: Synthetic oligonucleotide
gaaaatgtctaacttcgaaggtcccagcaacagttc

SEQ ID NO: 312096 - DNA, 37 bp, Artificial Sequence
  Description of Artificial Sequence: Synthetic oligonucleotide
aaaatgtctaacttcgaaggtcccagcaacagttctg

SEQ ID NO: 312097 - DNA, 36 bp, Artificial Sequence
  Description of Artificial Sequence: Synthetic oligonucleotide
aaatgtctaacttcgaaggtcccagcaacagttctg

SEQ ID NO: 312098 - DNA, 35 bp, Artificial Sequence
  Description of Artificial Sequence: Synthetic oligonucleotide
aatgtctaacttcgaaggtcccagcaacagttctg

SEQ ID NO: 312099 - DNA, 34 bp, Artificial Sequence
  Description of Artificial Sequence: Synthetic oligonucleotide
atgtctaacttcgaaggtcccagcaacagttctg

SEQ ID NO: 312100 - DNA, 33 bp, Artificial Sequence
  Description of Artificial Sequence: Synthetic oligonucleotide
tgtctaacttcgaaggtcccagcaacagttctg

SEQ ID NO: 312101 - DNA, 32 bp, Artificial Sequence
  Description of Artificial Sequence: Synthetic oligonucleotide
gtctaacttcgaaggtcccagcaacagttctg

SEQ ID NO: 312102 - DNA, 35 bp, Artificial Sequence
  Description of Artificial Sequence: Synthetic oligonucleotide
tctaacttcgaaggtcccagcaacagttctgaaac

SEQ ID NO: 312103 - DNA, 34 bp, Artificial Sequence
  Description of Artificial Sequence: Synthetic oligonucleotide
ctaacttcgaaggtcccagcaacagttctgaaac

SEQ ID NO: 312104 - DNA, 34 bp, Artificial Sequence
  Description of Artificial Sequence: Synthetic oligonucleotide
taacttcgaaggtcccagcaacagttctgaaacc

SEQ ID NO: 312105 - DNA, 33 bp, Artificial Sequence
  Description of Artificial Sequence: Synthetic oligonucleotide
aacttcgaaggtcccagcaacagttctgaaacc

SEQ ID NO: 312106 - DNA, 32 bp, Artificial Sequence
  Description of Artificial Sequence: Synthetic oligonucleotide
acttcgaaggtcccagcaacagttctgaaacc

SEQ ID NO: 312107 - DNA, 31 bp, Artificial Sequence
  Description of Artificial Sequence: Synthetic oligonucleotide
cttcgaaggtcccagcaacagttctgaaacc

SEQ ID NO: 312108 - DNA, 33 bp, Artificial Sequence
  Description of Artificial Sequence: Synthetic oligonucleotide
ttcgaaggtcccagcaacagttctgaaacctac

SEQ ID NO: 312109 - DNA, 32 bp, Artificial Sequence
  Description of Artificial Sequence: Synthetic oligonucleotide
tcgaaggtcccagcaacagttctgaaacctac

SEQ ID NO: 312110 - DNA, 31 bp, Artificial Sequence
  Description of Artificial Sequence: Synthetic oligonucleotide
cgaaggtcccagcaacagttctgaaacctac

SEQ ID NO: 312111 - DNA, 31 bp, Artificial Sequence
  Description of Artificial Sequence: Synthetic oligonucleotide
gaaggtcccagcaacagttctgaaacctacg

SEQ ID NO: 312112 - DNA, 32 bp, Artificial Sequence
  Description of Artificial Sequence: Synthetic oligonucleotide
aaggtcccagcaacagttctgaaacctacgac

SEQ ID NO: 312113 - DNA, 31 bp, Artificial Sequence
  Description of Artificial Sequence: Synthetic oligonucleotide
aggtcccagcaacagttctgaaacctacgac

SEQ ID NO: 312114 - DNA, 30 bp, Artificial Sequence
  Description of Artificial Sequence: Synthetic oligonucleotide
ggtcccagcaacagttctgaaacctacgac

SEQ ID NO: 312115 - DNA, 31 bp, Artificial Sequence
  Description of Artificial Sequence: Synthetic oligonucleotide
gtcccagcaacagttctgaaacctacgacag

SEQ ID NO: 312116 - DNA, 36 bp, Artificial Sequence
  Description of Artificial Sequence: Synthetic oligonucleotide
tcccagcaacagttctgaaacctacgacagtaaatc

SEQ ID NO: 312117 - DNA, 35 bp, Artificial Sequence
  Description of Artificial Sequence: Synthetic oligonucleotide
cccagcaacagttctgaaacctacgacagtaaatc

SEQ ID NO: 312118 - DNA, 37 bp, Artificial Sequence
  Description of Artificial Sequence: Synthetic oligonucleotide
ccagcaacagttctgaaacctacgacagtaaatcttc

SEQ ID NO: 312119 - DNA, 37 bp, Artificial Sequence
  Description of Artificial Sequence: Synthetic oligonucleotide
cagcaacagttctgaaacctacgacagtaaatcttcc

SEQ ID NO: 312120 - DNA, 39 bp, Artificial Sequence
  Description of Artificial Sequence: Synthetic oligonucleotide
agcaacagttctgaaacctacgacagtaaatcttccaac

SEQ ID NO: 312121 - DNA, 38 bp, Artificial Sequence
  Description of Artificial Sequence: Synthetic oligonucleotide
gcaacagttctgaaacctacgacagtaaatcttccaac

SEQ ID NO: 312122 - DNA, 40 bp, Artificial Sequence
  Description of Artificial Sequence: Synthetic oligonucleotide
caacagttctgaaacctacgacagtaaatcttccaactag

SEQ ID NO: 312123 - DNA, 41 bp, Artificial Sequence
  Description of Artificial Sequence: Synthetic oligonucleotide
aacagttctgaaacctacgacagtaaatcttccaactagag

SEQ ID NO: 312124 - DNA, 40 bp, Artificial Sequence
  Description of Artificial Sequence: Synthetic oligonucleotide
acagttctgaaacctacgacagtaaatcttccaactagag

SEQ ID NO: 312125 - DNA, 39 bp, Artificial Sequence
  Description of Artificial Sequence: Synthetic oligonucleotide
cagttctgaaacctacgacagtaaatcttccaactagag

SEQ ID NO: 312126 - DNA, 41 bp, Artificial Sequence
  Description of Artificial Sequence: Synthetic oligonucleotide
agttctgaaacctacgacagtaaatcttccaactagagaag

SEQ ID NO: 312127 - DNA, 40 bp, Artificial Sequence
  Description of Artificial Sequence: Synthetic oligonucleotide
gttctgaaacctacgacagtaaatcttccaactagagaag

SEQ ID NO: 312128 - DNA, 41 bp, Artificial Sequence
  Description of Artificial Sequence: Synthetic oligonucleotide
ttctgaaacctacgacagtaaatcttccaactagagaagtc

SEQ ID NO: 312129 - DNA, 40 bp, Artificial Sequence
  Description of Artificial Sequence: Synthetic oligonucleotide
tctgaaacctacgacagtaaatcttccaactagagaagtc

SEQ ID NO: 312130 - DNA, 39 bp, Artificial Sequence
  Description of Artificial Sequence: Synthetic oligonucleotide
ctgaaacctacgacagtaaatcttccaactagagaagtc

SEQ ID NO: 312131 - DNA, 40 bp, Artificial Sequence
  Description of Artificial Sequence: Synthetic oligonucleotide
tgaaacctacgacagtaaatcttccaactagagaagtctc

SEQ ID NO: 312132 - DNA, 39 bp, Artificial Sequence
  Description of Artificial Sequence: Synthetic oligonucleotide
gaaacctacgacagtaaatcttccaactagagaagtctc

SEQ ID NO: 312133 - DNA, 40 bp, Artificial Sequence
  Description of Artificial Sequence: Synthetic oligonucleotide
aaacctacgacagtaaatcttccaactagagaagtctctc

SEQ ID NO: 312134 - DNA, 39 bp, Artificial Sequence
  Description of Artificial Sequence: Synthetic oligonucleotide
aacctacgacagtaaatcttccaactagagaagtctctc

SEQ ID NO: 312135 - DNA, 38 bp, Artificial Sequence
  Description of Artificial Sequence: Synthetic oligonucleotide
acctacgacagtaaatcttccaactagagaagtctctc

SEQ ID NO: 312136 - DNA, 37 bp, Artificial Sequence
  Description of Artificial Sequence: Synthetic oligonucleotide
cctacgacagtaaatcttccaactagagaagtctctc

SEQ ID NO: 312137 - DNA, 37 bp, Artificial Sequence
  Description of Artificial Sequence: Synthetic oligonucleotide
ctacgacagtaaatcttccaactagagaagtctctcc

SEQ ID NO: 312138 - DNA, 39 bp, Artificial Sequence
  Description of Artificial Sequence: Synthetic oligonucleotide
tacgacagtaaatcttccaactagagaagtctctccaac

SEQ ID NO: 312139 - DNA, 38 bp, Artificial Sequence
  Description of Artificial Sequence: Synthetic oligonucleotide
acgacagtaaatcttccaactagagaagtctctccaac

SEQ ID NO: 312140 - DNA, 37 bp, Artificial Sequence
  Description of Artificial Sequence: Synthetic oligonucleotide
cgacagtaaatcttccaactagagaagtctctccaac

SEQ ID NO: 312141 - DNA, 39 bp, Artificial Sequence
  Description of Artificial Sequence: Synthetic oligonucleotide
gacagtaaatcttccaactagagaagtctctccaacttc

SEQ ID NO: 312142 - DNA, 40 bp, Artificial Sequence
  Description of Artificial Sequence: Synthetic oligonucleotide
acagtaaatcttccaactagagaagtctctccaacttctg

SEQ ID NO: 312143 - DNA, 39 bp, Artificial Sequence
  Description of Artificial Sequence: Synthetic oligonucleotide
cagtaaatcttccaactagagaagtctctccaacttctg

SEQ ID NO: 312144 - DNA, 40 bp, Artificial Sequence
  Description of Artificial Sequence: Synthetic oligonucleotide
agtaaatcttccaactagagaagtctctccaacttctgag

SEQ ID NO: 312145 - DNA, 39 bp, Artificial Sequence
  Description of Artificial Sequence: Synthetic oligonucleotide
gtaaatcttccaactagagaagtctctccaacttctgag

SEQ ID NO: 312146 - DNA, 43 bp, Artificial Sequence
  Description of Artificial Sequence: Synthetic oligonucleotide
taaatcttccaactagagaagtctctccaacttctgagaaaac

SEQ ID NO: 312147 - DNA, 42 bp, Artificial Sequence
  Description of Artificial Sequence: Synthetic oligonucleotide
aaatcttccaactagagaagtctctccaacttctgagaaaac

SEQ ID NO: 312148 - DNA, 41 bp, Artificial Sequence
  Description of Artificial Sequence: Synthetic oligonucleotide
aatcttccaactagagaagtctctccaacttctgagaaaac

SEQ ID NO: 312149 - DNA, 40 bp, Artificial Sequence
  Description of Artificial Sequence: Synthetic oligonucleotide
atcttccaactagagaagtctctccaacttctgagaaaac

SEQ ID NO: 312150 - DNA, 39 bp, Artificial Sequence
  Description of Artificial Sequence: Synthetic oligonucleotide
tcttccaactagagaagtctctccaacttctgagaaaac

SEQ ID NO: 312151 - DNA, 38 bp, Artificial Sequence
  Description of Artificial Sequence: Synthetic oligonucleotide
cttccaactagagaagtctctccaacttctgagaaaac

SEQ ID NO: 312152 - DNA, 38 bp, Artificial Sequence
  Description of Artificial Sequence: Synthetic oligonucleotide
ttccaactagagaagtctctccaacttctgagaaaacc

SEQ ID NO: 312153 - DNA, 37 bp, Artificial Sequence
  Description of Artificial Sequence: Synthetic oligonucleotide
tccaactagagaagtctctccaacttctgagaaaacc

SEQ ID NO: 312154 - DNA, 36 bp, Artificial Sequence
  Description of Artificial Sequence: Synthetic oligonucleotide
ccaactagagaagtctctccaacttctgagaaaacc

SEQ ID NO: 312155 - DNA, 37 bp, Artificial Sequence
  Description of Artificial Sequence: Synthetic oligonucleotide
caactagagaagtctctccaacttctgagaaaaccag

SEQ ID NO: 312156 - DNA, 37 bp, Artificial Sequence
  Description of Artificial Sequence: Synthetic oligonucleotide
aactagagaagtctctccaacttctgagaaaaccagc

SEQ ID NO: 312157 - DNA, 36 bp, Artificial Sequence
  Description of Artificial Sequence: Synthetic oligonucleotide
actagagaagtctctccaacttctgagaaaaccagc

SEQ ID NO: 312158 - DNA, 35 bp, Artificial Sequence
  Description of Artificial Sequence: Synthetic oligonucleotide
ctagagaagtctctccaacttctgagaaaaccagc

SEQ ID NO: 312159 - DNA, 36 bp, Artificial Sequence
  Description of Artificial Sequence: Synthetic oligonucleotide
tagagaagtctctccaacttctgagaaaaccagcac

SEQ ID NO: 312160 - DNA, 35 bp, Artificial Sequence
  Description of Artificial Sequence: Synthetic oligonucleotide
agagaagtctctccaacttctgagaaaaccagcac

SEQ ID NO: 312161 - DNA, 34 bp, Artificial Sequence
  Description of Artificial Sequence: Synthetic oligonucleotide
gagaagtctctccaacttctgagaaaaccagcac

SEQ ID NO: 312162 - DNA, 39 bp, Artificial Sequence
  Description of Artificial Sequence: Synthetic oligonucleotide
agaagtctctccaacttctgagaaaaccagcacaaaaac

SEQ ID NO: 312163 - DNA, 38 bp, Artificial Sequence
  Description of Artificial Sequence: Synthetic oligonucleotide
gaagtctctccaacttctgagaaaaccagcacaaaaac

SEQ ID NO: 312164 - DNA, 38 bp, Artificial Sequence
  Description of Artificial Sequence: Synthetic oligonucleotide
aagtctctccaacttctgagaaaaccagcacaaaaacg

SEQ ID NO: 312165 - DNA, 37 bp, Artificial Sequence
  Description of Artificial Sequence: Synthetic oligonucleotide
agtctctccaacttctgagaaaaccagcacaaaaacg

SEQ ID NO: 312166 - DNA, 36 bp, Artificial Sequence
  Description of Artificial Sequence: Synthetic oligonucleotide
gtctctccaacttctgagaaaaccagcacaaaaacg

SEQ ID NO: 312167 - DNA, 37 bp, Artificial Sequence
  Description of Artificial Sequence: Synthetic oligonucleotide
tctctccaacttctgagaaaaccagcacaaaaacgac

SEQ ID NO: 312168 - DNA, 36 bp, Artificial Sequence
  Description of Artificial Sequence: Synthetic oligonucleotide
ctctccaacttctgagaaaaccagcacaaaaacgac

SEQ ID NO: 312169 - DNA, 36 bp, Artificial Sequence
  Description of Artificial Sequence: Synthetic oligonucleotide
tctccaacttctgagaaaaccagcacaaaaacgacc

SEQ ID NO: 312170 - DNA, 35 bp, Artificial Sequence
  Description of Artificial Sequence: Synthetic oligonucleotide
ctccaacttctgagaaaaccagcacaaaaacgacc

SEQ ID NO: 312171 - DNA, 36 bp, Artificial Sequence
  Description of Artificial Sequence: Synthetic oligonucleotide
tccaacttctgagaaaaccagcacaaaaacgaccac

SEQ ID NO: 312172 - DNA, 35 bp, Artificial Sequence
  Description of Artificial Sequence: Synthetic oligonucleotide
ccaacttctgagaaaaccagcacaaaaacgaccac

SEQ ID NO: 312173 - DNA, 36 bp, Artificial Sequence
  Description of Artificial Sequence: Synthetic oligonucleotide
caacttctgagaaaaccagcacaaaaacgaccacac

SEQ ID NO: 312174 - DNA, 36 bp, Artificial Sequence
  Description of Artificial Sequence: Synthetic oligonucleotide
aacttctgagaaaaccagcacaaaaacgaccacacc

SEQ ID NO: 312175 - DNA, 35 bp, Artificial Sequence
  Description of Artificial Sequence: Synthetic oligonucleotide
acttctgagaaaaccagcacaaaaacgaccacacc

SEQ ID NO: 312176 - DNA, 34 bp, Artificial Sequence
  Description of Artificial Sequence: Synthetic oligonucleotide
cttctgagaaaaccagcacaaaaacgaccacacc

SEQ ID NO: 312177 - DNA, 38 bp, Artificial Sequence
  Description of Artificial Sequence: Synthetic oligonucleotide
ttctgagaaaaccagcacaaaaacgaccacaccatatg

SEQ ID NO: 312178 - DNA, 37 bp, Artificial Sequence
  Description of Artificial Sequence: Synthetic oligonucleotide
tctgagaaaaccagcacaaaaacgaccacaccatatg

SEQ ID NO: 312179 - DNA, 36 bp, Artificial Sequence
  Description of Artificial Sequence: Synthetic oligonucleotide
ctgagaaaaccagcacaaaaacgaccacaccatatg

SEQ ID NO: 312180 - DNA, 36 bp, Artificial Sequence
  Description of Artificial Sequence: Synthetic oligonucleotide
tgagaaaaccagcacaaaaacgaccacaccatatgc

SEQ ID NO: 312181 - DNA, 35 bp, Artificial Sequence
  Description of Artificial Sequence: Synthetic oligonucleotide
gagaaaaccagcacaaaaacgaccacaccatatgc

SEQ ID NO: 312182 - DNA, 36 bp, Artificial Sequence
  Description of Artificial Sequence: Synthetic oligonucleotide
agaaaaccagcacaaaaacgaccacaccatatgctc

SEQ ID NO: 312183 - DNA, 35 bp, Artificial Sequence
  Description of Artificial Sequence: Synthetic oligonucleotide
gaaaaccagcacaaaaacgaccacaccatatgctc

SEQ ID NO: 312184 - DNA, 37 bp, Artificial Sequence
  Description of Artificial Sequence: Synthetic oligonucleotide
aaaaccagcacaaaaacgaccacaccatatgctcaag

SEQ ID NO: 312185 - DNA, 36 bp, Artificial Sequence
  Description of Artificial Sequence: Synthetic oligonucleotide
aaaccagcacaaaaacgaccacaccatatgctcaag

SEQ ID NO: 312186 - DNA, 35 bp, Artificial Sequence
  Description of Artificial Sequence: Synthetic oligonucleotide
aaccagcacaaaaacgaccacaccatatgctcaag

SEQ ID NO: 312187 - DNA, 34 bp, Artificial Sequence
  Description of Artificial Sequence: Synthetic oligonucleotide
accagcacaaaaacgaccacaccatatgctcaag

SEQ ID NO: 312188 - DNA, 33 bp, Artificial Sequence
  Description of Artificial Sequence: Synthetic oligonucleotide
ccagcacaaaaacgaccacaccatatgctcaag

SEQ ID NO: 312189 - DNA, 33 bp, Artificial Sequence
  Description of Artificial Sequence: Synthetic oligonucleotide
cagcacaaaaacgaccacaccatatgctcaagg

SEQ ID NO: 312190 - DNA, 35 bp, Artificial Sequence
  Description of Artificial Sequence: Synthetic oligonucleotide
agcacaaaaacgaccacaccatatgctcaaggaac

SEQ ID NO: 312191 - DNA, 34 bp, Artificial Sequence
  Description of Artificial Sequence: Synthetic oligonucleotide
gcacaaaaacgaccacaccatatgctcaaggaac

SEQ ID NO: 312192 - DNA, 35 bp, Artificial Sequence
  Description of Artificial Sequence: Synthetic oligonucleotide
cacaaaaacgaccacaccatatgctcaaggaacac

SEQ ID NO: 312193 - DNA, 35 bp, Artificial Sequence
  Description of Artificial Sequence: Synthetic oligonucleotide
acaaaaacgaccacaccatatgctcaaggaacacg

SEQ ID NO: 312194 - DNA, 34 bp, Artificial Sequence
  Description of Artificial Sequence: Synthetic oligonucleotide
caaaaacgaccacaccatatgctcaaggaacacg

SEQ ID NO: 312195 - DNA, 34 bp, Artificial Sequence
  Description of Artificial Sequence: Synthetic oligonucleotide
aaaaacgaccacaccatatgctcaaggaacacgg

SEQ ID NO: 312196 - DNA, 33 bp, Artificial Sequence
  Description of Artificial Sequence: Synthetic oligonucleotide
aaaacgaccacaccatatgctcaaggaacacgg

SEQ ID NO: 312197 - DNA, 32 bp, Artificial Sequence
  Description of Artificial Sequence: Synthetic oligonucleotide
aaacgaccacaccatatgctcaaggaacacgg

SEQ ID NO: 312198 - DNA, 31 bp, Artificial Sequence
  Description of Artificial Sequence: Synthetic oligonucleotide
aacgaccacaccatatgctcaaggaacacgg

SEQ ID NO: 312199 - DNA, 30 bp, Artificial Sequence
  Description of Artificial Sequence: Synthetic oligonucleotide
acgaccacaccatatgctcaaggaacacgg

SEQ ID NO: 312200 - DNA, 29 bp, Artificial Sequence
  Description of Artificial Sequence: Synthetic oligonucleotide
cgaccacaccatatgctcaaggaacacgg

SEQ ID NO: 312201 - DNA, 30 bp, Artificial Sequence
  Description of Artificial Sequence: Synthetic oligonucleotide
gaccacaccatatgctcaaggaacacggag

SEQ ID NO: 312202 - DNA, 32 bp, Artificial Sequence
  Description of Artificial Sequence: Synthetic oligonucleotide
accacaccatatgctcaaggaacacggagaac

SEQ ID NO: 312203 - DNA, 31 bp, Artificial Sequence
  Description of Artificial Sequence: Synthetic oligonucleotide
ccacaccatatgctcaaggaacacggagaac

SEQ ID NO: 312204 - DNA, 32 bp, Artificial Sequence
  Description of Artificial Sequence: Synthetic oligonucleotide
cacaccatatgctcaaggaacacggagaacac

SEQ ID NO: 312205 - DNA, 32 bp, Artificial Sequence
  Description of Artificial Sequence: Synthetic oligonucleotide
acaccatatgctcaaggaacacggagaacacc

SEQ ID NO: 312206 - DNA, 31 bp, Artificial Sequence
  Description of Artificial Sequence: Synthetic oligonucleotide
caccatatgctcaaggaacacggagaacacc

SEQ ID NO: 312207 - DNA, 32 bp, Artificial Sequence
  Description of Artificial Sequence: Synthetic oligonucleotide
accatatgctcaaggaacacggagaacacctg

SEQ ID NO: 312208 - DNA, 31 bp, Artificial Sequence
  Description of Artificial Sequence: Synthetic oligonucleotide
ccatatgctcaaggaacacggagaacacctg

SEQ ID NO: 312209 - DNA, 34 bp, Artificial Sequence
  Description of Artificial Sequence: Synthetic oligonucleotide
catatgctcaaggaacacggagaacacctgttac

SEQ ID NO: 312210 - DNA, 34 bp, Artificial Sequence
  Description of Artificial Sequence: Synthetic oligonucleotide
atatgctcaaggaacacggagaacacctgttacc

SEQ ID NO: 312211 - DNA, 33 bp, Artificial Sequence
  Description of Artificial Sequence: Synthetic oligonucleotide
tatgctcaaggaacacggagaacacctgttacc

SEQ ID NO: 312212 - DNA, 32 bp, Artificial Sequence
  Description of Artificial Sequence: Synthetic oligonucleotide
atgctcaaggaacacggagaacacctgttacc

SEQ ID NO: 312213 - DNA, 31 bp, Artificial Sequence
  Description of Artificial Sequence: Synthetic oligonucleotide
tgctcaaggaacacggagaacacctgttacc

SEQ ID NO: 312214 - DNA, 30 bp, Artificial Sequence
  Description of Artificial Sequence: Synthetic oligonucleotide
gctcaaggaacacggagaacacctgttacc

SEQ ID NO: 312215 - DNA, 31 bp, Artificial Sequence
  Description of Artificial Sequence: Synthetic oligonucleotide
ctcaaggaacacggagaacacctgttaccag

SEQ ID NO: 312216 - DNA, 31 bp, Artificial Sequence
  Description of Artificial Sequence: Synthetic oligonucleotide
tcaaggaacacggagaacacctgttaccagg

SEQ ID NO: 312217 - DNA, 30 bp, Artificial Sequence
  Description of Artificial Sequence: Synthetic oligonucleotide
caaggaacacggagaacacctgttaccagg

SEQ ID NO: 312218 - DNA, 31 bp, Artificial Sequence
  Description of Artificial Sequence: Synthetic oligonucleotide
aaggaacacggagaacacctgttaccaggac

SEQ ID NO: 312219 - DNA, 30 bp, Artificial Sequence
  Description of Artificial Sequence: Synthetic oligonucleotide
aggaacacggagaacacctgttaccaggac

SEQ ID NO: 312220 - DNA, 29 bp, Artificial Sequence
  Description of Artificial Sequence: Synthetic oligonucleotide
ggaacacggagaacacctgttaccaggac

SEQ ID NO: 312221 - DNA, 31 bp, Artificial Sequence
  Description of Artificial Sequence: Synthetic oligonucleotide
gaacacggagaacacctgttaccaggacaag

SEQ ID NO: 312222 - DNA, 31 bp, Artificial Sequence
  Description of Artificial Sequence: Synthetic oligonucleotide
aacacggagaacacctgttaccaggacaagc

SEQ ID NO: 312223 - DNA, 30 bp, Artificial Sequence
  Description of Artificial Sequence: Synthetic oligonucleotide
acacggagaacacctgttaccaggacaagc

SEQ ID NO: 312224 - DNA, 29 bp, Artificial Sequence
  Description of Artificial Sequence: Synthetic oligonucleotide
cacggagaacacctgttaccaggacaagc

SEQ ID NO: 312225 - DNA, 31 bp, Artificial Sequence
  Description of Artificial Sequence: Synthetic oligonucleotide
acggagaacacctgttaccaggacaagcaag

SEQ ID NO: 312226 - DNA, 30 bp, Artificial Sequence
  Description of Artificial Sequence: Synthetic oligonucleotide
cggagaacacctgttaccaggacaagcaag

SEQ ID NO: 312227 - DNA, 30 bp, Artificial Sequence
  Description of Artificial Sequence: Synthetic oligonucleotide
ggagaacacctgttaccaggacaagcaagc

SEQ ID NO: 312228 - DNA, 35 bp, Artificial Sequence
  Description of Artificial Sequence: Synthetic oligonucleotide
gagaacacctgttaccaggacaagcaagcatttac

SEQ ID NO: 312229 - DNA, 37 bp, Artificial Sequence
  Description of Artificial Sequence: Synthetic oligonucleotide
agaacacctgttaccaggacaagcaagcatttacatg

SEQ ID NO: 312230 - DNA, 36 bp, Artificial Sequence
  Description of Artificial Sequence: Synthetic oligonucleotide
gaacacctgttaccaggacaagcaagcatttacatg

SEQ ID NO: 312231 - DNA, 39 bp, Artificial Sequence
  Description of Artificial Sequence: Synthetic oligonucleotide
aacacctgttaccaggacaagcaagcatttacatgaaac

SEQ ID NO: 312232 - DNA, 38 bp, Artificial Sequence
  Description of Artificial Sequence: Synthetic oligonucleotide
acacctgttaccaggacaagcaagcatttacatgaaac

SEQ ID NO: 312233 - DNA, 37 bp, Artificial Sequence
  Description of Artificial Sequence: Synthetic oligonucleotide
cacctgttaccaggacaagcaagcatttacatgaaac

SEQ ID NO: 312234 - DNA, 39 bp, Artificial Sequence
  Description of Artificial Sequence: Synthetic oligonucleotide
acctgttaccaggacaagcaagcatttacatgaaacatc

SEQ ID NO: 312235 - DNA, 38 bp, Artificial Sequence
  Description of Artificial Sequence: Synthetic oligonucleotide
cctgttaccaggacaagcaagcatttacatgaaacatc

SEQ ID NO: 312236 - DNA, 38 bp, Artificial Sequence
  Description of Artificial Sequence: Synthetic oligonucleotide
ctgttaccaggacaagcaagcatttacatgaaacatcc

SEQ ID NO: 312237 - DNA, 38 bp, Artificial Sequence
  Description of Artificial Sequence: Synthetic oligonucleotide
tgttaccaggacaagcaagcatttacatgaaacatccc

SEQ ID NO: 312238 - DNA, 37 bp, Artificial Sequence
  Description of Artificial Sequence: Synthetic oligonucleotide
gttaccaggacaagcaagcatttacatgaaacatccc

SEQ ID NO: 312239 - DNA, 37 bp, Artificial Sequence
  Description of Artificial Sequence: Synthetic oligonucleotide
ttaccaggacaagcaagcatttacatgaaacatcccc

SEQ ID NO: 312240 - DNA, 36 bp, Artificial Sequence
  Description of Artificial Sequence: Synthetic oligonucleotide
taccaggacaagcaagcatttacatgaaacatcccc

SEQ ID NO: 312241 - DNA, 35 bp, Artificial Sequence
  Description of Artificial Sequence: Synthetic oligonucleotide
accaggacaagcaagcatttacatgaaacatcccc

SEQ ID NO: 312242 - DNA, 34 bp, Artificial Sequence
  Description of Artificial Sequence: Synthetic oligonucleotide
ccaggacaagcaagcatttacatgaaacatcccc

SEQ ID NO: 312243 - DNA, 41 bp, Artificial Sequence
  Description of Artificial Sequence: Synthetic oligonucleotide
caggacaagcaagcatttacatgaaacatccccaaatatag

SEQ ID NO: 312244 - DNA, 41 bp, Artificial Sequence
  Description of Artificial Sequence: Synthetic oligonucleotide
aggacaagcaagcatttacatgaaacatccccaaatatagg

SEQ ID NO: 312245 - DNA, 40 bp, Artificial Sequence
  Description of Artificial Sequence: Synthetic oligonucleotide
ggacaagcaagcatttacatgaaacatccccaaatatagg

SEQ ID NO: 312246 - DNA, 42 bp, Artificial Sequence
  Description of Artificial Sequence: Synthetic oligonucleotide
gacaagcaagcatttacatgaaacatccccaaatataggaag

SEQ ID NO: 312247 - DNA, 43 bp, Artificial Sequence
  Description of Artificial Sequence: Synthetic oligonucleotide
acaagcaagcatttacatgaaacatccccaaatataggaagtg

SEQ ID NO: 312248 - DNA, 42 bp, Artificial Sequence
  Description of Artificial Sequence: Synthetic oligonucleotide
caagcaagcatttacatgaaacatccccaaatataggaagtg

SEQ ID NO: 312249 - DNA, 42 bp, Artificial Sequence
  Description of Artificial Sequence: Synthetic oligonucleotide
aagcaagcatttacatgaaacatccccaaatataggaagtgg

SEQ ID NO: 312250 - DNA, 41 bp, Artificial Sequence
  Description of Artificial Sequence: Synthetic oligonucleotide
agcaagcatttacatgaaacatccccaaatataggaagtgg

SEQ ID NO: 312251 - DNA, 40 bp, Artificial Sequence
  Description of Artificial Sequence: Synthetic oligonucleotide
gcaagcatttacatgaaacatccccaaatataggaagtgg

SEQ ID NO: 312252 - DNA, 42 bp, Artificial Sequence
  Description of Artificial Sequence: Synthetic oligonucleotide
caagcatttacatgaaacatccccaaatataggaagtggtac

SEQ ID NO: 312253 - DNA, 42 bp, Artificial Sequence
  Description of Artificial Sequence: Synthetic oligonucleotide
aagcatttacatgaaacatccccaaatataggaagtggtacc

SEQ ID NO: 312254 - DNA, 41 bp, Artificial Sequence
  Description of Artificial Sequence: Synthetic oligonucleotide
agcatttacatgaaacatccccaaatataggaagtggtacc

SEQ ID NO: 312255 - DNA, 40 bp, Artificial Sequence
  Description of Artificial Sequence: Synthetic oligonucleotide
gcatttacatgaaacatccccaaatataggaagtggtacc

SEQ ID NO: 312256 - DNA, 41 bp, Artificial Sequence
  Description of Artificial Sequence: Synthetic oligonucleotide
catttacatgaaacatccccaaatataggaagtggtaccac

SEQ ID NO: 312257 - DNA, 43 bp, Artificial Sequence
  Description of Artificial Sequence: Synthetic oligonucleotide
atttacatgaaacatccccaaatataggaagtggtaccacttc

SEQ ID NO: 312258 - DNA, 42 bp, Artificial Sequence
  Description of Artificial Sequence: Synthetic oligonucleotide
tttacatgaaacatccccaaatataggaagtggtaccacttc

SEQ ID NO: 312259 - DNA, 41 bp, Artificial Sequence
  Description of Artificial Sequence: Synthetic oligonucleotide
ttacatgaaacatccccaaatataggaagtggtaccacttc

SEQ ID NO: 312260 - DNA, 40 bp, Artificial Sequence
  Description of Artificial Sequence: Synthetic oligonucleotide
tacatgaaacatccccaaatataggaagtggtaccacttc

SEQ ID NO: 312261 - DNA, 39 bp, Artificial Sequence
  Description of Artificial Sequence: Synthetic oligonucleotide
acatgaaacatccccaaatataggaagtggtaccacttc

SEQ ID NO: 312262 - DNA, 38 bp, Artificial Sequence
  Description of Artificial Sequence: Synthetic oligonucleotide
catgaaacatccccaaatataggaagtggtaccacttc

SEQ ID NO: 312263 - DNA, 39 bp, Artificial Sequence
  Description of Artificial Sequence: Synthetic oligonucleotide
atgaaacatccccaaatataggaagtggtaccacttcac

SEQ ID NO: 312264 - DNA, 38 bp, Artificial Sequence
  Description of Artificial Sequence: Synthetic oligonucleotide
tgaaacatccccaaatataggaagtggtaccacttcac

SEQ ID NO: 312265 - DNA, 37 bp, Artificial Sequence
  Description of Artificial Sequence: Synthetic oligonucleotide
gaaacatccccaaatataggaagtggtaccacttcac

SEQ ID NO: 312266 - DNA, 37 bp, Artificial Sequence
  Description of Artificial Sequence: Synthetic oligonucleotide
aaacatccccaaatataggaagtggtaccacttcacg

SEQ ID NO: 312267 - DNA, 36 bp, Artificial Sequence
  Description of Artificial Sequence: Synthetic oligonucleotide
aacatccccaaatataggaagtggtaccacttcacg

SEQ ID NO: 312268 - DNA, 35 bp, Artificial Sequence
  Description of Artificial Sequence: Synthetic oligonucleotide
acatccccaaatataggaagtggtaccacttcacg

SEQ ID NO: 312269 - DNA, 34 bp, Artificial Sequence
  Description of Artificial Sequence: Synthetic oligonucleotide
catccccaaatataggaagtggtaccacttcacg

SEQ ID NO: 312270 - DNA, 36 bp, Artificial Sequence
  Description of Artificial Sequence: Synthetic oligonucleotide
atccccaaatataggaagtggtaccacttcacgtac

SEQ ID NO: 312271 - DNA, 35 bp, Artificial Sequence
  Description of Artificial Sequence: Synthetic oligonucleotide
tccccaaatataggaagtggtaccacttcacgtac

SEQ ID NO: 312272 - DNA, 34 bp, Artificial Sequence
  Description of Artificial Sequence: Synthetic oligonucleotide
ccccaaatataggaagtggtaccacttcacgtac

SEQ ID NO: 312273 - DNA, 36 bp, Artificial Sequence
  Description of Artificial Sequence: Synthetic oligonucleotide
cccaaatataggaagtggtaccacttcacgtactac

SEQ ID NO: 312274 - DNA, 36 bp, Artificial Sequence
  Description of Artificial Sequence: Synthetic oligonucleotide
ccaaatataggaagtggtaccacttcacgtactacc

SEQ ID NO: 312275 - DNA, 36 bp, Artificial Sequence
  Description of Artificial Sequence: Synthetic oligonucleotide
caaatataggaagtggtaccacttcacgtactaccc

SEQ ID NO: 312276 - DNA, 36 bp, Artificial Sequence
  Description of Artificial Sequence: Synthetic oligonucleotide
aaatataggaagtggtaccacttcacgtactacccc

SEQ ID NO: 312277 - DNA, 35 bp, Artificial Sequence
  Description of Artificial Sequence: Synthetic oligonucleotide
aatataggaagtggtaccacttcacgtactacccc

SEQ ID NO: 312278 - DNA, 34 bp, Artificial Sequence
  Description of Artificial Sequence: Synthetic oligonucleotide
atataggaagtggtaccacttcacgtactacccc

SEQ ID NO: 312279 - DNA, 33 bp, Artificial Sequence
  Description of Artificial Sequence: Synthetic oligonucleotide
tataggaagtggtaccacttcacgtactacccc

SEQ ID NO: 312280 - DNA, 32 bp, Artificial Sequence
  Description of Artificial Sequence: Synthetic oligonucleotide
ataggaagtggtaccacttcacgtactacccc

SEQ ID NO: 312281 - DNA, 31 bp, Artificial Sequence
  Description of Artificial Sequence: Synthetic oligonucleotide
taggaagtggtaccacttcacgtactacccc

SEQ ID NO: 312282 - DNA, 30 bp, Artificial Sequence
  Description of Artificial Sequence: Synthetic oligonucleotide
aggaagtggtaccacttcacgtactacccc

SEQ ID NO: 312283 - DNA, 29 bp, Artificial Sequence
  Description of Artificial Sequence: Synthetic oligonucleotide
ggaagtggtaccacttcacgtactacccc

SEQ ID NO: 312284 - DNA, 30 bp, Artificial Sequence
  Description of Artificial Sequence: Synthetic oligonucleotide
gaagtggtaccacttcacgtactacccctc

SEQ ID NO: 312285 - DNA, 32 bp, Artificial Sequence
  Description of Artificial Sequence: Synthetic oligonucleotide
aagtggtaccacttcacgtactacccctcttc

SEQ ID NO: 312286 - DNA, 31 bp, Artificial Sequence
  Description of Artificial Sequence: Synthetic oligonucleotide
agtggtaccacttcacgtactacccctcttc

SEQ ID NO: 312287 - DNA, 30 bp, Artificial Sequence
  Description of Artificial Sequence: Synthetic oligonucleotide
gtggtaccacttcacgtactacccctcttc

SEQ ID NO: 312288 - DNA, 33 bp, Artificial Sequence
  Description of Artificial Sequence: Synthetic oligonucleotide
tggtaccacttcacgtactacccctcttctatc

SEQ ID NO: 312289 - DNA, 32 bp, Artificial Sequence
  Description of Artificial Sequence: Synthetic oligonucleotide
ggtaccacttcacgtactacccctcttctatc

SEQ ID NO: 312290 - DNA, 33 bp, Artificial Sequence
  Description of Artificial Sequence: Synthetic oligonucleotide
gtaccacttcacgtactacccctcttctatcag

SEQ ID NO: 312291 - DNA, 33 bp, Artificial Sequence
  Description of Artificial Sequence: Synthetic oligonucleotide
taccacttcacgtactacccctcttctatcagg

SEQ ID NO: 312292 - DNA, 32 bp, Artificial Sequence
  Description of Artificial Sequence: Synthetic oligonucleotide
accacttcacgtactacccctcttctatcagg

SEQ ID NO: 312293 - DNA, 31 bp, Artificial Sequence
  Description of Artificial Sequence: Synthetic oligonucleotide
ccacttcacgtactacccctcttctatcagg

SEQ ID NO: 312294 - DNA, 31 bp, Artificial Sequence
  Description of Artificial Sequence: Synthetic oligonucleotide
cacttcacgtactacccctcttctatcaggg

SEQ ID NO: 312295 - DNA, 31 bp, Artificial Sequence
  Description of Artificial Sequence: Synthetic oligonucleotide
acttcacgtactacccctcttctatcagggc

SEQ ID NO: 312296 - DNA, 30 bp, Artificial Sequence
  Description of Artificial Sequence: Synthetic oligonucleotide
cttcacgtactacccctcttctatcagggc

SEQ ID NO: 312297 - DNA, 31 bp, Artificial Sequence
  Description of Artificial Sequence: Synthetic oligonucleotide
ttcacgtactacccctcttctatcagggcac

SEQ ID NO: 312298 - DNA, 30 bp, Artificial Sequence
  Description of Artificial Sequence: Synthetic oligonucleotide
tcacgtactacccctcttctatcagggcac

SEQ ID NO: 312299 - DNA, 29 bp, Artificial Sequence
  Description of Artificial Sequence: Synthetic oligonucleotide
cacgtactacccctcttctatcagggcac

SEQ ID NO: 312300 - DNA, 30 bp, Artificial Sequence
  Description of Artificial Sequence: Synthetic oligonucleotide
acgtactacccctcttctatcagggcacac

SEQ ID NO: 312301 - DNA, 29 bp, Artificial Sequence
  Description of Artificial Sequence: Synthetic oligonucleotide
cgtactacccctcttctatcagggcacac

SEQ ID NO: 312302 - DNA, 29 bp, Artificial Sequence
  Description of Artificial Sequence: Synthetic oligonucleotide
gtactacccctcttctatcagggcacacg

SEQ ID NO: 312303 - DNA, 30 bp, Artificial Sequence
  Description of Artificial Sequence: Synthetic oligonucleotide
tactacccctcttctatcagggcacacgag

SEQ ID NO: 312304 - DNA, 29 bp, Artificial Sequence
  Description of Artificial Sequence: Synthetic oligonucleotide
actacccctcttctatcagggcacacgag

SEQ ID NO: 312305 - DNA, 28 bp, Artificial Sequence
  Description of Artificial Sequence: Synthetic oligonucleotide
ctacccctcttctatcagggcacacgag

SEQ ID NO: 312306 - DNA, 31 bp, Artificial Sequence
  Description of Artificial Sequence: Synthetic oligonucleotide
tacccctcttctatcagggcacacgagtttc

SEQ ID NO: 312307 - DNA, 30 bp, Artificial Sequence
  Description of Artificial Sequence: Synthetic oligonucleotide
acccctcttctatcagggcacacgagtttc

SEQ ID NO: 312308 - DNA, 29 bp, Artificial Sequence
  Description of Artificial Sequence: Synthetic oligonucleotide
cccctcttctatcagggcacacgagtttc

SEQ ID NO: 312309 - DNA, 30 bp, Artificial Sequence
  Description of Artificial Sequence: Synthetic oligonucleotide
ccctcttctatcagggcacacgagtttcac

SEQ ID NO: 312310 - DNA, 30 bp, Artificial Sequence
  Description of Artificial Sequence: Synthetic oligonucleotide
cctcttctatcagggcacacgagtttcacg

SEQ ID NO: 312311 - DNA, 32 bp, Artificial Sequence
  Description of Artificial Sequence: Synthetic oligonucleotide
ctcttctatcagggcacacgagtttcacgtag

SEQ ID NO: 312312 - DNA, 33 bp, Artificial Sequence
  Description of Artificial Sequence: Synthetic oligonucleotide
tcttctatcagggcacacgagtttcacgtagac

SEQ ID NO: 312313 - DNA, 32 bp, Artificial Sequence
  Description of Artificial Sequence: Synthetic oligonucleotide
cttctatcagggcacacgagtttcacgtagac

SEQ ID NO: 312314 - DNA, 33 bp, Artificial Sequence
  Description of Artificial Sequence: Synthetic oligonucleotide
ttctatcagggcacacgagtttcacgtagacag

SEQ ID NO: 312315 - DNA, 32 bp, Artificial Sequence
  Description of Artificial Sequence: Synthetic oligonucleotide
tctatcagggcacacgagtttcacgtagacag

SEQ ID NO: 312316 - DNA, 31 bp, Artificial Sequence
  Description of Artificial Sequence: Synthetic oligonucleotide
ctatcagggcacacgagtttcacgtagacag

SEQ ID NO: 312317 - DNA, 31 bp, Artificial Sequence
  Description of Artificial Sequence: Synthetic oligonucleotide
tatcagggcacacgagtttcacgtagacagg

SEQ ID NO: 312318 - DNA, 30 bp, Artificial Sequence
  Description of Artificial Sequence: Synthetic oligonucleotide
atcagggcacacgagtttcacgtagacagg

SEQ ID NO: 312319 - DNA, 29 bp, Artificial Sequence
  Description of Artificial Sequence: Synthetic oligonucleotide
tcagggcacacgagtttcacgtagacagg

SEQ ID NO: 312320 - DNA, 28 bp, Artificial Sequence
  Description of Artificial Sequence: Synthetic oligonucleotide
cagggcacacgagtttcacgtagacagg

SEQ ID NO: 312321 - DNA, 31 bp, Artificial Sequence
  Description of Artificial Sequence: Synthetic oligonucleotide
agggcacacgagtttcacgtagacaggtttc

SEQ ID NO: 312322 - DNA, 30 bp, Artificial Sequence
  Description of Artificial Sequence: Synthetic oligonucleotide
gggcacacgagtttcacgtagacaggtttc

SEQ ID NO: 312323 - DNA, 30 bp, Artificial Sequence
  Description of Artificial Sequence: Synthetic oligonucleotide
ggcacacgagtttcacgtagacaggtttcc

SEQ ID NO: 312324 - DNA, 32 bp, Artificial Sequence
  Description of Artificial Sequence: Synthetic oligonucleotide
gcacacgagtttcacgtagacaggtttccttg

SEQ ID NO: 312325 - DNA, 32 bp, Artificial Sequence
  Description of Artificial Sequence: Synthetic oligonucleotide
cacacgagtttcacgtagacaggtttccttgg

SEQ ID NO: 312326 - DNA, 32 bp, Artificial Sequence
  Description of Artificial Sequence: Synthetic oligonucleotide
acacgagtttcacgtagacaggtttccttggg

SEQ ID NO: 312327 - DNA, 31 bp, Artificial Sequence
  Description of Artificial Sequence: Synthetic oligonucleotide
cacgagtttcacgtagacaggtttccttggg

SEQ ID NO: 312328 - DNA, 32 bp, Artificial Sequence
  Description of Artificial Sequence: Synthetic oligonucleotide
acgagtttcacgtagacaggtttccttgggac

SEQ ID NO: 312329 - DNA, 31 bp, Artificial Sequence
  Description of Artificial Sequence: Synthetic oligonucleotide
cgagtttcacgtagacaggtttccttgggac

SEQ ID NO: 312330 - DNA, 31 bp, Artificial Sequence
  Description of Artificial Sequence: Synthetic oligonucleotide
gagtttcacgtagacaggtttccttgggacg

SEQ ID NO: 312331 - DNA, 31 bp, Artificial Sequence
  Description of Artificial Sequence: Synthetic oligonucleotide
agtttcacgtagacaggtttccttgggacgg

SEQ ID NO: 312332 - DNA, 30 bp, Artificial Sequence
  Description of Artificial Sequence: Synthetic oligonucleotide
gtttcacgtagacaggtttccttgggacgg

SEQ ID NO: 312333 - DNA, 32 bp, Artificial Sequence
  Description of Artificial Sequence: Synthetic oligonucleotide
tttcacgtagacaggtttccttgggacggtag

SEQ ID NO: 312334 - DNA, 31 bp, Artificial Sequence
  Description of Artificial Sequence: Synthetic oligonucleotide
ttcacgtagacaggtttccttgggacggtag

SEQ ID NO: 312335 - DNA, 30 bp, Artificial Sequence
  Description of Artificial Sequence: Synthetic oligonucleotide
tcacgtagacaggtttccttgggacggtag

SEQ ID NO: 312336 - DNA, 29 bp, Artificial Sequence
  Description of Artificial Sequence: Synthetic oligonucleotide
cacgtagacaggtttccttgggacggtag

SEQ ID NO: 312337 - DNA, 32 bp, Artificial Sequence
  Description of Artificial Sequence: Synthetic oligonucleotide
acgtagacaggtttccttgggacggtagtaac

SEQ ID NO: 312338 - DNA, 31 bp, Artificial Sequence
  Description of Artificial Sequence: Synthetic oligonucleotide
cgtagacaggtttccttgggacggtagtaac

SEQ ID NO: 312339 - DNA, 31 bp, Artificial Sequence
  Description of Artificial Sequence: Synthetic oligonucleotide
gtagacaggtttccttgggacggtagtaacc

SEQ ID NO: 312340 - DNA, 33 bp, Artificial Sequence
  Description of Artificial Sequence: Synthetic oligonucleotide
tagacaggtttccttgggacggtagtaaccaag

SEQ ID NO: 312341 - DNA, 32 bp, Artificial Sequence
  Description of Artificial Sequence: Synthetic oligonucleotide
agacaggtttccttgggacggtagtaaccaag

SEQ ID NO: 312342 - DNA, 31 bp, Artificial Sequence
  Description of Artificial Sequence: Synthetic oligonucleotide
gacaggtttccttgggacggtagtaaccaag

SEQ ID NO: 312343 - DNA, 31 bp, Artificial Sequence
  Description of Artificial Sequence: Synthetic oligonucleotide
acaggtttccttgggacggtagtaaccaagg

SEQ ID NO: 312344 - DNA, 30 bp, Artificial Sequence
  Description of Artificial Sequence: Synthetic oligonucleotide
caggtttccttgggacggtagtaaccaagg

SEQ ID NO: 312345 - DNA, 30 bp, Artificial Sequence
  Description of Artificial Sequence: Synthetic oligonucleotide
aggtttccttgggacggtagtaaccaaggg

SEQ ID NO: 312346 - DNA, 29 bp, Artificial Sequence
  Description of Artificial Sequence: Synthetic oligonucleotide
ggtttccttgggacggtagtaaccaaggg

SEQ ID NO: 312347 - DNA, 29 bp, Artificial Sequence
  Description of Artificial Sequence: Synthetic oligonucleotide
gtttccttgggacggtagtaaccaagggc

SEQ ID NO: 312348 - DNA, 31 bp, Artificial Sequence
  Description of Artificial Sequence: Synthetic oligonucleotide
tttccttgggacggtagtaaccaagggcttg

SEQ ID NO: 312349 - DNA, 30 bp, Artificial Sequence
  Description of Artificial Sequence: Synthetic oligonucleotide
ttccttgggacggtagtaaccaagggcttg

SEQ ID NO: 312350 - DNA, 29 bp, Artificial Sequence
  Description of Artificial Sequence: Synthetic oligonucleotide
tccttgggacggtagtaaccaagggcttg

SEQ ID NO: 312351 - DNA, 28 bp, Artificial Sequence
  Description of Artificial Sequence: Synthetic oligonucleotide
ccttgggacggtagtaaccaagggcttg

SEQ ID NO: 312352 - DNA, 28 bp, Artificial Sequence
  Description of Artificial Sequence: Synthetic oligonucleotide
cttgggacggtagtaaccaagggcttgc

SEQ ID NO: 312353 - DNA, 29 bp, Artificial Sequence
  Description of Artificial Sequence: Synthetic oligonucleotide
ttgggacggtagtaaccaagggcttgctc

SEQ ID NO: 312354 - DNA, 28 bp, Artificial Sequence
  Description of Artificial Sequence: Synthetic oligonucleotide
tgggacggtagtaaccaagggcttgctc

SEQ ID NO: 312355 - DNA, 27 bp, Artificial Sequence
  Description of Artificial Sequence: Synthetic oligonucleotide
gggacggtagtaaccaagggcttgctc

SEQ ID NO: 312356 - DNA, 28 bp, Artificial Sequence
  Description of Artificial Sequence: Synthetic oligonucleotide
ggacggtagtaaccaagggcttgctcac

SEQ ID NO: 312357 - DNA, 31 bp, Artificial Sequence
  Description of Artificial Sequence: Synthetic oligonucleotide
gacggtagtaaccaagggcttgctcacttag

SEQ ID NO: 312358 - DNA, 36 bp, Artificial Sequence
  Description of Artificial Sequence: Synthetic oligonucleotide
atggaggaggtgcaggatgtttatgaagagatgatg

SEQ ID NO: 312359 - DNA, 35 bp, Artificial Sequence
  Description of Artificial Sequence: Synthetic oligonucleotide
tggaggaggtgcaggatgtttatgaagagatgatg

SEQ ID NO: 312360 - DNA, 34 bp, Artificial Sequence
  Description of Artificial Sequence: Synthetic oligonucleotide
ggaggaggtgcaggatgtttatgaagagatgatg

SEQ ID NO: 312361 - DNA, 34 bp, Artificial Sequence
  Description of Artificial Sequence: Synthetic oligonucleotide
gaggaggtgcaggatgtttatgaagagatgatgg

SEQ ID NO: 312362 - DNA, 35 bp, Artificial Sequence
  Description of Artificial Sequence: Synthetic oligonucleotide
aggaggtgcaggatgtttatgaagagatgatggag

SEQ ID NO: 312363 - DNA, 34 bp, Artificial Sequence
  Description of Artificial Sequence: Synthetic oligonucleotide
ggaggtgcaggatgtttatgaagagatgatggag

SEQ ID NO: 312364 - DNA, 34 bp, Artificial Sequence
  Description of Artificial Sequence: Synthetic oligonucleotide
gaggtgcaggatgtttatgaagagatgatggagc

SEQ ID NO: 312365 - DNA, 35 bp, Artificial Sequence
  Description of Artificial Sequence: Synthetic oligonucleotide
aggtgcaggatgtttatgaagagatgatggagcag

SEQ ID NO: 312366 - DNA, 34 bp, Artificial Sequence
  Description of Artificial Sequence: Synthetic oligonucleotide
ggtgcaggatgtttatgaagagatgatggagcag

SEQ ID NO: 312367 - DNA, 37 bp, Artificial Sequence
  Description of Artificial Sequence: Synthetic oligonucleotide
gtgcaggatgtttatgaagagatgatggagcagaatc

SEQ ID NO: 312368 - DNA, 38 bp, Artificial Sequence
  Description of Artificial Sequence: Synthetic oligonucleotide
tgcaggatgtttatgaagagatgatggagcagaatctg

SEQ ID NO: 312369 - DNA, 37 bp, Artificial Sequence
  Description of Artificial Sequence: Synthetic oligonucleotide
gcaggatgtttatgaagagatgatggagcagaatctg

SEQ ID NO: 312370 - DNA, 37 bp, Artificial Sequence
  Description of Artificial Sequence: Synthetic oligonucleotide
caggatgtttatgaagagatgatggagcagaatctgg

SEQ ID NO: 312371 - DNA, 38 bp, Artificial Sequence
  Description of Artificial Sequence: Synthetic oligonucleotide
aggatgtttatgaagagatgatggagcagaatctggtg

SEQ ID NO: 312372 - DNA, 37 bp, Artificial Sequence
  Description of Artificial Sequence: Synthetic oligonucleotide
ggatgtttatgaagagatgatggagcagaatctggtg

SEQ ID NO: 312373 - DNA, 37 bp, Artificial Sequence
  Description of Artificial Sequence: Synthetic oligonucleotide
gatgtttatgaagagatgatggagcagaatctggtgc

SEQ ID NO: 312374 - DNA, 38 bp, Artificial Sequence
  Description of Artificial Sequence: Synthetic oligonucleotide
atgtttatgaagagatgatggagcagaatctggtgcag

SEQ ID NO: 312375 - DNA, 37 bp, Artificial Sequence
  Description of Artificial Sequence: Synthetic oligonucleotide
tgtttatgaagagatgatggagcagaatctggtgcag

SEQ ID NO: 312376 - DNA, 36 bp, Artificial Sequence
  Description of Artificial Sequence: Synthetic oligonucleotide
gtttatgaagagatgatggagcagaatctggtgcag

SEQ ID NO: 312377 - DNA, 36 bp, Artificial Sequence
  Description of Artificial Sequence: Synthetic oligonucleotide
tttatgaagagatgatggagcagaatctggtgcagg

SEQ ID NO: 312378 - DNA, 35 bp, Artificial Sequence
  Description of Artificial Sequence: Synthetic oligonucleotide
ttatgaagagatgatggagcagaatctggtgcagg

SEQ ID NO: 312379 - DNA, 34 bp, Artificial Sequence
  Description of Artificial Sequence: Synthetic oligonucleotide
tatgaagagatgatggagcagaatctggtgcagg

SEQ ID NO: 312380 - DNA, 33 bp, Artificial Sequence
  Description of Artificial Sequence: Synthetic oligonucleotide
atgaagagatgatggagcagaatctggtgcagg

SEQ ID NO: 312381 - DNA, 32 bp, Artificial Sequence
  Description of Artificial Sequence: Synthetic oligonucleotide
tgaagagatgatggagcagaatctggtgcagg

SEQ ID NO: 312382 - DNA, 31 bp, Artificial Sequence
  Description of Artificial Sequence: Synthetic oligonucleotide
gaagagatgatggagcagaatctggtgcagg

SEQ ID NO: 312383 - DNA, 32 bp, Artificial Sequence
  Description of Artificial Sequence: Synthetic oligonucleotide
aagagatgatggagcagaatctggtgcaggag

SEQ ID NO: 312384 - DNA, 31 bp, Artificial Sequence
  Description of Artificial Sequence: Synthetic oligonucleotide
agagatgatggagcagaatctggtgcaggag

SEQ ID NO: 312385 - DNA, 30 bp, Artificial Sequence
  Description of Artificial Sequence: Synthetic oligonucleotide
gagatgatggagcagaatctggtgcaggag

SEQ ID NO: 312386 - DNA, 30 bp, Artificial Sequence
  Description of Artificial Sequence: Synthetic oligonucleotide
agatgatggagcagaatctggtgcaggagg

SEQ ID NO: 312387 - DNA, 29 bp, Artificial Sequence
  Description of Artificial Sequence: Synthetic oligonucleotide
gatgatggagcagaatctggtgcaggagg

SEQ ID NO: 312388 - DNA, 34 bp, Artificial Sequence
  Description of Artificial Sequence: Synthetic oligonucleotide
atgatggagcagaatctggtgcaggaggattatg

SEQ ID NO: 312389 - DNA, 33 bp, Artificial Sequence
  Description of Artificial Sequence: Synthetic oligonucleotide
tgatggagcagaatctggtgcaggaggattatg

SEQ ID NO: 312390 - DNA, 32 bp, Artificial Sequence
  Description of Artificial Sequence: Synthetic oligonucleotide
gatggagcagaatctggtgcaggaggattatg

SEQ ID NO: 312391 - DNA, 34 bp, Artificial Sequence
  Description of Artificial Sequence: Synthetic oligonucleotide
atggagcagaatctggtgcaggaggattatgaag

SEQ ID NO: 312392 - DNA, 33 bp, Artificial Sequence
  Description of Artificial Sequence: Synthetic oligonucleotide
tggagcagaatctggtgcaggaggattatgaag

SEQ ID NO: 312393 - DNA, 32 bp, Artificial Sequence
  Description of Artificial Sequence: Synthetic oligonucleotide
ggagcagaatctggtgcaggaggattatgaag

SEQ ID NO: 312394 - DNA, 33 bp, Artificial Sequence
  Description of Artificial Sequence: Synthetic oligonucleotide
gagcagaatctggtgcaggaggattatgaagac

SEQ ID NO: 312395 - DNA, 33 bp, Artificial Sequence
  Description of Artificial Sequence: Synthetic oligonucleotide
agcagaatctggtgcaggaggattatgaagacg

SEQ ID NO: 312396 - DNA, 32 bp, Artificial Sequence
  Description of Artificial Sequence: Synthetic oligonucleotide
gcagaatctggtgcaggaggattatgaagacg

SEQ ID NO: 312397 - DNA, 32 bp, Artificial Sequence
  Description of Artificial Sequence: Synthetic oligonucleotide
cagaatctggtgcaggaggattatgaagacgc

SEQ ID NO: 312398 - DNA, 33 bp, Artificial Sequence
  Description of Artificial Sequence: Synthetic oligonucleotide
agaatctggtgcaggaggattatgaagacgcag

SEQ ID NO: 312399 - DNA, 32 bp, Artificial Sequence
  Description of Artificial Sequence: Synthetic oligonucleotide
gaatctggtgcaggaggattatgaagacgcag

SEQ ID NO: 312400 - DNA, 33 bp, Artificial Sequence
  Description of Artificial Sequence: Synthetic oligonucleotide
aatctggtgcaggaggattatgaagacgcagac

SEQ ID NO: 312401 - DNA, 32 bp, Artificial Sequence
  Description of Artificial Sequence: Synthetic oligonucleotide
atctggtgcaggaggattatgaagacgcagac

SEQ ID NO: 312402 - DNA, 31 bp, Artificial Sequence
  Description of Artificial Sequence: Synthetic oligonucleotide
tctggtgcaggaggattatgaagacgcagac

SEQ ID NO: 312403 - DNA, 30 bp, Artificial Sequence
  Description of Artificial Sequence: Synthetic oligonucleotide
ctggtgcaggaggattatgaagacgcagac

SEQ ID NO: 312404 - DNA, 32 bp, Artificial Sequence
  Description of Artificial Sequence: Synthetic oligonucleotide
tggtgcaggaggattatgaagacgcagacatc

SEQ ID NO: 312405 - DNA, 31 bp, Artificial Sequence
  Description of Artificial Sequence: Synthetic oligonucleotide
ggtgcaggaggattatgaagacgcagacatc

SEQ ID NO: 312406 - DNA, 31 bp, Artificial Sequence
  Description of Artificial Sequence: Synthetic oligonucleotide
gtgcaggaggattatgaagacgcagacatcc

SEQ ID NO: 312407 - DNA, 31 bp, Artificial Sequence
  Description of Artificial Sequence: Synthetic oligonucleotide
tgcaggaggattatgaagacgcagacatccg

SEQ ID NO: 312408 - DNA, 30 bp, Artificial Sequence
  Description of Artificial Sequence: Synthetic oligonucleotide
gcaggaggattatgaagacgcagacatccg

SEQ ID NO: 312409 - DNA, 30 bp, Artificial Sequence
  Description of Artificial Sequence: Synthetic oligonucleotide
caggaggattatgaagacgcagacatccgc

SEQ ID NO: 312410 - DNA, 30 bp, Artificial Sequence
  Description of Artificial Sequence: Synthetic oligonucleotide
aggaggattatgaagacgcagacatccgcg

SEQ ID NO: 312411 - DNA, 29 bp, Artificial Sequence
  Description of Artificial Sequence: Synthetic oligonucleotide
ggaggattatgaagacgcagacatccgcg

SEQ ID NO: 312412 - DNA, 30 bp, Artificial Sequence
  Description of Artificial Sequence: Synthetic oligonucleotide
gaggattatgaagacgcagacatccgcgag

SEQ ID NO: 312413 - DNA, 31 bp, Artificial Sequence
  Description of Artificial Sequence: Synthetic oligonucleotide
aggattatgaagacgcagacatccgcgagtc

SEQ ID NO: 312414 - DNA, 30 bp, Artificial Sequence
  Description of Artificial Sequence: Synthetic oligonucleotide
ggattatgaagacgcagacatccgcgagtc

SEQ ID NO: 312415 - DNA, 30 bp, Artificial Sequence
  Description of Artificial Sequence: Synthetic oligonucleotide
gattatgaagacgcagacatccgcgagtcc

SEQ ID NO: 312416 - DNA, 30 bp, Artificial Sequence
  Description of Artificial Sequence: Synthetic oligonucleotide
attatgaagacgcagacatccgcgagtccc

SEQ ID NO: 312417 - DNA, 29 bp, Artificial Sequence
  Description of Artificial Sequence: Synthetic oligonucleotide
ttatgaagacgcagacatccgcgagtccc

SEQ ID NO: 312418 - DNA, 28 bp, Artificial Sequence
  Description of Artificial Sequence: Synthetic oligonucleotide
tatgaagacgcagacatccgcgagtccc

SEQ ID NO: 312419 - DNA, 27 bp, Artificial Sequence
  Description of Artificial Sequence: Synthetic oligonucleotide
atgaagacgcagacatccgcgagtccc

SEQ ID NO: 312420 - DNA, 27 bp, Artificial Sequence
  Description of Artificial Sequence: Synthetic oligonucleotide
tgaagacgcagacatccgcgagtccca

SEQ ID NO: 312421 - DNA, 26 bp, Artificial Sequence
  Description of Artificial Sequence: Synthetic oligonucleotide
gaagacgcagacatccgcgagtccca

SEQ ID NO: 312422 - DNA, 27 bp, Artificial Sequence
  Description of Artificial Sequence: Synthetic oligonucleotide
aagacgcagacatccgcgagtcccaca

SEQ ID NO: 312423 - DNA, 27 bp, Artificial Sequence
  Description of Artificial Sequence: Synthetic oligonucleotide
agacgcagacatccgcgagtcccacat

SEQ ID NO: 312424 - DNA, 26 bp, Artificial Sequence
  Description of Artificial Sequence: Synthetic oligonucleotide
gacgcagacatccgcgagtcccacat

SEQ ID NO: 312425 - DNA, 26 bp, Artificial Sequence
  Description of Artificial Sequence: Synthetic oligonucleotide
acgcagacatccgcgagtcccacatg

SEQ ID NO: 312426 - DNA, 25 bp, Artificial Sequence
  Description of Artificial Sequence: Synthetic oligonucleotide
cgcagacatccgcgagtcccacatg

SEQ ID NO: 312427 - DNA, 26 bp, Artificial Sequence
  Description of Artificial Sequence: Synthetic oligonucleotide
gcagacatccgcgagtcccacatgga

SEQ ID NO: 312428 - DNA, 26 bp, Artificial Sequence
  Description of Artificial Sequence: Synthetic oligonucleotide
cagacatccgcgagtcccacatggag

SEQ ID NO: 312429 - DNA, 27 bp, Artificial Sequence
  Description of Artificial Sequence: Synthetic oligonucleotide
agacatccgcgagtcccacatggagga

SEQ ID NO: 312430 - DNA, 26 bp, Artificial Sequence
  Description of Artificial Sequence: Synthetic oligonucleotide
gacatccgcgagtcccacatggagga

SEQ ID NO: 312431 - DNA, 26 bp, Artificial Sequence
  Description of Artificial Sequence: Synthetic oligonucleotide
acatccgcgagtcccacatggaggag

SEQ ID NO: 312432 - DNA, 25 bp, Artificial Sequence
  Description of Artificial Sequence: Synthetic oligonucleotide
catccgcgagtcccacatggaggag

SEQ ID NO: 312433 - DNA, 25 bp, Artificial Sequence
  Description of Artificial Sequence: Synthetic oligonucleotide
atccgcgagtcccacatggaggagg

SEQ ID NO: 312434 - DNA, 24 bp, Artificial Sequence
  Description of Artificial Sequence: Synthetic oligonucleotide
tccgcgagtcccacatggaggagg

SEQ ID NO: 312435 - DNA, 23 bp, Artificial Sequence
  Description of Artificial Sequence: Synthetic oligonucleotide
ccgcgagtcccacatggaggagg

SEQ ID NO: 312436 - DNA, 23 bp, Artificial Sequence
  Description of Artificial Sequence: Synthetic oligonucleotide
cgcgagtcccacatggaggaggc

SEQ ID NO: 312437 - DNA, 23 bp, Artificial Sequence
  Description of Artificial Sequence: Synthetic oligonucleotide
gcgagtcccacatggaggaggcg

SEQ ID NO: 312438 - DNA, 23 bp, Artificial Sequence
  Description of Artificial Sequence: Synthetic oligonucleotide
cgagtcccacatggaggaggcgg

SEQ ID NO: 312439 - DNA, 24 bp, Artificial Sequence
  Description of Artificial Sequence: Synthetic oligonucleotide
gagtcccacatggaggaggcggca

SEQ ID NO: 312440 - DNA, 24 bp, Artificial Sequence
  Description of Artificial Sequence: Synthetic oligonucleotide
agtcccacatggaggaggcggcag

SEQ ID NO: 312441 - DNA, 23 bp, Artificial Sequence
  Description of Artificial Sequence: Synthetic oligonucleotide
gtcccacatggaggaggcggcag

SEQ ID NO: 312442 - DNA, 24 bp, Artificial Sequence
  Description of Artificial Sequence: Synthetic oligonucleotide
tcccacatggaggaggcggcagct

SEQ ID NO: 312443 - DNA, 23 bp, Artificial Sequence
  Description of Artificial Sequence: Synthetic oligonucleotide
cccacatggaggaggcggcagct

SEQ ID NO: 312444 - DNA, 24 bp, Artificial Sequence
  Description of Artificial Sequence: Synthetic oligonucleotide
ccacatggaggaggcggcagctct

SEQ ID NO: 312445 - DNA, 24 bp, Artificial Sequence
  Description of Artificial Sequence: Synthetic oligonucleotide
cacatggaggaggcggcagctctc

SEQ ID NO: 312446 - DNA, 25 bp, Artificial Sequence
  Description of Artificial Sequence: Synthetic oligonucleotide
acatggaggaggcggcagctctcga

SEQ ID NO: 312447 - DNA, 24 bp, Artificial Sequence
  Description of Artificial Sequence: Synthetic oligonucleotide
catggaggaggcggcagctctcga

SEQ ID NO: 312448 - DNA, 25 bp, Artificial Sequence
  Description of Artificial Sequence: Synthetic oligonucleotide
atggaggaggcggcagctctcgaca

SEQ ID NO: 312449 - DNA, 24 bp, Artificial Sequence
  Description of Artificial Sequence: Synthetic oligonucleotide
tggaggaggcggcagctctcgaca

SEQ ID NO: 312450 - DNA, 23 bp, Artificial Sequence
  Description of Artificial Sequence: Synthetic oligonucleotide
ggaggaggcggcagctctcgaca

SEQ ID NO: 312451 - DNA, 23 bp, Artificial Sequence
  Description of Artificial Sequence: Synthetic oligonucleotide
gaggaggcggcagctctcgacac

SEQ ID NO: 312452 - DNA, 23 bp, Artificial Sequence
  Description of Artificial Sequence: Synthetic oligonucleotide
aggaggcggcagctctcgacacc

SEQ ID NO: 312453 - DNA, 22 bp, Artificial Sequence
  Description of Artificial Sequence: Synthetic oligonucleotide
ggaggcggcagctctcgacacc

SEQ ID NO: 312454 - DNA, 23 bp, Artificial Sequence
  Description of Artificial Sequence: Synthetic oligonucleotide
gaggcggcagctctcgacaccga

SEQ ID NO: 312455 - DNA, 23 bp, Artificial Sequence
  Description of Artificial Sequence: Synthetic oligonucleotide
aggcggcagctctcgacaccgac

SEQ ID NO: 312456 - DNA, 22 bp, Artificial Sequence
  Description of Artificial Sequence: Synthetic oligonucleotide
ggcggcagctctcgacaccgac

SEQ ID NO: 312457 - DNA, 22 bp, Artificial Sequence
  Description of Artificial Sequence: Synthetic oligonucleotide
gcggcagctctcgacaccgacg

SEQ ID NO: 312458 - DNA, 24 bp, Artificial Sequence
  Description of Artificial Sequence: Synthetic oligonucleotide
cggcagctctcgacaccgacgcaa

SEQ ID NO: 312459 - DNA, 25 bp, Artificial Sequence
  Description of Artificial Sequence: Synthetic oligonucleotide
ggcagctctcgacaccgacgcaaca

SEQ ID NO: 312460 - DNA, 25 bp, Artificial Sequence
  Description of Artificial Sequence: Synthetic oligonucleotide
gcagctctcgacaccgacgcaacag

SEQ ID NO: 312461 - DNA, 25 bp, Artificial Sequence
  Description of Artificial Sequence: Synthetic oligonucleotide
cagctctcgacaccgacgcaacagc

SEQ ID NO: 312462 - DNA, 26 bp, Artificial Sequence
  Description of Artificial Sequence: Synthetic oligonucleotide
agctctcgacaccgacgcaacagcct

SEQ ID NO: 312463 - DNA, 25 bp, Artificial Sequence
  Description of Artificial Sequence: Synthetic oligonucleotide
gctctcgacaccgacgcaacagcct

SEQ ID NO: 312464 - DNA, 26 bp, Artificial Sequence
  Description of Artificial Sequence: Synthetic oligonucleotide
ctctcgacaccgacgcaacagcctca

SEQ ID NO: 312465 - DNA, 27 bp, Artificial Sequence
  Description of Artificial Sequence: Synthetic oligonucleotide
tctcgacaccgacgcaacagcctcaga

SEQ ID NO: 312466 - DNA, 26 bp, Artificial Sequence
  Description of Artificial Sequence: Synthetic oligonucleotide
ctcgacaccgacgcaacagcctcaga

SEQ ID NO: 312467 - DNA, 27 bp, Artificial Sequence
  Description of Artificial Sequence: Synthetic oligonucleotide
tcgacaccgacgcaacagcctcagact

SEQ ID NO: 312468 - DNA, 27 bp, Artificial Sequence
  Description of Artificial Sequence: Synthetic oligonucleotide
cgacaccgacgcaacagcctcagacta

SEQ ID NO: 312469 - DNA, 27 bp, Artificial Sequence
  Description of Artificial Sequence: Synthetic oligonucleotide
gacaccgacgcaacagcctcagactac

SEQ ID NO: 312470 - DNA, 27 bp, Artificial Sequence
  Description of Artificial Sequence: Synthetic oligonucleotide
acaccgacgcaacagcctcagactacc

SEQ ID NO: 312471 - DNA, 27 bp, Artificial Sequence
  Description of Artificial Sequence: Synthetic oligonucleotide
caccgacgcaacagcctcagactacct

SEQ ID NO: 312472 - DNA, 27 bp, Artificial Sequence
  Description of Artificial Sequence: Synthetic oligonucleotide
accgacgcaacagcctcagactacctc

SEQ ID NO: 312473 - DNA, 27 bp, Artificial Sequence
  Description of Artificial Sequence: Synthetic oligonucleotide
ccgacgcaacagcctcagactacctca

SEQ ID NO: 312474 - DNA, 27 bp, Artificial Sequence
  Description of Artificial Sequence: Synthetic oligonucleotide
cgacgcaacagcctcagactacctcac

SEQ ID NO: 312475 - DNA, 27 bp, Artificial Sequence
  Description of Artificial Sequence: Synthetic oligonucleotide
gacgcaacagcctcagactacctcacc

SEQ ID NO: 312476 - DNA, 28 bp, Artificial Sequence
  Description of Artificial Sequence: Synthetic oligonucleotide
acgcaacagcctcagactacctcaccac

SEQ ID NO: 312477 - DNA, 27 bp, Artificial Sequence
  Description of Artificial Sequence: Synthetic oligonucleotide
cgcaacagcctcagactacctcaccac

SEQ ID NO: 312478 - DNA, 29 bp, Artificial Sequence
  Description of Artificial Sequence: Synthetic oligonucleotide
gcaacagcctcagactacctcaccacatc

SEQ ID NO: 312479 - DNA, 30 bp, Artificial Sequence
  Description of Artificial Sequence: Synthetic oligonucleotide
caacagcctcagactacctcaccacatctc

SEQ ID NO: 312480 - DNA, 31 bp, Artificial Sequence
  Description of Artificial Sequence: Synthetic oligonucleotide
aacagcctcagactacctcaccacatctcac

SEQ ID NO: 312481 - DNA, 30 bp, Artificial Sequence
  Description of Artificial Sequence: Synthetic oligonucleotide
acagcctcagactacctcaccacatctcac

SEQ ID NO: 312482 - DNA, 29 bp, Artificial Sequence
  Description of Artificial Sequence: Synthetic oligonucleotide
cagcctcagactacctcaccacatctcac

SEQ ID NO: 312483 - DNA, 29 bp, Artificial Sequence
  Description of Artificial Sequence: Synthetic oligonucleotide
agcctcagactacctcaccacatctcacc

SEQ ID NO: 312484 - DNA, 28 bp, Artificial Sequence
  Description of Artificial Sequence: Synthetic oligonucleotide
gcctcagactacctcaccacatctcacc

SEQ ID NO: 312485 - DNA, 28 bp, Artificial Sequence
  Description of Artificial Sequence: Synthetic oligonucleotide
cctcagactacctcaccacatctcaccc

SEQ ID NO: 312486 - DNA, 28 bp, Artificial Sequence
  Description of Artificial Sequence: Synthetic oligonucleotide
ctcagactacctcaccacatctcacccg

SEQ ID NO: 312487 - DNA, 28 bp, Artificial Sequence
  Description of Artificial Sequence: Synthetic oligonucleotide
tcagactacctcaccacatctcacccgg

SEQ ID NO: 312488 - DNA, 27 bp, Artificial Sequence
  Description of Artificial Sequence: Synthetic oligonucleotide
cagactacctcaccacatctcacccgg

SEQ ID NO: 312489 - DNA, 27 bp, Artificial Sequence
  Description of Artificial Sequence: Synthetic oligonucleotide
agactacctcaccacatctcacccggg

SEQ ID NO: 312490 - DNA, 27 bp, Artificial Sequence
  Description of Artificial Sequence: Synthetic oligonucleotide
gactacctcaccacatctcacccgggt

SEQ ID NO: 312491 - DNA, 28 bp, Artificial Sequence
  Description of Artificial Sequence: Synthetic oligonucleotide
actacctcaccacatctcacccgggttc

SEQ ID NO: 312492 - DNA, 27 bp, Artificial Sequence
  Description of Artificial Sequence: Synthetic oligonucleotide
ctacctcaccacatctcacccgggttc

SEQ ID NO: 312493 - DNA, 27 bp, Artificial Sequence
  Description of Artificial Sequence: Synthetic oligonucleotide
tacctcaccacatctcacccgggttcc

SEQ ID NO: 312494 - DNA, 26 bp, Artificial Sequence
  Description of Artificial Sequence: Synthetic oligonucleotide
acctcaccacatctcacccgggttcc

SEQ ID NO: 312495 - DNA, 25 bp, Artificial Sequence
  Description of Artificial Sequence: Synthetic oligonucleotide
cctcaccacatctcacccgggttcc

SEQ ID NO: 312496 - DNA, 26 bp, Artificial Sequence
  Description of Artificial Sequence: Synthetic oligonucleotide
ctcaccacatctcacccgggttccca

SEQ ID NO: 312497 - DNA, 27 bp, Artificial Sequence
  Description of Artificial Sequence: Synthetic oligonucleotide
tcaccacatctcacccgggttcccaca

SEQ ID NO: 312498 - DNA, 27 bp, Artificial Sequence
  Description of Artificial Sequence: Synthetic oligonucleotide
caccacatctcacccgggttcccacaa

SEQ ID NO: 312499 - DNA, 27 bp, Artificial Sequence
  Description of Artificial Sequence: Synthetic oligonucleotide
accacatctcacccgggttcccacaag

SEQ ID NO: 312500 - DNA, 26 bp, Artificial Sequence
  Description of Artificial Sequence: Synthetic oligonucleotide
ccacatctcacccgggttcccacaag

SEQ ID NO: 312501 - DNA, 27 bp, Artificial Sequence
  Description of Artificial Sequence: Synthetic oligonucleotide
cacatctcacccgggttcccacaagga

SEQ ID NO: 312502 - DNA, 27 bp, Artificial Sequence
  Description of Artificial Sequence: Synthetic oligonucleotide
acatctcacccgggttcccacaaggac

SEQ ID NO: 312503 - DNA, 27 bp, Artificial Sequence
  Description of Artificial Sequence: Synthetic oligonucleotide
catctcacccgggttcccacaaggact

SEQ ID NO: 312504 - DNA, 29 bp, Artificial Sequence
  Description of Artificial Sequence: Synthetic oligonucleotide
atctcacccgggttcccacaaggactatg

SEQ ID NO: 312505 - DNA, 28 bp, Artificial Sequence
  Description of Artificial Sequence: Synthetic oligonucleotide
tctcacccgggttcccacaaggactatg

SEQ ID NO: 312506 - DNA, 27 bp, Artificial Sequence
  Description of Artificial Sequence: Synthetic oligonucleotide
ctcacccgggttcccacaaggactatg

SEQ ID NO: 312507 - DNA, 28 bp, Artificial Sequence
  Description of Artificial Sequence: Synthetic oligonucleotide
tcacccgggttcccacaaggactatgtg

SEQ ID NO: 312508 - DNA, 27 bp, Artificial Sequence
  Description of Artificial Sequence: Synthetic oligonucleotide
cacccgggttcccacaaggactatgtg

SEQ ID NO: 312509 - DNA, 27 bp, Artificial Sequence
  Description of Artificial Sequence: Synthetic oligonucleotide
acccgggttcccacaaggactatgtgg

SEQ ID NO: 312510 - DNA, 27 bp, Artificial Sequence
  Description of Artificial Sequence: Synthetic oligonucleotide
cccgggttcccacaaggactatgtgga

SEQ ID NO: 312511 - DNA, 27 bp, Artificial Sequence
  Description of Artificial Sequence: Synthetic oligonucleotide
ccgggttcccacaaggactatgtggac

SEQ ID NO: 312512 - DNA, 27 bp, Artificial Sequence
  Description of Artificial Sequence: Synthetic oligonucleotide
cgggttcccacaaggactatgtggacc

SEQ ID NO: 312513 - DNA, 28 bp, Artificial Sequence
  Description of Artificial Sequence: Synthetic oligonucleotide
gggttcccacaaggactatgtggacctg

SEQ ID NO: 312514 - DNA, 28 bp, Artificial Sequence
  Description of Artificial Sequence: Synthetic oligonucleotide
ggttcccacaaggactatgtggacctgc

SEQ ID NO: 312515 - DNA, 29 bp, Artificial Sequence
  Description of Artificial Sequence: Synthetic oligonucleotide
gttcccacaaggactatgtggacctgcag

SEQ ID NO: 312516 - DNA, 29 bp, Artificial Sequence
  Description of Artificial Sequence: Synthetic oligonucleotide
ttcccacaaggactatgtggacctgcagg

SEQ ID NO: 312517 - DNA, 28 bp, Artificial Sequence
  Description of Artificial Sequence: Synthetic oligonucleotide
tcccacaaggactatgtggacctgcagg

SEQ ID NO: 312518 - DNA, 27 bp, Artificial Sequence
  Description of Artificial Sequence: Synthetic oligonucleotide
cccacaaggactatgtggacctgcagg

SEQ ID NO: 312519 - DNA, 28 bp, Artificial Sequence
  Description of Artificial Sequence: Synthetic oligonucleotide
ccacaaggactatgtggacctgcaggag

SEQ ID NO: 312520 - DNA, 28 bp, Artificial Sequence
  Description of Artificial Sequence: Synthetic oligonucleotide
cacaaggactatgtggacctgcaggagg

SEQ ID NO: 312521 - DNA, 29 bp, Artificial Sequence
  Description of Artificial Sequence: Synthetic oligonucleotide
acaaggactatgtggacctgcaggaggtg

SEQ ID NO: 312522 - DNA, 28 bp, Artificial Sequence
  Description of Artificial Sequence: Synthetic oligonucleotide
caaggactatgtggacctgcaggaggtg

SEQ ID NO: 312523 - DNA, 28 bp, Artificial Sequence
  Description of Artificial Sequence: Synthetic oligonucleotide
aaggactatgtggacctgcaggaggtgg

SEQ ID NO: 312524 - DNA, 27 bp, Artificial Sequence
  Description of Artificial Sequence: Synthetic oligonucleotide
aggactatgtggacctgcaggaggtgg

SEQ ID NO: 312525 - DNA, 27 bp, Artificial Sequence
  Description of Artificial Sequence: Synthetic oligonucleotide
ggactatgtggacctgcaggaggtggt

SEQ ID NO: 312526 - DNA, 27 bp, Artificial Sequence
  Description of Artificial Sequence: Synthetic oligonucleotide
gactatgtggacctgcaggaggtggtg

SEQ ID NO: 312527 - DNA, 29 bp, Artificial Sequence
  Description of Artificial Sequence: Synthetic oligonucleotide
actatgtggacctgcaggaggtggtgatg

SEQ ID NO: 312528 - DNA, 28 bp, Artificial Sequence
  Description of Artificial Sequence: Synthetic oligonucleotide
ctatgtggacctgcaggaggtggtgatg

SEQ ID NO: 312529 - DNA, 28 bp, Artificial Sequence
  Description of Artificial Sequence: Synthetic oligonucleotide
tatgtggacctgcaggaggtggtgatgg

SEQ ID NO: 312530 - DNA, 27 bp, Artificial Sequence
  Description of Artificial Sequence: Synthetic oligonucleotide
atgtggacctgcaggaggtggtgatgg

SEQ ID NO: 312531 - DNA, 27 bp, Artificial Sequence
  Description of Artificial Sequence: Synthetic oligonucleotide
tgtggacctgcaggaggtggtgatggt

SEQ ID NO: 312532 - DNA, 26 bp, Artificial Sequence
  Description of Artificial Sequence: Synthetic oligonucleotide
gtggacctgcaggaggtggtgatggt

SEQ ID NO: 312533 - DNA, 26 bp, Artificial Sequence
  Description of Artificial Sequence: Synthetic oligonucleotide
tggacctgcaggaggtggtgatggtc

SEQ ID NO: 312534 - DNA, 25 bp, Artificial Sequence
  Description of Artificial Sequence: Synthetic oligonucleotide
ggacctgcaggaggtggtgatggtc

SEQ ID NO: 312535 - DNA, 27 bp, Artificial Sequence
  Description of Artificial Sequence: Synthetic oligonucleotide
gacctgcaggaggtggtgatggtcgaa

SEQ ID NO: 312536 - DNA, 29 bp, Artificial Sequence
  Description of Artificial Sequence: Synthetic oligonucleotide
acctgcaggaggtggtgatggtcgaaaag

SEQ ID NO: 312537 - DNA, 28 bp, Artificial Sequence
  Description of Artificial Sequence: Synthetic oligonucleotide
cctgcaggaggtggtgatggtcgaaaag

SEQ ID NO: 312538 - DNA, 30 bp, Artificial Sequence
  Description of Artificial Sequence: Synthetic oligonucleotide
ctgcaggaggtggtgatggtcgaaaagaag

SEQ ID NO: 312539 - DNA, 30 bp, Artificial Sequence
  Description of Artificial Sequence: Synthetic oligonucleotide
tgcaggaggtggtgatggtcgaaaagaagc

SEQ ID NO: 312540 - DNA, 29 bp, Artificial Sequence
  Description of Artificial Sequence: Synthetic oligonucleotide
gcaggaggtggtgatggtcgaaaagaagc

SEQ ID NO: 312541 - DNA, 30 bp, Artificial Sequence
  Description of Artificial Sequence: Synthetic oligonucleotide
caggaggtggtgatggtcgaaaagaagcag

SEQ ID NO: 312542 - DNA, 30 bp, Artificial Sequence
  Description of Artificial Sequence: Synthetic oligonucleotide
aggaggtggtgatggtcgaaaagaagcagg

SEQ ID NO: 312543 - DNA, 29 bp, Artificial Sequence
  Description of Artificial Sequence: Synthetic oligonucleotide
ggaggtggtgatggtcgaaaagaagcagg

SEQ ID NO: 312544 - DNA, 30 bp, Artificial Sequence
  Description of Artificial Sequence: Synthetic oligonucleotide
gaggtggtgatggtcgaaaagaagcaggag

SEQ ID NO: 312545 - DNA, 30 bp, Artificial Sequence
  Description of Artificial Sequence: Synthetic oligonucleotide
aggtggtgatggtcgaaaagaagcaggagc

SEQ ID NO: 312546 - DNA, 29 bp, Artificial Sequence
  Description of Artificial Sequence: Synthetic oligonucleotide
ggtggtgatggtcgaaaagaagcaggagc

SEQ ID NO: 312547 - DNA, 30 bp, Artificial Sequence
  Description of Artificial Sequence: Synthetic oligonucleotide
gtggtgatggtcgaaaagaagcaggagctg

SEQ ID NO: 312548 - DNA, 31 bp, Artificial Sequence
  Description of Artificial Sequence: Synthetic oligonucleotide
tggtgatggtcgaaaagaagcaggagctgtg

SEQ ID NO: 312549 - DNA, 30 bp, Artificial Sequence
  Description of Artificial Sequence: Synthetic oligonucleotide
ggtgatggtcgaaaagaagcaggagctgtg

SEQ ID NO: 312550 - DNA, 32 bp, Artificial Sequence
  Description of Artificial Sequence: Synthetic oligonucleotide
gtgatggtcgaaaagaagcaggagctgtgatg

SEQ ID NO: 312551 - DNA, 32 bp, Artificial Sequence
  Description of Artificial Sequence: Synthetic oligonucleotide
tgatggtcgaaaagaagcaggagctgtgatgg

SEQ ID NO: 312552 - DNA, 31 bp, Artificial Sequence
  Description of Artificial Sequence: Synthetic oligonucleotide
gatggtcgaaaagaagcaggagctgtgatgg

SEQ ID NO: 312553 - DNA, 33 bp, Artificial Sequence
  Description of Artificial Sequence: Synthetic oligonucleotide
atggtcgaaaagaagcaggagctgtgatggatg

SEQ ID NO: 312554 - DNA, 32 bp, Artificial Sequence
  Description of Artificial Sequence: Synthetic oligonucleotide
tggtcgaaaagaagcaggagctgtgatggatg

SEQ ID NO: 312555 - DNA, 31 bp, Artificial Sequence
  Description of Artificial Sequence: Synthetic oligonucleotide
ggtcgaaaagaagcaggagctgtgatggatg

SEQ ID NO: 312556 - DNA, 31 bp, Artificial Sequence
  Description of Artificial Sequence: Synthetic oligonucleotide
gtcgaaaagaagcaggagctgtgatggatgg

SEQ ID NO: 312557 - DNA, 32 bp, Artificial Sequence
  Description of Artificial Sequence: Synthetic oligonucleotide
tcgaaaagaagcaggagctgtgatggatggtg

SEQ ID NO: 312558 - DNA, 31 bp, Artificial Sequence
  Description of Artificial Sequence: Synthetic oligonucleotide
cgaaaagaagcaggagctgtgatggatggtg

SEQ ID NO: 312559 - DNA, 31 bp, Artificial Sequence
  Description of Artificial Sequence: Synthetic oligonucleotide
gaaaagaagcaggagctgtgatggatggtgg

SEQ ID NO: 312560 - DNA, 31 bp, Artificial Sequence
  Description of Artificial Sequence: Synthetic oligonucleotide
aaaagaagcaggagctgtgatggatggtggc

SEQ ID NO: 312561 - DNA, 30 bp, Artificial Sequence
  Description of Artificial Sequence: Synthetic oligonucleotide
aaagaagcaggagctgtgatggatggtggc

SEQ ID NO: 312562 - DNA, 29 bp, Artificial Sequence
  Description of Artificial Sequence: Synthetic oligonucleotide
aagaagcaggagctgtgatggatggtggc

SEQ ID NO: 312563 - DNA, 28 bp, Artificial Sequence
  Description of Artificial Sequence: Synthetic oligonucleotide
agaagcaggagctgtgatggatggtggc

SEQ ID NO: 312564 - DNA, 27 bp, Artificial Sequence
  Description of Artificial Sequence: Synthetic oligonucleotide
gaagcaggagctgtgatggatggtggc

SEQ ID NO: 312565 - DNA, 27 bp, Artificial Sequence
  Description of Artificial Sequence: Synthetic oligonucleotide
aagcaggagctgtgatggatggtggcg

SEQ ID NO: 312566 - DNA, 26 bp, Artificial Sequence
  Description of Artificial Sequence: Synthetic oligonucleotide
agcaggagctgtgatggatggtggcg

SEQ ID NO: 312567 - DNA, 25 bp, Artificial Sequence
  Description of Artificial Sequence: Synthetic oligonucleotide
gcaggagctgtgatggatggtggcg

SEQ ID NO: 312568 - DNA, 25 bp, Artificial Sequence
  Description of Artificial Sequence: Synthetic oligonucleotide
caggagctgtgatggatggtggcgg

SEQ ID NO: 312569 - DNA, 25 bp, Artificial Sequence
  Description of Artificial Sequence: Synthetic oligonucleotide
aggagctgtgatggatggtggcggc

SEQ ID NO: 312570 - DNA, 24 bp, Artificial Sequence
  Description of Artificial Sequence: Synthetic oligonucleotide
ggagctgtgatggatggtggcggc

SEQ ID NO: 312571 - DNA, 24 bp, Artificial Sequence
  Description of Artificial Sequence: Synthetic oligonucleotide
gagctgtgatggatggtggcggcg

SEQ ID NO: 312572 - DNA, 24 bp, Artificial Sequence
  Description of Artificial Sequence: Synthetic oligonucleotide
agctgtgatggatggtggcggcgc

SEQ ID NO: 312573 - DNA, 23 bp, Artificial Sequence
  Description of Artificial Sequence: Synthetic oligonucleotide
gctgtgatggatggtggcggcgc

SEQ ID NO: 312574 - DNA, 23 bp, Artificial Sequence
  Description of Artificial Sequence: Synthetic oligonucleotide
ctgtgatggatggtggcggcgcg

SEQ ID NO: 312575 - DNA, 24 bp, Artificial Sequence
  Description of Artificial Sequence: Synthetic oligonucleotide
tgtgatggatggtggcggcgcggt

SEQ ID NO: 312576 - DNA, 23 bp, Artificial Sequence
  Description of Artificial Sequence: Synthetic oligonucleotide
gtgatggatggtggcggcgcggt

SEQ ID NO: 312577 - DNA, 23 bp, Artificial Sequence
  Description of Artificial Sequence: Synthetic oligonucleotide
tgatggatggtggcggcgcggtg

SEQ ID NO: 312578 - DNA, 22 bp, Artificial Sequence
  Description of Artificial Sequence: Synthetic oligonucleotide
gatggatggtggcggcgcggtg

SEQ ID NO: 312579 - DNA, 22 bp, Artificial Sequence
  Description of Artificial Sequence: Synthetic oligonucleotide
atggatggtggcggcgcggtgg

SEQ ID NO: 312580 - DNA, 21 bp, Artificial Sequence
  Description of Artificial Sequence: Synthetic oligonucleotide
tggatggtggcggcgcggtgg

SEQ ID NO: 312581 - DNA, 20 bp, Artificial Sequence
  Description of Artificial Sequence: Synthetic oligonucleotide
ggatggtggcggcgcggtgg

SEQ ID NO: 312582 - DNA, 21 bp, Artificial Sequence
  Description of Artificial Sequence: Synthetic oligonucleotide
gatggtggcggcgcggtgggt

SEQ ID NO: 312583 - DNA, 21 bp, Artificial Sequence
  Description of Artificial Sequence: Synthetic oligonucleotide
atggtggcggcgcggtgggtg

SEQ ID NO: 312584 - DNA, 20 bp, Artificial Sequence
  Description of Artificial Sequence: Synthetic oligonucleotide
tggtggcggcgcggtgggtg

SEQ ID NO: 312585 - DNA, 20 bp, Artificial Sequence
  Description of Artificial Sequence: Synthetic oligonucleotide
ggtggcggcgcggtgggtgt

SEQ ID NO: 312586 - DNA, 21 bp, Artificial Sequence
  Description of Artificial Sequence: Synthetic oligonucleotide
gtggcggcgcggtgggtgcaa

SEQ ID NO: 312587 - DNA, 22 bp, Artificial Sequence
  Description of Artificial Sequence: Synthetic oligonucleotide
tggcggcgcggtgggtgcaagt

SEQ ID NO: 312588 - DNA, 21 bp, Artificial Sequence
  Description of Artificial Sequence: Synthetic oligonucleotide
ggcggcgcggtgggtgcaagt

SEQ ID NO: 312589 - DNA, 21 bp, Artificial Sequence
  Description of Artificial Sequence: Synthetic oligonucleotide
gcggcgcggtgggtgcaagtg

SEQ ID NO: 312590 - DNA, 22 bp, Artificial Sequence
  Description of Artificial Sequence: Synthetic oligonucleotide
cggcgcggtgggtgcaagtgga

SEQ ID NO: 312591 - DNA, 22 bp, Artificial Sequence
  Description of Artificial Sequence: Synthetic oligonucleotide
ggcgcggtgggtgcaagtggag

SEQ ID NO: 312592 - DNA, 23 bp, Artificial Sequence
  Description of Artificial Sequence: Synthetic oligonucleotide
gcgcggtgggtgcaagtggagga

SEQ ID NO: 312593 - DNA, 25 bp, Artificial Sequence
  Description of Artificial Sequence: Synthetic oligonucleotide
cgcggtgggtgcaagtggaggagat

SEQ ID NO: 312594 - DNA, 25 bp, Artificial Sequence
  Description of Artificial Sequence: Synthetic oligonucleotide
gcggtgggtgcaagtggaggagatc

SEQ ID NO: 312595 - DNA, 26 bp, Artificial Sequence
  Description of Artificial Sequence: Synthetic oligonucleotide
cggtgggtgcaagtggaggagatcct

SEQ ID NO: 312596 - DNA, 26 bp, Artificial Sequence
  Description of Artificial Sequence: Synthetic oligonucleotide
ggtgggtgcaagtggaggagatcctg

SEQ ID NO: 312597 - DNA, 26 bp, Artificial Sequence
  Description of Artificial Sequence: Synthetic oligonucleotide
gtgggtgcaagtggaggagatcctgg

SEQ ID NO: 312598 - DNA, 26 bp, Artificial Sequence
  Description of Artificial Sequence: Synthetic oligonucleotide
tgggtgcaagtggaggagatcctggg

SEQ ID NO: 312599 - DNA, 25 bp, Artificial Sequence
  Description of Artificial Sequence: Synthetic oligonucleotide
gggtgcaagtggaggagatcctggg

SEQ ID NO: 312600 - DNA, 25 bp, Artificial Sequence
  Description of Artificial Sequence: Synthetic oligonucleotide
ggtgcaagtggaggagatcctgggg

SEQ ID NO: 312601 - DNA, 26 bp, Artificial Sequence
  Description of Artificial Sequence: Synthetic oligonucleotide
gtgcaagtggaggagatcctggggga

SEQ ID NO: 312602 - DNA, 27 bp, Artificial Sequence
  Description of Artificial Sequence: Synthetic oligonucleotide
tgcaagtggaggagatcctgggggaca

SEQ ID NO: 312603 - DNA, 27 bp, Artificial Sequence
  Description of Artificial Sequence: Synthetic oligonucleotide
gcaagtggaggagatcctgggggacaa

SEQ ID NO: 312604 - DNA, 28 bp, Artificial Sequence
  Description of Artificial Sequence: Synthetic oligonucleotide
caagtggaggagatcctgggggacaatg

SEQ ID NO: 312605 - DNA, 28 bp, Artificial Sequence
  Description of Artificial Sequence: Synthetic oligonucleotide
aagtggaggagatcctgggggacaatgg

SEQ ID NO: 312606 - DNA, 27 bp, Artificial Sequence
  Description of Artificial Sequence: Synthetic oligonucleotide
agtggaggagatcctgggggacaatgg

SEQ ID NO: 312607 - DNA, 26 bp, Artificial Sequence
  Description of Artificial Sequence: Synthetic oligonucleotide
gtggaggagatcctgggggacaatgg

SEQ ID NO: 312608 - DNA, 26 bp, Artificial Sequence
  Description of Artificial Sequence: Synthetic oligonucleotide
tggaggagatcctgggggacaatggg

SEQ ID NO: 312609 - DNA, 25 bp, Artificial Sequence
  Description of Artificial Sequence: Synthetic oligonucleotide
ggaggagatcctgggggacaatggg

SEQ ID NO: 312610 - DNA, 25 bp, Artificial Sequence
  Description of Artificial Sequence: Synthetic oligonucleotide
gaggagatcctgggggacaatgggg

SEQ ID NO: 312611 - DNA, 25 bp, Artificial Sequence
  Description of Artificial Sequence: Synthetic oligonucleotide
aggagatcctgggggacaatggggc

SEQ ID NO: 312612 - DNA, 24 bp, Artificial Sequence
  Description of Artificial Sequence: Synthetic oligonucleotide
ggagatcctgggggacaatggggc

SEQ ID NO: 312613 - DNA, 25 bp, Artificial Sequence
  Description of Artificial Sequence: Synthetic oligonucleotide
gagatcctgggggacaatggggcca

SEQ ID NO: 312614 - DNA, 25 bp, Artificial Sequence
  Description of Artificial Sequence: Synthetic oligonucleotide
agatcctgggggacaatggggccag

SEQ ID NO: 312615 - DNA, 24 bp, Artificial Sequence
  Description of Artificial Sequence: Synthetic oligonucleotide
gatcctgggggacaatggggccag

SEQ ID NO: 312616 - DNA, 24 bp, Artificial Sequence
  Description of Artificial Sequence: Synthetic oligonucleotide
atcctgggggacaatggggccagg

SEQ ID NO: 312617 - DNA, 23 bp, Artificial Sequence
  Description of Artificial Sequence: Synthetic oligonucleotide
tcctgggggacaatggggccagg

SEQ ID NO: 312618 - DNA, 22 bp, Artificial Sequence
  Description of Artificial Sequence: Synthetic oligonucleotide
cctgggggacaatggggccagg

SEQ ID NO: 312619 - DNA, 22 bp, Artificial Sequence
  Description of Artificial Sequence: Synthetic oligonucleotide
ctgggggacaatggggccaggg

SEQ ID NO: 312620 - DNA, 22 bp, Artificial Sequence
  Description of Artificial Sequence: Synthetic oligonucleotide
tgggggacaatggggccagggg

SEQ ID NO: 312621 - DNA, 21 bp, Artificial Sequence
  Description of Artificial Sequence: Synthetic oligonucleotide
gggggacaatggggccagggg

SEQ ID NO: 312622 - DNA, 21 bp, Artificial Sequence
  Description of Artificial Sequence: Synthetic oligonucleotide
ggggacaatggggccaggggc

SEQ ID NO: 312623 - DNA, 21 bp, Artificial Sequence
  Description of Artificial Sequence: Synthetic oligonucleotide
gggacaatggggccaggggcc

SEQ ID NO: 312624 - DNA, 21 bp, Artificial Sequence
  Description of Artificial Sequence: Synthetic oligonucleotide
ggacaatggggccaggggccg

SEQ ID NO: 312625 - DNA, 21 bp, Artificial Sequence
  Description of Artificial Sequence: Synthetic oligonucleotide
gacaatggggccaggggccgc

SEQ ID NO: 312626 - DNA, 21 bp, Artificial Sequence
  Description of Artificial Sequence: Synthetic oligonucleotide
acaatggggccaggggccgcc

SEQ ID NO: 312627 - DNA, 20 bp, Artificial Sequence
  Description of Artificial Sequence: Synthetic oligonucleotide
caatggggccaggggccgcc

SEQ ID NO: 312628 - DNA, 20 bp, Artificial Sequence
  Description of Artificial Sequence: Synthetic oligonucleotide
aatggggccaggggccgccg

SEQ ID NO: 312629 - DNA, 20 bp, Artificial Sequence
  Description of Artificial Sequence: Synthetic oligonucleotide
atggggccaggggccgccgt

SEQ ID NO: 312630 - DNA, 20 bp, Artificial Sequence
  Description of Artificial Sequence: Synthetic oligonucleotide
tggggccaggggccgccgtt

SEQ ID NO: 312631 - DNA, 20 bp, Artificial Sequence
  Description of Artificial Sequence: Synthetic oligonucleotide
ggggccaggggccgccgttt

SEQ ID NO: 312632 - DNA, 20 bp, Artificial Sequence
  Description of Artificial Sequence: Synthetic oligonucleotide
gggccaggggccgccggttt

SEQ ID NO: 312633 - DNA, 20 bp, Artificial Sequence
  Description of Artificial Sequence: Synthetic oligonucleotide
ggccaggggccgccggcatt

SEQ ID NO: 312634 - DNA, 20 bp, Artificial Sequence
  Description of Artificial Sequence: Synthetic oligonucleotide
gccaggggccgccggcactt

SEQ ID NO: 312635 - DNA, 20 bp, Artificial Sequence
  Description of Artificial Sequence: Synthetic oligonucleotide
ccaggggccgccggcacctt

SEQ ID NO: 312636 - DNA, 20 bp, Artificial Sequence
  Description of Artificial Sequence: Synthetic oligonucleotide
caggggccgccggcacctct

SEQ ID NO: 312637 - DNA, 21 bp, Artificial Sequence
  Description of Artificial Sequence: Synthetic oligonucleotide
aggggccgccggcacctctca

SEQ ID NO: 312638 - DNA, 20 bp, Artificial Sequence
  Description of Artificial Sequence: Synthetic oligonucleotide
ggggccgccggcacctctca

SEQ ID NO: 312639 - DNA, 21 bp, Artificial Sequence
  Description of Artificial Sequence: Synthetic oligonucleotide
gggccgccggcacctctcaca

SEQ ID NO: 312640 - DNA, 21 bp, Artificial Sequence
  Description of Artificial Sequence: Synthetic oligonucleotide
ggccgccggcacctctcacac

SEQ ID NO: 312641 - DNA, 22 bp, Artificial Sequence
  Description of Artificial Sequence: Synthetic oligonucleotide
gccgccggcacctctcacacct

SEQ ID NO: 312642 - DNA, 23 bp, Artificial Sequence
  Description of Artificial Sequence: Synthetic oligonucleotide
ccgccggcacctctcacacctca

SEQ ID NO: 312643 - DNA, 23 bp, Artificial Sequence
  Description of Artificial Sequence: Synthetic oligonucleotide
cgccggcacctctcacacctcac

SEQ ID NO: 312644 - DNA, 25 bp, Artificial Sequence
  Description of Artificial Sequence: Synthetic oligonucleotide
gccggcacctctcacacctcaccat

SEQ ID NO: 312645 - DNA, 26 bp, Artificial Sequence
  Description of Artificial Sequence: Synthetic oligonucleotide
ccggcacctctcacacctcaccatct

SEQ ID NO: 312646 - DNA, 26 bp, Artificial Sequence
  Description of Artificial Sequence: Synthetic oligonucleotide
cggcacctctcacacctcaccatctg

SEQ ID NO: 312647 - DNA, 27 bp, Artificial Sequence
  Description of Artificial Sequence: Synthetic oligonucleotide
ggcacctctcacacctcaccatctgga

SEQ ID NO: 312648 - DNA, 27 bp, Artificial Sequence
  Description of Artificial Sequence: Synthetic oligonucleotide
gcacctctcacacctcaccatctggag

SEQ ID NO: 312649 - DNA, 27 bp, Artificial Sequence
  Description of Artificial Sequence: Synthetic oligonucleotide
cacctctcacacctcaccatctggagc

SEQ ID NO: 312650 - DNA, 27 bp, Artificial Sequence
  Description of Artificial Sequence: Synthetic oligonucleotide
acctctcacacctcaccatctggagcc

SEQ ID NO: 312651 - DNA, 27 bp, Artificial Sequence
  Description of Artificial Sequence: Synthetic oligonucleotide
cctctcacacctcaccatctggagcca

SEQ ID NO: 312652 - DNA, 27 bp, Artificial Sequence
  Description of Artificial Sequence: Synthetic oligonucleotide
ctctcacacctcaccatctggagccac

SEQ ID NO: 312653 - DNA, 27 bp, Artificial Sequence
  Description of Artificial Sequence: Synthetic oligonucleotide
tctcacacctcaccatctggagccacc

SEQ ID NO: 312654 - DNA, 27 bp, Artificial Sequence
  Description of Artificial Sequence: Synthetic oligonucleotide
ctcacacctcaccatctggagccacct

SEQ ID NO: 312655 - DNA, 28 bp, Artificial Sequence
  Description of Artificial Sequence: Synthetic oligonucleotide
tcacacctcaccatctggagccacctag

SEQ ID NO: 312656 - DNA, 27 bp, Artificial Sequence
  Description of Artificial Sequence: Synthetic oligonucleotide
cacacctcaccatctggagccacctag

SEQ ID NO: 312657 - DNA, 28 bp, Artificial Sequence
  Description of Artificial Sequence: Synthetic oligonucleotide
acacctcaccatctggagccacctagag

SEQ ID NO: 312658 - DNA, 27 bp, Artificial Sequence
  Description of Artificial Sequence: Synthetic oligonucleotide
cacctcaccatctggagccacctagag

SEQ ID NO: 312659 - DNA, 27 bp, Artificial Sequence
  Description of Artificial Sequence: Synthetic oligonucleotide
acctcaccatctggagccacctagagc

SEQ ID NO: 312660 - DNA, 27 bp, Artificial Sequence
  Description of Artificial Sequence: Synthetic oligonucleotide
cctcaccatctggagccacctagagct

SEQ ID NO: 312661 - DNA, 27 bp, Artificial Sequence
  Description of Artificial Sequence: Synthetic oligonucleotide
ctcaccatctggagccacctagagctc

SEQ ID NO: 312662 - DNA, 27 bp, Artificial Sequence
  Description of Artificial Sequence: Synthetic oligonucleotide
tcaccatctggagccacctagagctcc

SEQ ID NO: 312663 - DNA, 26 bp, Artificial Sequence
  Description of Artificial Sequence: Synthetic oligonucleotide
caccatctggagccacctagagctcc

SEQ ID NO: 312664 - DNA, 27 bp, Artificial Sequence
  Description of Artificial Sequence: Synthetic oligonucleotide
accatctggagccacctagagctccgt

SEQ ID NO: 312665 - DNA, 27 bp, Artificial Sequence
  Description of Artificial Sequence: Synthetic oligonucleotide
ccatctggagccacctagagctccgta

SEQ ID NO: 312666 - DNA, 27 bp, Artificial Sequence
  Description of Artificial Sequence: Synthetic oligonucleotide
catctggagccacctagagctccgtag

SEQ ID NO: 312667 - DNA, 28 bp, Artificial Sequence
  Description of Artificial Sequence: Synthetic oligonucleotide
atctggagccacctagagctccgtagag

SEQ ID NO: 312668 - DNA, 27 bp, Artificial Sequence
  Description of Artificial Sequence: Synthetic oligonucleotide
tctggagccacctagagctccgtagag

SEQ ID NO: 312669 - DNA, 27 bp, Artificial Sequence
  Description of Artificial Sequence: Synthetic oligonucleotide
ctggagccacctagagctccgtagagt

SEQ ID NO: 312670 - DNA, 27 bp, Artificial Sequence
  Description of Artificial Sequence: Synthetic oligonucleotide
tggagccacctagagctccgtagagtc

SEQ ID NO: 312671 - DNA, 27 bp, Artificial Sequence
  Description of Artificial Sequence: Synthetic oligonucleotide
ggagccacctagagctccgtagagtca

SEQ ID NO: 312672 - DNA, 28 bp, Artificial Sequence
  Description of Artificial Sequence: Synthetic oligonucleotide
gagccacctagagctccgtagagtcatc

SEQ ID NO: 312673 - DNA, 29 bp, Artificial Sequence
  Description of Artificial Sequence: Synthetic oligonucleotide
agccacctagagctccgtagagtcatcac

SEQ ID NO: 312674 - DNA, 28 bp, Artificial Sequence
  Description of Artificial Sequence: Synthetic oligonucleotide
gccacctagagctccgtagagtcatcac

SEQ ID NO: 312675 - DNA, 28 bp, Artificial Sequence
  Description of Artificial Sequence: Synthetic oligonucleotide
ccacctagagctccgtagagtcatcacc

SEQ ID NO: 312676 - DNA, 30 bp, Artificial Sequence
  Description of Artificial Sequence: Synthetic oligonucleotide
cacctagagctccgtagagtcatcaccaag

SEQ ID NO: 312677 - DNA, 30 bp, Artificial Sequence
  Description of Artificial Sequence: Synthetic oligonucleotide
acctagagctccgtagagtcatcaccaagg

SEQ ID NO: 312678 - DNA, 29 bp, Artificial Sequence
  Description of Artificial Sequence: Synthetic oligonucleotide
cctagagctccgtagagtcatcaccaagg

SEQ ID NO: 312679 - DNA, 29 bp, Artificial Sequence
  Description of Artificial Sequence: Synthetic oligonucleotide
ctagagctccgtagagtcatcaccaaggc

SEQ ID NO: 312680 - DNA, 31 bp, Artificial Sequence
  Description of Artificial Sequence: Synthetic oligonucleotide
tagagctccgtagagtcatcaccaaggctac

SEQ ID NO: 312681 - DNA, 30 bp, Artificial Sequence
  Description of Artificial Sequence: Synthetic oligonucleotide
agagctccgtagagtcatcaccaaggctac

SEQ ID NO: 312682 - DNA, 29 bp, Artificial Sequence
  Description of Artificial Sequence: Synthetic oligonucleotide
gagctccgtagagtcatcaccaaggctac

SEQ ID NO: 312683 - DNA, 30 bp, Artificial Sequence
  Description of Artificial Sequence: Synthetic oligonucleotide
agctccgtagagtcatcaccaaggctactg

SEQ ID NO: 312684 - DNA, 29 bp, Artificial Sequence
  Description of Artificial Sequence: Synthetic oligonucleotide
gctccgtagagtcatcaccaaggctactg

SEQ ID NO: 312685 - DNA, 30 bp, Artificial Sequence
  Description of Artificial Sequence: Synthetic oligonucleotide
ctccgtagagtcatcaccaaggctactgtc

SEQ ID NO: 312686 - DNA, 30 bp, Artificial Sequence
  Description of Artificial Sequence: Synthetic oligonucleotide
tccgtagagtcatcaccaaggctactgtcc

SEQ ID NO: 312687 - DNA, 29 bp, Artificial Sequence
  Description of Artificial Sequence: Synthetic oligonucleotide
ccgtagagtcatcaccaaggctactgtcc

SEQ ID NO: 312688 - DNA, 30 bp, Artificial Sequence
  Description of Artificial Sequence: Synthetic oligonucleotide
cgtagagtcatcaccaaggctactgtcctg

SEQ ID NO: 312689 - DNA, 30 bp, Artificial Sequence
  Description of Artificial Sequence: Synthetic oligonucleotide
gtagagtcatcaccaaggctactgtcctgc

SEQ ID NO: 312690 - DNA, 32 bp, Artificial Sequence
  Description of Artificial Sequence: Synthetic oligonucleotide
tagagtcatcaccaaggctactgtcctgctag

SEQ ID NO: 312691 - DNA, 31 bp, Artificial Sequence
  Description of Artificial Sequence: Synthetic oligonucleotide
agagtcatcaccaaggctactgtcctgctag

SEQ ID NO: 312692 - DNA, 30 bp, Artificial Sequence
  Description of Artificial Sequence: Synthetic oligonucleotide
gagtcatcaccaaggctactgtcctgctag

SEQ ID NO: 312693 - DNA, 31 bp, Artificial Sequence
  Description of Artificial Sequence: Synthetic oligonucleotide
agtcatcaccaaggctactgtcctgctagac

SEQ ID NO: 312694 - DNA, 30 bp, Artificial Sequence
  Description of Artificial Sequence: Synthetic oligonucleotide
gtcatcaccaaggctactgtcctgctagac

SEQ ID NO: 312695 - DNA, 30 bp, Artificial Sequence
  Description of Artificial Sequence: Synthetic oligonucleotide
tcatcaccaaggctactgtcctgctagacc

SEQ ID NO: 312696 - DNA, 29 bp, Artificial Sequence
  Description of Artificial Sequence: Synthetic oligonucleotide
catcaccaaggctactgtcctgctagacc

SEQ ID NO: 312697 - DNA, 30 bp, Artificial Sequence
  Description of Artificial Sequence: Synthetic oligonucleotide
atcaccaaggctactgtcctgctagacctg

SEQ ID NO: 312698 - DNA, 29 bp, Artificial Sequence
  Description of Artificial Sequence: Synthetic oligonucleotide
tcaccaaggctactgtcctgctagacctg

SEQ ID NO: 312699 - DNA, 28 bp, Artificial Sequence
  Description of Artificial Sequence: Synthetic oligonucleotide
caccaaggctactgtcctgctagacctg

SEQ ID NO: 312700 - DNA, 28 bp, Artificial Sequence
  Description of Artificial Sequence: Synthetic oligonucleotide
accaaggctactgtcctgctagacctgg

SEQ ID NO: 312701 - DNA, 27 bp, Artificial Sequence
  Description of Artificial Sequence: Synthetic oligonucleotide
ccaaggctactgtcctgctagacctgg

SEQ ID NO: 312702 - DNA, 29 bp, Artificial Sequence
  Description of Artificial Sequence: Synthetic oligonucleotide
caaggctactgtcctgctagacctggaag

SEQ ID NO: 312703 - DNA, 30 bp, Artificial Sequence
  Description of Artificial Sequence: Synthetic oligonucleotide
aaggctactgtcctgctagacctggaagag

SEQ ID NO: 312704 - DNA, 29 bp, Artificial Sequence
  Description of Artificial Sequence: Synthetic oligonucleotide
aggctactgtcctgctagacctggaagag

SEQ ID NO: 312705 - DNA, 28 bp, Artificial Sequence
  Description of Artificial Sequence: Synthetic oligonucleotide
ggctactgtcctgctagacctggaagag

SEQ ID NO: 312706 - DNA, 29 bp, Artificial Sequence
  Description of Artificial Sequence: Synthetic oligonucleotide
gctactgtcctgctagacctggaagagac

SEQ ID NO: 312707 - DNA, 29 bp, Artificial Sequence
  Description of Artificial Sequence: Synthetic oligonucleotide
ctactgtcctgctagacctggaagagacc

SEQ ID NO: 312708 - DNA, 30 bp, Artificial Sequence
  Description of Artificial Sequence: Synthetic oligonucleotide
tactgtcctgctagacctggaagagacctg

SEQ ID NO: 312709 - DNA, 29 bp, Artificial Sequence
  Description of Artificial Sequence: Synthetic oligonucleotide
actgtcctgctagacctggaagagacctg

SEQ ID NO: 312710 - DNA, 28 bp, Artificial Sequence
  Description of Artificial Sequence: Synthetic oligonucleotide
ctgtcctgctagacctggaagagacctg

SEQ ID NO: 312711 - DNA, 28 bp, Artificial Sequence
  Description of Artificial Sequence: Synthetic oligonucleotide
tgtcctgctagacctggaagagacctgc

SEQ ID NO: 312712 - DNA, 27 bp, Artificial Sequence
  Description of Artificial Sequence: Synthetic oligonucleotide
gtcctgctagacctggaagagacctgc

SEQ ID NO: 312713 - DNA, 27 bp, Artificial Sequence
  Description of Artificial Sequence: Synthetic oligonucleotide
tcctgctagacctggaagagacctgcc

SEQ ID NO: 312714 - DNA, 27 bp, Artificial Sequence
  Description of Artificial Sequence: Synthetic oligonucleotide
cctgctagacctggaagagacctgcct

SEQ ID NO: 312715 - DNA, 27 bp, Artificial Sequence
  Description of Artificial Sequence: Synthetic oligonucleotide
ctgctagacctggaagagacctgcctg

SEQ ID NO: 312716 - DNA, 27 bp, Artificial Sequence
  Description of Artificial Sequence: Synthetic oligonucleotide
tgctagacctggaagagacctgcctgg

SEQ ID NO: 312717 - DNA, 26 bp, Artificial Sequence
  Description of Artificial Sequence: Synthetic oligonucleotide
gctagacctggaagagacctgcctgg

SEQ ID NO: 312718 - DNA, 27 bp, Artificial Sequence
  Description of Artificial Sequence: Synthetic oligonucleotide
ctagacctggaagagacctgcctggct

SEQ ID NO: 312719 - DNA, 27 bp, Artificial Sequence
  Description of Artificial Sequence: Synthetic oligonucleotide
tagacctggaagagacctgcctggctg

SEQ ID NO: 312720 - DNA, 26 bp, Artificial Sequence
  Description of Artificial Sequence: Synthetic oligonucleotide
agacctggaagagacctgcctggctg

SEQ ID NO: 312721 - DNA, 25 bp, Artificial Sequence
  Description of Artificial Sequence: Synthetic oligonucleotide
gacctggaagagacctgcctggctg

SEQ ID NO: 312722 - DNA, 26 bp, Artificial Sequence
  Description of Artificial Sequence: Synthetic oligonucleotide
acctggaagagacctgcctggctggt

SEQ ID NO: 312723 - DNA, 25 bp, Artificial Sequence
  Description of Artificial Sequence: Synthetic oligonucleotide
cctggaagagacctgcctggctggt

SEQ ID NO: 312724 - DNA, 26 bp, Artificial Sequence
  Description of Artificial Sequence: Synthetic oligonucleotide
ctggaagagacctgcctggctggtgt

SEQ ID NO: 312725 - DNA, 26 bp, Artificial Sequence
  Description of Artificial Sequence: Synthetic oligonucleotide
tggaagagacctgcctggctggtgtg

SEQ ID NO: 312726 - DNA, 25 bp, Artificial Sequence
  Description of Artificial Sequence: Synthetic oligonucleotide
ggaagagacctgcctggctggtgtg

SEQ ID NO: 312727 - DNA, 25 bp, Artificial Sequence
  Description of Artificial Sequence: Synthetic oligonucleotide
gaagagacctgcctggctggtgtgg

SEQ ID NO: 312728 - DNA, 25 bp, Artificial Sequence
  Description of Artificial Sequence: Synthetic oligonucleotide
aagagacctgcctggctggtgtggc

SEQ ID NO: 312729 - DNA, 24 bp, Artificial Sequence
  Description of Artificial Sequence: Synthetic oligonucleotide
agagacctgcctggctggtgtggc

SEQ ID NO: 312730 - DNA, 23 bp, Artificial Sequence
  Description of Artificial Sequence: Synthetic oligonucleotide
gagacctgcctggctggtgtggc

SEQ ID NO: 312731 - DNA, 25 bp, Artificial Sequence
  Description of Artificial Sequence: Synthetic oligonucleotide
agacctgcctggctggtgtggccaa

SEQ ID NO: 312732 - DNA, 24 bp, Artificial Sequence
  Description of Artificial Sequence: Synthetic oligonucleotide
gacctgcctggctggtgtggccaa

SEQ ID NO: 312733 - DNA, 24 bp, Artificial Sequence
  Description of Artificial Sequence: Synthetic oligonucleotide
acctgcctggctggtgtggccaac

SEQ ID NO: 312734 - DNA, 23 bp, Artificial Sequence
  Description of Artificial Sequence: Synthetic oligonucleotide
cctgcctggctggtgtggccaac

SEQ ID NO: 312735 - DNA, 25 bp, Artificial Sequence
  Description of Artificial Sequence: Synthetic oligonucleotide
ctgcctggctggtgtggccaacgaa

SEQ ID NO: 312736 - DNA, 26 bp, Artificial Sequence
  Description of Artificial Sequence: Synthetic oligonucleotide
tgcctggctggtgtggccaacgaact

SEQ ID NO: 312737 - DNA, 25 bp, Artificial Sequence
  Description of Artificial Sequence: Synthetic oligonucleotide
gcctggctggtgtggccaacgaact

SEQ ID NO: 312738 - DNA, 25 bp, Artificial Sequence
  Description of Artificial Sequence: Synthetic oligonucleotide
cctggctggtgtggccaacgaactg

SEQ ID NO: 312739 - DNA, 27 bp, Artificial Sequence
  Description of Artificial Sequence: Synthetic oligonucleotide
ctggctggtgtggccaacgaactgcta

SEQ ID NO: 312740 - DNA, 27 bp, Artificial Sequence
  Description of Artificial Sequence: Synthetic oligonucleotide
tggctggtgtggccaacgaactgctag

SEQ ID NO: 312741 - DNA, 27 bp, Artificial Sequence
  Description of Artificial Sequence: Synthetic oligonucleotide
ggctggtgtggccaacgaactgctagt

SEQ ID NO: 312742 - DNA, 27 bp, Artificial Sequence
  Description of Artificial Sequence: Synthetic oligonucleotide
gctggtgtggccaacgaactgctagtc

SEQ ID NO: 312743 - DNA, 28 bp, Artificial Sequence
  Description of Artificial Sequence: Synthetic oligonucleotide
ctggtgtggccaacgaactgctagtcag

SEQ ID NO: 312744 - DNA, 28 bp, Artificial Sequence
  Description of Artificial Sequence: Synthetic oligonucleotide
tggtgtggccaacgaactgctagtcagg

SEQ ID NO: 312745 - DNA, 27 bp, Artificial Sequence
  Description of Artificial Sequence: Synthetic oligonucleotide
ggtgtggccaacgaactgctagtcagg

SEQ ID NO: 312746 - DNA, 32 bp, Artificial Sequence
  Description of Artificial Sequence: Synthetic oligonucleotide
gtgtggccaacgaactgctagtcaggtttatg

SEQ ID NO: 312747 - DNA, 35 bp, Artificial Sequence
  Description of Artificial Sequence: Synthetic oligonucleotide
tgtggccaacgaactgctagtcaggtttatgtttg

SEQ ID NO: 312748 - DNA, 34 bp, Artificial Sequence
  Description of Artificial Sequence: Synthetic oligonucleotide
gtggccaacgaactgctagtcaggtttatgtttg

SEQ ID NO: 312749 - DNA, 36 bp, Artificial Sequence
  Description of Artificial Sequence: Synthetic oligonucleotide
tggccaacgaactgctagtcaggtttatgtttgaag

SEQ ID NO: 312750 - DNA, 35 bp, Artificial Sequence
  Description of Artificial Sequence: Synthetic oligonucleotide
ggccaacgaactgctagtcaggtttatgtttgaag

SEQ ID NO: 312751 - DNA, 36 bp, Artificial Sequence
  Description of Artificial Sequence: Synthetic oligonucleotide
gccaacgaactgctagtcaggtttatgtttgaagac

SEQ ID NO: 312752 - DNA, 36 bp, Artificial Sequence
  Description of Artificial Sequence: Synthetic oligonucleotide
ccaacgaactgctagtcaggtttatgtttgaagacg

SEQ ID NO: 312753 - DNA, 37 bp, Artificial Sequence
  Description of Artificial Sequence: Synthetic oligonucleotide
caacgaactgctagtcaggtttatgtttgaagacgag

SEQ ID NO: 312754 - DNA, 39 bp, Artificial Sequence
  Description of Artificial Sequence: Synthetic oligonucleotide
aacgaactgctagtcaggtttatgtttgaagacgagatc

SEQ ID NO: 312755 - DNA, 38 bp, Artificial Sequence
  Description of Artificial Sequence: Synthetic oligonucleotide
acgaactgctagtcaggtttatgtttgaagacgagatc

SEQ ID NO: 312756 - DNA, 37 bp, Artificial Sequence
  Description of Artificial Sequence: Synthetic oligonucleotide
cgaactgctagtcaggtttatgtttgaagacgagatc

SEQ ID NO: 312757 - DNA, 37 bp, Artificial Sequence
  Description of Artificial Sequence: Synthetic oligonucleotide
gaactgctagtcaggtttatgtttgaagacgagatcc

SEQ ID NO: 312758 - DNA, 37 bp, Artificial Sequence
  Description of Artificial Sequence: Synthetic oligonucleotide
aactgctagtcaggtttatgtttgaagacgagatccg

SEQ ID NO: 312759 - DNA, 36 bp, Artificial Sequence
  Description of Artificial Sequence: Synthetic oligonucleotide
actgctagtcaggtttatgtttgaagacgagatccg

SEQ ID NO: 312760 - DNA, 35 bp, Artificial Sequence
  Description of Artificial Sequence: Synthetic oligonucleotide
ctgctagtcaggtttatgtttgaagacgagatccg

SEQ ID NO: 312761 - DNA, 35 bp, Artificial Sequence
  Description of Artificial Sequence: Synthetic oligonucleotide
tgctagtcaggtttatgtttgaagacgagatccgg

SEQ ID NO: 312762 - DNA, 34 bp, Artificial Sequence
  Description of Artificial Sequence: Synthetic oligonucleotide
gctagtcaggtttatgtttgaagacgagatccgg

SEQ ID NO: 312763 - DNA, 34 bp, Artificial Sequence
  Description of Artificial Sequence: Synthetic oligonucleotide
ctagtcaggtttatgtttgaagacgagatccggc

SEQ ID NO: 312764 - DNA, 34 bp, Artificial Sequence
  Description of Artificial Sequence: Synthetic oligonucleotide
tagtcaggtttatgtttgaagacgagatccggcg

SEQ ID NO: 312765 - DNA, 33 bp, Artificial Sequence
  Description of Artificial Sequence: Synthetic oligonucleotide
agtcaggtttatgtttgaagacgagatccggcg

SEQ ID NO: 312766 - DNA, 32 bp, Artificial Sequence
  Description of Artificial Sequence: Synthetic oligonucleotide
gtcaggtttatgtttgaagacgagatccggcg

SEQ ID NO: 312767 - DNA, 33 bp, Artificial Sequence
  Description of Artificial Sequence: Synthetic oligonucleotide
tcaggtttatgtttgaagacgagatccggcgtc

SEQ ID NO: 312768 - DNA, 32 bp, Artificial Sequence
  Description of Artificial Sequence: Synthetic oligonucleotide
caggtttatgtttgaagacgagatccggcgtc

SEQ ID NO: 312769 - DNA, 33 bp, Artificial Sequence
  Description of Artificial Sequence: Synthetic oligonucleotide
aggtttatgtttgaagacgagatccggcgtcag

SEQ ID NO: 312770 - DNA, 32 bp, Artificial Sequence
  Description of Artificial Sequence: Synthetic oligonucleotide
ggtttatgtttgaagacgagatccggcgtcag

SEQ ID NO: 312771 - DNA, 32 bp, Artificial Sequence
  Description of Artificial Sequence: Synthetic oligonucleotide
gtttatgtttgaagacgagatccggcgtcagg

SEQ ID NO: 312772 - DNA, 33 bp, Artificial Sequence
  Description of Artificial Sequence: Synthetic oligonucleotide
tttatgtttgaagacgagatccggcgtcaggac

SEQ ID NO: 312773 - DNA, 32 bp, Artificial Sequence
  Description of Artificial Sequence: Synthetic oligonucleotide
ttatgtttgaagacgagatccggcgtcaggac

SEQ ID NO: 312774 - DNA, 31 bp, Artificial Sequence
  Description of Artificial Sequence: Synthetic oligonucleotide
tatgtttgaagacgagatccggcgtcaggac

SEQ ID NO: 312775 - DNA, 30 bp, Artificial Sequence
  Description of Artificial Sequence: Synthetic oligonucleotide
atgtttgaagacgagatccggcgtcaggac

SEQ ID NO: 312776 - DNA, 29 bp, Artificial Sequence
  Description of Artificial Sequence: Synthetic oligonucleotide
tgtttgaagacgagatccggcgtcaggac

SEQ ID NO: 312777 - DNA, 28 bp, Artificial Sequence
  Description of Artificial Sequence: Synthetic oligonucleotide
gtttgaagacgagatccggcgtcaggac

SEQ ID NO: 312778 - DNA, 28 bp, Artificial Sequence
  Description of Artificial Sequence: Synthetic oligonucleotide
tttgaagacgagatccggcgtcaggacc

SEQ ID NO: 312779 - DNA, 27 bp, Artificial Sequence
  Description of Artificial Sequence: Synthetic oligonucleotide
ttgaagacgagatccggcgtcaggacc

SEQ ID NO: 312780 - DNA, 26 bp, Artificial Sequence
  Description of Artificial Sequence: Synthetic oligonucleotide
tgaagacgagatccggcgtcaggacc

SEQ ID NO: 312781 - DNA, 25 bp, Artificial Sequence
  Description of Artificial Sequence: Synthetic oligonucleotide
gaagacgagatccggcgtcaggacc

SEQ ID NO: 312782 - DNA, 26 bp, Artificial Sequence
  Description of Artificial Sequence: Synthetic oligonucleotide
aagacgagatccggcgtcaggaccgt

SEQ ID NO: 312783 - DNA, 25 bp, Artificial Sequence
  Description of Artificial Sequence: Synthetic oligonucleotide
agacgagatccggcgtcaggaccgt

SEQ ID NO: 312784 - DNA, 24 bp, Artificial Sequence
  Description of Artificial Sequence: Synthetic oligonucleotide
gacgagatccggcgtcaggaccgt

SEQ ID NO: 312785 - DNA, 25 bp, Artificial Sequence
  Description of Artificial Sequence: Synthetic oligonucleotide
acgagatccggcgtcaggaccgtga

SEQ ID NO: 312786 - DNA, 24 bp, Artificial Sequence
  Description of Artificial Sequence: Synthetic oligonucleotide
cgagatccggcgtcaggaccgtga

SEQ ID NO: 312787 - DNA, 24 bp, Artificial Sequence
  Description of Artificial Sequence: Synthetic oligonucleotide
gagatccggcgtcaggaccgtgag

SEQ ID NO: 312788 - DNA, 25 bp, Artificial Sequence
  Description of Artificial Sequence: Synthetic oligonucleotide
agatccggcgtcaggaccgtgagga

SEQ ID NO: 312789 - DNA, 24 bp, Artificial Sequence
  Description of Artificial Sequence: Synthetic oligonucleotide
gatccggcgtcaggaccgtgagga

SEQ ID NO: 312790 - DNA, 24 bp, Artificial Sequence
  Description of Artificial Sequence: Synthetic oligonucleotide
atccggcgtcaggaccgtgaggag

SEQ ID NO: 312791 - DNA, 23 bp, Artificial Sequence
  Description of Artificial Sequence: Synthetic oligonucleotide
tccggcgtcaggaccgtgaggag

SEQ ID NO: 312792 - DNA, 22 bp, Artificial Sequence
  Description of Artificial Sequence: Synthetic oligonucleotide
ccggcgtcaggaccgtgaggag

SEQ ID NO: 312793 - DNA, 23 bp, Artificial Sequence
  Description of Artificial Sequence: Synthetic oligonucleotide
cggcgtcaggaccgtgaggagct

SEQ ID NO: 312794 - DNA, 23 bp, Artificial Sequence
  Description of Artificial Sequence: Synthetic oligonucleotide
ggcgtcaggaccgtgaggagctg

SEQ ID NO: 312795 - DNA, 24 bp, Artificial Sequence
  Description of Artificial Sequence: Synthetic oligonucleotide
gcgtcaggaccgtgaggagctggt

SEQ ID NO: 312796 - DNA, 24 bp, Artificial Sequence
  Description of Artificial Sequence: Synthetic oligonucleotide
cgtcaggaccgtgaggagctggtc

SEQ ID NO: 312797 - DNA, 24 bp, Artificial Sequence
  Description of Artificial Sequence: Synthetic oligonucleotide
gtcaggaccgtgaggagctggtcc

SEQ ID NO: 312798 - DNA, 24 bp, Artificial Sequence
  Description of Artificial Sequence: Synthetic oligonucleotide
tcaggaccgtgaggagctggtccg

SEQ ID NO: 312799 - DNA, 23 bp, Artificial Sequence
  Description of Artificial Sequence: Synthetic oligonucleotide
caggaccgtgaggagctggtccg

SEQ ID NO: 312800 - DNA, 23 bp, Artificial Sequence
  Description of Artificial Sequence: Synthetic oligonucleotide
aggaccgtgaggagctggtccgg

SEQ ID NO: 312801 - DNA, 22 bp, Artificial Sequence
  Description of Artificial Sequence: Synthetic oligonucleotide
ggaccgtgaggagctggtccgg

SEQ ID NO: 312802 - DNA, 22 bp, Artificial Sequence
  Description of Artificial Sequence: Synthetic oligonucleotide
gaccgtgaggagctggtccggg

SEQ ID NO: 312803 - DNA, 22 bp, Artificial Sequence
  Description of Artificial Sequence: Synthetic oligonucleotide
accgtgaggagctggtccgggc

SEQ ID NO: 312804 - DNA, 21 bp, Artificial Sequence
  Description of Artificial Sequence: Synthetic oligonucleotide
ccgtgaggagctggtccgggc

SEQ ID NO: 312805 - DNA, 21 bp, Artificial Sequence
  Description of Artificial Sequence: Synthetic oligonucleotide
cgtgaggagctggtccgggcc

SEQ ID NO: 312806 - DNA, 22 bp, Artificial Sequence
  Description of Artificial Sequence: Synthetic oligonucleotide
gtgaggagctggtccgggccca

SEQ ID NO: 312807 - DNA, 22 bp, Artificial Sequence
  Description of Artificial Sequence: Synthetic oligonucleotide
tgaggagctggtccgggcccag

SEQ ID NO: 312808 - DNA, 21 bp, Artificial Sequence
  Description of Artificial Sequence: Synthetic oligonucleotide
gaggagctggtccgggcccag

SEQ ID NO: 312809 - DNA, 22 bp, Artificial Sequence
  Description of Artificial Sequence: Synthetic oligonucleotide
aggagctggtccgggcccagct

SEQ ID NO: 312810 - DNA, 21 bp, Artificial Sequence
  Description of Artificial Sequence: Synthetic oligonucleotide
ggagctggtccgggcccagct

SEQ ID NO: 312811 - DNA, 21 bp, Artificial Sequence
  Description of Artificial Sequence: Synthetic oligonucleotide
gagctggtccgggcccagctg

SEQ ID NO: 312812 - DNA, 26 bp, Artificial Sequence
  Description of Artificial Sequence: Synthetic oligonucleotide
agctggtccgggcccagctgcttaat

SEQ ID NO: 312813 - DNA, 25 bp, Artificial Sequence
  Description of Artificial Sequence: Synthetic oligonucleotide
gctggtccgggcccagctgcttaat

SEQ ID NO: 312814 - DNA, 26 bp, Artificial Sequence
  Description of Artificial Sequence: Synthetic oligonucleotide
ctggtccgggcccagctgcttaatca

SEQ ID NO: 312815 - DNA, 27 bp, Artificial Sequence
  Description of Artificial Sequence: Synthetic oligonucleotide
tggtccgggcccagctgcttaatcaca

SEQ ID NO: 312816 - DNA, 26 bp, Artificial Sequence
  Description of Artificial Sequence: Synthetic oligonucleotide
ggtccgggcccagctgcttaatcaca

SEQ ID NO: 312817 - DNA, 26 bp, Artificial Sequence
  Description of Artificial Sequence: Synthetic oligonucleotide
gtccgggcccagctgcttaatcacag

SEQ ID NO: 312818 - DNA, 26 bp, Artificial Sequence
  Description of Artificial Sequence: Synthetic oligonucleotide
tccgggcccagctgcttaatcacagc

SEQ ID NO: 312819 - DNA, 25 bp, Artificial Sequence
  Description of Artificial Sequence: Synthetic oligonucleotide
ccgggcccagctgcttaatcacagc

SEQ ID NO: 312820 - DNA, 26 bp, Artificial Sequence
  Description of Artificial Sequence: Synthetic oligonucleotide
cgggcccagctgcttaatcacagcca

SEQ ID NO: 312821 - DNA, 26 bp, Artificial Sequence
  Description of Artificial Sequence: Synthetic oligonucleotide
gggcccagctgcttaatcacagccac

SEQ ID NO: 312822 - DNA, 26 bp, Artificial Sequence
  Description of Artificial Sequence: Synthetic oligonucleotide
ggcccagctgcttaatcacagccacc

SEQ ID NO: 312823 - DNA, 27 bp, Artificial Sequence
  Description of Artificial Sequence: Synthetic oligonucleotide
gcccagctgcttaatcacagccaccct

SEQ ID NO: 312824 - DNA, 27 bp, Artificial Sequence
  Description of Artificial Sequence: Synthetic oligonucleotide
cccagctgcttaatcacagccaccctg

SEQ ID NO: 312825 - DNA, 27 bp, Artificial Sequence
  Description of Artificial Sequence: Synthetic oligonucleotide
ccagctgcttaatcacagccaccctgg

SEQ ID NO: 312826 - DNA, 28 bp, Artificial Sequence
  Description of Artificial Sequence: Synthetic oligonucleotide
cagctgcttaatcacagccaccctggag

SEQ ID NO: 312827 - DNA, 29 bp, Artificial Sequence
  Description of Artificial Sequence: Synthetic oligonucleotide
agctgcttaatcacagccaccctggagag

SEQ ID NO: 312828 - DNA, 28 bp, Artificial Sequence
  Description of Artificial Sequence: Synthetic oligonucleotide
gctgcttaatcacagccaccctggagag

SEQ ID NO: 312829 - DNA, 28 bp, Artificial Sequence
  Description of Artificial Sequence: Synthetic oligonucleotide
ctgcttaatcacagccaccctggagagc

SEQ ID NO: 312830 - DNA, 29 bp, Artificial Sequence
  Description of Artificial Sequence: Synthetic oligonucleotide
tgcttaatcacagccaccctggagagcag

SEQ ID NO: 312831 - DNA, 28 bp, Artificial Sequence
  Description of Artificial Sequence: Synthetic oligonucleotide
gcttaatcacagccaccctggagagcag

SEQ ID NO: 312832 - DNA, 28 bp, Artificial Sequence
  Description of Artificial Sequence: Synthetic oligonucleotide
cttaatcacagccaccctggagagcagg

SEQ ID NO: 312833 - DNA, 29 bp, Artificial Sequence
  Description of Artificial Sequence: Synthetic oligonucleotide
ttaatcacagccaccctggagagcaggag

SEQ ID NO: 312834 - DNA, 28 bp, Artificial Sequence
  Description of Artificial Sequence: Synthetic oligonucleotide
taatcacagccaccctggagagcaggag

SEQ ID NO: 312835 - DNA, 27 bp, Artificial Sequence
  Description of Artificial Sequence: Synthetic oligonucleotide
aatcacagccaccctggagagcaggag

SEQ ID NO: 312836 - DNA, 26 bp, Artificial Sequence
  Description of Artificial Sequence: Synthetic oligonucleotide
atcacagccaccctggagagcaggag

SEQ ID NO: 312837 - DNA, 25 bp, Artificial Sequence
  Description of Artificial Sequence: Synthetic oligonucleotide
tcacagccaccctggagagcaggag

SEQ ID NO: 312838 - DNA, 24 bp, Artificial Sequence
  Description of Artificial Sequence: Synthetic oligonucleotide
cacagccaccctggagagcaggag

SEQ ID NO: 312839 - DNA, 24 bp, Artificial Sequence
  Description of Artificial Sequence: Synthetic oligonucleotide
acagccaccctggagagcaggagg

SEQ ID NO: 312840 - DNA, 23 bp, Artificial Sequence
  Description of Artificial Sequence: Synthetic oligonucleotide
cagccaccctggagagcaggagg

SEQ ID NO: 312841 - DNA, 23 bp, Artificial Sequence
  Description of Artificial Sequence: Synthetic oligonucleotide
agccaccctggagagcaggaggc

SEQ ID NO: 312842 - DNA, 22 bp, Artificial Sequence
  Description of Artificial Sequence: Synthetic oligonucleotide
gccaccctggagagcaggaggc

SEQ ID NO: 312843 - DNA, 22 bp, Artificial Sequence
  Description of Artificial Sequence: Synthetic oligonucleotide
ccaccctggagagcaggaggcc

SEQ ID NO: 312844 - DNA, 23 bp, Artificial Sequence
  Description of Artificial Sequence: Synthetic oligonucleotide
caccctggagagcaggaggccct

SEQ ID NO: 312845 - DNA, 23 bp, Artificial Sequence
  Description of Artificial Sequence: Synthetic oligonucleotide
accctggagagcaggaggccctc

SEQ ID NO: 312846 - DNA, 22 bp, Artificial Sequence
  Description of Artificial Sequence: Synthetic oligonucleotide
ccctggagagcaggaggccctc

SEQ ID NO: 312847 - DNA, 22 bp, Artificial Sequence
  Description of Artificial Sequence: Synthetic oligonucleotide
cctggagagcaggaggccctcg

SEQ ID NO: 312848 - DNA, 22 bp, Artificial Sequence
  Description of Artificial Sequence: Synthetic oligonucleotide
ctggagagcaggaggccctcgg

SEQ ID NO: 312849 - DNA, 22 bp, Artificial Sequence
  Description of Artificial Sequence: Synthetic oligonucleotide
tggagagcaggaggccctcggg

SEQ ID NO: 312850 - DNA, 21 bp, Artificial Sequence
  Description of Artificial Sequence: Synthetic oligonucleotide
ggagagcaggaggccctcggg

SEQ ID NO: 312851 - DNA, 21 bp, Artificial Sequence
  Description of Artificial Sequence: Synthetic oligonucleotide
gagagcaggaggccctcgggg

SEQ ID NO: 312852 - DNA, 22 bp, Artificial Sequence
  Description of Artificial Sequence: Synthetic oligonucleotide
agagcaggaggccctcgggggt

SEQ ID NO: 312853 - DNA, 21 bp, Artificial Sequence
  Description of Artificial Sequence: Synthetic oligonucleotide
gagcaggaggccctcgggggt

SEQ ID NO: 312854 - DNA, 22 bp, Artificial Sequence
  Description of Artificial Sequence: Synthetic oligonucleotide
agcaggaggccctcgggggtgt

SEQ ID NO: 312855 - DNA, 21 bp, Artificial Sequence
  Description of Artificial Sequence: Synthetic oligonucleotide
gcaggaggccctcgggggtgt

SEQ ID NO: 312856 - DNA, 23 bp, Artificial Sequence
  Description of Artificial Sequence: Synthetic oligonucleotide
caggaggccctcgggggtgtgta

SEQ ID NO: 312857 - DNA, 23 bp, Artificial Sequence
  Description of Artificial Sequence: Synthetic oligonucleotide
aggaggccctcgggggtgtgtag

SEQ ID NO: 312858 - DNA, 22 bp, Artificial Sequence
  Description of Artificial Sequence: Synthetic oligonucleotide
ggaggccctcgggggtgtgtag

SEQ ID NO: 312859 - DNA, 22 bp, Artificial Sequence
  Description of Artificial Sequence: Synthetic oligonucleotide
gaggccctcgggggtgtgtagc

SEQ ID NO: 312860 - DNA, 23 bp, Artificial Sequence
  Description of Artificial Sequence: Synthetic oligonucleotide
aggccctcgggggtgtgtagcct

SEQ ID NO: 312861 - DNA, 22 bp, Artificial Sequence
  Description of Artificial Sequence: Synthetic oligonucleotide
ggccctcgggggtgtgtagcct

SEQ ID NO: 312862 - DNA, 22 bp, Artificial Sequence
  Description of Artificial Sequence: Synthetic oligonucleotide
gccctcgggggtgtgtagcctg

SEQ ID NO: 312863 - DNA, 23 bp, Artificial Sequence
  Description of Artificial Sequence: Synthetic oligonucleotide
ccctcgggggtgtgtagcctgca

SEQ ID NO: 312864 - DNA, 24 bp, Artificial Sequence
  Description of Artificial Sequence: Synthetic oligonucleotide
cctcgggggtgtgtagcctgcaga

SEQ ID NO: 312865 - DNA, 24 bp, Artificial Sequence
  Description of Artificial Sequence: Synthetic oligonucleotide
ctcgggggtgtgtagcctgcagac

SEQ ID NO: 312866 - DNA, 25 bp, Artificial Sequence
  Description of Artificial Sequence: Synthetic oligonucleotide
tcgggggtgtgtagcctgcagacct

SEQ ID NO: 312867 - DNA, 24 bp, Artificial Sequence
  Description of Artificial Sequence: Synthetic oligonucleotide
cgggggtgtgtagcctgcagacct

SEQ ID NO: 312868 - DNA, 25 bp, Artificial Sequence
  Description of Artificial Sequence: Synthetic oligonucleotide
gggggtgtgtagcctgcagacctga

SEQ ID NO: 312869 - DNA, 26 bp, Artificial Sequence
  Description of Artificial Sequence: Synthetic oligonucleotide
ggggtgtgtagcctgcagacctgaca

SEQ ID NO: 312870 - DNA, 26 bp, Artificial Sequence
  Description of Artificial Sequence: Synthetic oligonucleotide
gggtgtgtagcctgcagacctgacac

SEQ ID NO: 312871 - DNA, 26 bp, Artificial Sequence
  Description of Artificial Sequence: Synthetic oligonucleotide
ggtgtgtagcctgcagacctgacacg

SEQ ID NO: 312872 - DNA, 27 bp, Artificial Sequence
  Description of Artificial Sequence: Synthetic oligonucleotide
gtgtgtagcctgcagacctgacacggt

SEQ ID NO: 312873 - DNA, 27 bp, Artificial Sequence
  Description of Artificial Sequence: Synthetic oligonucleotide
tgtgtagcctgcagacctgacacggtc

SEQ ID NO: 312874 - DNA, 27 bp, Artificial Sequence
  Description of Artificial Sequence: Synthetic oligonucleotide
gtgtagcctgcagacctgacacggtct

SEQ ID NO: 312875 - DNA, 27 bp, Artificial Sequence
  Description of Artificial Sequence: Synthetic oligonucleotide
tgtagcctgcagacctgacacggtctg

SEQ ID NO: 312876 - DNA, 26 bp, Artificial Sequence
  Description of Artificial Sequence: Synthetic oligonucleotide
gtagcctgcagacctgacacggtctg

SEQ ID NO: 312877 - DNA, 26 bp, Artificial Sequence
  Description of Artificial Sequence: Synthetic oligonucleotide
tagcctgcagacctgacacggtctgg

SEQ ID NO: 312878 - DNA, 25 bp, Artificial Sequence
  Description of Artificial Sequence: Synthetic oligonucleotide
agcctgcagacctgacacggtctgg

SEQ ID NO: 312879 - DNA, 24 bp, Artificial Sequence
  Description of Artificial Sequence: Synthetic oligonucleotide
gcctgcagacctgacacggtctgg

SEQ ID NO: 312880 - DNA, 24 bp, Artificial Sequence
  Description of Artificial Sequence: Synthetic oligonucleotide
cctgcagacctgacacggtctggg

SEQ ID NO: 312881 - DNA, 26 bp, Artificial Sequence
  Description of Artificial Sequence: Synthetic oligonucleotide
ctgcagacctgacacggtctggggat

SEQ ID NO: 312882 - DNA, 26 bp, Artificial Sequence
  Description of Artificial Sequence: Synthetic oligonucleotide
tgcagacctgacacggtctggggatg

SEQ ID NO: 312883 - DNA, 25 bp, Artificial Sequence
  Description of Artificial Sequence: Synthetic oligonucleotide
gcagacctgacacggtctggggatg

SEQ ID NO: 312884 - DNA, 27 bp, Artificial Sequence
  Description of Artificial Sequence: Synthetic oligonucleotide
cagacctgacacggtctggggatgctt

SEQ ID NO: 312885 - DNA, 27 bp, Artificial Sequence
  Description of Artificial Sequence: Synthetic oligonucleotide
agacctgacacggtctggggatgcttc

SEQ ID NO: 312886 - DNA, 27 bp, Artificial Sequence
  Description of Artificial Sequence: Synthetic oligonucleotide
gacctgacacggtctggggatgcttca

SEQ ID NO: 312887 - DNA, 27 bp, Artificial Sequence
  Description of Artificial Sequence: Synthetic oligonucleotide
acctgacacggtctggggatgcttcac

SEQ ID NO: 312888 - DNA, 27 bp, Artificial Sequence
  Description of Artificial Sequence: Synthetic oligonucleotide
cctgacacggtctggggatgcttcaca

SEQ ID NO: 312889 - DNA, 27 bp, Artificial Sequence
  Description of Artificial Sequence: Synthetic oligonucleotide
ctgacacggtctggggatgcttcacag

SEQ ID NO: 312890 - DNA, 27 bp, Artificial Sequence
  Description of Artificial Sequence: Synthetic oligonucleotide
tgacacggtctggggatgcttcacagc

SEQ ID NO: 312891 - DNA, 26 bp, Artificial Sequence
  Description of Artificial Sequence: Synthetic oligonucleotide
gacacggtctggggatgcttcacagc

SEQ ID NO: 312892 - DNA, 27 bp, Artificial Sequence
  Description of Artificial Sequence: Synthetic oligonucleotide
acacggtctggggatgcttcacagcgt

SEQ ID NO: 312893 - DNA, 26 bp, Artificial Sequence
  Description of Artificial Sequence: Synthetic oligonucleotide
cacggtctggggatgcttcacagcgt

SEQ ID NO: 312894 - DNA, 27 bp, Artificial Sequence
  Description of Artificial Sequence: Synthetic oligonucleotide
acggtctggggatgcttcacagcgtct

SEQ ID NO: 312895 - DNA, 26 bp, Artificial Sequence
  Description of Artificial Sequence: Synthetic oligonucleotide
cggtctggggatgcttcacagcgtct

SEQ ID NO: 312896 - DNA, 26 bp, Artificial Sequence
  Description of Artificial Sequence: Synthetic oligonucleotide
ggtctggggatgcttcacagcgtctg

SEQ ID NO: 312897 - DNA, 27 bp, Artificial Sequence
  Description of Artificial Sequence: Synthetic oligonucleotide
gtctggggatgcttcacagcgtctgct

SEQ ID NO: 312898 - DNA, 27 bp, Artificial Sequence
  Description of Artificial Sequence: Synthetic oligonucleotide
tctggggatgcttcacagcgtctgctc

SEQ ID NO: 312899 - DNA, 26 bp, Artificial Sequence
  Description of Artificial Sequence: Synthetic oligonucleotide
ctggggatgcttcacagcgtctgctc

SEQ ID NO: 312900 - DNA, 26 bp, Artificial Sequence
  Description of Artificial Sequence: Synthetic oligonucleotide
tggggatgcttcacagcgtctgctcc

SEQ ID NO: 312901 - DNA, 25 bp, Artificial Sequence
  Description of Artificial Sequence: Synthetic oligonucleotide
ggggatgcttcacagcgtctgctcc

SEQ ID NO: 312902 - DNA, 25 bp, Artificial Sequence
  Description of Artificial Sequence: Synthetic oligonucleotide
gggatgcttcacagcgtctgctccc

SEQ ID NO: 312903 - DNA, 25 bp, Artificial Sequence
  Description of Artificial Sequence: Synthetic oligonucleotide
ggatgcttcacagcgtctgctcccg

SEQ ID NO: 312904 - DNA, 27 bp, Artificial Sequence
  Description of Artificial Sequence: Synthetic oligonucleotide
gatgcttcacagcgtctgctcccgcaa

SEQ ID NO: 312905 - DNA, 27 bp, Artificial Sequence
  Description of Artificial Sequence: Synthetic oligonucleotide
atgcttcacagcgtctgctcccgcaac

SEQ ID NO: 312906 - DNA, 27 bp, Artificial Sequence
  Description of Artificial Sequence: Synthetic oligonucleotide
tgcttcacagcgtctgctcccgcaaca

SEQ ID NO: 312907 - DNA, 26 bp, Artificial Sequence
  Description of Artificial Sequence: Synthetic oligonucleotide
gcttcacagcgtctgctcccgcaaca

SEQ ID NO: 312908 - DNA, 27 bp, Artificial Sequence
  Description of Artificial Sequence: Synthetic oligonucleotide
cttcacagcgtctgctcccgcaacact

SEQ ID NO: 312909 - DNA, 27 bp, Artificial Sequence
  Description of Artificial Sequence: Synthetic oligonucleotide
ttcacagcgtctgctcccgcaacactc

SEQ ID NO: 312910 - DNA, 26 bp, Artificial Sequence
  Description of Artificial Sequence: Synthetic oligonucleotide
tcacagcgtctgctcccgcaacactc

SEQ ID NO: 312911 - DNA, 25 bp, Artificial Sequence
  Description of Artificial Sequence: Synthetic oligonucleotide
cacagcgtctgctcccgcaacactc

SEQ ID NO: 312912 - DNA, 26 bp, Artificial Sequence
  Description of Artificial Sequence: Synthetic oligonucleotide
acagcgtctgctcccgcaacactcca

SEQ ID NO: 312913 - DNA, 25 bp, Artificial Sequence
  Description of Artificial Sequence: Synthetic oligonucleotide
cagcgtctgctcccgcaacactcca

SEQ ID NO: 312914 - DNA, 26 bp, Artificial Sequence
  Description of Artificial Sequence: Synthetic oligonucleotide
agcgtctgctcccgcaacactccaca

SEQ ID NO: 312915 - DNA, 25 bp, Artificial Sequence
  Description of Artificial Sequence: Synthetic oligonucleotide
gcgtctgctcccgcaacactccaca

SEQ ID NO: 312916 - DNA, 26 bp, Artificial Sequence
  Description of Artificial Sequence: Synthetic oligonucleotide
cgtctgctcccgcaacactccacact

SEQ ID NO: 312917 - DNA, 26 bp, Artificial Sequence
  Description of Artificial Sequence: Synthetic oligonucleotide
gtctgctcccgcaacactccacactg

SEQ ID NO: 312918 - DNA, 27 bp, Artificial Sequence
  Description of Artificial Sequence: Synthetic oligonucleotide
tctgctcccgcaacactccacactgga

SEQ ID NO: 312919 - DNA, 26 bp, Artificial Sequence
  Description of Artificial Sequence: Synthetic oligonucleotide
ctgctcccgcaacactccacactgga

SEQ ID NO: 312920 - DNA, 27 bp, Artificial Sequence
  Description of Artificial Sequence: Synthetic oligonucleotide
tgctcccgcaacactccacactggaga

SEQ ID NO: 312921 - DNA, 26 bp, Artificial Sequence
  Description of Artificial Sequence: Synthetic oligonucleotide
gctcccgcaacactccacactggaga

SEQ ID NO: 312922 - DNA, 27 bp, Artificial Sequence
  Description of Artificial Sequence: Synthetic oligonucleotide
ctcccgcaacactccacactggagaga

SEQ ID NO: 312923 - DNA, 27 bp, Artificial Sequence
  Description of Artificial Sequence: Synthetic oligonucleotide
tcccgcaacactccacactggagagac

SEQ ID NO: 312924 - DNA, 27 bp, Artificial Sequence
  Description of Artificial Sequence: Synthetic oligonucleotide
cccgcaacactccacactggagagaca

SEQ ID NO: 312925 - DNA, 27 bp, Artificial Sequence
  Description of Artificial Sequence: Synthetic oligonucleotide
ccgcaacactccacactggagagacag

SEQ ID NO: 312926 - DNA, 27 bp, Artificial Sequence
  Description of Artificial Sequence: Synthetic oligonucleotide
cgcaacactccacactggagagacagc
